United States Patent 8,461,315 (MICRORNAS AND USES THEREOF) - sequence listing, part 11

SEQ ID NO: 280004 - RNA, 64 nt, Homo Sapiens
aucaugugacgcagaauaguauuuuuguauuuauuucauuuaaaauguguugauugugugguuc

SEQ ID NO: 280005 - RNA, 64 nt, Homo Sapiens
auaaaagguuggcauugauauauuuuuuugguuauucauuuauaucgugcccucauuuuucacu

SEQ ID NO: 280006 - RNA, 64 nt, Homo Sapiens
acauaccaaccauuauccagugagguugggcuuauucauuuaacucuugcugcguucuguuugc

SEQ ID NO: 280007 - RNA, 64 nt, Homo Sapiens
aaagagcucugacaccacuuuucauguuaagaucuucauuuagcuccuuuacugggauuuauug

SEQ ID NO: 280008 - RNA, 64 nt, Homo Sapiens
uuuccagguagacguggacuuuauugacugugaauucauuuacauguaacuucugacauuucac

SEQ ID NO: 280009 - RNA, 64 nt, Homo Sapiens
ugacuuuucaauaaaucagcugcaauccauuuauuucauuuacaaaagauuuauuguaagcauc

SEQ ID NO: 280010 - RNA, 64 nt, Homo Sapiens
ugguguauauuuuaauguuuuuaaaaagaguaauuucauuuaaauaucuguuauucaaauuuga

SEQ ID NO: 280011 - RNA, 64 nt, Homo Sapiens
cccacuuagacucaaacacauuuuagugugauauuucauuuauuauagguaguauauuuuaauu

SEQ ID NO: 280012 - RNA, 64 nt, Homo Sapiens
cuaggaaaugaaaguagcgucuuuuaaauugcuauucauuuaauauaccuguuuucccaucuuu

SEQ ID NO: 280013 - RNA, 64 nt, Homo Sapiens
uuacaguuuuucuuuugaucgugcacuuauagucuucauuuaauuccucauagaaucccaguca

SEQ ID NO: 280014 - RNA, 64 nt, Homo Sapiens
caauacaucuacccacuccauuauuuuuuaaaacuucauuuaauaguuuaaacaagauugguuu

SEQ ID NO: 280015 - RNA, 64 nt, Homo Sapiens
gauaaauaaaaaauaaaguauuugaaagugagcauucauuuaagcauugaguacugauggaugu

SEQ ID NO: 280016 - RNA, 64 nt, Homo Sapiens
gauuauucauacauucauuuuggccaucuauauauucauuuacaugaacagccaaacuaaacuu

SEQ ID NO: 280017 - RNA, 64 nt, Homo Sapiens
aguaccuauugggaacagacauaacauucaauuuuucauuuaugcuaagugaccacaguauaca

SEQ ID NO: 280018 - RNA, 64 nt, Homo Sapiens
uaguuaaaguuuuauugucacauagccacauacauucauuuacauguuuucugauuuuacacua

SEQ ID NO: 280019 - RNA, 64 nt, Homo Sapiens
cuuaaagaauuugaaaguuuccuuauuuucauaauucauuuaagaacaagagaccccugucugg

SEQ ID NO: 280020 - RNA, 64 nt, Homo Sapiens
uacagaaaauagcuuuuauugaguaauauuacauuucauuuauacuguagcaauauauuuguag

SEQ ID NO: 280021 - RNA, 64 nt, Homo Sapiens
uuugaaaagaaauuucuuuaauucagagggguuuuucauuuacuaaaaaauuaauauauaaaua

SEQ ID NO: 280022 - RNA, 64 nt, Homo Sapiens
ucucuguacuaugcauuuuuauucuuucgaagauuucauuuaaaguggacugaaaagcaaauuu

SEQ ID NO: 280023 - RNA, 64 nt, Homo Sapiens
auaguuccuagugacauagaaacgaugcguaguuuucauuuacuaauuacaaauguugaggccu

SEQ ID NO: 280024 - RNA, 64 nt, Homo Sapiens
ucuguccuauaaaagauuuauuaaaaaacaauccuucauuuauuuuuugucuaauuuuuuaguu

SEQ ID NO: 280025 - RNA, 64 nt, Homo Sapiens
acgucaaauuggaccaauugucuugguuucuugauucauuuauuugagaaaaaaacaauacaaa

SEQ ID NO: 280026 - RNA, 64 nt, Homo Sapiens
aaaacaguauuguccauucagaaaugugugacccuucauuuauggauauugacuauauguaaug

SEQ ID NO: 280027 - RNA, 64 nt, Homo Sapiens
uauuuaauaaagaagauugaguacucugacacauuucauuuaaauuaggaaauuuuuaauauua

SEQ ID NO: 280028 - RNA, 64 nt, Homo Sapiens
guuuuuuuuuuuuacaucguuuuaguaaguuaauuucauuuauuuacuuuggagcuauauuucc

SEQ ID NO: 280029 - RNA, 64 nt, Homo Sapiens
uugagagaggaggcugaguuuccagagcuuugcuuucauuuauuuuuauacacauugucucucu

SEQ ID NO: 280030 - RNA, 64 nt, Homo Sapiens
uaacucuuaucaaggccaucuuuuagaccugauuuucauuuauaugaaaacagaccuguccaug

SEQ ID NO: 280031 - RNA, 64 nt, Homo Sapiens
caauuuaaauaucacaacaauuugacacccuucauucauuuauaaaaauaaaugagcuaguucu

SEQ ID NO: 280032 - RNA, 64 nt, Homo Sapiens
guuuuuuuauuagaauguucuuuauccuaauuaguucauuuauccaagaauacaugaaugugau

SEQ ID NO: 280033 - RNA, 64 nt, Homo Sapiens
gcuuucugcccaguggcguugggggaauucagccuucauuuauaaucagugagauuccccuguu

SEQ ID NO: 280034 - RNA, 64 nt, Homo Sapiens
aaaggaagcuugcucuauggauuuaaaugcaaacuucauuuaccagugcaggaagucucauaaa

SEQ ID NO: 280035 - RNA, 64 nt, Homo Sapiens
caguagauuugaauaccuugauguuuugcauuacuucauuuauguuuacaucauguuuagaaau

SEQ ID NO: 280036 - RNA, 64 nt, Homo Sapiens
cuucauuuauguuuacaucauguuuagaaauguuuucauuuacuguggucuuuggucacuucag

SEQ ID NO: 280037 - RNA, 64 nt, Homo Sapiens
ucaaagaccuagugauggauauuucuuugaggcuuucauuuauauaauuuuauuuuguacaaug

SEQ ID NO: 280038 - RNA, 64 nt, Homo Sapiens
uaugauuaaaggaagguuaugauaaaaugauuaguucauuuacauucacuuguagcaauuacau

SEQ ID NO: 280039 - RNA, 64 nt, Homo Sapiens
uuucugaaucaguuaucaaaguaaagucacaagguucauuuaucauauguacauauucucauau

SEQ ID NO: 280040 - RNA, 64 nt, Homo Sapiens
aaaauaacauuugauuacuugccuguaaaggaguuucauuuaaaauaccacauauccuccucua

SEQ ID NO: 280041 - RNA, 64 nt, Homo Sapiens
guuucuuucaagcuguguauugcaacuuuuuuauuucauuuaguugauuaugcaucacucugug

SEQ ID NO: 280042 - RNA, 64 nt, Homo Sapiens
aauaguaauaguguauggcauaacaugcuaucuuuucauuuaauuugucguguuucauccuucu

SEQ ID NO: 280043 - RNA, 64 nt, Homo Sapiens
ggaaagaaaaugaguauuuuacuucucaacuguuuucauuuaagguaagccucuccuucuaaaa

SEQ ID NO: 280044 - RNA, 64 nt, Homo Sapiens
cuaaaaacugauugaaugaucccauacuaugguuuucauuuacuuguggugaaaacuuaccacc

SEQ ID NO: 280045 - RNA, 64 nt, Homo Sapiens
ccauuuacauauaaaagaucuugaguucagccucuucauuuacugacagaaaaaugaaaagugu

SEQ ID NO: 280046 - RNA, 64 nt, Homo Sapiens
auauucacauuuaguuuaugaaguauagaauuuauucauuuaacuuuaaaguucagguaugaca

SEQ ID NO: 280047 - RNA, 64 nt, Homo Sapiens
uuaauguaauuuccauucacuaguguuguauuuuuucauuuacaauuuaaaaagguguagcuau

SEQ ID NO: 280048 - RNA, 64 nt, Homo Sapiens
aagcauuuuuaaaaacgaauuguaguuguuuuucuucauuuaaaauggaucuguuggagguuau

SEQ ID NO: 280049 - RNA, 64 nt, Homo Sapiens
aucauauauauuuucuguauuaagcucauuuggcuucauuuaagcuguauacuuagucauauau

SEQ ID NO: 280050 - RNA, 64 nt, Homo Sapiens
gccaagucccugucucuuucagacacagacaagcuucauuuaaauuauuucaucugaucauuau

SEQ ID NO: 280051 - RNA, 64 nt, Homo Sapiens
cuaggaaauuuaaagcugcauggucugucuuguuuucauuuaauuauugugaauaccuagaauc

SEQ ID NO: 280052 - RNA, 64 nt, Homo Sapiens
cuuacuaacaaccccucuagaauacauuggugauuucauuuaaagagauuguaugcauuugugg

SEQ ID NO: 280053 - RNA, 64 nt, Homo Sapiens
acccaaaggccaugcugauccccugcucccugcuuucauuuauguuugcugaccuguggagacc

SEQ ID NO: 280054 - RNA, 64 nt, Homo Sapiens
uuucuucauugcaguggauucauagauuuuucuguucauuuauugagagcauguccuaugcaga

SEQ ID NO: 280055 - RNA, 64 nt, Homo Sapiens
auacaccaauguacucuggcaugauguucagugauucauuuaacauucucauagaacaccaaaa

SEQ ID NO: 280056 - RNA, 64 nt, Homo Sapiens
uguuuguaauuuuuguuaaucccuguauauuauguucauuuagccauuaaucugacgauaauuu

SEQ ID NO: 280057 - RNA, 64 nt, Homo Sapiens
uuuucucauuaucaguaccauuugauaacugcuauucauuuaacugaaacgugaagaaauugca

SEQ ID NO: 280058 - RNA, 64 nt, Homo Sapiens
ggcuacccccguguuuaauaauggguuaaaaauguucauuuaagauuuuacagggcuguugaug

SEQ ID NO: 280059 - RNA, 64 nt, Homo Sapiens
uuccacuuugcccccuguccauaacucguucaucuucauuuacuccagcuucagacuuguagau

SEQ ID NO: 280060 - RNA, 64 nt, Homo Sapiens
cugauuuaugaaaguaaguuauauauaauggauauucauuuauauucacuuuuacuuaaacaua

SEQ ID NO: 280061 - RNA, 64 nt, Homo Sapiens
ugcugauuuaaaaguaaaguaaggaaaaguuuucuucauuuagcauucuuaaucuuuuuuuaga

SEQ ID NO: 280062 - RNA, 64 nt, Homo Sapiens
uuguaaugauuaacagaaacuucauuuauacuuuuucauuuagaaccccgcccggcccuuuuuu

SEQ ID NO: 280063 - RNA, 64 nt, Homo Sapiens
cuuuuucauuuagauuguaacccggcccuuuuuuuucauuuauauacaggcgugagccaccccg

SEQ ID NO: 280064 - RNA, 64 nt, Homo Sapiens
aaaccuuucaaauuauuugaauaaucuucauauuuucauuuaaccuauaugacucuaauuuuuu

SEQ ID NO: 280065 - RNA, 64 nt, Homo Sapiens
uggguaauaagugugaaaauuuuaauuugugguuuucauuuauuaaugucugcccaucuguauu

SEQ ID NO: 280066 - RNA, 64 nt, Homo Sapiens
ucacagauaaacuucugccaucaaauggcuacaguucauuuaaauuuaaaaaaaagaaaaaaga

SEQ ID NO: 280067 - RNA, 64 nt, Homo Sapiens
gucuauacaaauaauuucucugaggugaauuuaauucauuuauuuucaaauaagcauaauuugc

SEQ ID NO: 280068 - RNA, 64 nt, Homo Sapiens
cucccccaggcccuacccugcaaugggauucgcuuucauuuaauggaaacuucugggacugaug

SEQ ID NO: 280069 - RNA, 64 nt, Homo Sapiens
uaacuucuagaugcuaccguugaccugaguuaaauucauuuagucguguacguaaaaacucucc

SEQ ID NO: 280070 - RNA, 64 nt, Homo Sapiens
cauuuauucauucauaaaaucacacauucauuuauucauuuauucacuuaugauauaauccauu

SEQ ID NO: 280071 - RNA, 64 nt, Homo Sapiens
cauuuauucauuuauucauuaauccauucacacauucauuuauuaccuauuacacuuaugauau

SEQ ID NO: 280072 - RNA, 64 nt, Homo Sapiens
uuuuuaaauguucuuaguuuuagcuaaugcuacuuucauuuauaugaaguugaauaucagucua

SEQ ID NO: 280073 - RNA, 64 nt, Homo Sapiens
cauuguugacauaauuuuacuuacauuggcaguuuucauuuauauauguuaaaagaaacauuaa

SEQ ID NO: 280074 - RNA, 64 nt, Homo Sapiens
caggaauaauccuuuuuuuuaaccugauacaugcuucauuuaauagguuuguauuguugaucua

SEQ ID NO: 280075 - RNA, 64 nt, Homo Sapiens
auaauacagagaauagcuaugacugaguggugacuucauuuauaaaccauauguguauuagggu

SEQ ID NO: 280076 - RNA, 64 nt, Homo Sapiens
uacaacaacuuugcgauguaugaacacgcacuaauucauuuaaucacuuggucugguuugguuu

SEQ ID NO: 280077 - RNA, 64 nt, Homo Sapiens
uauucagcagauauuuauugugccacuuuguucauucauuuauucaagccuaagauggcccaug

SEQ ID NO: 280078 - RNA, 64 nt, Homo Sapiens
ucccacucucugcaagguuuuccucauuuuuauauucauuuauucaucauucauucauucaccu

SEQ ID NO: 280079 - RNA, 64 nt, Homo Sapiens
uuaacaagcaagcaaaaugcaaaccaaaccauuauucauuuauuggcuuaaguaugcuuucucc

SEQ ID NO: 280080 - RNA, 64 nt, Homo Sapiens
uagauaacuuucuggcauuuagaauuuuguuccauucauuuaauuuguucaucugagaauuuuu

SEQ ID NO: 280081 - RNA, 64 nt, Homo Sapiens
ucuguuguguuuauguagaaaauucacaaaucuguucauuuaauuuuuuaauuugagaauuuuu

SEQ ID NO: 280082 - RNA, 64 nt, Homo Sapiens
uuugaccaagccaggauauaucuguuaggccacauucauuuagggaucauguuuuccaaagcag

SEQ ID NO: 280083 - RNA, 64 nt, Homo Sapiens
augacuccugucacucaguacaauuauuuugagauucauuuauguuauuguauguaucaauagu

SEQ ID NO: 280084 - RNA, 64 nt, Homo Sapiens
aaaagucaaaugacuuaauuaauaugugagacuuuucauuuaaaguuggcuugguucaguaaua

SEQ ID NO: 280085 - RNA, 64 nt, Homo Sapiens
ccuaaguauuucuuacuuuaacuucucaacuuuuuucauuuauuuuguagauuugaagguagaa

SEQ ID NO: 280086 - RNA, 64 nt, Homo Sapiens
guuuuacaggcuuugaaguaguccuaugguuuuauucauuuauguuugguuguguauguccaaa

SEQ ID NO: 280087 - RNA, 64 nt, Homo Sapiens
aggaaauggacuggcauuuaugagggaaagccaguucauuuaagaugguugcaccuuaugaccu

SEQ ID NO: 280088 - RNA, 64 nt, Homo Sapiens
uuuuucuauuuuuaguacuggcuuucugugaaauuucauuuauaguguuucugugagggaggcu

SEQ ID NO: 280089 - RNA, 64 nt, Homo Sapiens
ccuugcuggacaaacucuggaaguccuguaugcauucauuuauuccagacagucuacuagccaa

SEQ ID NO: 280090 - RNA, 64 nt, Homo Sapiens
auuugggaacugacaaugugucagaaaauauauguucauuuaucauuuuaaaaucuuguauaau

SEQ ID NO: 280091 - RNA, 64 nt, Homo Sapiens
aucauuuuaaaaucuuguauaauuugccacuguauucauuuaugccuaaaucucuauaacagau

SEQ ID NO: 280092 - RNA, 64 nt, Homo Sapiens
cuuuuggcaugaauguuucauagguuauguuguguucauuuaguagguggcgcauaaucugugg

SEQ ID NO: 280093 - RNA, 64 nt, Homo Sapiens
agccacacccacauauauauuaaaagugguuguauucauuuagugaaaaacaaaaaguagaugu

SEQ ID NO: 280094 - RNA, 64 nt, Homo Sapiens
cuugugccaaauggcaacacccacaucauggcaguucauuuacuaagaugggcuucucugaggu

SEQ ID NO: 280095 - RNA, 64 nt, Homo Sapiens
ugaagugauuucaaauauuuucuaaguguauaguuucauuuauuuuaauauaacauuuuaaaau

SEQ ID NO: 280096 - RNA, 64 nt, Homo Sapiens
ccagugaguuucugcugucucccaaauuucuuuuuucauuuacuaccucaggccaggugagcuc

SEQ ID NO: 280097 - RNA, 64 nt, Homo Sapiens
acaaauccacaucuuuuguagaauuauuuuuuuuuucauuuaaagucuuugguauuucauauag

SEQ ID NO: 280098 - RNA, 64 nt, Homo Sapiens
ucuuuccacacaggauuccguuggugaaccuguaaaaacaaaacaaacaaaacaaaacaaaaaa

SEQ ID NO: 280099 - RNA, 64 nt, Homo Sapiens
ccacacaggauuccguuggugaaccuguaaaaacaaaacaaacaaaacaaaacaaaaaagacaa

SEQ ID NO: 280100 - RNA, 64 nt, Homo Sapiens
auuccguuggugaaccuguaaaaacaaaacaaacaaaacaaaacaaaaaagacaaaaccuaaaa

SEQ ID NO: 280101 - RNA, 64 nt, Homo Sapiens
guuggugaaccuguaaaaacaaaacaaacaaaacaaaacaaaaaagacaaaaccuaaaacugag

SEQ ID NO: 280102 - RNA, 64 nt, Homo Sapiens
ugauagaugaaauucacaccccugcagaucagaaaaaacaaauagaagaaaaugaggguuacag

SEQ ID NO: 280103 - RNA, 64 nt, Homo Sapiens
uguguuuucuuuggucagaggucaaaauuuaugaaaaacaaaaugcuguaugaauggaaaucau

SEQ ID NO: 280104 - RNA, 64 nt, Homo Sapiens
ccugauaaccccuugucaguugucagcucuucccaaaacaaagcucuggaguuucugcuggaag

SEQ ID NO: 280105 - RNA, 64 nt, Homo Sapiens
gggaguugcagugaaugucauuaaaauuucuuccaaaacaaaacuagaaauaauugcugagggc

SEQ ID NO: 280106 - RNA, 64 nt, Homo Sapiens
gcugagggcuuauagggaagugauuuaaaaagaaaaaacaaacaacaacaaaaaaaacucuucg

SEQ ID NO: 280107 - RNA, 64 nt, Homo Sapiens
cagccugguuacagagcaagacucugucucaaacaaaacaaaacaaaacaaaaacacacuacug

SEQ ID NO: 280108 - RNA, 64 nt, Homo Sapiens
ugguuacagagcaagacucugucucaaacaaaacaaaacaaaacaaaaacacacuacuguauuu

SEQ ID NO: 280109 - RNA, 64 nt, Homo Sapiens
acagagcaagacucugucucaaacaaaacaaaacaaaacaaaaacacacuacuguauuuuggau

SEQ ID NO: 280110 - RNA, 64 nt, Homo Sapiens
cuccagccugggugacaaagccagacucucuccaaaaacaaaccagaaacagaaaagaaaugac

SEQ ID NO: 280111 - RNA, 64 nt, Homo Sapiens
agcauacuucuuuugcguauuauguuuaacucacaaaacaaagcucaucaugcguuugauucug

SEQ ID NO: 280112 - RNA, 64 nt, Homo Sapiens
ggcauuccucaucaccaucguguuugcaaagguuaaaacaaaaacaaaaaaccacaaaaauaaa

SEQ ID NO: 280113 - RNA, 64 nt, Homo Sapiens
ccucaucaccaucguguuugcaaagguuaaaacaaaaacaaaaaaccacaaaaauaaaaaacaa

SEQ ID NO: 280114 - RNA, 64 nt, Homo Sapiens
agguuaaaacaaaaacaaaaaaccacaaaaauaaaaaacaaaaaaaacaaaaaacccaagaaaa

SEQ ID NO: 280115 - RNA, 64 nt, Homo Sapiens
caaaaacaaaaaaccacaaaaauaaaaaacaaaaaaaacaaaaaacccaagaaaaaaaaaaaga

SEQ ID NO: 280116 - RNA, 64 nt, Homo Sapiens
cuacaucucaauuaguggcuggaaaguacaugguaaaacaaaguaaauuuuuuuauguucuuuu

SEQ ID NO: 280117 - RNA, 64 nt, Homo Sapiens
uuaaugauaaauuuuucaacauacuugccauuagaaaacaaaguauugcuaaguacuauaacau

SEQ ID NO: 280118 - RNA, 64 nt, Homo Sapiens
gcaucuuuucuaguugaaauggugaacugauaggaaaacaaaugaguagaaagaguucaugaag

SEQ ID NO: 280119 - RNA, 64 nt, Homo Sapiens
ccuggacugaguauaacagcuuuaugauuaugagaaaacaaauucuuuauuuuuuuuuucuguu

SEQ ID NO: 280120 - RNA, 64 nt, Homo Sapiens
uguguuuucauuguuuuaaguuuuucuucugaguaaaacaaaauuauagaaaacaaaugcaaca

SEQ ID NO: 280121 - RNA, 64 nt, Homo Sapiens
uuaaguuuuucuucugaguaaaacaaaauuauagaaaacaaaugcaacaaugugcacaucugac

SEQ ID NO: 280122 - RNA, 64 nt, Homo Sapiens
aaagcaaaccaauaccauugauaagaagaagauaaaaacaaaauauuuuggaguguuuuccaac

SEQ ID NO: 280123 - RNA, 64 nt, Homo Sapiens
ccucugcauguauauuugauaacaugucuuuuguaaaacaaaaauuacaaaaaaauuuguuuac

SEQ ID NO: 280124 - RNA, 64 nt, Homo Sapiens
auaauugauggucagagccagcacuggaauuuugaaaacaaauaaggugauuaucuauuuuagg

SEQ ID NO: 280125 - RNA, 64 nt, Homo Sapiens
ucugaauaauuauggaaguugggacauguuaaggaaaacaaauauguucaucaccaacaaucag

SEQ ID NO: 280126 - RNA, 64 nt, Homo Sapiens
ccagccuggcgacacagugagacucugucucaaaaaaacaaaacaaacaaacaaaaauacaaaa

SEQ ID NO: 280127 - RNA, 64 nt, Homo Sapiens
cuggcgacacagugagacucugucucaaaaaaacaaaacaaacaaacaaaaauacaaaaaauua

SEQ ID NO: 280128 - RNA, 64 nt, Homo Sapiens
uggagaggcaggagcccuggggugagaaaagcaaaaaacaaacaaaaaacaaaacccuggagug

SEQ ID NO: 280129 - RNA, 64 nt, Homo Sapiens
gagcccuggggugagaaaagcaaaaaacaaacaaaaaacaaaacccuggaguguuaggaggaga

SEQ ID NO: 280130 - RNA, 64 nt, Homo Sapiens
uguaggaaauguucuuuuuuaaaaaaaaauaacaaaaacaaaacaaaacuauuuauuuugugau

SEQ ID NO: 280131 - RNA, 64 nt, Homo Sapiens
gaaauguucuuuuuuaaaaaaaaauaacaaaaacaaaacaaaacuauuuauuuugugauuguuu

SEQ ID NO: 280132 - RNA, 64 nt, Homo Sapiens
uguuucuuaaugaacuugcaaaggaauauugcuaaaaacaaacaaaaaaaacuguuaucgaacu

SEQ ID NO: 280133 - RNA, 64 nt, Homo Sapiens
guacuuuauuuuuuugugccuucugaaaggaucuaaaacaaaaauauuuugccuuuuuuucccc

SEQ ID NO: 280134 - RNA, 64 nt, Homo Sapiens
agcauaaguuacaaccccuaggagcucugcuuucaaaacaaaaagagauugggggaguggggag

SEQ ID NO: 280135 - RNA, 64 nt, Homo Sapiens
uauaacuauuuggagggucuuuaacauugccaaaaaaacaaauauguugauuuuuauuuuauuu

SEQ ID NO: 280136 - RNA, 64 nt, Homo Sapiens
guauauguucagcaauguugaucucauaaaaggaaaaacaaaagauuuaaguauucuauauacc

SEQ ID NO: 280137 - RNA, 64 nt, Homo Sapiens
guuaacuaaaaaugcugagaccccuuuuuauagaaaaacaaaaagacaucaagucuucuuaauu

SEQ ID NO: 280138 - RNA, 64 nt, Homo Sapiens
gggccccuauaacaaaagacagauugacaagagaaaaacaaacauaaauuuauuagcggguaua

SEQ ID NO: 280139 - RNA, 64 nt, Homo Sapiens
ucgacaaagaacaguaaauuuuuagagaaacaacaaaacaaagaaaaagagcuuugagucugua

SEQ ID NO: 280140 - RNA, 64 nt, Homo Sapiens
aaaaacggcuucuuggcguucugugaaagaaaacaaaacaaaaccugagaucgcgguauuaaau

SEQ ID NO: 280141 - RNA, 64 nt, Homo Sapiens
aaaacaaaaacggcuucuuguaaaucugugaaagaaaacaaaacuuuggcugagaucgcgguau

SEQ ID NO: 280142 - RNA, 64 nt, Homo Sapiens
aguuuuuaaaacugauuuuaaaaaaaacaaaaaaaaaacaaaacagcaaaaaaaaaaaaaaaac

SEQ ID NO: 280143 - RNA, 64 nt, Homo Sapiens
aaaaacaaaacaguuuuuaaaaaaaaaaaacaaaaaaacaaaaaaaauaguccugagcaaaaaa

SEQ ID NO: 280144 - RNA, 64 nt, Homo Sapiens
aacaaaaaaaaaacaaaacagcaaaaaaaaaaaaaaaacaaaaacugaaagcaaauaguccuga

SEQ ID NO: 280145 - RNA, 64 nt, Homo Sapiens
aaccugagaaguuugaauugguaaaaaacaaacaaaaacaaaaauuccccaccuccucauuuua

SEQ ID NO: 280146 - RNA, 64 nt, Homo Sapiens
aaaacaaaaaaaccugagaaccucauuuuaguaaaaaacaaacacaaauagcucuuccccaccu

SEQ ID NO: 280147 - RNA, 64 nt, Homo Sapiens
aaugcuuuucgaaauuguuuccaucccagaaaacaaaacaaaauucuguagauucucuccucuc

SEQ ID NO: 280148 - RNA, 64 nt, Homo Sapiens
aaaauaaugcuuuucgaaaucucucccaucccagaaaacaaaacgcaaaucuguagauucucuc

SEQ ID NO: 280149 - RNA, 64 nt, Homo Sapiens
acaacaccaaaaaaacagcaauaaaaaaaaaaaaaaaacaaaaagcccaccugggcacuuuuag

SEQ ID NO: 280150 - RNA, 64 nt, Homo Sapiens
aaacaacaaaaaaagcuaaguuggaaaaaaacaaaaaacaaaaaccauuuuaaggaacuauucu

SEQ ID NO: 280151 - RNA, 64 nt, Homo Sapiens
acaaaaaaaacaacaaaaaacuauucuuuggaaaaaaacaaaaaggagcauccauuuuaaggaa

SEQ ID NO: 280152 - RNA, 64 nt, Homo Sapiens
uagagauugggucuuucccaaaacaaaacaaaacaaaacaaaaugagcgacacucggucucaaa

SEQ ID NO: 280153 - RNA, 64 nt, Homo Sapiens
aaaauuagagauugggucuuucaaaaaacaaaacaaaacaaaacugacagagcgacacucgguc

SEQ ID NO: 280154 - RNA, 64 nt, Homo Sapiens
aaaacaaaauuagagauuggcggucucaaaaaacaaaacaaaaccugggugacagagcgacacu

SEQ ID NO: 280155 - RNA, 64 nt, Homo Sapiens
aaaacaaaacaaaauuagagacacucggucucaaaaaacaaaacccagccugggugacagagcg

SEQ ID NO: 280156 - RNA, 64 nt, Homo Sapiens
gcacagcaucuguagucagcuucuuuuccaaaauaaaacaaaggacaagaugguacaaccuuua

SEQ ID NO: 280157 - RNA, 64 nt, Homo Sapiens
aacauuuugagaacaaagaucauaaagguaaaacaaaacaaaacucuguacaaaggggaaagaa

SEQ ID NO: 280158 - RNA, 64 nt, Homo Sapiens
aaaacaacauuuugagaacaaagaacauaaagguaaaacaaaacuagcaucuguacaaagggga

SEQ ID NO: 280159 - RNA, 64 nt, Homo Sapiens
caaauacaguauccaaacaucaagacucugucucaaaacaaacacuccagccugggcgacagag

SEQ ID NO: 280160 - RNA, 64 nt, Homo Sapiens
caauuagcugggcaugguggccccgucuccacuaaaaacaaaaagccuggccaacauggugaaa

SEQ ID NO: 280161 - RNA, 64 nt, Homo Sapiens
ucauguuacuaaaagacaggaucucaaaaacaaaaaaacaaaaugggcgacagagcaagacgcc

SEQ ID NO: 280162 - RNA, 64 nt, Homo Sapiens
aacaaaauucauguuacuaaaagacgccaucucaaaaacaaaaauccagccugggcgacagagc

SEQ ID NO: 280163 - RNA, 64 nt, Homo Sapiens
aacuaagaaucuuacuaaaagauuguaaaaaacaaaaacaaagauaugugucuuaaugcaguca

SEQ ID NO: 280164 - RNA, 64 nt, Homo Sapiens
caaagaaacuaagaaucuuacagucagauuguaaaaaacaaaaaagaguauaugugucuuaaug

SEQ ID NO: 280165 - RNA, 64 nt, Homo Sapiens
ugaaaacugcuuggcauuugaaguaaaacaaacaaaaacaaaccacuacaaaagaaaaauauaa

SEQ ID NO: 280166 - RNA, 54 nt, Homo Sapiens
aaaacaaaccugaaaacugcaaguaaaacaaacaacuacaaaagaaaaauauaa

SEQ ID NO: 280167 - RNA, 64 nt, Homo Sapiens
guuuuaaauguuuaguuucacuauaauaaauaauaaaacaaauuuacaauuuaaaaaguauauu

SEQ ID NO: 280168 - RNA, 64 nt, Homo Sapiens
ggaaaaacgaccccuuguuaaauaaccaauucagaaaacaaaauuuugugguuucaaaagugua

SEQ ID NO: 280169 - RNA, 64 nt, Homo Sapiens
aaaauaaaaaaguugugccuacugauuuaaaaacaaaacaaaaaucuaggacccgguuucuuuu

SEQ ID NO: 280170 - RNA, 64 nt, Homo Sapiens
aaaaaaaaauaaaaaaguugcuuuuacugauuuaaaaacaaaaccagcuucuaggacccgguuu

SEQ ID NO: 280171 - RNA, 64 nt, Homo Sapiens
aaaugaaugcacaaacuugcaacauauuuaaacaaaaacaaaaagccagcagugugauaauuua

SEQ ID NO: 280172 - RNA, 64 nt, Homo Sapiens
aaaaccuuguuccuuuauagaagaaaaaaaacaaaaaacaaaaagcuucacuugccuagucuug

SEQ ID NO: 280173 - RNA, 64 nt, Homo Sapiens
acaaaaaaaaaccuuguuccagucuugaagaaaaaaaacaaaaaucccacugcuucacuugccu

SEQ ID NO: 280174 - RNA, 64 nt, Homo Sapiens
aacacuaggaguccacucaauaaaaaaacaaaacaaaacaaaaacacaucgugcagucguguca

SEQ ID NO: 280175 - RNA, 64 nt, Homo Sapiens
aaaaaaacacuaggaguccaugucauaaaaaaacaaaacaaaacagauccacaucgugcagucg

SEQ ID NO: 280176 - RNA, 64 nt, Homo Sapiens
aaaacaaaaaaacacuaggaagucgugucauaaaaaaacaaaacggaccagauccacaucgugc

SEQ ID NO: 280177 - RNA, 64 nt, Homo Sapiens
gaaacuaaucugcugccucuaaacaacaacaacaaaaacaaaauuaguuucaguggaugauuga

SEQ ID NO: 280178 - RNA, 64 nt, Homo Sapiens
aaauauugaaaacugaggcaauacuagcggagguaaaacaaaagacuuuacagcaacauucgcc

SEQ ID NO: 280179 - RNA, 64 nt, Homo Sapiens
uccaaacaguguguuggugcaauuaaaacaaaacaaaacaaacuauguugguuucaguggcugg

SEQ ID NO: 280180 - RNA, 64 nt, Homo Sapiens
aaacuuccaaacaguguguugcuggaauuaaaacaaaacaaaaccuucuauguugguuucagug

SEQ ID NO: 280181 - RNA, 64 nt, Homo Sapiens
aaaacaaacuuccaaacagucaguggcuggaauuaaaacaaaacaauaacuucuauguugguuu

SEQ ID NO: 280182 - RNA, 64 nt, Homo Sapiens
ugagucgcacaucugcugcuaaaaaaaaaaacaaaaaacaaagaacucuaucucaaaaaaaaac

SEQ ID NO: 280183 - RNA, 64 nt, Homo Sapiens
acaaagaugagucgcacaucaaaaaacaaaaaaaaaaacaaaaagagcgagacucuaucucaaa

SEQ ID NO: 280184 - RNA, 64 nt, Homo Sapiens
aaaaaacaaaaaacaaagaucucuaucucaaaaaaaaacaaaaagccugggcaacagagcgaga

SEQ ID NO: 280185 - RNA, 64 nt, Homo Sapiens
ugcuggugucuugguuaccccucauuauuaaaaaaaaacaaacauuaguagauuuuucacacac

SEQ ID NO: 280186 - RNA, 64 nt, Homo Sapiens
gugauaaucucaaguuagaacguuggugucuuauaaaacaaacaucucucggucuuauaaaacu

SEQ ID NO: 280187 - RNA, 64 nt, Homo Sapiens
aagguugcuguuuucuauuugagaaguaggcuauaaaacaaaaaacuaaucacacaacaauuuu

SEQ ID NO: 280188 - RNA, 64 nt, Homo Sapiens
acuauagaacauuuaaaugaauuuggggaugguuaaaacaaauuuugacauuggcacuaaaugc

SEQ ID NO: 280189 - RNA, 64 nt, Homo Sapiens
ggagcauagcagugugugagaguaauauagccugaaaacaaaugugcagauauagcaaaggauu

SEQ ID NO: 280190 - RNA, 64 nt, Homo Sapiens
aacuaaagaaaugugagcuuucaaauuguuuaguaaaacaaaauacaugaauauaaugcuuacu

SEQ ID NO: 280191 - RNA, 64 nt, Homo Sapiens
gaagaagagaaccuucuguggagacaaugugcccaaaacaaaggguaacaaagugaaaacaggu

SEQ ID NO: 280192 - RNA, 64 nt, Homo Sapiens
cuguugugucccuuucucuucaaagauccugagcaaaacaaagauacgcuuuccauuugaugau

SEQ ID NO: 280193 - RNA, 64 nt, Homo Sapiens
gcuaugaugaccuucauauaaucagcauaaacauaaaacaaauuuuuuacuuaacaugagugca

SEQ ID NO: 280194 - RNA, 64 nt, Homo Sapiens
augucauuugcuaaugaauuuuaaaagcauauauaaaacaaaacaaacaaccugccacaaugug

SEQ ID NO: 280195 - RNA, 64 nt, Homo Sapiens
auuugcuaaugaauuuuaaaagcauauauaaaacaaaacaaacaaccugccacaaugugauaug

SEQ ID NO: 280196 - RNA, 64 nt, Homo Sapiens
augugcaaagcaagcaaggaacauuugggguaagaaaacaaacaugaggcaaaagaaaaaauac

SEQ ID NO: 280197 - RNA, 64 nt, Homo Sapiens
cagcagacauucacucuggcugcugggacaucagaaaacaaagucuucaucucucucuccaguu

SEQ ID NO: 280198 - RNA, 64 nt, Homo Sapiens
ucagcugaaagaaacagauauuuuaaauugccagaaaacaaaugaugaggcaacuacagucaga

SEQ ID NO: 280199 - RNA, 64 nt, Homo Sapiens
ugaacccuacuugcuaucucuaucuuagaaagcaaaaacaaacaggaguuuccagggagaaugg

SEQ ID NO: 280200 - RNA, 64 nt, Homo Sapiens
auguaaccaguagcugaucuuaaggcuuuuuuaaaaaacaaaacaaaacaacaaaaaaaaaucu

SEQ ID NO: 280201 - RNA, 64 nt, Homo Sapiens
accaguagcugaucuuaaggcuuuuuuaaaaaacaaaacaaaacaacaaaaaaaaaucuuuaua

SEQ ID NO: 280202 - RNA, 64 nt, Homo Sapiens
ccccgugaacuuccuuugacuuauuguccccacuaaaacaaaacaaaaaacuuuuaaugccuuc

SEQ ID NO: 280203 - RNA, 64 nt, Homo Sapiens
ugaacuuccuuugacuuauuguccccacuaaaacaaaacaaaaaacuuuuaaugccuuccacau

SEQ ID NO: 280204 - RNA, 64 nt, Homo Sapiens
cuccaguuuggacuacagagugagacuccaucucaaaacaaaacaaaacaacaacagcaaaaaa

SEQ ID NO: 280205 - RNA, 64 nt, Homo Sapiens
guuuggacuacagagugagacuccaucucaaaacaaaacaaaacaacaacagcaaaaaacaaca

SEQ ID NO: 280206 - RNA, 64 nt, Homo Sapiens
aaaacaaaacaaaacaacaacagcaaaaaacaacaaaacaaaacacaaauacucucacagggca

SEQ ID NO: 280207 - RNA, 64 nt, Homo Sapiens
ccgccgaccuucagcuuugugggacuaucaggaaaaaacaaaacaaaaacaaaauguagaaaaa

SEQ ID NO: 280208 - RNA, 64 nt, Homo Sapiens
gaccuucagcuuugugggacuaucaggaaaaaacaaaacaaaaacaaaauguagaaaaagcaaa

SEQ ID NO: 280209 - RNA, 64 nt, Homo Sapiens
cagcuuugugggacuaucaggaaaaaacaaaacaaaaacaaaauguagaaaaagcaaaagcucu

SEQ ID NO: 280210 - RNA, 64 nt, Homo Sapiens
cacuuuauagaauguuguaaaacagacaaacaagaaaacaaaccacauacuuuugaaguguauu

SEQ ID NO: 280211 - RNA, 64 nt, Homo Sapiens
aguuuuguuuaagguuuuggauaaggagcacuuuaaaacaaacugguguguuguuuuuaaguua

SEQ ID NO: 280212 - RNA, 64 nt, Homo Sapiens
uaguacucuucuuuccuccuacucuaugaacuucaaaacaaaaacaaaacuuugagagcagcac

SEQ ID NO: 280213 - RNA, 64 nt, Homo Sapiens
ucuucuuuccuccuacucuaugaacuucaaaacaaaaacaaaacuuugagagcagcacaugcau

SEQ ID NO: 280214 - RNA, 64 nt, Homo Sapiens
uuaacagacugccuugguacugccgaguccucucaaaacaaacacccucuugcaaccagcuuug

SEQ ID NO: 280215 - RNA, 64 nt, Homo Sapiens
cuccacaucugcuccuagcagugcaucagccaguaaaacaaacacauuuacaagaaaaauguuu

SEQ ID NO: 280216 - RNA, 64 nt, Homo Sapiens
uguaggcaucaaaaggcaaaaaucaaaaaaaaaaaaaacaaaaacaaaaaaaaagaugaaccua

SEQ ID NO: 280217 - RNA, 64 nt, Homo Sapiens
caucaaaaggcaaaaaucaaaaaaaaaaaaaacaaaaacaaaaaaaaagaugaaccuaggucug

SEQ ID NO: 280218 - RNA, 64 nt, Homo Sapiens
caagcucccuucccuuccucuucaguccuauuuaaaaacaaaaccugauuuuucaauguuauuc

SEQ ID NO: 280219 - RNA, 64 nt, Homo Sapiens
ccacagaggcggaaauaccgagaaaaaggaauuuaaaacaaaaagaaguaucagcacccagaag

SEQ ID NO: 280220 - RNA, 64 nt, Homo Sapiens
ccuggcugaguugauguuuuuauuauugcugcagaaaacaaaaggcuaagugcaggaggcccuu

SEQ ID NO: 280221 - RNA, 64 nt, Homo Sapiens
ccuccuucaaccuuauuuuuaccugcauccauccaaaacaaauuaaguauagcaauucaaacug

SEQ ID NO: 280222 - RNA, 64 nt, Homo Sapiens
gaugucucagguuuguuuugaauugcuuuuuuccaaaacaaaaaaagcuuugacucuauaagca

SEQ ID NO: 280223 - RNA, 64 nt, Homo Sapiens
acgaaugaaaauaacugaauaaagaaaggaaaagaaaacaaaaaaauaugcuuauaaccuaguu

SEQ ID NO: 280224 - RNA, 64 nt, Homo Sapiens
guccuguauuugaacucuguuagaaagucucuucaaaacaaacaacuauguuuuaaguacacuu

SEQ ID NO: 280225 - RNA, 64 nt, Homo Sapiens
uauucuuguaacucaguuuuaagggaugcacuguaaaacaaaaguuuuaaugagacuuccuagg

SEQ ID NO: 280226 - RNA, 64 nt, Homo Sapiens
caagagggcauagaugcaauucacacaaaauuucaaaacaaaaagugaaauauaaggcacguuu

SEQ ID NO: 280227 - RNA, 64 nt, Homo Sapiens
acaggggccaauaaauucccaaaaagaaaaacaaaaaacaaaaaucucaugcucuuguuucuca

SEQ ID NO: 280228 - RNA, 64 nt, Homo Sapiens
acaaaaaacaggggccaauauuucucaaaaaagaaaaacaaaaaacaaguaucucaugcucuug

SEQ ID NO: 280229 - RNA, 64 nt, Homo Sapiens
aacucuggcuuuugagaugauaacaacucauuaaaaaacaaaacuagaauaggcugcaucuuuu

SEQ ID NO: 280230 - RNA, 64 nt, Homo Sapiens
gcguuguuuaaaggauuauaaaaagauaaugaguaaaacaaauuagucuauuucagccuagaag

SEQ ID NO: 280231 - RNA, 64 nt, Homo Sapiens
ccccaaaaacagcaggcaaaugggcuucaaaaucaaaacaaaaacucuuauguauuuguaaggc

SEQ ID NO: 280232 - RNA, 64 nt, Homo Sapiens
cuguuuauacauaugagauaauauuguuuuucuaaaaacaaauguacagauucugcaguuuaug

SEQ ID NO: 280233 - RNA, 64 nt, Homo Sapiens
cacaaaaaacugagaacucuuguuuagcuuagcaaaaacaaacauagcgaacucuagcaaaacu

SEQ ID NO: 280234 - RNA, 64 nt, Homo Sapiens
uagacaaauauuuugauucuguaagaaaacugcaaaaacaaauagcugccagagguucugauau

SEQ ID NO: 280235 - RNA, 64 nt, Homo Sapiens
auuuuuaucaaauguuaugaaaaaacaaaaaacaaaaacaaaagguuuauuuuaguaaaaaaaa

SEQ ID NO: 280236 - RNA, 64 nt, Homo Sapiens
caaaagauuuuuaucaaaugaaaaaaaaaaacaaaaaacaaaaagaacagguuuauuuuaguaa

SEQ ID NO: 280237 - RNA, 64 nt, Homo Sapiens
acaaaaacaaaagauuuuuauuaguaaaaaaaaaaaaacaaaaauucccccgaacagguuuauu

SEQ ID NO: 280238 - RNA, 64 nt, Homo Sapiens
acuuaacuagaauucucuaauacauguauguggaaaaacaaaacccuauugaucuuaagguauu

SEQ ID NO: 280239 - RNA, 64 nt, Homo Sapiens
cuucaaguaugaagacuaaacuuaguuauuuuuaaaaacaaauugcuaauuuauuuuuuugcau

SEQ ID NO: 280240 - RNA, 64 nt, Homo Sapiens
acgcugaguuuaucaagaaauuuucuugucacugaaaacaaacaggguccccuuuccauguaug

SEQ ID NO: 280241 - RNA, 64 nt, Homo Sapiens
cauuuucuaaaaugcauuuuauggugcauuaugaaaaacaaaauuacacauccugugccccaau

SEQ ID NO: 280242 - RNA, 64 nt, Homo Sapiens
uuaacaaauuuuuaccuuguucccaagcugaauaaaaacaaacaguauucauggcacaaagcuu

SEQ ID NO: 280243 - RNA, 64 nt, Homo Sapiens
ccagacaaacccaaguugucuuuuaaagaaaaagaaaacaaaaguaguuuuacuguacauuuau

SEQ ID NO: 280244 - RNA, 64 nt, Homo Sapiens
acaacaacaaaauuauaaagaaacccaaaaaacaaaaacaaacagugagacugcaucucaaaaa

SEQ ID NO: 280245 - RNA, 64 nt, Homo Sapiens
caaacaacaacaacaaaauucaaaaaaaacccaaaaaacaaaaauacagagugagacugcaucu

SEQ ID NO: 280246 - RNA, 64 nt, Homo Sapiens
cacaaauuagucggguguggacugaaaaacaacaaaaacaaaaacaugguaaaacccugucucu

SEQ ID NO: 280247 - RNA, 64 nt, Homo Sapiens
aaacacaaaccaucaucacaaaaaaacgaaaacaaaaacaaaaagugagacuccaucucauuaa

SEQ ID NO: 280248 - RNA, 64 nt, Homo Sapiens
caaaaaaaacacaaaccauccauuaaaaaaaacgaaaacaaaaagacagagugagacuccaucu

SEQ ID NO: 280249 - RNA, 64 nt, Homo Sapiens
gaacaauccaugaacuuagagcaauugagaaaacaaaacaaaagauauggaccccugagaauga

SEQ ID NO: 280250 - RNA, 64 nt, Homo Sapiens
aaaaggaacaauccaugaacaaugagcaauugagaaaacaaaaccuuguauauggaccccugag

SEQ ID NO: 280251 - RNA, 64 nt, Homo Sapiens
ccaaaaaagucacccuaucaacuguccuuaaaacaaaacaaaaauuucaauaaaaaaaagagaa

SEQ ID NO: 280252 - RNA, 64 nt, Homo Sapiens
aaaaaccaaaaaagucacccgagaaacuguccuuaaaacaaaacuuucauuucaauaaaaaaaa

SEQ ID NO: 280253 - RNA, 64 nt, Homo Sapiens
cuugaaggagaggagggcggggaaauuuuucuguaaaacaaaaccauuugcagauacaaaagau

SEQ ID NO: 280254 - RNA, 64 nt, Homo Sapiens
gcaggaaucggugggacagucaaugccuuaagaaaaaacaaacaguuuucugaagucugaggaa

SEQ ID NO: 280255 - RNA, 64 nt, Homo Sapiens
uggacagaaacaggaaugugagggaccuuuaaagaaaacaaaacugcacccgggugggggacag

SEQ ID NO: 280256 - RNA, 64 nt, Homo Sapiens
ugauuaaaacuggugcuuaaagaucuaauaauacaaaacaaacugcacagaaaacaaauaucaa

SEQ ID NO: 280257 - RNA, 64 nt, Homo Sapiens
ucaaagaucuaauaauacaagacacgaggcacagaaaacaaauaccgagcugccgaauucaguu

SEQ ID NO: 280258 - RNA, 64 nt, Homo Sapiens
uauauuguuuucaggugcucaaaaugcaaaacacaaaacaaauccugcauuuagauacaccuca

SEQ ID NO: 280259 - RNA, 64 nt, Homo Sapiens
auuuaggaauuuaauaaccuuuaagucagaaacuaaaacaaauacugaaauauuagcucuuccu

SEQ ID NO: 280260 - RNA, 64 nt, Homo Sapiens
uuuuccugugaacacauaaauauauuuuuauagaaaaacaaaucuacauaaaauaaaucuacug

SEQ ID NO: 280261 - RNA, 64 nt, Homo Sapiens
uugguuuucuccuucccaaggcagcuggauugaaaaaacaaaacaaaacaaaaaaacccagggg

SEQ ID NO: 280262 - RNA, 64 nt, Homo Sapiens
uuucuccuucccaaggcagcuggauugaaaaaacaaaacaaaacaaaaaaacccaggggcguca

SEQ ID NO: 280263 - RNA, 64 nt, Homo Sapiens
ccuucccaaggcagcuggauugaaaaaacaaaacaaaacaaaaaaacccaggggcgucagucga

SEQ ID NO: 280264 - RNA, 64 nt, Homo Sapiens
caaacacccaaacuguuuggauugauugcuuuaaaaaacaaaccuggcucuuaccuuugaucuu

SEQ ID NO: 280265 - RNA, 64 nt, Homo Sapiens
accaucagauaacuguauuuugucaggugcaauaaaaacaaaauuaaaacccaaaucaucaaga

SEQ ID NO: 280266 - RNA, 64 nt, Homo Sapiens
uaccccaagaggaaguuuucugaaauaagauuuaaaaacaaaacaaaaaaaacacuuaauauuu

SEQ ID NO: 280267 - RNA, 64 nt, Homo Sapiens
caagaggaaguuuucugaaauaagauuuaaaaacaaaacaaaaaaaacacuuaauauuucagac

SEQ ID NO: 280268 - RNA, 64 nt, Homo Sapiens
aaaaaauuuccagaagaggaaaaaaaaacuacaaaaaacaaaacauugaagguugauauuuuau

SEQ ID NO: 280269 - RNA, 64 nt, Homo Sapiens
aaggcucucgaggcaagcugucaacgucuuguugaaaacaaaaaucaagaaagaauugaaauac

SEQ ID NO: 280270 - RNA, 64 nt, Homo Sapiens
agauaggagcuuauggucaaaaagugcaaaaaaaaaaacaaaaaaaaagcaauagauagagaaa

SEQ ID NO: 280271 - RNA, 64 nt, Homo Sapiens
uucuauuucaaaggaaaccaaaccuuaaaaaaaaaaaacaaaaacugggcugggucuuccaaac

SEQ ID NO: 280272 - RNA, 64 nt, Homo Sapiens
auugguucagccucaagucuggcccgucuucgaaaaaacaaacacauuuguaagcuuuguggga

SEQ ID NO: 280273 - RNA, 64 nt, Homo Sapiens
guauauuuauaaauaaaaauauuaaauagaagguaaaacaaaucagacauacacacauuagaua

SEQ ID NO: 280274 - RNA, 64 nt, Homo Sapiens
agccuggggguauauucaagguuauaugucuuagaaaacaaaaauacuuguuuggguucaguuu

SEQ ID NO: 280275 - RNA, 64 nt, Homo Sapiens
uuuggcuuuuuguucuguuggugugauucaaagcaaaacaaacaaacaaaaacaaauuuuaaga

SEQ ID NO: 280276 - RNA, 64 nt, Homo Sapiens
cuguuggugugauucaaagcaaaacaaacaaacaaaaacaaauuuuaagaacacaacaaaaaag

SEQ ID NO: 280277 - RNA, 64 nt, Homo Sapiens
aacaugaagucucuuuaugguuagagaagaccaaaaaacaaacaaacaaacuuagaaacauaaa

SEQ ID NO: 280278 - RNA, 64 nt, Homo Sapiens
aaaaaaugagacccuaaaaaguuucuagagagagaaaacaaaagaucagaaaugaaagcggggc

SEQ ID NO: 280279 - RNA, 64 nt, Homo Sapiens
gaagacacaagaaaagcauuucagaggcuaauuuaaaacaaaaaguaagcaccuaaaggcaagg

SEQ ID NO: 280280 - RNA, 64 nt, Homo Sapiens
uuccauuuccuagguaauuuuuuaaaagccagucaaaacaaaaacuuuacugaaaauggacaga

SEQ ID NO: 280281 - RNA, 57 nt, Homo Sapiens
auuuauuguaucccauguaaaaacaaaaaaacaaaaaacaaagaaaagaaagagauu

SEQ ID NO: 280282 - RNA, 64 nt, Homo Sapiens
auuuauuguaucccauguaaaaacaaaaaaacaaaaaacaaagaaaagaaagagauuuuauaga

SEQ ID NO: 280283 - RNA, 64 nt, Homo Sapiens
aaacuaguuucauauauuaccuaguuauucuuucaaaacaaaacaaaaaaaaaacaaaaacuga

SEQ ID NO: 280284 - RNA, 64 nt, Homo Sapiens
aguuucauauauuaccuaguuauucuuucaaaacaaaacaaaaaaaaaacaaaaacugacgcac

SEQ ID NO: 280285 - RNA, 64 nt, Homo Sapiens
aaaaaaugaauuguauauauacaaaucaacuuuaaaaacaaauuucaauugcuugaagcaauug

SEQ ID NO: 280286 - RNA, 64 nt, Homo Sapiens
gccuuagcaaaggcucaugcugaaauuugccaguaaaacaaagaaguuuaaagacuggcaggua

SEQ ID NO: 280287 - RNA, 64 nt, Homo Sapiens
uuuguauauguaaucagauguacauuuauauugaaaaacaaaugagauggacuuaaagagcaca

SEQ ID NO: 280288 - RNA, 64 nt, Homo Sapiens
guaaacuuugaagauuguuuguaucuuuuuuuaaaaaacaaaacaaaacaaaaauccccaaaau

SEQ ID NO: 280289 - RNA, 64 nt, Homo Sapiens
cuuugaagauuguuuguaucuuuuuuuaaaaaacaaaacaaaacaaaaauccccaaaauauaua

SEQ ID NO: 280290 - RNA, 64 nt, Homo Sapiens
aagauuguuuguaucuuuuuuuaaaaaacaaaacaaaacaaaaauccccaaaauauauagaaau

SEQ ID NO: 280291 - RNA, 64 nt, Homo Sapiens
aauuuguauuuagaaaagguuuauauuauuagugaaaacaaaacuaaagggaaguucaaguucu

SEQ ID NO: 280292 - RNA, 64 nt, Homo Sapiens
ugucucauauaauaaggugaugucggaaacacgcaaaacaaaacgaaaaaagauuucucaguau

SEQ ID NO: 280293 - RNA, 64 nt, Homo Sapiens
aaacaaaagagaacuaugcauuuucaaaaaacaaaaaacaaaacaguaauuguacugcaauaau

SEQ ID NO: 280294 - RNA, 64 nt, Homo Sapiens
acaaaacaaacaaaagagaacaauaauuuuucaaaaaacaaaaaaaauaggaguaauuguacug

SEQ ID NO: 280295 - RNA, 64 nt, Homo Sapiens
auuacuugaauauguuuguauuacauaauaacccaaaacaaauaugauauauaauuauuucaug

SEQ ID NO: 280296 - RNA, 64 nt, Homo Sapiens
caagcagcuuuugugacuaauaacuaaaaaaaaaaaaacaaaaauaacaauauuauuauuguua

SEQ ID NO: 280297 - RNA, 64 nt, Homo Sapiens
gcaauaacaauauuauuauuccugucucaaaagcaaaacaaacaccugggugacagagugagac

SEQ ID NO: 280298 - RNA, 64 nt, Homo Sapiens
ucgaaaggcuuaugccaaauuuucacugguuuaaaaaacaaacaugucuugcgugauuuguaua

SEQ ID NO: 280299 - RNA, 64 nt, Homo Sapiens
ucccuuccccagcagggcugaaacaaaacaaaacaaaacaaacccaagauaaaaggucuuggga

SEQ ID NO: 280300 - RNA, 64 nt, Homo Sapiens
aaaccucccuuccccagcagugggaaaacaaaacaaaacaaaacuggugcaagauaaaaggucu

SEQ ID NO: 280301 - RNA, 64 nt, Homo Sapiens
aaaacaaaccucccuuccccggucuugggaaaacaaaacaaaacuucucuggugcaagauaaaa

SEQ ID NO: 280302 - RNA, 64 nt, Homo Sapiens
aaaacaaaacaaaccucccuuaaaaggucuugggaaaacaaaacguaaauucucuggugcaaga

SEQ ID NO: 280303 - RNA, 64 nt, Homo Sapiens
aucuggaccuuuacagaagagaaaaaugacacacaaaacaaaauguuguaaaaaauauccauca

SEQ ID NO: 280304 - RNA, 64 nt, Homo Sapiens
aaagacaugugacuuauucaaguaagaccaagaaaaaacaaacugagaauuuuucccugugaaa

SEQ ID NO: 280305 - RNA, 64 nt, Homo Sapiens
aacaaaaaagcuauggcacucaaaacaacaacaaaaaacaaacaucucuuucuuaugaacaaaa

SEQ ID NO: 280306 - RNA, 64 nt, Homo Sapiens
aacaacaaaaaacaaacaaaucuuucuuaugaacaaaacaaaacggauaaguaguaucuuucuc

SEQ ID NO: 280307 - RNA, 64 nt, Homo Sapiens
uccagugucacaugggccugauucaaacaaaacuaaaacaaaaaguaagaacuauuuuuaaaau

SEQ ID NO: 280308 - RNA, 64 nt, Homo Sapiens
uuucaaugaucaaaaaaugccugcaccucccaccaaaacaaacuauuugaauaguuccugcuuu

SEQ ID NO: 280309 - RNA, 64 nt, Homo Sapiens
cucuggaauuugugcguucaaucggauugauuaaaaaacaaauuuauuuuguuguguaaaauug

SEQ ID NO: 280310 - RNA, 64 nt, Homo Sapiens
ggcaggcagacagaaauaauagucuucauuuuuaaaaacaaaaagacaaacuuguuucaaugau

SEQ ID NO: 280311 - RNA, 64 nt, Homo Sapiens
cauguuuugaagagaaaccagcauguuuguuaaaaaaacaaacauuggcaugccaaauuaacuu

SEQ ID NO: 280312 - RNA, 64 nt, Homo Sapiens
uaagguuuuaauuauacugcaacuguuuaucuuuaaaacaaauagauuuauuaaauuuccuuca

SEQ ID NO: 280313 - RNA, 64 nt, Homo Sapiens
aaccucuaugcaaucugagucaaacagaaaacagaaaacaaaaaaaaaaucugaccaaaacaaa

SEQ ID NO: 280314 - RNA, 64 nt, Homo Sapiens
aacagaaaacagaaaacaaacaaaaaaucugaccaaaacaaacagauacacuaugaagauguuu

SEQ ID NO: 280315 - RNA, 64 nt, Homo Sapiens
uuuugguaacugugcacuguaaaaacaaaaaacaaaaacaaaccguauuuaaagcaaaaaaacg

SEQ ID NO: 280316 - RNA, 64 nt, Homo Sapiens
caaaccuuuugguaacugugaaaacgaaaaacaaaaaacaaaaaguuuugguauuuaaagcaaa

SEQ ID NO: 280317 - RNA, 64 nt, Homo Sapiens
acaaaaacaaaccuuuugguaagcaaaaaaacgaaaaacaaaaauuuuguaguuuugguauuua

SEQ ID NO: 280318 - RNA, 64 nt, Homo Sapiens
aaauguuaagaaauggguuuuuuucaaauguuugaaaacaaaaaugcauacguuuugguguugc

SEQ ID NO: 280319 - RNA, 64 nt, Homo Sapiens
aacaaacaaaaaacccauguaaguaugguauuacaaaacaaacaauuuuggguauuguaaucug

SEQ ID NO: 280320 - RNA, 64 nt, Homo Sapiens
uuccaucugagugauugucaguguaaggccuuuuaaaacaaaagcaaguucuuuguuaggaauu

SEQ ID NO: 280321 - RNA, 64 nt, Homo Sapiens
cugugaagaaguuuucacaacuauuuaugcugguaaaacaaaugcuguuaaaucaccuuaugcg

SEQ ID NO: 280322 - RNA, 64 nt, Homo Sapiens
acagauaacaaaauacacuuuacugguaaaauuuaaaacaaaaaaggcaaaacaaaacaaacuc

SEQ ID NO: 280323 - RNA, 64 nt, Homo Sapiens
acacuuuacugguaaaauuuaaaacaaaaaaggcaaaacaaaacaaacucauuuuccccuuagu

SEQ ID NO: 280324 - RNA, 64 nt, Homo Sapiens
uuacugguaaaauuuaaaacaaaaaaggcaaaacaaaacaaacucauuuuccccuuaguuccca

SEQ ID NO: 280325 - RNA, 64 nt, Homo Sapiens
agccuggauauuauucuuguaguuuaccucuuuaaaaacaaaacaaaacaaaacaaaaaacucc

SEQ ID NO: 280326 - RNA, 64 nt, Homo Sapiens
ggauauuauucuuguaguuuaccucuuuaaaaacaaaacaaaacaaaacaaaaaacuccccuuc

SEQ ID NO: 280327 - RNA, 64 nt, Homo Sapiens
uuauucuuguaguuuaccucuuuaaaaacaaaacaaaacaaaacaaaaaacuccccuuccucac

SEQ ID NO: 280328 - RNA, 64 nt, Homo Sapiens
cuuguaguuuaccucuuuaaaaacaaaacaaaacaaaacaaaaaacuccccuuccucacugccc

SEQ ID NO: 280329 - RNA, 64 nt, Homo Sapiens
caaccugaauucaccacagcuggaauagcuguggaaaacaaaauaaaacaacaaaauuaauaau

SEQ ID NO: 280330 - RNA, 64 nt, Homo Sapiens
uuucuaguaaugcaaacaaauuauuuuuuacaaaaaaacaaaauaaauaaaauuagacuuccuu

SEQ ID NO: 280331 - RNA, 64 nt, Homo Sapiens
cuggggagaggacuuaacugacuuaagaaguaggaaaacaaaaaccucucuccucagccuucca

SEQ ID NO: 280332 - RNA, 64 nt, Homo Sapiens
uacuugaaauguauugacugcugacuauauuuuaaaaacaaaaugaaauaauuugaguuguauu

SEQ ID NO: 280333 - RNA, 64 nt, Homo Sapiens
uacugucuguuggauaauggcuguaaaauguuuaaaaacaaaacaaaacaaaaaagaggcacua

SEQ ID NO: 280334 - RNA, 64 nt, Homo Sapiens
ucuguuggauaauggcuguaaaauguuuaaaaacaaaacaaaacaaaaaagaggcacuagucua

SEQ ID NO: 280335 - RNA, 64 nt, Homo Sapiens
uggauaauggcuguaaaauguuuaaaaacaaaacaaaacaaaaaagaggcacuagucuaucugc

SEQ ID NO: 280336 - RNA, 64 nt, Homo Sapiens
aagcagcaucuuauguccugauuucauauaguagaaaacaaacauuggguccgacuucaaaaug

SEQ ID NO: 280337 - RNA, 64 nt, Homo Sapiens
uaguuauucucuaagaggaaacuaguguuuguuaaaaacaaaaauaaaaacaaaaccacacaag

SEQ ID NO: 280338 - RNA, 64 nt, Homo Sapiens
aagaggaaacuaguguuuguuaaaaacaaaaauaaaaacaaaaccacacaaggagaacccaauu

SEQ ID NO: 280339 - RNA, 64 nt, Homo Sapiens
cuucaaaugaaaaccgacuaaggauuuucuuucaaaaacaaaucagaagcagaugcugauuggg

SEQ ID NO: 280340 - RNA, 64 nt, Homo Sapiens
uagccugggugacagagucagacuccgucccaaaaaaacaaacaaacaaaacaaaacaaaaaaa

SEQ ID NO: 280341 - RNA, 64 nt, Homo Sapiens
agagucagacuccgucccaaaaaaacaaacaaacaaaacaaaacaaaaaaaaacagaaguuaca

SEQ ID NO: 280342 - RNA, 64 nt, Homo Sapiens
cagacuccgucccaaaaaaacaaacaaacaaaacaaaacaaaaaaaaacagaaguuacaaauga

SEQ ID NO: 280343 - RNA, 64 nt, Homo Sapiens
cagaagcauagauuuaauugcaucuuuauuuugaaaaacaaaugaaaauugaugggguuuaaag

SEQ ID NO: 280344 - RNA, 64 nt, Homo Sapiens
uuucuaguuauuguauugcuacaauuuaaauauuaaaacaaauaagagcuuucucaacaaauua

SEQ ID NO: 280345 - RNA, 64 nt, Homo Sapiens
ugcauuugcaagaucugagcaaauaagauuaaguaaaacaaaucaauuguauauauaauugacc

SEQ ID NO: 280346 - RNA, 64 nt, Homo Sapiens
gcccugucucaggaacaucuuaacagauggcaaaaaaacaaaaacuuuuuuucaacuccuauga

SEQ ID NO: 280347 - RNA, 64 nt, Homo Sapiens
agccuggaugacagagugagaccuugucucaaacaaaacaaaacaaaaaugaaauguucuaguu

SEQ ID NO: 280348 - RNA, 64 nt, Homo Sapiens
ggaugacagagugagaccuugucucaaacaaaacaaaacaaaaaugaaauguucuaguuuuggu

SEQ ID NO: 280349 - RNA, 64 nt, Homo Sapiens
ugaaugguagcuuuugcacagaacuuccaaaagcaaaacaaaaacaaaaucuauuguaguuaua

SEQ ID NO: 280350 - RNA, 64 nt, Homo Sapiens
guagcuuuugcacagaacuuccaaaagcaaaacaaaaacaaaaucuauuguaguuauauacuuc

SEQ ID NO: 280351 - RNA, 64 nt, Homo Sapiens
agucagaaaauggccuucugugcuuucaaaaaaaaaaacaaaaaaaaaaccacacacacacaua

SEQ ID NO: 280352 - RNA, 64 nt, Homo Sapiens
agccugggcaacaaagagcgaaacucugucucaaaaaacaaaccaacaaaaaccacaauugauu

SEQ ID NO: 280353 - RNA, 64 nt, Homo Sapiens
uaugucaaucuguauauauuguaccuuaauaugaaaaacaaauuuuuuaauucauaaaaguauu

SEQ ID NO: 280354 - RNA, 64 nt, Homo Sapiens
cuguuuuuccuaauuuuggcuaauuuagaaaaacaaaacaaaggugcuugucuuauuuuuagaa

SEQ ID NO: 280355 - RNA, 64 nt, Homo Sapiens
aaaggcuguuuuuccuaauuuagaauaauuuagaaaaacaaaaccuaccugcuugucuuauuuu

SEQ ID NO: 280356 - RNA, 64 nt, Homo Sapiens
gacagugugugugucuguuguauauuugauuguaaaaacaaaaaagcugaacuuacugcuuaua

SEQ ID NO: 280357 - RNA, 64 nt, Homo Sapiens
aacaacaauacaacaagaaccucuguacaaaaacaaaacaaaacaauuucuccuacuuuacacu

SEQ ID NO: 280358 - RNA, 64 nt, Homo Sapiens
aaaacaacaacaauacaacaacacucucuguacaaaaacaaaacuuaggaauuucuccuacuuu

SEQ ID NO: 280359 - RNA, 64 nt, Homo Sapiens
gcaagucuagcaauugaacugauuguugauaauaaaaacaaaaacaagaguguaccauuaacuu

SEQ ID NO: 280360 - RNA, 64 nt, Homo Sapiens
gccaacaacccagaaagguugcagaaaccauuaaaaaacaaaaaaaaaacaaaaaaguuggaag

SEQ ID NO: 280361 - RNA, 64 nt, Homo Sapiens
aguuggaaggcagaaaccauaaaaaguaaaaauaaaaacaaaaauuguuuagaaaaaaaagaca

SEQ ID NO: 280362 - RNA, 64 nt, Homo Sapiens
aacuucccuggcuucgcacccucaacccccaaacaaaacaaacaaccccacuccuacccccuuc

SEQ ID NO: 280363 - RNA, 64 nt, Homo Sapiens
uaagcaaaugcacaagcaaaaacugagaauaauuaaaacaaaauuaaauccauauuucauaaau

SEQ ID NO: 280364 - RNA, 64 nt, Homo Sapiens
ugagaaaccacaacacagguacaaggaugccaaaaaaacaaaggaaauaccuucagccuaaggc

SEQ ID NO: 280365 - RNA, 64 nt, Homo Sapiens
auaauuuugugcaauuaacaauauuuaaauggcaaaaacaaaaccagaauaggauucugugaua

SEQ ID NO: 280366 - RNA, 64 nt, Homo Sapiens
aaaacaaggagaaguuguccguuaaaaacaaaacaaaacaaaaagaccagagagagcuuggaau

SEQ ID NO: 280367 - RNA, 64 nt, Homo Sapiens
aaaaaaaaacaaggagaaguggaauguuaaaaacaaaacaaaacuaggggaccagagagagcuu

SEQ ID NO: 280368 - RNA, 64 nt, Homo Sapiens
aaaacaaaaaaaaacaaggaagcuuggaauguuaaaaacaaaacuuggauaggggaccagagag

SEQ ID NO: 280369 - RNA, 64 nt, Homo Sapiens
uguuguuucucuuucuugcuuagcagaaaaaaacaaaacaaaacauagaaacacauuuucuggc

SEQ ID NO: 280370 - RNA, 64 nt, Homo Sapiens
aaaacuguuguuucucuuuccuggcuagcagaaaaaaacaaaacaaugaauagaaacacauuuu

SEQ ID NO: 280371 - RNA, 64 nt, Homo Sapiens
augagcaaacacaaaacccaggugcagcuaaaacaaaacaaaacuggcacaaggaaucacacgu

SEQ ID NO: 280372 - RNA, 64 nt, Homo Sapiens
aaaacaugagcaaacacaaacacguggugcagcuaaaacaaaacgaaaauggcacaaggaauca

SEQ ID NO: 280373 - RNA, 64 nt, Homo Sapiens
aacaaaaacaacccuuccucagaagcaaaaaagaaaaacaaaaucagaagccuauuuuuaaagc

SEQ ID NO: 280374 - RNA, 64 nt, Homo Sapiens
gggaaauguccuagguuuucgaauuucccaguuuaaaacaaaaaugucuuccuccaaggaguua

SEQ ID NO: 280375 - RNA, 64 nt, Homo Sapiens
uuaguauuacugguauuaagagucggcuuugcccaaaacaaauugcgccacugacuccuccuuc

SEQ ID NO: 280376 - RNA, 64 nt, Homo Sapiens
gccaguugcauugguuucccuuuucuuccuauugaaaacaaaauuuuuaaaaccagauaccaca

SEQ ID NO: 280377 - RNA, 64 nt, Homo Sapiens
agaccuuccugugauacuuuaaaagcaaaaacaaaaaacaaaaacucauuuguaguaaaacuua

SEQ ID NO: 280378 - RNA, 64 nt, Homo Sapiens
acaaaaaagaccuuccugugaaacuuaaaaagcaaaaacaaaaagcugucacucauuuguagua

SEQ ID NO: 280379 - RNA, 64 nt, Homo Sapiens
caccaacacaccacucauuggaaaauggaaaaaaaaaacaaaaaaaaaacaaaaaaauguacaa

SEQ ID NO: 280380 - RNA, 64 nt, Homo Sapiens
cacucauuggaaaauggaaaaaaaaaacaaaaaaaaaacaaaaaaauguacaauggaugcauug

SEQ ID NO: 280381 - RNA, 64 nt, Homo Sapiens
cauagaaagugccagaaaguguuuaacuugucaaaaaacaaaaacccagcaacagaaaaaugga

SEQ ID NO: 280382 - RNA, 64 nt, Homo Sapiens
uauaugcacauauauauauguauuuaaaaaaaucaaaacaaaaaaaaacucauuuauaccugug

SEQ ID NO: 280383 - RNA, 64 nt, Homo Sapiens
auaaucccacagaauuuacuuuaaaugucacguaaaaacaaauucaccuaagauagucuugcuu

SEQ ID NO: 280384 - RNA, 64 nt, Homo Sapiens
uuguauaaguuaaggcagccauaaaugaaaauacaaaacaaacguuugcuuuuguauuugauuc

SEQ ID NO: 280385 - RNA, 64 nt, Homo Sapiens
gcucuucuaaggaaauggagaagcucuguuuauaaaaacaaaaacaaaaccagcugcuacucau

SEQ ID NO: 280386 - RNA, 64 nt, Homo Sapiens
cuaaggaaauggagaagcucuguuuauaaaaacaaaaacaaaaccagcugcuacucauaaguug

SEQ ID NO: 280387 - RNA, 64 nt, Homo Sapiens
ccagccugggcgacagagcgagacucugccucaaaaaacaaaacaaaacaaaacacucacccau

SEQ ID NO: 280388 - RNA, 64 nt, Homo Sapiens
cugggcgacagagcgagacucugccucaaaaaacaaaacaaaacaaaacacucacccaucaacg

SEQ ID NO: 280389 - RNA, 64 nt, Homo Sapiens
cgacagagcgagacucugccucaaaaaacaaaacaaaacaaaacacucacccaucaacgaauau

SEQ ID NO: 280390 - RNA, 64 nt, Homo Sapiens
ggcugagcugagcuucgguucuccagaauguaagaaaacaaaaucuaaaacaaaaucugaacuc

SEQ ID NO: 280391 - RNA, 64 nt, Homo Sapiens
cuucgguucuccagaauguaagaaaacaaaaucuaaaacaaaaucugaacucucaaaagucuau

SEQ ID NO: 280392 - RNA, 64 nt, Homo Sapiens
uggaagaaccuguuugaugcaaaaaagaaaaugaaaaacaaaacaaaaaauccccaaaaccuua

SEQ ID NO: 280393 - RNA, 64 nt, Homo Sapiens
gaaccuguuugaugcaaaaaagaaaaugaaaaacaaaacaaaaaauccccaaaaccuuauuaug

SEQ ID NO: 280394 - RNA, 64 nt, Homo Sapiens
caaacccauguugaaacuaguacuuuucccuuuaaaaacaaaccaaaaaaaaaaacaaaaaaaa

SEQ ID NO: 280395 - RNA, 64 nt, Homo Sapiens
uaguacuuuucccuuuaaaaacaaaccaaaaaaaaaaacaaaaaaaaacuuuuuaauuaaagaa

SEQ ID NO: 280396 - RNA, 64 nt, Homo Sapiens
uggugaaacccugccucuacuaaaaauacaaaaaaaaacaaaauuagccgggcgugguugcggg

SEQ ID NO: 280397 - RNA, 64 nt, Homo Sapiens
cuccagucugggcgacagagugagacuccaucucaaaacaaacaaaaaaaggauggggcugggc

SEQ ID NO: 280398 - RNA, 64 nt, Homo Sapiens
guuuucagaaggaacaacaccagggaaugccaaaaaaacaaagggcaagucaaccaaggcauuu

SEQ ID NO: 280399 - RNA, 64 nt, Homo Sapiens
ucagaaaagaaaaagaaugaugcuucuugcaacaaaaacaaaagugauuaugucacgagaggag

SEQ ID NO: 280400 - RNA, 64 nt, Homo Sapiens
guuacuuggaagguuagcuuaaagauuuaaguuaaaaacaaaguuuuggagucuuucaugucua

SEQ ID NO: 280401 - RNA, 64 nt, Homo Sapiens
cagagcugcccaggcuuucuugccaugcccagccaaaacaaacaggccuaggcuggcuccagug

SEQ ID NO: 280402 - RNA, 64 nt, Homo Sapiens
aaccaaacaaauacaaucuacaaaaaaacaaaacaaaacaaaacauuucacaaguccugugagg

SEQ ID NO: 280403 - RNA, 64 nt, Homo Sapiens
aaaacaaccaaacaaauacaugaggcaaaaaaacaaaacaaaacagacuauuucacaaguccug

SEQ ID NO: 280404 - RNA, 64 nt, Homo Sapiens
aaaacaaaacaaccaaacaauccugugaggcaaaaaaacaaaacucuuaagacuauuucacaag

SEQ ID NO: 280405 - RNA, 64 nt, Homo Sapiens
ugaugaagcuuuugaauaaucuggguucuggaaaaaaacaaacaaacuuuguccuauuugucaa

SEQ ID NO: 280406 - RNA, 64 nt, Homo Sapiens
uaaaucuaguuuagcacuaauuauuuuucuauuuaaaacaaaaaguuuuacuuucgugccugca

SEQ ID NO: 280407 - RNA, 64 nt, Homo Sapiens
cacuuauauugcuagcuacacugucucaaaacaaaaaacaaaacgcaacagagcaagacccugu

SEQ ID NO: 280408 - RNA, 64 nt, Homo Sapiens
acaaaaccacuuauauugcuacccugucugucucaaaacaaaaaagccugggcaacagagcaag

SEQ ID NO: 280409 - RNA, 64 nt, Homo Sapiens
acaguccugcauacucaccacuaaaaaacaaaacaaaacaaaacaagaaaauguguaaggcuug

SEQ ID NO: 280410 - RNA, 64 nt, Homo Sapiens
aaaacacaguccugcauacugcuugcuaaaaaacaaaacaaaacuacaaaagaaaauguguaag

SEQ ID NO: 280411 - RNA, 64 nt, Homo Sapiens
aaaacaaaacacaguccugcguaaggcuugcuaaaaaacaaaacuugcauacaaaagaaaaugu

SEQ ID NO: 280412 - RNA, 64 nt, Homo Sapiens
gcaauauuaaauguuugcuuuccaaaauguuagcaaaacaaaguuucaauuaggaaaaguaaaa

SEQ ID NO: 280413 - RNA, 64 nt, Homo Sapiens
ggcuuuuccauaaguggccucuuaaagcucauacaaaacaaauauugaccugguuaaauacugu

SEQ ID NO: 280414 - RNA, 64 nt, Homo Sapiens
uuugaaaaaacuuuaacauggcacaacaaggaacaaaacaaagcuuaaaacuuguuugugguca

SEQ ID NO: 280415 - RNA, 64 nt, Homo Sapiens
accaaagugguaaggauucaacaaaaacaggaaaaaaacaaaaagaaaaacaaaacaaaacaaa

SEQ ID NO: 280416 - RNA, 64 nt, Homo Sapiens
caggaaaaaaacaaaaaaccaaacaaaacaaaacaaaacaaaaaaagccucggguaacacugaa

SEQ ID NO: 280417 - RNA, 64 nt, Homo Sapiens
aaaaacaggaaaaaaacaaacugaaaaacaaaacaaaacaaaaccagagaagccucggguaaca

SEQ ID NO: 280418 - RNA, 64 nt, Homo Sapiens
aaaacaaaaacaggaaaaaauaacacugaaaaacaaaacaaaaccucuucagagaagccucggg

SEQ ID NO: 280419 - RNA, 64 nt, Homo Sapiens
aaaacaaaacaaaaacaggaucggguaacacugaaaaacaaaacacuagcucuucagagaagcc

SEQ ID NO: 280420 - RNA, 64 nt, Homo Sapiens
ucaagggauuuagugcccuguuggagccaucucuaaaacaaaccagaauuuuuuuuuaagggcc

SEQ ID NO: 280421 - RNA, 64 nt, Homo Sapiens
agcaacauccucaaaacccauuucaccccucugcaaaacaaacaguaaaggugaaaacaucccc

SEQ ID NO: 280422 - RNA, 64 nt, Homo Sapiens
aacaccaaaaaaacccccaaugucucaaaaaaacaaaacaaaaaugggugacagagcgagacuc

SEQ ID NO: 280423 - RNA, 64 nt, Homo Sapiens
aaaaaaacaccaaaaaaaccgacucugucucaaaaaaacaaaaccagccugggugacagagcga

SEQ ID NO: 280424 - RNA, 64 nt, Homo Sapiens
uguguggguaugcguggguguauguuugggaagaaaaacaaaggugcagacuaucuuccuuuuu

SEQ ID NO: 280425 - RNA, 64 nt, Homo Sapiens
uuuaaaaaagaaaauauguaauauaauguaaaaaaaaacaaaaaaaagcuuuuaugauggauuu

SEQ ID NO: 280426 - RNA, 64 nt, Homo Sapiens
uuuauauuuaaauguagacuuuugacacuuuuaaaaaacaaaaaaagacaagagagaugaaaac

SEQ ID NO: 280427 - RNA, 64 nt, Homo Sapiens
aggagaauuagccaaacacuguaagcuuuuaagaaaaacaaaguuuuaaacgaaauacugcucu

SEQ ID NO: 280428 - RNA, 64 nt, Homo Sapiens
gaaagaaagcugcaauuauccgccaacugcauuuaaaacaaaacaaaacagaaaaaucaaaaua

SEQ ID NO: 280429 - RNA, 64 nt, Homo Sapiens
aaagcugcaauuauccgccaacugcauuuaaaacaaaacaaaacagaaaaaucaaaauaacauu

SEQ ID NO: 280430 - RNA, 64 nt, Homo Sapiens
aaucuaagaauacgcggucuccugagaacuucaaaaaacaaaaacaaaaaaacccaaaggcccu

SEQ ID NO: 280431 - RNA, 64 nt, Homo Sapiens
agaauacgcggucuccugagaacuucaaaaaacaaaaacaaaaaaacccaaaggcccuuuucag

SEQ ID NO: 280432 - RNA, 64 nt, Homo Sapiens
cccgggcaacaagagcgaaaccccaucucgaaaaaaaacaaaacaaaacuagacaagugagugc

SEQ ID NO: 280433 - RNA, 64 nt, Homo Sapiens
gcaacaagagcgaaaccccaucucgaaaaaaaacaaaacaaaacuagacaagugagugccuacg

SEQ ID NO: 280434 - RNA, 64 nt, Homo Sapiens
guuucuccuucugacuuuuaauaaugguaauaggaaaacaaaacccaaagcuuuucagaacuuc

SEQ ID NO: 280435 - RNA, 64 nt, Homo Sapiens
aaaucuuacuuucuuuuaaugaccaaccuuagguaaaacaaaaauauuguaauccuagaaauua

SEQ ID NO: 280436 - RNA, 64 nt, Homo Sapiens
uuuucugcacuauaugcaaacaggguaacuaacuaaaacaaagccacuuucaaucuucaauccu

SEQ ID NO: 280437 - RNA, 64 nt, Homo Sapiens
caucagaugacaagaaaggcugcuguacugaaguaaaacaaacaauaccugaaugcucuguagc

SEQ ID NO: 280438 - RNA, 64 nt, Homo Sapiens
uaguucugcaaauucaaagauacaguaucccuucaaaacaaauaggaguucagggaagagaaac

SEQ ID NO: 280439 - RNA, 64 nt, Homo Sapiens
caaccuguaaacaugugccuguaacuuacuuccaaaaacaaaaucauacuuauuagaagaaaau

SEQ ID NO: 280440 - RNA, 64 nt, Homo Sapiens
agccugggcaacagagcgagaaccugucucaaaaaaaacaaaaacaaaguuacuaaaaugucac

SEQ ID NO: 280441 - RNA, 64 nt, Homo Sapiens
ggcaacagagcgagaaccugucucaaaaaaaacaaaaacaaaguuacuaaaaugucaccuucac

SEQ ID NO: 280442 - RNA, 64 nt, Homo Sapiens
gccauaucuccaaaaaaagaaagaaaaaauacaaaaaacaaaaacaaaaaaaaaagaggguaau

SEQ ID NO: 280443 - RNA, 64 nt, Homo Sapiens
ucuccaaaaaaagaaagaaaaaauacaaaaaacaaaaacaaaaaaaaaagaggguaauguacaa

SEQ ID NO: 280444 - RNA, 64 nt, Homo Sapiens
ucguaagggaaguaucacacacagaaagaaaacaaaaacaaaccuaaauugguuuggcuacaga

SEQ ID NO: 280445 - RNA, 64 nt, Homo Sapiens
caaaccucguaagggaaguauacagaacagaaagaaaacaaaaaggcugguaaauugguuuggc

SEQ ID NO: 280446 - RNA, 64 nt, Homo Sapiens
aaacuaaguugcuuucuuuuuuggggaaaaaacaaaaacaaaaauguaucucacuuuaaacucu

SEQ ID NO: 280447 - RNA, 64 nt, Homo Sapiens
caaaaaaaacuaaguugcuuaacucuuuggggaaaaaacaaaaaaaguacuguaucucacuuua

SEQ ID NO: 280448 - RNA, 64 nt, Homo Sapiens
cuggagaugcugaauuuugucuccaaaacaaaacaaaacaaaaugaaggaaacuaaggacuugg

SEQ ID NO: 280449 - RNA, 64 nt, Homo Sapiens
aaaaucuggagaugcugaaucuuggcuccaaaacaaaacaaaacacugagaaggaaacuaagga

SEQ ID NO: 280450 - RNA, 64 nt, Homo Sapiens
aaaacaaaaucuggagaugcaaggacuuggcuccaaaacaaaacguguuacugagaaggaaacu

SEQ ID NO: 280451 - RNA, 64 nt, Homo Sapiens
aacaaaaagauuuuauuaaaucugucuccaaaacaaaacaaacacuccaaccugggugacagac

SEQ ID NO: 280452 - RNA, 64 nt, Homo Sapiens
aaacaaacaaaaagauuuuacagacucugucuccaaaacaaaaccugcacuccaaccuggguga

SEQ ID NO: 280453 - RNA, 64 nt, Homo Sapiens
aaaacccugagaccaugaguuaaaaaaaaaaaaaaaaacaaaaaugcuaaggguuuauuuuaug

SEQ ID NO: 280454 - RNA, 64 nt, Homo Sapiens
ucccaauuaagaaccuccgaaaauucugucuaaaaaaacaaaagcagccuggacaacaagagcg

SEQ ID NO: 280455 - RNA, 64 nt, Homo Sapiens
agagguaaauaucacauuaauggaagccauuaggaaaacaaacuuuauugugaggaccuucuca

SEQ ID NO: 280456 - RNA, 64 nt, Homo Sapiens
gcuacuuguuaccucuauuuuuucuuguuacaugaaaacaaaauugacugagaaccugcagcca

SEQ ID NO: 280457 - RNA, 64 nt, Homo Sapiens
uuaacuagcaaaugcugugaacuagaggacugaaaaaacaaauugcugaugugcaguugagaaa

SEQ ID NO: 280458 - RNA, 64 nt, Homo Sapiens
uucauggucugaauuguauaaaguaaauguauuuaaaacaaauuuuuuuagagguacauguuuu

SEQ ID NO: 280459 - RNA, 64 nt, Homo Sapiens
acaggguuguuaaguuguacgaucccuguauucaaaaacaaauguggauuuccuacauuucuga

SEQ ID NO: 280460 - RNA, 64 nt, Homo Sapiens
gucuuuuguuugugaacacuguucaaaacaaaacaaaacaaaaacacagaauaucaccauugca

SEQ ID NO: 280461 - RNA, 64 nt, Homo Sapiens
aaaaagucuuuuguuugugauugcaguucaaaacaaaacaaaacugcugcacagaauaucacca

SEQ ID NO: 280462 - RNA, 64 nt, Homo Sapiens
aaaacaaaaagucuuuuguucaccauugcaguucaaaacaaaacaaauuugcugcacagaauau

SEQ ID NO: 280463 - RNA, 64 nt, Homo Sapiens
acaaaaaaaaaauuaaaaaaaaaacaaacaacaaaaaacaaacaaaagaaguccugcuauguua

SEQ ID NO: 280464 - RNA, 64 nt, Homo Sapiens
acaaaaaacaaacaacaaaaguccugcuauguuaaaaacaaacauaaaaaauaucaccaaagaa

SEQ ID NO: 280465 - RNA, 64 nt, Homo Sapiens
aaaauauugaugaucaggcauaauaaaacaaaacaaaacaaagcgacugggacuccagaaccau

SEQ ID NO: 280466 - RNA, 64 nt, Homo Sapiens
aaagcaaaauauugaugaucaccauuaauaaaacaaaacaaaacguagggacugggacuccaga

SEQ ID NO: 280467 - RNA, 64 nt, Homo Sapiens
aaaacaaagcaaaauauugaccagaaccauuaauaaaacaaaaccagggguagggacugggacu

SEQ ID NO: 280468 - RNA, 64 nt, Homo Sapiens
acaagaagcaaguuguacugagcauuaagaaauaaaaacaaaaaaacaaacaaaaaacaaccuu

SEQ ID NO: 280469 - RNA, 64 nt, Homo Sapiens
cccauggaagcaacaaaagacucaaaaaaacaaaaaaacaaaaagaauuguuuuaauaucuuua

SEQ ID NO: 280470 - RNA, 64 nt, Homo Sapiens
aacaaaaacccauggaagcauaucuuuacucaaaaaaacaaaaauggcaucugaauuguuuuaa

SEQ ID NO: 280471 - RNA, 64 nt, Homo Sapiens
gucccuuggaaccuuuguacgcuuugcucaaaaaaaaacaaaaaaaaaaaacaaaaaaaaaaaa

SEQ ID NO: 280472 - RNA, 64 nt, Homo Sapiens
uuuguacgcuuugcucaaaaaaaaacaaaaaaaaaaaacaaaaaaaaaaaacaacgguggagcc

SEQ ID NO: 280473 - RNA, 64 nt, Homo Sapiens
cagccaaagcaacaagagcaaaaacuucgucucaaaaacaaaacaaaaaaagaguauucauugu

SEQ ID NO: 280474 - RNA, 64 nt, Homo Sapiens
aaagcaacaagagcaaaaacuucgucucaaaaacaaaacaaaaaaagaguauucauugugagga

SEQ ID NO: 280475 - RNA, 64 nt, Homo Sapiens
uuggugacagggucugacauggucagucuacuaaaaaacaaaaaaaaaaaacaaaaaaaaaaaa

SEQ ID NO: 280476 - RNA, 64 nt, Homo Sapiens
cugacauggucagucuacuaaaaaacaaaaaaaaaaaacaaaaaaaaaaaaacaaaagaaaaaa

SEQ ID NO: 280477 - RNA, 64 nt, Homo Sapiens
cuacuaaaaaacaaaaaaaaaaaacaaaaaaaaaaaaacaaaagaaaaaaauaaaaauacggug

SEQ ID NO: 280478 - RNA, 64 nt, Homo Sapiens
cuguuacagauaaauggggccuuuaaaaauaugaaaaacaaacuugugaaaauguauaaaagau

SEQ ID NO: 280479 - RNA, 64 nt, Homo Sapiens
gagacacccuaccuucaauuguucaucaguggguaaaacaaauucugauguacauucaggacaa

SEQ ID NO: 280480 - RNA, 64 nt, Homo Sapiens
gacagagcaggacucucucucaaaaaaacacaaaaaaacaaaaacaaaaaaccauacacacaca

SEQ ID NO: 280481 - RNA, 64 nt, Homo Sapiens
gcaggacucucucucaaaaaaacacaaaaaaacaaaaacaaaaaaccauacacacacacacaca

SEQ ID NO: 280482 - RNA, 64 nt, Homo Sapiens
ggagggaaaaagaaauacagccucaacagauuaaaaaacaaaagucacacuuaaggauccuucu

SEQ ID NO: 280483 - RNA, 64 nt, Homo Sapiens
cauccugcuuauuucucaaaaaagagggacagugaaaacaaaaacgacauugggacaugcugcu

SEQ ID NO: 280484 - RNA, 54 nt, Homo Sapiens
gccaauauucucuagaaugagcacaaaacaaaucgaauaacagcuaaacaaauc

SEQ ID NO: 280485 - RNA, 64 nt, Homo Sapiens
gagguuuguaaacuguccuuuuuaaaucaaacugaaaacaaaaagcuuuaaccuuucaacagaa

SEQ ID NO: 280486 - RNA, 64 nt, Homo Sapiens
aaaaaaaaaaaagcgaaagacugcaguugugcuaaaaacaaaacaaaacaaacaaacaaacaaa

SEQ ID NO: 280487 - RNA, 64 nt, Homo Sapiens
aaaaaaagcgaaagacugcaguugugcuaaaaacaaaacaaaacaaacaaacaaacaaaaaagu

SEQ ID NO: 280488 - RNA, 64 nt, Homo Sapiens
aagcgaaagacugcaguugugcuaaaaacaaaacaaaacaaacaaacaaacaaaaaaguaaaaa

SEQ ID NO: 280489 - RNA, 64 nt, Homo Sapiens
ucugaauaucuucaaauuaagcucaaguugauagaaaacaaaauggugcaaagcgaaacugguu

SEQ ID NO: 280490 - RNA, 64 nt, Homo Sapiens
uuauguugcauuuacuaucacuuguaccacagacaaaacaaaucagagucugauaggacauauu

SEQ ID NO: 280491 - RNA, 64 nt, Homo Sapiens
gcacagccugaauggacguaagaaagaagcaacgaaaacaaaauuccagagacuggcucaaaaa

SEQ ID NO: 280492 - RNA, 64 nt, Homo Sapiens
uaguuuccacagugugaggagggcacucaaggggaaaacaaauggaagcaggcuguagauuuaa

SEQ ID NO: 280493 - RNA, 64 nt, Homo Sapiens
cuggggcaaauccauggaaaagaugugagauggaaaaacaaauuagaaauuuuguuuucuggca

SEQ ID NO: 280494 - RNA, 64 nt, Homo Sapiens
uccucuggauugagauacuuagcuuuucauuaagaaaacaaaaguaagauucauguguuuucua

SEQ ID NO: 280495 - RNA, 64 nt, Homo Sapiens
caaauuggugaaaagaauaaccauaauagacaccaaaacaaaccuccaccccuccccaucugga

SEQ ID NO: 280496 - RNA, 64 nt, Homo Sapiens
agcaacccaguccccaaccuaaaaaacaaaaacaaaaacaaaaaggaaaaauaaaagaaaaugu

SEQ ID NO: 280497 - RNA, 64 nt, Homo Sapiens
caaaaaagcaacccagucccaaauguaaaaaacaaaaacaaaaaaaaaugggaaaaauaaaaga

SEQ ID NO: 280498 - RNA, 64 nt, Homo Sapiens
caaaaacaaaaaagcaacccaaaagaaaauguaaaaaacaaaaacuuacaaaaaugggaaaaau

SEQ ID NO: 280499 - RNA, 64 nt, Homo Sapiens
caaauugcuuauaaaguuucagcuaacugcccauaaaacaaacuaauaaaaaaugcuuugagau

SEQ ID NO: 280500 - RNA, 64 nt, Homo Sapiens
cuuugcugaaauaggaaaaucuguuuagcuuuauaaaacaaacaugcauucucauuggaaaugu

SEQ ID NO: 280501 - RNA, 64 nt, Homo Sapiens
aaaauugagggcauguugcaagcacauuucccccaaaacaaaauaaaaaagcucuagguucuuc

SEQ ID NO: 280502 - RNA, 64 nt, Homo Sapiens
cugaugaaacagaugaaggaacaaaaguaaauuaaaaacaaaacaaaaaaaaaaacaaaaaaaa

SEQ ID NO: 280503 - RNA, 64 nt, Homo Sapiens
uaaauuaaaaacaaaaccugaaaaaaaacaaaaaaaaacaaaaggaaauuaaaaacaaaacaaa

SEQ ID NO: 280504 - RNA, 64 nt, Homo Sapiens
aaaacaaaaguaaauuaaaaacaaaacaaaaaaaaaaacaaaaacagaaaaauagaaauuaaaa

SEQ ID NO: 280505 - RNA, 64 nt, Homo Sapiens
aaaaaacaaaaaaaaacaaauagaaauuaaaaacaaaacaaaaauucugaguuaaccagaaaaa

SEQ ID NO: 280506 - RNA, 64 nt, Homo Sapiens
aaaaaaaaaaacaaaaaaaaaaaaauagaaauuaaaaacaaaacaagguuucugaguuaaccag

SEQ ID NO: 280507 - RNA, 64 nt, Homo Sapiens
aauuauccugucuuaucugagcuucaguuuucucaaaacaaaacaggucuuuuaagagauuuaa

SEQ ID NO: 280508 - RNA, 64 nt, Homo Sapiens
guaacacaguuaagagaaauggccgcagagggaaaaaacaaaacaguggagagggagcaaggga

SEQ ID NO: 280509 - RNA, 64 nt, Homo Sapiens
uaaggcacuucacuuagagaccacaaaaaacaaaaaaacaaaacccccccaaaaaauaaaaaaa

SEQ ID NO: 280510 - RNA, 64 nt, Homo Sapiens
aacaaaacuaaggcacuucauaaaaaaaccacaaaaaacaaaaaccucccacccccccaaaaaa

SEQ ID NO: 280511 - RNA, 64 nt, Homo Sapiens
ggaggcacaaaaccccaggcgucucaaaaaaaacaaaacaaaaaaggcaacagagcaagacucu

SEQ ID NO: 280512 - RNA, 64 nt, Homo Sapiens
aaaaaggaggcacaaaacccacucugucucaaaaaaaacaaaacagccuaggcaacagagcaag

SEQ ID NO: 280513 - RNA, 64 nt, Homo Sapiens
aaaaauuaucugaaugauccacuccaucucuuuaaaaacaaacaagccugagugacagagcgag

SEQ ID NO: 280514 - RNA, 64 nt, Homo Sapiens
uagccgggcaugauggugcaucuacuaaaauucaaaaacaaaaucaucauagcaagaccucauc

SEQ ID NO: 280515 - RNA, 64 nt, Homo Sapiens
aaaugugauuuguuucugucacauuuagaaaacaaaaacaaaaauugaaauuuucucuuguaaa

SEQ ID NO: 280516 - RNA, 64 nt, Homo Sapiens
caaaaaaaaugugauuuguuuguaaaacauuuagaaaacaaaaaaugcuuuugaaauuuucucu

SEQ ID NO: 280517 - RNA, 64 nt, Homo Sapiens
uuucuaauggauuuaucaaaggaaagcugauuaaaaaacaaaaaggcugccaaaaccauuaagu

SEQ ID NO: 280518 - RNA, 64 nt, Homo Sapiens
aacaaacaaaaaagauauuguccccgucuuuacaaaaacaaacagccugggcaacguggcgaaa

SEQ ID NO: 280519 - RNA, 64 nt, Homo Sapiens
guuaagaaaugaucuuuuuacaaccaauugcaacaaaacaaaaugauauuuaggugacuuacag

SEQ ID NO: 280520 - RNA, 64 nt, Homo Sapiens
cugguuuuuaauguaugcaugcuaaagcacauuaaaaacaaauccaguuuuagaaucuacugcu

SEQ ID NO: 280521 - RNA, 64 nt, Homo Sapiens
uugaaaaauaagacaaauccuuaugugcaaagugaaaacaaauuuuaucuacauuuugaagggu

SEQ ID NO: 280522 - RNA, 64 nt, Homo Sapiens
gacaagcuuucugugaaacacacguguacacagaaaaacaaaagcacgcacaagcgccagugcg

SEQ ID NO: 280523 - RNA, 64 nt, Homo Sapiens
ccagacugugucccacaaucuagaagacaggaagaaaacaaaaaucaggaaugucuuuuuuaau

SEQ ID NO: 280524 - RNA, 64 nt, Homo Sapiens
agcuuuuuucagagagugacgauucuacaugggaaaaacaaaccaagguucuuguacccagagu

SEQ ID NO: 280525 - RNA, 64 nt, Homo Sapiens
auaauuggaacaaauaaaggcagguucuaaauuuaaaacaaauauggguauuuuagacccaaca

SEQ ID NO: 280526 - RNA, 64 nt, Homo Sapiens
uuuucaggguauccuuaaaaaaaaacacacacgaaaaacaaaaguuugcuuguuuaaaaugaca

SEQ ID NO: 280527 - RNA, 64 nt, Homo Sapiens
uuuuuuaaagcugaguaguuaagaauucccuguaaaaacaaaacccuguaaauugagccucaug

SEQ ID NO: 280528 - RNA, 64 nt, Homo Sapiens
ugacgcuucuuccuauauccacucuuauuauguuaaaacaaauguauuugcgaguauuggcauu

SEQ ID NO: 280529 - RNA, 64 nt, Homo Sapiens
uuucccuaaguuugaguugauaguuauuaaaaagaaaacaaaacaaaaaaaaaaggcaaggcac

SEQ ID NO: 280530 - RNA, 64 nt, Homo Sapiens
cuaaguuugaguugauaguuauuaaaaagaaaacaaaacaaaaaaaaaaggcaaggcacaacaa

SEQ ID NO: 280531 - RNA, 64 nt, Homo Sapiens
caugugacuaguuacaaaagcaauaaauugaaacaaaacaaaacaaaacaaaacuuguuucuua

SEQ ID NO: 280532 - RNA, 64 nt, Homo Sapiens
gacuaguuacaaaagcaauaaauugaaacaaaacaaaacaaaacaaaacuuguuucuuaaaaau

SEQ ID NO: 280533 - RNA, 64 nt, Homo Sapiens
guuacaaaagcaauaaauugaaacaaaacaaaacaaaacaaaacuuguuucuuaaaaaugcggu

SEQ ID NO: 280534 - RNA, 64 nt, Homo Sapiens
uaaaagauucaccggauggauucugaugaaaacgaaaacaaaguaaaaugacuggcuuagcaga

SEQ ID NO: 280535 - RNA, 64 nt, Homo Sapiens
cucucugauaucacuuaaagcuggaguuuauuuuaaaacaaaugaagcaugggccaccucauga

SEQ ID NO: 280536 - RNA, 64 nt, Homo Sapiens
ugaacucccccaaacauggcuguggagagacaacaaaacaaaacaaagcacaaaagucucugcc

SEQ ID NO: 280537 - RNA, 64 nt, Homo Sapiens
ucccccaaacauggcuguggagagacaacaaaacaaaacaaagcacaaaagucucugccaacaa

SEQ ID NO: 280538 - RNA, 64 nt, Homo Sapiens
aaggauaugaugagauuuugcucacagucaugugaaaacaaaaucucagcucuuuauccauugc

SEQ ID NO: 280539 - RNA, 64 nt, Homo Sapiens
ucuuuauccauugcuuucacuuaguuuuaguaccaaaacaaagagaaugcaaaguuaagcagac

SEQ ID NO: 280540 - RNA, 64 nt, Homo Sapiens
ugaagaacaacuuuaucaaggaagcuaguauuuaaaaacaaauucaugagcaagcugcaaauga

SEQ ID NO: 280541 - RNA, 64 nt, Homo Sapiens
gaaagaucuauguuuauaaaccagcacuuggccaaaaacaaaauuguaaaggaaauuuaaauuc

SEQ ID NO: 280542 - RNA, 64 nt, Homo Sapiens
uguggaauucuuacuucauuaugaauguauuuaaaaaacaaacaccaaauaauuggaauauauu

SEQ ID NO: 280543 - RNA, 64 nt, Homo Sapiens
uaauuggaauauauugcaggcauuaagcucauuaaaaacaaacuggcuugcagaaggguccgau

SEQ ID NO: 280544 - RNA, 64 nt, Homo Sapiens
gccaccgcaauaauucgguaaagcaaaccagaacaaaacaaaaacacauucguuucccagugaa

SEQ ID NO: 280545 - RNA, 64 nt, Homo Sapiens
uaccaaaagcaaaagcauaauauuuguauugaagaaaacaaauuaauuauucuuccuaucugau

SEQ ID NO: 280546 - RNA, 64 nt, Homo Sapiens
caaacaaacaaaaaaccuucgaacaaaacaaaacaaaacaaacagggauuggugcugauugaaa

SEQ ID NO: 280547 - RNA, 64 nt, Homo Sapiens
aaacacaaacaaacaaaaaaugaaagaacaaaacaaaacaaaacuuuaugggauuggugcugau

SEQ ID NO: 280548 - RNA, 64 nt, Homo Sapiens
aaaacaaacacaaacaaacacugauugaaagaacaaaacaaaacgaucauuuaugggauuggug

SEQ ID NO: 280549 - RNA, 64 nt, Homo Sapiens
gaaaaccuuucuuuuguuuuauguuuuguaaguaaaaacaaaaauguauacaaagauauucucu

SEQ ID NO: 280550 - RNA, 64 nt, Homo Sapiens
aacuaacuaacuguguaaagaauuuuucuauaaaaaaacaaacuauguguaaauguagaacccu

SEQ ID NO: 280551 - RNA, 64 nt, Homo Sapiens
gugaaaaccaaaguggauuuaauugacgcaauauaaaacaaaaugcccccugagaaaacacuug

SEQ ID NO: 280552 - RNA, 64 nt, Homo Sapiens
uaucuugguuaacaugaaaauaacaaaguaaaguaaaacaaaccuaaguugaguuuguagaggg

SEQ ID NO: 280553 - RNA, 64 nt, Homo Sapiens
caacaguccuacuccgauguagaaucaaaagcagaaaacaaaaaauauguuuuucuuucccuua

SEQ ID NO: 280554 - RNA, 64 nt, Homo Sapiens
cuaaacacaaagcaucaguaaugagccuuuaaggaaaacaaaccaaauauuugccaucuuuauu

SEQ ID NO: 280555 - RNA, 64 nt, Homo Sapiens
uaaauaaaagaaaacacaucuaccaaauacaguaaaaacaaauguagagaguguugaaauucaa

SEQ ID NO: 280556 - RNA, 64 nt, Homo Sapiens
ggcuuugucucauugaucaggugauuuuaauuuaaaaacaaauuaaaauaaaaaguauucccaa

SEQ ID NO: 280557 - RNA, 64 nt, Homo Sapiens
ggaagaaauugaaauuucuuuguugauaugaguaaaaacaaauauaaauccagauacauauuaa

SEQ ID NO: 280558 - RNA, 64 nt, Homo Sapiens
ucaaaugccuauaauaccauaaacugaaaauaagaaaacaaaaaaugguaguaaagaaacugac

SEQ ID NO: 280559 - RNA, 64 nt, Homo Sapiens
aauucauuagccucagauucaaaagcaaaaacaaaaaacaaaacaaggcuuucagguaugaauu

SEQ ID NO: 280560 - RNA, 60 nt, Homo Sapiens
acaaaacaauucauuagccuauuaaaagcaaaaacaaaaauucaaggcuuucagguauga

SEQ ID NO: 280561 - RNA, 64 nt, Homo Sapiens
aacguguaauaaaguuaguggacaaaaaaaacaaaaaacaaaaaaccaacaauaagcuagaaaa

SEQ ID NO: 280562 - RNA, 64 nt, Homo Sapiens
acaaaaaaacguguaauaaauagaaaagacaaaaaaaacaaaaauuuuucuaccaacaauaagc

SEQ ID NO: 280563 - RNA, 64 nt, Homo Sapiens
aauguuuuauagacccugggaauaguaaaauauaaaaacaaauuaaaacaaaaaaacacaaaaa

SEQ ID NO: 280564 - RNA, 64 nt, Homo Sapiens
aacacaaaaaaauaguaaaauacuuauugauuuaaaaacaaaaaacauaaugcuaguccuagau

SEQ ID NO: 280565 - RNA, 64 nt, Homo Sapiens
uuuuaauuaaaaaaaauccuacuuggacccuuggaaaacaaaaguguagauuucugacaucaaa

SEQ ID NO: 280566 - RNA, 64 nt, Homo Sapiens
uacauugcuuaaaauauauaauauacacaguggcaaaacaaaagauucuguuauauaguggaug

SEQ ID NO: 280567 - RNA, 64 nt, Homo Sapiens
aaaaacacaaaagcugcaugaaaaaaaaaaaacaaaaacaaaaauaaacugguuuuuuucaaaa

SEQ ID NO: 280568 - RNA, 64 nt, Homo Sapiens
caaaaaaaaaacacaaaagcucaaaaaaaaaaaaaaaacaaaaaucaaaauaaacugguuuuuu

SEQ ID NO: 280569 - RNA, 64 nt, Homo Sapiens
acuggguagcaaaagaaaauggaaaaaaacccacaaaacaaacuuuaaaaaaaaaaaaaaacaa

SEQ ID NO: 280570 - RNA, 64 nt, Homo Sapiens
aaaaaacccacaaaacaaacuuuaaaaaaaaaaaaaaacaaauuugccaagguuuagcugcuca

SEQ ID NO: 280571 - RNA, 64 nt, Homo Sapiens
cuggaaaggaacucuccaccccucccauccugauaaaacaaacaagguuuacauuuacaacuaa

SEQ ID NO: 280572 - RNA, 64 nt, Homo Sapiens
aaugauuucaaguacccuguauucuggaugcuaaaaaacaaaaacaaacaaaaaaacaaaaaca

SEQ ID NO: 280573 - RNA, 64 nt, Homo Sapiens
uucaaguacccuguauucuggaugcuaaaaaacaaaaacaaacaaaaaaacaaaaacaaaaaaa

SEQ ID NO: 280574 - RNA, 64 nt, Homo Sapiens
guauucuggaugcuaaaaaacaaaaacaaacaaaaaaacaaaaacaaaaaaacaaaaccagaau

SEQ ID NO: 280575 - RNA, 64 nt, Homo Sapiens
uggaugcuaaaaaacaaaaacaaacaaaaaaacaaaaacaaaaaaacaaaaccagaaucaggua

SEQ ID NO: 280576 - RNA, 64 nt, Homo Sapiens
aaaaaacaaaaacaaacaaaaaaacaaaaacaaaaaaacaaaaccagaaucagguaaaacagcu

SEQ ID NO: 280577 - RNA, 64 nt, Homo Sapiens
auguuaaggauugucuuaaaguuccuuagccagcaaaacaaaacaaaacaaaacaaacaaauga

SEQ ID NO: 280578 - RNA, 64 nt, Homo Sapiens
aaggauugucuuaaaguuccuuagccagcaaaacaaaacaaaacaaaacaaacaaaugaaaaac

SEQ ID NO: 280579 - RNA, 64 nt, Homo Sapiens
uugucuuaaaguuccuuagccagcaaaacaaaacaaaacaaaacaaacaaaugaaaaacguuua

SEQ ID NO: 280580 - RNA, 64 nt, Homo Sapiens
uuaaaguuccuuagccagcaaaacaaaacaaaacaaaacaaacaaaugaaaaacguuuaaaaag

SEQ ID NO: 280581 - RNA, 64 nt, Homo Sapiens
ucugaggcuaagaaagguucaucucacaacaggaaaaacaaaucucaacacacauuagagauaa

SEQ ID NO: 280582 - RNA, 64 nt, Homo Sapiens
uaguuuuaaccaguuguagucaaaaugcuacaauaaaacaaaaaagagaaagaaaaugaagagc

SEQ ID NO: 280583 - RNA, 64 nt, Homo Sapiens
aaaagccuuuaguuguguuucuugaacuauaaagaaaacaaauuuuggcagucuuuaaguauau

SEQ ID NO: 280584 - RNA, 64 nt, Homo Sapiens
uuucuuccauucuuaacaguaugugcccauuugcaaaacaaaaaugcuaauaaucaguaauagu

SEQ ID NO: 280585 - RNA, 64 nt, Homo Sapiens
uuucaagaccuaacugcagccgcuuugggaaaaaaaaacaaaaaacaaaaaacagaaaacaaaa

SEQ ID NO: 280586 - RNA, 64 nt, Homo Sapiens
accuaacugcagccgcuuugggaaaaaaaaacaaaaaacaaaaaacagaaaacaaaaaaaaaaa

SEQ ID NO: 280587 - RNA, 64 nt, Homo Sapiens
agggaccacauuuuucaaguauuucuaaguauaaaaaacaaaacaaaaaucucuuaggaaaugu

SEQ ID NO: 280588 - RNA, 64 nt, Homo Sapiens
ccacauuuuucaaguauuucuaaguauaaaaaacaaaacaaaaaucucuuaggaaaugucuaga

SEQ ID NO: 280589 - RNA, 64 nt, Homo Sapiens
uccuugacaaaauuuaagcugagcuuaaaagcaaaaaacaaaaaguacacagaaauauuuauua

SEQ ID NO: 280590 - RNA, 64 nt, Homo Sapiens
auuccagguggaccaagaaucacaaaacaaauuaaaaacaaauuuacuuagugggacuauuaca

SEQ ID NO: 280591 - RNA, 64 nt, Homo Sapiens
aaaaacaaauuauuccagguggacuauuacacacaaaacaaauuuagcuaacaacuacuuagug

SEQ ID NO: 280592 - RNA, 64 nt, Homo Sapiens
uaggaaaugugaaaauauuuaugaaguaaaguuaaaaacaaacaccucaauuaucaguggcuuu

SEQ ID NO: 280593 - RNA, 64 nt, Homo Sapiens
aacagacuucauccuuagguuuccuuuuuuaggaaaaacaaaaccauuuuucuuugguucuuuu

SEQ ID NO: 280594 - RNA, 64 nt, Homo Sapiens
ucauugaugucgaaggauauuacuggaguaaaagaaaacaaagucagaucugugccuacuuuau

SEQ ID NO: 280595 - RNA, 64 nt, Homo Sapiens
ggccaaaagggggcugaccuauuagguuuuugacaaaacaaacaccaagaaaagcaagaagcag

SEQ ID NO: 280596 - RNA, 64 nt, Homo Sapiens
aaaguauuggacugucggaguccagcauagcaggaaaacaaacaaauaccuguagaaauauuau

SEQ ID NO: 280597 - RNA, 64 nt, Homo Sapiens
aacuagacaaggagagaggcaaaaaaaaaaaaaaaaaacaaaaaauaucaaacuugcaaaaaaa

SEQ ID NO: 280598 - RNA, 64 nt, Homo Sapiens
aacccacaaaaauuuguaaaaaaugaagcaaaacaaaacaaaaauguacacacacaacagaaca

SEQ ID NO: 280599 - RNA, 64 nt, Homo Sapiens
aaaaaaacccacaaaaauuugaacaaaaugaagcaaaacaaaacguuguuguacacacacaaca

SEQ ID NO: 280600 - RNA, 64 nt, Homo Sapiens
aaccacccauugggauauaaauauuuacaaaaacaaaacaaacaugaccugcuggugugugugu

SEQ ID NO: 280601 - RNA, 64 nt, Homo Sapiens
aaacaaaccacccauugggauguguauauuuacaaaaacaaaacgaccaugaccugcuggugug

SEQ ID NO: 280602 - RNA, 64 nt, Homo Sapiens
uguguuuuguauaaaucccuaauauuuaaaaaaaaaaacaaaacaaaaaaagguuacaaaguuu

SEQ ID NO: 280603 - RNA, 64 nt, Homo Sapiens
uuuguauaaaucccuaauauuuaaaaaaaaaaacaaaacaaaaaaagguuacaaaguuuguuaa

SEQ ID NO: 280604 - RNA, 64 nt, Homo Sapiens
ugggauggaaaggacuagccucuacugaugcaaaaaaacaaaaagcaacacaaacguuuccuuc

SEQ ID NO: 280605 - RNA, 64 nt, Homo Sapiens
caaaaugaggaagauguguucauuguggacucuaaaaacaaaacaaaacacaaaauccccuguu

SEQ ID NO: 280606 - RNA, 64 nt, Homo Sapiens
ugaggaagauguguucauuguggacucuaaaaacaaaacaaaacacaaaauccccuguucaaau

SEQ ID NO: 280607 - RNA, 64 nt, Homo Sapiens
auuagaaaaaaaaaauucuuguugaaauauuuugaaaacaaauucccuacuaucaucacaugcc

SEQ ID NO: 280608 - RNA, 64 nt, Homo Sapiens
uucuuccuauuacuuuauugacucauuuuauugcaaaacaaaaaggauuacccaaacaacaugu

SEQ ID NO: 280609 - RNA, 64 nt, Homo Sapiens
cuaauccaaguaaaggaauaugaagggauuguaaaaaacaaaauguccauugauagaccaucgu

SEQ ID NO: 280610 - RNA, 64 nt, Homo Sapiens
augacaaagaccgagucuucuuuuuuuuuaaacaaaaacaaaaaaagcaaccagggcuauuugu

SEQ ID NO: 280611 - RNA, 64 nt, Homo Sapiens
ucuuggaauguguauuguuuuuauuuugcgaaacaaaacaaaacaaaaaaaaaagcuuggaacu

SEQ ID NO: 280612 - RNA, 64 nt, Homo Sapiens
gaauguguauuguuuuuauuuugcgaaacaaaacaaaacaaaaaaaaaagcuuggaacuccauc

SEQ ID NO: 280613 - RNA, 64 nt, Homo Sapiens
aaaauagugagucucaaauuguucucuuuuaacuaaaacaaaucugcaaugaaucuagaugcaa

SEQ ID NO: 280614 - RNA, 64 nt, Homo Sapiens
aacuuggcuacguauuggaaucaccuaaaaaguuaaaacaaaacauggaugucugggucccgcc

SEQ ID NO: 280615 - RNA, 64 nt, Homo Sapiens
uucauugugaucagauuaaaauuacuauuugugcaaaacaaauuccacaccacauguacuguau

SEQ ID NO: 280616 - RNA, 64 nt, Homo Sapiens
gaaagguggucaggcccuucuaaaugcuuaaccaaaaacaaacauuauuggaguuucaguguaa

SEQ ID NO: 280617 - RNA, 64 nt, Homo Sapiens
ucuauuauuuguuuugguuagaaagugaauuuaaaaaacaaaccaaacucuaaacuuucucaga

SEQ ID NO: 280618 - RNA, 64 nt, Homo Sapiens
ucuauugcaauucccuauuauauucugcaucagaaaaacaaacaaaacaaaaacaacuuuaaau

SEQ ID NO: 280619 - RNA, 64 nt, Homo Sapiens
auucccuauuauauucugcaucagaaaaacaaacaaaacaaaaacaacuuuaaaugcuuguagc

SEQ ID NO: 280620 - RNA, 64 nt, Homo Sapiens
uggaacuucaggucuuaagugcaaaucaaagcaaaaaacaaacaaaacuuacauggaaaaacug

SEQ ID NO: 280621 - RNA, 64 nt, Homo Sapiens
aagguucucaaaggucucagaccuacaaagaguuaaaacaaacagacaaacaaaaaaaaacacu

SEQ ID NO: 280622 - RNA, 64 nt, Homo Sapiens
cugccuuuucuuuguuuguuuguuuuuuucucuaaaaacaaacagcaaaagacagcugaaaaca

SEQ ID NO: 280623 - RNA, 64 nt, Homo Sapiens
gauaggaaaaucugaauggaggcagcaaacagccaaaacaaacauuccccacccggcccugugc

SEQ ID NO: 280624 - RNA, 64 nt, Homo Sapiens
ucuuaaauuggguucaugaugcagucuccucuuuaaaacaaaacaaaacaaaacaaaacuauac

SEQ ID NO: 280625 - RNA, 64 nt, Homo Sapiens
aauuggguucaugaugcagucuccucuuuaaaacaaaacaaaacaaaacaaaacuauacuugaa

SEQ ID NO: 280626 - RNA, 64 nt, Homo Sapiens
gguucaugaugcagucuccucuuuaaaacaaaacaaaacaaaacaaaacuauacuugaacaaaa

SEQ ID NO: 280627 - RNA, 64 nt, Homo Sapiens
augaugcagucuccucuuuaaaacaaaacaaaacaaaacaaaacuauacuugaacaaaaggguc

SEQ ID NO: 280628 - RNA, 64 nt, Homo Sapiens
agacagggagagguggagaaggaaaaaacccuacaaaacaaaaacaaaccgcauacacguucac

SEQ ID NO: 280629 - RNA, 64 nt, Homo Sapiens
ggagagguggagaaggaaaaaacccuacaaaacaaaaacaaaccgcauacacguucaccgagaa

SEQ ID NO: 280630 - RNA, 64 nt, Homo Sapiens
uuucccccccaucuuuaaaaauaauuaguaauaaaaaacaaaaauuccauaucuagccccaucc

SEQ ID NO: 280631 - RNA, 64 nt, Homo Sapiens
aaagacaugggagagaugguaaaaaaaacaaaacaaaacaaaaagacagagccaaacuccguca

SEQ ID NO: 280632 - RNA, 64 nt, Homo Sapiens
aaaaaaaagacaugggagagcgucaaaaaaaaacaaaacaaaacggagugacagagccaaacuc

SEQ ID NO: 280633 - RNA, 64 nt, Homo Sapiens
aaaacaaaaaaaagacauggaacuccgucaaaaaaaaacaaaaccagcuggagugacagagcca

SEQ ID NO: 280634 - RNA, 64 nt, Homo Sapiens
uuguaaaguuguaacauuucguagauuuaaauaaaaaacaaaacccauguuucaguuucugcau

SEQ ID NO: 280635 - RNA, 64 nt, Homo Sapiens
augcccgucaacaugucacauguaaguaucauugaaaacaaaacagggaucuaggugagcccau

SEQ ID NO: 280636 - RNA, 64 nt, Homo Sapiens
aaggugaaauacgaaguccuaucccuauuucuuuaaaacaaaaucaagcacuugcaaacucuuu

SEQ ID NO: 280637 - RNA, 64 nt, Homo Sapiens
aaaaucuucgcuuuucauguuuagcuuaagcauaaaaacaaagagugggaaagcagaacugaag

SEQ ID NO: 280638 - RNA, 64 nt, Homo Sapiens
uauguuuuaaaugcuuugaagcacugauaaaacaaaaacaaaagggcgucuucaaaaacaaauu

SEQ ID NO: 280639 - RNA, 64 nt, Homo Sapiens
caaaaguauguuuuaaaugccaaauugcacugauaaaacaaaaauuuuccggcgucuucaaaaa

SEQ ID NO: 280640 - RNA, 64 nt, Homo Sapiens
gcacugauaaaacaaaaacauuccggcgucuucaaaaacaaauuucagguuaaaugaaauaguu

SEQ ID NO: 280641 - RNA, 64 nt, Homo Sapiens
cuagauggguauguguguuuugggaaaugugaugaaaacaaagaacauugacaugcgaucaguu

SEQ ID NO: 280642 - RNA, 64 nt, Homo Sapiens
uguucuuugcagcuuaucacuuaaaaaggaaaacaaaacaaacuuuguaaacaagauucuaaau

SEQ ID NO: 280643 - RNA, 64 nt, Homo Sapiens
aaacuuguucuuugcagcuuuaaauuuaaaaaggaaaacaaaacauguguuguaaacaagauuc

SEQ ID NO: 280644 - RNA, 64 nt, Homo Sapiens
acuuuuuaaagcccucuugcaaagcucccauuuaaaaacaaaauccugaaaaaggcagaguuug

SEQ ID NO: 280645 - RNA, 64 nt, Homo Sapiens
aaagugagggguuuuuuuaacuguaaggacuugcaaaacaaaagcagaguugcuguggacagac

SEQ ID NO: 280646 - RNA, 64 nt, Homo Sapiens
auaaaauauaaacaaucaaaacaaaaacaaaaacaaaacaaaacuggaggacgccaguaaaaaa

SEQ ID NO: 280647 - RNA, 64 nt, Homo Sapiens
aaaacauaaaauauaaacaaaaaaaacaaaaacaaaaacaaaacuugaauggaggacgccagua

SEQ ID NO: 280648 - RNA, 64 nt, Homo Sapiens
caaaacaaaacauaaaauauccaguaaaaaaacaaaaacaaaaaaaauguuugaauggaggacg

SEQ ID NO: 280649 - RNA, 64 nt, Homo Sapiens
caaaaacaaaacaaaacauaaggacgccaguaaaaaaacaaaaacuauguaaauguuugaaugg

SEQ ID NO: 280650 - RNA, 64 nt, Homo Sapiens
caaaaacuagugggaaaugucugaaaaugcaugaaaaacaaagggaggagggaaguugugcacu

SEQ ID NO: 280651 - RNA, 64 nt, Homo Sapiens
aacgaaagcaucuucacaauaugacugaaaacaaaaaacaaaaaaacucauucuucagugccuc

SEQ ID NO: 280652 - RNA, 64 nt, Homo Sapiens
acaaaaaaacgaaagcaucugugccucaugacugaaaacaaaaaucagcacaacucauucuuca

SEQ ID NO: 280653 - RNA, 64 nt, Homo Sapiens
accucacacauaccuaaaauagacccugucucuuaaaacaaaaaccagccuaggcaacagagca

SEQ ID NO: 280654 - RNA, 64 nt, Homo Sapiens
auaaaaauguuuauuuuuacacaucaagacaacuaaaacaaaugaguaauacgcuauuucucca

SEQ ID NO: 280655 - RNA, 64 nt, Homo Sapiens
acuguugucuaauauaucuaagaaucuaaaaaaaaaaacaaaaagugcuuauucuuuaacaaag

SEQ ID NO: 280656 - RNA, 64 nt, Homo Sapiens
guaaaaauuaguucccaaguaaauaauaaaacuaaaaacaaaaacauauuuucauaaucaguca

SEQ ID NO: 280657 - RNA, 64 nt, Homo Sapiens
cuaacuaacuuccaaaugggauuaaaaagaaaacaaaacaaaccuaaauaaaggggaaguccac

SEQ ID NO: 280658 - RNA, 64 nt, Homo Sapiens
aaacccuaacuaacuuccaauccacauuaaaaagaaaacaaaacaaauuuaaauaaaggggaag

SEQ ID NO: 280659 - RNA, 64 nt, Homo Sapiens
ggagggacuuuaaaauaccucagaaaucgaauuuaaaacaaaaaaaacauuuugcaaacugcag

SEQ ID NO: 280660 - RNA, 64 nt, Homo Sapiens
ggugccacccggccgugacauuuguuguauagucaaaacaaaucaaauacuuuugaaaaaaaag

SEQ ID NO: 280661 - RNA, 64 nt, Homo Sapiens
gacgccuauuuuguauaaagccugaagaauaaggaaaacaaagcauauuuucacauuucucagu

SEQ ID NO: 280662 - RNA, 64 nt, Homo Sapiens
cuccagcuugggcaacagagugagacuccaucucaaaacaaaacaaaacaaaacaaaacaaaaa

SEQ ID NO: 280663 - RNA, 64 nt, Homo Sapiens
gcuugggcaacagagugagacuccaucucaaaacaaaacaaaacaaaacaaaacaaaaaaaccc

SEQ ID NO: 280664 - RNA, 64 nt, Homo Sapiens
ggcaacagagugagacuccaucucaaaacaaaacaaaacaaaacaaaacaaaaaaacccggcuu

SEQ ID NO: 280665 - RNA, 64 nt, Homo Sapiens
cagagugagacuccaucucaaaacaaaacaaaacaaaacaaaacaaaaaaacccggcuuugcug

SEQ ID NO: 280666 - RNA, 64 nt, Homo Sapiens
ugagacuccaucucaaaacaaaacaaaacaaaacaaaacaaaaaaacccggcuuugcugcuuuu

SEQ ID NO: 280667 - RNA, 64 nt, Homo Sapiens
gcauaucaaccaggcaagucuugcuguaaaaaugaaaacaaaacaaacccaugagguuaccauc

SEQ ID NO: 280668 - RNA, 64 nt, Homo Sapiens
ucaaccaggcaagucuugcuguaaaaaugaaaacaaaacaaacccaugagguuaccaucaagug

SEQ ID NO: 280669 - RNA, 64 nt, Homo Sapiens
cacggacaguaguuucaguucugaugguauaagcaaaacaaauaaaacguuuauaaaaguugua

SEQ ID NO: 280670 - RNA, 64 nt, Homo Sapiens
ccaggaauucuuccaguaggugcucagcuauuuaaaaacaaaacuauucucaaacauucaucau

SEQ ID NO: 280671 - RNA, 64 nt, Homo Sapiens
aaaaguuuuuuuucaaucauuguaccuugauauuaaaacaaauauccuuuaaguauuucuaauc

SEQ ID NO: 280672 - RNA, 64 nt, Homo Sapiens
gcuucuggcuuuuaauuuugccagcuaaggacauaaaacaaaaauaaacaaacaaaaacaaaua

SEQ ID NO: 280673 - RNA, 64 nt, Homo Sapiens
ccagcuaaggacauaaaacaaaaauaaacaaacaaaaacaaauagccaucugcuaucagcauca

SEQ ID NO: 280674 - RNA, 64 nt, Homo Sapiens
aggcccccaucagggaccagacuguuccaaaaaaaaaacaaaaaacaaaaacaaacaaaaaaac

SEQ ID NO: 280675 - RNA, 64 nt, Homo Sapiens
caucagggaccagacuguuccaaaaaaaaaacaaaaaacaaaaacaaacaaaaaaacacuuaaa

SEQ ID NO: 280676 - RNA, 64 nt, Homo Sapiens
ggaccagacuguuccaaaaaaaaaacaaaaaacaaaaacaaacaaaaaaacacuuaaaagccca

SEQ ID NO: 280677 - RNA, 64 nt, Homo Sapiens
ccauccugggcagcauacugagacccugccuuuaaaaacaaacagaacaaaaacaaaacaccag

SEQ ID NO: 280678 - RNA, 64 nt, Homo Sapiens
uacugagacccugccuuuaaaaacaaacagaacaaaaacaaaacaccagggacacauuucucug

SEQ ID NO: 280679 - RNA, 64 nt, Homo Sapiens
augacccacuuuguuccuucaaagguucaagaauaaaacaaagccaggauucauacaugggacu

SEQ ID NO: 280680 - RNA, 64 nt, Homo Sapiens
cuugcacugaauucccaaugaugcacuaacucacaaaacaaacauaacaugcaaaaaaagcuga

SEQ ID NO: 280681 - RNA, 64 nt, Homo Sapiens
acaauauuuauuguauuuuaauuauucaccauguaaaacaaaaaguucucucuaugguaaagau

SEQ ID NO: 280682 - RNA, 64 nt, Homo Sapiens
accccccaucacaaacuuaaugagggacaaauuuaaaacaaacaaacuuuaugcagcuuccuuu

SEQ ID NO: 280683 - RNA, 64 nt, Homo Sapiens
agaaaagaaauuuauuuauuagugucuuuacaaaaaaacaaaaauaaaucuacuguuucaaaaa

SEQ ID NO: 280684 - RNA, 64 nt, Homo Sapiens
aucaaaaaaaaagacaguuuuuacagaguuacaaaaaacaaacagagacucaaaucuaaaacau

SEQ ID NO: 280685 - RNA, 64 nt, Homo Sapiens
auuuccuauaagcugaaagcgguguggguaaaagaaaacaaaaccugguuucuucucuuugguu

SEQ ID NO: 280686 - RNA, 64 nt, Homo Sapiens
cugaggccaccagcagaucagcacucucuggcuaaaaacaaacuauaguguucaaaaccuguag

SEQ ID NO: 280687 - RNA, 64 nt, Homo Sapiens
cgacaguaauaccaaggaauuugcuagguaaaacaaaacaaaaauugagaauaaguuuauauuc

SEQ ID NO: 280688 - RNA, 64 nt, Homo Sapiens
aaaaacgacaguaauaccaauauucuugcuagguaaaacaaaacggauuuugagaauaaguuua

SEQ ID NO: 280689 - RNA, 64 nt, Homo Sapiens
acacaccacacacacgcgcuuuucuccaaaaacaaaaacaaaacuacaauucauaaugcagcag

SEQ ID NO: 280690 - RNA, 64 nt, Homo Sapiens
caaaacacacaccacacacacagcaguuucuccaaaaacaaaaaagugguuacaauucauaaug

SEQ ID NO: 280691 - RNA, 64 nt, Homo Sapiens
gcucuuucacaugugcuuuaauguauuucugacuaaaacaaauguagaaguagaagaacauaag

SEQ ID NO: 280692 - RNA, 64 nt, Homo Sapiens
agagauggcaaagcagcagucccccgacuuccucaaaacaaacaacccuauucuuaccuagccu

SEQ ID NO: 280693 - RNA, 64 nt, Homo Sapiens
agacugauaucgcaccuaaaaaaaaacaaaaacaaaaacaaaaagagcaaggcucugucucaaa

SEQ ID NO: 280694 - RNA, 64 nt, Homo Sapiens
caaaaaagacugauaucgcacucaaaaaaaaacaaaaacaaaaagugacagagcaaggcucugu

SEQ ID NO: 280695 - RNA, 64 nt, Homo Sapiens
caaaaacaaaaaagacugaucucugucucaaaaaaaaacaaaaagccugggugacagagcaagg

SEQ ID NO: 280696 - RNA, 64 nt, Homo Sapiens
aacacguuuguagguucuuacaaguguuaaaacaaaaacaaacaggauuguuuaaucacaaccu

SEQ ID NO: 280697 - RNA, 64 nt, Homo Sapiens
caaacaaacacguuuguaggcaaccucaaguguuaaaacaaaaaaguuggggauuguuuaauca

SEQ ID NO: 280698 - RNA, 64 nt, Homo Sapiens
auccagauguauaaguacuauuuaucugaagaucaaaacaaacauugcauuccuugagaaugua

SEQ ID NO: 280699 - RNA, 64 nt, Homo Sapiens
ccaaaauauuuuagaauaaagacauuuuuauacuaaaacaaacauuacucagauuuggggaaau

SEQ ID NO: 280700 - RNA, 64 nt, Homo Sapiens
aacagugcuuuuuucaaaccugaaagaaaaaaacaaaacaaaaccaagggagaagauauucucg

SEQ ID NO: 280701 - RNA, 64 nt, Homo Sapiens
aaaacaacagugcuuuuuucucucgugaaagaaaaaaacaaaacucuuccaagggagaagauau

SEQ ID NO: 280702 - RNA, 64 nt, Homo Sapiens
ugaagcugccgagcaggaguaaccugacaagagaaaaacaaaccaacaacaacaacaacacaca

SEQ ID NO: 280703 - RNA, 64 nt, Homo Sapiens
aacaacaacaacacacaaacuuuuuaaaaagacaaaaacaaaacgguggccccgcucccuaaau

SEQ ID NO: 280704 - RNA, 64 nt, Homo Sapiens
uagagcaaagcugaccuggaugugaaaacaaaugaaaacaaaaugagaguucucccuccacgau

SEQ ID NO: 280705 - RNA, 64 nt, Homo Sapiens
aaaacaaaauuagagcaaagccuccacgauugugaaaacaaaugcaagccuccagagaguucuc

SEQ ID NO: 280706 - RNA, 64 nt, Homo Sapiens
aacaaacagaaagcaccgucuccaucucaaaacaaaaacaaacaccugggcgacagagagagac

SEQ ID NO: 280707 - RNA, 64 nt, Homo Sapiens
caaacaaacaaacagaaagcagagacuccaucucaaaacaaaaacuccagccugggcgacagag

SEQ ID NO: 280708 - RNA, 64 nt, Homo Sapiens
aguaucauuuuaguuaagugggucaaacagaaucaaaacaaaacccaaagaaauaaauaaaaaa

SEQ ID NO: 280709 - RNA, 64 nt, Homo Sapiens
acagaaucaaaacaaaacccaaagaaauaaauaaaaaacaaaauggcuaaauaguuuaaaauag

SEQ ID NO: 280710 - RNA, 64 nt, Homo Sapiens
gguggaaguauaaauaagccuaugaacuuauaauaaaacaaacuguagguagaaaaaaugagag

SEQ ID NO: 280711 - RNA, 64 nt, Homo Sapiens
aaaaauacuuguucagguaauucuaauucuuaauaaaacaaaugaguaucauacagguagaggu

SEQ ID NO: 280712 - RNA, 64 nt, Homo Sapiens
ugauauauucauauuacucguuuauaaaaaaucaaaaacaaaaggaaagaaaacaaaaaaaacu

SEQ ID NO: 280713 - RNA, 64 nt, Homo Sapiens
acucguuuauaaaaaaucaaaaacaaaaggaaagaaaacaaaaaaaacuugcacaaaaauacug

SEQ ID NO: 280714 - RNA, 64 nt, Homo Sapiens
accaucuccugaagaccuuucuuaccuuuuuuuaaaaacaaaaaaugaaauuauuuugcaugcu

SEQ ID NO: 280715 - RNA, 64 nt, Homo Sapiens
auugaaaggguuuuucuuucuuuuuuaaaaaagaaaaacaaacuauugauuguagauaaugaaa

SEQ ID NO: 280716 - RNA, 64 nt, Homo Sapiens
agacaguauuguaaucccaucaaaagaugaaagaaaaacaaaaacaaaaaccaacaacaauuag

SEQ ID NO: 280717 - RNA, 64 nt, Homo Sapiens
uauuguaaucccaucaaaagaugaaagaaaaacaaaaacaaaaaccaacaacaauuagccauag

SEQ ID NO: 280718 - RNA, 64 nt, Homo Sapiens
ugcucugaaaugaaaguuugucuucacaaauaucaaaacaaaauggaggaaaacuaagcauugg

SEQ ID NO: 280719 - RNA, 64 nt, Homo Sapiens
agcugccucuacugcucccacguguuccuguugaaaaacaaaggacuuuccacuggucugcaga

SEQ ID NO: 280720 - RNA, 64 nt, Homo Sapiens
ggggugggaacuuuuuuaaauguucauuuaaaaaaaaacaaaaacagggcagucuuguaguuua

SEQ ID NO: 280721 - RNA, 64 nt, Homo Sapiens
cuggguggcaaagugagacucuggcucaaaaaaaaaaacaaaaaacaaaaccaucugcccuccu

SEQ ID NO: 280722 - RNA, 64 nt, Homo Sapiens
gcaaagugagacucuggcucaaaaaaaaaaacaaaaaacaaaaccaucugcccuccuccccuag

SEQ ID NO: 280723 - RNA, 64 nt, Homo Sapiens
gaggcagaggcaggcaguagaaaaaaaaaaaaaaaaaacaaacauguaagaaaaaauguaagac

SEQ ID NO: 280724 - RNA, 64 nt, Homo Sapiens
ggcauacucugauuuuuauauuuuuuuuugguagaaaacaaagagcagaaauaaaucuuuuuuu

SEQ ID NO: 280725 - RNA, 64 nt, Homo Sapiens
acaacaacaacaaaaaacaacugaacuucaaaacaaaacaaaaauuacuguaaaaaaaagugca

SEQ ID NO: 280726 - RNA, 64 nt, Homo Sapiens
aaaaaacaacaacaacaaaagugcacugaacuucaaaacaaaacuaaucuuacuguaaaaaaaa

SEQ ID NO: 280727 - RNA, 64 nt, Homo Sapiens
guuuauuuccccaaaacaacgauauuguaaggggaaaacaaaguucaaacuucccuccaaggga

SEQ ID NO: 280728 - RNA, 64 nt, Homo Sapiens
acacguacauuagguccugguauuuaaaaaacaaaaaacaaaacggccauguuauaaauauugu

SEQ ID NO: 280729 - RNA, 64 nt, Homo Sapiens
acaaaacacacguacauuagauauuguuauuuaaaaaacaaaaaagucacuggccauguuauaa

SEQ ID NO: 280730 - RNA, 64 nt, Homo Sapiens
aacacaaaaaacacauucuauuaaaaucaaaaacaaaacaaaaacuuuggaaaagaauuccuuc

SEQ ID NO: 280731 - RNA, 64 nt, Homo Sapiens
aaaaaaacacaaaaaacacaccuucuuaaaaucaaaaacaaaacaguaacuuuggaaaagaauu

SEQ ID NO: 280732 - RNA, 64 nt, Homo Sapiens
aauaauggucuuuuuuuuuuuauacaggaaaaacaaaacaaagauuauauuugggguccuuuuu

SEQ ID NO: 280733 - RNA, 64 nt, Homo Sapiens
aaagaaauaauggucuuuuuuuuuuuauacaggaaaaacaaaacuaccuuuauauuuggggucc

SEQ ID NO: 280734 - RNA, 64 nt, Homo Sapiens
aacaaaaaaaacaccucaccaaaaaaaaaaaacaaaaacaaacacagaguaagacucugucuca

SEQ ID NO: 280735 - RNA, 64 nt, Homo Sapiens
caaacaaacaaaaaaaacacgucucaaaaaaaaaaaaacaaaaagggcaacagaguaagacucu

SEQ ID NO: 280736 - RNA, 64 nt, Homo Sapiens
uguagcaacucugaaguaucuacuuuaaaagggaaaaacaaauuuuccacaucgugagucauuu

SEQ ID NO: 280737 - RNA, 64 nt, Homo Sapiens
ucaaaaacaguaacuauuuugucuuuguuuuugaaaaacaaaaaaauggauuuuuaacagagaa

SEQ ID NO: 280738 - RNA, 64 nt, Homo Sapiens
uauaaaauuccauuuuuuccugucaaaauuuaagaaaacaaauguuaacuuucugaagaauauc

SEQ ID NO: 280739 - RNA, 64 nt, Homo Sapiens
aaccuaggagauaaauguagaucacaauauuccgaaaacaaaaaugguuuggucuuuauuaaaa

SEQ ID NO: 280740 - RNA, 64 nt, Homo Sapiens
aacaugagcagugguguucugaaaaaaacaaaacaaaacaaaaaaaugcuuuguuuaaaaaaac

SEQ ID NO: 280741 - RNA, 64 nt, Homo Sapiens
aaaaaaacaugagcagugguaaaacgaaaaaaacaaaacaaaacacacuaaugcuuuguuuaaa

SEQ ID NO: 280742 - RNA, 64 nt, Homo Sapiens
aaaacaaaaaaacaugagcauuaaaaaaacgaaaaaaacaaaacagauaacacuaaugcuuugu

SEQ ID NO: 280743 - RNA, 64 nt, Homo Sapiens
aacaaacaaaaagccuguccgaaaauuuuauuaaaaaacaaacaugaaaagaaaucacuuccuu

SEQ ID NO: 280744 - RNA, 64 nt, Homo Sapiens
gaugcaaacccuggaagucaugaauuaaaacuagaaaacaaauuuucacuauuuuauuuuuuaa

SEQ ID NO: 280745 - RNA, 64 nt, Homo Sapiens
uaacaucuucaguuuuucucgaaagucuauaugaaaaacaaaaauucuauauuuuacauucuug

SEQ ID NO: 280746 - RNA, 64 nt, Homo Sapiens
gauuucuaccagugaaagggaaagaaaaaggagaaaaacaaagaaagugaaaagagagaaagga

SEQ ID NO: 280747 - RNA, 64 nt, Homo Sapiens
acuagauauguaauuucuaaaaacaaaacaaaacaaaacaaaaacuuaucuuaaaaaguaaaca

SEQ ID NO: 280748 - RNA, 64 nt, Homo Sapiens
aaaaaacuagauauguaauuaaacaaaacaaaacaaaacaaaacggacucuuaucuuaaaaagu

SEQ ID NO: 280749 - RNA, 64 nt, Homo Sapiens
aaaacaaaaaacuagauaugaaaguaaacaaaacaaaacaaaaccggcaggacucuuaucuuaa

SEQ ID NO: 280750 - RNA, 64 nt, Homo Sapiens
aaaacaaaacaaaaaacuagcuuaaaaaguaaacaaaacaaaacaggugcggcaggacucuuau

SEQ ID NO: 280751 - RNA, 64 nt, Homo Sapiens
auuuuucagguuccaaggaaugcacuuuaaaaacaaaacaaaacaaggcuuuacuucuuuugca

SEQ ID NO: 280752 - RNA, 64 nt, Homo Sapiens
aaaacauuuuucagguuccauugcaugcacuuuaaaaacaaaacaaaaaaaggcuuuacuucuu

SEQ ID NO: 280753 - RNA, 64 nt, Homo Sapiens
uuuauuaaagauugaaaauucaucaggaauaaaaaaaacaaaguuuauuuuuuugguauuuauu

SEQ ID NO: 280754 - RNA, 64 nt, Homo Sapiens
auauaaugcuaguccuagauuacuuauugauuuaaaaacaaaaaaaagauuacuuaauuuugau

SEQ ID NO: 280755 - RNA, 64 nt, Homo Sapiens
aaaaacaaaaaaaagauuacuuaauuuugauuuaaaaacaaaaaaucguaaaauacaaaaacca

SEQ ID NO: 280756 - RNA, 64 nt, Homo Sapiens
ugcagaagguguauguuggggagaacugaaagggaaaacaaaauacuugacauagucuuaagua

SEQ ID NO: 280757 - RNA, 64 nt, Homo Sapiens
ugacauagucuuaaguagaagaaggcaguuagagaaaacaaaguaucuacuggccuugucaaca

SEQ ID NO: 280758 - RNA, 64 nt, Homo Sapiens
uauaaacacaaggaacauuccauaucauuagucgaaaacaaaaacaaaaaaaaaaccuuugguc

SEQ ID NO: 280759 - RNA, 64 nt, Homo Sapiens
cacaaggaacauuccauaucauuagucgaaaacaaaaacaaaaaaaaaaccuuuggucauuugu

SEQ ID NO: 280760 - RNA, 64 nt, Homo Sapiens
acaguaccuacauaguuuuuaaauuauuguuuaaaaaacaaaacagcuguuauaaaugaauauu

SEQ ID NO: 280761 - RNA, 64 nt, Homo Sapiens
ugaugaauaaaucuuaaaugcuuuguuuaauuaaaaaacaaaaaucaccaauauccaagacaug

SEQ ID NO: 280762 - RNA, 64 nt, Homo Sapiens
ccuuugcuguaucacuguguaaaaaacaaaaacaaaaacaaaaccucuuuccuuuccaguuaaa

SEQ ID NO: 280763 - RNA, 64 nt, Homo Sapiens
caaaacccuuugcuguaucaguuaaaaaaaaacaaaaacaaaaaucuuuccucuuuccuuucca

SEQ ID NO: 280764 - RNA, 64 nt, Homo Sapiens
caaaaacaaaacccuuugcuuuuccaguuaaaaaaaaacaaaaauucccuucuuuccucuuucc

SEQ ID NO: 280765 - RNA, 64 nt, Homo Sapiens
gaaucaaguuguaguuguuuuuuuucuucuggauaaaacaaauguucacauuuuacuuugaaug

SEQ ID NO: 280766 - RNA, 64 nt, Homo Sapiens
uugacaacauaguuucuuaaaauuuaacuucaagaaaacaaaauaaauaaccuuccuuaaguac

SEQ ID NO: 280767 - RNA, 64 nt, Homo Sapiens
cuguaugugaacuauguuuuuaccaauaaacauuaaaacaaagaaugcauugaagaucuguuuc

SEQ ID NO: 280768 - RNA, 64 nt, Homo Sapiens
gaaaaccuuuaagagaauguaaaaaucuccagugaaaacaaaacguuaaguucacuuggaggcu

SEQ ID NO: 280769 - RNA, 64 nt, Homo Sapiens
acugguaauuauuuuuaauauggcucuauuuuguaaaacaaacuuugggcaauuaaacaauuua

SEQ ID NO: 280770 - RNA, 64 nt, Homo Sapiens
gugccuguuuaaagcacucacugcaacaaaugaaaaaacaaaauacugagugugacuauuuuca

SEQ ID NO: 280771 - RNA, 64 nt, Homo Sapiens
auuuaaaaaaaagguuugcuaaaaaaacaaaaaaaaaacaaaaaucaccaucaauuuaaaagua

SEQ ID NO: 280772 - RNA, 64 nt, Homo Sapiens
aaaaacaaaaaauuuaaaaaauuuaaaaguaaaaaaaacaaaaaaaugccacgguucaccauca

SEQ ID NO: 280773 - RNA, 64 nt, Homo Sapiens
ggaaacauuacacaauguccguuuguaauuguuuaaaacaaaguuacauuauuuuaagccacau

SEQ ID NO: 280774 - RNA, 64 nt, Homo Sapiens
guccuacuaaucaaagcugcuaucuugcauucagaaaacaaacugagaaacagauucaugcuug

SEQ ID NO: 280775 - RNA, 64 nt, Homo Sapiens
acuauguauuugcacagcacacauuugccaaaacaaaacaaaaaagucauuaaaacaaaaugaa

SEQ ID NO: 280776 - RNA, 64 nt, Homo Sapiens
aaaaaacuauguauuugcacaugaaacauuugccaaaacaaaacaccgaagucauuaaaacaaa

SEQ ID NO: 280777 - RNA, 64 nt, Homo Sapiens
gaaacauuugccaaaacaaaggaccgaagucauuaaaacaaaauuauuucauuuucuuuauauu

SEQ ID NO: 280778 - RNA, 64 nt, Homo Sapiens
agaacaaaagcaaaggaaaaaauaaagacaaacuaaaacaaaaccaaccaccaaaaacuagaca

SEQ ID NO: 280779 - RNA, 64 nt, Homo Sapiens
uaccaaccaccaaaaacuagaggaacuauguacaaaaacaaaccccuaaauauccuggggacca

SEQ ID NO: 280780 - RNA, 64 nt, Homo Sapiens
cugaaauguauauuugggauugucuuuaaaaacaaaaacaaaccgugcacauauuccaggaaag

SEQ ID NO: 280781 - RNA, 64 nt, Homo Sapiens
caaacccugaaauguauauuggaaagugucuuuaaaaacaaaaaaccauagugcacauauucca

SEQ ID NO: 280782 - RNA, 64 nt, Homo Sapiens
aacauggugcaaccucgucuuuacuaaaaauacaaaaacaaaaauuagccagggguggugguau

SEQ ID NO: 280783 - RNA, 64 nt, Homo Sapiens
uccagccugggagacagagcaagacuccaucucaaaaacaaaaacaaaacaaaacaacaacaaa

SEQ ID NO: 280784 - RNA, 64 nt, Homo Sapiens
cugggagacagagcaagacuccaucucaaaaacaaaaacaaaacaaaacaacaacaaaaaaaga

SEQ ID NO: 280785 - RNA, 64 nt, Homo Sapiens
agacagagcaagacuccaucucaaaaacaaaaacaaaacaaaacaacaacaaaaaaagaaguua

SEQ ID NO: 280786 - RNA, 64 nt, Homo Sapiens
ucaucagagauacuuuccuaaaaaggaaaaauaaaaaacaaaauggugccacuuuggguugaag

SEQ ID NO: 280787 - RNA, 64 nt, Homo Sapiens
cuugaauucauuuauaugucuuuugauucuuaaaaaaacaaaaaacauuccauuagaagcacca

SEQ ID NO: 280788 - RNA, 64 nt, Homo Sapiens
aucauaccaaaaaguguaagugaaaacccccuuuaaaacaaaacaaaaaaaugaaauaaaauua

SEQ ID NO: 280789 - RNA, 64 nt, Homo Sapiens
accaaaaaguguaagugaaaacccccuuuaaaacaaaacaaaaaaaugaaauaaaauuaggcaa

SEQ ID NO: 280790 - RNA, 64 nt, Homo Sapiens
acuguaaccauguuuuuucuguuuaauuauguaaaaaacaaaacuacaacaacaaaaaaagaaa

SEQ ID NO: 280791 - RNA, 64 nt, Homo Sapiens
aaaagaaaaaaguuaaaaaagaaaaaaacaccaaaaaacaaaaacaaacaaaaaaaaaaaccca

SEQ ID NO: 280792 - RNA, 64 nt, Homo Sapiens
aaaaaguuaaaaaagaaaaaaacaccaaaaaacaaaaacaaacaaaaaaaaaaacccacaaccc

SEQ ID NO: 280793 - RNA, 64 nt, Homo Sapiens
auaaugacuggacaucagaagaggaaaaaaacucaaaacaaaagcgagagagacuauugccaua

SEQ ID NO: 280794 - RNA, 64 nt, Homo Sapiens
auuugcucacuucucucuucacccaucuuuuuuaaaaacaaauaaaugaauaaagcugcuguga

SEQ ID NO: 280795 - RNA, 64 nt, Homo Sapiens
guugaaaauauauuagacauucucccugagguuaaaaacaaaaaguacgugaccagucugguaa

SEQ ID NO: 280796 - RNA, 64 nt, Homo Sapiens
gaguuuuguauaugucugauaccguuguuauaacaaaacaaauuuuuuuacuauaguuuuuugu

SEQ ID NO: 280797 - RNA, 64 nt, Homo Sapiens
uuacuuaccucuugcaaaaaaaaugaaaaaugaaaaaacaaauucaaaaccuauucaaaugggu

SEQ ID NO: 280798 - RNA, 64 nt, Homo Sapiens
uuguuuaguauaaauugucauagcugguuuacugaaaacaaacacauuuaaaauugguuuaccu

SEQ ID NO: 280799 - RNA, 64 nt, Homo Sapiens
ugagaauuauuuagaaaagacaugcuccaaaaaaaaaacaaaacugauaaaacaguuuuucgaa

SEQ ID NO: 280800 - RNA, 64 nt, Homo Sapiens
ccuguguuaaacuguuuagugcucuguuuuuaagaaaacaaauguugaaccucacacuuuuaug

SEQ ID NO: 280801 - RNA, 64 nt, Homo Sapiens
aaaaaaaaaaagaaaaaaaaaacucugaaaaaacaaaacaaaaaggcucagucagcaaccucag

SEQ ID NO: 280802 - RNA, 64 nt, Homo Sapiens
aaaaaaaaaaaaaaaagaaacucagaacucugaaaaaacaaaacgcuguggcucagucagcaac

SEQ ID NO: 280803 - RNA, 64 nt, Homo Sapiens
ccuguaaaaauaauuuugagaacacuuuuacaaaaaaacaaaaauauuuuaccaagauuauaaa

SEQ ID NO: 280804 - RNA, 64 nt, Homo Sapiens
uuuuuaagcacuggggauaaaaaauaaaauaauaaaaacaaauucuccacugacuacugacuca

SEQ ID NO: 280805 - RNA, 64 nt, Homo Sapiens
aaauuagccuacuuaaaggccuccaucucaaaacaaaacaaaaaagccuggcgacagagagaga

SEQ ID NO: 280806 - RNA, 64 nt, Homo Sapiens
aaaaaaaauuagccuacuuaagagacuccaucucaaaacaaaacacuccagccuggcgacagag

SEQ ID NO: 280807 - RNA, 64 nt, Homo Sapiens
cuagggcuguauuuuauauaaaaaaaaaacaaaaaaaacaaaauucgugaccaaauuguuuaag

SEQ ID NO: 280808 - RNA, 64 nt, Homo Sapiens
aaacaaaaucuagggcuguauuguuuaagaaaaaaaaacaaaaaaaaggugcaucgugaccaaa

SEQ ID NO: 280809 - RNA, 64 nt, Homo Sapiens
uguuacaguguuuuuuguagguagccucugggaaaaaacaaacaguauuccagcaaaagaggau

SEQ ID NO: 280810 - RNA, 64 nt, Homo Sapiens
aaggacuucaauccaaaguuucuaaguaaaggaaaaaacaaaaucagcacuguauauaccuguc

SEQ ID NO: 280811 - RNA, 64 nt, Homo Sapiens
guaucaauguguauguggcugauuguugagaacaaaaacaaaaauguguuuaacuuuguauuuu

SEQ ID NO: 280812 - RNA, 64 nt, Homo Sapiens
cacccaguacuguggcucaguggagggaaacuuuaaaacaaaaaaauaugaucuuccauccaag

SEQ ID NO: 280813 - RNA, 64 nt, Homo Sapiens
uuuuuuauucaaaaguaacaagaaaaaaaucacaaaaacaaacuugaagaaaaaaaagaaaaag

SEQ ID NO: 280814 - RNA, 64 nt, Homo Sapiens
aauucuugaauuauauaacuagauaugaccaguuaaaacaaagcuuuuaaaaaaccuuaaugua

SEQ ID NO: 280815 - RNA, 64 nt, Homo Sapiens
aaauuaaggggaaaauuauuucaaaacaagaaacaaaacaaaaacugaaaccgcuuuuuaaaau

SEQ ID NO: 280816 - RNA, 64 nt, Homo Sapiens
ggcugccauaauauauuuuuagaaaaaaaaaacaaaaacaaacauagugaauuuggaaauaaaa

SEQ ID NO: 280817 - RNA, 64 nt, Homo Sapiens
caaacaggcugccauaauauauaaaaagaaaaaaaaaacaaaaauuuuguuagugaauuuggaa

SEQ ID NO: 280818 - RNA, 64 nt, Homo Sapiens
caauucaggaacaacggcuaguugaaugaaaagcaaaacaaaaaacaaguuacaaguugauauc

SEQ ID NO: 280819 - RNA, 64 nt, Homo Sapiens
acuaaauccuuuccaauaauugacugguggaaggaaaacaaaaaacaaaaacuaaaaaccucuu

SEQ ID NO: 280820 - RNA, 64 nt, Homo Sapiens
ccuuuccaauaauugacugguggaaggaaaacaaaaaacaaaaacuaaaaaccucuuagcuuuu

SEQ ID NO: 280821 - RNA, 64 nt, Homo Sapiens
aauuuguguuuauauuuccuguaagugaauaaauaaaacaaaacaaaacaaaaaaaacuugugc

SEQ ID NO: 280822 - RNA, 64 nt, Homo Sapiens
guguuuauauuuccuguaagugaauaaauaaaacaaaacaaaacaaaaaaaacuugugccugau

SEQ ID NO: 280823 - RNA, 64 nt, Homo Sapiens
uauauuuccuguaagugaauaaauaaaacaaaacaaaacaaaaaaaacuugugccugauaagcu

SEQ ID NO: 280824 - RNA, 64 nt, Homo Sapiens
cugguuagcuaauugaacuuuugugaccuguuuaaaaacaaaucaaauuuauugaacaaaugac

SEQ ID NO: 280825 - RNA, 64 nt, Homo Sapiens
ccagcccguaugacagagugagacccuguuucuaaaaacaaaacaaacaaacaaacaaacaacg

SEQ ID NO: 280826 - RNA, 64 nt, Homo Sapiens
ccguaugacagagugagacccuguuucuaaaaacaaaacaaacaaacaaacaaacaacguaucu

SEQ ID NO: 280827 - RNA, 64 nt, Homo Sapiens
agcuacugcagcaaggcuucuguguacuugccugaaaacaaaggaaggugcuggucauuccauu

SEQ ID NO: 280828 - RNA, 64 nt, Homo Sapiens
uuuaacuccuccuaccccccaagguaagaaacaaaaaacaaacaaacaaacaaaaauagaagac

SEQ ID NO: 280829 - RNA, 64 nt, Homo Sapiens
ugaaaacuuuaccaucuagagugcucaugcaauuaaaacaaaacaaacacaaacaaggaggcac

SEQ ID NO: 280830 - RNA, 64 nt, Homo Sapiens
acuuuaccaucuagagugcucaugcaauuaaaacaaaacaaacacaaacaaggaggcacuaagc

SEQ ID NO: 280831 - RNA, 64 nt, Homo Sapiens
guguucagggagauaauucugccuuuaauugucuaaaacaaaaacaaaaccagccaaccuaugu

SEQ ID NO: 280832 - RNA, 64 nt, Homo Sapiens
agggagauaauucugccuuuaauugucuaaaacaaaaacaaaaccagccaaccuauguuacacg

SEQ ID NO: 280833 - RNA, 64 nt, Homo Sapiens
agccugggugacagagcgagacuaucucagaaacaaaacaaaacaaaacaacaaaaaaagaaaa

SEQ ID NO: 280834 - RNA, 64 nt, Homo Sapiens
gggugacagagcgagacuaucucagaaacaaaacaaaacaaaacaacaaaaaaagaaaaggcag

SEQ ID NO: 280835 - RNA, 64 nt, Homo Sapiens
caaaggggugcaugggaaagggcuguugauauuaaaaacaaacaaaacaaaaaagccccacaca

SEQ ID NO: 280836 - RNA, 64 nt, Homo Sapiens
gcaugggaaagggcuguugauauuaaaaacaaacaaaacaaaaaagccccacacauaacuguuu

SEQ ID NO: 280837 - RNA, 64 nt, Homo Sapiens
uugguuuaacucuuuaguuuuauuuuaagaggggaaaacaaaaauaucuugcaagcagaaccuu

SEQ ID NO: 280838 - RNA, 64 nt, Homo Sapiens
cuugggaaacugaaaguguucccauauagcuucaaaaacaaaaacaaauguguuauccgacgga

SEQ ID NO: 280839 - RNA, 64 nt, Homo Sapiens
aaacugaaaguguucccauauagcuucaaaaacaaaaacaaauguguuauccgacggauacuuu

SEQ ID NO: 280840 - RNA, 64 nt, Homo Sapiens
caacucaugccacaguauguagcacaacaaauuaaaaacaaaaagcccucagaacuuuaguaac

SEQ ID NO: 280841 - RNA, 64 nt, Homo Sapiens
aaaggaaggaaaaaaaaagaaaacaaaacaaaauaaaacaaaaaauuuggcaugcuguaaaaca

SEQ ID NO: 280842 - RNA, 58 nt, Homo Sapiens
aaaacaaaaaaaaggaaggaaacaaaacaaaacaaaauaaggauuuggcaugcuguaa

SEQ ID NO: 280843 - RNA, 53 nt, Homo Sapiens
aaaauaaaacaaaaaaaaggaacaaaacaaaacaaggauuuggcaugcuguaa

SEQ ID NO: 280844 - RNA, 64 nt, Homo Sapiens
cuaaaaaccucuuagcuuuuuggaaggaaaacaaaaaacaaaaaccuuuccaauaauugacugg

SEQ ID NO: 280845 - RNA, 64 nt, Homo Sapiens
acaaaaacuaaaaaccucuuugacugguggaaggaaaacaaaaaacuaaauccuuuccaauaau

SEQ ID NO: 280846 - RNA, 64 nt, Homo Sapiens
ggaaaagaaaauauacaugagagacccuaucucaaaaacaaaaaugcagccugaguaacaaaau

SEQ ID NO: 280847 - RNA, 64 nt, Homo Sapiens
aaaagagcgaggaugggggucuauaugaugauuuaaaacaaaauuuagucuuaaacucaaauua

SEQ ID NO: 280848 - RNA, 64 nt, Homo Sapiens
aaaccucaugagugcauggaaacaaaaaacaaaaaaaacaaaaauuccugcuaaaaagacaaaa

SEQ ID NO: 280849 - RNA, 64 nt, Homo Sapiens
aaacaaaaaaaaccucaugaaagacaaaaaacaaaaaacaaaaacucccccucuuccugcuaaa

SEQ ID NO: 280850 - RNA, 64 nt, Homo Sapiens
acaaaaaaaacaaaaaaaacugcuaaaaagacaaaaaacaaaaauuauauucucccccucuucc

SEQ ID NO: 280851 - RNA, 64 nt, Homo Sapiens
cccuuuacucuguaggucauaccagaaaaaaacaaaaacaaaacccacagaaaugaugaaagug

SEQ ID NO: 280852 - RNA, 64 nt, Homo Sapiens
caaaaccccuuuacucuguaaaagugaccagaaaaaaacaaaaauuucucccacagaaaugaug

SEQ ID NO: 280853 - RNA, 64 nt, Homo Sapiens
aaauaaauauugacucaaaaucacuccagaaaagaaaacaaaucucuuuaaaguauuuacaaua

SEQ ID NO: 280854 - RNA, 64 nt, Homo Sapiens
uuuuuuccuauuacaaaaaacaguuaguuaaaaaaaaacaaacagaaaacauuccuucauaguu

SEQ ID NO: 280855 - RNA, 64 nt, Homo Sapiens
aaaguugaacuuguuuuucugaggggaaacaaugaaaacaaauagugaucggggucaggcaaag

SEQ ID NO: 280856 - RNA, 64 nt, Homo Sapiens
aaaaaauuaaccgagacacuaaguacaaacaugaaaaacaaacaaagcacuucuagaaugucug

SEQ ID NO: 280857 - RNA, 64 nt, Homo Sapiens
cauggcagaugcauauuguguuuuaaaaaaaacaaaaacaaaaacuuuguugcacuuuuaguuu

SEQ ID NO: 280858 - RNA, 64 nt, Homo Sapiens
caaaaacauggcagaugcauuaguuuuuuuaaaaaaaacaaaaaaacugacuuuguugcacuuu

SEQ ID NO: 280859 - RNA, 64 nt, Homo Sapiens
uagcugagcaugguggugugucucaaaacaaaacaaaacaaaauggcgacacagcgagacucca

SEQ ID NO: 280860 - RNA, 64 nt, Homo Sapiens
aaaauuagcugagcauggugcuccaucucaaaacaaaacaaaacgccugggcgacacagcgaga

SEQ ID NO: 280861 - RNA, 64 nt, Homo Sapiens
aaaacaaaauuagcugagcacgagacuccaucucaaaacaaaaccuugagccugggcgacacag

SEQ ID NO: 280862 - RNA, 64 nt, Homo Sapiens
ucucaaacuaauuuaacaagaccuuguacaaaauaaaacaaauuucacugugcagagggauugu

SEQ ID NO: 280863 - RNA, 64 nt, Homo Sapiens
gggcaaaccuaggaagcuaaucucacaagaauuaaaaacaaaaaccaagcccuaaagagaaccu

SEQ ID NO: 280864 - RNA, 64 nt, Homo Sapiens
cugucuuauuucuaaauuuccuucuuccaagaugaaaacaaaagaaaaacuuaaaacagaaggu

SEQ ID NO: 280865 - RNA, 64 nt, Homo Sapiens
caagagauucccaccauuauuuagguucaccugcaaaacaaaaaucuuacuccagccccucaau

SEQ ID NO: 280866 - RNA, 64 nt, Homo Sapiens
uuuuucaaggguuucccugugcuagcugagaugcaaaacaaaucauggaagauugcauaccugu

SEQ ID NO: 280867 - RNA, 64 nt, Homo Sapiens
aguagugauaaacaccuuaaucauaaaaugaauaaaaacaaaaaaaccauggggcuugucugca

SEQ ID NO: 280868 - RNA, 64 nt, Homo Sapiens
aacucaccauuucauccauauuucuuuuucuugcaaaacaaacauacccaucugcaccgacgcc

SEQ ID NO: 280869 - RNA, 64 nt, Homo Sapiens
aaaaaaauuuuuaaauaccacaagauggaaaaaaaaaacaaaaaaauuuaaaaagauggaaugu

SEQ ID NO: 280870 - RNA, 64 nt, Homo Sapiens
gauuuaauuugcuaaauagacuaacaggaggaaaaaaacaaacagccuagcuuuaaaaaacagu

SEQ ID NO: 280871 - RNA, 64 nt, Homo Sapiens
ucaucuuaccccuuuaugccaccuacugaaaagaaaaacaaauagcuagguuugguuuccuguu

SEQ ID NO: 280872 - RNA, 64 nt, Homo Sapiens
gagaucuugugguuccaugagaauuauuacuuuaaaaacaaaacaaaauauaaaaaacuguguu

SEQ ID NO: 280873 - RNA, 64 nt, Homo Sapiens
cuugugguuccaugagaauuauuacuuuaaaaacaaaacaaaauauaaaaaacuguguuugagu

SEQ ID NO: 280874 - RNA, 64 nt, Homo Sapiens
guaucauguuauuuagccaaugcaaaucuguuuuaaaacaaauaguuuaaaaaaagaacaaguu

SEQ ID NO: 280875 - RNA, 64 nt, Homo Sapiens
cuaauaaaugcagaaucugaagguaaauagguuuaaaacaaaacaaaaacccaccccuuuaagg

SEQ ID NO: 280876 - RNA, 64 nt, Homo Sapiens
aaaugcagaaucugaagguaaauagguuuaaaacaaaacaaaaacccaccccuuuaaggaguug

SEQ ID NO: 280877 - RNA, 64 nt, Homo Sapiens
acagcuuuacuucaaaagcaaccuuacucaagcaaaaacaaaaaaggcuucagagguaccuggc

SEQ ID NO: 280878 - RNA, 64 nt, Homo Sapiens
ccacucagaaacagagaaaauacaauccaggaaaaaaacaaaccauuccaccugacccugugug

SEQ ID NO: 280879 - RNA, 64 nt, Homo Sapiens
aaacuuuuuuuaaucguuguuuaaaaaaaacaaaaaaacaaaaaucucuccucauccuaguucu

SEQ ID NO: 280880 - RNA, 60 nt, Homo Sapiens
aacaaaaaaaacuuuuuuuauucuuuaaaaaaaacaaaaacggcucucuccucauccuag

SEQ ID NO: 280881 - RNA, 64 nt, Homo Sapiens
cuccaucucuucagaccccuuugccuuuaaaaaaaaaacaaaaacaaaaacaaaaaaacccaua

SEQ ID NO: 280882 - RNA, 64 nt, Homo Sapiens
cucuucagaccccuuugccuuuaaaaaaaaaacaaaaacaaaaacaaaaaaacccauaaugccc

SEQ ID NO: 280883 - RNA, 64 nt, Homo Sapiens
agaccccuuugccuuuaaaaaaaaaacaaaaacaaaaacaaaaaaacccauaaugcccacagaa

SEQ ID NO: 280884 - RNA, 64 nt, Homo Sapiens
cauuggaauucuacuggaaaaaaauacaaaaagcaaaacaaaacccucagcacuguuacaagag

SEQ ID NO: 280885 - RNA, 64 nt, Homo Sapiens
aagggcaaggaguuuauuacaauguaucuuuauuaaaacaaaaggguguauaguguucacaaac

SEQ ID NO: 280886 - RNA, 64 nt, Homo Sapiens
cugggcaaaaagagugagacucugucucaaaaaaaaaacaaaacaaaaaaaaccucuuugcugg

SEQ ID NO: 280887 - RNA, 64 nt, Homo Sapiens
caaaaagagugagacucugucucaaaaaaaaaacaaaacaaaaaaaaccucuuugcugguauau

SEQ ID NO: 280888 - RNA, 64 nt, Homo Sapiens
ggacuuggaggguugguccucuugccuccuggaaaaaacaaaaacaaaaaacugcagugaaaga

SEQ ID NO: 280889 - RNA, 64 nt, Homo Sapiens
ggaggguugguccucuugccuccuggaaaaaacaaaaacaaaaaacugcagugaaagacaagcu

SEQ ID NO: 280890 - RNA, 64 nt, Homo Sapiens
uucccuucugugugaccgaccccuuggccaaaaaaaaacaaaaagcaaaaaacaaaaaccuacc

SEQ ID NO: 280891 - RNA, 64 nt, Homo Sapiens
accgaccccuuggccaaaaaaaaacaaaaagcaaaaaacaaaaaccuacccuguucugguuuuu

SEQ ID NO: 280892 - RNA, 64 nt, Homo Sapiens
gcagggcuuaauacauuagugguaacugguuuaaaaaacaaagacuguaagccugugugugcca

SEQ ID NO: 280893 - RNA, 64 nt, Homo Sapiens
gucaguuucaaaucaaauuaucuaagaaaacaagaaaacaaaggcagcagacuauugguacaca

SEQ ID NO: 280894 - RNA, 64 nt, Homo Sapiens
auucugaucugcaaauagcuuaaaugucucuugcaaaacaaaguaagauaccaccaguauuaca

SEQ ID NO: 280895 - RNA, 64 nt, Homo Sapiens
aaaauuauuuauuuuguaaggagagguuuuaauuaaaacaaaaaaaaauucuuuuuuuuuuuuu

SEQ ID NO: 280896 - RNA, 64 nt, Homo Sapiens
uuguccaucccuuuuuucuuuguuguuuuuguugaaaacaaacuggaaacuuguuucuuuuuuu

SEQ ID NO: 280897 - RNA, 64 nt, Homo Sapiens
uacggaccaugugcuauauauugucguuguuuuuaaaacaaaggguauuccuaacagucuuuug

SEQ ID NO: 280898 - RNA, 64 nt, Homo Sapiens
aacucugagaugaacaauauucuaccacggcuuuaaaacaaaacugcacauuuaaagagaagca

SEQ ID NO: 280899 - RNA, 64 nt, Homo Sapiens
caacaacaaaaaacaaaagaucaaaaaacaaaacaaaacaaaaaaacaagaguaaaacuucauc

SEQ ID NO: 280900 - RNA, 64 nt, Homo Sapiens
aaaaacaacaacaaaaaacaucaucucaaaaaacaaaacaaaacuggucaacaagaguaaaacu

SEQ ID NO: 280901 - RNA, 64 nt, Homo Sapiens
aaaacaaaaacaacaacaaaaaacuucaucucaaaaaacaaaaccagccuggucaacaagagua

SEQ ID NO: 280902 - RNA, 64 nt, Homo Sapiens
cccagcacauacaagaaacacagaaaagaaaacaaaaacaaaaacuccccuuauucccgaggcc

SEQ ID NO: 280903 - RNA, 64 nt, Homo Sapiens
caaaaacccagcacauacaagaggcccagaaaagaaaacaaaaaacucuccuccccuuauuccc

SEQ ID NO: 280904 - RNA, 64 nt, Homo Sapiens
agcaaaaaacacaaaaaccuauuuucaacaaaacaaaacaaacauccccauucugugcccuacu

SEQ ID NO: 280905 - RNA, 64 nt, Homo Sapiens
aaacaagcaaaaaacacaaacuacuauuuucaacaaaacaaaacuccucuccccauucugugcc

SEQ ID NO: 280906 - RNA, 64 nt, Homo Sapiens
ugguuuuccuuuacuuugacuuaauguacugauaaaaacaaacaucuuuggcauuaaucuaauu

SEQ ID NO: 280907 - RNA, 64 nt, Homo Sapiens
uggugaccuaaaggcuuguuauuugaauagggccaaaacaaaguaucaagagauacucuugaua

SEQ ID NO: 280908 - RNA, 64 nt, Homo Sapiens
cagaccccaccugaauugggaaaggaaaaaacaaaaaacaaaccugaauugaguauauauuuga

SEQ ID NO: 280909 - RNA, 64 nt, Homo Sapiens
acaaacccagaccccaccuguauuugaaaaggaaaaaacaaaaacagagguugaauugaguaua

SEQ ID NO: 280910 - RNA, 64 nt, Homo Sapiens
aagccucgguauaauuuuguuaaaaguauaaaacaaaacaaaaaaaguuugcuggggaguuuga

SEQ ID NO: 280911 - RNA, 64 nt, Homo Sapiens
aaaaaaagccucgguauaauuuugauaaaaguauaaaacaaaacucagcaaguuugcuggggag

SEQ ID NO: 280912 - RNA, 64 nt, Homo Sapiens
auggaaaaaaaaaaccuuguugaaaaaaaaaacaaaaacaaaaacugaauaacccuuuuagcau

SEQ ID NO: 280913 - RNA, 64 nt, Homo Sapiens
caaaaaauggaaaaaaaaaauagcauugaaaaaaaaaacaaaaaaaaauucugaauaacccuuu

SEQ ID NO: 280914 - RNA, 64 nt, Homo Sapiens
aaaaacccuauuuaaaugaaaacaaaaaacaaaaaaaacaaaaaauagggaaguaaaaaaacaa

SEQ ID NO: 280915 - RNA, 64 nt, Homo Sapiens
aaacaaaaaaaaaacccuauaaaaaacaaaacaaaaaacaaaaaucaaaucgaauagggaagua

SEQ ID NO: 280916 - RNA, 64 nt, Homo Sapiens
acaaaaaaaacaaaaaaaaaggaaguaaaaaaacaaaacaaaaaaggaaacucaaaucgaauag

SEQ ID NO: 280917 - RNA, 64 nt, Homo Sapiens
aaaaaacaaaaaaaacaaaaaauagggaaguaaaaaaacaaaacgaaucaggaaacucaaaucg

SEQ ID NO: 280918 - RNA, 64 nt, Homo Sapiens
cagaacaaaagaagagagaaaaaaaaaaacacacaaaacaaaaauuuuucuaaaaaacaaacaa

SEQ ID NO: 280919 - RNA, 64 nt, Homo Sapiens
aaaaaaaaaacacacaaaacaccccuuuuucuaaaaaacaaacagauuuuauuucuucuccccc

SEQ ID NO: 280920 - RNA, 64 nt, Homo Sapiens
uggcaaggauuacauucuagcauccaacaccugaaaaacaaacugcccauagaugcauuggcuc

SEQ ID NO: 280921 - RNA, 64 nt, Homo Sapiens
aaagcuuguauauacuuugcuaaauuaaaaacagaaaacaaagaacucaucacauccccgaugc

SEQ ID NO: 280922 - RNA, 64 nt, Homo Sapiens
acuaaagggugagaauuugcaggaagaaaaacaaaaaacaaaaacauuugguuuauuuagaaaa

SEQ ID NO: 280923 - RNA, 64 nt, Homo Sapiens
acaaaaaacuaaagggugaguagaaaaaggaagaaaaacaaaaacaccaagcauuugguuuauu

SEQ ID NO: 280924 - RNA, 64 nt, Homo Sapiens
caccaagaaaccaagucaacucacugccugccagaaaacaaaaacuccuccuucaccccuccuc

SEQ ID NO: 280925 - RNA, 64 nt, Homo Sapiens
acuauaguuagaaaaauggaacugggaaaaaacaaaaacaaaaagaguuguuuuuuuuuuaaca

SEQ ID NO: 280926 - RNA, 64 nt, Homo Sapiens
caaaaaacuauaguuagaaauuaacaacugggaaaaaacaaaaaaacugugaguuguuuuuuuu

SEQ ID NO: 280927 - RNA, 64 nt, Homo Sapiens
ucugaaagaaacgucuuuagaauuuuuaaaauggaaaacaaaaacuccaaguagcuccaaaugc

SEQ ID NO: 280928 - RNA, 64 nt, Homo Sapiens
gacucacaaaccuccaaguauaucugaaaugaagaaaacaaaccaaaaaguuccaugacucgaa

SEQ ID NO: 280929 - RNA, 64 nt, Homo Sapiens
uagagcaaaugcuagagcgauuucagcugauagaaaaacaaaaaugaaaaaaaaaacacaaaaa

SEQ ID NO: 280930 - RNA, 64 nt, Homo Sapiens
ugauagaaaaacaaaaaugaaaaaaaaaacacaaaaaacaaaaaacauggcacguugcuaguuu

SEQ ID NO: 280931 - RNA, 64 nt, Homo Sapiens
aaacaccuugaaucaaguuuuuuuuuaaaaaaacaaaacaaacauuugucuuucuuuuuccuuu

SEQ ID NO: 280932 - RNA, 64 nt, Homo Sapiens
aaacaaaacaccuugaaucaccuuuuuuuuuaaaaaaacaaaacuuuccuuugucuuucuuuuu

SEQ ID NO: 280933 - RNA, 64 nt, Homo Sapiens
ucuugggggaagaaauuggcugcaucaaugaauuaaaacaaaaaaauucuuugauuuauuuuau

SEQ ID NO: 280934 - RNA, 64 nt, Homo Sapiens
gccagaaucuuccuuuuuuugcucuuuaaaaaagaaaacaaaaaaaagauuaugaaaggaacag

SEQ ID NO: 280935 - RNA, 64 nt, Homo Sapiens
uauaauggcuagaauacaaaaauuaaugugaaauaaaacaaaaauaugcauauaaaagugaugg

SEQ ID NO: 280936 - RNA, 64 nt, Homo Sapiens
aagucaaaauggacagucauuuuugaauggcaccaaaacaaaauuugcuaaggcuuuuaauaca

SEQ ID NO: 280937 - RNA, 64 nt, Homo Sapiens
uacauauuguuuaaaaaaaagcaagaaaaaaaggaaaacaaaggaaaauauccccaaaguuguu

SEQ ID NO: 280938 - RNA, 64 nt, Homo Sapiens
cccaaaguuguuuucuagauuuguggcuuuaagaaaaacaaaacaaaacaaacacauuguuuuu

SEQ ID NO: 280939 - RNA, 64 nt, Homo Sapiens
aguuguuuucuagauuuguggcuuuaagaaaaacaaaacaaaacaaacacauuguuuuucucag

SEQ ID NO: 280940 - RNA, 64 nt, Homo Sapiens
uuuucuagauuuguggcuuuaagaaaaacaaaacaaaacaaacacauuguuuuucucagaacca

SEQ ID NO: 280941 - RNA, 64 nt, Homo Sapiens
agggagggauggaggagauaauuugcuuauauuaaaaacaaaaaauggcugaggcaggaguuug

SEQ ID NO: 280942 - RNA, 64 nt, Homo Sapiens
uugcaugcaaaucaaguggacaagaaaaaauaacaaaacaaaaaacaagaaaaaaaaaacacaa

SEQ ID NO: 280943 - RNA, 64 nt, Homo Sapiens
uccucaggccgccagugucgcccugccccuuuuuaaaacaaaaugcccucguuuguaaacccuu

SEQ ID NO: 280944 - RNA, 64 nt, Homo Sapiens
cugggggagggggacauagcgagacucggucucaaaaacaaaacaaaacaaaacaaaacaaaac

SEQ ID NO: 280945 - RNA, 64 nt, Homo Sapiens
ggagggggacauagcgagacucggucucaaaaacaaaacaaaacaaaacaaaacaaaacaaaaa

SEQ ID NO: 280946 - RNA, 64 nt, Homo Sapiens
gggacauagcgagacucggucucaaaaacaaaacaaaacaaaacaaaacaaaacaaaaacaaaa

SEQ ID NO: 280947 - RNA, 64 nt, Homo Sapiens
auagcgagacucggucucaaaaacaaaacaaaacaaaacaaaacaaaacaaaaacaaaacaaaa

SEQ ID NO: 280948 - RNA, 64 nt, Homo Sapiens
gagacucggucucaaaaacaaaacaaaacaaaacaaaacaaaacaaaacaaaacaaaacaaaac

SEQ ID NO: 280949 - RNA, 64 nt, Homo Sapiens
ucggucucaaaaacaaaacaaaacaaaacaaaacaaaacaaaacaaaacaaaacaaaacacugc

SEQ ID NO: 280950 - RNA, 64 nt, Homo Sapiens
cucaaaaacaaaacaaaacaaaacaaaacaaaacaaaacaaaacaaaacaaaacacugccaaac

SEQ ID NO: 280951 - RNA, 64 nt, Homo Sapiens
aaacaaaacaaaacaaaacaaaacaaaacaaaacaaaacaaaacaaaacacugccaaacuguuu

SEQ ID NO: 280952 - RNA, 64 nt, Homo Sapiens
aacaaaacaaaacaaaacaaaaacaaaacaaaacaaaacaaaacacugccaaacuguuuccaaa

SEQ ID NO: 280953 - RNA, 64 nt, Homo Sapiens
ccacacacaccaucuuuccaucccaggcuuuugaaaaacaaacagaaacccguguaucugggau

SEQ ID NO: 280954 - RNA, 64 nt, Homo Sapiens
ugaccgagggaggcucugucucaaaagcaaagcaaaaacaaaaacaaaaacaccuaaaaaaccu

SEQ ID NO: 280955 - RNA, 64 nt, Homo Sapiens
agggaggcucugucucaaaagcaaagcaaaaacaaaaacaaaaacaccuaaaaaaccugcaguu

SEQ ID NO: 280956 - RNA, 64 nt, Homo Sapiens
ugauuccccaaaucugcauccuuuucaaaaccuaaaaacaaaaagaaaaacaaauaaaacaaaa

SEQ ID NO: 280957 - RNA, 64 nt, Homo Sapiens
ucugcauccuuuucaaaaccuaaaaacaaaaagaaaaacaaauaaaacaaaaccaacucagacc

SEQ ID NO: 280958 - RNA, 64 nt, Homo Sapiens
uuuucaaaaccuaaaaacaaaaagaaaaacaaauaaaacaaaaccaacucagaccagaacuguu

SEQ ID NO: 280959 - RNA, 64 nt, Homo Sapiens
ucaauaaaugugauuuaucacauacacagaacuaaaaacaaaaaccacaugaccaugaucaucu

SEQ ID NO: 280960 - RNA, 64 nt, Homo Sapiens
acuuaaugaugaacaccccaaagcaauugcaacaaaaacaaaaauugacaagugggaccuaauu

SEQ ID NO: 280961 - RNA, 64 nt, Homo Sapiens
agaaaaaaaaaagguuuuacgucacaaaagcaauaaaacaaacugaaaauccacaaauuccaau

SEQ ID NO: 280962 - RNA, 64 nt, Homo Sapiens
uuauauauagauauauauaucucuuuccuccuuaaaaacaaaaucacuuuuuagauuuuuuuuu

SEQ ID NO: 280963 - RNA, 64 nt, Homo Sapiens
aaaaccaccaaauccccaaaugaugcaaaaaacaaaaacaaaaacccuaaacccaagcacccaa

SEQ ID NO: 280964 - RNA, 64 nt, Homo Sapiens
caaaaaaaaaccaccaaaucacccaaugaugcaaaaaacaaaaaacccuucccuaaacccaagc

SEQ ID NO: 280965 - RNA, 64 nt, Homo Sapiens
caaagcugauuggaaacaauuguaaauugcagagaaaacaaaacauagauagaugguguuugca

SEQ ID NO: 280966 - RNA, 64 nt, Homo Sapiens
agggcuuggcuggucaaaggaagggaauguacguaaaacaaaaugcuugcuuugauuuuuagug

SEQ ID NO: 280967 - RNA, 64 nt, Homo Sapiens
guuuuaaaaaaauuguugaggaacguuucagaaaaaaacaaaaacaaaaggcucauaacaacaa

SEQ ID NO: 280968 - RNA, 64 nt, Homo Sapiens
gcucauaacaacaagaacgucauuuaacgagaacaaaacaaaagaaccaauuuugggucgagug

SEQ ID NO: 280969 - RNA, 64 nt, Homo Sapiens
cuagaugcaacagcgaaacacaauccagagacagaaaacaaaaugccgccagagcagcuuuuua

SEQ ID NO: 280970 - RNA, 64 nt, Homo Sapiens
uuagccaggcaugguggcacaccccaucucuacuaaaacaaaaaacccuggccaacauggugaa

SEQ ID NO: 280971 - RNA, 64 nt, Homo Sapiens
caaguucccacuggugaugcucaaaaaaaaaaacaaaacaaaacuaacagagcgagacuccauc

SEQ ID NO: 280972 - RNA, 64 nt, Homo Sapiens
aaaaccaaguucccacugguccaucucaaaaaaaaaaacaaaaccuggguaacagagcgagacu

SEQ ID NO: 280973 - RNA, 64 nt, Homo Sapiens
uccccggccaggcacagugguuuguaaacguuuaaaaacaaaguaugcaucgaaaaucuuuuug

SEQ ID NO: 280974 - RNA, 64 nt, Homo Sapiens
aaacuacacacugcacauccguguuauggaaauaaaaacaaauaggcccuucgcuuccucucuu

SEQ ID NO: 280975 - RNA, 64 nt, Homo Sapiens
cgggacgguugaaagccuucccaaaauugccuucaaaacaaaccggguuuccuugggcgcggcc

SEQ ID NO: 280976 - RNA, 64 nt, Homo Sapiens
aaaaaaaaaaaaaacccacaacaaaaaaaaaccaaaaacaaaccgaaccagaggugaaaaacaa

SEQ ID NO: 280977 - RNA, 64 nt, Homo Sapiens
aaaaaaaaccaaaaacaaacggaaccagaggugaaaaacaaacacagaaaccagcugccccaaa

SEQ ID NO: 280978 - RNA, 64 nt, Homo Sapiens
accacacacacauuuuguacaaaacaaaaaacaaaaaacaaaaaugcccccuuuuucuuguuaa

SEQ ID NO: 280979 - RNA, 64 nt, Homo Sapiens
acaaaaaaccacacacacauuuguuaaaaaacaaaaaacaaaaauggcuuuugcccccuuuuuc

SEQ ID NO: 280980 - RNA, 64 nt, Homo Sapiens
acaaaaaacaaaaaaccacacuuuuucuuguuaaaaaacaaaaaccauuccuggcuuuugcccc

SEQ ID NO: 280981 - RNA, 64 nt, Homo Sapiens
ucucgugaugauucauuucaagugauucaacuuuaaaacaaauuaacaguuguuagauguucuc

SEQ ID NO: 280982 - RNA, 64 nt, Homo Sapiens
uuggcuguuaaugucugcccgacucucucucaaaaaaacaaaaccagccugggcagcagaguga

SEQ ID NO: 280983 - RNA, 64 nt, Homo Sapiens
aacaagcaaaaaaccacaauagaaaaagcaaaacaaaacaaacaacagagcgagacuccaacuc

SEQ ID NO: 280984 - RNA, 64 nt, Homo Sapiens
aaacaaacaagcaaaaaaccaacucagaaaaagcaaaacaaaacgggcaacagagcgagacucc

SEQ ID NO: 280985 - RNA, 64 nt, Homo Sapiens
aaaaaccggauagaauaaugaacaacaacaaaacaaaacaaaaaacagcaaguucuuguuucca

SEQ ID NO: 280986 - RNA, 64 nt, Homo Sapiens
aaaaaaaaaaccggauagaauuccaaacaacaacaaaacaaaacgcgacacagcaaguucuugu

SEQ ID NO: 280987 - RNA, 64 nt, Homo Sapiens
aaaugaaaaggacuguaggagccucuauuauaaaaaaacaaaauacaacauauagcaagacucu

SEQ ID NO: 280988 - RNA, 64 nt, Homo Sapiens
gaaaacuguucuugggacugucucaacugugcaaaaaacaaaagauggaguguuuacaaguaga

SEQ ID NO: 280989 - RNA, 64 nt, Homo Sapiens
uagugacugagauguaaaaauagauuuuagaauuaaaacaaaauccaaguccucacaccccugu

SEQ ID NO: 280990 - RNA, 64 nt, Homo Sapiens
ugugaugccuuaggacauguuugaacugcagcaaaaaacaaaaacaaaaaacagugcauuagca

SEQ ID NO: 280991 - RNA, 64 nt, Homo Sapiens
gccuuaggacauguuugaacugcagcaaaaaacaaaaacaaaaaacagugcauuagcaauuuca

SEQ ID NO: 280992 - RNA, 64 nt, Homo Sapiens
uuuuuuuuuuuuuacugcauguuacauugaaauaaaaacaaaguaaaaugagcaauugccuuau

SEQ ID NO: 280993 - RNA, 64 nt, Homo Sapiens
gccugggcaacauagcaagacccugucucuuaaaaaaacaaaaagacauauucagguacugauu

SEQ ID NO: 280994 - RNA, 64 nt, Homo Sapiens
ugggcaacauagcgagaccucaucuccaaaaaagaaaacaaaaaacaaaaaaaggaaugauguu

SEQ ID NO: 280995 - RNA, 64 nt, Homo Sapiens
cauagcgagaccucaucuccaaaaaagaaaacaaaaaacaaaaaaaggaaugauguucuguaga

SEQ ID NO: 280996 - RNA, 64 nt, Homo Sapiens
ugaaaugagaaaagaaaaauuuaugcacugauuuaaaacaaaccaaaaaaaaagaaaaaaacaa

SEQ ID NO: 280997 - RNA, 64 nt, Homo Sapiens
ugcacugauuuaaaacaaaccaaaaaaaaagaaaaaaacaaaaaaaaaaaucccuccuuucuag

SEQ ID NO: 280998 - RNA, 64 nt, Homo Sapiens
ggcuggucugucuuuucuccauuuguuuaaaaaaaaaacaaaaacaaaaaacaacacuuuggug

SEQ ID NO: 280999 - RNA, 64 nt, Homo Sapiens
ucugucuuuucuccauuuguuuaaaaaaaaaacaaaaacaaaaaacaacacuuugguguggugg

SEQ ID NO: 281000 - RNA, 64 nt, Homo Sapiens
uaaaugcuacuguuccaaaggacaaaaaaaaaaaaaaacaaaccccaaagaaauaaacaagugu

SEQ ID NO: 281001 - RNA, 64 nt, Homo Sapiens
aaccaacuuuguuuuaaccacugacauuuccaugaaaacaaaggccuuagcuuuucauaguugu

SEQ ID NO: 281002 - RNA, 64 nt, Homo Sapiens
uuuuuuuagaagaugaauuugaauggguaaaaacaaaacaaaacgucuaauuuuuuuuccuguu

SEQ ID NO: 281003 - RNA, 64 nt, Homo Sapiens
aaaacuuuuuuuagaagaugcuguugaauggguaaaaacaaaacugugugucuaauuuuuuuuc

SEQ ID NO: 281004 - RNA, 64 nt, Homo Sapiens
aucuauuuuggcagaaauuguguaaguauccuuaaaaacaaagccagacugaucuaaugugaaa

SEQ ID NO: 281005 - RNA, 64 nt, Homo Sapiens
cagcaucuguuacuggaacauuaaaaaaaaaaacaaaacaaaacugacagagcgagacccuguc

SEQ ID NO: 281006 - RNA, 64 nt, Homo Sapiens
aaaaccagcaucuguuacugcugucuuaaaaaaaaaaacaaaaccugggugacagagcgagacc

SEQ ID NO: 281007 - RNA, 64 nt, Homo Sapiens
ggagaauggguuccuguggagaaaaauggugaagaaaacaaagaugaugauaauguuuucagca

SEQ ID NO: 281008 - RNA, 64 nt, Homo Sapiens
aaaaugggcuggagagaaggagaaggauuaggaaaaaacaaagaaggcaauaaggaacccaucc

SEQ ID NO: 281009 - RNA, 64 nt, Homo Sapiens
ccagucuggucggcaagagugagacuccgucucaaaaacaaaacaaaacaaaaaaaccacauaa

SEQ ID NO: 281010 - RNA, 64 nt, Homo Sapiens
cuggucggcaagagugagacuccgucucaaaaacaaaacaaaacaaaaaaaccacauaacauaa

SEQ ID NO: 281011 - RNA, 64 nt, Homo Sapiens
cggcaagagugagacuccgucucaaaaacaaaacaaaacaaaaaaaccacauaacauaaauuua

SEQ ID NO: 281012 - RNA, 64 nt, Homo Sapiens
acuaugugaugccucuauuugagacuguaaaacaaaaacaaaaauaugacuuuccucagaacau

SEQ ID NO: 281013 - RNA, 64 nt, Homo Sapiens
caaaaaacuaugugaugccugaacaugagacuguaaaacaaaaaaugacuuaugacuuuccuca

SEQ ID NO: 281014 - RNA, 64 nt, Homo Sapiens
aacaaaaaacacaaaaaaaaauuauuuuucucaaaaaacaaacagaaaugaggcuucaauuaga

SEQ ID NO: 281015 - RNA, 64 nt, Homo Sapiens
aaaauaugcucuugcgcccacccuagucuaugaaaaaacaaaccuuaguagugcagaccuuuac

SEQ ID NO: 281016 - RNA, 64 nt, Homo Sapiens
aauaaaaauaccaucugagggaaaaggggaauauaaaacaaaccucaaaacagaagggcaaaug

SEQ ID NO: 281017 - RNA, 64 nt, Homo Sapiens
cuacuuugguuguguaugucaaugguguaugugaaaaacaaaaacugcacuugaaguucaacuu

SEQ ID NO: 281018 - RNA, 64 nt, Homo Sapiens
cuuuuuagggcaauagaggaugcugccaguagccaaaacaaagucauacauggauuuugccaag

SEQ ID NO: 281019 - RNA, 64 nt, Homo Sapiens
cugagucuccagccaggaggcgucauuuaaagggaaaacaaaauuggguuucuuccaaccaucu

SEQ ID NO: 281020 - RNA, 64 nt, Homo Sapiens
uucuucgugauaauauaaucucuauuuuuuuaggaaaacaaaaaugaaaaacuacuccauuuga

SEQ ID NO: 281021 - RNA, 64 nt, Homo Sapiens
gagacaaacauuauaaaaaucugauggcaaaagcaaaacaaaauggaaaguaggggagguggau

SEQ ID NO: 281022 - RNA, 64 nt, Homo Sapiens
caguguucugcauuccacauguaagugaauugcaaaaacaaaacaaaacucacucucuuguagg

SEQ ID NO: 281023 - RNA, 64 nt, Homo Sapiens
uucugcauuccacauguaagugaauugcaaaaacaaaacaaaacucacucucuuguagguuuau

SEQ ID NO: 281024 - RNA, 64 nt, Homo Sapiens
aacaacuguucuuugccuaaaaaaaaaaaacaaaaaaacaaaaauccuuaaaggaaauguuaaa

SEQ ID NO: 281025 - RNA, 64 nt, Homo Sapiens
aacaaaaaaacaacuguucuauguuaaaaaaaaaaaaacaaaaaagccaccuuccuuaaaggaa

SEQ ID NO: 281026 - RNA, 64 nt, Homo Sapiens
caaacaaaccucgucaccacacugccaaaacaaaaaaacaaauacugcuggagaaaagccugga

SEQ ID NO: 281027 - RNA, 64 nt, Homo Sapiens
aacaaauacaaacaaaccucagccuggaacugccaaaacaaaaaagucccuccugcuggagaaa

SEQ ID NO: 281028 - RNA, 64 nt, Homo Sapiens
uuaaaaaaaagcgagagggaauaaacgagggaagaaaacaaacuaacaggaaaugugggaaaau

SEQ ID NO: 281029 - RNA, 64 nt, Homo Sapiens
aacacacacacacaaaaaaaaaacaaaaaaacaaaaaacaaaaagcaaaaacaaaaaacaaaaa

SEQ ID NO: 281030 - RNA, 64 nt, Homo Sapiens
acaaaaaaacacacacacacacaaaaaaaacaaaaaaacaaaaauccaaaagcaaaaacaaaaa

SEQ ID NO: 281031 - RNA, 64 nt, Homo Sapiens
aacaaaaaacaaaaaaacacaacaaaaaacaaaaaaaacaaaaaggagaccuuccaaaagcaaa

SEQ ID NO: 281032 - RNA, 64 nt, Homo Sapiens
aaacaaaaaaacaaaaaacaaaaagcaaaaacaaaaaacaaaaaccuccgcugggagaccuucc

SEQ ID NO: 281033 - RNA, 64 nt, Homo Sapiens
acaaaaaaaacaaaaaaacaaccuuccaaaagcaaaaacaaaaacccagacccuccgcugggag

SEQ ID NO: 281034 - RNA, 64 nt, Homo Sapiens
gauugaucaaaucuguacaguuuaguuuaaaaacaaaacaaaaaacauugguguguuuagagau

SEQ ID NO: 281035 - RNA, 64 nt, Homo Sapiens
aaaaagauugaucaaaucuggagauuuuaguuuaaaaacaaaacaugggacauugguguguuua

SEQ ID NO: 281036 - RNA, 64 nt, Homo Sapiens
uuaaaaaaaaaagaggagaaauauuuuuucaggaaaaacaaacucuuaaaaagaugagagaaac

SEQ ID NO: 281037 - RNA, 64 nt, Homo Sapiens
aaaucaaaaaaucaaaaaaaauuuaaaaaaacaaaaaacaaaaagcuguuucacaaacaguuuu

SEQ ID NO: 281038 - RNA, 64 nt, Homo Sapiens
acaaaaaaaaucaaaaaauccaguuuuauuuaaaaaaacaaaaauaaaauagcuguuucacaaa

SEQ ID NO: 281039 - RNA, 64 nt, Homo Sapiens
guuucaaucuguccaucuaccaggccucgcgauaaaaacaaaacaaaaaaacgcugccagguuu

SEQ ID NO: 281040 - RNA, 64 nt, Homo Sapiens
aaucuguccaucuaccaggccucgcgauaaaaacaaaacaaaaaaacgcugccagguuuuagaa

SEQ ID NO: 281041 - RNA, 64 nt, Homo Sapiens
uuuggaaaggcggggaagaaggaugaaaccuuuaaaaacaaaaacaaaaacaucaaugaguagg

SEQ ID NO: 281042 - RNA, 64 nt, Homo Sapiens
aaggcggggaagaaggaugaaaccuuuaaaaacaaaaacaaaaacaucaaugaguaggcauuuu

SEQ ID NO: 281043 - RNA, 64 nt, Homo Sapiens
uauauauauaaauauaaauauauauaaaaacaacaaaacaaaacaaaaaaagaaaaaaaaacaa

SEQ ID NO: 281044 - RNA, 64 nt, Homo Sapiens
auauaaauauaaauauauauaaaaacaacaaaacaaaacaaaaaaagaaaaaaaaacaaaaaac

SEQ ID NO: 281045 - RNA, 64 nt, Homo Sapiens
cuuuggcuaaaucugacaauuuuauauauagcuuaaaacaaagaauauacauucuuuucacccc

SEQ ID NO: 281046 - RNA, 64 nt, Homo Sapiens
auauauauuaaaagugguuguauucauuuagugaaaaacaaaaaguagauguacuucuguaaau

SEQ ID NO: 281047 - RNA, 64 nt, Homo Sapiens
uccugaugccaaagaauaugaaaauauuuaaguaaaaacaaaaugaugcauuuugagaagaaca

SEQ ID NO: 281048 - RNA, 64 nt, Homo Sapiens
uuuaaaaucuuaaauguguaagucacccccaccaaaaacaaaagagaagaaaaagaauagaaag

SEQ ID NO: 281049 - RNA, 64 nt, Homo Sapiens
uuguuguugauaaugggcuuuguuagcacuuuuuaaaacaaacaaacaaacaaaacaaaaaagc

SEQ ID NO: 281050 - RNA, 64 nt, Homo Sapiens
cuuuguuagcacuuuuuaaaacaaacaaacaaacaaaacaaaaaagcaaaccacauuuguuauc

SEQ ID NO: 281051 - RNA, 64 nt, Homo Sapiens
uccaaccugggugacagagugagauuccaucugaaaaacaaaaacaaaaacagaaaacaaacaa

SEQ ID NO: 281052 - RNA, 64 nt, Homo Sapiens
cugggugacagagugagauuccaucugaaaaacaaaaacaaaaacagaaaacaaacaaacaaaa

SEQ ID NO: 281053 - RNA, 64 nt, Homo Sapiens
ugagauuccaucugaaaaacaaaaacaaaaacagaaaacaaacaaacaaaaaacaaaaaauccc

SEQ ID NO: 281054 - RNA, 64 nt, Homo Sapiens
aaaacaaaaacaaaaacagaaaacaaacaaacaaaaaacaaaaaauccccacaacuuugucaaa

SEQ ID NO: 281055 - RNA, 64 nt, Homo Sapiens
gcaaucaugacugagccaaucacuguuucucagaaaaacaaaacaaaacaaaacaaaugacagu

SEQ ID NO: 281056 - RNA, 64 nt, Homo Sapiens
caugacugagccaaucacuguuucucagaaaaacaaaacaaaacaaaacaaaugacaguaaccc

SEQ ID NO: 281057 - RNA, 64 nt, Homo Sapiens
cugagccaaucacuguuucucagaaaaacaaaacaaaacaaaacaaaugacaguaacccuuccc

SEQ ID NO: 281058 - RNA, 64 nt, Homo Sapiens
ccaaucacuguuucucagaaaaacaaaacaaaacaaaacaaaugacaguaacccuuccccggaa

SEQ ID NO: 281059 - RNA, 64 nt, Homo Sapiens
cuaaugucaaacuugagucacaaagaacauguagaaaacaaaauggauaaaaucugauauguau

SEQ ID NO: 281060 - RNA, 64 nt, Homo Sapiens
ucuagccugggugacagagcaagacucugucuaaaaaacaaaacaaaacaaaacaaaacaaaaa

SEQ ID NO: 281061 - RNA, 64 nt, Homo Sapiens
ccugggugacagagcaagacucugucuaaaaaacaaaacaaaacaaaacaaaacaaaaaaaccu

SEQ ID NO: 281062 - RNA, 64 nt, Homo Sapiens
gugacagagcaagacucugucuaaaaaacaaaacaaaacaaaacaaaacaaaaaaaccucuuaa

SEQ ID NO: 281063 - RNA, 64 nt, Homo Sapiens
agagcaagacucugucuaaaaaacaaaacaaaacaaaacaaaacaaaaaaaccucuuaauauuc

SEQ ID NO: 281064 - RNA, 64 nt, Homo Sapiens
aagacucugucuaaaaaacaaaacaaaacaaaacaaaacaaaaaaaccucuuaauauucuggag

SEQ ID NO: 281065 - RNA, 64 nt, Homo Sapiens
ucgauuauuucaugcuuuuuuuuaaaaaaaaaaaaaaacaaaauaacaaucugaagaggcauuu

SEQ ID NO: 281066 - RNA, 64 nt, Homo Sapiens
cauuuugcgaggcuuaggcagcuagacaucguuuaaaacaaaauauuaacuuauauuacaugug

SEQ ID NO: 281067 - RNA, 64 nt, Homo Sapiens
ccuuaaaaaacucagccaacagguaguauugguaaaaacaaacaaacaaaaauccuuugcccuc

SEQ ID NO: 281068 - RNA, 64 nt, Homo Sapiens
auugaugaagcagaugaguuuguagcagggccacaaaacaaagugaaacguccaggggaaccca

SEQ ID NO: 281069 - RNA, 64 nt, Homo Sapiens
gauguugauuuugaccuguucaugauucagaagaaaaacaaacuuuuuuggauuuuuuuucccu

SEQ ID NO: 281070 - RNA, 64 nt, Homo Sapiens
cuaaucuguguacacaucuccaagcaaggaagaaaaaacaaacucugcucagacgccuaugaaa

SEQ ID NO: 281071 - RNA, 64 nt, Homo Sapiens
uaccuguuccaccaaaaccuauggaaauuuaaaaaaaacaaaaauaaaaagcaaaacaaaaauc

SEQ ID NO: 281072 - RNA, 64 nt, Homo Sapiens
cuauggaaauuuaaaaaaaacaaaaauaaaaagcaaaacaaaaaucccaaaaugaauuccauuc

SEQ ID NO: 281073 - RNA, 64 nt, Homo Sapiens
cauuuuuuaaauccccucuguuuaaaagguuuguaaaacaaaaacaaaaaacuaagucugcuca

SEQ ID NO: 281074 - RNA, 64 nt, Homo Sapiens
uuaaauccccucuguuuaaaagguuuguaaaacaaaaacaaaaaacuaagucugcucagugaaa

SEQ ID NO: 281075 - RNA, 64 nt, Homo Sapiens
gaacuuuuaaaaaaaaaaucauauucacaaagagaaaacaaaaguauguauaaucauauaugau

SEQ ID NO: 281076 - RNA, 64 nt, Homo Sapiens
gaacccaaaccagauggcaaagccagccuuaggaaaaacaaacaagaauaagguuccauugcgu

SEQ ID NO: 281077 - RNA, 64 nt, Homo Sapiens
cacacacacacacauacacaaaaccccuaaaaacaaaacaaacauaaaaaaaaguuguuuauaa

SEQ ID NO: 281078 - RNA, 64 nt, Homo Sapiens
aaacacacacacacacacauuauaaaaaccccuaaaaacaaaaccuuuauaaaaaaaaguuguu

SEQ ID NO: 281079 - RNA, 64 nt, Homo Sapiens
agugacacucacuuguguguacuaggucaaaaacaaaacaaaacaggaagcaauauuuaauaaa

SEQ ID NO: 281080 - RNA, 64 nt, Homo Sapiens
aaaacagugacacucacuugauaaaacuaggucaaaaacaaaacccccaaggaagcaauauuua

SEQ ID NO: 281081 - RNA, 64 nt, Homo Sapiens
aaccuuaaaugucaaaaaaauuaaaaaaaaaacaaaaacaaaaaugguaaaacuccgacucuau

SEQ ID NO: 281082 - RNA, 64 nt, Homo Sapiens
caaaaaaaccuuaaaugucacucuauuuaaaaaaaaaacaaaaagaaaugugguaaaacuccga

SEQ ID NO: 281083 - RNA, 64 nt, Homo Sapiens
cugaagcaugaagauuccugaggcaagaaacagcaaaacaaauacaguaugcaugaagacauga

SEQ ID NO: 281084 - RNA, 64 nt, Homo Sapiens
aaauuugucuguuuucaaccaagacauaacuaucaaaacaaaauauucuucuaauacauauuaa

SEQ ID NO: 281085 - RNA, 64 nt, Homo Sapiens
gugguccacuugaagcagcagcccuaucauauuaaaaacaaaaauuagcugacuuuucccugua

SEQ ID NO: 281086 - RNA, 64 nt, Homo Sapiens
gcaaacaacugagacagcaauaaaacuacagacaaaaacaaaguucuuuuucuuaaaaaaauaa

SEQ ID NO: 281087 - RNA, 64 nt, Homo Sapiens
agcuuuaaaaaaauaauuggauuucacaugagucaaaacaaagcuaagaauguaggccuuaacu

SEQ ID NO: 281088 - RNA, 64 nt, Homo Sapiens
aacaaacaaaacuugcaucuaaacaaaacaaaacaaaacaaacaaaaaacgaaacuccaucuca

SEQ ID NO: 281089 - RNA, 64 nt, Homo Sapiens
aaacaaacaaacaaaacuugucucaaaacaaaacaaaacaaaacgcgacaaaaacgaaacucca

SEQ ID NO: 281090 - RNA, 64 nt, Homo Sapiens
aaaacaaacaaacaaacaaacuccaucucaaaacaaaacaaaacccugggcgacaaaaacgaaa

SEQ ID NO: 281091 - RNA, 64 nt, Homo Sapiens
aaaacaaaacaaacaaacaacgaaacuccaucucaaaacaaaacuccagccugggcgacaaaaa

SEQ ID NO: 281092 - RNA, 64 nt, Homo Sapiens
acaaagaaugugauagcucaaguaaaaacaaaaaaaaacaaaugauggauugcuaguguuggug

SEQ ID NO: 281093 - RNA, 64 nt, Homo Sapiens
aaaacaaaugacaaagaaugaguguuggugaguaaaaacaaaaaggaaaacagaauggauugcu

SEQ ID NO: 281094 - RNA, 64 nt, Homo Sapiens
uaacugcuuaaauguuuuguaaacaaaacaaaacaaaacaaaaucacaauuguucuucaaaaac

SEQ ID NO: 281095 - RNA, 64 nt, Homo Sapiens
aaaauuaacugcuuaaauguaaaacaaacaaaacaaaacaaaacaagaccacaauuguucuuca

SEQ ID NO: 281096 - RNA, 64 nt, Homo Sapiens
aaaacaaaauuaacugcuuacuucaaaaacaaacaaaacaaaacuguaaaagaccacaauuguu

SEQ ID NO: 281097 - RNA, 64 nt, Homo Sapiens
aaacaaaacaaaacaaaauuacaauuguucuucaaaaacaaacaccaagaaaauguaaaagacc

SEQ ID NO: 281098 - RNA, 64 nt, Homo Sapiens
agcacucagcccagcuccucuaguacuuaaaaacaaaacaaacagaugugugcauuuggacaaa

SEQ ID NO: 281099 - RNA, 64 nt, Homo Sapiens
aaacaagcacucagcccagcacaaauaguacuuaaaaacaaaacccacagaugugugcauuugg

SEQ ID NO: 281100 - RNA, 64 nt, Homo Sapiens
caucuacagauauuuucagggauugcuucagaugaaaacaaaucacacaccguuucccaaacca

SEQ ID NO: 281101 - RNA, 64 nt, Homo Sapiens
cuguuauugucggcaggcggugagggguagaaaaaaaacaaacaaacaaacagaaaaaaaaacc

SEQ ID NO: 281102 - RNA, 64 nt, Homo Sapiens
uggguggcucacggguccggcuccgucucaaaacaaaacaaaaggccuggaggccagagugaga

SEQ ID NO: 281103 - RNA, 64 nt, Homo Sapiens
aaaaguggguggcucacgggugagacuccgucucaaaacaaaaccuccagccuggaggccagag

SEQ ID NO: 281104 - RNA, 64 nt, Homo Sapiens
gccuguguaaacaugucuuauaccauuccauauacuuacuaaaagaaaguauuaaagcucacuu

SEQ ID NO: 281105 - RNA, 64 nt, Homo Sapiens
aucuaccaguaaacaaacauuucuuuaccugaaacuuacuaagauaacauauguuuuaugcacc

SEQ ID NO: 281106 - RNA, 64 nt, Homo Sapiens
ggaauguggcaaagguuuuagccaacucucaaaccuuacuaaacacaagaagauucauacuaga

SEQ ID NO: 281107 - RNA, 64 nt, Homo Sapiens
agaaugugguaaugcuuuuaaccaauucucaaaucuuacuaaacaaaauuaauacugaaaaugu

SEQ ID NO: 281108 - RNA, 64 nt, Homo Sapiens
gaaaagagguuuguguucacuauuaaaaguaaaacuuacuaaaauuuuauuuucuuucacucug

SEQ ID NO: 281109 - RNA, 64 nt, Homo Sapiens
aaagaguuguauauaauauuaagccagugucuagcuuacuaaaaccccacucccacaaacucug

SEQ ID NO: 281110 - RNA, 64 nt, Homo Sapiens
aggcaccugcuuuuucuuuucucucauuguccaccuuacuaaaagucaguagaaucuucuaccu

SEQ ID NO: 281111 - RNA, 64 nt, Homo Sapiens
ccuuccaaaggcagcucagaagauuagaaccagacuuacuaaccaauuccaccccccaccaacc

SEQ ID NO: 281112 - RNA, 64 nt, Homo Sapiens
agaauguggcaaaggccuuuacugcuccuauucccuuacuaaagaauguggcaaagcuuuucac

SEQ ID NO: 281113 - RNA, 64 nt, Homo Sapiens
agaauguggcaaagauuucuauugauucucauaccuuacuaaauauaagauaauucauauugga

SEQ ID NO: 281114 - RNA, 64 nt, Homo Sapiens
agaauguggcaaaggcuuuaauuaguucucaucccuuacuaaacauaagagaauucauaccaua

SEQ ID NO: 281115 - RNA, 64 nt, Homo Sapiens
ggaaugucucaaagcuuuuuacugauucuuauaccuuacuaaacauaaaauaauucauaaagga

SEQ ID NO: 281116 - RNA, 64 nt, Homo Sapiens
aaaauguggcaaagcuuuuaaccaauuuucaaaccuuacuaaacauaagauaacucauacugga

SEQ ID NO: 281117 - RNA, 64 nt, Homo Sapiens
agacugugaaaaagacgucaauaucugcucacaucuuacuaaacaccagagaguucaugcuuaa

SEQ ID NO: 281118 - RNA, 64 nt, Homo Sapiens
agaaugugucaaagcuuuuaacuguuccucaauccuuacuaaacauaagggaauucauaauaga

SEQ ID NO: 281119 - RNA, 64 nt, Homo Sapiens
ugaauguggcauagccucuucccaguucucaacucuuacuaaacaugagaacacauguggaaga

SEQ ID NO: 281120 - RNA, 64 nt, Homo Sapiens
uucaauuaagguacuucucccucagggacguagaacaauggaaugucagucagucucuguaguu

SEQ ID NO: 281121 - RNA, 64 nt, Homo Sapiens; identical to SEQ ID NO: 281120

SEQ ID NO: 281122 - RNA, 64 nt, Homo Sapiens
guguuuaugguuucaggaaacuuucacauuccagacaauggagauacaggguuauaggccucuc

SEQ ID NO: 281123 - RNA, 64 nt, Homo Sapiens
cuuuuucaguuuuauaaaggcuggucuacuuaggacaauggagacauaagaauguuaucagaau

SEQ ID NO: 281124 - RNA, 64 nt, Homo Sapiens
agcccuggccccuccacugcuucucuccccauccacaauggagaaggugaaaagaggagggaaa

SEQ ID NO: 281125 - RNA, 64 nt, Homo Sapiens
auuaagggaaaauggugucauuuguugcagaaaaacaauggauacauuuucuucuggccuaaau

SEQ ID NO: 281126 - RNA, 64 nt, Homo Sapiens
gaaaaagugacuucauauacaauaugaguuuuguacaauggaauagcuauuagauuuuucucaa

SEQ ID NO: 281127 - RNA, 64 nt, Homo Sapiens
uaacauucauugacauuucuuuuuaaaugauuauacaauggaaacacccagcucuguaggugac

SEQ ID NO: 281128 - RNA, 64 nt, Homo Sapiens
gcucuccuuaagugaagaaaucuuucugugccacacaauggaugacaauggaaguuuaaacauu

SEQ ID NO: 281129 - RNA, 64 nt, Homo Sapiens
uuuaaacauuucuuucuguggauauuuuuuaauuacaauggaagaaacucagccaaggacacuu

SEQ ID NO: 281130 - RNA, 64 nt, Homo Sapiens
aagcucagccagggacacuuaauauuuuuuaauuacaauggaaauuuaaacauuuuuauguggg

SEQ ID NO: 281131 - RNA, 64 nt, Homo Sapiens
acaauggaaauuuaaacauuuuuaugugggcuacacaauggauggcucuucuuaagugaagaaa

SEQ ID NO: 281132 - RNA, 64 nt, Homo Sapiens
gugcugcuucauaacaaaaaugaaaagcugcaugcaucuacagcaggcauggauuguuuauguc

SEQ ID NO: 281133 - RNA, 64 nt, Homo Sapiens
gggaauuuuuuuccugaaguaauaauuuauuccacaucuacaucagugaaagcuaucuaccuau

SEQ ID NO: 281134 - RNA, 64 nt, Homo Sapiens
augcacguguucuggauguaauuauguacucuuucaucuacauaaauuuuaacuuuuaagugcu

SEQ ID NO: 281135 - RNA, 64 nt, Homo Sapiens
gaaggcuaaugucauucuucauguaaaaaagaugcaucuacaaacaaaacacacgaagcauaau

SEQ ID NO: 281136 - RNA, 64 nt, Homo Sapiens
gcuggaaggucuuugacggcaccaucuggaaggacaucuacaaucaggagugguggaaccucag

SEQ ID NO: 281137 - RNA, 64 nt, Homo Sapiens
ccucgggccacauggguccacugcaccagugugacaucuacaacuccaagauugccgggaagcu

SEQ ID NO: 281138 - RNA, 64 nt, Homo Sapiens
cccaagcacacacacauggucaaccaucuacacacaucuacacccagcuugggcccugcaaaca

SEQ ID NO: 281139 - RNA, 64 nt, Homo Sapiens
caucuacacccccaagcacaccugcaaacacaaccaucuacacauguaugugaacagcuugggc

SEQ ID NO: 281140 - RNA, 64 nt, Homo Sapiens
ccuacagguuguguacuuuucauaaugguuuccaugaauguaguacguucauacaggcuucauu

SEQ ID NO: 281141 - RNA, 64 nt, Homo Sapiens
cuuacaaaaauggaguauuuuaguaugaauuugcugaauguaagaccguggacuguuuuuuaua

SEQ ID NO: 281142 - RNA, 64 nt, Homo Sapiens
agaaaguggggucaggaggccaagaaagggaauaugaauguauauccaagucacucaggaacuu

SEQ ID NO: 281143 - RNA, 64 nt, Homo Sapiens
cauccucugggaucuucugagguggacagcacuuugaauguagcauuucacuggaacagagucu

SEQ ID NO: 281144 - RNA, 64 nt, Homo Sapiens
ugauucuuggucuauaauugcagauguuauuguaugaauguaccauaauauauuugagcagucc

SEQ ID NO: 281145 - RNA, 64 nt, Homo Sapiens
cguuguuuaggguagaauaggcuguguauuuacaugaauguauaauaucuaugucagcaguauu

SEQ ID NO: 281146 - RNA, 64 nt, Homo Sapiens
accuaccucaaacacacuguuuccacccucuucuugaauguauucaguagccuuuacugaaugu

SEQ ID NO: 281147 - RNA, 64 nt, Homo Sapiens
guuuuaauaugucaguuauugcccuuuuauauugugaauguaaugugcauaagcuauauccgua

SEQ ID NO: 281148 - RNA, 64 nt, Homo Sapiens
uuuguaucucacaauucuggucuagauucaguuaugaauguaggcauuaguuaaaauuaacaag

SEQ ID NO: 281149 - RNA, 64 nt, Homo Sapiens
ugagaaaaacaaugagcugagaggcagacuucccugaauguauugaacuuggaaagaaaugccc

SEQ ID NO: 281150 - RNA, 64 nt, Homo Sapiens
auuuuguuguguuaaaaguacuuuucuugauuuuugaauguauuuguuucagcagaagucauuu

SEQ ID NO: 281151 - RNA, 54 nt, Homo Sapiens; identical to SEQ ID NO: 227074

SEQ ID NO: 281152 - RNA, 64 nt, Homo Sapiens
cuccuaagagaguuguaaaaauagaggcuuggcuugaauguacauagaugguaccuggcaugga

SEQ ID NO: 281153 - RNA, 64 nt, Homo Sapiens
ggugacuuucauuccaguugcugggacggaaggcugaauguagggucauuuuguaugggauaug

SEQ ID NO: 281154 - RNA, 64 nt, Homo Sapiens
uauagauauaggacaguacuguaucauaccucugugaauguaaaauaucuuguaccugcuuuau

SEQ ID NO: 281155 - RNA, 64 nt, Homo Sapiens
aaguaaucuagaagaauguggauacucuuaggcgugaauguaaaugccuuaauauugaaggucc

SEQ ID NO: 281156 - RNA, 64 nt, Homo Sapiens
aagauuucuuuauuuacaaaugauuacauuuaaaugaauguacauucuucucacugacuuuggu

SEQ ID NO: 281157 - RNA, 64 nt, Homo Sapiens
cccccgucuuauuaaggagcuuuuaaaguuuuucugaauguauagacauuucucggguuccuac

SEQ ID NO: 281158 - RNA, 64 nt, Homo Sapiens
gcaacuguggcuuagcuaauauugcaauguggcuugaauguagguagcauccuuugaugcuucu

SEQ ID NO: 281159 - RNA, 64 nt, Homo Sapiens
cugcuucaugaguagaaauuucaacaacucuuuuugaauguaugaagaguagcaguccccuuug

SEQ ID NO: 281160 - RNA, 64 nt, Homo Sapiens
guuaaagguuuuggcugcuguaagaaugugaauuugaauguauuuugaauuguaagagcaaaag

SEQ ID NO: 281161 - RNA, 64 nt, Homo Sapiens; identical to SEQ ID NO: 117710

SEQ ID NO: 281162 - RNA, 64 nt, Homo Sapiens; identical to SEQ ID NO: 117711

SEQ ID NO: 281163 - RNA, 64 nt, Homo Sapiens
cuaguggaagauaguguucugcuuauaauuaaacugaauguagaguaucucuguauguuaauug

SEQ ID NO: 281164 - RNA, 64 nt, Homo Sapiens
auacugucaauuuuccuuguugucuacuuguaagugaauguaacaugaacuguauuuugcauuu

SEQ ID NO: 281165 - RNA, 64 nt, Homo Sapiens
gacacaucugggaguauuuucacugagugaaggaugaauguaugagcaacaacccucacauaug

SEQ ID NO: 281166 - RNA, 64 nt, Homo Sapiens
gcacuuaguacaguauaugauuaaaaugaggaaaugaauguaaaucauaggguuguugugagga

SEQ ID NO: 281167 - RNA, 64 nt, Homo Sapiens
cuucuguaccaaaacuugaaguggcacucauaguugaauguauaccaauguuugaugggaaaac

SEQ ID NO: 281168 - RNA, 64 nt, Homo Sapiens
gaaugaaaccuucugacacaugucaacuugucauugaauguaaaccuuuucccucucaccuaaa

SEQ ID NO: 281169 - RNA, 64 nt, Homo Sapiens
gagagaaaauguuuugaaaaaaggccuuuaguaaugaauguaauuagcaugauguauuuaaagu

SEQ ID NO: 281170 - RNA, 64 nt, Homo Sapiens
aaggauauauuuaguuugagacaaaaugucuuuuugaauguaucuaacuagcuuauuaaaauuu

SEQ ID NO: 281171 - RNA, 64 nt, Homo Sapiens
cuguagauuuuuaacaaagcguuuagccuuuacuugaauguauaaaauauaguuggcauuggaa

SEQ ID NO: 281172 - RNA, 64 nt, Homo Sapiens
caacauuucaauuugcauucaaauagcaacgagaugaauguaucuaaaggucuacuuuaaucag

SEQ ID NO: 281173 - RNA, 64 nt, Homo Sapiens
uuuauauucucuguauaucuuuucuaaaauaaagugaauguauuuuacucuaugagucuucauu

SEQ ID NO: 281174 - RNA, 64 nt, Homo Sapiens
aaggaauucaacugaaauccuaaugacaauuauuugaauguaacauuagaauaaaaugugcaaa

SEQ ID NO: 281175 - RNA, 64 nt, Homo Sapiens
augacuauuugggaggacacccuaaccaauacauugaauguaugggugguuuagggauuuuggc

SEQ ID NO: 281176 - RNA, 64 nt, Homo Sapiens; identical to SEQ ID NO: 117712

SEQ ID NO: 281177 - RNA, 64 nt, Homo Sapiens; identical to SEQ ID NO: 117713

SEQ ID NO: 281178 - RNA, 64 nt, Homo Sapiens
gaaaggaaauauucagagacaugcccaaauauauugaauguacaagauguauauagauguauau

SEQ ID NO: 281179 - RNA, 64 nt, Homo Sapiens
acgucucuguucugccagaggaagagcccagaucugaauguaaacuauaccuuaccagagcaug

SEQ ID NO: 281180 - RNA, 64 nt, Homo Sapiens
uuuuucuggacaagcuuacacuccuuuacuauguugaauguauugagucaaggaguguaaccuu

SEQ ID NO: 281181 - RNA, 64 nt, Homo Sapiens
ugaaccacuguaauagcauucuggaguuuccucuugaauguacacucccauguccccaagaccu

SEQ ID NO: 281182 - RNA, 64 nt, Homo Sapiens
uaggaacaagggggaaagucgcuuucauuuuccuugaauguacagcagccucuagagccuucuu

SEQ ID NO: 281183 - RNA, 64 nt, Homo Sapiens
uaggcuuuugacaaaaguugggauuugggcaaacugaauguauauacaauugugaaaaccucau

SEQ ID NO: 281184 - RNA, 64 nt, Homo Sapiens
uauguaguguauuaagaagcugguagauaguuauugaauguauuuagcuacacaguaaguagcu

SEQ ID NO: 281185 - RNA, 64 nt, Homo Sapiens
aaucuuagugcuggugcugaaauugcaaacaaacugaauguacaauguaaauggcucacaaguc

SEQ ID NO: 281186 - RNA, 64 nt, Homo Sapiens
uacucagaagaaauaaaaaauuagcuaaagcaauugaauguagauuugcauguuuuuuguuaau

SEQ ID NO: 281187 - RNA, 64 nt, Homo Sapiens
uauuuaaaaggagccucuugaaauguagaaguacugaauguauacagaguuuaaaugaauacau

SEQ ID NO: 281188 - RNA, 64 nt, Homo Sapiens
aacaugaccuccguguaguguguauuuagugucuugaauguaaguuuuugcauugccuucgguu

SEQ ID NO: 281189 - RNA, 64 nt, Homo Sapiens; identical to SEQ ID NO: 117714

SEQ ID NO: 281190 - RNA, 64 nt, Homo Sapiens; identical to SEQ ID NO: 117715

SEQ ID NO: 281191 - RNA, 64 nt, Homo Sapiens
guguaggaaaguacuuaauucuugagagaaacugugaauguaagaaaacaugaacagucacaua

SEQ ID NO: 281192 - RNA, 64 nt, Homo Sapiens
ugggaaaaauauugcuacaauuuuuuuuaaucucugaauguaauuucgauacuguguacauagc

SEQ ID NO: 281193 - RNA, 64 nt, Homo Sapiens
acaugauuuuauucuaugccaacauuugggccucugaauguaucuguuauuugaauuuaaguau

SEQ ID NO: 281194 - RNA, 64 nt, Homo Sapiens
uauauuuauacacauacaauuuauguuuuccuguugaauguauuuuuaugagauuuuaaccaga

SEQ ID NO: 281195 - RNA, 64 nt, Homo Sapiens
uaucugaaagaaguuucuggguuaggagaaguaaugaauguauccauuuguacaugguuuacau

SEQ ID NO: 281196 - RNA, 64 nt, Homo Sapiens
gaacaaucauuaauucuucgauauuucuguagcuugaauguaacugcuuuaagaaagguucuca

SEQ ID NO: 281197 - RNA, 64 nt, Homo Sapiens
agaguacuuuuuaaaauuauuucucacaaagaaaugaauguacaauccaaugaaaacauuuguu

SEQ ID NO: 281198 - RNA, 64 nt, Homo Sapiens
uaaaacaaugaaagagcauuuaucguuugucccuugaauguagaauuuguuuuugauuucauaa

SEQ ID NO: 281199 - RNA, 64 nt, Homo Sapiens
ccaggggugggaaguuuucauuugcaggggggucugaauguaacucaccauguggugugcaagg

SEQ ID NO: 281200 - RNA, 64 nt, Homo Sapiens
caauguauuauuaucacugucagaugagcaugcuugaauguagcaugacugccucuuuuugcuu

SEQ ID NO: 281201 - RNA, 64 nt, Homo Sapiens
agacauccaaucaauaaugaaggaaauuuuuuucugaauguagguuugagugaggggcaccucu

SEQ ID NO: 281202 - RNA, 64 nt, Homo Sapiens
agucccagccagaagaaucucugaaagcauauugugaauguauacaauguaguacaaacaaucu

SEQ ID NO: 281203 - RNA, 64 nt, Homo Sapiens
uuuccuccugucuuagaagaacagaccuaacuagugaauguauuaaugaaaaugcaucuauuuc

SEQ ID NO: 281204 - RNA, 64 nt, Homo Sapiens
accacacagcagaauuucuaauggaaguuuguugugaauguaaaggagggagcauucuuugcuu

SEQ ID NO: 281205 - RNA, 64 nt, Homo Sapiens
aauuuaauguaguaacucacuuuuccauauauuuugaauguauauuucuauuuaugauaccaau

SEQ ID NO: 281206 - RNA, 64 nt, Homo Sapiens
aacuugucuuuuuguuaugcaaaugagauuucuuugaauguauuguucuguuuguguuauuuca

SEQ ID NO: 281207 - RNA, 64 nt, Homo Sapiens
uuauguaauuuagggaggacuggucuguaauuucugaauguauauagaauaauauuuauguuua

SEQ ID NO: 281208 - RNA, 64 nt, Homo Sapiens
gagucauuucguucccugauuauuuauccuugucugaauguauuuauguguauauuuguagauu

SEQ ID NO: 281209 - RNA, 64 nt, Homo Sapiens
ucugaacuauaucuugacaaauauuauucaaacuugaauguaaauauauacaguauguauauuu

SEQ ID NO: 281210 - RNA, 64 nt, Homo Sapiens
auaaagaaaugggugacaggcuuaaccucaccuaugaauguacaguauguggauuugugaaacu

SEQ ID NO: 281211 - RNA, 64 nt, Homo Sapiens; identical to SEQ ID NO: 117716

SEQ ID NO: 281212 - RNA, 64 nt, Homo Sapiens; identical to SEQ ID NO: 117717

SEQ ID NO: 281213 - RNA, 64 nt, Homo Sapiens
cacuguucugauaucucugauugucauguggauuugaauguagcuugacagagggaaugucuaa

SEQ ID NO: 281214 - RNA, 64 nt, Homo Sapiens
aacagaaaagaacaacagcaacaaaaacauugugugaauguauguuuguauguguguauguaua

SEQ ID NO: 281215 - RNA, 64 nt, Homo Sapiens
uuaacuauugauuuuuuuuaaaaaaaauugucuuugaauguauuggaaguagacaugcauuaac

SEQ ID NO: 281216 - RNA, 64 nt, Homo Sapiens
caucaggacaugcgucuucauuuucagccagcacugaauguaucgggcacacacugaaguuggc

SEQ ID NO: 281217 - RNA, 64 nt, Homo Sapiens
uugcguaucccaaggcacuggcgugcccuguugcugaauguaugacuuguccguagggucacac

SEQ ID NO: 281218 - RNA, 64 nt, Homo Sapiens
uuugaacuguuuaacacuuuucauauaacugagaugaauguaauagguauuuacacauacaacu

SEQ ID NO: 281219 - RNA, 64 nt, Homo Sapiens
ccgugaagggagugccucuccugcccugagacagugaauguagucuguucccuaaucccacccc

SEQ ID NO: 281220 - RNA, 64 nt, Homo Sapiens
aacaucauauggucugaaaaaauauaaauuuuguugaauguauuuaaauucacagcaguaagau

SEQ ID NO: 281221 - RNA, 64 nt, Homo Sapiens
auacaauucuguuuuaaucuugauaacucaaaagugaauguauauggagugaauuaaguucacc

SEQ ID NO: 281222 - RNA, 64 nt, Homo Sapiens
uacaaagacucagcuacuucaaggaagauauguaugaauguauauacaguguaguguuuauucu

SEQ ID NO: 281223 - RNA, 64 nt, Homo Sapiens
cagcccacauccauuccagaugggcagcuggcucugaauguagcgaggccucugcaagauucug

SEQ ID NO: 281224 - RNA, 64 nt, Homo Sapiens
aauaaaaguccuuaaaauaaagcaguaucuaucaugaauguagaagacaucaugagaaaauacc

SEQ ID NO: 281225 - RNA, 64 nt, Homo Sapiens
gaaugugggaacgcuuugauagugagaaaccacgugaauguaauaacaugggagaauccauacu

SEQ ID NO: 281226 - RNA, 64 nt, Homo Sapiens; identical to SEQ ID NO: 117718

SEQ ID NO: 281227 - RNA, 64 nt, Homo Sapiens; identical to SEQ ID NO: 117719

SEQ ID NO: 281228 - RNA, 64 nt, Homo Sapiens
ggaagcaaggccuguauugcaaucuuacugguauugaauguaaacccuuccagcuuuucuguag

SEQ ID NO: 281229 - RNA, 64 nt, Homo Sapiens
auuggcauaucauggaaaauaucugaaauuuuaaugaauguauaauaagaauaauucagguagc

SEQ ID NO: 281230 - RNA, 64 nt, Homo Sapiens
acagucuucauuguacuauuaauuccuuauugucugaauguaauugcccugcaaauaaaaagac

SEQ ID NO: 281231 - RNA, 64 nt, Homo Sapiens
uaauuuuaugaauuauuuauaguuuauuuuuuagugaauguauuuuuucauuuuuuuacuuugu

SEQ ID NO: 281232 - RNA, 64 nt, Homo Sapiens
aagacccacacuauugagacaaguaagauccuuuugaauguacaaaaagcaaguuauaucagug

SEQ ID NO: 281233 - RNA, 64 nt, Homo Sapiens
aaaggugaagggacauuacacaaauauuuugcacugaauguaccuaaagguaaaaaaaauuccc

SEQ ID NO: 281234 - RNA, 64 nt, Homo Sapiens
cuagcauacaaggaucucaaacaguagaaccuuaugaauguauaagucaaauggcuucaugaga

SEQ ID NO: 281235 - RNA, 64 nt, Homo Sapiens
guauauaugaugucauuaauauaauccaugauuuugaauguaaagcauuugacacaauauugua

SEQ ID NO: 281236 - RNA, 64 nt, Homo Sapiens
uguuuucauauuuuucaaaauagguuuuuauuguugaauguacaucuaccccagccccucaaaa

SEQ ID NO: 281237 - RNA, 64 nt, Homo Sapiens
aagaucauuuuauuaucuuuaacuguaucuauuuugaauguaaauuuaaaaaaaguaauucucu

SEQ ID NO: 281238 - RNA, 64 nt, Homo Sapiens
uguauaauuacuugauucacacagugagaaaaaaugaauguauuccuguuuuugaagagaagaa

SEQ ID NO: 281239 - RNA, 64 nt, Homo Sapiens
guuuaaggcucuucauccugguuagcaaaaggugugaauguaaugugauggaauuuaaaaguuu

SEQ ID NO: 281240 - RNA, 64 nt, Homo Sapiens
aacuggaauagcuaauuacagucuauuaaaacugugaauguauguagcaauccugcgugugaag

SEQ ID NO: 281241 - RNA, 64 nt, Homo Sapiens; identical to SEQ ID NO: 117720

SEQ ID NO: 281242 - RNA, 64 nt, Homo Sapiens; identical to SEQ ID NO: 117721

SEQ ID NO: 281243 - RNA, 64 nt, Homo Sapiens
gggggaacauuguaaagaaacaaaaagguccagaugaauguaugcuagaaauaaaaguugaaag

SEQ ID NO: 281244 - RNA, 64 nt, Homo Sapiens
aauaaucuuccauuuggcugucgugaggaguaauugaauguaauccaucucuuacaaaauggag

SEQ ID NO: 281245 - RNA, 64 nt, Homo Sapiens
gcugcgcgggcuuauuuauuaacaggauaacccuugaauguagcagccccgggagggcggcaca

SEQ ID NO: 281246 - RNA, 64 nt, Homo Sapiens
cggagggaaauuguaaauccuguguuucauuacuugaauguaguuaucuauugaaaauauauau

SEQ ID NO: 281247 - RNA, 64 nt, Homo Sapiens
aaggguuucaaucaauuauuaaugcagagaguauugaauguaaaucagagcucucuagucuuca

SEQ ID NO: 281248 - RNA, 64 nt, Homo Sapiens
acuuguuuaucuuguugcugcaaugagaaauaaaugaauguauguauuuuggugcagacaccug

SEQ ID NO: 281249 - RNA, 64 nt, Homo Sapiens
cuauacacuaucaaauauauaaagcuuucuauauugaauguacauuauacagaucauucauaug

SEQ ID NO: 281250 - RNA, 64 nt, Homo Sapiens
accaucgccuuccaaagucagcacucuacacucuugaauguaccaaggaucucuuggcgacagu

SEQ ID NO: 281251 - RNA, 64 nt, Homo Sapiens
uaugguauuuauuuucaguaguaaagacccagcuugaauguaaauuuuguauaguguaaguaug

SEQ ID NO: 281252 - RNA, 64 nt, Homo Sapiens
uuccauuuuggcgcuauuacaaauagugcaacuaugaauguacugcauguuaccaucuuacuug

SEQ ID NO: 281253 - RNA, 64 nt, Homo Sapiens
uauucaauauuggucuguguuuaaguuuguuauuugaauguaauuuacauagaggaauauaaua

SEQ ID NO: 281254 - RNA, 64 nt, Homo Sapiens; identical to SEQ ID NO: 117722

SEQ ID NO: 281255 - RNA, 64 nt, Homo Sapiens; identical to SEQ ID NO: 117723

SEQ ID NO: 281256 - RNA, 64 nt, Homo Sapiens; identical to SEQ ID NO: 117724

SEQ ID NO: 281257 - RNA, 64 nt, Homo Sapiens; identical to SEQ ID NO: 117725

SEQ ID NO: 281258 - RNA, 64 nt, Homo Sapiens
uaaugugugguggccucagcuuuuaugaagugcgugaauguauggggucucucccucagguguu

SEQ ID NO: 281259 - RNA, 64 nt, Homo Sapiens
ucauucauauuuccucucacucuguuuuuaaguaugaauguauuaaguuuuggcaguaaaauac

SEQ ID NO: 281260 - RNA, 64 nt, Homo Sapiens
ccacugcaauuagaguauccucucaaaaaaaaaaugaauguaugacagaaggaagggaguccca

SEQ ID NO: 281261 - RNA, 64 nt, Homo Sapiens
auuuuauuugcuucguaauauuguucauauauuaugaauguauuauucuuaauguaugauuucu

SEQ ID NO: 281262 - RNA, 64 nt, Homo Sapiens
agagaaugucuuuguaacugaagaccucuaugaaugaauguaucuuacuauguauuuauacguu

SEQ ID NO: 281263 - RNA, 64 nt, Homo Sapiens
aagcauuuauuugucaauaaagaugggaaaaaccugaauguauauggaaaccaucacuauugag

SEQ ID NO: 281264 - RNA, 64 nt, Homo Sapiens
guuuaauaaagaaauuacaauaaagccuuuacacugaauguaauaucauggugauuaugauggu

SEQ ID NO: 281265 - RNA, 64 nt, Homo Sapiens
ccuaaaugugguuauugaaaucuaaucaguccuaugaauguaucuaaccauuucaccuggacua

SEQ ID NO: 281266 - RNA, 64 nt, Homo Sapiens
uggaauacuuacauauuauaccuaauucauacaaugaauguauuuuucuuauugcuuuuccuuc

SEQ ID NO: 281267 - RNA, 64 nt, Homo Sapiens
uacuagggcaccauaauacuaaacuagcuaaaccugaauguacccuuccugauugcgcagacug

SEQ ID NO: 281268 - RNA, 64 nt, Homo Sapiens
uaaauaaacuguacauagguuauuucacauccuaugaauguaugcuagcuuguuuugacagguu

SEQ ID NO: 281269 - RNA, 64 nt, Homo Sapiens
aauugauuuaaacaucauguucagcguuagaauuugaauguauuugcauuaccuaauaauuacc

SEQ ID NO: 281270 - RNA, 64 nt, Homo Sapiens
caauuguuauguguuuagaaagacaucuuaauccugaauguaaaaaagucguuucaacucuuaa

SEQ ID NO: 281271 - RNA, 64 nt, Homo Sapiens
uuuauauuuugauuaagauuguagauggcaguuaugaauguauauaggaccaaaacagaauauu

SEQ ID NO: 281272 - RNA, 64 nt, Homo Sapiens
ccuuccaacaccugacagaaagcaaaacaacggaugaauguagcgugaggcucccacaggcacc

SEQ ID NO: 281273 - RNA, 64 nt, Homo Sapiens
gacagaaguaagccuggacagauaugauuauuccugaauguacagagaguuguauguaaccagu

SEQ ID NO: 281274 - RNA, 64 nt, Homo Sapiens
ggcuagauguuuacauuuguaagaaauaacacugugaauguaaaacagagccauucccuuggaa

SEQ ID NO: 281275 - RNA, 64 nt, Homo Sapiens
cuccagacguagccauuuccugacaucaagauguugaauguaaucuggucugagcugggccugu

SEQ ID NO: 281276 - RNA, 64 nt, Homo Sapiens
aaaccucaauuuaagucuuuaaaagguuguauuuugaauguaaccaaaaguuuacaguuuuuug

SEQ ID NO: 281277 - RNA, 64 nt, Homo Sapiens
gguuuuaugcugcuuuguuaggacagauguguuuugaauguaccauuauaagaagaauucuaug

SEQ ID NO: 281278 - RNA, 64 nt, Homo Sapiens
caauguggaauuaccaaauuaaaagagaauacuaugaauguauucauauuuuuucuauauugaa

SEQ ID NO: 281279 - RNA, 64 nt, Homo Sapiens
aauggaauauuuucuaaaacauuuaguauacauuugaauguauuuuaaaccaugccaaacuacu

SEQ ID NO: 281280 - RNA, 64 nt, Homo Sapiens
agguaauauuuuuaauaugauacauuacauauugugaauguauacuaaaaaaacauuuuaaaug

SEQ ID NO: 281281 - RNA, 64 nt, Homo Sapiens
aagccuuuuuuuucuuuuuuuuuuuuuuggcaaaugaauguaccauuucaacuuugauuuuaau

SEQ ID NO: 281282 - RNA, 64 nt, Homo Sapiens
gacuuuccucucccaguuuccagacagggcucuuugaauguaugucaaacucaguuacuccaga

SEQ ID NO: 281283 - RNA, 64 nt, Homo Sapiens
uuaucuuuuuguggugugaauaaaucuuuuaucuugaauguaauaagaauuugguggugucaau

SEQ ID NO: 281284 - RNA, 64 nt, Homo Sapiens
acuuucuccaauguggacucugugugucagugaaugaauguaguaaaauucacuuuggaagguu

SEQ ID NO: 281285 - RNA, 64 nt, Homo Sapiens
gugauaauuuugcuuuguguuacuuuuuugcucuugaauguaucguuaugauggucucuuauaa

SEQ ID NO: 281286 - RNA, 64 nt, Homo Sapiens
auuucauugagggcaaggcugguggcagguacuaugaauguaauucauaauuuaaaaggaaaac

SEQ ID NO: 281287 - RNA, 64 nt, Homo Sapiens
aauaaguaucuauguaaauuuguuuaaaauaaacugaauguauuuaaugguccauuuauauguu

SEQ ID NO: 281288 - RNA, 64 nt, Homo Sapiens; identical to SEQ ID NO: 117726

SEQ ID NO: 281289 - RNA, 64 nt, Homo Sapiens; identical to SEQ ID NO: 117727

SEQ ID NO: 281290 - RNA, 64 nt, Homo Sapiens
uacuaguguguucauuauagaguaucuguagaggugaauguaaaaguaaguccaaucuauuuuc

SEQ ID NO: 281291 - RNA, 64 nt, Homo Sapiens
caugaacauuacugcagguuuuugaugaauauaaugaauguauggaauucaauugaauuugcau

SEQ ID NO: 281292 - RNA, 64 nt, Homo Sapiens
ucugcuuuaaaggcauguguguuuuuaaaauuaaugaauguagaugugugauugucugagugag

SEQ ID NO: 281293 - RNA, 64 nt, Homo Sapiens
aaguaaauuaaccaaaaaagcaacguuacauuuuugaauguaguuuuaagacacuuuuuggacu

SEQ ID NO: 281294 - RNA, 64 nt, Homo Sapiens
gaggggagccuccaagugugcccgauucgggugcugaauguaagucagagcuagggugggggug

SEQ ID NO: 281295 - RNA, 64 nt, Homo Sapiens
auuaacuuuauuuuggucuguguauauaugugacugaauguaaguuaaggagcauuuaaaaaua

SEQ ID NO: 281296 - RNA, 64 nt, Homo Sapiens
auaaggaucguauucccugcgguauauacuaaaaugaauguaaaggucugugcuaccucuguga

SEQ ID NO: 281297 - RNA, 64 nt, Homo Sapiens
ugcaugggauugguccuugaacuaagaacagcucugaauguauuauaaauuauaaaugcaauua

SEQ ID NO: 281298 - RNA, 64 nt, Homo Sapiens
gccuguucuaguccuggugggaagcauuucugucugaauguaaaguucauuucacugggauuuu

SEQ ID NO: 281299 - RNA, 64 nt, Homo Sapiens
agggaaauaaaagucuuuugugaaauuugcauaaugaauguaaagugugagaaaagaauagaag

SEQ ID NO: 281300 - RNA, 64 nt, Homo Sapiens; identical to SEQ ID NO: 117728

SEQ ID NO: 281301 - RNA, 64 nt, Homo Sapiens; identical to SEQ ID NO: 117729

SEQ ID NO: 281302 - RNA, 64 nt, Homo Sapiens
guuugcuaccuauuguaacuuuuauauuuauuguugaauguaugauuuauuuaaauauuuaaau

SEQ ID NO: 281303 - RNA, 64 nt, Homo Sapiens
aaauaagaguaaaugcccuaguuucaaacauaucugaauguauaguuuuguagccuuaagaagu

SEQ ID NO: 281304 - RNA, 64 nt, Homo Sapiens
uuaaauuugcucaaagaagcucuucuaccacaucugaauguaacaaguaccuggagcaucauuc

SEQ ID NO: 281305 - RNA, 64 nt, Homo Sapiens
uuaucuggucuuuucuauauuugccucucuuccuugaauguauuucaggcuugacaacuucaca

SEQ ID NO: 281306 - RNA, 64 nt, Homo Sapiens
guuacucagcucccuggaaagcaggcaagcauguugaauguaucuaguggucugauuuuaauuu

SEQ ID NO: 281307 - RNA, 64 nt, Homo Sapiens
acuggauuugauuucuuuuuaugaaaguuucauaugaauguaacuugauuuuuuacuauuauaa

SEQ ID NO: 281308 - RNA, 64 nt, Homo Sapiens
acauaugguagacaauuugccuuaggaagugacuugaauguacaaagauacuugaugcacuuau

SEQ ID NO: 281309 - RNA, 64 nt, Homo Sapiens
acacauaagccaaaacugagcauaaguccucuagugaauguaggcuggcuuucagaguaggcua

SEQ ID NO: 281310 - RNA, 64 nt, Homo Sapiens
gaaauuaacacuggaacugacccuuuucuggcagugaauguaagcucuagcucccccaucuacu

SEQ ID NO: 281311 - RNA, 64 nt, Homo Sapiens
augguuacacuguuagaacacuauuuucagaaucugaauguaauuuguguaauaaaguguuuuc

SEQ ID NO: 281312 - RNA, 64 nt, Homo Sapiens
gauggguuuguugguauuuaaaaugaauacaacuugaauguaauuaaagugcuguuuuuuggaa

SEQ ID NO: 281313 - RNA, 64 nt, Homo Sapiens
agucuugaacacagaauaacgauugugaccauuaugaauguaacuaauuucaguuguacuguga

SEQ ID NO: 281314 - RNA, 64 nt, Homo Sapiens
uucuaaauagcgauuauaaucuccaacuuuauuuugaauguaccucuauuaguuucaauugagu

SEQ ID NO: 281315 - RNA, 64 nt, Homo Sapiens
ucaggcagauuaaaagaaucauuuguugaacaacugaauguauaaaaaaauuauaaacuggugu

SEQ ID NO: 281316 - RNA, 64 nt, Homo Sapiens
acuauuaccuagagugaacuuuaagcuuuauuguugaauguaauuccauuauauuuccuuuugu

SEQ ID NO: 281317 - RNA, 64 nt, Homo Sapiens
aggggcaaaaauauuuugcaagcucuggaauuguugaauguauucuuuuauauaacuacauuaa

SEQ ID NO: 281318 - RNA, 64 nt, Homo Sapiens
uuuuauuuuguguccuugggcuauaaaagauuccugaauguaauuauaaggauuuggguuugga

SEQ ID NO: 281319 - RNA, 64 nt, Homo Sapiens
ugaaguaguguuuaggauccuccauggcaguuagugaauguaagaaguacaguguuaaaguguu

SEQ ID NO: 281320 - RNA, 64 nt, Homo Sapiens
aacucgaucuaaaguuuagcauuuccaucugcgaugaauguaggccacaaaccacaguaguauu

SEQ ID NO: 281321 - RNA, 64 nt, Homo Sapiens
cggccgccggggcacauagggguuuuaucgggcgugaauguaaauaaauuauauauauauauug

SEQ ID NO: 281322 - RNA, 64 nt, Homo Sapiens
gcugaacagugaugaucuguagacauuuauggacugaauguaaugguugauauauguacauucu

SEQ ID NO: 281323 - RNA, 64 nt, Homo Sapiens
uagcguugaguuaaaccccugauauucggaacugugaauguacaguggcgacuuagaguuggcg

SEQ ID NO: 281324 - RNA, 64 nt, Homo Sapiens
gcucaguaaaugacagaacuccgucauuugcauuugaauguaaguggcagcaguuuuauaaagu

SEQ ID NO: 281325 - RNA, 64 nt, Homo Sapiens
aagugcuuuuucaaaucuguuuacuagacauaacugaauguaaaugucuuaaaacaaggcuuac

SEQ ID NO: 281326 - RNA, 64 nt, Homo Sapiens
agaguauaaaauguuugccagugccaccuaacagugaauguauugaaaacuuacuuuucaugga

SEQ ID NO: 281327 - RNA, 64 nt, Homo Sapiens
gcugcauaagcuguuagguuugugggaaggccuuugaauguaaaccaacagaguugugaaugug

SEQ ID NO: 281328 - RNA, 64 nt, Homo Sapiens
ugccacuacauuuacaauaaaaugaugauuauucugaauguauuuaauuuucuaguuccuuuuu

SEQ ID NO: 281329 - RNA, 64 nt, Homo Sapiens
uucaguguaagaugaaaauuaagaaaguuaagucugaauguaaaauucauuaauuuaguguaag

SEQ ID NO: 281330 - RNA, 64 nt, Homo Sapiens; identical to SEQ ID NO: 117730

SEQ ID NO: 281331 - RNA, 64 nt, Homo Sapiens; identical to SEQ ID NO: 117731

SEQ ID NO: 281332 - RNA, 64 nt, Homo Sapiens; identical to SEQ ID NO: 117732

SEQ ID NO: 281333 - RNA, 64 nt, Homo Sapiens; identical to SEQ ID NO: 117733

SEQ ID NO: 281334 - RNA, 64 nt, Homo Sapiens
uuugaauuacuagguuucuuauccuuuucuaaauugaauguacuaugauuuauuaauuaccagg

SEQ ID NO: 281335 - RNA, 64 nt, Homo Sapiens
ugugggcaaacuauuuacccucugccacugaggaugaauguaacgacuugguucuaguccaauu

SEQ ID NO: 281336 - RNA, 64 nt, Homo Sapiens
cuuguuucuaccaauauucuaguuauuugccauaugaauguauuaauuuuguuccaccaugguu

SEQ ID NO: 281337 - RNA, 64 nt, Homo Sapiens; identical to SEQ ID NO: 117734

SEQ ID NO: 281338 - RNA, 64 nt, Homo Sapiens; identical to SEQ ID NO: 117735

SEQ ID NO: 281339 - RNA, 64 nt, Homo Sapiens
aauaaauaucgcuuagaauguuccaggacaggagugaauguaaacggaagucagggcggcugga

SEQ ID NO: 281340 - RNA, 64 nt, Homo Sapiens
aauguagggggucauggcuugaagaaauaccuuaugaauguaagagucucuccgaacucaaaug

SEQ ID NO: 281341 - RNA, 64 nt, Homo Sapiens
auuauuaguuaggcuucugagcuugcaaucauauugaauguaugaagagcgaaaucaaauucuu

SEQ ID NO: 281342 - RNA, 64 nt, Homo Sapiens
uacuuauccagguuugcaaauguacauguucauuugaauguaaaucaccauuucuuggaacccc

SEQ ID NO: 281343 - RNA, 64 nt, Homo Sapiens
uuuauuauuuauuuauuauuuauuuauuuacagaugaauguauuuauuugggagaccgggguau

SEQ ID NO: 281344 - RNA, 64 nt, Homo Sapiens
gcuggggagggaagcacugucauguggacguggaugaauguaggaccagcaucacccucugcuc

SEQ ID NO: 281345 - RNA, 64 nt, Homo Sapiens
ucugucauuauugcccugaucacaaacaaaagccugaauguacuauguuuaaaagacaaaccaa

SEQ ID NO: 281346 - RNA, 64 nt, Homo Sapiens
cuacucuaaugcauuugguauguaacuuuaaauuugaauguauucuuguaaaacauccaguauu

SEQ ID NO: 281347 - RNA, 64 nt, Homo Sapiens
gcccugggccugcuccuugccaccaaccgaaccgugaauguagggcccccagccucaccucugc

SEQ ID NO: 281348 - RNA, 64 nt, Homo Sapiens
ugaacagcauggaaucucauugccaaauuauuagugaauguauaguucagguauucuuugagac

SEQ ID NO: 281349 - RNA, 64 nt, Homo Sapiens
aaauuuuauucuuagcacacuguuauguccuaacugaauguauucaguauucaaauaaaagaca

SEQ ID NO: 281350 - RNA, 64 nt, Homo Sapiens
auuuuggauguaaagauuccugugucucauaauaugaauguauuuuuugauauacaagaaacug

SEQ ID NO: 281351 - RNA, 64 nt, Homo Sapiens
ucuaauaaggagauuuaagauaagacccaauaaaugaauguauucuguaaugcuuuuaggaugu

SEQ ID NO: 281352 - RNA, 64 nt, Homo Sapiens
caccaugaaauuaaaaucaucucauuccugaagaugaauguaggaccagacauuuuagcuucac

SEQ ID NO: 281353 - RNA, 64 nt, Homo Sapiens
cuccaccucaaaaaauaaaaucaagauaaccucuugaauguaauagcucauagcacuuuaauuu

SEQ ID NO: 281354 - RNA, 64 nt, Homo Sapiens
caaguuagugauugcauuugaucccaaaacaagaugaauguaugcaaugggauguacauaaguu

SEQ ID NO: 281355 - RNA, 64 nt, Homo Sapiens
ucuuccuugggccuuuggaaaaauaugugacaagugaauguaagucugugccuggagagcuaau

SEQ ID NO: 281356 - RNA, 64 nt, Homo Sapiens
ucucagacuauucugaguaaugcuugcuugcuaaugaauguauaggagaccacauuguaauugu

SEQ ID NO: 281357 - RNA, 64 nt, Homo Sapiens
uuuuugaaauuacauugcuuguuuaucagacaauugaauguaguaauucuguucuggauuuaau

SEQ ID NO: 281358 - RNA, 64 nt, Homo Sapiens
accaaaggcacagauuuguguacaauauacccauugaauguauauccugagaaaaauuggggcc

SEQ ID NO: 281359 - RNA, 64 nt, Homo Sapiens
guucugaaaauauggugaugguugcacaccauugugaauguacugaaugccauucagugguacc

SEQ ID NO: 281360 - RNA, 64 nt, Homo Sapiens
uugaaggggagaguucauggugguauuuaggcugugaauguaccuucguaaagaaaauuacuuc

SEQ ID NO: 281361 - RNA, 64 nt, Homo Sapiens
cccaccagagcagacaucuuuuucucuccuaaaaugaauguaugaugaaggguugugaguuuag

SEQ ID NO: 281362 - RNA, 64 nt, Homo Sapiens
uacuguauugucaucaaggagucuuggagaauugugaauguaugccuugauauacacagagaug

SEQ ID NO: 281363 - RNA, 64 nt, Homo Sapiens
ugcagaggaaguauuacaaaagguuugaacuaagugaauguaucgagacuaacuuuguauguua

SEQ ID NO: 281364 - RNA, 64 nt, Homo Sapiens
uaguguguaggcacuguaguucucucuaaacgcaugaauguaugcuuacgcagggagaugcagg

SEQ ID NO: 281365 - RNA, 64 nt, Homo Sapiens
uaaauagguuucuaaaaagucuacugauuugggcugaauguauguauagaaaaaaacauucuau

SEQ ID NO: 281366 - RNA, 64 nt, Homo Sapiens
uuuuuuauuaacagggaaagguacacugauucugugaauguacccuguuuauuuuuuauucuaa

SEQ ID NO: 281367 - RNA, 64 nt, Homo Sapiens
uggcuaaacgauucuuacucuuacccaguaacauugaauguagaauuauaauuugagaaaaaua

SEQ ID NO: 281368 - RNA, 64 nt, Homo Sapiens
aucccuaauaacaaccuucacagaacuuuauuucugaauguaacauaaaguguucuaugaaauu

SEQ ID NO: 281369 - RNA, 64 nt, Homo Sapiens
auucuauaaauugccuuucuuuaaaaaucaaauuugaauguacugaguuucugacaaauuuguu

SEQ ID NO: 281370 - RNA, 64 nt, Homo Sapiens
auauuuuguuagaauggaaaacucuuguuuaaacugaauguaugaaacgugugucuggauauua

SEQ ID NO: 281371 - RNA, 64 nt, Homo Sapiens
ccaggagagguagagugaaaaucccagccauggaugaauguacuaauuugaaagccaaguguua

SEQ ID NO: 281372 - RNA, 64 nt, Homo Sapiens
aaaccaagaaauguaaucaagcaguaaaaacaucugaauguagaccaugaucucaaguucuucc

SEQ ID NO: 281373 - RNA, 64 nt, Homo Sapiens
guuccuaagacccuugucccagauacucuaaaugugaauguaugagcugggggagucaacccag

SEQ ID NO: 281374 - RNA, 64 nt, Homo Sapiens
cuuauuucauaauugccuacauuuaucaugguccugaauguagcguguaagcuuguguuucuug

SEQ ID NO: 281375 - RNA, 64 nt, Homo Sapiens
cuucuauuccugagggcucagagcugaccaugcaugaauguauggcaguguccacuuuucugua

SEQ ID NO: 281376 - RNA, 64 nt, Homo Sapiens
agaaaaauugacauugcugccuuuaagaauaccaugaauguaagaaauugaaagaaauuguaaa

SEQ ID NO: 281377 - RNA, 64 nt, Homo Sapiens
gagugaguccuuuuuuuaugguguccucccucugugaauguacaggcggaacuguacgaacagc

SEQ ID NO: 281378 - RNA, 64 nt, Homo Sapiens; identical to SEQ ID NO: 117736

SEQ ID NO: 281379 - RNA, 64 nt, Homo Sapiens; identical to SEQ ID NO: 117737

SEQ ID NO: 281380 - RNA, 64 nt, Homo Sapiens; identical to SEQ ID NO: 117738

SEQ ID NO: 281381 - RNA, 64 nt, Homo Sapiens; identical to SEQ ID NO: 117739

SEQ ID NO: 281382 - RNA, 64 nt, Homo Sapiens
ccaauuuaugggagaauugcacacagaugugaaaugaauguaaucuaauagaagccuaaucagc

SEQ ID NO: 281383 - RNA, 64 nt, Homo Sapiens; identical to SEQ ID NO: 117740

SEQ ID NO: 281384 - RNA, 64 nt, Homo Sapiens; identical to SEQ ID NO: 117741

SEQ ID NO: 281385 - RNA, 64 nt, Homo Sapiens
uuuaaacuaaaacuaguauaauuuagucuuuucaugaauguacauacauaaaauuauacauaaa

SEQ ID NO: 281386 - RNA, 64 nt, Homo Sapiens
gggaagggauuguuguguagucaagucaccaugcugaauguacacugauuccuuuaugaugacu

SEQ ID NO: 281387 - RNA, 64 nt, Homo Sapiens
gcuggggacaggcaugcugcgccagagcagcaguugaauguaauggccagccggccucucgaga

SEQ ID NO: 281388 - RNA, 64 nt, Homo Sapiens; identical to SEQ ID NO: 117742

SEQ ID NO: 281389 - RNA, 64 nt, Homo Sapiens; identical to SEQ ID NO: 117743

SEQ ID NO: 281390 - RNA, 64 nt, Homo Sapiens
uuuuguguuauucgugaauagauggauggcacaaugaauguauauucagcucaauuguuaaugu

SEQ ID NO: 281391 - RNA, 64 nt, Homo Sapiens
auuuggcauucucugaauuucauuagcuuccugcugaauguagucuggacugccggaaucccag

SEQ ID NO: 281392 - RNA, 64 nt, Homo Sapiens
cuucauacagggaugguguucugcuaagaauauuugaauguauguccgugguuaaacucgcuca

SEQ ID NO: 281393 - RNA, 64 nt, Homo Sapiens
guacugugucugugaaaacuuauacuguguauagugaauguauuuaaggaugggaauauuuugu

SEQ ID NO: 281394 - RNA, 64 nt, Homo Sapiens
ccucagccuucucagcauuucucuuuguuauuauugaauguaccaaauacuuagaacuggaagg

SEQ ID NO: 281395 - RNA, 64 nt, Homo Sapiens
ggggacagcucaggguuguuguauuuaauugacaugaauguaaagacauuugacuuuuauuuuu

SEQ ID NO: 281396 - RNA, 64 nt, Homo Sapiens
agaaaauuuuuuuucaaaaagaacauaacucugcugaauguaaaaaaauguagaaauucuucau

SEQ ID NO: 281397 - RNA, 64 nt, Homo Sapiens
caacauuccaacuggagcucaagaggaagcugcaugaauguaaugugucaugaguguuuaaauc

SEQ ID NO: 281398 - RNA, 64 nt, Homo Sapiens
agagaaagcuuauuggacucagauuuaaauaagaugaauguaaauuucuucacugugacagcaa

SEQ ID NO: 281399 - RNA, 64 nt, Homo Sapiens; identical to SEQ ID NO: 117744

SEQ ID NO: 281400 - RNA, 64 nt, Homo Sapiens; identical to SEQ ID NO: 117745

SEQ ID NO: 281401 - RNA, 64 nt, Homo Sapiens
uaacaccacugaguuaaacaauggcuacacauugugaauguaauuuuugaacuaaauaguggug

SEQ ID NO: 281402 - RNA, 64 nt, Homo Sapiens
uaauucaugaauaaaugcacuucuuccuucaaacugaauguaaugaugaacuuuggaguacugu

SEQ ID NO: 281403 - RNA, 64 nt, Homo Sapiens
guaaaaggggaaaugccaaguuaaaaaguaagccugaauguagaauaaaaaugcuuguauuucu

SEQ ID NO: 281404 - RNA, 64 nt, Homo Sapiens
ugcucuuguuggaaaaaugugaaauguucuauauugaauguacaaaagacuguaacuauugcug

SEQ ID NO: 281405 - RNA, 64 nt, Homo Sapiens
ucaaauuuuuaggggaggguagucaugcaauaauugaauguaccugcuaaaaauauuaagacca

SEQ ID NO: 281406 - RNA, 64 nt, Homo Sapiens
uuuugagaaauacgagucugcagacagugucuucugaauguaagcuaaagauuucaaauagugg

SEQ ID NO: 281407 - RNA, 56 nt, Homo Sapiens; identical to SEQ ID NO: 227330

SEQ ID NO: 281408 - RNA, 64 nt, Homo Sapiens
ucagaaguauauagauacuuccggugacuacauaugaauguacuuucaauauuauuuuuuuauu

SEQ ID NO: 281409 - RNA, 64 nt, Homo Sapiens
auauacugcacauacugaaauagagggaaaucacugaauguaaagagguuucaucuaugccccc

SEQ ID NO: 281410 - RNA, 64 nt, Homo Sapiens
ccaggacaugagagacauagaaaaacagaagucaugaauguaaauugaaugagaggcuuaacau

SEQ ID NO: 281411 - RNA, 64 nt, Homo Sapiens
uaaacuauaucuuggcuaguggcuacugugucugugaauguaaccaguacuucuuuaagcucua

SEQ ID NO: 281412 - RNA, 64 nt, Homo Sapiens
uuuagucaugaguuguuuucaguuuucagacgaaugaauguaauaggaaacuauggaguuacca

SEQ ID NO: 281413 - RNA, 64 nt, Homo Sapiens
uuagacuucuuaauaaccuaaauauuuaaaauaaugaauguaacaccuuuuuuaguucacugau

SEQ ID NO: 281414 - RNA, 64 nt, Homo Sapiens
cuggaauuacaguugugagccaccacaccuggcuugaauguagauuuuaauaauugaauuuauu

SEQ ID NO: 281415 - RNA, 64 nt, Homo Sapiens
accagauucacuucugaauuggccagaggaaaucugaauguauuauccugugugugucuaggua

SEQ ID NO: 281416 - RNA, 64 nt, Homo Sapiens
uggggaaaacaguuguggaauucuuacuucauuaugaauguauuuaaaaaacaaacaccaaaua

SEQ ID NO: 281417 - RNA, 64 nt, Homo Sapiens
ccaggagugugagagacacagaauaugcacagucugaauguauacaagaaaaaaaaaaaaaaaa

SEQ ID NO: 281418 - RNA, 64 nt, Homo Sapiens
cuuucugucucaaacccuggaagagaaugaauucugaauguacaggcagcauaauuuugugguu

SEQ ID NO: 281419 - RNA, 64 nt, Homo Sapiens
guuccuguuagcguuacuucagcauggucuugacugaauguacuugcucucugccacagcuugc

SEQ ID NO: 281420 - RNA, 64 nt, Homo Sapiens
cagccacccuguugugguaucauguauaucucauugaauguauacuacugugugcaaaguguuu

SEQ ID NO: 281421 - RNA, 64 nt, Homo Sapiens
ugccaggucuuagaagucagaggaguagggcuagugaauguaucuucagugaaagaggaaggaa

SEQ ID NO: 281422 - RNA, 64 nt, Homo Sapiens
gaucaaauuuauuuauuugauugaaggauuuaacugaauguaugcuuuagguauuacuacauag

SEQ ID NO: 281423 - RNA, 64 nt, Homo Sapiens
uaaauguauguauuuaaggauacccaugucagauugaauguauuauguugacaggcaaauuuca

SEQ ID NO: 281424 - RNA, 64 nt, Homo Sapiens
aacuguugguggcccugaaucuauagcagaaaggugaauguacaacuaguaaauugucugccuc

SEQ ID NO: 281425 - RNA, 64 nt, Homo Sapiens
ucuuuuugugagcuuacuugcuaaauggauuagaugaauguacuaagcugauuugcaacauuug

SEQ ID NO: 281426 - RNA, 64 nt, Homo Sapiens
auacacacacacuuuagagauguauuacuauacaugaauguauuggagaaaaacauuuuagaua

SEQ ID NO: 281427 - RNA, 64 nt, Homo Sapiens
uuauuuaaaagauuuuauggaugcucugagaaauugaauguaccauaaauuaucugaauauuag

SEQ ID NO: 281428 - RNA, 64 nt, Homo Sapiens; identical to SEQ ID NO: 117746

SEQ ID NO: 281429 - RNA, 64 nt, Homo Sapiens; identical to SEQ ID NO: 117747

SEQ ID NO: 281430 - RNA, 64 nt, Homo Sapiens
acuguggacauugacuuccccaacguaugagaaaugaauguaacgcuauuucaaaggaaccagc

SEQ ID NO: 281431 - RNA, 64 nt, Homo Sapiens
agcugcuaauuguuccuguuggggugacagauacugaauguauacguauugugccugagcucac

SEQ ID NO: 281432 - RNA, 64 nt, Homo Sapiens
gucuuuuauuuguacccaugugucugucacaccaugaauguaccuggggaaaucaacugaccuc

SEQ ID NO: 281433 - RNA, 64 nt, Homo Sapiens
uaauuguugacuuucuuagauucacuuccauaugugaauguaagcucuuaacuaugucucuuug

SEQ ID NO: 281434 - RNA, 64 nt, Homo Sapiens
aaaaugagaugcacucauuuaaaucugcauucagugaauguauugggagaaaaauaggucuugc

SEQ ID NO: 281435 - RNA, 64 nt, Homo Sapiens
uuaauauuaauggacuguuucagguaaaagagaaugaauguaugauugugaacugugaagagaa

SEQ ID NO: 281436 - RNA, 64 nt, Homo Sapiens
ccgccaguucucaaguuuuccuccuaacuccauuugaauguaagggcagcuggcccccaaugug

SEQ ID NO: 281437 - RNA, 64 nt, Homo Sapiens
uucugaaccacuagaguuuccuugauucagacuuugaauguacuguucuauaguuuuucaggau

SEQ ID NO: 281438 - RNA, 64 nt, Homo Sapiens
auuuggcaggugaguggauggauagauggauaggugaauguagguggacaggugacugggugga

SEQ ID NO: 281439 - RNA, 64 nt, Homo Sapiens
aauauauguucuucauauuuccuuuacauuguggugaauguaacuuuauguaauaucaugugua

SEQ ID NO: 281440 - RNA, 64 nt, Homo Sapiens
guuguuguguuuuuuuuuaagauugucugauuucugaauguaaacauucaguggccuaucucca

SEQ ID NO: 281441 - RNA, 64 nt, Homo Sapiens
uauuauuagaguccgaaagucagaagauaaggugugaauguaugaccucccccauuuaaauacu

SEQ ID NO: 281442 - RNA, 64 nt, Homo Sapiens
aagacagucccagaaguaaaccaauugaggguagugaauguaaguaucagagauacacaaaaaa

SEQ ID NO: 281443 - RNA, 64 nt, Homo Sapiens
uuacuuuuguauuugaauuuauauuuuggagugaugaauguaguuuaacaauucuccuuaaaag

SEQ ID NO: 281444 - RNA, 64 nt, Homo Sapiens
gccuucaacaugaugcacauuuucacgacagaguugaauguaugcucauuuuucuauauauuua

SEQ ID NO: 281445 - RNA, 64 nt, Homo Sapiens
ugucuuggauagguugcuggaauugccuuuuuaaugaauguacuccuuaguaccaaauacacuc

SEQ ID NO: 281446 - RNA, 64 nt, Homo Sapiens
agugaguuuaacaaagaaacauuuagaauagaucugaauguaagaacuacagaacuguuucaga

SEQ ID NO: 281447 - RNA, 64 nt, Homo Sapiens
cuuuuuuuuuuuaacacacuaaucuucaguuggaugaauguaauguauaacuauguuuucagca

SEQ ID NO: 281448 - RNA, 64 nt, Homo Sapiens
uaaccuauuguuagaaaauauguguuuuuauaaaugaauguaaaauaauuaaaugaauugugaa

SEQ ID NO: 281449 - RNA, 64 nt, Homo Sapiens
caaaggagcugaauguguuaugcuuccaaacaacugaauguaaaacacuccuagccaguuguug

SEQ ID NO: 281450 - RNA, 64 nt, Homo Sapiens
cugaccuguuguaggcagcuaucuuacagacgcaugaauguaagaguaggaagggguggguguc

SEQ ID NO: 281451 - RNA, 64 nt, Homo Sapiens
uucuacccucuuuuuccugcuaauccugucauaaugaauguagcuucucaguucacuguauaug

SEQ ID NO: 281452 - RNA, 64 nt, Homo Sapiens
acuaacgacuucagggcagggcucugauauuccaugaauguaucaggaaauauauaugugugug

SEQ ID NO: 281453 - RNA, 57 nt, Homo Sapiens; identical to SEQ ID NO: 227376

SEQ ID NO: 281454 - RNA, 64 nt, Homo Sapiens
uaugcucuggcaucuaacauaugauucuguaguaugaauguaaucaguguauguuaguacaaau

SEQ ID NO: 281455 - RNA, 64 nt, Homo Sapiens
aauuuucaguauuuuaacuaccucaauaaugcuaugaauguaagauauugggauagagauccca

SEQ ID NO: 281456 - RNA, 64 nt, Homo Sapiens; identical to SEQ ID NO: 117748

SEQ ID NO: 281457 - RNA, 64 nt, Homo Sapiens; identical to SEQ ID NO: 117749

SEQ ID NO: 281458 - RNA, 64 nt, Homo Sapiens
ccuucacccaaccucucccaccuccaccccacaaugaauguauuuauugugagaauggcuacac

SEQ ID NO: 281459 - RNA, 64 nt, Homo Sapiens
cuguccagcacagcuucuggcacaggaugcuuggugaauguacccuuucuuucccucccugcag

SEQ ID NO: 281460 - RNA, 64 nt, Homo Sapiens
cugacggggaaaaaaaaaaaaaaagaauggggugugaauguaccaacacugaaucuuacagcag

SEQ ID NO: 281461 - RNA, 64 nt, Homo Sapiens
gaagcuguaagccagcccaucucauagauaaauaugaauguaggcuauuaccaauuuuucagaa

SEQ ID NO: 281462 - RNA, 64 nt, Homo Sapiens
aauguuugguauuuaauucuccaucuuucagaguugaauguaauacaugcuuuaagauuucuau

SEQ ID NO: 281463 - RNA, 64 nt, Homo Sapiens
caccuguguuaccacgaauguguuaaaugccauuugaauguaaugggcaguuuggugcaauuua

SEQ ID NO: 281464 - RNA, 64 nt, Homo Sapiens
cugcuagcucuccgaaggccgagggccaucugccugaauguaacucuguggguuugggugggaa

SEQ ID NO: 281465 - RNA, 64 nt, Homo Sapiens
ugaauaacuucaguauacuuggaucuuuauaguuugaauguauuugaugccaguaaucuauaag

SEQ ID NO: 281466 - RNA, 64 nt, Homo Sapiens
agucuuuccaagagccuacuuccauuguagacuuugaauguaguagauccauuuugugccacac

SEQ ID NO: 281467 - RNA, 64 nt, Homo Sapiens
cccaaauuguggaauugccauucugggauuacaaugaauguaagaggguaaauggagaaaauau

SEQ ID NO: 281468 - RNA, 64 nt, Homo Sapiens
auuaucuauagauuauacauuugccauuguccccugaauguaguguucugcauugagccuaguu

SEQ ID NO: 281469 - RNA, 64 nt, Homo Sapiens
aguaugggaauuauuuuuuauguuaaauagaaacugaauguacuggguugaaugguguccucuc

SEQ ID NO: 281470 - RNA, 64 nt, Homo Sapiens
gcauggagugaccauagcuccuucucucuuacauugaauguagagaauguagccauuguagcag

SEQ ID NO: 281471 - RNA, 64 nt, Homo Sapiens
aaaauccuuuuauggaaaccauuuuuuuaaaaagugaauguacacaaauccacagaggacugug

SEQ ID NO: 281472 - RNA, 64 nt, Homo Sapiens
aucauguucuuauaccuaauuuuagucuuucaaaugaauguacuguaaugcuuguauguauaaa

SEQ ID NO: 281473 - RNA, 64 nt, Homo Sapiens
ccccuucaggaaggaccccccaaagcugaggggcugaauguagccuuuucaacagagaaggcuc

SEQ ID NO: 281474 - RNA, 64 nt, Homo Sapiens
ucucaucguaaggcagcuaguucuaauuugcauuugaauguauaacaaauugcaucacuuuuca

SEQ ID NO: 281475 - RNA, 64 nt, Homo Sapiens
uagaguugucuuucagcauucaaucaggcugagcugaauguagugauguuuacauuguuuacau

SEQ ID NO: 281476 - RNA, 64 nt, Homo Sapiens
uucaucucuuuagagaaguccaagcaacagccuuugaauguaaccaauccuacuaauaaaccag

SEQ ID NO: 281477 - RNA, 64 nt, Homo Sapiens
aaaggauggucacucuuccgaggucucccugaaaugaauguauuucucccccaaaagagcugau

SEQ ID NO: 281478 - RNA, 64 nt, Homo Sapiens
cagaugcagaagguuucucuggauagcacaccucugaauguaaaucaugauaaaauggauauuu

SEQ ID NO: 281479 - RNA, 64 nt, Homo Sapiens
ccacaugcuauugucugaacccugucaaaaauuuugaauguacaauuuuuuaaugugcucugua

SEQ ID NO: 281480 - RNA, 64 nt, Homo Sapiens
gggggcuucaagguaugggugccaaacuuggucuugaauguacuugaaagaugcuaaucuauuu

SEQ ID NO: 281481 - RNA, 64 nt, Homo Sapiens
gaaugcauacugccuaggccuacaggaauccuuaugaauguauaccaacuggggcuccuggggg

SEQ ID NO: 281482 - RNA, 64 nt, Homo Sapiens
cuccauaaaauuccaguauucuccuuucuuuaugugaauguauuuguuccaaaacaaaauucac

SEQ ID NO: 281483 - RNA, 64 nt, Homo Sapiens
aaaaacuaauuuuggagaaguuguauaaccuaccugaauguauucaggccucgggaccaacucu

SEQ ID NO: 281484 - RNA, 64 nt, Homo Sapiens
uuuucuaacaaacucaaaauugauucaccaaacaugaauguacaucuuuucccagaagagucuu

SEQ ID NO: 281485 - RNA, 64 nt, Homo Sapiens
auuugugaaacuugaguuuugugacuucuuuuugugaauguaaaugugugacuuugagcaaaaa

SEQ ID NO: 281486 - RNA, 64 nt, Homo Sapiens
ggggaaaaauaaggugagaaccacacuuagccauugaauguaaagagcauuuacagaugaaucc

SEQ ID NO: 281487 - RNA, 64 nt, Homo Sapiens
uuuuuuuguuguuguuaucuaaauacccguacuuugaauguagguaguauaauuuguuacuuuc

SEQ ID NO: 281488 - RNA, 64 nt, Homo Sapiens
ugaacauacuuuccuauuucugugcaguauacguugaauguauauuguauuguaguaaccaaua

SEQ ID NO: 281489 - RNA, 64 nt, Homo Sapiens
gaugccaccucccucucucugagagaccauggugugaauguagaucccaagauccuggggaaag

SEQ ID NO: 281490 - RNA, 64 nt, Homo Sapiens
uuaaaacgugugcccuuuuaguaguaaugucauaugaauguaucucauuauuuauuuuuuugua

SEQ ID NO: 281491 - RNA, 64 nt, Homo Sapiens
uaugagagugcugccauuaacuuugguugguccgugaauguagucuuucuaggcuuggagaugg

SEQ ID NO: 281492 - RNA, 64 nt, Homo Sapiens
uugcaucccugguuuuggacuuaagucuuugaacugaauguauuuaauguugagcuaagaagca

SEQ ID NO: 281493 - RNA, 64 nt, Homo Sapiens
gugucugccccgcguuuccugccugcggaccagaugaauguagcagauccccagccucuggccu

SEQ ID NO: 281494 - RNA, 64 nt, Homo Sapiens
ugauacuaguaauucauaagggaucuguguaaucugaauguauuugaauaacuuuagcucuacu

SEQ ID NO: 281495 - RNA, 64 nt, Homo Sapiens
uuucaggucauuuccugauagucuagucagcuuaugaauguaagcaaaacaggaccaaugaaag

SEQ ID NO: 281496 - RNA, 64 nt, Homo Sapiens
aaagacugaggcauuuuccagucuacuugccuaaugaauguauaggaacugucuaugaguaugg

SEQ ID NO: 281497 - RNA, 64 nt, Homo Sapiens
cacagcucaggaaaaagaugaggcauaacgaccuugaauguaauuggaguaagugacaaaauaa

SEQ ID NO: 281498 - RNA, 64 nt, Homo Sapiens
aagaaaaaaauuugccuuuaagaguuacuuuuguugaauguauuugacuuaguucuuauuuuaa

SEQ ID NO: 281499 - RNA, 64 nt, Homo Sapiens
ucuucucuucauuaccuuuuaaggacagugucuuugaauguagggcccacccugaucuagggug

SEQ ID NO: 281500 - RNA, 64 nt, Homo Sapiens; identical to SEQ ID NO: 117750

SEQ ID NO: 281501 - RNA, 64 nt, Homo Sapiens; identical to SEQ ID NO: 117751

SEQ ID NO: 281502 - RNA, 64 nt, Homo Sapiens; identical to SEQ ID NO: 117752

SEQ ID NO: 281503 - RNA, 64 nt, Homo Sapiens; identical to SEQ ID NO: 117753

SEQ ID NO: 281504 - RNA, 64 nt, Homo Sapiens
uuagugacccccaucuuguaaccuguugcaagagugaauguaaaaaauaguuguggcauuuuaa

SEQ ID NO: 281505 - RNA, 64 nt, Homo Sapiens
uugaacacacuaugaagaauuccagguguacuagugaauguaauuuauaguugccaaaaaaaaa

SEQ ID NO: 281506 - RNA, 64 nt, Homo Sapiens
uacccucauauucuuuaaaaaacuuaaagcauuaugaauguagagaaauucaccagagcucacu

SEQ ID NO: 281507 - RNA, 57 nt, Homo Sapiens; identical to SEQ ID NO: 227430

SEQ ID NO: 281508 - RNA, 64 nt, Homo Sapiens
gguuuuuuaguugaauuuuuuuuaacauuccucaugaauguaaauuuguacuauuuaacugacu

SEQ ID NO: 281509 - RNA, 64 nt, Homo Sapiens
gauuugggcugccccaggcccacccagggggcucugaauguauuuuguaccguguuucuuuccc

SEQ ID NO: 281510 - RNA, 64 nt, Homo Sapiens
ccacugcucugaugggugguuuguccaaggaugcugaauguaaugccuggucaauguggaagcc

SEQ ID NO: 281511 - RNA, 64 nt, Homo Sapiens
gcccuugaggagcacaggcagaagugugaacuugugaauguaauugaucuuuccuuccuuccag

SEQ ID NO: 281512 - RNA, 64 nt, Homo Sapiens
aucguuaacggguaccauuaaauauucugagaggugaauguaaaauauaaaagguauagguuuu

SEQ ID NO: 281513 - RNA, 64 nt, Homo Sapiens
auuagucauguauauuuuaaaugcuaacauuugaugaauguaaguuuccacauuguugcuguuu

SEQ ID NO: 281514 - RNA, 64 nt, Homo Sapiens
acauauuuuucacuugaauuuuuuuggaaauagcugaauguaaauagcagggaggaagaagcaa

SEQ ID NO: 281515 - RNA, 64 nt, Homo Sapiens; identical to SEQ ID NO: 117754

SEQ ID NO: 281516 - RNA, 64 nt, Homo Sapiens; identical to SEQ ID NO: 117755

SEQ ID NO: 281517 - RNA, 64 nt, Homo Sapiens; identical to SEQ ID NO: 117756

SEQ ID NO: 281518 - RNA, 64 nt, Homo Sapiens; identical to SEQ ID NO: 117757

SEQ ID NO: 281519 - RNA, 64 nt, Homo Sapiens
caaaggaauuauggcugguauugguacuagauacugaauguaaacuauuggaaggaguuagaug

SEQ ID NO: 281520 - RNA, 64 nt, Homo Sapiens
uaaauauuuuuaacuccuaucauauauguauguaugaauguacauuguuaaacauuuagacaaa

SEQ ID NO: 281521 - RNA, 64 nt, Homo Sapiens
guuacacuguucacaaagguuuugucaucccugaugaauguaaacuaggcaucauguccuauag

SEQ ID NO: 281522 - RNA, 64 nt, Homo Sapiens
auaaaauaaaaugcggacugugcaggaacuuauaugaauguacuugaccugguuaccuuggaaa

SEQ ID NO: 281523 - RNA, 64 nt, Homo Sapiens
uuguuugcacuuaauccuuacgcuagucaagcugugaauguauauauaaauugugauguagccu

SEQ ID NO: 281524 - RNA, 64 nt, Homo Sapiens
auauucuaaacaucuguuuuuuuguauccuaaaaugaauguaugccuaaaaugugaaagcauau

SEQ ID NO: 281525 - RNA, 64 nt, Homo Sapiens
ccauuuuccaaaaaggaaacuucuaagacauuucugaauguagaaguuuuuuuuuaaaugcuug

SEQ ID NO: 281526 - RNA, 64 nt, Homo Sapiens; identical to SEQ ID NO: 117758

SEQ ID NO: 281527 - RNA, 64 nt, Homo Sapiens; identical to SEQ ID NO: 117759

SEQ ID NO: 281528 - RNA, 64 nt, Homo Sapiens
agaaagggacucauccagaaacuuccuuaaguuaugaauguacuguagggcauuuucugauugc

SEQ ID NO: 281529 - RNA, 64 nt, Homo Sapiens
uaccaaaagauuuagaagugguuaugcuuaaauaugaauguaaucaguuuucuuuuuuauuuug

SEQ ID NO: 281530 - RNA, 64 nt, Homo Sapiens
cuuauaaagcacaaagcauauaugucaucuauguugaauguaaguacauuugaguaugguaacu

SEQ ID NO: 281531 - RNA, 64 nt, Homo Sapiens
ucauucaaaucuguauuccuauguauuuauggaaugaauguauugugggaagguuuugcugcua

SEQ ID NO: 281532 - RNA, 64 nt, Homo Sapiens
augagaaauucaacguuaauuuacuguuuuuagaugaauguacgaucucccuucacaaguuuuu

SEQ ID NO: 281533 - RNA, 64 nt, Homo Sapiens
uuccugaggcaucagaacuuuugggcaguuuaaaugaauguacaaauacaaccucaguguguca

SEQ ID NO: 281534 - RNA, 64 nt, Homo Sapiens
guuaggagacuaaaauauaaauuaaguugugauuugaauguagauugguaucaccuccaacucc

SEQ ID NO: 281535 - RNA, 64 nt, Homo Sapiens
guaagaaacuguccgauaugaaucacaacgugggugaauguaguauuuuccugaagugugaaag

SEQ ID NO: 281536 - RNA, 64 nt, Homo Sapiens
auauuagugauugaaguauuuugacuuuugagauugaauguaaaauauuuuaaauuugggauca

SEQ ID NO: 281537 - RNA, 64 nt, Homo Sapiens
gcacacacauacacaccaccaccaacaacgcuugugaauguauuuuucuguuagcuggguuuac

SEQ ID NO: 281538 - RNA, 64 nt, Homo Sapiens
cggaacaguguggaagcagauuuuuacugcuuucugaauguagaaguguucauugcacaauaua

SEQ ID NO: 281539 - RNA, 64 nt, Homo Sapiens
ucagugcuauaaaugccagagagcuucucugggcugaauguaugguuuagagagccugucacca

SEQ ID NO: 281540 - RNA, 64 nt, Homo Sapiens
uagcacuaaacguuuucuuugcagaguuuuaaaaugaauguaaacagaauuaaauuuguauaga

SEQ ID NO: 281541 - RNA, 64 nt, Homo Sapiens
aucacuugagucuaggaguuuugggaggaucacuugaauguaggcaagucugagucccaguuac

SEQ ID NO: 281542 - RNA, 64 nt, Homo Sapiens
uuuuucuccaaagaacagcaauacuugaaaaaaaugaauguauugcaucuuuguauauugcaau

SEQ ID NO: 281543 - RNA, 64 nt, Homo Sapiens; identical to SEQ ID NO: 117760

SEQ ID NO: 281544 - RNA, 64 nt, Homo Sapiens; identical to SEQ ID NO: 117761

SEQ ID NO: 281545 - RNA, 64 nt, Homo Sapiens
aaaauuaucaaauuguauucuaaaaaguuuuuauugaauguauguauuaugucuuuauuguugu

SEQ ID NO: 281546 - RNA, 64 nt, Homo Sapiens
auucaaugauuuuuuaugauaagaaaaauuaucuugaauguaguacaauagcccaaagccaaga

SEQ ID NO: 281547 - RNA, 64 nt, Homo Sapiens
gugaucucccugaacauuuuuugcaagacaaaguugaauguaaacuuuagaacagaggauugua

SEQ ID NO: 281548 - RNA, 64 nt, Homo Sapiens
uugacauggaugauucugaggaggaagcuguuauugaauguauagagauuuauccaaauaaaua

SEQ ID NO: 281549 - RNA, 64 nt, Homo Sapiens
uuguauugaaaugaaaccaccaguguuaucaacuugaauguaaauguacaugugcagauauucc

SEQ ID NO: 281550 - RNA, 64 nt, Homo Sapiens
uagaccugaccuuguuauuuauuagauaacauuuugaauguauccauuggauuucuaaaaugua

SEQ ID NO: 281551 - RNA, 64 nt, Homo Sapiens
aucacaguauuguuaggagauuuaaaugaauuagugaauguaagauacuuuagaaagcauguaa

SEQ ID NO: 281552 - RNA, 64 nt, Homo Sapiens
uggccuaagaaauaaggaucaauaaggaaugauuugaauguaauuuugugaauguguggaaaau

SEQ ID NO: 281553 - RNA, 64 nt, Homo Sapiens
ccauuccuacuguauuucuguaugaauguguuugugaauguauguguaaaagucuuucuuuucc

SEQ ID NO: 281554 - RNA, 64 nt, Homo Sapiens
gaugcacuuugaauauugagauauuuugcacggaugaauguaugggaacuacccaugaugaugu

SEQ ID NO: 281555 - RNA, 64 nt, Homo Sapiens
aaauuccuguacauagagauauauuuuuuaagugugaauguaacaacauacugugaauuccauc

SEQ ID NO: 281556 - RNA, 64 nt, Homo Sapiens
guucuagugggauacacaaacugcaaguauauugugaauguauuaugacgcgccaggcacaguu

SEQ ID NO: 281557 - RNA, 64 nt, Homo Sapiens; identical to SEQ ID NO: 117762

SEQ ID NO: 281558 - RNA, 64 nt, Homo Sapiens; identical to SEQ ID NO: 117763

SEQ ID NO: 281559 - RNA, 64 nt, Homo Sapiens
ggaaagaaaggaaaaacugauucacugugaauagugaauguaaaaaaaaaaaacaugcaccugu

SEQ ID NO: 281560 - RNA, 64 nt, Homo Sapiens
uaugacuuucuggaaaguuuuauaaaauguacaaugaauguaaauaaauuuguauuuaugugua

SEQ ID NO: 281561 - RNA, 64 nt, Homo Sapiens
aauuucagauucucuaaaacuuuaauuccauucuugaauguagauuuuuccccucacauugaau

SEQ ID NO: 281562 - RNA, 64 nt, Homo Sapiens
uauuauuccucuugcugguccacacacauuaagaugaauguaauuaauguaaacagaacuggca

SEQ ID NO: 281563 - RNA, 64 nt, Homo Sapiens
uggggaaaaucaagaugguagagaccagaccaggugaauguaacucuacucuucuaagcuuaca

SEQ ID NO: 281564 - RNA, 64 nt, Homo Sapiens
agacacaaaugaagaagaacugauauuagcuuguugaauguaaguucacucagagaagcaaggc

SEQ ID NO: 281565 - RNA, 64 nt, Homo Sapiens
acauaaugguucucuucuguuaaaucagaaagucugaauguagcaugucagguuauacuaaaac

SEQ ID NO: 281566 - RNA, 64 nt, Homo Sapiens
auguuuuacuuuaaaugugucucagucaacagugugaauguaucgcagugagcaucacuacagu

SEQ ID NO: 281567 - RNA, 64 nt, Homo Sapiens
uccuugugacuucaacggacucuuccaaauuguaugaauguaucaauguauuagauaaacccag

SEQ ID NO: 281568 - RNA, 64 nt, Homo Sapiens; identical to SEQ ID NO: 117764

SEQ ID NO: 281569 - RNA, 64 nt, Homo Sapiens; identical to SEQ ID NO: 117765

SEQ ID NO: 281570 - RNA, 64 nt, Homo Sapiens
uuaaaaaguuucaaaucuagacacuaaaugugugugaauguacaaagaaaacaaaccauugcuu

SEQ ID NO: 281571 - RNA, 64 nt, Homo Sapiens
cggggcagcguggccccaccggacuagcacaugaugaauguaaaguuggcacaaugaaaaugac

SEQ ID NO: 281572 - RNA, 64 nt, Homo Sapiens
aaugcccuuuagggcacaacuaguuaucaguaacugaauguaucuuaaucauuauggcugcuuc

SEQ ID NO: 281573 - RNA, 58 nt, Homo Sapiens; identical to SEQ ID NO: 227496

SEQ ID NO: 281574 - RNA, 64 nt, Homo Sapiens
aauguauuagauaaacccagucuuccaaauuguaugaauguaucuccuugugacuucaacggac

SEQ ID NO: 281575 - RNA, 64 nt, Homo Sapiens
aaguaguauuccacuguacugguagaaacauguaugaauguacuauauauaaaaaucuugagau

SEQ ID NO: 281576 - RNA, 64 nt, Homo Sapiens
gguaacaaauuuggggaagacagcacaaucuucuugaauguagcucuugggaaugcauuauuac

SEQ ID NO: 281577 - RNA, 64 nt, Homo Sapiens
cauccucucccauaagcacccaugucuuugaauaugaauguauuuguaaaauaccacguuucau

SEQ ID NO: 281578 - RNA, 64 nt, Homo Sapiens
uccuccucuccccaccuuugccauucuuaaguauugaauguacuuuguauaauuuuaguggaau

SEQ ID NO: 281579 - RNA, 64 nt, Homo Sapiens
cauugacauucauuccuauuuuacugggcaccuaugaauguaugcugugugcuagaaauagacu

SEQ ID NO: 281580 - RNA, 64 nt, Homo Sapiens
gggguucucaauggaaaaacgaaugcucuuacacugaauguacaggcagugggcuugcagcacu

SEQ ID NO: 281581 - RNA, 64 nt, Homo Sapiens
uuguuugaauuaauuguauuguaauauuauuuguugaauguaguaauuagguauuuaugaauau

SEQ ID NO: 281582 - RNA, 64 nt, Homo Sapiens
aguugcaacacacaaacggaaagagaucugguuuugaauguaaagguuacuaaccuugaaaugu

SEQ ID NO: 281583 - RNA, 64 nt, Homo Sapiens; identical to SEQ ID NO: 117766

SEQ ID NO: 281584 - RNA, 64 nt, Homo Sapiens; identical to SEQ ID NO: 117767

SEQ ID NO: 281585 - RNA, 64 nt, Homo Sapiens
ccaauuuuacuucuuuaaaacucaacuucuuugaugaauguaacacauaaauucuacuuuauuc

SEQ ID NO: 281586 - RNA, 64 nt, Homo Sapiens
gcuguuggaggacaucucgagcccgugguuacuaugaauguauuggagagagccgcgggguccu

SEQ ID NO: 281587 - RNA, 64 nt, Homo Sapiens
uagucuuugcagagguccaacguguacguuaaugugaauguauagccagaggccugaagcugag

SEQ ID NO: 281588 - RNA, 64 nt, Homo Sapiens
ccgcugugugucuuagcauggaaauaaauaaaccugaauguacgugcucgccucuggccugugu

SEQ ID NO: 281589 - RNA, 64 nt, Homo Sapiens
uuuauuugcacgucaggggagccggcuccccccuugaauguaccagacccuggggggggucacu

SEQ ID NO: 281590 - RNA, 64 nt, Homo Sapiens
cuuucuggauuucucuugaagugcuacacugcacugaauguaaggaauuguugcuuguggaagu

SEQ ID NO: 281591 - RNA, 64 nt, Homo Sapiens
ugucagacuuccaaauccuggaaggacacagugaugaauguacuaugucugaacauagaaacuc

SEQ ID NO: 281592 - RNA, 64 nt, Homo Sapiens
uuucuaauuaggcauuuuauguuagucacagucuugaauguauaaacagcacuaagacucucag

SEQ ID NO: 281593 - RNA, 64 nt, Homo Sapiens
acaagacuuucccagcuuguauuaccuagaagcgugaauguauaggauaccugacuacuaagac

SEQ ID NO: 281594 - RNA, 64 nt, Homo Sapiens
uugauguuuuaacucuaucugucauacauccuagugaauguaaaaugcaaaauccuggugaugu

SEQ ID NO: 281595 - RNA, 64 nt, Homo Sapiens; identical to SEQ ID NO: 117768

SEQ ID NO: 281596 - RNA, 64 nt, Homo Sapiens; identical to SEQ ID NO: 117769

SEQ ID NO: 281597 - RNA, 64 nt, Homo Sapiens
ggagucuucuuucaaaccaguggggguuggacaaugaauguaguuaacugguuccugcucacac

SEQ ID NO: 281598 - RNA, 64 nt, Homo Sapiens
ucaaggcgccuuuccuaauaauaugguucaacugugaauguagaagugggggggaggggggaga

SEQ ID NO: 281599 - RNA, 64 nt, Homo Sapiens
agagacccugcaagaccacggagggagcgacacuugaauguagaauaggcagggggcccugccc

SEQ ID NO: 281600 - RNA, 64 nt, Homo Sapiens; identical to SEQ ID NO: 117770

SEQ ID NO: 281601 - RNA, 64 nt, Homo Sapiens; identical to SEQ ID NO: 117771

SEQ ID NO: 281602 - RNA, 64 nt, Homo Sapiens
cguaugugcucuuauaaaguggacuucugaaaaaugaauguaaaagacacugguguaucucaga

SEQ ID NO: 281603 - RNA, 64 nt, Homo Sapiens
uuuaguugacuguauuauuugauuucggauugaaugaauguaaauagaaauuaaaugcaaauuu

SEQ ID NO: 281604 - RNA, 64 nt, Homo Sapiens
gguucaucuguccaugcaguccucuuggauucucugaauguaguaacuaugaagcuaugccaaa

SEQ ID NO: 281605 - RNA, 64 nt, Homo Sapiens
aaagccuucguuguauguugacgaugcacuuuuaugaauguaguuucuaucgcuguuuuuagcc

SEQ ID NO: 281606 - RNA, 64 nt, Homo Sapiens
gauuucaaauccaggggauuccaugcucaauggaugaauguagacacaaaacagcaacacuugu

SEQ ID NO: 281607 - RNA, 64 nt, Homo Sapiens
acaagcgaugagcaaacucuggcaucguuguuuuugaauguagcugucacugaggguuuugguu

SEQ ID NO: 281608 - RNA, 64 nt, Homo Sapiens
cgccucgguucccaccacugguucgacgcgucucugaauguauccugacuugccuuauuuauuu

SEQ ID NO: 281609 - RNA, 64 nt, Homo Sapiens
aaguuccaauuuuuaagggggacgaauuuccuacugaauguaccgucuuggccacagccugagu

SEQ ID NO: 281610 - RNA, 64 nt, Homo Sapiens
agaugaauugugcaagugacggccuggccagcagugaauguaggauuucaacccaggugccccu

SEQ ID NO: 281611 - RNA, 64 nt, Homo Sapiens
uaaacuuugaauaguuuuagagaugaucuuugucugaauguaauccuauguagcaacagugguu

SEQ ID NO: 281612 - RNA, 64 nt, Homo Sapiens
cugccucugcuuucuccugcccgagaucuugcccugaauguaccaucaggacucagaccccagg

SEQ ID NO: 281613 - RNA, 64 nt, Homo Sapiens
aagacaccuuucccgauaacgaggaugaaaggagugaauguauacuuccacacagggugcaugu

SEQ ID NO: 281614 - RNA, 64 nt, Homo Sapiens
aaaggcugaauucuguaauacacuaaagacagaaugaauguagagagaacagcaguuuauuacu

SEQ ID NO: 281615 - RNA, 64 nt, Homo Sapiens
aaguuuucacaugucccauuuccaaaaccuaaauugaauguacucuuguuuauccaacuaagug

SEQ ID NO: 281616 - RNA, 64 nt, Homo Sapiens
uauuaaauggagauguugaaaacuauuaccugcuugaauguaaaugucuaaacuauaagcuucc

SEQ ID NO: 281617 - RNA, 64 nt, Homo Sapiens
auagcauuuuucaacauuuaauggucuguacaguugaauguaaguguucaauauguauugcuga

SEQ ID NO: 281618 - RNA, 64 nt, Homo Sapiens
ucauuugcauaagauuuaacagcauuuuuuauaaugaauguaaacauuuuaacuuaaugguacu

SEQ ID NO: 281619 - RNA, 64 nt, Homo Sapiens
uuucugcauagcgaaauaaaaucacagcccauggugaauguauguccauuacacgaucaccugc

SEQ ID NO: 281620 - RNA, 64 nt, Homo Sapiens
augguuacuaauaguuuuauuucauucucuaucuugaauguauuuccugaguggaugacagguc

SEQ ID NO: 281621 - RNA, 64 nt, Homo Sapiens
aaagaaaaagaucaaguuguagaaauagaaauuuugaauguauaagaaauuuuaaaauaauaga

SEQ ID NO: 281622 - RNA, 64 nt, Homo Sapiens
uuuuauuauagaauuuucugaguaggaggagaagugaauguaaaaugcugauaaauguaagauu

SEQ ID NO: 281623 - RNA, 64 nt, Homo Sapiens
uaaaagccucaacuagucaucauguuagaagcaaugaauguauaauuuuccuuauuguuaaaaa

SEQ ID NO: 281624 - RNA, 64 nt, Homo Sapiens
uugagagggcacugaagaccgaaugaaauucaugugaauguaggucccucuguaauuucaaaau

SEQ ID NO: 281625 - RNA, 64 nt, Homo Sapiens
ugugcacaggaaaugacugggggagcagguuuuaugaauguaaccacaaacaaacaaaggaggg

SEQ ID NO: 281626 - RNA, 64 nt, Homo Sapiens
gcgcgggggggaggcuggggucccgccgccgugaugaauguacugacgagccgaggcagcagug

SEQ ID NO: 281627 - RNA, 64 nt, Homo Sapiens; identical to SEQ ID NO: 117772

SEQ ID NO: 281628 - RNA, 64 nt, Homo Sapiens; identical to SEQ ID NO: 117773

SEQ ID NO: 281629 - RNA, 64 nt, Homo Sapiens
ucugggucauucaggcaguacaucugaauuaagcugaauguagacaaauaaagaaaaacaaaac

SEQ ID NO: 281630 - RNA, 64 nt, Homo Sapiens
ggcccccuccccaccaaaggguucaccucacacuugaauguacaacccaccccacugucgggaa

SEQ ID NO: 281631 - RNA, 64 nt, Homo Sapiens
uacaugaaagauuucaaacugcagagaaccacuaugaauguaaacaaugugguaaagcauuuag

SEQ ID NO: 281632 - RNA, 64 nt, Homo Sapiens; identical to SEQ ID NO: 117774

SEQ ID NO: 281633 - RNA, 64 nt, Homo Sapiens; identical to SEQ ID NO: 117775

SEQ ID NO: 281634 - RNA, 64 nt, Homo Sapiens; identical to SEQ ID NO: 117776

SEQ ID NO: 281635 - RNA, 64 nt, Homo Sapiens; identical to SEQ ID NO: 117777

SEQ ID NO: 281636 - RNA, 64 nt, Homo Sapiens; identical to SEQ ID NO: 117778

SEQ ID NO: 281637 - RNA, 64 nt, Homo Sapiens; identical to SEQ ID NO: 117779

SEQ ID NO: 281638 - RNA, 64 nt, Homo Sapiens; identical to SEQ ID NO: 117780

SEQ ID NO: 281639 - RNA, 64 nt, Homo Sapiens; identical to SEQ ID NO: 117781

SEQ ID NO: 281640 - RNA, 64 nt, Homo Sapiens; identical to SEQ ID NO: 117782

SEQ ID NO: 281641 - RNA, 64 nt, Homo Sapiens; identical to SEQ ID NO: 117783

SEQ ID NO: 281642 - RNA, 64 nt, Homo Sapiens; identical to SEQ ID NO: 117784

SEQ ID NO: 281643 - RNA, 64 nt, Homo Sapiens
gauacauuaaaauacucacugaagagaagcccuaugaauguaaguaacgugggaaagcaugaaa

SEQ ID NO: 281644 - RNA, 64 nt, Homo Sapiens
uguucuggggcuuguccuuccuuugcagcuguuuugaauguaguuuuccuuuucuauuuauuug

SEQ ID NO: 281645 - RNA, 64 nt, Homo Sapiens; identical to SEQ ID NO: 117785

SEQ ID NO: 281646 - RNA, 64 nt, Homo Sapiens; identical to SEQ ID NO: 117786

SEQ ID NO: 281647 - RNA, 64 nt, Homo Sapiens
aacucaaucaauguuauugugaaaacugggaaugugaauguaauauauguagaaaaacauuuag

SEQ ID NO: 281648 - RNA, 59 nt, Homo Sapiens; identical to SEQ ID NO: 58889

SEQ ID NO: 281649 - RNA, 64 nt, Homo Sapiens; identical to SEQ ID NO: 117788

SEQ ID NO: 281650 - RNA, 64 nt, Homo Sapiens; identical to SEQ ID NO: 117789

SEQ ID NO: 281651 - RNA, 64 nt, Homo Sapiens
aaggccugcccaccaccgcccgccugggcagccaugaauguagcgccccaggcccugccccagc

SEQ ID NO: 281652 - RNA, 64 nt, Homo Sapiens
gcauauaaugagaugcuugaugaauggugcauauugaauguauaaagcccaccgguccugagag

SEQ ID NO: 281653 - RNA, 64 nt, Homo Sapiens
ucuugcuucuucuaccuuuauuuauucucagcucugaauguaugaaccugcucaaucaccucau

SEQ ID NO: 281654 - RNA, 64 nt, Homo Sapiens
aaguuaguuuuguggcuuuccaucugacccuaugugaauguaaggugaugugaccuuguuggug

SEQ ID NO: 281655 - RNA, 64 nt, Homo Sapiens
uaguucacacuggaaaaaggccacguaugugccuugaauguagccaaaaugacgaacaacaccc

SEQ ID NO: 281656 - RNA, 64 nt, Homo Sapiens
agcaucagagaguucacacuagagaaaggccuuaugaauguagugaaugugggaaauccuuuag

SEQ ID NO: 281657 - RNA, 64 nt, Homo Sapiens
gagccagacaaagcugugaaugccccgugcugaaugaauguacaggcugguggcauggcccccc

SEQ ID NO: 281658 - RNA, 64 nt, Homo Sapiens; identical to SEQ ID NO: 117790

SEQ ID NO: 281659 - RNA, 64 nt, Homo Sapiens; identical to SEQ ID NO: 117791

SEQ ID NO: 281660 - RNA, 60 nt, Homo Sapiens; identical to SEQ ID NO: 227583

SEQ ID NO: 281661 - RNA, 64 nt, Homo Sapiens
gauaugaguguuguuaccauggggagaaauacuaugaauguaagugcaugaaagaauucacacu

SEQ ID NO: 281662 - RNA, 64 nt, Homo Sapiens
gauagauauuuggacaucaauccacgugcacacgugaauguagccacacgaauccauccaccug

SEQ ID NO: 281663 - RNA, 64 nt, Homo Sapiens; identical to SEQ ID NO: 117792

SEQ ID NO: 281664 - RNA, 64 nt, Homo Sapiens; identical to SEQ ID NO: 117793

SEQ ID NO: 281665 - RNA, 64 nt, Homo Sapiens; identical to SEQ ID NO: 117794

SEQ ID NO: 281666 - RNA, 64 nt, Homo Sapiens; identical to SEQ ID NO: 117795

SEQ ID NO: 281667 - RNA, 64 nt, Homo Sapiens; identical to SEQ ID NO: 117796

SEQ ID NO: 281668 - RNA, 64 nt, Homo Sapiens; identical to SEQ ID NO: 117797

SEQ ID NO: 281669 - RNA, 64 nt, Homo Sapiens; identical to SEQ ID NO: 117798

SEQ ID NO: 281670 - RNA, 64 nt, Homo Sapiens; identical to SEQ ID NO: 117799

SEQ ID NO: 281671 - RNA, 64 nt, Homo Sapiens; identical to SEQ ID NO: 117800

SEQ ID NO: 281672 - RNA, 64 nt, Homo Sapiens; identical to SEQ ID NO: 117801

SEQ ID NO: 281673 - RNA, 64 nt, Homo Sapiens; identical to SEQ ID NO: 117802

SEQ ID NO: 281674 - RNA, 64 nt, Homo Sapiens; identical to SEQ ID NO: 117803

SEQ ID NO: 281675 - RNA, 64 nt, Homo Sapiens; identical to SEQ ID NO: 117804

SEQ ID NO: 281676 - RNA, 64 nt, Homo Sapiens; identical to SEQ ID NO: 117805

SEQ ID NO: 281677 - RNA, 64 nt, Homo Sapiens; identical to SEQ ID NO: 117806

SEQ ID NO: 281678 - RNA, 64 nt, Homo Sapiens
cacuugguaaagccuuaaguggagauagacccugugaauguaagauacuuguacgaaacacauu

SEQ ID NO: 281679 - RNA, 64 nt, Homo Sapiens
acccagccgaggggacggugcuucugacaaucagugaauguacaccccacagcaguaucagaaa

SEQ ID NO: 281680 - RNA, 64 nt, Homo Sapiens
cauugugauuaagccuucagggugagaaacaguaugaauguaaaagcacgaaagaauucccacu

SEQ ID NO: 281681 - RNA, 64 nt, Homo Sapiens; identical to SEQ ID NO: 117807

SEQ ID NO: 281682 - RNA, 64 nt, Homo Sapiens; identical to SEQ ID NO: 117808

SEQ ID NO: 281683 - RNA, 64 nt, Homo Sapiens
aauuaaucuauuuugcuccauauagaacauucuaugaauguaguagucuuuucaacuucugugu

SEQ ID NO: 281684 - RNA, 64 nt, Homo Sapiens
acaucuugcuucugcucagauuucauaucuauaaugaauguagauuuaagaaaaucuucaucua

SEQ ID NO: 281685 - RNA, 64 nt, Homo Sapiens; identical to SEQ ID NO: 117809

SEQ ID NO: 281686 - RNA, 64 nt, Homo Sapiens; identical to SEQ ID NO: 117810

SEQ ID NO: 281687 - RNA, 64 nt, Homo Sapiens; identical to SEQ ID NO: 117811

SEQ ID NO: 281688 - RNA, 64 nt, Homo Sapiens; identical to SEQ ID NO: 117812

SEQ ID NO: 281689 - RNA, 64 nt, Homo Sapiens; identical to SEQ ID NO: 117813

SEQ ID NO: 281690 - RNA, 64 nt, Homo Sapiens
auacauauguuguacuuuuauaguggugggauucugaauguauagacauauaacuacuuaucuc

SEQ ID NO: 281691 - RNA, 64 nt, Homo Sapiens
agagccuuuaguuuuuguuccuuugcaaguauaaugaauguagcuaauuuauacuggagaaaaa

SEQ ID NO: 281692 - RNA, 64 nt, Homo Sapiens
gaucccuucagucaccacuccccugugaauacagugaauguaaggcagucacuuuggagagaag

SEQ ID NO: 281693 - RNA, 64 nt, Homo Sapiens
aaaaauaauaguauugaaugugaagugcuaaaucugaauguaaggggugcccaggaguagaaua

SEQ ID NO: 281694 - RNA, 64 nt, Homo Sapiens
ucugcauuauacuccugcaagagauuuuccuguuugaauguauggcacacaccacagaaugugu

SEQ ID NO: 281695 - RNA, 64 nt, Homo Sapiens
gcuauuuuaaaugucaaggucagcaguguuacuuugaauguaaacugguauaauagguaguuuu

SEQ ID NO: 281696 - RNA, 64 nt, Homo Sapiens
caguugacugguuuuguguccuguuugaacuugcugaauguaaggcaggcuacuaugcguuaua

SEQ ID NO: 281697 - RNA, 64 nt, Homo Sapiens
uaugucauucuggauaaauccccaagccccuuuaugaauguagugaaauacauggcaugugggu

SEQ ID NO: 281698 - RNA, 64 nt, Homo Sapiens
uuuaaacaaaugaugcugagaauaaggagagaaaugaauguagagagagguagagagagaaaua

SEQ ID NO: 281699 - RNA, 64 nt, Homo Sapiens; identical to SEQ ID NO: 117814

SEQ ID NO: 281700 - RNA, 64 nt, Homo Sapiens; identical to SEQ ID NO: 117815

SEQ ID NO: 281701 - RNA, 64 nt, Homo Sapiens
uuuuccugucugacucugacaaguccucccucacugaauguagaaucguugccaaguuucugag

SEQ ID NO: 281702 - RNA, 64 nt, Homo Sapiens
agccuuggaaauuaacaaaaccuagaaggaucagugaauguaagguagaaauucucccuguaug

SEQ ID NO: 281703 - RNA, 64 nt, Homo Sapiens
uuuccaaucacaucuuuaguuggugauacuucuuugaauguagauuggaauggguggcgguaau

SEQ ID NO: 281704 - RNA, 64 nt, Homo Sapiens
uuuuuuaaugguuuauugcuggacugugauaaacugaauguauggacagcucccaguauacugu

SEQ ID NO: 281705 - RNA, 64 nt, Homo Sapiens
ugcugauacguugcucacaugaguagcacaagaaugaauguauugcucuaugcuaaauaaugaa

SEQ ID NO: 281706 - RNA, 64 nt, Homo Sapiens
uaauuuuccuguuuauuguagucaagcuugagaaugaauguauggggcuggauagauuaucuaa

SEQ ID NO: 281707 - RNA, 64 nt, Homo Sapiens
cgcaugcugaagcuaaguaauuaauuuuguauuuugaauguacaaauuaaugacaacucaugcu

SEQ ID NO: 281708 - RNA, 64 nt, Homo Sapiens
aaaauaccaauuauuuuccuuuuaaccacauuucugaauguauaugggcuuucagauuucucuu

SEQ ID NO: 281709 - RNA, 64 nt, Homo Sapiens; identical to SEQ ID NO: 117816

SEQ ID NO: 281710 - RNA, 64 nt, Homo Sapiens; identical to SEQ ID NO: 117817

SEQ ID NO: 281711 - RNA, 64 nt, Homo Sapiens
cucguucaguugcacuucaguauuuucacggauaugaauguaaaauauauaaauauauaaaccu

SEQ ID NO: 281712 - RNA, 64 nt, Homo Sapiens
auugagcagcugaagcuaacucaugacucuguuuugaauguaaauauuuguaauuaagccugca

SEQ ID NO: 281713 - RNA, 64 nt, Homo Sapiens
uuuauuguuaguucucacuuguuuccauauuuagugaauguacauuuaauugcaaagcugucau

SEQ ID NO: 281714 - RNA, 64 nt, Homo Sapiens
caacuugagcucuugaacuccuccugugggccugugaauguauucauucauuccacaacucugg

SEQ ID NO: 281715 - RNA, 64 nt, Homo Sapiens
uuuuaauuugauuuuagaaucuggacacuuucuaugaauguaauucggcugagaaacauguugc

SEQ ID NO: 281716 - RNA, 64 nt, Homo Sapiens
aucaggggacauuugaagauacaagaaacacugaugaauguaaaauugaacauccccugggcuu

SEQ ID NO: 281717 - RNA, 64 nt, Homo Sapiens
gggcacuuggccaguuuucuguucagcuuuucagugaauguaccccuuuaagguucagacuuaa

SEQ ID NO: 281718 - RNA, 64 nt, Homo Sapiens; identical to SEQ ID NO: 117818

SEQ ID NO: 281719 - RNA, 64 nt, Homo Sapiens; identical to SEQ ID NO: 117819

SEQ ID NO: 281720 - RNA, 64 nt, Homo Sapiens
gggguauuggaaauguuuggggacuagguagaggugaauguacuaaaugccacugaauuuguau

SEQ ID NO: 281721 - RNA, 64 nt, Homo Sapiens
uuuccuccauguuauuuaugaauuuuauauuccgugaauguauauugucuuguaauguugcaua

SEQ ID NO: 281722 - RNA, 64 nt, Homo Sapiens
uauaugcauuccauuugggagcauagcagcugugugaauguauguaauugugugugggggguuu

SEQ ID NO: 281723 - RNA, 64 nt, Homo Sapiens
ggaaacguaggagcaucuggugugaaagaaacugugaauguaauuucuccuuugaaugcuguuu

SEQ ID NO: 281724 - RNA, 64 nt, Homo Sapiens
acagcuugcagcuauucuguucuugcuuuggacaugaauguauugugaagcuugcaacuuuaug

SEQ ID NO: 281725 - RNA, 64 nt, Homo Sapiens; identical to SEQ ID NO: 117820

SEQ ID NO: 281726 - RNA, 64 nt, Homo Sapiens; identical to SEQ ID NO: 117821

SEQ ID NO: 281727 - RNA, 64 nt, Homo Sapiens
cuguggggauguuucauacuaaauuccucuuugaugaauguaccagcacauggccuugggugac

SEQ ID NO: 281728 - RNA, 64 nt, Homo Sapiens; identical to SEQ ID NO: 117822

SEQ ID NO: 281729 - RNA, 64 nt, Homo Sapiens; identical to SEQ ID NO: 117823

SEQ ID NO: 281730 - RNA, 64 nt, Homo Sapiens
auuucaaaccauuuaccaucugaaaguuuugauuugaauguaaaacaggaaauuggaauuccuu

SEQ ID NO: 281731 - RNA, 64 nt, Homo Sapiens
uguuucucccuugggacugugucucauguuugugugaauguagaccaggaaagggggcugcaaa

SEQ ID NO: 281732 - RNA, 64 nt, Homo Sapiens
agguuucaaaaaucauguaaggauuuaaacuugcugaauguaaagauugaaccucaagucacug

SEQ ID NO: 281733 - RNA, 64 nt, Homo Sapiens
ucauuuuuacuuuuucuuauuuuuaaaauuaggcugaauguacuucaugugauuugucaaccau

SEQ ID NO: 281734 - RNA, 64 nt, Homo Sapiens
ccaguagcaauaaacauauaauauaggaggagucugaauguagagaugaaaaauacagaaugua

SEQ ID NO: 281735 - RNA, 64 nt, Homo Sapiens
augucuugaacuuuuccucaaagcauuacacuugugaauguauuuuugucuaauagggucgaaa

SEQ ID NO: 281736 - RNA, 64 nt, Homo Sapiens
aauauauaugcauaccuggauuuccuuggcuucgugaauguaagagaaauuaaaucugaauaaa

SEQ ID NO: 281737 - RNA, 64 nt, Homo Sapiens
cuuaucaggcauuuucauuuggaaauuucauuauugaauguagcaagguuguaguuguuuuuuu

SEQ ID NO: 281738 - RNA, 64 nt, Homo Sapiens
uguauauacacacacaccucaguaugugauaaagugaauguacacucagaagucaagcugaugg

SEQ ID NO: 281739 - RNA, 64 nt, Homo Sapiens
gaaagacauuuugguuauacaaucugcuuguuucugaauguaugcaugcauaaaaauagaagac

SEQ ID NO: 281740 - RNA, 64 nt, Homo Sapiens
gcuacaugaaugcuugauuuagaaauguuucuguugaauguaaugaucuuaaacccaaaguacg

SEQ ID NO: 281741 - RNA, 64 nt, Homo Sapiens
acuuccaaaauguacauaucuguggaacagcuguugaauguaauaguccuaaaaauggccagau

SEQ ID NO: 281742 - RNA, 64 nt, Homo Sapiens
ccaaaugcaaguccauuccaugccaguagcacagugaauguaugauucucguaaaacugcgcuu

SEQ ID NO: 281743 - RNA, 64 nt, Homo Sapiens
ugguuaaugauacacauuccucuaaugggaguugugaauguaacaaaugaacugcccuucagca

SEQ ID NO: 281744 - RNA, 64 nt, Homo Sapiens
aggugucaacaaacugggaaugagcaguugccugugaauguaagacuguauuucccaauacacu

SEQ ID NO: 281745 - RNA, 64 nt, Homo Sapiens
uuguuugaaaaacuugcacacuugugaauauauuugaauguauguugccuuaguacuaucaaga

SEQ ID NO: 281746 - RNA, 64 nt, Homo Sapiens
gacaggccuagggaccuugcagcaagggaaggucugaauguaagucugucaaggaauuacaagu

SEQ ID NO: 281747 - RNA, 64 nt, Homo Sapiens
ucaucuugguguuauuauacgaaaaaugccuaauugaauguaacaagucugcuuaauuucaaaa

SEQ ID NO: 281748 - RNA, 64 nt, Homo Sapiens
gcaacagacuguauuuuugugacgccccguaguaugaauguacaucuuguaaaacugagauaua

SEQ ID NO: 281749 - RNA, 64 nt, Homo Sapiens
gcaguauucuucaguaaauaaagaauggaauugcugaauguaaucauugaaccucgagucacug

SEQ ID NO: 281750 - RNA, 66 nt, Homo Sapiens
caccuacagguuguguacuuuucauaaugguuuccaugaauguaguacguucauacaggcuucauu

SEQ ID NO: 281751 - RNA, 66 nt, Homo Sapiens
aucuuacaaaaauggaguauuuuaguaugaauuugcugaauguaagaccguggacuguuuuuuaua

SEQ ID NO: 281752 - RNA, 66 nt, Homo Sapiens
guagaaaguggggucaggaggccaagaaagggaauaugaauguauauccaagucacucaggaacuu

SEQ ID NO: 281753 - RNA, 66 nt, Homo Sapiens
ugcauccucugggaucuucugagguggacagcacuuugaauguagcauuucacuggaacagagucu

SEQ ID NO: 281754 - RNA, 66 nt, Homo Sapiens
cuugauucuuggucuauaauugcagauguuauuguaugaauguaccauaauauauuugagcagucc

SEQ ID NO: 281755 - RNA, 66 nt, Homo Sapiens
accguuguuuaggguagaauaggcuguguauuuacaugaauguauaauaucuaugucagcaguauu

SEQ ID NO: 281756 - RNA, 66 nt, Homo Sapiens
agaccuaccucaaacacacuguuuccacccucuucuugaauguauucaguagccuuuacugaaugu

SEQ ID NO: 281757 - RNA, 66 nt, Homo Sapiens
auguuuuaauaugucaguuauugcccuuuuauauugugaauguaaugugcauaagcuauauccgua

SEQ ID NO: 281758 - RNA, 66 nt, Homo Sapiens
cuuuuguaucucacaauucuggucuagauucaguuaugaauguaggcauuaguuaaaauuaacaag

SEQ ID NO: 281759 - RNA, 66 nt, Homo Sapiens
cuugagaaaaacaaugagcugagaggcagacuucccugaauguauugaacuuggaaagaaaugccc

SEQ ID NO: 281760 - RNA, 66 nt, Homo Sapiens
guauuuuguuguguuaaaaguacuuuucuugauuuuugaauguauuuguuucagcagaagucauuu

SEQ ID NO: 281761 - RNA, 54 nt, Homo Sapiens; identical to SEQ ID NO: 227074

SEQ ID NO: 281762 - RNA, 66 nt, Homo Sapiens
gacuccuaagagaguuguaaaaauagaggcuuggcuugaauguacauagaugguaccuggcaugga

SEQ ID NO: 281763 - RNA, 66 nt, Homo Sapiens
ugggugacuuucauuccaguugcugggacggaaggcugaauguagggucauuuuguaugggauaug

SEQ ID NO: 281764 - RNA, 66 nt, Homo Sapiens
auuauagauauaggacaguacuguaucauaccucugugaauguaaaauaucuuguaccugcuuuau

SEQ ID NO: 281765 - RNA, 66 nt, Homo Sapiens
ucaaguaaucuagaagaauguggauacucuuaggcgugaauguaaaugccuuaauauugaaggucc

SEQ ID NO: 281766 - RNA, 66 nt, Homo Sapiens
ucaagauuucuuuauuuacaaaugauuacauuuaaaugaauguacauucuucucacugacuuuggu

SEQ ID NO: 281767 - RNA, 66 nt, Homo Sapiens
cacccccgucuuauuaaggagcuuuuaaaguuuuucugaauguauagacauuucucggguuccuac

SEQ ID NO: 281768 - RNA, 66 nt, Homo Sapiens
gugcaacuguggcuuagcuaauauugcaauguggcuugaauguagguagcauccuuugaugcuucu

SEQ ID NO: 281769 - RNA, 66 nt, Homo Sapiens
agcugcuucaugaguagaaauuucaacaacucuuuuugaauguaugaagaguagcaguccccuuug

SEQ ID NO: 281770 - RNA, 66 nt, Homo Sapiens
ggguuaaagguuuuggcugcuguaagaaugugaauuugaauguauuuugaauuguaagagcaaaag

SEQ ID NO: 281771 - RNA, 66 nt, Homo Sapiens
ucagggaagauacauacauauaugagguacaguuuuugaauguacugguaaugccuaauguggucu

SEQ ID NO: 281772 - RNA, 66 nt, Homo Sapiens
cuuaaaaacuuguauaguugucuagauuucugcaccugaauguauguuugaugcuuugauuugaaa

SEQ ID NO: 281773 - RNA, 66 nt, Homo Sapiens
cacuaguggaagauaguguucugcuuauaauuaaacugaauguagaguaucucuguauguuaauug

SEQ ID NO: 281774 - RNA, 66 nt, Homo Sapiens
auacugucaauuuuccuuguuuugucuacuuguaagugaauguaacagaugaacuguauuuugcau

SEQ ID NO: 281775 - RNA, 66 nt, Homo Sapiens
gacacaucugggaguauuuuugcacugagugaaggaugaauguaugccagcaacaacccucacaua

SEQ ID NO: 281776 - RNA, 66 nt, Homo Sapiens
gcacuuaguacaguauaugagauuaaaaugaggaaaugaauguaaaccucauaggguuguugugag

SEQ ID NO: 281777 - RNA, 66 nt, Homo Sapiens
cuucuguaccaaaacuugaaacguggcacucauaguugaauguauagaccaauguuugaugggaaa

SEQ ID NO: 281778 - RNA, 66 nt, Homo Sapiens
gaaugaaaccuucugacacaaaugucaacuugucauugaauguaaacuccuuuucccucucaccua

SEQ ID NO: 281779 - RNA, 66 nt, Homo Sapiens
gagagaaaauguuuugaaaaguaaggccuuuaguaaugaauguaauuguagcaugauguauuuaaa

SEQ ID NO: 281780 - RNA, 66 nt, Homo Sapiens
aaggauauauuuaguuugaguuacaaaaugucuuuuugaauguaucacuaacuagcuuauuaaaau

SEQ ID NO: 281781 - RNA, 66 nt, Homo Sapiens
cuguagauuuuuaacaaagcaaguuuagccuuuacuugaauguauaucaaauauaguuggcauugg

SEQ ID NO: 281782 - RNA, 66 nt, Homo Sapiens
caacauuucaauuugcauucagaaauagcaacgagaugaauguaucguuaaaggucuacuuuaauc

SEQ ID NO: 281783 - RNA, 66 nt, Homo Sapiens
uuuauauucucuguauaucuuuuuucuaaaauaaagugaauguauugcuuacucuaugagucuuca

SEQ ID NO: 281784 - RNA, 66 nt, Homo Sapiens
aaggaauucaacugaaauccaauaaugacaauuauuugaauguaacuuauuagaauaaaaugugca

SEQ ID NO: 281785 - RNA, 66 nt, Homo Sapiens
augacuauuugggaggacacgcccuaaccaauacauugaauguauggaggugguuuagggauuuug

SEQ ID NO: 281786 - RNA, 66 nt, Homo Sapiens
aaaagggcuuauucuuccuccagucuguugaaggccugaauguaacuaauguggguggaccccguc

SEQ ID NO: 281787 - RNA, 66 nt, Homo Sapiens
uaaccugagcccucuccauuuuucccaugaaaagggugaauguauaccccaccucaggccucacac

SEQ ID NO: 281788 - RNA, 66 nt, Homo Sapiens
gaaaggaaauauucagagacauaugcccaaauauauugaauguacaaaagauguauauagauguau

SEQ ID NO: 281789 - RNA, 66 nt, Homo Sapiens
acgucucuguucugccagaguggaagagcccagaucugaauguaaauccuauaccuuaccagagca

SEQ ID NO: 281790 - RNA, 66 nt, Homo Sapiens
uuuuucuggacaagcuuacauucuccuuuacuauguugaauguauuaugagucaaggaguguaacc

SEQ ID NO: 281791 - RNA, 66 nt, Homo Sapiens
ugaaccacuguaauagcauucucuggaguuuccucuugaauguacaagcucccauguccccaagac

SEQ ID NO: 281792 - RNA, 66 nt, Homo Sapiens
uaggaacaagggggaaagucuugcuuucauuuuccuugaauguacaaggcagccucuagagccuuc

SEQ ID NO: 281793 - RNA, 66 nt, Homo Sapiens
uaggcuuuugacaaaaguugauggauuugggcaaacugaauguauauuuacaauugugaaaaccuc

SEQ ID NO: 281794 - RNA, 66 nt, Homo Sapiens
uauguaguguauuaagaagccuugguagauaguuauugaauguauuuguagcuacacaguaaguag

SEQ ID NO: 281795 - RNA, 66 nt, Homo Sapiens
aaucuuagugcuggugcugaucaauugcaaacaaacugaauguacacuauguaaauggcucacaag

SEQ ID NO: 281796 - RNA, 66 nt, Homo Sapiens
uacucagaagaaauaaaaaaauuuagcuaaagcaauugaauguagauauuugcauguuuuuuguua

SEQ ID NO: 281797 - RNA, 66 nt, Homo Sapiens
uauuuaaaaggagccucuugauaaauguagaaguacugaauguauauacagaguuuaaaugaauac

SEQ ID NO: 281798 - RNA, 66 nt, Homo Sapiens
aacaugaccuccguguaguguuuguauuuagugucuugaauguaagcauuuuugcauugccuucgg

SEQ ID NO: 281799 - RNA, 66 nt, Homo Sapiens
cccuggcgacaguugagaccacuccuggugugaagaugaauguaaaugugaagaugaaugaaugua

SEQ ID NO: 281800 - RNA, 66 nt, Homo Sapiens
uccuggugugaagaugaaugccgaugugaagaugaaugaauguaacaaccacggcagagagcagcg

SEQ ID NO: 281801 - RNA, 66 nt, Homo Sapiens
guguaggaaaguacuuaauuuacuugagagaaacugugaauguaagcaaaaacaugaacagucaca

SEQ ID NO: 281802 - RNA, 66 nt, Homo Sapiens
ugugggaaaaauauugcuacaauuuuuuuuaaucucugaauguaauuucgauacuguguacauagc

SEQ ID NO: 281803 - RNA, 66 nt, Homo Sapiens
gaacaugauuuuauucuaugccaacauuugggccucugaauguaucuguuauuugaauuuaaguau

SEQ ID NO: 281804 - RNA, 66 nt, Homo Sapiens
uauauauuuauacacauacaauuuauguuuuccuguugaauguauuuuuaugagauuuuaaccaga

SEQ ID NO: 281805 - RNA, 66 nt, Homo Sapiens
uuuaucugaaagaaguuucuggguuaggagaaguaaugaauguauccauuuguacaugguuuacau

SEQ ID NO: 281806 - RNA, 66 nt, Homo Sapiens
gugaacaaucauuaauucuucgauauuucuguagcuugaauguaacugcuuuaagaaagguucuca

SEQ ID NO: 281807 - RNA, 66 nt, Homo Sapiens
uuagaguacuuuuuaaaauuauuucucacaaagaaaugaauguacaauccaaugaaaacauuuguu

SEQ ID NO: 281808 - RNA, 66 nt, Homo Sapiens
cuuaaaacaaugaaagagcauuuaucguuugucccuugaauguagaauuuguuuuugauuucauaa

SEQ ID NO: 281809 - RNA, 66 nt, Homo Sapiens
gcccaggggugggaaguuuucauuugcaggggggucugaauguaacucaccauguggugugcaagg

SEQ ID NO: 281810 - RNA, 66 nt, Homo Sapiens
cacaauguauuauuaucacugucagaugagcaugcuugaauguagcaugacugccucuuuuugcuu

SEQ ID NO: 281811 - RNA, 66 nt, Homo Sapiens
uaagacauccaaucaauaaugaaggaaauuuuuuucugaauguagguuugagugaggggcaccucu

SEQ ID NO: 281812 - RNA, 66 nt, Homo Sapiens
ucagucccagccagaagaaucucugaaagcauauugugaauguauacaauguaguacaaacaaucu

SEQ ID NO: 281813 - RNA, 66 nt, Homo Sapiens
ucuuuccuccugucuuagaagaacagaccuaacuagugaauguauuaaugaaaaugcaucuauuuc

SEQ ID NO: 281814 - RNA, 66 nt, Homo Sapiens
ucaccacacagcagaauuucuaauggaaguuuguugugaauguaaaggagggagcauucuuugcuu

SEQ ID NO: 281815 - RNA, 66 nt, Homo Sapiens
caaauuuaauguaguaacucacuuuuccauauauuuugaauguauauuucuauuuaugauaccaau

SEQ ID NO: 281816 - RNA, 66 nt, Homo Sapiens
uuaacuugucuuuuuguuaugcaaaugagauuucuuugaauguauuguucuguuuguguuauuuca

SEQ ID NO: 281817 - RNA, 66 nt, Homo Sapiens
guuuauguaauuuagggaggacuggucuguaauuucugaauguauauagaauaauauuuauguuua

SEQ ID NO: 281818 - RNA, 66 nt, Homo Sapiens
gcgagucauuucguucccugauuauuuauccuugucugaauguauuuauguguauauuuguagauu

SEQ ID NO: 281819 - RNA, 66 nt, Homo Sapiens
aaucugaacuauaucuugacaaauauuauucaaacuugaauguaaauauauacaguauguauauuu

SEQ ID NO: 281820 - RNA, 66 nt, Homo Sapiens
aaauaaagaaaugggugacaggcuuaaccucaccuaugaauguacaguauguggauuugugaaacu

SEQ ID NO: 281821 - RNA, 66 nt, Homo Sapiens
cuguuuaagauauguuuggugaccaaaacguaugugugaauguaguuauaaugcuuuugaaaaauu

SEQ ID NO: 281822 - RNA, 66 nt, Homo Sapiens
gucagauuuagauucuuccuggggauuacacagcuaugaauguauuugcuucuaaaaccucccaaa

SEQ ID NO: 281823 - RNA, 66 nt, Homo Sapiens
aacacuguucugauaucucugauugucauguggauuugaauguagcuugacagagggaaugucuaa

SEQ ID NO: 281824 - RNA, 66 nt, Homo Sapiens
aaaacagaaaagaacaacagcaacaaaaacauugugugaauguauguuuguauguguguauguaua

SEQ ID NO: 281825 - RNA, 66 nt, Homo Sapiens
uuuuaacuauugauuuuuuuuaaaaaaaauugucuuugaauguauuggaaguagacaugcauuaac

SEQ ID NO: 281826 - RNA, 66 nt, Homo Sapiens
caucaggacaugcgucuucagcuuuucagccagcacugaauguaucuagggcacacacugaaguug

SEQ ID NO: 281827 - RNA, 66 nt, Homo Sapiens
uugcguaucccaaggcacugacgcgugcccuguugcugaauguauggcacuuguccguagggucac

SEQ ID NO: 281828 - RNA, 66 nt, Homo Sapiens
uuugaacuguuuaacacuuucuucauauaacugagaugaauguaaucaagguauuuacacauacaa

SEQ ID NO: 281829 - RNA, 66 nt, Homo Sapiens
ccgugaagggagugccucuccccugcccugagacagugaauguaguugcuguucccuaaucccacc

SEQ ID NO: 281830 - RNA, 66 nt, Homo Sapiens
aacaucauauggucugaaaaauaauauaaauuuuguugaauguauuuguaaauucacagcaguaag

SEQ ID NO: 281831 - RNA, 66 nt, Homo Sapiens
auacaauucuguuuuaaucuccugauaacucaaaagugaauguauaucuggagugaauuaaguuca

SEQ ID NO: 281832 - RNA, 66 nt, Homo Sapiens
uacaaagacucagcuacuuccuaaggaagauauguaugaauguauaauuacaguguaguguuuauu

SEQ ID NO: 281833 - RNA, 66 nt, Homo Sapiens
cagcccacauccauuccagaugugggcagcuggcucugaauguagcuggaggccucugcaagauuc

SEQ ID NO: 281834 - RNA, 66 nt, Homo Sapiens
aauaaaaguccuuaaaauaaccagcaguaucuaucaugaauguagaaaagacaucaugagaaaaua

SEQ ID NO: 281835 - RNA, 66 nt, Homo Sapiens
gaaugugggaacgcuuugaucuagugagaaaccacgugaauguaaucaaacaugggagaauccaua

SEQ ID NO: 281836 - RNA, 66 nt, Homo Sapiens
uggaaaaccccuaaaaauccgaaugaccaggcucuaugaauguacaaggcucuaugaauguacaug

SEQ ID NO: 281837 - RNA, 66 nt, Homo Sapiens
uggaaugaccaggcucuaugugcugaccaggcucuaugaauguacaacgcaacaaggacuccucgc

SEQ ID NO: 281838 - RNA, 66 nt, Homo Sapiens
ggaagcaaggccuguauugcagaaucuuacugguauugaauguaaagucccuuccagcuuuucugu

SEQ ID NO: 281839 - RNA, 66 nt, Homo Sapiens
auuggcauaucauggaaaaugcaucugaaauuuuaaugaauguauaagauaagaauaauucaggua

SEQ ID NO: 281840 - RNA, 66 nt, Homo Sapiens
acagucuucauuguacuauuacaauuccuuauugucugaauguaauuuugcccugcaaauaaaaag

SEQ ID NO: 281841 - RNA, 66 nt, Homo Sapiens
uaauuuuaugaauuauuuauguaguuuauuuuuuagugaauguauuauuuuucauuuuuuuacuuu

SEQ ID NO: 281842 - RNA, 66 nt, Homo Sapiens
aagacccacacuauugagacugaaguaagauccuuuugaauguacauuaaaagcaaguuauaucag

SEQ ID NO: 281843 - RNA, 66 nt, Homo Sapiens
aaaggugaagggacauuacacccaaauauuuugcacugaauguaccuauaaagguaaaaaaaauuc

SEQ ID NO: 281844 - RNA, 66 nt, Homo Sapiens
cuagcauacaaggaucucaagaacaguagaaccuuaugaauguauaccagucaaauggcuucauga

SEQ ID NO: 281845 - RNA, 66 nt, Homo Sapiens
guauauaugaugucauuaauuaauaauccaugauuuugaauguaaauugcauuugacacaauauug

SEQ ID NO: 281846 - RNA, 66 nt, Homo Sapiens
aauguuuucauauuuuucaaaauagguuuuuauuguugaauguacaucuaccccagccccucaaaa

SEQ ID NO: 281847 - RNA, 66 nt, Homo Sapiens
aaaagaucauuuuauuaucuuuaacuguaucuauuuugaauguaaauuuaaaaaaaguaauucucu

SEQ ID NO: 281848 - RNA, 66 nt, Homo Sapiens
uuuguauaauuacuugauucacacagugagaaaaaaugaauguauuccuguuuuugaagagaagaa

SEQ ID NO: 281849 - RNA, 66 nt, Homo Sapiens
cuguuuaaggcucuucauccugguuagcaaaaggugugaauguaaugugauggaauuuaaaaguuu

SEQ ID NO: 281850 - RNA, 66 nt, Homo Sapiens
acaacuggaauagcuaauuacagucuauuaaaacugugaauguauguagcaauccugcgugugaag

SEQ ID NO: 281851 - RNA, 66 nt, Homo Sapiens
ccuuacauagcacuugauacguguuaaaugaacauaugaauguaauuuauauauuccuagaauuua

SEQ ID NO: 281852 - RNA, 66 nt, Homo Sapiens
auuagcagcucaauuuguacuacuucagccaaucugugaauguaaaaacuacacuguugccuugcu

SEQ ID NO: 281853 - RNA, 66 nt, Homo Sapiens
uagggggaacauuguaaagaaacaaaaagguccagaugaauguaugcuagaaauaaaaguugaaag

SEQ ID NO: 281854 - RNA, 66 nt, Homo Sapiens
agaauaaucuuccauuuggcugucgugaggaguaauugaauguaauccaucucuuacaaaauggag

SEQ ID NO: 281855 - RNA, 66 nt, Homo Sapiens
cagcugcgcgggcuuauuuauuaacaggauaacccuugaauguagcagccccgggagggcggcaca

SEQ ID NO: 281856 - RNA, 66 nt, Homo Sapiens
uucggagggaaauuguaaauccuguguuucauuacuugaauguaguuaucuauugaaaauauauau

SEQ ID NO: 281857 - RNA, 66 nt, Homo Sapiens
uuaaggguuucaaucaauuauuaaugcagagaguauugaauguaaaucagagcucucuagucuuca

SEQ ID NO: 281858 - RNA, 66 nt, Homo Sapiens
auacuuguuuaucuuguugcugcaaugagaaauaaaugaauguauguauuuuggugcagacaccug

SEQ ID NO: 281859 - RNA, 66 nt, Homo Sapiens
uucuauacacuaucaaauauauaaagcuuucuauauugaauguacauuauacagaucauucauaug

SEQ ID NO: 281860 - RNA, 66 nt, Homo Sapiens
guaccaucgccuuccaaagucagcacucuacacucuugaauguaccaaggaucucuuggcgacagu

SEQ ID NO: 281861 - RNA, 66 nt, Homo Sapiens
cuuaugguauuuauuuucaguaguaaagacccagcuugaauguaaauuuuguauaguguaaguaug

SEQ ID NO: 281862 - RNA, 66 nt, Homo Sapiens
cuuuccauuuuggcgcuauuacaaauagugcaacuaugaauguacugcauguuaccaucuuacuug

SEQ ID NO: 281863 - RNA, 66 nt, Homo Sapiens
aauauucaauauuggucuguguuuaaguuuguuauuugaauguaauuuacauagaggaauauaaua

SEQ ID NO: 281864 - RNA, 66 nt, Homo Sapiens
caggagaggaacugcauaaccgugaagaaguaucucugaauguaucagagcgcaucaccugaaugu

SEQ ID NO: 281865 - RNA, 66 nt, Homo Sapiens
guacacuuucaauccucccccaccacgucccccgcaugaauguacucagccaugcacccgcccagc

SEQ ID NO: 281866 - RNA, 66 nt, Homo Sapiens
auuugauccucauuguguuccccagguguccugauuugaauguacuaggauaucuuuguccauaua

SEQ ID NO: 281867 - RNA, 66 nt, Homo Sapiens
aacuuacugugggcauuuacguaugcgguuuggaaaugaauguagacuuugcugucuuuuuacacu

SEQ ID NO: 281868 - RNA, 66 nt, Homo Sapiens
uaaugugugguggccucagcuuuuuuaugaagugcgugaauguaugcagggucucucccucaggug

SEQ ID NO: 281869 - RNA, 66 nt, Homo Sapiens
ucauucauauuuccucucacacucuguuuuuaaguaugaauguauuuaaaguuuuggcaguaaaau

SEQ ID NO: 281870 - RNA, 66 nt, Homo Sapiens
ccacugcaauuagaguaucccaucucaaaaaaaaaaugaauguaugcuacagaaggaagggagucc

SEQ ID NO: 281871 - RNA, 66 nt, Homo Sapiens
auuuuauuugcuucguaauacuuuguucauauauuaugaauguauuggauucuuaauguaugauuu

SEQ ID NO: 281872 - RNA, 66 nt, Homo Sapiens
agagaaugucuuuguaacuguuaagaccucuaugaaugaauguaucauuuacuauguauuuauacg

SEQ ID NO: 281873 - RNA, 66 nt, Homo Sapiens
aagcauuuauuugucaauaaagagaugggaaaaaccugaauguauauuuggaaaccaucacuauug

SEQ ID NO: 281874 - RNA, 66 nt, Homo Sapiens
guuuaauaaagaaauuacaaguuaaagccuuuacacugaauguaauauaucauggugauuaugaug

SEQ ID NO: 281875 - RNA, 66 nt, Homo Sapiens
ccuaaaugugguuauugaaauaucuaaucaguccuaugaauguaucuauaaccauuucaccuggac

SEQ ID NO: 281876 - RNA, 66 nt, Homo Sapiens
uggaauacuuacauauuauaucccuaauucauacaaugaauguauuuguuucuuauugcuuuuccu

SEQ ID NO: 281877 - RNA, 66 nt, Homo Sapiens
uacuagggcaccauaauacuugaaacuagcuaaaccugaauguaccugcuuccugauugcgcagac

SEQ ID NO: 281878 - RNA, 66 nt, Homo Sapiens
uaaauaaacuguacauagguuuuauuucacauccuaugaauguaugaacuagcuuguuuugacagg

SEQ ID NO: 281879 - RNA, 66 nt, Homo Sapiens
aauugauuuaaacaucauguccucagcguuagaauuugaauguauuccugcauuaccuaauaauua

SEQ ID NO: 281880 - RNA, 66 nt, Homo Sapiens
caauuguuauguguuuagaaaaagacaucuuaauccugaauguaaaccaaagucguuucaacucuu

SEQ ID NO: 281881 - RNA, 66 nt, Homo Sapiens
uuuauauuuugauuaagauuuuguagauggcaguuaugaauguauauauaggaccaaaacagaaua

SEQ ID NO: 281882 - RNA, 66 nt, Homo Sapiens
ccuuccaacaccugacagaaccagcaaaacaacggaugaauguagcaagugaggcucccacaggca

SEQ ID NO: 281883 - RNA, 66 nt, Homo Sapiens
gacagaaguaagccuggacagugauaugauuauuccugaauguacaaugagaguuguauguaacca

SEQ ID NO: 281884 - RNA, 66 nt, Homo Sapiens
cuggcuagauguuuacauuuguaagaaauaacacugugaauguaaaacagagccauucccuuggaa

SEQ ID NO: 281885 - RNA, 66 nt, Homo Sapiens
gccuccagacguagccauuuccugacaucaagauguugaauguaaucuggucugagcugggccugu

SEQ ID NO: 281886 - RNA, 66 nt, Homo Sapiens
uaaaaccucaauuuaagucuuuaaaagguuguauuuugaauguaaccaaaaguuuacaguuuuuug

SEQ ID NO: 281887 - RNA, 66 nt, Homo Sapiens
uugguuuuaugcugcuuuguuaggacagauguguuuugaauguaccauuauaagaagaauucuaug

SEQ ID NO: 281888 - RNA, 66 nt, Homo Sapiens
gacaauguggaauuaccaaauuaaaagagaauacuaugaauguauucauauuuuuucuauauugaa

SEQ ID NO: 281889 - RNA, 66 nt, Homo Sapiens
acaauggaauauuuucuaaaacauuuaguauacauuugaauguauuuuaaaccaugccaaacuacu

SEQ ID NO: 281890 - RNA, 66 nt, Homo Sapiens
aaagguaauauuuuuaauaugauacauuacauauugugaauguauacuaaaaaaacauuuuaaaug

SEQ ID NO: 281891 - RNA, 66 nt, Homo Sapiens
uuaagccuuuuuuuucuuuuuuuuuuuuuuggcaaaugaauguaccauuucaacuuugauuuuaau

SEQ ID NO: 281892 - RNA, 66 nt, Homo Sapiens
augacuuuccucucccaguuuccagacagggcucuuugaauguaugucaaacucaguuacuccaga

SEQ ID NO: 281893 - RNA, 66 nt, Homo Sapiens
gauuaucuuuuuguggugugaauaaaucuuuuaucuugaauguaauaagaauuugguggugucaau

SEQ ID NO: 281894 - RNA, 66 nt, Homo Sapiens
agacuuucuccaauguggacucugugugucagugaaugaauguaguaaaauucacuuuggaagguu

SEQ ID NO: 281895 - RNA, 66 nt, Homo Sapiens
aggugauaauuuugcuuuguguuacuuuuuugcucuugaauguaucguuaugauggucucuuauaa

SEQ ID NO: 281896 - RNA, 66 nt, Homo Sapiens
agauuucauugagggcaaggcugguggcagguacuaugaauguaauucauaauuuaaaaggaaaac

SEQ ID NO: 281897 - RNA, 66 nt, Homo Sapiens
uaaauaaguaucuauguaaauuuguuuaaaauaaacugaauguauuuaaugguccauuuauauguu

SEQ ID NO: 281898 - RNA, 66 nt, Homo Sapiens
agaaggaaucauuggugaacuuuccaagguuauuucugaauguaacaauuuccuuaaaaaugacuu

SEQ ID NO: 281899 - RNA, 66 nt, Homo Sapiens
cuagaauagauuaauaaauuggcuauguuguuccaaugaauguacagcacuuccauuaacuuuuga

SEQ ID NO: 281900 - RNA, 66 nt, Homo Sapiens
cauacuaguguguucauuauagaguaucuguagaggugaauguaaaaguaaguccaaucuauuuuc

SEQ ID NO: 281901 - RNA, 66 nt, Homo Sapiens
ggcaugaacauuacugcagguuuuugaugaauauaaugaauguauggaauucaauugaauuugcau

SEQ ID NO: 281902 - RNA, 66 nt, Homo Sapiens
uuucugcuuuaaaggcauguguguuuuuaaaauuaaugaauguagaugugugauugucugagugag

SEQ ID NO: 281903 - RNA, 66 nt, Homo Sapiens
aaguaaauuaaccaaaaaagcucaacguuacauuuuugaauguagugauuuaagacacuuuuugga

SEQ ID NO: 281904 - RNA, 66 nt, Homo Sapiens
gaggggagccuccaagugugugcccgauucgggugcugaauguaagugucagagcuaggguggggg

SEQ ID NO: 281905 - RNA, 66 nt, Homo Sapiens
auuaacuuuauuuuggucuguauguauauaugugacugaauguaagauuuaaggagcauuuaaaaa

SEQ ID NO: 281906 - RNA, 66 nt, Homo Sapiens
auaaggaucguauucccugcgagguauauacuaaaaugaauguaaagaggucugugcuaccucugu

SEQ ID NO: 281907 - RNA, 66 nt, Homo Sapiens
ugcaugggauugguccuugauaacuaagaacagcucugaauguauuguauaaauuauaaaugcaau

SEQ ID NO: 281908 - RNA, 66 nt, Homo Sapiens
gccuguucuaguccuggugguugaagcauuucugucugaauguaaacaguucauuucacugggauu

SEQ ID NO: 281909 - RNA, 66 nt, Homo Sapiens
agggaaauaaaagucuuuugagugaaauuugcauaaugaauguaaagugugugagaaaagaauaga

SEQ ID NO: 281910 - RNA, 66 nt, Homo Sapiens
aagaugaauauauuccuuacuguucaaccaagauuuugaauguaaugaaaacuuuauaaucgucau

SEQ ID NO: 281911 - RNA, 66 nt, Homo Sapiens
uauuuucuaaacacuuuacuagcacacugcccacaaugaauguaacauggcaaauaagaauguuug

SEQ ID NO: 281912 - RNA, 66 nt, Homo Sapiens
guuugcuaccuauuguaacuauuuuauauuuauuguugaauguaugcuauuuauuuaaauauuuaa

SEQ ID NO: 281913 - RNA, 66 nt, Homo Sapiens
aaauaagaguaaaugcccuaguguuucaaacauaucugaauguauacuguuuuguagccuuaagaa

SEQ ID NO: 281914 - RNA, 66 nt, Homo Sapiens
uuaaauuugcucaaagaagcucucuucuaccacaucugaauguaacagaaguaccuggagcaucau

SEQ ID NO: 281915 - RNA, 66 nt, Homo Sapiens
uuaucuggucuuuucuauaucauugccucucuuccuugaauguauucuucaggcuugacaacuuca

SEQ ID NO: 281916 - RNA, 66 nt, Homo Sapiens
ugguuacucagcucccuggaaagcaggcaagcauguugaauguaucuaguggucugauuuuaauuu

SEQ ID NO: 281917 - RNA, 66 nt, Homo Sapiens
aaacuggauuugauuucuuuuuaugaaaguuucauaugaauguaacuugauuuuuuacuauuauaa

SEQ ID NO: 281918 - RNA, 66 nt, Homo Sapiens
guacauaugguagacaauuugccuuaggaagugacuugaauguacaaagauacuugaugcacuuau

SEQ ID NO: 281919 - RNA, 66 nt, Homo Sapiens
guacacauaagccaaaacugagcauaaguccucuagugaauguaggcuggcuuucagaguaggcua

SEQ ID NO: 281920 - RNA, 66 nt, Homo Sapiens
gggaaauuaacacuggaacugacccuuuucuggcagugaauguaagcucuagcucccccaucuacu

SEQ ID NO: 281921 - RNA, 66 nt, Homo Sapiens
agaugguuacacuguuagaacacuauuuucagaaucugaauguaauuuguguaauaaaguguuuuc

SEQ ID NO: 281922 - RNA, 66 nt, Homo Sapiens
augauggguuuguugguauuuaaaaugaauacaacuugaauguaauuaaagugcuguuuuuuggaa

SEQ ID NO: 281923 - RNA, 66 nt, Homo Sapiens
agagucuugaacacagaauaacgauugugaccauuaugaauguaacuaauuucaguuguacuguga

SEQ ID NO: 281924 - RNA, 66 nt, Homo Sapiens
gauucuaaauagcgauuauaaucuccaacuuuauuuugaauguaccucuauuaguuucaauugagu

SEQ ID NO: 281925 - RNA, 66 nt, Homo Sapiens
cuucaggcagauuaaaagaaucauuuguugaacaacugaauguauaaaaaaauuauaaacuggugu

SEQ ID NO: 281926 - RNA, 66 nt, Homo Sapiens
caacuauuaccuagagugaacuuuaagcuuuauuguugaauguaauuccauuauauuuccuuuugu

SEQ ID NO: 281927 - RNA, 66 nt, Homo Sapiens
agaggggcaaaaauauuuugcaagcucuggaauuguugaauguauucuuuuauauaacuacauuaa

SEQ ID NO: 281928 - RNA, 66 nt, Homo Sapiens
ucuuuuauuuuguguccuugggcuauaaaagauuccugaauguaauuauaaggauuuggguuugga

SEQ ID NO: 281929 - RNA, 66 nt, Homo Sapiens
gcugaaguaguguuuaggauccuccauggcaguuagugaauguaagaaguacaguguuaaaguguu

SEQ ID NO: 281930 - RNA, 66 nt, Homo Sapiens
uaaacucgaucuaaaguuuagcauuuccaucugcgaugaauguaggccacaaaccacaguaguauu

SEQ ID NO: 281931 - RNA, 66 nt, Homo Sapiens
cccggccgccggggcacauagggguuuuaucgggcgugaauguaaauaaauuauauauauauauug

SEQ ID NO: 281932 - RNA, 66 nt, Homo Sapiens
aagcugaacagugaugaucuguagacauuuauggacugaauguaaugguugauauauguacauucu

SEQ ID NO: 281933 - RNA, 66 nt, Homo Sapiens
uagcguugaguuaaaccccucggauauucggaacugugaauguacaucguggcgacuuagaguugg

SEQ ID NO: 281934 - RNA, 66 nt, Homo Sapiens
gcucaguaaaugacagaacuguccgucauuugcauuugaauguaagauuggcagcaguuuuauaaa

SEQ ID NO: 281935 - RNA, 66 nt, Homo Sapiens
aagugcuuuuucaaaucuguacuuacuagacauaacugaauguaaacgugucuuaaaacaaggcuu

SEQ ID NO: 281936 - RNA, 66 nt, Homo Sapiens
agaguauaaaauguuugccagagugccaccuaacagugaauguauugggaaaacuuacuuuucaug

SEQ ID NO: 281937 - RNA, 66 nt, Homo Sapiens
gcugcauaagcuguuagguuugugugggaaggccuuugaauguaaaggccaacagaguugugaaug

SEQ ID NO: 281938 - RNA, 66 nt, Homo Sapiens
ugccacuacauuuacaauaauuaaugaugauuauucugaauguauuuauaauuuucuaguuccuuu

SEQ ID NO: 281939 - RNA, 66 nt, Homo Sapiens
uucaguguaagaugaaaauuagaagaaaguuaagucugaauguaaauaauucauuaauuuagugua

SEQ ID NO: 281940 - RNA, 66 nt, Homo Sapiens
guugaaaagucugguuuacugaauagauacauguuuugaauguaaaaucuaucagaaauuguaaga

SEQ ID NO: 281941 - RNA, 66 nt, Homo Sapiens
aucaguaguguuuacaagaucacuaagaauacaguuugaauguauaguccuaguaagugccacuuc

SEQ ID NO: 281942 - RNA, 66 nt, Homo Sapiens
aauacauuaaauuuuuaaaauguauucuacuggaaaugaauguaauagaugugauagugccgugaa

SEQ ID NO: 281943 - RNA, 66 nt, Homo Sapiens
cuacuggaaaugaauguaauagaugugauagugccgugaauguauuggccaguucaaaagaauagu

SEQ ID NO: 281944 - RNA, 66 nt, Homo Sapiens
uuugaauuacuagguuucuuggauccuuuucuaaauugaauguacuuaaugauuuauuaauuacca

SEQ ID NO: 281945 - RNA, 66 nt, Homo Sapiens
ugugggcaaacuauuuacccuuucugccacugaggaugaauguaacgagacuugguucuaguccaa

SEQ ID NO: 281946 - RNA, 66 nt, Homo Sapiens
cuuguuucuaccaauauucuuuaguuauuugccauaugaauguauuagaauuuuguuccaccaugg

SEQ ID NO: 281947 - RNA, 66 nt, Homo Sapiens
gauuuagaaaauauauauaaaaaacaaguuaaaaacugaauguacuuucuucuguuugugaagaaa

SEQ ID NO: 281948 - RNA, 66 nt, Homo Sapiens
agaaguguacugaagggacuaaccacuuauaugaauugaauguaucaaaaaaacacacauucagcc

SEQ ID NO: 281949 - RNA, 66 nt, Homo Sapiens
aauaaauaucgcuuagaauggauuccaggacaggagugaauguaaacgcggaagucagggcggcug

SEQ ID NO: 281950 - RNA, 66 nt, Homo Sapiens
aauguagggggucauggcuuuggaagaaauaccuuaugaauguaagcaagucucuccgaacucaaa

SEQ ID NO: 281951 - RNA, 66 nt, Homo Sapiens
cuauuauuaguuaggcuucugagcuugcaaucauauugaauguaugaagagcgaaaucaaauucuu

SEQ ID NO: 281952 - RNA, 66 nt, Homo Sapiens
ucuacuuauccagguuugcaaauguacauguucauuugaauguaaaucaccauuucuuggaacccc

SEQ ID NO: 281953 - RNA, 66 nt, Homo Sapiens
uauuuauuauuuauuuauuauuuauuuauuuacagaugaauguauuuauuugggagaccgggguau

SEQ ID NO: 281954 - RNA, 66 nt, Homo Sapiens
cggcuggggagggaagcacugucauguggacguggaugaauguaggaccagcaucacccucugcuc

SEQ ID NO: 281955 - RNA, 66 nt, Homo Sapiens
uaucugucauuauugcccugaucacaaacaaaagccugaauguacuauguuuaaaagacaaaccaa

SEQ ID NO: 281956 - RNA, 66 nt, Homo Sapiens
aacuacucuaaugcauuugguauguaacuuuaaauuugaauguauucuuguaaaacauccaguauu

SEQ ID NO: 281957 - RNA, 66 nt, Homo Sapiens
aggcccugggccugcuccuugccaccaaccgaaccgugaauguagggcccccagccucaccucugc

SEQ ID NO: 281958 - RNA, 66 nt, Homo Sapiens
guugaacagcauggaaucucauugccaaauuauuagugaauguauaguucagguauucuuugagac

SEQ ID NO: 281959 - RNA, 66 nt, Homo Sapiens
aaaaauuuuauucuuagcacacuguuauguccuaacugaauguauucaguauucaaauaaaagaca

SEQ ID NO: 281960 - RNA, 66 nt, Homo Sapiens
uuauuuuggauguaaagauuccugugucucauaauaugaauguauuuuuugauauacaagaaacug

SEQ ID NO: 281961 - RNA, 66 nt, Homo Sapiens
uaucuaauaaggagauuuaagauaagacccaauaaaugaauguauucuguaaugcuuuuaggaugu

SEQ ID NO: 281962 - RNA, 66 nt, Homo Sapiens
ugcaccaugaaauuaaaaucaucucauuccugaagaugaauguaggaccagacauuuuagcuucac

SEQ ID NO: 281963 - RNA, 66 nt, Homo Sapiens
gacuccaccucaaaaaauaaaaucaagauaaccucuugaauguaauagcucauagcacuuuaauuu

SEQ ID NO: 281964 - RNA, 66 nt, Homo Sapiens
gucaaguuagugauugcauuugaucccaaaacaagaugaauguaugcaaugggauguacauaaguu

SEQ ID NO: 281965 - RNA, 66 nt, Homo Sapiens
gaucuuccuugggccuuuggaaaaauaugugacaagugaauguaagucugugccuggagagcuaau

SEQ ID NO: 281966 - RNA, 66 nt, Homo Sapiens
acucucagacuauucugaguaaugcuugcuugcuaaugaauguauaggagaccacauuguaauugu

SEQ ID NO: 281967 - RNA, 66 nt, Homo Sapiens
uuuuuuugaaauuacauugcuuguuuaucagacaauugaauguaguaauucuguucuggauuuaau

SEQ ID NO: 281968 - RNA, 66 nt, Homo Sapiens
aaaccaaaggcacagauuuguguacaauauacccauugaauguauauccugagaaaaauuggggcc

SEQ ID NO: 281969 - RNA, 66 nt, Homo Sapiens
auguucugaaaauauggugaugguugcacaccauugugaauguacugaaugccauucagugguacc

SEQ ID NO: 281970 - RNA, 66 nt, Homo Sapiens
uugaaggggagaguucauggucugguauuuaggcugugaauguaccuguucguaaagaaaauuacu

SEQ ID NO: 281971 - RNA, 66 nt, Homo Sapiens
cccaccagagcagacaucuuaguuucucuccuaaaaugaauguaugaaaugaaggguugugaguuu

SEQ ID NO: 281972 - RNA, 66 nt, Homo Sapiens
uacuguauugucaucaaggauggucuuggagaauugugaauguaugaaccuugauauacacagaga

SEQ ID NO: 281973 - RNA, 66 nt, Homo Sapiens
ugcagaggaaguauuacaaauaagguuugaacuaagugaauguauccugagacuaacuuuguaugu

SEQ ID NO: 281974 - RNA, 66 nt, Homo Sapiens
uaguguguaggcacuguaguggucucucuaaacgcaugaauguauguacuuacgcagggagaugca

SEQ ID NO: 281975 - RNA, 66 nt, Homo Sapiens
uaaauagguuucuaaaaaguaucuacugauuugggcugaauguaugaauauagaaaaaaacauucu

SEQ ID NO: 281976 - RNA, 66 nt, Homo Sapiens
uuuuuuauuaacagggaaagaaguacacugauucugugaauguacccucuguuuauuuuuuauucu

SEQ ID NO: 281977 - RNA, 66 nt, Homo Sapiens
uggcuaaacgauucuuacucuauuacccaguaacauugaauguagagaauuauaauuugagaaaaa

SEQ ID NO: 281978 - RNA, 66 nt, Homo Sapiens
aucccuaauaacaaccuucauucagaacuuuauuucugaauguaacgaauaaaguguucuaugaaa

SEQ ID NO: 281979 - RNA, 66 nt, Homo Sapiens
auucuauaaauugccuuucuuuuuaaaaaucaaauuugaauguacuuugaguuucugacaaauuug

SEQ ID NO: 281980 - RNA, 66 nt, Homo Sapiens
auauuuuguuagaauggaaauaacucuuguuuaaacugaauguauggaaaacgugugucuggauau

SEQ ID NO: 281981 - RNA, 66 nt, Homo Sapiens
agccaggagagguagagugaaaaucccagccauggaugaauguacuaauuugaaagccaaguguua

SEQ ID NO: 281982 - RNA, 66 nt, Homo Sapiens
ugaaaccaagaaauguaaucaagcaguaaaaacaucugaauguagaccaugaucucaaguucuucc

SEQ ID NO: 281983 - RNA, 66 nt, Homo Sapiens
auguuccuaagacccuugucccagauacucuaaaugugaauguaugagcugggggagucaacccag

SEQ ID NO: 281984 - RNA, 66 nt, Homo Sapiens
aacuuauuucauaauugccuacauuuaucaugguccugaauguagcguguaagcuuguguuucuug

SEQ ID NO: 281985 - RNA, 66 nt, Homo Sapiens
cccuucuauuccugagggcucagagcugaccaugcaugaauguauggcaguguccacuuuucugua

SEQ ID NO: 281986 - RNA, 66 nt, Homo Sapiens
gcagaaaaauugacauugcugccuuuaagaauaccaugaauguaagaaauugaaagaaauuguaaa

SEQ ID NO: 281987 - RNA, 66 nt, Homo Sapiens
cugagugaguccuuuuuuuaugguguccucccucugugaauguacaggcggaacuguacgaacagc

SEQ ID NO: 281988 - RNA, 66 nt, Homo Sapiens
ugaacacuuaaaucuaacagaggauuuucagaguagugaauguaaggaaagcuuaauggaucucuc

SEQ ID NO: 281989 - RNA, 66 nt, Homo Sapiens
ucagcaucaaagaauucacacaggagagaaagcacaugaauguaaugaauguggaaaagcuuucag

SEQ ID NO: 281990 - RNA, 66 nt, Homo Sapiens
ucagcaucacaaaaugcauaggaaagagaaaucguaugaauguaaugaguaugagggcaguuucag

SEQ ID NO: 281991 - RNA, 66 nt, Homo Sapiens
guucaacaucagagcauucauaccaaagagaacucaugaauguaaugaagaugggaagauauuuau

SEQ ID NO: 281992 - RNA, 66 nt, Homo Sapiens
gaccaauuuaugggagaauugcacacagaugugaaaugaauguaaucuaauagaagccuaaucagc

SEQ ID NO: 281993 - RNA, 66 nt, Homo Sapiens
uugcuuauauugacaacaaaucaucucgcuaaagagugaauguaggccaggcgcgguggcucaugc

SEQ ID NO: 281994 - RNA, 66 nt, Homo Sapiens
uccgucucaaaaaaaaaaaaaaaaaaaaaaaaagagugaauguaauagucuugcagaaaaugaaug

SEQ ID NO: 281995 - RNA, 66 nt, Homo Sapiens
cauuuaaacuaaaacuaguauaauuuagucuuuucaugaauguacauacauaaaauuauacauaaa

SEQ ID NO: 281996 - RNA, 66 nt, Homo Sapiens
aggggaagggauuguuguguagucaagucaccaugcugaauguacacugauuccuuuaugaugacu

SEQ ID NO: 281997 - RNA, 66 nt, Homo Sapiens
gcuggggacaggcaugcugcgagccagagcagcaguugaauguaaugaggccagccggccucucga

SEQ ID NO: 281998 - RNA, 66 nt, Homo Sapiens
acaccuugacauuucuuuuuacccugauuguuuauaugaauguagaucuuuacaauuucaaauguu

SEQ ID NO: 281999 - RNA, 66 nt, Homo Sapiens
cgggaggacaagggcuuccauucuuggagaaacauaugaauguauuaagcaagccauuuaauccgg

SEQ ID NO: 282000 - RNA, 66 nt, Homo Sapiens
uuuuguguuauucgugaauagugauggauggcacaaugaauguauauuuucagcucaauuguuaau

SEQ ID NO: 282001 - RNA, 66 nt, Homo Sapiens
auuuggcauucucugaauuuagcauuagcuuccugcugaauguagucccuggacugccggaauccc

SEQ ID NO: 282002 - RNA, 66 nt, Homo Sapiens
cuucauacagggaugguguucacugcuaagaauauuugaauguaugguuccgugguuaaacucgcu

SEQ ID NO: 282003 - RNA, 66 nt, Homo Sapiens
guacugugucugugaaaacuguuauacuguguauagugaauguauugguaaggaugggaauauuuu

SEQ ID NO: 282004 - RNA, 66 nt, Homo Sapiens
ccucagccuucucagcauuuggcucuuuguuauuauugaauguaccacaaauacuuagaacuggaa

SEQ ID NO: 282005 - RNA, 66 nt, Homo Sapiens
ggggacagcucaggguuguuuuguauuuaauugacaugaauguaaaaggacauuugacuuuuauuu

SEQ ID NO: 282006 - RNA, 66 nt, Homo Sapiens
agaaaauuuuuuuucaaaaaaugaacauaacucugcugaauguaaauaaaaauguagaaauucuuc

SEQ ID NO: 282007 - RNA, 66 nt, Homo Sapiens
caacauuccaacuggagcucucaagaggaagcugcaugaauguaauaugugucaugaguguuuaaa

SEQ ID NO: 282008 - RNA, 66 nt, Homo Sapiens
agagaaagcuuauuggacucaaagauuuaaauaagaugaauguaaauauuucuucacugugacagc

SEQ ID NO: 282009 - RNA, 66 nt, Homo Sapiens
ggggggaucgaaaagaagguuuuaagucuccuuuacugaauguaagaauuugggauacuaaaguag

SEQ ID NO: 282010 - RNA, 66 nt, Homo Sapiens
uugguugcugauguuuauaagaauuggucuuaauguugaauguauucaggaccuagcuguuguaaa

SEQ ID NO: 282011 - RNA, 66 nt, Homo Sapiens
uaacaccacugaguuaaacaugauggcuacacauugugaauguaauauuuuugaacuaaauagugg

SEQ ID NO: 282012 - RNA, 66 nt, Homo Sapiens
uaauucaugaauaaaugcacguuucuuccuucaaacugaauguaauuugaugaacuuuggaguacu

SEQ ID NO: 282013 - RNA, 66 nt, Homo Sapiens
guaaaaggggaaaugccaagcuuuaaaaaguaagccugaauguagaaaauaaaaaugcuuguauuu

SEQ ID NO: 282014 - RNA, 66 nt, Homo Sapiens
ugcucuuguuggaaaaauguuggaaauguucuauauugaauguacaagaaagacuguaacuauugc

SEQ ID NO: 282015 - RNA, 66 nt, Homo Sapiens
ucaaauuuuuaggggagggucaagucaugcaauaauugaauguacccuugcuaaaaauauuaagac

SEQ ID NO: 282016 - RNA, 66 nt, Homo Sapiens
uuuugagaaauacgagucugggcagacagugucuucugaauguaagcucuaaagauuucaaauagu

SEQ ID NO: 282017 - RNA, 56 nt, Homo Sapiens; identical to SEQ ID NO: 227330

SEQ ID NO: 282018 - RNA, 66 nt, Homo Sapiens
cuucagaaguauauagauacuuccggugacuacauaugaauguacuuucaauauuauuuuuuuauu

SEQ ID NO: 282019 - RNA, 66 nt, Homo Sapiens
gcauauacugcacauacugaaauagagggaaaucacugaauguaaagagguuucaucuaugccccc

SEQ ID NO: 282020 - RNA, 66 nt, Homo Sapiens
aaccaggacaugagagacauagaaaaacagaagucaugaauguaaauugaaugagaggcuuaacau

SEQ ID NO: 282021 - RNA, 66 nt, Homo Sapiens
gauaaacuauaucuuggcuaguggcuacugugucugugaauguaaccaguacuucuuuaagcucua

SEQ ID NO: 282022 - RNA, 66 nt, Homo Sapiens
auuuuagucaugaguuguuuucaguuuucagacgaaugaauguaauaggaaacuauggaguuacca

SEQ ID NO: 282023 - RNA, 66 nt, Homo Sapiens
uuuuagacuucuuaauaaccuaaauauuuaaaauaaugaauguaacaccuuuuuuaguucacugau

SEQ ID NO: 282024 - RNA, 66 nt, Homo Sapiens
ugcuggaauuacaguugugagccaccacaccuggcuugaauguagauuuuaauaauugaauuuauu

SEQ ID NO: 282025 - RNA, 66 nt, Homo Sapiens
uuaccagauucacuucugaauuggccagaggaaaucugaauguauuauccugugugugucuaggua

SEQ ID NO: 282026 - RNA, 66 nt, Homo Sapiens
ucuggggaaaacaguuguggaauucuuacuucauuaugaauguauuuaaaaaacaaacaccaaaua

SEQ ID NO: 282027 - RNA, 66 nt, Homo Sapiens
ccaggagugugagagacacaaagaauaugcacagucugaauguauauucaagaaaaaaaaaaaaaa

SEQ ID NO: 282028 - RNA, 66 nt, Homo Sapiens
cuuucugucucaaacccugguuaagagaaugaauucugaauguacacuggcagcauaauuuugugg

SEQ ID NO: 282029 - RNA, 66 nt, Homo Sapiens
guuccuguuagcguuacuucgcagcauggucuugacugaauguacuguugcucucugccacagcuu

SEQ ID NO: 282030 - RNA, 66 nt, Homo Sapiens
cagccacccuguugugguauuucauguauaucucauugaauguauagccuacugugugcaaagugu

SEQ ID NO: 282031 - RNA, 66 nt, Homo Sapiens
ugccaggucuuagaagucagaaaggaguagggcuagugaauguauccuuucagugaaagaggaagg

SEQ ID NO: 282032 - RNA, 66 nt, Homo Sapiens
gaucaaauuuauuuauuugaaguugaaggauuuaacugaauguaugcacuuuagguauuacuacau

SEQ ID NO: 282033 - RNA, 66 nt, Homo Sapiens
uaaauguauguauuuaaggacauacccaugucagauugaauguauuaaauguugacaggcaaauuu

SEQ ID NO: 282034 - RNA, 66 nt, Homo Sapiens
aacuguugguggcccugaauuccuauagcagaaaggugaauguacaagacuaguaaauugucugcc

SEQ ID NO: 282035 - RNA, 66 nt, Homo Sapiens
ucuuuuugugagcuuacuugugcuaaauggauuagaugaauguacuggaagcugauuugcaacauu

SEQ ID NO: 282036 - RNA, 66 nt, Homo Sapiens
auacacacacacuuuagagauauguauuacuauacaugaauguauuugggagaaaaacauuuuaga

SEQ ID NO: 282037 - RNA, 66 nt, Homo Sapiens
uuauuuaaaagauuuuauggagaugcucugagaaauugaauguaccauauaaauuaucugaauauu

SEQ ID NO: 282038 - RNA, 66 nt, Homo Sapiens
agcucugugaaucagaccagguguuauuuugagucaugaauguacaaaucauuuggguuugagggu

SEQ ID NO: 282039 - RNA, 66 nt, Homo Sapiens
cuuucaguacgagacaaaguuggaccugacccacacugaauguaguugcguucuggcuaacacugu

SEQ ID NO: 282040 - RNA, 66 nt, Homo Sapiens
acuguggacauugacuucccgccaacguaugagaaaugaauguaacaggcuauuucaaaggaacca

SEQ ID NO: 282041 - RNA, 66 nt, Homo Sapiens
uaagcugcuaauuguuccuguuggggugacagauacugaauguauacguauugugccugagcucac

SEQ ID NO: 282042 - RNA, 66 nt, Homo Sapiens
gggucuuuuauuuguacccaugugucugucacaccaugaauguaccuggggaaaucaacugaccuc

SEQ ID NO: 282043 - RNA, 66 nt, Homo Sapiens
aauaauuguugacuuucuuagauucacuuccauaugugaauguaagcucuuaacuaugucucuuug

SEQ ID NO: 282044 - RNA, 66 nt, Homo Sapiens
ucaaaaugagaugcacucauuuaaaucugcauucagugaauguauugggagaaaaauaggucuugc

SEQ ID NO: 282045 - RNA, 66 nt, Homo Sapiens
ccuuaauauuaauggacuguuucagguaaaagagaaugaauguaugauugugaacugugaagagaa

SEQ ID NO: 282046 - RNA, 66 nt, Homo Sapiens
ugccgccaguucucaaguuuuccuccuaacuccauuugaauguaagggcagcuggcccccaaugug

SEQ ID NO: 282047 - RNA, 66 nt, Homo Sapiens
gauucugaaccacuagaguuuccuugauucagacuuugaauguacuguucuauaguuuuucaggau

SEQ ID NO: 282048 - RNA, 66 nt, Homo Sapiens
auauuuggcaggugaguggauggauagauggauaggugaauguagguggacaggugacugggugga

SEQ ID NO: 282049 - RNA, 66 nt, Homo Sapiens
aauauauguucuucauauuuuaccuuuacauuguggugaauguaacuuuuuauguaauaucaugug

SEQ ID NO: 282050 - RNA, 66 nt, Homo Sapiens
guuguuguguuuuuuuuuaacagauugucugauuucugaauguaaacgcauucaguggccuaucuc

SEQ ID NO: 282051 - RNA, 66 nt, Homo Sapiens
uauuauuagaguccgaaagucucagaagauaaggugugaauguauggaaccucccccauuuaaaua

SEQ ID NO: 282052 - RNA, 66 nt, Homo Sapiens
aagacagucccagaaguaaaaaccaauugaggguagugaauguaaggauaucagagauacacaaaa

SEQ ID NO: 282053 - RNA, 66 nt, Homo Sapiens
uuacuuuuguauuugaauuuagauauuuuggagugaugaauguaguuuuuaacaauucuccuuaaa

SEQ ID NO: 282054 - RNA, 66 nt, Homo Sapiens
gccuucaacaugaugcacauuauuucacgacagaguugaauguaugaccucauuuuucuauauauu

SEQ ID NO: 282055 - RNA, 66 nt, Homo Sapiens
ugucuuggauagguugcuggucaauugccuuuuuaaugaauguacuacccuuaguaccaaauacac

SEQ ID NO: 282056 - RNA, 66 nt, Homo Sapiens
caagugaguuuaacaaagaaacauuuagaauagaucugaauguaagaacuacagaacuguuucaga

SEQ ID NO: 282057 - RNA, 66 nt, Homo Sapiens
aacuuuuuuuuuuuaacacacuaaucuucaguuggaugaauguaauguauaacuauguuuucagca

SEQ ID NO: 282058 - RNA, 66 nt, Homo Sapiens
aauaaccuauuguuagaaaauauguguuuuuauaaaugaauguaaaauaauuaaaugaauugugaa

SEQ ID NO: 282059 - RNA, 66 nt, Homo Sapiens
uucaaaggagcugaauguguuaugcuuccaaacaacugaauguaaaacacuccuagccaguuguug

SEQ ID NO: 282060 - RNA, 66 nt, Homo Sapiens
uacugaccuguuguaggcagcuaucuuacagacgcaugaauguaagaguaggaagggguggguguc

SEQ ID NO: 282061 - RNA, 66 nt, Homo Sapiens
cauucuacccucuuuuuccugcuaauccugucauaaugaauguagcuucucaguucacuguauaug

SEQ ID NO: 282062 - RNA, 66 nt, Homo Sapiens
acacuaacgacuucagggcagggcucugauauuccaugaauguaucaggaaauauauaugugugug

SEQ ID NO: 282063 - RNA, 57 nt, Homo Sapiens; identical to SEQ ID NO: 227376

SEQ ID NO: 282064 - RNA, 66 nt, Homo Sapiens
auuaugcucuggcaucuaacauaugauucuguaguaugaauguaaucaguguauguuaguacaaau

SEQ ID NO: 282065 - RNA, 66 nt, Homo Sapiens
ccaauuuucaguauuuuaacuaccucaauaaugcuaugaauguaagauauugggauagagauccca

SEQ ID NO: 282066 - RNA, 66 nt, Homo Sapiens
agcagguaaauugucgggggagagaguuagcauguaugaauguaaggaugagggaagcgaagcaag

SEQ ID NO: 282067 - RNA, 66 nt, Homo Sapiens
uuaagugcccacauuugauggaggguggaaauaauuugaauguauuugauuuauaaguuuuuuuuu

SEQ ID NO: 282068 - RNA, 66 nt, Homo Sapiens
gcccuucacccaaccucucccaccuccaccccacaaugaauguauuuauugugagaauggcuacac

SEQ ID NO: 282069 - RNA, 66 nt, Homo Sapiens
cccuguccagcacagcuucuggcacaggaugcuuggugaauguacccuuucuuucccucccugcag

SEQ ID NO: 282070 - RNA, 66 nt, Homo Sapiens
gacugacggggaaaaaaaaaaaaaaagaauggggugugaauguaccaacacugaaucuuacagcag

SEQ ID NO: 282071 - RNA, 66 nt, Homo Sapiens
gaagcuguaagccagcccauaacucauagauaaauaugaauguaggcucuauuaccaauuuuucag

SEQ ID NO: 282072 - RNA, 66 nt, Homo Sapiens
aauguuugguauuuaauucuauccaucuuucagaguugaauguaaugcacaugcuuuaagauuucu

SEQ ID NO: 282073 - RNA, 66 nt, Homo Sapiens
caccuguguuaccacgaauguauguuaaaugccauuugaauguaauuagggcaguuuggugcaauu

SEQ ID NO: 282074 - RNA, 66 nt, Homo Sapiens
cugcuagcucuccgaaggccaagagggccaucugccugaauguaacguucuguggguuuggguggg

SEQ ID NO: 282075 - RNA, 66 nt, Homo Sapiens
ugaauaacuucaguauacuuagggaucuuuauaguuugaauguauucuugaugccaguaaucuaua

SEQ ID NO: 282076 - RNA, 66 nt, Homo Sapiens
agucuuuccaagagccuacuacuccauuguagacuuugaauguaguauagauccauuuugugccac

SEQ ID NO: 282077 - RNA, 66 nt, Homo Sapiens
cccaaauuguggaauugccaauuucugggauuacaaugaauguaagugaggguaaauggagaaaau

SEQ ID NO: 282078 - RNA, 66 nt, Homo Sapiens
auuaucuauagauuauacauuuuugccauuguccccugaauguaguauguucugcauugagccuag

SEQ ID NO: 282079 - RNA, 66 nt, Homo Sapiens
auaguaugggaauuauuuuuuauguuaaauagaaacugaauguacuggguugaaugguguccucuc

SEQ ID NO: 282080 - RNA, 66 nt, Homo Sapiens
uugcauggagugaccauagcuccuucucucuuacauugaauguagagaauguagccauuguagcag

SEQ ID NO: 282081 - RNA, 66 nt, Homo Sapiens
caaaaauccuuuuauggaaaccauuuuuuuaaaaagugaauguacacaaauccacagaggacugug

SEQ ID NO: 282082 - RNA, 66 nt, Homo Sapiens
aaaucauguucuuauaccuaauuuuagucuuucaaaugaauguacuguaaugcuuguauguauaaa

SEQ ID NO: 282083 - RNA, 66 nt, Homo Sapiens
agccccuucaggaaggaccccccaaagcugaggggcugaauguagccuuuucaacagagaaggcuc

SEQ ID NO: 282084 - RNA, 66 nt, Homo Sapiens
aaucucaucguaaggcagcuaguucuaauuugcauuugaauguauaacaaauugcaucacuuuuca

SEQ ID NO: 282085 - RNA, 66 nt, Homo Sapiens
uuuagaguugucuuucagcauucaaucaggcugagcugaauguagugauguuuacauuguuuacau

SEQ ID NO: 282086 - RNA, 66 nt, Homo Sapiens
gcuucaucucuuuagagaaguccaagcaacagccuuugaauguaaccaauccuacuaauaaaccag

SEQ ID NO: 282087 - RNA, 66 nt, Homo Sapiens
caaaaggauggucacucuuccgaggucucccugaaaugaauguauuucucccccaaaagagcugau

SEQ ID NO: 282088 - RNA, 66 nt, Homo Sapiens
uacagaugcagaagguuucucuggauagcacaccucugaauguaaaucaugauaaaauggauauuu

SEQ ID NO: 282089 - RNA, 66 nt, Homo Sapiens
ccacaugcuauugucugaacuaccugucaaaaauuuugaauguacaucauuuuuuaaugugcucug

SEQ ID NO: 282090 - RNA, 66 nt, Homo Sapiens
gggggcuucaagguauggguuugccaaacuuggucuugaauguacuccugaaagaugcuaaucuau

SEQ ID NO: 282091 - RNA, 66 nt, Homo Sapiens
gaaugcauacugccuaggccgguacaggaauccuuaugaauguauaucccaacuggggcuccuggg

SEQ ID NO: 282092 - RNA, 66 nt, Homo Sapiens
cuccauaaaauuccaguauuaccuccuuucuuuaugugaauguauuccuguuccaaaacaaaauuc

SEQ ID NO: 282093 - RNA, 66 nt, Homo Sapiens
aaaaacuaauuuuggagaagcuuuguauaaccuaccugaauguauucccaggccucgggaccaacu

SEQ ID NO: 282094 - RNA, 66 nt, Homo Sapiens
uuuucuaacaaacucaaaauuuugauucaccaaacaugaauguacaauucuuuucccagaagaguc

SEQ ID NO: 282095 - RNA, 66 nt, Homo Sapiens
auuugugaaacuugaguuuuaagugacuucuuuuugugaauguaaacgugugugacuuugagcaaa

SEQ ID NO: 282096 - RNA, 66 nt, Homo Sapiens
ggggaaaaauaaggugagaaccccacacuuagccauugaauguaaagggagcauuuacagaugaau

SEQ ID NO: 282097 - RNA, 66 nt, Homo Sapiens
uuuuuuuguuguuguuaucuucaaauacccguacuuugaauguaggaguaguauaauuuguuacuu

SEQ ID NO: 282098 - RNA, 66 nt, Homo Sapiens
ugaacauacuuuccuauuucuaugugcaguauacguugaauguauacuuuguauuguaguaaccaa

SEQ ID NO: 282099 - RNA, 66 nt, Homo Sapiens
gaugccaccucccucucucuaggagagaccauggugugaauguagauaucccaagauccuggggaa

SEQ ID NO: 282100 - RNA, 66 nt, Homo Sapiens
uuaaaacgugugcccuuuuauaguaguaaugucauaugaauguaucaaucauuauuuauuuuuuug

SEQ ID NO: 282101 - RNA, 66 nt, Homo Sapiens
uaugagagugcugccauuaaggcuuugguugguccgugaauguaguuccuuucuaggcuuggagau

SEQ ID NO: 282102 - RNA, 66 nt, Homo Sapiens
uugcaucccugguuuuggaccauuaagucuuugaacugaauguauucuuaauguugagcuaagaag

SEQ ID NO: 282103 - RNA, 66 nt, Homo Sapiens
aggugucugccccgcguuuccugccugcggaccagaugaauguagcagauccccagccucuggccu

SEQ ID NO: 282104 - RNA, 66 nt, Homo Sapiens
uaugauacuaguaauucauaagggaucuguguaaucugaauguauuugaauaacuuuagcucuacu

SEQ ID NO: 282105 - RNA, 66 nt, Homo Sapiens
auuuucaggucauuuccugauagucuagucagcuuaugaauguaagcaaaacaggaccaaugaaag

SEQ ID NO: 282106 - RNA, 66 nt, Homo Sapiens
cgaaagacugaggcauuuuccagucuacuugccuaaugaauguauaggaacugucuaugaguaugg

SEQ ID NO: 282107 - RNA, 66 nt, Homo Sapiens
gccacagcucaggaaaaagaugaggcauaacgaccuugaauguaauuggaguaagugacaaaauaa

SEQ ID NO: 282108 - RNA, 66 nt, Homo Sapiens
auaagaaaaaaauuugccuuuaagaguuacuuuuguugaauguauuugacuuaguucuuauuuuaa

SEQ ID NO: 282109 - RNA, 66 nt, Homo Sapiens
ugucuucucuucauuaccuuuuaaggacagugucuuugaauguagggcccacccugaucuagggug

SEQ ID NO: 282110 - RNA, 66 nt, Homo Sapiens
caaaucuguugucauguuaguaaaugauuugaaaacugaauguaauacuugaguagauuuuuuuuu

SEQ ID NO: 282111 - RNA, 66 nt, Homo Sapiens
gugacauagaguaaacaucuuaguaauauauuaaagugaauguaaauggugguuaaaauuacauua

SEQ ID NO: 282112 - RNA, 66 nt, Homo Sapiens
ugcuucuaaccccaguagaguagaacuaaauugcacugaauguauaguuaacucugucuugaauuc

SEQ ID NO: 282113 - RNA, 66 nt, Homo Sapiens
uaauaauuuuuugucauuugucuuuauguccagcuaugaauguagauuuugugucccgacagcccu

SEQ ID NO: 282114 - RNA, 66 nt, Homo Sapiens
gcuuagugacccccaucuuguaaccuguugcaagagugaauguaaaaaauaguuguggcauuuuaa

SEQ ID NO: 282115 - RNA, 66 nt, Homo Sapiens
aguugaacacacuaugaagaauuccagguguacuagugaauguaauuuauaguugccaaaaaaaaa

SEQ ID NO: 282116 - RNA, 66 nt, Homo Sapiens
uuuacccucauauucuuuaaaaaacuuaaagcauuaugaauguagagaaauucaccagagcucacu

SEQ ID NO: 282117 - RNA, 57 nt, Homo Sapiens; identical to SEQ ID NO: 227430

SEQ ID NO: 282118 - RNA, 66 nt, Homo Sapiens
uggguuuuuuaguugaauuuuuuuuaacauuccucaugaauguaaauuuguacuauuuaacugacu

SEQ ID NO: 282119 - RNA, 66 nt, Homo Sapiens
aggauuugggcugccccaggcccacccagggggcucugaauguauuuuguaccguguuucuuuccc

SEQ ID NO: 282120 - RNA, 66 nt, Homo Sapiens
acccacugcucugaugggugguuuguccaaggaugcugaauguaaugccuggucaauguggaagcc

SEQ ID NO: 282121 - RNA, 66 nt, Homo Sapiens
cugcccuugaggagcacaggcagaagugugaacuugugaauguaauugaucuuuccuuccuuccag

SEQ ID NO: 282122 - RNA, 66 nt, Homo Sapiens
acaucguuaacggguaccauuaaauauucugagaggugaauguaaaauauaaaagguauagguuuu

SEQ ID NO: 282123 - RNA, 66 nt, Homo Sapiens
uuauuagucauguauauuuuaaaugcuaacauuugaugaauguaaguuuccacauuguugcuguuu

SEQ ID NO: 282124 - RNA, 66 nt, Homo Sapiens
ucacauauuuuucacuugaauuuuuuuggaaauagcugaauguaaauagcagggaggaagaagcaa

SEQ ID NO: 282125 - RNA, 66 nt, Homo Sapiens
ugaacaccagugaauuuacacugcaaagaaaaacuaugaauguauggaauuuuuuaaaaagaagua

SEQ ID NO: 282126 - RNA, 66 nt, Homo Sapiens
uuaauacucuuguaggagaaaaagcaacuguauaaaugaauguagagugacuuucugcaauauuuc

SEQ ID NO: 282127 - RNA, 66 nt, Homo Sapiens
cgacauuaugggcuuauuuauuuaaaauaaaaauucugaauguacauuguuacucugguucuuugu

SEQ ID NO: 282128 - RNA, 66 nt, Homo Sapiens
ugcacugucacuuugcucugcccacacuugagaggaugaauguaugugagucaaugugcaguguag

SEQ ID NO: 282129 - RNA, 66 nt, Homo Sapiens
caaaggaauuauggcugguauguugguacuagauacugaauguaaacacuauuggaaggaguuaga

SEQ ID NO: 282130 - RNA, 66 nt, Homo Sapiens
uaaauauuuuuaacuccuauaacauauauguauguaugaauguacaaauuguuaaacauuuagaca

SEQ ID NO: 282131 - RNA, 66 nt, Homo Sapiens
guuacacuguucacaaagguaguuugucaucccugaugaauguaaauucuaggcaucauguccuau

SEQ ID NO: 282132 - RNA, 66 nt, Homo Sapiens
auaaaauaaaaugcggacugaaugcaggaacuuauaugaauguacuugugaccugguuaccuugga

SEQ ID NO: 282133 - RNA, 66 nt, Homo Sapiens
uuguuugcacuuaauccuuacucgcuagucaagcugugaauguauauuuauaaauugugauguagc

SEQ ID NO: 282134 - RNA, 66 nt, Homo Sapiens
auauucuaaacaucuguuuuauuuuguauccuaaaaugaauguaugugccuaaaaugugaaagcau

SEQ ID NO: 282135 - RNA, 66 nt, Homo Sapiens
ccauuuuccaaaaaggaaacuguucuaagacauuucugaauguagauuaguuuuuuuuuaaaugcu

SEQ ID NO: 282136 - RNA, 66 nt, Homo Sapiens
cauaaaggaauccaaagcuuuucuuuuaacaugucuugaauguacaaugguuuauuuugaugaaag

SEQ ID NO: 282137 - RNA, 66 nt, Homo Sapiens
auggucccauuucaauuuccacuuaggagaaaaugcugaauguaaguuacagagcuauguaaaggg

SEQ ID NO: 282138 - RNA, 66 nt, Homo Sapiens
agaaagggacucauccagaagcacuuccuuaaguuaugaauguacuguguagggcauuuucugauu

SEQ ID NO: 282139 - RNA, 66 nt, Homo Sapiens
uaccaaaagauuuagaagugugguuaugcuuaaauaugaauguaauuucaguuuucuuuuuuauuu

SEQ ID NO: 282140 - RNA, 66 nt, Homo Sapiens
cuuauaaagcacaaagcauacuuaugucaucuauguugaauguaagcuuacauuugaguaugguaa

SEQ ID NO: 282141 - RNA, 66 nt, Homo Sapiens
ucauucaaaucuguauuccuuaauguauuuauggaaugaauguauuuggugggaagguuuugcugc

SEQ ID NO: 282142 - RNA, 66 nt, Homo Sapiens
augagaaauucaacguuaauuuuuacuguuuuuagaugaauguacgcaaucucccuucacaaguuu

SEQ ID NO: 282143 - RNA, 66 nt, Homo Sapiens
uuccugaggcaucagaacuucauugggcaguuuaaaugaauguacaguaauacaaccucagugugu

SEQ ID NO: 282144 - RNA, 66 nt, Homo Sapiens
agguuaggagacuaaaauauaaauuaaguugugauuugaauguagauugguaucaccuccaacucc

SEQ ID NO: 282145 - RNA, 66 nt, Homo Sapiens
gaguaagaaacuguccgauaugaaucacaacgugggugaauguaguauuuuccugaagugugaaag

SEQ ID NO: 282146 - RNA, 66 nt, Homo Sapiens
acauauuagugauugaaguauuuugacuuuugagauugaauguaaaauauuuuaaauuugggauca

SEQ ID NO: 282147 - RNA, 66 nt, Homo Sapiens
uagcacacacauacacaccaccaccaacaacgcuugugaauguauuuuucuguuagcuggguuuac

SEQ ID NO: 282148 - RNA, 66 nt, Homo Sapiens
cggaacaguguggaagcagauauuuuuacugcuuucugaauguagaaaaguguucauugcacaaua

SEQ ID NO: 282149 - RNA, 66 nt, Homo Sapiens
ucagugcuauaaaugccagacagagcuucucugggcugaauguauguuguuuagagagccugucac

SEQ ID NO: 282150 - RNA, 66 nt, Homo Sapiens
uagcacuaaacguuuucuuugagcagaguuuuaaaaugaauguaaaaucagaauuaaauuuguaua

SEQ ID NO: 282151 - RNA, 66 nt, Homo Sapiens
aucacuugagucuaggaguuacuugggaggaucacuugaauguaggcccaagucugagucccaguu

SEQ ID NO: 282152 - RNA, 66 nt, Homo Sapiens
uuuuucuccaaagaacagcaauauacuugaaaaaaaugaauguauugagcaucuuuguauauugca

SEQ ID NO: 282153 - RNA, 66 nt, Homo Sapiens
auaaguacccaugauuucuaaauaaugccuuccaucugaauguaaacuuuuuuuuaauacauaucc

SEQ ID NO: 282154 - RNA, 66 nt, Homo Sapiens
guaaauaaguaacuuugacucaguugcacgaaggcaugaauguauuguuggcuacgcagggauggg

SEQ ID NO: 282155 - RNA, 66 nt, Homo Sapiens
aaaauuaucaaauuguauucguuaaaaaguuuuuauugaauguaugaguauuaugucuuuauuguu

SEQ ID NO: 282156 - RNA, 66 nt, Homo Sapiens
auucaaugauuuuuuaugaugaaagaaaaauuaucuugaauguaguagacaauagcccaaagccaa

SEQ ID NO: 282157 - RNA, 66 nt, Homo Sapiens
gugaucucccugaacauuuuuauugcaagacaaaguugaauguaaaaacuuuagaacagaggauug

SEQ ID NO: 282158 - RNA, 66 nt, Homo Sapiens
uuuugacauggaugauucugaggaggaagcuguuauugaauguauagagauuuauccaaauaaaua

SEQ ID NO: 282159 - RNA, 66 nt, Homo Sapiens
auuuguauugaaaugaaaccaccaguguuaucaacuugaauguaaauguacaugugcagauauucc

SEQ ID NO: 282160 - RNA, 66 nt, Homo Sapiens
aguagaccugaccuuguuauuuauuagauaacauuuugaauguauccauuggauuucuaaaaugua

SEQ ID NO: 282161 - RNA, 66 nt, Homo Sapiens
ucaucacaguauuguuaggagauuuaaaugaauuagugaauguaagauacuuuagaaagcauguaa

SEQ ID NO: 282162 - RNA, 66 nt, Homo Sapiens
cauggccuaagaaauaaggaucaauaaggaaugauuugaauguaauuuugugaauguguggaaaau

SEQ ID NO: 282163 - RNA, 66 nt, Homo Sapiens
auccauuccuacuguauuucuguaugaauguguuugugaauguauguguaaaagucuuucuuuucc

SEQ ID NO: 282164 - RNA, 66 nt, Homo Sapiens
uugaugcacuuugaauauugagauauuuugcacggaugaauguaugggaacuacccaugaugaugu

SEQ ID NO: 282165 - RNA, 66 nt, Homo Sapiens
gcaaauuccuguacauagagauauauuuuuuaagugugaauguaacaacauacugugaauuccauc

SEQ ID NO: 282166 - RNA, 66 nt, Homo Sapiens
guucuagugggauacacaaauucugcaaguauauugugaauguauuccaugacgcgccaggcacag

SEQ ID NO: 282167 - RNA, 66 nt, Homo Sapiens
uuuuacugugaagcuaucugaaaccuauuaguauugugaauguagaguauaauuuguuaacacuag

SEQ ID NO: 282168 - RNA, 66 nt, Homo Sapiens
cagggauaugcguauaguuuauuguaguuuaaugauugaauguagaccugccauuuuaccagcauu

SEQ ID NO: 282169 - RNA, 66 nt, Homo Sapiens
ggaaagaaaggaaaaacugaguuucacugugaauagugaauguaaagaaaaaaaaaacaugcaccu

SEQ ID NO: 282170 - RNA, 66 nt, Homo Sapiens
uaugacuuucuggaaaguuuuauauaaaauguacaaugaauguaaauauaaauuuguauuuaugug

SEQ ID NO: 282171 - RNA, 66 nt, Homo Sapiens
aauuucagauucucuaaaacauuuuaauuccauucuugaauguagacuuuuuuccccucacauuga

SEQ ID NO: 282172 - RNA, 66 nt, Homo Sapiens
uauuauuccucuugcugguccacacacacauuaagaugaauguaauguuaauguaaacagaacugg

SEQ ID NO: 282173 - RNA, 66 nt, Homo Sapiens
uggggaaaaucaagaugguacagagaccagaccaggugaauguaacauucuacucuucuaagcuua

SEQ ID NO: 282174 - RNA, 66 nt, Homo Sapiens
agacacaaaugaagaagaacgcugauauuagcuuguugaauguaagccuucacucagagaagcaag

SEQ ID NO: 282175 - RNA, 66 nt, Homo Sapiens
acauaaugguucucuucuguacuaaaucagaaagucugaauguagccaaugucagguuauacuaaa

SEQ ID NO: 282176 - RNA, 66 nt, Homo Sapiens
auguuuuacuuuaaaugugugucucagucaacagugugaauguaucuugcagugagcaucacuaca

SEQ ID NO: 282177 - RNA, 66 nt, Homo Sapiens
gguccuugugacuucaacggacucuuccaaauuguaugaauguaucaauguauuagauaaacccag

SEQ ID NO: 282178 - RNA, 66 nt, Homo Sapiens
uucauuagggcuugcagacaaugucaccuaaauugcugaauguacucauuauaauaugauaucuga

SEQ ID NO: 282179 - RNA, 66 nt, Homo Sapiens
uacuuugcaguaaguaucauguaaauaugcaaauguugaauguaauauagauuguguccucauuga

SEQ ID NO: 282180 - RNA, 66 nt, Homo Sapiens
aauuaaaaaguuucaaaucuagacacuaaaugugugugaauguacaaagaaaacaaaccauugcuu

SEQ ID NO: 282181 - RNA, 66 nt, Homo Sapiens
ugcggggcagcguggccccaccggacuagcacaugaugaauguaaaguuggcacaaugaaaaugac

SEQ ID NO: 282182 - RNA, 66 nt, Homo Sapiens
auaaugcccuuuagggcacaacuaguuaucaguaacugaauguaucuuaaucauuauggcugcuuc

SEQ ID NO: 282183 - RNA, 58 nt, Homo Sapiens; identical to SEQ ID NO: 227496

SEQ ID NO: 282184 - RNA, 66 nt, Homo Sapiens
aauguauuagauaaacccagacucuuccaaauuguaugaauguaucgguccuugugacuucaacgg

SEQ ID NO: 282185 - RNA, 66 nt, Homo Sapiens
aaguaguauuccacuguacuaugguagaaacauguaugaauguacuguauauauaaaaaucuugag

SEQ ID NO: 282186 - RNA, 66 nt, Homo Sapiens
cagguaacaaauuuggggaagacagcacaaucuucuugaauguagcucuugggaaugcauuauuac

SEQ ID NO: 282187 - RNA, 66 nt, Homo Sapiens
accauccucucccauaagcacccaugucuuugaauaugaauguauuuguaaaauaccacguuucau

SEQ ID NO: 282188 - RNA, 66 nt, Homo Sapiens
ucuccuccucuccccaccuuugccauucuuaaguauugaauguacuuuguauaauuuuaguggaau

SEQ ID NO: 282189 - RNA, 66 nt, Homo Sapiens
uacauugacauucauuccuauuuuacugggcaccuaugaauguaugcugugugcuagaaauagacu

SEQ ID NO: 282190 - RNA, 66 nt, Homo Sapiens
cagggguucucaauggaaaaacgaaugcucuuacacugaauguacaggcagugggcuugcagcacu

SEQ ID NO: 282191 - RNA, 66 nt, Homo Sapiens
acuuguuugaauuaauuguauuguaauauuauuuguugaauguaguaauuagguauuuaugaauau

SEQ ID NO: 282192 - RNA, 66 nt, Homo Sapiens
aguugcaacacacaaacggaguaagagaucugguuuugaauguaaauggguuacuaaccuugaaau

SEQ ID NO: 282193 - RNA, 66 nt, Homo Sapiens
uuaaccacaguguccuaaacgucuauuuuuuucuagugaauguauuggggaaaggaguuugaaugu

SEQ ID NO: 282194 - RNA, 66 nt, Homo Sapiens
auguauguucaaguauucagucucugugguacacauugaauguacugaaugaaguagaggugacuc

SEQ ID NO: 282195 - RNA, 66 nt, Homo Sapiens
ccaauuuuacuucuuuaaaauccucaacuucuuugaugaauguaacuuacauaaauucuacuuuau

SEQ ID NO: 282196 - RNA, 66 nt, Homo Sapiens
gcuguuggaggacaucucgacugcccgugguuacuaugaauguauuggggagagagccgcgggguc

SEQ ID NO: 282197 - RNA, 66 nt, Homo Sapiens
uagucuuugcagagguccaaagcguguacguuaaugugaauguauaccgccagaggccugaagcug

SEQ ID NO: 282198 - RNA, 66 nt, Homo Sapiens
cgccgcugugugucuuagcauggaaauaaauaaaccugaauguacgugcucgccucuggccugugu

SEQ ID NO: 282199 - RNA, 66 nt, Homo Sapiens
ccuuuauuugcacgucaggggagccggcuccccccuugaauguaccagacccuggggggggucacu

SEQ ID NO: 282200 - RNA, 66 nt, Homo Sapiens
aacuuucuggauuucucuugaagugcuacacugcacugaauguaaggaauuguugcuuguggaagu

SEQ ID NO: 282201 - RNA, 66 nt, Homo Sapiens
uuugucagacuuccaaauccuggaaggacacagugaugaauguacuaugucugaacauagaaacuc

SEQ ID NO: 282202 - RNA, 66 nt, Homo Sapiens
acuuucuaauuaggcauuuuauguuagucacagucuugaauguauaaacagcacuaagacucucag

SEQ ID NO: 282203 - RNA, 66 nt, Homo Sapiens
aaacaagacuuucccagcuuguauuaccuagaagcgugaauguauaggauaccugacuacuaagac

SEQ ID NO: 282204 - RNA, 66 nt, Homo Sapiens
uguugauguuuuaacucuaucugucauacauccuagugaauguaaaaugcaaaauccuggugaugu

SEQ ID NO: 282205 - RNA, 66 nt, Homo Sapiens
uccugcggcucagccuugcacacccacugccccgugugaauguagcuuccaccucauggauugcca

SEQ ID NO: 282206 - RNA, 66 nt, Homo Sapiens
ugacaucuacauuuuuuaaaacugaaucuuaaucgaugaauguaaacucgggggugcuggggccag

SEQ ID NO: 282207 - RNA, 66 nt, Homo Sapiens
uuggagucuucuuucaaaccaguggggguuggacaaugaauguaguuaacugguuccugcucacac

SEQ ID NO: 282208 - RNA, 66 nt, Homo Sapiens
caucaaggcgccuuuccuaauaauaugguucaacugugaauguagaagugggggggaggggggaga

SEQ ID NO: 282209 - RNA, 66 nt, Homo Sapiens
agagagacccugcaagaccacggagggagcgacacuugaauguagaauaggcagggggcccugccc

SEQ ID NO: 282210 - RNA, 66 nt, Homo Sapiens
aauucugaauagaugaaagcauaaaaugugagaaacugaauguauuauucaggaagaauacugagu

SEQ ID NO: 282211 - RNA, 66 nt, Homo Sapiens
caggaagaauacugagugccuucauuuaacuaaaguugaauguaaaagucaauuugcacuucuuua

SEQ ID NO: 282212 - RNA, 66 nt, Homo Sapiens
aacguaugugcucuuauaaaguggacuucugaaaaaugaauguaaaagacacugguguaucucaga

SEQ ID NO: 282213 - RNA, 66 nt, Homo Sapiens
uauuuaguugacuguauuauuugauuucggauugaaugaauguaaauagaaauuaaaugcaaauuu

SEQ ID NO: 282214 - RNA, 66 nt, Homo Sapiens
aagguucaucuguccaugcaguccucuuggauucucugaauguaguaacuaugaagcuaugccaaa

SEQ ID NO: 282215 - RNA, 66 nt, Homo Sapiens
ccaaagccuucguuguauguugacgaugcacuuuuaugaauguaguuucuaucgcuguuuuuagcc

SEQ ID NO: 282216 - RNA, 66 nt, Homo Sapiens
aagauuucaaauccaggggauuccaugcucaauggaugaauguagacacaaaacagcaacacuugu

SEQ ID NO: 282217 - RNA, 66 nt, Homo Sapiens
acaagcgaugagcaaacucuuuggcaucguuguuuuugaauguagcccugucacugaggguuuugg

SEQ ID NO: 282218 - RNA, 66 nt, Homo Sapiens
cgccucgguucccaccacuguuguucgacgcgucucugaauguaucuccugacuugccuuauuuau

SEQ ID NO: 282219 - RNA, 66 nt, Homo Sapiens
aaguuccaauuuuuaagggggugacgaauuuccuacugaauguaccuggucuuggccacagccuga

SEQ ID NO: 282220 - RNA, 66 nt, Homo Sapiens
agaugaauugugcaagugaccuggccuggccagcagugaauguaggugauuucaacccaggugccc

SEQ ID NO: 282221 - RNA, 66 nt, Homo Sapiens
uaaacuuugaauaguuuuaguuagaugaucuuugucugaauguaauucccuauguagcaacagugg

SEQ ID NO: 282222 - RNA, 66 nt, Homo Sapiens
cugccucugcuuucuccugcggccgagaucuugcccugaauguaccccaucaggacucagacccca

SEQ ID NO: 282223 - RNA, 66 nt, Homo Sapiens
aagacaccuuucccgauaacgugaggaugaaaggagugaauguauaaccuuccacacagggugcau

SEQ ID NO: 282224 - RNA, 66 nt, Homo Sapiens
aaaggcugaauucuguaauacucacuaaagacagaaugaauguagaaugagaacagcaguuuauua

SEQ ID NO: 282225 - RNA, 66 nt, Homo Sapiens
aaguuuucacaugucccauuuguccaaaaccuaaauugaauguacuaacuuguuuauccaacuaag

SEQ ID NO: 282226 - RNA, 66 nt, Homo Sapiens
uauuaaauggagauguugaaccaacuauuaccugcuugaauguaaaaaugucuaaacuauaagcuu

SEQ ID NO: 282227 - RNA, 66 nt, Homo Sapiens
auauagcauuuuucaacauuuaauggucuguacaguugaauguaaguguucaauauguauugcuga

SEQ ID NO: 282228 - RNA, 66 nt, Homo Sapiens
aaucauuugcauaagauuuaacagcauuuuuuauaaugaauguaaacauuuuaacuuaaugguacu

SEQ ID NO: 282229 - RNA, 66 nt, Homo Sapiens
uuucugcauagcgaaauaaagcaucacagcccauggugaauguaugucuccauuacacgaucaccu

SEQ ID NO: 282230 - RNA, 66 nt, Homo Sapiens
augguuacuaauaguuuuauucuucauucucuaucuugaauguauuucuccugaguggaugacagg

SEQ ID NO: 282231 - RNA, 66 nt, Homo Sapiens
aaagaaaaagaucaaguugugaagaaauagaaauuuugaauguauaagagaaauuuuaaaauaaua

SEQ ID NO: 282232 - RNA, 66 nt, Homo Sapiens
uuuuauuauagaauuuucuguuaguaggaggagaagugaauguaaaguaugcugauaaauguaaga

SEQ ID NO: 282233 - RNA, 66 nt, Homo Sapiens
uaaaagccucaacuagucauaacauguuagaagcaaugaauguauagcauuuuccuuauuguuaaa

SEQ ID NO: 282234 - RNA, 66 nt, Homo Sapiens
uugagagggcacugaagaccaugaaugaaauucaugugaauguaggugucccucuguaauuucaaa

SEQ ID NO: 282235 - RNA, 66 nt, Homo Sapiens
ugugcacaggaaaugacugggggggagcagguuuuaugaauguaacuucacaaacaaacaaaggag

SEQ ID NO: 282236 - RNA, 66 nt, Homo Sapiens
gggcgcgggggggaggcuggggucccgccgccgugaugaauguacugacgagccgaggcagcagug

SEQ ID NO: 282237 - RNA, 66 nt, Homo Sapiens
ucagaucuuaacaauuccaauagaagagaagacauaugaauguaaggaaugugggaaaaucuuggc

SEQ ID NO: 282238 - RNA, 66 nt, Homo Sapiens
uauucagcugugaucucacaagugugaaaaaucuuaugaauguaaaauguguggagauucuucuuu

SEQ ID NO: 282239 - RNA, 66 nt, Homo Sapiens
ugucugggucauucaggcaguacaucugaauuaagcugaauguagacaaauaaagaaaaacaaaac

SEQ ID NO: 282240 - RNA, 66 nt, Homo Sapiens
ggggcccccuccccaccaaaggguucaccucacacuugaauguacaacccaccccacugucgggaa

SEQ ID NO: 282241 - RNA, 66 nt, Homo Sapiens
guuacaugaaagauuucaaacugcagagaaccacuaugaauguaaacaaugugguaaagcauuuag

SEQ ID NO: 282242 - RNA, 66 nt, Homo Sapiens
auuucauaaaaggacacacacuggagagaaacccugugaauguaagaaauguagaaaagcauucca

SEQ ID NO: 282243 - RNA, 66 nt, Homo Sapiens
aauacaugaaaggaugcacagaggagagaagcucugugaauguaagcauugugggaaagcauucau

SEQ ID NO: 282244 - RNA, 66 nt, Homo Sapiens
aauacaugcaagaacacacaauggagagaaacccuaugaauguaaagaaugcagaaaagcauucag

SEQ ID NO: 282245 - RNA, 66 nt, Homo Sapiens
aaugcauggaaggacucacacuggagaaaaacccuaugaauguaagcaguaugggaaagcguucag

SEQ ID NO: 282246 - RNA, 66 nt, Homo Sapiens
cguucagaccugacaagauucuuugaauacagauaaugaauguaaacaauuaacuguuuauaauaa

SEQ ID NO: 282247 - RNA, 66 nt, Homo Sapiens
aauuuaugaaaggacacacacuggagagaaacccuaugaauguaagaaauguggaaaagcguucca

SEQ ID NO: 282248 - RNA, 66 nt, Homo Sapiens
ugaauacaugcaaaacacacacuggagagaaaccuaugaauguaaggaaugcaaacaagcauucaa

SEQ ID NO: 282249 - RNA, 66 nt, Homo Sapiens
uauacaugaaaggacucauacgagagagaauccguaugaauguaaggauugugggaaagcauucag

SEQ ID NO: 282250 - RNA, 66 nt, Homo Sapiens
cauagacauguaaagacacaccagaaggaaacccuaugaauguaagcaauguggcaaaagcuuuca

SEQ ID NO: 282251 - RNA, 66 nt, Homo Sapiens
aaugcauggaagcacucacacuuggcagaaacucuaugaauguaagcaguaugggaaagccuucag

SEQ ID NO: 282252 - RNA, 66 nt, Homo Sapiens
ccuucagaucggcuaggauucuuugaauacaaauaaugaauguaaacaauuaacuguuuauaauaa

SEQ ID NO: 282253 - RNA, 66 nt, Homo Sapiens
cagauacauuaaaauacucacugaagagaagcccuaugaauguaaguaacgugggaaagcaugaaa

SEQ ID NO: 282254 - RNA, 66 nt, Homo Sapiens
ucuguucuggggcuuguccuuccuuugcagcuguuuugaauguaguuuuccuuuucuauuuauuug

SEQ ID NO: 282255 - RNA, 66 nt, Homo Sapiens
ucagcaaagccauucuuaagagucgugagguccuucugaauguaaaacuggagcccaggagaagcu

SEQ ID NO: 282256 - RNA, 66 nt, Homo Sapiens
acauaauuaacuuaauuggagaugcauuaggucacuugaauguauaagcaagcaccuaugguaggc

SEQ ID NO: 282257 - RNA, 66 nt, Homo Sapiens
gaaacucaaucaauguuauugugaaaacugggaaugugaauguaauauauguagaaaaacauuuag

SEQ ID NO: 282258 - RNA, 59 nt, Homo Sapiens; identical to SEQ ID NO: 58889

SEQ ID NO: 282259 - RNA, 66 nt, Homo Sapiens
ucuucaugugagaagucacacaggggagaaacccuaugaauguaauaaaugugggaaagccuuuuc

SEQ ID NO: 282260 - RNA, 66 nt, Homo Sapiens
uauacauaugagaagucauacuggugagaaacccuuugaauguaaugaaugugggaaagcauucuc

SEQ ID NO: 282261 - RNA, 66 nt, Homo Sapiens
cuaaggccugcccaccaccgcccgccugggcagccaugaauguagcgccccaggcccugccccagc

SEQ ID NO: 282262 - RNA, 66 nt, Homo Sapiens
cagcauauaaugagaugcuugaugaauggugcauauugaauguauaaagcccaccgguccugagag

SEQ ID NO: 282263 - RNA, 66 nt, Homo Sapiens
cuucuugcuucuucuaccuuuauuuauucucagcucugaauguaugaaccugcucaaucaccucau

SEQ ID NO: 282264 - RNA, 66 nt, Homo Sapiens
ccaaguuaguuuuguggcuuuccaucugacccuaugugaauguaaggugaugugaccuuguuggug

SEQ ID NO: 282265 - RNA, 66 nt, Homo Sapiens
uguaguucacacuggaaaaaggccacguaugugccuugaauguagccaaaaugacgaacaacaccc

SEQ ID NO: 282266 - RNA, 66 nt, Homo Sapiens
gcagcaucagagaguucacacuagagaaaggccuuaugaauguagugaaugugggaaauccuuuag

SEQ ID NO: 282267 - RNA, 66 nt, Homo Sapiens
gagccagacaaagcugugaaccugccccgugcugaaugaauguacacaggcugguggcauggcccc

SEQ ID NO: 282268 - RNA, 66 nt, Homo Sapiens
gaaucugggaauaccuuucucuggagagaaacuguaugaauguagacaaacacaucagaaaucuca

SEQ ID NO: 282269 - RNA, 66 nt, Homo Sapiens
aauguggaagcaacuuuguacuggggagaaacccuaugaauguaaaucugaagacaugaaaacuca

SEQ ID NO: 282270 - RNA, 60 nt, Homo Sapiens; identical to SEQ ID NO: 227583

SEQ ID NO: 282271 - RNA, 66 nt, Homo Sapiens
gauaugaguguuguuaccaucuggggagaaauacuaugaauguaaguaugcaugaaagaauucaca

SEQ ID NO: 282272 - RNA, 66 nt, Homo Sapiens
gauagauauuuggacaucaauguccacgugcacacgugaauguagcggcacacgaauccauccacc

SEQ ID NO: 282273 - RNA, 66 nt, Homo Sapiens
gaauguggaaaacccuucagcuggagagaaacccuaugaauguaaauauacaugaacgaauucaua

SEQ ID NO: 282274 - RNA, 66 nt, Homo Sapiens
cagugugguaaagccuucagcuggagagaaaccuuaugaauguaaagauacaugaaagaacccaca

SEQ ID NO: 282275 - RNA, 66 nt, Homo Sapiens
aaaugugggaaaacauacaucugcaaagaaacaguaugaauguaaaaagacaugaaaggaugcaca

SEQ ID NO: 282276 - RNA, 66 nt, Homo Sapiens
cugugugggaaaacuuacuucugcacagaaacacuaugaauguaaaaaaacaugagaggaaucaca

SEQ ID NO: 282277 - RNA, 66 nt, Homo Sapiens
aaaugugggaaaguguucgucuggagaaaaacccuaugaauguaaaagcacaugaaagaacucaca

SEQ ID NO: 282278 - RNA, 66 nt, Homo Sapiens
caauguggaaaaaccuacaucuguacagaaacgcuaugaauguaaaagcacaugaaaggaaucaca

SEQ ID NO: 282279 - RNA, 66 nt, Homo Sapiens
cacauaguaaagccuuaauuuuggagauaaacccuaugaauguaaaucagauagaaauaauucuca

SEQ ID NO: 282280 - RNA, 66 nt, Homo Sapiens
aaauguagaaaagcauugagcuggagagaagucauaugaauguaagaguacaugaaaggauucacu

SEQ ID NO: 282281 - RNA, 66 nt, Homo Sapiens
ccauguggugaaggcuuaagaaagaaauaaacucuaugaauguaaaaaaaaaauaaaaaaaaagaa

SEQ ID NO: 282282 - RNA, 66 nt, Homo Sapiens
gaauguggaaaagcauugagccgcaaagaagcuaugugaauguaagaggacaugaaagaacucaua

SEQ ID NO: 282283 - RNA, 66 nt, Homo Sapiens
gaaugcaggaaagcauucuccuggagagaagccguaugaauguaaggcaacaugaaaggauucaca

SEQ ID NO: 282284 - RNA, 66 nt, Homo Sapiens
uaaugugggaaagcauuuggugggagagaagccauaugaauguaaaaaaucaugagacaacucaua

SEQ ID NO: 282285 - RNA, 66 nt, Homo Sapiens
caaugugggaaagcauuugagugcagagaaaccccaugaauguaagaagacgugaaaccacucaca

SEQ ID NO: 282286 - RNA, 66 nt, Homo Sapiens
caguguucuaaagccuuccccuggggagaaacuguaugaauguaagaagacaugaaagaacacgua

SEQ ID NO: 282287 - RNA, 66 nt, Homo Sapiens
caguguucuaaagccuuucacuggagagaaacuauaugaauguaaguaugcaugaaagaacucacu

SEQ ID NO: 282288 - RNA, 66 nt, Homo Sapiens
cacuugguaaagccuuaaguuuggagauagacccugugaauguaagagauacuuguacgaaacaca

SEQ ID NO: 282289 - RNA, 66 nt, Homo Sapiens
acccagccgaggggacggugaacuucugacaaucagugaauguacagcccccacagcaguaucaga

SEQ ID NO: 282290 - RNA, 66 nt, Homo Sapiens
cauugugauuaagccuucagcuggugagaaacaguaugaauguaaaugagcacgaaagaauuccca

SEQ ID NO: 282291 - RNA, 66 nt, Homo Sapiens
aaguucuucagcacuugagcaaaauuuagauuguagugaauguaggaaacauaauuuauucuaggu

SEQ ID NO: 282292 - RNA, 66 nt, Homo Sapiens
aaaaucuuuagccuuaucugugagagaauaauguaaugaauguagguuaucuucagcaaauuccua

SEQ ID NO: 282293 - RNA, 66 nt, Homo Sapiens
aauuaaucuauuuugcuccaguuauagaacauucuaugaauguaguaaagucuuuucaacuucugu

SEQ ID NO: 282294 - RNA, 66 nt, Homo Sapiens
acaucuugcuucugcucagauauuucauaucuauaaugaauguagaaauuuaagaaaaucuucauc

SEQ ID NO: 282295 - RNA, 66 nt, Homo Sapiens
aaagcuuuuaucuauuacacaaucauguugacuuugugaauguagagagaauagcauauagagaau

SEQ ID NO: 282296 - RNA, 66 nt, Homo Sapiens
gaaugugagaaggccucuuccuggugagaaacccuaugaauguaauucaacaucaaagaauuccua

SEQ ID NO: 282297 - RNA, 66 nt, Homo Sapiens
gauuguaaaaaagcuuuucucuggugacaaacccuaugaauguaaauaaacaucagacaauucaca

SEQ ID NO: 282298 - RNA, 66 nt, Homo Sapiens
gaauguguaaagaccuuuacccagugugaaacccuaugaauguaagucaacaucaaagaauucaua

SEQ ID NO: 282299 - RNA, 66 nt, Homo Sapiens
gaaugugggaaugccuucauguggggagaaacccuaugaauguaaugagacaucagagaauucaca

SEQ ID NO: 282300 - RNA, 66 nt, Homo Sapiens
auacauauguuguacuuuuaucuaguggugggauucugaauguauaaggacauauaacuacuuauc

SEQ ID NO: 282301 - RNA, 66 nt, Homo Sapiens
agagccuuuaguuuuuguucaacuuugcaaguauaaugaauguagcaauaauuuauacuggagaaa

SEQ ID NO: 282302 - RNA, 66 nt, Homo Sapiens
gaucccuucagucaccacucagcccugugaauacagugaauguaaggagcagucacuuuggagaga

SEQ ID NO: 282303 - RNA, 66 nt, Homo Sapiens
aaaaauaauaguauugaauguaugaagugcuaaaucugaauguaagcugggugcccaggaguagaa

SEQ ID NO: 282304 - RNA, 66 nt, Homo Sapiens
ucugcauuauacuccugcaagugagauuuuccuguuugaauguaugcugcacacaccacagaaugu

SEQ ID NO: 282305 - RNA, 66 nt, Homo Sapiens
gggcuauuuuaaaugucaaggucagcaguguuacuuugaauguaaacugguauaauagguaguuuu

SEQ ID NO: 282306 - RNA, 66 nt, Homo Sapiens
uucaguugacugguuuuguguccuguuugaacuugcugaauguaaggcaggcuacuaugcguuaua

SEQ ID NO: 282307 - RNA, 66 nt, Homo Sapiens
gguaugucauucuggauaaauccccaagccccuuuaugaauguagugaaauacauggcaugugggu

SEQ ID NO: 282308 - RNA, 66 nt, Homo Sapiens
uuuuuaaacaaaugaugcugagaauaaggagagaaaugaauguagagagagguagagagagaaaua

SEQ ID NO: 282309 - RNA, 66 nt, Homo Sapiens
ucugagcccccuuuucuggacaccaacuguguccugugaauguaucgcuacugugagcuguucccg

SEQ ID NO: 282310 - RNA, 66 nt, Homo Sapiens
gucagugucggggcugagccccuugagcugcuucagugaauguacagugcccggcacgagcugaac

SEQ ID NO: 282311 - RNA, 66 nt, Homo Sapiens
gcuuuuccugucugacucugacaaguccucccucacugaauguagaaucguugccaaguuucugag

SEQ ID NO: 282312 - RNA, 66 nt, Homo Sapiens
agccuuggaaauuaacaaaaugccuagaaggaucagugaauguaagugguagaaauucucccugua

SEQ ID NO: 282313 - RNA, 66 nt, Homo Sapiens
uuuccaaucacaucuuuaguauuggugauacuucuuugaauguagaaauuggaauggguggcggua

SEQ ID NO: 282314 - RNA, 66 nt, Homo Sapiens
uuuuuuaaugguuuauugcuguggacugugauaaacugaauguauguggacagcucccaguauacu

SEQ ID NO: 282315 - RNA, 66 nt, Homo Sapiens
ugcugauacguugcucacauaagaguagcacaagaaugaauguauuuagcucuaugcuaaauaaug

SEQ ID NO: 282316 - RNA, 66 nt, Homo Sapiens
uaauuuuccuguuuauuguaaagucaagcuugagaaugaauguaugcagggcuggauagauuaucu

SEQ ID NO: 282317 - RNA, 66 nt, Homo Sapiens
cgcaugcugaagcuaaguaacuuuaauuuuguauuuugaauguacacaaauuaaugacaacucaug

SEQ ID NO: 282318 - RNA, 66 nt, Homo Sapiens
aaaauaccaauuauuuuccuuuuuuaaccacauuucugaauguauauuugggcuuucagauuucuc

SEQ ID NO: 282319 - RNA, 66 nt, Homo Sapiens
ugccagagucguaauugaaaucuaggaagucucgcuugaauguaugcgauacauauuuucacuacg

SEQ ID NO: 282320 - RNA, 66 nt, Homo Sapiens
uuuuaaagguagaguuaacagaauauacugguggacugaauguagguugagagaggaagcgagaag

SEQ ID NO: 282321 - RNA, 66 nt, Homo Sapiens
uccucguucaguugcacuucaguauuuucacggauaugaauguaaaauauauaaauauauaaaccu

SEQ ID NO: 282322 - RNA, 66 nt, Homo Sapiens
gcauugagcagcugaagcuaacucaugacucuguuuugaauguaaauauuuguaauuaagccugca

SEQ ID NO: 282323 - RNA, 66 nt, Homo Sapiens
uuuuuauuguuaguucucacuuguuuccauauuuagugaauguacauuuaauugcaaagcugucau

SEQ ID NO: 282324 - RNA, 66 nt, Homo Sapiens
cucaacuugagcucuugaacuccuccugugggccugugaauguauucauucauuccacaacucugg

SEQ ID NO: 282325 - RNA, 66 nt, Homo Sapiens
gcuuuuaauuugauuuuagaaucuggacacuuucuaugaauguaauucggcugagaaacauguugc

SEQ ID NO: 282326 - RNA, 66 nt, Homo Sapiens
aucaggggacauuugaagauuuacaagaaacacugaugaauguaaauuauugaacauccccugggc

SEQ ID NO: 282327 - RNA, 66 nt, Homo Sapiens
gagggcacuuggccaguuuucuguucagcuuuucagugaauguaccccuuuaagguucagacuuaa

SEQ ID NO: 282328 - RNA, 66 nt, Homo Sapiens
uccgcccccuccggggcugagccugggucugaagacugaauguaacaggggccgcuggcacuccug

SEQ ID NO: 282329 - RNA, 66 nt, Homo Sapiens
caguguuguuuuuguaucaauauguuugugcagugaugaauguauuuauuucucagacuuggggcg

SEQ ID NO: 282330 - RNA, 66 nt, Homo Sapiens
cugggguauuggaaauguuuggggacuagguagaggugaauguacuaaaugccacugaauuuguau

SEQ ID NO: 282331 - RNA, 66 nt, Homo Sapiens
guuuuccuccauguuauuuaugaauuuuauauuccgugaauguauauugucuuguaauguugcaua

SEQ ID NO: 282332 - RNA, 66 nt, Homo Sapiens
aauauaugcauuccauuugggagcauagcagcugugugaauguauguaauugugugugggggguuu

SEQ ID NO: 282333 - RNA, 66 nt, Homo Sapiens
ggaaacguaggagcaucugguuugugaaagaaacugugaauguaauccuucuccuuugaaugcugu

SEQ ID NO: 282334 - RNA, 66 nt, Homo Sapiens
acagcuugcagcuauucuguugucuugcuuuggacaugaauguauuaugugaagcuugcaacuuua

SEQ ID NO: 282335 - RNA, 66 nt, Homo Sapiens
auaccuaguuuacuugccaguugagggaauguguggugaauguaaauuucuaacaacuguggagau

SEQ ID NO: 282336 - RNA, 66 nt, Homo Sapiens
uauaacuauuuauuucuggaucugggauguaaacucugaauguauuuuuuuugguguuccaaugaa

SEQ ID NO: 282337 - RNA, 66 nt, Homo Sapiens
cuguggggauguuucauacuacaaauuccucuuugaugaauguaccaaagcacauggccuugggug

SEQ ID NO: 282338 - RNA, 66 nt, Homo Sapiens
ugggaggggucgggggcacgcuuuguucagacuaaaugaauguaucugcacagaaugagcuucgag

SEQ ID NO: 282339 - RNA, 66 nt, Homo Sapiens
gacccgugggcacuuuuccucagcccccacccgcuuugaauguagaccaucugccuuucuuucccc

SEQ ID NO: 282340 - RNA, 66 nt, Homo Sapiens
aaauuucaaaccauuuaccaucugaaaguuuugauuugaauguaaaacaggaaauuggaauuccuu

SEQ ID NO: 282341 - RNA, 66 nt, Homo Sapiens
ucuguuucucccuugggacugugucucauguuugugugaauguagaccaggaaagggggcugcaaa

SEQ ID NO: 282342 - RNA, 66 nt, Homo Sapiens
uaagguuucaaaaaucauguaaggauuuaaacuugcugaauguaaagauugaaccucaagucacug

SEQ ID NO: 282343 - RNA, 66 nt, Homo Sapiens
auucauuuuuacuuuuucuuauuuuuaaaauuaggcugaauguacuucaugugauuugucaaccau

SEQ ID NO: 282344 - RNA, 66 nt, Homo Sapiens
ucccaguagcaauaaacauauaauauaggaggagucugaauguagagaugaaaaauacagaaugua

SEQ ID NO: 282345 - RNA, 66 nt, Homo Sapiens
uuaugucuugaacuuuuccucaaagcauuacacuugugaauguauuuuugucuaauagggucgaaa

SEQ ID NO: 282346 - RNA, 66 nt, Homo Sapiens
aaaauauauaugcauaccuggauuuccuuggcuucgugaauguaagagaaauuaaaucugaauaaa

SEQ ID NO: 282347 - RNA, 66 nt, Homo Sapiens
cucuuaucaggcauuuucauuuggaaauuucauuauugaauguagcaagguuguaguuguuuuuuu

SEQ ID NO: 282348 - RNA, 66 nt, Homo Sapiens
uguauauacacacacaccucggaguaugugauaaagugaauguacaaucucagaagucaagcugau

SEQ ID NO: 282349 - RNA, 66 nt, Homo Sapiens
gaaagacauuuugguuauacacaaucugcuuguuucugaauguaugcacaugcauaaaaauagaag

SEQ ID NO: 282350 - RNA, 66 nt, Homo Sapiens
gcuacaugaaugcuugauuucgagaaauguuucuguugaauguaauaggaucuuaaacccaaagua

SEQ ID NO: 282351 - RNA, 66 nt, Homo Sapiens
acuuccaaaauguacauaucauuguggaacagcuguugaauguaauacaguccuaaaaauggccag

SEQ ID NO: 282352 - RNA, 66 nt, Homo Sapiens
ccaaaugcaaguccauuccauuugccaguagcacagugaauguaugauauucucguaaaacugcgc

SEQ ID NO: 282353 - RNA, 66 nt, Homo Sapiens
ugguuaaugauacacauucccaucuaaugggaguugugaauguaacaaaaaugaacugcccuucag

SEQ ID NO: 282354 - RNA, 66 nt, Homo Sapiens
aggugucaacaaacugggaacuugagcaguugccugugaauguaagcaacuguauuucccaauaca

SEQ ID NO: 282355 - RNA, 66 nt, Homo Sapiens
uuguuugaaaaacuugcacagacuugugaauauauuugaauguauguguugccuuaguacuaucaa

SEQ ID NO: 282356 - RNA, 66 nt, Homo Sapiens
gacaggccuagggaccuugcguagcaagggaaggucugaauguaagcuucugucaaggaauuacaa

SEQ ID NO: 282357 - RNA, 66 nt, Homo Sapiens
ucaucuugguguuauuauacaagaaaaaugccuaauugaauguaacaaaagucugcuuaauuucaa

SEQ ID NO: 282358 - RNA, 66 nt, Homo Sapiens
cagcaacagacuguauuuuugugacgccccguaguaugaauguacaucuuguaaaacugagauaua

SEQ ID NO: 282359 - RNA, 66 nt, Homo Sapiens
cagcaguauucuucaguaaauaaagaauggaauugcugaauguaaucauugaaccucgagucacug

SEQ ID NO: 282360 - RNA, 64 nt, Homo Sapiens; identical to SEQ ID NO: 210303

SEQ ID NO: 282361 - RNA, 64 nt, Homo Sapiens; identical to SEQ ID NO: 210304

SEQ ID NO: 282362 - RNA, 64 nt, Homo Sapiens; identical to SEQ ID NO: 210305

SEQ ID NO: 282363 - RNA, 64 nt, Homo Sapiens; identical to SEQ ID NO: 210306

SEQ ID NO: 282364 - RNA, 64 nt, Homo Sapiens; identical to SEQ ID NO: 210307

SEQ ID NO: 282365 - RNA, 64 nt, Homo Sapiens; identical to SEQ ID NO: 210308

SEQ ID NO: 282366 - RNA, 64 nt, Homo Sapiens; identical to SEQ ID NO: 210309

SEQ ID NO: 282367 - RNA, 64 nt, Homo Sapiens; identical to SEQ ID NO: 210310

SEQ ID NO: 282368 - RNA, 64 nt, Homo Sapiens; identical to SEQ ID NO: 210311

SEQ ID NO: 282369 - RNA, 64 nt, Homo Sapiens; identical to SEQ ID NO: 210312

SEQ ID NO: 282370 - RNA, 64 nt, Homo Sapiens; identical to SEQ ID NO: 210313

SEQ ID NO: 282371 - RNA, 64 nt, Homo Sapiens; identical to SEQ ID NO: 210314

SEQ ID NO: 282372 - RNA, 64 nt, Homo Sapiens; identical to SEQ ID NO: 210315

SEQ ID NO: 282373 - RNA, 64 nt, Homo Sapiens; identical to SEQ ID NO: 210316

SEQ ID NO: 282374 - RNA, 64 nt, Homo Sapiens; identical to SEQ ID NO: 210317

SEQ ID NO: 282375 - RNA, 64 nt, Homo Sapiens; identical to SEQ ID NO: 210318

SEQ ID NO: 282376 - RNA, 64 nt, Homo Sapiens; identical to SEQ ID NO: 210319

SEQ ID NO: 282377 - RNA, 64 nt, Homo Sapiens
caccuuuuaaaaugcagaaccacuuuuuguuucuuucagguagaccgccacacauacacacaca

SEQ ID NO: 282378 - RNA, 64 nt, Homo Sapiens
cacugacugcgcuuguuggaaugugacuguauucuucagguaaaauauugaaagugaagcaacu

SEQ ID NO: 282379 - RNA, 64 nt, Homo Sapiens
gguguggauuggccugcuuuagccugaaaaauauuucagguaauaauccauaaaguuauaaauu

SEQ ID NO: 282380 - RNA, 64 nt, Homo Sapiens
guccagcuauauguguaugucugguaugauguuauucagguaguauucagguguucagagccuc

SEQ ID NO: 282381 - RNA, 64 nt, Homo Sapiens
guuucccuuuuuuuugcuucauuuuguuuaaauuuucagguauuuagcuccccuuucauauuau

SEQ ID NO: 282382 - RNA, 64 nt, Homo Sapiens
ugggaauccuagaaugccugaucuauuuuaucuguucagguaguuuuguuauuguacccucuuu

SEQ ID NO: 282383 - RNA, 64 nt, Homo Sapiens
auuuccacuuaucauuaaugauuuaauguuggauuucagguaccuuguaugucuuaauuuauuu

SEQ ID NO: 282384 - RNA, 64 nt, Homo Sapiens
aaaaguacagaaaauuugacuauuauuuauagauuucagguauauuuauauguguaaaagaaau

SEQ ID NO: 282385 - RNA, 64 nt, Homo Sapiens
auuuuuuugguguaguuuuuuaaauauuauuuauuucagguagaucaagacugggacaaaagua

SEQ ID NO: 282386 - RNA, 64 nt, Homo Sapiens
cucagaaauguauucugcacuacauuuaggauacuucagguauccccucccaguggaggcaucu

SEQ ID NO: 282387 - RNA, 64 nt, Homo Sapiens
uacuagggaagcuuuauaagauugagucaauuuguucagguaagugacauaaguaaauuuauuu

SEQ ID NO: 282388 - RNA, 64 nt, Homo Sapiens
uuacuaaaucagagugcugauaaggcacugaugcuucagguauugaauuuacaguagaaauaug

SEQ ID NO: 282389 - RNA, 64 nt, Homo Sapiens
cauuucauaagacuuacaauaacucuauuuaaaauucagguauuguacucgggaggcugaggug

SEQ ID NO: 282390 - RNA, 64 nt, Homo Sapiens
aagacccugucucuuaaaaaaacaaaaagacauauucagguacugauuuuucaucaagagauug

SEQ ID NO: 282391 - RNA, 64 nt, Homo Sapiens
aaaaugacauugaauucugguuuuuuuagauaaucuaagcuagauguauccccuguuguggcau

SEQ ID NO: 282392 - RNA, 64 nt, Homo Sapiens
ucauccaaagauuguccuuuaaugagcaaguguccuaagcuaugugaagggacucuuuuaaaua

SEQ ID NO: 282393 - RNA, 64 nt, Homo Sapiens; identical to SEQ ID NO: 195961

SEQ ID NO: 282394 - RNA, 64 nt, Homo Sapiens; identical to SEQ ID NO: 195962

SEQ ID NO: 282395 - RNA, 64 nt, Homo Sapiens; identical to SEQ ID NO: 195963

SEQ ID NO: 282396 - RNA, 64 nt, Homo Sapiens; identical to SEQ ID NO: 195964

SEQ ID NO: 282397 - RNA, 64 nt, Homo Sapiens; identical to SEQ ID NO: 195965

SEQ ID NO: 282398 - RNA, 64 nt, Homo Sapiens; identical to SEQ ID NO: 195966

SEQ ID NO: 282399 - RNA, 64 nt, Homo Sapiens; identical to SEQ ID NO: 195967

SEQ ID NO: 282400 - RNA, 64 nt, Homo Sapiens; identical to SEQ ID NO: 195968

SEQ ID NO: 282401 - RNA, 64 nt, Homo Sapiens; identical to SEQ ID NO: 195969

SEQ ID NO: 282402 - RNA, 64 nt, Homo Sapiens; identical to SEQ ID NO: 195970

SEQ ID NO: 282403 - RNA, 64 nt, Homo Sapiens; identical to SEQ ID NO: 195971

SEQ ID NO: 282404 - RNA, 64 nt, Homo Sapiens; identical to SEQ ID NO: 195972

SEQ ID NO: 282405 - RNA, 64 nt, Homo Sapiens; identical to SEQ ID NO: 195973

SEQ ID NO: 282406 - RNA, 64 nt, Homo Sapiens; identical to SEQ ID NO: 195974

SEQ ID NO: 282407 - RNA, 64 nt, Homo Sapiens; identical to SEQ ID NO: 195975

SEQ ID NO: 282408 - RNA, 64 nt, Homo Sapiens; identical to SEQ ID NO: 195976

SEQ ID NO: 282409 - RNA, 64 nt, Homo Sapiens; identical to SEQ ID NO: 195977

SEQ ID NO: 282410 - RNA, 64 nt, Homo Sapiens; identical to SEQ ID NO: 195978

SEQ ID NO: 282411 - RNA, 64 nt, Homo Sapiens; identical to SEQ ID NO: 195979

SEQ ID NO: 282412 - RNA, 64 nt, Homo Sapiens; identical to SEQ ID NO: 195980

SEQ ID NO: 282413 - RNA, 64 nt, Homo Sapiens; identical to SEQ ID NO: 195981

SEQ ID NO: 282414 - RNA, 64 nt, Homo Sapiens; identical to SEQ ID NO: 195982

SEQ ID NO: 282415 - RNA, 64 nt, Homo Sapiens; identical to SEQ ID NO: 195983

SEQ ID NO: 282416 - RNA, 64 nt, Homo Sapiens; identical to SEQ ID NO: 195984

SEQ ID NO: 282417 - RNA, 64 nt, Homo Sapiens; identical to SEQ ID NO: 195985

SEQ ID NO: 282418 - RNA, 64 nt, Homo Sapiens; identical to SEQ ID NO: 195986

SEQ ID NO: 282419 - RNA, 64 nt, Homo Sapiens; identical to SEQ ID NO: 195987

SEQ ID NO: 282420 - RNA, 64 nt, Homo Sapiens; identical to SEQ ID NO: 60048

SEQ ID NO: 282421 - RNA, 64 nt, Homo Sapiens; identical to SEQ ID NO: 60049

SEQ ID NO: 282422 - RNA, 64 nt, Homo Sapiens; identical to SEQ ID NO: 60050

SEQ ID NO: 282423 - RNA, 64 nt, Homo Sapiens; identical to SEQ ID NO: 60051

SEQ ID NO: 282424 - RNA, 64 nt, Homo Sapiens; identical to SEQ ID NO: 60052

SEQ ID NO: 282425 - RNA, 64 nt, Homo Sapiens; identical to SEQ ID NO: 60053

SEQ ID NO: 282426 - RNA, 64 nt, Homo Sapiens
uuuucuuuagccauaguaacuuuuugucacaauaacuaaguauucaauuauauauaaagaguga

SEQ ID NO: 282427 - RNA, 64 nt, Homo Sapiens
auauaaacaaaagaaaaauccaacugaaaauaacacuaaguauuuuugaguuccuagaaugucc

SEQ ID NO: 282428 - RNA, 64 nt, Homo Sapiens
cuugggguggugcugggucaccggacacucgccuacuaaguaccguacagcugacgguuucucc

SEQ ID NO: 282429 - RNA, 64 nt, Homo Sapiens
gcugacgguuucuccccggagcuuggggauugccacuaaguacaauuugaggacugaagcuggg

SEQ ID NO: 282430 - RNA, 64 nt, Homo Sapiens
acucucaguuucuugguaucuaguggaagguuucacuaaguaaagauauuugacuuuucauaag

SEQ ID NO: 282431 - RNA, 64 nt, Homo Sapiens
gaucugaguuucuugguaucuaguggaagguuucacuaaguaaagguauuugacuuuucauaag

SEQ ID NO: 282432 - RNA, 64 nt, Homo Sapiens
uguacacagcuuuuacaaaucaauaaagaugauuguacaagaguauuuucagacuaauuggauu

SEQ ID NO: 282433 - RNA, 64 nt, Homo Sapiens
gaauauaacugcuuuuauaaaucuuuugaaucauguacaagacuuauaucuacauuuuuugauc

SEQ ID NO: 282434 - RNA, 64 nt, Homo Sapiens; identical to SEQ ID NO: 199794

SEQ ID NO: 282435 - RNA, 64 nt, Homo Sapiens; identical to SEQ ID NO: 199795

SEQ ID NO: 282436 - RNA, 64 nt, Homo Sapiens; identical to SEQ ID NO: 199796

SEQ ID NO: 282437 - RNA, 64 nt, Homo Sapiens; identical to SEQ ID NO: 199797

SEQ ID NO: 282438 - RNA, 64 nt, Homo Sapiens; identical to SEQ ID NO: 199798

SEQ ID NO: 282439 - RNA, 64 nt, Homo Sapiens; identical to SEQ ID NO: 199799

SEQ ID NO: 282440 - RNA, 64 nt, Homo Sapiens; identical to SEQ ID NO: 199800

SEQ ID NO: 282441 - RNA, 64 nt, Homo Sapiens; identical to SEQ ID NO: 199801

SEQ ID NO: 282442 - RNA, 64 nt, Homo Sapiens; identical to SEQ ID NO: 199802

SEQ ID NO: 282443 - RNA, 64 nt, Homo Sapiens; identical to SEQ ID NO: 199803

SEQ ID NO: 282444 - RNA, 64 nt, Homo Sapiens; identical to SEQ ID NO: 199804

SEQ ID NO: 282445 - RNA, 55 nt, Homo Sapiens; identical to SEQ ID NO: 199805

SEQ ID NO: 282446 - RNA, 64 nt, Homo Sapiens; identical to SEQ ID NO: 199806

SEQ ID NO: 282447 - RNA, 64 nt, Homo Sapiens; identical to SEQ ID NO: 199807

SEQ ID NO: 282448 - RNA, 64 nt, Homo Sapiens; identical to SEQ ID NO: 199808

SEQ ID NO: 282449 - RNA, 64 nt, Homo Sapiens; identical to SEQ ID NO: 199809

SEQ ID NO: 282450 - RNA, 64 nt, Homo Sapiens; identical to SEQ ID NO: 199810

SEQ ID NO: 282451 - RNA, 51 nt, Homo Sapiens; identical to SEQ ID NO: 199811

SEQ ID NO: 282452 - RNA, 64 nt, Homo Sapiens; identical to SEQ ID NO: 199812

SEQ ID NO: 282453 - RNA, 64 nt, Homo Sapiens; identical to SEQ ID NO: 199813

SEQ ID NO: 282454 - RNA, 64 nt, Homo Sapiens; identical to SEQ ID NO: 199814

SEQ ID NO: 282455 - RNA, 64 nt, Homo Sapiens; identical to SEQ ID NO: 199815

SEQ ID NO: 282456 - RNA, 64 nt, Homo Sapiens; identical to SEQ ID NO: 199816

SEQ ID NO: 282457 - RNA, 64 nt, Homo Sapiens; identical to SEQ ID NO: 199817

SEQ ID NO: 282458 - RNA, 64 nt, Homo Sapiens; identical to SEQ ID NO: 199818

SEQ ID NO: 282459 - RNA, 64 nt, Homo Sapiens; identical to SEQ ID NO: 199819

SEQ ID NO: 282460 - RNA, 64 nt, Homo Sapiens; identical to SEQ ID NO: 199820

SEQ ID NO: 282461 - RNA, 64 nt, Homo Sapiens; identical to SEQ ID NO: 199821

SEQ ID NO: 282462 - RNA, 64 nt, Homo Sapiens; identical to SEQ ID NO: 199822

SEQ ID NO: 282463 - RNA, 64 nt, Homo Sapiens; identical to SEQ ID NO: 199823

SEQ ID NO: 282464 - RNA, 64 nt, Homo Sapiens; identical to SEQ ID NO: 199824

SEQ ID NO: 282465 - RNA, 64 nt, Homo Sapiens; identical to SEQ ID NO: 282432

SEQ ID NO: 282466 - RNA, 64 nt, Homo Sapiens; identical to SEQ ID NO: 282433

SEQ ID NO: 282467 - RNA, 64 nt, Homo Sapiens; identical to SEQ ID NO: 199794

SEQ ID NO: 282468 - RNA, 64 nt, Homo Sapiens; identical to SEQ ID NO: 199795

SEQ ID NO: 282469 - RNA, 64 nt, Homo Sapiens; identical to SEQ ID NO: 199796

SEQ ID NO: 282470 - RNA, 64 nt, Homo Sapiens; identical to SEQ ID NO: 199797

SEQ ID NO: 282471 - RNA, 64 nt, Homo Sapiens; identical to SEQ ID NO: 199798

SEQ ID NO: 282472 - RNA, 64 nt, Homo Sapiens; identical to SEQ ID NO: 199799

SEQ ID NO: 282473 - RNA, 64 nt, Homo Sapiens; identical to SEQ ID NO: 199800

SEQ ID NO: 282474 - RNA, 64 nt, Homo Sapiens; identical to SEQ ID NO: 199801

SEQ ID NO: 282475 - RNA, 64 nt, Homo Sapiens; identical to SEQ ID NO: 199802

SEQ ID NO: 282476 - RNA, 64 nt, Homo Sapiens; identical to SEQ ID NO: 199803

SEQ ID NO: 282477 - RNA, 64 nt, Homo Sapiens; identical to SEQ ID NO: 199804

SEQ ID NO: 282478 - RNA, 55 nt, Homo Sapiens; identical to SEQ ID NO: 199805

SEQ ID NO: 282479 - RNA, 64 nt, Homo Sapiens; identical to SEQ ID NO: 199806

SEQ ID NO: 282480 - RNA, 64 nt, Homo Sapiens; identical to SEQ ID NO: 199807

SEQ ID NO: 282481 - RNA, 64 nt, Homo Sapiens; identical to SEQ ID NO: 199808

SEQ ID NO: 282482 - RNA, 64 nt, Homo Sapiens; identical to SEQ ID NO: 199809

SEQ ID NO: 282483 - RNA, 64 nt, Homo Sapiens; identical to SEQ ID NO: 199810

SEQ ID NO: 282484 - RNA, 51 nt, Homo Sapiens; identical to SEQ ID NO: 199811

SEQ ID NO: 282485 - RNA, 64 nt, Homo Sapiens; identical to SEQ ID NO: 199812

SEQ ID NO: 282486 - RNA, 64 nt, Homo Sapiens; identical to SEQ ID NO: 199813

SEQ ID NO: 282487 - RNA, 64 nt, Homo Sapiens; identical to SEQ ID NO: 199814

SEQ ID NO: 282488 - RNA, 64 nt, Homo Sapiens; identical to SEQ ID NO: 199815

SEQ ID NO: 282489 - RNA, 64 nt, Homo Sapiens; identical to SEQ ID NO: 199816

SEQ ID NO: 282490 - RNA, 64 nt, Homo Sapiens; identical to SEQ ID NO: 199817

SEQ ID NO: 282491 - RNA, 64 nt, Homo Sapiens; identical to SEQ ID NO: 199818

SEQ ID NO: 282492 - RNA, 64 nt, Homo Sapiens; identical to SEQ ID NO: 199819

SEQ ID NO: 282493 - RNA, 64 nt, Homo Sapiens; identical to SEQ ID NO: 199820

SEQ ID NO: 282494 - RNA, 64 nt, Homo Sapiens; identical to SEQ ID NO: 199821

SEQ ID NO: 282495 - RNA, 64 nt, Homo Sapiens; identical to SEQ ID NO: 199822

SEQ ID NO: 282496 - RNA, 64 nt, Homo Sapiens; identical to SEQ ID NO: 199823

SEQ ID NO: 282497 - RNA, 64 nt, Homo Sapiens; identical to SEQ ID NO: 199824

SEQ ID NO: 282498 - RNA, 64 nt, Homo Sapiens
uacgaaagcccuacauugagcuccaaucugcucggggugggacgggugcuucccacaccucugg

SEQ ID NO: 282499 - RNA, 64 nt, Homo Sapiens
gagugggucuccauuccccgagaagccgggggcagggugggauggggaagaccaggagcagagu

SEQ ID NO: 282500 - RNA, 64 nt, Homo Sapiens
uccuugcugauuugauauuuuuggucauggagaagggugggauugggugggaaugggguggaag

SEQ ID NO: 282501 - RNA, 64 nt, Homo Sapiens
uuugauauuuuuggucauggagaagggugggauugggugggaaugggguggaagggugaugggg

SEQ ID NO: 282502 - RNA, 64 nt, Homo Sapiens
acuuuagaugggaaagugaggggcuugagaaagugggugggaggagggaaggauuuuuuaggag

SEQ ID NO: 282503 - RNA, 64 nt, Homo Sapiens
aaccuuuuguaccuuucuuuggggaauggggugggggugggagaggagguagauggggaagaaa

SEQ ID NO: 282504 - RNA, 64 nt, Homo Sapiens
gcuuuuguuaacacuauuaaugggguggggaauagggugggaguggggguuugggagacgggug

SEQ ID NO: 282505 - RNA, 64 nt, Homo Sapiens
uggggaauagggugggaguggggguuugggagacgggugggaaagggugguuggggggaccgau

SEQ ID NO: 282506 - RNA, 64 nt, Homo Sapiens
ucagaaaugcucaaauggguacaaccaucaccaagggugggaugggagggcagaggggaaauaa

SEQ ID NO: 282507 - RNA, 64 nt, Homo Sapiens
ugaauguuccuaaagaacugcugccccacagugagggugggagcagcggaacagggaaugccag

SEQ ID NO: 282508 - RNA, 64 nt, Homo Sapiens
augccagacacaggcucgcugcugcuggaaggcggggugggacuuccuuccucuguccggagag

SEQ ID NO: 282509 - RNA, 64 nt, Homo Sapiens
gaggcggggcuacagauugggcggggcuucucuugggugggacagggcuucuccugcgggggcg

SEQ ID NO: 282510 - RNA, 64 nt, Homo Sapiens
gaccaggcuccaauggggcggggcuucucuccgcgggugggacucuucccugggaaccgcccuc

SEQ ID NO: 282511 - RNA, 64 nt, Homo Sapiens
uaccgcaggugcaucgcgucccgugacuucgccugggugggauguccccucuucugcgucuguu

SEQ ID NO: 282512 - RNA, 64 nt, Homo Sapiens
cucggggcccagggguggagcccggcuccucagcgggugggaaccuggcgcguuucucggagcu

SEQ ID NO: 282513 - RNA, 64 nt, Homo Sapiens
guuucuccaagccugcuuugugcuucucaccuuugggugggaugccuugccagugugucuuacu

SEQ ID NO: 282514 - RNA, 64 nt, Homo Sapiens
ugccagcgcagcguucugggcuccucagucgcaggggugggaugugagucaugcggauuaucca

SEQ ID NO: 282515 - RNA, 64 nt, Homo Sapiens
gugucuuuacuauguccuaggaguggccugcugggggugggaggaccccagcucuugaagggcu

SEQ ID NO: 282516 - RNA, 64 nt, Homo Sapiens
gugagcaaagggagcagaaagauuccgaaggguagggugggaagcacugcccccugcuugaauu

SEQ ID NO: 282517 - RNA, 64 nt, Homo Sapiens
caugccuuccucccccuauuggguggacucagaugggugggacaucaucucucucuccuuccug

SEQ ID NO: 282518 - RNA, 64 nt, Homo Sapiens
gguggugcuuaaaagaggaaagccccugaggguggggugggacgcccugggccaagcugacacc

SEQ ID NO: 282519 - RNA, 64 nt, Homo Sapiens
cuucuuccucaaguuucggcaguucuugugcuaugggugggagucuggcccagacaguauuugc

SEQ ID NO: 282520 - RNA, 64 nt, Homo Sapiens
cugagaggcccuggcucuggccaggcugggaucugggugggaggcuggggcucuucuucuucca

SEQ ID NO: 282521 - RNA, 64 nt, Homo Sapiens
uggggagaaaacgggaggugcucgugcuggcccugggugggagcggggaguccuggugagaccc

SEQ ID NO: 282522 - RNA, 64 nt, Homo Sapiens
cugggcuggggccuuccuccagggaaggaggcuggggugggaacacuggccucccccagaauaa

SEQ ID NO: 282523 - RNA, 64 nt, Homo Sapiens
ggagcugggcuggccaguacagccaguggggagugggugggaggcaccaaaacuuggcagcugu

SEQ ID NO: 282524 - RNA, 64 nt, Homo Sapiens
ucucugacggugcucguucaguuucuguacgugugggugggaaugguuguaauauaaaaacugu

SEQ ID NO: 282525 - RNA, 64 nt, Homo Sapiens
gcugccucagccaagcugaggaacacgcagccaggggugggaaaagguuuacagaccagggacc

SEQ ID NO: 282526 - RNA, 64 nt, Homo Sapiens
aaaggaaagaagcaacagucaauuuuuauguugugggugggaggauuuugcaacuggguaucuu

SEQ ID NO: 282527 - RNA, 64 nt, Homo Sapiens
aucacuugagcccaggagguuucucaggaggcuggggugggaagcacaugccuguagucccagc

SEQ ID NO: 282528 - RNA, 64 nt, Homo Sapiens
uggaaaagaaggcagccuagaguggagggcucaugggugggacaccaggcuuacugagcugucc

SEQ ID NO: 282529 - RNA, 64 nt, Homo Sapiens
agaugaaaauaucagcuuuuugggagggggagaugggugggaggaugcucagcacauauuugca

SEQ ID NO: 282530 - RNA, 64 nt, Homo Sapiens
aggaagaaagggaagaauuagaagcaggcggguugggugggaggguugccaaggcucaucuuga

SEQ ID NO: 282531 - RNA, 64 nt, Homo Sapiens
aggaagaaagggaagaauuagaagcaggcggguugggugggaggcuugaguuuguugccacuga

SEQ ID NO: 282532 - RNA, 64 nt, Homo Sapiens
acugucccucuggggacgugagccagggguuccugggugggagggccgguggugcuuucugggc

SEQ ID NO: 282533 - RNA, 64 nt, Homo Sapiens
acagguuucuaguuuuuaccuaaagcaaaggccugggugggagaaccgucagcuugauaauuac

SEQ ID NO: 282534 - RNA, 64 nt, Homo Sapiens
cugagggccccaauguauguguggcugugggugugggugggagugugucugcugaguaaggaac

SEQ ID NO: 282535 - RNA, 64 nt, Homo Sapiens
acggaaacauacagaggaugccuuuucugugauugggugggauuuuuucccuuuuuauguggga

SEQ ID NO: 282536 - RNA, 64 nt, Homo Sapiens
ugaagaguuuagaaugaggcagcggugagaagaagggugggagggcgugggggccccugggugg

SEQ ID NO: 282537 - RNA, 64 nt, Homo Sapiens
auuuuucaauccuccacucuaagugauuccuccagggugggaagcacggggagcaauggaauca

SEQ ID NO: 282538 - RNA, 64 nt, Homo Sapiens
ccauugucgucuuuucuauugaggguugggauuugggugggagaggaaagcaaauuuuauuuuc

SEQ ID NO: 282539 - RNA, 64 nt, Homo Sapiens
cggauaguggcagggguggggguugcuaaggaaagggugggaugggaguggguaaagaguuugg

SEQ ID NO: 282540 - RNA, 64 nt, Homo Sapiens
gaggggaaaggcaaaugcagggagcagggguggggggugggagguugauggggaagcugcugga

SEQ ID NO: 282541 - RNA, 64 nt, Homo Sapiens
gaaggcuggggguuuuguaaauuuuggugggguugggugggaaguuuuuuaaggggguaguuuu

SEQ ID NO: 282542 - RNA, 64 nt, Homo Sapiens
aaacauguuuuggggggggaggcaaaaaagaggugggugggaugucuguuuuuaggucugggag

SEQ ID NO: 282543 - RNA, 64 nt, Homo Sapiens
agaaauucuugagcaaauuuaggacuuguggggugggugggaccgcaguugggaaaggaaagcc

SEQ ID NO: 282544 - RNA, 64 nt, Homo Sapiens
uaagucaguugcagcuguaauuuuuuaccuucaggggugggagcuuuuuauuuuccagaacuca

SEQ ID NO: 282545 - RNA, 64 nt, Homo Sapiens
augguuugacuuuuuuucccugagggugagggaugggugggaagagaggacaucuguccagucu

SEQ ID NO: 282546 - RNA, 64 nt, Homo Sapiens
aaccguuggcauuaucaggauucguguuuugugggggugggaguggagaguaggguggucuugu

SEQ ID NO: 282547 - RNA, 64 nt, Homo Sapiens
aaaagaggcuuuugggccaaaaugugaggguggugggugggaugggcagggaaggaauccuggu

SEQ ID NO: 282548 - RNA, 64 nt, Homo Sapiens
gggaagggcgggcaaggaguggggagggagucuggggugggagggaggcaucugcaugggucuu

SEQ ID NO: 282549 - RNA, 64 nt, Homo Sapiens
auggaugcaacugaagcagaaggaguugaauuuggggugggaggaaagucuuuuguauuggguc

SEQ ID NO: 282550 - RNA, 64 nt, Homo Sapiens
aacaaaggcaauggugaaaaugccaggagcugaagggugggaacucugauuccucugcuguccc

SEQ ID NO: 282551 - RNA, 64 nt, Homo Sapiens
gggauggggguguguuuuauggggguucuggauagggugggacaucuuuugauguuccuauugu

SEQ ID NO: 282552 - RNA, 64 nt, Homo Sapiens
gcccccaccuccauccauuuuaaauuaucagucugggugggaaaauauuccccuaaaaugucua

SEQ ID NO: 282553 - RNA, 64 nt, Homo Sapiens
cuccucccucagagcuggggcagcugccucccaggggugggacucugggcucagagagaggccc

SEQ ID NO: 282554 - RNA, 64 nt, Homo Sapiens
gcugacaugcucgggaaagggcagaggucacugggggugggaaggucauccaguccagacucag

SEQ ID NO: 282555 - RNA, 64 nt, Homo Sapiens
ggaaaagagagguaguuuagaacucucugcauaggggugggaauuaaucaaaaaccucagaggc

SEQ ID NO: 282556 - RNA, 64 nt, Homo Sapiens
aauuaagcacacaaaugcuaaggcagaauuuugagggugggagagaagaaaagggaaagaagcu

SEQ ID NO: 282557 - RNA, 64 nt, Homo Sapiens
cugggaaguaacaguacuuagcacucuugguggugggugggaggguggguacaggccagggaua

SEQ ID NO: 282558 - RNA, 64 nt, Homo Sapiens
gcacaauagccugaaugggauuucagguuaggcagggugggaggggaggcucucuggcuuuagu

SEQ ID NO: 282559 - RNA, 64 nt, Homo Sapiens
cuggcuuggguguggcugagggcaccacugcaaggggugggagcugucugcugggcugccaggc

SEQ ID NO: 282560 - RNA, 64 nt, Homo Sapiens
cugucugcugggcugccaggaggucugccgaugggggugggagcagggcgcagguggaggggac

SEQ ID NO: 282561 - RNA, 64 nt, Homo Sapiens
gccauguuuucauuuccuuuugcccaaaugagcggggugggaagaggguuagucuuaugugagc

SEQ ID NO: 282562 - RNA, 64 nt, Homo Sapiens
ucuguccugccuucuuucccucugcgaggcaguggggugggauucagagugcuuagucugcuca

SEQ ID NO: 282563 - RNA, 64 nt, Homo Sapiens
ucaggucuguagucuuugggucuuugggaggccagggugggaggaucacuugagcucaggaguu

SEQ ID NO: 282564 - RNA, 64 nt, Homo Sapiens
uggcucagguggggucacucuggcagcucagagagggugggagugggcccaaugcacuuuguuc

SEQ ID NO: 282565 - RNA, 64 nt, Homo Sapiens
guucuggcucuuccaggcugggagagccuuccaggggugggacacccugugauggggcccugcc

SEQ ID NO: 282566 - RNA, 64 nt, Homo Sapiens
auugcauaagaccagggggaagagugucagcguggggugggaauucccgcggccuccaccugcu

SEQ ID NO: 282567 - RNA, 64 nt, Homo Sapiens
caggggagggccagauggcauccuggcuuggggcgggugggaccuacccaggcucugagacuuu

SEQ ID NO: 282568 - RNA, 64 nt, Homo Sapiens
cuggggagcuggucugccucagagacagaguagggggugggagcagagccucggugagggucuu

SEQ ID NO: 282569 - RNA, 64 nt, Homo Sapiens
ucucuucccuuugagaagauauuuucccacaaaggggugggaagccaggagugagaaggaauuc

SEQ ID NO: 282570 - RNA, 64 nt, Homo Sapiens
cuugaccaucguccuuccucucaagcuagccagagggugggagccuaaggaagcgugggguagc

SEQ ID NO: 282571 - RNA, 64 nt, Homo Sapiens
cuagggaggugggguacauuucucugagcagucagggugggaagaaagaaugcaagaguggacu

SEQ ID NO: 282572 - RNA, 64 nt, Homo Sapiens
ucuauuguuaucugacaucucuugacaugcccgugggugggaugggaguggaggguucauauga

SEQ ID NO: 282573 - RNA, 64 nt, Homo Sapiens
aguucucucccauggggaaagauucucacugcuggggugggaagauucucgcugcuggggugug

SEQ ID NO: 282574 - RNA, 64 nt, Homo Sapiens
ggguauggagaugcaauuugagacguucggggcagggugggaguuuuuguuuguuuguuuuuua

SEQ ID NO: 282575 - RNA, 64 nt, Homo Sapiens
auguggggugaggguucuuagcugcagcguugcggggugggagacccggcucuguccugugugc

SEQ ID NO: 282576 - RNA, 64 nt, Homo Sapiens
auguguuuguauacaaaggggggggcugggaucugggugggaaucugggagcuauaugggaagu

SEQ ID NO: 282577 - RNA, 64 nt, Homo Sapiens
cccguaccgcggcuggcugggggcugggggguuggggugggacaucacaguuucccucgccccu

SEQ ID NO: 282578 - RNA, 64 nt, Homo Sapiens
gagaacuaugaaccaggaagacuccaucgcugaggggugggaaucacgugggccuggaacucua

SEQ ID NO: 282579 - RNA, 64 nt, Homo Sapiens
ugggucuucagaucauaaacggcaccagcugcuggggugggacuucaccgucaccuggaagcag

SEQ ID NO: 282580 - RNA, 64 nt, Homo Sapiens
agcccaagcgcuccggcggagcccaaaagggugggggugggaggggcagaggccaacggauccc

SEQ ID NO: 282581 - RNA, 64 nt, Homo Sapiens
ggcgggggaggcugggagcugggccuccugcguggggugggacucgcaggggccgggucuccgu

SEQ ID NO: 282582 - RNA, 64 nt, Homo Sapiens
ccaagcccccaggggagcccucccuggcguccgagggugggagucgggguguggcaggccgcgg

SEQ ID NO: 282583 - RNA, 64 nt, Homo Sapiens
uuuugugugugugcacgcauggcugagcaugugugggugggagucagcacauucacgauacugu

SEQ ID NO: 282584 - RNA, 64 nt, Homo Sapiens
gucucuggguugucauucacuuugagagcccgaggggugggagggagugaugcaggcagacgcu

SEQ ID NO: 282585 - RNA, 64 nt, Homo Sapiens
gguugaggugagucauggccucuugcuggcaauggggugggaggaguacccccaaguccucuca

SEQ ID NO: 282586 - RNA, 64 nt, Homo Sapiens
gcgaggccggagagcuggugacuuuggggacagggggugggaaggggauggacacccccagcug

SEQ ID NO: 282587 - RNA, 64 nt, Homo Sapiens
cuucgggcaguccugugugaggauuaagggacgggggugggagguaggcuguggggugggcugg

SEQ ID NO: 282588 - RNA, 64 nt, Homo Sapiens
cguuuuucucuguggcuguauguggguugcuugggggugggaugggaagaggcucuuugcaaac

SEQ ID NO: 282589 - RNA, 64 nt, Homo Sapiens
ggugugggguugggggaugaggucagggggucuugggugggaguugggggccccuucauuuccc

SEQ ID NO: 282590 - RNA, 64 nt, Homo Sapiens
ggaagaaaaacucuauuuuuugaaaaaaaaaggggggugggaggggcuggaagcagaaacaaaa

SEQ ID NO: 282591 - RNA, 64 nt, Homo Sapiens
gucugcagggaauugggggggggugagcacucuggggugggaggacgucccugcggaagccaca

SEQ ID NO: 282592 - RNA, 64 nt, Homo Sapiens
aacucugccaaauggaaaaugaccaaauuuaagagggugggacaguccccugcuccucucccag

SEQ ID NO: 282593 - RNA, 64 nt, Homo Sapiens
uuuccuggaaucaguuuauuauacugaaaacugggggugggaguagggagcuaguuuguugaua

SEQ ID NO: 282594 - RNA, 64 nt, Homo Sapiens
cugcccgggaagugcagcaggcagcuuuucuuuggggugggacuugcccugagcuuggagcugc

SEQ ID NO: 282595 - RNA, 64 nt, Homo Sapiens
aggccucguuuuccuggucuugacugcucuguuugggugggagaagauucucugggggucccca

SEQ ID NO: 282596 - RNA, 64 nt, Homo Sapiens
ggcuuuaucagguaucaucaccaagcuacagguggggugggaaauccagugcuccuacugguuc

SEQ ID NO: 282597 - RNA, 64 nt, Homo Sapiens
cacccccuccagugcuccuaaagaaagagggauggggugggagggcuaagggaucagggagagg

SEQ ID NO: 282598 - RNA, 64 nt, Homo Sapiens
cagaggugcaucuagggucccacucagggagggagggugggacaaccccagaggcaaggcugug

SEQ ID NO: 282599 - RNA, 64 nt, Homo Sapiens
cccccuuuuuuuuuguuuuguucuguuuuguuuugggugggagggugggaaauuuggguuuuua

SEQ ID NO: 282600 - RNA, 64 nt, Homo Sapiens
uuuuuuguuuuguucuguuuuguuuugggugggagggugggaaauuuggguuuuuaaguccucu

SEQ ID NO: 282601 - RNA, 64 nt, Homo Sapiens
cuuccuccacccuaagcccuggggcccugaaauggggugggagggcaggggugggagcccuccu

SEQ ID NO: 282602 - RNA, 64 nt, Homo Sapiens
agcccuggggcccugaaauggggugggagggcaggggugggagcccuccuaguggguuuggggg

SEQ ID NO: 282603 - RNA, 60 nt, Homo Sapiens
ccgggaggcggagguugcagugagccaagaucgcaccacugcacuccagccuggcaacag

SEQ ID NO: 282604 - RNA, 60 nt, Homo Sapiens
ccuggagauggagguugcagugagcagagaucgcaccacugcacuccagccugggcaaga

SEQ ID NO: 282605 - RNA, 64 nt, Homo Sapiens
ucguaauaaccuuuuggaauuauauuuuuccacuuuuaggcaaagugcuuagacauuuucaauu

SEQ ID NO: 282606 - RNA, 64 nt, Homo Sapiens
ccaaccaacaaacuuaaaaguuuaucuaccucguuuuaggcaaucaagauucuggagagucuug

SEQ ID NO: 282607 - RNA, 64 nt, Homo Sapiens
cugagccaucaaugagcugagagaucaaugacuuuuuaggcagcuguguuuuuuaagccauaua

SEQ ID NO: 282608 - RNA, 64 nt, Homo Sapiens
gauacacacuuaucuauucugucuccuucuagcuuuuaggcagccuacucuuggaaacuggagg

SEQ ID NO: 282609 - RNA, 64 nt, Homo Sapiens
ccugucucucaaaugaucagguugaagaaacaguauacaagaacuuuuuguaaaugagguuuac

SEQ ID NO: 282610 - RNA, 64 nt, Homo Sapiens
gugaagugaccucucugucacauagucagugccuauacaagacaugacuguuuuaacaaauacu

SEQ ID NO: 282611 - RNA, 64 nt, Homo Sapiens
aauuucuuuguguucccagugucuugcccaguagauacaagauaaauauugccagaaucagaua

SEQ ID NO: 282612 - RNA, 64 nt, Homo Sapiens
accaggccccucccacaacauggaauaaugggagauacaagauauuuggguggagacacagagc

SEQ ID NO: 282613 - RNA, 64 nt, Homo Sapiens
uugugucuacaccagguuugaaauaaguaaacaaauacaagagguucauauaaaagggcaaaug

SEQ ID NO: 282614 - RNA, 64 nt, Homo Sapiens
ugaggccaaugcugcuuucugguguauauucuccauacaagauuauuauuaacugcucuuuuuc

SEQ ID NO: 282615 - RNA, 64 nt, Homo Sapiens
auuaauaaaaaauuuauauaucaagaucuucccaauacaagaaacuucucauccuggagcguau

SEQ ID NO: 282616 - RNA, 64 nt, Homo Sapiens
ucuuuugauaguauagaaugucuuugaaaagguaauacaagacuaaaaauauuuauuuugugga

SEQ ID NO: 282617 - RNA, 64 nt, Homo Sapiens
uagcaauccugacauuaaaaggaaauguauuucuauacaagauuauuagcuguaauacaagaua

SEQ ID NO: 282618 - RNA, 64 nt, Homo Sapiens
ggaaauguauuucuauacaagauuauuagcuguaauacaagauauuuauuuaaccaaugaccuu

SEQ ID NO: 282619 - RNA, 64 nt, Homo Sapiens
aaugcuggauggaugcaggaaggaauggaggaaugaaugggaagggagaacauaucuauccucu

SEQ ID NO: 282620 - RNA, 64 nt, Homo Sapiens
ccccuggggcuagagguggaggaggcaguccugggaaugggaaaaaccccaacuuuggggucau

SEQ ID NO: 282621 - RNA, 64 nt, Homo Sapiens
uaaaauguggucuguccacggucuaccaacugaugaaugggaaaaaaguggaaacaacccaaau

SEQ ID NO: 282622 - RNA, 64 nt, Homo Sapiens
aaauauuugcgagucauauaaaagauaaccugcagaaugggagaagacccuaucaagaagguga

SEQ ID NO: 282623 - RNA, 64 nt, Homo Sapiens
gggcaacagugaaaaauauuagauaauuuuuaaagaaugggaguuguccuggggcuaagaaaga

SEQ ID NO: 282624 - RNA, 64 nt, Homo Sapiens
aagaugacuagcauagcagucugaaggaauacaggaaugggauuuucugaaacucuaccacaua

SEQ ID NO: 282625 - RNA, 64 nt, Homo Sapiens
cuuuguuagcaguuauguggucagaaaacaacuagaaugggagcacaccuggugcccagauuuu

SEQ ID NO: 282626 - RNA, 64 nt, Homo Sapiens
aaauauuuacaagcccaaacuaauauaaaugauugaaugggaacaaaucucuugugcagaagaa

SEQ ID NO: 282627 - RNA, 64 nt, Homo Sapiens
uugguguguuuagagauuuuugugcaauauuuuggaaugggacaggguuuuguauucagaaugu

SEQ ID NO: 282628 - RNA, 64 nt, Homo Sapiens
gcccugcaaagcacccaaguccagcccaggcacggaaugggaggcuuacuucuagaaaaaagau

SEQ ID NO: 282629 - RNA, 64 nt, Homo Sapiens
cccagaguuugcucaauuccaagacagugcccaugaaugggacaccuguaauguaacccacaca

SEQ ID NO: 282630 - RNA, 64 nt, Homo Sapiens
cuaaagccuuguugccuucucuuuaaugccuagagaaugggaugugugaugcaaaugcucaaaa

SEQ ID NO: 282631 - RNA, 64 nt, Homo Sapiens; identical to SEQ ID NO: 154250

SEQ ID NO: 282632 - RNA, 64 nt, Homo Sapiens; identical to SEQ ID NO: 154251

SEQ ID NO: 282633 - RNA, 64 nt, Homo Sapiens; identical to SEQ ID NO: 154252

SEQ ID NO: 282634 - RNA, 64 nt, Homo Sapiens; identical to SEQ ID NO: 154253

SEQ ID NO: 282635 - RNA, 64 nt, Homo Sapiens; identical to SEQ ID NO: 154254

SEQ ID NO: 282636 - RNA, 64 nt, Homo Sapiens; identical to SEQ ID NO: 154255

SEQ ID NO: 282637 - RNA, 64 nt, Homo Sapiens; identical to SEQ ID NO: 154256

SEQ ID NO: 282638 - RNA, 64 nt, Homo Sapiens; identical to SEQ ID NO: 154257

SEQ ID NO: 282639 - RNA, 64 nt, Homo Sapiens; identical to SEQ ID NO: 154258

SEQ ID NO: 282640 - RNA, 64 nt, Homo Sapiens; identical to SEQ ID NO: 154259

SEQ ID NO: 282641 - RNA, 64 nt, Homo Sapiens; identical to SEQ ID NO: 154260

SEQ ID NO: 282642 - RNA, 64 nt, Homo Sapiens; identical to SEQ ID NO: 154261

SEQ ID NO: 282643 - RNA, 64 nt, Homo Sapiens; identical to SEQ ID NO: 154262

SEQ ID NO: 282644 - RNA, 64 nt, Homo Sapiens; identical to SEQ ID NO: 154263

SEQ ID NO: 282645 - RNA, 64 nt, Homo Sapiens; identical to SEQ ID NO: 154264

SEQ ID NO: 282646 - RNA, 64 nt, Homo Sapiens; identical to SEQ ID NO: 154265

SEQ ID NO: 282647 - RNA, 64 nt, Homo Sapiens; identical to SEQ ID NO: 154266

SEQ ID NO: 282648 - RNA, 64 nt, Homo Sapiens; identical to SEQ ID NO: 154267

SEQ ID NO: 282649 - RNA, 64 nt, Homo Sapiens; identical to SEQ ID NO: 154268

SEQ ID NO: 282650 - RNA, 64 nt, Homo Sapiens; identical to SEQ ID NO: 154269

SEQ ID NO: 282651 - RNA, 64 nt, Homo Sapiens; identical to SEQ ID NO: 154270

SEQ ID NO: 282652 - RNA, 64 nt, Homo Sapiens; identical to SEQ ID NO: 154271

SEQ ID NO: 282653 - RNA, 64 nt, Homo Sapiens; identical to SEQ ID NO: 154272

SEQ ID NO: 282654 - RNA, 64 nt, Homo Sapiens; identical to SEQ ID NO: 154273

SEQ ID NO: 282655 - RNA, 64 nt, Homo Sapiens; identical to SEQ ID NO: 154274

SEQ ID NO: 282656 - RNA, 64 nt, Homo Sapiens; identical to SEQ ID NO: 154275

SEQ ID NO: 282657 - RNA, 64 nt, Homo Sapiens; identical to SEQ ID NO: 154276

SEQ ID NO: 282658 - RNA, 64 nt, Homo Sapiens; identical to SEQ ID NO: 154277

SEQ ID NO: 282659 - RNA, 64 nt, Homo Sapiens; identical to SEQ ID NO: 154278

SEQ ID NO: 282660 - RNA, 64 nt, Homo Sapiens
gaaaaaggacagcuucugagugugguaauugugccucuagcacccagccuuucaaagcccaccu

SEQ ID NO: 282661 - RNA, 64 nt, Homo Sapiens
caguguuguugauucugauugugaauccccucaacucuagcagacacauacacaccccugaaau

SEQ ID NO: 282662 - RNA, 64 nt, Homo Sapiens
uucaaaacugaggcuggguuagacuauuccuggacucuagcaacuucucaaaaccugggugaga

SEQ ID NO: 282663 - RNA, 64 nt, Homo Sapiens
cuauuuacuguuuaucaaucccaccugucuuccucucuagcaaucucaccauccaauuaucuac

SEQ ID NO: 282664 - RNA, 64 nt, Homo Sapiens
caauacacuauuugguaagauaauguacugacaucucuagcaaucuuuuuugccaguggcuuua

SEQ ID NO: 282665 - RNA, 64 nt, Homo Sapiens
auaaucacauuagaggaaaugagauauccauuaccucuagcauuuauucuuuuuauuacaagca

SEQ ID NO: 282666 - RNA, 64 nt, Homo Sapiens
caugcaguccaaggaauaucguucuuuaaucuuccucuagcaggguuuagccauuuuggcugcu

SEQ ID NO: 282667 - RNA, 64 nt, Homo Sapiens
caugcaguccaaggaauaucgcucuuuaauuuuccucuagcaggguuuaaccauuuuggcugcu

SEQ ID NO: 282668 - RNA, 64 nt, Homo Sapiens
aguuuuaaaaaugucucuuuuggauguaaaaucuaucaguuaaucuaaauucuuagcaucucac

SEQ ID NO: 282669 - RNA, 64 nt, Homo Sapiens
gaagacuuaugaaaaggucauuuauuuuuaaacuaucaguuacuuauucccaagaagaaauuga

SEQ ID NO: 282670 - RNA, 64 nt, Homo Sapiens
auauaguuuuaaauguauguucauauuccauuguaucaguuaacugcugagucauuuucucaaa

SEQ ID NO: 282671 - RNA, 64 nt, Homo Sapiens
aauauuagcauuucaaucagcaauaucauauaucaucaguuagccuguuuccaaaaagaaggug

SEQ ID NO: 282672 - RNA, 64 nt, Homo Sapiens
accaauguauuucuugccccaaaggggauugaaaaucaguuagaagugguuuauuccacuggag

SEQ ID NO: 282673 - RNA, 64 nt, Homo Sapiens
uuugcacagauucuagggggcauacugcaggugcaucaguuacuugagaacaucucucguguca

SEQ ID NO: 282674 - RNA, 64 nt, Homo Sapiens
gagugaagaaagacgggaaucaagaaacaagauaaucaguuacuuuagguuaaauaucugugga

SEQ ID NO: 282675 - RNA, 64 nt, Homo Sapiens
aguacaagugccgcauagugauaaaauugugauaaucaguuaucuguuaaaugaugagcauuua

SEQ ID NO: 282676 - RNA, 64 nt, Homo Sapiens
uucuucagcuuuaauuucauauuaugguuucuaaaucaguuauuggcuaaauauuuguccuuuu

SEQ ID NO: 282677 - RNA, 64 nt, Homo Sapiens
auaccuugagaaaaacugcaaauuucuaucugaaaucaguuaagcuauuuuuaaggugaauuuu

SEQ ID NO: 282678 - RNA, 64 nt, Homo Sapiens
guuaggaagaacaagaugccuccuccuaacccucaucaguuaaguauccuuauucugagccuuc

SEQ ID NO: 282679 - RNA, 64 nt, Homo Sapiens
uuuaucuguaccuucuuugcuugccuuauguugaaucaguuauagcacguuuuugucccuucag

SEQ ID NO: 282680 - RNA, 64 nt, Homo Sapiens
uuuuugggcuggaugugguauguacauauuucacuaaagacaagaauauaaucaaagaauuuuc

SEQ ID NO: 282681 - RNA, 64 nt, Homo Sapiens
agccaagguguaugcucucaaauaaauaaaugaauaaagacaaagggcacaaaaugaaugaaua

SEQ ID NO: 282682 - RNA, 64 nt, Homo Sapiens
uggguguggguugaagguguuuaacucagaaaaguaaagacaggaaauaacucucugcuagguc

SEQ ID NO: 282683 - RNA, 64 nt, Homo Sapiens
uucuucuaaaucauaaaugcagacaauguuuagguaaagacauacucauuaaguguuauuuauu

SEQ ID NO: 282684 - RNA, 64 nt, Homo Sapiens
guuucaccauguuggccagguuuuguguuuuuaauaaagacagggugccacccacccaacuaau

SEQ ID NO: 282685 - RNA, 64 nt, Homo Sapiens
gucucgcucuguugcccaggucuuuuuuuuuuuuuaaagacagauuccuggcucaucucuuuau

SEQ ID NO: 282686 - RNA, 64 nt, Homo Sapiens
aaauuuuuuauaauauauguaauuugucuagucuuaaagacauuuggagcauggccaacaggaa

SEQ ID NO: 282687 - RNA, 64 nt, Homo Sapiens
uuucaucaagcagucaacauguaaauuucuguuguaaagacaccuuauuuaauauaaucgauuc

SEQ ID NO: 282688 - RNA, 64 nt, Homo Sapiens
uccaaagagacucccacucagauucuaaagcauuuaaagacaauucuagcagaauuuaucaaaa

SEQ ID NO: 282689 - RNA, 64 nt, Homo Sapiens
cuugaaagcaauguucauaaauauuuaagcaaauuaaagacaauguuaacaaauuuucuauuaa

SEQ ID NO: 282690 - RNA, 64 nt, Homo Sapiens
guagaucguguuuagaggcuacugagaaauuuuuuaaagacauggguccccucuaguauguguc

SEQ ID NO: 282691 - RNA, 64 nt, Homo Sapiens
uuuacucaauauuggagaaguacaugugugccccuaaagacacaauuuaaguggauuaauauuc

SEQ ID NO: 282692 - RNA, 64 nt, Homo Sapiens
aaccgaaugugaaauaccagccugggaguagagauaaagacacagucuuaagugagaauauuug

SEQ ID NO: 282693 - RNA, 64 nt, Homo Sapiens
aauuuagaauugauuucuuuaacauaguauucauuaaagacaugaguuuuuauacagguugcaa

SEQ ID NO: 282694 - RNA, 64 nt, Homo Sapiens
caacauuaagggccauauugaaaauaggaacaaauaaagacaaaagaagaaaaagagaaagaug

SEQ ID NO: 282695 - RNA, 64 nt, Homo Sapiens
auaaaaauaauuguuauguugaggcuuucuuuuguaaagacagaaaagacuuuuucauagagaa

SEQ ID NO: 282696 - RNA, 64 nt, Homo Sapiens
ugcacgcguauguucguugcagaaaucauuguuauaaagacacaggguauauacccaaaggaau

SEQ ID NO: 282697 - RNA, 64 nt, Homo Sapiens
gauaccauucaacccagcaaagacaguguggggauaaagacagaauuaguucagccauugugga

SEQ ID NO: 282698 - RNA, 64 nt, Homo Sapiens
aucugguuguauuagucuguuuucacgcugcugauaaagacauaccugagaccaggaagaaaaa

SEQ ID NO: 282699 - RNA, 64 nt, Homo Sapiens
aguuuacuguauuagucuguuuucacacugcugauaaagacauuccucaagauugugaagaaaa

SEQ ID NO: 282700 - RNA, 64 nt, Homo Sapiens
gcuggauucucuucacuauaacugagugguaauuuaaagacaacaauuuaaugucacuaauuuu

SEQ ID NO: 282701 - RNA, 64 nt, Homo Sapiens
cuuaggauuccugaaaagaauuucaaaaaaaaaauaaagacacuguugccaaugugacccaaaa

SEQ ID NO: 282702 - RNA, 64 nt, Homo Sapiens
uuuccaauguaguaucuguaaacaccugugugauuaaagacaacgguaaauuuauauugaguuu

SEQ ID NO: 282703 - RNA, 64 nt, Homo Sapiens
cuaaagggaacagauuaaaacgaggggaacuguauaaagacauaguuauaucaguguauauaca

SEQ ID NO: 282704 - RNA, 64 nt, Homo Sapiens
uaugaauauuacucucaaaacauagacugagguauaaagacaagcagugacuuggccccagacg

SEQ ID NO: 282705 - RNA, 64 nt, Homo Sapiens
uuacgaagacaaagucccaguuuuuuuuuuuuuuuaaagacaggauguuauacaaggcaagcau

SEQ ID NO: 282706 - RNA, 64 nt, Homo Sapiens
ugauuuaaguagcaugaggugauuauuguccaauuaaagacaguaauugaccccuuuaacaugu

SEQ ID NO: 282707 - RNA, 64 nt, Homo Sapiens
uuagagcaaauugaccccuuaagauagucaagacuaaagacacacaugacuguauauucacugg

SEQ ID NO: 282708 - RNA, 64 nt, Homo Sapiens
gcaguuucaaguuaguuagaagcauguugucaacuaaagacaacaaacuaucagauucauucau

SEQ ID NO: 282709 - RNA, 64 nt, Homo Sapiens
aggcccauaacagaggacuaaaaucucugaauuuuaaagacacagaugacuggcauauuuugga

SEQ ID NO: 282710 - RNA, 64 nt, Homo Sapiens
cauaagaaauuauaaaaguauuuagagauugcaguaaagacaggugaaaucuuuacaauuuaug

SEQ ID NO: 282711 - RNA, 64 nt, Homo Sapiens
cauaggaaaucacaaggguauugagagauuaaaguaaagacaggauccuccucagcugacagga

SEQ ID NO: 282712 - RNA, 64 nt, Homo Sapiens
aagccacgggugccagaagccaucaagacuuugcuaaagacaugcacuuuuucucuuuccauga

SEQ ID NO: 282713 - RNA, 64 nt, Homo Sapiens
guuaaacuuauaacccacuuugugacuucuauuuuaaagacaauaagacaggcuggaagauagc

SEQ ID NO: 282714 - RNA, 64 nt, Homo Sapiens
ucacucuccuuauuacacaagcacagccgcccagugugcacaucaugugcagacaccuuggaaa

SEQ ID NO: 282715 - RNA, 64 nt, Homo Sapiens
gcucggggugugugugugcgugcuguguguauggugugcacauacgugagugugggugugugua

SEQ ID NO: 282716 - RNA, 64 nt, Homo Sapiens
cacgcacucuccccgcucagcacacucauacacaugugcacacaugagugagcacacccgugug

SEQ ID NO: 282717 - RNA, 64 nt, Homo Sapiens
cauacacaugugcacacacaagugagcacacccgugugcacacuaugugugcaugugcugugug

SEQ ID NO: 282718 - RNA, 64 nt, Homo Sapiens
acggacucaagugggcuggugacccagucagaguugugcacauggcuuaguuuucauacacagc

SEQ ID NO: 282719 - RNA, 64 nt, Homo Sapiens
gagagagguuuuuuucuguucugucucauaugauugugcacauacuugagacuguuuugaauuu

SEQ ID NO: 282720 - RNA, 64 nt, Homo Sapiens
uuuguggagaggaggguguuaaugagcgugcaagugugcacacguaugaugugugcacaugcuu

SEQ ID NO: 282721 - RNA, 64 nt, Homo Sapiens
cuuaaugagcgugcaagugugugugaauaugaugugugcacaugaucaagagcauggcuugagu

SEQ ID NO: 282722 - RNA, 64 nt, Homo Sapiens
gcacggauauugccuggacacacacacacacacgugugcacagauaugcugucuggacacgcac

SEQ ID NO: 282723 - RNA, 64 nt, Homo Sapiens
ucacacacgugcagauauugccuggacacacacaugugcacagauaugcugucuggacaugcac

SEQ ID NO: 282724 - RNA, 64 nt, Homo Sapiens
guugcccauggugggagcguggucacugugcaguugugcacagaugucuuuccuuuaccguugg

SEQ ID NO: 282725 - RNA, 64 nt, Homo Sapiens
uuucgggagucaggggaggagaugacuuugcuucugugcacagccccgucuuccaggagccaca

SEQ ID NO: 282726 - RNA, 64 nt, Homo Sapiens
cuuggaggcgagaugagcucgaacaaaccauuucugugcacauccaccuugucucccuucccaa

SEQ ID NO: 282727 - RNA, 64 nt, Homo Sapiens
ggagugcuccacucccuagcgagcaccuauuuucugugcacaugcuucacuagagcuuacucug

SEQ ID NO: 282728 - RNA, 64 nt, Homo Sapiens
cggguguuggugcaacucacauguaugcaccacaugugcacacaagugccucugugcugguuau

SEQ ID NO: 282729 - RNA, 64 nt, Homo Sapiens
ccguugcagcacaagcuuauggagcagcaggucaugugcacauggcaugcuucguagagggcca

SEQ ID NO: 282730 - RNA, 64 nt, Homo Sapiens
cacagggcucuuguguguguuaacaagaggcauuugugcacacaaguagcgguuucuuucaggu

SEQ ID NO: 282731 - RNA, 64 nt, Homo Sapiens
acauugcacaggguuggugacucgacguggugaaugugcacacgcccugccugguccgccaugu

SEQ ID NO: 282732 - RNA, 64 nt, Homo Sapiens
uuuauuauuagaagacacaguggcagagcacacaugugcacagguucugauuauuucucuugga

SEQ ID NO: 282733 - RNA, 64 nt, Homo Sapiens
gucuuccagcgugccgcucaguuccccgaauccgugugcacacgugugaucucgucuucagugu

SEQ ID NO: 282734 - RNA, 64 nt, Homo Sapiens
cgucuucagugugccgcucaguucccugaauccgugugcacacugcguauguguacgcgcagca

SEQ ID NO: 282735 - RNA, 64 nt, Homo Sapiens
uuaugaugaagauuagauugguuuggugucuuuuugugcacagagugaugugcacauguugucu

SEQ ID NO: 282736 - RNA, 64 nt, Homo Sapiens
uugucuguuuggugucuuuuucauuucacugugaugugcacauguuuucacuggaccugugaug

SEQ ID NO: 282737 - RNA, 64 nt, Homo Sapiens
ccacccacuuuccucugcuugggaccucaccuccugugcacagcucccacagugccuuuuaagg

SEQ ID NO: 282738 - RNA, 64 nt, Homo Sapiens
ugucccuccacuggauccccucgcacauccugugugugcacagcucgccccuuucugggugugu

SEQ ID NO: 282739 - RNA, 64 nt, Homo Sapiens
uauauauagauaucuguauauacacacacacauaugugcacacacacacucucucuccauuauc

SEQ ID NO: 282740 - RNA, 64 nt, Homo Sapiens
ccaaagaaauauguuuuuguaagugguaggaacaugugcacacaauagaacaugaaauaaguuu

SEQ ID NO: 282741 - RNA, 64 nt, Homo Sapiens
uggaagggugcauggcccgccuucagcacaucccugugcacagcugacgcacugccuccugcac

SEQ ID NO: 282742 - RNA, 64 nt, Homo Sapiens
cauguaaaccagggaccuucugcuuaugcaugugugugcacaugacucccauuagggccugcuu

SEQ ID NO: 282743 - RNA, 64 nt, Homo Sapiens
cccugugcaugucuggacucacggagcucacccaugugcacaagugugcacaguaaacguguuu

SEQ ID NO: 282744 - RNA, 64 nt, Homo Sapiens
gucuggacucacggagcucacccaugugcacaagugugcacaguaaacguguuuguggucaaca

SEQ ID NO: 282745 - RNA, 64 nt, Homo Sapiens
uaugugcgugugugcaagugucugugugcaagugugugcacaugugugcgugugcgugcaugug

SEQ ID NO: 282746 - RNA, 64 nt, Homo Sapiens
gacagauuccaggcgaugugcaaguguaugcacgugugcacacacaccacacauacacacacac

SEQ ID NO: 282747 - RNA, 64 nt, Homo Sapiens
cuuuagaagcacccaugaaguaguguguucagacugugcacacagaaaacaggcucugccuuca

SEQ ID NO: 282748 - RNA, 64 nt, Homo Sapiens
uccuucucuuugagaccugacugaaaaaauuaggugugcacaccuguaaucccagcuaccuggg

SEQ ID NO: 282749 - RNA, 64 nt, Homo Sapiens
uguccauggacgugaaacugcauaguaaugagacugugcacacugauguuuacaagauugaaag

SEQ ID NO: 282750 - RNA, 64 nt, Homo Sapiens
guugcucuugggucaacuggcuuacagauuuacaugugcacacacacacaaauuucuuaucaca

SEQ ID NO: 282751 - RNA, 64 nt, Homo Sapiens
gaauuagugaaugcugaauguucugugaauuuucugugcacacuuguuacucgugguaguuagg

SEQ ID NO: 282752 - RNA, 64 nt, Homo Sapiens
uacacauguacauuuauaugaaauacuuaacacaugugcacaugauauaaaggcuugagucaug

SEQ ID NO: 282753 - RNA, 64 nt, Homo Sapiens
uucuuguauccucuuaacuggccauuaucuuguaugugcacauuuuauaaauguacagaaacau

SEQ ID NO: 282754 - RNA, 64 nt, Homo Sapiens
aacaguaacaaaaaaaucugcucagaaaaauguaugugcacaaauaaaaaaaauuaauggcaau

SEQ ID NO: 282755 - RNA, 64 nt, Homo Sapiens
uucuuuuauccucuuaacuggccauuaucuuguaugugcacauuuuauaaauguacagaaacau

SEQ ID NO: 282756 - RNA, 64 nt, Homo Sapiens; identical to SEQ ID NO: 282754

SEQ ID NO: 282757 - RNA, 64 nt, Homo Sapiens
auaccuuccaucucaaccuaccucgaguggcgaguccagacaccaucaccacgcagagagggga

SEQ ID NO: 282758 - RNA, 64 nt, Homo Sapiens
gccauucugauuggaccuggcccagugcaaucuguccagacaagcccugcuugcuggaaaacug

SEQ ID NO: 282759 - RNA, 64 nt, Homo Sapiens
gaucaugggaauugagugucuaugaaaaccauauuccagacaagaauauagucuaagguaaaug

SEQ ID NO: 282760 - RNA, 64 nt, Homo Sapiens
cuuuuuuaauacacaugacuuuccucucccaguuuccagacagggcucuuugaauguaugucaa

SEQ ID NO: 282761 - RNA, 64 nt, Homo Sapiens
gguuucuugcuuuguuuuccuguuccuguucgguuccagacacuggagaaccaugcucuuguuc

SEQ ID NO: 282762 - RNA, 64 nt, Homo Sapiens
cgcucagucuguucacugcagucugaagcucgcauccagacaguagcugccucuucucuugaca

SEQ ID NO: 282763 - RNA, 64 nt, Homo Sapiens
ugaaacccggugucuaccaaaaauacaaaauguauccagacauggugguguguaccuguagucc

SEQ ID NO: 282764 - RNA, 64 nt, Homo Sapiens
agacccugacucagaaagaaccacuugcccacaguccagacagauggauuguagguggguuuuc

SEQ ID NO: 282765 - RNA, 64 nt, Homo Sapiens
uaaaaacuuaaacucaccaaaugguguuuuguuauccagacagccuaguaugaaccguggagga

SEQ ID NO: 282766 - RNA, 64 nt, Homo Sapiens
aacaccagugaguguucaucugcagccuucccucuccagacagagcagcuacaccaguaauggc

SEQ ID NO: 282767 - RNA, 64 nt, Homo Sapiens
uacacaaaaauauuuuccuuguagaaaauaguuuuccagacacuuagccuucugaagugcucau

SEQ ID NO: 282768 - RNA, 64 nt, Homo Sapiens
cuguguacagcgagugaauuaaaaugucugccucuccagacauuucuuaaugauuccacuuaau

SEQ ID NO: 282769 - RNA, 64 nt, Homo Sapiens
uuccuguugcauuaagacuuuguucuugcuggucuccagacacaggaucagugcucucuauuga

SEQ ID NO: 282770 - RNA, 64 nt, Homo Sapiens
ugcugugagcaaaugaacauaaauuaauuuuccauccagacagcuuaacuggggaccaucugug

SEQ ID NO: 282771 - RNA, 64 nt, Homo Sapiens
guggggcuuagaauggggcuggccaagccaggguuccagacaggagaagugggauucaggaaug

SEQ ID NO: 282772 - RNA, 64 nt, Homo Sapiens
guggaucuggagucugaaggcagggggguuggguuccagacagaguguggaguggaggggucag

SEQ ID NO: 282773 - RNA, 64 nt, Homo Sapiens
aggaggaaagaggcccagcucucagcugacgauggaggcagaaccggagucggguuuggggaag

SEQ ID NO: 282774 - RNA, 64 nt, Homo Sapiens
cacaaccaagcacuuugacauuugcaccuuaggagaggcagauguuaaaauggaauccaaagac

SEQ ID NO: 282775 - RNA, 64 nt, Homo Sapiens
aacaguuguagcagcagcagacgaagccauugcagaggcagaauaugcugagugucuggaguca

SEQ ID NO: 282776 - RNA, 64 nt, Homo Sapiens
ucccacccuugagaauguggagaacucccauggagaggcagaauggcaggagguuucauguccc

SEQ ID NO: 282777 - RNA, 64 nt, Homo Sapiens
gggaggcugaggcaggagaauugcuugaacccuggaggcagaaguugcagugagccgagaucgc

SEQ ID NO: 282778 - RNA, 64 nt, Homo Sapiens
uaaauugucgaaggucucccaggagcucuguacugaggcagacacagaaagacacaaaacgguc

SEQ ID NO: 282779 - RNA, 64 nt, Homo Sapiens
uugcagugagccgagauuauuugcuugaaccggggaggcagaaggggaggcugaggcaggagaa

SEQ ID NO: 282780 - RNA, 64 nt, Homo Sapiens
uugcagugagcugagauugcuggcaugaaccugggaggcagagcgggaggcugaggcaggagaa

SEQ ID NO: 282781 - RNA, 64 nt, Homo Sapiens
ccaggagcuccaagaaaggcauuucaugggggcugaggcagaacaagucccaggcaaugccagc

SEQ ID NO: 282782 - RNA, 64 nt, Homo Sapiens
guacccaggggacugagggcgccagggcccuggggaggcagaggcaugcccaccuagcucccug

SEQ ID NO: 282783 - RNA, 64 nt, Homo Sapiens
uugcagugagccgagaucacuugcuugaaccugggaggcagaggaggaggcugaggcaggagaa

SEQ ID NO: 282784 - RNA, 54 nt, Homo Sapiens
ugcagagcuuguuuuguuucgcaggaggcagacugcaacaagccuguaugcuga

SEQ ID NO: 282785 - RNA, 64 nt, Homo Sapiens
uucugcccacuguuaucuuccacacaggacagaggaggcagagcgcccccaugccccucugagu

SEQ ID NO: 282786 - RNA, 64 nt, Homo Sapiens
ccuaagaaguuaucuuuucuuucccccaagugaagaggcagaaaucuggccaggccccccuuuu

SEQ ID NO: 282787 - RNA, 64 nt, Homo Sapiens
ucagcccgaaugccugucaguaccgcgagacugagaggcagaagcuagaaaaacuugggucucu

SEQ ID NO: 282788 - RNA, 64 nt, Homo Sapiens
aaauuuauuuccaucuaggauauaccagagaccugaggcagaugguaacugggaucgcaccuuu

SEQ ID NO: 282789 - RNA, 64 nt, Homo Sapiens
gccgccacccuggcaugccccuagaguuuaagcugaggcagaguaguuccaaagacucagagaa

SEQ ID NO: 282790 - RNA, 64 nt, Homo Sapiens
cagcccuucccccgagugcauguacccuucgcuugaggcagaugucuugagcaaauuaggaaaa

SEQ ID NO: 282791 - RNA, 64 nt, Homo Sapiens
ugaaaacaggguuggaaggaaauggaaggguuuggaggcagagcacugggaggugaaaugggga

SEQ ID NO: 282792 - RNA, 64 nt, Homo Sapiens
uggaggagaggugcagugaacauaguggaggggagaggcagaacagaaugaacugcaaguucag

SEQ ID NO: 282793 - RNA, 64 nt, Homo Sapiens
ucauggugagccgagaucacucacuugaacccgggaggcagagggggaggcugaggcaggagaa

SEQ ID NO: 282794 - RNA, 64 nt, Homo Sapiens
uuaccauugucuuuucacugucacaaaugaaaaggaggcagaugaggaaugugguguucuggcu

SEQ ID NO: 282795 - RNA, 64 nt, Homo Sapiens
acuuguuuaucucagucuguacaaaaacaguaaggaggcagaaagccaagcacugcauuuuuag

SEQ ID NO: 282796 - RNA, 64 nt, Homo Sapiens
gggaggcugaggcaggagaaucacuugaacccgggaggcagagguugcagugagcugagauugc

SEQ ID NO: 282797 - RNA, 64 nt, Homo Sapiens
uugcagugagccaaggucauuggcuugaacccaggaggcagaggagggggcugaggcaggggaa

SEQ ID NO: 282798 - RNA, 64 nt, Homo Sapiens
uugcagugagcugagauuguucgcuugaaccugggaggcagaaggggaggcugaggcaggagaa

SEQ ID NO: 282799 - RNA, 64 nt, Homo Sapiens
ugggcggaucacaaggucaauuccagcacuuugggaggcagaggacaguggcucaugccuauaa

SEQ ID NO: 282800 - RNA, 64 nt, Homo Sapiens
gcgguggcucaugccuguaauuccagcacuuugggaggcagaguugggaggaucaccugauguc

SEQ ID NO: 282801 - RNA, 64 nt, Homo Sapiens
gggaggcugaggcaagagaaucgcuugaacccaggaggcagagguugcagugagcugagaucau

SEQ ID NO: 282802 - RNA, 64 nt, Homo Sapiens
accaaacuuguaaaagcauuccauguauucaguggaggcagaauguauaauauuuuuuccuuau

SEQ ID NO: 282803 - RNA, 64 nt, Homo Sapiens
auaacacauguaauacauaguagaauacauuucagaggcagaguuccucggauuauuuuuuaug

SEQ ID NO: 282804 - RNA, 64 nt, Homo Sapiens
gaagaagaaaaacaguuaaagaggcagagagagggaggcagaugauucuugguuuuaaugagag

SEQ ID NO: 282805 - RNA, 64 nt, Homo Sapiens
gagggaggcagauggaagaagguuuuaaugagaggaggcagagaccaaacuaagcuagauucuu

SEQ ID NO: 282806 - RNA, 64 nt, Homo Sapiens
cugcagugagccgagauugcucauuugaacccgcgaggcagagugggaggcugaggcaugagaa

SEQ ID NO: 282807 - RNA, 64 nt, Homo Sapiens
aagcacaggaucaaggaauuaggguggucuacuugaggcagaugggauaguagcugggaacugu

SEQ ID NO: 282808 - RNA, 64 nt, Homo Sapiens
uggaggcugaggcaggagaauggcaugaacccaggaggcagagauugcagugagccaagaucac

SEQ ID NO: 282809 - RNA, 64 nt, Homo Sapiens
uuguagugagccgagaucgcuugcuugauccugggaggcagaggggaggcugaggcaggagaau

SEQ ID NO: 282810 - RNA, 64 nt, Homo Sapiens
ugagaagauuaaaaaaaaauuugcagugguuucagaggcagaucaauuaaguugcauagcugcu

SEQ ID NO: 282811 - RNA, 64 nt, Homo Sapiens
agcucgccucuuuaggguccaugguggcagcagagaggcagaagugggaguccagagccaggaa

SEQ ID NO: 282812 - RNA, 64 nt, Homo Sapiens
cuccaguccaugcucuucuggacguggacucucugaggcagaacugagcuuuuccaggccucuu

SEQ ID NO: 282813 - RNA, 64 nt, Homo Sapiens
gcucacgccuguaauccuaacacuuugggaggccgaggcagacagaucaccugaggucaggagu

SEQ ID NO: 282814 - RNA, 64 nt, Homo Sapiens
uccaggcaccugugaucccagcuacuuagaggcugaggcagaagaauugcuuuaaccuuggagg

SEQ ID NO: 282815 - RNA, 64 nt, Homo Sapiens
aggaggcuaaggcaggagaaucacuugaacccaggaggcagagguuggagugagcugagaucgc

SEQ ID NO: 282816 - RNA, 64 nt, Homo Sapiens
cgggaggauugcuugaggccuuccaacacuuugggaggcagagggcaauggcucacaccuguaa

SEQ ID NO: 282817 - RNA, 64 nt, Homo Sapiens
uugcagugagccaagauuauucgcuugaaccugggaggcagaggaagaggcugaggcaggagaa

SEQ ID NO: 282818 - RNA, 64 nt, Homo Sapiens
aagagcuagagaauugguuuguggaggagaauaagaggcagagcauucagaaauguauuggggg

SEQ ID NO: 282819 - RNA, 64 nt, Homo Sapiens
auaaaguguucuaugaaauuugaaauguaaagaugaggcagagacgacauuccccccgaaaaau

SEQ ID NO: 282820 - RNA, 64 nt, Homo Sapiens
uugcagugacccaagaucguuugcucaaacccgggaggcagagggggaggcugaggcaggagaa

SEQ ID NO: 282821 - RNA, 64 nt, Homo Sapiens
cuugcucugcuggagugcgguuuuuuuuuuuuuugaggcagaguuagcuguguucaauuuuuuu

SEQ ID NO: 282822 - RNA, 64 nt, Homo Sapiens
gaaauuagaauagaaccaaaaacgccagucaugggaggcagagcugggggagcgaggcugacaa

SEQ ID NO: 282823 - RNA, 64 nt, Homo Sapiens
gugcacgucuguagucccagcuacucaggaggcugaggcagaagaaucgcuugaacccuggagg

SEQ ID NO: 282824 - RNA, 64 nt, Homo Sapiens
uacuccagaagaguauaucuaaguaacuaaaauggaggcagaaaauguuuuaaggauuuucuuc

SEQ ID NO: 282825 - RNA, 64 nt, Homo Sapiens
gggaggcugaggcaggagaaucacuugaacccaggaggcagagguugcagugagccaagauugc

SEQ ID NO: 282826 - RNA, 64 nt, Homo Sapiens
ugccugaacccgcgaggcggcuacucagaagggugaggcagaaugggcaugccuguagucccag

SEQ ID NO: 282827 - RNA, 64 nt, Homo Sapiens
uugcacugagccgagaucgcuugcuugagccugggaggcagagaagguggcugaggcauaagaa

SEQ ID NO: 282828 - RNA, 64 nt, Homo Sapiens
cugcggggugguagaaaaggggacccuggacccagaggcagauaccccagugccggagcagaaa

SEQ ID NO: 282829 - RNA, 64 nt, Homo Sapiens
cccugcguggcccauggucggcggaaggugggaggaggcagacggcuuugaaggccugaggucu

SEQ ID NO: 282830 - RNA, 64 nt, Homo Sapiens
auggaaaaggaauaggaaggauuucugagaaaaugaggcagagcauaauaaucaaaugccuuca

SEQ ID NO: 282831 - RNA, 64 nt, Homo Sapiens
ugugugcuccauagcguguaucuggugucagcacgaggcagagccucagcucccaccguguuug

SEQ ID NO: 282832 - RNA, 64 nt, Homo Sapiens
uugcggugagcccagaucgcuugcuugaacuggggaggcagaggaggaggccgaggcagaagaa

SEQ ID NO: 282833 - RNA, 64 nt, Homo Sapiens
aauugcuugaacuggggaggcuacucaggaggccgaggcagaaggcgcauggcuguaauccugg

SEQ ID NO: 282834 - RNA, 53 nt, Homo Sapiens
ggucacacgagccagugugaguggaggcagaggagugaggcccacgggcagcg

SEQ ID NO: 282835 - RNA, 64 nt, Homo Sapiens
gaccccccgacauagcaaaagguggcaacccauggaggcagaaagaaggacgccagccugaccc

SEQ ID NO: 282836 - RNA, 64 nt, Homo Sapiens
ucaaaccgcaaguaugggagauuuaggcccugcagaggcagaccauuccuuaguaucucacaaa

SEQ ID NO: 282837 - RNA, 64 nt, Homo Sapiens
auuccuuaguaucucacaaagcagaguaauacuggaggcagaguagggggugguuggagagcag

SEQ ID NO: 282838 - RNA, 64 nt, Homo Sapiens
gaguagggggugguuggagagcaguuaguacaaagaggcagaacagugucugguuuacuuggca

SEQ ID NO: 282839 - RNA, 64 nt, Homo Sapiens
gugccguggagugguuuuugcagauagggaaacugaggcagagauguuguccagaaaaucuucc

SEQ ID NO: 282840 - RNA, 64 nt, Homo Sapiens
cggcucagagcagguccacccagugcuaggacgggaggcagagcggugaucaauuacaugugca

SEQ ID NO: 282841 - RNA, 64 nt, Homo Sapiens
gccucgguggcccugacugucagggagggccagggaggcagagcgggagggagucucaggagga

SEQ ID NO: 282842 - RNA, 64 nt, Homo Sapiens
gccccccagcuacuguaugcccccgacccccgcagaggcagaaugaacccauagggagcugauc

SEQ ID NO: 282843 - RNA, 64 nt, Homo Sapiens
cacacaaagguuguucagggagaagggggugcaggaggcagagggugccccgcagggagcuggu

SEQ ID NO: 282844 - RNA, 64 nt, Homo Sapiens
gaggcguuucuggggcuccagagaagugccacgggaggcagaaguccagaacugcccauauaga

SEQ ID NO: 282845 - RNA, 64 nt, Homo Sapiens
cacugcucccucuagaaagauuccuucaggucuggaggcagaggaaugggcauagcugagccag

SEQ ID NO: 282846 - RNA, 64 nt, Homo Sapiens
uugccacaaugguaugauggcuugguagccccucgaggcagaugcaccugacuugcugcuauua

SEQ ID NO: 282847 - RNA, 53 nt, Homo Sapiens
cccuaccccacggaggaugagaagaggcagaucgcagcccagaccaaccucac

SEQ ID NO: 282848 - RNA, 64 nt, Homo Sapiens
cggaaggacuugaguuguuuacaagcccugcacugaggcagauuggugcuguucgcagaguagg

SEQ ID NO: 282849 - RNA, 64 nt, Homo Sapiens
aaagcaaggcucccgaaaccccagccuccgacccgaggcagaaugcacuggaggucucgcuccc

SEQ ID NO: 282850 - RNA, 64 nt, Homo Sapiens
uggucguucucaacgcgcccaggacaucgggacggaggcagacgcaaggcugucugguuuggcg

SEQ ID NO: 282851 - RNA, 64 nt, Homo Sapiens
gccucuacggccccgacggacgcuugugaggcccgaggcagaagggcccaccccgucccuccuc

SEQ ID NO: 282852 - RNA, 64 nt, Homo Sapiens
caggaccagagaagggaaaugacuucuccaggcagaggcagaucugagucuagaacccaggcuu

SEQ ID NO: 282853 - RNA, 64 nt, Homo Sapiens
gaacaaaaagagcagcagugagaaggcaaagagagaggcagaagagacagacgaggcagagaca

SEQ ID NO: 282854 - RNA, 64 nt, Homo Sapiens
ugagaaggcaaagagagaggcagaagagacagacgaggcagagacaaaacacugagaaagagac

SEQ ID NO: 282855 - RNA, 64 nt, Homo Sapiens
gaacuggcuccggggggaguggggcccugcgcuagaggcagaggcaguucuuuguucaagcguu

SEQ ID NO: 282856 - RNA, 64 nt, Homo Sapiens
uugguuuugggagggcgaggacugggccagguuagaggcagauggcacaggggcguguggcggg

SEQ ID NO: 282857 - RNA, 64 nt, Homo Sapiens
cagaggacaagccugccucagaguucaagggccugaggcagauccucuguugaacuggucuaau

SEQ ID NO: 282858 - RNA, 64 nt, Homo Sapiens
aagaagggugaggacagcaccauucagucugcuagaggcagaggcuuugguguggaggugcugg

SEQ ID NO: 282859 - RNA, 64 nt, Homo Sapiens
acagcucauugggucacuggccucacacagacccgaggcagagaggguggcccaggagccaugg

SEQ ID NO: 282860 - RNA, 64 nt, Homo Sapiens
gugaggguggcccaggagccuaaggaagaagucugaggcagacgaaaguggacacagaccagac

SEQ ID NO: 282861 - RNA, 64 nt, Homo Sapiens
cacuucaccccucagagucccugagacccucucggaggcagaagccucgggcuccaggccccca

SEQ ID NO: 282862 - RNA, 64 nt, Homo Sapiens
uaauagagacacagagauggaauagaaaagaugagaggcagaggcagacaggcgcuggacagag

SEQ ID NO: 282863 - RNA, 64 nt, Homo Sapiens
agacacagagauggaauagaaaagaugagaggcagaggcagacaggcgcuggacagaggggcag

SEQ ID NO: 282864 - RNA, 64 nt, Homo Sapiens
gacagaggggcaggggagugccaagguuguccuggaggcagacagcccagcugagccuccuuac

SEQ ID NO: 282865 - RNA, 64 nt, Homo Sapiens
uugcagugagccaagaucgcucgcuugaaccugggaggcagaggaggaggcugaggcaggagaa

SEQ ID NO: 282866 - RNA, 64 nt, Homo Sapiens
cuugugucaguuggaggaaaaaccuccauacacugaggcagaaaaguuuccuauuacugaggaa

SEQ ID NO: 282867 - RNA, 64 nt, Homo Sapiens
aguaacuguuccuacuuuguaacugaccuccuuagaggcagauuucauacagcuauuaaaaugu

SEQ ID NO: 282868 - RNA, 64 nt, Homo Sapiens
gauuuggaaaauucacagagaagcuaggaaagaggaggcagaaaaaaaaagaaaugaaauugac

SEQ ID NO: 282869 - RNA, 64 nt, Homo Sapiens
cgugccucacugacccccaggaggggguggccuugaggcagagcgcuucacccuguguccuuag

SEQ ID NO: 282870 - RNA, 64 nt, Homo Sapiens
cccccaccccugccuccuccuaccugccucguccgaggcagacagcuguggcccugcauccaga

SEQ ID NO: 282871 - RNA, 64 nt, Homo Sapiens
acuucaaguccucuguaacaucugaggugaccaagaggcagaagagcagagcagucgggggccg

SEQ ID NO: 282872 - RNA, 64 nt, Homo Sapiens
caacugcagcucugcugugggggcccgugggagggaggcagaccccugggcuuuccugcuggcc

SEQ ID NO: 282873 - RNA, 64 nt, Homo Sapiens
cgggagagacacaggauaaaagguuaaaagugcagaggcagagucuggggcucagguugggucu

SEQ ID NO: 282874 - RNA, 64 nt, Homo Sapiens
gcccccucuguccuuuucagaacacauggacuuggaggcagauuugaaauaaacuuuuaguaaa

SEQ ID NO: 282875 - RNA, 64 nt, Homo Sapiens
acuggggagugcuggaauggggaccugggguggggaggcagagggucacuuuacauaggauuaa

SEQ ID NO: 282876 - RNA, 64 nt, Homo Sapiens
agcugugaaauugaagucccaauuuaagaguccugaggcagaaccugguggcuggaggcauucc

SEQ ID NO: 282877 - RNA, 64 nt, Homo Sapiens
uggcuccgcuguguggauggggagaucggggccagaggcagaacccuggugaggaagcuccagu

SEQ ID NO: 282878 - RNA, 64 nt, Homo Sapiens
gguugggcagcugaacaguguuggcuuucaugaggaggcagaaagcagaggcuggccucagacu

SEQ ID NO: 282879 - RNA, 64 nt, Homo Sapiens
cugccuagcacucacaugcuggacaggucugggagaggcagagugccccaccugccacuaggcu

SEQ ID NO: 282880 - RNA, 64 nt, Homo Sapiens
ugggccugcagccuuccucuucugggacugcugugaggcagaggaaugauggagaaucuagugu

SEQ ID NO: 282881 - RNA, 64 nt, Homo Sapiens
agcuucgcacaggcuccuggagggcugccugggggaggcagacaugggagugccaagguggcca

SEQ ID NO: 282882 - RNA, 64 nt, Homo Sapiens
gacagagagggagagagggaggcagagagggagagaggcagagagagaggcagagagggagaga

SEQ ID NO: 282883 - RNA, 64 nt, Homo Sapiens
gggagagaggcagagagacaggcagagagggagagaggcagagagacaggcagagaaggagaga

SEQ ID NO: 282884 - RNA, 64 nt, Homo Sapiens
gggagagaggcagagagggaggcagagaaggagagaggcagagaggcagagaaggaaagagaca

SEQ ID NO: 282885 - RNA, 64 nt, Homo Sapiens
aggaaagagacaggcagagaggcagagagggaaagaggcagagagagagacagaggggaagaga

SEQ ID NO: 282886 - RNA, 64 nt, Homo Sapiens
gggaaagaggcagagaaggagacagaggggaagagaggcagagagagagacagagggagagaga

SEQ ID NO: 282887 - RNA, 64 nt, Homo Sapiens
gggagagaaacagaggagacagagagagacagaggaggcagagagaggggagagagauaugagg

SEQ ID NO: 282888 - RNA, 64 nt, Homo Sapiens
cuuguucuguugccugggcuuuuuuuuuuuuuuugaggcagaguguucuguuuuuuuuuuuuuu

SEQ ID NO: 282889 - RNA, 64 nt, Homo Sapiens
aguauaucaagacauacuucgaaaauuuuggaaugaggcagaaagucuuauauaaugagcauag

SEQ ID NO: 282890 - RNA, 64 nt, Homo Sapiens
gcgggcaucuguaauaccagcuacuugggaggcugaggcagaagaaucacuugaacccgggagg

SEQ ID NO: 282891 - RNA, 64 nt, Homo Sapiens
gggaggcugaggcagaagaaucacuugaacccgggaggcagagguuacagugagcugagaucgc

SEQ ID NO: 282892 - RNA, 64 nt, Homo Sapiens
gggaggcugaggcaugagaaucacuuaaaccugagaggcagagguuacagugagccaagaucgu

SEQ ID NO: 282893 - RNA, 64 nt, Homo Sapiens
gggaggcugaggcaggagaacugcuugaacccaggaggcagagguugcagugauccaagaucau

SEQ ID NO: 282894 - RNA, 64 nt, Homo Sapiens
gccagagcuuuguuuuauauauuuauucaucugggaggcagaacaggcuucggacagugcccau

SEQ ID NO: 282895 - RNA, 64 nt, Homo Sapiens
accaaacucauucaccaaaugaugccacuucccagaggcagagccugagucacuggucacccuu

SEQ ID NO: 282896 - RNA, 64 nt, Homo Sapiens
gcuggcgccuguaaucccagcuacucaggagacugaggcagaaggaucgcuugaaccugggagg

SEQ ID NO: 282897 - RNA, 64 nt, Homo Sapiens
aggagacugaggcagaaggaucgcuugaaccugggaggcagagguugcagugagccgagauugc

SEQ ID NO: 282898 - RNA, 64 nt, Homo Sapiens
agagacacacagagaagaaagccauguggcggcagaggcagagaugggagugaugcggacggac

SEQ ID NO: 282899 - RNA, 64 nt, Homo Sapiens
uggagaaucugggggacugggagugggggucagagaggcagauuccuuccccucccguccccuc

SEQ ID NO: 282900 - RNA, 64 nt, Homo Sapiens
acacugcccucauagagcucacaguccaauggaggaggcagauguguccucaggcagcgacugg

SEQ ID NO: 282901 - RNA, 64 nt, Homo Sapiens
uugcaaugagccgagauuguuugcuugaauccaggaggcagaggaggaggcugaggcagaugaa

SEQ ID NO: 282902 - RNA, 64 nt, Homo Sapiens
aauugcuugaauccaggaggcuacucaggaggcugaggcagauggcgcgcgccuguaaucccag

SEQ ID NO: 282903 - RNA, 64 nt, Homo Sapiens
cagagggugcuguuucaacgccaccaccaggagagaggcagaggggcugugccgugcuagaguc

SEQ ID NO: 282904 - RNA, 64 nt, Homo Sapiens
gcugggagaccagguccucugugcaugggcccgggaggcagaccugccccaagggugaugcaga

SEQ ID NO: 282905 - RNA, 64 nt, Homo Sapiens
caagauuguuugaaaaaaaaaaaaggggagcagggaggcagaaaguccuggaaaaguaaauugu

SEQ ID NO: 282906 - RNA, 64 nt, Homo Sapiens
gcgggcgccuguaaucccagcuacuugggaggcugaggcagaagaaucauuugaacccaggagg

SEQ ID NO: 282907 - RNA, 64 nt, Homo Sapiens
gggaggcugaggcagaagaaucauuugaacccaggaggcagagguuacagugagccgagaucgu

SEQ ID NO: 282908 - RNA, 64 nt, Homo Sapiens
agggaguguggagaagguggaagagcugagcucagaggcagagaagcuccuugcagggagcacu

SEQ ID NO: 282909 - RNA, 64 nt, Homo Sapiens
uggcagagccugggccaagcugcagccuacugaggaggcagaggccaccuccuccagaaagccc

SEQ ID NO: 282910 - RNA, 64 nt, Homo Sapiens
ggagugaugcggccacaagcgacacguggagacagaggcagacuacacagacacagagcaggag

SEQ ID NO: 282911 - RNA, 64 nt, Homo Sapiens
cugaagugaugcugccccaagccacauaaagacagaggcagagaacacagacacaaagcaggag

SEQ ID NO: 282912 - RNA, 64 nt, Homo Sapiens; identical to SEQ ID NO: 229025

SEQ ID NO: 282913 - RNA, 64 nt, Homo Sapiens; identical to SEQ ID NO: 229026

SEQ ID NO: 282914 - RNA, 64 nt, Homo Sapiens; identical to SEQ ID NO: 229027

SEQ ID NO: 282915 - RNA, 64 nt, Homo Sapiens; identical to SEQ ID NO: 229028

SEQ ID NO: 282916 - RNA, 64 nt, Homo Sapiens; identical to SEQ ID NO: 229029

SEQ ID NO: 282917 - RNA, 64 nt, Homo Sapiens; identical to SEQ ID NO: 229030

SEQ ID NO: 282918 - RNA, 64 nt, Homo Sapiens; identical to SEQ ID NO: 229031

SEQ ID NO: 282919 - RNA, 64 nt, Homo Sapiens; identical to SEQ ID NO: 229032

SEQ ID NO: 282920 - RNA, 64 nt, Homo Sapiens; identical to SEQ ID NO: 229033

SEQ ID NO: 282921 - RNA, 64 nt, Homo Sapiens; identical to SEQ ID NO: 229034

SEQ ID NO: 282922 - RNA, 64 nt, Homo Sapiens; identical to SEQ ID NO: 229035

SEQ ID NO: 282923 - RNA, 64 nt, Homo Sapiens; identical to SEQ ID NO: 229036

SEQ ID NO: 282924 - RNA, 64 nt, Homo Sapiens; identical to SEQ ID NO: 229037

SEQ ID NO: 282925 - RNA, 64 nt, Homo Sapiens; identical to SEQ ID NO: 229038

SEQ ID NO: 282926 - RNA, 64 nt, Homo Sapiens; identical to SEQ ID NO: 229039

SEQ ID NO: 282927 - RNA, 64 nt, Homo Sapiens; identical to SEQ ID NO: 229040

SEQ ID NO: 282928 - RNA, 64 nt, Homo Sapiens; identical to SEQ ID NO: 229041

SEQ ID NO: 282929 - RNA, 64 nt, Homo Sapiens; identical to SEQ ID NO: 229042

SEQ ID NO: 282930 - RNA, 64 nt, Homo Sapiens; identical to SEQ ID NO: 229043

SEQ ID NO: 282931 - RNA, 64 nt, Homo Sapiens; identical to SEQ ID NO: 229044

SEQ ID NO: 282932 - RNA, 64 nt, Homo Sapiens; identical to SEQ ID NO: 229045

SEQ ID NO: 282933 - RNA, 64 nt, Homo Sapiens; identical to SEQ ID NO: 229046

SEQ ID NO: 282934 - RNA, 64 nt, Homo Sapiens; identical to SEQ ID NO: 229047

SEQ ID NO: 282935 - RNA, 64 nt, Homo Sapiens; identical to SEQ ID NO: 229048

SEQ ID NO: 282936 - RNA, 64 nt, Homo Sapiens; identical to SEQ ID NO: 229049

SEQ ID NO: 282937 - RNA, 64 nt, Homo Sapiens; identical to SEQ ID NO: 229050

SEQ ID NO: 282938 - RNA, 64 nt, Homo Sapiens; identical to SEQ ID NO: 229051

SEQ ID NO: 282939 - RNA, 64 nt, Homo Sapiens; identical to SEQ ID NO: 229052

SEQ ID NO: 282940 - RNA, 64 nt, Homo Sapiens; identical to SEQ ID NO: 229053

SEQ ID NO: 282941 - RNA, 64 nt, Homo Sapiens; identical to SEQ ID NO: 229054

SEQ ID NO: 282942 - RNA, 64 nt, Homo Sapiens
aaauauuuuugcuguagacugccuguaugcaacaggcacucaauuugccggugccuaggauugu

SEQ ID NO: 282943 - RNA, 64 nt, Homo Sapiens
cgcgaaaguaucaccaggguggcccacguagggcggcacucacaagcaccucgaguuagaaccc

SEQ ID NO: 282944 - RNA, 64 nt, Homo Sapiens
ccuccccugcuuucucaaacacuugcccaccucaggcacucagcgggcuccgccguggugagag

SEQ ID NO: 282945 - RNA, 64 nt, Homo Sapiens
uguagccagguccgcaucuccccaccaccaccagggcacucacucgcagcuauagcccaggaca

SEQ ID NO: 282946 - RNA, 64 nt, Homo Sapiens
cucagggagaggccaugcggccagcccaggucugcaugcugagccccauccuccacagcuugcc

SEQ ID NO: 282947 - RNA, 64 nt, Homo Sapiens
gcugggaggggacccuccauuucucccccucacccaugcugaguguagagccggggccugggug

SEQ ID NO: 282948 - RNA, 64 nt, Homo Sapiens
uguccaccugccugcugaccacuggacgcugcuccaugcugaagaaaagugacagucuccaggg

SEQ ID NO: 282949 - RNA, 64 nt, Homo Sapiens
aagaaaagugacagucuccaggggacauuucagccaugcugaaagggaggcuggcaguggucau

SEQ ID NO: 282950 - RNA, 64 nt, Homo Sapiens
auucauuuugcguccucuggacuguuuuaguaaacaugcugagcgcuguguuuauuguagagac

SEQ ID NO: 282951 - RNA, 64 nt, Homo Sapiens
ucggugcuguauuucagagguguccuuuugccuccaugcugaggagggacguggucuugcccac

SEQ ID NO: 282952 - RNA, 64 nt, Homo Sapiens
ccccaugucuacuaaagauaaccagccugacuaacaugcugaaaccugagaucaggaguucaag

SEQ ID NO: 282953 - RNA, 64 nt, Homo Sapiens
cacauggugcuguccggacacgcggccuggccugcaugcugagcaugggagucaaacccaggca

SEQ ID NO: 282954 - RNA, 64 nt, Homo Sapiens
augagccauaggaaggcacuacaugaaauaaugcacugaguaugcaaugcuaucacugucuuug

SEQ ID NO: 282955 - RNA, 64 nt, Homo Sapiens
gacuuuauguauuauuugcacagggagaauugaaacugaguauaaucaauaagcuagauacgaa

SEQ ID NO: 282956 - RNA, 64 nt, Homo Sapiens
cuccugggcucaagugguccuccugccucagcuuacugaguaaggauauguauuucuuaaaagu

SEQ ID NO: 282957 - RNA, 64 nt, Homo Sapiens
agcauuguuuacuugaagugggcagggaagcagcacugaguaaaguucaauugagugguuacag

SEQ ID NO: 282958 - RNA, 64 nt, Homo Sapiens; identical to SEQ ID NO: 21812

SEQ ID NO: 282959 - RNA, 64 nt, Homo Sapiens; identical to SEQ ID NO: 21813

SEQ ID NO: 282960 - RNA, 64 nt, Homo Sapiens; identical to SEQ ID NO: 21814

SEQ ID NO: 282961 - RNA, 64 nt, Homo Sapiens; identical to SEQ ID NO: 21815

SEQ ID NO: 282962 - RNA, 64 nt, Homo Sapiens; identical to SEQ ID NO: 21816

SEQ ID NO: 282963 - RNA, 64 nt, Homo Sapiens; identical to SEQ ID NO: 21817

SEQ ID NO: 282964 - RNA, 64 nt, Homo Sapiens; identical to SEQ ID NO: 21818

SEQ ID NO: 282965 - RNA, 64 nt, Homo Sapiens; identical to SEQ ID NO: 21819

SEQ ID NO: 282966 - RNA, 64 nt, Homo Sapiens; identical to SEQ ID NO: 21820

SEQ ID NO: 282967 - RNA, 64 nt, Homo Sapiens; identical to SEQ ID NO: 21821

SEQ ID NO: 282968 - RNA, 64 nt, Homo Sapiens; identical to SEQ ID NO: 21822

SEQ ID NO: 282969 - RNA, 64 nt, Homo Sapiens; identical to SEQ ID NO: 21823

SEQ ID NO: 282970 - RNA, 64 nt, Homo Sapiens; identical to SEQ ID NO: 21824

SEQ ID NO: 282971 - RNA, 64 nt, Homo Sapiens; identical to SEQ ID NO: 21825

SEQ ID NO: 282972 - RNA, 64 nt, Homo Sapiens; identical to SEQ ID NO: 21826

SEQ ID NO: 282973 - RNA, 64 nt, Homo Sapiens; identical to SEQ ID NO: 21827

SEQ ID NO: 282974 - RNA, 64 nt, Homo Sapiens; identical to SEQ ID NO: 21828

SEQ ID NO: 282975 - RNA, 64 nt, Homo Sapiens; identical to SEQ ID NO: 21829

SEQ ID NO: 282976 - RNA, 64 nt, Homo Sapiens; identical to SEQ ID NO: 21830

SEQ ID NO: 282977 - RNA, 64 nt, Homo Sapiens; identical to SEQ ID NO: 21831

SEQ ID NO: 282978 - RNA, 50 nt, Homo Sapiens; identical to SEQ ID NO: 21832

SEQ ID NO: 282979 - RNA, 64 nt, Homo Sapiens; identical to SEQ ID NO: 21833

SEQ ID NO: 282980 - RNA, 64 nt, Homo Sapiens; identical to SEQ ID NO: 21834

SEQ ID NO: 282981 - RNA, 64 nt, Homo Sapiens; identical to SEQ ID NO: 21835

SEQ ID NO: 282982 - RNA, 64 nt, Homo Sapiens; identical to SEQ ID NO: 21836

SEQ ID NO: 282983 - RNA, 64 nt, Homo Sapiens; identical to SEQ ID NO: 21837

SEQ ID NO: 282984 - RNA, 64 nt, Homo Sapiens; identical to SEQ ID NO: 21838

SEQ ID NO: 282985 - RNA, 64 nt, Homo Sapiens; identical to SEQ ID NO: 21839

SEQ ID NO: 282986 - RNA, 64 nt, Homo Sapiens; identical to SEQ ID NO: 21840

SEQ ID NO: 282987 - RNA, 64 nt, Homo Sapiens; identical to SEQ ID NO: 21841

SEQ ID NO: 282988 - RNA, 64 nt, Homo Sapiens; identical to SEQ ID NO: 21842

SEQ ID NO: 282989 - RNA, 64 nt, Homo Sapiens; identical to SEQ ID NO: 21843

SEQ ID NO: 282990 - RNA, 64 nt, Homo Sapiens; identical to SEQ ID NO: 21844

SEQ ID NO: 282991 - RNA, 64 nt, Homo Sapiens; identical to SEQ ID NO: 21845

SEQ ID NO: 282992 - RNA, 64 nt, Homo Sapiens; identical to SEQ ID NO: 21846

SEQ ID NO: 282993 - RNA, 64 nt, Homo Sapiens; identical to SEQ ID NO: 21847

SEQ ID NO: 282994 - RNA, 64 nt, Homo Sapiens; identical to SEQ ID NO: 21848

SEQ ID NO: 282995 - RNA, 64 nt, Homo Sapiens; identical to SEQ ID NO: 21849

SEQ ID NO: 282996 - RNA, 64 nt, Homo Sapiens; identical to SEQ ID NO: 21850

SEQ ID NO: 282997 - RNA, 64 nt, Homo Sapiens; identical to SEQ ID NO: 21851

SEQ ID NO: 282998 - RNA, 64 nt, Homo Sapiens; identical to SEQ ID NO: 21852

SEQ ID NO: 282999 - RNA, 64 nt, Homo Sapiens; identical to SEQ ID NO: 21853

SEQ ID NO: 283000 - RNA, 64 nt, Homo Sapiens; identical to SEQ ID NO: 21854

SEQ ID NO: 283001 - RNA, 64 nt, Homo Sapiens; identical to SEQ ID NO: 21855

SEQ ID NO: 283002 - RNA, 64 nt, Homo Sapiens; identical to SEQ ID NO: 21856

SEQ ID NO: 283003 - RNA, 64 nt, Homo Sapiens; identical to SEQ ID NO: 21857

SEQ ID NO: 283004 - RNA, 64 nt, Homo Sapiens; identical to SEQ ID NO: 21858

SEQ ID NO: 283005 - RNA, 64 nt, Homo Sapiens; identical to SEQ ID NO: 21859

SEQ ID NO: 283006 - RNA, 64 nt, Homo Sapiens; identical to SEQ ID NO: 21860

SEQ ID NO: 283007 - RNA, 64 nt, Homo Sapiens; identical to SEQ ID NO: 21861

SEQ ID NO: 283008 - RNA, 64 nt, Homo Sapiens; identical to SEQ ID NO: 21862

SEQ ID NO: 283009 - RNA, 64 nt, Homo Sapiens; identical to SEQ ID NO: 21863

SEQ ID NO: 283010 - RNA, 64 nt, Homo Sapiens; identical to SEQ ID NO: 21864

SEQ ID NO: 283011 - RNA, 64 nt, Homo Sapiens; identical to SEQ ID NO: 21865

SEQ ID NO: 283012 - RNA, 64 nt, Homo Sapiens; identical to SEQ ID NO: 21866

SEQ ID NO: 283013 - RNA, 64 nt, Homo Sapiens; identical to SEQ ID NO: 21867

SEQ ID NO: 283014 - RNA, 64 nt, Homo Sapiens; identical to SEQ ID NO: 21868

SEQ ID NO: 283015 - RNA, 64 nt, Homo Sapiens; identical to SEQ ID NO: 21869

SEQ ID NO: 283016 - RNA, 64 nt, Homo Sapiens; identical to SEQ ID NO: 21870

SEQ ID NO: 283017 - RNA, 64 nt, Homo Sapiens; identical to SEQ ID NO: 21871

SEQ ID NO: 283018 - RNA, 64 nt, Homo Sapiens; identical to SEQ ID NO: 21872

SEQ ID NO: 283019 - RNA, 64 nt, Homo Sapiens; identical to SEQ ID NO: 21873

SEQ ID NO: 283020 - RNA, 64 nt, Homo Sapiens; identical to SEQ ID NO: 21874

SEQ ID NO: 283021 - RNA, 64 nt, Homo Sapiens
gcaggcaacccccuugugggaacccacagguuaguucagucaaacacaucuguucguuggacua

SEQ ID NO: 283022 - RNA, 64 nt, Homo Sapiens
ggcgaaucuguucugcccgaauccauucagucgauucagucauaaggccaggcugucgcuggcc

SEQ ID NO: 283023 - RNA, 64 nt, Homo Sapiens
uaaaauuuuaaaaauuuaaauuaaaauuuaaauuuucagucauuuuaaauuuuguuucagucau

SEQ ID NO: 283024 - RNA, 64 nt, Homo Sapiens
uaaaauuuaaauuuucagucuguuuaaauuuuguuucagucauuuugugaauuuugaauaauaa

SEQ ID NO: 283025 - RNA, 64 nt, Homo Sapiens
gaagcccuacaaauguaaagaaugugaaaagucuuucagucagagcucaagucuuagucgacau

SEQ ID NO: 283026 - RNA, 64 nt, Homo Sapiens
gaaagcacaugaauguaaugaauguggaaaagcuuucagucaaaccucaugccuuauucagcau

SEQ ID NO: 283027 - RNA, 64 nt, Homo Sapiens
gaaaucguaugaauguaaugaguaugagggcaguuucagucauagcucagaucuuauccugcaa

SEQ ID NO: 283028 - RNA, 64 nt, Homo Sapiens
gagaaaucauguauguacugcaugugguaaagccuucagucauagcucagccauugcucagcau

SEQ ID NO: 283029 - RNA, 64 nt, Homo Sapiens
auaaauguaauaagcauguaugugugugaggagauucagucauaacccaacgcucauucaacau

SEQ ID NO: 283030 - RNA, 64 nt, Homo Sapiens
accgugcugccauuaaaggcagcuguucuagaguuucagucaccuaaguacacccacaaaacaa

SEQ ID NO: 283031 - RNA, 64 nt, Homo Sapiens
uuuaaauuuaucaacuuuuuacauuuguguuauuuucagucagggcuucuuagaucuacuuaug

SEQ ID NO: 283032 - RNA, 64 nt, Homo Sapiens
aaccaaacccuaaauugaaagacaaaacuaugguuucagucaacauauucaugaauuagggagc

SEQ ID NO: 283033 - RNA, 64 nt, Homo Sapiens
gcaccaggggaugcucuacaucaagggaugcaccuucagucaaacugucaaaaagcccagaauu

SEQ ID NO: 283034 - RNA, 64 nt, Homo Sapiens
gucacuagauacacaacccccuucccaccaucccuucagucacuaguggaagcuuucaaguuag

SEQ ID NO: 283035 - RNA, 64 nt, Homo Sapiens
uucagucacuaguggaagcuuucaaguuaguuauuucagucaggauauacaguguugaaaucuc

SEQ ID NO: 283036 - RNA, 64 nt, Homo Sapiens
ggcaacacauaggccccuuguucuuucuagugcuuucagucagugagccacuuguuacccucua

SEQ ID NO: 283037 - RNA, 64 nt, Homo Sapiens
gugcuagaaaccgaugacuucaacucacuggucuuucagucaacagggcagaauucaacaagca

SEQ ID NO: 283038 - RNA, 64 nt, Homo Sapiens
uacaguaacuugauguguauauuaauaaaaguaauucagucauuuuaguuuuugauugaaaaua

SEQ ID NO: 283039 - RNA, 64 nt, Homo Sapiens
uuaauuuuggaagugcaguuuuguaaaaaccuuuuucagucaaacaguaaagacuuuauuuaug

SEQ ID NO: 283040 - RNA, 64 nt, Homo Sapiens
gaaaccuuacaaaugugaagcaugugacaaaguuuucagucacagaucacgccuuaaaagacau

SEQ ID NO: 283041 - RNA, 64 nt, Homo Sapiens
gaaaccuuacaaaugucaugacuguggcaaggucuucagucaagcuucauccuaugcaaaacau

SEQ ID NO: 283042 - RNA, 64 nt, Homo Sapiens
uuucauccuaugcaaaacauauuguggcaaggucuucagucaaggaaaccuuauaaaugucaug

SEQ ID NO: 283043 - RNA, 64 nt, Homo Sapiens
ugucaaaccuuguauaccauaguguggcaagaccuucagucagagaaaccuugaaaguguaaug

SEQ ID NO: 283044 - RNA, 64 nt, Homo Sapiens
auucacuccuacacagcaucaauguggcaagguuuucagucacagaaaccauacaaguauaaua

SEQ ID NO: 283045 - RNA, 62 nt, Homo Sapiens
guuuaaauccugugagucauuauggcaaggucuucagucaaaaaccuuauaaaagaaauuaa

SEQ ID NO: 283046 - RNA, 64 nt, Homo Sapiens; identical to SEQ ID NO: 108245

SEQ ID NO: 283047 - RNA, 64 nt, Homo Sapiens; identical to SEQ ID NO: 108246

SEQ ID NO: 283048 - RNA, 64 nt, Homo Sapiens; identical to SEQ ID NO: 108247

SEQ ID NO: 283049 - RNA, 64 nt, Homo Sapiens; identical to SEQ ID NO: 108248

SEQ ID NO: 283050 - RNA, 64 nt, Homo Sapiens; identical to SEQ ID NO: 108249

SEQ ID NO: 283051 - RNA, 64 nt, Homo Sapiens; identical to SEQ ID NO: 108250

SEQ ID NO: 283052 - RNA, 64 nt, Homo Sapiens; identical to SEQ ID NO: 108251

SEQ ID NO: 283053 - RNA, 64 nt, Homo Sapiens; identical to SEQ ID NO: 108252

SEQ ID NO: 283054 - RNA, 64 nt, Homo Sapiens; identical to SEQ ID NO: 108253

SEQ ID NO: 283055 - RNA, 64 nt, Homo Sapiens; identical to SEQ ID NO: 108254

SEQ ID NO: 283056 - RNA, 64 nt, Homo Sapiens; identical to SEQ ID NO: 108255

SEQ ID NO: 283057 - RNA, 64 nt, Homo Sapiens; identical to SEQ ID NO: 108256

SEQ ID NO: 283058 - RNA, 64 nt, Homo Sapiens; identical to SEQ ID NO: 108257

SEQ ID NO: 283059 - RNA, 64 nt, Homo Sapiens; identical to SEQ ID NO: 108258

SEQ ID NO: 283060 - RNA, 64 nt, Homo Sapiens; identical to SEQ ID NO: 108259

SEQ ID NO: 283061 - RNA, 64 nt, Homo Sapiens; identical to SEQ ID NO: 108260

SEQ ID NO: 283062 - RNA, 64 nt, Homo Sapiens; identical to SEQ ID NO: 108261

SEQ ID NO: 283063 - RNA, 64 nt, Homo Sapiens; identical to SEQ ID NO: 108262

SEQ ID NO: 283064 - RNA, 64 nt, Homo Sapiens; identical to SEQ ID NO: 108263

SEQ ID NO: 283065 - RNA, 64 nt, Homo Sapiens; identical to SEQ ID NO: 108264

SEQ ID NO: 283066 - RNA, 64 nt, Homo Sapiens; identical to SEQ ID NO: 108265

SEQ ID NO: 283067 - RNA, 64 nt, Homo Sapiens; identical to SEQ ID NO: 108266

SEQ ID NO: 283068 - RNA, 64 nt, Homo Sapiens; identical to SEQ ID NO: 108267

SEQ ID NO: 283069 - RNA, 64 nt, Homo Sapiens; identical to SEQ ID NO: 108268

SEQ ID NO: 283070 - RNA, 64 nt, Homo Sapiens; identical to SEQ ID NO: 108269

SEQ ID NO: 283071 - RNA, 64 nt, Homo Sapiens; identical to SEQ ID NO: 108270

SEQ ID NO: 283072 - RNA, 64 nt, Homo Sapiens; identical to SEQ ID NO: 108271

SEQ ID NO: 283073 - RNA, 64 nt, Homo Sapiens; identical to SEQ ID NO: 108272

SEQ ID NO: 283074 - RNA, 64 nt, Homo Sapiens; identical to SEQ ID NO: 108273

SEQ ID NO: 283075 - RNA, 64 nt, Homo Sapiens; identical to SEQ ID NO: 108274

SEQ ID NO: 283076 - RNA, 64 nt, Homo Sapiens; identical to SEQ ID NO: 108275

SEQ ID NO: 283077 - RNA, 64 nt, Homo Sapiens; identical to SEQ ID NO: 108276

SEQ ID NO: 283078 - RNA, 64 nt, Homo Sapiens; identical to SEQ ID NO: 108277

SEQ ID NO: 283079 - RNA, 64 nt, Homo Sapiens; identical to SEQ ID NO: 108278

SEQ ID NO: 283080 - RNA, 64 nt, Homo Sapiens; identical to SEQ ID NO: 108279

SEQ ID NO: 283081 - RNA, 64 nt, Homo Sapiens; identical to SEQ ID NO: 108280

SEQ ID NO: 283082 - RNA, 64 nt, Homo Sapiens; identical to SEQ ID NO: 108281

SEQ ID NO: 283083 - RNA, 64 nt, Homo Sapiens; identical to SEQ ID NO: 108282

SEQ ID NO: 283084 - RNA, 64 nt, Homo Sapiens; identical to SEQ ID NO: 108283

SEQ ID NO: 283085 - RNA, 64 nt, Homo Sapiens; identical to SEQ ID NO: 108284

SEQ ID NO: 283086 - RNA, 64 nt, Homo Sapiens; identical to SEQ ID NO: 262900

SEQ ID NO: 283087 - RNA, 64 nt, Homo Sapiens; identical to SEQ ID NO: 262901

SEQ ID NO: 283088 - RNA, 64 nt, Homo Sapiens; identical to SEQ ID NO: 262902

SEQ ID NO: 283089 - RNA, 64 nt, Homo Sapiens; identical to SEQ ID NO: 262903

SEQ ID NO: 283090 - RNA, 64 nt, Homo Sapiens; identical to SEQ ID NO: 262904

SEQ ID NO: 283091 - RNA, 64 nt, Homo Sapiens; identical to SEQ ID NO: 262905

SEQ ID NO: 283092 - RNA, 64 nt, Homo Sapiens; identical to SEQ ID NO: 262906

SEQ ID NO: 283093 - RNA, 64 nt, Homo Sapiens; identical to SEQ ID NO: 262907

SEQ ID NO: 283094 - RNA, 64 nt, Homo Sapiens; identical to SEQ ID NO: 262908

SEQ ID NO: 283095 - RNA, 64 nt, Homo Sapiens; identical to SEQ ID NO: 262909

SEQ ID NO: 283096 - RNA, 64 nt, Homo Sapiens; identical to SEQ ID NO: 262910

SEQ ID NO: 283097 - RNA, 64 nt, Homo Sapiens; identical to SEQ ID NO: 262911

SEQ ID NO: 283098 - RNA, 64 nt, Homo Sapiens; identical to SEQ ID NO: 262912

SEQ ID NO: 283099 - RNA, 64 nt, Homo Sapiens; identical to SEQ ID NO: 80484

SEQ ID NO: 283100 - RNA, 64 nt, Homo Sapiens; identical to SEQ ID NO: 80485

SEQ ID NO: 283101 - RNA, 64 nt, Homo Sapiens; identical to SEQ ID NO: 80486

SEQ ID NO: 283102 - RNA, 64 nt, Homo Sapiens; identical to SEQ ID NO: 80487

SEQ ID NO: 283103 - RNA, 64 nt, Homo Sapiens; identical to SEQ ID NO: 80488

SEQ ID NO: 283104 - RNA, 64 nt, Homo Sapiens; identical to SEQ ID NO: 80489

SEQ ID NO: 283105 - RNA, 64 nt, Homo Sapiens; identical to SEQ ID NO: 80490

SEQ ID NO: 283106 - RNA, 64 nt, Homo Sapiens; identical to SEQ ID NO: 80491

SEQ ID NO: 283107 - RNA, 64 nt, Homo Sapiens; identical to SEQ ID NO: 80492

SEQ ID NO: 283108 - RNA, 64 nt, Homo Sapiens; identical to SEQ ID NO: 80493

SEQ ID NO: 283109 - RNA, 64 nt, Homo Sapiens; identical to SEQ ID NO: 80494

SEQ ID NO: 283110 - RNA, 64 nt, Homo Sapiens; identical to SEQ ID NO: 80495

SEQ ID NO: 283111 - RNA, 64 nt, Homo Sapiens; identical to SEQ ID NO: 80496

SEQ ID NO: 283112 - RNA, 64 nt, Homo Sapiens; identical to SEQ ID NO: 80497

SEQ ID NO: 283113 - RNA, 64 nt, Homo Sapiens; identical to SEQ ID NO: 80498

SEQ ID NO: 283114 - RNA, 64 nt, Homo Sapiens; identical to SEQ ID NO: 80499

SEQ ID NO: 283115 - RNA, 64 nt, Homo Sapiens; identical to SEQ ID NO: 80500

SEQ ID NO: 283116 - RNA, 64 nt, Homo Sapiens; identical to SEQ ID NO: 80501

SEQ ID NO: 283117 - RNA, 64 nt, Homo Sapiens; identical to SEQ ID NO: 80502

SEQ ID NO: 283118 - RNA, 64 nt, Homo Sapiens; identical to SEQ ID NO: 80503

SEQ ID NO: 283119 - RNA, 64 nt, Homo Sapiens; identical to SEQ ID NO: 80504

SEQ ID NO: 283120 - RNA, 64 nt, Homo Sapiens; identical to SEQ ID NO: 80505

SEQ ID NO: 283121 - RNA, 64 nt, Homo Sapiens; identical to SEQ ID NO: 80506

SEQ ID NO: 283122 - RNA, 64 nt, Homo Sapiens; identical to SEQ ID NO: 80507

SEQ ID NO: 283123 - RNA, 64 nt, Homo Sapiens; identical to SEQ ID NO: 80508

SEQ ID NO: 283124 - RNA, 64 nt, Homo Sapiens; identical to SEQ ID NO: 80509

SEQ ID NO: 283125 - RNA, 64 nt, Homo Sapiens; identical to SEQ ID NO: 80510

SEQ ID NO: 283126 - RNA, 64 nt, Homo Sapiens; identical to SEQ ID NO: 80511

SEQ ID NO: 283127 - RNA, 64 nt, Homo Sapiens; identical to SEQ ID NO: 80512

SEQ ID NO: 283128 - RNA, 64 nt, Homo Sapiens; identical to SEQ ID NO: 80513

SEQ ID NO: 283129 - RNA, 64 nt, Homo Sapiens; identical to SEQ ID NO: 80514

SEQ ID NO: 283130 - RNA, 64 nt, Homo Sapiens; identical to SEQ ID NO: 80515

SEQ ID NO: 283131 - RNA, 64 nt, Homo Sapiens; identical to SEQ ID NO: 80516

SEQ ID NO: 283132 - RNA, 64 nt, Homo Sapiens; identical to SEQ ID NO: 80517

SEQ ID NO: 283133 - RNA, 64 nt, Homo Sapiens; identical to SEQ ID NO: 80518

SEQ ID NO: 283134 - RNA, 64 nt, Homo Sapiens; identical to SEQ ID NO: 80519

SEQ ID NO: 283135 - RNA, 64 nt, Homo Sapiens
cccucugggucauauggugcagacugugaccagcaccaggcaggcaguccugucugcgugugga

SEQ ID NO: 283136 - RNA, 64 nt, Homo Sapiens
caaagguuggagucugcuggugcgguguuuacacaccaggcagggcugucugccaccuugugug

SEQ ID NO: 283137 - RNA, 64 nt, Homo Sapiens
agccucugcagcaauggguccaaguauggggaaaaccaggcaccugucuuuggguuuagaagac

SEQ ID NO: 283138 - RNA, 64 nt, Homo Sapiens
cucuggcacuguugcuugcccugggcuuccugugaccaggcaccgggcagcauggaacaugcag

SEQ ID NO: 283139 - RNA, 64 nt, Homo Sapiens
cgggcugaaguggggucccaaccuggagcagcggaccaggcagaugaggcugaggauggccuga

SEQ ID NO: 283140 - RNA, 64 nt, Homo Sapiens
gggcuaaauacuuacauuuaagggccuacuguggaccaggcacuucauggcuaaauauuuaugg

SEQ ID NO: 283141 - RNA, 64 nt, Homo Sapiens
agcaugaacaccaagcuggguggcaauaucuaaaaccaggcaccuguguccuuugaggggcuga

SEQ ID NO: 283142 - RNA, 64 nt, Homo Sapiens
ugugauucacagugugaaucuuggugucuacguuaccaggcaggaaggcugagaggagagagac

SEQ ID NO: 283143 - RNA, 64 nt, Homo Sapiens
aucugaugcaagcaagaaacacugggcuucuagaaccaggcaacuugggaacuagacucccaag

SEQ ID NO: 283144 - RNA, 64 nt, Homo Sapiens
ccauccacugaaggcuguguucuagagucugugcaccaggcaguuuucauuucauccuggucag

SEQ ID NO: 283145 - RNA, 64 nt, Homo Sapiens
guguguagccccaggguuugagugacaguuguuuaccaggcacuauucauuccucaggcacuug

SEQ ID NO: 283146 - RNA, 64 nt, Homo Sapiens
gccuacugaccccaaggagcggagaaagccugauaccaggcacaauauucaucccuucaguucu

SEQ ID NO: 283147 - RNA, 64 nt, Homo Sapiens
caagggagccaaacacacuaccccuuugaagaaaaccaggcagcgauaggaaccuucuuggaga

SEQ ID NO: 283148 - RNA, 64 nt, Homo Sapiens
gcugggcaaggcgcucaggcaugcaaccaugggcaccaggcaauacccauccaucacccaucuc

SEQ ID NO: 283149 - RNA, 64 nt, Homo Sapiens
aucuaucucacacugcaccaagcacccacugugcaccaggcacuaagucucuagccucuuucuc

SEQ ID NO: 283150 - RNA, 64 nt, Homo Sapiens
cgucauggcacuuuuuaacgcuucagcaacaaacaccaggcagcuguugccacuggccuccuac

SEQ ID NO: 283151 - RNA, 64 nt, Homo Sapiens
guagaggugagaauggggaggcaagaucucaggcaccaggcaggaggugccuuguaagcuaacu

SEQ ID NO: 283152 - RNA, 64 nt, Homo Sapiens
ggccaucucuggaugccugauugccaagcucaggaccaggcaaugugacuuugcaucagcaaca

SEQ ID NO: 283153 - RNA, 64 nt, Homo Sapiens
cgugggccugggguaccaagagacuccuugagagaccaggcaaagcaagugauugggacagagg

SEQ ID NO: 283154 - RNA, 64 nt, Homo Sapiens
cagccauccagggcuacccacugcuuacucagggaccaggcagcccccauggcaguaaaagcag

SEQ ID NO: 283155 - RNA, 64 nt, Homo Sapiens
agaagcccuggcuggccccacuugguaccaauccaccaggcagcucagggcuccugcccagccc

SEQ ID NO: 283156 - RNA, 64 nt, Homo Sapiens
cuaccuacgagugaaacucuguccucccgcgaggaccaggcaucgcugugugaggacggcacgg

SEQ ID NO: 283157 - RNA, 64 nt, Homo Sapiens
ggggggagccauccccgccgcccucacaggacccaccaggcagcggagacauguggaauuagag

SEQ ID NO: 283158 - RNA, 64 nt, Homo Sapiens
acagccgcaguuccucaguuacgucugcucaugcaccaggcagccagccggcaggcgccccugu

SEQ ID NO: 283159 - RNA, 64 nt, Homo Sapiens
gagcuagcucccugcacggcgcauccaguacagaaccaggcaucuagccaccagugauccccaa

SEQ ID NO: 283160 - RNA, 64 nt, Homo Sapiens
acaaacccccaaacaccucccuccaaagagacauaccaggcaaguuuggugccaaaccccaaau

SEQ ID NO: 283161 - RNA, 64 nt, Homo Sapiens
aggcgccuccguccuagccacaaaggaccccaggaccaggcagacaucuggccugcacccuuga

SEQ ID NO: 283162 - RNA, 64 nt, Homo Sapiens
cagcugugugaccauccagggguggagggggaaaaccaggcaauuucguuccuggaaucaacca

SEQ ID NO: 283163 - RNA, 64 nt, Homo Sapiens
uccauggcagggguggauucgggagcugggaguaaccaggcaaagucaaccagaugccuagcuc

SEQ ID NO: 283164 - RNA, 64 nt, Homo Sapiens
ucauucugggaacauguuguaagcacugacugggaccaggcaccaggcagggucuagaaggcug

SEQ ID NO: 283165 - RNA, 64 nt, Homo Sapiens
gggaacauguuguaagcacugacugggaccaggcaccaggcagggucuagaaggcuguggugag

SEQ ID NO: 283166 - RNA, 64 nt, Homo Sapiens
aaaggcuggacucagcaggaacaccaaaucccggaccaggcagaaaccacccaagacugagggg

SEQ ID NO: 283167 - RNA, 64 nt, Homo Sapiens
ucagacuaacggcuaaagagacugaugcaucaacaccaggcagagaauaaagcagauuuuuuug

SEQ ID NO: 283168 - RNA, 64 nt, Homo Sapiens; identical to SEQ ID NO: 172311

SEQ ID NO: 283169 - RNA, 64 nt, Homo Sapiens; identical to SEQ ID NO: 172312

SEQ ID NO: 283170 - RNA, 64 nt, Homo Sapiens; identical to SEQ ID NO: 172313

SEQ ID NO: 283171 - RNA, 64 nt, Homo Sapiens; identical to SEQ ID NO: 172314

SEQ ID NO: 283172 - RNA, 64 nt, Homo Sapiens; identical to SEQ ID NO: 172315

SEQ ID NO: 283173 - RNA, 64 nt, Homo Sapiens; identical to SEQ ID NO: 172316

SEQ ID NO: 283174 - RNA, 64 nt, Homo Sapiens; identical to SEQ ID NO: 172317

SEQ ID NO: 283175 - RNA, 64 nt, Homo Sapiens; identical to SEQ ID NO: 172318

SEQ ID NO: 283176 - RNA, 63 nt, Homo Sapiens
ccacccacccccuaccauugagccaccaugcccagccccaaagccucuuaauugcucuaacaa

SEQ ID NO: 283177 - RNA, 63 nt, Homo Sapiens
gugcugggauuacacacgugagucaccaugcccagccccaaagccauuucuugaagaauuucu

SEQ ID NO: 283178 - RNA, 63 nt, Homo Sapiens
ccuuuagacccagagcccaaacucaucugucagagccccaagcccggggcaagauccuuccag

SEQ ID NO: 283179 - RNA, 63 nt, Homo Sapiens
acagcagaugcuuccugggccaccaggaacuagagccccaaccgagcccuucccauccuuacc

SEQ ID NO: 283180 - RNA, 63 nt, Homo Sapiens
cccacgguccccaggaggacgcuuccuggccaaagccccaagccuuuggugagaagccaauuc

SEQ ID NO: 283181 - RNA, 63 nt, Homo Sapiens
cuuguggcuagaguacagugggguagacccuccagccccaauagcccuaguacccagcuggca

SEQ ID NO: 283182 - RNA, 63 nt, Homo Sapiens
cuuaaaacucccuugcuaccgaucuggaacucaagccccaagacauccccuuagaugaucuga

SEQ ID NO: 283183 - RNA, 63 nt, Homo Sapiens
aucacaagaagcuggggcuuccuugagaaggccagccccaaagguaccuguguuuaaaagaug

SEQ ID NO: 283184 - RNA, 63 nt, Homo Sapiens
gucccugcuccucuuagaauguggcuaccucucagccccaauacccugccuagugggguggua

SEQ ID NO: 283185 - RNA, 63 nt, Homo Sapiens
ggggaauuugucauggggaagguaugaaaauacagccccaaagaguggcggcugaucuguaga

SEQ ID NO: 283186 - RNA, 63 nt, Homo Sapiens
ugcuacaaaugaaguccuucuccaaaugcauugagccccaagaaaaaucgcugauucugagga

SEQ ID NO: 283187 - RNA, 63 nt, Homo Sapiens
cgcgcagaaugugcucgcugccccgcggcuucgagccccaagcucccgaggacuuggcgcagc

SEQ ID NO: 283188 - RNA, 63 nt, Homo Sapiens
agggacagaggggguggccucccaacucaccccagccccaaaacucuccucugcugcuggcug

SEQ ID NO: 283189 - RNA, 63 nt, Homo Sapiens
uggcugguuagagguucccuuugacgccaucccagccccaaugaacaauuauuuauuaaaugc

SEQ ID NO: 283190 - RNA, 63 nt, Homo Sapiens
gcugggcuuccuggggccacagagccccaacucagccccaaaaugccucuggcucugucggcc

SEQ ID NO: 283191 - RNA, 63 nt, Homo Sapiens
cagccccaaaagcugggcuucucugucggccagagccccaacuagcccuggccuugccucugg

SEQ ID NO: 283192 - RNA, 63 nt, Homo Sapiens
ugagcgcugaaucguguccccauucggcaaauuagccccaaauaggucaggauggaacuaccu

SEQ ID NO: 283193 - RNA, 63 nt, Homo Sapiens
cucuuccuccagcuggcucccuugugcccuggaagccccaaggguaggggucacugucacaug

SEQ ID NO: 283194 - RNA, 63 nt, Homo Sapiens
cuccauccccaacccauccucauccccaacuacagccccaaacccagccccagacuaauccac

SEQ ID NO: 283195 - RNA, 63 nt, Homo Sapiens
agccauccccaacucauccucauccccaacugcagccccaaacccaacccagggccaucccca

SEQ ID NO: 283196 - RNA, 63 nt, Homo Sapiens
cccuggccacauccccauccucccccaaccuccagccccaacacccaucaucccccugagcuc

SEQ ID NO: 283197 - RNA, 63 nt, Homo Sapiens
cccuucccacuuggcacccaagguucccaagccagccccaacauguuggaagggcagcgggua

SEQ ID NO: 283198 - RNA, 63 nt, Homo Sapiens
gggauuuugugggaccgcugguccuccucagggagccccaagggguggaagcggcagccacaa

SEQ ID NO: 283199 - RNA, 63 nt, Homo Sapiens
cuggggcuucaggccagagcgccaccuacauccagccccaaaaccuugaaccuaggaccaaga

SEQ ID NO: 283200 - RNA, 63 nt, Homo Sapiens
uaagauaucccucacacccacuacccccacgccagccccaaacacaggacaucugugaccgcc

SEQ ID NO: 283201 - RNA, 63 nt, Homo Sapiens
ugucaccugcuucucugcccugggacagggagcagccccaaaucgaagcaugaacagugcacc

SEQ ID NO: 283202 - RNA, 63 nt, Homo Sapiens
caaaacuggcaaggacgcuucuggccccacaccagccccaaucccacccgugguggcucaagu

SEQ ID NO: 283203 - RNA, 64 nt, Homo Sapiens
ucaguauccuucagcuuuuuacauuaacccaguguccucugauauaggugagucuugugguagc

SEQ ID NO: 283204 - RNA, 64 nt, Homo Sapiens
uaaaaaaucccaauuacagaacaggagauauguuuccucugacaaaaccccauuuuuagagugu

SEQ ID NO: 283205 - RNA, 64 nt, Homo Sapiens
uccauggcuuccuccucccuggauccuagccuuauccucugaucaauccucuuccucugaggcu

SEQ ID NO: 283206 - RNA, 64 nt, Homo Sapiens
cuggauccuagccuuauccuccgaaaaauccucuuccucugaggagccucucaccuguacucuu

SEQ ID NO: 283207 - RNA, 64 nt, Homo Sapiens
cuuuccuggggccuccucccggccugacucucacuccucugagguggcucuccggacaggagcu

SEQ ID NO: 283208 - RNA, 64 nt, Homo Sapiens
cgugaugccaaagguugcgaaccgggcuugggcuuccucugagcguguagacagcaggaggagc

SEQ ID NO: 283209 - RNA, 64 nt, Homo Sapiens
cugcccugccuccuccaucagagaaggguggggcuccucugagcauugggaagucuccccgcug

SEQ ID NO: 283210 - RNA, 64 nt, Homo Sapiens
cagggcuggcccgccaggugacccaccuggccccuccucugacacccucucugggggcugaggg

SEQ ID NO: 283211 - RNA, 64 nt, Homo Sapiens
caagccccccgcccaaucauguguucaguagccguccucugagcagggcccaaggcagccaggg

SEQ ID NO: 283212 - RNA, 64 nt, Homo Sapiens
gcccuggguggaaggaaggcacugagagcccccuuccucugagggccccaccucaccccuuggu

SEQ ID NO: 283213 - RNA, 64 nt, Homo Sapiens
cagcugcuucuccaauggcuucagugacacaguuuccucugaugcaaacagaagggagaaagug

SEQ ID NO: 283214 - RNA, 64 nt, Homo Sapiens
aacgccugcuucuccauaucuaagaaauccuagguccucugagcacuucuucaucaaguuuuga

SEQ ID NO: 283215 - RNA, 64 nt, Homo Sapiens
guuagccaucacauaacuuaccuguccuaccugcuccucugauuacuuucuuaauuuaaucugc

SEQ ID NO: 283216 - RNA, 64 nt, Homo Sapiens
uuacaagcagagacucacucacgauggcaggcauuccucugagucugcccuuucccuucagaaa

SEQ ID NO: 283217 - RNA, 64 nt, Homo Sapiens
aucuccuuucggaaugaauguucauggaagaggcuccucugagggcaagagaccuguuuuagug

SEQ ID NO: 283218 - RNA, 64 nt, Homo Sapiens
auuguaacuauucaguauuuacugguaggcacuguccucugauuaaacuuggccuacuggcaau

SEQ ID NO: 283219 - RNA, 64 nt, Homo Sapiens
auuugcauuugaaaggauugaaugccuuguuuucuccucugaauuuucucuccucuucuugggc

SEQ ID NO: 283220 - RNA, 64 nt, Homo Sapiens
aguugacucuucgacccccaugaauuguuuuuaauccucugacacaaauaagaggcauauacau

SEQ ID NO: 283221 - RNA, 64 nt, Homo Sapiens
uuucugaacaucccacagcagucucaguccugguuccucugauaagaucgacaaaagaaacaac

SEQ ID NO: 283222 - RNA, 64 nt, Homo Sapiens
uuaauuguaugaaaacacaaagcacaggucaggauccucugagagaaaaucaacauugcaccac

SEQ ID NO: 283223 - RNA, 64 nt, Homo Sapiens
ccccaucuccauucucacccgagcuccucuuuuguccucugagauguugagauaugcaagcacu

SEQ ID NO: 283224 - RNA, 64 nt, Homo Sapiens
ucccuuucccaacugucaccgcaaacccacccuguccucugacggauauuucuuugaagggaga

SEQ ID NO: 283225 - RNA, 64 nt, Homo Sapiens
acaucuuuuucucaccuucaucuuauuuuuugcuuccucugaggguucugauagguacagauuc

SEQ ID NO: 283226 - RNA, 64 nt, Homo Sapiens
gacguuuuuuaguucuuuuaugcaaauuuccacuuccucugauauuauuuuccaaauuucguuc

SEQ ID NO: 283227 - RNA, 64 nt, Homo Sapiens
ccaccuggcgugagguggacugguugcacagggguccucugagaggcugcagcuuuccuuaaug

SEQ ID NO: 283228 - RNA, 64 nt, Homo Sapiens
cggcgccccuggccagcaggcaggucagggcagguccucugagcggcugucuggucagcacgug

SEQ ID NO: 283229 - RNA, 64 nt, Homo Sapiens; identical to SEQ ID NO: 45461

SEQ ID NO: 283230 - RNA, 64 nt, Homo Sapiens; identical to SEQ ID NO: 45462

SEQ ID NO: 283231 - RNA, 64 nt, Homo Sapiens; identical to SEQ ID NO: 175237

SEQ ID NO: 283232 - RNA, 64 nt, Homo Sapiens; identical to SEQ ID NO: 175238

SEQ ID NO: 283233 - RNA, 64 nt, Homo Sapiens; identical to SEQ ID NO: 175239

SEQ ID NO: 283234 - RNA, 64 nt, Homo Sapiens; identical to SEQ ID NO: 175240

SEQ ID NO: 283235 - RNA, 64 nt, Homo Sapiens; identical to SEQ ID NO: 175241

SEQ ID NO: 283236 - RNA, 64 nt, Homo Sapiens; identical to SEQ ID NO: 175242

SEQ ID NO: 283237 - RNA, 64 nt, Homo Sapiens; identical to SEQ ID NO: 175243

SEQ ID NO: 283238 - RNA, 64 nt, Homo Sapiens; identical to SEQ ID NO: 175244

SEQ ID NO: 283239 - RNA, 64 nt, Homo Sapiens; identical to SEQ ID NO: 175245

SEQ ID NO: 283240 - RNA, 64 nt, Homo Sapiens; identical to SEQ ID NO: 175246

SEQ ID NO: 283241 - RNA, 64 nt, Homo Sapiens; identical to SEQ ID NO: 175247

SEQ ID NO: 283242 - RNA, 64 nt, Homo Sapiens; identical to SEQ ID NO: 175248

SEQ ID NO: 283243 - RNA, 64 nt, Homo Sapiens; identical to SEQ ID NO: 175249

SEQ ID NO: 283244 - RNA, 64 nt, Homo Sapiens; identical to SEQ ID NO: 175250

SEQ ID NO: 283245 - RNA, 64 nt, Homo Sapiens; identical to SEQ ID NO: 175251

SEQ ID NO: 283246 - RNA, 64 nt, Homo Sapiens; identical to SEQ ID NO: 175252

SEQ ID NO: 283247 - RNA, 64 nt, Homo Sapiens; identical to SEQ ID NO: 175253

SEQ ID NO: 283248 - RNA, 64 nt, Homo Sapiens; identical to SEQ ID NO: 175254

SEQ ID NO: 283249 - RNA, 64 nt, Homo Sapiens; identical to SEQ ID NO: 175255

SEQ ID NO: 283250 - RNA, 64 nt, Homo Sapiens; identical to SEQ ID NO: 175256

SEQ ID NO: 283251 - RNA, 64 nt, Homo Sapiens; identical to SEQ ID NO: 175257

SEQ ID NO: 283252 - RNA, 64 nt, Homo Sapiens; identical to SEQ ID NO: 175258

SEQ ID NO: 283253 - RNA, 64 nt, Homo Sapiens; identical to SEQ ID NO: 175259

SEQ ID NO: 283254 - RNA, 64 nt, Homo Sapiens; identical to SEQ ID NO: 175260

SEQ ID NO: 283255 - RNA, 64 nt, Homo Sapiens; identical to SEQ ID NO: 175261

SEQ ID NO: 283256 - RNA, 64 nt, Homo Sapiens; identical to SEQ ID NO: 175262

SEQ ID NO: 283257 - RNA, 64 nt, Homo Sapiens; identical to SEQ ID NO: 175263

SEQ ID NO: 283258 - RNA, 64 nt, Homo Sapiens; identical to SEQ ID NO: 175264

SEQ ID NO: 283259 - RNA, 64 nt, Homo Sapiens; identical to SEQ ID NO: 175265

SEQ ID NO: 283260 - RNA, 64 nt, Homo Sapiens; identical to SEQ ID NO: 175266

SEQ ID NO: 283261 - RNA, 64 nt, Homo Sapiens; identical to SEQ ID NO: 175267

SEQ ID NO: 283262 - RNA, 64 nt, Homo Sapiens; identical to SEQ ID NO: 175268

SEQ ID NO: 283263 - RNA, 64 nt, Homo Sapiens; identical to SEQ ID NO: 175269

SEQ ID NO: 283264 - RNA, 64 nt, Homo Sapiens; identical to SEQ ID NO: 175270

SEQ ID NO: 283265 - RNA, 64 nt, Homo Sapiens; identical to SEQ ID NO: 175271

SEQ ID NO: 283266 - RNA, 64 nt, Homo Sapiens; identical to SEQ ID NO: 175272

SEQ ID NO: 283267 - RNA, 64 nt, Homo Sapiens; identical to SEQ ID NO: 175273

SEQ ID NO: 283268 - RNA, 64 nt, Homo Sapiens; identical to SEQ ID NO: 175274

SEQ ID NO: 283269 - RNA, 64 nt, Homo Sapiens; identical to SEQ ID NO: 175275

SEQ ID NO: 283270 - RNA, 64 nt, Homo Sapiens; identical to SEQ ID NO: 175276

SEQ ID NO: 283271 - RNA, 64 nt, Homo Sapiens; identical to SEQ ID NO: 175277

SEQ ID NO: 283272 - RNA, 64 nt, Homo Sapiens; identical to SEQ ID NO: 175278

SEQ ID NO: 283273 - RNA, 64 nt, Homo Sapiens; identical to SEQ ID NO: 237354

SEQ ID NO: 283274 - RNA, 64 nt, Homo Sapiens; identical to SEQ ID NO: 237355

SEQ ID NO: 283275 - RNA, 64 nt, Homo Sapiens; identical to SEQ ID NO: 237356

SEQ ID NO: 283276 - RNA, 64 nt, Homo Sapiens; identical to SEQ ID NO: 237357

SEQ ID NO: 283277 - RNA, 64 nt, Homo Sapiens; identical to SEQ ID NO: 237358

SEQ ID NO: 283278 - RNA, 64 nt, Homo Sapiens; identical to SEQ ID NO: 237359

SEQ ID NO: 283279 - RNA, 64 nt, Homo Sapiens; identical to SEQ ID NO: 237360

SEQ ID NO: 283280 - RNA, 64 nt, Homo Sapiens; identical to SEQ ID NO: 237361

SEQ ID NO: 283281 - RNA, 64 nt, Homo Sapiens; identical to SEQ ID NO: 237362

SEQ ID NO: 283282 - RNA, 64 nt, Homo Sapiens; identical to SEQ ID NO: 237363

SEQ ID NO: 283283 - RNA, 64 nt, Homo Sapiens; identical to SEQ ID NO: 237364

SEQ ID NO: 283284 - RNA, 64 nt, Homo Sapiens; identical to SEQ ID NO: 237365

SEQ ID NO: 283285 - RNA, 64 nt, Homo Sapiens; identical to SEQ ID NO: 237366

SEQ ID NO: 283286 - RNA, 64 nt, Homo Sapiens; identical to SEQ ID NO: 237367

SEQ ID NO: 283287 - RNA, 64 nt, Homo Sapiens; identical to SEQ ID NO: 237368

SEQ ID NO: 283288 - RNA, 64 nt, Homo Sapiens; identical to SEQ ID NO: 237369

SEQ ID NO: 283289 - RNA, 64 nt, Homo Sapiens; identical to SEQ ID NO: 237370

SEQ ID NO: 283290 - RNA, 64 nt, Homo Sapiens; identical to SEQ ID NO: 237371

SEQ ID NO: 283291 - RNA, 64 nt, Homo Sapiens; identical to SEQ ID NO: 237372

SEQ ID NO: 283292 - RNA, 64 nt, Homo Sapiens; identical to SEQ ID NO: 237373

SEQ ID NO: 283293 - RNA, 64 nt, Homo Sapiens; identical to SEQ ID NO: 237374

SEQ ID NO: 283294 - RNA, 64 nt, Homo Sapiens; identical to SEQ ID NO: 237375

SEQ ID NO: 283295 - RNA, 64 nt, Homo Sapiens; identical to SEQ ID NO: 237376

SEQ ID NO: 283296 - RNA, 64 nt, Homo Sapiens; identical to SEQ ID NO: 237377

SEQ ID NO: 283297 - RNA, 64 nt, Homo Sapiens; identical to SEQ ID NO: 237378

SEQ ID NO: 283298 - RNA, 64 nt, Homo Sapiens; identical to SEQ ID NO: 237379

SEQ ID NO: 283299 - RNA, 64 nt, Homo Sapiens; identical to SEQ ID NO: 237380

SEQ ID NO: 283300 - RNA, 64 nt, Homo Sapiens; identical to SEQ ID NO: 237381

SEQ ID NO: 283301 - RNA, 64 nt, Homo Sapiens; identical to SEQ ID NO: 237382

SEQ ID NO: 283302 - RNA, 64 nt, Homo Sapiens; identical to SEQ ID NO: 237383

SEQ ID NO: 283303 - RNA, 64 nt, Homo Sapiens; identical to SEQ ID NO: 237384

SEQ ID NO: 283304 - RNA, 64 nt, Homo Sapiens; identical to SEQ ID NO: 237385

SEQ ID NO: 283305 - RNA, 64 nt, Homo Sapiens; identical to SEQ ID NO: 237386

SEQ ID NO: 283306 - RNA, 64 nt, Homo Sapiens; identical to SEQ ID NO: 237387

SEQ ID NO: 283307 - RNA, 64 nt, Homo Sapiens; identical to SEQ ID NO: 237388

SEQ ID NO: 283308 - RNA, 64 nt, Homo Sapiens; identical to SEQ ID NO: 237389

SEQ ID NO: 283309 - RNA, 64 nt, Homo Sapiens; identical to SEQ ID NO: 237390

SEQ ID NO: 283310 - RNA, 64 nt, Homo Sapiens; identical to SEQ ID NO: 237391

SEQ ID NO: 283311 - RNA, 64 nt, Homo Sapiens; identical to SEQ ID NO: 237392

SEQ ID NO: 283312 - RNA, 64 nt, Homo Sapiens; identical to SEQ ID NO: 237393

SEQ ID NO: 283313 - RNA, 64 nt, Homo Sapiens; identical to SEQ ID NO: 237394

SEQ ID NO: 283314 - RNA, 64 nt, Homo Sapiens; identical to SEQ ID NO: 237395

SEQ ID NO: 283315 - RNA, 64 nt, Homo Sapiens; identical to SEQ ID NO: 237396

SEQ ID NO: 283316 - RNA, 64 nt, Homo Sapiens; identical to SEQ ID NO: 237397

SEQ ID NO: 283317 - RNA, 64 nt, Homo Sapiens; identical to SEQ ID NO: 237398

SEQ ID NO: 283318 - RNA, 64 nt, Homo Sapiens; identical to SEQ ID NO: 237399

SEQ ID NO: 283319 - RNA, 64 nt, Homo Sapiens; identical to SEQ ID NO: 237400

SEQ ID NO: 283320 - RNA, 64 nt, Homo Sapiens; identical to SEQ ID NO: 237401

SEQ ID NO: 283321 - RNA, 64 nt, Homo Sapiens; identical to SEQ ID NO: 237402

SEQ ID NO: 283322 - RNA, 64 nt, Homo Sapiens; identical to SEQ ID NO: 237403

SEQ ID NO: 283323 - RNA, 64 nt, Homo Sapiens; identical to SEQ ID NO: 237404

SEQ ID NO: 283324 - RNA, 64 nt, Homo Sapiens; identical to SEQ ID NO: 237405

SEQ ID NO: 283325 - RNA, 64 nt, Homo Sapiens; identical to SEQ ID NO: 237406

SEQ ID NO: 283326 - RNA, 64 nt, Homo Sapiens; identical to SEQ ID NO: 237407

SEQ ID NO: 283327 - RNA, 64 nt, Homo Sapiens; identical to SEQ ID NO: 237408

SEQ ID NO: 283328 - RNA, 64 nt, Homo Sapiens; identical to SEQ ID NO: 237409

SEQ ID NO: 283329 - RNA, 64 nt, Homo Sapiens
cagugguuauucagggucugagcagcaguaaaagucacccuaaaucaaggggcuuuucagaagg

SEQ ID NO: 283330 - RNA, 64 nt, Homo Sapiens
uccuuuuuaaagccauggaacaaaaccugauacaucacccuaacagagcauuaaguuguaacug

SEQ ID NO: 283331 - RNA, 64 nt, Homo Sapiens
caguucucccugaguugauugauaggcuuaauggucacccuaaaaacacccacauaugcuuuuc

SEQ ID NO: 283332 - RNA, 64 nt, Homo Sapiens
gaugcauucaucauaauaauuccagacauuuucaucacccuaaaaggaaacccugaaacccauu

SEQ ID NO: 283333 - RNA, 64 nt, Homo Sapiens; identical to SEQ ID NO: 62936

SEQ ID NO: 283334 - RNA, 64 nt, Homo Sapiens; identical to SEQ ID NO: 62937

SEQ ID NO: 283335 - RNA, 64 nt, Homo Sapiens; identical to SEQ ID NO: 62938

SEQ ID NO: 283336 - RNA, 64 nt, Homo Sapiens; identical to SEQ ID NO: 62939

SEQ ID NO: 283337 - RNA, 64 nt, Homo Sapiens; identical to SEQ ID NO: 62940

SEQ ID NO: 283338 - RNA, 64 nt, Homo Sapiens; identical to SEQ ID NO: 62941

SEQ ID NO: 283339 - RNA, 64 nt, Homo Sapiens; identical to SEQ ID NO: 62942

SEQ ID NO: 283340 - RNA, 64 nt, Homo Sapiens; identical to SEQ ID NO: 62943

SEQ ID NO: 283341 - RNA, 64 nt, Homo Sapiens; identical to SEQ ID NO: 62944

SEQ ID NO: 283342 - RNA, 64 nt, Homo Sapiens; identical to SEQ ID NO: 62945

SEQ ID NO: 283343 - RNA, 64 nt, Homo Sapiens; identical to SEQ ID NO: 62946

SEQ ID NO: 283344 - RNA, 64 nt, Homo Sapiens; identical to SEQ ID NO: 62947

SEQ ID NO: 283345 - RNA, 64 nt, Homo Sapiens; identical to SEQ ID NO: 62948

SEQ ID NO: 283346 - RNA, 64 nt, Homo Sapiens; identical to SEQ ID NO: 62949

SEQ ID NO: 283347 - RNA, 64 nt, Homo Sapiens; identical to SEQ ID NO: 62950

SEQ ID NO: 283348 - RNA, 64 nt, Homo Sapiens; identical to SEQ ID NO: 62951

SEQ ID NO: 283349 - RNA, 64 nt, Homo Sapiens; identical to SEQ ID NO: 62952

SEQ ID NO: 283350 - RNA, 64 nt, Homo Sapiens; identical to SEQ ID NO: 62953

SEQ ID NO: 283351 - RNA, 64 nt, Homo Sapiens; identical to SEQ ID NO: 62954

SEQ ID NO: 283352 - RNA, 64 nt, Homo Sapiens; identical to SEQ ID NO: 62955

SEQ ID NO: 283353 - RNA, 64 nt, Homo Sapiens; identical to SEQ ID NO: 62956

SEQ ID NO: 283354 - RNA, 64 nt, Homo Sapiens; identical to SEQ ID NO: 62957

SEQ ID NO: 283355 - RNA, 64 nt, Homo Sapiens; identical to SEQ ID NO: 62958

SEQ ID NO: 283356 - RNA, 64 nt, Homo Sapiens; identical to SEQ ID NO: 62959

SEQ ID NO: 283357 - RNA, 64 nt, Homo Sapiens; identical to SEQ ID NO: 62960

SEQ ID NO: 283358 - RNA, 64 nt, Homo Sapiens; identical to SEQ ID NO: 62961

SEQ ID NO: 283359 - RNA, 64 nt, Homo Sapiens; identical to SEQ ID NO: 62962

SEQ ID NO: 283360 - RNA, 64 nt, Homo Sapiens; identical to SEQ ID NO: 62963

SEQ ID NO: 283361 - RNA, 64 nt, Homo Sapiens; identical to SEQ ID NO: 62964

SEQ ID NO: 283362 - RNA, 64 nt, Homo Sapiens; identical to SEQ ID NO: 62965

SEQ ID NO: 283363 - RNA, 64 nt, Homo Sapiens; identical to SEQ ID NO: 62966

SEQ ID NO: 283364 - RNA, 64 nt, Homo Sapiens; identical to SEQ ID NO: 62967

SEQ ID NO: 283365 - RNA, 64 nt, Homo Sapiens; identical to SEQ ID NO: 62968

SEQ ID NO: 283366 - RNA, 64 nt, Homo Sapiens; identical to SEQ ID NO: 62969

SEQ ID NO: 283367 - RNA, 64 nt, Homo Sapiens; identical to SEQ ID NO: 62970

SEQ ID NO: 283368 - RNA, 64 nt, Homo Sapiens; identical to SEQ ID NO: 62971

SEQ ID NO: 283369 - RNA, 64 nt, Homo Sapiens; identical to SEQ ID NO: 62972

SEQ ID NO: 283370 - RNA, 64 nt, Homo Sapiens; identical to SEQ ID NO: 62973

SEQ ID NO: 283371 - RNA, 64 nt, Homo Sapiens; identical to SEQ ID NO: 62974

SEQ ID NO: 283372 - RNA, 64 nt, Homo Sapiens; identical to SEQ ID NO: 62975

SEQ ID NO: 283373 - RNA, 64 nt, Homo Sapiens; identical to SEQ ID NO: 62976

SEQ ID NO: 283374 - RNA, 64 nt, Homo Sapiens; identical to SEQ ID NO: 62977

SEQ ID NO: 283375 - RNA, 64 nt, Homo Sapiens; identical to SEQ ID NO: 62978

SEQ ID NO: 283376 - RNA, 64 nt, Homo Sapiens; identical to SEQ ID NO: 62979

SEQ ID NO: 283377 - RNA, 64 nt, Homo Sapiens; identical to SEQ ID NO: 62980

SEQ ID NO: 283378 - RNA, 64 nt, Homo Sapiens; identical to SEQ ID NO: 62981

SEQ ID NO: 283379 - RNA, 64 nt, Homo Sapiens; identical to SEQ ID NO: 62982

SEQ ID NO: 283380 - RNA, 64 nt, Homo Sapiens; identical to SEQ ID NO: 62983

SEQ ID NO: 283381 - RNA, 64 nt, Homo Sapiens; identical to SEQ ID NO: 62984

SEQ ID NO: 283382 - RNA, 64 nt, Homo Sapiens; identical to SEQ ID NO: 62985

SEQ ID NO: 283383 - RNA, 64 nt, Homo Sapiens; identical to SEQ ID NO: 62986

SEQ ID NO: 283384 - RNA, 64 nt, Homo Sapiens; identical to SEQ ID NO: 62987

SEQ ID NO: 283385 - RNA, 64 nt, Homo Sapiens; identical to SEQ ID NO: 62988

SEQ ID NO: 283386 - RNA, 64 nt, Homo Sapiens; identical to SEQ ID NO: 62989

SEQ ID NO: 283387 - RNA, 64 nt, Homo Sapiens; identical to SEQ ID NO: 62990

SEQ ID NO: 283388 - RNA, 64 nt, Homo Sapiens; identical to SEQ ID NO: 62991

SEQ ID NO: 283389 - RNA, 64 nt, Homo Sapiens; identical to SEQ ID NO: 62992

SEQ ID NO: 283390 - RNA, 64 nt, Homo Sapiens; identical to SEQ ID NO: 62993

SEQ ID NO: 283391 - RNA, 64 nt, Homo Sapiens; identical to SEQ ID NO: 62994

SEQ ID NO: 283392 - RNA, 64 nt, Homo Sapiens; identical to SEQ ID NO: 62995

SEQ ID NO: 283393 - RNA, 64 nt, Homo Sapiens; identical to SEQ ID NO: 62996

SEQ ID NO: 283394 - RNA, 64 nt, Homo Sapiens; identical to SEQ ID NO: 62997

SEQ ID NO: 283395 - RNA, 64 nt, Homo Sapiens; identical to SEQ ID NO: 62998

SEQ ID NO: 283396 - RNA, 64 nt, Homo Sapiens; identical to SEQ ID NO: 62999

SEQ ID NO: 283397 - RNA, 64 nt, Homo Sapiens; identical to SEQ ID NO: 63000

SEQ ID NO: 283398 - RNA, 64 nt, Homo Sapiens; identical to SEQ ID NO: 63001

SEQ ID NO: 283399 - RNA, 64 nt, Homo Sapiens; identical to SEQ ID NO: 63002

SEQ ID NO: 283400 - RNA, 64 nt, Homo Sapiens; identical to SEQ ID NO: 63003

SEQ ID NO: 283401 - RNA, 64 nt, Homo Sapiens; identical to SEQ ID NO: 63004

SEQ ID NO: 283402 - RNA, 64 nt, Homo Sapiens; identical to SEQ ID NO: 63005

SEQ ID NO: 283403 - RNA, 64 nt, Homo Sapiens; identical to SEQ ID NO: 63006

SEQ ID NO: 283404 - RNA, 64 nt, Homo Sapiens; identical to SEQ ID NO: 63007

SEQ ID NO: 283405 - RNA, 64 nt, Homo Sapiens; identical to SEQ ID NO: 63008

SEQ ID NO: 283406 - RNA, 64 nt, Homo Sapiens; identical to SEQ ID NO: 63009

SEQ ID NO: 283407 - RNA, 64 nt, Homo Sapiens; identical to SEQ ID NO: 63010

SEQ ID NO: 283408 - RNA, 64 nt, Homo Sapiens; identical to SEQ ID NO: 63011

SEQ ID NO: 283409 - RNA, 64 nt, Homo Sapiens; identical to SEQ ID NO: 63012

SEQ ID NO: 283410 - RNA, 64 nt, Homo Sapiens; identical to SEQ ID NO: 63013

SEQ ID NO: 283411 - RNA, 64 nt, Homo Sapiens; identical to SEQ ID NO: 63014

SEQ ID NO: 283412 - RNA, 64 nt, Homo Sapiens; identical to SEQ ID NO: 63015

SEQ ID NO: 283413 - RNA, 64 nt, Homo Sapiens
cugacucucugcaucuguauacuccaauucagccugagugcaacggaacauuuucuuaaagaac

SEQ ID NO: 283414 - RNA, 64 nt, Homo Sapiens
ugggguugcacuucagcuucaaagaacccaagguugagugcaacggacgauggaaccguucagu

SEQ ID NO: 283415 - RNA, 64 nt, Homo Sapiens
cgaaggcagaagacugaugcaauuuucgaguaauugagugcaguucugggaaaauaccacauuc

SEQ ID NO: 283416 - RNA, 64 nt, Homo Sapiens
uugcagagccagccccgcgugagaacgugcauaaugagugcacaccaucaugucaaggugcaua

SEQ ID NO: 283417 - RNA, 64 nt, Homo Sapiens
gugugugcgugugccuguguccuucagugcguggugagugcagccagacuuggggcugugaugc

SEQ ID NO: 283418 - RNA, 64 nt, Homo Sapiens
ugugcaugcauguguguauggacgggugacagugugagugcauguguguggcacagauggcugg

SEQ ID NO: 283419 - RNA, 64 nt, Homo Sapiens
gacaucggagaaaucacuuuggagaaaggucuuuugagugcacugagugugggagaguuuuuag

SEQ ID NO: 283420 - RNA, 64 nt, Homo Sapiens
gucaugagagaguucauacuggagaaaagccuuaugagugcagugaaugugggaaagucuuuag

SEQ ID NO: 283421 - RNA, 64 nt, Homo Sapiens
uacaucugagaguucacacuggagaaaggccuuaugagugcagugacugugggaaauccuuugc

SEQ ID NO: 283422 - RNA, 64 nt, Homo Sapiens
cauaaaagagugcucccacugaagaagugccuuuugagugcaaugaaugugagaaagccuucag

SEQ ID NO: 283423 - RNA, 64 nt, Homo Sapiens; identical to SEQ ID NO: 164705

SEQ ID NO: 283424 - RNA, 64 nt, Homo Sapiens; identical to SEQ ID NO: 164706

SEQ ID NO: 283425 - RNA, 64 nt, Homo Sapiens; identical to SEQ ID NO: 133550

SEQ ID NO: 283426 - RNA, 64 nt, Homo Sapiens; identical to SEQ ID NO: 133551

SEQ ID NO: 283427 - RNA, 64 nt, Homo Sapiens; identical to SEQ ID NO: 133552

SEQ ID NO: 283428 - RNA, 64 nt, Homo Sapiens; identical to SEQ ID NO: 133553

SEQ ID NO: 283429 - RNA, 64 nt, Homo Sapiens; identical to SEQ ID NO: 133554

SEQ ID NO: 283430 - RNA, 64 nt, Homo Sapiens; identical to SEQ ID NO: 133555

SEQ ID NO: 283431 - RNA, 64 nt, Homo Sapiens; identical to SEQ ID NO: 133556

SEQ ID NO: 283432 - RNA, 64 nt, Homo Sapiens; identical to SEQ ID NO: 133557

SEQ ID NO: 283433 - RNA, 64 nt, Homo Sapiens; identical to SEQ ID NO: 133558

SEQ ID NO: 283434 - RNA, 64 nt, Homo Sapiens; identical to SEQ ID NO: 133559

SEQ ID NO: 283435 - RNA, 64 nt, Homo Sapiens; identical to SEQ ID NO: 133560

SEQ ID NO: 283436 - RNA, 64 nt, Homo Sapiens; identical to SEQ ID NO: 133561

SEQ ID NO: 283437 - RNA, 64 nt, Homo Sapiens; identical to SEQ ID NO: 133562

SEQ ID NO: 283438 - RNA, 64 nt, Homo Sapiens; identical to SEQ ID NO: 133563

SEQ ID NO: 283439 - RNA, 64 nt, Homo Sapiens; identical to SEQ ID NO: 133564

SEQ ID NO: 283440 - RNA, 64 nt, Homo Sapiens; identical to SEQ ID NO: 133565

SEQ ID NO: 283441 - RNA, 64 nt, Homo Sapiens; identical to SEQ ID NO: 133566

SEQ ID NO: 283442 - RNA, 64 nt, Homo Sapiens; identical to SEQ ID NO: 133567

SEQ ID NO: 283443 - RNA, 64 nt, Homo Sapiens; identical to SEQ ID NO: 133568

SEQ ID NO: 283444 - RNA, 64 nt, Homo Sapiens; identical to SEQ ID NO: 133569

SEQ ID NO: 283445 - RNA, 64 nt, Homo Sapiens; identical to SEQ ID NO: 133570

SEQ ID NO: 283446 - RNA, 64 nt, Homo Sapiens; identical to SEQ ID NO: 133571

SEQ ID NO: 283447 - RNA, 64 nt, Homo Sapiens; identical to SEQ ID NO: 133572

SEQ ID NO: 283448 - RNA, 64 nt, Homo Sapiens; identical to SEQ ID NO: 133573

SEQ ID NO: 283449 - RNA, 64 nt, Homo Sapiens; identical to SEQ ID NO: 133574

SEQ ID NO: 283450 - RNA, 64 nt, Homo Sapiens; identical to SEQ ID NO: 133575

SEQ ID NO: 283451 - RNA, 64 nt, Homo Sapiens; identical to SEQ ID NO: 133576

SEQ ID NO: 283452 - RNA, 64 nt, Homo Sapiens; identical to SEQ ID NO: 133577

SEQ ID NO: 283453 - RNA, 64 nt, Homo Sapiens; identical to SEQ ID NO: 133578

SEQ ID NO: 283454 - RNA, 64 nt, Homo Sapiens; identical to SEQ ID NO: 133579

SEQ ID NO: 283455 - RNA, 64 nt, Homo Sapiens; identical to SEQ ID NO: 133580

SEQ ID NO: 283456 - RNA, 64 nt, Homo Sapiens; identical to SEQ ID NO: 133581

SEQ ID NO: 283457 - RNA, 64 nt, Homo Sapiens; identical to SEQ ID NO: 133582

SEQ ID NO: 283458 - RNA, 64 nt, Homo Sapiens; identical to SEQ ID NO: 133583

SEQ ID NO: 283459 - RNA, 64 nt, Homo Sapiens; identical to SEQ ID NO: 133584

SEQ ID NO: 283460 - RNA, 64 nt, Homo Sapiens; identical to SEQ ID NO: 133585

SEQ ID NO: 283461 - RNA, 64 nt, Homo Sapiens; identical to SEQ ID NO: 133586

SEQ ID NO: 283462 - RNA, 64 nt, Homo Sapiens; identical to SEQ ID NO: 133587

SEQ ID NO: 283463 - RNA, 64 nt, Homo Sapiens; identical to SEQ ID NO: 133588

SEQ ID NO: 283464 - RNA, 64 nt, Homo Sapiens; identical to SEQ ID NO: 133589

SEQ ID NO: 283465 - RNA, 64 nt, Homo Sapiens; identical to SEQ ID NO: 133590

SEQ ID NO: 283466 - RNA, 64 nt, Homo Sapiens; identical to SEQ ID NO: 133591

SEQ ID NO: 283467 - RNA, 64 nt, Homo Sapiens; identical to SEQ ID NO: 133592

SEQ ID NO: 283468 - RNA, 64 nt, Homo Sapiens; identical to SEQ ID NO: 133593

SEQ ID NO: 283469 - RNA, 64 nt, Homo Sapiens; identical to SEQ ID NO: 133594

SEQ ID NO: 283470 - RNA, 64 nt, Homo Sapiens; identical to SEQ ID NO: 133595

SEQ ID NO: 283471 - RNA, 64 nt, Homo Sapiens; identical to SEQ ID NO: 133596

SEQ ID NO: 283472 - RNA, 64 nt, Homo Sapiens; identical to SEQ ID NO: 133597

SEQ ID NO: 283473 - RNA, 64 nt, Homo Sapiens; identical to SEQ ID NO: 133598

SEQ ID NO: 283474 - RNA, 64 nt, Homo Sapiens; identical to SEQ ID NO: 133599

SEQ ID NO: 283475 - RNA, 64 nt, Homo Sapiens; identical to SEQ ID NO: 133600

SEQ ID NO: 283476 - RNA, 64 nt, Homo Sapiens; identical to SEQ ID NO: 133601

SEQ ID NO: 283477 - RNA, 64 nt, Homo Sapiens; identical to SEQ ID NO: 133602

SEQ ID NO: 283478 - RNA, 64 nt, Homo Sapiens; identical to SEQ ID NO: 133603

SEQ ID NO: 283479 - RNA, 64 nt, Homo Sapiens; identical to SEQ ID NO: 133604

SEQ ID NO: 283480 - RNA, 64 nt, Homo Sapiens; identical to SEQ ID NO: 133605

SEQ ID NO: 283481 - RNA, 64 nt, Homo Sapiens; identical to SEQ ID NO: 133606

SEQ ID NO: 283482 - RNA, 64 nt, Homo Sapiens; identical to SEQ ID NO: 133607

SEQ ID NO: 283483 - RNA, 64 nt, Homo Sapiens; identical to SEQ ID NO: 133608

SEQ ID NO: 283484 - RNA, 64 nt, Homo Sapiens; identical to SEQ ID NO: 133609

SEQ ID NO: 283485 - RNA, 64 nt, Homo Sapiens; identical to SEQ ID NO: 133610

SEQ ID NO: 283486 - RNA, 52 nt, Homo Sapiens; identical to SEQ ID NO: 133611

SEQ ID NO: 283487 - RNA, 55 nt, Homo Sapiens; identical to SEQ ID NO: 133612

SEQ ID NO: 283488 - RNA, 64 nt, Homo Sapiens; identical to SEQ ID NO: 133613

SEQ ID NO: 283489 - RNA, 64 nt, Homo Sapiens; identical to SEQ ID NO: 133614

SEQ ID NO: 283490 - RNA, 64 nt, Homo Sapiens; identical to SEQ ID NO: 133615

SEQ ID NO: 283491 - RNA, 64 nt, Homo Sapiens; identical to SEQ ID NO: 133616

SEQ ID NO: 283492 - RNA, 64 nt, Homo Sapiens; identical to SEQ ID NO: 133617

SEQ ID NO: 283493 - RNA, 64 nt, Homo Sapiens; identical to SEQ ID NO: 133618

SEQ ID NO: 283494 - RNA, 64 nt, Homo Sapiens; identical to SEQ ID NO: 133619

SEQ ID NO: 283495 - RNA, 64 nt, Homo Sapiens; identical to SEQ ID NO: 133620

SEQ ID NO: 283496 - RNA, 64 nt, Homo Sapiens; identical to SEQ ID NO: 133621

SEQ ID NO: 283497 - RNA, 64 nt, Homo Sapiens; identical to SEQ ID NO: 133622

SEQ ID NO: 283498 - RNA, 64 nt, Homo Sapiens; identical to SEQ ID NO: 133623

SEQ ID NO: 283499 - RNA, 64 nt, Homo Sapiens; identical to SEQ ID NO: 133624

SEQ ID NO: 283500 - RNA, 64 nt, Homo Sapiens; identical to SEQ ID NO: 133625

SEQ ID NO: 283501 - RNA, 64 nt, Homo Sapiens; identical to SEQ ID NO: 133626

SEQ ID NO: 283502 - RNA, 64 nt, Homo Sapiens; identical to SEQ ID NO: 133627

SEQ ID NO: 283503 - RNA, 64 nt, Homo Sapiens; identical to SEQ ID NO: 133628

SEQ ID NO: 283504 - RNA, 64 nt, Homo Sapiens; identical to SEQ ID NO: 133629

SEQ ID NO: 283505 - RNA, 64 nt, Homo Sapiens; identical to SEQ ID NO: 133630

SEQ ID NO: 283506 - RNA, 64 nt, Homo Sapiens; identical to SEQ ID NO: 133631

SEQ ID NO: 283507 - RNA, 64 nt, Homo Sapiens; identical to SEQ ID NO: 133632

SEQ ID NO: 283508 - RNA, 64 nt, Homo Sapiens; identical to SEQ ID NO: 133633

SEQ ID NO: 283509 - RNA, 64 nt, Homo Sapiens; identical to SEQ ID NO: 133634

SEQ ID NO: 283510 - RNA, 64 nt, Homo Sapiens; identical to SEQ ID NO: 133635

SEQ ID NO: 283511 - RNA, 64 nt, Homo Sapiens; identical to SEQ ID NO: 133636

SEQ ID NO: 283512 - RNA, 64 nt, Homo Sapiens; identical to SEQ ID NO: 133637

SEQ ID NO: 283513 - RNA, 64 nt, Homo Sapiens; identical to SEQ ID NO: 133638

SEQ ID NO: 283514 - RNA, 63 nt, Homo Sapiens; identical to SEQ ID NO: 133639

SEQ ID NO: 283515 - RNA, 51 nt, Homo Sapiens; identical to SEQ ID NO: 133640

SEQ ID NO: 283516 - RNA, 64 nt, Homo Sapiens; identical to SEQ ID NO: 133641

SEQ ID NO: 283517 - RNA, 64 nt, Homo Sapiens; identical to SEQ ID NO: 133642

SEQ ID NO: 283518 - RNA, 64 nt, Homo Sapiens; identical to SEQ ID NO: 133643

SEQ ID NO: 283519 - RNA, 64 nt, Homo Sapiens; identical to SEQ ID NO: 133644

SEQ ID NO: 283520 - RNA, 64 nt, Homo Sapiens; identical to SEQ ID NO: 133645

SEQ ID NO: 283521 - RNA, 64 nt, Homo Sapiens; identical to SEQ ID NO: 133646

SEQ ID NO: 283522 - RNA, 64 nt, Homo Sapiens; identical to SEQ ID NO: 133647

SEQ ID NO: 283523 - RNA, 64 nt, Homo Sapiens; identical to SEQ ID NO: 133648

SEQ ID NO: 283524 - RNA, 64 nt, Homo Sapiens; identical to SEQ ID NO: 133649

SEQ ID NO: 283525 - RNA, 64 nt, Homo Sapiens; identical to SEQ ID NO: 133650

SEQ ID NO: 283526 - RNA, 64 nt, Homo Sapiens; identical to SEQ ID NO: 133651

SEQ ID NO: 283527 - RNA, 64 nt, Homo Sapiens; identical to SEQ ID NO: 133652

SEQ ID NO: 283528 - RNA, 64 nt, Homo Sapiens; identical to SEQ ID NO: 133653

SEQ ID NO: 283529 - RNA, 64 nt, Homo Sapiens; identical to SEQ ID NO: 133654

SEQ ID NO: 283530 - RNA, 64 nt, Homo Sapiens; identical to SEQ ID NO: 133655

SEQ ID NO: 283531 - RNA, 64 nt, Homo Sapiens; identical to SEQ ID NO: 133656

SEQ ID NO: 283532 - RNA, 64 nt, Homo Sapiens; identical to SEQ ID NO: 133657

SEQ ID NO: 283533 - RNA, 64 nt, Homo Sapiens; identical to SEQ ID NO: 133658

SEQ ID NO: 283534 - RNA, 64 nt, Homo Sapiens; identical to SEQ ID NO: 133659

SEQ ID NO: 283535 - RNA, 64 nt, Homo Sapiens; identical to SEQ ID NO: 133660

SEQ ID NO: 283536 - RNA, 64 nt, Homo Sapiens; identical to SEQ ID NO: 133661

SEQ ID NO: 283537 - RNA, 64 nt, Homo Sapiens; identical to SEQ ID NO: 133662

SEQ ID NO: 283538 - RNA, 64 nt, Homo Sapiens; identical to SEQ ID NO: 133663

SEQ ID NO: 283539 - RNA, 64 nt, Homo Sapiens; identical to SEQ ID NO: 133664

SEQ ID NO: 283540 - RNA, 64 nt, Homo Sapiens; identical to SEQ ID NO: 133665

SEQ ID NO: 283541 - RNA, 64 nt, Homo Sapiens; identical to SEQ ID NO: 133666

SEQ ID NO: 283542 - RNA, 64 nt, Homo Sapiens; identical to SEQ ID NO: 133667

SEQ ID NO: 283543 - RNA, 64 nt, Homo Sapiens; identical to SEQ ID NO: 133668

SEQ ID NO: 283544 - RNA, 64 nt, Homo Sapiens; identical to SEQ ID NO: 133669

SEQ ID NO: 283545 - RNA, 64 nt, Homo Sapiens; identical to SEQ ID NO: 133670

SEQ ID NO: 283546 - RNA, 64 nt, Homo Sapiens; identical to SEQ ID NO: 133671

SEQ ID NO: 283547 - RNA, 64 nt, Homo Sapiens; identical to SEQ ID NO: 133672

SEQ ID NO: 283548 - RNA, 64 nt, Homo Sapiens; identical to SEQ ID NO: 133673

SEQ ID NO: 283549 - RNA, 64 nt, Homo Sapiens; identical to SEQ ID NO: 133674

SEQ ID NO: 283550 - RNA, 64 nt, Homo Sapiens; identical to SEQ ID NO: 133675

SEQ ID NO: 283551 - RNA, 64 nt, Homo Sapiens; identical to SEQ ID NO: 133676

SEQ ID NO: 283552 - RNA, 50 nt, Homo Sapiens; identical to SEQ ID NO: 133677

SEQ ID NO: 283553 - RNA, 64 nt, Homo Sapiens; identical to SEQ ID NO: 133678

SEQ ID NO: 283554 - RNA, 64 nt, Homo Sapiens; identical to SEQ ID NO: 133679

SEQ ID NO: 283555 - RNA, 64 nt, Homo Sapiens; identical to SEQ ID NO: 133680

SEQ ID NO: 283556 - RNA, 64 nt, Homo Sapiens; identical to SEQ ID NO: 133681

SEQ ID NO: 283557 - RNA, 64 nt, Homo Sapiens; identical to SEQ ID NO: 133682

SEQ ID NO: 283558 - RNA, 64 nt, Homo Sapiens; identical to SEQ ID NO: 133683

SEQ ID NO: 283559 - RNA, 64 nt, Homo Sapiens; identical to SEQ ID NO: 133684

SEQ ID NO: 283560 - RNA, 64 nt, Homo Sapiens; identical to SEQ ID NO: 133685

SEQ ID NO: 283561 - RNA, 64 nt, Homo Sapiens; identical to SEQ ID NO: 133686

SEQ ID NO: 283562 - RNA, 64 nt, Homo Sapiens; identical to SEQ ID NO: 133687

SEQ ID NO: 283563 - RNA, 64 nt, Homo Sapiens; identical to SEQ ID NO: 133688

SEQ ID NO: 283564 - RNA, 64 nt, Homo Sapiens; identical to SEQ ID NO: 133689

SEQ ID NO: 283565 - RNA, 64 nt, Homo Sapiens; identical to SEQ ID NO: 133690

SEQ ID NO: 283566 - RNA, 64 nt, Homo Sapiens; identical to SEQ ID NO: 133691

SEQ ID NO: 283567 - RNA, 64 nt, Homo Sapiens; identical to SEQ ID NO: 133692

SEQ ID NO: 283568 - RNA, 64 nt, Homo Sapiens; identical to SEQ ID NO: 133693

SEQ ID NO: 283569 - RNA, 64 nt, Homo Sapiens; identical to SEQ ID NO: 133694

SEQ ID NO: 283570 - RNA, 64 nt, Homo Sapiens; identical to SEQ ID NO: 133695

SEQ ID NO: 283571 - RNA, 64 nt, Homo Sapiens; identical to SEQ ID NO: 133696

SEQ ID NO: 283572 - RNA, 64 nt, Homo Sapiens; identical to SEQ ID NO: 133697

SEQ ID NO: 283573 - RNA, 64 nt, Homo Sapiens; identical to SEQ ID NO: 133698

SEQ ID NO: 283574 - RNA, 64 nt, Homo Sapiens; identical to SEQ ID NO: 133699

SEQ ID NO: 283575 - RNA, 64 nt, Homo Sapiens; identical to SEQ ID NO: 133700

SEQ ID NO: 283576 - RNA, 64 nt, Homo Sapiens; identical to SEQ ID NO: 133701

SEQ ID NO: 283577 - RNA, 64 nt, Homo Sapiens; identical to SEQ ID NO: 133702

SEQ ID NO: 283578 - RNA, 64 nt, Homo Sapiens; identical to SEQ ID NO: 133703

SEQ ID NO: 283579 - RNA, 64 nt, Homo Sapiens; identical to SEQ ID NO: 133704

SEQ ID NO: 283580 - RNA, 64 nt, Homo Sapiens; identical to SEQ ID NO: 133705

SEQ ID NO: 283581 - RNA, 64 nt, Homo Sapiens; identical to SEQ ID NO: 133706

SEQ ID NO: 283582 - RNA, 64 nt, Homo Sapiens; identical to SEQ ID NO: 133707

SEQ ID NO: 283583 - RNA, 64 nt, Homo Sapiens; identical to SEQ ID NO: 133708

SEQ ID NO: 283584 - RNA, 64 nt, Homo Sapiens; identical to SEQ ID NO: 133709

SEQ ID NO: 283585 - RNA, 64 nt, Homo Sapiens; identical to SEQ ID NO: 133710

SEQ ID NO: 283586 - RNA, 64 nt, Homo Sapiens; identical to SEQ ID NO: 133711

SEQ ID NO: 283587 - RNA, 64 nt, Homo Sapiens; identical to SEQ ID NO: 133712

SEQ ID NO: 283588 - RNA, 64 nt, Homo Sapiens; identical to SEQ ID NO: 133713

SEQ ID NO: 283589 - RNA, 64 nt, Homo Sapiens; identical to SEQ ID NO: 133714

SEQ ID NO: 283590 - RNA, 64 nt, Homo Sapiens; identical to SEQ ID NO: 133715

SEQ ID NO: 283591 - RNA, 64 nt, Homo Sapiens; identical to SEQ ID NO: 133716

SEQ ID NO: 283592 - RNA, 64 nt, Homo Sapiens; identical to SEQ ID NO: 133717

SEQ ID NO: 283593 - RNA, 64 nt, Homo Sapiens; identical to SEQ ID NO: 133718

SEQ ID NO: 283594 - RNA, 64 nt, Homo Sapiens; identical to SEQ ID NO: 133719

SEQ ID NO: 283595 - RNA, 64 nt, Homo Sapiens; identical to SEQ ID NO: 133720

SEQ ID NO: 283596 - RNA, 64 nt, Homo Sapiens; identical to SEQ ID NO: 133721

SEQ ID NO: 283597 - RNA, 64 nt, Homo Sapiens; identical to SEQ ID NO: 133722

SEQ ID NO: 283598 - RNA, 64 nt, Homo Sapiens; identical to SEQ ID NO: 133723

SEQ ID NO: 283599 - RNA, 64 nt, Homo Sapiens; identical to SEQ ID NO: 133724

SEQ ID NO: 283600 - RNA, 64 nt, Homo Sapiens; identical to SEQ ID NO: 133725

SEQ ID NO: 283601 - RNA, 64 nt, Homo Sapiens; identical to SEQ ID NO: 133726

SEQ ID NO: 283602 - RNA, 64 nt, Homo Sapiens; identical to SEQ ID NO: 133727

SEQ ID NO: 283603 - RNA, 64 nt, Homo Sapiens; identical to SEQ ID NO: 133728

SEQ ID NO: 283604 - RNA, 64 nt, Homo Sapiens; identical to SEQ ID NO: 133729

SEQ ID NO: 283605 - RNA, 64 nt, Homo Sapiens; identical to SEQ ID NO: 133730

SEQ ID NO: 283606 - RNA, 64 nt, Homo Sapiens; identical to SEQ ID NO: 133731

SEQ ID NO: 283607 - RNA, 64 nt, Homo Sapiens; identical to SEQ ID NO: 133732

SEQ ID NO: 283608 - RNA, 64 nt, Homo Sapiens; identical to SEQ ID NO: 133733

SEQ ID NO: 283609 - RNA, 64 nt, Homo Sapiens; identical to SEQ ID NO: 133734

SEQ ID NO: 283610 - RNA, 64 nt, Homo Sapiens; identical to SEQ ID NO: 133735

SEQ ID NO: 283611 - RNA, 64 nt, Homo Sapiens; identical to SEQ ID NO: 133736

SEQ ID NO: 283612 - RNA, 64 nt, Homo Sapiens; identical to SEQ ID NO: 133737

SEQ ID NO: 283613 - RNA, 64 nt, Homo Sapiens; identical to SEQ ID NO: 133738

SEQ ID NO: 283614 - RNA, 64 nt, Homo Sapiens; identical to SEQ ID NO: 133739

SEQ ID NO: 283615 - RNA, 64 nt, Homo Sapiens; identical to SEQ ID NO: 133740

SEQ ID NO: 283616 - RNA, 64 nt, Homo Sapiens; identical to SEQ ID NO: 133741

SEQ ID NO: 283617 - RNA, 64 nt, Homo Sapiens; identical to SEQ ID NO: 133742

SEQ ID NO: 283618 - RNA, 64 nt, Homo Sapiens; identical to SEQ ID NO: 133743

SEQ ID NO: 283619 - RNA, 64 nt, Homo Sapiens; identical to SEQ ID NO: 133744

SEQ ID NO: 283620 - RNA, 64 nt, Homo Sapiens; identical to SEQ ID NO: 133745

SEQ ID NO: 283621 - RNA, 64 nt, Homo Sapiens; identical to SEQ ID NO: 133746

SEQ ID NO: 283622 - RNA, 64 nt, Homo Sapiens; identical to SEQ ID NO: 133747

SEQ ID NO: 283623 - RNA, 64 nt, Homo Sapiens; identical to SEQ ID NO: 133748

SEQ ID NO: 283624 - RNA, 64 nt, Homo Sapiens; identical to SEQ ID NO: 133749

SEQ ID NO: 283625 - RNA, 64 nt, Homo Sapiens; identical to SEQ ID NO: 133750

SEQ ID NO: 283626 - RNA, 64 nt, Homo Sapiens; identical to SEQ ID NO: 133751

SEQ ID NO: 283627 - RNA, 64 nt, Homo Sapiens; identical to SEQ ID NO: 133752

SEQ ID NO: 283628 - RNA, 64 nt, Homo Sapiens; identical to SEQ ID NO: 133753

SEQ ID NO: 283629 - RNA, 64 nt, Homo Sapiens; identical to SEQ ID NO: 133754

SEQ ID NO: 283630 - RNA, 64 nt, Homo Sapiens; identical to SEQ ID NO: 133755

SEQ ID NO: 283631 - RNA, 64 nt, Homo Sapiens; identical to SEQ ID NO: 133756

SEQ ID NO: 283632 - RNA, 64 nt, Homo Sapiens; identical to SEQ ID NO: 133757

SEQ ID NO: 283633 - RNA, 64 nt, Homo Sapiens; identical to SEQ ID NO: 133758

SEQ ID NO: 283634 - RNA, 64 nt, Homo Sapiens; identical to SEQ ID NO: 133759

SEQ ID NO: 283635 - RNA, 64 nt, Homo Sapiens; identical to SEQ ID NO: 133760

SEQ ID NO: 283636 - RNA, 64 nt, Homo Sapiens; identical to SEQ ID NO: 133761

SEQ ID NO: 283637 - RNA, 64 nt, Homo Sapiens; identical to SEQ ID NO: 133762

SEQ ID NO: 283638 - RNA, 64 nt, Homo Sapiens; identical to SEQ ID NO: 133763

SEQ ID NO: 283639 - RNA, 64 nt, Homo Sapiens; identical to SEQ ID NO: 133764

SEQ ID NO: 283640 - RNA, 64 nt, Homo Sapiens; identical to SEQ ID NO: 133765

SEQ ID NO: 283641 - RNA, 60 nt, Homo Sapiens; identical to SEQ ID NO: 133766

SEQ ID NO: 283642 - RNA, 57 nt, Homo Sapiens; identical to SEQ ID NO: 133767

SEQ ID NO: 283643 - RNA, 64 nt, Homo Sapiens; identical to SEQ ID NO: 133768

SEQ ID NO: 283644 - RNA, 64 nt, Homo Sapiens; identical to SEQ ID NO: 133769

SEQ ID NO: 283645 - RNA, 64 nt, Homo Sapiens; identical to SEQ ID NO: 133770

SEQ ID NO: 283646 - RNA, 64 nt, Homo Sapiens; identical to SEQ ID NO: 133771

SEQ ID NO: 283647 - RNA, 64 nt, Homo Sapiens; identical to SEQ ID NO: 133772

SEQ ID NO: 283648 - RNA, 64 nt, Homo Sapiens; identical to SEQ ID NO: 133773

SEQ ID NO: 283649 - RNA, 64 nt, Homo Sapiens; identical to SEQ ID NO: 133774

SEQ ID NO: 283650 - RNA, 64 nt, Homo Sapiens; identical to SEQ ID NO: 133775

SEQ ID NO: 283651 - RNA, 64 nt, Homo Sapiens; identical to SEQ ID NO: 133776

SEQ ID NO: 283652 - RNA, 64 nt, Homo Sapiens; identical to SEQ ID NO: 133777

SEQ ID NO: 283653 - RNA, 64 nt, Homo Sapiens; identical to SEQ ID NO: 133778

SEQ ID NO: 283654 - RNA, 64 nt, Homo Sapiens; identical to SEQ ID NO: 133779

SEQ ID NO: 283655 - RNA, 64 nt, Homo Sapiens; identical to SEQ ID NO: 133780

SEQ ID NO: 283656 - RNA, 64 nt, Homo Sapiens; identical to SEQ ID NO: 133781

SEQ ID NO: 283657 - RNA, 64 nt, Homo Sapiens; identical to SEQ ID NO: 133782

SEQ ID NO: 283658 - RNA, 64 nt, Homo Sapiens; identical to SEQ ID NO: 133783

SEQ ID NO: 283659 - RNA, 64 nt, Homo Sapiens; identical to SEQ ID NO: 133784

SEQ ID NO: 283660 - RNA, 64 nt, Homo Sapiens; identical to SEQ ID NO: 133785

SEQ ID NO: 283661 - RNA, 64 nt, Homo Sapiens; identical to SEQ ID NO: 133786

SEQ ID NO: 283662 - RNA, 64 nt, Homo Sapiens; identical to SEQ ID NO: 133787

SEQ ID NO: 283663 - RNA, 64 nt, Homo Sapiens; identical to SEQ ID NO: 133788

SEQ ID NO: 283664 - RNA, 64 nt, Homo Sapiens; identical to SEQ ID NO: 133789

SEQ ID NO: 283665 - RNA, 64 nt, Homo Sapiens; identical to SEQ ID NO: 133790

SEQ ID NO: 283666 - RNA, 64 nt, Homo Sapiens; identical to SEQ ID NO: 133791

SEQ ID NO: 283667 - RNA, 64 nt, Homo Sapiens; identical to SEQ ID NO: 133792

SEQ ID NO: 283668 - RNA, 64 nt, Homo Sapiens; identical to SEQ ID NO: 133793

SEQ ID NO: 283669 - RNA, 64 nt, Homo Sapiens; identical to SEQ ID NO: 133794

SEQ ID NO: 283670 - RNA, 64 nt, Homo Sapiens; identical to SEQ ID NO: 133795

SEQ ID NO: 283671 - RNA, 64 nt, Homo Sapiens; identical to SEQ ID NO: 133796

SEQ ID NO: 283672 - RNA, 64 nt, Homo Sapiens; identical to SEQ ID NO: 133797

SEQ ID NO: 283673 - RNA, 64 nt, Homo Sapiens; identical to SEQ ID NO: 133798

SEQ ID NO: 283674 - RNA, 64 nt, Homo Sapiens; identical to SEQ ID NO: 133799

SEQ ID NO: 283675 - RNA, 64 nt, Homo Sapiens; identical to SEQ ID NO: 133800

SEQ ID NO: 283676 - RNA, 64 nt, Homo Sapiens; identical to SEQ ID NO: 133801

SEQ ID NO: 283677 - RNA, 64 nt, Homo Sapiens; identical to SEQ ID NO: 133802

SEQ ID NO: 283678 - RNA, 64 nt, Homo Sapiens; identical to SEQ ID NO: 133803

SEQ ID NO: 283679 - RNA, 64 nt, Homo Sapiens; identical to SEQ ID NO: 133804

SEQ ID NO: 283680 - RNA, 64 nt, Homo Sapiens; identical to SEQ ID NO: 133805

SEQ ID NO: 283681 - RNA, 64 nt, Homo Sapiens; identical to SEQ ID NO: 133806

SEQ ID NO: 283682 - RNA, 64 nt, Homo Sapiens; identical to SEQ ID NO: 133807

SEQ ID NO: 283683 - RNA, 64 nt, Homo Sapiens; identical to SEQ ID NO: 133808

SEQ ID NO: 283684 - RNA, 64 nt, Homo Sapiens; identical to SEQ ID NO: 133809

SEQ ID NO: 283685 - RNA, 64 nt, Homo Sapiens; identical to SEQ ID NO: 133810

SEQ ID NO: 283686 - RNA, 64 nt, Homo Sapiens; identical to SEQ ID NO: 133811

SEQ ID NO: 283687 - RNA, 64 nt, Homo Sapiens; identical to SEQ ID NO: 133812

SEQ ID NO: 283688 - RNA, 64 nt, Homo Sapiens; identical to SEQ ID NO: 133813

SEQ ID NO: 283689 - RNA, 64 nt, Homo Sapiens; identical to SEQ ID NO: 133814

SEQ ID NO: 283690 - RNA, 64 nt, Homo Sapiens; identical to SEQ ID NO: 133815

SEQ ID NO: 283691 - RNA, 64 nt, Homo Sapiens; identical to SEQ ID NO: 133816

SEQ ID NO: 283692 - RNA, 64 nt, Homo Sapiens; identical to SEQ ID NO: 133817

SEQ ID NO: 283693 - RNA, 64 nt, Homo Sapiens; identical to SEQ ID NO: 133818

SEQ ID NO: 283694 - RNA, 64 nt, Homo Sapiens; identical to SEQ ID NO: 133819

SEQ ID NO: 283695 - RNA, 64 nt, Homo Sapiens; identical to SEQ ID NO: 133820

SEQ ID NO: 283696 - RNA, 64 nt, Homo Sapiens; identical to SEQ ID NO: 133821

SEQ ID NO: 283697 - RNA, 64 nt, Homo Sapiens; identical to SEQ ID NO: 133822

SEQ ID NO: 283698 - RNA, 64 nt, Homo Sapiens; identical to SEQ ID NO: 133823

SEQ ID NO: 283699 - RNA, 64 nt, Homo Sapiens; identical to SEQ ID NO: 133824

SEQ ID NO: 283700 - RNA, 64 nt, Homo Sapiens; identical to SEQ ID NO: 133825

SEQ ID NO: 283701 - RNA, 64 nt, Homo Sapiens; identical to SEQ ID NO: 133826

SEQ ID NO: 283702 - RNA, 64 nt, Homo Sapiens; identical to SEQ ID NO: 133827

SEQ ID NO: 283703 - RNA, 64 nt, Homo Sapiens; identical to SEQ ID NO: 133828

SEQ ID NO: 283704 - RNA, 64 nt, Homo Sapiens; identical to SEQ ID NO: 133829

SEQ ID NO: 283705 - RNA, 64 nt, Homo Sapiens
cuuccauguguagagugcuuagaaaccccaucaacugaucuagugagucagacuguggaaucuc

SEQ ID NO: 283706 - RNA, 64 nt, Homo Sapiens
cccugcauccaacaucugaucugcugagauaugucugaucuaucucugcucgcuguucucccgu

SEQ ID NO: 283707 - RNA, 64 nt, Homo Sapiens; identical to SEQ ID NO: 144190

SEQ ID NO: 283708 - RNA, 64 nt, Homo Sapiens; identical to SEQ ID NO: 144191

SEQ ID NO: 283709 - RNA, 64 nt, Homo Sapiens; identical to SEQ ID NO: 144192

SEQ ID NO: 283710 - RNA, 64 nt, Homo Sapiens; identical to SEQ ID NO: 144193

SEQ ID NO: 283711 - RNA, 64 nt, Homo Sapiens; identical to SEQ ID NO: 144194

SEQ ID NO: 283712 - RNA, 64 nt, Homo Sapiens; identical to SEQ ID NO: 144195

SEQ ID NO: 283713 - RNA, 64 nt, Homo Sapiens; identical to SEQ ID NO: 144196

SEQ ID NO: 283714 - RNA, 64 nt, Homo Sapiens; identical to SEQ ID NO: 144197

SEQ ID NO: 283715 - RNA, 64 nt, Homo Sapiens; identical to SEQ ID NO: 144198

SEQ ID NO: 283716 - RNA, 64 nt, Homo Sapiens; identical to SEQ ID NO: 144199

SEQ ID NO: 283717 - RNA, 64 nt, Homo Sapiens; identical to SEQ ID NO: 144200

SEQ ID NO: 283718 - RNA, 64 nt, Homo Sapiens; identical to SEQ ID NO: 144201

SEQ ID NO: 283719 - RNA, 64 nt, Homo Sapiens; identical to SEQ ID NO: 144202

SEQ ID NO: 283720 - RNA, 64 nt, Homo Sapiens; identical to SEQ ID NO: 144203

SEQ ID NO: 283721 - RNA, 64 nt, Homo Sapiens; identical to SEQ ID NO: 144204

SEQ ID NO: 283722 - RNA, 64 nt, Homo Sapiens; identical to SEQ ID NO: 144205

SEQ ID NO: 283723 - RNA, 64 nt, Homo Sapiens; identical to SEQ ID NO: 144206

SEQ ID NO: 283724 - RNA, 64 nt, Homo Sapiens; identical to SEQ ID NO: 144207

SEQ ID NO: 283725 - RNA, 64 nt, Homo Sapiens; identical to SEQ ID NO: 144208

SEQ ID NO: 283726 - RNA, 64 nt, Homo Sapiens; identical to SEQ ID NO: 144209

SEQ ID NO: 283727 - RNA, 64 nt, Homo Sapiens; identical to SEQ ID NO: 144210

SEQ ID NO: 283728 - RNA, 64 nt, Homo Sapiens; identical to SEQ ID NO: 144211

SEQ ID NO: 283729 - RNA, 64 nt, Homo Sapiens; identical to SEQ ID NO: 144212

SEQ ID NO: 283730 - RNA, 64 nt, Homo Sapiens; identical to SEQ ID NO: 144213

SEQ ID NO: 283731 - RNA, 64 nt, Homo Sapiens; identical to SEQ ID NO: 144214

SEQ ID NO: 283732 - RNA, 64 nt, Homo Sapiens; identical to SEQ ID NO: 144215

SEQ ID NO: 283733 - RNA, 64 nt, Homo Sapiens; identical to SEQ ID NO: 144216

SEQ ID NO: 283734 - RNA, 64 nt, Homo Sapiens; identical to SEQ ID NO: 144217

SEQ ID NO: 283735 - RNA, 64 nt, Homo Sapiens; identical to SEQ ID NO: 144218

SEQ ID NO: 283736 - RNA, 64 nt, Homo Sapiens; identical to SEQ ID NO: 144219

SEQ ID NO: 283737 - RNA, 64 nt, Homo Sapiens; identical to SEQ ID NO: 144220

SEQ ID NO: 283738 - RNA, 64 nt, Homo Sapiens; identical to SEQ ID NO: 144221

SEQ ID NO: 283739 - RNA, 64 nt, Homo Sapiens; identical to SEQ ID NO: 144222

SEQ ID NO: 283740 - RNA, 64 nt, Homo Sapiens; identical to SEQ ID NO: 144223

SEQ ID NO: 283741 - RNA, 64 nt, Homo Sapiens; identical to SEQ ID NO: 144224

SEQ ID NO: 283742 - RNA, 64 nt, Homo Sapiens; identical to SEQ ID NO: 144225

SEQ ID NO: 283743 - RNA, 64 nt, Homo Sapiens; identical to SEQ ID NO: 144226

SEQ ID NO: 283744 - RNA, 64 nt, Homo Sapiens; identical to SEQ ID NO: 144227

SEQ ID NO: 283745 - RNA, 64 nt, Homo Sapiens; identical to SEQ ID NO: 144228

SEQ ID NO: 283746 - RNA, 64 nt, Homo Sapiens; identical to SEQ ID NO: 144229

SEQ ID NO: 283747 - RNA, 64 nt, Homo Sapiens; identical to SEQ ID NO: 144230

SEQ ID NO: 283748 - RNA, 64 nt, Homo Sapiens; identical to SEQ ID NO: 144231

SEQ ID NO: 283749 - RNA, 64 nt, Homo Sapiens; identical to SEQ ID NO: 144232

SEQ ID NO: 283750 - RNA, 64 nt, Homo Sapiens; identical to SEQ ID NO: 144233

SEQ ID NO: 283751 - RNA, 64 nt, Homo Sapiens; identical to SEQ ID NO: 144234

SEQ ID NO: 283752 - RNA, 64 nt, Homo Sapiens; identical to SEQ ID NO: 144235

SEQ ID NO: 283753 - RNA, 64 nt, Homo Sapiens; identical to SEQ ID NO: 144236

SEQ ID NO: 283754 - RNA, 64 nt, Homo Sapiens; identical to SEQ ID NO: 144237

SEQ ID NO: 283755 - RNA, 64 nt, Homo Sapiens; identical to SEQ ID NO: 144238

SEQ ID NO: 283756 - RNA, 64 nt, Homo Sapiens; identical to SEQ ID NO: 144239

SEQ ID NO: 283757 - RNA, 64 nt, Homo Sapiens; identical to SEQ ID NO: 144240

SEQ ID NO: 283758 - RNA, 64 nt, Homo Sapiens; identical to SEQ ID NO: 144241

SEQ ID NO: 283759 - RNA, 64 nt, Homo Sapiens; identical to SEQ ID NO: 144242

SEQ ID NO: 283760 - RNA, 64 nt, Homo Sapiens; identical to SEQ ID NO: 144243

SEQ ID NO: 283761 - RNA, 64 nt, Homo Sapiens; identical to SEQ ID NO: 144244

SEQ ID NO: 283762 - RNA, 64 nt, Homo Sapiens; identical to SEQ ID NO: 144245

SEQ ID NO: 283763 - RNA, 64 nt, Homo Sapiens; identical to SEQ ID NO: 144246

SEQ ID NO: 283764 - RNA, 64 nt, Homo Sapiens; identical to SEQ ID NO: 144247

SEQ ID NO: 283765 - RNA, 64 nt, Homo Sapiens; identical to SEQ ID NO: 144248

SEQ ID NO: 283766 - RNA, 64 nt, Homo Sapiens; identical to SEQ ID NO: 144249

SEQ ID NO: 283767 - RNA, 64 nt, Homo Sapiens; identical to SEQ ID NO: 144250

SEQ ID NO: 283768 - RNA, 64 nt, Homo Sapiens; identical to SEQ ID NO: 144251

SEQ ID NO: 283769 - RNA, 64 nt, Homo Sapiens; identical to SEQ ID NO: 144252

SEQ ID NO: 283770 - RNA, 64 nt, Homo Sapiens; identical to SEQ ID NO: 144253

SEQ ID NO: 283771 - RNA, 64 nt, Homo Sapiens; identical to SEQ ID NO: 144254

SEQ ID NO: 283772 - RNA, 64 nt, Homo Sapiens; identical to SEQ ID NO: 144255

SEQ ID NO: 283773 - RNA, 64 nt, Homo Sapiens
guaacaaucccaaaucaaaucugucuccaggcuggagaggcaggagcccuggggugagaaaagc

SEQ ID NO: 283774 - RNA, 64 nt, Homo Sapiens
guguggcugccccuccuugcuccagcagcagugggagaggcacugcucuggggccugaacugcc

SEQ ID NO: 283775 - RNA, 64 nt, Homo Sapiens
gauaguaaauaaauugcucuccuuccugauccuggagaggcaggucucaucccagauuacuaac

SEQ ID NO: 283776 - RNA, 64 nt, Homo Sapiens
auuggcccacaggauaagccaucucucuuccagagagaggcagcugucuccugggacagaggcc

SEQ ID NO: 283777 - RNA, 64 nt, Homo Sapiens
uccuguucugcuccccugagaacagugugguggggagaggcagggcugagguggucuacgaaug

SEQ ID NO: 283778 - RNA, 64 nt, Homo Sapiens
guagggaaggggagaugucugucucuugagaagagagaggcaugugugccggcauccuugaugg

SEQ ID NO: 283779 - RNA, 64 nt, Homo Sapiens
gguagcugagcggcugcccuugggugacaccuccgagaggcagccagacccagagcccucugag

SEQ ID NO: 283780 - RNA, 64 nt, Homo Sapiens
ggagagugcacugaccuguaggucaggaccaucagagaggcaagguugcccuuuccuuuuaaaa

SEQ ID NO: 283781 - RNA, 64 nt, Homo Sapiens
aucaggccccuggagggcugguaaaagcacaagugagaggcagcccccgguugaaaguccgcuu

SEQ ID NO: 283782 - RNA, 64 nt, Homo Sapiens
gaaaagccccacaaaauuccauuuccacaugaaggagaggcaagaagagcgaaaugaguguguc

SEQ ID NO: 283783 - RNA, 64 nt, Homo Sapiens
uacccuuaaagaaucugggucuguauccugcugggagaggcaauugcaaccugacucucugcau

SEQ ID NO: 283784 - RNA, 64 nt, Homo Sapiens
aacacacagucaccuccacugugagagagcaagagagaggcauggcagccauccagguauaaug

SEQ ID NO: 283785 - RNA, 64 nt, Homo Sapiens
auuuauacacccugcaauguuuauugucauuaaagagaggcauuucaugcuagccaagaggaca

SEQ ID NO: 283786 - RNA, 64 nt, Homo Sapiens
agagucaggcugcaguggaaguuguccuacggaggagaggcagugacaaugagacauuuaguua

SEQ ID NO: 283787 - RNA, 64 nt, Homo Sapiens
ucuccugcaaugauugaugaucacuccguggauagagaggcacacugucagaggugaccggaga

SEQ ID NO: 283788 - RNA, 64 nt, Homo Sapiens
aacacugcuucuccaggcccgggguuguuggggagagaggcagaggcagcuggagcgccguucu

SEQ ID NO: 283789 - RNA, 64 nt, Homo Sapiens
aagaugcucggauucacucugugaccgcauaugugagaggcagagagggcgaguggcugcgaga

SEQ ID NO: 283790 - RNA, 64 nt, Homo Sapiens
ggcccuuccuuccccacuucuaagccaaagaaaggagaggcaggugcuccuguaccccagcccc

SEQ ID NO: 283791 - RNA, 64 nt, Homo Sapiens
uaugagagagagagagagagacaacagagacagagagaggcagagaggcauagagagacagaga

SEQ ID NO: 283792 - RNA, 64 nt, Homo Sapiens
agagagagagagacaacagagacagagagaggcagagaggcauagagagacagagagagagaca

SEQ ID NO: 283793 - RNA, 64 nt, Homo Sapiens
guaauuacuuuuauuaauuuaaaauagaacgcuugagaggcacuuuguaaagauuuguuaaacu

SEQ ID NO: 283794 - RNA, 64 nt, Homo Sapiens
uaaaauagaaugcuuaaaauaaaauagaaugcuugagaggcacugaguaaagauuuguugaacu

SEQ ID NO: 283795 - RNA, 64 nt, Homo Sapiens
cuaugcugccagaauucccacaggcuggggaacagagaggcacgcaagaagagugguuugugcu

SEQ ID NO: 283796 - RNA, 64 nt, Homo Sapiens
guaucugaacaagaaucuauaaucucuggcaacagagaggcaaaucuucccuuacccccuuaca

SEQ ID NO: 283797 - RNA, 64 nt, Homo Sapiens
gagacagagagggagagagggaggcagagagggagagaggcagagagagaggcagagagggaga

SEQ ID NO: 283798 - RNA, 64 nt, Homo Sapiens
gagggagagaggcagagagagaggcagagagggagagaggcagagagacaggcagagaaggaga

SEQ ID NO: 283799 - RNA, 64 nt, Homo Sapiens
gagggagagaggcagagaggcaggcagagaaggagagaggcagagaggcagagaaggaaagaga

SEQ ID NO: 283800 - RNA, 64 nt, Homo Sapiens
gagggaaagaggcagagaaggagacagaggggaagagaggcagagagagagacagagggagaga

SEQ ID NO: 283801 - RNA, 64 nt, Homo Sapiens
ugccaacuacuugcuuucccaagacaccagguuggagaggcaccgcccagggcaaggaugccca

SEQ ID NO: 283802 - RNA, 64 nt, Homo Sapiens
gcaccugagugguugggacaagguggauucuguugagaggcaaacauaccuagcagggaacugc

SEQ ID NO: 283803 - RNA, 64 nt, Homo Sapiens
ggcgggcgaggcggccacagcguggggcuaagccgagaggcacagugccccagcuugagcugga

SEQ ID NO: 283804 - RNA, 64 nt, Homo Sapiens
ugagguggcccugaagaugcgguggaggcccggggagaggcacccuggccuugccgggugcaga

SEQ ID NO: 283805 - RNA, 64 nt, Homo Sapiens
gccagugugccaccaggcugcacaggucuaagaggagaggcagaucuuggucacugcugagacc

SEQ ID NO: 283806 - RNA, 64 nt, Homo Sapiens
ucccacacuccuauggucacggccugguuuccucgagaggcaccgccugcacccuuccacagcu

SEQ ID NO: 283807 - RNA, 64 nt, Homo Sapiens
aaggauccuccccuagagcccccccaggagcugggagaggcaggaagcccagggacaccuggag

SEQ ID NO: 283808 - RNA, 64 nt, Homo Sapiens
aaggacccuccccuagagucuccccaggagcugggagaggcaggaagcccagggaugccuggag

SEQ ID NO: 283809 - RNA, 64 nt, Homo Sapiens; identical to SEQ ID NO: 223465

SEQ ID NO: 283810 - RNA, 64 nt, Homo Sapiens; identical to SEQ ID NO: 223466

SEQ ID NO: 283811 - RNA, 64 nt, Homo Sapiens; identical to SEQ ID NO: 223467

SEQ ID NO: 283812 - RNA, 64 nt, Homo Sapiens; identical to SEQ ID NO: 223468

SEQ ID NO: 283813 - RNA, 64 nt, Homo Sapiens; identical to SEQ ID NO: 223469

SEQ ID NO: 283814 - RNA, 64 nt, Homo Sapiens; identical to SEQ ID NO: 223470

SEQ ID NO: 283815 - RNA, 64 nt, Homo Sapiens; identical to SEQ ID NO: 223471

SEQ ID NO: 283816 - RNA, 64 nt, Homo Sapiens; identical to SEQ ID NO: 223472

SEQ ID NO: 283817 - RNA, 64 nt, Homo Sapiens; identical to SEQ ID NO: 223473

SEQ ID NO: 283818 - RNA, 64 nt, Homo Sapiens; identical to SEQ ID NO: 223474

SEQ ID NO: 283819 - RNA, 64 nt, Homo Sapiens; identical to SEQ ID NO: 223475

SEQ ID NO: 283820 - RNA, 64 nt, Homo Sapiens; identical to SEQ ID NO: 223476

SEQ ID NO: 283821 - RNA, 64 nt, Homo Sapiens; identical to SEQ ID NO: 223477

SEQ ID NO: 283822 - RNA, 64 nt, Homo Sapiens; identical to SEQ ID NO: 223478

SEQ ID NO: 283823 - RNA, 64 nt, Homo Sapiens; identical to SEQ ID NO: 223479

SEQ ID NO: 283824 - RNA, 64 nt, Homo Sapiens; identical to SEQ ID NO: 223480

SEQ ID NO: 283825 - RNA, 64 nt, Homo Sapiens; identical to SEQ ID NO: 223481

SEQ ID NO: 283826 - RNA, 64 nt, Homo Sapiens; identical to SEQ ID NO: 223482

SEQ ID NO: 283827 - RNA, 64 nt, Homo Sapiens; identical to SEQ ID NO: 223483

SEQ ID NO: 283828 - RNA, 64 nt, Homo Sapiens; identical to SEQ ID NO: 223484

SEQ ID NO: 283829 - RNA, 64 nt, Homo Sapiens; identical to SEQ ID NO: 223485

SEQ ID NO: 283830 - RNA, 64 nt, Homo Sapiens; identical to SEQ ID NO: 223486

SEQ ID NO: 283831 - RNA, 64 nt, Homo Sapiens; identical to SEQ ID NO: 223487

SEQ ID NO: 283832 - RNA, 64 nt, Homo Sapiens; identical to SEQ ID NO: 223488

SEQ ID NO: 283833 - RNA, 64 nt, Homo Sapiens; identical to SEQ ID NO: 223489

SEQ ID NO: 283834 - RNA, 64 nt, Homo Sapiens; identical to SEQ ID NO: 223490

SEQ ID NO: 283835 - RNA, 64 nt, Homo Sapiens; identical to SEQ ID NO: 223491

SEQ ID NO: 283836 - RNA, 64 nt, Homo Sapiens; identical to SEQ ID NO: 223492

SEQ ID NO: 283837 - RNA, 64 nt, Homo Sapiens; identical to SEQ ID NO: 223493

SEQ ID NO: 283838 - RNA, 64 nt, Homo Sapiens; identical to SEQ ID NO: 223494

SEQ ID NO: 283839 - RNA, 64 nt, Homo Sapiens; identical to SEQ ID NO: 223495

SEQ ID NO: 283840 - RNA, 64 nt, Homo Sapiens; identical to SEQ ID NO: 223496

SEQ ID NO: 283841 - RNA, 64 nt, Homo Sapiens; identical to SEQ ID NO: 223497

SEQ ID NO: 283842 - RNA, 64 nt, Homo Sapiens; identical to SEQ ID NO: 223498

SEQ ID NO: 283843 - RNA, 64 nt, Homo Sapiens; identical to SEQ ID NO: 223499

SEQ ID NO: 283844 - RNA, 64 nt, Homo Sapiens; identical to SEQ ID NO: 223500

SEQ ID NO: 283845 - RNA, 64 nt, Homo Sapiens; identical to SEQ ID NO: 223501

SEQ ID NO: 283846 - RNA, 64 nt, Homo Sapiens; identical to SEQ ID NO: 223502

SEQ ID NO: 283847 - RNA, 64 nt, Homo Sapiens; identical to SEQ ID NO: 223503

SEQ ID NO: 283848 - RNA, 64 nt, Homo Sapiens; identical to SEQ ID NO: 223504

SEQ ID NO: 283849 - RNA, 64 nt, Homo Sapiens; identical to SEQ ID NO: 223505

SEQ ID NO: 283850 - RNA, 64 nt, Homo Sapiens; identical to SEQ ID NO: 223506

SEQ ID NO: 283851 - RNA, 64 nt, Homo Sapiens; identical to SEQ ID NO: 223507

SEQ ID NO: 283852 - RNA, 64 nt, Homo Sapiens; identical to SEQ ID NO: 223508

SEQ ID NO: 283853 - RNA, 64 nt, Homo Sapiens; identical to SEQ ID NO: 223509

SEQ ID NO: 283854 - RNA, 64 nt, Homo Sapiens; identical to SEQ ID NO: 223510

SEQ ID NO: 283855 - RNA, 64 nt, Homo Sapiens; identical to SEQ ID NO: 223511

SEQ ID NO: 283856 - RNA, 64 nt, Homo Sapiens; identical to SEQ ID NO: 223512

SEQ ID NO: 283857 - RNA, 64 nt, Homo Sapiens; identical to SEQ ID NO: 223513

SEQ ID NO: 283858 - RNA, 64 nt, Homo Sapiens; identical to SEQ ID NO: 223514

SEQ ID NO: 283859 - RNA, 64 nt, Homo Sapiens; identical to SEQ ID NO: 223515

SEQ ID NO: 283860 - RNA, 64 nt, Homo Sapiens; identical to SEQ ID NO: 223516

SEQ ID NO: 283861 - RNA, 64 nt, Homo Sapiens; identical to SEQ ID NO: 223517

SEQ ID NO: 283862 - RNA, 64 nt, Homo Sapiens; identical to SEQ ID NO: 223518

SEQ ID NO: 283863 - RNA, 64 nt, Homo Sapiens; identical to SEQ ID NO: 223519

SEQ ID NO: 283864 - RNA, 64 nt, Homo Sapiens; identical to SEQ ID NO: 223520

SEQ ID NO: 283865 - RNA, 64 nt, Homo Sapiens; identical to SEQ ID NO: 223521

SEQ ID NO: 283866 - RNA, 64 nt, Homo Sapiens; identical to SEQ ID NO: 223522

SEQ ID NO: 283867 - RNA, 64 nt, Homo Sapiens; identical to SEQ ID NO: 223523

SEQ ID NO: 283868 - RNA, 64 nt, Homo Sapiens; identical to SEQ ID NO: 223524

SEQ ID NO: 283869 - RNA, 64 nt, Homo Sapiens; identical to SEQ ID NO: 223525

SEQ ID NO: 283870 - RNA, 64 nt, Homo Sapiens; identical to SEQ ID NO: 223526

SEQ ID NO: 283871 - RNA, 64 nt, Homo Sapiens; identical to SEQ ID NO: 223527

SEQ ID NO: 283872 - RNA, 64 nt, Homo Sapiens; identical to SEQ ID NO: 223528

SEQ ID NO: 283873 - RNA, 64 nt, Homo Sapiens; identical to SEQ ID NO: 223529

SEQ ID NO: 283874 - RNA, 64 nt, Homo Sapiens; identical to SEQ ID NO: 223530

SEQ ID NO: 283875 - RNA, 64 nt, Homo Sapiens; identical to SEQ ID NO: 223531

SEQ ID NO: 283876 - RNA, 64 nt, Homo Sapiens; identical to SEQ ID NO: 223532

SEQ ID NO: 283877 - RNA, 64 nt, Homo Sapiens; identical to SEQ ID NO: 223533

SEQ ID NO: 283878 - RNA, 64 nt, Homo Sapiens; identical to SEQ ID NO: 223534

SEQ ID NO: 283879 - RNA, 64 nt, Homo Sapiens; identical to SEQ ID NO: 223535

SEQ ID NO: 283880 - RNA, 64 nt, Homo Sapiens; identical to SEQ ID NO: 223536

SEQ ID NO: 283881 - RNA, 64 nt, Homo Sapiens; identical to SEQ ID NO: 223537

SEQ ID NO: 283882 - RNA, 64 nt, Homo Sapiens; identical to SEQ ID NO: 223538

SEQ ID NO: 283883 - RNA, 64 nt, Homo Sapiens; identical to SEQ ID NO: 223539

SEQ ID NO: 283884 - RNA, 64 nt, Homo Sapiens; identical to SEQ ID NO: 223540

SEQ ID NO: 283885 - RNA, 64 nt, Homo Sapiens; identical to SEQ ID NO: 223541

SEQ ID NO: 283886 - RNA, 64 nt, Homo Sapiens; identical to SEQ ID NO: 223542

SEQ ID NO: 283887 - RNA, 64 nt, Homo Sapiens; identical to SEQ ID NO: 223543

SEQ ID NO: 283888 - RNA, 64 nt, Homo Sapiens; identical to SEQ ID NO: 223544

SEQ ID NO: 283889 - RNA, 64 nt, Homo Sapiens; identical to SEQ ID NO: 223545

SEQ ID NO: 283890 - RNA, 64 nt, Homo Sapiens; identical to SEQ ID NO: 223546

SEQ ID NO: 283891 - RNA, 64 nt, Homo Sapiens; identical to SEQ ID NO: 223547

SEQ ID NO: 283892 - RNA, 64 nt, Homo Sapiens; identical to SEQ ID NO: 223548

SEQ ID NO: 283893 - RNA, 64 nt, Homo Sapiens; identical to SEQ ID NO: 223549

SEQ ID NO: 283894 - RNA, 64 nt, Homo Sapiens; identical to SEQ ID NO: 223550

SEQ ID NO: 283895 - RNA, 64 nt, Homo Sapiens; identical to SEQ ID NO: 223551

SEQ ID NO: 283896 - RNA, 64 nt, Homo Sapiens; identical to SEQ ID NO: 223552

SEQ ID NO: 283897 - RNA, 64 nt, Homo Sapiens; identical to SEQ ID NO: 223553

SEQ ID NO: 283898 - RNA, 64 nt, Homo Sapiens; identical to SEQ ID NO: 223554

SEQ ID NO: 283899 - RNA, 64 nt, Homo Sapiens; identical to SEQ ID NO: 223555

SEQ ID NO: 283900 - RNA, 64 nt, Homo Sapiens; identical to SEQ ID NO: 223556

SEQ ID NO: 283901 - RNA, 64 nt, Homo Sapiens; identical to SEQ ID NO: 223557

SEQ ID NO: 283902 - RNA, 64 nt, Homo Sapiens; identical to SEQ ID NO: 223558

SEQ ID NO: 283903 - RNA, 64 nt, Homo Sapiens; identical to SEQ ID NO: 223559

SEQ ID NO: 283904 - RNA, 64 nt, Homo Sapiens; identical to SEQ ID NO: 223560

SEQ ID NO: 283905 - RNA, 64 nt, Homo Sapiens; identical to SEQ ID NO: 223561

SEQ ID NO: 283906 - RNA, 64 nt, Homo Sapiens; identical to SEQ ID NO: 223562

SEQ ID NO: 283907 - RNA, 64 nt, Homo Sapiens; identical to SEQ ID NO: 223563

SEQ ID NO: 283908 - RNA, 64 nt, Homo Sapiens; identical to SEQ ID NO: 223564

SEQ ID NO: 283909 - RNA, 64 nt, Homo Sapiens; identical to SEQ ID NO: 223565

SEQ ID NO: 283910 - RNA, 64 nt, Homo Sapiens; identical to SEQ ID NO: 223566

SEQ ID NO: 283911 - RNA, 64 nt, Homo Sapiens; identical to SEQ ID NO: 223567

SEQ ID NO: 283912 - RNA, 64 nt, Homo Sapiens; identical to SEQ ID NO: 223568

SEQ ID NO: 283913 - RNA, 64 nt, Homo Sapiens; identical to SEQ ID NO: 223569

SEQ ID NO: 283914 - RNA, 64 nt, Homo Sapiens; identical to SEQ ID NO: 223570

SEQ ID NO: 283915 - RNA, 64 nt, Homo Sapiens; identical to SEQ ID NO: 223571

SEQ ID NO: 283916 - RNA, 64 nt, Homo Sapiens
agcguagacagguguuacuucugggaguuauaggucaugggaaggcggccauaagaggugaucu

SEQ ID NO: 283917 - RNA, 64 nt, Homo Sapiens
acagaccugugugugccuccucuuuccuccugcuucaugggaaauucuagaaucucguuucucc

SEQ ID NO: 283918 - RNA, 64 nt, Homo Sapiens
caggaugguaaauuggauugguggauccaccauaucaugggauuuaaauuuaucauaaccaugu

SEQ ID NO: 283919 - RNA, 64 nt, Homo Sapiens
uuuugauaaaacuuuauucacaaaaacagccgggucaugggauuuggcuugugagucuguaaca

SEQ ID NO: 283920 - RNA, 64 nt, Homo Sapiens
cacuaaaccguuccgccgcccacccucugcuagacacagccaaggccaacgaggcaagcagaag

SEQ ID NO: 283921 - RNA, 64 nt, Homo Sapiens
aguaugucugccgguuucaacacacacagacaaacacagccacacgcgcacacaaguauaagac

SEQ ID NO: 283922 - RNA, 64 nt, Homo Sapiens
cucugcgccgcagcuggacgccaccuccgacggacacagccagccccuuccugcugccaaggug

SEQ ID NO: 283923 - RNA, 64 nt, Homo Sapiens
uuuaaaaauauaagcucacaugccuuuucccugccacagccaaacccccacugcacccuaccca

SEQ ID NO: 283924 - RNA, 64 nt, Homo Sapiens
ugucaucuaggacacguccaaaggagugcauggccacagccaccuccacccccaagaaaccucc

SEQ ID NO: 283925 - RNA, 64 nt, Homo Sapiens
uacacacacacacacacacacacacacacacacacacagccauucaucugggcuggcagagggg

SEQ ID NO: 283926 - RNA, 64 nt, Homo Sapiens
cccuccaggaacauucccacauaauacauuccaucacagccagcccagcuccacucagggcugg

SEQ ID NO: 283927 - RNA, 64 nt, Homo Sapiens
ggcucuucccuugggggccuccuuucaucuggggcacagccacaagucucaucucuaacguucu

SEQ ID NO: 283928 - RNA, 64 nt, Homo Sapiens
agggcaccacgcaagggcagagcugggcggcauccacagccagagaggcagaggcaagagcaga

SEQ ID NO: 283929 - RNA, 64 nt, Homo Sapiens
uggagagaagcuuccagaccagcccuucacacaccacagccaggaggggccuuucccaccugga

SEQ ID NO: 283930 - RNA, 64 nt, Homo Sapiens
ccuggagagaaacuuccagaccagccccucauaccacagccaagaggggccuuucucaccugga

SEQ ID NO: 283931 - RNA, 64 nt, Homo Sapiens
ccuggagagaaauuuccagaccauccccucucaccacagccaggagaggccuuucccaccggua

SEQ ID NO: 283932 - RNA, 64 nt, Homo Sapiens
ccgguagagaaacuuccagaccagccccucacaccacagccaagagaagccuuuccagccugga

SEQ ID NO: 283933 - RNA, 64 nt, Homo Sapiens
cgccuggaaacuuccggacaagccucucacacaccacagccaggagaggccuuucccaccugga

SEQ ID NO: 283934 - RNA, 64 nt, Homo Sapiens
ccuggacagaaacuuccagaccagccccucucaccacagccaggagaggccuuuaccaccugga

SEQ ID NO: 283935 - RNA, 64 nt, Homo Sapiens
ccuggagagaagcuuccagaccagccccucacaccacagccaggagaggccuuucccaccugga

SEQ ID NO: 283936 - RNA, 64 nt, Homo Sapiens; identical to SEQ ID NO: 283930

SEQ ID NO: 283937 - RNA, 64 nt, Homo Sapiens
ccgggagagaaacuuccagaccagccccucacaccacagccaggagaggccuuucccaccggga

SEQ ID NO: 283938 - RNA, 64 nt, Homo Sapiens
ccgggagaggaacuuccagaccagccccucacaccacagccaggagaggccuuucccgccugga

SEQ ID NO: 283939 - RNA, 64 nt, Homo Sapiens
gccuggagagaagcuucaggccagcuccucacaccacagccaggagagaccuuuucugccugga

SEQ ID NO: 283940 - RNA, 64 nt, Homo Sapiens
ccuggagagaaacuuucagaccagccccacacaccacagccaggagaggccguuccugccugga

SEQ ID NO: 283941 - RNA, 64 nt, Homo Sapiens
ccuggagagaagcuuccagaccagcccuucacaccacagccaggagaggccuuucccaccugga

SEQ ID NO: 283942 - RNA, 64 nt, Homo Sapiens
ccuggagagaaacuuccagaccagccccucucaccacagccaggagaggccguucccaccugga

SEQ ID NO: 283943 - RNA, 64 nt, Homo Sapiens
aaacaccagugauuucacacucuccggauggaaucacagccaaucggggccccugcguguguuc

SEQ ID NO: 283944 - RNA, 64 nt, Homo Sapiens
gcagacggggggcugcgggccccgcacucaggagcacagccauaggcggugggcgccugucggg

SEQ ID NO: 283945 - RNA, 60 nt, Homo Sapiens
accuccagaacaccagguagccguggccaccacagccagacugaacguuugugaaagcug

SEQ ID NO: 283946 - RNA, 64 nt, Homo Sapiens
aguuagggcauuguccuacacauuggcccaguaucacagccaagacgagaagucauuucccagc

SEQ ID NO: 283947 - RNA, 64 nt, Homo Sapiens
cgugugaccugcugggccguggcacgcacacagccacagccacagcacacugccacugucccuu

SEQ ID NO: 283948 - RNA, 64 nt, Homo Sapiens
gccacacgugugaccugcugucccuuggcacgcacacagccacaacaauggcacacugccacug

SEQ ID NO: 283949 - RNA, 64 nt, Homo Sapiens
accuggauggaucugcuccaccucccuccuggcucacagccaccgccccagagaagccucaguc

SEQ ID NO: 283950 - RNA, 64 nt, Homo Sapiens
aacugaacuggccgcugggaugcccccuggggggcacagccagacagauugcggugugagaugg

SEQ ID NO: 283951 - RNA, 64 nt, Homo Sapiens
uugagucuguggucccuggacggugggucuccaccacagccacuuugacaucacccuacccagg

SEQ ID NO: 283952 - RNA, 64 nt, Homo Sapiens
caucucccauucacauggccagaugccuggacagcacagccaccuaucccccaauguugucagc

SEQ ID NO: 283953 - RNA, 64 nt, Homo Sapiens
cccccugauucuggaacucgggaggccacagccacacagccacgguaagccccgcccaccccac

SEQ ID NO: 283954 - RNA, 64 nt, Homo Sapiens
cagccacgcccccugauucucaccccacggaggccacagccacacccggcauguaagccccgcc

SEQ ID NO: 283955 - RNA, 64 nt, Homo Sapiens
agagauacacuuugguaggcugaggccccuguuccacagccacuauuugcauugcugucccugc

SEQ ID NO: 283956 - RNA, 64 nt, Homo Sapiens
ccuuccacaucuacagggucacugucauccucaccacagccaggggugauucucaccucugccu

SEQ ID NO: 283957 - RNA, 64 nt, Homo Sapiens
agccaagggagaaugcugcugguuuggcccauggcacagccagcuucucugaccaguaauccgg

SEQ ID NO: 283958 - RNA, 64 nt, Homo Sapiens
ugagcucccuuccaaaggaucguuccucucauugcacagccauauuacaaaggguuuccugcuc

SEQ ID NO: 283959 - RNA, 64 nt, Homo Sapiens
agcccaggcugcccugcacuccugccucccagcccacagccaggugcuuucaucacagcuaaac

SEQ ID NO: 283960 - RNA, 64 nt, Homo Sapiens
gaaagcagccagcucaucccagugacucacaggacacagccauccagcggcaucuuuccuuguc

SEQ ID NO: 283961 - RNA, 64 nt, Homo Sapiens
gcugaggaguggccgggcaggccaugcccacagccacagccacacccagugugcacgccguccg

SEQ ID NO: 283962 - RNA, 64 nt, Homo Sapiens
gccacagcugaggaguggcccguccggccaugcccacagccacaggacggcccagugugcacgc

SEQ ID NO: 283963 - RNA, 64 nt, Homo Sapiens
ccuccaggcuuuccugcccugggcagccccaccucacagccagagucaaugccuucaugggaag

SEQ ID NO: 283964 - RNA, 64 nt, Homo Sapiens
cacacgcuuguucacacucagaacccaggacagccacagccaccgcuuaggggaagccacugca

SEQ ID NO: 283965 - RNA, 64 nt, Homo Sapiens
gaagccacugcagaugccccuggaaugggcacagcacagccagggcgcucuuccaggcaggcga

SEQ ID NO: 283966 - RNA, 64 nt, Homo Sapiens
gagagagagagggagucaaggugugaccgucgaccacagccagugucaggccucugccucuggg

SEQ ID NO: 283967 - RNA, 64 nt, Homo Sapiens
agaaggaaagaagccuggagcagccucuccuguccacagccagggguuaggucugcaggcccgu

SEQ ID NO: 283968 - RNA, 64 nt, Homo Sapiens
aguccuaugccuugaaauaucaugcaccaugacccacagccaucugguuaugucuuauuuuuuu

SEQ ID NO: 283969 - RNA, 64 nt, Homo Sapiens
uggugguuucugugagaauuggccauccugaggacacagccaggacggcagaggccuccuggcc

SEQ ID NO: 283970 - RNA, 64 nt, Homo Sapiens
ccuccccucaccccaacucuagguuuccaggccucacagccaagcugaagcuuggagaaaacuc

SEQ ID NO: 283971 - RNA, 64 nt, Homo Sapiens
ugcuuuuauucuuccagcuaccacuugggcacuucacagccagccuagggucuucggcaccucc

SEQ ID NO: 283972 - RNA, 64 nt, Homo Sapiens
gcagccacgaggugcaacaagguccucugucagucacagccaccccugagauccggcaacauca

SEQ ID NO: 283973 - RNA, 64 nt, Homo Sapiens
aaguggacucagggcagcgccaggcugaccacagcacagccaacacgcaccugccucaggacug

SEQ ID NO: 283974 - RNA, 64 nt, Homo Sapiens
agacuggcuggaaaugcucugacuccugugaaggcacagccagcguuguggccugagggaggcc

SEQ ID NO: 283975 - RNA, 64 nt, Homo Sapiens
caguagcuguguguccgaggucagugugcggaaucacagccaaggacgugaagagauguacggg

SEQ ID NO: 283976 - RNA, 64 nt, Homo Sapiens
ccugugccuugagacagcagccuaucuggggccacacagccaacccagcccuggucccugaggu

SEQ ID NO: 283977 - RNA, 64 nt, Homo Sapiens
uugggccuagagccacuucuuaccaggcaacgggcacagccacccuggcacacccucugccugg

SEQ ID NO: 283978 - RNA, 64 nt, Homo Sapiens
gagaacagagcucagagcacccaguguagggaaacacagccagaccacuguggugacagacuuu

SEQ ID NO: 283979 - RNA, 64 nt, Homo Sapiens
aucacgagguguaauuuuuauuuuccacguacuccacagccaacguaauuuuuuuguucuauuu

SEQ ID NO: 283980 - RNA, 64 nt, Homo Sapiens
cucuucaacgguuaccaaaccagagggacaaagccacagccacagcuucaaauggccaauugug

SEQ ID NO: 283981 - RNA, 64 nt, Homo Sapiens
ccaccgcggggccucagugggggucucuggggaacacagccagacauccugauggggaggcaga

SEQ ID NO: 283982 - RNA, 64 nt, Homo Sapiens
ucccuuggccucagagcugccccugcucucccaccacagccacccagaggcaccccaugaagcu

SEQ ID NO: 283983 - RNA, 64 nt, Homo Sapiens
gccugugaggagcugccuucucugcaucaccacacacagccagacccuaagccccacagccagc

SEQ ID NO: 283984 - RNA, 64 nt, Homo Sapiens
ucugcaucaccacacacagccacucccuaagccccacagccagcagagcaaggagagggcuccc

SEQ ID NO: 283985 - RNA, 64 nt, Homo Sapiens
aaaagccaucuauucuucugcagccucaggagcgagacuucaaggacucaguuugguuccaccc

SEQ ID NO: 283986 - RNA, 64 nt, Homo Sapiens
cgcaccacugcacuccagccuaggagacaaaacgagacuucauuuaaaaaaaauaaaaauaaaa

SEQ ID NO: 283987 - RNA, 64 nt, Homo Sapiens
uuuagugauugacaagcaaaaaauacuuauaaaaagacuucauuuauauauuguaacuuaaaga

SEQ ID NO: 283988 - RNA, 64 nt, Homo Sapiens
aaggauaguuagaaagguuugauguugcaugggcagacuucaaagggcuucugcuugccucgcu

SEQ ID NO: 283989 - RNA, 64 nt, Homo Sapiens
ggccauaagaacaguggaagaggagcauggacucagacuucaaggaagaagccauuuccccagg

SEQ ID NO: 283990 - RNA, 64 nt, Homo Sapiens
ucauuuccauuuuguuugugauauuuagacgcgcagacuucaggaaguucaccuuuaacuucag

SEQ ID NO: 283991 - RNA, 64 nt, Homo Sapiens
gcccaguaguacugcggccaaggggacaguuaggagacuucaucuaaagcaugaaaccuagcuc

SEQ ID NO: 283992 - RNA, 64 nt, Homo Sapiens
uuaacuugaaaauuugaaaauauuuaauguugaaagacuucaauuagggcuauuagaguuauau

SEQ ID NO: 283993 - RNA, 64 nt, Homo Sapiens
uagagaaguguauaagucugaggacagauuagaaagacuucaggaaauucuaaggaaauuucug

SEQ ID NO: 283994 - RNA, 64 nt, Homo Sapiens
gagaaaagcccuauacguguagugaauguggaaaagacuucagauugaauucacaucuuauuca

SEQ ID NO: 283995 - RNA, 64 nt, Homo Sapiens
uucuggacucucaugcccccaucuccgaccugggagacuucaggaaugacaaccuacccagccu

SEQ ID NO: 283996 - RNA, 64 nt, Homo Sapiens
cuggcaggaugguggagguuucucaaggagcuggagacuucagggagccccucucauggggagg

SEQ ID NO: 283997 - RNA, 64 nt, Homo Sapiens
gaccacacuguggaaaauacuuuuuuucuugaguagacuucaguaaaaaaaaauucuccacuuu

SEQ ID NO: 283998 - RNA, 64 nt, Homo Sapiens
gggucacuggaaugcuuuguggccauugguaaaaagacuucauagcaauaguuccgggagaauu

SEQ ID NO: 283999 - RNA, 64 nt, Homo Sapiens
cugcauagaaaucuuacaaauugcaagucaucauagacuucauauuuuaaucaacaaucacacc

SEQ ID NO: 284000 - RNA, 64 nt, Homo Sapiens
cuggagagaaaccuuacaaauugcacaucaccauagacuucauauuuuaaucaaaaagcaaccu

SEQ ID NO: 284001 - RNA, 64 nt, Homo Sapiens
ugggguuggggguggggcugcuggggccuccaggcaaggccaagcuccugccguccugcgccug

SEQ ID NO: 284002 - RNA, 64 nt, Homo Sapiens
aggagacagccgugacgguagcccgagggcucagcaaggccaagcuaucuaaguggaacuaauu

SEQ ID NO: 284003 - RNA, 64 nt, Homo Sapiens
aagucggaacaauuccuagcaccugucggaaggucaaggccaaaggcaaauucaaggccagacu

SEQ ID NO: 284004 - RNA, 64 nt, Homo Sapiens
gcaccugucggaaggucaaggccaaaggcaaauucaaggccagacugugacaaacccagggcug

SEQ ID NO: 284005 - RNA, 64 nt, Homo Sapiens
accaagaccuacugaucuggagucccacguuccccaaggccagcgggaugugugccccuccucc

SEQ ID NO: 284006 - RNA, 64 nt, Homo Sapiens
ccuuggggcagguuuuuaaaaauuagcuaggcaucaaggccagaccagggcuggggguugggcu

SEQ ID NO: 284007 - RNA, 64 nt, Homo Sapiens
agcuauuguucuuccacuucguuuucugcugucccaaggccagaugaguggaaucaccaucuga

SEQ ID NO: 284008 - RNA, 64 nt, Homo Sapiens
ucaauugagcaguugugaaaauugcuaauggugccaaggccaagcaaagaguuucagaaaauga

SEQ ID NO: 284009 - RNA, 64 nt, Homo Sapiens
ggugaggacugagggggcugacacugccagucaccaaggccaugacgaggcacuguauaugggg

SEQ ID NO: 284010 - RNA, 64 nt, Homo Sapiens
gccagugcccuacaugggcuugugaugucccugccaaggccauuucaagugccauguguuuugc

SEQ ID NO: 284011 - RNA, 64 nt, Homo Sapiens
uuccaccacuuacuagguuuuacagaucuggguucaaggccaaaaagcacuucggcucuggagu

SEQ ID NO: 284012 - RNA, 64 nt, Homo Sapiens
cccccggcccaccagcuuucauggcuucugaguacaaggccagcccaccccacgugggacuucc

SEQ ID NO: 284013 - RNA, 64 nt, Homo Sapiens
gccgacgcaggaggauugcuugaggccaggaguucaaggccagccuggacaacauaguaagacc

SEQ ID NO: 284014 - RNA, 64 nt, Homo Sapiens
gaagcagaggaucagagaugggaaaggacuagcccaaggccaacauuaacaagcccucuaacaa

SEQ ID NO: 284015 - RNA, 64 nt, Homo Sapiens
ccuucugugaugauaaagccuuggagccuuagcccaaggccauuugcccuugacuccaccuaug

SEQ ID NO: 284016 - RNA, 64 nt, Homo Sapiens
gguuuucaccccucagucaucccaacuccaucuccaaggccaagguuuuuuucucuucauaggu

SEQ ID NO: 284017 - RNA, 64 nt, Homo Sapiens
cccugccccagauccucauacaagaccagcaggccaaggccaagcagaccaagcucaacgccuc

SEQ ID NO: 284018 - RNA, 64 nt, Homo Sapiens
aacccaagccaccccggcucccaaagggaggugccaaggccaggcagccacgcuccaucgccgc

SEQ ID NO: 284019 - RNA, 64 nt, Homo Sapiens
caauagcuuccuuugcuccaauaagcuuugcaaucaaggccaaagaaaaugaucugcuuccccu

SEQ ID NO: 284020 - RNA, 64 nt, Homo Sapiens
agaagaagaggcggucccggucgcggaccaaguccaaggccaggucucagucggugucacccag

SEQ ID NO: 284021 - RNA, 64 nt, Homo Sapiens
ugggcugaugcagcuuugagugcuucucugggagcaaggccacauccaugcccaaacuggcaga

SEQ ID NO: 284022 - RNA, 64 nt, Homo Sapiens
ccuuaagccugccuccaccuagaaccaaaccacccaaggccagcgaugaagaaaacccuguggu

SEQ ID NO: 284023 - RNA, 64 nt, Homo Sapiens
uaauguaccaacuagauacagacagggccaguggcaaggccaucagaaaacuucuucccaaggc

SEQ ID NO: 284024 - RNA, 64 nt, Homo Sapiens
gggccaguggcaaggccaucagaaaacuucuucccaaggccacaccacaccugcaaaaugccua

SEQ ID NO: 284025 - RNA, 64 nt, Homo Sapiens
cucuugucuucagggaauucagaggauugcucuccaaggccauaaugaccccuugccuucccca

SEQ ID NO: 284026 - RNA, 64 nt, Homo Sapiens
gggcccacgaccaagacccuggguguucagaccccaaggccagggccuuucccgcugcaucaag

SEQ ID NO: 284027 - RNA, 64 nt, Homo Sapiens
aggggaccccggccuaggagaccccagccaacaccaaggccacacaggcccauccucaacagcu

SEQ ID NO: 284028 - RNA, 64 nt, Homo Sapiens
cuccaaacacaaucagaaccgcucgggccucacccaaggccaaagcuguagccacagaccccuu

SEQ ID NO: 284029 - RNA, 64 nt, Homo Sapiens
gggauauucugaaacuugaagaggagauccagggcaaggccauuuggaaauuggaagagcacaa

SEQ ID NO: 284030 - RNA, 54 nt, Homo Sapiens
ugcacaucccuggaaggacaacagcaaggccagagcucccuugauggaacuuag

SEQ ID NO: 284031 - RNA, 64 nt, Homo Sapiens
ugacuccuaucacgacgcacuuucucagacaggccaaggccaccauuuucucgcugaaaccaug

SEQ ID NO: 284032 - RNA, 64 nt, Homo Sapiens
agggcaggggaggggaagacaguuccugacugugcaaggccaacggggaguuuucccgcaguuc

SEQ ID NO: 284033 - RNA, 64 nt, Homo Sapiens
gacugcugcccaccuugggacucaggagcucagucaaggccacaggcuggaggagagacggggc

SEQ ID NO: 284034 - RNA, 64 nt, Homo Sapiens
agguaggcgcccugcagccucccugcucccagcccaaggccagucggccugggaaguucacugc

SEQ ID NO: 284035 - RNA, 64 nt, Homo Sapiens
ucucugaucagggugagggauguggaugcaccuacaaggccaacgucuguucacggaggugcgg

SEQ ID NO: 284036 - RNA, 64 nt, Homo Sapiens
cucuacaucauugcuuaauaguuaaaaucaugggcaaggccauuaauuuguugggggucugaug

SEQ ID NO: 284037 - RNA, 64 nt, Homo Sapiens
aguugaguggggcagagggacagggcagccagaccaaggccaagccuucucacccuuggccagc

SEQ ID NO: 284038 - RNA, 64 nt, Homo Sapiens
gccaaagcaacucaacagaugccaaugccaauuccaaggccagccacaacccugccaccuuggg

SEQ ID NO: 284039 - RNA, 64 nt, Homo Sapiens
uccacauaucauugacuguauccuguaauaugcaacggcacagcuaguuuucccgauuuggaua

SEQ ID NO: 284040 - RNA, 64 nt, Homo Sapiens
agcauccagggagguuucucgccccaauagccucacggcacaguacucuugggcaguaacugga

SEQ ID NO: 284041 - RNA, 64 nt, Homo Sapiens
aagaauauauuucuugcucaguuguuucaggcaagcccaagacuuuguaauuuuuaaagggccc

SEQ ID NO: 284042 - RNA, 64 nt, Homo Sapiens
ucaggcaagcccaagacuuuguaauuuuuaaagggcccaagauuuuuuuuuuuuuuuuuuuuuu

SEQ ID NO: 284043 - RNA, 64 nt, Homo Sapiens
aaaucccucacucaaccugcgagucccccacacugcccaagaccacugucccuagacaaaggug

SEQ ID NO: 284044 - RNA, 64 nt, Homo Sapiens
gcaacaagacccccagccuaccugaaggcuucaagcccaagaaucucccaucucaaucauugag

SEQ ID NO: 284045 - RNA, 64 nt, Homo Sapiens
uuucagagugauagagcuccuaacagguguacaggcccaagaguugaaggugauugguuuucuu

SEQ ID NO: 284046 - RNA, 64 nt, Homo Sapiens
gugcugggauuacaggcgugagccacugcuccuggcccaagaucugaugguuuuguaagggaau

SEQ ID NO: 284047 - RNA, 64 nt, Homo Sapiens
ccagagccugggguguucucuuugguguuacacagcccaagaggacugagacuggcacuuagcc

SEQ ID NO: 284048 - RNA, 64 nt, Homo Sapiens
uuacacagcccaagaggacugagacuggcacuuagcccaagaggucugagcccugguguguuuc

SEQ ID NO: 284049 - RNA, 64 nt, Homo Sapiens
ggcaccuggcacccaccuucccugcugccaggaugcccaagaaaaaggucagcuccaccgaagg

SEQ ID NO: 284050 - RNA, 64 nt, Homo Sapiens
aggucagcuccaccgaaggggcugccauggaagagcccaagaggagaucagcgcaauugucagc

SEQ ID NO: 284051 - RNA, 64 nt, Homo Sapiens
ugcacucacacuccuacaacgccuacccaucugggcccaagagccagccucuccuccuacaccg

SEQ ID NO: 284052 - RNA, 64 nt, Homo Sapiens
auuuggcagccaaguggaugugguucccagcacagcccaagauugagcuuuccuacaucuuccg

SEQ ID NO: 284053 - RNA, 64 nt, Homo Sapiens
cggcugaccucauacaucaagccaauaccguguggcccaagacccccaccauaaaucacaucau

SEQ ID NO: 284054 - RNA, 64 nt, Homo Sapiens
uaaaucacaucauuagcaugaaccacccagaguggcccaagacucccagaucagcuaccaggca

SEQ ID NO: 284055 - RNA, 64 nt, Homo Sapiens
gccuaauuuaacagggauuugcacacguccuccagcccaagacugugaggcacuggggaggcag

SEQ ID NO: 284056 - RNA, 64 nt, Homo Sapiens
augagcccaaccaguacacccuauacccucugcugcccaagaaacuuauccaacuagcccuagc

SEQ ID NO: 284057 - RNA, 64 nt, Homo Sapiens
acuacauccacauuauugacccuuuuuuccaaagagcucaaaaccuaauuaauuuauguagagu

SEQ ID NO: 284058 - RNA, 64 nt, Homo Sapiens
aauuaagugggaacauuuuuaggaacucauagcgagcucaaagcuugcuuggacaaaauauucc

SEQ ID NO: 284059 - RNA, 64 nt, Homo Sapiens
cacuccaccugagaaaaaagaaaaaaaaauugauagcucaaaugcauguaauucauaaacacug

SEQ ID NO: 284060 - RNA, 64 nt, Homo Sapiens
ccucaccuaguguccccuuggugacguaugcagcagcucaaauuaaaccuuugugcauuggguu

SEQ ID NO: 284061 - RNA, 64 nt, Homo Sapiens
agaaauuagguuaaaaugccgaaauguauuugaaagcucaaaauauugaucauaaaaccuuuag

SEQ ID NO: 284062 - RNA, 64 nt, Homo Sapiens
cccaauauaaguggaccagucaagguaaacuaacagcucaaauuguuuuuaccaagaaaggugg

SEQ ID NO: 284063 - RNA, 64 nt, Homo Sapiens
agcuguagacguacgcucaggcgcuccugcuguccugggggagagaagguucgccccuccccga

SEQ ID NO: 284064 - RNA, 64 nt, Homo Sapiens
gaggcgacuagggcaccauacucacuuuccagggcugggggaagggggacgcaggaucaucccc

SEQ ID NO: 284065 - RNA, 64 nt, Homo Sapiens
caaccugacaguccaggagauggacuggcuggugcugggggagcugcagauggcccuggagugg

SEQ ID NO: 284066 - RNA, 64 nt, Homo Sapiens
ccucucaacaguggggucgggggcccacccccagcugggggaccccaugcaggcugaugggccc

SEQ ID NO: 284067 - RNA, 64 nt, Homo Sapiens
agccaagcccucaccccacagaucacucugugcccugggggagggaacgggucacccugcugaa

SEQ ID NO: 284068 - RNA, 64 nt, Homo Sapiens
caggcaggggaagggcagaggcccggcucauggucugggggaugcccugaaugcauuggccggu

SEQ ID NO: 284069 - RNA, 64 nt, Homo Sapiens
gucacugcuacaccuuagcagcucuuccccuuuccugggggaugugcacggcagcuugagccug

SEQ ID NO: 284070 - RNA, 64 nt, Homo Sapiens
cugucacguggucaaggcccggccccaucagaggcugggggaggcggcacauuggcaguguguc

SEQ ID NO: 284071 - RNA, 64 nt, Homo Sapiens
auccccauccucugccucaucguuccccugagcacugggggacagacccucacccccacccugg

SEQ ID NO: 284072 - RNA, 64 nt, Homo Sapiens
gguguuggggggcccccuuccaugacucuguccccugggggagguaggacagggcugggcuucc

SEQ ID NO: 284073 - RNA, 57 nt, Homo Sapiens
ugcagacgcccguccagugaacucgagcugggggaggggcagagcgcggggcucccc

SEQ ID NO: 284074 - RNA, 64 nt, Homo Sapiens
gccacaaaguaaacuucauuuucaggcaguguuucugggggagguuauggagggaagaaaaaag

SEQ ID NO: 284075 - RNA, 64 nt, Homo Sapiens
gcacagcagugaucaagugucaucccuuacgugacugggggaugucuguccuaaaagcugacug

SEQ ID NO: 284076 - RNA, 64 nt, Homo Sapiens
ugaccguaaguaaaaacacacagaauuguguugacugggggaggugaaucacaaaaaaguuacg

SEQ ID NO: 284077 - RNA, 64 nt, Homo Sapiens
auagcuccccaagagcuggcagaacuuaacccaccugggggaaaauccuguuguauacuaggag

SEQ ID NO: 284078 - RNA, 64 nt, Homo Sapiens
gcagggaggaggcacuucuuggcagggaguaauccugggggacagauguggggagaguggaaga

SEQ ID NO: 284079 - RNA, 64 nt, Homo Sapiens
agugggccuccuuagggagauccccccuggcuuucugggggaggccugggugaugagcagcuuu

SEQ ID NO: 284080 - RNA, 64 nt, Homo Sapiens
cguuucugccacccuggguggggcagcccaacugcugggggagaagaggccugguggcccugcu

SEQ ID NO: 284081 - RNA, 64 nt, Homo Sapiens
auauaugucuuaguggacagaguuugcccaggaacugggggaucgucugcagugaauguucaac

SEQ ID NO: 284082 - RNA, 64 nt, Homo Sapiens
gacuguugugggaacgucccgcaugaagggcagccugggggacaaagcgcagugcaugcugggu

SEQ ID NO: 284083 - RNA, 64 nt, Homo Sapiens
ugugugucgugcuuuuuaccaucuugggaaaguccugggggacgcagcggccuccuguagcacc

SEQ ID NO: 284084 - RNA, 64 nt, Homo Sapiens
ccccagccucccacccuggucccgcaaagugccucugggggaccucccacccuggucccaguuu

SEQ ID NO: 284085 - RNA, 64 nt, Homo Sapiens
cuaggacugagacccuggguggugcccgcaggggcugggggaugcagguggauggaagguucug

SEQ ID NO: 284086 - RNA, 64 nt, Homo Sapiens
uuuuuaaaaguuaaggggcaagcagcauugcauucugggggaacgauccuggccacagccgcca

SEQ ID NO: 284087 - RNA, 64 nt, Homo Sapiens
agcucccgccuugcgggcagugcuaaagguggagcugggggauuuuccugggaaugauuugagg

SEQ ID NO: 284088 - RNA, 64 nt, Homo Sapiens
cgugucacuccugggccaugaugggcucuggcugcugggggagcgugaccugucuggcucagga

SEQ ID NO: 284089 - RNA, 64 nt, Homo Sapiens
agggggucucuggagauguccuacccaggggugucugggggacaugugaagggucagacacagu

SEQ ID NO: 284090 - RNA, 64 nt, Homo Sapiens
ccguggcgaugggcgcugggcaggcuggcccugccugggggagucacuggugacugcugguggg

SEQ ID NO: 284091 - RNA, 55 nt, Homo Sapiens
gugggcuguuguggcugggucccagcugggggacacaaacuuugaggucaucuag

SEQ ID NO: 284092 - RNA, 64 nt, Homo Sapiens
uggaugucagaucugguagguuggcccaugggugcugggggaggcuuggcugccccaggccucc

SEQ ID NO: 284093 - RNA, 64 nt, Homo Sapiens
uuuuagguguugagaugggguguggcugcagagccugggggagcucggcucagcaggaggaggc

SEQ ID NO: 284094 - RNA, 64 nt, Homo Sapiens
cugaguugugucacuucagucauuaggaguggaacugggggaauuacagaaucagggaaagaac

SEQ ID NO: 284095 - RNA, 64 nt, Homo Sapiens
agggaagacgaggaaccccaggagccccucucugcugggggagacaggaggggcgaccagauaa

SEQ ID NO: 284096 - RNA, 64 nt, Homo Sapiens
uucuuccagguggcucccgcugaggcagcggucucugggggaucccccagcugaaggaggcugg

SEQ ID NO: 284097 - RNA, 64 nt, Homo Sapiens
cugcccuguccaggugggaagcugagucccagugcugggggacuguggccugggcugaucuuga

SEQ ID NO: 284098 - RNA, 64 nt, Homo Sapiens
gggaugguugugggucuuucagggagagacagaacugggggaaacucaggagugggcagcaguc

SEQ ID NO: 284099 - RNA, 64 nt, Homo Sapiens
ccuggcuccaaccaaccccuguacugccccaccccugggggaaaagcagucuauaccagcauga

SEQ ID NO: 284100 - RNA, 64 nt, Homo Sapiens
gugcagccagcaugugcaguaccaggaggccacacugggggagcggggcgccuguggggaggga

SEQ ID NO: 284101 - RNA, 64 nt, Homo Sapiens
aggcaaucgcuguagcugccuccggcuggauguucugggggaggagugaggugugauugggccc

SEQ ID NO: 284102 - RNA, 64 nt, Homo Sapiens
gaggggcuggccaggucuggacacgaaaccucaacugggggaguagccagucucacugugaacc

SEQ ID NO: 284103 - RNA, 64 nt, Homo Sapiens
uccagagacuaggccucuccccuuccuuaguagccugggggaugcugagccaggagugaauggc

SEQ ID NO: 284104 - RNA, 64 nt, Homo Sapiens
uucuugauuucacuucugauggaugcauggggcucugggggaaugcugggaaaaugggcaagca

SEQ ID NO: 284105 - RNA, 64 nt, Homo Sapiens
ugucuggccagggagauccaugugcucaauguugcugggggaccuacaaaagucaaacauugcu

SEQ ID NO: 284106 - RNA, 64 nt, Homo Sapiens
uccugccccugcuaccugcuucauuguccauccccugggggagugggucagagguacuggaggg

SEQ ID NO: 284107 - RNA, 64 nt, Homo Sapiens
ggaaaggacacacacaggauaugggagccaggggcugggggagguggaaggggcggggggcggg

SEQ ID NO: 284108 - RNA, 64 nt, Homo Sapiens
cugaaguguuacuugaaccgggggaaucucggaccugggggagccggggugugaggggacugga

SEQ ID NO: 284109 - RNA, 64 nt, Homo Sapiens
cuggugccagccuugaaaguucugcuucucuuggcugggggacuccugcccuuugguucauuuu

SEQ ID NO: 284110 - RNA, 64 nt, Homo Sapiens
cccucugugaaugggucucucccggccucccacccugggggaggagggguuguggggccugaac

SEQ ID NO: 284111 - RNA, 64 nt, Homo Sapiens
ucaccuuccagagaggacagacacagauuuccugcugggggagggaggaguccacgcauccuga

SEQ ID NO: 284112 - RNA, 64 nt, Homo Sapiens
cagaugcccucagaauuggggcaugggaggggggcugggggaccccaugauucagccacggacu

SEQ ID NO: 284113 - RNA, 64 nt, Homo Sapiens
acugaacuugcuauggaaaggacagugugggaggcugggggagcuguguccugcaguucccagg

SEQ ID NO: 284114 - RNA, 64 nt, Homo Sapiens
gccaccuugaccguaggggaaggaggaaugugggcugggggaagaugcccucaacucacccccu

SEQ ID NO: 284115 - RNA, 64 nt, Homo Sapiens
caccugcccucccgggcaguacuggggaccuucccugggggacggggagggaggaggcagcgac

SEQ ID NO: 284116 - RNA, 64 nt, Homo Sapiens
acaggggggucuccccucaccccugcacccccagcugggggagcuggcucugccccgaccuccu

SEQ ID NO: 284117 - RNA, 64 nt, Homo Sapiens
uuuuugauggaauugauuuucccugaguggagugcugggggaaggaggagguccaggccgguag

SEQ ID NO: 284118 - RNA, 64 nt, Homo Sapiens
gcuggcugagauuggggcagcggcucagcagucccugggggaagccauugacguguaccaggcg

SEQ ID NO: 284119 - RNA, 64 nt, Homo Sapiens
gcugcucugggcagggugugcgggccgggcccggcugggggagggcagcucugggcacgccgca

SEQ ID NO: 284120 - RNA, 64 nt, Homo Sapiens
gcagcucugggcacgccgcacccacgccccccaccugggggaaacaggcgguuccugcccgguu

SEQ ID NO: 284121 - RNA, 64 nt, Homo Sapiens
cugaccagcuugggcuccacaugaagcugcaggucugggggacaauggagcuaccguguccagg

SEQ ID NO: 284122 - RNA, 64 nt, Homo Sapiens
gcaguggguucugggggggcccuccuguugaagacugggggagacaugcggccccaggggccuc

SEQ ID NO: 284123 - RNA, 64 nt, Homo Sapiens
cagggcacagggagaugcucggugaaguaguaaacugggggaggaagagcagcagcagcaggau

SEQ ID NO: 284124 - RNA, 64 nt, Homo Sapiens
caggcucacuggccauuuucaguccccuagguggcugggggaggugggaccuuucccucccagg

SEQ ID NO: 284125 - RNA, 64 nt, Homo Sapiens
cagggagagcugcugagccuaaagacuggagaaucugggggacugggagugggggucagagagg

SEQ ID NO: 284126 - RNA, 64 nt, Homo Sapiens
uauggacaggggccugggcuuucuuccaagggcacugggggagccauggcaagguuguagguag

SEQ ID NO: 284127 - RNA, 64 nt, Homo Sapiens
aaugaggugagggggguucugauuacuuuugauccugggggacccccuuuccuuuugguuuugg

SEQ ID NO: 284128 - RNA, 64 nt, Homo Sapiens
ggucugagacucccuuuccucucuccgucggcagcugggggaagggauacuugccaaaaugaga

SEQ ID NO: 284129 - RNA, 64 nt, Homo Sapiens
gggcccacccuuaaaggcggccuuaguccuugggcugggggaggccugcugcagccaccuggug

SEQ ID NO: 284130 - RNA, 64 nt, Homo Sapiens
cccgcggcggccugaacccugacgggcccagaggcugggggagcgcgccuuccacgccccccag

SEQ ID NO: 284131 - RNA, 64 nt, Homo Sapiens; identical to SEQ ID NO: 82929

SEQ ID NO: 284132 - RNA, 64 nt, Homo Sapiens; identical to SEQ ID NO: 82930

SEQ ID NO: 284133 - RNA, 64 nt, Homo Sapiens; identical to SEQ ID NO: 82931

SEQ ID NO: 284134 - RNA, 64 nt, Homo Sapiens; identical to SEQ ID NO: 82932

SEQ ID NO: 284135 - RNA, 64 nt, Homo Sapiens; identical to SEQ ID NO: 82933

SEQ ID NO: 284136 - RNA, 64 nt, Homo Sapiens; identical to SEQ ID NO: 82934

SEQ ID NO: 284137 - RNA, 64 nt, Homo Sapiens; identical to SEQ ID NO: 82935

SEQ ID NO: 284138 - RNA, 64 nt, Homo Sapiens; identical to SEQ ID NO: 82936

SEQ ID NO: 284139 - RNA, 64 nt, Homo Sapiens; identical to SEQ ID NO: 82937

SEQ ID NO: 284140 - RNA, 64 nt, Homo Sapiens; identical to SEQ ID NO: 82938

SEQ ID NO: 284141 - RNA, 64 nt, Homo Sapiens; identical to SEQ ID NO: 82939

SEQ ID NO: 284142 - RNA, 64 nt, Homo Sapiens; identical to SEQ ID NO: 82940

SEQ ID NO: 284143 - RNA, 64 nt, Homo Sapiens; identical to SEQ ID NO: 82941

SEQ ID NO: 284144 - RNA, 64 nt, Homo Sapiens; identical to SEQ ID NO: 82942

SEQ ID NO: 284145 - RNA, 64 nt, Homo Sapiens; identical to SEQ ID NO: 82943

SEQ ID NO: 284146 - RNA, 64 nt, Homo Sapiens; identical to SEQ ID NO: 82944

SEQ ID NO: 284147 - RNA, 64 nt, Homo Sapiens; identical to SEQ ID NO: 82945

SEQ ID NO: 284148 - RNA, 64 nt, Homo Sapiens; identical to SEQ ID NO: 82946

SEQ ID NO: 284149 - RNA, 64 nt, Homo Sapiens; identical to SEQ ID NO: 82947

SEQ ID NO: 284150 - RNA, 64 nt, Homo Sapiens; identical to SEQ ID NO: 82948

SEQ ID NO: 284151 - RNA, 64 nt, Homo Sapiens; identical to SEQ ID NO: 82949

SEQ ID NO: 284152 - RNA, 64 nt, Homo Sapiens; identical to SEQ ID NO: 82950

SEQ ID NO: 284153 - RNA, 64 nt, Homo Sapiens; identical to SEQ ID NO: 82951

SEQ ID NO: 284154 - RNA, 64 nt, Homo Sapiens; identical to SEQ ID NO: 82952

SEQ ID NO: 284155 - RNA, 64 nt, Homo Sapiens; identical to SEQ ID NO: 82953

SEQ ID NO: 284156 - RNA, 64 nt, Homo Sapiens; identical to SEQ ID NO: 82954

SEQ ID NO: 284157 - RNA, 64 nt, Homo Sapiens; identical to SEQ ID NO: 82955

SEQ ID NO: 284158 - RNA, 64 nt, Homo Sapiens; identical to SEQ ID NO: 82956

SEQ ID NO: 284159 - RNA, 64 nt, Homo Sapiens; identical to SEQ ID NO: 82957

SEQ ID NO: 284160 - RNA, 64 nt, Homo Sapiens; identical to SEQ ID NO: 82958

SEQ ID NO: 284161 - RNA, 64 nt, Homo Sapiens; identical to SEQ ID NO: 82959

SEQ ID NO: 284162 - RNA, 64 nt, Homo Sapiens; identical to SEQ ID NO: 82960

SEQ ID NO: 284163 - RNA, 64 nt, Homo Sapiens; identical to SEQ ID NO: 82961

SEQ ID NO: 284164 - RNA, 64 nt, Homo Sapiens; identical to SEQ ID NO: 82962

SEQ ID NO: 284165 - RNA, 64 nt, Homo Sapiens; identical to SEQ ID NO: 82963

SEQ ID NO: 284166 - RNA, 64 nt, Homo Sapiens; identical to SEQ ID NO: 82964

SEQ ID NO: 284167 - RNA, 64 nt, Homo Sapiens; identical to SEQ ID NO: 82965

SEQ ID NO: 284168 - RNA, 64 nt, Homo Sapiens; identical to SEQ ID NO: 82966

SEQ ID NO: 284169 - RNA, 64 nt, Homo Sapiens; identical to SEQ ID NO: 82967

SEQ ID NO: 284170 - RNA, 64 nt, Homo Sapiens; identical to SEQ ID NO: 82968

SEQ ID NO: 284171 - RNA, 64 nt, Homo Sapiens; identical to SEQ ID NO: 82969

SEQ ID NO: 284172 - RNA, 64 nt, Homo Sapiens; identical to SEQ ID NO: 82970

SEQ ID NO: 284173 - RNA, 64 nt, Homo Sapiens; identical to SEQ ID NO: 82971

SEQ ID NO: 284174 - RNA, 64 nt, Homo Sapiens; identical to SEQ ID NO: 82972

SEQ ID NO: 284175 - RNA, 64 nt, Homo Sapiens; identical to SEQ ID NO: 82973

SEQ ID NO: 284176 - RNA, 64 nt, Homo Sapiens; identical to SEQ ID NO: 82974

SEQ ID NO: 284177 - RNA, 64 nt, Homo Sapiens; identical to SEQ ID NO: 82975

SEQ ID NO: 284178 - RNA, 64 nt, Homo Sapiens; identical to SEQ ID NO: 82976

SEQ ID NO: 284179 - RNA, 64 nt, Homo Sapiens; identical to SEQ ID NO: 82977

SEQ ID NO: 284180 - RNA, 64 nt, Homo Sapiens; identical to SEQ ID NO: 82978

SEQ ID NO: 284181 - RNA, 64 nt, Homo Sapiens; identical to SEQ ID NO: 82979

SEQ ID NO: 284182 - RNA, 64 nt, Homo Sapiens; identical to SEQ ID NO: 82980

SEQ ID NO: 284183 - RNA, 64 nt, Homo Sapiens; identical to SEQ ID NO: 82981

SEQ ID NO: 284184 - RNA, 64 nt, Homo Sapiens; identical to SEQ ID NO: 82982

SEQ ID NO: 284185 - RNA, 64 nt, Homo Sapiens
guuucugccaaacggggaccuccauccagagaaaaggaagaaggugcagggugggccaagaggc

SEQ ID NO: 284186 - RNA, 64 nt, Homo Sapiens
cccugggccaucacugcaguggcccugggaggugaggaagaagcuggcuagaggagggggcucc

SEQ ID NO: 284187 - RNA, 64 nt, Homo Sapiens
auucaggauuuuauuggcacaggcccuucuuaguaggaagaaagggugcuuagcuuuggaccug

SEQ ID NO: 284188 - RNA, 64 nt, Homo Sapiens
gaaaacuuuuuuuuagcuucaccgaugacaacagaggaagaagggaacugggauuuggguaagu

SEQ ID NO: 284189 - RNA, 64 nt, Homo Sapiens
cucuugcaaauuaauaaucgaugguaugaguuagaggaagaauucugaacucugucugaguggg

SEQ ID NO: 284190 - RNA, 64 nt, Homo Sapiens
aagaggaagcgcugaauuauccaugaacaaggugaggaagaagaucugcugauggaacagccag

SEQ ID NO: 284191 - RNA, 64 nt, Homo Sapiens
auaaaaucucguguauuccacaucugagaauucuaggaagaauacuguuucuacuaaccuauac

SEQ ID NO: 284192 - RNA, 64 nt, Homo Sapiens
uucuuccccaaaacagaauuuugaucuaaucugcaggaagaauuacacagccuaaauaaggcau

SEQ ID NO: 284193 - RNA, 64 nt, Homo Sapiens
gcuccgccuccgccgcuuagucccaacccugcccaggaagaagggcccguggggcuuugccugu

SEQ ID NO: 284194 - RNA, 64 nt, Homo Sapiens
gaacaguggaagaggagcauggacucagacuucaaggaagaagccauuuccccagguccuuccu

SEQ ID NO: 284195 - RNA, 64 nt, Homo Sapiens
aaaagcagaaaccccugauaggcaagaaaaaaugaggaagaagcaaagacacuucuuacauugu

SEQ ID NO: 284196 - RNA, 64 nt, Homo Sapiens
aaaaguggaaaccccugauaagcaagagaaaaugaggaagaagcaaaggcacuucuuacauggc

SEQ ID NO: 284197 - RNA, 64 nt, Homo Sapiens
agucuaaacuggccaugcuuuuuagaagccagauaggaagaaucacuuuaggagggugcuagac

SEQ ID NO: 284198 - RNA, 64 nt, Homo Sapiens
agaggaagagaagggaaggaagagaagggaagagaggaagaacguugaggcaaguuggaugaac

SEQ ID NO: 284199 - RNA, 64 nt, Homo Sapiens
uuauuaauguuucuuaaaaguuuuugagaaaaaaaggaagaaaccaacucauucagaaggcucg

SEQ ID NO: 284200 - RNA, 64 nt, Homo Sapiens
uucugaucaccuuagaaauggcaguaagcccaaaaggaagaauuaugcugguaguaaaugggac

SEQ ID NO: 284201 - RNA, 64 nt, Homo Sapiens
aacaguaaaaaugacucccauccauccucugacaaggaagaaggugaggccacauccgauucug

SEQ ID NO: 284202 - RNA, 64 nt, Homo Sapiens
aguccgggagaaccauaugaaggagcaggaggagaggaagaaacuuuuuuuccuucuuuuccag

SEQ ID NO: 284203 - RNA, 64 nt, Homo Sapiens
uugcccaagaggcaucucaguacuccagcaauggaggaagaauagagaauuuugccuggcaaug

SEQ ID NO: 284204 - RNA, 64 nt, Homo Sapiens
acuaaauggcagggugaucaaguugcgauucuaaaggaagaagcaaccguuccaagguggggcc

SEQ ID NO: 284205 - RNA, 64 nt, Homo Sapiens
gcuugugcuuaaggacaaagugaucaugucauauaggaagaaugcuauauauaaaucuuuguua

SEQ ID NO: 284206 - RNA, 64 nt, Homo Sapiens
uuuaaagaaaagcuagaggaaaaggcaauauuagaggaagaaaacuggucugccuuguacaaga

SEQ ID NO: 284207 - RNA, 64 nt, Homo Sapiens
ugccugucggggcucacuugaaucccacaccaucaggaagaaggccuacgucugacuccucucc

SEQ ID NO: 284208 - RNA, 64 nt, Homo Sapiens
aaaaacuguuucaucauuucgcaggaggaagaaaaggaagaaagaugacaguugcccuuucaaa

SEQ ID NO: 284209 - RNA, 64 nt, Homo Sapiens
ggaagaaagaaaaacuguuuccuuucaaagcaggaggaagaaaaauaucccucaugacaguugc

SEQ ID NO: 284210 - RNA, 64 nt, Homo Sapiens
auaauauaagaaaggaaauuucuaaaaaaaccuaaggaagaauaauucaggaagaaaugaccug

SEQ ID NO: 284211 - RNA, 64 nt, Homo Sapiens
gaccugucuaaaaaaaccuaaaggaaaaucauucaggaagaaauaaaaauaaaaauaaaagaaa

SEQ ID NO: 284212 - RNA, 64 nt, Homo Sapiens
aaaaucaacccauccauagagccacuuaauuuagaggaagaaaaaacaaauauauuagucuagg

SEQ ID NO: 284213 - RNA, 64 nt, Homo Sapiens
cagaauaacugaacaaauaugugaaauggcaguaaggaagaaaaaggaacucacugauggagau

SEQ ID NO: 284214 - RNA, 64 nt, Homo Sapiens
gucacagagagcaagccaagacauccagggaaagaggaagaaaggccuuagugugccccagcag

SEQ ID NO: 284215 - RNA, 64 nt, Homo Sapiens
cccaggaccaacaacacccugguuuggagcugggaggaagaagggggccugagagagccccagg

SEQ ID NO: 284216 - RNA, 64 nt, Homo Sapiens
aaagaagagaaaaaauuaagaaaaaaaucaaaaaaggaagaaaacuaaaaaaaaaaaaaaucaa

SEQ ID NO: 284217 - RNA, 64 nt, Homo Sapiens
aacaaaucaaccccagcaccaaacccacccaggcaggaagaagccgccccuccucuggggccau

SEQ ID NO: 284218 - RNA, 64 nt, Homo Sapiens
aacuggcuguuuucuguucuuguuuauccagcguaggaagaaggaaaagaaaaucuuugcuccu

SEQ ID NO: 284219 - RNA, 64 nt, Homo Sapiens
ucaaaaaagagaaaaugaaaaaaauacaacuaaaaggaagaaacacaacuucaaagauuuuuca

SEQ ID NO: 284220 - RNA, 64 nt, Homo Sapiens
cuauugauuuuuacuucaaugggcucuuccaacaaggaagaagcuugcugguagcacuugcuac

SEQ ID NO: 284221 - RNA, 64 nt, Homo Sapiens
cuccuagucaauauccaccccauccaauuuaucaaggaagaaaugguucagaaaauauuuucag

SEQ ID NO: 284222 - RNA, 64 nt, Homo Sapiens
uccccuacucccuuauguguuguguauuccacuuaggaagaaaugcccaaaagagguccuggcc

SEQ ID NO: 284223 - RNA, 64 nt, Homo Sapiens
aaguccacuuuacucaaauuggugaacaguguauaggaagaagccagcaggagcucugacuaag

SEQ ID NO: 284224 - RNA, 64 nt, Homo Sapiens
cuugacuauuuagauucuagaggagggaaagaaaaggaagaacuaguagugaaucucucagcca

SEQ ID NO: 284225 - RNA, 64 nt, Homo Sapiens
ggaccccucuccaguccuggcagaaccaauuggaaggaagaaaguacaggugucuucugggggg

SEQ ID NO: 284226 - RNA, 64 nt, Homo Sapiens
ucugauaaaccuagguuuacgucacagcgucgccaggaagaagagagcagcaguucauuuaauu

SEQ ID NO: 284227 - RNA, 64 nt, Homo Sapiens
gagaguucaacaccuucgagcuggcacccuuguaaggaagaaaaaacaaaugcaguuaagaauu

SEQ ID NO: 284228 - RNA, 64 nt, Homo Sapiens
uguuuucucuccugcguaugagaacaugcccugcaggaagaaaaauucagaaauaugauguagu

SEQ ID NO: 284229 - RNA, 64 nt, Homo Sapiens
gauucagaaauaugauguaggagagugaccgaauaggaagaaggaaacaaaccagcuuuuuuca

SEQ ID NO: 284230 - RNA, 64 nt, Homo Sapiens
uugagaaguuaacuuuuguggaauaugaaaccaaaggaagaauuuccauguagauaaauuaaga

SEQ ID NO: 284231 - RNA, 64 nt, Homo Sapiens
guaagaccacaagucugcaggaaacucuggaaucaggaagaaaagcuauguucauacucuaaau

SEQ ID NO: 284232 - RNA, 64 nt, Homo Sapiens
uucccuuuguuuacucagauuucucuuagccauaaggaagaaaaagaacucuugcaugaaaaua

SEQ ID NO: 284233 - RNA, 64 nt, Homo Sapiens
gaaaaagaacucuugcaugaaaauagcaugaugcaggaagaaauugccaugcuaagaauagaac

SEQ ID NO: 284234 - RNA, 64 nt, Homo Sapiens
ggaagaauuagguuugaauugguugggugggaggaggaagaaagcucaucuugagaagcaggcg

SEQ ID NO: 284235 - RNA, 64 nt, Homo Sapiens
ggaagaauuagguuugaauugguugggugggaggaggaagaaaguugccacugagaagcaggcg

SEQ ID NO: 284236 - RNA, 64 nt, Homo Sapiens
gugcuggacaguuuuguugaaaaauuaaaagaagaggaagaaagagaaauaaucaaacugacca

SEQ ID NO: 284237 - RNA, 64 nt, Homo Sapiens
gaugacuuucaaugacuuucaauacuuccccugaaggaagaaugauaaggagaaaugucuguuu

SEQ ID NO: 284238 - RNA, 64 nt, Homo Sapiens
uuuucacgcugcugauaaagacauaccugagaccaggaagaaaaagagguuuaauuggacuuac

SEQ ID NO: 284239 - RNA, 64 nt, Homo Sapiens
aauacaauugacauaggaauuacauuaaaauauuaggaagaaacaaggacaaauuuagaccuug

SEQ ID NO: 284240 - RNA, 64 nt, Homo Sapiens
gguagaauaaagauuugaugcucuuccuguucaaaggaagaaugcagcuaguuugacuugguuu

SEQ ID NO: 284241 - RNA, 64 nt, Homo Sapiens
auuaagaagacaacuuacaaaggcuucuauuuggaggaagaaaaguaacacuguauaugaugaa

SEQ ID NO: 284242 - RNA, 64 nt, Homo Sapiens
guuaauuuaagaaugaaacuacaagggaaguggaaggaagaacauuauuuugcuacugagucac

SEQ ID NO: 284243 - RNA, 64 nt, Homo Sapiens
ggauaaaaucuuccaaaucccaagugagacccaaaggaagaacuaaauaauacaaauuggcuuu

SEQ ID NO: 284244 - RNA, 64 nt, Homo Sapiens
agaacucuccauagaauguauggccaaagauaggaggaagaaagucaggagaagccagaggccc

SEQ ID NO: 284245 - RNA, 64 nt, Homo Sapiens
augugggaauaggugggccagccugccugauaccaggaagaaccgagagccccauaugcacacu

SEQ ID NO: 284246 - RNA, 64 nt, Homo Sapiens
auuugaugaguauuuucaggagaugaaaaaucacaggaagaagaaaggguccacuaccagagac

SEQ ID NO: 284247 - RNA, 64 nt, Homo Sapiens
ugcuucagaaucugaacuuuuugaaacucugaugaggaagaaagugucugcuaauguaacuacu

SEQ ID NO: 284248 - RNA, 64 nt, Homo Sapiens
gccucugcuuugucaugccauuaagcucacaauaaggaagaaauaacagauaaguccauuggug

SEQ ID NO: 284249 - RNA, 64 nt, Homo Sapiens
ugcugauagcucauauuauaaauuucuaaauccuaggaagaaacgcuuggagugcuucugaaua

SEQ ID NO: 284250 - RNA, 64 nt, Homo Sapiens
gaauuguaugcuuuuuucuguguaacauuccuucaggaagaauaauauaaaaaagugggcauuu

SEQ ID NO: 284251 - RNA, 64 nt, Homo Sapiens
gaggauauauuuaagauacaaauugauuuuaaauaggaagaaaacuuacuagcucaauuuaaau

SEQ ID NO: 284252 - RNA, 64 nt, Homo Sapiens
aguccuguccuuggcaagcuauaggugaggcuggaggaagaaucgcggaacaaugacugccccg

SEQ ID NO: 284253 - RNA, 64 nt, Homo Sapiens
cuaagagugaaguagguguggaagccccacuugaaggaagaaguagaccaguccuguuugcagg

SEQ ID NO: 284254 - RNA, 64 nt, Homo Sapiens
accaccaugcaggaacagacuuuugguggugaggaggaagaacaaauaauagaagaaaauaaaa

SEQ ID NO: 284255 - RNA, 64 nt, Homo Sapiens
guuuacuauauauaaagcuaagauguggauuuacaggaagaacccugguuugaauaacugaucu

SEQ ID NO: 284256 - RNA, 64 nt, Homo Sapiens
agaugaaacaagugccuaacaccuuauuuccuggaggaagaaacuuucaccaccuguguuguua

SEQ ID NO: 284257 - RNA, 64 nt, Homo Sapiens
caguaaacauguaaauauaggaguggugcuagccaggaagaagcauguuggggguuggggggaa

SEQ ID NO: 284258 - RNA, 64 nt, Homo Sapiens
gcugauagaaauucaagauuuuucaguuguucuuaggaagaacauauuuuuacugugaaggugu

SEQ ID NO: 284259 - RNA, 64 nt, Homo Sapiens
ccuuugaccucaccaggccuugugugggggaacuaggaagaaguuccauagcucucugcccuga

SEQ ID NO: 284260 - RNA, 64 nt, Homo Sapiens
gugaggacagcaccagacuuucugcuagaggcagaggaagaaggguggaggugcuggcauucag

SEQ ID NO: 284261 - RNA, 64 nt, Homo Sapiens
cugaggcagacggugagggucacagaccagacuaaggaagaaguguuacuuuagaaaaagugga

SEQ ID NO: 284262 - RNA, 64 nt, Homo Sapiens
gguggagccucagggccagguagguccuggguggaggaagaaguaaaacaaaacacacguacau

SEQ ID NO: 284263 - RNA, 64 nt, Homo Sapiens
gccccagguucucuuuucuuccagggugccaagaaggaagaaaaauaggugggaggacuaacuu

SEQ ID NO: 284264 - RNA, 64 nt, Homo Sapiens
aggagcuaggcagaagccuuagcugccucugggaaggaagaaacuagcccccacccuccugcca

SEQ ID NO: 284265 - RNA, 64 nt, Homo Sapiens
uuguuugaauuucaauaaucagggguuugggucaaggaagaaaaaucaugggacuugccauuua

SEQ ID NO: 284266 - RNA, 64 nt, Homo Sapiens
auugagagcuauuauuaagaaaaacaguugagagaggaagaauuugaagagggcucaagauuuu

SEQ ID NO: 284267 - RNA, 64 nt, Homo Sapiens
ccagaaaaaagucaauuguucagguacaccaaagaggaagaagagcuguggaggccacccucua

SEQ ID NO: 284268 - RNA, 64 nt, Homo Sapiens
agaaaaugauucacgaauuccaaaucagauugccaggaagaaauaggacgugacgguacugggc

SEQ ID NO: 284269 - RNA, 64 nt, Homo Sapiens
agagcuuuguguguuuaacuuaccuucuauuuagaggaagaaugcaucuguguguccucuugac

SEQ ID NO: 284270 - RNA, 64 nt, Homo Sapiens
aagcagcuaaaaaagagugguugcaucauuuuaaaggaagaaaaugagcuggggccuccuucca

SEQ ID NO: 284271 - RNA, 64 nt, Homo Sapiens
aaaaucaugccaaaauguaaagaccaucgagacuaggaagaaacugcaugaacuaacgagcaaa

SEQ ID NO: 284272 - RNA, 64 nt, Homo Sapiens
uuccucaacacguacacccucccaagacuaaaccaggaagaaguugaaucucugaauagaccaa

SEQ ID NO: 284273 - RNA, 64 nt, Homo Sapiens
caaagaaauggaagagcauuccaugcucauggguaggaagaaucaauaucaugaaaauggccca

SEQ ID NO: 284274 - RNA, 64 nt, Homo Sapiens
uuguuuucagcauaguaaaguugcacuggaggggaggaagaaagccauccccgcucagccuggg

SEQ ID NO: 284275 - RNA, 64 nt, Homo Sapiens
uggcugagauaagaaaggaaaauuccucuacuacaggaagaagggcacgauaagaauagcaggg

SEQ ID NO: 284276 - RNA, 64 nt, Homo Sapiens
ucuucaagccaaggaacacacgaugugaagacacaggaagaacagcagauguacagagggaaga

SEQ ID NO: 284277 - RNA, 64 nt, Homo Sapiens
ccuucgaaugcaaagaaugugggacccacacuguaggaagaaguguuauuuuaucauucauaau

SEQ ID NO: 284278 - RNA, 64 nt, Homo Sapiens
cauauguucuaaaaugacuagcaaugguuuaaaaaggaagaagaguggaagugaagaagguggu

SEQ ID NO: 284279 - RNA, 62 nt, Homo Sapiens
uuuuucuaccucuuuaacaguuaauauuuuuuaaaggaagaaauggaauguaccuucagggg

SEQ ID NO: 284280 - RNA, 64 nt, Homo Sapiens
ucccuaggaaaaaggucgcuggcuuuggugcaagaggaagaagaauguuccacuggaagccuga

SEQ ID NO: 284281 - RNA, 64 nt, Homo Sapiens
acaaaucauugaacugagggggaaaaauguaacuaggaagaaaaacccaauuuaagaaauuaca

SEQ ID NO: 284282 - RNA, 64 nt, Homo Sapiens
gagguuuuauacuucagguuaguuaguuuuuggaaggaagaacauuuuuagguuugcaagccuc

SEQ ID NO: 284283 - RNA, 64 nt, Homo Sapiens
guuucuucaauuagucucaguucucuuaauuuucaggaagaaagggaaauugcagccccucagc

SEQ ID NO: 284284 - RNA, 64 nt, Homo Sapiens
ucagagagggcagaggugacugcggaggaacggcaggaagaaccggauuaguuuuccaggacuc

SEQ ID NO: 284285 - RNA, 64 nt, Homo Sapiens
auaauugaggggcgugucugggacuggaaacuuuaggaagaaaggugaccucaacuuugaguag

SEQ ID NO: 284286 - RNA, 64 nt, Homo Sapiens
ucaguaacauuauccuuagguaccuaaguaaaacaggaagaaaagguguccauaugucuuuacc

SEQ ID NO: 284287 - RNA, 64 nt, Homo Sapiens
ucugucaaucauggacgcauugugacuuuagugcaggaagaacucagaggcccggacucuccua

SEQ ID NO: 284288 - RNA, 64 nt, Homo Sapiens
acacccuuggaauagaaauugggagucuuggccaaggaagaaucuuuguaccauuuaauggguu

SEQ ID NO: 284289 - RNA, 64 nt, Homo Sapiens
uguaccauuuaauggguuggauacucagggguccaggaagaauuuuguuuuauuauuccuggcc

SEQ ID NO: 284290 - RNA, 64 nt, Homo Sapiens
ccaagcugcacaauuuaauauauucaagaguggggggaggaagcagaggucuucagggcucuuu

SEQ ID NO: 284291 - RNA, 64 nt, Homo Sapiens
ccugucuggcuucuagagaugugccugugggagggggaggaaguuggcugagccauugagugcu

SEQ ID NO: 284292 - RNA, 64 nt, Homo Sapiens
gggagguggucaagcuugaacuggugugccuucagggaggaagauuccacaguaaugggaucgg

SEQ ID NO: 284293 - RNA, 64 nt, Homo Sapiens
uuuucaccauguuauugaaguucucugcuucccugggaggaauucccauguggcacuggcauca

SEQ ID NO: 284294 - RNA, 64 nt, Homo Sapiens
gcuagcuguagugugacacagcugggagggaguggggaggaauugugggguggagggaggaagg

SEQ ID NO: 284295 - RNA, 64 nt, Homo Sapiens
gcugggagggaguggggagggguugugggguggagggaggaagguuugccucaaauggcuauag

SEQ ID NO: 284296 - RNA, 64 nt, Homo Sapiens
auuuuuuauuuaaaguugauggagugggaggaaggggaggaauaaacauuuuguagaguauagg

SEQ ID NO: 284297 - RNA, 64 nt, Homo Sapiens
ggaggaauaauuuuuuauuugaguauaggggagugggaggaaggcccagggaaaacauuuugua

SEQ ID NO: 284298 - RNA, 64 nt, Homo Sapiens
caggcgcacgagguccagggacuggccccaugaggggaggaaggagacagacaggccuggggac

SEQ ID NO: 284299 - RNA, 64 nt, Homo Sapiens
gacuggaaccuuucuuugacaagcagggcacauggggaggaagacugcccugacccaccuggca

SEQ ID NO: 284300 - RNA, 64 nt, Homo Sapiens
gagggcugaagggagaggggccagagucgauguggggaggaacaaguaagauggaugguuccgg

SEQ ID NO: 284301 - RNA, 64 nt, Homo Sapiens
cagugcuagagcuugaagccacucaagccaguuggggaggaaagggaugcggagguacccucua

SEQ ID NO: 284302 - RNA, 64 nt, Homo Sapiens
uaaguaaggaagguacugcggacagugugggccagggaggaaaaccagagcacacaguuuuguc

SEQ ID NO: 284303 - RNA, 64 nt, Homo Sapiens
auaauuacagucaaaauauuaaaguggggaggaagggaggaaaauaaucugcagcaugcuauag

SEQ ID NO: 284304 - RNA, 64 nt, Homo Sapiens
gaggaaaaauaauuacagucugcuauagaaaguggggaggaagguuacuguauaaucugcagca

SEQ ID NO: 284305 - RNA, 64 nt, Homo Sapiens
gcaguguccccugucaccacccaaggagacccgggggaggaacccacguugcagaaagagccag

SEQ ID NO: 284306 - RNA, 64 nt, Homo Sapiens
gcacagcaggagcggucagggucagugagcgggcgggaggaaggugcuuuuuccacgagugucu

SEQ ID NO: 284307 - RNA, 64 nt, Homo Sapiens
cagaaagaacaucugcuaguugguuauaggcggugggaggaauaauauaccuaauugguuauag

SEQ ID NO: 284308 - RNA, 64 nt, Homo Sapiens
aagaacauaauguaaaauugucagcagccucauggggaggaaaaaggaagagucaacucacuug

SEQ ID NO: 284309 - RNA, 64 nt, Homo Sapiens
uggagagagcacagugaaauggaauucgucuucugggaggaagcgugaggaaggagacaggggu

SEQ ID NO: 284310 - RNA, 64 nt, Homo Sapiens
aucaccguugacgcaucuugaagggaaacaaugugggaggaagaugaaaaaauaacaguuuaaa

SEQ ID NO: 284311 - RNA, 64 nt, Homo Sapiens
cccaaaaacgcaacacgucucaaggcaaacccgagggaggaacuuggucugggaggaagagaga

SEQ ID NO: 284312 - RNA, 64 nt, Homo Sapiens
gucucaaggcaaacccgagggaggaacuuggucugggaggaagagagaacucgcuccucaacca

SEQ ID NO: 284313 - RNA, 64 nt, Homo Sapiens
ucugcaggaucucacagcagcccugagaagacaugggaggaagaagccaguggcccuggggugg

SEQ ID NO: 284314 - RNA, 64 nt, Homo Sapiens
gcccacaguagugcuagcugaggcccagaggaacgggaggaaagggaggcagcgccggacggcg

SEQ ID NO: 284315 - RNA, 64 nt, Homo Sapiens
ggaccaagccagagagggacauuuacagaaaguagggaggaaggauucugguuuagauacagau

SEQ ID NO: 284316 - RNA, 64 nt, Homo Sapiens
uaauucucacuguacuugaagcacuagagaggucgggaggaaguuauggaaucuauuucugucu

SEQ ID NO: 284317 - RNA, 64 nt, Homo Sapiens
cagacgcggagccugggugcgcgagccgcccuccgggaggaaggcgcccggcugcgucugcaga

SEQ ID NO: 284318 - RNA, 64 nt, Homo Sapiens
uuuuaaauguuuuauuuugcuuucccagcgggaggggaggaagaagaguguuuacaaaguccug

SEQ ID NO: 284319 - RNA, 64 nt, Homo Sapiens
auguaagagagggaacauuugagugcaggggguugggaggaagcaaaugaauaagguguugaaa

SEQ ID NO: 284320 - RNA, 64 nt, Homo Sapiens
ggagcaagacuugggcucacgggcggggguacgagggaggaaggauuccagggcgcccaggggc

SEQ ID NO: 284321 - RNA, 64 nt, Homo Sapiens
gccccugggggcuucuggcuuccugccucccagagggaggaaaauaggugccccuaguucuuug

SEQ ID NO: 284322 - RNA, 64 nt, Homo Sapiens
caaagaaaaccauuuucaggcaggccagggaacggggaggaaacacuguccaaaccugugaccc

SEQ ID NO: 284323 - RNA, 64 nt, Homo Sapiens
ggggcugagaacugcagcccugggucuucccuuagggaggaagggcagaugaacccagcaggcu

SEQ ID NO: 284324 - RNA, 64 nt, Homo Sapiens
cugguuucccagaucuguauuucaguguuuacaagggaggaaggaccuuuccucaccucccuuu

SEQ ID NO: 284325 - RNA, 64 nt, Homo Sapiens
ccaaguauacacaacuucccaguaaaugguuguggggaggaaagagguggagccuccccagccg

SEQ ID NO: 284326 - RNA, 64 nt, Homo Sapiens
ggacuuuagagagggaugaaaaugagcccugggagggaggaagggacgaggagggguggcugca

SEQ ID NO: 284327 - RNA, 64 nt, Homo Sapiens
accucuccccacguggaggguggagcaguuaugagggaggaagucaacugcuguucagccucag

SEQ ID NO: 284328 - RNA, 64 nt, Homo Sapiens
gagaaucuccaagagaaaaauauuuggggaaggagggaggaaauaugucccuugcacaccaccc

SEQ ID NO: 284329 - RNA, 64 nt, Homo Sapiens
aagccaccucccaucacaccccugagcagaguuagggaggaauucuacuucccauaaaaggacc

SEQ ID NO: 284330 - RNA, 64 nt, Homo Sapiens
cuagggggaagugacaaggccccagagacucagagggaggaaucgaggaaccagagccauggac

SEQ ID NO: 284331 - RNA, 64 nt, Homo Sapiens
aaauggcaauucuuugaccucaaccugugaugaggggaggaaacucaccugcuggccccucacc

SEQ ID NO: 284332 - RNA, 64 nt, Homo Sapiens
uaguuaaaaagcauuauacuguggguaaugaaaagggaggaaaaaaaaagaaggaaaaggaauu

SEQ ID NO: 284333 - RNA, 64 nt, Homo Sapiens
uuaugcucaggagcauuggaauccucuucuuccagggaggaauuagccugcaagguuaggacuu

SEQ ID NO: 284334 - RNA, 50 nt, Homo Sapiens
aacugggagccgacagcugagggaggaauuagccaguggacaccccauuu

SEQ ID NO: 284335 - RNA, 64 nt, Homo Sapiens
gcacuaagggcugaggucaauaccgcagaccuuggggaggaagcugagcaucccccgggauguc

SEQ ID NO: 284336 - RNA, 64 nt, Homo Sapiens
uacacucaaguguggggagucaugggguguggaggggaggaaaggaaagguauuuuguuucuuu

SEQ ID NO: 284337 - RNA, 64 nt, Homo Sapiens
aaaccaagggcagaauguuucacccugaucuuaugggaggaaucaaacucccaaaauagugugu

SEQ ID NO: 284338 - RNA, 64 nt, Homo Sapiens
aauaauccaccccuuguuuauaugucccaaaagggggaggaaugaacaucaggaaguuacccga

SEQ ID NO: 284339 - RNA, 64 nt, Homo Sapiens
uagaguaagagguugaagauugggacuucggcuagggaggaaggggucucuuaggcuuuaggac

SEQ ID NO: 284340 - RNA, 64 nt, Homo Sapiens
accauagcauuguacuugccggaggaugaguccugggaggaaguaagaugaguccuggagggaa

SEQ ID NO: 284341 - RNA, 64 nt, Homo Sapiens
ugaaaggauacuaaugauucaggcaugagccagagggaggaagucuccaagccauucaugaagc

SEQ ID NO: 284342 - RNA, 64 nt, Homo Sapiens
guauuuauugcaauguaaauguauccugaagguggggaggaauguuuaaucuaccauguccgug

SEQ ID NO: 284343 - RNA, 64 nt, Homo Sapiens
aggcccagagaccugcuguccuuuuucuccuugagggaggaaauaaaacugcggaauacaaugu

SEQ ID NO: 284344 - RNA, 64 nt, Homo Sapiens
aaagggcgguggcucgggagcggguggaggguuggggaggaaagccggcagguuuuuuacgagc

SEQ ID NO: 284345 - RNA, 64 nt, Homo Sapiens
gcugggcgagaggccuagaggacagaggagaggagggaggaagauuucagacaaaaauuaacca

SEQ ID NO: 284346 - RNA, 64 nt, Homo Sapiens
acgagcagaaggcccuggcgggcaggaccuuggagggaggaacaauuucuccuggagccuccag

SEQ ID NO: 284347 - RNA, 64 nt, Homo Sapiens
cgagcccucaugugugucccgucgcagcucuggugggaggaagguccaggcaauuggaucagaa

SEQ ID NO: 284348 - RNA, 64 nt, Homo Sapiens
ggggacauaaagccuguccucccuggaguugggagggaggaaugacaaaggacccuuucaaugu

SEQ ID NO: 284349 - RNA, 64 nt, Homo Sapiens
ucccuuuuguucuucccccucaacuuuuuggccagggaggaauggacagcuuauccuuuucaac

SEQ ID NO: 284350 - RNA, 64 nt, Homo Sapiens
ggaagcagcuguucugguggggggagggaaaggugggaggaauguggggauggaugggagggaa

SEQ ID NO: 284351 - RNA, 64 nt, Homo Sapiens
gugggagggagggcuggggaugggaagggaguuggggaggaagacuccccucuccacugauggc

SEQ ID NO: 284352 - RNA, 64 nt, Homo Sapiens
gcgucccucuuggcccucccgggcaggcauggaggggaggaaagguuccugagggccaggucgg

SEQ ID NO: 284353 - RNA, 64 nt, Homo Sapiens
agaggcagaugggaaagcaguuaccauugcuguugggaggaagcuaaucuaaagaaagcacauu

SEQ ID NO: 284354 - RNA, 64 nt, Homo Sapiens
gcauaagaaugucagccuaguuauuaggcuauuucaaagccacaugcucugggcaaguggauau

SEQ ID NO: 284355 - RNA, 64 nt, Homo Sapiens
caacaagucuguaggaaguuaucagcauuuggggcaaagccauuacuuuguuguccauauugcu

SEQ ID NO: 284356 - RNA, 64 nt, Homo Sapiens
aaaaaguuggacuucuuuugaaugcuauugcagacaaagccaauuugaaaauuagccaggauca

SEQ ID NO: 284357 - RNA, 64 nt, Homo Sapiens
gccacaugugcucaucaaacaguacugugacuuccaaagccagacccuggcaccaacacccgcc

SEQ ID NO: 284358 - RNA, 64 nt, Homo Sapiens
augcccaggccucggccggggcgcagcgaucccccaaagccagcgccguggaguucgugccaau

SEQ ID NO: 284359 - RNA, 64 nt, Homo Sapiens
uggauuuacagaaaugugucaaauguaaaucuuucaaagccauuuaaaaauauucacuuuaguu

SEQ ID NO: 284360 - RNA, 64 nt, Homo Sapiens
uggguggaagucaguuggccgucugcuccugcaccaaagccauaucaauugggagauaccuuug

SEQ ID NO: 284361 - RNA, 64 nt, Homo Sapiens
cucacaagaaagggcaccaggugugugggaaggacaaagccacuuguauguaugcacacauugu

SEQ ID NO: 284362 - RNA, 64 nt, Homo Sapiens
uuagacaguguggcaaagugcuuggguuccaguucaaagccaccaauaccaaccuuuauuugca

SEQ ID NO: 284363 - RNA, 64 nt, Homo Sapiens
gacucaugacacagcccugacagugugacagcuucaaagccacugccgcaguuaggcaaaauga

SEQ ID NO: 284364 - RNA, 64 nt, Homo Sapiens
aaagaugcugccaguguucgcccuagaguuauuacaaagccagugccaaaacccagccaugggc

SEQ ID NO: 284365 - RNA, 64 nt, Homo Sapiens
ugagggucuuucaguguuccuguuuacaacaugucaaagccauugguucaagggcguaauaaau

SEQ ID NO: 284366 - RNA, 64 nt, Homo Sapiens
aggguccacggauggccccaaaggcugagggccccaaagccacuugucuccuaggauccaggcc

SEQ ID NO: 284367 - RNA, 64 nt, Homo Sapiens
aggggcucccuccucuucacauuccccccgaccccaaagccagagaaagccagauggcaccagc

SEQ ID NO: 284368 - RNA, 64 nt, Homo Sapiens
gaugggcuggugggccauuccagcuugccgaaaucaaagccaucugaagccugucucuggugaa

SEQ ID NO: 284369 - RNA, 64 nt, Homo Sapiens
aagaaaaagggccuucaaggcaggaaugagaaagcaaagccaaucucucauuuagaccuggcuu

SEQ ID NO: 284370 - RNA, 64 nt, Homo Sapiens
gcccaagccuaaaaaggcccuaaaccugcuccuccaaagccagaagaucugcgagguugucugc

SEQ ID NO: 284371 - RNA, 64 nt, Homo Sapiens
uauugauggugugaauuaauauuuguuagccaagcaaagccauuaguaagucucuaagucaauc

SEQ ID NO: 284372 - RNA, 64 nt, Homo Sapiens
ucaccauguaugccugaaccaggcuggccucauccaaagccaugcaggaucacucaggauuuca

SEQ ID NO: 284373 - RNA, 64 nt, Homo Sapiens
gaucacucaggauuucaguuucacccucuauuuccaaagccauuuaccucaaaggacccagcag

SEQ ID NO: 284374 - RNA, 64 nt, Homo Sapiens
ucuuauuuauuuauuuauuucaccaccguccuuccaaagccagaugugacccggggcccaaagc

SEQ ID NO: 284375 - RNA, 59 nt, Homo Sapiens
accguccuuccaaagccagacccggggcccaaagccaccugcugaagacucggcuguga

SEQ ID NO: 284376 - RNA, 64 nt, Homo Sapiens
gccacacucuucaacgguuaauugugcagagggacaaagccacacauuuugcuucaaauggcca

SEQ ID NO: 284377 - RNA, 64 nt, Homo Sapiens
acugagaggggaccccagacccuaagacugcagucaaagccagacugggccagcaccgcugagu

SEQ ID NO: 284378 - RNA, 64 nt, Homo Sapiens
auccugcuuguuugcuuaaaucaagaacgagcaucaaagccagagguagcaagagugaccgaug

SEQ ID NO: 284379 - RNA, 64 nt, Homo Sapiens
cugccuccagcuuuacugaggagccaccaacucccaaagccagccaccagccucgggagcugcu

SEQ ID NO: 284380 - RNA, 64 nt, Homo Sapiens; identical to SEQ ID NO: 72274

SEQ ID NO: 284381 - RNA, 64 nt, Homo Sapiens; identical to SEQ ID NO: 72275

SEQ ID NO: 284382 - RNA, 64 nt, Homo Sapiens; identical to SEQ ID NO: 72276

SEQ ID NO: 284383 - RNA, 64 nt, Homo Sapiens; identical to SEQ ID NO: 72277

SEQ ID NO: 284384 - RNA, 64 nt, Homo Sapiens; identical to SEQ ID NO: 72278

SEQ ID NO: 284385 - RNA, 64 nt, Homo Sapiens; identical to SEQ ID NO: 72279

SEQ ID NO: 284386 - RNA, 64 nt, Homo Sapiens; identical to SEQ ID NO: 72280

SEQ ID NO: 284387 - RNA, 64 nt, Homo Sapiens; identical to SEQ ID NO: 72281

SEQ ID NO: 284388 - RNA, 64 nt, Homo Sapiens; identical to SEQ ID NO: 72282

SEQ ID NO: 284389 - RNA, 64 nt, Homo Sapiens; identical to SEQ ID NO: 72283

SEQ ID NO: 284390 - RNA, 64 nt, Homo Sapiens; identical to SEQ ID NO: 72284

SEQ ID NO: 284391 - RNA, 64 nt, Homo Sapiens; identical to SEQ ID NO: 72285

SEQ ID NO: 284392 - RNA, 64 nt, Homo Sapiens; identical to SEQ ID NO: 72286

SEQ ID NO: 284393 - RNA, 64 nt, Homo Sapiens; identical to SEQ ID NO: 72287

SEQ ID NO: 284394 - RNA, 64 nt, Homo Sapiens; identical to SEQ ID NO: 72288

SEQ ID NO: 284395 - RNA, 64 nt, Homo Sapiens; identical to SEQ ID NO: 72289

SEQ ID NO: 284396 - RNA, 64 nt, Homo Sapiens; identical to SEQ ID NO: 72290

SEQ ID NO: 284397 - RNA, 64 nt, Homo Sapiens; identical to SEQ ID NO: 72291

SEQ ID NO: 284398 - RNA, 64 nt, Homo Sapiens; identical to SEQ ID NO: 72292

SEQ ID NO: 284399 - RNA, 64 nt, Homo Sapiens; identical to SEQ ID NO: 72293

SEQ ID NO: 284400 - RNA, 64 nt, Homo Sapiens; identical to SEQ ID NO: 72294

SEQ ID NO: 284401 - RNA, 64 nt, Homo Sapiens; identical to SEQ ID NO: 72295

SEQ ID NO: 284402 - RNA, 64 nt, Homo Sapiens; identical to SEQ ID NO: 72296

SEQ ID NO: 284403 - RNA, 64 nt, Homo Sapiens; identical to SEQ ID NO: 72297

SEQ ID NO: 284404 - RNA, 64 nt, Homo Sapiens; identical to SEQ ID NO: 72298

SEQ ID NO: 284405 - RNA, 64 nt, Homo Sapiens; identical to SEQ ID NO: 72299

SEQ ID NO: 284406 - RNA, 64 nt, Homo Sapiens; identical to SEQ ID NO: 72300

SEQ ID NO: 284407 - RNA, 64 nt, Homo Sapiens; identical to SEQ ID NO: 72301

SEQ ID NO: 284408 - RNA, 64 nt, Homo Sapiens; identical to SEQ ID NO: 72302

SEQ ID NO: 284409 - RNA, 64 nt, Homo Sapiens; identical to SEQ ID NO: 72303

SEQ ID NO: 284410 - RNA, 64 nt, Homo Sapiens; identical to SEQ ID NO: 72304

SEQ ID NO: 284411 - RNA, 64 nt, Homo Sapiens; identical to SEQ ID NO: 72305

SEQ ID NO: 284412 - RNA, 64 nt, Homo Sapiens; identical to SEQ ID NO: 72306

SEQ ID NO: 284413 - RNA, 64 nt, Homo Sapiens; identical to SEQ ID NO: 72307

SEQ ID NO: 284414 - RNA, 64 nt, Homo Sapiens; identical to SEQ ID NO: 72308

SEQ ID NO: 284415 - RNA, 64 nt, Homo Sapiens; identical to SEQ ID NO: 72309

SEQ ID NO: 284416 - RNA, 64 nt, Homo Sapiens; identical to SEQ ID NO: 72310

SEQ ID NO: 284417 - RNA, 64 nt, Homo Sapiens; identical to SEQ ID NO: 72311

SEQ ID NO: 284418 - RNA, 64 nt, Homo Sapiens; identical to SEQ ID NO: 72312

SEQ ID NO: 284419 - RNA, 64 nt, Homo Sapiens; identical to SEQ ID NO: 72313

SEQ ID NO: 284420 - RNA, 64 nt, Homo Sapiens; identical to SEQ ID NO: 72314

SEQ ID NO: 284421 - RNA, 64 nt, Homo Sapiens; identical to SEQ ID NO: 72315

SEQ ID NO: 284422 - RNA, 64 nt, Homo Sapiens; identical to SEQ ID NO: 72316

SEQ ID NO: 284423 - RNA, 64 nt, Homo Sapiens; identical to SEQ ID NO: 72317

SEQ ID NO: 284424 - RNA, 64 nt, Homo Sapiens; identical to SEQ ID NO: 72318

SEQ ID NO: 284425 - RNA, 64 nt, Homo Sapiens; identical to SEQ ID NO: 72319

SEQ ID NO: 284426 - RNA, 64 nt, Homo Sapiens; identical to SEQ ID NO: 72320

SEQ ID NO: 284427 - RNA, 64 nt, Homo Sapiens; identical to SEQ ID NO: 72321

SEQ ID NO: 284428 - RNA, 64 nt, Homo Sapiens; identical to SEQ ID NO: 72322

SEQ ID NO: 284429 - RNA, 64 nt, Homo Sapiens; identical to SEQ ID NO: 72323

SEQ ID NO: 284430 - RNA, 64 nt, Homo Sapiens; identical to SEQ ID NO: 72324

SEQ ID NO: 284431 - RNA, 64 nt, Homo Sapiens; identical to SEQ ID NO: 72325

SEQ ID NO: 284432 - RNA, 64 nt, Homo Sapiens; identical to SEQ ID NO: 72326

SEQ ID NO: 284433 - RNA, 64 nt, Homo Sapiens; identical to SEQ ID NO: 72327

SEQ ID NO: 284434 - RNA, 64 nt, Homo Sapiens; identical to SEQ ID NO: 72328

SEQ ID NO: 284435 - RNA, 64 nt, Homo Sapiens; identical to SEQ ID NO: 72329

SEQ ID NO: 284436 - RNA, 64 nt, Homo Sapiens; identical to SEQ ID NO: 72330

SEQ ID NO: 284437 - RNA, 64 nt, Homo Sapiens; identical to SEQ ID NO: 72331

SEQ ID NO: 284438 - RNA, 64 nt, Homo Sapiens; identical to SEQ ID NO: 72332

SEQ ID NO: 284439 - RNA, 64 nt, Homo Sapiens; identical to SEQ ID NO: 72333

SEQ ID NO: 284440 - RNA, 64 nt, Homo Sapiens; identical to SEQ ID NO: 72334

SEQ ID NO: 284441 - RNA, 64 nt, Homo Sapiens; identical to SEQ ID NO: 72335

SEQ ID NO: 284442 - RNA, 64 nt, Homo Sapiens; identical to SEQ ID NO: 72336

SEQ ID NO: 284443 - RNA, 64 nt, Homo Sapiens; identical to SEQ ID NO: 72337

SEQ ID NO: 284444 - RNA, 64 nt, Homo Sapiens; identical to SEQ ID NO: 72338

SEQ ID NO: 284445 - RNA, 64 nt, Homo Sapiens; identical to SEQ ID NO: 72339

SEQ ID NO: 284446 - RNA, 64 nt, Homo Sapiens; identical to SEQ ID NO: 72340

SEQ ID NO: 284447 - RNA, 64 nt, Homo Sapiens; identical to SEQ ID NO: 72341

SEQ ID NO: 284448 - RNA, 64 nt, Homo Sapiens; identical to SEQ ID NO: 72342

SEQ ID NO: 284449 - RNA, 64 nt, Homo Sapiens; identical to SEQ ID NO: 72343

SEQ ID NO: 284450 - RNA, 64 nt, Homo Sapiens; identical to SEQ ID NO: 72344

SEQ ID NO: 284451 - RNA, 64 nt, Homo Sapiens; identical to SEQ ID NO: 72345

SEQ ID NO: 284452 - RNA, 64 nt, Homo Sapiens; identical to SEQ ID NO: 72346

SEQ ID NO: 284453 - RNA, 64 nt, Homo Sapiens; identical to SEQ ID NO: 72347

SEQ ID NO: 284454 - RNA, 64 nt, Homo Sapiens; identical to SEQ ID NO: 72348

SEQ ID NO: 284455 - RNA, 64 nt, Homo Sapiens; identical to SEQ ID NO: 72349

SEQ ID NO: 284456 - RNA, 64 nt, Homo Sapiens; identical to SEQ ID NO: 72350

SEQ ID NO: 284457 - RNA, 64 nt, Homo Sapiens; identical to SEQ ID NO: 72351

SEQ ID NO: 284458 - RNA, 64 nt, Homo Sapiens; identical to SEQ ID NO: 72352

SEQ ID NO: 284459 - RNA, 64 nt, Homo Sapiens; identical to SEQ ID NO: 72353

SEQ ID NO: 284460 - RNA, 64 nt, Homo Sapiens; identical to SEQ ID NO: 72354

SEQ ID NO: 284461 - RNA, 64 nt, Homo Sapiens; identical to SEQ ID NO: 72355

SEQ ID NO: 284462 - RNA, 64 nt, Homo Sapiens; identical to SEQ ID NO: 72356

SEQ ID NO: 284463 - RNA, 64 nt, Homo Sapiens; identical to SEQ ID NO: 72357

SEQ ID NO: 284464 - RNA, 64 nt, Homo Sapiens; identical to SEQ ID NO: 72358

SEQ ID NO: 284465 - RNA, 64 nt, Homo Sapiens; identical to SEQ ID NO: 72359

SEQ ID NO: 284466 - RNA, 64 nt, Homo Sapiens; identical to SEQ ID NO: 72360

SEQ ID NO: 284467 - RNA, 64 nt, Homo Sapiens; identical to SEQ ID NO: 72361

SEQ ID NO: 284468 - RNA, 64 nt, Homo Sapiens; identical to SEQ ID NO: 72362

SEQ ID NO: 284469 - RNA, 64 nt, Homo Sapiens; identical to SEQ ID NO: 72363

SEQ ID NO: 284470 - RNA, 64 nt, Homo Sapiens; identical to SEQ ID NO: 72364

SEQ ID NO: 284471 - RNA, 64 nt, Homo Sapiens; identical to SEQ ID NO: 72365

SEQ ID NO: 284472 - RNA, 64 nt, Homo Sapiens; identical to SEQ ID NO: 72366

SEQ ID NO: 284473 - RNA, 64 nt, Homo Sapiens; identical to SEQ ID NO: 72367

SEQ ID NO: 284474 - RNA, 64 nt, Homo Sapiens; identical to SEQ ID NO: 72368

SEQ ID NO: 284475 - RNA, 64 nt, Homo Sapiens; identical to SEQ ID NO: 72369

SEQ ID NO: 284476 - RNA, 64 nt, Homo Sapiens; identical to SEQ ID NO: 72370

SEQ ID NO: 284477 - RNA, 64 nt, Homo Sapiens; identical to SEQ ID NO: 72371

SEQ ID NO: 284478 - RNA, 64 nt, Homo Sapiens; identical to SEQ ID NO: 72372

SEQ ID NO: 284479 - RNA, 64 nt, Homo Sapiens; identical to SEQ ID NO: 72373

SEQ ID NO: 284480 - RNA, 64 nt, Homo Sapiens; identical to SEQ ID NO: 72374

SEQ ID NO: 284481 - RNA, 64 nt, Homo Sapiens; identical to SEQ ID NO: 72375

SEQ ID NO: 284482 - RNA, 64 nt, Homo Sapiens; identical to SEQ ID NO: 72376

SEQ ID NO: 284483 - RNA, 64 nt, Homo Sapiens; identical to SEQ ID NO: 72377

SEQ ID NO: 284484 - RNA, 64 nt, Homo Sapiens; identical to SEQ ID NO: 72378

SEQ ID NO: 284485 - RNA, 64 nt, Homo Sapiens; identical to SEQ ID NO: 72379

SEQ ID NO: 284486 - RNA, 64 nt, Homo Sapiens; identical to SEQ ID NO: 72380

SEQ ID NO: 284487 - RNA, 64 nt, Homo Sapiens; identical to SEQ ID NO: 72381

SEQ ID NO: 284488 - RNA, 64 nt, Homo Sapiens; identical to SEQ ID NO: 72382

SEQ ID NO: 284489 - RNA, 64 nt, Homo Sapiens; identical to SEQ ID NO: 72383

SEQ ID NO: 284490 - RNA, 64 nt, Homo Sapiens; identical to SEQ ID NO: 72384

SEQ ID NO: 284491 - RNA, 64 nt, Homo Sapiens; identical to SEQ ID NO: 72385

SEQ ID NO: 284492 - RNA, 64 nt, Homo Sapiens; identical to SEQ ID NO: 72386

SEQ ID NO: 284493 - RNA, 64 nt, Homo Sapiens; identical to SEQ ID NO: 72387

SEQ ID NO: 284494 - RNA, 64 nt, Homo Sapiens; identical to SEQ ID NO: 72388

SEQ ID NO: 284495 - RNA, 64 nt, Homo Sapiens; identical to SEQ ID NO: 72389

SEQ ID NO: 284496 - RNA, 64 nt, Homo Sapiens; identical to SEQ ID NO: 72390

SEQ ID NO: 284497 - RNA, 64 nt, Homo Sapiens; identical to SEQ ID NO: 72391

SEQ ID NO: 284498 - RNA, 64 nt, Homo Sapiens; identical to SEQ ID NO: 72392

SEQ ID NO: 284499 - RNA, 64 nt, Homo Sapiens; identical to SEQ ID NO: 72393

SEQ ID NO: 284500 - RNA, 64 nt, Homo Sapiens; identical to SEQ ID NO: 72394

SEQ ID NO: 284501 - RNA, 64 nt, Homo Sapiens; identical to SEQ ID NO: 72395

SEQ ID NO: 284502 - RNA, 64 nt, Homo Sapiens; identical to SEQ ID NO: 72396

SEQ ID NO: 284503 - RNA, 64 nt, Homo Sapiens; identical to SEQ ID NO: 72397

SEQ ID NO: 284504 - RNA, 64 nt, Homo Sapiens; identical to SEQ ID NO: 72398

SEQ ID NO: 284505 - RNA, 64 nt, Homo Sapiens; identical to SEQ ID NO: 72399

SEQ ID NO: 284506 - RNA, 64 nt, Homo Sapiens; identical to SEQ ID NO: 72400

SEQ ID NO: 284507 - RNA, 64 nt, Homo Sapiens; identical to SEQ ID NO: 72401

SEQ ID NO: 284508 - RNA, 64 nt, Homo Sapiens; identical to SEQ ID NO: 72402

SEQ ID NO: 284509 - RNA, 64 nt, Homo Sapiens; identical to SEQ ID NO: 72403

SEQ ID NO: 284510 - RNA, 64 nt, Homo Sapiens; identical to SEQ ID NO: 72404

SEQ ID NO: 284511 - RNA, 64 nt, Homo Sapiens; identical to SEQ ID NO: 72405

SEQ ID NO: 284512 - RNA, 64 nt, Homo Sapiens; identical to SEQ ID NO: 72406

SEQ ID NO: 284513 - RNA, 64 nt, Homo Sapiens; identical to SEQ ID NO: 72407

SEQ ID NO: 284514 - RNA, 64 nt, Homo Sapiens; identical to SEQ ID NO: 72408

SEQ ID NO: 284515 - RNA, 64 nt, Homo Sapiens; identical to SEQ ID NO: 72409

SEQ ID NO: 284516 - RNA, 64 nt, Homo Sapiens; identical to SEQ ID NO: 72410

SEQ ID NO: 284517 - RNA, 64 nt, Homo Sapiens; identical to SEQ ID NO: 72411

SEQ ID NO: 284518 - RNA, 64 nt, Homo Sapiens; identical to SEQ ID NO: 72412

SEQ ID NO: 284519 - RNA, 64 nt, Homo Sapiens; identical to SEQ ID NO: 72413

SEQ ID NO: 284520 - RNA, 64 nt, Homo Sapiens; identical to SEQ ID NO: 72414

SEQ ID NO: 284521 - RNA, 64 nt, Homo Sapiens; identical to SEQ ID NO: 72415

SEQ ID NO: 284522 - RNA, 64 nt, Homo Sapiens; identical to SEQ ID NO: 72416

SEQ ID NO: 284523 - RNA, 64 nt, Homo Sapiens; identical to SEQ ID NO: 72417

SEQ ID NO: 284524 - RNA, 64 nt, Homo Sapiens; identical to SEQ ID NO: 72418

SEQ ID NO: 284525 - RNA, 64 nt, Homo Sapiens; identical to SEQ ID NO: 72419

SEQ ID NO: 284526 - RNA, 64 nt, Homo Sapiens; identical to SEQ ID NO: 72420

SEQ ID NO: 284527 - RNA, 64 nt, Homo Sapiens; identical to SEQ ID NO: 72421

SEQ ID NO: 284528 - RNA, 64 nt, Homo Sapiens; identical to SEQ ID NO: 72422

SEQ ID NO: 284529 - RNA, 64 nt, Homo Sapiens; identical to SEQ ID NO: 72423

SEQ ID NO: 284530 - RNA, 64 nt, Homo Sapiens; identical to SEQ ID NO: 72424

SEQ ID NO: 284531 - RNA, 64 nt, Homo Sapiens; identical to SEQ ID NO: 72425

SEQ ID NO: 284532 - RNA, 64 nt, Homo Sapiens; identical to SEQ ID NO: 72426

SEQ ID NO: 284533 - RNA, 64 nt, Homo Sapiens; identical to SEQ ID NO: 72427

SEQ ID NO: 284534 - RNA, 64 nt, Homo Sapiens; identical to SEQ ID NO: 72428

SEQ ID NO: 284535 - RNA, 64 nt, Homo Sapiens; identical to SEQ ID NO: 72429

SEQ ID NO: 284536 - RNA, 64 nt, Homo Sapiens; identical to SEQ ID NO: 72430

SEQ ID NO: 284537 - RNA, 64 nt, Homo Sapiens; identical to SEQ ID NO: 72431

SEQ ID NO: 284538 - RNA, 64 nt, Homo Sapiens; identical to SEQ ID NO: 72432

SEQ ID NO: 284539 - RNA, 64 nt, Homo Sapiens; identical to SEQ ID NO: 72433

SEQ ID NO: 284540 - RNA, 64 nt, Homo Sapiens; identical to SEQ ID NO: 72434

SEQ ID NO: 284541 - RNA, 64 nt, Homo Sapiens
cuaacagguaagaaaugaaauugaacuauugacugggccccagaaauccauaaaauggcugcag

SEQ ID NO: 284542 - RNA, 64 nt, Homo Sapiens
guggccccagcuggguuucccaggucaggaaugugggccccaggcaaggugcagccuuugcuca

SEQ ID NO: 284543 - RNA, 64 nt, Homo Sapiens
gccgcugcuugaguggacagcagcuggacugggugggccccacaguggucagcgauuccugcca

SEQ ID NO: 284544 - RNA, 64 nt, Homo Sapiens
guggucagcgauuccugccaaguaggguuuagccgggccccauggucacagaccccugggggag

SEQ ID NO: 284545 - RNA, 64 nt, Homo Sapiens
cucugccccaagcccccaacucacagcugcagcugggccccauguuuuauucuaugagaacaag

SEQ ID NO: 284546 - RNA, 64 nt, Homo Sapiens
ucugccugggccugugcagcauuugccagcacaggggccccagacugucagaggcuaagaugag

SEQ ID NO: 284547 - RNA, 64 nt, Homo Sapiens
uacuugugacugaaggggcaagaggugggcagcugggccccaccgcuguacccuuccaccuccu

SEQ ID NO: 284548 - RNA, 64 nt, Homo Sapiens
acuguggggcaagccugaguggugaggggccacugggccccauucucccuccauggcaggaagg

SEQ ID NO: 284549 - RNA, 64 nt, Homo Sapiens
gccuugggggucugcucugugccugggaucaguggggccccaaagcccagcccggcugaccaac

SEQ ID NO: 284550 - RNA, 64 nt, Homo Sapiens
caggcuagaggaggcacaggagggggagccccacgggccccaggggacacgcuggucugagaug

SEQ ID NO: 284551 - RNA, 64 nt, Homo Sapiens
cuucuccauggccacaugggcggguguaucgccugggccccaggggcaccuuggggcuagcaca

SEQ ID NO: 284552 - RNA, 64 nt, Homo Sapiens
gugagauugggccuggggucucaccccuaguguggggccccaggucccgugccuccccuuccca

SEQ ID NO: 284553 - RNA, 64 nt, Homo Sapiens
uuccacugggccuaccuuccuuggggauguucaugggccccaguuuccaguuucccuugccaga

SEQ ID NO: 284554 - RNA, 64 nt, Homo Sapiens
ccucuccccaccccguccuguccaugcgcuuccagggccccacgguccccaggaggacgcuucc

SEQ ID NO: 284555 - RNA, 64 nt, Homo Sapiens
guccugggccagagacaggcagggcccaguccaggggccccaggccuccccagucccagugugc

SEQ ID NO: 284556 - RNA, 64 nt, Homo Sapiens
gggggaggaggaagccacugcaucuguuggcucagggccccagccugugcgagcagggcgccug

SEQ ID NO: 284557 - RNA, 64 nt, Homo Sapiens
ccugggggccaggucgaccuucaaguggcuuuuggggccccagguugagcucuggauguuucaa

SEQ ID NO: 284558 - RNA, 64 nt, Homo Sapiens
gguggggguccgggucaccauuuccuccaguccugggccccauccuugagggccuucccagcca

SEQ ID NO: 284559 - RNA, 64 nt, Homo Sapiens
agaccgacuggucgcacucgcagcugcuggacuugggccccaucgacgcgcucaacuucuucug

SEQ ID NO: 284560 - RNA, 64 nt, Homo Sapiens
cgcagagguccgcgagguccgcgaugagacugaggggccccaugcggucccggcucugugcggg

SEQ ID NO: 284561 - RNA, 64 nt, Homo Sapiens
cagccucucucccagucuacuugcuggggacggggggccccaguacuggccugcacggugggcc

SEQ ID NO: 284562 - RNA, 64 nt, Homo Sapiens
ccacccuccugucuucccaggagggucccaagcugggccccagcucacacagccaggugccuug

SEQ ID NO: 284563 - RNA, 64 nt, Homo Sapiens
caccccacggggcuugggcgacuacagggucuucgggccccagcccuggagcugcaggaguugg

SEQ ID NO: 284564 - RNA, 64 nt, Homo Sapiens
ugguggaaauggcaggagggugcagguacucuuggggccccagcggugggagugcaaaagaccc

SEQ ID NO: 284565 - RNA, 64 nt, Homo Sapiens
ucuccacugccaagcaggacuuguaacacuuuaagggccccaggacuucccuugcugcaggcug

SEQ ID NO: 284566 - RNA, 64 nt, Homo Sapiens
ggcuuguuucaugguguugcggagaagacacuaagggccccacauguuucuggugggcucugcg

SEQ ID NO: 284567 - RNA, 64 nt, Homo Sapiens
uggaaggaaggcacugagagcccccuuccucugagggccccaccucaccccuuggugucacccc

SEQ ID NO: 284568 - RNA, 64 nt, Homo Sapiens
gggcgacuccauaugcaaucaguagcgagcagccgggccccacagacccucaugcacucucuua

SEQ ID NO: 284569 - RNA, 64 nt, Homo Sapiens
gguuaaguacccgaggccucucuuaagauguccagggccccaggcccgcgggcacagccagccc

SEQ ID NO: 284570 - RNA, 64 nt, Homo Sapiens
ccaucacuagagugcucugacccugggcuuucacgggccccauuccaccgccuccccaacuuga

SEQ ID NO: 284571 - RNA, 59 nt, Homo Sapiens
cagaggauucccgagugugagcugucuuggggccccaccuggccaagaguagcagccac

SEQ ID NO: 284572 - RNA, 64 nt, Homo Sapiens
gugagccauagugggccaggcugcccuccaugcugggccccagcccaggucugcacucgccugg

SEQ ID NO: 284573 - RNA, 64 nt, Homo Sapiens
cagacuuggcagggccuucaagaggccugugugggggccccaggaauccuuagcugaagcgggg

SEQ ID NO: 284574 - RNA, 64 nt, Homo Sapiens
gagaaggaaaagugacgaagagagaggaggaggggggccccagauggcccuuccuuuggugcau

SEQ ID NO: 284575 - RNA, 64 nt, Homo Sapiens
caaaguugacccucggguaggguuguccugccuggggccccacuugaaggaggcaggacagagg

SEQ ID NO: 284576 - RNA, 64 nt, Homo Sapiens
uugaugggccaagggcuaaaccaguucauucccagggccccaucggauggaggagggucugcag

SEQ ID NO: 284577 - RNA, 64 nt, Homo Sapiens
gcuuccaugccuggugcugucuugcccaugucccgggccccauucugaucgggccagggacagg

SEQ ID NO: 284578 - RNA, 64 nt, Homo Sapiens
gugagcuggggugagcugggccgcaccuacccuggggccccagggagcaggacgcuccggggcc

SEQ ID NO: 284579 - RNA, 64 nt, Homo Sapiens
acaagagugcauuugucucccccuuccacccguggggccccaccuucaggucuuagugguucac

SEQ ID NO: 284580 - RNA, 64 nt, Homo Sapiens
guguccgaguguguugggucgcuuagcccucacagggccccaagggagcugacgccaccacccu

SEQ ID NO: 284581 - RNA, 64 nt, Homo Sapiens
cccagcccugccuuggucccagagcuuggagucugggccccacagccuuggucccccaaccccc

SEQ ID NO: 284582 - RNA, 64 nt, Homo Sapiens
ggugggcuagguguaaggcaucaugguggggcuggggccccagauagguuaggaaagcggaggc

SEQ ID NO: 284583 - RNA, 64 nt, Homo Sapiens
cagcucgguguucugagacccugccuugcaccaagggccccacccgcagccuagcuccucacag

SEQ ID NO: 284584 - RNA, 56 nt, Homo Sapiens
aauaccuauuucccuguuaagggggagggccccaggacaccccucaccuacuuuca

SEQ ID NO: 284585 - RNA, 64 nt, Homo Sapiens
accccaccccugggcuggggccaaggcuacauaggggccccauucaccuggaggcaucucaggc

SEQ ID NO: 284586 - RNA, 64 nt, Homo Sapiens
uccuugaccgcauggcggcagcccaccuugguaagggccccagggcccaugcgagagcugccug

SEQ ID NO: 284587 - RNA, 64 nt, Homo Sapiens
cuccagucuuguuacuguagacuguagaaagcacgggccccaggcucugagcuuaguaauaacc

SEQ ID NO: 284588 - RNA, 64 nt, Homo Sapiens
ggugaggcagaacagcuagaacuccucccugcuggggccccacagccucccucugaggcuggug

SEQ ID NO: 284589 - RNA, 64 nt, Homo Sapiens
gacgugucugguugagcucaugaugcacacuauggggccccagcagagaguuacagguuggaca

SEQ ID NO: 284590 - RNA, 64 nt, Homo Sapiens
gaggccgcggucugaacugcggcacuggacccccgggccccacgccgggccccauaguggugcg

SEQ ID NO: 284591 - RNA, 64 nt, Homo Sapiens
guggugcgggcacuggacccgggagcccagucccgggccccauacuggguuggaggucuggaca

SEQ ID NO: 284592 - RNA, 64 nt, Homo Sapiens
cagcccuucucuccuccagcccggggacccccgcgggccccagaagcagcccaguucucagaga

SEQ ID NO: 284593 - RNA, 64 nt, Homo Sapiens
gagggccuccuuccugccacgagggaggggagucgggccccaggucgcccccgcccccagcccu

SEQ ID NO: 284594 - RNA, 64 nt, Homo Sapiens
cggccccgaccggguccaggccugccgcagaauggggccccagcacccugugccccagagcucc

SEQ ID NO: 284595 - RNA, 64 nt, Homo Sapiens
ugucacgugcccgaggccacguuuaucaggacacgggccccacccguuccuuuuguuccugucc

SEQ ID NO: 284596 - RNA, 64 nt, Homo Sapiens
ggagaagcggccagggcccggcagagggucaugcgggccccacaccauuucuucccaagcccga

SEQ ID NO: 284597 - RNA, 64 nt, Homo Sapiens
gaggcacuuugucccgcccaacugaguggcccgcgggccccagucggggaaccaggcgggaggg

SEQ ID NO: 284598 - RNA, 64 nt, Homo Sapiens
cagcacccagugcucccuccucuacucugaccuggggccccagcauccuggagcacacgcucca

SEQ ID NO: 284599 - RNA, 64 nt, Homo Sapiens
gcuguggcggaagagcauguggggcuugguggaggggccccaggauuuguugggggcaaagggg

SEQ ID NO: 284600 - RNA, 64 nt, Homo Sapiens
gcccagagccuccaaagagagcugaggggauguggggccccaaacucauuaauucacugaagac

SEQ ID NO: 284601 - RNA, 64 nt, Homo Sapiens
cuguggaaggagggcugcccucuugcccuagugagggccccauguggauccacucuagugcugg

SEQ ID NO: 284602 - RNA, 64 nt, Homo Sapiens
cgagccucuugucccuucccugcucugcugcauggggccccauggcuuuggcuggccacugagg

SEQ ID NO: 284603 - RNA, 64 nt, Homo Sapiens
ccccaggcugcaggugaggcuucaggggaugcuggggccccacugccccuccgcugccuugccc

SEQ ID NO: 284604 - RNA, 64 nt, Homo Sapiens
uuuuaaaugcaauaucucuguauacagacuggcugggccccacccccugcguguggcccuccca

SEQ ID NO: 284605 - RNA, 64 nt, Homo Sapiens
acuaccagagacucugggaaauggacaagguggggggccccacucuuucucuccugcagucccg

SEQ ID NO: 284606 - RNA, 64 nt, Homo Sapiens
agaacuuggugaaauaaauuuuuaaguagaauucagugccaaggcucuacuguaugaauuaugc

SEQ ID NO: 284607 - RNA, 64 nt, Homo Sapiens
cuuuacucucucauacagccccccaaguuaauaaagugccaaccucaacauaugucuacauugc

SEQ ID NO: 284608 - RNA, 64 nt, Homo Sapiens
uuuuugacugaaaguacuaaaagucagcuuuacuagugccaaaccuuuaaauuuucaaaagaaa

SEQ ID NO: 284609 - RNA, 64 nt, Homo Sapiens
gagacugacugaguagcucauucuugugacuuacagugccaacauuuaaaaaaguaugaaaaug

SEQ ID NO: 284610 - RNA, 64 nt, Homo Sapiens
auauaauacuaaucuaaacaguacuagaaauuacagugccaagagccaccaggaggcccagcca

SEQ ID NO: 284611 - RNA, 64 nt, Homo Sapiens
gagguagagcaaugaucagaugggugcacagaccagugccaaucugaacauuguuaauggccug

SEQ ID NO: 284612 - RNA, 64 nt, Homo Sapiens
uuguacugaaguguugaccauacaucuuugagcaagugccaaauuuaucuauugcacaccacac

SEQ ID NO: 284613 - RNA, 64 nt, Homo Sapiens
aguggcuugugaauguguuuucacucagguacacagugccaacacuacaauguucuagaaauuc

SEQ ID NO: 284614 - RNA, 64 nt, Homo Sapiens
agcccagagggacucuaagagggaucacuuuccaagugccaaagcucauggggcaggaaauggg

SEQ ID NO: 284615 - RNA, 64 nt, Homo Sapiens
ccucccccugcccauucucaccucucccacagccagugccaagugaggccugguggagccauaa

SEQ ID NO: 284616 - RNA, 64 nt, Homo Sapiens
guccaggccauuugacacaccuguaccucuccugagugccaacuccaacaacugucacccucuu

SEQ ID NO: 284617 - RNA, 64 nt, Homo Sapiens
aauuauugauagcugauaauuaaacaaaagugaaagugccaacaacaguguauuggaaauuuua

SEQ ID NO: 284618 - RNA, 64 nt, Homo Sapiens
aacccuguuuauugugggauaucaauauuuuuaaagugccaacacagucaugauaggacaauau

SEQ ID NO: 284619 - RNA, 64 nt, Homo Sapiens
aucuccaccaucuauagugagccucuccauaauuagugccaaccauuagucucguucauauuuu

SEQ ID NO: 284620 - RNA, 64 nt, Homo Sapiens; identical to SEQ ID NO: 218492

SEQ ID NO: 284621 - RNA, 64 nt, Homo Sapiens; identical to SEQ ID NO: 218493

SEQ ID NO: 284622 - RNA, 64 nt, Homo Sapiens; identical to SEQ ID NO: 218494

SEQ ID NO: 284623 - RNA, 64 nt, Homo Sapiens; identical to SEQ ID NO: 218495

SEQ ID NO: 284624 - RNA, 64 nt, Homo Sapiens; identical to SEQ ID NO: 218496

SEQ ID NO: 284625 - RNA, 64 nt, Homo Sapiens; identical to SEQ ID NO: 218497

SEQ ID NO: 284626 - RNA, 64 nt, Homo Sapiens; identical to SEQ ID NO: 218498

SEQ ID NO: 284627 - RNA, 64 nt, Homo Sapiens; identical to SEQ ID NO: 218499

SEQ ID NO: 284628 - RNA, 64 nt, Homo Sapiens; identical to SEQ ID NO: 218500

SEQ ID NO: 284629 - RNA, 64 nt, Homo Sapiens; identical to SEQ ID NO: 218501

SEQ ID NO: 284630 - RNA, 64 nt, Homo Sapiens; identical to SEQ ID NO: 218502

SEQ ID NO: 284631 - RNA, 64 nt, Homo Sapiens; identical to SEQ ID NO: 218503

SEQ ID NO: 284632 - RNA, 64 nt, Homo Sapiens
agcaaagaaaaaaaaaaaagccaaaguacagaauuugaauuaucuguuguaccucuuuugcuug

SEQ ID NO: 284633 - RNA, 64 nt, Homo Sapiens
gaguauagugggguuccaugaaagaaaucaauaguugaauuaguucauaaagucaguugcucaa

SEQ ID NO: 284634 - RNA, 64 nt, Homo Sapiens
aaacaaauauauuucuuacuagcaaaauagaaaauugaauuauuuuucuccaaauugagacucu

SEQ ID NO: 284635 - RNA, 64 nt, Homo Sapiens
uuuucuccaaauugagacucucagaaaaggaagauugaauuagcguguuuuuuguuuguuuguu

SEQ ID NO: 284636 - RNA, 64 nt, Homo Sapiens
acauauuuguuauguaaacuuauacuauguaaacuugaauuaguuuuuugcuuccuugaauuaa

SEQ ID NO: 284637 - RNA, 64 nt, Homo Sapiens
auacuauguaaacuugaauuaguuuuuugcuuccuugaauuaauaaagcccauuaaugcaaauc

SEQ ID NO: 284638 - RNA, 64 nt, Homo Sapiens
acuugauuauacuauuuauaauuggcacaguacuuugaauuaugccaguacuacauuguaaaac

SEQ ID NO: 284639 - RNA, 64 nt, Homo Sapiens
aucucacuuuaaaaaugaccaaaacaugucuuucuugaauuaacuuugaauaaaaguuuguaua

SEQ ID NO: 284640 - RNA, 64 nt, Homo Sapiens
gugcuuaaugcaugguaggcccuuaguaauguuuuugaauuaaugaggcaugauucuaaaugcc

SEQ ID NO: 284641 - RNA, 64 nt, Homo Sapiens
uugauaaaguuucuuucuuacagaaguucugauauugaauuaaggaaugggucacuacuuaaga

SEQ ID NO: 284642 - RNA, 64 nt, Homo Sapiens
uuaugcucuguuuccaacugcauuuccuuuccaauugaauuaaaguguggccucguuuuuaguc

SEQ ID NO: 284643 - RNA, 64 nt, Homo Sapiens
uugcauucacagagaggucauugguuauagagacuugaauuaauaagugacauuaugccaguuu

SEQ ID NO: 284644 - RNA, 64 nt, Homo Sapiens
ucuuugguaaaucaagauccagucaggguuucucuugaauuauuuuggaacaaugccaggaucc

SEQ ID NO: 284645 - RNA, 64 nt, Homo Sapiens
acaguauaccucucaacaguuuauaaauaauauguugaauuaugucagugugggcagcaguaga

SEQ ID NO: 284646 - RNA, 64 nt, Homo Sapiens
uuugcauacuuuaaaaucaccuaacuuggacugcuugaauuacauuggcuuuuagaaccgaaau

SEQ ID NO: 284647 - RNA, 64 nt, Homo Sapiens
uggaagcuuucuucucugaagucgauauaugguuuugaauuacuagagcuuuggucaguauuuc

SEQ ID NO: 284648 - RNA, 64 nt, Homo Sapiens
cagcaucacuauguagcauucuguuuuagcaucuuugaauuaugaucauuugauuuggcuaauu

SEQ ID NO: 284649 - RNA, 64 nt, Homo Sapiens
cauuacauauuuaguuuuaaaaggaggagucaccuugaauuauuuucugagucaccuugaguua

SEQ ID NO: 284650 - RNA, 64 nt, Homo Sapiens
gaaaauacugaaaguuugauuuuucuuuccauauuugaauuaauuuuuucuguuugacuggaag

SEQ ID NO: 284651 - RNA, 64 nt, Homo Sapiens
ccagcuaguccuagaguucuauauuucuacauaguugaauuauuuuaucaugcuguugcugggg

SEQ ID NO: 284652 - RNA, 64 nt, Homo Sapiens
uacuagaaucaauuuguuccuuguuaaaggccuuuugaauuauacugcagggcaucuugugaau

SEQ ID NO: 284653 - RNA, 64 nt, Homo Sapiens
augggaaguuagggaaaaugugugauuuuguguuuugaauuacugucagaauuacauacacaau

SEQ ID NO: 284654 - RNA, 64 nt, Homo Sapiens
cauucugacauucuuuggacgcagaguuggauaauugaauuaguuucuuuccucuuccagcuga

SEQ ID NO: 284655 - RNA, 64 nt, Homo Sapiens
augagagaaaauuauguaccaagcucaggguuuguugaauuagcuagccauagauggagaaaca

SEQ ID NO: 284656 - RNA, 64 nt, Homo Sapiens
aaauaugcaaguuagaaauugaacuugaguacaguugaauuauuuucuuagagaaguaugagug

SEQ ID NO: 284657 - RNA, 64 nt, Homo Sapiens
uagugaauaaagaaauaaacccuuugugaaauuguugaauuagugccugagaaaucccuaugua

SEQ ID NO: 284658 - RNA, 64 nt, Homo Sapiens
agaccagaaaguaacuucaauugcuagaaauggauugaauuaguccuuuuuguuguuguuguug

SEQ ID NO: 284659 - RNA, 64 nt, Homo Sapiens
ggaaguuucuugucugugaugaaauggucucccuuugaauuaugugcgcaccuuugcuaauaag

SEQ ID NO: 284660 - RNA, 64 nt, Homo Sapiens
gacagugcucuuaauaguuuggguuugaaagauuuugaauuauacagcaaagagcuuugugauu

SEQ ID NO: 284661 - RNA, 64 nt, Homo Sapiens
aauaacacagucuuuuuaaauugacaaaaaaaaauugaauuaaauaggagaacagagaugagau

SEQ ID NO: 284662 - RNA, 64 nt, Homo Sapiens
ucauccaaauguacugagguuuguucacagauacuugaauuaaugggcgagagaggccagggau

SEQ ID NO: 284663 - RNA, 64 nt, Homo Sapiens
uugauacacacagaggggaaucugaagauaagguuugaauuaaauguaguauucaucuuuguau

SEQ ID NO: 284664 - RNA, 64 nt, Homo Sapiens
ggcagggaauauacuuauguuuggauuuuuuucuuugaauuauuauuuuucuuuacuaaucauu

SEQ ID NO: 284665 - RNA, 64 nt, Homo Sapiens
uuaauaaaaucuuuugacacauuucccuaacaaauugaauuaguaccaguuguaacaucuuacc

SEQ ID NO: 284666 - RNA, 64 nt, Homo Sapiens
aucucagaagucaagcugauaacaaagaugaaacuugaauuaccgagacagaaacgaagcccag

SEQ ID NO: 284667 - RNA, 64 nt, Homo Sapiens
aaugauuuucauuacuugaguauuucaucaguuauugaauuaagauguuuuuauggcuauuauc

SEQ ID NO: 284668 - RNA, 64 nt, Homo Sapiens
aacaaccaaggcaucucagcaguucaggcgcuccuugaauuacccuugugaaaguuggugucac

SEQ ID NO: 284669 - RNA, 64 nt, Homo Sapiens
auccuuuguuagaguggucgcacacugacccuauuugaauuaauccugugcuaguuuucauguu

SEQ ID NO: 284670 - RNA, 64 nt, Homo Sapiens
uaagcuaagaucacuauaggcugcuuugaaugaguugaauuacauuggaagagacugcagacua

SEQ ID NO: 284671 - RNA, 64 nt, Homo Sapiens
agguuagucuucaauagacuuguaccugccaugaacaugacaaacuuauaaaaaacuaguguca

SEQ ID NO: 284672 - RNA, 64 nt, Homo Sapiens
ucucaagguacucacagaucuagcaucuuauucuacaugacaacaaucccaaacucugcccucu

SEQ ID NO: 284673 - RNA, 64 nt, Homo Sapiens
gggugcagaaaggugaauuaacuuuacaaaguagacaugacaagugaacagcagagcugggauc

SEQ ID NO: 284674 - RNA, 64 nt, Homo Sapiens
gugucuugguugagagaauaaccucauaguaccaacaugacaugugacuuggaaagagacuaga

SEQ ID NO: 284675 - RNA, 64 nt, Homo Sapiens
ccauuuucuagcagcugccaccuuucugaauagaacaugacaugauguacuauucuauaaauug

SEQ ID NO: 284676 - RNA, 64 nt, Homo Sapiens
cugugaguuuguguguuuguaauuuuuggguacaacaugacaagaauaaugugauggcaaucuu

SEQ ID NO: 284677 - RNA, 64 nt, Homo Sapiens
uugagauuuuuuuuaaucaagcccaauucucucuacaugacauaguucaaaaggaaaagaguau

SEQ ID NO: 284678 - RNA, 64 nt, Homo Sapiens
ugguggcacgcuguuuuuacgagugcagcaagcaacaugacagagcugugguuaggcuugguua

SEQ ID NO: 284679 - RNA, 64 nt, Homo Sapiens
auuuuccaagcguguaauaaugauguuuuuccuaacaugacagaugaguaguaaauguugauau

SEQ ID NO: 284680 - RNA, 64 nt, Homo Sapiens
ugacagaugaguaguaaauguugauauauccuauacaugacagugugagacuuuuucauuaaau

SEQ ID NO: 284681 - RNA, 64 nt, Homo Sapiens
guuuaguuaauucuuguauaagcuacacuaaaccacaugacaguuaugauacaugcauaacuug

SEQ ID NO: 284682 - RNA, 64 nt, Homo Sapiens
uuguaaucauaagagauggucuaguaaugguuuuacaugacaauacuuucaaaauuauuaguga

SEQ ID NO: 284683 - RNA, 64 nt, Homo Sapiens
cacuguuuucaauaaaugcagcacuuaacagagugcauagcauagauuaacuaauagaugcaua

SEQ ID NO: 284684 - RNA, 64 nt, Homo Sapiens
uaacagagugcauagcauacauuaacuaauagaugcauagcacuaaaagucugaugaggaaaag

SEQ ID NO: 284685 - RNA, 64 nt, Homo Sapiens
aagaauuguaguggucauggacagcuaagacugagcauagcaguucacauggucuggguaaaca

SEQ ID NO: 284686 - RNA, 64 nt, Homo Sapiens
gccaggccacauggcuggagaggaauuucagggagcauagcaucgggaggaugcuacauaucca

SEQ ID NO: 284687 - RNA, 64 nt, Homo Sapiens
ugcauguauacgcccauacagacaugcacacacagacuccuacuccauuagcuaacauacccuc

SEQ ID NO: 284688 - RNA, 64 nt, Homo Sapiens
uucuuccugaauaaugucuucaguuucuugaggagacuccuaguuuugguuuucaaauuacuug

SEQ ID NO: 284689 - RNA, 64 nt, Homo Sapiens
ccccaaccacugggucaugcgauccuggauccuagacuccuaugucaugggaucccagcaucca

SEQ ID NO: 284690 - RNA, 64 nt, Homo Sapiens
ccccaaccauugggucaugggauccuggauccuagacuccuaugccacgagaucccaguaccca

SEQ ID NO: 284691 - RNA, 64 nt, Homo Sapiens
uaucugauuuuaaaaauuccuuuagucuguaaaacuccuagagggagggagguaacugaauuca

SEQ ID NO: 284692 - RNA, 64 nt, Homo Sapiens
cugcaucuucguccagcgacccuuugcuuuucggcuccuagaauccuuagagucugaauuccuu

SEQ ID NO: 284693 - RNA, 64 nt, Homo Sapiens
ucccauccugagcucucucaccuaccugcucucucuccuagagcaggauacugggguacuuuua

SEQ ID NO: 284694 - RNA, 64 nt, Homo Sapiens; identical to SEQ ID NO: 154522

SEQ ID NO: 284695 - RNA, 64 nt, Homo Sapiens; identical to SEQ ID NO: 154523

SEQ ID NO: 284696 - RNA, 64 nt, Homo Sapiens; identical to SEQ ID NO: 154524

SEQ ID NO: 284697 - RNA, 64 nt, Homo Sapiens; identical to SEQ ID NO: 154525

SEQ ID NO: 284698 - RNA, 64 nt, Homo Sapiens; identical to SEQ ID NO: 154526

SEQ ID NO: 284699 - RNA, 64 nt, Homo Sapiens; identical to SEQ ID NO: 154527

SEQ ID NO: 284700 - RNA, 64 nt, Homo Sapiens; identical to SEQ ID NO: 154528

SEQ ID NO: 284701 - RNA, 64 nt, Homo Sapiens; identical to SEQ ID NO: 154529

SEQ ID NO: 284702 - RNA, 64 nt, Homo Sapiens; identical to SEQ ID NO: 154530

SEQ ID NO: 284703 - RNA, 64 nt, Homo Sapiens; identical to SEQ ID NO: 154531

SEQ ID NO: 284704 - RNA, 64 nt, Homo Sapiens; identical to SEQ ID NO: 154532

SEQ ID NO: 284705 - RNA, 64 nt, Homo Sapiens; identical to SEQ ID NO: 154533

SEQ ID NO: 284706 - RNA, 64 nt, Homo Sapiens; identical to SEQ ID NO: 154534

SEQ ID NO: 284707 - RNA, 64 nt, Homo Sapiens; identical to SEQ ID NO: 154535

SEQ ID NO: 284708 - RNA, 64 nt, Homo Sapiens; identical to SEQ ID NO: 154536

SEQ ID NO: 284709 - RNA, 64 nt, Homo Sapiens; identical to SEQ ID NO: 154537

SEQ ID NO: 284710 - RNA, 64 nt, Homo Sapiens; identical to SEQ ID NO: 154538

SEQ ID NO: 284711 - RNA, 64 nt, Homo Sapiens; identical to SEQ ID NO: 154539

SEQ ID NO: 284712 - RNA, 64 nt, Homo Sapiens; identical to SEQ ID NO: 154540

SEQ ID NO: 284713 - RNA, 64 nt, Homo Sapiens; identical to SEQ ID NO: 154541

SEQ ID NO: 284714 - RNA, 64 nt, Homo Sapiens; identical to SEQ ID NO: 154542

SEQ ID NO: 284715 - RNA, 64 nt, Homo Sapiens; identical to SEQ ID NO: 154543

SEQ ID NO: 284716 - RNA, 64 nt, Homo Sapiens; identical to SEQ ID NO: 154544

SEQ ID NO: 284717 - RNA, 64 nt, Homo Sapiens; identical to SEQ ID NO: 154545

SEQ ID NO: 284718 - RNA, 64 nt, Homo Sapiens; identical to SEQ ID NO: 154546

SEQ ID NO: 284719 - RNA, 64 nt, Homo Sapiens; identical to SEQ ID NO: 154547

SEQ ID NO: 284720 - RNA, 64 nt, Homo Sapiens; identical to SEQ ID NO: 154548

SEQ ID NO: 284721 - RNA, 64 nt, Homo Sapiens; identical to SEQ ID NO: 154549

SEQ ID NO: 284722 - RNA, 64 nt, Homo Sapiens; identical to SEQ ID NO: 154550

SEQ ID NO: 284723 - RNA, 64 nt, Homo Sapiens; identical to SEQ ID NO: 154551

SEQ ID NO: 284724 - RNA, 64 nt, Homo Sapiens
aggguugauggguuaccuuaaaaaguugauuuccuugaagcaguuugaaaauuugaauugaguc

SEQ ID NO: 284725 - RNA, 64 nt, Homo Sapiens
uguuuugcauuugcuauaauuuucaaaauuauuuuugaagcaagacaaaaguuuaaugucagcu

SEQ ID NO: 284726 - RNA, 64 nt, Homo Sapiens
gaauccaaccaguuucuuuguuaaaaggguccuuuugaagcaauuaagugcugguaagaauauu

SEQ ID NO: 284727 - RNA, 64 nt, Homo Sapiens
ccuuccuuucuuuccugcuuccuuugccuuacaauugaagcagcccgugguaccaucacaguau

SEQ ID NO: 284728 - RNA, 64 nt, Homo Sapiens
gaauggugaaaaagaacagaaagucuucaguuucuugaagcacuccuguccucaucccucugag

SEQ ID NO: 284729 - RNA, 64 nt, Homo Sapiens
ggucagcucagucaagacagacauccuggcguacuugaagcaauucaaaaccaaauaggaaggu

SEQ ID NO: 284730 - RNA, 64 nt, Homo Sapiens
cuucauuaaugcagauaaaaugauugagagccauuugaagcaaucugucuugauuugaagcaua

SEQ ID NO: 284731 - RNA, 64 nt, Homo Sapiens
ugauugagagccauuugaagagcacugucuugauuugaagcauauguuuaugcugcuggaacuu

SEQ ID NO: 284732 - RNA, 64 nt, Homo Sapiens
cccuagucuccaccugagacccugggagagaaguuugaagcacaacucccuuaaggucuccaaa

SEQ ID NO: 284733 - RNA, 64 nt, Homo Sapiens
gguuauuuuggaguguaggugacuuguuuacucauugaagcagauuucugcuuccuuuuauuuu

SEQ ID NO: 284734 - RNA, 64 nt, Homo Sapiens
gaucaaauaaaaaucuugugagauuguuuauguuuugaagcaggaggauuucuugagauuugau

SEQ ID NO: 284735 - RNA, 64 nt, Homo Sapiens
ugaaauauuuucuuauugaauuaauauuuuugucuugaagcauuuucuagugauagaauguauu

SEQ ID NO: 284736 - RNA, 64 nt, Homo Sapiens
ccugccuauuaacaaaaacccaauuuuguucauauugaagcaugaaauaaaugagagcaaggua

SEQ ID NO: 284737 - RNA, 64 nt, Homo Sapiens
auguaaaacugcaaacuuaaaaaccugcaucuucuugaagcaucaguuuuacuuaccaaauggu

SEQ ID NO: 284738 - RNA, 64 nt, Homo Sapiens
ugcagguuuguuuugcaugcuggacuagagcauauugaagcaugacugacuguuaaguuauaag

SEQ ID NO: 284739 - RNA, 64 nt, Homo Sapiens
accaugaugaaguucgccugcuuugaacguacuguugaagcacuguacaaguuugugguuccua

SEQ ID NO: 284740 - RNA, 64 nt, Homo Sapiens
aauuaacacucaaaacuauuuuuaaaauaugcauuugaagcaucuguugauuguauggauguaa

SEQ ID NO: 284741 - RNA, 64 nt, Homo Sapiens
cuacaacauuuauuuaaaaagguaaaucuuuuuguugaagcagcaaguuaucugguagaacuua

SEQ ID NO: 284742 - RNA, 64 nt, Homo Sapiens
ucuuuuugagaauuuguuuacaguguucucuuauuugaagcaaaaaggagaucuuccaccuaaa

SEQ ID NO: 284743 - RNA, 64 nt, Homo Sapiens
cauaaaacugagacugagacaaaauuauuuguuguugaagcaguauuguaaaacuagaaucauc

SEQ ID NO: 284744 - RNA, 64 nt, Homo Sapiens
uuuugcuaauguuuuauucacucacauuaucugcuugaagcacauaacauauucuuuaguagaa

SEQ ID NO: 284745 - RNA, 64 nt, Homo Sapiens
aauagauaugagaggccauacaaucccucaugaguugaagcauuacaaauguagugacaguggc

SEQ ID NO: 284746 - RNA, 64 nt, Homo Sapiens
cauauuugcaguuuacugaagaauauguuauagguugaagcacaaugacaagcucaaagugaca

SEQ ID NO: 284747 - RNA, 64 nt, Homo Sapiens
uuuuugagaaauaguaaaauuauuauagagucuuuugaagcaaugaaauucuccagaaagauag

SEQ ID NO: 284748 - RNA, 64 nt, Homo Sapiens
uggugaccuagcauuuucaccaagaaguggacguggagaggaccagagugaucaaggguguaug

SEQ ID NO: 284749 - RNA, 64 nt, Homo Sapiens
caacauggagauuagauuagagcaaggauguaagggagaggaagggacauagcaguauuucagg

SEQ ID NO: 284750 - RNA, 64 nt, Homo Sapiens
gauguugguggugcagccccaggaccaagcuuaaggagaggagagcaucugcucugagacggau

SEQ ID NO: 284751 - RNA, 64 nt, Homo Sapiens
aggugaccccaucucugcugcuucugggccugauggagaggagaacacuagacaugccaacucg

SEQ ID NO: 284752 - RNA, 64 nt, Homo Sapiens
ggaggguccccacuggcccggcccaagcaccccuggagaggaagcuccucaagcagcgauugga

SEQ ID NO: 284753 - RNA, 64 nt, Homo Sapiens
aaagaucugagaauguccuuggcugaccaguuugggagaggagauagagucagagcggguuugg

SEQ ID NO: 284754 - RNA, 64 nt, Homo Sapiens
uacucagagaccccaacaggacaagggugaacugggagaggacuuggcugagcccaggaaagcg

SEQ ID NO: 284755 - RNA, 64 nt, Homo Sapiens
uggaaauuuguucuuguucuacaguuccuagucuggagaggauaggcacaggagucucuauaga

SEQ ID NO: 284756 - RNA, 64 nt, Homo Sapiens
cgggagggcuggagaccaggccaugggcccucacggagaggaagggaaggaaggagagggaggg

SEQ ID NO: 284757 - RNA, 64 nt, Homo Sapiens
ccccucuccaggcccagcuccccucuuggcagggggagaggauggcccagcaggccuggcccag

SEQ ID NO: 284758 - RNA, 64 nt, Homo Sapiens
guccugcugaagccaggagggucuucccaagauaggagaggaaccgcagguggugagcggcugg

SEQ ID NO: 284759 - RNA, 64 nt, Homo Sapiens
aauugauucuucaaauuaaaaguucuugagagaaggagaggaagauacagcagacauaggacug

SEQ ID NO: 284760 - RNA, 64 nt, Homo Sapiens
cgcucggaaauccucucccgugccuuuagaggaaggagaggauugcugaggaaugcagggacgc

SEQ ID NO: 284761 - RNA, 64 nt, Homo Sapiens
guaucuuuuccuccuguguuuaauguuucacuagggagaggaaauaaagcagaaggaacgugug

SEQ ID NO: 284762 - RNA, 64 nt, Homo Sapiens
ucuaugugagcaagugagagaagguuagguaaggggagaggauggaaugcuugccuccaaugaa

SEQ ID NO: 284763 - RNA, 64 nt, Homo Sapiens
ucuucuuccacacuaggcugggcccagcaauacaggagaggaugaagggaggagcuccaggagg

SEQ ID NO: 284764 - RNA, 64 nt, Homo Sapiens
ugcauaaccaaaggggugacucugaauguauccaggagaggaacgaaugucgugaagaaguauc

SEQ ID NO: 284765 - RNA, 64 nt, Homo Sapiens
agagaaggcuuccuggguuucuccguagacgaagggagaggaggcugagggguuuaacaacaug

SEQ ID NO: 284766 - RNA, 64 nt, Homo Sapiens
ucuuccuacacgcgcauugagggaaaaaugugggggagaggacuggcuauaaaacaaucuuguu

SEQ ID NO: 284767 - RNA, 64 nt, Homo Sapiens
cggaggggaguagagaaguugccaucucaugaggggagaggagacggggccuuaucgggcucca

SEQ ID NO: 284768 - RNA, 64 nt, Homo Sapiens
aaagcaguugaaaacuaguuaccuggaggguuugggagaggagcgcauaagugucuucauuccc

SEQ ID NO: 284769 - RNA, 64 nt, Homo Sapiens
gcugugagagcaccggcaccaggaggaccccaggggagaggagaucuggucccaggagcucagg

SEQ ID NO: 284770 - RNA, 64 nt, Homo Sapiens
cuucccuccugcagugcugagaggcagcgaggacggagaggacagcggcaucucuaggcucuuc

SEQ ID NO: 284771 - RNA, 64 nt, Homo Sapiens
cucucacuacagccagaagaggccuuucccaccgggagaggaacuuccagaccagccccucaca

SEQ ID NO: 284772 - RNA, 64 nt, Homo Sapiens
cugcagaggccagcccggggcuggggaggcgcaaggagaggagggauccaguggggccgugggc

SEQ ID NO: 284773 - RNA, 64 nt, Homo Sapiens
gcucugccucauucccuguucguaggaaggugcaggagaggaggugggcaagcuuauggguuuc

SEQ ID NO: 284774 - RNA, 64 nt, Homo Sapiens
ccaaggggacaaauaaaggcaaauuuagcaauaaggagaggaguauuuuccagauccuaauugg

SEQ ID NO: 284775 - RNA, 64 nt, Homo Sapiens
caggggccgagggggugcuuugcaggagaaggguggagaggaggaaaauaaauaucgcuuagaa

SEQ ID NO: 284776 - RNA, 64 nt, Homo Sapiens
ggcgcgcaggcagggagaagggccgggggggguaggagaggagaaaaaaaaagugaaaaaaaga

SEQ ID NO: 284777 - RNA, 64 nt, Homo Sapiens
ugaggugagacuucccagaccccggaggcguggaggagaggagacuguuugaugugguacaggg

SEQ ID NO: 284778 - RNA, 64 nt, Homo Sapiens
aauuucugcauggggcgugauugaagggcuucugggagaggaggaguccugagaagcuuugacc

SEQ ID NO: 284779 - RNA, 64 nt, Homo Sapiens
ucccagcaaauugggaucacguguuugaaaugcaggagaggauaguggcugacacugagugaag

SEQ ID NO: 284780 - RNA, 64 nt, Homo Sapiens
agggugagaggugaggcaagguucauccugaaugggagaggaagucgaaccacugcuguguguc

SEQ ID NO: 284781 - RNA, 64 nt, Homo Sapiens
aauacuaaguuagaguuaguggauuucuaguuuaggagaggagcucaaaacuauaaucuuuaac

SEQ ID NO: 284782 - RNA, 64 nt, Homo Sapiens
gggaggucauuuaucugaguaggccagugggagaggagaggaggugcaucaucuguacuugaag

SEQ ID NO: 284783 - RNA, 64 nt, Homo Sapiens
ggagggggaggucauuuaucugaagaggccagugggagaggagaauacaugcaucaucuguacu

SEQ ID NO: 284784 - RNA, 64 nt, Homo Sapiens
gguuuucucaggaugaugucuugggugaggguagggagaggacaaggggucaccgagcccuucc

SEQ ID NO: 284785 - RNA, 64 nt, Homo Sapiens
uucacugggcuccacccccaccuccaggaggggaggagaggaccugacaucuguagguggcccc

SEQ ID NO: 284786 - RNA, 64 nt, Homo Sapiens
auccccacgugaacaaaaugggaaggagccgugaggagaggagugaggcaacaggcacccgaag

SEQ ID NO: 284787 - RNA, 64 nt, Homo Sapiens
cccccaucucuaagucacucugaaagggaguuguggagaggagacgccuccagacucucagaag

SEQ ID NO: 284788 - RNA, 64 nt, Homo Sapiens
cugagcaaauaaguacuuuccagccuguguuucaggagaggacugugcuggaucaugcuugccc

SEQ ID NO: 284789 - RNA, 64 nt, Homo Sapiens
cucccaaacaggacaagcccaggcagggcugcauggagaggaauggaaccuggagcuagaauua

SEQ ID NO: 284790 - RNA, 64 nt, Homo Sapiens
gggcagaggcaaaucaccgggcagagggaggggaggagaggaggccgcacucucccugucucuc

SEQ ID NO: 284791 - RNA, 64 nt, Homo Sapiens
cccccagccagggaucccagaggcugaggguuggggagaggaagccaucaucucauuaccucug

SEQ ID NO: 284792 - RNA, 64 nt, Homo Sapiens
ucuuaagauuacaagauaaacuguaaaguugaggggagaggaaacggcagguggccuaaggcug

SEQ ID NO: 284793 - RNA, 64 nt, Homo Sapiens
cacaguuugcuauuugcuuuggccaaagucaguaggagaggaugaccaagcuuguuucccugcu

SEQ ID NO: 284794 - RNA, 64 nt, Homo Sapiens
uuuuucugagcgauuauuauuaaccucagcucugggagaggauuuauagcaaacuuggaauuug

SEQ ID NO: 284795 - RNA, 64 nt, Homo Sapiens
aguaaggugcaguucccccacacuaggggauauaggagaggaaacuuggguucugauauugccg

SEQ ID NO: 284796 - RNA, 64 nt, Homo Sapiens
gauggagaagcucugcucgcuuucuggcagggaaggagaggagggggccacuugcuuaauugca

SEQ ID NO: 284797 - RNA, 64 nt, Homo Sapiens
gcgccucuugggcugcucccguccacagcaccacggagaggacacgggagagagccgcagcucc

SEQ ID NO: 284798 - RNA, 64 nt, Homo Sapiens
auuccugugaggugucucaaaccaaaguuaacagggagaggaugggggaggggacaaauuagaa

SEQ ID NO: 284799 - RNA, 64 nt, Homo Sapiens
agugaaaugaaaacgggcugaaaauaccaccccaggagaggaccucgccccaagcaagccagug

SEQ ID NO: 284800 - RNA, 64 nt, Homo Sapiens
agugguugaggucugggggccaggccacauggcuggagaggaauuucagggagcauagcaucgg

SEQ ID NO: 284801 - RNA, 64 nt, Homo Sapiens
ccacaggucagaauaugggacaggacauggucagggagaggacccugugaguuggugacauaua

SEQ ID NO: 284802 - RNA, 64 nt, Homo Sapiens
cucuaccaagcuauccuggcucuuuggagaucaaggagaggaggcaacuuuccuuguuccccau

SEQ ID NO: 284803 - RNA, 64 nt, Homo Sapiens
guuagagcugacacaaaccugccuggguuuaaggggagaggaaauauugcuggggucauuuaug

SEQ ID NO: 284804 - RNA, 64 nt, Homo Sapiens
ucuucaguacuauugaaggaucuuccaguucugaggagaggaggcaaaucugaacaagcccaag

SEQ ID NO: 284805 - RNA, 64 nt, Homo Sapiens
uaaagcagccgguguggcaggcugcggcacuuauggagaggaucacgucuucccuucucucccu

SEQ ID NO: 284806 - RNA, 64 nt, Homo Sapiens
ggccaaccagugaacaccagcugugaaggccuugggagaggaggaacaggcccuugggcagaug

SEQ ID NO: 284807 - RNA, 64 nt, Homo Sapiens
ucccccucugagcaacagacugcuugucuugcuaggagaggaggauggggggcugagcacucag

SEQ ID NO: 284808 - RNA, 64 nt, Homo Sapiens
ugauguccggguccuuuaucauccuauucauccuggagaggaaaagugucgggcaaagggggau

SEQ ID NO: 284809 - RNA, 64 nt, Homo Sapiens
gugugugggaaugauugaguccuguuugcaagcuggagaggagcucucccuuugcuaguacuuu

SEQ ID NO: 284810 - RNA, 64 nt, Homo Sapiens
uugugaucaggccccuggggcggucaauaauuguggagaggagagaaugagagaguguggaaaa

SEQ ID NO: 284811 - RNA, 64 nt, Homo Sapiens
cacgggggaggccgaggcaggggcugggcagaggggagaggaagcacaagaagugggaguggga

SEQ ID NO: 284812 - RNA, 64 nt, Homo Sapiens
gcagaggggagaggaagcacaagaagugggagugggagaggaagccacgugcuggagaguagac

SEQ ID NO: 284813 - RNA, 64 nt, Homo Sapiens
ccuguucugcccacucuggggaauagggaggggaggagaggagaggagagggaggauccuggag

SEQ ID NO: 284814 - RNA, 64 nt, Homo Sapiens
ucugcccacucuggggaauagggaggggaggagaggagaggagagggaggauccuggaggacug

SEQ ID NO: 284815 - RNA, 64 nt, Homo Sapiens
ccuagacuuauauacuaguuaguggugcagccagggagaggacucagauuuccuggaggcaaag

SEQ ID NO: 284816 - RNA, 64 nt, Homo Sapiens
ggcugagauucgggaggaagugugacaccaagcaggagaggaagaaugauuuucuuuguacuua

SEQ ID NO: 284817 - RNA, 64 nt, Homo Sapiens
ccgcugcucugugucguguuugcuguggccgcagggagaggagcaggacacgcaccuuuccagg

SEQ ID NO: 284818 - RNA, 64 nt, Homo Sapiens
ucccccaggcccuccccagccgacgacagccaccggagaggagaucggaacacgauugucucag

SEQ ID NO: 284819 - RNA, 64 nt, Homo Sapiens
agaacugaacccggaccugcucacugcccuggcuggagaggagcacaacagaugccacgucuuc

SEQ ID NO: 284820 - RNA, 64 nt, Homo Sapiens
ggacggcaccugguaugcgggaggaacagagugaggagaggagggcagggcgugcagggccuug

SEQ ID NO: 284821 - RNA, 64 nt, Homo Sapiens
guccuacccccuuuccccaccgagagcugggccgggagaggaccgcagggcagguggcgugagg

SEQ ID NO: 284822 - RNA, 64 nt, Homo Sapiens
cccccaagugagauugcacauuuaacuacuguaaggagaggagcggcguuggcaaaugugaacc

SEQ ID NO: 284823 - RNA, 64 nt, Homo Sapiens
ucuucuccuacaucccccaggccuuuugcaagaaggagaggaaugggggagaggacgugaggga

SEQ ID NO: 284824 - RNA, 64 nt, Homo Sapiens
cccccaggccuuuugcaagaaggagaggaaugggggagaggacgugagggaccacccccaccca

SEQ ID NO: 284825 - RNA, 57 nt, Homo Sapiens
cagcgggccccgucucuauaggggagaggagaggacuccccggaggagaagaaguag

SEQ ID NO: 284826 - RNA, 52 nt, Homo Sapiens
ggacucagcgggccccgucuggggagaggagaccccggaggagaagaaguag

SEQ ID NO: 284827 - RNA, 64 nt, Homo Sapiens
acccagguuggcgacugcaacaggaacuuggaguggagaggaaaagcaucagaaagaggcagac

SEQ ID NO: 284828 - RNA, 64 nt, Homo Sapiens
uauaaugcgggugagaguaaugaggcuuggggcuggagaggacaagauggguaaacccucacau

SEQ ID NO: 284829 - RNA, 64 nt, Homo Sapiens
aagggccuccgaaaccccaaugagggaagggagaggagaggaaccugccugcucaccccugggc

SEQ ID NO: 284830 - RNA, 64 nt, Homo Sapiens
ggaacaagggccuccgaaacugggcugagggaagggagaggagaaccgacugccugcucacccc

SEQ ID NO: 284831 - RNA, 64 nt, Homo Sapiens
gccagccaagaagaaaauuuaaaggcaacuugcaggagaggagaauaucacaccccaaguggau

SEQ ID NO: 284832 - RNA, 64 nt, Homo Sapiens
uucuugguuacuuguauucaaagaguuggucuguggagaggauuagcccugcaugcacuggcug

SEQ ID NO: 284833 - RNA, 64 nt, Homo Sapiens
ugauuucugcccagggauuuauaauuacaucuuuggagaggauugaggguugaggcaggugcca

SEQ ID NO: 284834 - RNA, 64 nt, Homo Sapiens
gaugcaacucgcccuguuugugguugggguggggggagaggagguuccaaagaguguggaauuu

SEQ ID NO: 284835 - RNA, 64 nt, Homo Sapiens
ccuguguacccacuggguauccguuagagguaagggagaggagaggauugauagaguguugcaa

SEQ ID NO: 284836 - RNA, 64 nt, Homo Sapiens
guacccacuggguauccguuagagguaagggagaggagaggauugauagaguguugcaaaagua

SEQ ID NO: 284837 - RNA, 64 nt, Homo Sapiens
augaauggugaaagagaguggagauacggaagggggagaggagaggagaaauguggacagaggg

SEQ ID NO: 284838 - RNA, 64 nt, Homo Sapiens
uggugaaagagaguggagauacggaagggggagaggagaggagaaauguggacagagggcuuga

SEQ ID NO: 284839 - RNA, 64 nt, Homo Sapiens
gcgcuagagcauucugggguaucuggagucugaaggagaggaguuuggguuccagacagagugg

SEQ ID NO: 284840 - RNA, 64 nt, Homo Sapiens
uguggaguggaggggucagccccaagguggucuuggagaggaggguagagaggacaguuuagga

SEQ ID NO: 284841 - RNA, 64 nt, Homo Sapiens
ucccuccuugggcucuucccuuuuuauauugcuucccugcuauuuuguuuguucauuuucagua

SEQ ID NO: 284842 - RNA, 64 nt, Homo Sapiens
ggcaagaccacaucuaauuccagcugccaguacucccugcuaaacucuucugccucgucauggc

SEQ ID NO: 284843 - RNA, 64 nt, Homo Sapiens
ugguccagcacauccacgcuguauacgccacccacccugcuagugacuuaguagccgucuuggu

SEQ ID NO: 284844 - RNA, 64 nt, Homo Sapiens
auucugucuuuacuccguggcaucuguggaauaacccugcuaauguaacacgugagaaagccuu

SEQ ID NO: 284845 - RNA, 64 nt, Homo Sapiens
caccuaccaggugucugagccugaggugucccuccccugcuagucgcuucggcagaauggagag

SEQ ID NO: 284846 - RNA, 64 nt, Homo Sapiens
gugcuguguggccuucuguaugguuccuagccagcccugcuaaugggugagagggagaagaccu

SEQ ID NO: 284847 - RNA, 64 nt, Homo Sapiens
aucagucucggcucuucugauaaucucugccaucucgcuaaaucucauuuaaucauuucaaagu

SEQ ID NO: 284848 - RNA, 64 nt, Homo Sapiens
uacuucaucuccaucuagcaaagcauagcugacuucgcuaaaguugcuacaucaaacggaaugg

SEQ ID NO: 284849 - RNA, 64 nt, Homo Sapiens; identical to SEQ ID NO: 277339

SEQ ID NO: 284850 - RNA, 64 nt, Homo Sapiens; identical to SEQ ID NO: 277340

SEQ ID NO: 284851 - RNA, 64 nt, Homo Sapiens; identical to SEQ ID NO: 277341

SEQ ID NO: 284852 - RNA, 64 nt, Homo Sapiens; identical to SEQ ID NO: 277342

SEQ ID NO: 284853 - RNA, 64 nt, Homo Sapiens; identical to SEQ ID NO: 277343

SEQ ID NO: 284854 - RNA, 64 nt, Homo Sapiens; identical to SEQ ID NO: 277344

SEQ ID NO: 284855 - RNA, 64 nt, Homo Sapiens; identical to SEQ ID NO: 277345

SEQ ID NO: 284856 - RNA, 64 nt, Homo Sapiens; identical to SEQ ID NO: 277346

SEQ ID NO: 284857 - RNA, 64 nt, Homo Sapiens; identical to SEQ ID NO: 277347

SEQ ID NO: 284858 - RNA, 64 nt, Homo Sapiens; identical to SEQ ID NO: 277348

SEQ ID NO: 284859 - RNA, 64 nt, Homo Sapiens; identical to SEQ ID NO: 277349

SEQ ID NO: 284860 - RNA, 64 nt, Homo Sapiens; identical to SEQ ID NO: 277350

SEQ ID NO: 284861 - RNA, 64 nt, Homo Sapiens; identical to SEQ ID NO: 277351

SEQ ID NO: 284862 - RNA, 64 nt, Homo Sapiens; identical to SEQ ID NO: 277352

SEQ ID NO: 284863 - RNA, 64 nt, Homo Sapiens; identical to SEQ ID NO: 277353

SEQ ID NO: 284864 - RNA, 64 nt, Homo Sapiens; identical to SEQ ID NO: 277354

SEQ ID NO: 284865 - RNA, 64 nt, Homo Sapiens; identical to SEQ ID NO: 277355

SEQ ID NO: 284866 - RNA, 64 nt, Homo Sapiens; identical to SEQ ID NO: 277356

SEQ ID NO: 284867 - RNA, 64 nt, Homo Sapiens; identical to SEQ ID NO: 277357

SEQ ID NO: 284868 - RNA, 64 nt, Homo Sapiens; identical to SEQ ID NO: 277358

SEQ ID NO: 284869 - RNA, 64 nt, Homo Sapiens; identical to SEQ ID NO: 277359

SEQ ID NO: 284870 - RNA, 64 nt, Homo Sapiens; identical to SEQ ID NO: 277360

SEQ ID NO: 284871 - RNA, 64 nt, Homo Sapiens; identical to SEQ ID NO: 277361

SEQ ID NO: 284872 - RNA, 64 nt, Homo Sapiens; identical to SEQ ID NO: 277362

SEQ ID NO: 284873 - RNA, 64 nt, Homo Sapiens; identical to SEQ ID NO: 277363

SEQ ID NO: 284874 - RNA, 64 nt, Homo Sapiens; identical to SEQ ID NO: 277364

SEQ ID NO: 284875 - RNA, 64 nt, Homo Sapiens; identical to SEQ ID NO: 277365

SEQ ID NO: 284876 - RNA, 64 nt, Homo Sapiens; identical to SEQ ID NO: 277366

SEQ ID NO: 284877 - RNA, 64 nt, Homo Sapiens; identical to SEQ ID NO: 277367

SEQ ID NO: 284878 - RNA, 64 nt, Homo Sapiens; identical to SEQ ID NO: 277368

SEQ ID NO: 284879 - RNA, 64 nt, Homo Sapiens; identical to SEQ ID NO: 277369

SEQ ID NO: 284880 - RNA, 64 nt, Homo Sapiens; identical to SEQ ID NO: 277370

SEQ ID NO: 284881 - RNA, 64 nt, Homo Sapiens; identical to SEQ ID NO: 277371

SEQ ID NO: 284882 - RNA, 64 nt, Homo Sapiens; identical to SEQ ID NO: 277372

SEQ ID NO: 284883 - RNA, 64 nt, Homo Sapiens; identical to SEQ ID NO: 277373

SEQ ID NO: 284884 - RNA, 64 nt, Homo Sapiens; identical to SEQ ID NO: 277374

SEQ ID NO: 284885 - RNA, 64 nt, Homo Sapiens; identical to SEQ ID NO: 277375

SEQ ID NO: 284886 - RNA, 64 nt, Homo Sapiens; identical to SEQ ID NO: 277376

SEQ ID NO: 284887 - RNA, 58 nt, Homo Sapiens; identical to SEQ ID NO: 277377

SEQ ID NO: 284888 - RNA, 64 nt, Homo Sapiens; identical to SEQ ID NO: 277378

SEQ ID NO: 284889 - RNA, 64 nt, Homo Sapiens; identical to SEQ ID NO: 277379

SEQ ID NO: 284890 - RNA, 64 nt, Homo Sapiens; identical to SEQ ID NO: 277380

SEQ ID NO: 284891 - RNA, 64 nt, Homo Sapiens; identical to SEQ ID NO: 277381

SEQ ID NO: 284892 - RNA, 64 nt, Homo Sapiens; identical to SEQ ID NO: 277382

SEQ ID NO: 284893 - RNA, 64 nt, Homo Sapiens; identical to SEQ ID NO: 277383

SEQ ID NO: 284894 - RNA, 64 nt, Homo Sapiens; identical to SEQ ID NO: 277384

SEQ ID NO: 284895 - RNA, 64 nt, Homo Sapiens; identical to SEQ ID NO: 277385

SEQ ID NO: 284896 - RNA, 64 nt, Homo Sapiens; identical to SEQ ID NO: 277386

SEQ ID NO: 284897 - RNA, 64 nt, Homo Sapiens; identical to SEQ ID NO: 277387

SEQ ID NO: 284898 - RNA, 64 nt, Homo Sapiens; identical to SEQ ID NO: 277388

SEQ ID NO: 284899 - RNA, 64 nt, Homo Sapiens; identical to SEQ ID NO: 277389

SEQ ID NO: 284900 - RNA, 64 nt, Homo Sapiens; identical to SEQ ID NO: 277390

SEQ ID NO: 284901 - RNA, 64 nt, Homo Sapiens; identical to SEQ ID NO: 277391

SEQ ID NO: 284902 - RNA, 64 nt, Homo Sapiens; identical to SEQ ID NO: 277392

SEQ ID NO: 284903 - RNA, 64 nt, Homo Sapiens; identical to SEQ ID NO: 277393

SEQ ID NO: 284904 - RNA, 64 nt, Homo Sapiens; identical to SEQ ID NO: 277394

SEQ ID NO: 284905 - RNA, 64 nt, Homo Sapiens; identical to SEQ ID NO: 277395

SEQ ID NO: 284906 - RNA, 64 nt, Homo Sapiens; identical to SEQ ID NO: 277396

SEQ ID NO: 284907 - RNA, 64 nt, Homo Sapiens; identical to SEQ ID NO: 277397

SEQ ID NO: 284908 - RNA, 64 nt, Homo Sapiens; identical to SEQ ID NO: 277398

SEQ ID NO: 284909 - RNA, 64 nt, Homo Sapiens; identical to SEQ ID NO: 277399

SEQ ID NO: 284910 - RNA, 64 nt, Homo Sapiens; identical to SEQ ID NO: 277400

SEQ ID NO: 284911 - RNA, 64 nt, Homo Sapiens; identical to SEQ ID NO: 277401

SEQ ID NO: 284912 - RNA, 64 nt, Homo Sapiens; identical to SEQ ID NO: 277402

SEQ ID NO: 284913 - RNA, 64 nt, Homo Sapiens; identical to SEQ ID NO: 277403

SEQ ID NO: 284914 - RNA, 64 nt, Homo Sapiens; identical to SEQ ID NO: 277404

SEQ ID NO: 284915 - RNA, 64 nt, Homo Sapiens; identical to SEQ ID NO: 277405

SEQ ID NO: 284916 - RNA, 64 nt, Homo Sapiens; identical to SEQ ID NO: 277406

SEQ ID NO: 284917 - RNA, 64 nt, Homo Sapiens; identical to SEQ ID NO: 277407

SEQ ID NO: 284918 - RNA, 64 nt, Homo Sapiens; identical to SEQ ID NO: 277408

SEQ ID NO: 284919 - RNA, 64 nt, Homo Sapiens; identical to SEQ ID NO: 277409

SEQ ID NO: 284920 - RNA, 64 nt, Homo Sapiens; identical to SEQ ID NO: 277410

SEQ ID NO: 284921 - RNA, 64 nt, Homo Sapiens; identical to SEQ ID NO: 277411

SEQ ID NO: 284922 - RNA, 64 nt, Homo Sapiens; identical to SEQ ID NO: 277412

SEQ ID NO: 284923 - RNA, 64 nt, Homo Sapiens; identical to SEQ ID NO: 277413

SEQ ID NO: 284924 - RNA, 64 nt, Homo Sapiens; identical to SEQ ID NO: 277414

SEQ ID NO: 284925 - RNA, 64 nt, Homo Sapiens; identical to SEQ ID NO: 277415

SEQ ID NO: 284926 - RNA, 64 nt, Homo Sapiens; identical to SEQ ID NO: 277416

SEQ ID NO: 284927 - RNA, 64 nt, Homo Sapiens; identical to SEQ ID NO: 277417

SEQ ID NO: 284928 - RNA, 64 nt, Homo Sapiens; identical to SEQ ID NO: 277418

SEQ ID NO: 284929 - RNA, 64 nt, Homo Sapiens; identical to SEQ ID NO: 277419

SEQ ID NO: 284930 - RNA, 64 nt, Homo Sapiens; identical to SEQ ID NO: 277420

SEQ ID NO: 284931 - RNA, 60 nt, Homo Sapiens; identical to SEQ ID NO: 277421

SEQ ID NO: 284932 - RNA, 64 nt, Homo Sapiens; identical to SEQ ID NO: 155572

SEQ ID NO: 284933 - RNA, 64 nt, Homo Sapiens; identical to SEQ ID NO: 155573

SEQ ID NO: 284934 - RNA, 64 nt, Homo Sapiens
caccuggccuccauucucuugggggagucuuggcacuuugcaaacauccuggccaccaugggca

SEQ ID NO: 284935 - RNA, 64 nt, Homo Sapiens
cauucugaugccucccuggggaacaaggauaaugacuuugcaucugcaccuggaacggggccug

SEQ ID NO: 284936 - RNA, 64 nt, Homo Sapiens
aauuaaaacuacccuaaguagcuccucaacaauaacuuugcaauccauaauauaaggaagguga

SEQ ID NO: 284937 - RNA, 64 nt, Homo Sapiens
uguguaguacuuuauaguuugguuaauguauuuuacuuugcauuuauauaaaugcuagaaauau

SEQ ID NO: 284938 - RNA, 64 nt, Homo Sapiens
gaguaaaacauuuuguaauuuagagcacaguaagacuuugcaugaagucauaaagagcauauuu

SEQ ID NO: 284939 - RNA, 64 nt, Homo Sapiens
agagaauuuagaugagagaugaacuggauauuaaacuuugcaaauguuuuacuuauguggcaaa

SEQ ID NO: 284940 - RNA, 64 nt, Homo Sapiens
uaucuugcucuugagguggaaucuacacaaggugacuuugcaucuuacagggguguagaaugua

SEQ ID NO: 284941 - RNA, 64 nt, Homo Sapiens
aaauugcaggucuuuuaagaguuaccucuggauuacuuugcaguguuaaccuccugcuuccuuu

SEQ ID NO: 284942 - RNA, 64 nt, Homo Sapiens
uaaaaagggauauuguaaauuuucacagcccucgacuuugcacuagaccccccaccgugguucu

SEQ ID NO: 284943 - RNA, 64 nt, Homo Sapiens
ucgcccaaagagauacaaccagucagguuuggcuacuuugcagcuccacauucuuaccuuuggu

SEQ ID NO: 284944 - RNA, 64 nt, Homo Sapiens
gccagggccguuggcuuaugccuguaaucccagcacuuugcaggccgagguagacagauggcuu

SEQ ID NO: 284945 - RNA, 64 nt, Homo Sapiens
agagccuuugugaauuaaaguggaagagaauaacacuuugcaugcuauaaacgugaaaacuaac

SEQ ID NO: 284946 - RNA, 64 nt, Homo Sapiens
uuggcgggaccagcgggcauuuguuuucuugcugacuuugcaccuccuuuuuuccccaaacacu

SEQ ID NO: 284947 - RNA, 64 nt, Homo Sapiens
agucagguggagccaccugcugggcucccccagaacuuugcacacaucuugcuauguauuagcc

SEQ ID NO: 284948 - RNA, 64 nt, Homo Sapiens
ucaugucgucaugcaucugucaugaaugaaugauacuuugcacugggcuguacgacagugagga

SEQ ID NO: 284949 - RNA, 63 nt, Homo Sapiens
aauuaccaaaaggguccauuauuucauaagaguuacuuugcaaaaaaaaaaauguggguuuuu

SEQ ID NO: 284950 - RNA, 64 nt, Homo Sapiens; identical to SEQ ID NO: 199527

SEQ ID NO: 284951 - RNA, 64 nt, Homo Sapiens; identical to SEQ ID NO: 199528

SEQ ID NO: 284952 - RNA, 64 nt, Homo Sapiens; identical to SEQ ID NO: 199529

SEQ ID NO: 284953 - RNA, 64 nt, Homo Sapiens; identical to SEQ ID NO: 199530

SEQ ID NO: 284954 - RNA, 64 nt, Homo Sapiens; identical to SEQ ID NO: 199531

SEQ ID NO: 284955 - RNA, 64 nt, Homo Sapiens; identical to SEQ ID NO: 199532

SEQ ID NO: 284956 - RNA, 64 nt, Homo Sapiens; identical to SEQ ID NO: 199533

SEQ ID NO: 284957 - RNA, 64 nt, Homo Sapiens; identical to SEQ ID NO: 199534

SEQ ID NO: 284958 - RNA, 64 nt, Homo Sapiens; identical to SEQ ID NO: 199535

SEQ ID NO: 284959 - RNA, 64 nt, Homo Sapiens; identical to SEQ ID NO: 199536

SEQ ID NO: 284960 - RNA, 64 nt, Homo Sapiens; identical to SEQ ID NO: 199537

SEQ ID NO: 284961 - RNA, 64 nt, Homo Sapiens; identical to SEQ ID NO: 199538

SEQ ID NO: 284962 - RNA, 64 nt, Homo Sapiens; identical to SEQ ID NO: 199539

SEQ ID NO: 284963 - RNA, 64 nt, Homo Sapiens; identical to SEQ ID NO: 199540

SEQ ID NO: 284964 - RNA, 64 nt, Homo Sapiens; identical to SEQ ID NO: 199541

SEQ ID NO: 284965 - RNA, 64 nt, Homo Sapiens; identical to SEQ ID NO: 199542

SEQ ID NO: 284966 - RNA, 64 nt, Homo Sapiens; identical to SEQ ID NO: 199543

SEQ ID NO: 284967 - RNA, 64 nt, Homo Sapiens; identical to SEQ ID NO: 199544

SEQ ID NO: 284968 - RNA, 64 nt, Homo Sapiens; identical to SEQ ID NO: 199545

SEQ ID NO: 284969 - RNA, 64 nt, Homo Sapiens; identical to SEQ ID NO: 199546

SEQ ID NO: 284970 - RNA, 64 nt, Homo Sapiens; identical to SEQ ID NO: 199547

SEQ ID NO: 284971 - RNA, 64 nt, Homo Sapiens; identical to SEQ ID NO: 199548

SEQ ID NO: 284972 - RNA, 64 nt, Homo Sapiens; identical to SEQ ID NO: 199549

SEQ ID NO: 284973 - RNA, 64 nt, Homo Sapiens; identical to SEQ ID NO: 199550

SEQ ID NO: 284974 - RNA, 64 nt, Homo Sapiens; identical to SEQ ID NO: 199551

SEQ ID NO: 284975 - RNA, 64 nt, Homo Sapiens; identical to SEQ ID NO: 199552

SEQ ID NO: 284976 - RNA, 64 nt, Homo Sapiens; identical to SEQ ID NO: 199553

SEQ ID NO: 284977 - RNA, 64 nt, Homo Sapiens; identical to SEQ ID NO: 199554

SEQ ID NO: 284978 - RNA, 64 nt, Homo Sapiens; identical to SEQ ID NO: 199555

SEQ ID NO: 284979 - RNA, 64 nt, Homo Sapiens; identical to SEQ ID NO: 199556

SEQ ID NO: 284980 - RNA, 64 nt, Homo Sapiens; identical to SEQ ID NO: 199557

SEQ ID NO: 284981 - RNA, 64 nt, Homo Sapiens; identical to SEQ ID NO: 199558

SEQ ID NO: 284982 - RNA, 64 nt, Homo Sapiens; identical to SEQ ID NO: 199559

SEQ ID NO: 284983 - RNA, 64 nt, Homo Sapiens; identical to SEQ ID NO: 199560

SEQ ID NO: 284984 - RNA, 64 nt, Homo Sapiens; identical to SEQ ID NO: 199561

SEQ ID NO: 284985 - RNA, 64 nt, Homo Sapiens; identical to SEQ ID NO: 199562

SEQ ID NO: 284986 - RNA, 64 nt, Homo Sapiens; identical to SEQ ID NO: 199563

SEQ ID NO: 284987 - RNA, 64 nt, Homo Sapiens; identical to SEQ ID NO: 199564

SEQ ID NO: 284988 - RNA, 64 nt, Homo Sapiens; identical to SEQ ID NO: 199565

SEQ ID NO: 284989 - RNA, 64 nt, Homo Sapiens; identical to SEQ ID NO: 199566

SEQ ID NO: 284990 - RNA, 64 nt, Homo Sapiens; identical to SEQ ID NO: 199567

SEQ ID NO: 284991 - RNA, 64 nt, Homo Sapiens; identical to SEQ ID NO: 199568

SEQ ID NO: 284992 - RNA, 64 nt, Homo Sapiens; identical to SEQ ID NO: 199569

SEQ ID NO: 284993 - RNA, 64 nt, Homo Sapiens; identical to SEQ ID NO: 199570

SEQ ID NO: 284994 - RNA, 64 nt, Homo Sapiens; identical to SEQ ID NO: 199571

SEQ ID NO: 284995 - RNA, 64 nt, Homo Sapiens; identical to SEQ ID NO: 199572

SEQ ID NO: 284996 - RNA, 64 nt, Homo Sapiens; identical to SEQ ID NO: 199573

SEQ ID NO: 284997 - RNA, 64 nt, Homo Sapiens; identical to SEQ ID NO: 199574

SEQ ID NO: 284998 - RNA, 64 nt, Homo Sapiens; identical to SEQ ID NO: 199575

SEQ ID NO: 284999 - RNA, 64 nt, Homo Sapiens; identical to SEQ ID NO: 199576

SEQ ID NO: 285000 - RNA, 64 nt, Homo Sapiens; identical to SEQ ID NO: 199577

SEQ ID NO: 285001 - RNA, 64 nt, Homo Sapiens; identical to SEQ ID NO: 199578

SEQ ID NO: 285002 - RNA, 64 nt, Homo Sapiens; identical to SEQ ID NO: 199579

SEQ ID NO: 285003 - RNA, 64 nt, Homo Sapiens; identical to SEQ ID NO: 199580

SEQ ID NO: 285004 - RNA, 64 nt, Homo Sapiens; identical to SEQ ID NO: 199581

SEQ ID NO: 285005 - RNA, 64 nt, Homo Sapiens; identical to SEQ ID NO: 199582

SEQ ID NO: 285006 - RNA, 64 nt, Homo Sapiens; identical to SEQ ID NO: 199583

SEQ ID NO: 285007 - RNA, 64 nt, Homo Sapiens; identical to SEQ ID NO: 199584

SEQ ID NO: 285008 - RNA, 64 nt, Homo Sapiens; identical to SEQ ID NO: 199585

SEQ ID NO: 285009 - RNA, 64 nt, Homo Sapiens; identical to SEQ ID NO: 199586

SEQ ID NO: 285010 - RNA, 64 nt, Homo Sapiens; identical to SEQ ID NO: 199587

SEQ ID NO: 285011 - RNA, 64 nt, Homo Sapiens; identical to SEQ ID NO: 199588

SEQ ID NO: 285012 - RNA, 64 nt, Homo Sapiens; identical to SEQ ID NO: 199589

SEQ ID NO: 285013 - RNA, 64 nt, Homo Sapiens; identical to SEQ ID NO: 199590

SEQ ID NO: 285014 - RNA, 64 nt, Homo Sapiens; identical to SEQ ID NO: 199591

SEQ ID NO: 285015 - RNA, 64 nt, Homo Sapiens; identical to SEQ ID NO: 199592

SEQ ID NO: 285016 - RNA, 64 nt, Homo Sapiens; identical to SEQ ID NO: 199593

SEQ ID NO: 285017 - RNA, 64 nt, Homo Sapiens; identical to SEQ ID NO: 199594

SEQ ID NO: 285018 - RNA, 64 nt, Homo Sapiens; identical to SEQ ID NO: 199595

SEQ ID NO: 285019 - RNA, 64 nt, Homo Sapiens; identical to SEQ ID NO: 199596

SEQ ID NO: 285020 - RNA, 64 nt, Homo Sapiens; identical to SEQ ID NO: 199597

SEQ ID NO: 285021 - RNA, 64 nt, Homo Sapiens; identical to SEQ ID NO: 199598

SEQ ID NO: 285022 - RNA, 64 nt, Homo Sapiens; identical to SEQ ID NO: 199599

SEQ ID NO: 285023 - RNA, 64 nt, Homo Sapiens; identical to SEQ ID NO: 199600

SEQ ID NO: 285024 - RNA, 64 nt, Homo Sapiens; identical to SEQ ID NO: 199601

SEQ ID NO: 285025 - RNA, 64 nt, Homo Sapiens; identical to SEQ ID NO: 199602

SEQ ID NO: 285026 - RNA, 64 nt, Homo Sapiens; identical to SEQ ID NO: 199603

SEQ ID NO: 285027 - RNA, 64 nt, Homo Sapiens; identical to SEQ ID NO: 199604

SEQ ID NO: 285028 - RNA, 64 nt, Homo Sapiens
auuuccauaucauaguauuuuuuuaucucuagugauugcauauucucuacuuggguagaaaaua

SEQ ID NO: 285029 - RNA, 64 nt, Homo Sapiens
aaagaaaauguguaaggcuuuuauuuuauuaaauauugcauacaaaaaaccaaauuauccaaaa

SEQ ID NO: 285030 - RNA, 64 nt, Homo Sapiens
uuuugaaauagcuagaagagguuaacaauaaccuauugcauauaugcauaguagggugacuaga

SEQ ID NO: 285031 - RNA, 64 nt, Homo Sapiens
agggugacuagaguuaacaaagugcuaauguuuuauugcauaguuaaaaacuucacauuaaaua

SEQ ID NO: 285032 - RNA, 64 nt, Homo Sapiens
auuauuuguaggaaugucuuccuaauggggaagaauugcauaggagcauuaugcaaaucuacac

SEQ ID NO: 285033 - RNA, 64 nt, Homo Sapiens
aaaaagaaacugauuuaccuaaguuuacuuuuuaauugcauaauagagcauuuuuuguuuugag

SEQ ID NO: 285034 - RNA, 64 nt, Homo Sapiens
gucuuuuggccauaagugggaaaguuuucuguauauugcauagcauuacacauuuaugccuauu

SEQ ID NO: 285035 - RNA, 64 nt, Homo Sapiens
ucaugcagaauuuugaaauguuuucaguuuguauauugcauauucacaugaucauuguucacua

SEQ ID NO: 285036 - RNA, 64 nt, Homo Sapiens
cccucuguaucacagguaucucgggggagcuuugugccuugauggaucaaguucaucauaugca

SEQ ID NO: 285037 - RNA, 64 nt, Homo Sapiens
uaaauccucuccucucccuucuguagguacuagcugccuugauuuuuuuuuguggguggggggg

SEQ ID NO: 285038 - RNA, 64 nt, Homo Sapiens
caugacagaaaguggggaaaaugccgcaguuuguugccuugaaaccuaagagcaauccuugguu

SEQ ID NO: 285039 - RNA, 64 nt, Homo Sapiens
cuuggcaaaaaucacuauaaggcagcucuaaauuugccuugauaagcuaaauaaauuacuuuua

SEQ ID NO: 285040 - RNA, 64 nt, Homo Sapiens
ccggacaguuaaaucagaaccucagacagcaauaugccuugagaugccuugaaccaugcuugag

SEQ ID NO: 285041 - RNA, 64 nt, Homo Sapiens
aaaucagaaccucagacagcaauaugccuugagaugccuugaaccaugcuugagaaggaaggac

SEQ ID NO: 285042 - RNA, 64 nt, Homo Sapiens
ggugcacucagcugcccagggccucugggacacuugccuugacuugcaacuugccuugaacauc

SEQ ID NO: 285043 - RNA, 64 nt, Homo Sapiens
agggccucugggacacuugccuugacuugcaacuugccuugaacaucacgaucaaagcagcagg

SEQ ID NO: 285044 - RNA, 64 nt, Homo Sapiens
aauugauuuuuauuugacucuguggcucuaagacugccuugaaccgccugaggccuaugcaucu

SEQ ID NO: 285045 - RNA, 64 nt, Homo Sapiens
uaaauuuuaaaagauuaucaggauaacaugaccuugccuugaaaaaccuaaauuucauacagaa

SEQ ID NO: 285046 - RNA, 64 nt, Homo Sapiens
auuauagauacaguuuugggauauauacaaggauugccuugaucuggcacuuacugauacaagc

SEQ ID NO: 285047 - RNA, 64 nt, Homo Sapiens
uggagggugggcaccagaugaaaauggacaaaagugccuugacgaaacugacucacuugauugg

SEQ ID NO: 285048 - RNA, 64 nt, Homo Sapiens
ucucucgccccuuucuggguuguccccaguugugugccuugaccccuccugaggcccaggucuu

SEQ ID NO: 285049 - RNA, 64 nt, Homo Sapiens
accuccccugccagggcucgggcgcuguggcuccugccuugaugaagcccguguccugccuuga

SEQ ID NO: 285050 - RNA, 64 nt, Homo Sapiens
cgcuguggcuccugccuugaugaagcccguguccugccuugaugaagccugugccaccugcaag

SEQ ID NO: 285051 - RNA, 64 nt, Homo Sapiens
uguccacuaccugaggacgcuaggaaguuguacgugccuugaaaagccuggagcugcuauugcu

SEQ ID NO: 285052 - RNA, 64 nt, Homo Sapiens
cucauucacaagcagcccccauccacuccuuuagugccuugaauugcccgaggcccacgcaucc

SEQ ID NO: 285053 - RNA, 64 nt, Homo Sapiens
agucuuucagcugugacugcgcccaaauguagucugccuugaaacuacaucacuuguaucucca

SEQ ID NO: 285054 - RNA, 64 nt, Homo Sapiens
aagguaagauaaaugaaacgaucuguacuuuguuugccuugauacuauguuuuuaauguacagc

SEQ ID NO: 285055 - RNA, 64 nt, Homo Sapiens
gagugagccaauuaacagcucuugagacagugcuugccuugagacaucucugccuugagacugc

SEQ ID NO: 285056 - RNA, 64 nt, Homo Sapiens
cagugcuugccuugagagagcucugccuugagacugccuugagaucuguuuuuugcugugucau

SEQ ID NO: 285057 - RNA, 64 nt, Homo Sapiens
cugccuugagacagugcuugugcugugucaucucugccuugagauuuucucccccucuguuuuu

SEQ ID NO: 285058 - RNA, 64 nt, Homo Sapiens; identical to SEQ ID NO: 105601

SEQ ID NO: 285059 - RNA, 64 nt, Homo Sapiens; identical to SEQ ID NO: 105602

SEQ ID NO: 285060 - RNA, 64 nt, Homo Sapiens; identical to SEQ ID NO: 105603

SEQ ID NO: 285061 - RNA, 64 nt, Homo Sapiens; identical to SEQ ID NO: 105604

SEQ ID NO: 285062 - RNA, 64 nt, Homo Sapiens; identical to SEQ ID NO: 105605

SEQ ID NO: 285063 - RNA, 64 nt, Homo Sapiens; identical to SEQ ID NO: 105606

SEQ ID NO: 285064 - RNA, 64 nt, Homo Sapiens; identical to SEQ ID NO: 105607

SEQ ID NO: 285065 - RNA, 64 nt, Homo Sapiens; identical to SEQ ID NO: 105608

SEQ ID NO: 285066 - RNA, 64 nt, Homo Sapiens; identical to SEQ ID NO: 105609

SEQ ID NO: 285067 - RNA, 64 nt, Homo Sapiens; identical to SEQ ID NO: 105610

SEQ ID NO: 285068 - RNA, 64 nt, Homo Sapiens; identical to SEQ ID NO: 105611

SEQ ID NO: 285069 - RNA, 64 nt, Homo Sapiens; identical to SEQ ID NO: 105612

SEQ ID NO: 285070 - RNA, 64 nt, Homo Sapiens; identical to SEQ ID NO: 105613

SEQ ID NO: 285071 - RNA, 64 nt, Homo Sapiens; identical to SEQ ID NO: 105614

SEQ ID NO: 285072 - RNA, 64 nt, Homo Sapiens
acucguugagcagcaacgcaaucaccaucaucccacugcccaaucuagaauaugucugcucucc

SEQ ID NO: 285073 - RNA, 64 nt, Homo Sapiens
acccucaugaaaaauuaauccucaguuccacgagacugcccacccacagacaaaaaaauauaua

SEQ ID NO: 285074 - RNA, 64 nt, Homo Sapiens
cauuggcauggucaugaaugguuguuuccaucccacugcccaaguugcaguuaacaucuagagu

SEQ ID NO: 285075 - RNA, 64 nt, Homo Sapiens
cagucacagggauucuguguauuccaccauggucacugcccaucugaugaccauaagcaggagg

SEQ ID NO: 285076 - RNA, 64 nt, Homo Sapiens
ucuaagaagcccggcucuccgcccaccaccacccacugcccacccaagcauacuuaccaguacu

SEQ ID NO: 285077 - RNA, 64 nt, Homo Sapiens
accacccacugcccaccucugcauacuuaccaguacugcccaccggcaagucccagccacccaa

SEQ ID NO: 285078 - RNA, 64 nt, Homo Sapiens
ccaugccagccccacggugguccaugacugcggaacugcccagacauaagcaggagccuccgag

SEQ ID NO: 285079 - RNA, 64 nt, Homo Sapiens
agugguguguaccccuaaauccucccaccccagcacugcccaucuguaaaaucuuguaaagccc

SEQ ID NO: 285080 - RNA, 64 nt, Homo Sapiens
gugccagaguuuuagccaaacucugccaggaucaacugcccagaccaugggucugacccuugga

SEQ ID NO: 285081 - RNA, 64 nt, Homo Sapiens
uuucugaggcuucagagucggccugugccccaugacugcccauguaaauccccaguuccucaag

SEQ ID NO: 285082 - RNA, 64 nt, Homo Sapiens
agggacucaucuugcauggcaccgccggccagacacugcccaaggaccaguauuugucacuacc

SEQ ID NO: 285083 - RNA, 64 nt, Homo Sapiens
agaaacuagcucugauccuaacaggccacguuaaacugcccaucuggagaaucgccugcaggug

SEQ ID NO: 285084 - RNA, 64 nt, Homo Sapiens
cuccaagagguuuuucagcucuuugacaacgccaacugcccaagccuacagaacaaaccaaaaa

SEQ ID NO: 285085 - RNA, 64 nt, Homo Sapiens
gugaugccgguaaagaaaaguugccgaagaugagacugcccacgcgcucagacaugauaugcgg

SEQ ID NO: 285086 - RNA, 64 nt, Homo Sapiens
ugccucggguacaaguccuggaaugugacugcccacugcccagcggauuccucagggccuacug

SEQ ID NO: 285087 - RNA, 64 nt, Homo Sapiens
gcccagcugccucggguacaccuacuggaaugugacugcccacuuauuuggggauuccucaggg

SEQ ID NO: 285088 - RNA, 64 nt, Homo Sapiens
ucuugcagcccagaaccaagucagccucccugcgacugcccaggcacacugcccaccaccccac

SEQ ID NO: 285089 - RNA, 64 nt, Homo Sapiens
aaccaagucagccucccugcgacugcccaggcacacugcccaccaccccacccccgaaacaaug

SEQ ID NO: 285090 - RNA, 64 nt, Homo Sapiens
accaugaguugggugcagacugcugcuccucuccacugcccagcccuucagccucccuuuguaa

SEQ ID NO: 285091 - RNA, 64 nt, Homo Sapiens
ccccccuccaugcugggguugccaaauuggggagacugcccacucguggaacugaccuaggggg

SEQ ID NO: 285092 - RNA, 62 nt, Homo Sapiens
gccacagugcucacaacuagccgggaggcaagacugcccaacugucagguaaauucagaugu

SEQ ID NO: 285093 - RNA, 64 nt, Homo Sapiens
ucugggguggaaguuuuguagccacacacaggauacugcccaagauccagcggguguuuucuuc

SEQ ID NO: 285094 - RNA, 64 nt, Homo Sapiens
ccucagccaggucuucuggaguuuuuguguguggacugcccagaauugugggaggaaaugcuag

SEQ ID NO: 285095 - RNA, 64 nt, Homo Sapiens
auuccugggagucuuaggaucucuuggauaugaaacugcccagccucuccacaucuuucccuga

SEQ ID NO: 285096 - RNA, 64 nt, Homo Sapiens
cggccugcagaacaucuguccccaagccagcuccacugcccaggcccccaagagggcagcucca

SEQ ID NO: 285097 - RNA, 64 nt, Homo Sapiens
gccugagucccaggaggccuccuggaagcccaggacugcccacccaccacgcuggugcccaccg

SEQ ID NO: 285098 - RNA, 64 nt, Homo Sapiens
caggacccccuuuggagaugcccauggcaugggcacugcccacaggcucagccagaaccucuug

SEQ ID NO: 285099 - RNA, 64 nt, Homo Sapiens
cuuuuugcucaggggccaaacacugaaggcacguacugcccaacccacugagcgccugaggcca

SEQ ID NO: 285100 - RNA, 64 nt, Homo Sapiens
ccauucaccccucacuguacccauccuggcgaccacugcccauuucucugagcugggugggagg

SEQ ID NO: 285101 - RNA, 64 nt, Homo Sapiens
ucccagcuccacuggcccaauugaccuuuggugcacugcccacucuuccaauagaaaauuccgc

SEQ ID NO: 285102 - RNA, 64 nt, Homo Sapiens
uuuuuauuaacccuggcuuuggugguaagggaaacuuccagaaaugcuuguggguauauuggau

SEQ ID NO: 285103 - RNA, 64 nt, Homo Sapiens
gaacugugggugacuuuauccucacaucguguuucuuccagaaauucagacgcaacagagguua

SEQ ID NO: 285104 - RNA, 64 nt, Homo Sapiens
caacugcauugguuuuccaucaugaauuccacuccuuccagaacauaagucugggcacuggaug

SEQ ID NO: 285105 - RNA, 64 nt, Homo Sapiens
aggcccaaaacauauauaggauccuuccagggcucuuccagauggggcaccuuaaaacuuaacu

SEQ ID NO: 285106 - RNA, 64 nt, Homo Sapiens
ugagcuguuucuggauaauguccucuucugaucacuuccagagauccuucgauuccauuuuacc

SEQ ID NO: 285107 - RNA, 64 nt, Homo Sapiens
agucugccccucaaggaaggccagaagucguggccuuccagaacaaaacagacucccacugucu

SEQ ID NO: 285108 - RNA, 64 nt, Homo Sapiens
gcucucccugauagaugcugagagcauccagaaacuuccagaccagcccucucaccacacccag

SEQ ID NO: 285109 - RNA, 64 nt, Homo Sapiens
cacccagaagaggccuuucccaucuggagagaagcuuccagaccagcccuucacacaccacagc

SEQ ID NO: 285110 - RNA, 64 nt, Homo Sapiens
cagccaggaggggccuuucccaccuggagagaaacuuccagaccagccccucauaccacagcca

SEQ ID NO: 285111 - RNA, 64 nt, Homo Sapiens
cagccaggagaggccuuucccaccgguagagaaacuuccagaccagccccucacaccacagcca

SEQ ID NO: 285112 - RNA, 64 nt, Homo Sapiens
cagccaagagaagccuuuccagccuggagagaaacuuccagaccagcccucucacuacagccag

SEQ ID NO: 285113 - RNA, 64 nt, Homo Sapiens
cagccaggagaggccuuucccaccuggacagaaacuuccagaccagccccucucaccacagcca

SEQ ID NO: 285114 - RNA, 64 nt, Homo Sapiens
cagccaggagaggccuuuaccaccuggagagaagcuuccagaccagccccucacaccacagcca

SEQ ID NO: 285115 - RNA, 64 nt, Homo Sapiens
cagccaggagaggccuuucccaccuggagagaaacuuccagaccagccccucauaccacagcca

SEQ ID NO: 285116 - RNA, 64 nt, Homo Sapiens
cagccaagaggggccuuucucaccuggagagaaacuuccagaccagccccucacaccaccgcca

SEQ ID NO: 285117 - RNA, 64 nt, Homo Sapiens
ccgccaggagaggccuuucccaccgggagagaaacuuccagaccagccccucacaccacagcca

SEQ ID NO: 285118 - RNA, 64 nt, Homo Sapiens
cagccaggagaggccuuucccaccgggagagaaacuuccagaccagcccucucacuacagccag

SEQ ID NO: 285119 - RNA, 64 nt, Homo Sapiens
cagccagaagaggccuuucccaccgggagaggaacuuccagaccagccccucacaccacagcca

SEQ ID NO: 285120 - RNA, 64 nt, Homo Sapiens
cagccaggagaggccguuccugccuggagagaagcuuccagaccagcccuucacaccacagcca

SEQ ID NO: 285121 - RNA, 64 nt, Homo Sapiens
cagccaggagaggccuuucccaccuggagagaaacuuccagaccagccccucucaccacagcca

SEQ ID NO: 285122 - RNA, 64 nt, Homo Sapiens
cagugaagaguaaguuuucccuccuacucucgaucuuccagaagcuguacuuuuaccaguuucu

SEQ ID NO: 285123 - RNA, 64 nt, Homo Sapiens
uaaauguaaguauuacaugacaugcauucuguuucuuccagaguucugucugccacacgaaaga

SEQ ID NO: 285124 - RNA, 64 nt, Homo Sapiens
guagugaccggcagggcuggggugagaccccucccuuccagaauccaggccccaucucccccaa

SEQ ID NO: 285125 - RNA, 64 nt, Homo Sapiens
gcuuaaacaggguucucugucauuuuccuguuuucuuccagagucccaauccuuugcccuaguu

SEQ ID NO: 285126 - RNA, 64 nt, Homo Sapiens
uggcacccugaggucaggggauccuaaggguguccuuccagagacgguguuuccagggggagga

SEQ ID NO: 285127 - RNA, 64 nt, Homo Sapiens
agagacgguguuuccagggggaggaccgcccccgcuuccagauccccggccccggcugugacug

SEQ ID NO: 285128 - RNA, 64 nt, Homo Sapiens
uggucaacuucuggaacacuagucugucuucuugcuuccagaugcucuagggugcuucuuccag

SEQ ID NO: 285129 - RNA, 64 nt, Homo Sapiens
cugucuucuugcuuccagauucucuagggugcuucuuccagaguagugaaggggguuccuggag

SEQ ID NO: 285130 - RNA, 64 nt, Homo Sapiens
agugucacacugggagcugggcacagccgaucuccuuccagaaggguucugucuguauccuuua

SEQ ID NO: 285131 - RNA, 64 nt, Homo Sapiens
cccacccccggccaacuaaccacugcaggcuccucuuccagacucaccagggggccucgaggcc

SEQ ID NO: 285132 - RNA, 64 nt, Homo Sapiens
uucagccucucuucgucguccuccaacucugagccuuccagagcaccaggaacccagacaccac

SEQ ID NO: 285133 - RNA, 64 nt, Homo Sapiens
ugggccaaucauccuggacaagagagugaacagucuuccagaucgcccuggacagagagccucc

SEQ ID NO: 285134 - RNA, 64 nt, Homo Sapiens
cacagguaggggagugugaauucaagugugacuccuuccagagcauugggaaguuugguugagg

SEQ ID NO: 285135 - RNA, 64 nt, Homo Sapiens
cguggucucaaggagucagaggaaaccauggcaccuuccagagcuguggcuccuagugcaaacc

SEQ ID NO: 285136 - RNA, 64 nt, Homo Sapiens
uaaccauccuugagcccagauggggcucagggcccuuccagagccugucauguccuugugcagu

SEQ ID NO: 285137 - RNA, 64 nt, Homo Sapiens
uguaugggcucccaaggacccagcagccuggauccuuccagagcaucccuccuggaggccuggg

SEQ ID NO: 285138 - RNA, 64 nt, Homo Sapiens
cuggccgucaugacagcugcuuggagacccgugccuuccagauggcugggagaugccucugugg

SEQ ID NO: 285139 - RNA, 64 nt, Homo Sapiens
uuuauagaacuucuggaucuaacucacaaacaagcuuccagaagagacuagagaccuuaggcca

SEQ ID NO: 285140 - RNA, 64 nt, Homo Sapiens
caccagcgggaacagggcaccccuucugcacugacuuccagaucaugguucucccuuccucccu

SEQ ID NO: 285141 - RNA, 64 nt, Homo Sapiens
ggccccuggcuccgcagucacccuccaucagaugcuuccagaagcaccuacucugugcaagggc

SEQ ID NO: 285142 - RNA, 64 nt, Homo Sapiens
gaugcuuccugugcccucucaagccaguucuucucuuccagaagaauucagaguaugugucuca

SEQ ID NO: 285143 - RNA, 64 nt, Homo Sapiens
ggguguggcugcccaaccccauccagagcaucugcuuccagaugagccagugccucgcaugaua

SEQ ID NO: 285144 - RNA, 64 nt, Homo Sapiens
ccagagacauuguuaauaaaauuaacagucuguucuuccagaguauguuaauauugcuuuauga

SEQ ID NO: 285145 - RNA, 64 nt, Homo Sapiens
ucagaguugugaugcucucucagugccaaggucacuuccagaauugaaugcaguugcauugauu

SEQ ID NO: 285146 - RNA, 64 nt, Homo Sapiens
augagcacaaggugauucaggccagcuggagaagcuuccagaagggcccugcacugcuacccuc

SEQ ID NO: 285147 - RNA, 64 nt, Homo Sapiens
cucuccgggagcagacuucagcuugcccucucugcuuccagagcaccuccuagauaccucucuu

SEQ ID NO: 285148 - RNA, 64 nt, Homo Sapiens
uuacccaucauccccccaugaaacgcuucuaccccuuccagaacccaugcuccaacucccacac

SEQ ID NO: 285149 - RNA, 64 nt, Homo Sapiens
gggccuugguguuugcuggacugguugcuccuggcuuccagacuugccuaugcucucaccuucc

SEQ ID NO: 285150 - RNA, 64 nt, Homo Sapiens
ugcagcugccgaaagugccaugccagaggugcggcuuccagaggagaggugucagagguggcug

SEQ ID NO: 285151 - RNA, 64 nt, Homo Sapiens
uacagcugccgaaagugucaugccggaggugcggcuuccagaggaaaggugccagagauggcug

SEQ ID NO: 285152 - RNA, 64 nt, Homo Sapiens
uacagcugcugaaagugucgugccggaggugcggcuuccagaggaaaggugccagagauggcug

SEQ ID NO: 285153 - RNA, 64 nt, Homo Sapiens
uagagcugcccaaagugucaugccggaggugcggcuuccagaggaaaggugccagagauggcug

SEQ ID NO: 285154 - RNA, 64 nt, Homo Sapiens
uucgacucccagagguggagugcccgaggcagcccuuccagaggugaggucaagcuuccaaaag

SEQ ID NO: 285155 - RNA, 64 nt, Homo Sapiens
gcugcuaagaagcaccagaagaccugcgagaucucuuccagaagcuucugccccgcagaaagca

SEQ ID NO: 285156 - RNA, 64 nt, Homo Sapiens
ucucugcccaagcuuccuguccuaugcucuacagcuuccagacagccuucuauccagccggcac

SEQ ID NO: 285157 - RNA, 64 nt, Homo Sapiens
uccucguacucuuucucccgggaguggugagggccuuccagagaucagggugcuccagcgcugg

SEQ ID NO: 285158 - RNA, 64 nt, Homo Sapiens
cgaggauccuugccacuugaugccaugggguuuccuuccagauuguccucucacccccagcagu

SEQ ID NO: 285159 - RNA, 64 nt, Homo Sapiens
ccaccaccgccaacaggccacggggcaaggggcccuuccagauggcucccuauuuggaagcaag

SEQ ID NO: 285160 - RNA, 64 nt, Homo Sapiens; identical to SEQ ID NO: 144070

SEQ ID NO: 285161 - RNA, 64 nt, Homo Sapiens; identical to SEQ ID NO: 144071

SEQ ID NO: 285162 - RNA, 64 nt, Homo Sapiens; identical to SEQ ID NO: 144072

SEQ ID NO: 285163 - RNA, 64 nt, Homo Sapiens; identical to SEQ ID NO: 144073

SEQ ID NO: 285164 - RNA, 64 nt, Homo Sapiens; identical to SEQ ID NO: 144074

SEQ ID NO: 285165 - RNA, 64 nt, Homo Sapiens; identical to SEQ ID NO: 144075

SEQ ID NO: 285166 - RNA, 64 nt, Homo Sapiens; identical to SEQ ID NO: 144076

SEQ ID NO: 285167 - RNA, 64 nt, Homo Sapiens; identical to SEQ ID NO: 144077

SEQ ID NO: 285168 - RNA, 64 nt, Homo Sapiens; identical to SEQ ID NO: 144078

SEQ ID NO: 285169 - RNA, 64 nt, Homo Sapiens; identical to SEQ ID NO: 144079

SEQ ID NO: 285170 - RNA, 64 nt, Homo Sapiens; identical to SEQ ID NO: 144080

SEQ ID NO: 285171 - RNA, 64 nt, Homo Sapiens; identical to SEQ ID NO: 144081

SEQ ID NO: 285172 - RNA, 64 nt, Homo Sapiens; identical to SEQ ID NO: 144082

SEQ ID NO: 285173 - RNA, 64 nt, Homo Sapiens; identical to SEQ ID NO: 144083

SEQ ID NO: 285174 - RNA, 64 nt, Homo Sapiens; identical to SEQ ID NO: 144084

SEQ ID NO: 285175 - RNA, 64 nt, Homo Sapiens; identical to SEQ ID NO: 144085

SEQ ID NO: 285176 - RNA, 64 nt, Homo Sapiens; identical to SEQ ID NO: 144086

SEQ ID NO: 285177 - RNA, 64 nt, Homo Sapiens; identical to SEQ ID NO: 144087

SEQ ID NO: 285178 - RNA, 64 nt, Homo Sapiens; identical to SEQ ID NO: 144088

SEQ ID NO: 285179 - RNA, 64 nt, Homo Sapiens; identical to SEQ ID NO: 144089

SEQ ID NO: 285180 - RNA, 64 nt, Homo Sapiens; identical to SEQ ID NO: 144090

SEQ ID NO: 285181 - RNA, 64 nt, Homo Sapiens; identical to SEQ ID NO: 144091

SEQ ID NO: 285182 - RNA, 64 nt, Homo Sapiens; identical to SEQ ID NO: 144092

SEQ ID NO: 285183 - RNA, 64 nt, Homo Sapiens; identical to SEQ ID NO: 144093

SEQ ID NO: 285184 - RNA, 64 nt, Homo Sapiens; identical to SEQ ID NO: 144094

SEQ ID NO: 285185 - RNA, 64 nt, Homo Sapiens; identical to SEQ ID NO: 144095

SEQ ID NO: 285186 - RNA, 64 nt, Homo Sapiens; identical to SEQ ID NO: 144096

SEQ ID NO: 285187 - RNA, 64 nt, Homo Sapiens; identical to SEQ ID NO: 144097

SEQ ID NO: 285188 - RNA, 64 nt, Homo Sapiens; identical to SEQ ID NO: 144098

SEQ ID NO: 285189 - RNA, 64 nt, Homo Sapiens; identical to SEQ ID NO: 144099

SEQ ID NO: 285190 - RNA, 64 nt, Homo Sapiens; identical to SEQ ID NO: 144100

SEQ ID NO: 285191 - RNA, 64 nt, Homo Sapiens; identical to SEQ ID NO: 144101

SEQ ID NO: 285192 - RNA, 64 nt, Homo Sapiens; identical to SEQ ID NO: 144102

SEQ ID NO: 285193 - RNA, 64 nt, Homo Sapiens; identical to SEQ ID NO: 144103

SEQ ID NO: 285194 - RNA, 64 nt, Homo Sapiens; identical to SEQ ID NO: 144104

SEQ ID NO: 285195 - RNA, 64 nt, Homo Sapiens; identical to SEQ ID NO: 144105

SEQ ID NO: 285196 - RNA, 64 nt, Homo Sapiens; identical to SEQ ID NO: 144106

SEQ ID NO: 285197 - RNA, 64 nt, Homo Sapiens; identical to SEQ ID NO: 144107

SEQ ID NO: 285198 - RNA, 64 nt, Homo Sapiens; identical to SEQ ID NO: 144108

SEQ ID NO: 285199 - RNA, 64 nt, Homo Sapiens; identical to SEQ ID NO: 144109

SEQ ID NO: 285200 - RNA, 64 nt, Homo Sapiens; identical to SEQ ID NO: 144110

SEQ ID NO: 285201 - RNA, 64 nt, Homo Sapiens; identical to SEQ ID NO: 144111

SEQ ID NO: 285202 - RNA, 64 nt, Homo Sapiens; identical to SEQ ID NO: 144112

SEQ ID NO: 285203 - RNA, 64 nt, Homo Sapiens; identical to SEQ ID NO: 144113

SEQ ID NO: 285204 - RNA, 64 nt, Homo Sapiens; identical to SEQ ID NO: 144114

SEQ ID NO: 285205 - RNA, 64 nt, Homo Sapiens; identical to SEQ ID NO: 144115

SEQ ID NO: 285206 - RNA, 64 nt, Homo Sapiens; identical to SEQ ID NO: 144116

SEQ ID NO: 285207 - RNA, 64 nt, Homo Sapiens; identical to SEQ ID NO: 144117

SEQ ID NO: 285208 - RNA, 64 nt, Homo Sapiens; identical to SEQ ID NO: 144118

SEQ ID NO: 285209 - RNA, 64 nt, Homo Sapiens; identical to SEQ ID NO: 144119

SEQ ID NO: 285210 - RNA, 64 nt, Homo Sapiens; identical to SEQ ID NO: 144120

SEQ ID NO: 285211 - RNA, 64 nt, Homo Sapiens; identical to SEQ ID NO: 144121

SEQ ID NO: 285212 - RNA, 64 nt, Homo Sapiens; identical to SEQ ID NO: 144122

SEQ ID NO: 285213 - RNA, 64 nt, Homo Sapiens; identical to SEQ ID NO: 144123

SEQ ID NO: 285214 - RNA, 64 nt, Homo Sapiens; identical to SEQ ID NO: 144124

SEQ ID NO: 285215 - RNA, 64 nt, Homo Sapiens; identical to SEQ ID NO: 144125

SEQ ID NO: 285216 - RNA, 64 nt, Homo Sapiens; identical to SEQ ID NO: 144126

SEQ ID NO: 285217 - RNA, 64 nt, Homo Sapiens; identical to SEQ ID NO: 144127

SEQ ID NO: 285218 - RNA, 64 nt, Homo Sapiens; identical to SEQ ID NO: 144128

SEQ ID NO: 285219 - RNA, 64 nt, Homo Sapiens; identical to SEQ ID NO: 144129

SEQ ID NO: 285220 - RNA, 64 nt, Homo Sapiens; identical to SEQ ID NO: 144130

SEQ ID NO: 285221 - RNA, 64 nt, Homo Sapiens; identical to SEQ ID NO: 144131

SEQ ID NO: 285222 - RNA, 64 nt, Homo Sapiens; identical to SEQ ID NO: 144132

SEQ ID NO: 285223 - RNA, 64 nt, Homo Sapiens; identical to SEQ ID NO: 144133

SEQ ID NO: 285224 - RNA, 64 nt, Homo Sapiens; identical to SEQ ID NO: 144134

SEQ ID NO: 285225 - RNA, 64 nt, Homo Sapiens; identical to SEQ ID NO: 144135

SEQ ID NO: 285226 - RNA, 64 nt, Homo Sapiens; identical to SEQ ID NO: 144136

SEQ ID NO: 285227 - RNA, 64 nt, Homo Sapiens; identical to SEQ ID NO: 144137

SEQ ID NO: 285228 - RNA, 64 nt, Homo Sapiens; identical to SEQ ID NO: 144138

SEQ ID NO: 285229 - RNA, 64 nt, Homo Sapiens; identical to SEQ ID NO: 144139

SEQ ID NO: 285230 - RNA, 64 nt, Homo Sapiens; identical to SEQ ID NO: 144140

SEQ ID NO: 285231 - RNA, 64 nt, Homo Sapiens; identical to SEQ ID NO: 144141

SEQ ID NO: 285232 - RNA, 64 nt, Homo Sapiens; identical to SEQ ID NO: 144142

SEQ ID NO: 285233 - RNA, 64 nt, Homo Sapiens; identical to SEQ ID NO: 144143

SEQ ID NO: 285234 - RNA, 64 nt, Homo Sapiens; identical to SEQ ID NO: 144144

SEQ ID NO: 285235 - RNA, 64 nt, Homo Sapiens; identical to SEQ ID NO: 144145

SEQ ID NO: 285236 - RNA, 64 nt, Homo Sapiens; identical to SEQ ID NO: 144146

SEQ ID NO: 285237 - RNA, 64 nt, Homo Sapiens; identical to SEQ ID NO: 144147

SEQ ID NO: 285238 - RNA, 64 nt, Homo Sapiens; identical to SEQ ID NO: 144148

SEQ ID NO: 285239 - RNA, 64 nt, Homo Sapiens; identical to SEQ ID NO: 144149

SEQ ID NO: 285240 - RNA, 64 nt, Homo Sapiens; identical to SEQ ID NO: 144150

SEQ ID NO: 285241 - RNA, 64 nt, Homo Sapiens; identical to SEQ ID NO: 144151

SEQ ID NO: 285242 - RNA, 64 nt, Homo Sapiens; identical to SEQ ID NO: 144152

SEQ ID NO: 285243 - RNA, 64 nt, Homo Sapiens; identical to SEQ ID NO: 144153

SEQ ID NO: 285244 - RNA, 64 nt, Homo Sapiens; identical to SEQ ID NO: 144154

SEQ ID NO: 285245 - RNA, 64 nt, Homo Sapiens; identical to SEQ ID NO: 144155

SEQ ID NO: 285246 - RNA, 64 nt, Homo Sapiens; identical to SEQ ID NO: 193740

SEQ ID NO: 285247 - RNA, 64 nt, Homo Sapiens; identical to SEQ ID NO: 193741

SEQ ID NO: 285248 - RNA, 64 nt, Homo Sapiens; identical to SEQ ID NO: 193742

SEQ ID NO: 285249 - RNA, 64 nt, Homo Sapiens; identical to SEQ ID NO: 193743

SEQ ID NO: 285250 - RNA, 64 nt, Homo Sapiens; identical to SEQ ID NO: 193744

SEQ ID NO: 285251 - RNA, 64 nt, Homo Sapiens; identical to SEQ ID NO: 193745

SEQ ID NO: 285252 - RNA, 64 nt, Homo Sapiens; identical to SEQ ID NO: 134047

SEQ ID NO: 285253 - RNA, 64 nt, Homo Sapiens; identical to SEQ ID NO: 134048

SEQ ID NO: 285254 - RNA, 64 nt, Homo Sapiens; identical to SEQ ID NO: 134049

SEQ ID NO: 285255 - RNA, 64 nt, Homo Sapiens; identical to SEQ ID NO: 134050

SEQ ID NO: 285256 - RNA, 64 nt, Homo Sapiens; identical to SEQ ID NO: 134051

SEQ ID NO: 285257 - RNA, 64 nt, Homo Sapiens; identical to SEQ ID NO: 134052

SEQ ID NO: 285258 - RNA, 64 nt, Homo Sapiens; identical to SEQ ID NO: 134053

SEQ ID NO: 285259 - RNA, 64 nt, Homo Sapiens; identical to SEQ ID NO: 134054

SEQ ID NO: 285260 - RNA, 64 nt, Homo Sapiens
uagauguuaaguaucagauuuuaagcuuguuuuaauggucaaaaaauuaggacagaaauaauau

SEQ ID NO: 285261 - RNA, 64 nt, Homo Sapiens
uugaaagaaaggcguuaaucauaaagaagcaagaauggucaaaaucgaaugcugcauuuuuaua

SEQ ID NO: 285262 - RNA, 64 nt, Homo Sapiens
auauaauauauaaauauggugucuguguacauauagugaagauaugcaguaagagcuaccuuaa

SEQ ID NO: 285263 - RNA, 64 nt, Homo Sapiens
uuuuguuaugcuaguaucagucagaugcacuuagagugaagaaacacuguaauuacagcacaca

SEQ ID NO: 285264 - RNA, 64 nt, Homo Sapiens
aaaguggcuaauguuagcuacuaugaauggugccagugaagacacugaaaaauaagugauuuca

SEQ ID NO: 285265 - RNA, 64 nt, Homo Sapiens
aaaucuuugcacucacagagcuuacaugccagugagugaagaucgaugauaaauaaagcaaaug

SEQ ID NO: 285266 - RNA, 64 nt, Homo Sapiens
cuaaaaggaauuagaauacagcagaauuggccucagugaagagcuuaaaauuguucuccucgua

SEQ ID NO: 285267 - RNA, 64 nt, Homo Sapiens
ugcuugaaguaagcaacugaaaaauccucagcaaagugaagaaucucguguucuuuuccagaag

SEQ ID NO: 285268 - RNA, 64 nt, Homo Sapiens
ccucguuuugauguaucgcugaagaagcucuaaaagugaagagagaguaaggacauuucugacu

SEQ ID NO: 285269 - RNA, 64 nt, Homo Sapiens
cagcucaaacauuuugauaaaaggauggcauccuagugaagaaggacucccuacugggaugaug

SEQ ID NO: 285270 - RNA, 64 nt, Homo Sapiens
cuggucccugucuuuaaggagugggaaugacagaagugaagaauacucaaaugaaucaaacccc

SEQ ID NO: 285271 - RNA, 64 nt, Homo Sapiens
gacuggcuucucagcugaggaaugcauuuccaucagugaagaaucaaccggaccuguugcuagc

SEQ ID NO: 285272 - RNA, 64 nt, Homo Sapiens
auaauaaaaauauaaaaaggugauguucaacagaagugaagacaaaacaauaugcaucaggaga

SEQ ID NO: 285273 - RNA, 64 nt, Homo Sapiens
aaaguauuaaagcucacuuugcucuacuacagagagugaagaagcaugguuuuggaccccuucu

SEQ ID NO: 285274 - RNA, 64 nt, Homo Sapiens
aauguucuguuagaagaucucuuggaugucuaucagugaagaaaugauuuagaaauggaauggc

SEQ ID NO: 285275 - RNA, 64 nt, Homo Sapiens
cgauacacuuggcauugacgagacacacaacggcagugaagaacgcugaaucagacaguggaug

SEQ ID NO: 285276 - RNA, 64 nt, Homo Sapiens
gccuguuguuuaagugacugcuccagggguuuacagugaagaaauuagguacucaaacuccauu

SEQ ID NO: 285277 - RNA, 64 nt, Homo Sapiens
gucaagagaucuuucagaaaauauaagccuuuaaagugaagaagaggagccaguugugcuggcu

SEQ ID NO: 285278 - RNA, 64 nt, Homo Sapiens
gacauuaaaauguaagaugcaugaugaaaaccugagugaagaggcuguuuguguuuaacuuaua

SEQ ID NO: 285279 - RNA, 64 nt, Homo Sapiens
agagccuugaguuacgguguuuauuuuccaaucaagugaagauaucuccuacuucuccuacugg

SEQ ID NO: 285280 - RNA, 64 nt, Homo Sapiens
ccuacuucuccuacuggaacaucucagcuucugcagugaagaaaaauuccugugauaguucagu

SEQ ID NO: 285281 - RNA, 64 nt, Homo Sapiens
ccgaggaugaacuugcauugcaagaugucuccagagugaagaugacuaugaacgguuuuuuauu

SEQ ID NO: 285282 - RNA, 64 nt, Homo Sapiens
gagaaggugaacuugcuuuguaaagagcuuccacagugaagauguuacacaaagugccacuuau

SEQ ID NO: 285283 - RNA, 64 nt, Homo Sapiens
gacagguuggcucaacuuuuuuucauggcaucugagugaagagugacugucuggugaugauguc

SEQ ID NO: 285284 - RNA, 64 nt, Homo Sapiens
gcaugcaguaauuccaauguguacauuaagcuuuagugaagaguacaguucauuuggaauucag

SEQ ID NO: 285285 - RNA, 64 nt, Homo Sapiens
gaaggcuggagagaaugauuuuuaaaaaaauguaagugaagaugcaauuuggggcuuaaucuug

SEQ ID NO: 285286 - RNA, 64 nt, Homo Sapiens
auuuaguuguuaguugcuuuauuccuuaguauguagugaagaaacgcaagaauaaguucuuuga

SEQ ID NO: 285287 - RNA, 64 nt, Homo Sapiens
caagcacuuuaauggccuggagggacuuuuaaucagugaagaugcaaucagacaaguguuuugg

SEQ ID NO: 285288 - RNA, 64 nt, Homo Sapiens
aaacaggcuaaaugcaccaagaaagcuucuucagagugaagaaucuuaaugcuuguaauuuaaa

SEQ ID NO: 285289 - RNA, 64 nt, Homo Sapiens
ucuaccauagcaaggccuaauuaagaaacaacccagugaagagugucaguugcgugaauuuuuu

SEQ ID NO: 285290 - RNA, 64 nt, Homo Sapiens
uuucuuuauuccuggcaguggucccucccucaguagugaagaguuuuauuuuucuagguuuucu

SEQ ID NO: 285291 - RNA, 61 nt, Homo Sapiens
uuggauaccuguaucucuaaguguugcucagagugaagagugaagagcauuugguacacac

SEQ ID NO: 285292 - RNA, 64 nt, Homo Sapiens
auaccuguaucucuaaguguugcucagagugaagagugaagagcauuugguacacacuugaccu

SEQ ID NO: 285293 - RNA, 64 nt, Homo Sapiens
ugaucaaaagugagcuggcagcaaaaugaaauccagugaagaaacuuaguagccacuucacaaa

SEQ ID NO: 285294 - RNA, 64 nt, Homo Sapiens
cucuuccagagaccaccuucuaacgaccuuuguaagugaagaugcaugacaucucucuccaaag

SEQ ID NO: 285295 - RNA, 64 nt, Homo Sapiens
ugaaaacuggacacucccuaaauguccaccuuucagugaagagauaguuaagccaauuccauuu

SEQ ID NO: 285296 - RNA, 64 nt, Homo Sapiens
auguugaacaacaugggaaggucgcagcguacuaagugaagaagucagaggacagaggaauuuc

SEQ ID NO: 285297 - RNA, 64 nt, Homo Sapiens
cuuuuaugguuaacuuauaaaugaugaaaaucuaagugaagagagacauuaaaauaugagaugu

SEQ ID NO: 285298 - RNA, 64 nt, Homo Sapiens
auuuugaagaagaacauuguauauaagcuuuuaaagugaagagugucaaaauaucuuuaagaaa

SEQ ID NO: 285299 - RNA, 64 nt, Homo Sapiens
ggaauucgugcaggaagccaugaaaggaaagaucagugaagacagcaaucacgguucugccccu

SEQ ID NO: 285300 - RNA, 64 nt, Homo Sapiens
ccaugugucauguggaaaccuccacaggucugcuagugaagaaugcauguaugugagauuuuug

SEQ ID NO: 285301 - RNA, 64 nt, Homo Sapiens; identical to SEQ ID NO: 88546

SEQ ID NO: 285302 - RNA, 64 nt, Homo Sapiens; identical to SEQ ID NO: 88547

SEQ ID NO: 285303 - RNA, 51 nt, Homo Sapiens; identical to SEQ ID NO: 88548

SEQ ID NO: 285304 - RNA, 64 nt, Homo Sapiens; identical to SEQ ID NO: 88549

SEQ ID NO: 285305 - RNA, 64 nt, Homo Sapiens; identical to SEQ ID NO: 88550

SEQ ID NO: 285306 - RNA, 64 nt, Homo Sapiens; identical to SEQ ID NO: 88551

SEQ ID NO: 285307 - RNA, 64 nt, Homo Sapiens; identical to SEQ ID NO: 88552

SEQ ID NO: 285308 - RNA, 64 nt, Homo Sapiens; identical to SEQ ID NO: 88553

SEQ ID NO: 285309 - RNA, 64 nt, Homo Sapiens; identical to SEQ ID NO: 88554

SEQ ID NO: 285310 - RNA, 64 nt, Homo Sapiens; identical to SEQ ID NO: 88555

SEQ ID NO: 285311 - RNA, 64 nt, Homo Sapiens; identical to SEQ ID NO: 88556

SEQ ID NO: 285312 - RNA, 64 nt, Homo Sapiens; identical to SEQ ID NO: 88557

SEQ ID NO: 285313 - RNA, 64 nt, Homo Sapiens; identical to SEQ ID NO: 88558

SEQ ID NO: 285314 - RNA, 64 nt, Homo Sapiens; identical to SEQ ID NO: 88559

SEQ ID NO: 285315 - RNA, 64 nt, Homo Sapiens; identical to SEQ ID NO: 88560

SEQ ID NO: 285316 - RNA, 64 nt, Homo Sapiens; identical to SEQ ID NO: 88561

SEQ ID NO: 285317 - RNA, 64 nt, Homo Sapiens; identical to SEQ ID NO: 88562

SEQ ID NO: 285318 - RNA, 64 nt, Homo Sapiens; identical to SEQ ID NO: 88563

SEQ ID NO: 285319 - RNA, 64 nt, Homo Sapiens; identical to SEQ ID NO: 88564

SEQ ID NO: 285320 - RNA, 64 nt, Homo Sapiens; identical to SEQ ID NO: 88565

SEQ ID NO: 285321 - RNA, 64 nt, Homo Sapiens; identical to SEQ ID NO: 88566

SEQ ID NO: 285322 - RNA, 64 nt, Homo Sapiens; identical to SEQ ID NO: 88567

SEQ ID NO: 285323 - RNA, 64 nt, Homo Sapiens; identical to SEQ ID NO: 88568

SEQ ID NO: 285324 - RNA, 64 nt, Homo Sapiens; identical to SEQ ID NO: 88569

SEQ ID NO: 285325 - RNA, 64 nt, Homo Sapiens; identical to SEQ ID NO: 88570

SEQ ID NO: 285326 - RNA, 64 nt, Homo Sapiens; identical to SEQ ID NO: 88571

SEQ ID NO: 285327 - RNA, 64 nt, Homo Sapiens; identical to SEQ ID NO: 88572

SEQ ID NO: 285328 - RNA, 64 nt, Homo Sapiens; identical to SEQ ID NO: 88573

SEQ ID NO: 285329 - RNA, 64 nt, Homo Sapiens; identical to SEQ ID NO: 88574

SEQ ID NO: 285330 - RNA, 64 nt, Homo Sapiens; identical to SEQ ID NO: 88575

SEQ ID NO: 285331 - RNA, 64 nt, Homo Sapiens; identical to SEQ ID NO: 88576

SEQ ID NO: 285332 - RNA, 64 nt, Homo Sapiens; identical to SEQ ID NO: 88577

SEQ ID NO: 285333 - RNA, 64 nt, Homo Sapiens; identical to SEQ ID NO: 88578

SEQ ID NO: 285334 - RNA, 64 nt, Homo Sapiens; identical to SEQ ID NO: 88579

SEQ ID NO: 285335 - RNA, 64 nt, Homo Sapiens; identical to SEQ ID NO: 88580

SEQ ID NO: 285336 - RNA, 64 nt, Homo Sapiens; identical to SEQ ID NO: 88581

SEQ ID NO: 285337 - RNA, 64 nt, Homo Sapiens; identical to SEQ ID NO: 88582

SEQ ID NO: 285338 - RNA, 64 nt, Homo Sapiens; identical to SEQ ID NO: 88583

SEQ ID NO: 285339 - RNA, 64 nt, Homo Sapiens; identical to SEQ ID NO: 88584

SEQ ID NO: 285340 - RNA, 64 nt, Homo Sapiens; identical to SEQ ID NO: 88585

SEQ ID NO: 285341 - RNA, 64 nt, Homo Sapiens; identical to SEQ ID NO: 88586

SEQ ID NO: 285342 - RNA, 64 nt, Homo Sapiens; identical to SEQ ID NO: 88587

SEQ ID NO: 285343 - RNA, 64 nt, Homo Sapiens; identical to SEQ ID NO: 88588

SEQ ID NO: 285344 - RNA, 64 nt, Homo Sapiens; identical to SEQ ID NO: 88589

SEQ ID NO: 285345 - RNA, 64 nt, Homo Sapiens; identical to SEQ ID NO: 88590

SEQ ID NO: 285346 - RNA, 64 nt, Homo Sapiens; identical to SEQ ID NO: 88591

SEQ ID NO: 285347 - RNA, 64 nt, Homo Sapiens; identical to SEQ ID NO: 88592

SEQ ID NO: 285348 - RNA, 64 nt, Homo Sapiens; identical to SEQ ID NO: 88593

SEQ ID NO: 285349 - RNA, 64 nt, Homo Sapiens
gguuuggcccauggggcccccccaggccccugccccaacugauucugcccagauaaucgugucu

SEQ ID NO: 285350 - RNA, 64 nt, Homo Sapiens
acacaacaggacugagcagaaccaaacacuucuuccaacugacucugcucccugcccucaccau

SEQ ID NO: 285351 - RNA, 64 nt, Homo Sapiens
uucuauugcuaggguaaaauaaauacauuuguguccaacugaaauauaauugucauuaaaauaa

SEQ ID NO: 285352 - RNA, 64 nt, Homo Sapiens
ugagagguuaguuuuuuuccuacacuuuuuuuugccaacugacuuaacaacauugcugucaggu

SEQ ID NO: 285353 - RNA, 63 nt, Homo Sapiens
uacacaccaaccugcuggcuuuagaauaaaagcaccaacugaacugagaugugugguguggua

SEQ ID NO: 285354 - RNA, 64 nt, Homo Sapiens
auggacuuuccacuguaggaguggacauuucaagccaacugagccuuuuccucaagugccgaca

SEQ ID NO: 285355 - RNA, 64 nt, Homo Sapiens
uauuucauauucuacagaaguaaaucagguuucaccaacugaaaugucucccuuugaaaguagc

SEQ ID NO: 285356 - RNA, 64 nt, Homo Sapiens
augaaaauacaucuaucccucauuuugagagccuccaacugauccaagugucauccggaggagg

SEQ ID NO: 285357 - RNA, 64 nt, Homo Sapiens
aaagaugagccucgauuuuaaaaucuauccacauccaacugauggcaccauugaugugcaaaua

SEQ ID NO: 285358 - RNA, 64 nt, Homo Sapiens
ugguauacuguuuuagucuugaauugccaacuuuccaacugaucuauccauauuccuuaaguac

SEQ ID NO: 285359 - RNA, 64 nt, Homo Sapiens
gaaacccuaucuuucacuuuacauuccuuucaauccaacugaucaaaacugguacccacacuug

SEQ ID NO: 285360 - RNA, 64 nt, Homo Sapiens
ucagaagguuuggguacauuacagcuuggguuuuccaacugacuuaggauuucugacuuuuuau

SEQ ID NO: 285361 - RNA, 64 nt, Homo Sapiens
aauccacauuugguguugcagaugaguuguaaagccaacugaaagaguuccuucaagaaguucc

SEQ ID NO: 285362 - RNA, 64 nt, Homo Sapiens
uggggcgcugcuccccacaguuccccagcggccaccaacugaccgcucaccccacuccagggcc

SEQ ID NO: 285363 - RNA, 64 nt, Homo Sapiens
ucaagggcuguagguucaugcauuucccuacuccccaacugaguuugaaucgcugcgauacugg

SEQ ID NO: 285364 - RNA, 64 nt, Homo Sapiens
cauugaauuuaaaauagagcaggugccaguuuuuccaacugauuauuccuuccauaucuuuagc

SEQ ID NO: 285365 - RNA, 64 nt, Homo Sapiens
ucuuguauauucuguuagauagucauaaauuuucccaacugaagucuuuuuugcccuuucaugg

SEQ ID NO: 285366 - RNA, 64 nt, Homo Sapiens
uaggagacugacugugaguguuauccagucugugccaacugaaguuucccaucccaggagcuca

SEQ ID NO: 285367 - RNA, 64 nt, Homo Sapiens
accugagauggagauauguugaaguaagagccaaccaacugaaaauuaaaguacuugggcuuca

SEQ ID NO: 285368 - RNA, 64 nt, Homo Sapiens
cauauaacguuuucaucuccuuagagcauuuugaccaacugaaauugcaauauucaguaucaaa

SEQ ID NO: 285369 - RNA, 64 nt, Homo Sapiens
uuuaguaaaauccuuuuuagaagguauuuuuuuuccaacugaguagugaaaaucaacaaggugc

SEQ ID NO: 285370 - RNA, 64 nt, Homo Sapiens
uuaguauuugaaaaucagugugauuccuuaauggccaacugaagauugaauugccgcuaacaac

SEQ ID NO: 285371 - RNA, 64 nt, Homo Sapiens
auucuucauagggaccuuuaaaaagcaggaaauaccaacugaagucaauuugggggacaugcua

SEQ ID NO: 285372 - RNA, 64 nt, Homo Sapiens
augucgaaagagcuggcugggggccuugcccaaaccaacugaggucuuaaaguccagggaaaaa

SEQ ID NO: 285373 - RNA, 64 nt, Homo Sapiens
aagauggaaauuucuuuuuaggcuaauuugaaauccaacugaagcuuuuuaaccaauauuuuaa

SEQ ID NO: 285374 - RNA, 64 nt, Homo Sapiens
gacucaaaauugcaaauauaaacaaaagaaaaauccaacugaaaauaacacuaaguauuuuuga

SEQ ID NO: 285375 - RNA, 64 nt, Homo Sapiens
uguucaacauuuuugaauacauuaaaagaaguaaccaacugaacgacaaagcaugguauuugaa

SEQ ID NO: 285376 - RNA, 64 nt, Homo Sapiens
gacguuccauacccccacaugccaauuucagcacccaacugagauccgaggagcuccugggaag

SEQ ID NO: 285377 - RNA, 64 nt, Homo Sapiens
agaaugagacaauuccuugggcuguaguuuggacccaacugaauccugagugcucuguggcuga

SEQ ID NO: 285378 - RNA, 64 nt, Homo Sapiens
cuucaaaaagccacuuuucccccuauccugauccccaacugaagacuccuacccuuccagggac

SEQ ID NO: 285379 - RNA, 64 nt, Homo Sapiens
gugaacuuguucauucaccuuauccuuaaucuggccaacugaaauucucaauuaaaaagaagug

SEQ ID NO: 285380 - RNA, 64 nt, Homo Sapiens
ggggcagcugaagcucacggugacucagcagugcccaacugaccaaucucccgcagcucuccug

SEQ ID NO: 285381 - RNA, 64 nt, Homo Sapiens
cugcuucucccauguaccagggcaccaggcccacccaacugaaggcauggcggcggggugcagg

SEQ ID NO: 285382 - RNA, 64 nt, Homo Sapiens
acaauucauuuuucucuucuaaagguagucuuucccaacugacuguaggguugugucuuuuccc

SEQ ID NO: 285383 - RNA, 64 nt, Homo Sapiens
cuggucagccuuuuuggguaacacaguuaauuuaccaacugauacagauaauagaauauauuca

SEQ ID NO: 285384 - RNA, 64 nt, Homo Sapiens
aaugggaaauaaaaugugguaacccaaaugucuaccaacugaugaauagccaaaaaguggaaac

SEQ ID NO: 285385 - RNA, 64 nt, Homo Sapiens
gaagucuugaccuugauaccuuucaguuccccacccaacugacuagcccucccaugucugcugg

SEQ ID NO: 285386 - RNA, 64 nt, Homo Sapiens
ugcuuagguaccuggcagcuguguccugcuguacccaacugacuagcuacccuggaaugguggc

SEQ ID NO: 285387 - RNA, 64 nt, Homo Sapiens
uaccagaaaaugacauucuguccucuccugcaggccaacugaaauguguugucauucaaggacu

SEQ ID NO: 285388 - RNA, 64 nt, Homo Sapiens
aaaaaauucucaggcuuuacgccuugcagaagaaccaacugaaaauaucuuugcagguaucaca

SEQ ID NO: 285389 - RNA, 64 nt, Homo Sapiens
caauguaacaguguaaucuaccaucaggaagcucccaacugaagacucaugagcacuauaauaa

SEQ ID NO: 285390 - RNA, 64 nt, Homo Sapiens
gccguaaaaccuuuguugcuucucauuuguucuuccaacugaaauaguucagcugcugucacag

SEQ ID NO: 285391 - RNA, 64 nt, Homo Sapiens
uggguccacuuucugagaugcuuucuaaaaccaaccaacugauaaaaaguagaugagacuucuc

SEQ ID NO: 285392 - RNA, 64 nt, Homo Sapiens
ccacauucaauauuuugauucuugcacaauaaagccaacugauugcaacugauucuuugagagg

SEQ ID NO: 285393 - RNA, 64 nt, Homo Sapiens
uccaccuggaccuccauuuuucccuguaaauucuccaacugauccuacccucccuacuccugca

SEQ ID NO: 285394 - RNA, 64 nt, Homo Sapiens
ugaacccugaaacaaagauaaugauuuggaccacccaacugaaguggcauguuauguuuuuggc

SEQ ID NO: 285395 - RNA, 64 nt, Homo Sapiens
gugauugauguagggaaaugaggagaggcacuuuccaacugaagugaguuuugaucucuuuuua

SEQ ID NO: 285396 - RNA, 64 nt, Homo Sapiens
ugccaacaaaauaaaaauaaaauaaauguugaaaccaacugaaccugguauauaguaggugcuc

SEQ ID NO: 285397 - RNA, 64 nt, Homo Sapiens
gucacuuaaaugaaaauuuagauuuaauuugcucccaacugauuuuuuuuucaccuuaagggag

SEQ ID NO: 285398 - RNA, 64 nt, Homo Sapiens
ugcaugcccaggacacaaguuuucacauuuuaccccaacugaccagaauggcuaugaagcguca

SEQ ID NO: 285399 - RNA, 64 nt, Homo Sapiens
uaauggauguaaaaaagccuauuucuacauuauaccaacugagaaaaaaauggucgguaaagug

SEQ ID NO: 285400 - RNA, 64 nt, Homo Sapiens
augcaauuagccucauaguuauuauccagaggacccaacugaacugaacuaauccuucuggcag

SEQ ID NO: 285401 - RNA, 64 nt, Homo Sapiens
cugcugaacauuuggaaaccaugcacuagccaacccaacugacuucugcuagguagaggcauuu

SEQ ID NO: 285402 - RNA, 64 nt, Homo Sapiens
uguuagggcuucaaggcccucagagaugaucaguccaacugaacgaccuuacaaaugaggaaac

SEQ ID NO: 285403 - RNA, 64 nt, Homo Sapiens
guuuuuuauccagaaauauuuucagcaaaacuuuccaacugaguggagucugauuaaggauuua

SEQ ID NO: 285404 - RNA, 64 nt, Homo Sapiens
cggauuagcuagcaccuuuaagcccugcauuucuccaacugacaagugggugggggugauggca

SEQ ID NO: 285405 - RNA, 64 nt, Homo Sapiens
gaaggacagaacuugacuggcuccauuucauggaccaacugaucaauugccaguacuaagccac

SEQ ID NO: 285406 - RNA, 64 nt, Homo Sapiens
acuacaagccauacugaggcggcagcaggagcgaccaacugaucgcacacaugcuuuguuugga

SEQ ID NO: 285407 - RNA, 64 nt, Homo Sapiens
ugauuugauuuauccuuguaccucaucugagggcccaacugauaacaagcauugcuaccaaccg

SEQ ID NO: 285408 - RNA, 64 nt, Homo Sapiens
ccccagcaccugcuacaguggcuucuccaagaccccaacugagucauucuugcuauaacuaagu

SEQ ID NO: 285409 - RNA, 64 nt, Homo Sapiens
gaauccuggcaggaacagacauuaccuucagaggccaacugacaccauagggacagcuuguaua

SEQ ID NO: 285410 - RNA, 64 nt, Homo Sapiens
cugagccaggguucccccagugccuccagggaggccaacugacuaggggccgugaccagcccuc

SEQ ID NO: 285411 - RNA, 64 nt, Homo Sapiens
agccuucacuugucaguaucauaaagaguauugcccaacugaacuuugcucccacugguuuaau

SEQ ID NO: 285412 - RNA, 64 nt, Homo Sapiens
ccccaaagcuguagucccaaucaaucaaaggcuaccaacugaguccucagguucauuucuuuuu

SEQ ID NO: 285413 - RNA, 64 nt, Homo Sapiens
cauugccccuccgaugcugaggccacccacugacccaacugauccugcuccagcagcacaccuc

SEQ ID NO: 285414 - RNA, 64 nt, Homo Sapiens
gucucaccucacauugucccuacaaggacaggccccaacugauaaccguugcuuuuuuuuuuuu

SEQ ID NO: 285415 - RNA, 64 nt, Homo Sapiens
ucugcccuugggauuccaaaccucccuagggcucccaacugaccucaggccucugagucacuga

SEQ ID NO: 285416 - RNA, 64 nt, Homo Sapiens
gauggcugguguuauuggccaguuuuuagccaauccaacugaccuagugaagguucagaugcaa

SEQ ID NO: 285417 - RNA, 64 nt, Homo Sapiens
ugaaucccuuaggacuggaacacuucaagcucaaccaacugacucaguugucauucuucacaaa

SEQ ID NO: 285418 - RNA, 64 nt, Homo Sapiens
ugauguuccacuccacuuuguauagacaucugccccaacugaauguguucugucacucagcuuu

SEQ ID NO: 285419 - RNA, 64 nt, Homo Sapiens
gaagaauaauucauggauuuguucauuguucuuuccaacugaaggcaguaaccauuacuucuaa

SEQ ID NO: 285420 - RNA, 64 nt, Homo Sapiens
auaugcccuaggaaaguacaaccagaauugaaaaccaacugaucuauaccaguucuuucaauua

SEQ ID NO: 285421 - RNA, 64 nt, Homo Sapiens
cauuugugcacguguauagcggggaagauuuccaccaacugaauacuuuaacaaugaaggggaa

SEQ ID NO: 285422 - RNA, 64 nt, Homo Sapiens
uacccgguagacugaauaucgucagacacgaaauccaacugaauuauauucuucuacugauuca

SEQ ID NO: 285423 - RNA, 64 nt, Homo Sapiens
gauagacucugagcacuaauagccaaaauaucucccaacugacucagugaaacaacaucauuua

SEQ ID NO: 285424 - RNA, 64 nt, Homo Sapiens
aaaccccugugguccggcagauucugaagcagcaccaacugagcaguuccaagcauggaggcuc

SEQ ID NO: 285425 - RNA, 64 nt, Homo Sapiens
ccuuuccucuccuggguacugaggugcuaugaagccaacugacaaagaugcaucacgugucuua

SEQ ID NO: 285426 - RNA, 64 nt, Homo Sapiens
cuguugucuucaaauacuaaaugaacaauaucugccaacugaacaaaaacaaccucaagggucc

SEQ ID NO: 285427 - RNA, 64 nt, Homo Sapiens
accaacaguuccaagccagagagggaguccuuugccaacugaugcuuuuacaguuaauccagga

SEQ ID NO: 285428 - RNA, 64 nt, Homo Sapiens
cacaugaugauuuuguggucgaaaaucuuuguugccaacugaaguuuccucauaagcauaaaaa

SEQ ID NO: 285429 - RNA, 64 nt, Homo Sapiens
gggcuuugacuaugucauuagguggguacaaaacccaacugauguggagaaaaauugauguuug

SEQ ID NO: 285430 - RNA, 64 nt, Homo Sapiens
aggggggaugucuugagauguauuaugcaaaguaccaacugagccaaaaacaauaaacgaaaca

SEQ ID NO: 285431 - RNA, 64 nt, Homo Sapiens
aucaaucaugggaauuacauaaggauaaugaggcccaacugaaaccaaguuucagucugccuua

SEQ ID NO: 285432 - RNA, 64 nt, Homo Sapiens
cagcaguauuuuaaguggggaaugcaacgugaggccaacugaacaauuccccccguggcugccc

SEQ ID NO: 285433 - RNA, 64 nt, Homo Sapiens
ugaaugaaauuaucacagguugucucaagcacaaccaacugaaugucucuuaacuguggggacc

SEQ ID NO: 285434 - RNA, 64 nt, Homo Sapiens
aguguucugcccuagauugguucaaggaggucauccaacugacuuuaucaaguggaauugggau

SEQ ID NO: 285435 - RNA, 64 nt, Homo Sapiens
auuuuaaugauuguguguucuaauucaugugcugccaacugaguuaucuagugauaugaccuca

SEQ ID NO: 285436 - RNA, 64 nt, Homo Sapiens
uaaacuuaaguccagaagccggaugaggaugucaccaacugaauaacaggagaaaggacaacca

SEQ ID NO: 285437 - RNA, 64 nt, Homo Sapiens
gaucgcccaacguuuuuggagacgcccucuuccuccaacugaagacugugugagcuacuuaacu

SEQ ID NO: 285438 - RNA, 64 nt, Homo Sapiens
ugccagccgguucugcuagacuauuuguuucaacccaacugaccuccagucuggagagcugugu

SEQ ID NO: 285439 - RNA, 64 nt, Homo Sapiens
guaguauguggagcauaaaaacaucuucauucucccaacugaguacaaagacuucaacaauugc

SEQ ID NO: 285440 - RNA, 64 nt, Homo Sapiens
auuaugucuuaguuauaauuagauugugaaucagccaacugaaaauccuuuuugcauauuucaa

SEQ ID NO: 285441 - RNA, 64 nt, Homo Sapiens
ucucucucucuaguauucuaaacugaccccaugaccaacugagaauuuauuuuuguuucauugg

SEQ ID NO: 285442 - RNA, 64 nt, Homo Sapiens
cagugcauguguggcagagagcaggcaagggcuuccaacugaggcaggacauacuaguucccug

SEQ ID NO: 285443 - RNA, 55 nt, Homo Sapiens; identical to SEQ ID NO: 221797

SEQ ID NO: 285444 - RNA, 64 nt, Homo Sapiens
cuacuaggauccugugugugcacugaugcuuucgccaacugaaauacuguaauugggccuggcu

SEQ ID NO: 285445 - RNA, 64 nt, Homo Sapiens
auaugaggacugcauguaaucuuuaguuugcuaaccaacugaaucaucccauaaauaaaaaaua

SEQ ID NO: 285446 - RNA, 64 nt, Homo Sapiens
caucuugugaguggauaaucucauggucaaguucccaacugaguccagccagaaagcacuacaa

SEQ ID NO: 285447 - RNA, 64 nt, Homo Sapiens
uuauaacccucugcaccuucuagcugcauuacugccaacugaccauuucauucauaccagauaa

SEQ ID NO: 285448 - RNA, 64 nt, Homo Sapiens
aggaaaaacuucuguauggaucaauggacuugacccaacugagacucaagcuguaacagaaagg

SEQ ID NO: 285449 - RNA, 64 nt, Homo Sapiens
gugagggagucucacccaccuuccaucaucagggccaacugagauucucaggcugcaccaaaga

SEQ ID NO: 285450 - RNA, 64 nt, Homo Sapiens
uggccuucaggagccuagguucgccugccccuguccaacugagauggcugaggccagaggccca

SEQ ID NO: 285451 - RNA, 64 nt, Homo Sapiens
uucacaagccaaguagggcauauaucagauuuggccaacugaauggcgucuguccugucaucca

SEQ ID NO: 285452 - RNA, 64 nt, Homo Sapiens
auacguaggaauuuuuuccuuuuguguucugucaccaacugaaguggcuaaagagcuuugugau

SEQ ID NO: 285453 - RNA, 64 nt, Homo Sapiens
ugcccacacaacaggcuuauuuucugugaaggaaccaacugaucucccccacccuuggauuaga

SEQ ID NO: 285454 - RNA, 64 nt, Homo Sapiens
uuguuaagaggaaauaaucaagaucacucauaucccaacugaaucugagguuuuauaaaucccu

SEQ ID NO: 285455 - RNA, 64 nt, Homo Sapiens
accacuguccuacagagucagacagagucaacccccaacugaggguugccagaugccccuaggg

SEQ ID NO: 285456 - RNA, 64 nt, Homo Sapiens
gaugaugugguugcuauggaaaaguguugucaggccaacugaauugguuuuuuuuuuuuuaacc

SEQ ID NO: 285457 - RNA, 64 nt, Homo Sapiens
uauagacuuacugcuggacaggccucuuuacugaccaacugaagagaagagguguccuuacaga

SEQ ID NO: 285458 - RNA, 64 nt, Homo Sapiens
aagacuagagggauuaguaccuggucacacacaaccaacugaaaaggguauuuaagugcuaggg

SEQ ID NO: 285459 - RNA, 64 nt, Homo Sapiens
auugaaaucucucauuugccuguuuuccaggaauccaacugagcggugcuuggcagcuguucug

SEQ ID NO: 285460 - RNA, 64 nt, Homo Sapiens
cugaucaacgaagagggauugacagcuacauccuccaacugaccgcccaccuggcuaccaggcc

SEQ ID NO: 285461 - RNA, 52 nt, Homo Sapiens; identical to SEQ ID NO: 221815

SEQ ID NO: 285462 - RNA, 64 nt, Homo Sapiens
uuuaaacuuuguucuuguccaauuaaaagaaauuccaacugacuucuuguccccuuggucuuuu

SEQ ID NO: 285463 - RNA, 64 nt, Homo Sapiens
gaaacugaggguccugcccugggaaacugagguuccaacugacacaagucacucacuuaaaaug

SEQ ID NO: 285464 - RNA, 64 nt, Homo Sapiens
uccccaacccacucccuuccaacaacaaccagcuccaacugacucuggucuugggaggugaggc

SEQ ID NO: 285465 - RNA, 64 nt, Homo Sapiens
augacgucugaccucuaccaucgccauuuuugcuccaacugaggaaacuacaggggaagugggg

SEQ ID NO: 285466 - RNA, 64 nt, Homo Sapiens
gugcuaauugcuuggaucucacuuaggagcagcaccaacugaagauaguaguuagaggcuuaca

SEQ ID NO: 285467 - RNA, 64 nt, Homo Sapiens
cuaaaggaaacaaacaaaaacagcgguaacacugccaacugagagaacagagaagagauuacac

SEQ ID NO: 285468 - RNA, 64 nt, Homo Sapiens
ugaggagcuuccucucuuccaaaccucuguaaccccaacugaaagaacuuacgauaucugcccc

SEQ ID NO: 285469 - RNA, 64 nt, Homo Sapiens
uaccgugaugguguugauuuuuuacacguguaagccaacugagauugcucuuugaaaauuucuu

SEQ ID NO: 285470 - RNA, 64 nt, Homo Sapiens
cacguaaagcucgaaccacgugauggaaugaaagccaacugaacacugggauuuaagacacccc

SEQ ID NO: 285471 - RNA, 64 nt, Homo Sapiens
uugggaaguuugguugaggucaucuuuuugacuuccaacugauaaaguccagaaagaaaggguu

SEQ ID NO: 285472 - RNA, 64 nt, Homo Sapiens
uugaaccucuuagccacauuuccagcagggcaaaccaacugaugcccuggaagagucuuccgca

SEQ ID NO: 285473 - RNA, 64 nt, Homo Sapiens
cauuggaaagcuaauccuaccuugucaguuucaaccaacugaguuuuuucuuuaagaaagguaa

SEQ ID NO: 285474 - RNA, 64 nt, Homo Sapiens
gcuaaaaagcaacaggccauaauuucccccuaaaccaacugaaggcaggucucauagguugagc

SEQ ID NO: 285475 - RNA, 64 nt, Homo Sapiens
uuccaaauauaagaguacucauguuuauuuauuuccaacugagcagcaaccuccuuuguuucac

SEQ ID NO: 285476 - RNA, 64 nt, Homo Sapiens
uuugccagacaagucuccaggggaucccuguuucccaacugaaaggugugaacggacacacaca

SEQ ID NO: 285477 - RNA, 64 nt, Homo Sapiens
ucauuuuaguauuaacucuuuagcaucucaaauuccaacugaaacacucaaaauaaauggucuu

SEQ ID NO: 285478 - RNA, 64 nt, Homo Sapiens
uuguauguaaauaccaagagucuaagaaauagagccaacugauuucuuucuucccguguguauu

SEQ ID NO: 285479 - RNA, 64 nt, Homo Sapiens
ccugacuuucccccuguaccaagguaggacucaaccaacugaaaaaaaagccuaacaaacagau

SEQ ID NO: 285480 - RNA, 64 nt, Homo Sapiens
ugaugcuuaauaaaacugcuccgccacccacaugccaacugacuuuauuccauuaccaggcacu

SEQ ID NO: 285481 - RNA, 64 nt, Homo Sapiens
uuaaacccuuaccaaggaaaaaaaagggauguuaccaacugagaucgaucaguucauccaauca

SEQ ID NO: 285482 - RNA, 64 nt, Homo Sapiens
ggacacgaagucuagcuccguagaaaaccauuuaccaacugaaaaagaaauauuauugauucua

SEQ ID NO: 285483 - RNA, 64 nt, Homo Sapiens
cguggggugagcuuuauagcuuccaaggugaggcccaacugaauuaaggagguuguggguggga

SEQ ID NO: 285484 - RNA, 64 nt, Homo Sapiens
accaaauugagauggcaaauuaauauauccaaauccaacugaaucugugacugacagguaaucc

SEQ ID NO: 285485 - RNA, 64 nt, Homo Sapiens
cguuuaaauuugcccuaggaguggcuuuuuccuaccaacugauauggaaaauuaaaggccacuu

SEQ ID NO: 285486 - RNA, 64 nt, Homo Sapiens
uuuuuguauuuuaaaggaaaaaugacuuucauucccaacugauuaugaccuuucaggaugucgu

SEQ ID NO: 285487 - RNA, 64 nt, Homo Sapiens
uuguuuuuuuuuuaugaggcuccugagaaucaacccaacugaagcauuucaauucacuugaaug

SEQ ID NO: 285488 - RNA, 64 nt, Homo Sapiens
cuugugauuccuaccccucuuccagcuucuuuugccaacugaagccuucuucugccacuucugc

SEQ ID NO: 285489 - RNA, 64 nt, Homo Sapiens
uuugcuccaccccacucacagagacacagggcauccaacugagaaaacgaaacugcucuaagca

SEQ ID NO: 285490 - RNA, 64 nt, Homo Sapiens
ccccuuggccugcucccuguaggaagucauccugccaacugauuuaaaagggcucuuuagccag

SEQ ID NO: 285491 - RNA, 64 nt, Homo Sapiens
aaagaggugacugucaguggaggggucucugcagccaacugagacuaucuugcugugcccugag

SEQ ID NO: 285492 - RNA, 64 nt, Homo Sapiens
aacccccuugggguggggcagaaggugaagcaucccaacugacuagagacucaggcccugcagg

SEQ ID NO: 285493 - RNA, 64 nt, Homo Sapiens
gagccaguuagacuaguccccggucucccgauucccaacugaguguuauuugcacacugcacug

SEQ ID NO: 285494 - RNA, 64 nt, Homo Sapiens
uguaauauugguuagggaaacaaacuucaggucaccaacugaagucauuacaaacuccuuguac

SEQ ID NO: 285495 - RNA, 64 nt, Homo Sapiens
gaugccagccaggcccaggagugcccagcaucccccaacugaugacacaguagcacugauucug

SEQ ID NO: 285496 - RNA, 64 nt, Homo Sapiens
ugcgcuggagcugcucuuauuggcccucacaggcccaacugaccucgcuugcugcccaacacca

SEQ ID NO: 285497 - RNA, 64 nt, Homo Sapiens
uaaaugcuauuuaaauaaagcaacuggcauagagccaacugagaccuuaccccaauaccaagac

SEQ ID NO: 285498 - RNA, 64 nt, Homo Sapiens
acaacagugacauguuugaaucugcaguguccucccaacugaaaucccugccagaaaaaugugc

SEQ ID NO: 285499 - RNA, 64 nt, Homo Sapiens
acaaaauccuggcccgugcuggacacacggaaacccaacugagaaggaaacccaagagcugccu

SEQ ID NO: 285500 - RNA, 64 nt, Homo Sapiens
agccccaagcucuccauggcacaaccugcuguuaccaacugaagauggagggcugagcccugug

SEQ ID NO: 285501 - RNA, 64 nt, Homo Sapiens
accuuuguuucucccccaugaggagcuccccuccccaacugaccagggcagccagggagagccc

SEQ ID NO: 285502 - RNA, 64 nt, Homo Sapiens
uccauuagccggacucgaaaguuggccuuaagucccaacugaugggucucagguuggauuauuu

SEQ ID NO: 285503 - RNA, 64 nt, Homo Sapiens
uuuacaaaccagacuuuuaucugaauagacuuggccaacugauguuccacuaucaugaaggacu

SEQ ID NO: 285504 - RNA, 64 nt, Homo Sapiens
aaacugaacucacaccugguaccacucagaaccuccaacugacugaaugccaggagcugaacau

SEQ ID NO: 285505 - RNA, 64 nt, Homo Sapiens
uguaucuguccguggaaaauuucccucuucuaacccaacugacuaaaccagagccuauauggag

SEQ ID NO: 285506 - RNA, 64 nt, Homo Sapiens
cauaucuuuuuguucaucaguaauaacuaguuggccaacugacugugguccauggacuacacag

SEQ ID NO: 285507 - RNA, 64 nt, Homo Sapiens
ccuggacagggggcagccguggaggccaccguuaccaacugaagcugggggccuggguccuacc

SEQ ID NO: 285508 - RNA, 64 nt, Homo Sapiens
cgcauugagccaguggugcuaaaugcuacauacuccaacugaaauguuaaggaagaagauagau

SEQ ID NO: 285509 - RNA, 64 nt, Homo Sapiens
cuaagauucaagggaguguugcuucucaacucagccaacugaguagcaaaucauuuguucuaga

SEQ ID NO: 285510 - RNA, 64 nt, Homo Sapiens
ugcaaggauguaugauaauauguacaaaguaauuccaacugaggaagcucaccugauccuuagu

SEQ ID NO: 285511 - RNA, 64 nt, Homo Sapiens
cuccugacauaagugcacagagcuucaguguccaccaacugaccaugaaauagaguaugcugua

SEQ ID NO: 285512 - RNA, 64 nt, Homo Sapiens
auuagaaaugcaaauucuugggucacucucuagaccaacugaugcagaaacaggaggugugagc

SEQ ID NO: 285513 - RNA, 64 nt, Homo Sapiens
acccgcucugauuccccacauucuccuucaagacccaacugagccaccucccacccuccuccuc

SEQ ID NO: 285514 - RNA, 64 nt, Homo Sapiens
guagucggcucaacacccucgcaggccacccauuccaacugaguaagcuggagcacuacgacuu

SEQ ID NO: 285515 - RNA, 64 nt, Homo Sapiens
ggugcgaaccagcauuaacggauggggcacgugcccaacugaggaacaggagaagaaaucacca

SEQ ID NO: 285516 - RNA, 64 nt, Homo Sapiens
gggaaaguuucagcucacugugaagccagacuccccaacugaaacaccagaagguuuggaguga

SEQ ID NO: 285517 - RNA, 64 nt, Homo Sapiens
auaaguuucuuuuagcuuguacagcauccucagaccaacugaggagcuuuccuuguuaacaauu

SEQ ID NO: 285518 - RNA, 64 nt, Homo Sapiens
ggccuggaguugccgaggaagucacagaaaaugaccaacugauggggccuggagugcaggaggg

SEQ ID NO: 285519 - RNA, 64 nt, Homo Sapiens
ccaaacuuuucuaaugucugcuggauuuguuuuuccaacugaguguaaaggacuuuuuuaacug

SEQ ID NO: 285520 - RNA, 64 nt, Homo Sapiens
uuuguauuuuuaguagagacgcacaccaccacgcccaacugauuaaguagcugagauuacaggc

SEQ ID NO: 285521 - RNA, 64 nt, Homo Sapiens
ccccagagguuuguauaucaugaacuugauugugccaacugaaauauuuucuguuaguacaagu

SEQ ID NO: 285522 - RNA, 64 nt, Homo Sapiens
cuggacguccaggugggcccccccagcaccucccccaacugaccgguggccagguggggcggga

SEQ ID NO: 285523 - RNA, 64 nt, Homo Sapiens
gcucacuuuuuguauuuaaauauuaaaaaugauuccaacugaaagugucauccuaaguaccuug

SEQ ID NO: 285524 - RNA, 64 nt, Homo Sapiens
acuuaccugccuaguuaauaagagaaagaauuaaccaacugauguuucuaacuucucaaguucu

SEQ ID NO: 285525 - RNA, 64 nt, Homo Sapiens
ugauggggugggggugcuccagagaccagaggagccaacugagaaagugccugaugcccgcguc

SEQ ID NO: 285526 - RNA, 64 nt, Homo Sapiens
caaaauuauauugagcaaucgccaaggccuaaagccaacugacuuaaagguaaucauuucagcu

SEQ ID NO: 285527 - RNA, 64 nt, Homo Sapiens
ccccugccaugcucuggucuguucugaaacugugccaacugaaagaugauaguccacacagcac

SEQ ID NO: 285528 - RNA, 64 nt, Homo Sapiens
uaauuacaucccauaacuugucaggauaguugcuccaacugaauugcuaucauuuggcuggaug

SEQ ID NO: 285529 - RNA, 64 nt, Homo Sapiens
uuauuaugagaaaguggacuuaaccgaaauggaaccaacugacauucuaucguguuguacauag

SEQ ID NO: 285530 - RNA, 64 nt, Homo Sapiens
cagaagggugcuaagucaccuacugaagagagaaccaacugacuuuccuauugacucaucagga

SEQ ID NO: 285531 - RNA, 64 nt, Homo Sapiens
uccuucuaucuugaaucuucuagagaguugcugaccaacugacguauguuucccuuugugaauu

SEQ ID NO: 285532 - RNA, 64 nt, Homo Sapiens
ucagggacauugccagcuccgaaaaggcuauuuuccaacugaagaaucuuugugugaaggauug

SEQ ID NO: 285533 - RNA, 64 nt, Homo Sapiens
uguuauagguccuuuagaaaaagcuagaacacugccaacugaucaaucugcccccaacucccaa

SEQ ID NO: 285534 - RNA, 64 nt, Homo Sapiens
ucucaauguucucaguacgauuucagggugucuuccaacugaaagggguaugcuacucauaaga

SEQ ID NO: 285535 - RNA, 64 nt, Homo Sapiens
aguaccuuaucaaaguagcaauaucuaaaucuguccaacugagauguuuacagagaugucucuu

SEQ ID NO: 285536 - RNA, 64 nt, Homo Sapiens; identical to SEQ ID NO: 21758

SEQ ID NO: 285537 - RNA, 64 nt, Homo Sapiens; identical to SEQ ID NO: 21759

SEQ ID NO: 285538 - RNA, 64 nt, Homo Sapiens; identical to SEQ ID NO: 21760

SEQ ID NO: 285539 - RNA, 64 nt, Homo Sapiens; identical to SEQ ID NO: 21761

SEQ ID NO: 285540 - RNA, 64 nt, Homo Sapiens; identical to SEQ ID NO: 21762

SEQ ID NO: 285541 - RNA, 64 nt, Homo Sapiens; identical to SEQ ID NO: 21763

SEQ ID NO: 285542 - RNA, 64 nt, Homo Sapiens; identical to SEQ ID NO: 21764

SEQ ID NO: 285543 - RNA, 64 nt, Homo Sapiens; identical to SEQ ID NO: 21765

SEQ ID NO: 285544 - RNA, 64 nt, Homo Sapiens; identical to SEQ ID NO: 21766

SEQ ID NO: 285545 - RNA, 64 nt, Homo Sapiens; identical to SEQ ID NO: 21767

SEQ ID NO: 285546 - RNA, 64 nt, Homo Sapiens; identical to SEQ ID NO: 21768

SEQ ID NO: 285547 - RNA, 64 nt, Homo Sapiens; identical to SEQ ID NO: 21769

SEQ ID NO: 285548 - RNA, 64 nt, Homo Sapiens; identical to SEQ ID NO: 21770

SEQ ID NO: 285549 - RNA, 64 nt, Homo Sapiens; identical to SEQ ID NO: 21771

SEQ ID NO: 285550 - RNA, 64 nt, Homo Sapiens; identical to SEQ ID NO: 21772

SEQ ID NO: 285551 - RNA, 64 nt, Homo Sapiens; identical to SEQ ID NO: 21773

SEQ ID NO: 285552 - RNA, 64 nt, Homo Sapiens; identical to SEQ ID NO: 21774

SEQ ID NO: 285553 - RNA, 64 nt, Homo Sapiens; identical to SEQ ID NO: 21775

SEQ ID NO: 285554 - RNA, 64 nt, Homo Sapiens; identical to SEQ ID NO: 21776

SEQ ID NO: 285555 - RNA, 64 nt, Homo Sapiens; identical to SEQ ID NO: 21777

SEQ ID NO: 285556 - RNA, 64 nt, Homo Sapiens; identical to SEQ ID NO: 21778

SEQ ID NO: 285557 - RNA, 64 nt, Homo Sapiens; identical to SEQ ID NO: 21779

SEQ ID NO: 285558 - RNA, 64 nt, Homo Sapiens; identical to SEQ ID NO: 21780

SEQ ID NO: 285559 - RNA, 64 nt, Homo Sapiens; identical to SEQ ID NO: 21781

SEQ ID NO: 285560 - RNA, 64 nt, Homo Sapiens; identical to SEQ ID NO: 262484

SEQ ID NO: 285561 - RNA, 64 nt, Homo Sapiens; identical to SEQ ID NO: 262485

SEQ ID NO: 285562 - RNA, 64 nt, Homo Sapiens; identical to SEQ ID NO: 262486

SEQ ID NO: 285563 - RNA, 64 nt, Homo Sapiens; identical to SEQ ID NO: 262487

SEQ ID NO: 285564 - RNA, 64 nt, Homo Sapiens; identical to SEQ ID NO: 262488

SEQ ID NO: 285565 - RNA, 64 nt, Homo Sapiens; identical to SEQ ID NO: 262489

SEQ ID NO: 285566 - RNA, 64 nt, Homo Sapiens; identical to SEQ ID NO: 262490

SEQ ID NO: 285567 - RNA, 64 nt, Homo Sapiens; identical to SEQ ID NO: 262491

SEQ ID NO: 285568 - RNA, 64 nt, Homo Sapiens; identical to SEQ ID NO: 262492

SEQ ID NO: 285569 - RNA, 64 nt, Homo Sapiens; identical to SEQ ID NO: 262493

SEQ ID NO: 285570 - RNA, 64 nt, Homo Sapiens; identical to SEQ ID NO: 262494

SEQ ID NO: 285571 - RNA, 64 nt, Homo Sapiens; identical to SEQ ID NO: 262495

SEQ ID NO: 285572 - RNA, 64 nt, Homo Sapiens; identical to SEQ ID NO: 262496

SEQ ID NO: 285573 - RNA, 64 nt, Homo Sapiens; identical to SEQ ID NO: 262497

SEQ ID NO: 285574 - RNA, 64 nt, Homo Sapiens; identical to SEQ ID NO: 262498

SEQ ID NO: 285575 - RNA, 64 nt, Homo Sapiens; identical to SEQ ID NO: 262499

SEQ ID NO: 285576 - RNA, 64 nt, Homo Sapiens; identical to SEQ ID NO: 262500

SEQ ID NO: 285577 - RNA, 64 nt, Homo Sapiens; identical to SEQ ID NO: 262501

SEQ ID NO: 285578 - RNA, 64 nt, Homo Sapiens; identical to SEQ ID NO: 262502

SEQ ID NO: 285579 - RNA, 64 nt, Homo Sapiens; identical to SEQ ID NO: 262503

SEQ ID NO: 285580 - RNA, 64 nt, Homo Sapiens; identical to SEQ ID NO: 262504

SEQ ID NO: 285581 - RNA, 64 nt, Homo Sapiens; identical to SEQ ID NO: 262505

SEQ ID NO: 285582 - RNA, 64 nt, Homo Sapiens; identical to SEQ ID NO: 262506

SEQ ID NO: 285583 - RNA, 64 nt, Homo Sapiens; identical to SEQ ID NO: 262507

SEQ ID NO: 285584 - RNA, 64 nt, Homo Sapiens; identical to SEQ ID NO: 262508

SEQ ID NO: 285585 - RNA, 64 nt, Homo Sapiens; identical to SEQ ID NO: 262509

SEQ ID NO: 285586 - RNA, 64 nt, Homo Sapiens; identical to SEQ ID NO: 262510

SEQ ID NO: 285587 - RNA, 64 nt, Homo Sapiens; identical to SEQ ID NO: 262511

SEQ ID NO: 285588 - RNA, 64 nt, Homo Sapiens; identical to SEQ ID NO: 262512

SEQ ID NO: 285589 - RNA, 64 nt, Homo Sapiens; identical to SEQ ID NO: 262513

SEQ ID NO: 285590 - RNA, 64 nt, Homo Sapiens; identical to SEQ ID NO: 262514

SEQ ID NO: 285591 - RNA, 64 nt, Homo Sapiens; identical to SEQ ID NO: 262515

SEQ ID NO: 285592 - RNA, 64 nt, Homo Sapiens; identical to SEQ ID NO: 262516

SEQ ID NO: 285593 - RNA, 64 nt, Homo Sapiens; identical to SEQ ID NO: 262517

SEQ ID NO: 285594 - RNA, 64 nt, Homo Sapiens; identical to SEQ ID NO: 262518

SEQ ID NO: 285595 - RNA, 64 nt, Homo Sapiens; identical to SEQ ID NO: 262519

SEQ ID NO: 285596 - RNA, 64 nt, Homo Sapiens; identical to SEQ ID NO: 262520

SEQ ID NO: 285597 - RNA, 64 nt, Homo Sapiens; identical to SEQ ID NO: 262521

SEQ ID NO: 285598 - RNA, 64 nt, Homo Sapiens; identical to SEQ ID NO: 262522

SEQ ID NO: 285599 - RNA, 64 nt, Homo Sapiens; identical to SEQ ID NO: 262523

SEQ ID NO: 285600 - RNA, 64 nt, Homo Sapiens; identical to SEQ ID NO: 262524

SEQ ID NO: 285601 - RNA, 64 nt, Homo Sapiens; identical to SEQ ID NO: 262525

SEQ ID NO: 285602 - RNA, 64 nt, Homo Sapiens; identical to SEQ ID NO: 262526

SEQ ID NO: 285603 - RNA, 64 nt, Homo Sapiens; identical to SEQ ID NO: 262527

SEQ ID NO: 285604 - RNA, 64 nt, Homo Sapiens; identical to SEQ ID NO: 262528

SEQ ID NO: 285605 - RNA, 64 nt, Homo Sapiens; identical to SEQ ID NO: 262529

SEQ ID NO: 285606 - RNA, 64 nt, Homo Sapiens; identical to SEQ ID NO: 262530

SEQ ID NO: 285607 - RNA, 64 nt, Homo Sapiens; identical to SEQ ID NO: 262531

SEQ ID NO: 285608 - RNA, 64 nt, Homo Sapiens; identical to SEQ ID NO: 262532

SEQ ID NO: 285609 - RNA, 64 nt, Homo Sapiens; identical to SEQ ID NO: 262533

SEQ ID NO: 285610 - RNA, 64 nt, Homo Sapiens; identical to SEQ ID NO: 262534

SEQ ID NO: 285611 - RNA, 64 nt, Homo Sapiens; identical to SEQ ID NO: 262535

SEQ ID NO: 285612 - RNA, 64 nt, Homo Sapiens; identical to SEQ ID NO: 262536

SEQ ID NO: 285613 - RNA, 64 nt, Homo Sapiens; identical to SEQ ID NO: 262537

SEQ ID NO: 285614 - RNA, 64 nt, Homo Sapiens; identical to SEQ ID NO: 262538

SEQ ID NO: 285615 - RNA, 64 nt, Homo Sapiens; identical to SEQ ID NO: 262539

SEQ ID NO: 285616 - RNA, 64 nt, Homo Sapiens; identical to SEQ ID NO: 262540

SEQ ID NO: 285617 - RNA, 64 nt, Homo Sapiens; identical to SEQ ID NO: 262541

SEQ ID NO: 285618 - RNA, 64 nt, Homo Sapiens; identical to SEQ ID NO: 262542

SEQ ID NO: 285619 - RNA, 64 nt, Homo Sapiens; identical to SEQ ID NO: 262543

SEQ ID NO: 285620 - RNA, 64 nt, Homo Sapiens; identical to SEQ ID NO: 262544

SEQ ID NO: 285621 - RNA, 64 nt, Homo Sapiens; identical to SEQ ID NO: 262545

SEQ ID NO: 285622 - RNA, 64 nt, Homo Sapiens; identical to SEQ ID NO: 262546

SEQ ID NO: 285623 - RNA, 64 nt, Homo Sapiens; identical to SEQ ID NO: 262547

SEQ ID NO: 285624 - RNA, 64 nt, Homo Sapiens; identical to SEQ ID NO: 262548

SEQ ID NO: 285625 - RNA, 64 nt, Homo Sapiens; identical to SEQ ID NO: 262549

SEQ ID NO: 285626 - RNA, 64 nt, Homo Sapiens; identical to SEQ ID NO: 262550

SEQ ID NO: 285627 - RNA, 64 nt, Homo Sapiens; identical to SEQ ID NO: 262551

SEQ ID NO: 285628 - RNA, 64 nt, Homo Sapiens; identical to SEQ ID NO: 262552

SEQ ID NO: 285629 - RNA, 64 nt, Homo Sapiens; identical to SEQ ID NO: 262553

SEQ ID NO: 285630 - RNA, 64 nt, Homo Sapiens; identical to SEQ ID NO: 262554

SEQ ID NO: 285631 - RNA, 64 nt, Homo Sapiens; identical to SEQ ID NO: 262555

SEQ ID NO: 285632 - RNA, 64 nt, Homo Sapiens; identical to SEQ ID NO: 262556

SEQ ID NO: 285633 - RNA, 64 nt, Homo Sapiens; identical to SEQ ID NO: 262557

SEQ ID NO: 285634 - RNA, 64 nt, Homo Sapiens; identical to SEQ ID NO: 262558

SEQ ID NO: 285635 - RNA, 64 nt, Homo Sapiens; identical to SEQ ID NO: 262559

SEQ ID NO: 285636 - RNA, 64 nt, Homo Sapiens; identical to SEQ ID NO: 262560

SEQ ID NO: 285637 - RNA, 64 nt, Homo Sapiens; identical to SEQ ID NO: 262561

SEQ ID NO: 285638 - RNA, 64 nt, Homo Sapiens; identical to SEQ ID NO: 262562

SEQ ID NO: 285639 - RNA, 64 nt, Homo Sapiens
acauauauauaaauauaccugaugccagauuuuuuucauaaauauucugccuacuguaaauaug

SEQ ID NO: 285640 - RNA, 64 nt, Homo Sapiens
uacaguuuaauuaauuauucuuagugcuuaaggcuucauaaaguaauuuuuccaaccuuuuuuu

SEQ ID NO: 285641 - RNA, 64 nt, Homo Sapiens
auugcuuucugauucguguagucucucccacagauucauaaacuuuuaugacuuauauuguuuc

SEQ ID NO: 285642 - RNA, 64 nt, Homo Sapiens
caggugcuucuccuuuaugauuugaguuggccucuucauaaauuagugcuguuuacuuucagag

SEQ ID NO: 285643 - RNA, 64 nt, Homo Sapiens
agacuggauaacuucuaaccaauaguuuauuuguuucauaaaucuaaaagcugagaaguccaag

SEQ ID NO: 285644 - RNA, 64 nt, Homo Sapiens
uguuccugggcaaaucacaacauggggaauuuuauucauaaauguccacagaaacaguaaaugu

SEQ ID NO: 285645 - RNA, 64 nt, Homo Sapiens
cuguugcugaaauguggcuuuggcauuguuggauuucauaaaaaauuucuggcaggaagucuug

SEQ ID NO: 285646 - RNA, 64 nt, Homo Sapiens
aaaaaauaaaaguaucuccuagucccuuaauuuuuucauaaauauuucuggcuuuugaguagug

SEQ ID NO: 285647 - RNA, 64 nt, Homo Sapiens
cuaaaacauuugaagaaacauggugcauuauuuuuucauaaacgauguuagaaauccaaaaucu

SEQ ID NO: 285648 - RNA, 64 nt, Homo Sapiens
uuucucuuuuauaccuuccucaaucugaacacaauucauaaagaauauuauguuuauacaaaau

SEQ ID NO: 285649 - RNA, 64 nt, Homo Sapiens
uaaagcuuaaaaauugucuuggaaucugaaauguuucauaaaaauugaugugcugugauaugag

SEQ ID NO: 285650 - RNA, 64 nt, Homo Sapiens
caauucagcaaauauuuccauccaagaggaagcuuucauaaaaaauacucugauccuuacagaa

SEQ ID NO: 285651 - RNA, 64 nt, Homo Sapiens
uagauguaaacaccucuucuauuuggaaauaaauuucauaaaaauuauauacacugccucuuca

SEQ ID NO: 285652 - RNA, 64 nt, Homo Sapiens
uuuuacuuaaaaucuguaacacacauucuguuucuucauaaaaaacagguaucuuggauuucag

SEQ ID NO: 285653 - RNA, 64 nt, Homo Sapiens
ccaucugcaucccaaguccuauuuuauaaggauauucauaaaaauuccauggugaauccuuguc

SEQ ID NO: 285654 - RNA, 64 nt, Homo Sapiens
cacccuucuccuuggauuguuuuggaaguuauucuucauaaaaaauguuaacgugggcugggca

SEQ ID NO: 285655 - RNA, 64 nt, Homo Sapiens
cuuuuaguaagaggaaaaagggauuauaaaacccuucauaaaucaagaaggccaucacuuagaa

SEQ ID NO: 285656 - RNA, 64 nt, Homo Sapiens
aaaauaucacugacucaucccuacccauauucuuuucauaaaacccacucaccagguacaauag

SEQ ID NO: 285657 - RNA, 64 nt, Homo Sapiens
ggguuaauuauuugcuacaacauuuuauguuuuauucauaaaggucagugaguaaaagcuuuga

SEQ ID NO: 285658 - RNA, 64 nt, Homo Sapiens
caaaugcuugucugcuagcaauaagagugccucuuucauaaaacacauacuagcuucuuucucu

SEQ ID NO: 285659 - RNA, 64 nt, Homo Sapiens
uguugucauguguaugagaacaagguauguacaguucauaaauugugucuaguagaacaaugua

SEQ ID NO: 285660 - RNA, 64 nt, Homo Sapiens
ucaugacugagucuggcaaauaaauuguuauaacuucauaaaaccugaauauuaagaaacaauu

SEQ ID NO: 285661 - RNA, 64 nt, Homo Sapiens
ugcuuucuuaugacuguuuuuauaaauaaacuguuucauaaauaauguauacuggaaaauuguc

SEQ ID NO: 285662 - RNA, 64 nt, Homo Sapiens
caaaaucuccaaaccucugaaaacugaaauauuuuucauaaauuaggcguaaauucuaugcccu

SEQ ID NO: 285663 - RNA, 64 nt, Homo Sapiens
ggcagaaaaauggucaaggaauaggaacuacaacuucauaaaugaggaaccagaaaagguaaaa

SEQ ID NO: 285664 - RNA, 64 nt, Homo Sapiens
uacggcuuuauugaaaacauugauauauugaauauucauaaauuuuaauuuaacuuucuuuuau

SEQ ID NO: 285665 - RNA, 64 nt, Homo Sapiens
auaauguauaaucuauacauuaugaauauuaugguucauaaauuuaacacaaauaauuauucua

SEQ ID NO: 285666 - RNA, 64 nt, Homo Sapiens
acugagaauaauuaaaacaauacuaaauccauauuucauaaauauuuugucucucuccugaucu

SEQ ID NO: 285667 - RNA, 64 nt, Homo Sapiens
cgcucuuccuuaggccuggggucuuggaaacuccuucauaaagccacagugugaucucucaccu

SEQ ID NO: 285668 - RNA, 64 nt, Homo Sapiens
gaagaaaaagaauguggccauagguccauaauauuucauaaaaucuccuuccacaagaagugca

SEQ ID NO: 285669 - RNA, 64 nt, Homo Sapiens
ugacaggcauaaacccaaauagucauuuuucuuauucauaaaucuggauuauagacuuaaaaau

SEQ ID NO: 285670 - RNA, 64 nt, Homo Sapiens
ugacacugauaaagccuuuguuagggaaaauuguuucauaaauggucccugauuuuauuuucuu

SEQ ID NO: 285671 - RNA, 64 nt, Homo Sapiens
agcacuguugugauaacaccuugguaacaguuguuucauaaauguagcacuguuaaagcacgaa

SEQ ID NO: 285672 - RNA, 64 nt, Homo Sapiens
auggaucucgcuuugguugugugagaauaauguguucauaaagcucaaaccuauccccggaugu

SEQ ID NO: 285673 - RNA, 64 nt, Homo Sapiens
ccucuuauagaguuacucuuaaauuaaauuguacuucauaaaauagugcuugagacuggaacca

SEQ ID NO: 285674 - RNA, 64 nt, Homo Sapiens
ugucugggggcuuccuuguuauauuuccauaucguucauaaaugguccauuugaguucuuucca

SEQ ID NO: 285675 - RNA, 64 nt, Homo Sapiens
acuuauagccuuaaaccauuaauucaagagaugcuucauaaaacguauuuccaauuuggucuuc

SEQ ID NO: 285676 - RNA, 64 nt, Homo Sapiens
auuuguacccagaauguauuuaauuucuuuugaguucauaaaucuuacauguuuuaggauaaac

SEQ ID NO: 285677 - RNA, 64 nt, Homo Sapiens
cucaucauucuguuggcuaauggaagaauuaaaauucauaaaguugcaaaagccacaacaguag

SEQ ID NO: 285678 - RNA, 64 nt, Homo Sapiens
cuucccauggaguuuugcuaaucccuuauaguaauucauaaaugcauugccuucuguuuuguau

SEQ ID NO: 285679 - RNA, 64 nt, Homo Sapiens
agugggcaauagauaaaggaggcuuuaaaaauuauucauaaaacuaaagauguaugauuucuaa

SEQ ID NO: 285680 - RNA, 64 nt, Homo Sapiens
cgcagucucagcuuaugguucuuucaaugaaccuuucauaaauuaugcaccaccuguuugcuug

SEQ ID NO: 285681 - RNA, 64 nt, Homo Sapiens
acauuaugcuaaucugaaaugagaauugucaugguucauaaaucauaacugaguaauauauuaa

SEQ ID NO: 285682 - RNA, 64 nt, Homo Sapiens
uaaggauguauuauugagaaaaaauauuaacauuuucauaaauaaaagaugaaauaaaguauuc

SEQ ID NO: 285683 - RNA, 64 nt, Homo Sapiens
ugccagaggcagaaauggucuggguauaagcuauuucauaaaagcagcuuuaaauugucaguau

SEQ ID NO: 285684 - RNA, 64 nt, Homo Sapiens
gucuuaauuucuaacauuaucuuugcuuuuauguuucauaaaaauuugucauuauuuaugcugg

SEQ ID NO: 285685 - RNA, 64 nt, Homo Sapiens
cuaguaccucaaugcgauucugagauauuugaauuucauaaaauuguaacugaaauuuaaaauu

SEQ ID NO: 285686 - RNA, 64 nt, Homo Sapiens
aauaauugcuuguuuucuagccuggcaagauauuuucauaaaagagggauaacaaugcugauua

SEQ ID NO: 285687 - RNA, 64 nt, Homo Sapiens
aagccacgguguucugugauauaaguguguguuuuucauaaagcaggcagaacucaucuaggua

SEQ ID NO: 285688 - RNA, 64 nt, Homo Sapiens
uaugauacuugaaaauuaacaugaauauuuaguguucauaaauaaaguuuguugaaacacaacc

SEQ ID NO: 285689 - RNA, 64 nt, Homo Sapiens
uuaaaugcuuuaagaaaugguuaugaacauuuuuuucauaaaaauaagaacauacauuuugaaa

SEQ ID NO: 285690 - RNA, 64 nt, Homo Sapiens
agaauugauccuguggcuggucaggaauagauuuuucauaaagcagaaguacgugaguuguucc

SEQ ID NO: 285691 - RNA, 64 nt, Homo Sapiens
cccugucucuaggucgcugagagaggugcuuuucuucauaaaaccuuugggguuuggauuuccc

SEQ ID NO: 285692 - RNA, 64 nt, Homo Sapiens
uguaaaagaugcauggagucaggagaaaaccaccuucauaaacugcucugugcaaagaggaaua

SEQ ID NO: 285693 - RNA, 64 nt, Homo Sapiens
auuugaagugaaguuauaaaagggcaaauccagauucauaaacuaucaccucggauuucuugua

SEQ ID NO: 285694 - RNA, 64 nt, Homo Sapiens
aaauacaugcuuaacaaaaggaaugagccugaaguucauaaagaauacauaucaauauucuuau

SEQ ID NO: 285695 - RNA, 64 nt, Homo Sapiens
uuaccuaagcaaguggucuuauuaguuuuguugcuucauaaaauggguuaaaauucuucaccau

SEQ ID NO: 285696 - RNA, 64 nt, Homo Sapiens
cucaagagcauuuuuaagccuuuguaucauuucuuucauaaaacgaaaguuagagaacauuaug

SEQ ID NO: 285697 - RNA, 64 nt, Homo Sapiens
caagcacuaccacuggucagcuguuuaauggccauucauaaauuuacaucugaguuuaaauguu

SEQ ID NO: 285698 - RNA, 64 nt, Homo Sapiens
aggcacaaaaguuuuaucaguguaaucuauuuucuucauaaaaccuaucaaucuuauaaauaua

SEQ ID NO: 285699 - RNA, 64 nt, Homo Sapiens
auggaaaacucacugcugagucugaauauccuucuucauaaaucuuauuuuaucccagaugugu

SEQ ID NO: 285700 - RNA, 64 nt, Homo Sapiens
aagcagcuuuaaacaaauuccaguucauguuugcuucauaaaugcuuccuuucuaggcugguaa

SEQ ID NO: 285701 - RNA, 64 nt, Homo Sapiens
aagucuuuguacccacuccuuauguuucuuuucauucauaaacagguguauaaggaacaauguc

SEQ ID NO: 285702 - RNA, 64 nt, Homo Sapiens
uuccacuggcaccauuagugaauauuuaguuguuuucauaaacgaugcugugaugaagacucau

SEQ ID NO: 285703 - RNA, 64 nt, Homo Sapiens
acguuuuauuggagcauagcgauguccaccuguuuucauaaauauccuccaugggcuaaaucca

SEQ ID NO: 285704 - RNA, 64 nt, Homo Sapiens
uuauggcaugucuucuauuuccuacaaauuaacuuucauaaauuauuuuuuaaauguauucauu

SEQ ID NO: 285705 - RNA, 64 nt, Homo Sapiens
aaauaagcuuuuacuuuuuaaaaccacuugagguuucauaaagcuugggguuuuuuuuuuuccu

SEQ ID NO: 285706 - RNA, 64 nt, Homo Sapiens
uacuguauugggaaacuugaggagaacucuuuaguucauaaagcuucaaugucuuuuuuuuuuu

SEQ ID NO: 285707 - RNA, 64 nt, Homo Sapiens
uuuaguuuaaugugcucuuuagauuaagucauaauucauaaaaugagucugcuguugaacuauu

SEQ ID NO: 285708 - RNA, 64 nt, Homo Sapiens
guuaauggaagcuuuuugauacuagauugccaaauucauaaaaucacaauacuuaauguauugu

SEQ ID NO: 285709 - RNA, 64 nt, Homo Sapiens
acugaaccaguuggccacucucucagauucccucuucauaaagcuuccgugacuucuaaaccau

SEQ ID NO: 285710 - RNA, 64 nt, Homo Sapiens
acucuugugcuaguaugucuauagugugaauacauucauaaauuucuugaucaaagcuagguca

SEQ ID NO: 285711 - RNA, 64 nt, Homo Sapiens
cuuaucaagaguuguuuuuuaaaaauuuaauaaauucauaaaaaagacucauaucuuugcaaac

SEQ ID NO: 285712 - RNA, 64 nt, Homo Sapiens
ucccuucuuccuagcgagcauauuucaacuguucuucauaaauguuuaugugccuuaaaagacu

SEQ ID NO: 285713 - RNA, 64 nt, Homo Sapiens
ucuuuauaugcucagauucuguugggcguuagaauucauaaaagcaaugaaugcucaaguuggg

SEQ ID NO: 285714 - RNA, 64 nt, Homo Sapiens
ugcaguuuuaugucuuuuacggaauuugcuccaauucauaaauuuuccuuguuuuauucccuuu

SEQ ID NO: 285715 - RNA, 64 nt, Homo Sapiens
gcuggcugagaaauaaaagaaaacaagacaguuguucauaaaguuucauuuuguaugcacugau

SEQ ID NO: 285716 - RNA, 64 nt, Homo Sapiens
aucucuuuuuuuguuuuugaaaauauggccauuuuucauaaaauguuauuuguguuagcaugua

SEQ ID NO: 285717 - RNA, 64 nt, Homo Sapiens
gucccuguaccagaguauguauccugaacuuugguucauaaauauggcucuugaacccauagac

SEQ ID NO: 285718 - RNA, 64 nt, Homo Sapiens
acuuccuguuuauggguuugccuauucuggaucuuucauaaaaauggaauuacacaauuguggc

SEQ ID NO: 285719 - RNA, 64 nt, Homo Sapiens
uccggaaagcgcgguaggguucguagguagggcuaguagguaggguuaguagguagggcuagua

SEQ ID NO: 285720 - RNA, 64 nt, Homo Sapiens
guaggguucguagguagggcuaguagguaggguuaguagguagggcuaguagguagggcuagua

SEQ ID NO: 285721 - RNA, 64 nt, Homo Sapiens
guagggcuaguagguaggguuaguagguagggcuaguagguagggcuaguagguaggguucgua

SEQ ID NO: 285722 - RNA, 64 nt, Homo Sapiens
guaggguuaguagguagggcuaguagguagggcuaguagguaggguucguagguaggguucgua

SEQ ID NO: 285723 - RNA, 64 nt, Homo Sapiens
guaggguucguagguagggcugguagguaggguuaguagguagggcuaguagguaggguuagua

SEQ ID NO: 285724 - RNA, 64 nt, Homo Sapiens
guagggcugguagguaggguuaguagguagggcuaguagguaggguuaguagguaggguucgua

SEQ ID NO: 285725 - RNA, 64 nt, Homo Sapiens
guaggguuaguagguagggcuaguagguaggguuaguagguaggguucguagguaggguucgua

SEQ ID NO: 285726 - RNA, 64 nt, Homo Sapiens
guaggguucguagguaggguucguagguagggcuaguagguaggguuaguagguaggguucgua

SEQ ID NO: 285727 - RNA, 64 nt, Homo Sapiens
guaggguucguagguagggcuaguagguaggguuaguagguaggguucguagguagggcuagua

SEQ ID NO: 285728 - RNA, 64 nt, Homo Sapiens
guaggguucguagguaggguucguagguagggcuaguagguaggguuaguagguagggcuagua

SEQ ID NO: 285729 - RNA, 64 nt, Homo Sapiens; identical to SEQ ID NO: 285720

SEQ ID NO: 285730 - RNA, 64 nt, Homo Sapiens
guagggcuaguagguaggguuaguagguagggcuaguagguagggcuaguagguaggguuagua

SEQ ID NO: 285731 - RNA, 64 nt, Homo Sapiens
guaggguuaguagguagggcuaguagguagggcuaguagguaggguuaguagguagggcuagua

SEQ ID NO: 285732 - RNA, 64 nt, Homo Sapiens
guagggcuaguagguagggcuaguagguaggguuaguagguagggcuaguagguaggguucgua

SEQ ID NO: 285733 - RNA, 64 nt, Homo Sapiens
guagggcuaguagguaggguuaguagguagggcuaguagguaggguucguagguaggguuagua

SEQ ID NO: 285734 - RNA, 64 nt, Homo Sapiens
guagggcuaguagguaggguucguagguaggguuaguagguagggcuaguagguaggguucgua

SEQ ID NO: 285735 - RNA, 64 nt, Homo Sapiens
guaggguucguagguaggguuaguagguagggcuaguagguaggguucguagguaggguucgua

SEQ ID NO: 285736 - RNA, 64 nt, Homo Sapiens; identical to SEQ ID NO: 285728

SEQ ID NO: 285737 - RNA, 64 nt, Homo Sapiens; identical to SEQ ID NO: 285720

SEQ ID NO: 285738 - RNA, 64 nt, Homo Sapiens; identical to SEQ ID NO: 285721

SEQ ID NO: 285739 - RNA, 64 nt, Homo Sapiens; identical to SEQ ID NO: 285722

SEQ ID NO: 285740 - RNA, 64 nt, Homo Sapiens
guaggguucguagguaggguucguagguaggguuaguagguaggguucguagguagggcuagua

SEQ ID NO: 285741 - RNA, 64 nt, Homo Sapiens
guaggguuaguagguaggguucguagguagggcuaguagguagggcuaguagguagggcuagua

SEQ ID NO: 285742 - RNA, 64 nt, Homo Sapiens
guaggguucguagguagggcuaguagguagggcuaguagguagggcuaguagguaggguuagua

SEQ ID NO: 285743 - RNA, 64 nt, Homo Sapiens
guagggcuaguagguagggcuaguagguagggcuaguagguaggguuaguagguagggcuagua

SEQ ID NO: 285744 - RNA, 64 nt, Homo Sapiens
guagggcuaguagguagggcuaguagguaggguuaguagguagggcuaguagguagggcuagua

SEQ ID NO: 285745 - RNA, 64 nt, Homo Sapiens
guagggcuaguagguaggguuaguagguagggcuaguagguagggcuaguagguagggcuagua

SEQ ID NO: 285746 - RNA, 64 nt, Homo Sapiens
guaggguuaguagguagggcuaguagguagggcuaguagguagggcuaguagguagggcuagua

SEQ ID NO: 285747 - RNA, 64 nt, Homo Sapiens
guagggcuaguagguagggcuaguagguagggcuaguagguagggcuaguagguaggguucgua

SEQ ID NO: 285748 - RNA, 64 nt, Homo Sapiens
guagggcuaguagguagggcuaguagguagggcuaguagguaggguucguagguaggguucgua

SEQ ID NO: 285749 - RNA, 64 nt, Homo Sapiens
ucugaaaguuaccaauucaaggauagcaugccuaauugugcauuacugauugugcauuguaucu

SEQ ID NO: 285750 - RNA, 64 nt, Homo Sapiens
guaucuggauagcaugccuaauaagggaauacugauugugcauuuauuuaaaaauagguguuca

SEQ ID NO: 285751 - RNA, 64 nt, Homo Sapiens
gaacugauucuguggauggaugugauuucaggagauugugcagugccagcaucagugcauaaag

SEQ ID NO: 285752 - RNA, 64 nt, Homo Sapiens
ugaagccuauugggguuaaguuuguaaguguuuaauugugcaaauugccacccuguguaccucc

SEQ ID NO: 285753 - RNA, 64 nt, Homo Sapiens
cuggaugagauaaugacauauuaauuuucuuagaauugugcaggagguaugauaauuuuuguaa

SEQ ID NO: 285754 - RNA, 64 nt, Homo Sapiens
uccuguguaaaguaaggauugcagcagaauuugaauugugcaacgaggcacaucucacuguuuu

SEQ ID NO: 285755 - RNA, 64 nt, Homo Sapiens
cuuaggguuuuuccaucccuguuaaaugcucacaauugugcauucagccacaguugugaugguu

SEQ ID NO: 285756 - RNA, 64 nt, Homo Sapiens
ugccaauuuuuuguuaaaacaaauugguggagaaauugugcauaacuaaaugguugacacacaa

SEQ ID NO: 285757 - RNA, 58 nt, Homo Sapiens
gagccaugaaauguaguuaguguggcaaauugugcagaguaguuuauuccuucugacc

SEQ ID NO: 285758 - RNA, 64 nt, Homo Sapiens
uaagcccaggaguuugagucuguaaugcacuaugauugugcaugugaauagccacugcacucca

SEQ ID NO: 285759 - RNA, 64 nt, Homo Sapiens
uguauauauagaagucauuauggcagaugcacaaauugugcagugauguaaauauacauacuuc

SEQ ID NO: 285760 - RNA, 64 nt, Homo Sapiens
aauuuacacaaauuauaaaaauuagucgggugucauugugcauaccuguagucccagcuauuca

SEQ ID NO: 285761 - RNA, 64 nt, Homo Sapiens
cugccugcuucagccucccacuugaacuacugagcucaagcaauuccauguugcccaagcuggu

SEQ ID NO: 285762 - RNA, 64 nt, Homo Sapiens
ccuuucaccucaaccccccacucaaccucccaggcucaagcagucaaacaugggucauuguagc

SEQ ID NO: 285763 - RNA, 64 nt, Homo Sapiens
guauugaauuuuaaaauaaccucaaacuccugggcucaagcaauaccguuuugcccaggcuggu

SEQ ID NO: 285764 - RNA, 64 nt, Homo Sapiens
ccucucaccucagccugcuggccugccucucaggcucaagcaaacaaucuugccucacugcaac

SEQ ID NO: 285765 - RNA, 64 nt, Homo Sapiens
cuacccaccuugaccucccacucgaacucuugagcucaagcagugugacauugcccaggcuggu

SEQ ID NO: 285766 - RNA, 64 nt, Homo Sapiens
ccucccacuucaaccucccacucugccuucugggcucaagcaaucaaucucggcucacugcaac

SEQ ID NO: 285767 - RNA, 64 nt, Homo Sapiens
ccuccugccucggccucccacucaaccuccugggcucaagcaauaccauguugcccaggcuggu

SEQ ID NO: 285768 - RNA, 64 nt, Homo Sapiens
ucucccaccucagccucccacucugccuccugggcucaagcaaucaaucucggcucacugcaac

SEQ ID NO: 285769 - RNA, 64 nt, Homo Sapiens
ugaucuuggcucacggcagccuugcccucccuggcucaagcagucuucaucucagccuccagag

SEQ ID NO: 285770 - RNA, 64 nt, Homo Sapiens
gccauauuugccaggcugguuugaacuccuacaacucaagcauuccucccaccuuggucuccca

SEQ ID NO: 285771 - RNA, 64 nt, Homo Sapiens
ccaccugccuuggccucccacucaaacuuguggccucaagcaauguuuuguugccaaagcuggu

SEQ ID NO: 285772 - RNA, 64 nt, Homo Sapiens
ccuccugccucagccuuccacucauacuccugggcucaagcaauugaucauagcucacugcagc

SEQ ID NO: 285773 - RNA, 64 nt, Homo Sapiens
cuuuacaccauacuuuacuugcaaaacuauucuucucaagcaucuaaaauggaggcaguaggga

SEQ ID NO: 285774 - RNA, 64 nt, Homo Sapiens
uauucuuucuguagggaccagaaaagcuggguaacucaagcagcaaagaacuaggaucucacag

SEQ ID NO: 285775 - RNA, 64 nt, Homo Sapiens
uuuaaucaaugaucaucucaguuugacuagccaucucaagcaagcaucucaagcaaguuucgac

SEQ ID NO: 285776 - RNA, 64 nt, Homo Sapiens
uuucgacguuugacuagccaguuugacuagccaucucaagcaagcuuuuucuuugauuuucgac

SEQ ID NO: 285777 - RNA, 64 nt, Homo Sapiens
ugaucauagcucacuguaaccucaaacucuggggcucaagcaguucucccaccagccuccuuuu

SEQ ID NO: 285778 - RNA, 64 nt, Homo Sapiens
gcuauguugcccaagcuggucuuaaacuccuggccucaagcaauccuucugccuuggcccccca

SEQ ID NO: 285779 - RNA, 64 nt, Homo Sapiens
ccuccugccuuggccucccacucaaaccccugggcucaagcaaguaccauuugccccagcuggu

SEQ ID NO: 285780 - RNA, 64 nt, Homo Sapiens
ccuccugccucugccucccacuggaccucccaagcucaagcaaugugauuacagcucauguagc

SEQ ID NO: 285781 - RNA, 64 nt, Homo Sapiens
uuuuuucuuuguucacugccccuggacuguguuucucaagcacaaucugagaguuuuccuuuaa

SEQ ID NO: 285782 - RNA, 64 nt, Homo Sapiens
aauucaacugcauuaaccgaacguugcucacauucucaagcaaagaaugaauguauuugcugau

SEQ ID NO: 285783 - RNA, 61 nt, Homo Sapiens
cucaauaguacaugaaaucaagaugcuuaugagcauggaaauguauuuaaaguuuuugcuu

SEQ ID NO: 285784 - RNA, 61 nt, Homo Sapiens
uacgugugaguauaaaagacaaaaguugaacagcauggaaucucauugccaaauuauuagu

SEQ ID NO: 285785 - RNA, 61 nt, Homo Sapiens
gcuuucagguaugugugucuaucauugaaagagcauggacucaaacaucagcccugaguuc

SEQ ID NO: 285786 - RNA, 61 nt, Homo Sapiens
uacccccacccaggaaaaccugcauugugcuagcauggaagaaucaugggcuuuggaauua

SEQ ID NO: 285787 - RNA, 61 nt, Homo Sapiens
uccuuuaaaaaggugcacuaugcugcugugcagcauggaaugccccgaggagcccgaaguc

SEQ ID NO: 285788 - RNA, 61 nt, Homo Sapiens
gaggccugugcuagaagcucagaaaggaggcagcauggagaagcuuauaaaaauaaaggga

SEQ ID NO: 285789 - RNA, 61 nt, Homo Sapiens
auguuguacuucacuccucucugcucugggaagcauggaggaggcauacagaagguuuguc

SEQ ID NO: 285790 - RNA, 61 nt, Homo Sapiens
ugagcucaguaggaaacuaaucugaaaucaaagcauggauaucuucuagcaccagauaaac

SEQ ID NO: 285791 - RNA, 61 nt, Homo Sapiens
caaaggcagcaaggcagugagcuaugagcccagcauggaugugucucaggcaccucauccc

SEQ ID NO: 285792 - RNA, 61 nt, Homo Sapiens
ucacacacaccaaaccagacagaggcagggcagcauggagacagguagacagaccuccagg

SEQ ID NO: 285793 - RNA, 61 nt, Homo Sapiens
aguauccuugacugcuuaagucagccaguucagcauggauaccaacauuagcuuuucuucu

SEQ ID NO: 285794 - RNA, 61 nt, Homo Sapiens
aaguuaggaggcaacuuugggauggugcuagagcauggaaagcacagagaauuggacaaac

SEQ ID NO: 285795 - RNA, 61 nt, Homo Sapiens
uucucaagggacacaguggccugcaugggccagcauggacccugggcugaucaugugcauu

SEQ ID NO: 285796 - RNA, 61 nt, Homo Sapiens
ucucuggggacacagugggcccacaugggccagcauggacccugggcuagagcaagcacau

SEQ ID NO: 285797 - RNA, 61 nt, Homo Sapiens
acagauuagguuagauguucgcuagccaaccagcauggaaaacuuaaccuguuucuggcug

SEQ ID NO: 285798 - RNA, 61 nt, Homo Sapiens
auaacccagauaacuaaccccugauucagccagcauggauacuggucccaccucuggaaau

SEQ ID NO: 285799 - RNA, 64 nt, Homo Sapiens; identical to SEQ ID NO: 218191

SEQ ID NO: 285800 - RNA, 64 nt, Homo Sapiens; identical to SEQ ID NO: 218192

SEQ ID NO: 285801 - RNA, 64 nt, Homo Sapiens; identical to SEQ ID NO: 218193

SEQ ID NO: 285802 - RNA, 64 nt, Homo Sapiens; identical to SEQ ID NO: 218194

SEQ ID NO: 285803 - RNA, 64 nt, Homo Sapiens; identical to SEQ ID NO: 218195

SEQ ID NO: 285804 - RNA, 64 nt, Homo Sapiens; identical to SEQ ID NO: 218196

SEQ ID NO: 285805 - RNA, 64 nt, Homo Sapiens; identical to SEQ ID NO: 218197

SEQ ID NO: 285806 - RNA, 64 nt, Homo Sapiens; identical to SEQ ID NO: 218198

SEQ ID NO: 285807 - RNA, 64 nt, Homo Sapiens; identical to SEQ ID NO: 218199

SEQ ID NO: 285808 - RNA, 64 nt, Homo Sapiens; identical to SEQ ID NO: 218200

SEQ ID NO: 285809 - RNA, 64 nt, Homo Sapiens; identical to SEQ ID NO: 218201

SEQ ID NO: 285810 - RNA, 64 nt, Homo Sapiens; identical to SEQ ID NO: 218202

SEQ ID NO: 285811 - RNA, 64 nt, Homo Sapiens; identical to SEQ ID NO: 218203

SEQ ID NO: 285812 - RNA, 64 nt, Homo Sapiens; identical to SEQ ID NO: 218204

SEQ ID NO: 285813 - RNA, 64 nt, Homo Sapiens; identical to SEQ ID NO: 218205

SEQ ID NO: 285814 - RNA, 64 nt, Homo Sapiens; identical to SEQ ID NO: 218206

SEQ ID NO: 285815 - RNA, 64 nt, Homo Sapiens; identical to SEQ ID NO: 218207

SEQ ID NO: 285816 - RNA, 64 nt, Homo Sapiens; identical to SEQ ID NO: 218208

SEQ ID NO: 285817 - RNA, 64 nt, Homo Sapiens; identical to SEQ ID NO: 218209

SEQ ID NO: 285818 - RNA, 64 nt, Homo Sapiens; identical to SEQ ID NO: 218210

SEQ ID NO: 285819 - RNA, 64 nt, Homo Sapiens; identical to SEQ ID NO: 218211

SEQ ID NO: 285820 - RNA, 64 nt, Homo Sapiens; identical to SEQ ID NO: 218212

SEQ ID NO: 285821 - RNA, 64 nt, Homo Sapiens; identical to SEQ ID NO: 218213

SEQ ID NO: 285822 - RNA, 64 nt, Homo Sapiens; identical to SEQ ID NO: 218214

SEQ ID NO: 285823 - RNA, 64 nt, Homo Sapiens; identical to SEQ ID NO: 218215

SEQ ID NO: 285824 - RNA, 64 nt, Homo Sapiens; identical to SEQ ID NO: 218216

SEQ ID NO: 285825 - RNA, 64 nt, Homo Sapiens; identical to SEQ ID NO: 218217

SEQ ID NO: 285826 - RNA, 64 nt, Homo Sapiens; identical to SEQ ID NO: 218218

SEQ ID NO: 285827 - RNA, 64 nt, Homo Sapiens; identical to SEQ ID NO: 218219

SEQ ID NO: 285828 - RNA, 64 nt, Homo Sapiens; identical to SEQ ID NO: 218220

SEQ ID NO: 285829 - RNA, 64 nt, Homo Sapiens; identical to SEQ ID NO: 218221

SEQ ID NO: 285830 - RNA, 64 nt, Homo Sapiens; identical to SEQ ID NO: 218222

SEQ ID NO: 285831 - RNA, 64 nt, Homo Sapiens; identical to SEQ ID NO: 218223

SEQ ID NO: 285832 - RNA, 64 nt, Homo Sapiens; identical to SEQ ID NO: 218224

SEQ ID NO: 285833 - RNA, 64 nt, Homo Sapiens; identical to SEQ ID NO: 218225

SEQ ID NO: 285834 - RNA, 64 nt, Homo Sapiens; identical to SEQ ID NO: 218226

SEQ ID NO: 285835 - RNA, 64 nt, Homo Sapiens; identical to SEQ ID NO: 218227

SEQ ID NO: 285836 - RNA, 64 nt, Homo Sapiens; identical to SEQ ID NO: 218228

SEQ ID NO: 285837 - RNA, 64 nt, Homo Sapiens; identical to SEQ ID NO: 218229

SEQ ID NO: 285838 - RNA, 64 nt, Homo Sapiens; identical to SEQ ID NO: 218230

SEQ ID NO: 285839 - RNA, 64 nt, Homo Sapiens; identical to SEQ ID NO: 218231

SEQ ID NO: 285840 - RNA, 64 nt, Homo Sapiens; identical to SEQ ID NO: 218232

SEQ ID NO: 285841 - RNA, 64 nt, Homo Sapiens; identical to SEQ ID NO: 218233

SEQ ID NO: 285842 - RNA, 64 nt, Homo Sapiens; identical to SEQ ID NO: 218234

SEQ ID NO: 285843 - RNA, 64 nt, Homo Sapiens; identical to SEQ ID NO: 218235

SEQ ID NO: 285844 - RNA, 64 nt, Homo Sapiens; identical to SEQ ID NO: 218236

SEQ ID NO: 285845 - RNA, 64 nt, Homo Sapiens; identical to SEQ ID NO: 218237

SEQ ID NO: 285846 - RNA, 64 nt, Homo Sapiens; identical to SEQ ID NO: 218238

SEQ ID NO: 285847 - RNA, 64 nt, Homo Sapiens; identical to SEQ ID NO: 218239

SEQ ID NO: 285848 - RNA, 64 nt, Homo Sapiens; identical to SEQ ID NO: 218240

SEQ ID NO: 285849 - RNA, 64 nt, Homo Sapiens; identical to SEQ ID NO: 218241

SEQ ID NO: 285850 - RNA, 64 nt, Homo Sapiens; identical to SEQ ID NO: 218242

SEQ ID NO: 285851 - RNA, 64 nt, Homo Sapiens; identical to SEQ ID NO: 218243

SEQ ID NO: 285852 - RNA, 64 nt, Homo Sapiens; identical to SEQ ID NO: 218244

SEQ ID NO: 285853 - RNA, 64 nt, Homo Sapiens; identical to SEQ ID NO: 218245

SEQ ID NO: 285854 - RNA, 64 nt, Homo Sapiens; identical to SEQ ID NO: 218246

SEQ ID NO: 285855 - RNA, 64 nt, Homo Sapiens; identical to SEQ ID NO: 218247

SEQ ID NO: 285856 - RNA, 64 nt, Homo Sapiens; identical to SEQ ID NO: 218248

SEQ ID NO: 285857 - RNA, 64 nt, Homo Sapiens; identical to SEQ ID NO: 218249

SEQ ID NO: 285858 - RNA, 64 nt, Homo Sapiens; identical to SEQ ID NO: 218250

SEQ ID NO: 285859 - RNA, 64 nt, Homo Sapiens; identical to SEQ ID NO: 218251

SEQ ID NO: 285860 - RNA, 64 nt, Homo Sapiens; identical to SEQ ID NO: 218252

SEQ ID NO: 285861 - RNA, 64 nt, Homo Sapiens; identical to SEQ ID NO: 218253

SEQ ID NO: 285862 - RNA, 64 nt, Homo Sapiens; identical to SEQ ID NO: 218254

SEQ ID NO: 285863 - RNA, 64 nt, Homo Sapiens; identical to SEQ ID NO: 218255

SEQ ID NO: 285864 - RNA, 64 nt, Homo Sapiens; identical to SEQ ID NO: 218256

SEQ ID NO: 285865 - RNA, 64 nt, Homo Sapiens; identical to SEQ ID NO: 218257

SEQ ID NO: 285866 - RNA, 64 nt, Homo Sapiens; identical to SEQ ID NO: 218258

SEQ ID NO: 285867 - RNA, 64 nt, Homo Sapiens; identical to SEQ ID NO: 218259

SEQ ID NO: 285868 - RNA, 64 nt, Homo Sapiens; identical to SEQ ID NO: 218260

SEQ ID NO: 285869 - RNA, 64 nt, Homo Sapiens; identical to SEQ ID NO: 218261

SEQ ID NO: 285870 - RNA, 64 nt, Homo Sapiens; identical to SEQ ID NO: 218262

SEQ ID NO: 285871 - RNA, 64 nt, Homo Sapiens; identical to SEQ ID NO: 218263

SEQ ID NO: 285872 - RNA, 64 nt, Homo Sapiens; identical to SEQ ID NO: 218264

SEQ ID NO: 285873 - RNA, 64 nt, Homo Sapiens; identical to SEQ ID NO: 218265

SEQ ID NO: 285874 - RNA, 64 nt, Homo Sapiens; identical to SEQ ID NO: 218266

SEQ ID NO: 285875 - RNA, 64 nt, Homo Sapiens; identical to SEQ ID NO: 218267

SEQ ID NO: 285876 - RNA, 64 nt, Homo Sapiens; identical to SEQ ID NO: 218268

SEQ ID NO: 285877 - RNA, 64 nt, Homo Sapiens; identical to SEQ ID NO: 218269

SEQ ID NO: 285878 - RNA, 64 nt, Homo Sapiens; identical to SEQ ID NO: 218270

SEQ ID NO: 285879 - RNA, 64 nt, Homo Sapiens; identical to SEQ ID NO: 218271

SEQ ID NO: 285880 - RNA, 64 nt, Homo Sapiens; identical to SEQ ID NO: 218272

SEQ ID NO: 285881 - RNA, 64 nt, Homo Sapiens; identical to SEQ ID NO: 218273

SEQ ID NO: 285882 - RNA, 64 nt, Homo Sapiens; identical to SEQ ID NO: 218274

SEQ ID NO: 285883 - RNA, 64 nt, Homo Sapiens; identical to SEQ ID NO: 218275

SEQ ID NO: 285884 - RNA, 64 nt, Homo Sapiens; identical to SEQ ID NO: 218276

SEQ ID NO: 285885 - RNA, 64 nt, Homo Sapiens; identical to SEQ ID NO: 218277

SEQ ID NO: 285886 - RNA, 64 nt, Homo Sapiens; identical to SEQ ID NO: 218278

SEQ ID NO: 285887 - RNA, 64 nt, Homo Sapiens; identical to SEQ ID NO: 218279

SEQ ID NO: 285888 - RNA, 64 nt, Homo Sapiens; identical to SEQ ID NO: 218280

SEQ ID NO: 285889 - RNA, 64 nt, Homo Sapiens; identical to SEQ ID NO: 218281

SEQ ID NO: 285890 - RNA, 64 nt, Homo Sapiens; identical to SEQ ID NO: 218282

SEQ ID NO: 285891 - RNA, 64 nt, Homo Sapiens; identical to SEQ ID NO: 218283

SEQ ID NO: 285892 - RNA, 64 nt, Homo Sapiens; identical to SEQ ID NO: 218284

SEQ ID NO: 285893 - RNA, 64 nt, Homo Sapiens; identical to SEQ ID NO: 218285

SEQ ID NO: 285894 - RNA, 64 nt, Homo Sapiens; identical to SEQ ID NO: 218286

SEQ ID NO: 285895 - RNA, 64 nt, Homo Sapiens; identical to SEQ ID NO: 218287

SEQ ID NO: 285896 - RNA, 64 nt, Homo Sapiens; identical to SEQ ID NO: 218288

SEQ ID NO: 285897 - RNA, 64 nt, Homo Sapiens; identical to SEQ ID NO: 218289

SEQ ID NO: 285898 - RNA, 64 nt, Homo Sapiens; identical to SEQ ID NO: 218290

SEQ ID NO: 285899 - RNA, 64 nt, Homo Sapiens; identical to SEQ ID NO: 218291

SEQ ID NO: 285900 - RNA, 64 nt, Homo Sapiens; identical to SEQ ID NO: 218292

SEQ ID NO: 285901 - RNA, 64 nt, Homo Sapiens; identical to SEQ ID NO: 218293

SEQ ID NO: 285902 - RNA, 64 nt, Homo Sapiens; identical to SEQ ID NO: 218294

SEQ ID NO: 285903 - RNA, 64 nt, Homo Sapiens; identical to SEQ ID NO: 218295

SEQ ID NO: 285904 - RNA, 64 nt, Homo Sapiens; identical to SEQ ID NO: 218296

SEQ ID NO: 285905 - RNA, 64 nt, Homo Sapiens; identical to SEQ ID NO: 218297

SEQ ID NO: 285906 - RNA, 64 nt, Homo Sapiens; identical to SEQ ID NO: 218298

SEQ ID NO: 285907 - RNA, 64 nt, Homo Sapiens; identical to SEQ ID NO: 218299

SEQ ID NO: 285908 - RNA, 64 nt, Homo Sapiens; identical to SEQ ID NO: 218300

SEQ ID NO: 285909 - RNA, 64 nt, Homo Sapiens; identical to SEQ ID NO: 218301

SEQ ID NO: 285910 - RNA, 64 nt, Homo Sapiens; identical to SEQ ID NO: 218302

SEQ ID NO: 285911 - RNA, 64 nt, Homo Sapiens; identical to SEQ ID NO: 218303

SEQ ID NO: 285912 - RNA, 64 nt, Homo Sapiens; identical to SEQ ID NO: 218304

SEQ ID NO: 285913 - RNA, 64 nt, Homo Sapiens; identical to SEQ ID NO: 218305

SEQ ID NO: 285914 - RNA, 64 nt, Homo Sapiens; identical to SEQ ID NO: 218306

SEQ ID NO: 285915 - RNA, 64 nt, Homo Sapiens; identical to SEQ ID NO: 218307

SEQ ID NO: 285916 - RNA, 64 nt, Homo Sapiens; identical to SEQ ID NO: 218308

SEQ ID NO: 285917 - RNA, 64 nt, Homo Sapiens; identical to SEQ ID NO: 218309

SEQ ID NO: 285918 - RNA, 64 nt, Homo Sapiens; identical to SEQ ID NO: 218310

SEQ ID NO: 285919 - RNA, 64 nt, Homo Sapiens; identical to SEQ ID NO: 218311

SEQ ID NO: 285920 - RNA, 64 nt, Homo Sapiens; identical to SEQ ID NO: 218312

SEQ ID NO: 285921 - RNA, 64 nt, Homo Sapiens; identical to SEQ ID NO: 218313

SEQ ID NO: 285922 - RNA, 64 nt, Homo Sapiens; identical to SEQ ID NO: 218314

SEQ ID NO: 285923 - RNA, 64 nt, Homo Sapiens; identical to SEQ ID NO: 218315

SEQ ID NO: 285924 - RNA, 64 nt, Homo Sapiens; identical to SEQ ID NO: 218316

SEQ ID NO: 285925 - RNA, 64 nt, Homo Sapiens; identical to SEQ ID NO: 218317

SEQ ID NO: 285926 - RNA, 64 nt, Homo Sapiens; identical to SEQ ID NO: 218318

SEQ ID NO: 285927 - RNA, 64 nt, Homo Sapiens; identical to SEQ ID NO: 218319

SEQ ID NO: 285928 - RNA, 64 nt, Homo Sapiens; identical to SEQ ID NO: 218320

SEQ ID NO: 285929 - RNA, 64 nt, Homo Sapiens; identical to SEQ ID NO: 218321

SEQ ID NO: 285930 - RNA, 64 nt, Homo Sapiens; identical to SEQ ID NO: 218322

SEQ ID NO: 285931 - RNA, 64 nt, Homo Sapiens; identical to SEQ ID NO: 218323

SEQ ID NO: 285932 - RNA, 64 nt, Homo Sapiens; identical to SEQ ID NO: 218324

SEQ ID NO: 285933 - RNA, 64 nt, Homo Sapiens; identical to SEQ ID NO: 218325

SEQ ID NO: 285934 - RNA, 64 nt, Homo Sapiens; identical to SEQ ID NO: 218326

SEQ ID NO: 285935 - RNA, 64 nt, Homo Sapiens; identical to SEQ ID NO: 218327

SEQ ID NO: 285936 - RNA, 64 nt, Homo Sapiens; identical to SEQ ID NO: 218328

SEQ ID NO: 285937 - RNA, 64 nt, Homo Sapiens; identical to SEQ ID NO: 218329

SEQ ID NO: 285938 - RNA, 64 nt, Homo Sapiens; identical to SEQ ID NO: 218330

SEQ ID NO: 285939 - RNA, 64 nt, Homo Sapiens; identical to SEQ ID NO: 218331

SEQ ID NO: 285940 - RNA, 64 nt, Homo Sapiens; identical to SEQ ID NO: 218332

SEQ ID NO: 285941 - RNA, 64 nt, Homo Sapiens; identical to SEQ ID NO: 218333

SEQ ID NO: 285942 - RNA, 64 nt, Homo Sapiens; identical to SEQ ID NO: 218334

SEQ ID NO: 285943 - RNA, 64 nt, Homo Sapiens; identical to SEQ ID NO: 218335

SEQ ID NO: 285944 - RNA, 64 nt, Homo Sapiens; identical to SEQ ID NO: 218336

SEQ ID NO: 285945 - RNA, 64 nt, Homo Sapiens; identical to SEQ ID NO: 218337

SEQ ID NO: 285946 - RNA, 64 nt, Homo Sapiens; identical to SEQ ID NO: 218338

SEQ ID NO: 285947 - RNA, 64 nt, Homo Sapiens; identical to SEQ ID NO: 218339

SEQ ID NO: 285948 - RNA, 64 nt, Homo Sapiens; identical to SEQ ID NO: 218340

SEQ ID NO: 285949 - RNA, 64 nt, Homo Sapiens; identical to SEQ ID NO: 218341

SEQ ID NO: 285950 - RNA, 64 nt, Homo Sapiens; identical to SEQ ID NO: 218342

SEQ ID NO: 285951 - RNA, 64 nt, Homo Sapiens; identical to SEQ ID NO: 218343

SEQ ID NO: 285952 - RNA, 64 nt, Homo Sapiens; identical to SEQ ID NO: 218344

SEQ ID NO: 285953 - RNA, 64 nt, Homo Sapiens; identical to SEQ ID NO: 125759

SEQ ID NO: 285954 - RNA, 64 nt, Homo Sapiens; identical to SEQ ID NO: 125760

SEQ ID NO: 285955 - RNA, 64 nt, Homo Sapiens
cuguccaucuuuaagaccuucauccauggaaucuacuauacaggaggaugcagugggcuggagg

SEQ ID NO: 285956 - RNA, 64 nt, Homo Sapiens
uucuugccucccucccuucuaaacauguguaauaacuauacagagacugcuacaaaauuguaua

SEQ ID NO: 285957 - RNA, 64 nt, Homo Sapiens
ugaaagaaacauguugggaucguggauuuaagaaacuauacacuguuucucauaaucucuugaa

SEQ ID NO: 285958 - RNA, 64 nt, Homo Sapiens
guaaacauggagacuuaaacauaaagaaauaggcacuauacaauggggacauaaaaaaagaaaa

SEQ ID NO: 285959 - RNA, 64 nt, Homo Sapiens
uuuucagugguugccgauuuccauuugaugaagaacuauacagcuuaaaaaaauacguuaguua

SEQ ID NO: 285960 - RNA, 64 nt, Homo Sapiens
agugaaaugggacagugccuugcagucuuugcccacuauacauaggcuaaggcuaagcucuuug

SEQ ID NO: 285961 - RNA, 64 nt, Homo Sapiens; identical to SEQ ID NO: 264323

SEQ ID NO: 285962 - RNA, 64 nt, Homo Sapiens; identical to SEQ ID NO: 264324

SEQ ID NO: 285963 - RNA, 64 nt, Homo Sapiens; identical to SEQ ID NO: 264325

SEQ ID NO: 285964 - RNA, 64 nt, Homo Sapiens; identical to SEQ ID NO: 264326

SEQ ID NO: 285965 - RNA, 64 nt, Homo Sapiens; identical to SEQ ID NO: 264327

SEQ ID NO: 285966 - RNA, 64 nt, Homo Sapiens; identical to SEQ ID NO: 264328

SEQ ID NO: 285967 - RNA, 64 nt, Homo Sapiens; identical to SEQ ID NO: 264329

SEQ ID NO: 285968 - RNA, 64 nt, Homo Sapiens; identical to SEQ ID NO: 264330

SEQ ID NO: 285969 - RNA, 64 nt, Homo Sapiens; identical to SEQ ID NO: 264331

SEQ ID NO: 285970 - RNA, 64 nt, Homo Sapiens; identical to SEQ ID NO: 264332

SEQ ID NO: 285971 - RNA, 64 nt, Homo Sapiens; identical to SEQ ID NO: 264333

SEQ ID NO: 285972 - RNA, 64 nt, Homo Sapiens; identical to SEQ ID NO: 264334

SEQ ID NO: 285973 - RNA, 64 nt, Homo Sapiens; identical to SEQ ID NO: 264335

SEQ ID NO: 285974 - RNA, 64 nt, Homo Sapiens; identical to SEQ ID NO: 264336

SEQ ID NO: 285975 - RNA, 64 nt, Homo Sapiens; identical to SEQ ID NO: 264337

SEQ ID NO: 285976 - RNA, 64 nt, Homo Sapiens; identical to SEQ ID NO: 264338

SEQ ID NO: 285977 - RNA, 64 nt, Homo Sapiens; identical to SEQ ID NO: 264339

SEQ ID NO: 285978 - RNA, 64 nt, Homo Sapiens; identical to SEQ ID NO: 264340

SEQ ID NO: 285979 - RNA, 64 nt, Homo Sapiens; identical to SEQ ID NO: 264341

SEQ ID NO: 285980 - RNA, 64 nt, Homo Sapiens; identical to SEQ ID NO: 264342

SEQ ID NO: 285981 - RNA, 64 nt, Homo Sapiens; identical to SEQ ID NO: 264343

SEQ ID NO: 285982 - RNA, 64 nt, Homo Sapiens; identical to SEQ ID NO: 264344

SEQ ID NO: 285983 - RNA, 64 nt, Homo Sapiens; identical to SEQ ID NO: 264345

SEQ ID NO: 285984 - RNA, 64 nt, Homo Sapiens; identical to SEQ ID NO: 264346

SEQ ID NO: 285985 - RNA, 64 nt, Homo Sapiens; identical to SEQ ID NO: 264347

SEQ ID NO: 285986 - RNA, 64 nt, Homo Sapiens; identical to SEQ ID NO: 264348

SEQ ID NO: 285987 - RNA, 64 nt, Homo Sapiens; identical to SEQ ID NO: 264349

SEQ ID NO: 285988 - RNA, 64 nt, Homo Sapiens; identical to SEQ ID NO: 264350

SEQ ID NO: 285989 - RNA, 64 nt, Homo Sapiens; identical to SEQ ID NO: 264351

SEQ ID NO: 285990 - RNA, 64 nt, Homo Sapiens; identical to SEQ ID NO: 264352

SEQ ID NO: 285991 - RNA, 64 nt, Homo Sapiens; identical to SEQ ID NO: 264353

SEQ ID NO: 285992 - RNA, 64 nt, Homo Sapiens; identical to SEQ ID NO: 264354

SEQ ID NO: 285993 - RNA, 64 nt, Homo Sapiens; identical to SEQ ID NO: 264355

SEQ ID NO: 285994 - RNA, 64 nt, Homo Sapiens; identical to SEQ ID NO: 264356

SEQ ID NO: 285995 - RNA, 64 nt, Homo Sapiens; identical to SEQ ID NO: 264357

SEQ ID NO: 285996 - RNA, 64 nt, Homo Sapiens; identical to SEQ ID NO: 264358

SEQ ID NO: 285997 - RNA, 64 nt, Homo Sapiens; identical to SEQ ID NO: 264359

SEQ ID NO: 285998 - RNA, 64 nt, Homo Sapiens; identical to SEQ ID NO: 264360

SEQ ID NO: 285999 - RNA, 64 nt, Homo Sapiens; identical to SEQ ID NO: 264361

SEQ ID NO: 286000 - RNA, 64 nt, Homo Sapiens; identical to SEQ ID NO: 264362

SEQ ID NO: 286001 - RNA, 64 nt, Homo Sapiens; identical to SEQ ID NO: 264363

SEQ ID NO: 286002 - RNA, 64 nt, Homo Sapiens; identical to SEQ ID NO: 264364

SEQ ID NO: 286003 - RNA, 64 nt, Homo Sapiens
accugacuugaaaugccauuucuuuuaaccuuccaaauccuaaauguuuccuucaaggcaucuu

SEQ ID NO: 286004 - RNA, 64 nt, Homo Sapiens
uaauagguaaagucuaauauuaguucccuuaacaaaauccuaacuguauaccagaauuagguca

SEQ ID NO: 286005 - RNA, 64 nt, Homo Sapiens
uuuacaaaauauagcagaugcaagauuaugggggaaauccuauauucagaguacucuauaaauu

SEQ ID NO: 286006 - RNA, 64 nt, Homo Sapiens
accagagaacuacuaaaaaaaccaacugcuuuuuaaauccuauuguguaguuaaagugucaugc

SEQ ID NO: 286007 - RNA, 64 nt, Homo Sapiens
gugcucuaugagauuguacugguauugaucagugaaauccuagggguacuuuuaggugccauua

SEQ ID NO: 286008 - RNA, 64 nt, Homo Sapiens
aaacuguuaaacccaccuucaaaaugacacuuauaaauccuaaugguuuaaaucgacuguuuuu

SEQ ID NO: 286009 - RNA, 64 nt, Homo Sapiens
gaaaacaauuccacgaggccaaucuaaagggaaaaaauccuacacuacuuuuacuacuuuugau

SEQ ID NO: 286010 - RNA, 64 nt, Homo Sapiens
gacuuucuacgaacagguaccuugcugucuugacaaauccuaaugucacgccuacagccccaac

SEQ ID NO: 286011 - RNA, 64 nt, Homo Sapiens
ccugccaaauuuugauccuuccccucuuuuggccaaauccuagggggaagaaauccuaguaugc

SEQ ID NO: 286012 - RNA, 64 nt, Homo Sapiens
ccuuccccucuuuuggccaaauccuagggggaagaaauccuaguaugccaaaaauauaugcuaa

SEQ ID NO: 286013 - RNA, 64 nt, Homo Sapiens
ugauuguuguggucaaugaauuuguuuucauuuuaaauccuagcauucuaaagacugcuaaggu

SEQ ID NO: 286014 - RNA, 64 nt, Homo Sapiens
cuuccauguacauuacauggaaaacuucagggugaaauccuaugaaucucuuugucaaauuacg

SEQ ID NO: 286015 - RNA, 64 nt, Homo Sapiens
ccuuacuaaacauaagagaauucauaccauagagaaauccuacaaauaugaagaaugugacaaa

SEQ ID NO: 286016 - RNA, 64 nt, Homo Sapiens
cuuuucuaaucauaaaagaaaucauauuggugagaaauccuagaaauguggagaauguaacaaa

SEQ ID NO: 286017 - RNA, 64 nt, Homo Sapiens
caaauuuaauuugaauucaauucaguccauuaaaaaauccuaacaauaggaaaaacaguauguu

SEQ ID NO: 286018 - RNA, 64 nt, Homo Sapiens
uauuucuuguguguucuuuuccauauccuaacugaaauccuauauaagcaucaucuccauuuca

SEQ ID NO: 286019 - RNA, 64 nt, Homo Sapiens
aacauuuguacacacaggcuacuguuacaaauaaaaauccuauguuuuguucccgguuuuucuu

SEQ ID NO: 286020 - RNA, 64 nt, Homo Sapiens
aauguggcagacuauaaaaguuguauacugagaaaaauccuauguaggacauuaugucuaaaaa

SEQ ID NO: 286021 - RNA, 64 nt, Homo Sapiens
gauacuuuccugaauguguucuugguguuugugaaaauccuauaagauuuaaagaaauauauau

SEQ ID NO: 286022 - RNA, 64 nt, Homo Sapiens
cauuucauaguuucaaaucuguaaucagcaauaaaaauccuaaaauauguaccuaagaacaucu

SEQ ID NO: 286023 - RNA, 64 nt, Homo Sapiens
aaucaauauaauuuauuuauuuuuuucagcuguuaaauccuaaauccaguggaagcagaaaggg

SEQ ID NO: 286024 - RNA, 64 nt, Homo Sapiens
uaaugacauccuuguagcauuccaguaauugaacaaauccuauuaacugaucauagaagaagaa

SEQ ID NO: 286025 - RNA, 64 nt, Homo Sapiens; identical to SEQ ID NO: 114439

SEQ ID NO: 286026 - RNA, 64 nt, Homo Sapiens; identical to SEQ ID NO: 114440

SEQ ID NO: 286027 - RNA, 64 nt, Homo Sapiens; identical to SEQ ID NO: 114441

SEQ ID NO: 286028 - RNA, 64 nt, Homo Sapiens; identical to SEQ ID NO: 114442

SEQ ID NO: 286029 - RNA, 64 nt, Homo Sapiens; identical to SEQ ID NO: 114443

SEQ ID NO: 286030 - RNA, 64 nt, Homo Sapiens; identical to SEQ ID NO: 114444

SEQ ID NO: 286031 - RNA, 64 nt, Homo Sapiens; identical to SEQ ID NO: 114445

SEQ ID NO: 286032 - RNA, 64 nt, Homo Sapiens; identical to SEQ ID NO: 114446

SEQ ID NO: 286033 - RNA, 64 nt, Homo Sapiens; identical to SEQ ID NO: 114447

SEQ ID NO: 286034 - RNA, 64 nt, Homo Sapiens; identical to SEQ ID NO: 114448

SEQ ID NO: 286035 - RNA, 64 nt, Homo Sapiens; identical to SEQ ID NO: 114449

SEQ ID NO: 286036 - RNA, 64 nt, Homo Sapiens; identical to SEQ ID NO: 114450

SEQ ID NO: 286037 - RNA, 64 nt, Homo Sapiens; identical to SEQ ID NO: 114451

SEQ ID NO: 286038 - RNA, 64 nt, Homo Sapiens; identical to SEQ ID NO: 114452

SEQ ID NO: 286039 - RNA, 64 nt, Homo Sapiens; identical to SEQ ID NO: 114453

SEQ ID NO: 286040 - RNA, 64 nt, Homo Sapiens; identical to SEQ ID NO: 114454

SEQ ID NO: 286041 - RNA, 64 nt, Homo Sapiens; identical to SEQ ID NO: 114455

SEQ ID NO: 286042 - RNA, 64 nt, Homo Sapiens; identical to SEQ ID NO: 114456

SEQ ID NO: 286043 - RNA, 64 nt, Homo Sapiens; identical to SEQ ID NO: 114457

SEQ ID NO: 286044 - RNA, 64 nt, Homo Sapiens; identical to SEQ ID NO: 114458

SEQ ID NO: 286045 - RNA, 64 nt, Homo Sapiens; identical to SEQ ID NO: 114459

SEQ ID NO: 286046 - RNA, 64 nt, Homo Sapiens; identical to SEQ ID NO: 114460

SEQ ID NO: 286047 - RNA, 64 nt, Homo Sapiens; identical to SEQ ID NO: 114461

SEQ ID NO: 286048 - RNA, 64 nt, Homo Sapiens; identical to SEQ ID NO: 114462

SEQ ID NO: 286049 - RNA, 64 nt, Homo Sapiens; identical to SEQ ID NO: 114463

SEQ ID NO: 286050 - RNA, 64 nt, Homo Sapiens; identical to SEQ ID NO: 114464

SEQ ID NO: 286051 - RNA, 64 nt, Homo Sapiens; identical to SEQ ID NO: 114465

SEQ ID NO: 286052 - RNA, 64 nt, Homo Sapiens; identical to SEQ ID NO: 114466

SEQ ID NO: 286053 - RNA, 64 nt, Homo Sapiens; identical to SEQ ID NO: 114467

SEQ ID NO: 286054 - RNA, 64 nt, Homo Sapiens; identical to SEQ ID NO: 114468

SEQ ID NO: 286055 - RNA, 64 nt, Homo Sapiens; identical to SEQ ID NO: 114469

SEQ ID NO: 286056 - RNA, 64 nt, Homo Sapiens; identical to SEQ ID NO: 114470

SEQ ID NO: 286057 - RNA, 64 nt, Homo Sapiens; identical to SEQ ID NO: 114471

SEQ ID NO: 286058 - RNA, 64 nt, Homo Sapiens; identical to SEQ ID NO: 114472

SEQ ID NO: 286059 - RNA, 64 nt, Homo Sapiens; identical to SEQ ID NO: 114473

SEQ ID NO: 286060 - RNA, 64 nt, Homo Sapiens; identical to SEQ ID NO: 114474

SEQ ID NO: 286061 - RNA, 64 nt, Homo Sapiens; identical to SEQ ID NO: 114475

SEQ ID NO: 286062 - RNA, 64 nt, Homo Sapiens; identical to SEQ ID NO: 114476

SEQ ID NO: 286063 - RNA, 64 nt, Homo Sapiens; identical to SEQ ID NO: 114477

SEQ ID NO: 286064 - RNA, 64 nt, Homo Sapiens; identical to SEQ ID NO: 114478

SEQ ID NO: 286065 - RNA, 64 nt, Homo Sapiens; identical to SEQ ID NO: 114479

SEQ ID NO: 286066 - RNA, 64 nt, Homo Sapiens; identical to SEQ ID NO: 114480

SEQ ID NO: 286067 - RNA, 64 nt, Homo Sapiens; identical to SEQ ID NO: 114481

SEQ ID NO: 286068 - RNA, 64 nt, Homo Sapiens; identical to SEQ ID NO: 114482

SEQ ID NO: 286069 - RNA, 64 nt, Homo Sapiens; identical to SEQ ID NO: 114483

SEQ ID NO: 286070 - RNA, 64 nt, Homo Sapiens; identical to SEQ ID NO: 114484

SEQ ID NO: 286071 - RNA, 64 nt, Homo Sapiens; identical to SEQ ID NO: 114485

SEQ ID NO: 286072 - RNA, 64 nt, Homo Sapiens; identical to SEQ ID NO: 114486

SEQ ID NO: 286073 - RNA, 64 nt, Homo Sapiens; identical to SEQ ID NO: 114487

SEQ ID NO: 286074 - RNA, 64 nt, Homo Sapiens; identical to SEQ ID NO: 114488

SEQ ID NO: 286075 - RNA, 64 nt, Homo Sapiens; identical to SEQ ID NO: 114489

SEQ ID NO: 286076 - RNA, 64 nt, Homo Sapiens; identical to SEQ ID NO: 114490

SEQ ID NO: 286077 - RNA, 64 nt, Homo Sapiens; identical to SEQ ID NO: 114491

SEQ ID NO: 286078 - RNA, 64 nt, Homo Sapiens; identical to SEQ ID NO: 114492

SEQ ID NO: 286079 - RNA, 64 nt, Homo Sapiens; identical to SEQ ID NO: 114493

SEQ ID NO: 286080 - RNA, 64 nt, Homo Sapiens; identical to SEQ ID NO: 114494

SEQ ID NO: 286081 - RNA, 64 nt, Homo Sapiens; identical to SEQ ID NO: 114495

SEQ ID NO: 286082 - RNA, 64 nt, Homo Sapiens; identical to SEQ ID NO: 114496

SEQ ID NO: 286083 - RNA, 64 nt, Homo Sapiens; identical to SEQ ID NO: 114497

SEQ ID NO: 286084 - RNA, 64 nt, Homo Sapiens; identical to SEQ ID NO: 114498

SEQ ID NO: 286085 - RNA, 64 nt, Homo Sapiens; identical to SEQ ID NO: 114499

SEQ ID NO: 286086 - RNA, 64 nt, Homo Sapiens; identical to SEQ ID NO: 114500

SEQ ID NO: 286087 - RNA, 64 nt, Homo Sapiens; identical to SEQ ID NO: 114501

SEQ ID NO: 286088 - RNA, 64 nt, Homo Sapiens; identical to SEQ ID NO: 114502

SEQ ID NO: 286089 - RNA, 64 nt, Homo Sapiens; identical to SEQ ID NO: 114503

SEQ ID NO: 286090 - RNA, 64 nt, Homo Sapiens; identical to SEQ ID NO: 114504

SEQ ID NO: 286091 - RNA, 64 nt, Homo Sapiens; identical to SEQ ID NO: 114505

SEQ ID NO: 286092 - RNA, 64 nt, Homo Sapiens; identical to SEQ ID NO: 114506

SEQ ID NO: 286093 - RNA, 64 nt, Homo Sapiens; identical to SEQ ID NO: 114507

SEQ ID NO: 286094 - RNA, 64 nt, Homo Sapiens; identical to SEQ ID NO: 114508

SEQ ID NO: 286095 - RNA, 64 nt, Homo Sapiens; identical to SEQ ID NO: 114509

SEQ ID NO: 286096 - RNA, 64 nt, Homo Sapiens; identical to SEQ ID NO: 114510

SEQ ID NO: 286097 - RNA, 64 nt, Homo Sapiens; identical to SEQ ID NO: 114511

SEQ ID NO: 286098 - RNA, 64 nt, Homo Sapiens; identical to SEQ ID NO: 114512

SEQ ID NO: 286099 - RNA, 64 nt, Homo Sapiens; identical to SEQ ID NO: 114513

SEQ ID NO: 286100 - RNA, 64 nt, Homo Sapiens; identical to SEQ ID NO: 114514

SEQ ID NO: 286101 - RNA, 64 nt, Homo Sapiens; identical to SEQ ID NO: 114515

SEQ ID NO: 286102 - RNA, 64 nt, Homo Sapiens; identical to SEQ ID NO: 114516

SEQ ID NO: 286103 - RNA, 64 nt, Homo Sapiens
aauccaggugcuuuccagacgaaauccaggcuccucucccaagaccacagcccuccucucccaa

SEQ ID NO: 286104 - RNA, 64 nt, Homo Sapiens
aauccaggcuccucucccaauuccacagcccuccucucccaagagaagaagaacugauuggggc

SEQ ID NO: 286105 - RNA, 64 nt, Homo Sapiens
gaaucuuuuuaagauuaaaaaugaauaccuuaaaucucccaaaagagauaaccaguaucugaag

SEQ ID NO: 286106 - RNA, 64 nt, Homo Sapiens
gaacuccugaccgcaagugauccacacgccuuggucucccaaagugcugggauuacgguguuag

SEQ ID NO: 286107 - RNA, 64 nt, Homo Sapiens
gagaaacugcagccccacuucuguuucccuggagucucccaauggaucauucaggaguguccua

SEQ ID NO: 286108 - RNA, 64 nt, Homo Sapiens
aucugaaggggaagagggugaccucagcggcuuuucucccaaaaaucggcugaaggcugguugu

SEQ ID NO: 286109 - RNA, 64 nt, Homo Sapiens
cugcucccuuuuguuuugugacucacaaucaucuucucccaagaauguacuacccucagucuac

SEQ ID NO: 286110 - RNA, 64 nt, Homo Sapiens
agugcucuuuccaccccaaacuguccagcaggggucucccaacaucugccuuugugcucuguuc

SEQ ID NO: 286111 - RNA, 64 nt, Homo Sapiens
ugcagugggagagcuuugcugagaaauaccugauucucccaaucccuggcagccccccaugugg

SEQ ID NO: 286112 - RNA, 64 nt, Homo Sapiens
gaaaccaaaugcgccccuuccgcccgcucucuuuucucccaagcccucacugcgccagccuccc

SEQ ID NO: 286113 - RNA, 64 nt, Homo Sapiens
accuuagaguagggacacugagcucucccaagucucucccaaaugggugagacaguccacccag

SEQ ID NO: 286114 - RNA, 64 nt, Homo Sapiens
cucucccaaauaccuuagagaguccacccagagcucucccaagugcauuugaacagggugagac

SEQ ID NO: 286115 - RNA, 64 nt, Homo Sapiens
agccgaacguggaacaguaucacaaaagauuccaucucccaacgauuucagaacucugagcuca

SEQ ID NO: 286116 - RNA, 64 nt, Homo Sapiens
uaagagaagaaagauaaggaggcucccacccaccucucccaagagcagacauuaaacaucuuug

SEQ ID NO: 286117 - RNA, 64 nt, Homo Sapiens
cauauuuuugauaggaaaaauuagagccucuuuuucucccaacuuaaaggggaaagaaacuacu

SEQ ID NO: 286118 - RNA, 64 nt, Homo Sapiens
uuuaaaaacaaauuggaagaaggagaaaggggaaucucccaaaaguguguaugcuuccaggugg

SEQ ID NO: 286119 - RNA, 64 nt, Homo Sapiens
acagcaagacugucagccucgcugcagcucguuuucucccaauuugacucaaucugccaaaugu

SEQ ID NO: 286120 - RNA, 64 nt, Homo Sapiens
gaagcguuggcagcaaagggaacccucuccagccucucccaaaguccacuaggagauuuuuaua

SEQ ID NO: 286121 - RNA, 64 nt, Homo Sapiens
ggcugcccugggccauaugugcuauggagaggacucucccaaacccccaauagcuagugacagc

SEQ ID NO: 286122 - RNA, 64 nt, Homo Sapiens
uuccaaagcuuccccuuaucguccccugugauuaucucccaaccccgugacaaagguagagcaa

SEQ ID NO: 286123 - RNA, 64 nt, Homo Sapiens
aucacguuugucacugccguuuauuacauugacuucucccaagaugaaucuuccuuccaaaugu

SEQ ID NO: 286124 - RNA, 64 nt, Homo Sapiens
aacccugaagauaaucaaggccaguuacucaucaucucccaaccacuguuuccucaacugcccu

SEQ ID NO: 286125 - RNA, 64 nt, Homo Sapiens; identical to SEQ ID NO: 61562

SEQ ID NO: 286126 - RNA, 64 nt, Homo Sapiens; identical to SEQ ID NO: 61563

SEQ ID NO: 286127 - RNA, 64 nt, Homo Sapiens; identical to SEQ ID NO: 61564

SEQ ID NO: 286128 - RNA, 64 nt, Homo Sapiens; identical to SEQ ID NO: 61565

SEQ ID NO: 286129 - RNA, 64 nt, Homo Sapiens; identical to SEQ ID NO: 61566

SEQ ID NO: 286130 - RNA, 64 nt, Homo Sapiens; identical to SEQ ID NO: 61567

SEQ ID NO: 286131 - RNA, 64 nt, Homo Sapiens; identical to SEQ ID NO: 61568

SEQ ID NO: 286132 - RNA, 64 nt, Homo Sapiens; identical to SEQ ID NO: 61569

SEQ ID NO: 286133 - RNA, 64 nt, Homo Sapiens; identical to SEQ ID NO: 61570

SEQ ID NO: 286134 - RNA, 64 nt, Homo Sapiens; identical to SEQ ID NO: 61571

SEQ ID NO: 286135 - RNA, 64 nt, Homo Sapiens; identical to SEQ ID NO: 61572

SEQ ID NO: 286136 - RNA, 64 nt, Homo Sapiens; identical to SEQ ID NO: 61573

SEQ ID NO: 286137 - RNA, 64 nt, Homo Sapiens; identical to SEQ ID NO: 61574

SEQ ID NO: 286138 - RNA, 64 nt, Homo Sapiens; identical to SEQ ID NO: 61575

SEQ ID NO: 286139 - RNA, 64 nt, Homo Sapiens; identical to SEQ ID NO: 61576

SEQ ID NO: 286140 - RNA, 64 nt, Homo Sapiens; identical to SEQ ID NO: 61577

SEQ ID NO: 286141 - RNA, 64 nt, Homo Sapiens; identical to SEQ ID NO: 61578

SEQ ID NO: 286142 - RNA, 64 nt, Homo Sapiens; identical to SEQ ID NO: 61579

SEQ ID NO: 286143 - RNA, 64 nt, Homo Sapiens; identical to SEQ ID NO: 61580

SEQ ID NO: 286144 - RNA, 64 nt, Homo Sapiens; identical to SEQ ID NO: 61581

SEQ ID NO: 286145 - RNA, 64 nt, Homo Sapiens; identical to SEQ ID NO: 61582

SEQ ID NO: 286146 - RNA, 64 nt, Homo Sapiens; identical to SEQ ID NO: 61583

SEQ ID NO: 286147 - RNA, 64 nt, Homo Sapiens; identical to SEQ ID NO: 61584

SEQ ID NO: 286148 - RNA, 64 nt, Homo Sapiens; identical to SEQ ID NO: 61585

SEQ ID NO: 286149 - RNA, 64 nt, Homo Sapiens; identical to SEQ ID NO: 61586

SEQ ID NO: 286150 - RNA, 64 nt, Homo Sapiens; identical to SEQ ID NO: 61587

SEQ ID NO: 286151 - RNA, 64 nt, Homo Sapiens; identical to SEQ ID NO: 61588

SEQ ID NO: 286152 - RNA, 64 nt, Homo Sapiens; identical to SEQ ID NO: 61589

SEQ ID NO: 286153 - RNA, 64 nt, Homo Sapiens; identical to SEQ ID NO: 61590

SEQ ID NO: 286154 - RNA, 64 nt, Homo Sapiens; identical to SEQ ID NO: 61591

SEQ ID NO: 286155 - RNA, 64 nt, Homo Sapiens; identical to SEQ ID NO: 61592

SEQ ID NO: 286156 - RNA, 64 nt, Homo Sapiens; identical to SEQ ID NO: 61593

SEQ ID NO: 286157 - RNA, 64 nt, Homo Sapiens; identical to SEQ ID NO: 61594

SEQ ID NO: 286158 - RNA, 64 nt, Homo Sapiens; identical to SEQ ID NO: 61595

SEQ ID NO: 286159 - RNA, 64 nt, Homo Sapiens; identical to SEQ ID NO: 61596

SEQ ID NO: 286160 - RNA, 64 nt, Homo Sapiens; identical to SEQ ID NO: 61597

SEQ ID NO: 286161 - RNA, 64 nt, Homo Sapiens; identical to SEQ ID NO: 61598

SEQ ID NO: 286162 - RNA, 64 nt, Homo Sapiens; identical to SEQ ID NO: 61599

SEQ ID NO: 286163 - RNA, 64 nt, Homo Sapiens; identical to SEQ ID NO: 61600

SEQ ID NO: 286164 - RNA, 64 nt, Homo Sapiens; identical to SEQ ID NO: 61601

SEQ ID NO: 286165 - RNA, 64 nt, Homo Sapiens; identical to SEQ ID NO: 61602

SEQ ID NO: 286166 - RNA, 64 nt, Homo Sapiens; identical to SEQ ID NO: 61603

SEQ ID NO: 286167 - RNA, 64 nt, Homo Sapiens; identical to SEQ ID NO: 61604

SEQ ID NO: 286168 - RNA, 64 nt, Homo Sapiens; identical to SEQ ID NO: 61605

SEQ ID NO: 286169 - RNA, 64 nt, Homo Sapiens; identical to SEQ ID NO: 61606

SEQ ID NO: 286170 - RNA, 64 nt, Homo Sapiens; identical to SEQ ID NO: 61607

SEQ ID NO: 286171 - RNA, 64 nt, Homo Sapiens; identical to SEQ ID NO: 61608

SEQ ID NO: 286172 - RNA, 64 nt, Homo Sapiens; identical to SEQ ID NO: 61609

SEQ ID NO: 286173 - RNA, 64 nt, Homo Sapiens; identical to SEQ ID NO: 61610

SEQ ID NO: 286174 - RNA, 64 nt, Homo Sapiens; identical to SEQ ID NO: 61611

SEQ ID NO: 286175 - RNA, 64 nt, Homo Sapiens; identical to SEQ ID NO: 61612

SEQ ID NO: 286176 - RNA, 64 nt, Homo Sapiens; identical to SEQ ID NO: 61613

SEQ ID NO: 286177 - RNA, 64 nt, Homo Sapiens; identical to SEQ ID NO: 61614

SEQ ID NO: 286178 - RNA, 64 nt, Homo Sapiens; identical to SEQ ID NO: 61615

SEQ ID NO: 286179 - RNA, 64 nt, Homo Sapiens; identical to SEQ ID NO: 61616

SEQ ID NO: 286180 - RNA, 64 nt, Homo Sapiens; identical to SEQ ID NO: 61617

SEQ ID NO: 286181 - RNA, 64 nt, Homo Sapiens; identical to SEQ ID NO: 61618

SEQ ID NO: 286182 - RNA, 64 nt, Homo Sapiens; identical to SEQ ID NO: 61619

SEQ ID NO: 286183 - RNA, 64 nt, Homo Sapiens; identical to SEQ ID NO: 61620

SEQ ID NO: 286184 - RNA, 64 nt, Homo Sapiens; identical to SEQ ID NO: 61621

SEQ ID NO: 286185 - RNA, 64 nt, Homo Sapiens; identical to SEQ ID NO: 61622

SEQ ID NO: 286186 - RNA, 64 nt, Homo Sapiens
uaacuucuuuugacuuaaaugaauuuaaaaugagccaaaggacccugaaaagaagacauguuga

SEQ ID NO: 286187 - RNA, 64 nt, Homo Sapiens
cagcugcagcaaggagguggggaaggagggcaccccaaaggacagcgccuucuucucuuccacc

SEQ ID NO: 286188 - RNA, 64 nt, Homo Sapiens
cucauuaaacuuggcuuagugaagaagagagaugccaaaggaaugaaccaacccuucacauaaa

SEQ ID NO: 286189 - RNA, 64 nt, Homo Sapiens
gagggacuaggggagugguggggaggugaguggaccaaaggauauaggccccaggcaugcagau

SEQ ID NO: 286190 - RNA, 64 nt, Homo Sapiens
cuaugaacuuuuugaacugauuuaggcaggagugccaaaggacauaaaaauauugcagugacuu

SEQ ID NO: 286191 - RNA, 64 nt, Homo Sapiens
acugcacaguccuacuacaggaaagcaucaucccccaaaggauccuugacgaggauacaaaagu

SEQ ID NO: 286192 - RNA, 64 nt, Homo Sapiens
acaaacaaaaaacuguuuucauuugcucucuugaccaaaggauaggacuuuaguucuuuaagca

SEQ ID NO: 286193 - RNA, 64 nt, Homo Sapiens
acugacaagaugucuaauuuuuuuuuaaguaggaccaaaggaaaacaagauuuagauagucuga

SEQ ID NO: 286194 - RNA, 64 nt, Homo Sapiens
guuuucaauaacuuuuauuucuguuuuguaaugaccaaaggaaugaggcugacauagguauaua

SEQ ID NO: 286195 - RNA, 64 nt, Homo Sapiens
gagucuguaccagguggugguuauggggucugaaccaaaggauagcagcucuucauuccucuuc

SEQ ID NO: 286196 - RNA, 64 nt, Homo Sapiens
ugggcuuuccugaauugccaagccuggugccuuuccaaaggacuagcagggccugugguggagc

SEQ ID NO: 286197 - RNA, 64 nt, Homo Sapiens
uuuccagaaaggauuaagaagcaauaaaaaugaaccaaaggauauuuguuuugccuagagaggg

SEQ ID NO: 286198 - RNA, 64 nt, Homo Sapiens
uauguauugcauuaaucaggagaggaaauaccugccaaaggaagcuaaaauugucuauuaaagc

SEQ ID NO: 286199 - RNA, 64 nt, Homo Sapiens
cauaguugaugcauccaauccuaaaacuuacauuccaaaggaauuauaucauuauguuccuaag

SEQ ID NO: 286200 - RNA, 64 nt, Homo Sapiens
ucacccuggagauauuuuuucuuauuugaguccaccaaaggauaaugccaacuuauauaaguuc

SEQ ID NO: 286201 - RNA, 64 nt, Homo Sapiens
uuuuaaaggccguuggcuguuaccaaaugaaaugccaaaggaagaaggauuuucuuuuuaacuu

SEQ ID NO: 286202 - RNA, 64 nt, Homo Sapiens
cauaucacugcugcugggacaucagauaaugccaccaaaggagagggcuguacaguauuguggc

SEQ ID NO: 286203 - RNA, 64 nt, Homo Sapiens
ucuuagccuucaauugggagcacuaaacauuagcccaaaggacuuuuuuaaaggaacuucguga

SEQ ID NO: 286204 - RNA, 64 nt, Homo Sapiens
cccucccuggugucugaucauauccacaucaugaccaaaggaacacucaaauucgcaucuucuc

SEQ ID NO: 286205 - RNA, 64 nt, Homo Sapiens
caaguucuaauuauaaccuugcaacucccagauuccaaaggauuccaguucuuaaaugcuacau

SEQ ID NO: 286206 - RNA, 64 nt, Homo Sapiens
cagcgggaacaggcugcuugagcauuaacuguggccaaaggaggcccauaggaggccuaugugg

SEQ ID NO: 286207 - RNA, 64 nt, Homo Sapiens
cacacaggggggaagcccuagauguuauuacacaccaaaggacaaagguuucagugauaaguca

SEQ ID NO: 286208 - RNA, 64 nt, Homo Sapiens
aauggggagcucuagaguggcuuuucuagcccacccaaaggacacagagggagauuucaagggc

SEQ ID NO: 286209 - RNA, 64 nt, Homo Sapiens
uggagaagaacaugagguuauuguuucauuuacuccaaaggauccugaagccugcgaggaaagg

SEQ ID NO: 286210 - RNA, 64 nt, Homo Sapiens
gcgauugaccaguaacugugagaucagaauucacccaaaggaagacauuuucaucucuguauua

SEQ ID NO: 286211 - RNA, 64 nt, Homo Sapiens; identical to SEQ ID NO: 43717

SEQ ID NO: 286212 - RNA, 64 nt, Homo Sapiens; identical to SEQ ID NO: 43718

SEQ ID NO: 286213 - RNA, 64 nt, Homo Sapiens; identical to SEQ ID NO: 43719

SEQ ID NO: 286214 - RNA, 64 nt, Homo Sapiens; identical to SEQ ID NO: 43720

SEQ ID NO: 286215 - RNA, 64 nt, Homo Sapiens; identical to SEQ ID NO: 43721

SEQ ID NO: 286216 - RNA, 64 nt, Homo Sapiens; identical to SEQ ID NO: 43722

SEQ ID NO: 286217 - RNA, 64 nt, Homo Sapiens; identical to SEQ ID NO: 43723

SEQ ID NO: 286218 - RNA, 64 nt, Homo Sapiens; identical to SEQ ID NO: 43724

SEQ ID NO: 286219 - RNA, 64 nt, Homo Sapiens; identical to SEQ ID NO: 43725

SEQ ID NO: 286220 - RNA, 64 nt, Homo Sapiens; identical to SEQ ID NO: 43726

SEQ ID NO: 286221 - RNA, 64 nt, Homo Sapiens; identical to SEQ ID NO: 43727

SEQ ID NO: 286222 - RNA, 64 nt, Homo Sapiens; identical to SEQ ID NO: 43728

SEQ ID NO: 286223 - RNA, 64 nt, Homo Sapiens; identical to SEQ ID NO: 43729

SEQ ID NO: 286224 - RNA, 64 nt, Homo Sapiens; identical to SEQ ID NO: 43730

SEQ ID NO: 286225 - RNA, 64 nt, Homo Sapiens; identical to SEQ ID NO: 43731

SEQ ID NO: 286226 - RNA, 64 nt, Homo Sapiens; identical to SEQ ID NO: 43732

SEQ ID NO: 286227 - RNA, 64 nt, Homo Sapiens; identical to SEQ ID NO: 43733

SEQ ID NO: 286228 - RNA, 64 nt, Homo Sapiens; identical to SEQ ID NO: 43734

SEQ ID NO: 286229 - RNA, 64 nt, Homo Sapiens; identical to SEQ ID NO: 43735

SEQ ID NO: 286230 - RNA, 64 nt, Homo Sapiens; identical to SEQ ID NO: 43736

SEQ ID NO: 286231 - RNA, 64 nt, Homo Sapiens; identical to SEQ ID NO: 43737

SEQ ID NO: 286232 - RNA, 64 nt, Homo Sapiens; identical to SEQ ID NO: 43738

SEQ ID NO: 286233 - RNA, 64 nt, Homo Sapiens; identical to SEQ ID NO: 43739

SEQ ID NO: 286234 - RNA, 64 nt, Homo Sapiens; identical to SEQ ID NO: 43740

SEQ ID NO: 286235 - RNA, 64 nt, Homo Sapiens; identical to SEQ ID NO: 43741

SEQ ID NO: 286236 - RNA, 64 nt, Homo Sapiens; identical to SEQ ID NO: 43742

SEQ ID NO: 286237 - RNA, 64 nt, Homo Sapiens; identical to SEQ ID NO: 43743

SEQ ID NO: 286238 - RNA, 64 nt, Homo Sapiens; identical to SEQ ID NO: 43744

SEQ ID NO: 286239 - RNA, 64 nt, Homo Sapiens; identical to SEQ ID NO: 43745

SEQ ID NO: 286240 - RNA, 64 nt, Homo Sapiens; identical to SEQ ID NO: 43746

SEQ ID NO: 286241 - RNA, 64 nt, Homo Sapiens; identical to SEQ ID NO: 100592

SEQ ID NO: 286242 - RNA, 64 nt, Homo Sapiens; identical to SEQ ID NO: 100593

SEQ ID NO: 286243 - RNA, 64 nt, Homo Sapiens; identical to SEQ ID NO: 100594

SEQ ID NO: 286244 - RNA, 64 nt, Homo Sapiens; identical to SEQ ID NO: 100595

SEQ ID NO: 286245 - RNA, 64 nt, Homo Sapiens; identical to SEQ ID NO: 100596

SEQ ID NO: 286246 - RNA, 64 nt, Homo Sapiens; identical to SEQ ID NO: 100597

SEQ ID NO: 286247 - RNA, 64 nt, Homo Sapiens; identical to SEQ ID NO: 100598

SEQ ID NO: 286248 - RNA, 64 nt, Homo Sapiens; identical to SEQ ID NO: 100599

SEQ ID NO: 286249 - RNA, 64 nt, Homo Sapiens; identical to SEQ ID NO: 100600

SEQ ID NO: 286250 - RNA, 64 nt, Homo Sapiens; identical to SEQ ID NO: 100601

SEQ ID NO: 286251 - RNA, 64 nt, Homo Sapiens; identical to SEQ ID NO: 100602

SEQ ID NO: 286252 - RNA, 64 nt, Homo Sapiens; identical to SEQ ID NO: 100603

SEQ ID NO: 286253 - RNA, 64 nt, Homo Sapiens; identical to SEQ ID NO: 100604

SEQ ID NO: 286254 - RNA, 64 nt, Homo Sapiens; identical to SEQ ID NO: 100605

SEQ ID NO: 286255 - RNA, 64 nt, Homo Sapiens; identical to SEQ ID NO: 100606

SEQ ID NO: 286256 - RNA, 64 nt, Homo Sapiens; identical to SEQ ID NO: 100607

SEQ ID NO: 286257 - RNA, 64 nt, Homo Sapiens; identical to SEQ ID NO: 100608

SEQ ID NO: 286258 - RNA, 64 nt, Homo Sapiens; identical to SEQ ID NO: 100609

SEQ ID NO: 286259 - RNA, 64 nt, Homo Sapiens; identical to SEQ ID NO: 100610

SEQ ID NO: 286260 - RNA, 64 nt, Homo Sapiens; identical to SEQ ID NO: 100611

SEQ ID NO: 286261 - RNA, 64 nt, Homo Sapiens; identical to SEQ ID NO: 100612

SEQ ID NO: 286262 - RNA, 64 nt, Homo Sapiens; identical to SEQ ID NO: 100613

SEQ ID NO: 286263 - RNA, 64 nt, Homo Sapiens; identical to SEQ ID NO: 100614

SEQ ID NO: 286264 - RNA, 64 nt, Homo Sapiens; identical to SEQ ID NO: 100615

SEQ ID NO: 286265 - RNA, 64 nt, Homo Sapiens; identical to SEQ ID NO: 100616

SEQ ID NO: 286266 - RNA, 64 nt, Homo Sapiens; identical to SEQ ID NO: 100617

SEQ ID NO: 286267 - RNA, 64 nt, Homo Sapiens; identical to SEQ ID NO: 100618

SEQ ID NO: 286268 - RNA, 64 nt, Homo Sapiens; identical to SEQ ID NO: 100619

SEQ ID NO: 286269 - RNA, 64 nt, Homo Sapiens; identical to SEQ ID NO: 100620

SEQ ID NO: 286270 - RNA, 64 nt, Homo Sapiens; identical to SEQ ID NO: 100621

SEQ ID NO: 286271 - RNA, 64 nt, Homo Sapiens; identical to SEQ ID NO: 100622

SEQ ID NO: 286272 - RNA, 64 nt, Homo Sapiens; identical to SEQ ID NO: 100623

SEQ ID NO: 286273 - RNA, 64 nt, Homo Sapiens; identical to SEQ ID NO: 100624

SEQ ID NO: 286274 - RNA, 64 nt, Homo Sapiens; identical to SEQ ID NO: 100625

SEQ ID NO: 286275 - RNA, 64 nt, Homo Sapiens; identical to SEQ ID NO: 100626

SEQ ID NO: 286276 - RNA, 64 nt, Homo Sapiens; identical to SEQ ID NO: 100627

SEQ ID NO: 286277 - RNA, 64 nt, Homo Sapiens; identical to SEQ ID NO: 100628

SEQ ID NO: 286278 - RNA, 64 nt, Homo Sapiens; identical to SEQ ID NO: 100629

SEQ ID NO: 286279 - RNA, 64 nt, Homo Sapiens; identical to SEQ ID NO: 100630

SEQ ID NO: 286280 - RNA, 64 nt, Homo Sapiens; identical to SEQ ID NO: 100631

SEQ ID NO: 286281 - RNA, 64 nt, Homo Sapiens; identical to SEQ ID NO: 100632

SEQ ID NO: 286282 - RNA, 64 nt, Homo Sapiens; identical to SEQ ID NO: 100633

SEQ ID NO: 286283 - RNA, 64 nt, Homo Sapiens; identical to SEQ ID NO: 100634

SEQ ID NO: 286284 - RNA, 64 nt, Homo Sapiens; identical to SEQ ID NO: 100635

SEQ ID NO: 286285 - RNA, 64 nt, Homo Sapiens; identical to SEQ ID NO: 100636

SEQ ID NO: 286286 - RNA, 64 nt, Homo Sapiens; identical to SEQ ID NO: 100637

SEQ ID NO: 286287 - RNA, 64 nt, Homo Sapiens; identical to SEQ ID NO: 100638

SEQ ID NO: 286288 - RNA, 64 nt, Homo Sapiens; identical to SEQ ID NO: 100639

SEQ ID NO: 286289 - RNA, 64 nt, Homo Sapiens; identical to SEQ ID NO: 100640

SEQ ID NO: 286290 - RNA, 64 nt, Homo Sapiens; identical to SEQ ID NO: 100641

SEQ ID NO: 286291 - RNA, 64 nt, Homo Sapiens; identical to SEQ ID NO: 100642

SEQ ID NO: 286292 - RNA, 64 nt, Homo Sapiens; identical to SEQ ID NO: 100643

SEQ ID NO: 286293 - RNA, 64 nt, Homo Sapiens; identical to SEQ ID NO: 100644

SEQ ID NO: 286294 - RNA, 64 nt, Homo Sapiens; identical to SEQ ID NO: 100645

SEQ ID NO: 286295 - RNA, 64 nt, Homo Sapiens; identical to SEQ ID NO: 100646

SEQ ID NO: 286296 - RNA, 64 nt, Homo Sapiens; identical to SEQ ID NO: 100647

SEQ ID NO: 286297 - RNA, 64 nt, Homo Sapiens; identical to SEQ ID NO: 100648

SEQ ID NO: 286298 - RNA, 64 nt, Homo Sapiens; identical to SEQ ID NO: 100649

SEQ ID NO: 286299 - RNA, 64 nt, Homo Sapiens; identical to SEQ ID NO: 100650

SEQ ID NO: 286300 - RNA, 64 nt, Homo Sapiens; identical to SEQ ID NO: 100651

SEQ ID NO: 286301 - RNA, 64 nt, Homo Sapiens; identical to SEQ ID NO: 100652

SEQ ID NO: 286302 - RNA, 64 nt, Homo Sapiens; identical to SEQ ID NO: 100653

SEQ ID NO: 286303 - RNA, 64 nt, Homo Sapiens; identical to SEQ ID NO: 100654

SEQ ID NO: 286304 - RNA, 64 nt, Homo Sapiens; identical to SEQ ID NO: 100655

SEQ ID NO: 286305 - RNA, 64 nt, Homo Sapiens; identical to SEQ ID NO: 100656

SEQ ID NO: 286306 - RNA, 64 nt, Homo Sapiens; identical to SEQ ID NO: 100657

SEQ ID NO: 286307 - RNA, 64 nt, Homo Sapiens; identical to SEQ ID NO: 100658

SEQ ID NO: 286308 - RNA, 63 nt, Homo Sapiens; identical to SEQ ID NO: 100659

SEQ ID NO: 286309 - RNA, 64 nt, Homo Sapiens; identical to SEQ ID NO: 100660

SEQ ID NO: 286310 - RNA, 64 nt, Homo Sapiens; identical to SEQ ID NO: 100661

SEQ ID NO: 286311 - RNA, 64 nt, Homo Sapiens; identical to SEQ ID NO: 100662

SEQ ID NO: 286312 - RNA, 64 nt, Homo Sapiens; identical to SEQ ID NO: 100663

SEQ ID NO: 286313 - RNA, 64 nt, Homo Sapiens; identical to SEQ ID NO: 100664

SEQ ID NO: 286314 - RNA, 64 nt, Homo Sapiens; identical to SEQ ID NO: 100665

SEQ ID NO: 286315 - RNA, 64 nt, Homo Sapiens; identical to SEQ ID NO: 100666

SEQ ID NO: 286316 - RNA, 64 nt, Homo Sapiens; identical to SEQ ID NO: 100667

SEQ ID NO: 286317 - RNA, 64 nt, Homo Sapiens; identical to SEQ ID NO: 100668

SEQ ID NO: 286318 - RNA, 64 nt, Homo Sapiens; identical to SEQ ID NO: 100669

SEQ ID NO: 286319 - RNA, 54 nt, Homo Sapiens; identical to SEQ ID NO: 100670

SEQ ID NO: 286320 - RNA, 64 nt, Homo Sapiens; identical to SEQ ID NO: 100671

SEQ ID NO: 286321 - RNA, 64 nt, Homo Sapiens; identical to SEQ ID NO: 100672

SEQ ID NO: 286322 - RNA, 64 nt, Homo Sapiens; identical to SEQ ID NO: 100673

SEQ ID NO: 286323 - RNA, 64 nt, Homo Sapiens; identical to SEQ ID NO: 100674

SEQ ID NO: 286324 - RNA, 64 nt, Homo Sapiens; identical to SEQ ID NO: 100675

SEQ ID NO: 286325 - RNA, 64 nt, Homo Sapiens; identical to SEQ ID NO: 100676

SEQ ID NO: 286326 - RNA, 64 nt, Homo Sapiens; identical to SEQ ID NO: 100677

SEQ ID NO: 286327 - RNA, 64 nt, Homo Sapiens; identical to SEQ ID NO: 100678

SEQ ID NO: 286328 - RNA, 57 nt, Homo Sapiens; identical to SEQ ID NO: 100679

SEQ ID NO: 286329 - RNA, 64 nt, Homo Sapiens; identical to SEQ ID NO: 100680

SEQ ID NO: 286330 - RNA, 64 nt, Homo Sapiens; identical to SEQ ID NO: 100681

SEQ ID NO: 286331 - RNA, 64 nt, Homo Sapiens; identical to SEQ ID NO: 100682

SEQ ID NO: 286332 - RNA, 64 nt, Homo Sapiens; identical to SEQ ID NO: 100683

SEQ ID NO: 286333 - RNA, 64 nt, Homo Sapiens
uucugccacgagccagcugugugaauuuggucaagggaccuaacucucugaguuccagguuccu

SEQ ID NO: 286334 - RNA, 64 nt, Homo Sapiens
caauuauauuuuaagagguguucccaggacuuuugggaccuacuaaaacaaugaugguuauuuu

SEQ ID NO: 286335 - RNA, 64 nt, Homo Sapiens
gaaaagguaccguggcugcugcagggcacauggagggaccuacccucugggaaagcccuugugu

SEQ ID NO: 286336 - RNA, 64 nt, Homo Sapiens
uggccagggagauccaugugcucaauguugcugggggaccuacaaaagucaaacauugcucagu

SEQ ID NO: 286337 - RNA, 63 nt, Homo Sapiens
agaccaagucccuauaaacaaggaccuuccaguccaggggaaugacugugcaagguaguaucu

SEQ ID NO: 286338 - RNA, 63 nt, Homo Sapiens
uugagcccaggaguucaagaccagccugagcaaccaggggagaccuuguuucuacaaaagaau

SEQ ID NO: 286339 - RNA, 63 nt, Homo Sapiens
aaguaggauguuguugccuuuaacuuuucuuauccaggggaaaauugccauuuuagggucagc

SEQ ID NO: 286340 - RNA, 63 nt, Homo Sapiens
gaaagaaagacgcugggcccaauuuugacuuggccaggggacaccuugguguguuuguuaucu

SEQ ID NO: 286341 - RNA, 63 nt, Homo Sapiens
gugaagcaucugcuggacaagucggaccacuggccaggggaccuuugauugucuuuccagaga

SEQ ID NO: 286342 - RNA, 63 nt, Homo Sapiens
ggagaccaaggcaauaguccuuuccacuacaggccaggggaugggacaagaaguagggaacag

SEQ ID NO: 286343 - RNA, 63 nt, Homo Sapiens
cugcgaaggagagguucuguaagguccccuuccccaggggagcccaugggaacgccaacugga

SEQ ID NO: 286344 - RNA, 63 nt, Homo Sapiens
ggcuguuugcuggcucaggcuuuuuuuuugucuccaggggaggccagccuuuuuuuuuuuuuu

SEQ ID NO: 286345 - RNA, 63 nt, Homo Sapiens
uauacgugauuuaaucugcaauagguggaauaaccaggggaacugguuaugaauaugugaaug

SEQ ID NO: 286346 - RNA, 63 nt, Homo Sapiens
ugaugcuuuuucucugaaguggugugggaaguaccaggggacuggcagaagcccaggcccucu

SEQ ID NO: 286347 - RNA, 63 nt, Homo Sapiens
gacaccacagaaggagacccgcuggcggcagucccaggggagagggucgucgagaggcugcgg

SEQ ID NO: 286348 - RNA, 63 nt, Homo Sapiens
gccacccacaggccauguccgaucuuccuccugccaggggagauuuccgcacucugagaccau

SEQ ID NO: 286349 - RNA, 63 nt, Homo Sapiens
ccucccgugccccuccccgcuguccucuuggccccaggggagaagaugaggccaucagagaug

SEQ ID NO: 286350 - RNA, 63 nt, Homo Sapiens
agaugaggccaucagagauggccaggagaagggccaggggaauagagcuauuuuuuuaacaaa

SEQ ID NO: 286351 - RNA, 63 nt, Homo Sapiens
gcccaccugucaaacaaagccagaagcugagcaccaggggaugaguggagguuaaggcugagg

SEQ ID NO: 286352 - RNA, 63 nt, Homo Sapiens
gggugggguggagaacuccuaggguggcuggguccaggggaugggagguugugggcauugaug

SEQ ID NO: 286353 - RNA, 63 nt, Homo Sapiens
cugggcugacaguaaaagcacagaauacaaaacccaggggauggggcugggaggggcugugag

SEQ ID NO: 286354 - RNA, 63 nt, Homo Sapiens
uccccuaaagguagaagauacucgagcaugcugccaggggagcuggauggugaaacaccugaa

SEQ ID NO: 286355 - RNA, 63 nt, Homo Sapiens
gcaaagggcgucucagggaagcgagggcagaccccaggggaaagggcaccaggggacgcucug

SEQ ID NO: 286356 - RNA, 63 nt, Homo Sapiens
cucuggcgagggcagacccccaaugagugggcaccaggggacgcccuucccccucgacccccg

SEQ ID NO: 286357 - RNA, 63 nt, Homo Sapiens
ccucugacccuggcccagggaccccucacggggccaggggaggcauagcagaaagacuggccc

SEQ ID NO: 286358 - RNA, 63 nt, Homo Sapiens
ugggggugcagagcccaccuggguaccugacccccaggggaugaaaaugcaaggaugagucug

SEQ ID NO: 286359 - RNA, 63 nt, Homo Sapiens
gcagagaccugggaugggagaaguccuggggcgccaggggauccagccuagagcagaccuuag

SEQ ID NO: 286360 - RNA, 63 nt, Homo Sapiens
ccaagagcacccaccaagacacagcaggacaggccaggggagggcaucuggaccagggcaucc

SEQ ID NO: 286361 - RNA, 63 nt, Homo Sapiens
cagcgccaauaacaauacagugucugaguaucuccaggggaugauuucuggcucuuugucucc

SEQ ID NO: 286362 - RNA, 63 nt, Homo Sapiens
ugaagcugauuuguaaugauuggcacucuucagccaggggaguggguaggccauagccaagga

SEQ ID NO: 286363 - RNA, 63 nt, Homo Sapiens
ggacccgugggauggugcccucacccugaggccccaggggagaaaaaaacugcuccuucaccc

SEQ ID NO: 286364 - RNA, 63 nt, Homo Sapiens
ggagggagcgaggggcucacaagggcucugagcccaggggaggaggggccacacggcgggagg

SEQ ID NO: 286365 - RNA, 63 nt, Homo Sapiens
ggcaggagucccagcaccauaggauugagggagccaggggagguauccuaugggggccugagc

SEQ ID NO: 286366 - RNA, 63 nt, Homo Sapiens
ccauccagccuguaggaaacgccuacaaggcuuccaggggaugagcccugccaggggcugugg

SEQ ID NO: 286367 - RNA, 63 nt, Homo Sapiens
uaaauguggagauuaaauaaaauauaaaaagauccaggggacacaccucccuucuucuaacua

SEQ ID NO: 286368 - RNA, 63 nt, Homo Sapiens
acuuccaaauguuaauuuuuagccccucuuccuccaggggagacaguucuguuccuucugacu

SEQ ID NO: 286369 - RNA, 63 nt, Homo Sapiens
cagggagcagggccaggcgggcucgggggccggccaggggagcaccccacucaacuacucaga

SEQ ID NO: 286370 - RNA, 63 nt, Homo Sapiens
caggcucucugguggccgccccugugcaccuggccaggggaagcccgggggucuggggccucc

SEQ ID NO: 286371 - RNA, 63 nt, Homo Sapiens
cccuagccgucaucuccacacucaccaggcccaccaggggagggggcuggccugggggucuug

SEQ ID NO: 286372 - RNA, 63 nt, Homo Sapiens
agauacaagaggcaguaggaccuggguuggaacccaggggagcagacuggggggcuguugccc

SEQ ID NO: 286373 - RNA, 63 nt, Homo Sapiens
aacaccccggccucggggcuccugguggcagcaccaggggacacaccugccaaacccaccaga

SEQ ID NO: 286374 - RNA, 63 nt, Homo Sapiens
augcugucacucagccagaucaguauugacccaccaggggaggugggguuuggugagagacgc

SEQ ID NO: 286375 - RNA, 63 nt, Homo Sapiens
cugcuaaaaggccuugugagguggccccacccuccaggggagcuggugaagaugggccacaga

SEQ ID NO: 286376 - RNA, 63 nt, Homo Sapiens
gacagccuuuguuuucugagauaccaaagagagccaggggagggccccggguucggcggccag

SEQ ID NO: 286377 - RNA, 64 nt, Homo Sapiens
gugccccauccuggaggauuggccccaagaucuccuagaacaggauaauugccuguguuuaggc

SEQ ID NO: 286378 - RNA, 64 nt, Homo Sapiens
aucaaaaacaaagaagcccuauaagaccauuucucuagaacagauguucuuaauauuuuucuua

SEQ ID NO: 286379 - RNA, 64 nt, Homo Sapiens
aggccaaggcgagcggaucaugaggucagaagaucuagaacagccuggucaacauggugaaacc

SEQ ID NO: 286380 - RNA, 64 nt, Homo Sapiens
gauaaggcuucaucacuggauuucugugucuucacuagaacaccauugucaucucauauugauc

SEQ ID NO: 286381 - RNA, 64 nt, Homo Sapiens
auaguggauugggcagacuggccuggaggaaaugcuagaacagagggaaaggaggcuggagagg

SEQ ID NO: 286382 - RNA, 64 nt, Homo Sapiens
gaugguggagaucuggcaugccaggcuuaggugucuagaacagcaacuguaugugaaggggagc

SEQ ID NO: 286383 - RNA, 64 nt, Homo Sapiens
uuccagcacauagcaaguguuguaacuccaguuccuagaacaauaauguuauuuuuuuuacugc

SEQ ID NO: 286384 - RNA, 64 nt, Homo Sapiens
cucucccaaguauaugucuggcuguucccucugccuagaacacugccucagggccuucgcaugu

SEQ ID NO: 286385 - RNA, 64 nt, Homo Sapiens
ggcccauuuccuuuucucuaaaaugagggucaucauaccuaaggauguugugaggcgugaguga

SEQ ID NO: 286386 - RNA, 64 nt, Homo Sapiens
auugugacuauaauacauuuuugguaauuuuuuuauaccuaauuuguauaggaagugcuauuuc

SEQ ID NO: 286387 - RNA, 64 nt, Homo Sapiens
agaacauuauacaauugucaaaugaacuauaaugauaccuaaccauauggaugaaucugagcaa

SEQ ID NO: 286388 - RNA, 63 nt, Homo Sapiens
gcuuugaggacagcagcugacagcauucggcguauaccuaaggagaguuuuuuccccgaacug

SEQ ID NO: 286389 - RNA, 64 nt, Homo Sapiens
ugauaaagcugcuuuaauaaauacuucuggucugauaccuaaggagccugguucaguagaaagu

SEQ ID NO: 286390 - RNA, 64 nt, Homo Sapiens
cuuucauugcuauauaauauucaguggcucauuuauaccuaauaaaauaaugguauuuuaaaau

SEQ ID NO: 286391 - RNA, 64 nt, Homo Sapiens
ccguuaaguaaaauggacuuuguaauuguacagcauaccuaagaaacucagaaggugcauuuaa

SEQ ID NO: 286392 - RNA, 64 nt, Homo Sapiens
gcugcucagcagauauggauggaucugcaaucacauaccuaauguggagcugggcuuuucugga

SEQ ID NO: 286393 - RNA, 64 nt, Homo Sapiens
aggaauaugaaagaaaggcacauguuuaagaggaauaccuaaagguuuuucuaaauuccaacau

SEQ ID NO: 286394 - RNA, 64 nt, Homo Sapiens
uguauguucagaaaagcauuguuaauugugccagauaccuaaaacaaaaaugggcagacauuug

SEQ ID NO: 286395 - RNA, 64 nt, Homo Sapiens
guuuauuaaaaguuagaagauacuguaauguauuauaccuaaauguuuguaucuaaauagcacu

SEQ ID NO: 286396 - RNA, 64 nt, Homo Sapiens
ucaauaguguuggcuuuuaacaccccugaagggcauaccuaaccgauuuaaccauucuaggcaa

SEQ ID NO: 286397 - RNA, 64 nt, Homo Sapiens
guggcuuuugcggccaguauuagacuggaaguucauaccuaaguacuguaauaauaccucaaug

SEQ ID NO: 286398 - RNA, 64 nt, Homo Sapiens
ugcugcaguauaaaagagcaaagagcuuugggaaauaccuaagaagcaccuuaagauuagggug

SEQ ID NO: 286399 - RNA, 64 nt, Homo Sapiens
aucuaagaagguuauaacaaaaugcucuucagaaauaccuaagugcugagaauuuuuaguacua

SEQ ID NO: 286400 - RNA, 64 nt, Homo Sapiens
ggaaauagcuaaacacaacaggaacccauuacuaauaccuaacaauuuuuggcucaggucauug

SEQ ID NO: 286401 - RNA, 64 nt, Homo Sapiens
cuguuaaggaagacagaaaaccccacacccaccaauaccuaaaucuguuugcucauguucugug

SEQ ID NO: 286402 - RNA, 64 nt, Homo Sapiens
gcgaauuuguggcugagaggggguauaggaaaauauaccuaaaaugauuuuguaauuugcaaaa

SEQ ID NO: 286403 - RNA, 64 nt, Homo Sapiens
guaaaauuuuuuuauuuacauguuaauugaaugcauaccuaauuauuuauuugguugccuugug

SEQ ID NO: 286404 - RNA, 64 nt, Homo Sapiens
cuuccugccgcaacaguuuuaaauggagggaauaauaccuaagcccucaguuuuaucauuuuca

SEQ ID NO: 286405 - RNA, 64 nt, Homo Sapiens
auuguagagucauucccucuacaaaucauuuggaauaccuaaagagucacucuuuuuaguacaa

SEQ ID NO: 286406 - RNA, 64 nt, Homo Sapiens
ccugcaccuaaguggccauguccuuccaucagccauaccuaagaaucuucugagagaaccugcu

SEQ ID NO: 286407 - RNA, 64 nt, Homo Sapiens
aaccuuccuauugaaaauacaggcaguuugcacaauaccuaauuggacugagugcuuccguugc

SEQ ID NO: 286408 - RNA, 64 nt, Homo Sapiens
guuccagaaucaggugccuuuuagggagagaacaauaccuaagauugucugagcuuccaucuuu

SEQ ID NO: 286409 - RNA, 64 nt, Homo Sapiens
aauauuaacaugaaggauaaaccaacuuauuuguauaccuaaggcaggcauuuggaucaguaac

SEQ ID NO: 286410 - RNA, 64 nt, Homo Sapiens
aaauugagccugauaacaagauuacaaauucacaauaccuaauacuuagggaaauauaaaaauu

SEQ ID NO: 286411 - RNA, 64 nt, Homo Sapiens
auguauagauuuugcaaauauuaugcuauauguaauaccuaacuguaucuguaguguauaugua

SEQ ID NO: 286412 - RNA, 64 nt, Homo Sapiens
aaagcaauuguauuaguaagaacuuuguaaauaaauaccuaaaacccaaguguauuuuaugucu

SEQ ID NO: 286413 - RNA, 64 nt, Homo Sapiens
uagucuauuaaaagauacguggagauauuaaauuauaccuaaagcagacguccaacaaauucug

SEQ ID NO: 286414 - RNA, 64 nt, Homo Sapiens
aaaagguauaaauaauaauauaaugaauuccuauauaccuaauacccaguuuaagacaccaaau

SEQ ID NO: 286415 - RNA, 64 nt, Homo Sapiens
aaacauaacauuacuuggaguaaacauaacauuaauaccuaagugccucugauacauaccuaag

SEQ ID NO: 286416 - RNA, 64 nt, Homo Sapiens
aaacauaacauuaauaccuaauugccucugauacauaccuaaguuaagaucugcuuuggaaauu

SEQ ID NO: 286417 - RNA, 64 nt, Homo Sapiens
guacagugagugugggggaacaauguaaaaacaaauaccuaacuuuugcaccuaguagauagau

SEQ ID NO: 286418 - RNA, 64 nt, Homo Sapiens
uuguauuuuuugugacuuugauaauuucauucguauaccuaaguuguuuuuaaauaauguuuuu

SEQ ID NO: 286419 - RNA, 64 nt, Homo Sapiens
ggcaggcucuggaaguuggaaguaaaauggaauaauaccuaacacuucauuuauuuaucucaug

SEQ ID NO: 286420 - RNA, 64 nt, Homo Sapiens
gcuugaaauucuagucuguuguacuguucuugaaauaccuaaugcugacuggcaauaacgcacg

SEQ ID NO: 286421 - RNA, 64 nt, Homo Sapiens
ggaagcuuagaugggcugugggacauacuaaaaaauaccuaaaaugaagcagguguuuucucuu

SEQ ID NO: 286422 - RNA, 64 nt, Homo Sapiens
gaaucauggaaacacucuuuuggacuacuucagaauaccuaaauaaauguaggacccaaguuuc

SEQ ID NO: 286423 - RNA, 64 nt, Homo Sapiens
uaaaugacgaguuaauggguuaguguuaggagaaauaccuaaugguggggggcugggagaggga

SEQ ID NO: 286424 - RNA, 64 nt, Homo Sapiens
cuaaaaaaaagcaaggguuuaagaugucaguguuauaccuaaaguuuacuaacacguuuuucaa

SEQ ID NO: 286425 - RNA, 64 nt, Homo Sapiens
accagaaaggaaauggcaugcacacacacaaaaaauaccuaaauuuuggaugagaaaaugauaa

SEQ ID NO: 286426 - RNA, 64 nt, Homo Sapiens
uuaaaaguaauaaagagaaauauauuugucacuuauaccuaaaauaugaguggcucauuuuugc

SEQ ID NO: 286427 - RNA, 62 nt, Homo Sapiens
acagcaauaugaagaaaaauaaauuaagucccuuauaccuaagaccucuauuucucuguuga

SEQ ID NO: 286428 - RNA, 64 nt, Homo Sapiens
uuuaagugaauauuuuuaaacuucaauaaucaagauaccuaauauauauauggggacaucaaaa

SEQ ID NO: 286429 - RNA, 64 nt, Homo Sapiens
uuaaaugacgaguuacuggauagcauuuggagauauaccuaaugaaauacaauggggggaagga

SEQ ID NO: 286430 - RNA, 64 nt, Homo Sapiens
gauccuguaaucacaacucagcauuggccuuaauauaccuaaaucuccaaaaacagugauuaaa

SEQ ID NO: 286431 - RNA, 64 nt, Homo Sapiens
ucucuccccuauggauuuugcuaaugguugagugauaccuaaaggccuuguugcauuuuuuaca

SEQ ID NO: 286432 - RNA, 64 nt, Homo Sapiens
uuuuuuuucuuaguauuucuaaguaucucauuaaauaccuaaaaugguauaagauuuaucaauu

SEQ ID NO: 286433 - RNA, 64 nt, Homo Sapiens
caagaauacauuuagcaucuuuguguuggguucuauaccuaaaaauuuucccucccugcccaag

SEQ ID NO: 286434 - RNA, 64 nt, Homo Sapiens
ugaaaauaauagugucuucuauggcauguaauggauaccuaauaccgaugaguuaaaucuugca

SEQ ID NO: 286435 - RNA, 64 nt, Homo Sapiens
aagcaguacaguaucuuaagugucaaccaguuauauaccuaaucugguuuuuuauaacuucugu

SEQ ID NO: 286436 - RNA, 64 nt, Homo Sapiens
ggaaccugagguauuuuucaugcuaucuaaucauauaccuaagauaaaccaacccaguuacuua

SEQ ID NO: 286437 - RNA, 64 nt, Homo Sapiens
ggagacccuaaagucuguuggcugugacgucauuauaccuaaaaucugcaucauaccugcaagc

SEQ ID NO: 286438 - RNA, 64 nt, Homo Sapiens
aaaacuggaaaaaaauuucuuaauuuugucaauuauaccuaaauuuguacaacugaaauauaaa

SEQ ID NO: 286439 - RNA, 64 nt, Homo Sapiens
cuguuauuaagacaaaccaacuuauauguuacuuauaccuaaagaaaauuaauuaacauaucua

SEQ ID NO: 286440 - RNA, 51 nt, Homo Sapiens
auuguuagaaauuggugggauauaccuaaaauugcacaaauacuccuuuaa

SEQ ID NO: 286441 - RNA, 64 nt, Homo Sapiens
acuagaauauccagcuaaaugguauaugaaaaagauaccuaagcucuguuuaaccuguucgugu

SEQ ID NO: 286442 - RNA, 64 nt, Homo Sapiens
aaaauuuaaaaguaggucaguuuauaacgaguaaauaccuaacacaccaagaaugugcagugaa

SEQ ID NO: 286443 - RNA, 64 nt, Homo Sapiens
cuguauacuuuaaaucaucucuagauuacuuauaauaccuaauacaauguaaaugcuauguaaa

SEQ ID NO: 286444 - RNA, 64 nt, Homo Sapiens
caaucauuccauucgguuuuaaauuauccuguauauaccuaauuaugugcacuggagaguaauu

SEQ ID NO: 286445 - RNA, 64 nt, Homo Sapiens
uugauuccuuuugccaacaauuuuaccagcaguuauaccuaacauauuaugcaauuuucucuug

SEQ ID NO: 286446 - RNA, 64 nt, Homo Sapiens
aagcuauaugauuucuucaaaaagcaaaagcaauauaccuaauucauuuggaucaaacuuacau

SEQ ID NO: 286447 - RNA, 64 nt, Homo Sapiens
uuuauagugcuuuacuaucagugccaaaaauaucauaccuaauuuuggguuuaaaaagugcuuu

SEQ ID NO: 286448 - RNA, 64 nt, Homo Sapiens
ucacaguauuccugucacgacagcacauuaaaacauaccuaauugguauggcaaguugugaaga

SEQ ID NO: 286449 - RNA, 64 nt, Homo Sapiens
uauaaaccuuauguacaaguuacuuaggguggguauaccuaaauucaugccuucaaucagaugu

SEQ ID NO: 286450 - RNA, 64 nt, Homo Sapiens
auuuggaccaauagcccacagcugagaauguggaauaccuaaggauagcaccgcuuuuguucuc

SEQ ID NO: 286451 - RNA, 64 nt, Homo Sapiens
uaacuaccucugauccucuuugaccuuccauuacauaccuaauccuagcugucuccucaucuca

SEQ ID NO: 286452 - RNA, 64 nt, Homo Sapiens
cauaacccaacgcucauucaacaucaaagaauuuauaccuaagagaacuuauuuggguguagua

SEQ ID NO: 286453 - RNA, 64 nt, Homo Sapiens
acagauguuggcucaaguucagggccaccaucauauaccuaacaagaguucaugauucuuuagg

SEQ ID NO: 286454 - RNA, 64 nt, Homo Sapiens
cugcuaguugguuauaggcggugggaggaauaauauaccuaauugguuauagguggggggagca

SEQ ID NO: 286455 - RNA, 64 nt, Homo Sapiens
gggggaagacagccaauagcacccauuaaaagaaauaccuaaauaaaaccucucucccacucag

SEQ ID NO: 286456 - RNA, 64 nt, Homo Sapiens
aaagugcaucagugaagagagcuucugacuaucaauaccuaaagaugcauaauaaaugcuuugu

SEQ ID NO: 286457 - RNA, 64 nt, Homo Sapiens
ugcauucgguuaggggauauugcaauuuugagggauaccuaauuagcaaacuaggaggagaaug

SEQ ID NO: 286458 - RNA, 64 nt, Homo Sapiens
uauuguuugaugauuuguuucucuaaugaaauaaauaccuaaguaaugugagguuuaccugauu

SEQ ID NO: 286459 - RNA, 64 nt, Homo Sapiens
ccagaguguucaaggcauuuuucuaccuaaaugaauaccuaaaucuugaguaguguacgguaau

SEQ ID NO: 286460 - RNA, 64 nt, Homo Sapiens
uucauuuuagagcacguuuuggucauuuuuaaaaauaccuaaagugccagaccggaaccuauag

SEQ ID NO: 286461 - RNA, 64 nt, Homo Sapiens
gaaaaauugauguuugauguugauagauaugcuuauaccuaauuuuuaguuuuuaaacuauuuu

SEQ ID NO: 286462 - RNA, 64 nt, Homo Sapiens
cagcuugggcuaccuaaacuaaaacacauuuuugauaccuaaauuaaugagcuauagauaaaau

SEQ ID NO: 286463 - RNA, 64 nt, Homo Sapiens
cauuccuccagugcauacugcagugaaaguuuuaauaccuaaguagacaaugaaacaacagaga

SEQ ID NO: 286464 - RNA, 64 nt, Homo Sapiens
ugcuucuuuaacauagagauggauggaauucagaauaccuaagcauacucacuuaaaccaacug

SEQ ID NO: 286465 - RNA, 64 nt, Homo Sapiens
gagauuucaagagauuuaauuaacaagguccaagauaccuaaaaaccuuaaguaagcaacagca

SEQ ID NO: 286466 - RNA, 64 nt, Homo Sapiens
agauuucaauaaaaauccaagcagaauuuguuugauaccuaacaaauauuuuuaucugaagaaa

SEQ ID NO: 286467 - RNA, 64 nt, Homo Sapiens
ucaguauagagaacuuaagaggcuggcuuauguuauaccuaaauuuuuacuuucuuguauacaa

SEQ ID NO: 286468 - RNA, 64 nt, Homo Sapiens
cggaaucacacauguuaucuuaaacccagccaucauaccuaagucuuuugccaaaaccucucau

SEQ ID NO: 286469 - RNA, 64 nt, Homo Sapiens
uggacuuaacucacguaguaaauacugcugaucaauaccuaaucauuccacauuuauugagcuc

SEQ ID NO: 286470 - RNA, 64 nt, Homo Sapiens
guugggguggggcggaguugcugugugucucaguauaccuaaagugguggggagggggcaaucu

SEQ ID NO: 286471 - RNA, 64 nt, Homo Sapiens
gaauaaaaagcuguucugucuguaaauaugauuuauaccuaacuaguacaccccaccucuuccu

SEQ ID NO: 286472 - RNA, 64 nt, Homo Sapiens
auaaagcagcaaagaaauguagaggaaauguggaauaccuaaguaacaguaagccagguucacc

SEQ ID NO: 286473 - RNA, 64 nt, Homo Sapiens
gguauagucucuaggaguuuugaacaaccaaaauauaccuaaaacugauucacuaacacacaga

SEQ ID NO: 286474 - RNA, 64 nt, Homo Sapiens
cugggacagggaggugacagacuuugaaugaauuauaccuaaaugcauauggauggcauuuaaa

SEQ ID NO: 286475 - RNA, 64 nt, Homo Sapiens
uaccaaacaucauagcuuagaaaauguauuuaauauaccuaaccgaaaauaugaucauaaguca

SEQ ID NO: 286476 - RNA, 64 nt, Homo Sapiens
acacauauauucaguucucauagguuugccuuagauaccuaaaugauauaucuagauccauaua

SEQ ID NO: 286477 - RNA, 64 nt, Homo Sapiens
uuaucagcacuuuaugcacguauuauugacauuaauaccuaaucggcgagugcccaucugcccc

SEQ ID NO: 286478 - RNA, 64 nt, Homo Sapiens
gugguccccucuccccucugacuaccuaaaaucaauaccuaaauacagaagccuuggucuaaca

SEQ ID NO: 286479 - RNA, 64 nt, Homo Sapiens
aagugucccuuaauaguguccuucccugaaauaaauaccuaagggaguguaacagucucuggag

SEQ ID NO: 286480 - RNA, 64 nt, Homo Sapiens
guagcuugagaagcaaauuggcagguaauauuucauaccuaaauuaagacucugacuuggauug

SEQ ID NO: 286481 - RNA, 64 nt, Homo Sapiens
cugcaaaaucagaugucagcauaagcgauggauaauaccuaauaaacugcccucaguaaaucca

SEQ ID NO: 286482 - RNA, 64 nt, Homo Sapiens
ccagccauuacccagcuaaauaaucuuacucuagauaccuaaaacauaagaucacugccagaga

SEQ ID NO: 286483 - RNA, 64 nt, Homo Sapiens
uugauauuaccacaugaaauauugccagaccaagauaccuaaacucaugaugucuguggugcug

SEQ ID NO: 286484 - RNA, 64 nt, Homo Sapiens
gcccuuucuuccucuagucgaaaaagggugacugauaccuaaaacgcguuccuauuauugaagc

SEQ ID NO: 286485 - RNA, 64 nt, Homo Sapiens
auaagcuauaaaacaauagaucuggugacaagcuauaccuaauuugauauuuuggacaaggagu

SEQ ID NO: 286486 - RNA, 64 nt, Homo Sapiens
uguguccaaagaauuuauagggcuguauuccucaauaccuaauugaaaacucuuuaucuuauga

SEQ ID NO: 286487 - RNA, 64 nt, Homo Sapiens
uaaguauauaucuguaaccaaaaaaaccucacacauaccuaaaaaagacccugucucuuaaaac

SEQ ID NO: 286488 - RNA, 64 nt, Homo Sapiens
ugguucugaugucaucggguggaggugguguucuauaccuaaaggaugaccugcuccagaaaca

SEQ ID NO: 286489 - RNA, 64 nt, Homo Sapiens
ugccuuuacuacuucuuuauguaauagaaguuauauaccuaagcuuauauaauacauggggagg

SEQ ID NO: 286490 - RNA, 64 nt, Homo Sapiens
uaccuacugugucuuggaaucuagccgauggaaaauaccuaauuguggaugaugauugcgcagg

SEQ ID NO: 286491 - RNA, 64 nt, Homo Sapiens
ccaggcuauaaauauccuuucaaaucauguucuuauaccuaauuuuagucuuucaaaugaaugu

SEQ ID NO: 286492 - RNA, 64 nt, Homo Sapiens
agccuagcucuacagcaaucauccugaaauaagcauaccuaauuucaagcaauuguuguauuuu

SEQ ID NO: 286493 - RNA, 64 nt, Homo Sapiens
auauugccuguuuugugaauacugacacauguccauaccuaaaacacuccugagucaaguccca

SEQ ID NO: 286494 - RNA, 64 nt, Homo Sapiens
auauuguguguuuacuaacacacuuaauguuuauauaccuaauauuuauuaugccauaucugaa

SEQ ID NO: 286495 - RNA, 64 nt, Homo Sapiens
aguacauuguuaccucuauaaauuuauuauuaacauaccuaagaauggcaaccauuauaaccuu

SEQ ID NO: 286496 - RNA, 64 nt, Homo Sapiens
gcaggagcaagccccucacaugaugaaccugcuuauaccuaagggccaaacucacaaauuggag

SEQ ID NO: 286497 - RNA, 64 nt, Homo Sapiens
auuuuuuccaugagaagcaccagagaaaaggccaauaccuaagcaaaaggaaaaauaugguuuc

SEQ ID NO: 286498 - RNA, 64 nt, Homo Sapiens
auauaggauugcauuuaauauaucaucaacuucuauaccuaagaccauggcaaguagaaaggua

SEQ ID NO: 286499 - RNA, 64 nt, Homo Sapiens
aauuugugucuuaaauauuggcuguccugagcccauaccuaaugcaaguauuaaauaagagcaa

SEQ ID NO: 286500 - RNA, 64 nt, Homo Sapiens
auugucaaaaacagucaauagguaaaauuuucuaauaccuaaaauaauaguuauuaggcauuua

SEQ ID NO: 286501 - RNA, 64 nt, Homo Sapiens
cuuuuaaugugggauauuuuaaggugaggugaauauaccuaaaauguggugagaagguugggga

SEQ ID NO: 286502 - RNA, 64 nt, Homo Sapiens
cauggacuguaucuuaucuaccacuauaucccaaauaccuaagauagugcuuacguucagugac

SEQ ID NO: 286503 - RNA, 64 nt, Homo Sapiens
gaucaaaucaccauuuaaggggauggcauucuuuauaccuaaacaccuaagagcugaagucagg

SEQ ID NO: 286504 - RNA, 64 nt, Homo Sapiens
auuuuaucauauaagcaaguaauaccuauuagucauaccuaaauuuuucagcacuucauucaau

SEQ ID NO: 286505 - RNA, 64 nt, Homo Sapiens
auuaguuaggaaugacuuauacguuuuguuuugaauaccuaagagauacuuuuuggauauuuau

SEQ ID NO: 286506 - RNA, 64 nt, Homo Sapiens
acugcauaaaccuagauauaccauuaucccuuuuauaccuaagaagggcaugcuaauaauuacc

SEQ ID NO: 286507 - RNA, 64 nt, Homo Sapiens
uucaacaaauguuauuuuuguagagaaaagaaagauaccuaaccauccugugaaagauuccaca

SEQ ID NO: 286508 - RNA, 64 nt, Homo Sapiens
uuucugucuuggggcuuuuggaaaaagaaacugaauaccuaagauuugaacuagcaaugccugu

SEQ ID NO: 286509 - RNA, 64 nt, Homo Sapiens
cacauugaacuucuaagagaauuaauugauaaucauaccuaaagcugaauaauguaauuaugca

SEQ ID NO: 286510 - RNA, 64 nt, Homo Sapiens
auauauauauauauauaugagcuugcccagauacauaccuaaaugggccuccuccugggccuca

SEQ ID NO: 286511 - RNA, 64 nt, Homo Sapiens
uguuaaccauauaguuuuuguccuugcuuguuauauaccuaaaaauuuuuucucauccuugcau

SEQ ID NO: 286512 - RNA, 64 nt, Homo Sapiens
aaguauugguuuuaguaagaaugaaaaaauaugcauaccuaaugaaguaugugaaaagaaaauu

SEQ ID NO: 286513 - RNA, 64 nt, Homo Sapiens
acuaauuuaaacacauaucaaaggcagaaaaggcauaccuaaggaagggugagcaacagaacaa

SEQ ID NO: 286514 - RNA, 64 nt, Homo Sapiens
uuuuacaucaauccuuuuaaaguuucucccagacauaccuaaauggaaguccuagggugguuuc

SEQ ID NO: 286515 - RNA, 64 nt, Homo Sapiens
uaugaguuuuauuaauauuuaccucuuauugacaauaccuaaauuuaaauaaugcagcaauauc

SEQ ID NO: 286516 - RNA, 64 nt, Homo Sapiens
ccugagccuccuuugggaagucaccaacagccagauaccuaaucugguucauagaccaccugug

SEQ ID NO: 286517 - RNA, 64 nt, Homo Sapiens
aggaagaaaauucuauuguuauuaaauguuuagaauaccuaaacuuuuagucaaaagucaguuu

SEQ ID NO: 286518 - RNA, 64 nt, Homo Sapiens
auaugaccuauuuaucugaaguuuauaauuguuuauaccuaauacaguucuuuuuggaguaaga

SEQ ID NO: 286519 - RNA, 64 nt, Homo Sapiens
auucuaaacaauacaguggaugacccuuuugaauauaccuaaugauuuccuuaaaaaagaaauu

SEQ ID NO: 286520 - RNA, 64 nt, Homo Sapiens
uguuguuuaggcuaacagugaggucuggauuuuuauaccuaaguaauuuguaguaaauuagcag

SEQ ID NO: 286521 - RNA, 64 nt, Homo Sapiens
ucauaguuguacaauaugaaaauuacgucgcuuaauaccuaauaugguucacuaguagagaaag

SEQ ID NO: 286522 - RNA, 64 nt, Homo Sapiens
acaggacuuaaaauauagauaaaagacuuauaaaauaccuaacuauguguagaauauauuuaau

SEQ ID NO: 286523 - RNA, 64 nt, Homo Sapiens
guaaauaaauguauguauagcuucuaagaagcguauaccuaacuccuaauuugcuauuuaaagg

SEQ ID NO: 286524 - RNA, 64 nt, Homo Sapiens
guauuuaauuuuuguuuauuaacuauguaacuaaauaccuaauguuuacuuacauaggcuaaaa

SEQ ID NO: 286525 - RNA, 64 nt, Homo Sapiens
uuugagaacagcaagcccuaaugcuuuugccauuauaccuaauuaacuuuagauauggauauua

SEQ ID NO: 286526 - RNA, 64 nt, Homo Sapiens
uucuugcaauaaaugcaaaaguguauugucaaacauaccuaacuccaguauguacuucaaaaau

SEQ ID NO: 286527 - RNA, 64 nt, Homo Sapiens
aagaaaaugccuuaauauaaacugacucaguugaauaccuaauuugcugagaccucagcguuuc

SEQ ID NO: 286528 - RNA, 64 nt, Homo Sapiens
ucacacaaauuccaauugagaagcauucuuuaaaauaccuaaccaguacuucucaaaacuauca

SEQ ID NO: 286529 - RNA, 64 nt, Homo Sapiens
gcaauuauagugggacaucuuucauuuguuaaaaauaccuaagauuuucugugaauuaugacua

SEQ ID NO: 286530 - RNA, 64 nt, Homo Sapiens
guuuuuuuaaacuaugggagauauauaaaauaauauaccuaaguuuauauaucugauauauauu

SEQ ID NO: 286531 - RNA, 64 nt, Homo Sapiens
gaugacagaagcauagcccuaggaguagccuuaaauaccuaaaaagcucaaaguagcuagcuaa

SEQ ID NO: 286532 - RNA, 64 nt, Homo Sapiens
cccaccuguggcaucacugaaaauaaauuugaucauaccuaagagguuaggaaauggugccauu

SEQ ID NO: 286533 - RNA, 64 nt, Homo Sapiens
gaggaggcaguaaaugaaguuacaggcuagcacaauaccuaacucauguuucccaguacaccug

SEQ ID NO: 286534 - RNA, 64 nt, Homo Sapiens
aguaaguuagcguuaaauggaaguaaauauauguauaccuaagagaaugucaaaauaaacacca

SEQ ID NO: 286535 - RNA, 64 nt, Homo Sapiens
uaaguuuucuuuguguaauauguaaaguuuuuugauaccuaaugaaaaaaacaaauguacagau

SEQ ID NO: 286536 - RNA, 64 nt, Homo Sapiens
uacaauuucuccugaguuaacuuuugugaaaauaauaccuaagguuuucuggcuuauugaggaa

SEQ ID NO: 286537 - RNA, 64 nt, Homo Sapiens
ccaaacuggugcaugacaaguacuguauuuuuuuauaccuaaauaaagaaaaaucuuuagccug

SEQ ID NO: 286538 - RNA, 64 nt, Homo Sapiens
agagcauugaccagaaaaauggcuuuuauguaugauaccuaaucaagauuuaaacuaauaugcu

SEQ ID NO: 286539 - RNA, 64 nt, Homo Sapiens
gcaaaacuaaacaaagaaagauguccguguauaaauaccuaaaauauaguuacaacuuguaagc

SEQ ID NO: 286540 - RNA, 64 nt, Homo Sapiens
ucuccagccccgccguggguggcaagcuguguucauaccuaaauuuucuggaaggggacaguga

SEQ ID NO: 286541 - RNA, 64 nt, Homo Sapiens
uuuucauacuucaguugguuuuggaaucugccuuauaccuaauauuuauuuauucacacucaua

SEQ ID NO: 286542 - RNA, 64 nt, Homo Sapiens
ggcucaaaggaacguauucuugaaggugacggaaauaccuaaaaacuccuaaaggugcagagca

SEQ ID NO: 286543 - RNA, 64 nt, Homo Sapiens
ggugggcuccuuauuuggggacuggucaccaaaaauaccuaacuaugguuggaagcuuagugcu

SEQ ID NO: 286544 - RNA, 63 nt, Homo Sapiens
ccuucuguuaguugucuggugaguaaaaagaaauauaccuaaaugugaacuuuuuuuuuuuaa

SEQ ID NO: 286545 - RNA, 64 nt, Homo Sapiens
accaaaacugugaggaagguuuuccuugagcuaaauaccuaauauuaaaguagaaagucagcau

SEQ ID NO: 286546 - RNA, 64 nt, Homo Sapiens
cacucuaacuuaagaguuuuuacuuuauguagugauaccuaauacaauuuugaaaauacaauag

SEQ ID NO: 286547 - RNA, 64 nt, Homo Sapiens
cagaauuaaaggagggaauuguauugauacuccaauaccuaaauuucacaauaccacuuaggaa

SEQ ID NO: 286548 - RNA, 64 nt, Homo Sapiens
uuucugaagaugcuuuuuggaaagcucugaaucuauaccuaaugcucuuaauuauuggcuuguu

SEQ ID NO: 286549 - RNA, 64 nt, Homo Sapiens
ugcuguggaaucuugaguuuuucuauaaguaaguauaccuaacauguugggaaucuauuuccua

SEQ ID NO: 286550 - RNA, 64 nt, Homo Sapiens
guaacuuuagcuuuauggaauuuacugaagguuuauaccuaaauuuaugguugcuguugccaua

SEQ ID NO: 286551 - RNA, 64 nt, Homo Sapiens
guaauucugucuuuccuaaaauucagaacauuuuauaccuaaaaaagcacuauagaauuugcaa

SEQ ID NO: 286552 - RNA, 64 nt, Homo Sapiens
uguuauggagguugauugaucagcaguauuugauauaccuaacuuuuuugcuggauggguuuua

SEQ ID NO: 286553 - RNA, 64 nt, Homo Sapiens
ucaucauuucugaaaauguagcagggagaucuuaauaccuaauucaacaaaggaauugaaacag

SEQ ID NO: 286554 - RNA, 64 nt, Homo Sapiens
ccuucuuauguuucuaaauuuuugaauuuaggugauaccuaaauaaccuagaaacacacauuuc

SEQ ID NO: 286555 - RNA, 64 nt, Homo Sapiens; identical to SEQ ID NO: 286554

SEQ ID NO: 286556 - RNA, 64 nt, Homo Sapiens
uucuuuuuuuuuuuuuuuuuuuccaaagguaaggauaccuaacaagaaugcaguauaacaccac

SEQ ID NO: 286557 - RNA, 64 nt, Homo Sapiens
uuguuuaaauucuagauguaagcaauuagagaccauaccuaauaaugacaucaccaacagucaa

SEQ ID NO: 286558 - RNA, 64 nt, Homo Sapiens
acauaauuagagggcuuugaaaugaucuacugaaauaccuaaauugauagaaauuaaucauacu

SEQ ID NO: 286559 - RNA, 64 nt, Homo Sapiens
uccaacaagccucaaagucccuugagacuccccaauaccuaauaaggcaugcgaaauguucuca

SEQ ID NO: 286560 - RNA, 64 nt, Homo Sapiens
auagcauucaacccagcaucccauuacuggguguauaccuaaaggaauauaaucauuccaccau

SEQ ID NO: 286561 - RNA, 64 nt, Homo Sapiens
ccuuccaugguccucacugauuguuuucuuugucauaccuaaucuguugaguuugugcagugag

SEQ ID NO: 286562 - RNA, 64 nt, Homo Sapiens
ccuaaaguggaacaguaagaacacauauguauguauaccuaacuauauauauauacauauauau

SEQ ID NO: 286563 - RNA, 64 nt, Homo Sapiens
ccacagaugcuguguuccuucagacccccuaagcauaccuaaaucauaugcaggggauugguuc

SEQ ID NO: 286564 - RNA, 64 nt, Homo Sapiens
ccacacaugccaaguuucuuagcagucccugaucauaccuaaauauaugcaggggauuaauucc

SEQ ID NO: 286565 - RNA, 64 nt, Homo Sapiens
cccagauaggaccaaacucuaagacccccaguggauaccuaaaauucugcaagagauggacucu

SEQ ID NO: 286566 - RNA, 64 nt, Homo Sapiens
uaccccaguguggguguggguggcuaaguaaaccauaccuaacccuccugcccccgggggccug

SEQ ID NO: 286567 - RNA, 64 nt, Homo Sapiens
uuauaaaaaauggccuggagugacacauuuuauuauaccuaauauucacugcaucaguaucaca

SEQ ID NO: 286568 - RNA, 64 nt, Homo Sapiens
aauagugauaacuuguuaauaauaguaaaccuuuauaccuaaaguaaaugucuucccucccaca

SEQ ID NO: 286569 - RNA, 64 nt, Homo Sapiens
aggguugguuuguagauucaaauaauccagaaauauaccuaauaagauugagugaaaaauuuga

SEQ ID NO: 286570 - RNA, 64 nt, Homo Sapiens
gagauucagagcuaucgcucauuuccuacacuucauaccuaaagaaguuugcugcagaaauaca

SEQ ID NO: 286571 - RNA, 64 nt, Homo Sapiens
caauauauuuaauuuuuaaucccuuuuaaaaaauauaccuaauauauuaauauuuuuuacuuug

SEQ ID NO: 286572 - RNA, 64 nt, Homo Sapiens
agaaaucauguuuauuuaaauauugaagggaaaaauaccuaaaaauguacaaagguuuuauauu

SEQ ID NO: 286573 - RNA, 64 nt, Homo Sapiens
gaaaaauauuauaucuaauuaugucuaugugguaauaccuaaaaagagguagagagacucuaug

SEQ ID NO: 286574 - RNA, 64 nt, Homo Sapiens
guuccaacaaagucccuuuuacucagaccaaauuauaccuaaaaacuuuaauuucuaggcuaua

SEQ ID NO: 286575 - RNA, 64 nt, Homo Sapiens
gcacuuuuauugagaaugagaaaaauacacagguauaccuaaagcaguagugaaugcagaaaau

SEQ ID NO: 286576 - RNA, 64 nt, Homo Sapiens
aagagcgacugcagugggucuccgugucuaucaaauaccuaaggaguccccaggagcuggcugg

SEQ ID NO: 286577 - RNA, 64 nt, Homo Sapiens
uauugaggggauaagaggaugucaaaaaaguuaaauaccuaaguagaaaaaaauauagaaauaa

SEQ ID NO: 286578 - RNA, 64 nt, Homo Sapiens
auauaccaguucaaguccuuuuaggaagaagaaaauaccuaauuuauguaaaauuuaaauaauu

SEQ ID NO: 286579 - RNA, 64 nt, Homo Sapiens
cuuucugcugugucuucacaucacccuccucuguauaccuaaucugccucugccucuguuuaau

SEQ ID NO: 286580 - RNA, 64 nt, Homo Sapiens
uuuuaggucuagccuauguggauuuuuuccuaacauaccuaagcaaacccagugucaggauggu

SEQ ID NO: 286581 - RNA, 64 nt, Homo Sapiens
accacucgguccaaccuagacaaccaagaccgcuauaccuaaagaccucuauauccuggugccu

SEQ ID NO: 286582 - RNA, 64 nt, Homo Sapiens
guaugaaaguagauucuauuuuguaaugcugauaauaccuaaagaugcauugaaugcuuggaag

SEQ ID NO: 286583 - RNA, 64 nt, Homo Sapiens
aaggguaggaugaauauuucgcuuugaugauguaauaccuaauauauuuucauugccacaaagu

SEQ ID NO: 286584 - RNA, 64 nt, Homo Sapiens
uuaauaauaucuaugaaauccucgggcucuuggaauaccuaauugaaggcuuugauucaucagu

SEQ ID NO: 286585 - RNA, 64 nt, Homo Sapiens
agagauagcucaucuuugccgguaaauuaauuguauaccuaaacaaaagggauauuguauccau

SEQ ID NO: 286586 - RNA, 64 nt, Homo Sapiens
gguuuuucuccgugaaucuuggcaagagggccagauaccuaacagguaaaaucaauagauuuca

SEQ ID NO: 286587 - RNA, 64 nt, Homo Sapiens
uauaaucguuugcuucuccaagugaagcucagaaauaccuaaaaauagcuguaacguucgcguu

SEQ ID NO: 286588 - RNA, 64 nt, Homo Sapiens; identical to SEQ ID NO: 170380

SEQ ID NO: 286589 - RNA, 64 nt, Homo Sapiens; identical to SEQ ID NO: 170381

SEQ ID NO: 286590 - RNA, 64 nt, Homo Sapiens; identical to SEQ ID NO: 170382

SEQ ID NO: 286591 - RNA, 64 nt, Homo Sapiens; identical to SEQ ID NO: 170383

SEQ ID NO: 286592 - RNA, 64 nt, Homo Sapiens; identical to SEQ ID NO: 170384

SEQ ID NO: 286593 - RNA, 64 nt, Homo Sapiens; identical to SEQ ID NO: 170385

SEQ ID NO: 286594 - RNA, 64 nt, Homo Sapiens; identical to SEQ ID NO: 170386

SEQ ID NO: 286595 - RNA, 64 nt, Homo Sapiens; identical to SEQ ID NO: 170387

SEQ ID NO: 286596 - RNA, 64 nt, Homo Sapiens; identical to SEQ ID NO: 170388

SEQ ID NO: 286597 - RNA, 64 nt, Homo Sapiens; identical to SEQ ID NO: 170389

SEQ ID NO: 286598 - RNA, 64 nt, Homo Sapiens; identical to SEQ ID NO: 170390

SEQ ID NO: 286599 - RNA, 64 nt, Homo Sapiens; identical to SEQ ID NO: 170391

SEQ ID NO: 286600 - RNA, 64 nt, Homo Sapiens; identical to SEQ ID NO: 170392

SEQ ID NO: 286601 - RNA, 64 nt, Homo Sapiens; identical to SEQ ID NO: 170393

SEQ ID NO: 286602 - RNA, 64 nt, Homo Sapiens; identical to SEQ ID NO: 170394

SEQ ID NO: 286603 - RNA, 64 nt, Homo Sapiens; identical to SEQ ID NO: 170395

SEQ ID NO: 286604 - RNA, 64 nt, Homo Sapiens; identical to SEQ ID NO: 170396

SEQ ID NO: 286605 - RNA, 64 nt, Homo Sapiens; identical to SEQ ID NO: 170397

SEQ ID NO: 286606 - RNA, 64 nt, Homo Sapiens; identical to SEQ ID NO: 170398

SEQ ID NO: 286607 - RNA, 64 nt, Homo Sapiens; identical to SEQ ID NO: 170399

SEQ ID NO: 286608 - RNA, 64 nt, Homo Sapiens; identical to SEQ ID NO: 170400

SEQ ID NO: 286609 - RNA, 64 nt, Homo Sapiens; identical to SEQ ID NO: 170401

SEQ ID NO: 286610 - RNA, 64 nt, Homo Sapiens; identical to SEQ ID NO: 170402

SEQ ID NO: 286611 - RNA, 64 nt, Homo Sapiens; identical to SEQ ID NO: 170403

SEQ ID NO: 286612 - RNA, 64 nt, Homo Sapiens; identical to SEQ ID NO: 170404

SEQ ID NO: 286613 - RNA, 64 nt, Homo Sapiens; identical to SEQ ID NO: 170405

SEQ ID NO: 286614 - RNA, 64 nt, Homo Sapiens; identical to SEQ ID NO: 170406

SEQ ID NO: 286615 - RNA, 64 nt, Homo Sapiens; identical to SEQ ID NO: 170407

SEQ ID NO: 286616 - RNA, 64 nt, Homo Sapiens; identical to SEQ ID NO: 170408

SEQ ID NO: 286617 - RNA, 64 nt, Homo Sapiens; identical to SEQ ID NO: 170409

SEQ ID NO: 286618 - RNA, 64 nt, Homo Sapiens; identical to SEQ ID NO: 170410

SEQ ID NO: 286619 - RNA, 64 nt, Homo Sapiens; identical to SEQ ID NO: 170411

SEQ ID NO: 286620 - RNA, 64 nt, Homo Sapiens; identical to SEQ ID NO: 170412

SEQ ID NO: 286621 - RNA, 64 nt, Homo Sapiens; identical to SEQ ID NO: 170413

SEQ ID NO: 286622 - RNA, 64 nt, Homo Sapiens; identical to SEQ ID NO: 170414

SEQ ID NO: 286623 - RNA, 64 nt, Homo Sapiens
uacaaccccaaaucuacuacauggucugcaaaaguuacuccauagaaugaucaaaguucagaaa

SEQ ID NO: 286624 - RNA, 64 nt, Homo Sapiens
agaucaccuuacuuaauuggccaggccagaaguauuacuccacuugacugguuuuauuuuucuc

SEQ ID NO: 286625 - RNA, 64 nt, Homo Sapiens
ggguaaaugguugacugaguagaucugcuaaaacuuacuccacucuuacuaguguguaugagca

SEQ ID NO: 286626 - RNA, 64 nt, Homo Sapiens
ccucccuuuuuauuucuugaagucaucuuaucuauuacuccaaauuaggaagagugaguauugg

SEQ ID NO: 286627 - RNA, 64 nt, Homo Sapiens
uggggucaggggccagagugaaauugccaaagagugggaacaggucaucucuuccuuuguugau

SEQ ID NO: 286628 - RNA, 64 nt, Homo Sapiens
ggccugggccuccccguuugcauucacagggucuugggaacaaaguuuuugggggaacagggag

SEQ ID NO: 286629 - RNA, 64 nt, Homo Sapiens
uaagagcaaucaaccauauaaaucaaguaccuauugggaacagacauaacauucaauuuuucau

SEQ ID NO: 286630 - RNA, 64 nt, Homo Sapiens
caccugccagagaaacacaggcucagaggaugccugggaacagggaggaugggauuaguggaag

SEQ ID NO: 286631 - RNA, 64 nt, Homo Sapiens
ggcuggggccuuccuccagggaaggaggcuggggugggaacacuggccucccccagaauaaaac

SEQ ID NO: 286632 - RNA, 64 nt, Homo Sapiens
uuucuugguaaagagccuuuaccacagcaaggaaugggaacauuuccccaucagcaacggggcu

SEQ ID NO: 286633 - RNA, 64 nt, Homo Sapiens
caaacuaggagggguuauugcaucccucagccuaugggaacaccccccaaggguacaggagggg

SEQ ID NO: 286634 - RNA, 64 nt, Homo Sapiens
gccuuuuuaacacacguaagccaccgcacccaguugggaacaaagcugggauuauaggugugag

SEQ ID NO: 286635 - RNA, 64 nt, Homo Sapiens
uagaugugggugugucucaguggggcccccaggcugggaacacacucggaagaucccgugugug

SEQ ID NO: 286636 - RNA, 64 nt, Homo Sapiens
aaggcuugggaaccauuugcauccaggaguuagaugggaacaagugucacuccuggucaccugg

SEQ ID NO: 286637 - RNA, 64 nt, Homo Sapiens
uagaacugauggaggcuuuuaugagcuuauauuuugggaacacauugccugaccucguuaucac

SEQ ID NO: 286638 - RNA, 64 nt, Homo Sapiens
auuguauuguauuaaaauucgagccuaggaaauuugggaacauguauugagacuguauuguuau

SEQ ID NO: 286639 - RNA, 64 nt, Homo Sapiens
ucuggcugcacaggcugaaaaaagcagagccuccugggaacacacaggccuuacaucuggcugg

SEQ ID NO: 286640 - RNA, 64 nt, Homo Sapiens
guucugggcaaagaggauccgcucgucagccaccugggaacacagcagggcuggcacgugacag

SEQ ID NO: 286641 - RNA, 64 nt, Homo Sapiens
gagcaguauguugaguagaaugugccgggcuggcugggaacaagugcccuguguccaugguggg

SEQ ID NO: 286642 - RNA, 64 nt, Homo Sapiens
caccagugcuccagcuccucuguuuucagauuccugggaacagaucuggagauagauggagaag

SEQ ID NO: 286643 - RNA, 64 nt, Homo Sapiens
uccacucuagugcugggagccagcgcucccuuacugggaacaggauuccaggaccccuuucuug

SEQ ID NO: 286644 - RNA, 64 nt, Homo Sapiens
ugcaggcuaggaaguggccuagugcaagaugagcugggaacaagggaggagagagcaggagcug

SEQ ID NO: 286645 - RNA, 64 nt, Homo Sapiens
ccugccuuuuguguaaugcgaucuuuaauuuuucugggaacacauuuguacuucuuguaagacc

SEQ ID NO: 286646 - RNA, 64 nt, Homo Sapiens
ggacuacuuuggggcuuucuuauucuuugggcucugggaacagggucuuguucucccaucuguu

SEQ ID NO: 286647 - RNA, 64 nt, Homo Sapiens
agaaguuugauggcuuugccguucuaauaggagaugggaacacgccuccccaguuuaccacuuu

SEQ ID NO: 286648 - RNA, 64 nt, Homo Sapiens; identical to SEQ ID NO: 90763

SEQ ID NO: 286649 - RNA, 64 nt, Homo Sapiens; identical to SEQ ID NO: 90764

SEQ ID NO: 286650 - RNA, 64 nt, Homo Sapiens; identical to SEQ ID NO: 90765

SEQ ID NO: 286651 - RNA, 64 nt, Homo Sapiens; identical to SEQ ID NO: 90766

SEQ ID NO: 286652 - RNA, 64 nt, Homo Sapiens; identical to SEQ ID NO: 90767

SEQ ID NO: 286653 - RNA, 64 nt, Homo Sapiens; identical to SEQ ID NO: 90768

SEQ ID NO: 286654 - RNA, 64 nt, Homo Sapiens; identical to SEQ ID NO: 90769

SEQ ID NO: 286655 - RNA, 64 nt, Homo Sapiens; identical to SEQ ID NO: 90770

SEQ ID NO: 286656 - RNA, 64 nt, Homo Sapiens; identical to SEQ ID NO: 90771

SEQ ID NO: 286657 - RNA, 64 nt, Homo Sapiens; identical to SEQ ID NO: 90772

SEQ ID NO: 286658 - RNA, 64 nt, Homo Sapiens; identical to SEQ ID NO: 90773

SEQ ID NO: 286659 - RNA, 64 nt, Homo Sapiens; identical to SEQ ID NO: 90774

SEQ ID NO: 286660 - RNA, 64 nt, Homo Sapiens; identical to SEQ ID NO: 90775

SEQ ID NO: 286661 - RNA, 64 nt, Homo Sapiens; identical to SEQ ID NO: 90776

SEQ ID NO: 286662 - RNA, 64 nt, Homo Sapiens; identical to SEQ ID NO: 90777

SEQ ID NO: 286663 - RNA, 64 nt, Homo Sapiens; identical to SEQ ID NO: 90778

SEQ ID NO: 286664 - RNA, 64 nt, Homo Sapiens; identical to SEQ ID NO: 90779

SEQ ID NO: 286665 - RNA, 64 nt, Homo Sapiens; identical to SEQ ID NO: 90780

SEQ ID NO: 286666 - RNA, 64 nt, Homo Sapiens; identical to SEQ ID NO: 90781

SEQ ID NO: 286667 - RNA, 64 nt, Homo Sapiens; identical to SEQ ID NO: 90782

SEQ ID NO: 286668 - RNA, 64 nt, Homo Sapiens; identical to SEQ ID NO: 90783

SEQ ID NO: 286669 - RNA, 64 nt, Homo Sapiens; identical to SEQ ID NO: 90784

SEQ ID NO: 286670 - RNA, 64 nt, Homo Sapiens; identical to SEQ ID NO: 90785

SEQ ID NO: 286671 - RNA, 64 nt, Homo Sapiens; identical to SEQ ID NO: 90786

SEQ ID NO: 286672 - RNA, 64 nt, Homo Sapiens; identical to SEQ ID NO: 90787

SEQ ID NO: 286673 - RNA, 64 nt, Homo Sapiens; identical to SEQ ID NO: 90788

SEQ ID NO: 286674 - RNA, 64 nt, Homo Sapiens; identical to SEQ ID NO: 90789

SEQ ID NO: 286675 - RNA, 64 nt, Homo Sapiens; identical to SEQ ID NO: 90790

SEQ ID NO: 286676 - RNA, 64 nt, Homo Sapiens; identical to SEQ ID NO: 90791

SEQ ID NO: 286677 - RNA, 64 nt, Homo Sapiens; identical to SEQ ID NO: 90792

SEQ ID NO: 286678 - RNA, 64 nt, Homo Sapiens; identical to SEQ ID NO: 90793

SEQ ID NO: 286679 - RNA, 64 nt, Homo Sapiens; identical to SEQ ID NO: 90794

SEQ ID NO: 286680 - RNA, 64 nt, Homo Sapiens; identical to SEQ ID NO: 90795

SEQ ID NO: 286681 - RNA, 64 nt, Homo Sapiens; identical to SEQ ID NO: 90796

SEQ ID NO: 286682 - RNA, 64 nt, Homo Sapiens; identical to SEQ ID NO: 90797

SEQ ID NO: 286683 - RNA, 64 nt, Homo Sapiens; identical to SEQ ID NO: 90798

SEQ ID NO: 286684 - RNA, 64 nt, Homo Sapiens; identical to SEQ ID NO: 90799

SEQ ID NO: 286685 - RNA, 64 nt, Homo Sapiens; identical to SEQ ID NO: 90800

SEQ ID NO: 286686 - RNA, 64 nt, Homo Sapiens; identical to SEQ ID NO: 90801

SEQ ID NO: 286687 - RNA, 64 nt, Homo Sapiens; identical to SEQ ID NO: 90802

SEQ ID NO: 286688 - RNA, 64 nt, Homo Sapiens; identical to SEQ ID NO: 90803

SEQ ID NO: 286689 - RNA, 64 nt, Homo Sapiens; identical to SEQ ID NO: 90804

SEQ ID NO: 286690 - RNA, 64 nt, Homo Sapiens; identical to SEQ ID NO: 90805

SEQ ID NO: 286691 - RNA, 64 nt, Homo Sapiens; identical to SEQ ID NO: 90806

SEQ ID NO: 286692 - RNA, 64 nt, Homo Sapiens; identical to SEQ ID NO: 90807

SEQ ID NO: 286693 - RNA, 64 nt, Homo Sapiens; identical to SEQ ID NO: 90808

SEQ ID NO: 286694 - RNA, 64 nt, Homo Sapiens; identical to SEQ ID NO: 90809

SEQ ID NO: 286695 - RNA, 64 nt, Homo Sapiens; identical to SEQ ID NO: 90810

SEQ ID NO: 286696 - RNA, 64 nt, Homo Sapiens; identical to SEQ ID NO: 90811

SEQ ID NO: 286697 - RNA, 64 nt, Homo Sapiens; identical to SEQ ID NO: 90812

SEQ ID NO: 286698 - RNA, 64 nt, Homo Sapiens; identical to SEQ ID NO: 90813

SEQ ID NO: 286699 - RNA, 64 nt, Homo Sapiens; identical to SEQ ID NO: 90814

SEQ ID NO: 286700 - RNA, 64 nt, Homo Sapiens; identical to SEQ ID NO: 90815

SEQ ID NO: 286701 - RNA, 64 nt, Homo Sapiens; identical to SEQ ID NO: 90816

SEQ ID NO: 286702 - RNA, 64 nt, Homo Sapiens; identical to SEQ ID NO: 90817

SEQ ID NO: 286703 - RNA, 64 nt, Homo Sapiens; identical to SEQ ID NO: 90818

SEQ ID NO: 286704 - RNA, 64 nt, Homo Sapiens; identical to SEQ ID NO: 90819

SEQ ID NO: 286705 - RNA, 64 nt, Homo Sapiens; identical to SEQ ID NO: 90820

SEQ ID NO: 286706 - RNA, 64 nt, Homo Sapiens; identical to SEQ ID NO: 90821

SEQ ID NO: 286707 - RNA, 64 nt, Homo Sapiens; identical to SEQ ID NO: 90822

SEQ ID NO: 286708 - RNA, 64 nt, Homo Sapiens; identical to SEQ ID NO: 90823

SEQ ID NO: 286709 - RNA, 64 nt, Homo Sapiens; identical to SEQ ID NO: 90824

SEQ ID NO: 286710 - RNA, 64 nt, Homo Sapiens; identical to SEQ ID NO: 90825

SEQ ID NO: 286711 - RNA, 64 nt, Homo Sapiens; identical to SEQ ID NO: 90826

SEQ ID NO: 286712 - RNA, 64 nt, Homo Sapiens; identical to SEQ ID NO: 90827

SEQ ID NO: 286713 - RNA, 64 nt, Homo Sapiens; identical to SEQ ID NO: 90828

SEQ ID NO: 286714 - RNA, 64 nt, Homo Sapiens; identical to SEQ ID NO: 90829

SEQ ID NO: 286715 - RNA, 64 nt, Homo Sapiens; identical to SEQ ID NO: 90830

SEQ ID NO: 286716 - RNA, 64 nt, Homo Sapiens; identical to SEQ ID NO: 90831

SEQ ID NO: 286717 - RNA, 64 nt, Homo Sapiens; identical to SEQ ID NO: 90832

SEQ ID NO: 286718 - RNA, 64 nt, Homo Sapiens; identical to SEQ ID NO: 90833

SEQ ID NO: 286719 - RNA, 64 nt, Homo Sapiens; identical to SEQ ID NO: 90834

SEQ ID NO: 286720 - RNA, 64 nt, Homo Sapiens; identical to SEQ ID NO: 90835

SEQ ID NO: 286721 - RNA, 64 nt, Homo Sapiens; identical to SEQ ID NO: 90836

SEQ ID NO: 286722 - RNA, 64 nt, Homo Sapiens; identical to SEQ ID NO: 90837

SEQ ID NO: 286723 - RNA, 64 nt, Homo Sapiens; identical to SEQ ID NO: 90838

SEQ ID NO: 286724 - RNA, 64 nt, Homo Sapiens; identical to SEQ ID NO: 90839

SEQ ID NO: 286725 - RNA, 64 nt, Homo Sapiens; identical to SEQ ID NO: 90840

SEQ ID NO: 286726 - RNA, 64 nt, Homo Sapiens; identical to SEQ ID NO: 90841

SEQ ID NO: 286727 - RNA, 64 nt, Homo Sapiens; identical to SEQ ID NO: 90842

SEQ ID NO: 286728 - RNA, 64 nt, Homo Sapiens; identical to SEQ ID NO: 90843

SEQ ID NO: 286729 - RNA, 64 nt, Homo Sapiens; identical to SEQ ID NO: 90844

SEQ ID NO: 286730 - RNA, 64 nt, Homo Sapiens; identical to SEQ ID NO: 90845

SEQ ID NO: 286731 - RNA, 64 nt, Homo Sapiens; identical to SEQ ID NO: 90846

SEQ ID NO: 286732 - RNA, 64 nt, Homo Sapiens; identical to SEQ ID NO: 90847

SEQ ID NO: 286733 - RNA, 64 nt, Homo Sapiens; identical to SEQ ID NO: 90848

SEQ ID NO: 286734 - RNA, 64 nt, Homo Sapiens; identical to SEQ ID NO: 90849

SEQ ID NO: 286735 - RNA, 64 nt, Homo Sapiens; identical to SEQ ID NO: 90850

SEQ ID NO: 286736 - RNA, 64 nt, Homo Sapiens; identical to SEQ ID NO: 90851

SEQ ID NO: 286737 - RNA, 64 nt, Homo Sapiens; identical to SEQ ID NO: 90852

SEQ ID NO: 286738 - RNA, 64 nt, Homo Sapiens; identical to SEQ ID NO: 90853

SEQ ID NO: 286739 - RNA, 64 nt, Homo Sapiens; identical to SEQ ID NO: 90854

SEQ ID NO: 286740 - RNA, 64 nt, Homo Sapiens; identical to SEQ ID NO: 90855

SEQ ID NO: 286741 - RNA, 64 nt, Homo Sapiens; identical to SEQ ID NO: 90856

SEQ ID NO: 286742 - RNA, 64 nt, Homo Sapiens; identical to SEQ ID NO: 90857

SEQ ID NO: 286743 - RNA, 64 nt, Homo Sapiens; identical to SEQ ID NO: 90858

SEQ ID NO: 286744 - RNA, 64 nt, Homo Sapiens; identical to SEQ ID NO: 90859

SEQ ID NO: 286745 - RNA, 64 nt, Homo Sapiens; identical to SEQ ID NO: 90860

SEQ ID NO: 286746 - RNA, 64 nt, Homo Sapiens; identical to SEQ ID NO: 90861

SEQ ID NO: 286747 - RNA, 64 nt, Homo Sapiens; identical to SEQ ID NO: 90862

SEQ ID NO: 286748 - RNA, 64 nt, Homo Sapiens; identical to SEQ ID NO: 90863

SEQ ID NO: 286749 - RNA, 64 nt, Homo Sapiens; identical to SEQ ID NO: 90864

SEQ ID NO: 286750 - RNA, 64 nt, Homo Sapiens; identical to SEQ ID NO: 90865

SEQ ID NO: 286751 - RNA, 64 nt, Homo Sapiens; identical to SEQ ID NO: 90866

SEQ ID NO: 286752 - RNA, 64 nt, Homo Sapiens; identical to SEQ ID NO: 90867

SEQ ID NO: 286753 - RNA, 64 nt, Homo Sapiens; identical to SEQ ID NO: 90868

SEQ ID NO: 286754 - RNA, 64 nt, Homo Sapiens; identical to SEQ ID NO: 90869

SEQ ID NO: 286755 - RNA, 64 nt, Homo Sapiens; identical to SEQ ID NO: 90870

SEQ ID NO: 286756 - RNA, 64 nt, Homo Sapiens; identical to SEQ ID NO: 90871

SEQ ID NO: 286757 - RNA, 64 nt, Homo Sapiens; identical to SEQ ID NO: 90872

SEQ ID NO: 286758 - RNA, 64 nt, Homo Sapiens; identical to SEQ ID NO: 90873

SEQ ID NO: 286759 - RNA, 64 nt, Homo Sapiens; identical to SEQ ID NO: 90874

SEQ ID NO: 286760 - RNA, 64 nt, Homo Sapiens; identical to SEQ ID NO: 90875

SEQ ID NO: 286761 - RNA, 64 nt, Homo Sapiens; identical to SEQ ID NO: 90876

SEQ ID NO: 286762 - RNA, 64 nt, Homo Sapiens; identical to SEQ ID NO: 90877

SEQ ID NO: 286763 - RNA, 64 nt, Homo Sapiens; identical to SEQ ID NO: 90878

SEQ ID NO: 286764 - RNA, 64 nt, Homo Sapiens; identical to SEQ ID NO: 90879

SEQ ID NO: 286765 - RNA, 64 nt, Homo Sapiens; identical to SEQ ID NO: 90880

SEQ ID NO: 286766 - RNA, 64 nt, Homo Sapiens; identical to SEQ ID NO: 90881

SEQ ID NO: 286767 - RNA, 64 nt, Homo Sapiens; identical to SEQ ID NO: 90882

SEQ ID NO: 286768 - RNA, 64 nt, Homo Sapiens; identical to SEQ ID NO: 90883

SEQ ID NO: 286769 - RNA, 64 nt, Homo Sapiens; identical to SEQ ID NO: 90884

SEQ ID NO: 286770 - RNA, 64 nt, Homo Sapiens; identical to SEQ ID NO: 90885

SEQ ID NO: 286771 - RNA, 64 nt, Homo Sapiens; identical to SEQ ID NO: 90886

SEQ ID NO: 286772 - RNA, 64 nt, Homo Sapiens; identical to SEQ ID NO: 90887

SEQ ID NO: 286773 - RNA, 64 nt, Homo Sapiens; identical to SEQ ID NO: 90888

SEQ ID NO: 286774 - RNA, 64 nt, Homo Sapiens; identical to SEQ ID NO: 90889

SEQ ID NO: 286775 - RNA, 64 nt, Homo Sapiens; identical to SEQ ID NO: 90890

SEQ ID NO: 286776 - RNA, 64 nt, Homo Sapiens; identical to SEQ ID NO: 90891

SEQ ID NO: 286777 - RNA, 64 nt, Homo Sapiens; identical to SEQ ID NO: 90892

SEQ ID NO: 286778 - RNA, 64 nt, Homo Sapiens; identical to SEQ ID NO: 90893

SEQ ID NO: 286779 - RNA, 64 nt, Homo Sapiens; identical to SEQ ID NO: 90894

SEQ ID NO: 286780 - RNA, 64 nt, Homo Sapiens; identical to SEQ ID NO: 90895

SEQ ID NO: 286781 - RNA, 64 nt, Homo Sapiens; identical to SEQ ID NO: 90896

SEQ ID NO: 286782 - RNA, 64 nt, Homo Sapiens; identical to SEQ ID NO: 90897

SEQ ID NO: 286783 - RNA, 64 nt, Homo Sapiens; identical to SEQ ID NO: 90898

SEQ ID NO: 286784 - RNA, 64 nt, Homo Sapiens; identical to SEQ ID NO: 90899

SEQ ID NO: 286785 - RNA, 54 nt, Homo Sapiens; identical to SEQ ID NO: 90900

SEQ ID NO: 286786 - RNA, 64 nt, Homo Sapiens; identical to SEQ ID NO: 90901

SEQ ID NO: 286787 - RNA, 64 nt, Homo Sapiens; identical to SEQ ID NO: 90902

SEQ ID NO: 286788 - RNA, 64 nt, Homo Sapiens; identical to SEQ ID NO: 90903

SEQ ID NO: 286789 - RNA, 64 nt, Homo Sapiens; identical to SEQ ID NO: 90904

SEQ ID NO: 286790 - RNA, 64 nt, Homo Sapiens; identical to SEQ ID NO: 90905

SEQ ID NO: 286791 - RNA, 64 nt, Homo Sapiens; identical to SEQ ID NO: 90906

SEQ ID NO: 286792 - RNA, 64 nt, Homo Sapiens; identical to SEQ ID NO: 90907

SEQ ID NO: 286793 - RNA, 64 nt, Homo Sapiens; identical to SEQ ID NO: 90908

SEQ ID NO: 286794 - RNA, 64 nt, Homo Sapiens; identical to SEQ ID NO: 90909

SEQ ID NO: 286795 - RNA, 64 nt, Homo Sapiens; identical to SEQ ID NO: 90910

SEQ ID NO: 286796 - RNA, 64 nt, Homo Sapiens; identical to SEQ ID NO: 90911

SEQ ID NO: 286797 - RNA, 64 nt, Homo Sapiens; identical to SEQ ID NO: 90912

SEQ ID NO: 286798 - RNA, 64 nt, Homo Sapiens; identical to SEQ ID NO: 90913

SEQ ID NO: 286799 - RNA, 64 nt, Homo Sapiens; identical to SEQ ID NO: 90914

SEQ ID NO: 286800 - RNA, 64 nt, Homo Sapiens; identical to SEQ ID NO: 90915

SEQ ID NO: 286801 - RNA, 64 nt, Homo Sapiens; identical to SEQ ID NO: 90916

SEQ ID NO: 286802 - RNA, 64 nt, Homo Sapiens; identical to SEQ ID NO: 90917

SEQ ID NO: 286803 - RNA, 64 nt, Homo Sapiens; identical to SEQ ID NO: 90918

SEQ ID NO: 286804 - RNA, 64 nt, Homo Sapiens; identical to SEQ ID NO: 90919

SEQ ID NO: 286805 - RNA, 64 nt, Homo Sapiens; identical to SEQ ID NO: 90920

SEQ ID NO: 286806 - RNA, 64 nt, Homo Sapiens; identical to SEQ ID NO: 90921

SEQ ID NO: 286807 - RNA, 64 nt, Homo Sapiens; identical to SEQ ID NO: 90922

SEQ ID NO: 286808 - RNA, 64 nt, Homo Sapiens; identical to SEQ ID NO: 90923

SEQ ID NO: 286809 - RNA, 64 nt, Homo Sapiens; identical to SEQ ID NO: 90924

SEQ ID NO: 286810 - RNA, 64 nt, Homo Sapiens; identical to SEQ ID NO: 90925

SEQ ID NO: 286811 - RNA, 64 nt, Homo Sapiens; identical to SEQ ID NO: 90926

SEQ ID NO: 286812 - RNA, 64 nt, Homo Sapiens; identical to SEQ ID NO: 90927

SEQ ID NO: 286813 - RNA, 64 nt, Homo Sapiens; identical to SEQ ID NO: 90928

SEQ ID NO: 286814 - RNA, 64 nt, Homo Sapiens; identical to SEQ ID NO: 90929

SEQ ID NO: 286815 - RNA, 64 nt, Homo Sapiens; identical to SEQ ID NO: 90811

SEQ ID NO: 286816 - RNA, 64 nt, Homo Sapiens; identical to SEQ ID NO: 90931

SEQ ID NO: 286817 - RNA, 64 nt, Homo Sapiens; identical to SEQ ID NO: 90932

SEQ ID NO: 286818 - RNA, 64 nt, Homo Sapiens; identical to SEQ ID NO: 90933

SEQ ID NO: 286819 - RNA, 64 nt, Homo Sapiens; identical to SEQ ID NO: 90934

SEQ ID NO: 286820 - RNA, 64 nt, Homo Sapiens; identical to SEQ ID NO: 90935

SEQ ID NO: 286821 - RNA, 64 nt, Homo Sapiens; identical to SEQ ID NO: 90936

SEQ ID NO: 286822 - RNA, 64 nt, Homo Sapiens; identical to SEQ ID NO: 90937

SEQ ID NO: 286823 - RNA, 64 nt, Homo Sapiens; identical to SEQ ID NO: 90938

SEQ ID NO: 286824 - RNA, 64 nt, Homo Sapiens; identical to SEQ ID NO: 90939

SEQ ID NO: 286825 - RNA, 64 nt, Homo Sapiens; identical to SEQ ID NO: 90940

SEQ ID NO: 286826 - RNA, 64 nt, Homo Sapiens; identical to SEQ ID NO: 90941

SEQ ID NO: 286827 - RNA, 64 nt, Homo Sapiens; identical to SEQ ID NO: 90942

SEQ ID NO: 286828 - RNA, 64 nt, Homo Sapiens; identical to SEQ ID NO: 90943

SEQ ID NO: 286829 - RNA, 64 nt, Homo Sapiens; identical to SEQ ID NO: 90944

SEQ ID NO: 286830 - RNA, 64 nt, Homo Sapiens; identical to SEQ ID NO: 90945

SEQ ID NO: 286831 - RNA, 64 nt, Homo Sapiens; identical to SEQ ID NO: 90946

SEQ ID NO: 286832 - RNA, 64 nt, Homo Sapiens; identical to SEQ ID NO: 90947

SEQ ID NO: 286833 - RNA, 64 nt, Homo Sapiens; identical to SEQ ID NO: 90948

SEQ ID NO: 286834 - RNA, 64 nt, Homo Sapiens; identical to SEQ ID NO: 90949

SEQ ID NO: 286835 - RNA, 64 nt, Homo Sapiens; identical to SEQ ID NO: 90950

SEQ ID NO: 286836 - RNA, 64 nt, Homo Sapiens; identical to SEQ ID NO: 90951

SEQ ID NO: 286837 - RNA, 64 nt, Homo Sapiens; identical to SEQ ID NO: 90952

SEQ ID NO: 286838 - RNA, 64 nt, Homo Sapiens; identical to SEQ ID NO: 90953

SEQ ID NO: 286839 - RNA, 64 nt, Homo Sapiens; identical to SEQ ID NO: 90954

SEQ ID NO: 286840 - RNA, 64 nt, Homo Sapiens; identical to SEQ ID NO: 90955

SEQ ID NO: 286841 - RNA, 64 nt, Homo Sapiens; identical to SEQ ID NO: 90956

SEQ ID NO: 286842 - RNA, 64 nt, Homo Sapiens; identical to SEQ ID NO: 90957

SEQ ID NO: 286843 - RNA, 64 nt, Homo Sapiens; identical to SEQ ID NO: 90958

SEQ ID NO: 286844 - RNA, 64 nt, Homo Sapiens; identical to SEQ ID NO: 90959

SEQ ID NO: 286845 - RNA, 64 nt, Homo Sapiens; identical to SEQ ID NO: 90960

SEQ ID NO: 286846 - RNA, 64 nt, Homo Sapiens; identical to SEQ ID NO: 90961

SEQ ID NO: 286847 - RNA, 64 nt, Homo Sapiens; identical to SEQ ID NO: 90962

SEQ ID NO: 286848 - RNA, 64 nt, Homo Sapiens; identical to SEQ ID NO: 90963

SEQ ID NO: 286849 - RNA, 64 nt, Homo Sapiens; identical to SEQ ID NO: 90964

SEQ ID NO: 286850 - RNA, 64 nt, Homo Sapiens; identical to SEQ ID NO: 90965

SEQ ID NO: 286851 - RNA, 64 nt, Homo Sapiens; identical to SEQ ID NO: 90966

SEQ ID NO: 286852 - RNA, 64 nt, Homo Sapiens; identical to SEQ ID NO: 90967

SEQ ID NO: 286853 - RNA, 64 nt, Homo Sapiens; identical to SEQ ID NO: 90968

SEQ ID NO: 286854 - RNA, 64 nt, Homo Sapiens; identical to SEQ ID NO: 90969

SEQ ID NO: 286855 - RNA, 64 nt, Homo Sapiens; identical to SEQ ID NO: 90970

SEQ ID NO: 286856 - RNA, 64 nt, Homo Sapiens; identical to SEQ ID NO: 90971

SEQ ID NO: 286857 - RNA, 64 nt, Homo Sapiens; identical to SEQ ID NO: 90972

SEQ ID NO: 286858 - RNA, 64 nt, Homo Sapiens; identical to SEQ ID NO: 90973

SEQ ID NO: 286859 - RNA, 64 nt, Homo Sapiens; identical to SEQ ID NO: 90974

SEQ ID NO: 286860 - RNA, 64 nt, Homo Sapiens; identical to SEQ ID NO: 90975

SEQ ID NO: 286861 - RNA, 64 nt, Homo Sapiens; identical to SEQ ID NO: 90976

SEQ ID NO: 286862 - RNA, 64 nt, Homo Sapiens; identical to SEQ ID NO: 90977

SEQ ID NO: 286863 - RNA, 64 nt, Homo Sapiens; identical to SEQ ID NO: 90978

SEQ ID NO: 286864 - RNA, 64 nt, Homo Sapiens; identical to SEQ ID NO: 90979

SEQ ID NO: 286865 - RNA, 64 nt, Homo Sapiens; identical to SEQ ID NO: 90980

SEQ ID NO: 286866 - RNA, 64 nt, Homo Sapiens; identical to SEQ ID NO: 90981

SEQ ID NO: 286867 - RNA, 64 nt, Homo Sapiens; identical to SEQ ID NO: 90982

SEQ ID NO: 286868 - RNA, 64 nt, Homo Sapiens; identical to SEQ ID NO: 90983

SEQ ID NO: 286869 - RNA, 64 nt, Homo Sapiens; identical to SEQ ID NO: 90984

SEQ ID NO: 286870 - RNA, 64 nt, Homo Sapiens; identical to SEQ ID NO: 90985

SEQ ID NO: 286871 - RNA, 64 nt, Homo Sapiens; identical to SEQ ID NO: 90986

SEQ ID NO: 286872 - RNA, 64 nt, Homo Sapiens; identical to SEQ ID NO: 90987

SEQ ID NO: 286873 - RNA, 64 nt, Homo Sapiens; identical to SEQ ID NO: 90988

SEQ ID NO: 286874 - RNA, 64 nt, Homo Sapiens; identical to SEQ ID NO: 90989

SEQ ID NO: 286875 - RNA, 64 nt, Homo Sapiens; identical to SEQ ID NO: 90990

SEQ ID NO: 286876 - RNA, 64 nt, Homo Sapiens; identical to SEQ ID NO: 90991

SEQ ID NO: 286877 - RNA, 64 nt, Homo Sapiens; identical to SEQ ID NO: 90992

SEQ ID NO: 286878 - RNA, 64 nt, Homo Sapiens; identical to SEQ ID NO: 90993

SEQ ID NO: 286879 - RNA, 64 nt, Homo Sapiens; identical to SEQ ID NO: 90994

SEQ ID NO: 286880 - RNA, 64 nt, Homo Sapiens; identical to SEQ ID NO: 90995

SEQ ID NO: 286881 - RNA, 64 nt, Homo Sapiens; identical to SEQ ID NO: 90996

SEQ ID NO: 286882 - RNA, 64 nt, Homo Sapiens; identical to SEQ ID NO: 90997

SEQ ID NO: 286883 - RNA, 64 nt, Homo Sapiens; identical to SEQ ID NO: 90998

SEQ ID NO: 286884 - RNA, 64 nt, Homo Sapiens; identical to SEQ ID NO: 90999

SEQ ID NO: 286885 - RNA, 64 nt, Homo Sapiens; identical to SEQ ID NO: 91000

SEQ ID NO: 286886 - RNA, 64 nt, Homo Sapiens; identical to SEQ ID NO: 91001

SEQ ID NO: 286887 - RNA, 64 nt, Homo Sapiens; identical to SEQ ID NO: 91002

SEQ ID NO: 286888 - RNA, 64 nt, Homo Sapiens; identical to SEQ ID NO: 91003

SEQ ID NO: 286889 - RNA, 64 nt, Homo Sapiens; identical to SEQ ID NO: 91004

SEQ ID NO: 286890 - RNA, 64 nt, Homo Sapiens; identical to SEQ ID NO: 91005

SEQ ID NO: 286891 - RNA, 64 nt, Homo Sapiens; identical to SEQ ID NO: 91006

SEQ ID NO: 286892 - RNA, 64 nt, Homo Sapiens; identical to SEQ ID NO: 91007

SEQ ID NO: 286893 - RNA, 64 nt, Homo Sapiens; identical to SEQ ID NO: 91008

SEQ ID NO: 286894 - RNA, 64 nt, Homo Sapiens; identical to SEQ ID NO: 91009

SEQ ID NO: 286895 - RNA, 64 nt, Homo Sapiens; identical to SEQ ID NO: 91010

SEQ ID NO: 286896 - RNA, 64 nt, Homo Sapiens; identical to SEQ ID NO: 91011

SEQ ID NO: 286897 - RNA, 64 nt, Homo Sapiens; identical to SEQ ID NO: 91012

SEQ ID NO: 286898 - RNA, 64 nt, Homo Sapiens; identical to SEQ ID NO: 91013

SEQ ID NO: 286899 - RNA, 64 nt, Homo Sapiens; identical to SEQ ID NO: 91014

SEQ ID NO: 286900 - RNA, 64 nt, Homo Sapiens; identical to SEQ ID NO: 91015

SEQ ID NO: 286901 - RNA, 64 nt, Homo Sapiens; identical to SEQ ID NO: 91016

SEQ ID NO: 286902 - RNA, 64 nt, Homo Sapiens; identical to SEQ ID NO: 91017

SEQ ID NO: 286903 - RNA, 64 nt, Homo Sapiens; identical to SEQ ID NO: 91018

SEQ ID NO: 286904 - RNA, 64 nt, Homo Sapiens; identical to SEQ ID NO: 91019

SEQ ID NO: 286905 - RNA, 64 nt, Homo Sapiens; identical to SEQ ID NO: 91020

SEQ ID NO: 286906 - RNA, 64 nt, Homo Sapiens; identical to SEQ ID NO: 91021

SEQ ID NO: 286907 - RNA, 64 nt, Homo Sapiens; identical to SEQ ID NO: 91022

SEQ ID NO: 286908 - RNA, 64 nt, Homo Sapiens; identical to SEQ ID NO: 91023

SEQ ID NO: 286909 - RNA, 64 nt, Homo Sapiens; identical to SEQ ID NO: 91024

SEQ ID NO: 286910 - RNA, 64 nt, Homo Sapiens; identical to SEQ ID NO: 91025

SEQ ID NO: 286911 - RNA, 64 nt, Homo Sapiens; identical to SEQ ID NO: 91026

SEQ ID NO: 286912 - RNA, 64 nt, Homo Sapiens; identical to SEQ ID NO: 91027

SEQ ID NO: 286913 - RNA, 64 nt, Homo Sapiens; identical to SEQ ID NO: 91028

SEQ ID NO: 286914 - RNA, 64 nt, Homo Sapiens; identical to SEQ ID NO: 91029

SEQ ID NO: 286915 - RNA, 64 nt, Homo Sapiens
cagcgagggucuccuucgccuucaaccuccuagugucuguuagcaucuuccuuuucaugggggg

SEQ ID NO: 286916 - RNA, 64 nt, Homo Sapiens
uguaagcauguuuaccuguuggcuugcuuugugugucuguuaaaugaaugucauauguaaaugc

SEQ ID NO: 286917 - RNA, 61 nt, Homo Sapiens
aaacagaaccaccuggcuagacccuaggaagccaggagaggaucagguuccaaaggggaau

SEQ ID NO: 286918 - RNA, 64 nt, Homo Sapiens
acucgggaggcugagacaggagaaucgcuugaacccaggagauggagauugcaguaggccaaga

SEQ ID NO: 286919 - RNA, 64 nt, Homo Sapiens
cccaagcagaauuagcaacaggaaaagcagagccccaggagagacacucuacuauauauacucu

SEQ ID NO: 286920 - RNA, 64 nt, Homo Sapiens
caauacaugugcagggguugcugcuuucccagugccaggagaacccccgcuccgagucagccug

SEQ ID NO: 286921 - RNA, 64 nt, Homo Sapiens
ccgagucagccugugugggucaugaggcuggggcccaggagacacggucccaggcacugcacag

SEQ ID NO: 286922 - RNA, 64 nt, Homo Sapiens
gucccuggaaaagaaagaauaaguggauucucccccaggagaauccuuuuugcaaagauaggca

SEQ ID NO: 286923 - RNA, 64 nt, Homo Sapiens
cugcaagccuugaagccuccagcaacgucuaucuccaggagagcagggcagccuaugcaagugu

SEQ ID NO: 286924 - RNA, 64 nt, Homo Sapiens
cauuuggaaagggcaugauaucauucacaaaaagccaggagaagucuccuuuaucgucauuaag

SEQ ID NO: 286925 - RNA, 64 nt, Homo Sapiens
aagaacaaacaaacuacggaccagaugauugagcccaggagagguucccugcagugaggcuugu

SEQ ID NO: 286926 - RNA, 64 nt, Homo Sapiens
ccugggcaucucccaccugucaucuauccaggcuccaggagaccugguggccgguagaauucuc

SEQ ID NO: 286927 - RNA, 64 nt, Homo Sapiens
auuuaaguguauuguaucauuaccaugagcuccuccaggagauuaaucaacacuguucucucug

SEQ ID NO: 286928 - RNA, 64 nt, Homo Sapiens
aaaguguggaggccucggggcuuggaggcagggcccaggagaaccucugaguucugugcugucu

SEQ ID NO: 286929 - RNA, 64 nt, Homo Sapiens
gacugacugugacccucugcgguggggagcugggccaggagaggagaguaucgcccugggaugu

SEQ ID NO: 286930 - RNA, 64 nt, Homo Sapiens
agagagcacuuucuucccaggaacauagccaagaccaggagaaggaggugguucaaauccucug

SEQ ID NO: 286931 - RNA, 64 nt, Homo Sapiens
gaggucuuccugggcccucauuuaggaugggcccccaggagacucuuugcugcccuugccaucu

SEQ ID NO: 286932 - RNA, 64 nt, Homo Sapiens
aauuuggggccuaggaaccgggcuugccacagccccaggagaggcaagggaggugccaacacug

SEQ ID NO: 286933 - RNA, 64 nt, Homo Sapiens
caggcuuugcugaggugcugcccaaccugacaguccaggagauggacuggcuggugcuggggga

SEQ ID NO: 286934 - RNA, 64 nt, Homo Sapiens
cagagacuugccagggcugccaaggagccgggacccaggagagggugagcuggaagggugcgug

SEQ ID NO: 286935 - RNA, 64 nt, Homo Sapiens
uggauguuuugcgugcaacaccagaaccacuccuccaggagagcgaggaccgguugcagcuuac

SEQ ID NO: 286936 - RNA, 64 nt, Homo Sapiens
uccccccuugaggcagagagcccacaccagaccuccaggagacagcccacuucccacugcucag

SEQ ID NO: 286937 - RNA, 64 nt, Homo Sapiens
aucagccucuccugggagcaaaagguuuaaacacccaggagaccacccaaagggaugcucugcc

SEQ ID NO: 286938 - RNA, 64 nt, Homo Sapiens
agagaaauuuccagaccauccccucucaccacagccaggagaggccuuucccaccgguagagaa

SEQ ID NO: 286939 - RNA, 64 nt, Homo Sapiens
gagagaaacuuccagaccagcccucucacuacagccaggagaggccuuucccgccuggaaacuu

SEQ ID NO: 286940 - RNA, 64 nt, Homo Sapiens
ggaaacuuccggacaagccucucacacaccacagccaggagaggccuuucccaccuggacagaa

SEQ ID NO: 286941 - RNA, 64 nt, Homo Sapiens
acagaaacuuccagaccagccccucucaccacagccaggagaggccuuuaccaccuggagagaa

SEQ ID NO: 286942 - RNA, 64 nt, Homo Sapiens
agagaagcuuccagaccagccccucacaccacagccaggagaggccuuucccaccuggagagaa

SEQ ID NO: 286943 - RNA, 64 nt, Homo Sapiens
agagaaacuuccagaccagccccucacaccaccgccaggagaggccuuucccaccgggagagaa

SEQ ID NO: 286944 - RNA, 64 nt, Homo Sapiens
agagaaacuuccagaccagccccucacaccacagccaggagaggccuuucccaccgggagagaa

SEQ ID NO: 286945 - RNA, 64 nt, Homo Sapiens
agaggaacuuccagaccagccccucacaccacagccaggagaggccuuucccgccuggagagaa

SEQ ID NO: 286946 - RNA, 64 nt, Homo Sapiens
gagagaagcuucaggccagcuccucacaccacagccaggagagaccuuuucugccuggagagaa

SEQ ID NO: 286947 - RNA, 64 nt, Homo Sapiens
agagaaacuuucagaccagccccacacaccacagccaggagaggccguuccugccuggagagaa

SEQ ID NO: 286948 - RNA, 64 nt, Homo Sapiens
agagaagcuuccagaccagcccuucacaccacagccaggagaggccuuucccaccuggagagaa

SEQ ID NO: 286949 - RNA, 64 nt, Homo Sapiens
agagaaacuuccagaccagccccucucaccacagccaggagaggccguucccaccuggagggaa

SEQ ID NO: 286950 - RNA, 64 nt, Homo Sapiens
gggacagguucuguugggggugucaggggugacaccaggagagacaggagagagggacagguuc

SEQ ID NO: 286951 - RNA, 64 nt, Homo Sapiens
gggacagguucugucaggggugucgggggugacaccaggagagagaggagacagggacagguuc

SEQ ID NO: 286952 - RNA, 64 nt, Homo Sapiens
gggacagguucuguuggggguaucaugggugacaccaggagagagaggacacagggacagguuc

SEQ ID NO: 286953 - RNA, 64 nt, Homo Sapiens
gggacagguucugucagggggcacaaccugcaaaccaggagagaguauuugugaauaacaaacu

SEQ ID NO: 286954 - RNA, 64 nt, Homo Sapiens
acccuucuccacucagcucccagacaugcgggagccaggagagcagcggcccucaggcuuuucu

SEQ ID NO: 286955 - RNA, 64 nt, Homo Sapiens
guucauucaacucuugcuuuucacaaaauaguaaccaggagauguuuaaugugccugauuuaau

SEQ ID NO: 286956 - RNA, 64 nt, Homo Sapiens
uguuucuccuugacacauuucucaauccacgaagccaggagagguagagugaaaaucccagcca

SEQ ID NO: 286957 - RNA, 64 nt, Homo Sapiens
acuuuucugucuucacagcuuuggggaauuuuggccaggagacccugaaacaugaaaccaaaca

SEQ ID NO: 286958 - RNA, 64 nt, Homo Sapiens
ugccuuaccuuuacccguccuugagaacagcgguccaggagaaucaggcagucuguggccuccu

SEQ ID NO: 286959 - RNA, 64 nt, Homo Sapiens
aggguuaggugugcccagccgugaccugcagucaccaggagauggcacuccugaagaagggagu

SEQ ID NO: 286960 - RNA, 64 nt, Homo Sapiens
gccuggggcucuugcuucccugguugguccccuaccaggagaggcaguacccagcaagugggga

SEQ ID NO: 286961 - RNA, 64 nt, Homo Sapiens
uccugacagggaugcucaugcccagaaagcaagcccaggagaggaaggcagagugugacagagc

SEQ ID NO: 286962 - RNA, 64 nt, Homo Sapiens
agagugugacagagcagagccagggccaggcgcaccaggagaggcguuucuggggcuccagaga

SEQ ID NO: 286963 - RNA, 64 nt, Homo Sapiens
ggaaggccaggguggaagggcggcuugagggacgccaggagaagacugaaugccaggcuaggaa

SEQ ID NO: 286964 - RNA, 64 nt, Homo Sapiens
uacccuauggccacagcaggaggucagcccagggccaggagacacauggcuggacaaggcuuug

SEQ ID NO: 286965 - RNA, 64 nt, Homo Sapiens
cacaacaaccucgucaucauccccacuuuaaaccccaggagacugaaacucaaacaacccuggg

SEQ ID NO: 286966 - RNA, 64 nt, Homo Sapiens
gagcucugaccuuucucuuggccccuuguacaccccaggagagaaguucucaaucccagcaguu

SEQ ID NO: 286967 - RNA, 64 nt, Homo Sapiens
gcaccccacagcccucacauccccuggccuggacccaggagacccaggagaaagcacccucccu

SEQ ID NO: 286968 - RNA, 64 nt, Homo Sapiens
agcccucacauccccuggccuggacccaggagacccaggagaaagcacccucccuuaggaauga

SEQ ID NO: 286969 - RNA, 64 nt, Homo Sapiens
uucagugccugggugcucaggcuuugcccaggugccaggagaaggugugagcaugagccuauug

SEQ ID NO: 286970 - RNA, 64 nt, Homo Sapiens
aguccugcagagccucugggcugggcuggugcccccaggagauggagggccugguggaugcccu

SEQ ID NO: 286971 - RNA, 64 nt, Homo Sapiens
gcacccuucuggaccaaagcgccaaggacugcagccaggagagagggggcucaccucuuauccu

SEQ ID NO: 286972 - RNA, 64 nt, Homo Sapiens
cgcaggccgggaagcagugcccgccaggccugggccaggagagcuccaggaagggcacugagcg

SEQ ID NO: 286973 - RNA, 64 nt, Homo Sapiens
aagaccauccugacuaacaagaucgugugcgaggccaggagaucaauagugugauuagaacacu

SEQ ID NO: 286974 - RNA, 64 nt, Homo Sapiens
ggagggacuggccccugggagaaagcaagguuccccaggagaggguguaaaguauguugguggu

SEQ ID NO: 286975 - RNA, 64 nt, Homo Sapiens
agucgugagguccuucugaauguaaaacuggagcccaggagaagcugucccaggagggcuguua

SEQ ID NO: 286976 - RNA, 64 nt, Homo Sapiens
gcugucccaggagggcuguuaacucccuauagagccaggagacaggauagggguuucuaggguc

SEQ ID NO: 286977 - RNA, 64 nt, Homo Sapiens
cgccugccaccuccuccucaccucaguccccaccccaggagaggcaugguacugucuccacagc

SEQ ID NO: 286978 - RNA, 64 nt, Homo Sapiens
ggccgacccuccucgggaacccccuccacucugcccaggagaggcacacacuccacgagagcag

SEQ ID NO: 286979 - RNA, 64 nt, Homo Sapiens
gaugcccaucgcgaguacagagaugagccaggguccaggagacaacaacacggggagcagcaag

SEQ ID NO: 286980 - RNA, 64 nt, Homo Sapiens
gcuacugacuuguuaucaucaguccuuagaacccccaggagagauuccauaggacauuucacac

SEQ ID NO: 286981 - RNA, 64 nt, Homo Sapiens
gccuucucucuccagccaucuggaauauuuugagccaggagagcguucguuuauuacuuaccau

SEQ ID NO: 286982 - RNA, 64 nt, Homo Sapiens
acugucuccucgcuggccuggccucaaguacauuccaggagaccaggaccggggguggagagga

SEQ ID NO: 286983 - RNA, 64 nt, Homo Sapiens
cacuuacauucuggugccuuaagggauuuugggcccaggagaaagaaacgacgguacccaggag

SEQ ID NO: 286984 - RNA, 64 nt, Homo Sapiens
ggauuuugggcccaggagaaagaaacgacgguacccaggagaagcuauggcugagccuggagcc

SEQ ID NO: 286985 - RNA, 64 nt, Homo Sapiens
uauuuccagcagcuggcaccuguugcaaccccauccaggagacaccuccacggcuguguacgcc

SEQ ID NO: 286986 - RNA, 64 nt, Homo Sapiens
gugauugggagaggguaaggugcucggucaagugccaggagauuuuaacuucauauugugagac

SEQ ID NO: 286987 - RNA, 64 nt, Homo Sapiens
cagggcccagcacccagguuccuaacccuuggcuccaggagacaagagugacagcugcucaggc

SEQ ID NO: 286988 - RNA, 64 nt, Homo Sapiens
aggcuggacagaggagaaggccagcagcaaagccccaggagaacccacccgccccauccaggcu

SEQ ID NO: 286989 - RNA, 64 nt, Homo Sapiens
uggccagagggccucagggagcugcaaaacucauccaggagaaaaaggcaggagcagcaaguga

SEQ ID NO: 286990 - RNA, 64 nt, Homo Sapiens
agacucccauccucucuucccccucaccaagugcccaggagaccccuggcucagaccagcccaa

SEQ ID NO: 286991 - RNA, 64 nt, Homo Sapiens
aaaugccuuaaacugcaacgucccgucccuuccccacccccaucccauccccacccccagcccc

SEQ ID NO: 286992 - RNA, 64 nt, Homo Sapiens
acgucccgucccuuccccacccccaucccauccccacccccagccccagcccaguccuccuagg

SEQ ID NO: 286993 - RNA, 64 nt, Homo Sapiens
ccuaccaagcucgagcuggcccuugacccccacccacccccacccuugcuggcaggggcaggga

SEQ ID NO: 286994 - RNA, 64 nt, Homo Sapiens
uuugggguuuucugugcccaugacuugggggcugcacccccacagcacccccacaauguaggaa

SEQ ID NO: 286995 - RNA, 64 nt, Homo Sapiens
cugugcccaugacuugggggcugcacccccacagcacccccacaauguaggaaaagaccucagg

SEQ ID NO: 286996 - RNA, 64 nt, Homo Sapiens
uugcagaccacgcggggcagggcuccacugaagccacccccaccccucgccagcuagcuccaua

SEQ ID NO: 286997 - RNA, 64 nt, Homo Sapiens
ugccucauggaagccuuugaggguaucacacagacacccccaccuuccuccagccugugcgcac

SEQ ID NO: 286998 - RNA, 64 nt, Homo Sapiens
ccuguugugcccuuuaagagacauguuuccaccccacccccaaccuugucccaagugcccugga

SEQ ID NO: 286999 - RNA, 64 nt, Homo Sapiens
aggagaggggcuugggagcccacuuuuaauuucucacccccauuuuacaaagagugcuuagauu

SEQ ID NO: 287000 - RNA, 64 nt, Homo Sapiens
uccucugcagcuuccuccucagccucccuccuugcacccccacagguuuggcuugugguuuuug

SEQ ID NO: 287001 - RNA, 64 nt, Homo Sapiens
cggcccagccuguccaggauacaguggggcugagcacccccaggccuuccacuccucuacccuc

SEQ ID NO: 287002 - RNA, 64 nt, Homo Sapiens
ucugggcaccagaaggcuccuggaccaugagcuucacccccagaauucccugcugacccugccc

SEQ ID NO: 287003 - RNA, 64 nt, Homo Sapiens
aucacacugcaugggagauuuuguuaacgucugccacccccacucucacccccaagcucuaagc

SEQ ID NO: 287004 - RNA, 64 nt, Homo Sapiens
gggagauuuuguuaacgucugccacccccacucucacccccaagcucuaagcccccgggaggcc

SEQ ID NO: 287005 - RNA, 64 nt, Homo Sapiens
aggaccagguccccaagucccuucacaggguccccacccccacuggcuuuggugcuguccacac

SEQ ID NO: 287006 - RNA, 64 nt, Homo Sapiens
uaccaggcggaggggcugcuuuucugcccuuccucacccccacgccccaccccacucccccaga

SEQ ID NO: 287007 - RNA, 64 nt, Homo Sapiens
uuaucccucuccauaaccccacccuugcccaccccacccccacccccaccaagggcgcaagagu

SEQ ID NO: 287008 - RNA, 64 nt, Homo Sapiens
cucuccauaaccccacccuugcccaccccacccccacccccaccaagggcgcaagaguagcggu

SEQ ID NO: 287009 - RNA, 64 nt, Homo Sapiens
acccucgagcgggguuccccuggaaagugucccccacccccaccacacagauuugagucagaac

SEQ ID NO: 287010 - RNA, 64 nt, Homo Sapiens
ccggcccgggauacugccccgaggcauagguuaccacccccaccugcagccacauccuuguaca

SEQ ID NO: 287011 - RNA, 64 nt, Homo Sapiens
ccugacaaucacccacacucccauggaggugccccacccccacagaagggaggggcaggauggg

SEQ ID NO: 287012 - RNA, 64 nt, Homo Sapiens
gugugugggugcuggcugagucuugugugugcugcacccccaagcgugccacaccugcgcugau

SEQ ID NO: 287013 - RNA, 64 nt, Homo Sapiens
uagagggaaauaaccaaaaagagcccucccaccccacccccagaggugccgagcccugcaugug

SEQ ID NO: 287014 - RNA, 64 nt, Homo Sapiens
uucucuuucccucucaacaguggggucgggggcccacccccagcugggggaccccaugcaggcu

SEQ ID NO: 287015 - RNA, 64 nt, Homo Sapiens
cagugccuuugcuccucuguccugccucuacucccacccccacuaccucugggaaccacagcuc

SEQ ID NO: 287016 - RNA, 64 nt, Homo Sapiens
auccuauuaaacauuuuuaaccacccuaaccccccacccccacccccuccaucucugaccaccc

SEQ ID NO: 287017 - RNA, 64 nt, Homo Sapiens
cuaaccccccacccccaccaccuccaucucugaccacccccacccucauuuucuucccucucuc

SEQ ID NO: 287018 - RNA, 64 nt, Homo Sapiens
aauucuugacacucuuucuauaauuagcguucuucacccccacccccacccccaccccccuuau

SEQ ID NO: 287019 - RNA, 64 nt, Homo Sapiens
ugacacucuuucuauaauuagcguucuucacccccacccccacccccaccccccuuauuuuccu

SEQ ID NO: 287020 - RNA, 64 nt, Homo Sapiens
ucuuucuauaauuagcguucuucacccccacccccacccccaccccccuuauuuuccuuuuguc

SEQ ID NO: 287021 - RNA, 64 nt, Homo Sapiens
acccaucacuucugguguuacauccacauuccuacacccccacagagaccugugucaaaacuua

SEQ ID NO: 287022 - RNA, 64 nt, Homo Sapiens
cacacacacacacacacaugccuaccccaucccccacccccacaacaugagccaaaagcacaua

SEQ ID NO: 287023 - RNA, 64 nt, Homo Sapiens
cccgaaugccucccugggaggcacacugauugcccacccccaccacugcaccauuuccaggagg

SEQ ID NO: 287024 - RNA, 64 nt, Homo Sapiens
ucaucguuccccugagcacugggggacagacccucacccccacccuggggguguggcaccucca

SEQ ID NO: 287025 - RNA, 64 nt, Homo Sapiens
cucucagcuccagguggcucugaggugccugucccacccccacccccagcucaauggacuggaa

SEQ ID NO: 287026 - RNA, 64 nt, Homo Sapiens
gcuccagguggcucugaggugccugucccacccccacccccagcucaauggacuggaaggggaa

SEQ ID NO: 287027 - RNA, 64 nt, Homo Sapiens
ccugacaaaaacacguaggggcagggacgguccccacccccagggacacaaccccuggucuugg

SEQ ID NO: 287028 - RNA, 64 nt, Homo Sapiens
caaccugagacagaaccaggcugagccaggccuccacccccacccccguuugcugggggcuccu

SEQ ID NO: 287029 - RNA, 64 nt, Homo Sapiens
acugcucugggagggcccugaggacucccacccucacccccacccccacagggucagcaacugc

SEQ ID NO: 287030 - RNA, 64 nt, Homo Sapiens
cugggagggcccugaggacucccacccucacccccacccccacagggucagcaacugcuuccgg

SEQ ID NO: 287031 - RNA, 64 nt, Homo Sapiens
acucagcugccccuguccccaccucuggagaauccacccccaccagauuccuccgcgggaggug

SEQ ID NO: 287032 - RNA, 64 nt, Homo Sapiens
cgugggaccaugacuuagggaggugggacccacccacccccauccaggaaccgugacguccaag

SEQ ID NO: 287033 - RNA, 64 nt, Homo Sapiens
ugaauaauggcccauucaugaaauggagacaucccacccccaguugaauuugagcacaguccag

SEQ ID NO: 287034 - RNA, 64 nt, Homo Sapiens
cacgucaucugcauuguuaucuccccccaccacccacccccacacucugucucuccuucucucu

SEQ ID NO: 287035 - RNA, 64 nt, Homo Sapiens
uccuagaggccccggaggagcugggccagccgcccacccccacccccagugcagggcuggucuu

SEQ ID NO: 287036 - RNA, 64 nt, Homo Sapiens
aggccccggaggagcugggccagccgcccacccccacccccagugcagggcuggucuuggggag

SEQ ID NO: 287037 - RNA, 64 nt, Homo Sapiens
caaggcugacuucucugaauccucccacacuucccacccccagguaaguuagacucuuccccuc

SEQ ID NO: 287038 - RNA, 64 nt, Homo Sapiens
cacaaaacauucauguaacuugcuccccugagaccacccccaaaccucugccauguuuuucccc

SEQ ID NO: 287039 - RNA, 64 nt, Homo Sapiens
aaacaaaggugccaugaugggcuguucuaacccccacccccacugccagguaagggugucaggg

SEQ ID NO: 287040 - RNA, 64 nt, Homo Sapiens
aguccuuaucaccagccucacaaucccacaggcccacccccagugggccuguggcauucauauu

SEQ ID NO: 287041 - RNA, 64 nt, Homo Sapiens
gaaaagacuagaaaggacauugcuuucucagccccacccccagguccacaguguccaagguaau

SEQ ID NO: 287042 - RNA, 64 nt, Homo Sapiens
guuuuuccccacaccucugaacucagggccuagccacccccaaacuuccaaaucccacuuuugu

SEQ ID NO: 287043 - RNA, 64 nt, Homo Sapiens
uuuccagcccuuuuaugccugugugaucccaccccacccccauaguuguauaaaggucauagug

SEQ ID NO: 287044 - RNA, 64 nt, Homo Sapiens
ccaucugccuucaggucuucuguagcaaaauaagcacccccacccauucaagccccuucuccac

SEQ ID NO: 287045 - RNA, 64 nt, Homo Sapiens
auuccuacacaucuugccagggccccuggcuaugcacccccaccgggccccuggccucgggagc

SEQ ID NO: 287046 - RNA, 64 nt, Homo Sapiens
cuuaccucagggggugccucgaccucaggcaaagcacccccaaaagcagggccgcgcccuuggu

SEQ ID NO: 287047 - RNA, 64 nt, Homo Sapiens
uucaagaguggauguggcccgaccccucccccaacacccccaaacuucugaccaacacacacac

SEQ ID NO: 287048 - RNA, 64 nt, Homo Sapiens
ucuuuccagaacugcuugaagauuggaaaccccccacccccaccucugaagcaaagaggccaaa

SEQ ID NO: 287049 - RNA, 64 nt, Homo Sapiens
caauuugaaugccuacaauaaggacucauuguuccacccccaacauuacuugauuuaucuucuc

SEQ ID NO: 287050 - RNA, 64 nt, Homo Sapiens
ccugggcaccauuuaggacauccuucaacauccucacccccaccuagcacacaucugcugacuc

SEQ ID NO: 287051 - RNA, 64 nt, Homo Sapiens
ugacugacacagguggucuacuacuguuaaccaacacccccaagcuagaggugagcucagaaac

SEQ ID NO: 287052 - RNA, 64 nt, Homo Sapiens
cuaucccagaggccuugcagccagcuucccucugcacccccagcccccuggggaccccaaggcc

SEQ ID NO: 287053 - RNA, 64 nt, Homo Sapiens
ccuccuggcuccuuaucccccaccuccccauucacacccccauuugccacaaauaagcaucgag

SEQ ID NO: 287054 - RNA, 64 nt, Homo Sapiens
auaggauaugcuuguauccccuuugaaugaccgucacccccaguauaagcugcaguaauuugcu

SEQ ID NO: 287055 - RNA, 64 nt, Homo Sapiens
gcucgggucaguccucaucggucucgccagcgcccacccccaugggccaccucgugggggacaa

SEQ ID NO: 287056 - RNA, 64 nt, Homo Sapiens
aaaacugcucuggacuugcucuuuguacagccuccacccccauuccgcuucagugggccuugcc

SEQ ID NO: 287057 - RNA, 64 nt, Homo Sapiens
cugacaccaucagucccccucuuucugcugagaccacccccaccgaggccugaugccguuucug

SEQ ID NO: 287058 - RNA, 64 nt, Homo Sapiens
gugcccugaggccccaggcacccacccucacccccacccccaggccauccuaggcugggcuggc

SEQ ID NO: 287059 - RNA, 64 nt, Homo Sapiens
cccagggugcccugaggcccgcuggccccacccucacccccaccugcugaccauccuaggcugg

SEQ ID NO: 287060 - RNA, 64 nt, Homo Sapiens
cuuccucugagggccccaccucaccccuuggugucacccccaccacgccuaggcagcucugggc

SEQ ID NO: 287061 - RNA, 64 nt, Homo Sapiens
gggcacccuccugggagcaggccuuccucccucccacccccaauguccuguugguaggaggugg

SEQ ID NO: 287062 - RNA, 64 nt, Homo Sapiens
ccaccccaggacgagccaucagggacagaccccccacccccaaggcugcagccacaccauguuu

SEQ ID NO: 287063 - RNA, 64 nt, Homo Sapiens
agggagcgagcccagaacggaccggacgccugugcacccccagcccugccccuuggccgcagag

SEQ ID NO: 287064 - RNA, 64 nt, Homo Sapiens
agcuugacccuggaaauucugggccaucccccuccacccccacccugaggcucccccugcaggu

SEQ ID NO: 287065 - RNA, 64 nt, Homo Sapiens
uccucucagggcccacccucgccaggagcugccacacccccaagugcccugcucuggagggagg

SEQ ID NO: 287066 - RNA, 64 nt, Homo Sapiens
gacagagcuggucucugggcugcccuggccugaacacccccagggcuagccccugccccaaucc

SEQ ID NO: 287067 - RNA, 64 nt, Homo Sapiens
accuguuauccucuucuuucacccuaucucuucccacccccagcuucccuuugccccacaaagu

SEQ ID NO: 287068 - RNA, 64 nt, Homo Sapiens
gcuuccccacccccuccucaggcuccugcgagcacacccccacccccaaaucccucccuguucu

SEQ ID NO: 287069 - RNA, 64 nt, Homo Sapiens
ccacccccuccucaggcuccugcgagcacacccccacccccaaaucccucccuguucuacacug

SEQ ID NO: 287070 - RNA, 64 nt, Homo Sapiens
ccugcacacggggccgcugggcaggugccccucacacccccaggaugucagugcucaccucgag

SEQ ID NO: 287071 - RNA, 64 nt, Homo Sapiens
agagugacgccacagcccaucccggugacaugcucacccccaacccccguguccgggaccccgg

SEQ ID NO: 287072 - RNA, 64 nt, Homo Sapiens
uuuuuaucguagcaccaaagaaaugaaaacagaucacccccaaagccaagcaagugauugggua

SEQ ID NO: 287073 - RNA, 64 nt, Homo Sapiens
aaacuguaccaguucugaagaccguuuucugccacacccccacccccagcugaccagggaggca

SEQ ID NO: 287074 - RNA, 64 nt, Homo Sapiens
uaccaguucugaagaccguuuucugccacacccccacccccagcugaccagggaggcagaggac

SEQ ID NO: 287075 - RNA, 64 nt, Homo Sapiens
caacugcgucuucucucagcccuccacacacacucacccccacucccacacacauacacacaca

SEQ ID NO: 287076 - RNA, 55 nt, Homo Sapiens
auuccaauucugugaauuagcaccccacccccauaccccuucuuccacccccaga

SEQ ID NO: 287077 - RNA, 64 nt, Homo Sapiens
gugaauuagcaccccacccccauaccccuucuuccacccccagacuaaaggaagauacuuacuc

SEQ ID NO: 287078 - RNA, 64 nt, Homo Sapiens
uguguuucagaccuacaagaugggguacuaacaccacccccaccgcccccaccaccacccccag

SEQ ID NO: 287079 - RNA, 64 nt, Homo Sapiens
gggguacuaacaccacccccaccgcccccaccaccacccccagcuccugaggugcuggccagug

SEQ ID NO: 287080 - RNA, 64 nt, Homo Sapiens
ccaccacccccagcuccugaggugcuggccagugcacccccacucccacccucaaccgcggccc

SEQ ID NO: 287081 - RNA, 64 nt, Homo Sapiens
agccuggcugucucuagcgacagacuccaucccccacccccaggccccccgaccuccacccccu

SEQ ID NO: 287082 - RNA, 64 nt, Homo Sapiens
aucggcacugagggacaucggacagaccgcauuccacccccaacuucuuucaaaagaccccacc

SEQ ID NO: 287083 - RNA, 64 nt, Homo Sapiens
ccccaaguguccuggacccuggccuaaagaaucccacccccacuucaugcccacugccgaugcc

SEQ ID NO: 287084 - RNA, 64 nt, Homo Sapiens
cuugacuggcucaagaauuagggccccaacuacacacccccaagccacagggaagcauguacug

SEQ ID NO: 287085 - RNA, 64 nt, Homo Sapiens
uugggugugugugcgugguccagagcacccccuccacccccaccgugugaugugugugaugcac

SEQ ID NO: 287086 - RNA, 64 nt, Homo Sapiens
gcagacccuggugucccugggacccaggcagccccacccccacgccaggcucacucccaaaaca

SEQ ID NO: 287087 - RNA, 64 nt, Homo Sapiens
aggaguucucuuccgcagccccuuuccccacgcccacccccagucuccagggacccuugccugc

SEQ ID NO: 287088 - RNA, 64 nt, Homo Sapiens
uuccuguccuaaaaauaggggccguuuucuuacacacccccagagagaggagggacugucacac

SEQ ID NO: 287089 - RNA, 64 nt, Homo Sapiens
ccgagcugcccccacccccggccucagccaccagcacccccauagggcccccagacaccacaca

SEQ ID NO: 287090 - RNA, 64 nt, Homo Sapiens
ggcccgaguuccuccauuucccuggccugccccccacccccaaccugucccacccccgugcccc

SEQ ID NO: 287091 - RNA, 64 nt, Homo Sapiens
gacgggccuacaggggggucuccccucaccccugcacccccagcugggggagcuggcucugccc

SEQ ID NO: 287092 - RNA, 64 nt, Homo Sapiens
acucaccucuugguuagcgggagugugcugcccccacccccacccccgcacccccauucuacac

SEQ ID NO: 287093 - RNA, 64 nt, Homo Sapiens
uagcgggagugugcugcccccacccccacccccgcacccccauucuacacaaggcagaagaggc

SEQ ID NO: 287094 - RNA, 64 nt, Homo Sapiens
augccacuacucaccaguguuguucaccaacacccacccccacacacaccaacauuuugcugcc

SEQ ID NO: 287095 - RNA, 64 nt, Homo Sapiens
ccagucuugggaggagcgcgcugcuuuggugagacacccccaugcaagguccucagaguagccg

SEQ ID NO: 287096 - RNA, 64 nt, Homo Sapiens
ccccagagguggcccuuguuccaucccagggucccacccccaacagaaacagcugcuucucccc

SEQ ID NO: 287097 - RNA, 64 nt, Homo Sapiens
ccuccuaggggaagggggugccagcccccccacccacccccaggacauuccagccaggcccagg

SEQ ID NO: 287098 - RNA, 64 nt, Homo Sapiens
cacacacacaugguccgugcucuacacacaucuacacccccaaggggcccugcaaacacaacca

SEQ ID NO: 287099 - RNA, 64 nt, Homo Sapiens
ccuccugaaccaaaagcucccaagcuccugggcccacccccagauggggaacuuaucgacaaug

SEQ ID NO: 287100 - RNA, 64 nt, Homo Sapiens
cccacgaccaucguucugaaccagccccucccagcacccccagcgaucacaaagccaaccaugc

SEQ ID NO: 287101 - RNA, 64 nt, Homo Sapiens
caaacccgagcaagggucgugcagggggaccugccacccccagcaugaagaaacuaacaagaaa

SEQ ID NO: 287102 - RNA, 64 nt, Homo Sapiens
ccuugagaggucagcggaccguaagcucugaccccacccccaccgcacaagaagacagaaaccu

SEQ ID NO: 287103 - RNA, 64 nt, Homo Sapiens
ugaggcccggucaccuggucuccaauugccccuccacccccagcuugccagaggcaaacagccu

SEQ ID NO: 287104 - RNA, 64 nt, Homo Sapiens
aaccuuacccucaccggggaauugugaagcgcugcacccccaccaggagggcuaaggcuuuagc

SEQ ID NO: 287105 - RNA, 64 nt, Homo Sapiens
cuccagucuccgcguuuugcgccuggaacgcccucacccccaacguuagggcgccggagcccgg

SEQ ID NO: 287106 - RNA, 64 nt, Homo Sapiens
cuaccccggcgccgggcgcgccagagcgcagggacacccccauccgccccccuguccccagccc

SEQ ID NO: 287107 - RNA, 64 nt, Homo Sapiens
cagccuccagaagcuggaacacccacccccaccccacccccaccggagcugggcucuaucccac

SEQ ID NO: 287108 - RNA, 64 nt, Homo Sapiens
ccacccccacccagccuccacucuaucccacacccacccccaccagaggcuuggaggagcuggg

SEQ ID NO: 287109 - RNA, 64 nt, Homo Sapiens
cuucccugggggcgauuagcgucagagaugagcccacccccaccguggagagccgcaugucacu

SEQ ID NO: 287110 - RNA, 64 nt, Homo Sapiens
ggaugcacaggagccacucaaauccagacauucucacccccagcccuacgugagucacccauga

SEQ ID NO: 287111 - RNA, 64 nt, Homo Sapiens
cgcccccggccguccccccucaucgccccgcgcccacccccaucgccccugcccccggcggcgg

SEQ ID NO: 287112 - RNA, 64 nt, Homo Sapiens
cccaccguggccccccacgccccauuaacccccacacccccauuccgcgcaauaaacgacagca

SEQ ID NO: 287113 - RNA, 64 nt, Homo Sapiens
cagggccgcugugagcaaagcugaccccagcccccacccccaguuaacacugcugcuucucuga

SEQ ID NO: 287114 - RNA, 64 nt, Homo Sapiens
caaggugcgcaacauggcugccagccccgccucccacccccaccccgaguccugagcucacuuu

SEQ ID NO: 287115 - RNA, 64 nt, Homo Sapiens
uuagcccccagccggccugagugggggauauugacacccccagcuaaagcacaagcaccuuagu

SEQ ID NO: 287116 - RNA, 64 nt, Homo Sapiens
gugggggggccagcuccugggccuggggucuucucacccccacccccuuguccuggguaggccc

SEQ ID NO: 287117 - RNA, 64 nt, Homo Sapiens
uuuucucucccuccagagcucccacgagcugaugcacccccaggcuucaaaccaccuggaaugc

SEQ ID NO: 287118 - RNA, 64 nt, Homo Sapiens
augugcuuugccgggaggagcggcggccgcagcccacccccacugcuguucgaaucaagcagga

SEQ ID NO: 287119 - RNA, 52 nt, Homo Sapiens
augaggaccagcuuagcugacacacccccagcuggcccuccacccccaccuc

SEQ ID NO: 287120 - RNA, 64 nt, Homo Sapiens
accagcuuagcugacacacccccagcuggcccuccacccccaccucaagugccuuauucucaca

SEQ ID NO: 287121 - RNA, 64 nt, Homo Sapiens
caggcucucuccccugcucucccaccucuaccuccacccccaccggccugacgcuguggccccg

SEQ ID NO: 287122 - RNA, 64 nt, Homo Sapiens
aaugggggugcaugcugggccuggcccccuggcccacccccacuuuccagggcaaaaagggccc

SEQ ID NO: 287123 - RNA, 55 nt, Homo Sapiens
ccagcgggcgcaggaagugacuucccacccccaggaccugacacaucucgucucc

SEQ ID NO: 287124 - RNA, 64 nt, Homo Sapiens
cccuauagccauaucucggccccuucccacucaccacccccaccccaggugcugggggucccuu

SEQ ID NO: 287125 - RNA, 64 nt, Homo Sapiens
gaaggagaggaaugggggagaggacgugagggaccacccccacccacacagcugccgcagcauc

SEQ ID NO: 287126 - RNA, 64 nt, Homo Sapiens
gccaucucaguauugccugugggggccaccccuccacccccacccccaagugccuucgcucugu

SEQ ID NO: 287127 - RNA, 64 nt, Homo Sapiens
ucaguauugccugugggggccaccccuccacccccacccccaagugccuucgcucuguuuuuau

SEQ ID NO: 287128 - RNA, 64 nt, Homo Sapiens
cauagcucugacccuggaaugggguugguuuggacacccccagggaucugagcccugacccuuu

SEQ ID NO: 287129 - RNA, 64 nt, Homo Sapiens
agcccugacccuuugugacugcugaccccugagccacccccacucccacagggagccccggcca

SEQ ID NO: 287130 - RNA, 64 nt, Homo Sapiens
agcugcucacuuuugccggguuugguggccacuucacccccaacccugucucacccccauuauc

SEQ ID NO: 287131 - RNA, 64 nt, Homo Sapiens
ggguuugguggccacuucacccccaacccugucucacccccauuaucccuccucaauuggaggc

SEQ ID NO: 287132 - RNA, 64 nt, Homo Sapiens
aguugagugcauggaucugucccacccccacccccacccccaggcccauuccucaucccucacu

SEQ ID NO: 287133 - RNA, 64 nt, Homo Sapiens
cccaggaguugagugcauggcucacucccacccccacccccaccuucccacccauuccucaucc

SEQ ID NO: 287134 - RNA, 64 nt, Homo Sapiens
cccacccccaggaguugaguucaucccucacucccacccccaccccuugcuucccacccauucc

SEQ ID NO: 287135 - RNA, 64 nt, Homo Sapiens
acugggaggggacuucuuuugccuaggccccugccacccccaagcacaccccccccccaccgag

SEQ ID NO: 287136 - RNA, 64 nt, Homo Sapiens
cucgaccacccccgaugggacagagaugugcccccacccccaccuuuuucggcuaaaaagaaug

SEQ ID NO: 287137 - RNA, 64 nt, Homo Sapiens
ccacccaaccacaggccccaccagcccccacccacacccccaucagaggggcucacgcuuaacu

SEQ ID NO: 287138 - RNA, 64 nt, Homo Sapiens
ccacccuccaggguuaggggcuugcaucuaauuucacccccaccgccagagggccccagaguuc

SEQ ID NO: 287139 - RNA, 64 nt, Homo Sapiens
gacccugccagccacagaccauccaggagggagccacccccaaggccaggagugucucuaagag

SEQ ID NO: 287140 - RNA, 64 nt, Homo Sapiens
ccucacacucccuugucuuuccacauaccacaaccacccccaagcaccaggagggcagacccag

SEQ ID NO: 287141 - RNA, 64 nt, Homo Sapiens
uguuaauaaauaucucaacugagcccacccccagcacccccaucugcauccccucugggggcag

SEQ ID NO: 287142 - RNA, 64 nt, Homo Sapiens
acccccaucuguuaauaaauugggggcaggagcccacccccagcgcauccaccugcauccccuc

SEQ ID NO: 287143 - RNA, 64 nt, Homo Sapiens
cgguuuggaccccaccacugcacccuccaugcuccacccccaggggcccacuccaguuccagac

SEQ ID NO: 287144 - RNA, 64 nt, Homo Sapiens
ugccaccucagacugacacaguuucaugggcgagcacccccaucuaacagggcacaccccucua

SEQ ID NO: 287145 - RNA, 64 nt, Homo Sapiens
ggacgaagaggucaagaacccucucagaaaguuucacccccagagcacagaagucgcaggcagc

SEQ ID NO: 287146 - RNA, 64 nt, Homo Sapiens
gggagccgagacucggaaagccuccuuaaaguuucacccccagauugaaccccaguacugacag

SEQ ID NO: 287147 - RNA, 64 nt, Homo Sapiens
ugcacugagaagagaaguuuagacaggcccaacccacccccauuccaggaggcuggugccaggg

SEQ ID NO: 287148 - RNA, 64 nt, Homo Sapiens
uucucuccucuggacccccaccucaucacccugacacccccacacccacgauggcccccauugc

SEQ ID NO: 287149 - RNA, 64 nt, Homo Sapiens
acauggaaugggcuggucuagaucuaugugcacacacccccauccuugcccaguagaauggacu

SEQ ID NO: 287150 - RNA, 64 nt, Homo Sapiens
aagggaagacugccccauucaaaagaugggcacccacccccaccaucuugagagcccuaauacu

SEQ ID NO: 287151 - RNA, 64 nt, Homo Sapiens
cccccaucccuuccccaccuguccuaucccaacucacccccaaagcgcuuggcgcuccuccucc

SEQ ID NO: 287152 - RNA, 64 nt, Homo Sapiens
ccccacucccacacacaguuuucacacacacacacacccccacaucaggccuuaggucuggcca

SEQ ID NO: 287153 - RNA, 64 nt, Homo Sapiens
acagcagucuucuucacccgcacccccaccccaacacccccaagaagggagaagaaauccauaa

SEQ ID NO: 287154 - RNA, 64 nt, Homo Sapiens
ccaacacccccaagacagcagaagaaauccauaacacccccaccuguugcagagacgcaaggga

SEQ ID NO: 287155 - RNA, 64 nt, Homo Sapiens
gggucuccccaccccaccccggagccaacaccaccacccccaggccuuuacccaggaaaucucc

SEQ ID NO: 287156 - RNA, 64 nt, Homo Sapiens
gggccugcuggccucccucgagaccccggggacccacccccacucuccccagguguauuucagc

SEQ ID NO: 287157 - RNA, 64 nt, Homo Sapiens
gcucaggccacagccggagccuccgcauugcccccacccccauuuuccagggggguuguaauuu

SEQ ID NO: 287158 - RNA, 64 nt, Homo Sapiens
uguguguguguguguguguguggugcaggagugccacccccagggcccugucaaccucucuuuu

SEQ ID NO: 287159 - RNA, 64 nt, Homo Sapiens
ggaggccccgcugaaaccugggcugcccuucccccacccccacggcucuccugguugaggaggg

SEQ ID NO: 287160 - RNA, 64 nt, Homo Sapiens
ccuccccaggcccaacucugcuagcuucccagaccacccccaucgagugcggagagagugggag

SEQ ID NO: 287161 - RNA, 64 nt, Homo Sapiens
acagggggauucugagcaguuccccuccuucccucacccccagcuauuccucuguccuaaaccg

SEQ ID NO: 287162 - RNA, 64 nt, Homo Sapiens
cccgccucagggccaggcccccagccucgccugucacccccacuugcaggugccagggcccacc

SEQ ID NO: 287163 - RNA, 64 nt, Homo Sapiens
ugauuuucuguuacacuguauaguaguccuauggcacccccaccccaucccuuucgugccacuc

SEQ ID NO: 287164 - RNA, 64 nt, Homo Sapiens
ccccaccccaucccuuucgugccacucccguccccacccccaccccaguguguauaagcuggca

SEQ ID NO: 287165 - RNA, 64 nt, Homo Sapiens
agagcugcuggggauucuggccuagucccuuccacacccccaccccuugcucucaacccaggag

SEQ ID NO: 287166 - RNA, 64 nt, Homo Sapiens
uuggggcaggaugauuuuggccucauuacuuuaccacccccacaccuggaaagcauauacuaua

SEQ ID NO: 287167 - RNA, 64 nt, Homo Sapiens
uagccgagcugguccuaggccccgccuagugccccacccccacccacagugcugcacuccuccu

SEQ ID NO: 287168 - RNA, 64 nt, Homo Sapiens
uggccugcucaggcuucccacccugugcggggcacacccccaggaagggacccuggacacggcu

SEQ ID NO: 287169 - RNA, 64 nt, Homo Sapiens
aguugccaugggguuuccuugggacccguccucucacccccagcccccauguccucccugccuu

SEQ ID NO: 287170 - RNA, 64 nt, Homo Sapiens
caccauugucaccacacucaacucccacccccaccacccccaguccggccaccagggggcuccu

SEQ ID NO: 287171 - RNA, 64 nt, Homo Sapiens
acccccagucaccauugucaggggcuccuacucccacccccacccccuggaucccggccaccag

SEQ ID NO: 287172 - RNA, 64 nt, Homo Sapiens
uugggacgccuuguuuagcuccacucccgccccgcacccccaagcuuguuccccacccccaccc

SEQ ID NO: 287173 - RNA, 64 nt, Homo Sapiens
cccgccccgcacccccaaguuuguuccccacccccacccccacucggccugcgcucguccaccc

SEQ ID NO: 287174 - RNA, 64 nt, Homo Sapiens
cccacucccgccccgcacccccacccuuguuccccacccccaccgagcaccggccugcgcucgu

SEQ ID NO: 287175 - RNA, 64 nt, Homo Sapiens
ucuguccccaggcucugcccggguuggaauggggcacccccaagggguguggcgcauggcgcug

SEQ ID NO: 287176 - RNA, 64 nt, Homo Sapiens
gugacggguggcgagcuguuagccaaaccccuggcacccccaggccaggcugagugccuggguc

SEQ ID NO: 287177 - RNA, 64 nt, Homo Sapiens
uccuuggauugucaacccccaucccccaaauggaaauuccgaaggaggccuccucgcaccugcc

SEQ ID NO: 287178 - RNA, 64 nt, Homo Sapiens
cgcaaggacaaugaauccacucacauugcagaacaauuccgaaaauggcaaacuacuacuacua

SEQ ID NO: 287179 - RNA, 64 nt, Homo Sapiens
uuaguauuaaaccuuuuuuaugccauuucauaagaauuccgauauauacuugaugauugccaag

SEQ ID NO: 287180 - RNA, 64 nt, Homo Sapiens
gcuccacaugcuguaccuggaucauucugaagcaaauuccgagcauuacaucauuuuguccaua

SEQ ID NO: 287181 - RNA, 64 nt, Homo Sapiens
auacaccagcucacaaaugauuaaaauuaaaaauaauuccgaagcuuauucauuuugcaugguu

SEQ ID NO: 287182 - RNA, 64 nt, Homo Sapiens
aaccuacugccagcagagggacuucgaggacuggaauuccgaggaauggucuugucaccuuuca

SEQ ID NO: 287183 - RNA, 64 nt, Homo Sapiens
ugaggaccccuggggcccccaucggagcccugcaaauuccgagaaaugugaaacuugguggggu

SEQ ID NO: 287184 - RNA, 64 nt, Homo Sapiens
caagcacuggccuccccuggcuccugccuggaagaauuccgagccagcccauuucuagaauguc

SEQ ID NO: 287185 - RNA, 64 nt, Homo Sapiens
uaggauuaugccuaguuuguauuuucuacucaacaauuccgagaacaggaguauuaguacauaa

SEQ ID NO: 287186 - RNA, 64 nt, Homo Sapiens
ccccuccuuccugaaaaagaaaagaagaaaaagaaauuccgaacucaccuuccaagucucccuc

SEQ ID NO: 287187 - RNA, 64 nt, Homo Sapiens
cuggggcaauggaaucacugcuaguuuaaaucacaauuccgaauucugaugccugaagagaggc

SEQ ID NO: 287188 - RNA, 64 nt, Homo Sapiens
gcaaggggacucugggaggaguuuuccagaaugcaauuccgagugagcaaaucgcauagcugua

SEQ ID NO: 287189 - RNA, 64 nt, Homo Sapiens
uggcugccuucucuggaaacaaggaaaacccaauaauuccgaggaacauuggggguuaaauacc

SEQ ID NO: 287190 - RNA, 64 nt, Homo Sapiens
aggagaaucaucuucaugccugaaaauuuagcaaaauuccgacuauggccuccaggggcaauuc

SEQ ID NO: 287191 - RNA, 64 nt, Homo Sapiens
uucucagcaguggugucucuugcugaaggucaguaauuccgacuguuccauaaaauuggagaac

SEQ ID NO: 287192 - RNA, 64 nt, Homo Sapiens
uaccucugaaaaauguguagugcaacaagaggauaauuccgaccacugugccuguuuccucauu

SEQ ID NO: 287193 - RNA, 64 nt, Homo Sapiens
cugcagcccccucggggacgcccccaccagcucaaauuccgagugcagaaaagaaaccggaccc

SEQ ID NO: 287194 - RNA, 64 nt, Homo Sapiens
cuaguuugcuuugcugaccagccaguggcuuauuaauuccgauacucugccccagauagguggu

SEQ ID NO: 287195 - RNA, 64 nt, Homo Sapiens
cguagaauucucuacacaccaguaacgggauuucaauuccgauggacucugccgcccuggcggc

SEQ ID NO: 287196 - RNA, 64 nt, Homo Sapiens
gugcucucuuucaggugggaugugugugggcugaaauuccgagcugcgguugugcaugagaaua

SEQ ID NO: 287197 - RNA, 64 nt, Homo Sapiens
gccuuuugguacaguguuuucaucucuuggucauaauuccgagauccccagagaccacuguuuc

SEQ ID NO: 287198 - RNA, 64 nt, Homo Sapiens
guccagcacugccguauugcuuugccuucaagggaauuccgaguaucacgcucuguuccuugcu

SEQ ID NO: 287199 - RNA, 64 nt, Homo Sapiens
ccucucuucuugcacuguccccaaacuugcugucaauuccgagaucuaaucucccccuacgcuc

SEQ ID NO: 287200 - RNA, 64 nt, Homo Sapiens
aauugugaaccgcuaacauugaagaaauuuugacaauuccgauuugaugcugcaauuacuugcu

SEQ ID NO: 287201 - RNA, 64 nt, Homo Sapiens
cauacaagacaaaaaaaauguuuugcuaugcuauaauuccgaaaaugaacucuucucaacucug

SEQ ID NO: 287202 - RNA, 64 nt, Homo Sapiens
cucccucauccaugaugcgucccuuacuuaacacaauuccgaaugaauggcucagaagccgcgu

SEQ ID NO: 287203 - RNA, 64 nt, Homo Sapiens
uuguuauuugcuaaaucuccuauguucgcuuuauaauuccgaaguaggccucauauuuacacua

SEQ ID NO: 287204 - RNA, 64 nt, Homo Sapiens
uggaaccuuagaugucuauuuuuuaaaaauauuuaauuccgauuugagcaaauuaggugacuug

SEQ ID NO: 287205 - RNA, 64 nt, Homo Sapiens
aaaaguaggauguagguauuuauuguguucuagaaauuccgacucuuuucauuagauauaugcu

SEQ ID NO: 287206 - RNA, 64 nt, Homo Sapiens
ccuguggugugguuuaaaaaucuauaggccugggaauuccgauccuagcugcagaucgcauccc

SEQ ID NO: 287207 - RNA, 64 nt, Homo Sapiens
uguucccugggcucuguuaauccaaugcugugagaauuccgagccagagcucaagaagggggcu

SEQ ID NO: 287208 - RNA, 64 nt, Homo Sapiens
uuuaaagucaauacgauggaaaucaauaaaucugaauuccgaacauguuguguggaauacucuu

SEQ ID NO: 287209 - RNA, 64 nt, Homo Sapiens
ccucuugcagguaagccccacgccguguccaacaaauuccgagaagcugccuuucugacuuggc

SEQ ID NO: 287210 - RNA, 64 nt, Homo Sapiens
caaaacugugacaaucuuuucccagagagagcauaauuccgaaaaaaagugcuaaaguuuucuu

SEQ ID NO: 287211 - RNA, 64 nt, Homo Sapiens
ugaucgugacaagaaauaccuuaggccuucagucaauuccgaagcuccuucaguuguuuuuaua

SEQ ID NO: 287212 - RNA, 64 nt, Homo Sapiens
agugugguccagcagcagggaggaguucugcccaaauuccgauaucaccccuucccccauccaa

SEQ ID NO: 287213 - RNA, 64 nt, Homo Sapiens
gguuaguauuuaacuacaucugccucggcucacaaauuccgauuagaccuuuauccagcuagug

SEQ ID NO: 287214 - RNA, 64 nt, Homo Sapiens
augacacuuggaagaaaaauguaugaaauucagaaauuccgaucaaagaaaaguaauucuuucu

SEQ ID NO: 287215 - RNA, 64 nt, Homo Sapiens
ugacagguuaucuggaacaaaaaaugguauuuggaauuccgaauuauauucuacuccuguaagg

SEQ ID NO: 287216 - RNA, 64 nt, Homo Sapiens
aacagcauuaacugucuuaaagagagagagagagaauuccgaauuggggaacacacgauaccug

SEQ ID NO: 287217 - RNA, 64 nt, Homo Sapiens
caguauuccagguuuucucuuuccagggaggucuaauuccgaaguuguugguguguuuguuuuu

SEQ ID NO: 287218 - RNA, 64 nt, Homo Sapiens
cuuucucacugccuuuguuuguaauaaaugauaaaauuccgaguuuucuuuuuuccccuuucuu

SEQ ID NO: 287219 - RNA, 64 nt, Homo Sapiens
augcucaagagggagguuucgccuucccaugaaaaauuccgaaggugcacaccaacacugagac

SEQ ID NO: 287220 - RNA, 64 nt, Homo Sapiens
uaaaucuagaggguuguuuugucuuagccacaagaauuccgaggucuugacccugaugaucaac

SEQ ID NO: 287221 - RNA, 64 nt, Homo Sapiens; identical to SEQ ID NO: 130118

SEQ ID NO: 287222 - RNA, 64 nt, Homo Sapiens; identical to SEQ ID NO: 130119

SEQ ID NO: 287223 - RNA, 64 nt, Homo Sapiens; identical to SEQ ID NO: 130120

SEQ ID NO: 287224 - RNA, 64 nt, Homo Sapiens; identical to SEQ ID NO: 130121

SEQ ID NO: 287225 - RNA, 64 nt, Homo Sapiens; identical to SEQ ID NO: 130122

SEQ ID NO: 287226 - RNA, 64 nt, Homo Sapiens; identical to SEQ ID NO: 130123

SEQ ID NO: 287227 - RNA, 64 nt, Homo Sapiens; identical to SEQ ID NO: 130124

SEQ ID NO: 287228 - RNA, 64 nt, Homo Sapiens; identical to SEQ ID NO: 130125

SEQ ID NO: 287229 - RNA, 64 nt, Homo Sapiens; identical to SEQ ID NO: 130126

SEQ ID NO: 287230 - RNA, 64 nt, Homo Sapiens; identical to SEQ ID NO: 130127

SEQ ID NO: 287231 - RNA, 64 nt, Homo Sapiens; identical to SEQ ID NO: 130128

SEQ ID NO: 287232 - RNA, 64 nt, Homo Sapiens; identical to SEQ ID NO: 130129

SEQ ID NO: 287233 - RNA, 64 nt, Homo Sapiens; identical to SEQ ID NO: 130130

SEQ ID NO: 287234 - RNA, 64 nt, Homo Sapiens; identical to SEQ ID NO: 130131

SEQ ID NO: 287235 - RNA, 64 nt, Homo Sapiens; identical to SEQ ID NO: 130132

SEQ ID NO: 287236 - RNA, 64 nt, Homo Sapiens; identical to SEQ ID NO: 130133

SEQ ID NO: 287237 - RNA, 64 nt, Homo Sapiens; identical to SEQ ID NO: 130134

SEQ ID NO: 287238 - RNA, 64 nt, Homo Sapiens; identical to SEQ ID NO: 130135

SEQ ID NO: 287239 - RNA, 64 nt, Homo Sapiens; identical to SEQ ID NO: 130136

SEQ ID NO: 287240 - RNA, 64 nt, Homo Sapiens; identical to SEQ ID NO: 130137

SEQ ID NO: 287241 - RNA, 64 nt, Homo Sapiens; identical to SEQ ID NO: 130138

SEQ ID NO: 287242 - RNA, 64 nt, Homo Sapiens; identical to SEQ ID NO: 130139

SEQ ID NO: 287243 - RNA, 64 nt, Homo Sapiens; identical to SEQ ID NO: 130140

SEQ ID NO: 287244 - RNA, 64 nt, Homo Sapiens; identical to SEQ ID NO: 130141

SEQ ID NO: 287245 - RNA, 64 nt, Homo Sapiens; identical to SEQ ID NO: 130142

SEQ ID NO: 287246 - RNA, 64 nt, Homo Sapiens; identical to SEQ ID NO: 130143

SEQ ID NO: 287247 - RNA, 64 nt, Homo Sapiens; identical to SEQ ID NO: 130144

SEQ ID NO: 287248 - RNA, 64 nt, Homo Sapiens; identical to SEQ ID NO: 130145

SEQ ID NO: 287249 - RNA, 64 nt, Homo Sapiens; identical to SEQ ID NO: 130146

SEQ ID NO: 287250 - RNA, 64 nt, Homo Sapiens; identical to SEQ ID NO: 130147

SEQ ID NO: 287251 - RNA, 64 nt, Homo Sapiens; identical to SEQ ID NO: 130148

SEQ ID NO: 287252 - RNA, 64 nt, Homo Sapiens; identical to SEQ ID NO: 130149

SEQ ID NO: 287253 - RNA, 64 nt, Homo Sapiens; identical to SEQ ID NO: 130150

SEQ ID NO: 287254 - RNA, 64 nt, Homo Sapiens; identical to SEQ ID NO: 130151

SEQ ID NO: 287255 - RNA, 64 nt, Homo Sapiens; identical to SEQ ID NO: 130152

SEQ ID NO: 287256 - RNA, 64 nt, Homo Sapiens; identical to SEQ ID NO: 130153

SEQ ID NO: 287257 - RNA, 64 nt, Homo Sapiens; identical to SEQ ID NO: 130154

SEQ ID NO: 287258 - RNA, 64 nt, Homo Sapiens; identical to SEQ ID NO: 130155

SEQ ID NO: 287259 - RNA, 64 nt, Homo Sapiens; identical to SEQ ID NO: 130156

SEQ ID NO: 287260 - RNA, 64 nt, Homo Sapiens; identical to SEQ ID NO: 130157

SEQ ID NO: 287261 - RNA, 64 nt, Homo Sapiens; identical to SEQ ID NO: 130158

SEQ ID NO: 287262 - RNA, 64 nt, Homo Sapiens; identical to SEQ ID NO: 130159

SEQ ID NO: 287263 - RNA, 64 nt, Homo Sapiens; identical to SEQ ID NO: 130160

SEQ ID NO: 287264 - RNA, 64 nt, Homo Sapiens; identical to SEQ ID NO: 130161

SEQ ID NO: 287265 - RNA, 64 nt, Homo Sapiens; identical to SEQ ID NO: 130162

SEQ ID NO: 287266 - RNA, 64 nt, Homo Sapiens; identical to SEQ ID NO: 130163

SEQ ID NO: 287267 - RNA, 64 nt, Homo Sapiens; identical to SEQ ID NO: 130164

SEQ ID NO: 287268 - RNA, 64 nt, Homo Sapiens; identical to SEQ ID NO: 130165

SEQ ID NO: 287269 - RNA, 64 nt, Homo Sapiens; identical to SEQ ID NO: 130166

SEQ ID NO: 287270 - RNA, 64 nt, Homo Sapiens; identical to SEQ ID NO: 130167

SEQ ID NO: 287271 - RNA, 64 nt, Homo Sapiens; identical to SEQ ID NO: 130168

SEQ ID NO: 287272 - RNA, 64 nt, Homo Sapiens; identical to SEQ ID NO: 130169

SEQ ID NO: 287273 - RNA, 64 nt, Homo Sapiens; identical to SEQ ID NO: 130170

SEQ ID NO: 287274 - RNA, 64 nt, Homo Sapiens; identical to SEQ ID NO: 130171

SEQ ID NO: 287275 - RNA, 64 nt, Homo Sapiens; identical to SEQ ID NO: 130172

SEQ ID NO: 287276 - RNA, 64 nt, Homo Sapiens; identical to SEQ ID NO: 130173

SEQ ID NO: 287277 - RNA, 64 nt, Homo Sapiens; identical to SEQ ID NO: 130174

SEQ ID NO: 287278 - RNA, 64 nt, Homo Sapiens; identical to SEQ ID NO: 130175

SEQ ID NO: 287279 - RNA, 64 nt, Homo Sapiens; identical to SEQ ID NO: 130176

SEQ ID NO: 287280 - RNA, 64 nt, Homo Sapiens; identical to SEQ ID NO: 130177

SEQ ID NO: 287281 - RNA, 64 nt, Homo Sapiens; identical to SEQ ID NO: 130178

SEQ ID NO: 287282 - RNA, 64 nt, Homo Sapiens; identical to SEQ ID NO: 130179

SEQ ID NO: 287283 - RNA, 64 nt, Homo Sapiens; identical to SEQ ID NO: 130180

SEQ ID NO: 287284 - RNA, 64 nt, Homo Sapiens; identical to SEQ ID NO: 130181

SEQ ID NO: 287285 - RNA, 64 nt, Homo Sapiens; identical to SEQ ID NO: 130182

SEQ ID NO: 287286 - RNA, 64 nt, Homo Sapiens; identical to SEQ ID NO: 130183

SEQ ID NO: 287287 - RNA, 64 nt, Homo Sapiens; identical to SEQ ID NO: 130184

SEQ ID NO: 287288 - RNA, 64 nt, Homo Sapiens; identical to SEQ ID NO: 130185

SEQ ID NO: 287289 - RNA, 64 nt, Homo Sapiens; identical to SEQ ID NO: 130186

SEQ ID NO: 287290 - RNA, 64 nt, Homo Sapiens; identical to SEQ ID NO: 130187

SEQ ID NO: 287291 - RNA, 64 nt, Homo Sapiens; identical to SEQ ID NO: 130188

SEQ ID NO: 287292 - RNA, 64 nt, Homo Sapiens; identical to SEQ ID NO: 130189

SEQ ID NO: 287293 - RNA, 64 nt, Homo Sapiens; identical to SEQ ID NO: 130190

SEQ ID NO: 287294 - RNA, 64 nt, Homo Sapiens; identical to SEQ ID NO: 130191

SEQ ID NO: 287295 - RNA, 64 nt, Homo Sapiens; identical to SEQ ID NO: 130192

SEQ ID NO: 287296 - RNA, 64 nt, Homo Sapiens; identical to SEQ ID NO: 130193

SEQ ID NO: 287297 - RNA, 64 nt, Homo Sapiens; identical to SEQ ID NO: 130194

SEQ ID NO: 287298 - RNA, 64 nt, Homo Sapiens; identical to SEQ ID NO: 130195

SEQ ID NO: 287299 - RNA, 64 nt, Homo Sapiens; identical to SEQ ID NO: 130196

SEQ ID NO: 287300 - RNA, 64 nt, Homo Sapiens
gaaugagugcuaugguguugaaaacugcaguguccguuaugagugccaaaaaucugucuugaag

SEQ ID NO: 287301 - RNA, 64 nt, Homo Sapiens
acaauuaucccuuacagacuugaacauuugcagacguuaugaucuugcuuccaacucccaccug

SEQ ID NO: 287302 - RNA, 64 nt, Homo Sapiens
ugucuguuuaagagagaaaacacuggacucuguucguuaugauucuuguugcgacagagggacu

SEQ ID NO: 287303 - RNA, 64 nt, Homo Sapiens
accuggcaacaaaaaguaauuuaagaauuugaaacguuaugaugagcuguugacguuugcucau

SEQ ID NO: 287304 - RNA, 64 nt, Homo Sapiens
auuuuaauuuguauauuuuugugauuuauuuuggcguuaugaguuugacucucggggaguuuug

SEQ ID NO: 287305 - RNA, 64 nt, Homo Sapiens
cauaaguucagccugucauacuuuuugcauugaucguuaugaauaccagaccauuuguaagugu

SEQ ID NO: 287306 - RNA, 64 nt, Homo Sapiens
guuacacauguccucggcaucagauuccuagagacguuaugaugaccccaacucaaauuaaaua

SEQ ID NO: 287307 - RNA, 64 nt, Homo Sapiens
augccuuccacgcaaauaagcuaaaccaguacuucguuaugaaaacuccuauuuacugcuuuua

SEQ ID NO: 287308 - RNA, 64 nt, Homo Sapiens
ugauaguauuauuauuuaauaacagcauuauucacguuaugauuggcuucucuucaacucuaau

SEQ ID NO: 287309 - RNA, 64 nt, Homo Sapiens
uguucagcccuccuaguuauguuccugaugucuucguuaugaaacuguugauguuugcaucaua

SEQ ID NO: 287310 - RNA, 64 nt, Homo Sapiens
cuccugucugauagcgguagaugaaaaauaaggucguuaugacuuuggcaacuugcuucauuuc

SEQ ID NO: 287311 - RNA, 64 nt, Homo Sapiens
uugcuuuguguuacuuuuuugcucuugaauguaucguuaugauggucucuuauaaucaugguau

SEQ ID NO: 287312 - RNA, 64 nt, Homo Sapiens
gaaggcugcuuugaaaauggcgugucuuacccaucguuaugauggaggcucaguaaaggaauac

SEQ ID NO: 287313 - RNA, 64 nt, Homo Sapiens
auuaaagaagguaauuuuguucuuuccgccaaugcguuaugauguggggauaaucaggcacagg

SEQ ID NO: 287314 - RNA, 64 nt, Homo Sapiens
aagcaauauagcuuccauucuaaggcuguauucccguuaugaauuacuagcugauuacaguuca

SEQ ID NO: 287315 - RNA, 64 nt, Homo Sapiens
acagaugcccccgugaaugcaauauugauuucuacguuaugaaaagauguguuuuuaauguuaa

SEQ ID NO: 287316 - RNA, 64 nt, Homo Sapiens
uaagugauaauuguccuggccucucagccaugaccguuaugaggaaauaucccccauucgaacu

SEQ ID NO: 287317 - RNA, 64 nt, Homo Sapiens
uucaucugcaggucagagguggagugcaaaauaucguuaugauaaggagugguugaauaauggg

SEQ ID NO: 287318 - RNA, 64 nt, Homo Sapiens
acauuuggugcccagaagucauaauugauguuuucguuaugaaauguacuugguauuauaaugc

SEQ ID NO: 287319 - RNA, 64 nt, Homo Sapiens
uggagagcagcacauucuuacagaggagauggagcguuaugagcauaguauguggauagguauc

SEQ ID NO: 287320 - RNA, 64 nt, Homo Sapiens
agagcuaugagauacgcacaauacuugcuguucacguuaugacucucaugcaagcaaaauacac

SEQ ID NO: 287321 - RNA, 64 nt, Homo Sapiens
ggaaaauaaaucaaugaacaauuaaaaugcagaccguuaugauucauuuacaacaaauauuaau

SEQ ID NO: 287322 - RNA, 64 nt, Homo Sapiens
gugucccacggugccuugggcaaacuggaaaguacguuaugauauggcagaguggauucuugaa

SEQ ID NO: 287323 - RNA, 64 nt, Homo Sapiens
guauuuuugagauauuuuccggcuuuugauacuucguuaugaguccaaauaugcaaaauuuuaa

SEQ ID NO: 287324 - RNA, 64 nt, Homo Sapiens
cgucugcagugcuuagccuaacuuuuguuuaugucguuaugaagcauucaacugugcucuguga

SEQ ID NO: 287325 - RNA, 64 nt, Homo Sapiens
agcuaauuuacuggacaaagaaaugguggaacugcguuaugaagaugaaucuaugcuggauaag

SEQ ID NO: 287326 - RNA, 64 nt, Homo Sapiens
aagaaaaaaggaauuccuugaacaacagcagcuucguuaugaacaagagaggaacucagaaggc

SEQ ID NO: 287327 - RNA, 64 nt, Homo Sapiens
ucacccuagcuuguaacggaugcucauaccagcgcguuaugaacaggacgcuaaauaauaggau

SEQ ID NO: 287328 - RNA, 64 nt, Homo Sapiens
cauagaaaauuaaacaguaucccacuucuguguacguuaugaagauagcacaaaauuuugaaaa

SEQ ID NO: 287329 - RNA, 64 nt, Homo Sapiens
uaaaaugauuuagaccgauuuucagauuuuauuucguuaugauuaaagaugucucauguacuug

SEQ ID NO: 287330 - RNA, 64 nt, Homo Sapiens
uauccuagccacaugcagggcucaguacaaacuccguuaugauacauccagcaaaucagaagga

SEQ ID NO: 287331 - RNA, 64 nt, Homo Sapiens
acuaaccauguguaacaauaggggcaggggauuacguuaugaaaauggaguccugaguugcucu

SEQ ID NO: 287332 - RNA, 64 nt, Homo Sapiens
gaauuauuggauaaaaaagcuauuuuuauaaauucguuaugaauuggaugaugacuauauugag

SEQ ID NO: 287333 - RNA, 64 nt, Homo Sapiens
ucguaaguaaaaauuaucacaagcccuuugcacucguuaugaccaaagaauaagaugcaucacu

SEQ ID NO: 287334 - RNA, 64 nt, Homo Sapiens
ugauuugaccuuggcacacagugauugaggacgucguuaugauuggcacccgguuuacagggag

SEQ ID NO: 287335 - RNA, 64 nt, Homo Sapiens
auauagggcuguauucaaacaucguguggaacuguacaaauauuuauaccaaaaauauagauaa

SEQ ID NO: 287336 - RNA, 64 nt, Homo Sapiens
cugaauuuagauaucuuuauuccauuuauuaugguacaaauaacugauguuuuaaccagaguaa

SEQ ID NO: 287337 - RNA, 64 nt, Homo Sapiens
aaaagugauguguuuuauauaaacuuucacugaauacaaauagacucauuuacuugaaauguaa

SEQ ID NO: 287338 - RNA, 64 nt, Homo Sapiens
guuuguaagaaaauguucauaaaaaucaguuucuuacaaauaaacaguguguuugcuaauuaau

SEQ ID NO: 287339 - RNA, 64 nt, Homo Sapiens
uaagagcagcucagcuuggucguaaucccuuugcuacaaauauuuaagugcucagaccuaugaa

SEQ ID NO: 287340 - RNA, 64 nt, Homo Sapiens
ccagccccaaaugagaaaucaaaauuaaaaagaauacaaauauucuucuaauaaaugaaguaaa

SEQ ID NO: 287341 - RNA, 64 nt, Homo Sapiens
cuuguuuguuuucuuuuuucacucauaaggcauauacaaauaaauugaaguaaccuuauagguu

SEQ ID NO: 287342 - RNA, 64 nt, Homo Sapiens
ccuguuucugaaccauuacugcccaaggaguaaguacaaauauuaacaagacacccaaguccag

SEQ ID NO: 287343 - RNA, 64 nt, Homo Sapiens
aaugugaaauuuaaauaauagacauacagagauauacaaauauauuauauauuuuucugagauu

SEQ ID NO: 287344 - RNA, 64 nt, Homo Sapiens
cagguccuuccuucugcaucucaccaccccuaguuacaaauaacuccauugaacagcaucuauu

SEQ ID NO: 287345 - RNA, 64 nt, Homo Sapiens
ucuuugauuaacccccauaaggcauguguguguauacaaauauacuucucuuuggcuuuucgac

SEQ ID NO: 287346 - RNA, 64 nt, Homo Sapiens
gguuuuucccaugacuguauugcuuuuauaaauguacaaauaguuacugaaaugacgagacccu

SEQ ID NO: 287347 - RNA, 64 nt, Homo Sapiens
augggcacuugagaacuuuccauuuuggcgcuauuacaaauagugcaacuaugaauguacugca

SEQ ID NO: 287348 - RNA, 64 nt, Homo Sapiens
ggaacaacucuccagugccuggauccccucugucuacaaauauaagauuuucugggccuaaagg

SEQ ID NO: 287349 - RNA, 64 nt, Homo Sapiens
auaaggauuuuccuagauauugcacgggagaauauacaaauagcaaaauugaggccaagggcca

SEQ ID NO: 287350 - RNA, 64 nt, Homo Sapiens
guaauuucuugcugguugaaacuuguuuauuauguacaaauagauucuuauaauauuauuuaaa

SEQ ID NO: 287351 - RNA, 64 nt, Homo Sapiens
ugacugagcuggggauuaaaauuucugauaagacuacaaauaucaacaacuaccuaauacaaau

SEQ ID NO: 287352 - RNA, 64 nt, Homo Sapiens
ucugauaagacuacaaauauaaacaacuaccuaauacaaauauuaagcaauagaauaggaaaua

SEQ ID NO: 287353 - RNA, 64 nt, Homo Sapiens
uugaugaauuucuagguguuugggucacaguuccuacaaauacggaaaaggggguuaaaaagca

SEQ ID NO: 287354 - RNA, 64 nt, Homo Sapiens
acauauuauugcuauuaccugaacaaaauagaauuacaaauagcacuugauaauuuuaaaguau

SEQ ID NO: 287355 - RNA, 64 nt, Homo Sapiens
auauagauauauauguccacacuguauaucuauauacaaauaauuuacuuugguacaaauaaaa

SEQ ID NO: 287356 - RNA, 64 nt, Homo Sapiens
aacuguauaucuauauacaauaguuuuacuuugguacaaauaaauagaauuaggcaguugguga

SEQ ID NO: 287357 - RNA, 64 nt, Homo Sapiens
ugcacaggaaagcauuuauacuucagaaagauuguacaaauacaaggaauguggaaaagccauu

SEQ ID NO: 287358 - RNA, 64 nt, Homo Sapiens
acaaaaaaagaguauucauugugaggacaaacaauacaaauacgaagaggguuguaguaccuuu

SEQ ID NO: 287359 - RNA, 64 nt, Homo Sapiens
aaaugagggaaggcaagaaauggaaaaacaaauauacaaauauggggagucaggauguucacua

SEQ ID NO: 287360 - RNA, 64 nt, Homo Sapiens
uuuguacaagacuuuuuguaaugaauaaagcugcuacaaauauuauuucuaauuuucggcugcu

SEQ ID NO: 287361 - RNA, 64 nt, Homo Sapiens
cuaagauuuuacagucugguacaugaucagaucauacaaauaauugaagauuguacacuacauu

SEQ ID NO: 287362 - RNA, 64 nt, Homo Sapiens
auuauguuagcauuuacacuguuuuuggcaaaacuacaaauaggauuuuuuugaauuugugaaa

SEQ ID NO: 287363 - RNA, 64 nt, Homo Sapiens
gcaaugcuuacaauagaugucucacacagaacaauacaaauauguaaaaaaucuuucaccacau

SEQ ID NO: 287364 - RNA, 64 nt, Homo Sapiens
uugccaauuaauuggaucauauaaguaaaaucauuacaaauauaaguauuuacaggauuuuaaa

SEQ ID NO: 287365 - RNA, 64 nt, Homo Sapiens
ucauuuuauguaagggacuugugcguugguuauauacaaauauggauaaaguauacaggcggau

SEQ ID NO: 287366 - RNA, 64 nt, Homo Sapiens
aauacaguauaacaguuauuaaaaauaaaaauaauacaaauaaaugcagaucaaaaauauuaga

SEQ ID NO: 287367 - RNA, 64 nt, Homo Sapiens
uuagccucauucauuuuuuaauccaugauggcuguacaaauaauggcuguauugaaaaauauaa

SEQ ID NO: 287368 - RNA, 64 nt, Homo Sapiens
ccuccugcgcacaguguuguucaguuucacaugguacaaauaaguaaaaccaaaugagcaaaca

SEQ ID NO: 287369 - RNA, 64 nt, Homo Sapiens
uuuaaauauuguuaguuuuaauauuccugauauuuacaaauauucauucuuauauacaaugaaa

SEQ ID NO: 287370 - RNA, 64 nt, Homo Sapiens
uaaacauaagagaauucauaccauagagaaauccuacaaauaugaagaaugugacaaagcuuuu

SEQ ID NO: 287371 - RNA, 64 nt, Homo Sapiens
uacacguaagauaauucauacuggaaggaaacccuacaaauaugaggaaugucucaaagcuuuu

SEQ ID NO: 287372 - RNA, 64 nt, Homo Sapiens
ucagauaucgagcaaaugguaaaaauagauggguuacaaauacauaauuuagucauguugggag

SEQ ID NO: 287373 - RNA, 64 nt, Homo Sapiens
uuacucuaaaauagcaccuauuguacacaaaaucuacaaauacauuucuauuuuuguuuagagu

SEQ ID NO: 287374 - RNA, 64 nt, Homo Sapiens
gaauucuuucauaaagcagaaaaccauuuuauaauacaaauaaccauucucugauuuaucucuu

SEQ ID NO: 287375 - RNA, 64 nt, Homo Sapiens
auuuuuuagcaguacuuuagcuugaaaguacucguacaaauacuguuagauuuaguugcaaaua

SEQ ID NO: 287376 - RNA, 64 nt, Homo Sapiens
uaagaguauaauuggauuguuaauagcuuaauuguacaaauaacaaccgggugaguauagucaa

SEQ ID NO: 287377 - RNA, 64 nt, Homo Sapiens
auaaggggaaguuuuauuaguguuaugcacacauuacaaauaauacuguaacaaaaguguacua

SEQ ID NO: 287378 - RNA, 64 nt, Homo Sapiens
uuuuaaccuagaucucccuauacugcucccagcaagagccaagauggggauuacaggugcgagc

SEQ ID NO: 287379 - RNA, 64 nt, Homo Sapiens
uuuuuuuuaauauagagacaagcuaguaaguagcagagccaagaauaacuuaucugugguuaca

SEQ ID NO: 287380 - RNA, 64 nt, Homo Sapiens
cauucuuggcccaggagcaugggggugcuggccaagagccaacagucuucuuagaguuaaagga

SEQ ID NO: 287381 - RNA, 64 nt, Homo Sapiens
auguuaacucuuccuuaucaucuuuaccuggcaaagagccaaucugguaaaucugccuuauccu

SEQ ID NO: 287382 - RNA, 64 nt, Homo Sapiens
gcugaugagagcaaugaacaggagaaggagggagagagccaaaugucugaguaaacagauaucc

SEQ ID NO: 287383 - RNA, 64 nt, Homo Sapiens
caaagauagaauuccaaguuauaaagcauaaaaaagagccaacagaaguaacuaauccgggaaa

SEQ ID NO: 287384 - RNA, 64 nt, Homo Sapiens
ggaaagaguaacagcaauugaaaaaagagauucaagagccaaguacucagcccuggcaggggau

SEQ ID NO: 287385 - RNA, 64 nt, Homo Sapiens
gugccucugaacagacugcugagauacccaaucaagagccaauccuugcuucccuagacucucc

SEQ ID NO: 287386 - RNA, 64 nt, Homo Sapiens
cuuggccuuaaggaaaucuuuacuccuguaagcaagagccaaccucacaggauuaggagcuggg

SEQ ID NO: 287387 - RNA, 64 nt, Homo Sapiens
guacauaaaaguuucuuuccuaaaccauucaccaagagccaauaucuaggcauuuucuugguag

SEQ ID NO: 287388 - RNA, 64 nt, Homo Sapiens
cuuauucaauucuucugaccucagaacuggcagaaggucagaugugacuacagaacucuaggug

SEQ ID NO: 287389 - RNA, 64 nt, Homo Sapiens
cagcucuuugggaggcugaagcggguggaucaugaggucagaagaucaagaccauacuggcuaa

SEQ ID NO: 287390 - RNA, 64 nt, Homo Sapiens
guucccaaaccccuggggcucugccuugaccucaaggucagaagcagaaggucagacuccaugu

SEQ ID NO: 287391 - RNA, 64 nt, Homo Sapiens
ccaugucugccuugaccucaaugugcugcucagaaggucagacuauaaaauucaaaaaagugug

SEQ ID NO: 287392 - RNA, 64 nt, Homo Sapiens
cacaggccaggcccagucacagcugggcuuccacaggucagaauaugggacaggacauggucag

SEQ ID NO: 287393 - RNA, 64 nt, Homo Sapiens
uccaugacaguagccauggagucccaccugugccaggucagagcccacccggcagguuucagag

SEQ ID NO: 287394 - RNA, 64 nt, Homo Sapiens
ucuagcacccagaggcaugacaggcccugcucagaggucagagggucugggcagaggagggacc

SEQ ID NO: 287395 - RNA, 64 nt, Homo Sapiens
gcagcccagggguaaguaaacaaaguauggaugaaggucagauuuucuugucaguuucugagaa

SEQ ID NO: 287396 - RNA, 64 nt, Homo Sapiens
auaggagcucagcaggcagacgaaugaggaauaaaggucagagaaggucagagcugagugacgu

SEQ ID NO: 287397 - RNA, 64 nt, Homo Sapiens
agcaggcagacgaaugaggaauaaaggucagagaaggucagagcugagugacguuuggaaucca

SEQ ID NO: 287398 - RNA, 64 nt, Homo Sapiens
uucaagagcacccuggcuaagaguggaucaccuaaggucagaagacacuuugguagacugaugu

SEQ ID NO: 287399 - RNA, 64 nt, Homo Sapiens
uuugaaaccagcauggccaaacauaggucacuugaggucagaaggcacgguuggaggccaaggc

SEQ ID NO: 287400 - RNA, 64 nt, Homo Sapiens
aucccucccuuuggggagccuauauugcuggagucauacccagccuaaguguugcccugcacua

SEQ ID NO: 287401 - RNA, 64 nt, Homo Sapiens
ucccccucaucucuggggcccccuguggaucuggcauacccaaguucaguaaaugucuaucagu

SEQ ID NO: 287402 - RNA, 64 nt, Homo Sapiens
cgcagcuccuagcccguugcgguggcccaucccgcauacccaucuucucgggcuucagcccagu

SEQ ID NO: 287403 - RNA, 64 nt, Homo Sapiens
ugcaguaucuuccccugacuccagccacaaagcucauacccagcccuaccaaucaugaacugga

SEQ ID NO: 287404 - RNA, 64 nt, Homo Sapiens
gcccagcuucucccugagggaccagccugugcugcauacccacccagcuucucccugagggccc

SEQ ID NO: 287405 - RNA, 64 nt, Homo Sapiens
gcccagcuucucccugagggaccagccugugcugcauacccaccugcccugccucugagggccc

SEQ ID NO: 287406 - RNA, 64 nt, Homo Sapiens
uucaucauuggcauuugaacgcuccaaaugaguccauacccaucaccagacucaauuuaaaucu

SEQ ID NO: 287407 - RNA, 64 nt, Homo Sapiens
uacacagcaaugaauggcaccguugucaaaaugccauacccaaaauaugguuuucuguuacuuu

SEQ ID NO: 287408 - RNA, 64 nt, Homo Sapiens
aaaaugaguaagaacuggcaaagaaauguauaaaaaaccugaaaacauaauguauguguuguuu

SEQ ID NO: 287409 - RNA, 64 nt, Homo Sapiens
ugccucuuuagcaaaagccuguuguuuuaauuugaaaccugaaaugcuuuuucacuaaagguca

SEQ ID NO: 287410 - RNA, 64 nt, Homo Sapiens
acugcuuggcauuugaguagaaacaaacaaaaacaaaccugaaaaaaagaaaaauauaaaagua

SEQ ID NO: 287411 - RNA, 64 nt, Homo Sapiens
uauacagaacugaagggaauauugaggcucaaugaaaccugacaaagagacuguaauauuguag

SEQ ID NO: 287412 - RNA, 64 nt, Homo Sapiens
gacuugcaguaguaaguaacugagagcauaaaauaaaccugacuguaugaagucaauuuaagug

SEQ ID NO: 287413 - RNA, 64 nt, Homo Sapiens
agaagcaugaaaguaauaaugugggauuacuagaaaaccugacuaauggugucacugcuggcaa

SEQ ID NO: 287414 - RNA, 64 nt, Homo Sapiens
agaagcacggaaguacucaugucggauucccagaaaaccugacuaauggugccacugcuggcaa

SEQ ID NO: 287415 - RNA, 64 nt, Homo Sapiens
aaagcauauggucaguuauuuaauuaaaaaggcaaaaccugaaccaccuucugcacuuaaagaa

SEQ ID NO: 287416 - RNA, 64 nt, Homo Sapiens
gcaucugaagcuucuuuggccuagauuuuagcacaaaccugaguauaucucuucuacuuucauc

SEQ ID NO: 287417 - RNA, 64 nt, Homo Sapiens
agaccacucaauccauccauguacuucccucuugaaaccugaugucagcugcuguugaacuuuu

SEQ ID NO: 287418 - RNA, 64 nt, Homo Sapiens
cgaagacugagccagauuggccaauuaaaaacgaaaaccugacuagguucuguagagccaauua

SEQ ID NO: 287419 - RNA, 64 nt, Homo Sapiens
cucacuaaacauaagauaauacugaaaacuuuacaaaccugaaugaugugacaauaauuuugac

SEQ ID NO: 287420 - RNA, 64 nt, Homo Sapiens
gaauaaggacauuaaaauguaagaugcaugaugaaaaccugagugaagaggcuguuuguguuua

SEQ ID NO: 287421 - RNA, 64 nt, Homo Sapiens
ggaggccauugugugagccuaucagaguugcugcaaaccugaccccugcucaguaaagcacuug

SEQ ID NO: 287422 - RNA, 64 nt, Homo Sapiens
uucuucugaacucaaacugaggaauuucaccuguaaaccugagucguacagaaagcugccuggu

SEQ ID NO: 287423 - RNA, 64 nt, Homo Sapiens
ugacaccagagaacaauaguagucucaagaauggaaaccugaaugucugagggaaugggcuggu

SEQ ID NO: 287424 - RNA, 64 nt, Homo Sapiens
ugggacagcugauuucuuugauucccuagcugcaaaaccugaaauugaccacuaggugacagaa

SEQ ID NO: 287425 - RNA, 64 nt, Homo Sapiens
gauagguauuguuucccagauuaauuuaauauuuaaaccugagauaugcauuaaaauauauuug

SEQ ID NO: 287426 - RNA, 64 nt, Homo Sapiens
acugaggacaaaguggaggaagcggcagaaaggaaaaccugaaggaacccacaacuuaggcccu

SEQ ID NO: 287427 - RNA, 64 nt, Homo Sapiens
uuacugaaacauuuugccagacuuucuccaaaugaaaccugaaucaauuuuucuaaaucuaggu

SEQ ID NO: 287428 - RNA, 64 nt, Homo Sapiens
ggacuucagaagugcaauguauuuuucuccugugaaaccugaaucuacaaguuuuccugccaag

SEQ ID NO: 287429 - RNA, 64 nt, Homo Sapiens
cugccgagcaggaguggauggacaagagaaaaacaaaccugaagcaacaacaacacacaaaccu

SEQ ID NO: 287430 - RNA, 64 nt, Homo Sapiens
agagaaaaacaaaccugaagcaacaacaacacacaaaccugacaaaaagacaaaaacaaaacaa

SEQ ID NO: 287431 - RNA, 64 nt, Homo Sapiens
gaccgguagcagcgcucgcugacagcuugggaggaaaccugagaucuguguuuuuuaaauugau

SEQ ID NO: 287432 - RNA, 64 nt, Homo Sapiens
auugugcuguuugcuuguaguugaauaaaaauagaaaccugaaugaaggaacugaguccccgga

SEQ ID NO: 287433 - RNA, 64 nt, Homo Sapiens
augccacuuucaugcaguuucugggcaaaccugaaaaccugaaaagcccagcaaacguugacuu

SEQ ID NO: 287434 - RNA, 64 nt, Homo Sapiens
accugaaaaugccacuuucaguugacuucugggcaaaccugaaauuucuccaagcccagcaaac

SEQ ID NO: 287435 - RNA, 64 nt, Homo Sapiens
ccccccguccccccccccccaaaagaccccguguaaaccugagcgaugauuaaacguuguauua

SEQ ID NO: 287436 - RNA, 64 nt, Homo Sapiens
gcaagcaacaaaacauacacuuuuccaguaaacaaaaccugaaacugacaggagcauuuuuuuu

SEQ ID NO: 287437 - RNA, 64 nt, Homo Sapiens
auuauuaccagccuagagucgcaaaagggagaauaaaccugaauacucuggguaucccacagau

SEQ ID NO: 287438 - RNA, 64 nt, Homo Sapiens
aucugagggugaugucuggcgccaagguuuauagaaaccugagagcgcccucuccucucuuccu

SEQ ID NO: 287439 - RNA, 64 nt, Homo Sapiens
aaccaaaguaaaucugaaaggucuuuuuauuacuuauaaagacaguauucuugugccauauucu

SEQ ID NO: 287440 - RNA, 64 nt, Homo Sapiens
auacuugcaauauauuuuucuaauugaaauugucuauaaagaaauuccuuaaacuauuguuuuc

SEQ ID NO: 287441 - RNA, 64 nt, Homo Sapiens
uauaaaucauuaagacaacuuaguauaaagauuauauaaagaccacaagugagacaaaaagcac

SEQ ID NO: 287442 - RNA, 64 nt, Homo Sapiens
auauaaagaccuauaaaucaacaaaaagcacuaguauaaagauuacaaauaaaugacaagugag

SEQ ID NO: 287443 - RNA, 64 nt, Homo Sapiens
ucuuucccagaauuguuuuuuggcagggacuucauauaaagaaacaauuaggauggcuggcuag

SEQ ID NO: 287444 - RNA, 64 nt, Homo Sapiens
uguggccaugcuuuaaaccuaacuagaauuuuaauauaaagaaaguuucuaaaagaaauguaca

SEQ ID NO: 287445 - RNA, 64 nt, Homo Sapiens
agugucaucuccuggguaaauuuugaugucgcauuauaaagacaugcauaauugaugguuucua

SEQ ID NO: 287446 - RNA, 64 nt, Homo Sapiens
aguagcuaagaaguauuaaaacuauauacauccauauaaagaugaaauaugaacuaucucauua

SEQ ID NO: 287447 - RNA, 64 nt, Homo Sapiens
acuuucaaggaacauauaauaauacaaaagggaauauaaagaugguguacaaaguacuguucua

SEQ ID NO: 287448 - RNA, 64 nt, Homo Sapiens
ugggaaggauaccuggagcaaccccaaaauuagauauaaagaauuguuuuuaaugcuaacauag

SEQ ID NO: 287449 - RNA, 64 nt, Homo Sapiens
uaguaaaugcaucuccuagaaaacagauauagcguauaaagauaugcugcagauauauaacuca

SEQ ID NO: 287450 - RNA, 64 nt, Homo Sapiens
uauuaaccuuuauaaacauuagacauagaacccuuauaaagaauauaaguagaagauuuguuga

SEQ ID NO: 287451 - RNA, 64 nt, Homo Sapiens
uauuuucuucuccuuuauauguaaugaaagcacuuauaaagaaacaggaaucauuagaccaggu

SEQ ID NO: 287452 - RNA, 64 nt, Homo Sapiens
uuuaaaaguaaaauacuucugacuguuaaaacuauauaaagaaaaucucauuugucuaauugca

SEQ ID NO: 287453 - RNA, 64 nt, Homo Sapiens
agcuucacuuuuuguguucuaauuguuuuugagauauaaagacccugaaaaagcccauuuuaga

SEQ ID NO: 287454 - RNA, 64 nt, Homo Sapiens
uaaauuuaaaagcaguccaguaaaagguuaacuguauaaagaaucuaugacuuuuugagggaag

SEQ ID NO: 287455 - RNA, 64 nt, Homo Sapiens
uucagcuacaucaugccgcgcuguuguaauacuguauaaagaccucaaucuauccagaguauuu

SEQ ID NO: 287456 - RNA, 64 nt, Homo Sapiens
uugcagcuuugaaaacauucaucucagaguuagguauaaagacauaaaaaugugugucaagccc

SEQ ID NO: 287457 - RNA, 64 nt, Homo Sapiens
cuaaacauguaucugagcugcaauaucuuugcuuuauaaagauuauuaucuuuauggaacuuuu

SEQ ID NO: 287458 - RNA, 64 nt, Homo Sapiens
cucccagccaggccaacaugcacuaacaaaaugguauaaagaauccuaagaaauaccacccuac

SEQ ID NO: 287459 - RNA, 64 nt, Homo Sapiens
aaaccacucugguggcuguucauguacuuguguuuauaaagaaguuggaauuucaaauaaaccu

SEQ ID NO: 287460 - RNA, 64 nt, Homo Sapiens
aucuuguaagauacuccugacagcagugauauuguauaaagaacuuauuaaaaguugcuuguuu

SEQ ID NO: 287461 - RNA, 64 nt, Homo Sapiens
ccuauggacguuaauugaaaagaaagauuguuguuauaaagaauugguuucuuggaaagcaggc

SEQ ID NO: 287462 - RNA, 64 nt, Homo Sapiens
aggaaacaguauuguaugauauauuuauaaaugcuauaaagaaauauuguguuucaugcauuca

SEQ ID NO: 287463 - RNA, 64 nt, Homo Sapiens
gugccuacuucaugaucaugaauuccaguuaauuuauaaagaggcgauuuuugugugccauuca

SEQ ID NO: 287464 - RNA, 64 nt, Homo Sapiens
agaaguugccugcaugccgguccaaauuguucuguauaaagaugcucuuaaaagacacaagagu

SEQ ID NO: 287465 - RNA, 64 nt, Homo Sapiens
uucuuuuuuauuugaaauuuuaagucaaguccuuuauaaagaccauagcaguggaaaacagugu

SEQ ID NO: 287466 - RNA, 64 nt, Homo Sapiens
uuuuugacaaguaagauugcaaaauagaaauaucuauaaagauuccacaguuugacauuauggc

SEQ ID NO: 287467 - RNA, 64 nt, Homo Sapiens
uucugugguaauacuacugauauuugcuuuucuauauaaagaaauguugccuaaggcugucugg

SEQ ID NO: 287468 - RNA, 64 nt, Homo Sapiens
acuagcuuacaaauauucuguuaagggguaguuuuauaaagaaaaaugauauauaguuauguug

SEQ ID NO: 287469 - RNA, 64 nt, Homo Sapiens
uucaguuaaaguuuugacuucuuauuauaaauaauauaaagaaugucucaguaauuagaaaucc

SEQ ID NO: 287470 - RNA, 64 nt, Homo Sapiens
agagauguguagcucacaggggcuaccuuaccaguauaaagagcugauaacaguacucagaaga

SEQ ID NO: 287471 - RNA, 64 nt, Homo Sapiens
auacaguuauucuuuuuuuuaaagaacauuguuuuauaaagaacgugauuuccagugaucucug

SEQ ID NO: 287472 - RNA, 64 nt, Homo Sapiens
gaucuguugccguauuaguccguuuucacacagcuauaaagaaugccugagacugggugaugua

SEQ ID NO: 287473 - RNA, 64 nt, Homo Sapiens
cacagcuauaaagaaugccugagacugggugauguauaaagaaaagaaguuuaacugacucaca

SEQ ID NO: 287474 - RNA, 64 nt, Homo Sapiens
ugacuuaaaaugaagaauuaacuuguguuacaucuauaaagagcaaaauaacacacuccagaac

SEQ ID NO: 287475 - RNA, 64 nt, Homo Sapiens
auuaauuggcuuucuguauucuaugccuuuuauuuauaaagacacuaagaaaacccauguuugu

SEQ ID NO: 287476 - RNA, 64 nt, Homo Sapiens
ugacugaaaguuguugacagucaaaauacaaaaauauaaagaaauuuguuuaaaagaaguuuug

SEQ ID NO: 287477 - RNA, 64 nt, Homo Sapiens
uauuuuuuuuuuuuuaagaggagaagccacauacuauaaagaucgagaaaaagguggaaaggaa

SEQ ID NO: 287478 - RNA, 64 nt, Homo Sapiens
auuuauaauacuguuuuaaaggauuaaaccuuuuuauaaagaucuaaaagccuuccaguuuugu

SEQ ID NO: 287479 - RNA, 64 nt, Homo Sapiens
aaggugaggggaagacaaagucaaaauggugugcuauaaagauagaugcuugauuguuuugguc

SEQ ID NO: 287480 - RNA, 64 nt, Homo Sapiens
guuuaaaauaucuugauauuugaaaauuagcaauuauaaagauuagccgaacaguauucuuuuu

SEQ ID NO: 287481 - RNA, 64 nt, Homo Sapiens
aauacuuaguagauaaaaacaaauauucuauuuuuauaaagauauauacuauuagauaagaauu

SEQ ID NO: 287482 - RNA, 64 nt, Homo Sapiens
gaucucuuaauaagugaaucaaacauuacuuccauauaaagacaaauguuaguuucauuccgug

SEQ ID NO: 287483 - RNA, 64 nt, Homo Sapiens
uuuauugaacauuuauuaaagaguaauuuuccacuauaaagaaugauuugagugguuauucauu

SEQ ID NO: 287484 - RNA, 64 nt, Homo Sapiens
accagacagauuuauaguugaagccuacgagauguauaaagaaaagcuguuaccaaucuuacug

SEQ ID NO: 287485 - RNA, 64 nt, Homo Sapiens
caaacugcaucugacaaagaucuaauccagaaucuauaaagaacucaaacaaaucaacaaugag

SEQ ID NO: 287486 - RNA, 64 nt, Homo Sapiens
aaaaaugaaucauuguguuaggauucuaauucuuuauaaagaacuucaugggcuucaauaaugu

SEQ ID NO: 287487 - RNA, 64 nt, Homo Sapiens
uucuagugguuugauccaaaucccauuacaguuguauaaagaaauaaaauuuuguacuuauauu

SEQ ID NO: 287488 - RNA, 64 nt, Homo Sapiens
ucuauuuaagcaugugguuuuaaaaauagacaguauuuuuuaaaaaucaaaaaaugacuugcaa

SEQ ID NO: 287489 - RNA, 64 nt, Homo Sapiens
gugauaagguugugugucgugugggaguggggcgauuuuuuaugugccaaauacccccgucccc

SEQ ID NO: 287490 - RNA, 64 nt, Homo Sapiens
acaggcaugcgccaccaugccuggcuaauuucauauuuuuuaguagagacaggauuucuccaug

SEQ ID NO: 287491 - RNA, 64 nt, Homo Sapiens
agucuaauauugcaguuggaauucuugcuguauuauuuuuuaagcaaguguuaggugcauuuaa

SEQ ID NO: 287492 - RNA, 64 nt, Homo Sapiens
aggggcuugagaaagugggugggaggagggaaggauuuuuuaggagccuuaaucagaaaaggac

SEQ ID NO: 287493 - RNA, 64 nt, Homo Sapiens
guuuuaauggguucagaauccaguuuguaggaagauuuuuuaaugguuuugguugcuccucccc

SEQ ID NO: 287494 - RNA, 64 nt, Homo Sapiens
agguuagucaucaguaaccuucucuauuauuauuauuuuuuagaaacuuggaauacugucguca

SEQ ID NO: 287495 - RNA, 64 nt, Homo Sapiens
ugcagauaaggauccauuucugggauagaauuguauuuuuuaagucauuuuuuuuucuugaaau

SEQ ID NO: 287496 - RNA, 64 nt, Homo Sapiens
guuggauuugcccauauuuauguaggugguuuuaauuuuuuaaauggugauuaguguuaaaaau

SEQ ID NO: 287497 - RNA, 64 nt, Homo Sapiens
agaaacaucuuuaacauauaguuucauaccauucauuuuuuaacaaagaaagggaaaagucugc

SEQ ID NO: 287498 - RNA, 64 nt, Homo Sapiens
uuuaaaugaagcaccaugaauucuuuuuuaaauuauuuuuuaaaagucuuucucucucugauuc

SEQ ID NO: 287499 - RNA, 64 nt, Homo Sapiens
guacagccuaccaggaacauguuguguuuucuuuauuuuuuaaaaucauuauauugaguugugu

SEQ ID NO: 287500 - RNA, 64 nt, Homo Sapiens
cuuccuuuuuauuucauaagacugcuaggaagugauuuuuuaaaauuaggacuccuuaagaaua

SEQ ID NO: 287501 - RNA, 64 nt, Homo Sapiens
guauacauguacuuaguaugugugguaucaggauauuuuuuaaacugugauaauacaacagaua

SEQ ID NO: 287502 - RNA, 64 nt, Homo Sapiens
cuauuguuugugugcuuguuuugcgcuauggaacauuuuuuaauuuauuuuaagauaaauuauu

SEQ ID NO: 287503 - RNA, 64 nt, Homo Sapiens
uccuuacgauacugaaacuuuacagcugcuguaaauuuuuuauaaaugaauuucaaaauguuau

SEQ ID NO: 287504 - RNA, 64 nt, Homo Sapiens
uguuauuugcuuuucuccuccaccugugugguauauuuuuuaagcagaauuuuauuuuuuaaaa

SEQ ID NO: 287505 - RNA, 64 nt, Homo Sapiens
ccaccugugugguauauuuuuuaagcagaauuuuauuuuuuaaaauaaaagguucuuuacaaga

SEQ ID NO: 287506 - RNA, 64 nt, Homo Sapiens
uucuuaaguuaaggauguuuggcuuuuuucuuuaauuuuuuaaaaaccauuuuccuauguuagg

SEQ ID NO: 287507 - RNA, 64 nt, Homo Sapiens
aggggacaguuaaauaucuuaaaauaucuaaaacauuuuuuaaagcacuuagauugucuuacgu

SEQ ID NO: 287508 - RNA, 64 nt, Homo Sapiens
aaauuugcgccucgguaucuuauuucugacucuuauuuuuuaaacaacagaaaccuuuuauuuu

SEQ ID NO: 287509 - RNA, 64 nt, Homo Sapiens
ucuugaccaacagaaaccuugaagaaacuuuuuuauuuuuuaaaggacuugugauuggcugcag

SEQ ID NO: 287510 - RNA, 64 nt, Homo Sapiens
cacaguaauugaacuguauuuauguaaaaaugaaauuuuuuagaguuguaaauauugucuuggu

SEQ ID NO: 287511 - RNA, 64 nt, Homo Sapiens
auaggauuuagaaaccaagguuuacaauuaggcuauuuuuuaaugugucuacagcuaaauuuug

SEQ ID NO: 287512 - RNA, 64 nt, Homo Sapiens
gccagugcucuaagaccucaggacuggugaaaauauuuuuuaaaaucggguuuucauuuacucu

SEQ ID NO: 287513 - RNA, 64 nt, Homo Sapiens
aaacaccaugcuuggaggguuaagggaaaaauuaauuuuuuaaaaggugagaguuuuuaaagug

SEQ ID NO: 287514 - RNA, 64 nt, Homo Sapiens
gagguauuuaccacugaagaauaauuuuuuaauaauuuuuuaauacuagggcuuuguauuguca

SEQ ID NO: 287515 - RNA, 64 nt, Homo Sapiens
aauuuuuuaaugagguauuuuuguauugucaauaauuuuuuaauucuguauacuaacuagggcu

SEQ ID NO: 287516 - RNA, 64 nt, Homo Sapiens
aagguuuucuauauggggauacauuguauauauaauuuuuuaaaacuuaaagcuucuaugguug

SEQ ID NO: 287517 - RNA, 64 nt, Homo Sapiens
agagaugggguuucaccaucaagcuaauuuuuguauuuuuuagucaggugcgcacuaccacgcc

SEQ ID NO: 287518 - RNA, 64 nt, Homo Sapiens
aaauacacugaaauuuaaccucugugaaaguaauauuuuuuauaugcuauuguaucucuucacu

SEQ ID NO: 287519 - RNA, 64 nt, Homo Sapiens
gucuuuugcuccauaucagguuuuuaaaacugucauuuuuuacuuaaaugcacgaaugucuuuu

SEQ ID NO: 287520 - RNA, 64 nt, Homo Sapiens
auccacuugugcauguaguucauuuucuucauacauuuuuuaggccauaaauauuauggccuuc

SEQ ID NO: 287521 - RNA, 64 nt, Homo Sapiens
gaaagacuuuugaaaagugccugguacuuuuauuauuuuuuaguaguacuuagaauuuguuuaa

SEQ ID NO: 287522 - RNA, 64 nt, Homo Sapiens
uuuuuuaaauuuugaugugaacauauucaaacacauuuuuuaacaccacuucugugugauaugu

SEQ ID NO: 287523 - RNA, 64 nt, Homo Sapiens
cauacaaauucauaaauuccaaaauaaaaauggaauuuuuuaccuguucuccccuacauuagua

SEQ ID NO: 287524 - RNA, 64 nt, Homo Sapiens
uucaugucuaugacaugaacagcaggaacuuuaaauuuuuuaagguagaugcaucuaagcaggc

SEQ ID NO: 287525 - RNA, 64 nt, Homo Sapiens
gaaggcacuuuuaaaauuaauuuaaaauuaaguaauuuuuuaaaaaguuuccccacuuuuauuu

SEQ ID NO: 287526 - RNA, 64 nt, Homo Sapiens
auuaaguaauuuuuuaaagaguuuccccacuuuuauuuuuuaaacuugaaagucaccugaggaa

SEQ ID NO: 287527 - RNA, 64 nt, Homo Sapiens
ccauucuuuguuuguuuaccgguuauuauuuuuuauuuuuuaauucuccuucaggguuuauuua

SEQ ID NO: 287528 - RNA, 64 nt, Homo Sapiens
uuuuaauccauucuuuguuuuuauuuagguuauuauuuuuuauuaucagacucuccuucagggu

SEQ ID NO: 287529 - RNA, 64 nt, Homo Sapiens
uaacuacacuucuugauauuuugguccguucauuauuuuuuagugcaaucguuuuccauggagu

SEQ ID NO: 287530 - RNA, 64 nt, Homo Sapiens
ggaacaugaaaaccuccacauguggauuuuuaauauuuuuuaaugggauccaucuggguugguc

SEQ ID NO: 287531 - RNA, 64 nt, Homo Sapiens
uuuugaauuugacauugaguuguucuaauuuuguauuuuuuaauugguaaauuuaaauacauac

SEQ ID NO: 287532 - RNA, 64 nt, Homo Sapiens
uguauugcauuuucccccuaauauccaguuuuucauuuuuuaccauauaaauugaccauugaug

SEQ ID NO: 287533 - RNA, 64 nt, Homo Sapiens
cuacacuaucaaaauaauuuugcuaaauaagccuauuuuuuacauuuuagagaacacuacuaaa

SEQ ID NO: 287534 - RNA, 64 nt, Homo Sapiens
agauagcaguuagcacuuaaauuguuuuaaauuaauuuuuuagcuuauuuugugagcauaauuu

SEQ ID NO: 287535 - RNA, 64 nt, Homo Sapiens
uccugauuaauauauugugaucugugaaaauuuaauuuuuuauaaacaaacaucccugaaaacc

SEQ ID NO: 287536 - RNA, 64 nt, Homo Sapiens
uggugucucacgcuaucgccguuuuuauuuuuuuauuuuuuagauuaauuucucauuuuggggg

SEQ ID NO: 287537 - RNA, 64 nt, Homo Sapiens
aauucaguuuuaagaucucucugcacauggcagcauuuuuuaaagggauuacaggcgggagcca

SEQ ID NO: 287538 - RNA, 64 nt, Homo Sapiens
aauacagaaucuauucuacugauguaaccaccucauuuuuuacaagucccccuucaacccaguu

SEQ ID NO: 287539 - RNA, 64 nt, Homo Sapiens
uuuaaauauaucuucagguuugaaggaugaugcuauuuuuuauugaaaugccaaaaacuuggag

SEQ ID NO: 287540 - RNA, 64 nt, Homo Sapiens
gaugagaauuguaugucauguugcaguaguauuuauuuuuuagucuuuuaugauuuuguuuaua

SEQ ID NO: 287541 - RNA, 64 nt, Homo Sapiens
uucaguucuacgugaauuagguuugccuuauuuaauuuuuuacucuacaccaagguaaacaggu

SEQ ID NO: 287542 - RNA, 64 nt, Homo Sapiens
uuucuagaagagaaaaacuacugauucuagguacauuuuuuaacugaaggcuaaaugagauaca

SEQ ID NO: 287543 - RNA, 64 nt, Homo Sapiens
gauaucugugggggcaaaauuuaauuuggauuugauuuuuuaaaacaauguuuacugcgauuuc

SEQ ID NO: 287544 - RNA, 64 nt, Homo Sapiens
ugaccuucauauaaucagcauaaacauaaaacaaauuuuuuacuuaacaugagugcacuuuacu

SEQ ID NO: 287545 - RNA, 64 nt, Homo Sapiens
gaaauuuuggaccuacuaacucuaagccuauuuuauuuuuuauaaaacuaugugacauuuuggu

SEQ ID NO: 287546 - RNA, 64 nt, Homo Sapiens
gugauucaugcaggguuaaagaugcuuuguuuuuauuuuuuaaguaccaaaauugguuucagaa

SEQ ID NO: 287547 - RNA, 64 nt, Homo Sapiens
gcaggcaugagccaccgugcccagccucaaaaauauuuuuuaaaagaaaagagaaaauaauucu

SEQ ID NO: 287548 - RNA, 64 nt, Homo Sapiens
aauauuuuacuuuauugauaaugacaaaaagaauauuuuuuaaaccccaucaaaauagauuuca

SEQ ID NO: 287549 - RNA, 64 nt, Homo Sapiens
uacuaaugaugacauucaguucucuuuuguuuuuauuuuuuaaaaacucagguguaauuauuau

SEQ ID NO: 287550 - RNA, 64 nt, Homo Sapiens
aagcacagaaacaucuuuacgguggcaucaucucauuuuuuaggaagacaugauaauacugccc

SEQ ID NO: 287551 - RNA, 64 nt, Homo Sapiens
gauuugcuuucagcuguuucugugauuauaaagcauuuuuuaagagacaaauuuuaacuuuuaa

SEQ ID NO: 287552 - RNA, 64 nt, Homo Sapiens
uugcaucuaacugccagugccauugucaaaacuuauuuuuuaaaucguuguacauuucuuauua

SEQ ID NO: 287553 - RNA, 64 nt, Homo Sapiens
uccuauuucaugccauucuuguuaguugacugguauuuuuuacugaggagcaacucauuccagc

SEQ ID NO: 287554 - RNA, 64 nt, Homo Sapiens
uuuuuacgcugcuuuuuucaaugcauuucuuaauauuuuuuaaguuucaugaaugcaugcucag

SEQ ID NO: 287555 - RNA, 64 nt, Homo Sapiens
acguuuaaaaccuuuauugucucuccuuagucuaauuuuuuaaauauggauuaugcuugaauua

SEQ ID NO: 287556 - RNA, 64 nt, Homo Sapiens
caggguuugaaaucaguuuuugugggugauugcaauuuuuuaaugaaaugcauuagaacaucua

SEQ ID NO: 287557 - RNA, 64 nt, Homo Sapiens
auauaugcauuaaguguagcaaaucgugauguaaauuuuuuacugcuggucauggucaaaaagu

SEQ ID NO: 287558 - RNA, 64 nt, Homo Sapiens
auuauucuaauuuuauauauagagaaagugaccuauuuuuuaaaaaaaucacacucuaaguucu

SEQ ID NO: 287559 - RNA, 64 nt, Homo Sapiens
ugccuuucuuauuugcaauaaaagguauugagccauuuuuuaaaugacauuuuugauaaauuau

SEQ ID NO: 287560 - RNA, 64 nt, Homo Sapiens
uuucaauucuucuggugagaauuagaaaugaaauauuuuuuauucauuggccaaaaaguucaca

SEQ ID NO: 287561 - RNA, 64 nt, Homo Sapiens
uccauuuuaggucuuuuucaagaauagugaacacauuuuuuaacaaaauaaguuguaauuuuaa

SEQ ID NO: 287562 - RNA, 64 nt, Homo Sapiens
aaaguguugauuaauagaugaaauuuuuaaauuaauuuuuuaaaacaugccauacauuguauca

SEQ ID NO: 287563 - RNA, 64 nt, Homo Sapiens
agauaauguuauucauuuagaacaaauaagguauauuuuuuagaaucaacuuuguaagcacuau

SEQ ID NO: 287564 - RNA, 64 nt, Homo Sapiens
aaauaaaacugaauauuaugcagauuuaugccuuauuuuuuagcauuuuuuaagguugggucuu

SEQ ID NO: 287565 - RNA, 64 nt, Homo Sapiens
gaauauuaugcagauuuaugccuuauuuuuuagcauuuuuuaagguugggucuuucaggcuggu

SEQ ID NO: 287566 - RNA, 64 nt, Homo Sapiens
ugggaggaagaaauuuucucagagcaaacuuucuauuuuuuaccugugaaauaacagugacuuu

SEQ ID NO: 287567 - RNA, 64 nt, Homo Sapiens
uuuguaugcguauauaagcaaauauguaaucuuuauuuuuuaaauaaaugggaucauauuauau

SEQ ID NO: 287568 - RNA, 64 nt, Homo Sapiens
cagggagacuugucuaugacucgaucuucaauuuauuuuuuacauauauaugagaagaguguca

SEQ ID NO: 287569 - RNA, 64 nt, Homo Sapiens
caaaagacccaaaucaaaaaguuaguuugaaagcauuuuuuaauaauuguauuuaugcauuucc

SEQ ID NO: 287570 - RNA, 64 nt, Homo Sapiens
auaacuguaaagauguuuauuucaggcauuggauauuuuuuacuuuagaagccugcauaauguu

SEQ ID NO: 287571 - RNA, 64 nt, Homo Sapiens
uaccuguggauauuuguauaaaagugugaaauaaauuuuuuauaaaaguguucauuguuucgua

SEQ ID NO: 287572 - RNA, 64 nt, Homo Sapiens
cuguuuucuacuucaguauucuaccagagaacauauuuuuuaggggagaaggguuaugguuuug

SEQ ID NO: 287573 - RNA, 64 nt, Homo Sapiens
uuugccucuuuguuuuucaauagauuauucugccauuuuuuaaaggaaagggaaaaugaaaaca

SEQ ID NO: 287574 - RNA, 64 nt, Homo Sapiens
ugggacuacaggggcccgccaccacaccuggcuaauuuuuuaaaaauauuuuuaguagagacag

SEQ ID NO: 287575 - RNA, 64 nt, Homo Sapiens
uaucuuuaaaauuuaaguaucuuuuuucaaaaacauuuuuuaauagaauaaaauauaauuugau

SEQ ID NO: 287576 - RNA, 64 nt, Homo Sapiens
uguauuugggccaguugauuguagguuguccaacauuuuuuaauauugggaaaauuaugauaaa

SEQ ID NO: 287577 - RNA, 64 nt, Homo Sapiens
gccaagauggugaaaccccgucucuauuaaaaauauuuuuuaaaaauuaacugagcgugguggu

SEQ ID NO: 287578 - RNA, 64 nt, Homo Sapiens
cugggcugaugcuccguuucucugggaauuggugauuuuuuacugugaagaugaaauuacccua

SEQ ID NO: 287579 - RNA, 64 nt, Homo Sapiens
ugggacuacaggcgcccgccaccacgccuggcuaauuuuuuauauuuuuaguagagacaggguu

SEQ ID NO: 287580 - RNA, 64 nt, Homo Sapiens
ugcugucaaaguuacaguuuuuaauuugauuuuuauuuuuuaaaagaaguggccucaaaggcac

SEQ ID NO: 287581 - RNA, 64 nt, Homo Sapiens
cacauuaaucagauaucauuaaacuucccacuuuauuuuuuauaauacugcaagaagguuuuuu

SEQ ID NO: 287582 - RNA, 64 nt, Homo Sapiens
uuuauaugguuucagaaguagugauuuuuuaaaaauuuuuuaucuuuauuucuccaaaucgaga

SEQ ID NO: 287583 - RNA, 64 nt, Homo Sapiens
aauuuuuuaucuuuauauggccaaaucgagagugauuuuuuaaauauaauguaaauuuauuucu

SEQ ID NO: 287584 - RNA, 64 nt, Homo Sapiens
guucuuguguauauuuggggucauccauuuguaaauuuuuuaagaaacuauuuauugacuuuau

SEQ ID NO: 287585 - RNA, 64 nt, Homo Sapiens
ugauuccuaggauuuaguaaugaagaaaacauuuauuuuuuauuauaaaagccuuccccuucag

SEQ ID NO: 287586 - RNA, 64 nt, Homo Sapiens
gucuucuaaggauggucuucguguaucagaaguaauuuuuuaauaucuaaauuauuaggagugu

SEQ ID NO: 287587 - RNA, 64 nt, Homo Sapiens
aucuuaaauccucuguccaaacuuaugcuucuuaauuuuuuaaaccuugaccagagcacagauu

SEQ ID NO: 287588 - RNA, 64 nt, Homo Sapiens
acuugaaaaacacuucugugcuauacauuucaaaauuuuuuauauguauugguugcuccugaca

SEQ ID NO: 287589 - RNA, 64 nt, Homo Sapiens
aaguccacagaggagaauuuuuaaaaaaauguaaauuuuuuaaaaauacucugcaaaguagccu

SEQ ID NO: 287590 - RNA, 64 nt, Homo Sapiens
ucacaugcauguuaggaaacuauuuuuuauuuuuauuuuuuaaagccagcaucucacggcaccu

SEQ ID NO: 287591 - RNA, 64 nt, Homo Sapiens
uuuauuuuuuaaaucacaugucucacggcaccuuauuuuuuauuaaauguuaaaacugccagca

SEQ ID NO: 287592 - RNA, 64 nt, Homo Sapiens
uguucccuaagaaaguaauuagucaauucuuaaaauuuuuuauugacucuggggugcuuacuuu

SEQ ID NO: 287593 - RNA, 64 nt, Homo Sapiens
uuuguauuuuuauacaaccuauuaauaaaaguucauuuuuuaaaucaauuauuuuguauuuaug

SEQ ID NO: 287594 - RNA, 64 nt, Homo Sapiens
aaucuuacgagugaaauguugcaggccccaaguuauuuuuuagcaguagcuucaccuuguguau

SEQ ID NO: 287595 - RNA, 64 nt, Homo Sapiens
ggaugugccuaugcauugauggggaccuuaauauauuuuuuaagaaguugauucaccccuuuuu

SEQ ID NO: 287596 - RNA, 64 nt, Homo Sapiens
gacucagcuguggcuuuuagccaugccuaggaacauuuuuuaaggucuuucacuggaaugaaga

SEQ ID NO: 287597 - RNA, 64 nt, Homo Sapiens
aacaaugaaauugucaaauucaaaguaaacguguauuuuuuaguaaaauuauacaugagcagcu

SEQ ID NO: 287598 - RNA, 64 nt, Homo Sapiens
gaguauaugguauauuguguacuuucauagaauaauuuuuuauaccugucuacuguaacuuaag

SEQ ID NO: 287599 - RNA, 64 nt, Homo Sapiens
uaccaaagcaguuuacauauguccuuauaugcauauuuuuuauuauauauuuaguguuuuauag

SEQ ID NO: 287600 - RNA, 64 nt, Homo Sapiens
cauauuuuuuauuauauauuuaguguuuuauagaauuuuuuaaaguuaacauauaauguagaua

SEQ ID NO: 287601 - RNA, 64 nt, Homo Sapiens
acaagcuaacaggcaauagaaauauguauaucagauuuuuuaauguaacaaacuacauguuaau

SEQ ID NO: 287602 - RNA, 64 nt, Homo Sapiens
gaagacagaacuauaauaaauuaguuuuguucugauuuuuuagaacacuugcaauaauguauca

SEQ ID NO: 287603 - RNA, 64 nt, Homo Sapiens
aaaugucuuaaagggaaucauuuuuguaggaagcauuuuuuauaauuuucuaagucgugcacuu

SEQ ID NO: 287604 - RNA, 64 nt, Homo Sapiens
aggugugugggccaccgugccuggcugauucagcauuuuuuaucaggcaggaccagguggcacu

SEQ ID NO: 287605 - RNA, 64 nt, Homo Sapiens
aaaaaaacccccagacuguaauaguauuauuauuauuuuuuaagauggaaucuugcucuguugc

SEQ ID NO: 287606 - RNA, 64 nt, Homo Sapiens
ccuccugaguagugugugccaccacgcccagcuaauuuuuuaauuuuuaguagagacaggguuu

SEQ ID NO: 287607 - RNA, 64 nt, Homo Sapiens
ugcaguuuguuuuauugugucuugcggauauugcauuuuuuacaaacugaagguuuguggcagg

SEQ ID NO: 287608 - RNA, 64 nt, Homo Sapiens
gguguuucaaacuuagagaagaccaagggacaguauuuuuuaucaaaggaauacuauuuuuuca

SEQ ID NO: 287609 - RNA, 64 nt, Homo Sapiens
guucauaauaaaaaucuguuagcucucaaagcuaauuuuuuacuaaaguuuuuauacagccuca

SEQ ID NO: 287610 - RNA, 64 nt, Homo Sapiens
ugccuaucaguuugaaauauauacacauauauauauuuuuuacauauuuacgccauuuuuacuu

SEQ ID NO: 287611 - RNA, 64 nt, Homo Sapiens
aauauuguucugaaaugcuuaacuucagaauuacauuuuuuaaaguaaauaauuguuuuaaauc

SEQ ID NO: 287612 - RNA, 64 nt, Homo Sapiens
cuggaacuacaggugugcacuccucgccuggcuaauuuuuuauuuuuuguacaggcaggaucuu

SEQ ID NO: 287613 - RNA, 64 nt, Homo Sapiens
ugauguuuuauauauaucauucagaaaaaguuuuauuuuuuaauaacauucuauuaacauuauu

SEQ ID NO: 287614 - RNA, 64 nt, Homo Sapiens
gagggaaauacauuuuaggaggaguuuugccuuaauuuuuuaaguacugcaccaaaaccaaaga

SEQ ID NO: 287615 - RNA, 64 nt, Homo Sapiens
acuuaauauucucuauaauguauuauuuuauuuuauuuuuuacaauuagccuuuuuuuuaguua

SEQ ID NO: 287616 - RNA, 64 nt, Homo Sapiens
agaaaccauugggaacuauacucuuuuuauuuuuauuuuuuauuuuuuuuauuauuuuuuuuuu

SEQ ID NO: 287617 - RNA, 64 nt, Homo Sapiens
guauuuauuuuaugccucaguauauuauuauuuaauuuuuuagguaaugccuaucucuuggucu

SEQ ID NO: 287618 - RNA, 64 nt, Homo Sapiens
ugaaaaauauuaucuuggguucuuuguaaaauuuauuuuuuacaugcugaauuagccucgaucu

SEQ ID NO: 287619 - RNA, 64 nt, Homo Sapiens
cauuuuuagguuagccagugugacuaugcaccuaauuuuuuaugagauuaaauucauaagacuu

SEQ ID NO: 287620 - RNA, 64 nt, Homo Sapiens
auaguuuuugaaaaauacagucaguagauguuuuauuuuuuagcuauucaguuauguuuauaag

SEQ ID NO: 287621 - RNA, 64 nt, Homo Sapiens
acuauuguuuguuucaucuugcuuuugcauuuuuauuuuuuaauuuccaaauuuuaaguguucc

SEQ ID NO: 287622 - RNA, 64 nt, Homo Sapiens
uuuaagacauaagaauuccucaaagaagccauacauuuuuuaagguggggauugacuuuuauuc

SEQ ID NO: 287623 - RNA, 64 nt, Homo Sapiens
acucaaauuugugucauucuauuuuauuuauuuuauuuuuuauuuccuucccucauaccuugcc

SEQ ID NO: 287624 - RNA, 64 nt, Homo Sapiens
cagguauuuagcuccccuuucauauuauuuuuaaauuuuuuaauuaccuguuguaggguguucc

SEQ ID NO: 287625 - RNA, 64 nt, Homo Sapiens
uccuuuuaacaguaggaggcagugugagcuuuuuauuuuuuauuuuucuuaagguggucuuagu

SEQ ID NO: 287626 - RNA, 64 nt, Homo Sapiens
uuuccuuauaauuuagcauacaggaaaaguauuuauuuuuuaaguaggguaucuuaauuaugcu

SEQ ID NO: 287627 - RNA, 64 nt, Homo Sapiens
uagaauacauuucagaggcagaguuccucggauuauuuuuuauggauauuaguguucagcagcu

SEQ ID NO: 287628 - RNA, 64 nt, Homo Sapiens
uaaaaaguaaacaugauuaucuaaauuacuuaaaauuuuuuaaucuuaguaaaaauuuuaggaa

SEQ ID NO: 287629 - RNA, 64 nt, Homo Sapiens
ugccaauuacagugcaaucuuuauuuauuguaaaauuuuuuaaguguacuuauguacuaauuuu

SEQ ID NO: 287630 - RNA, 64 nt, Homo Sapiens
uaaaaaauuccaugcagguguuuuggggagagguauuuuuuaagcaaugaaaauucaacugagu

SEQ ID NO: 287631 - RNA, 64 nt, Homo Sapiens
uaaaugaaagaaaauugaguugcacuuauugaccauuuuuuaauuuacuuguuuuggauggcuu

SEQ ID NO: 287632 - RNA, 64 nt, Homo Sapiens
uuaauguuuucaaaagguauuauacaugugauacauuuuuuaagcuucaguugcuugucuucug

SEQ ID NO: 287633 - RNA, 64 nt, Homo Sapiens
gcaaagucuacuacuuccaaccuaaagaaaagccauuuuuuaauaaaauaauugauuauacuuu

SEQ ID NO: 287634 - RNA, 64 nt, Homo Sapiens
ugccaucacauaaacaaaguaaaaagaacaugcuauuuuuuaaauuagauauaaaauucaguuu

SEQ ID NO: 287635 - RNA, 64 nt, Homo Sapiens
uaaguuuaauuauaaagugaucucaagaaaaaaaauuuuuuaaaugggccacagagcaagacug

SEQ ID NO: 287636 - RNA, 64 nt, Homo Sapiens
gaauccaagacaaacuaaacaaauucugggccuaauuuuuuaaagguaguaauuaggauaacua

SEQ ID NO: 287637 - RNA, 64 nt, Homo Sapiens
aauuggcauuuuaaguguuuauuuaucugcaaggauuuuuuaaaugagacugaaagaaacuaag

SEQ ID NO: 287638 - RNA, 64 nt, Homo Sapiens
uuuuuaguagagacgggguuaccacgccuggguuauuuuuuauaugggacuacaagugccugcc

SEQ ID NO: 287639 - RNA, 64 nt, Homo Sapiens
uuuuuuuguagagacaaaaccacccugccagcuaauuuuuuauacuggggcuacaggugugugc

SEQ ID NO: 287640 - RNA, 64 nt, Homo Sapiens
ucaaaagauaggcuucuguuuuuaaugaaauuaaauuuuuuauuaguaccugcgcaauccuuga

SEQ ID NO: 287641 - RNA, 64 nt, Homo Sapiens
ucuaggcuuagucauguaaauguacauaggacacauuuuuuaucuucauuuagauaauaaacua

SEQ ID NO: 287642 - RNA, 64 nt, Homo Sapiens
ccuuccuuucuacccccaaccacuuucaccuuuuauuuuuuauuguuguuugacaccuucuuuc

SEQ ID NO: 287643 - RNA, 64 nt, Homo Sapiens
gagagaaugucaaaaguggcuaacauuuucuaguauuuuuuaugucucuuuucaguauaguagu

SEQ ID NO: 287644 - RNA, 64 nt, Homo Sapiens
aauauuuuacaguuguaaaaagaauagcuaaauaauuuuuuaaaauaauggaguaacaaauuac

SEQ ID NO: 287645 - RNA, 64 nt, Homo Sapiens
auaauggaguaacaaauuacgacuaguuacuucuauuuuuuaaacuugaguagucugauuuaga

SEQ ID NO: 287646 - RNA, 64 nt, Homo Sapiens
aacagcugaauagcuuugcgauauuuaaacuucaauuuuuuagcuauuuaaacuucaauuuuuu

SEQ ID NO: 287647 - RNA, 64 nt, Homo Sapiens
uuuaaacuucaauuuuuuagauauuuaaacuucaauuuuuuauaagguccgaauuuucacauuu

SEQ ID NO: 287648 - RNA, 64 nt, Homo Sapiens
aaauauucagguaacaguucccucauggaacuuaauuuuuuauuagcuuuuagagaccuaugau

SEQ ID NO: 287649 - RNA, 64 nt, Homo Sapiens
aaaauaauuuaguaucaagguaugaauacuguguauuuuuuaaauuugcagcucaagcaugcag

SEQ ID NO: 287650 - RNA, 64 nt, Homo Sapiens
guauuuuauuugguugagggucgggcaaccguuuauuuuuuauuggaaacuggagaaaugauug

SEQ ID NO: 287651 - RNA, 64 nt, Homo Sapiens
aacuaaaguuguaccuuuuaaucuuuauaguaaaauuuuuuauacuauuagaaaagguaugaaa

SEQ ID NO: 287652 - RNA, 64 nt, Homo Sapiens
aucugaaguugcucuuuuccaugggaaaauaagcauuuuuuaaaaaaaaggcagaaaacccacc

SEQ ID NO: 287653 - RNA, 64 nt, Homo Sapiens
cuaauacuuuucuccacugaaauuuuaaaaaguuauuuuuuaccauguuuaggacaacaaaaau

SEQ ID NO: 287654 - RNA, 64 nt, Homo Sapiens
auuguuauuauuauuauuggugguuucuaauaggauuuuuuauuaaacucucagugcuuccuua

SEQ ID NO: 287655 - RNA, 64 nt, Homo Sapiens
uuuuauccaagaaguuuuuugcaauugcaauaguauuuuuuagauguuuuuuucuucaagagac

SEQ ID NO: 287656 - RNA, 64 nt, Homo Sapiens
acuacucugggaaaugguuuguuuuuuuaguguuauuuuuuaucguaagugacucaccuuuaaa

SEQ ID NO: 287657 - RNA, 64 nt, Homo Sapiens
acauacuuacuuuggacuagauuuuuuggccaaaauuuuuuaaaaacugaaaggguuuuuguaa

SEQ ID NO: 287658 - RNA, 64 nt, Homo Sapiens
uuacucaagaaccagcauuauuugaguaaauacaauuuuuuaggacuauaaauagcauucuaaa

SEQ ID NO: 287659 - RNA, 64 nt, Homo Sapiens
cuaucauugaggaauaauuauagcaauaauaagcauuuuuuacaacuaugaauuagacaucagu

SEQ ID NO: 287660 - RNA, 64 nt, Homo Sapiens
uauuauuuucagguccuuuggacuuugccuguucauuuuuuaaaccugucauggaugaacugaa

SEQ ID NO: 287661 - RNA, 64 nt, Homo Sapiens
gucucuuguuuaaaaagugauguuugugggcaauauuuuuuauucugcccuagagcugggauau

SEQ ID NO: 287662 - RNA, 64 nt, Homo Sapiens
uuuuaauuuguauguuuuuauguggaugaagagcauuuuuuaugcuuuugugcaauagguucca

SEQ ID NO: 287663 - RNA, 64 nt, Homo Sapiens
uacauguguuugacuguuuaauuugaaaguuuacauuuuuuaugcuuuguguugguguguaauu

SEQ ID NO: 287664 - RNA, 64 nt, Homo Sapiens
aagacccauaagaaacccauauuuaaaaaucugaauuuuuuagaagaaugcaaaacuuuaguaa

SEQ ID NO: 287665 - RNA, 64 nt, Homo Sapiens
cauugcauauuuugcagauuuuauccacagugucauuuuuuacugucagaaaagauaccccuuu

SEQ ID NO: 287666 - RNA, 64 nt, Homo Sapiens
ugucagaaaagauaccccuuuugucauugcaacuauuuuuuaaauccagaaaucuuuguacuga

SEQ ID NO: 287667 - RNA, 64 nt, Homo Sapiens
auuaugauguuuuucaaaaugcaagugagguuugauuuuuuacugaaucaaaugcaaauguuac

SEQ ID NO: 287668 - RNA, 64 nt, Homo Sapiens
agaaaaaaaggagaucuaacaaaaacacuugaauauuuuuuauuuucaaaacuaaacacauaaa

SEQ ID NO: 287669 - RNA, 64 nt, Homo Sapiens
gagccauauaaguuugaaggaaacaguuaauaccauuuuuuaaggaaacaauauaaccacaaag

SEQ ID NO: 287670 - RNA, 64 nt, Homo Sapiens
uugaauauucccaagcccaugaguccuugaaaauauuuuuuauauauacaguaacuuuaugugu

SEQ ID NO: 287671 - RNA, 64 nt, Homo Sapiens
aauuuuuaugcuaggaugccuuuaugaccacuuaauuuuuuaaucuuaguuuaauggucucucc

SEQ ID NO: 287672 - RNA, 64 nt, Homo Sapiens
uacaaagucuaguuuguauguagguaugaagggaauuuuuuaaauaaauugaaaagcugugaac

SEQ ID NO: 287673 - RNA, 64 nt, Homo Sapiens
uuuaaaguauuucuggguuaaaugaaacaaugaaauuuuuuaguauguucaacucucauccaaa

SEQ ID NO: 287674 - RNA, 64 nt, Homo Sapiens
aaauagaaaauguaauaacuuucuuaccauuaacauuuuuuacccuuccauagaagggagggaa

SEQ ID NO: 287675 - RNA, 64 nt, Homo Sapiens
uucugauaauuuaaaauccauuuuaggugauaaaauuuuuuaaaaguuuugaaggaaaccucug

SEQ ID NO: 287676 - RNA, 64 nt, Homo Sapiens
uguguauagcucaguuuggauaauuggucaaacaauuuuuuauccaguaguaaaauauguaacc

SEQ ID NO: 287677 - RNA, 64 nt, Homo Sapiens
uuuuuaaucaagauagugugcuuuauucuguuguauuuuuuauuauuuuaauauacuguaagcc

SEQ ID NO: 287678 - RNA, 64 nt, Homo Sapiens
ugcagcagauacucuuccugccagugguaauacgauuuuuuaagaaggcaguuugucaauuuua

SEQ ID NO: 287679 - RNA, 64 nt, Homo Sapiens
aaguaauauccuuuacaguucugugaaaggacuuauuuuuuaacuguaauauuuauuaguuuua

SEQ ID NO: 287680 - RNA, 64 nt, Homo Sapiens
aauauuuguaucucauuuguaacaauuuguuuuaauuuuuuauauauauguuuuuauuuuuaaa

SEQ ID NO: 287681 - RNA, 64 nt, Homo Sapiens
ggacuguuugaauauucuauuccaaugggcauuuauuuuuuauccugucauuaaaaaaaaaaga

SEQ ID NO: 287682 - RNA, 64 nt, Homo Sapiens
cauaaccccuauaugcguuguugcauaacagaugauuuuuuaaaauauauacuuccuuaugcaa

SEQ ID NO: 287683 - RNA, 64 nt, Homo Sapiens
uuuacacagaaauuccauuguaaauugauaauggauuuuuuauguuacuagaagagauuauuug

SEQ ID NO: 287684 - RNA, 64 nt, Homo Sapiens
gucacuuuuauuugaaaugucauuuggugccaguauuuuuuaacugcauaauagccuaacauga

SEQ ID NO: 287685 - RNA, 64 nt, Homo Sapiens
cacauuuggcaguuuaauagauguuacucaaagaauuuuuuaagaacuguauuuuauuuuuuaa

SEQ ID NO: 287686 - RNA, 64 nt, Homo Sapiens
uguuacucaaagaauuuuuuaagaacuguauuuuauuuuuuaaaugguguuuuauuacaaggga

SEQ ID NO: 287687 - RNA, 64 nt, Homo Sapiens
guauuauuauuguugauguugucaugguuaaucuauuuuuuaaaauugaaaugaagcagaagua

SEQ ID NO: 287688 - RNA, 64 nt, Homo Sapiens
uaguagaaucaaucucgaccuauauaaauaguagauuuuuuauggugaaacuuucccacauaaa

SEQ ID NO: 287689 - RNA, 64 nt, Homo Sapiens
uguuacuuacugcuccaggcauuuuauuaaauuaauuuuuuaaauuauuuuccacccuacauca

SEQ ID NO: 287690 - RNA, 64 nt, Homo Sapiens
gcaugagccaccaugccuggcccaaaguucuagaauuuuuuaaagguauucauggugacucagg

SEQ ID NO: 287691 - RNA, 64 nt, Homo Sapiens
uaauuugauaggcaauacaucuacccacuccauuauuuuuuaaaacuucauuuaauaguuuaaa

SEQ ID NO: 287692 - RNA, 64 nt, Homo Sapiens
guagguuuucuuacuuugguaucauuuucaacuuauuuuuuaaauuguuaauacugccaauaaa

SEQ ID NO: 287693 - RNA, 64 nt, Homo Sapiens
auaugaaaauugcaguagcuguacacauaaaaauauuuuuuaccauuuuuauauauguguaugu

SEQ ID NO: 287694 - RNA, 64 nt, Homo Sapiens
aauggaagguuuauggcaacuuugcaaauaaugcauuuuuuacaugcguuuugcuuuauugcac

SEQ ID NO: 287695 - RNA, 64 nt, Homo Sapiens
auaccacaaucauuugaagacaaauuugggagagauuuuuuaaacaccacugucccuaugucau

SEQ ID NO: 287696 - RNA, 64 nt, Homo Sapiens
uuaguccuauuuguauuauuauauauuucaauguauuuuuuauuacauuucaugcaaaaaauau

SEQ ID NO: 287697 - RNA, 64 nt, Homo Sapiens
uagguaagauaccauuauauuuaagccauuuaacauuuuuuaaacauaagagucuuaaaagaaa

SEQ ID NO: 287698 - RNA, 64 nt, Homo Sapiens
cacuuguuaugaguuaaguuuugaauauaaauguauuuuuuaaagaaacuauuauuuuuuagau

SEQ ID NO: 287699 - RNA, 64 nt, Homo Sapiens
uuugaauauaaauguauuuuacauugaaacuauuauuuuuuagauagaguaauauucacuuaac

SEQ ID NO: 287700 - RNA, 64 nt, Homo Sapiens
aacuuacaacucagaaaagaaauuguuagaauuuauuuuuuaagaagucaaaucaguauucugu

SEQ ID NO: 287701 - RNA, 64 nt, Homo Sapiens
gacauuugaggggaggaggagaacuguuucauguauuuuuuaaagcucuucgguuuuuguuauu

SEQ ID NO: 287702 - RNA, 64 nt, Homo Sapiens
agaggucuuucuccccgaaacacuaauugggauuauuuuuuaaaaugucagccauuuacucucc

SEQ ID NO: 287703 - RNA, 64 nt, Homo Sapiens
aacagcuuaauauaaaacauaaguuuguuaaaguauuuuuuauaccccguaaaaaguagaagau

SEQ ID NO: 287704 - RNA, 64 nt, Homo Sapiens
caggggaauauuuuauucaagagcaagcuuuuuuauuuuuuauaaaauacucuaauucuaacca

SEQ ID NO: 287705 - RNA, 64 nt, Homo Sapiens
cuugugaauauguacauagggugaacuagcuggaauuuuuuauucucagaacggacgagauaau

SEQ ID NO: 287706 - RNA, 64 nt, Homo Sapiens
guaaaacauuuauuuugacauaaaguugauaaagauuuuuuaauaauuuagacuucaagcaugg

SEQ ID NO: 287707 - RNA, 64 nt, Homo Sapiens
auuuauuuaaaauagcaaaagaagaaguuucaucauuuuuuacuuccucucugaguggacuggc

SEQ ID NO: 287708 - RNA, 64 nt, Homo Sapiens
aagaagaaucucaucucagugaagaauacuucucauuuuuuaaaaaagcuuaaaacuuugaagu

SEQ ID NO: 287709 - RNA, 64 nt, Homo Sapiens
aagaacagccucauuuuagauguaguccuguuggauuuuuuaugccuccucaguaaccagaaau

SEQ ID NO: 287710 - RNA, 64 nt, Homo Sapiens
cgcaguuugaauuaaucauaucaaaucaguuuuaauuuuuuaaauuguacuucagagucuauau

SEQ ID NO: 287711 - RNA, 64 nt, Homo Sapiens
gaaaucacuucaugaaaauaagcaaagaccacacauuuuuuacuacaaaauguaaaggauaaau

SEQ ID NO: 287712 - RNA, 64 nt, Homo Sapiens
uuacuugccauuuauuguaaggaaacuuuaaagcauuuuuuaggaaauacucaaaagcaagguu

SEQ ID NO: 287713 - RNA, 64 nt, Homo Sapiens
cacaugggacaaaguuccaaaaugccaaauucuuauuuuuuaaaaagcuaguucuauaaaauac

SEQ ID NO: 287714 - RNA, 64 nt, Homo Sapiens
aucaaaacaaaaaaaaacucauuuauaccuguguauuuuuuaaagcuacaaucuguucaauguu

SEQ ID NO: 287715 - RNA, 64 nt, Homo Sapiens
acagaugaaaagccucuguuuugauauggguaguauuuuuuacauuuuacacacuguacacaua

SEQ ID NO: 287716 - RNA, 64 nt, Homo Sapiens
uaacuuaaugaaaacaaugcaguacaggacauauauuuuuuaaaauaagucugauuuaauuggg

SEQ ID NO: 287717 - RNA, 64 nt, Homo Sapiens
ccauuuacuuaagacuuaaugagacuuuaaaagcauuuuuuaaccuccuaaguaucaaguauag

SEQ ID NO: 287718 - RNA, 64 nt, Homo Sapiens
guaaggauugugauauuagaggcuggaaauccuuauuuuuuaaaaaaucagauaggcauaaaua

SEQ ID NO: 287719 - RNA, 64 nt, Homo Sapiens
uaaagguuugauguauauagaaauuccauguuugauuuuuuaaaauauguguauaagucuguca

SEQ ID NO: 287720 - RNA, 64 nt, Homo Sapiens
uuauguuaucuuaaaaagugcuggugaauuuuccauuuuuuacauccauuucacauguaagaga

SEQ ID NO: 287721 - RNA, 64 nt, Homo Sapiens
gucacuuuuuuauuuaacugauaagauuuuuguuauuuuuuacuuugauaaguaaaccaaagaa

SEQ ID NO: 287722 - RNA, 64 nt, Homo Sapiens
guggguggcuauuuugauuuggcaugacuacuuaauuuuuuaaaaaaauugugguuugugaauu

SEQ ID NO: 287723 - RNA, 64 nt, Homo Sapiens
uguuuuaaagauaugaaaucuguuuacucaaccaauuuuuuaaaugucauauugugauaaugcu

SEQ ID NO: 287724 - RNA, 64 nt, Homo Sapiens
gcugucugcaguuuacaauguauuguaaaugaagauuuuuuaaauucuaucuugcugauuuuuu

SEQ ID NO: 287725 - RNA, 64 nt, Homo Sapiens
uguucuaaaaugaaacauauuacuuuguuaguacauuuuuuagugucacacugacuuuuaaaau

SEQ ID NO: 287726 - RNA, 64 nt, Homo Sapiens
aacuggaacaugcuuuuacuuuauugcccuaacaauuuuuuauuaaauuuauuugaaaaugcau

SEQ ID NO: 287727 - RNA, 64 nt, Homo Sapiens
cucuucucucauuuaucgaugauccucuuuuuccauuuuuuaaguacuuauguggaagcuaguc

SEQ ID NO: 287728 - RNA, 64 nt, Homo Sapiens
guacuuuuauuacugagagaucuucauauacuucauuuuuuaauauaaauaauuuuaauaaauu

SEQ ID NO: 287729 - RNA, 64 nt, Homo Sapiens
uaagaaucgggacaauauuguauucaacuguuuuauuuuuuauauuuuuaaaauuuaaaguaua

SEQ ID NO: 287730 - RNA, 64 nt, Homo Sapiens
guauuuauuauagcauuuuaaauaaggguaauucauuuuuuauuaaagucauuuucacguuaag

SEQ ID NO: 287731 - RNA, 64 nt, Homo Sapiens
acagaauuagaaacccaucccaccuuguuucaucauuuuuuaugaccugaagucccucugacau

SEQ ID NO: 287732 - RNA, 64 nt, Homo Sapiens
aaaugaaaauuguuuuucuaaggaaacaugcagcauuuuuuaaaaaacuccauuuagguacuuc

SEQ ID NO: 287733 - RNA, 64 nt, Homo Sapiens
accauaguccauguuaauagaauuaaaugucaaaauuuuuuauuuaaauacuauauguugaaca

SEQ ID NO: 287734 - RNA, 64 nt, Homo Sapiens
uacaauuaggauaauuagcaagcucuauguuuuaauuuuuuauauuaagaauuuuguaacagaa

SEQ ID NO: 287735 - RNA, 64 nt, Homo Sapiens
uagacuucaguugagauguaguaucuauuaggacauuuuuuacacucaccaaagguaaauaucu

SEQ ID NO: 287736 - RNA, 64 nt, Homo Sapiens
aaucauuuuauuuugugauagacuagagacccacauuuuuuaaauuuaaaauuuacacuucuaa

SEQ ID NO: 287737 - RNA, 64 nt, Homo Sapiens
uuuuaugcuugcuuccauuacaagccuuuucauuauuuuuuagcucuugcugugauagguuuug

SEQ ID NO: 287738 - RNA, 64 nt, Homo Sapiens
aagaugguuuuuaaaacuuuaaguaaugaucuacauuuuuuauguuacuacuguuggagcuuau

SEQ ID NO: 287739 - RNA, 64 nt, Homo Sapiens
uguuacaguaaguaauccuuagaaugaugguuuuauuuuuuaauguaaaguauugauaaauaug

SEQ ID NO: 287740 - RNA, 64 nt, Homo Sapiens
cuuuauuugcuguuaaauucauguacagaacuaaauuuuuuaaaaauagggauaguuggaacua

SEQ ID NO: 287741 - RNA, 64 nt, Homo Sapiens
auguaagaauuuuguacuuuucuccaauuaaaaaauuuuuuaacgaagaaagcagagguacuaa

SEQ ID NO: 287742 - RNA, 64 nt, Homo Sapiens
ucaccuggaaacuaccauugaccgacuaaaagcuauuuuuuaccuuucaaaaagauuucuuauu

SEQ ID NO: 287743 - RNA, 64 nt, Homo Sapiens
ugaacacguguagcuugcaguuguuuauauuaauauuuuuuacucuuagaaugaaaaaggguac

SEQ ID NO: 287744 - RNA, 64 nt, Homo Sapiens
gauacucugaauggcaauuaaccaaguauuuuuuauuuuuuaugauaauuuuaauagucacuca

SEQ ID NO: 287745 - RNA, 64 nt, Homo Sapiens
uuuuauggauacucugaaugucacucaaccaaguauuuuuuauuauaaagcauaauuuuaauag

SEQ ID NO: 287746 - RNA, 64 nt, Homo Sapiens
uuuugcagagauggagucucacccaacuaauuuuauuuuuuauucuacaggcaugcaccaccau

SEQ ID NO: 287747 - RNA, 64 nt, Homo Sapiens
cuuuggucucuuuugacucuugacauuugacaucauuuuuuauugugagugguauugccauccu

SEQ ID NO: 287748 - RNA, 64 nt, Homo Sapiens
acaaaugaauaaauggacaaccaugccuggccucauuuuuuaaagggauuacaggcaugaguca

SEQ ID NO: 287749 - RNA, 64 nt, Homo Sapiens
ucuuuaugagacgaucucacuuauuuuauuuuuaauuuuuuauaaggcacucauuuuuuaauuu

SEQ ID NO: 287750 - RNA, 64 nt, Homo Sapiens
uuuuauuuuauuuuuaauuugccugaaggcacucauuuuuuaauucaccaaugcuuggaacacu

SEQ ID NO: 287751 - RNA, 64 nt, Homo Sapiens
uucccaauuuuuucaguuuucaaaacacauuauuauuuuuuaauuuauaaaaagugcaauuuuu

SEQ ID NO: 287752 - RNA, 64 nt, Homo Sapiens
guuaggaagauccagcaauugcuuuggaaaucagauuuuuuaauucuaaaaccaaacugaaauc

SEQ ID NO: 287753 - RNA, 64 nt, Homo Sapiens
auuauauccuauuuuaauauacacauugagaauaauuuuuuauuucaggcaaauuugaaaauau

SEQ ID NO: 287754 - RNA, 64 nt, Homo Sapiens
cuucauuucauguauuuauuuguuaugguccugaauuuuuuaugugacaacuaaaacauuccau

SEQ ID NO: 287755 - RNA, 64 nt, Homo Sapiens
auuuaacccuguacuuggcauaauauuuuaauuuauuuuuuacuaaaauauauauucacaauuu

SEQ ID NO: 287756 - RNA, 64 nt, Homo Sapiens
uuucaaacucauacuuuauuaguugucucuaaauauuuuuuaauuauuuugcuauuaaugugaa

SEQ ID NO: 287757 - RNA, 64 nt, Homo Sapiens
uuguuaauuauguuuuuaggggauuuuuuauuuuauuuuuuauuaaaacguugacuggggcaaa

SEQ ID NO: 287758 - RNA, 64 nt, Homo Sapiens
uuauuuuuuauuuuguuaaugacuggggcaaaggauuuuuuauuauggaugcugcaaaaacguu

SEQ ID NO: 287759 - RNA, 64 nt, Homo Sapiens
aucaagaaaauuuaaaaagacaaaacacaaauacauuuuuuaaauggguuugcguuccaaccug

SEQ ID NO: 287760 - RNA, 64 nt, Homo Sapiens
uuucucagucccgaagaucuaucugagugguuuuauuuuuuagauuugaucugucaccuaugga

SEQ ID NO: 287761 - RNA, 64 nt, Homo Sapiens
uaaaaaaaggaaauuugaguauguacccacaaaaauuuuuuaauccucauaaacaaauacaccu

SEQ ID NO: 287762 - RNA, 64 nt, Homo Sapiens
ccaaaaaucuguacuaacacaagcaaagauacuaauuuuuuaaguacccacugccagcaucaaa

SEQ ID NO: 287763 - RNA, 64 nt, Homo Sapiens
acugccauuuacuguauguauuuagaaaaugagcauuuuuuacaaauuauagcacuaacuugau

SEQ ID NO: 287764 - RNA, 64 nt, Homo Sapiens
ugaaaccauauuuuaaguguuugaaguauuuuuaauuuuuuaaagagacuuaguuuuugaagug

SEQ ID NO: 287765 - RNA, 64 nt, Homo Sapiens
caaguuauuguacagcuguuuuuuuucuuacauaauuuuuuauuuagugaacuacgcuugcuca

SEQ ID NO: 287766 - RNA, 64 nt, Homo Sapiens
guuuucaucuguuguuuugugguuuuguuguuuuauuuuuuauucuaucaguuuguccuguaga

SEQ ID NO: 287767 - RNA, 64 nt, Homo Sapiens
cacgugcagucuucagcccauuaaauuaucgauuauuuuuuaaugaauugaauuuauauugagu

SEQ ID NO: 287768 - RNA, 64 nt, Homo Sapiens
gaauaauuaauguucaaaggcaagagggcaaggcauuuuuuaacacuuuuuaaaauaaaaauuu

SEQ ID NO: 287769 - RNA, 64 nt, Homo Sapiens
auuaaaaaacaauccuucauuuauuuuuugucuaauuuuuuaguuuucagcauuaugauuuggg

SEQ ID NO: 287770 - RNA, 64 nt, Homo Sapiens
uugggagaauaguugagaucuggaaagcauagacauuuuuuacacucuggauagacuuuauucu

SEQ ID NO: 287771 - RNA, 64 nt, Homo Sapiens
uacaaacuucagaagaaagcugacauuuuaaugaauuuuuuaaaaaauuaauaaacaaauuguc

SEQ ID NO: 287772 - RNA, 64 nt, Homo Sapiens
aaacacugccagaauacuuucuagcugcuuuguaauuuuuuaagaguguuauuuuguuuuuguu

SEQ ID NO: 287773 - RNA, 64 nt, Homo Sapiens
aaacuuauguggcuuuuugaccuuugaauagggaauuuuuuaaauuuuuuaaaaauuaaaauaa

SEQ ID NO: 287774 - RNA, 64 nt, Homo Sapiens
uggcuuuuugaccuuugaauagggaauuuuuuaaauuuuuuaaaaauuaaaauaaaaaaaacac

SEQ ID NO: 287775 - RNA, 64 nt, Homo Sapiens
gcauagauacuauaugguaucaugggacccaucuauuuuuuaccaguggacuacaggauuacuu

SEQ ID NO: 287776 - RNA, 64 nt, Homo Sapiens
auugugggcagagaucuuuaguucaaauccacguauuuuuuaaaagagagaaccggagguagag

SEQ ID NO: 287777 - RNA, 64 nt, Homo Sapiens
ugggacuacaggugugcaccaacaugcccagcuaauuuuuuauauuuuuaguagagacgggguu

SEQ ID NO: 287778 - RNA, 64 nt, Homo Sapiens
cuaccauuuccagaagcuuuuuuaacaagugaauauuuuuuacauaauggauaauaaaugguau

SEQ ID NO: 287779 - RNA, 64 nt, Homo Sapiens
cgaagaaaauaaaugacuuuaggaagagguauacauuuuuuaagucgcucugccuccaaaucug

SEQ ID NO: 287780 - RNA, 64 nt, Homo Sapiens
caaggaaaauuagagaaagucacauuuaggguuuauuuuuuacacuuggccaguaaaauagggu

SEQ ID NO: 287781 - RNA, 64 nt, Homo Sapiens
acuuggccaguaaaauaggguaaauccuauuagaauuuuuuaaagaacuuuuuuuaaguuuccu

SEQ ID NO: 287782 - RNA, 64 nt, Homo Sapiens
ugugaaccugaaauggcuuuaaauuaauacucuuauuuuuuauuuaauuuaauuacauaaauua

SEQ ID NO: 287783 - RNA, 64 nt, Homo Sapiens
uguguuauucaugucuuuaaaucagauaccaaauauuuuuuaggaaagaaaaauguuauuacug

SEQ ID NO: 287784 - RNA, 64 nt, Homo Sapiens
aaacuaauauuuuacauaaaaacuaauacuuucaauuuuuuauauaguaauauccccauuuugu

SEQ ID NO: 287785 - RNA, 64 nt, Homo Sapiens
aagacauccauucagaaacaaaaauuagcacuaaauuuuuuauaaaauagaccagaugacaaaa

SEQ ID NO: 287786 - RNA, 64 nt, Homo Sapiens
cgggggaaagaaaaugaaacuuuuuggugugaauauuuuuuaugcugaugugaauuauuuuguu

SEQ ID NO: 287787 - RNA, 64 nt, Homo Sapiens
auauuauauauauauauguaugcauauauaucauauuuuuuacaaggaacauuuuaugaugaaa

SEQ ID NO: 287788 - RNA, 64 nt, Homo Sapiens
caauuagaaauugucuuuugaauauacuauauauauuuuuuauguuccaauaauguuuuguaca

SEQ ID NO: 287789 - RNA, 64 nt, Homo Sapiens
aagcauaugaucucuuuauuagugaaucaugcuuauuuuuuacucuuaaugccacuaauauaca

SEQ ID NO: 287790 - RNA, 64 nt, Homo Sapiens
uuccacgugacaguucuucacaauuccuuucaucauuuuuuaaauauuuuuuuuacugccuaug

SEQ ID NO: 287791 - RNA, 64 nt, Homo Sapiens
ugugguaacuacgaagugaugguagauuuaaauaauuuuuuauuuuuauuuuauauauuuuuuc

SEQ ID NO: 287792 - RNA, 64 nt, Homo Sapiens
gcucuuuaguaaagaaaggcuaaaucuuucacauauuuuuuauuaaacaaauuugagguaugga

SEQ ID NO: 287793 - RNA, 64 nt, Homo Sapiens
ugccauaaaccaagcaaaaggaagaacuaaguugauuuuuuauuaacaaaaaaaaaaucuaacu

SEQ ID NO: 287794 - RNA, 64 nt, Homo Sapiens
cauuguaaaacauagacguuuuaaaguuuuuauuauuuuuuauauaaagcuauaauccccagaa

SEQ ID NO: 287795 - RNA, 64 nt, Homo Sapiens
ucucuccauauuccugaccaugaacuuuuuaaacauuuuuuacucuuaaaugugguacugagca

SEQ ID NO: 287796 - RNA, 64 nt, Homo Sapiens
uguaucucuugccuaaaggauugauuuucaaauaauuuuuuaaaggauuuauguaggaagaaac

SEQ ID NO: 287797 - RNA, 64 nt, Homo Sapiens
ugaaaaaccuaguuaccugauauaaggucauuacauuuuuuaacagucucaguaaucuagcuua

SEQ ID NO: 287798 - RNA, 64 nt, Homo Sapiens
uuuuuuuugagacagagucuguaaguaaucuuuuauuuuuuauuaaugacaaauugaaccauau

SEQ ID NO: 287799 - RNA, 64 nt, Homo Sapiens
accugaagcaccaucugaaaguuuguguugggauauuuuuuagcugucagcuagccaccugcuu

SEQ ID NO: 287800 - RNA, 64 nt, Homo Sapiens
ucuguagcugaauuuguuaagguguuuacagauuauuuuuuauauaauaaauucgcauuuuaaa

SEQ ID NO: 287801 - RNA, 64 nt, Homo Sapiens
uuguuuuaacagaaauauagacuaaauguguaccauuuuuuaaauguuucacaauucauuuucu

SEQ ID NO: 287802 - RNA, 64 nt, Homo Sapiens
aacacuguuaagcccuaagugagcaaagauaacaauuuuuuacauguuaaaucaggccugacua

SEQ ID NO: 287803 - RNA, 64 nt, Homo Sapiens
auuucgacuuacauaaugaagauaggucauuaugauuuuuuaccagcauauauaugaugcaucg

SEQ ID NO: 287804 - RNA, 64 nt, Homo Sapiens
uaguguuauaguuucauguuauuugggagaaaauauuuuuuaaguagucaaaaaugcuaaaaua

SEQ ID NO: 287805 - RNA, 64 nt, Homo Sapiens
aaugccaucuacuuucuagaaaguguauguaacuauuuuuuagaaggaaugucuguucuuuauc

SEQ ID NO: 287806 - RNA, 64 nt, Homo Sapiens
guuaggcagaacacauucaucuuaggaucaagacauuuuuuaaugagaugucaaauggaagaga

SEQ ID NO: 287807 - RNA, 64 nt, Homo Sapiens
uuguuaaauagauauugugguuuggggaaguugaauuuuuuauagguuaaaugucauuuuagag

SEQ ID NO: 287808 - RNA, 64 nt, Homo Sapiens
ugauaaaagcaacuuagcaaggcuucuuuucauuauuuuuuauguuucacuuauaaagucuuag

SEQ ID NO: 287809 - RNA, 64 nt, Homo Sapiens
uccagauaaucuggagguuagcauuugauaaaugauuuuuuaaaguagauaugaagauuuuguu

SEQ ID NO: 287810 - RNA, 64 nt, Homo Sapiens
aauuuuucccccuacuuucuugcuucuguuucacauuuuuuaaaagggcaaguacaggagcaac

SEQ ID NO: 287811 - RNA, 64 nt, Homo Sapiens
ugacauuauaugguaugauaugaaaaaaucaccaauuuuuuacauauaaaagauaccuuuuuaa

SEQ ID NO: 287812 - RNA, 64 nt, Homo Sapiens
cucuauuuccuaaauaucauucuauacaaaagauauuuuuuaaacgguaaggauuaagacaauc

SEQ ID NO: 287813 - RNA, 64 nt, Homo Sapiens
cuagaauguaacuaaauugcuuauaaaugucagcauuuuuuaaagguacaguauauggggauug

SEQ ID NO: 287814 - RNA, 64 nt, Homo Sapiens
auggugucugcugugcauggcauuuuauauguuaauuuuuuaguuuaaaaugaaguauauugaa

SEQ ID NO: 287815 - RNA, 64 nt, Homo Sapiens
aguuuuuaugagaaguauauuauauuaaaugugaauuuuuuaaauuuugcuucuuauacuggaa

SEQ ID NO: 287816 - RNA, 64 nt, Homo Sapiens
uaauuuacuacauauuaguacuauauucguaaggauuuuuuauuaaccauuacagauuuuacaa

SEQ ID NO: 287817 - RNA, 64 nt, Homo Sapiens
cauauuggaguccaaaacuugaauucuggguugaauuuuuuaaaaaucagguaccacuugauuu

SEQ ID NO: 287818 - RNA, 64 nt, Homo Sapiens
cugguuuugucgacguaaacauuuaaaguguuauauuuuuuauaaaaauguuuauuuuuaauga

SEQ ID NO: 287819 - RNA, 64 nt, Homo Sapiens
cauauuauggcaucguuuucuagucuacuucaaaauuuuuuacacguuugcagaggugcaauca

SEQ ID NO: 287820 - RNA, 64 nt, Homo Sapiens
uuuuuaaaaggaagaaagcggauuuuggaauugcauuuuuuaaagcaccacucuugauuuucug

SEQ ID NO: 287821 - RNA, 64 nt, Homo Sapiens
aagcagugaggcugguguguaugauugucuuaaaauuuuuuaauagauauggccgagcgugaug

SEQ ID NO: 287822 - RNA, 64 nt, Homo Sapiens
aacuuuaauguauugaaaugcauaaauaaaauuuauuuuuuauauuuuguuuagaguaacagug

SEQ ID NO: 287823 - RNA, 64 nt, Homo Sapiens
ccagcaauuauuauuuagcuauugaccaaaaaaaauuuuuuaggcuauuucauaucuaccuaca

SEQ ID NO: 287824 - RNA, 64 nt, Homo Sapiens
uuuuuuaaaagguacuuuucucuucuucaugcucauuuuuuacuuuguuaagaccccuauugcc

SEQ ID NO: 287825 - RNA, 64 nt, Homo Sapiens
aacgacuaaggaaaaaaccuugaucuguagcaccauuuuuuacauauugacucuuagaugcuau

SEQ ID NO: 287826 - RNA, 64 nt, Homo Sapiens
aaauuaauuugucucaaaacggaauugauaaaccauuuuuuacacguguguuuuauacaaaaau

SEQ ID NO: 287827 - RNA, 64 nt, Homo Sapiens
aaaucuguuguuccaaauguuaacaccaaacuucauuuuuuaaaaaauaguuaaaaugcugaca

SEQ ID NO: 287828 - RNA, 64 nt, Homo Sapiens
aggaauuuauaacaaauaugaguagaaacuacuaauuuuuuaagucaucaaaaagaaaaaucaa

SEQ ID NO: 287829 - RNA, 64 nt, Homo Sapiens
augauaaaagacauuguguuuuuuuauaauaaauauuuuuuaugguacagagaaaugugauaau

SEQ ID NO: 287830 - RNA, 64 nt, Homo Sapiens
auaaauauuuuuuaugaugaagagaaaugugauaauuuuuuauauuugucuuuaugcuauguac

SEQ ID NO: 287831 - RNA, 64 nt, Homo Sapiens
guagaauaacuccugaguuuauggccagcuccuuauuuuuuaauaagacuacaggaguuaacag

SEQ ID NO: 287832 - RNA, 64 nt, Homo Sapiens
auuuacuuaguaaugcacauagcaagaagguuauauuuuuuaaaguuugcuguguuuucuucag

SEQ ID NO: 287833 - RNA, 64 nt, Homo Sapiens
gcccuucugaugauuccaaucggcuggcaguuguauuuuuuaaacagguaugagccaccaugcc

SEQ ID NO: 287834 - RNA, 64 nt, Homo Sapiens
agagacaggguuucacugugagcuaauuuuuuguauuuuuuaguaggcacacacugccgcgccc

SEQ ID NO: 287835 - RNA, 64 nt, Homo Sapiens
augagauaacacaucaggugcauggccacuuacaauuuuuuaaccaucauuuuuggcuccuuag

SEQ ID NO: 287836 - RNA, 64 nt, Homo Sapiens
acaacacuaaguucugcuucuuguuguaaaucauauuuuuuauuuguauguauaccaaacaaga

SEQ ID NO: 287837 - RNA, 64 nt, Homo Sapiens
uuugauauaaacgugcaauuaaaauucaaaguuuauuuuuuaucacaagcaccuuugaaaugua

SEQ ID NO: 287838 - RNA, 64 nt, Homo Sapiens
ugcuggaguugucauggccgcaguucagugugagauuuuuuaccagguauugcgcuuaagggac

SEQ ID NO: 287839 - RNA, 64 nt, Homo Sapiens
cugcuuuagagcuguguguugagcuaaaaauauaauuuuuuaaaaauugacuagcaaaaucuau

SEQ ID NO: 287840 - RNA, 64 nt, Homo Sapiens
gcaggaccuuucaauaaauauuuauuuggucaaaauuuuuuauuuugauuuuauuaaaugggaa

SEQ ID NO: 287841 - RNA, 64 nt, Homo Sapiens
auugcuuuuugagauuuuugcguguguguuugauauuuuuuacgauaauuagcugcaugugaau

SEQ ID NO: 287842 - RNA, 64 nt, Homo Sapiens
uagcugcaugugaauuuuucaugaccuucuuuacauuuuuuauuuuuuauuucuuuauuuuuuu

SEQ ID NO: 287843 - RNA, 64 nt, Homo Sapiens
augugaauuuuucaugaccuucuuuacauuuuuuauuuuuuauuucuuuauuuuuuuuucucua

SEQ ID NO: 287844 - RNA, 64 nt, Homo Sapiens
gauuaucuccuccacuauaauccucuuuagggugauuuuuuaaaucaaaacccagugaaucuca

SEQ ID NO: 287845 - RNA, 64 nt, Homo Sapiens
caucugugccaauuacaaagcaauuaaaagauuuauuuuuuaugaucugguguagugacugaau

SEQ ID NO: 287846 - RNA, 64 nt, Homo Sapiens
agugguggggacuuuguuuauuuauuuauuuuuaauuuuuuaauuuuauauuauuauuauuauu

SEQ ID NO: 287847 - RNA, 64 nt, Homo Sapiens
ucauccaugucccuacaaaggacaugaacucaucauuuuuuauggcugcauaguauuccauggu

SEQ ID NO: 287848 - RNA, 64 nt, Homo Sapiens
aaaauauaacggguauauuuguuauucuaacucuauuuuuuaaaguuaauaauauaaaguggcc

SEQ ID NO: 287849 - RNA, 64 nt, Homo Sapiens
aaucacauccaauuauuugaacacaugcaaaauaauuuuuuaaauuauguuauuguuuaaauuu

SEQ ID NO: 287850 - RNA, 64 nt, Homo Sapiens
caaacuguaaaagauugaaauaaucuuucucaggauuuuuuaaaugucuaagauuaugauguca

SEQ ID NO: 287851 - RNA, 64 nt, Homo Sapiens
auaaauuuuauuguuggaaaucaaaaauuaguagauuuuuuaccauguuaaauuauagugagau

SEQ ID NO: 287852 - RNA, 64 nt, Homo Sapiens
aauaaauacaguuaacauaguaccauuucaaacuauuuuuuaaauucugaaaauugcauuuuau

SEQ ID NO: 287853 - RNA, 64 nt, Homo Sapiens
uuaagcaguucuacucgaucgaaguaacugaauuauuuuuuaaauauccaccccaggccaggug

SEQ ID NO: 287854 - RNA, 64 nt, Homo Sapiens
aagauacuuugagaugcauugccuacauuuuuauauuuuuuaaguuacaagagagcacaaguug

SEQ ID NO: 287855 - RNA, 64 nt, Homo Sapiens
ugucugcauguuuaaaaaaaguugugcuauccagauuuuuuauaaauaacuuuguugccaaaag

SEQ ID NO: 287856 - RNA, 64 nt, Homo Sapiens
aaaauguuaacugaugagaugcuuuaaaugauuuauuuuuuaugagaauuuguaggcguauaca

SEQ ID NO: 287857 - RNA, 64 nt, Homo Sapiens
uggguuauuugucuuuuuauuagaucacuugcucauuuuuuaaucuucuuaggacagcuaucuu

SEQ ID NO: 287858 - RNA, 64 nt, Homo Sapiens
ucgugauuucggccuauuucuacuuaaacacaacauuuuuuaaacugaacacaggguuccagag

SEQ ID NO: 287859 - RNA, 64 nt, Homo Sapiens
aaugugaaauguaauguuuuuuuacuguuaaaaaauuuuuuaaagcugucuuccaaguauuauu

SEQ ID NO: 287860 - RNA, 64 nt, Homo Sapiens
aaaaagaaacaaaaauauuuugugcgaacauuuuauuuuuuaaauuaaagcaauuuucucccau

SEQ ID NO: 287861 - RNA, 64 nt, Homo Sapiens
auuuagcgauuuuuaauguuuuuuuuacuuauauauuuuuuaacauaacaaguuuuuccaaaua

SEQ ID NO: 287862 - RNA, 64 nt, Homo Sapiens
uauauauuuuuuaacauuuaaaguuuuuccaaauauuuuuuacucuauugaaauaagacauaac

SEQ ID NO: 287863 - RNA, 64 nt, Homo Sapiens
uuaucuuucaggguaacaugucuaagaaggccauauuuuuuaagauaauagcagaguggccugu

SEQ ID NO: 287864 - RNA, 64 nt, Homo Sapiens
auagcagaguggccuguucuucuugcugucaccaauuuuuuauacacauaucagugauacaauu

SEQ ID NO: 287865 - RNA, 64 nt, Homo Sapiens
agccuauuguuuuucagaaugguaaucaagucuuauuuuuuaaaacuacauauuacuuguuucu

SEQ ID NO: 287866 - RNA, 64 nt, Homo Sapiens
aauacauuuuaugguucucucaguuuuuaagagaauuuuuuaaauuagagagaaggauuguuuu

SEQ ID NO: 287867 - RNA, 64 nt, Homo Sapiens
uuuauuuuuuuaagcuuuugucaaauauaauuccauuuuuuauuaaugcaggugucaggaaaug

SEQ ID NO: 287868 - RNA, 64 nt, Homo Sapiens
agcauggcuagauuuacuucgagugaccuaaagcauuuuuuaaaaauguuaacugccaagcuug

SEQ ID NO: 287869 - RNA, 64 nt, Homo Sapiens
cugagggguuggugauaacuaauauaacuugaaaauuuuuuauagcacaccaaguuauaugacu

SEQ ID NO: 287870 - RNA, 64 nt, Homo Sapiens
uuuacugagagaccuuuauuacagcaggucuaauauuuuuuaagggaggaggaaaugcuagaga

SEQ ID NO: 287871 - RNA, 64 nt, Homo Sapiens
acaggcuagaaucucauguuuagcaaguauacuuauuuuuuaaaaaaaagagugaagauaguac

SEQ ID NO: 287872 - RNA, 64 nt, Homo Sapiens
aacauuggaaauauauucaauuguaugauuuuuuauuuuuuaauuuuaaugugcuaaauauauc

SEQ ID NO: 287873 - RNA, 64 nt, Homo Sapiens
uuuuaauaacauuggaaauaauauaucuuguaugauuuuuuauucuuaaguuuuaaugugcuaa

SEQ ID NO: 287874 - RNA, 64 nt, Homo Sapiens
auuuucuuaguuuuguucuucauccauugcauccauuuuuuauuaucucucagauguguugaag

SEQ ID NO: 287875 - RNA, 64 nt, Homo Sapiens
cuugauugccauuaaagcagaaguggaauuguacauuuuuuaaauauaaaggaauaguauggau

SEQ ID NO: 287876 - RNA, 64 nt, Homo Sapiens
uuugaauaguuuuauauuaauaaaagaagacaaaauuuuuuaaauguuagaaaaagcagaucug

SEQ ID NO: 287877 - RNA, 64 nt, Homo Sapiens
aauugcuaguuuauauuuuagauauaaacaucauauuuuuuauuaauaccuacaucaaauggaa

SEQ ID NO: 287878 - RNA, 64 nt, Homo Sapiens
acugcuuaguccuuucucagauacucuuaaaacaauuuuuuauuguuaaauuugugguaauaca

SEQ ID NO: 287879 - RNA, 64 nt, Homo Sapiens
ucacagcacagcugcagacacaacaacgugcagcauuuuuuacauaaaaauaugguagaauuaa

SEQ ID NO: 287880 - RNA, 64 nt, Homo Sapiens
aacugugcauaugaaauuucuucuuuuuaagguuauuuuuuauucuggagaccuuuguuauuca

SEQ ID NO: 287881 - RNA, 64 nt, Homo Sapiens
accaccaucauuccuugucuccugaucagaauguauuuuuuauagcugacaaguuaccaguuca

SEQ ID NO: 287882 - RNA, 64 nt, Homo Sapiens
uuuaccugauuugcagucauccucaaaguacuguauuuuuuauuuaucaugagcuaguccuagg

SEQ ID NO: 287883 - RNA, 64 nt, Homo Sapiens
aauuuuuguaaaacuguguagaagugcaaaaaaaauuuuuuagccauuuaaaaauuuaaaaauu

SEQ ID NO: 287884 - RNA, 64 nt, Homo Sapiens
uauuguauuugugcacaauggauuuucuauuuuuauuuuuuaaauacuuuuguauuugaauuuu

SEQ ID NO: 287885 - RNA, 64 nt, Homo Sapiens
gcucuaccacauagacaauacugaaagaaauaacauuuuuuaaguuucuauuuguagaccauau

SEQ ID NO: 287886 - RNA, 64 nt, Homo Sapiens
uuuuccuguguaaaccuaaucuuuuaaaauaguaauuuuuuacacuucauuaauacuguguuac

SEQ ID NO: 287887 - RNA, 64 nt, Homo Sapiens
uuuacagaauauuauauaacauuaaucuuucuauauuuuuuaaauguaagacuucagauuucaa

SEQ ID NO: 287888 - RNA, 64 nt, Homo Sapiens
aauuaguaucuacuaucuugagaauaguacucugauuuuuuaagagaugggaggagaggguaaa

SEQ ID NO: 287889 - RNA, 64 nt, Homo Sapiens
uaacaugaaguaaaauugaauuccucucuauuuuauuuuuuauucuguucuacuguuuuaaaag

SEQ ID NO: 287890 - RNA, 64 nt, Homo Sapiens
aucaggaagauuggacuaagugauccugaaauguauuuuuuagcacuggauuucuacaaauaau

SEQ ID NO: 287891 - RNA, 64 nt, Homo Sapiens
uaaaaucucauauuauuuuuuuuuuaauuuuuuuauuuuuuaugacagggucucacuaugucac

SEQ ID NO: 287892 - RNA, 64 nt, Homo Sapiens
cuggcucaauuuucuucugucaaauuauaugguuauuuuuuauauuaccacaucagcauuauau

SEQ ID NO: 287893 - RNA, 64 nt, Homo Sapiens
ugauuaggaaauucauguaagacuuuuuaagaguauuuuuuagguuuucacucaaucuuuccug

SEQ ID NO: 287894 - RNA, 64 nt, Homo Sapiens
acuguacguaguuaagucguagcuauaacuucaaauuuuuuaaaagagacaaacuguaaaaaau

SEQ ID NO: 287895 - RNA, 64 nt, Homo Sapiens
uugguuuaauauuaccuaaugaaagugaugacauauuuuuuauaucuggaaugagccuguuggg

SEQ ID NO: 287896 - RNA, 64 nt, Homo Sapiens
uuaaacucauauugaaacuucaucuagucucuuaauuuuuuaacacuaaauucaagucauuugu

SEQ ID NO: 287897 - RNA, 64 nt, Homo Sapiens
cuuucacuuaugguucauugguuuuuguaccaauauuuuuuaugcacuucagugcaagucuugu

SEQ ID NO: 287898 - RNA, 64 nt, Homo Sapiens
uauuaauuuuugaaaagguuuuuuuuauucugcaauuuuuuauuuuuguucuacacaugaauuu

SEQ ID NO: 287899 - RNA, 64 nt, Homo Sapiens
uuuauauacuaaaauuaaggguggagaagaucuuauuuuuuaaaucauggucauaauuuuucuu

SEQ ID NO: 287900 - RNA, 64 nt, Homo Sapiens
cucaauaccugcuucacuugauaaucauauuauaauuuuuuaucaugauuauugacuauauuuu

SEQ ID NO: 287901 - RNA, 64 nt, Homo Sapiens
aagaaucuauagcauuaguauacacuggcacauaauuuuuuaaaaaguuuuaagaaaagauuca

SEQ ID NO: 287902 - RNA, 64 nt, Homo Sapiens
uauauauaucuaaaugaaugcaaugugcauaaauauuuuuuaaacauaacagugaacuauugca

SEQ ID NO: 287903 - RNA, 64 nt, Homo Sapiens
ugcuaauuucaaaugaagauuccugccuuaaaauauuuuuuaauuuaauggucaguauauuuug

SEQ ID NO: 287904 - RNA, 64 nt, Homo Sapiens
uaagaaaagaauccuuaaaaucuagauuuauaccauuuuuuaaagucccaccuuucaauguuua

SEQ ID NO: 287905 - RNA, 64 nt, Homo Sapiens
aaaauauauuuuaaccuacaggagcaaauuggucauuuuuuaaaacagccuuaagaauugcagu

SEQ ID NO: 287906 - RNA, 64 nt, Homo Sapiens
uaguguaugcguagccucuauuuuuauauauccuauuuuuuauggacucugaaugaauuauuuu

SEQ ID NO: 287907 - RNA, 64 nt, Homo Sapiens
guaccaaagguauuugguaauaucauggacauacauuuuuuaaauuuuggauuaaaaaguauua

SEQ ID NO: 287908 - RNA, 64 nt, Homo Sapiens
augggucagacuuuuggauuuguuuauaauuuuuauuuuuuaaucaugcuuguguaauuggcuu

SEQ ID NO: 287909 - RNA, 64 nt, Homo Sapiens
acuucauugcuguuuuugacugaauuuuuggguuauuuuuuaaaaucuaaaggauauuauuguu

SEQ ID NO: 287910 - RNA, 64 nt, Homo Sapiens
auaaugcuuuuuguaaacaaggaacaaaaaauccauuuuuuauauagcagaaaaauaccuuaaa

SEQ ID NO: 287911 - RNA, 64 nt, Homo Sapiens
acacagagguguucugaccuccuucaaaaaaauuauuuuuuaaaguuauauuaaaagagagggu

SEQ ID NO: 287912 - RNA, 64 nt, Homo Sapiens
aaaaguuuuuuucauucaaacuauaaaaauacucauuuuuuaaaaaauuaagaaucuauauaag

SEQ ID NO: 287913 - RNA, 64 nt, Homo Sapiens
ccugauuugucacucgugacugcuugguaccuuaauuuuuuauacuuugauucacaccuuuguc

SEQ ID NO: 287914 - RNA, 64 nt, Homo Sapiens
uuguguaauuuuacauuucaguaaacauauggguauuuuuuauuaauuguuuaaaguauuauau

SEQ ID NO: 287915 - RNA, 64 nt, Homo Sapiens
gaucagaauguggcaccagaaggugaaagguuauauuuuuuacauuaaacaaaguauauguaaa

SEQ ID NO: 287916 - RNA, 64 nt, Homo Sapiens
auuucuugggugugacaucauagcuuuucuggacauuuuuuauuauuuguguccaaagaauuua

SEQ ID NO: 287917 - RNA, 64 nt, Homo Sapiens
aagcacugucccaguggauucucaacugccaguaauuuuuuaaaaaaaaaauaugaaaugugug

SEQ ID NO: 287918 - RNA, 64 nt, Homo Sapiens
gaaaaugcuuuaguuuucuuuuuagaaacuggaaauuuuuuaaaaccuguuuugccuuauacau

SEQ ID NO: 287919 - RNA, 64 nt, Homo Sapiens
caacaucguuuaaaaauaauuaauguguuuuaacauuuuuuaauucaugguggcaauauccuuu

SEQ ID NO: 287920 - RNA, 64 nt, Homo Sapiens
guguuuaagauagacacuuauucuaucuuguuggauuuuuuacauuaauuuuagagccaaauuu

SEQ ID NO: 287921 - RNA, 64 nt, Homo Sapiens
guggaaguuaugaaagaauguaauucacuaaauuauuuuuuaaaugaaaccuuuuuuuuucuuu

SEQ ID NO: 287922 - RNA, 64 nt, Homo Sapiens
ugugugugcaguuauauuuuauauggacgaccaaauuuuuuauuaagaugaguaaauauuugaa

SEQ ID NO: 287923 - RNA, 64 nt, Homo Sapiens
gacucuugaaggcaauccuuccucuggccaggaaauuuuuuaaaaaauaauacuguguuguguu

SEQ ID NO: 287924 - RNA, 64 nt, Homo Sapiens
uaguaaguaauaaagucucuuauuagaaucuuguauuuuuuaauugagcuaaucaaaauaauuc

SEQ ID NO: 287925 - RNA, 64 nt, Homo Sapiens
aaauugaggagauugauucauaauucacaugucaauuuuuuauaguaauauguacuucuaauuu

SEQ ID NO: 287926 - RNA, 64 nt, Homo Sapiens
aagucauuuuuucacccuguauaguaugggaauuauuuuuuauguuaaauagaaacugaaugua

SEQ ID NO: 287927 - RNA, 64 nt, Homo Sapiens
cuucccucaaggggcuccccucccgugcauggacauuuuuuaaaccaccgauuccaagaggaug

SEQ ID NO: 287928 - RNA, 64 nt, Homo Sapiens
ggggagaucccagccuccacaaagaggcccuuuuauuuuuuauucugauuagccauuuuaaacc

SEQ ID NO: 287929 - RNA, 64 nt, Homo Sapiens
uaaacagauuaccaguuuuuuacuugugggugugauuuuuuaaaauaguucuuuauauauaauu

SEQ ID NO: 287930 - RNA, 64 nt, Homo Sapiens
guuaagugcacuuguauugcuuuuuaaucuguuaauuuuuuaaagacccaagcagucauuuuga

SEQ ID NO: 287931 - RNA, 64 nt, Homo Sapiens
cugggaaacauagcagaccucguuucuacuaaaaauuuuuuaaaaaagaaaauuagggcaaggu

SEQ ID NO: 287932 - RNA, 64 nt, Homo Sapiens
gggcaacaugaugugaaaacccaucucuacaaaaauuuuuuaaaaaauaagccagggauugugg

SEQ ID NO: 287933 - RNA, 64 nt, Homo Sapiens
gcacuucauagggagaagcacuuaugacaaggcuauuuuuuaaaccgcgguauuauccuaauuu

SEQ ID NO: 287934 - RNA, 64 nt, Homo Sapiens
uuauccuaauuuaaaagaagaucgguuuuuaauaauuuuuuauuuucauaggaugaaguuagag

SEQ ID NO: 287935 - RNA, 64 nt, Homo Sapiens
gugcucuguaccugucaaaauugaucaugucuucauuuuuuaauuauuugucucuuacaucucc

SEQ ID NO: 287936 - RNA, 64 nt, Homo Sapiens
agagacagaguuucaccaugggcuaauuuucuguauuuuuuaguaggaacgugccaccaugacu

SEQ ID NO: 287937 - RNA, 64 nt, Homo Sapiens
ggauauauauauuuuucaguuucccccuucaaaaauuuuuuauucugccauuuaugugcuuuua

SEQ ID NO: 287938 - RNA, 64 nt, Homo Sapiens
uugaauuuguuagcaaauauacauuaaugacuucauuuuuuagcaggugcccucauaccucuug

SEQ ID NO: 287939 - RNA, 64 nt, Homo Sapiens
aaagagccuauucaauagcuaucuuccccauacuauuuuuuauauuaaauggaaauuuccauac

SEQ ID NO: 287940 - RNA, 64 nt, Homo Sapiens
aaucuauuuuaaaaugugaugaacagcuguuaauauuuuuuaaauguauuaagcacaagauaaa

SEQ ID NO: 287941 - RNA, 64 nt, Homo Sapiens
guugggucuuucaggcugguccuuauuuuuuagcauuuuuuaagcaauauuaugcagauuuaug

SEQ ID NO: 287942 - RNA, 64 nt, Homo Sapiens
auuuuuuaagguugggucuucagauuuaugccuuauuuuuuagcaaauaaaacucaauauuaug

SEQ ID NO: 287943 - RNA, 64 nt, Homo Sapiens
gcacuacucauauccuuuaaacuguggagggaauauuuuuuaaauuauuaaagguggcauggag

SEQ ID NO: 287944 - RNA, 64 nt, Homo Sapiens
auuugggaauauuugcauguguuucaggcuucagauuuuuuaagaaaugcuuaggaccaggagu

SEQ ID NO: 287945 - RNA, 64 nt, Homo Sapiens
augcuuuaaacacuauguaauuguauuguaauuuauuuuuuauucuccuuccuaaagagcacuu

SEQ ID NO: 287946 - RNA, 64 nt, Homo Sapiens
aaauuguaugauuuacauauauuuuuccaauacuauuuuuuaaauuaaauguauagaccuugau

SEQ ID NO: 287947 - RNA, 64 nt, Homo Sapiens
agcugaaaauuuagaagcaauucauauaauuuauauuuuuuaaaacuauuuuccaacuuguauu

SEQ ID NO: 287948 - RNA, 64 nt, Homo Sapiens
uucaggggugggagcuaaguauuuuccagaacucauuuuuuaccgaauuguuauucuauuuuuu

SEQ ID NO: 287949 - RNA, 64 nt, Homo Sapiens
uuccagaacucauuuuuuacugaauuguuauucuauuuuuuauuguugguuggacucugaauuu

SEQ ID NO: 287950 - RNA, 64 nt, Homo Sapiens
uaaaauuuuguuuuucuguaauuuugauguaacaauuuuuuaaacacagauuugaaggaaaaaa

SEQ ID NO: 287951 - RNA, 64 nt, Homo Sapiens
aaagcaacggucccuaauaguuauaucucaagguauuuuuuaaaaaagugaugacuucuaaugc

SEQ ID NO: 287952 - RNA, 64 nt, Homo Sapiens
gguccuuggacuuuuagcuguuaaaugguaucucauuuuuuaaaacacauuucacauuuaaagu

SEQ ID NO: 287953 - RNA, 64 nt, Homo Sapiens
agaugccaacguugucuuugauaauauuuaauauauuuuuuaaaaaacaauucuuguaaaauac

SEQ ID NO: 287954 - RNA, 64 nt, Homo Sapiens
uauuauauuuguagaaguauuagaaaaauauucuauuuuuuauucagugcugcguaauuaccca

SEQ ID NO: 287955 - RNA, 64 nt, Homo Sapiens
auuacaggcgugagccaccaugcccggcccaaauauuuuuuauucaggaugguauaaccuaacu

SEQ ID NO: 287956 - RNA, 64 nt, Homo Sapiens
ggaauucacugaaacaguaccagcaagucaugagauuuuuuaguaaagaugagaaagaugguug

SEQ ID NO: 287957 - RNA, 64 nt, Homo Sapiens
uuauuaacuauaauauaugauggauuuuuuccuaauuuuuuauauuuccuuacaauuuuggugg

SEQ ID NO: 287958 - RNA, 64 nt, Homo Sapiens
aucugcauaaaugguaaccaguagcucuacuuuuauuuuuuauguugcuuaacuguuuuauuug

SEQ ID NO: 287959 - RNA, 64 nt, Homo Sapiens
ugauguuuaucagaacuguucacuuucagaaaugauuuuuuaaagcauuuuguugaaaaugcgg

SEQ ID NO: 287960 - RNA, 64 nt, Homo Sapiens
uaagaaauaugggguuuagaaugggguugacuguauuuuuuaaccuaauucuggagagaagauu

SEQ ID NO: 287961 - RNA, 64 nt, Homo Sapiens
guauuuuuuaaccuaauucuggagagaagauuguauuuuuuacaguuuuuuggguuuggcuucc

SEQ ID NO: 287962 - RNA, 64 nt, Homo Sapiens
cugcauuuuaaaaauuggauaagacucagugcuuauuuuuuaaauuugccugccuuguaauaac

SEQ ID NO: 287963 - RNA, 64 nt, Homo Sapiens
uuuaguagagacgggguuucaccagacccggcuaauuuuuuaguuggguuuauaggugcccgcc

SEQ ID NO: 287964 - RNA, 64 nt, Homo Sapiens
gauguaaaacauucugcuuugauuuagcuuuaauauuuuuuagacuuuguacugcauuuauaga

SEQ ID NO: 287965 - RNA, 64 nt, Homo Sapiens
uuaauuuucuugcugugauauauuuagucuuuaaauuuuuuaggguauuuaccuguuaagagau

SEQ ID NO: 287966 - RNA, 64 nt, Homo Sapiens
auuuaccuguuaagagauuaugaauaccaauuuaauuuuuuaguacaguuuguauauuuuuaaa

SEQ ID NO: 287967 - RNA, 64 nt, Homo Sapiens
ucauucugccuuuccuauuuuuaauacacauaacauuuuuuagugagccugaaaagauuuguau

SEQ ID NO: 287968 - RNA, 64 nt, Homo Sapiens
agggaaacaguaccaaggagaggauuguuugaguauuuuuuaaacuuuggggaaugggugggaa

SEQ ID NO: 287969 - RNA, 64 nt, Homo Sapiens
uagaaguuacuucauuauauaccugccuuguaccauuuuuuaaaacuaaagcauuuuaaauaau

SEQ ID NO: 287970 - RNA, 64 nt, Homo Sapiens
uuuguuuuaugcaaaaaaguuaccuuuuuaaacuauuuuuuaacgaaugaugcucauauaagaa

SEQ ID NO: 287971 - RNA, 64 nt, Homo Sapiens
cuauguucuuuaaaucaacaacaucaugcuucucauuuuuuaaauguuugagauuugaaauuau

SEQ ID NO: 287972 - RNA, 64 nt, Homo Sapiens
aaacuguccuaucucauuuuagauuucuuccaguauuuuuuaaaagcuugaacauuauucacuu

SEQ ID NO: 287973 - RNA, 64 nt, Homo Sapiens
uuuacuuauucccuucacagugagcuuuucuuuaauuuuuuaugccuuucuguuuuuuuuuaag

SEQ ID NO: 287974 - RNA, 64 nt, Homo Sapiens
acuugagguagguagcuacaauuacccccacaagauuuuuuaaauacaggauaauauuagccuu

SEQ ID NO: 287975 - RNA, 64 nt, Homo Sapiens
uaaauauuuagcuguagcgcacuacaugcccugcauuuuuuauuuacugugcccaguuuccuuc

SEQ ID NO: 287976 - RNA, 64 nt, Homo Sapiens
uauuuuuaaauuuucucuuuaaaaauauuuuuuuauuuuuuacuucuugcccaggcugcuuuuu

SEQ ID NO: 287977 - RNA, 64 nt, Homo Sapiens
cuaauuuuuuucuaaucaaaaaauuuuagauuuuauuuuuuaauucuuuuuuagccagcacauu

SEQ ID NO: 287978 - RNA, 64 nt, Homo Sapiens
guuagaaggcuccauuguuuggcaggaguuggaaauuuuuuaaaugugaauuugggggugcagg

SEQ ID NO: 287979 - RNA, 64 nt, Homo Sapiens
gaauuaaaacuagaaaacaacaauucacuauuuuauuuuuuaauuugaaaauaacucauuauac

SEQ ID NO: 287980 - RNA, 64 nt, Homo Sapiens
gugcuggggcaaacaaagcacuaaaaagagcuguauuuuuuaaacuuaacuguucuuccuggcg

SEQ ID NO: 287981 - RNA, 64 nt, Homo Sapiens
aagcaaacugguguguauucggccccuaugugggauuuuuuaaauuugauuuaaaauuaugcag

SEQ ID NO: 287982 - RNA, 64 nt, Homo Sapiens
aaucuauauuuugggaaaaauauuguauguauauauuuuuuaaagcauaauuucagcuucuaua

SEQ ID NO: 287983 - RNA, 64 nt, Homo Sapiens
cccgucaacaaaucuaggaaggagaacucauguuauuuuuuaaccauugugugugcagacuuca

SEQ ID NO: 287984 - RNA, 64 nt, Homo Sapiens
uuuguuuuuuccacuuguauaugcacuaauuuuaauuuuuuaaagacuuuuucugaucuuugaa

SEQ ID NO: 287985 - RNA, 64 nt, Homo Sapiens
ugccugcuagucagauacauuuacauuuaugcaaauuuuuuaaauaggagaaaauuaagaaauu

SEQ ID NO: 287986 - RNA, 64 nt, Homo Sapiens
ccaaugccaagacaaaauuauuuuucuuauacuuauuuuuuauuaaacaaaaugaaaaagaucc

SEQ ID NO: 287987 - RNA, 64 nt, Homo Sapiens
gauaacugagaggcucagaaucuuuaccaaggauauuuuuuaggauaagguagcugccuguuca

SEQ ID NO: 287988 - RNA, 64 nt, Homo Sapiens
cauaaccccacccuuuacauuuugugcagugauuauuuuuuaaagucuucuuucauguaaguag

SEQ ID NO: 287989 - RNA, 64 nt, Homo Sapiens
aaaucuuaagagaauccacauaaaagaagaaacuauuuuuuaaaaauucacuucuauauauaca

SEQ ID NO: 287990 - RNA, 64 nt, Homo Sapiens
cuuuuccuuuuuacuucuggcuuauuuuaaaaauauuuuuuaucuauuuacuguguguuuaagc

SEQ ID NO: 287991 - RNA, 64 nt, Homo Sapiens
uaagcaagcaacagugcacugaucugguaguuaaauuuuuuaauuaaauaguuaaaauaaugua

SEQ ID NO: 287992 - RNA, 64 nt, Homo Sapiens
uuuuuaugaugaugaaaauuuuaccagcagaaggauuuuuuaaaguuuuuuuuuuuuuuuuaau

SEQ ID NO: 287993 - RNA, 64 nt, Homo Sapiens
aaauauguacaauugugggcauaaacuguuucagauuuuuuauuugaagguuuuaagugguuug

SEQ ID NO: 287994 - RNA, 64 nt, Homo Sapiens
guguggagaaauuaaagagugaaggccauauuucauuuuuuauaaauuaucuuucaagcucaga

SEQ ID NO: 287995 - RNA, 64 nt, Homo Sapiens
agguaaagauggaaaugacagagcacagacauuuauuuuuuaaauugauaggguagaaaaugaa

SEQ ID NO: 287996 - RNA, 64 nt, Homo Sapiens
acaaaaacauuauuugugccacuguuguuaaaauauuuuuuaaauugauuuuuuuucuauuaaa

SEQ ID NO: 287997 - RNA, 64 nt, Homo Sapiens
ugauggggaugccacugagugagaagccacuaccauuuuuuagguauuagcucacugggguggg

SEQ ID NO: 287998 - RNA, 64 nt, Homo Sapiens
cacacauguauguucuccaauauuguuccuugccauuuuuuaauucuuuccccaugucauuuuu

SEQ ID NO: 287999 - RNA, 64 nt, Homo Sapiens
guuccuugccauuuuuuaauucuuuccccaugucauuuuuuauuguucuuccuauuuucuuacc

SEQ ID NO: 288000 - RNA, 64 nt, Homo Sapiens
uguauucauuccuacaaauuacagauuaaccaguauuuuuuaaaaggcaaauguggaauuccuc

SEQ ID NO: 288001 - RNA, 64 nt, Homo Sapiens
cucaaacguuucaauaaaacuucuugcaaugcauauuuuuuaauucagaauguuugucauaugc

SEQ ID NO: 288002 - RNA, 64 nt, Homo Sapiens
acuaauuuuguacucucagaugguaaauuauguuauuuuuuacauucuauaugaguggguuuac

SEQ ID NO: 288003 - RNA, 64 nt, Homo Sapiens
aaaaugagcacuuuucauucgcaacauaaaccacauuuuuuaaaucaaaagcaguugaguaaca

SEQ ID NO: 288004 - RNA, 64 nt, Homo Sapiens
acauuaagcaacaguguaaugguauucaaaaggaauuuuuuaaaaaggacaauuuguguuggau

SEQ ID NO: 288005 - RNA, 64 nt, Homo Sapiens
gcuuagauauaaaaggucucuuguuguugcuagaauuuuuuauagagauuuuuuguuguuauug

SEQ ID NO: 288006 - RNA, 64 nt, Homo Sapiens
auguaagcaaaaccaauaaaggcuauaguuacugauuuuuuauuauuuuuugguugccuaaagu

SEQ ID NO: 288007 - RNA, 64 nt, Homo Sapiens
guuagcacuucaacauagcucgugaaagcacuuaauuuuuuacagggaauuaagaaagccucgu

SEQ ID NO: 288008 - RNA, 64 nt, Homo Sapiens
uuuuaacaaacuuguucauuauggaauuuuuuuuauuuuuuaucauuucaaggauuaucaaggu

SEQ ID NO: 288009 - RNA, 64 nt, Homo Sapiens
gaauuuuuuuuaaacuuacaauuuuuuucaacuaauuuuuuagugguacucuaguguuaagugu

SEQ ID NO: 288010 - RNA, 64 nt, Homo Sapiens
gacauucuacuauugaauuauguacaacauuuucauuuuuuaugcuucuugaggugguaaugag

SEQ ID NO: 288011 - RNA, 64 nt, Homo Sapiens
ucaguuccccuaaaccaauaaacauuuauacuagauuuuuuauuuccacuuaucauuaaugauu

SEQ ID NO: 288012 - RNA, 64 nt, Homo Sapiens
uguuaauguguacuuauaaauucacauugucaguauuuuuuaauauugggucugaauaauuauc

SEQ ID NO: 288013 - RNA, 64 nt, Homo Sapiens
uugucuuuucacauaugauguguuuggaacccaaauuuuuuacugauuuuauuguguuguuggu

SEQ ID NO: 288014 - RNA, 64 nt, Homo Sapiens
uucucuuguauuuuucuuacuuacuauggguuacauuuuuuauuuuucaaauuggaugauaauu

SEQ ID NO: 288015 - RNA, 64 nt, Homo Sapiens
uauuuuucaaauuggaugauaauuucuuggaaacauuuuuuauguuuuaguaaacaguauuuuu

SEQ ID NO: 288016 - RNA, 64 nt, Homo Sapiens
aaugcuugauguuuuaaaauaauaacauuuuuauauuuuuuaaaagacaaacuucauauuaucc

SEQ ID NO: 288017 - RNA, 64 nt, Homo Sapiens
cagucugguaauacuauucuauuuuauuuaaaauauuuuuuauugaaauauuaauguuuauuac

SEQ ID NO: 288018 - RNA, 64 nt, Homo Sapiens
aaauaacuauuuuguaucuacagucggauaauggauuuuuuauuuuguauauuuauucuauuuu

SEQ ID NO: 288019 - RNA, 64 nt, Homo Sapiens
auuguuaagugcaauaaaguuuuugccuugcuuuauuuuuuaauacauaaaacuuacauucuca

SEQ ID NO: 288020 - RNA, 64 nt, Homo Sapiens
aaguuuuccaguauugaaaacuucaaagcugaauauuuuuuauuucuaaguauuuaaauguucu

SEQ ID NO: 288021 - RNA, 64 nt, Homo Sapiens
uaaaguauguuuuuaaauuuuaaaaagcagcugcauuuuuuauuuaguuggaauaucacccaau

SEQ ID NO: 288022 - RNA, 64 nt, Homo Sapiens
agcugcauuuuuuauuuaguuggaauaucacccaauuuuuuauuuuuauugcuauuaaaauauc

SEQ ID NO: 288023 - RNA, 64 nt, Homo Sapiens
uuuggugaauuuccucaauguuuuauaaauguacauuuuuuaaguccuuaagcugacucuuagc

SEQ ID NO: 288024 - RNA, 64 nt, Homo Sapiens
cuuuccuuaagacuuuaaaaauguauuuaaaacuauuuuuuauuaaauacuuugugauuuccua

SEQ ID NO: 288025 - RNA, 64 nt, Homo Sapiens
uugugauuuaugugauuucucaugugagaaaugaauuuuuuauuggcagacuuugcuuuuuuaa

SEQ ID NO: 288026 - RNA, 64 nt, Homo Sapiens
cuguuuuaaaugugaauucucuuacuaaauccagauuuuuuaaauuauuuauuuuucuaaaacu

SEQ ID NO: 288027 - RNA, 64 nt, Homo Sapiens
gagacacugucccacuccauugcaccuggcccacauuuuuuaaaggaugacaggugcgagccac

SEQ ID NO: 288028 - RNA, 64 nt, Homo Sapiens
guugaagaauuaaauauuuuuuugauuuuauuuaauuuuuuaaauauucuggucauuauccuau

SEQ ID NO: 288029 - RNA, 64 nt, Homo Sapiens
gucauuacuaaauaaucuguguguguguugcuaaauuuuuuacuuuaaacauacucuuguuuaa

SEQ ID NO: 288030 - RNA, 64 nt, Homo Sapiens
gaaguuccuuauuuugucuuugcugcaagaauguauuuuuuaaugcagcaguaagagaaacuag

SEQ ID NO: 288031 - RNA, 64 nt, Homo Sapiens
uaguagcugcuaucagagacaacauacauuuuuuauuuuuuaaugugaugauuaaaguuaggaa

SEQ ID NO: 288032 - RNA, 64 nt, Homo Sapiens
uuuuaauuaguagcugcuauuuaggaaaacauacauuuuuuauuuuaucuggugaugauuaaag

SEQ ID NO: 288033 - RNA, 64 nt, Homo Sapiens
gaguuugaagcaacuguuugcucauuauauauauauuuuuuaaaagacucgagucuuugggaaa

SEQ ID NO: 288034 - RNA, 64 nt, Homo Sapiens
uauuauaaguggucaugaaaacuuuuuaaauuugauuuuuuaaauauguucaauguauggucau

SEQ ID NO: 288035 - RNA, 64 nt, Homo Sapiens
uguuuucauauuuauagccauucuuuguauucugauuuuuuaaggucaugugaggcaauaugca

SEQ ID NO: 288036 - RNA, 64 nt, Homo Sapiens
uaaaaauuugagauuuuuaagaauuuuauaaaugauuuuuuauuauuuuagagccauccauccu

SEQ ID NO: 288037 - RNA, 64 nt, Homo Sapiens
acuguacuucuggugacuguagugaagugugugcauuuuuuauaggaaggugcuggagauccca

SEQ ID NO: 288038 - RNA, 64 nt, Homo Sapiens
accagagcauaucuauuauaugaacccacauuuuauuuuuuauuugagugccauguauaucaca

SEQ ID NO: 288039 - RNA, 64 nt, Homo Sapiens
auuucuuuuauaauaugcuuaccuucauuuguaaauuuuuuaaagugcaaguuaguuaacauga

SEQ ID NO: 288040 - RNA, 64 nt, Homo Sapiens
aaaccuuaauguaagauauguagaugucuauuugauuuuuuaaauuaauuccgauuuggaaccu

SEQ ID NO: 288041 - RNA, 64 nt, Homo Sapiens
auaaaaaugaucuuuggcuauguagucuacggauauuuuuuaucacauuuuaaaaaccagaaua

SEQ ID NO: 288042 - RNA, 64 nt, Homo Sapiens
ucaggaaauguaagaaaccaaauaucaggaagccauuuuuuauugcauuuuuaaauaaaauacc

SEQ ID NO: 288043 - RNA, 64 nt, Homo Sapiens
uaauuucuuuucuuccugucuuuuuuuuucuuucauuuuuuauuccuucauccuccauuggucc

SEQ ID NO: 288044 - RNA, 64 nt, Homo Sapiens
uguaagcuuguccuuuuaaauacuggagcucguaauuuuuuaacguaggcacuugcuguauuuu

SEQ ID NO: 288045 - RNA, 64 nt, Homo Sapiens
uuuuuuuuugguuuuuguuuuuuuuuuuuuaauuauuuuuuaauaaauaaaaaguggcaugcag

SEQ ID NO: 288046 - RNA, 64 nt, Homo Sapiens
agucaaaacucuaagugguuaaaaauuaguaugaauuuuuuagcuucuuaaugaauauggauuu

SEQ ID NO: 288047 - RNA, 64 nt, Homo Sapiens
ugaaaugacuugccuuucugguaauacaaugcugauuuuuuaguaauugccuuuucauuacuuu

SEQ ID NO: 288048 - RNA, 64 nt, Homo Sapiens
gauucuuaguguaguuaugauguggauccuacguauuuuuuaaaaaacucuccagauaauuuug

SEQ ID NO: 288049 - RNA, 64 nt, Homo Sapiens
uaaacuuacuagcuuuaccuucuaaaaguacugcauuuuuuacuuuuuuuuaugaucaaggaaa

SEQ ID NO: 288050 - RNA, 64 nt, Homo Sapiens
uauuuugcuuuaauugcuuuaaaucuuaagcaauauuuuuuauucaguaaacaaauucuuucac

SEQ ID NO: 288051 - RNA, 64 nt, Homo Sapiens
uguuuugucuuuuuuuauuacuaguguuuaagucauuuuuuacuugaaucagauggugucauuu

SEQ ID NO: 288052 - RNA, 64 nt, Homo Sapiens
uuauaaaaugcuccuagaagucuuaauuguguuuauuuuuuaaaaaaacaaauguuagacuugu

SEQ ID NO: 288053 - RNA, 64 nt, Homo Sapiens
gcagaggaagacuccuuuuuucaucacuguaugaauuuuuuauaauguuuuuuuaaaauauauu

SEQ ID NO: 288054 - RNA, 64 nt, Homo Sapiens
augauuaaggaagacuauaucuagaucaugucugauuuuuuauugugacuucuccagcccuggu

SEQ ID NO: 288055 - RNA, 64 nt, Homo Sapiens
gcacaggggcccugaauuuaugugguuuuuauacauuuuuuaauaagaugcacuuuaugucauu

SEQ ID NO: 288056 - RNA, 64 nt, Homo Sapiens
uuuauacauuuuuuaauaagaugcacuuuaugucauuuuuuaauaaagucugaagaauuacugu

SEQ ID NO: 288057 - RNA, 64 nt, Homo Sapiens
uuugaaauacuuaaucuuuccaaauguuagcuucauuuuuuacccaugaaacuuaccuaaucuu

SEQ ID NO: 288058 - RNA, 64 nt, Homo Sapiens
cauuuucaucuuuauauucuuguacuucauaauaauuuuuuaucgcaagucaaauucuaaugug

SEQ ID NO: 288059 - RNA, 64 nt, Homo Sapiens
uauauuuuaggaauaauaaagaaaaaugugcauuauuuuuuauuaacauguguauagugaugcu

SEQ ID NO: 288060 - RNA, 64 nt, Homo Sapiens
ugaggaaacugaggcucauacuauuauuauccucauuuuuuaguacauccccaugaaguaaaca

SEQ ID NO: 288061 - RNA, 64 nt, Homo Sapiens
uggaggagagauuuuucuaucauguagaguagguauuuuuuauagauugaagguugaucaauuu

SEQ ID NO: 288062 - RNA, 64 nt, Homo Sapiens
gaguagguauuuuuuauagauugaagguugaucaauuuuuuaauacuuucaagagaaaacugug

SEQ ID NO: 288063 - RNA, 58 nt, Homo Sapiens
ugaaaucugucacuguguaaaaagacagauuuuuuaaauugacuuaauuacuaaguca

SEQ ID NO: 288064 - RNA, 64 nt, Homo Sapiens
ggaguuuacuguaaugugaaauuuucacauuugaauuuuuuaauugccuggcaaaagcugauau

SEQ ID NO: 288065 - RNA, 64 nt, Homo Sapiens
ucuggugaaaagguuaaaucguagaagcuaguauauuuuuuauauuuuuguaacaauugcuuuu

SEQ ID NO: 288066 - RNA, 64 nt, Homo Sapiens
gggguuaguauuuauaguccuaacaaguccaguaauuuuuuauaaaucuucagauuauaaacag

SEQ ID NO: 288067 - RNA, 64 nt, Homo Sapiens
guuuugcacuaugauuauaauaccugcauuucuaauuuuuuaagcauguagccaguaauaauuu

SEQ ID NO: 288068 - RNA, 64 nt, Homo Sapiens
aauagaaccuuuugagaugaauuaauguaagaauauuuuuuaaauaggcuuacugucaaauugc

SEQ ID NO: 288069 - RNA, 64 nt, Homo Sapiens
ucagcuacucuaguucuguuguuuuguguauauaauuuuuuaaaaaaaauuugugugcuucugc

SEQ ID NO: 288070 - RNA, 64 nt, Homo Sapiens
ugggaccacaggcaugcaccacuacgcaugacuaauuuuuuaaauauuugagacggggucuccc

SEQ ID NO: 288071 - RNA, 64 nt, Homo Sapiens
ccacugcaccugcccagcuccccaacucccugccauuuuuuaagagacaguuucgcuccaucgc

SEQ ID NO: 288072 - RNA, 64 nt, Homo Sapiens
uaaaacuuuggcgguucuugcauaacauugucagauuuuuuaguguauuucugugaagucauuu

SEQ ID NO: 288073 - RNA, 64 nt, Homo Sapiens
uaguaguugcuguuuggauaaaaguugaugugugauuuuuuauuaaacaaauaguaaacccuuc

SEQ ID NO: 288074 - RNA, 64 nt, Homo Sapiens
uuguugagcuuguaaaaugcaaaaccaguguucaauuuuuuaucuuacauaaaauuagaguaug

SEQ ID NO: 288075 - RNA, 64 nt, Homo Sapiens
aaugccgagcagggcaaugcuuaaggaaagagccauuuuuuaaaguuguucugacgugugaaau

SEQ ID NO: 288076 - RNA, 64 nt, Homo Sapiens
uaaagacuaaugcuuugauuaauauuuccuuuuaauuuuuuaaugauugcuuggcuauugucug

SEQ ID NO: 288077 - RNA, 64 nt, Homo Sapiens
guccugcuacagcuagugugauuccaugcucaguauuuuuuauuuaauggcagagauuaaaagu

SEQ ID NO: 288078 - RNA, 64 nt, Homo Sapiens
aaaguagauaauacuuaaaaugaagaccacugugauuuuuuaaauuuguuuuuucgccauguga

SEQ ID NO: 288079 - RNA, 64 nt, Homo Sapiens
ggcuucuauguuguauauuuauuaauagacccauauuuuuuagucauuuugaaaugggcucuug

SEQ ID NO: 288080 - RNA, 64 nt, Homo Sapiens
auuugaacugauaagcacuuuuuaauuugucuuuauuuuuuaucuuuaaauuuuaaugcaaaau

SEQ ID NO: 288081 - RNA, 64 nt, Homo Sapiens
uuaaauuuuuuguuuuuacuauagcuccugcuuuauuuuuuaaacuuugaauuuuguugucuaa

SEQ ID NO: 288082 - RNA, 64 nt, Homo Sapiens
gaaaucuugagugcuugagggcccuccugcuuucauuuuuuaaauuccugugcggcccuucguu

SEQ ID NO: 288083 - RNA, 64 nt, Homo Sapiens
aaccgacguuucagggaagaacagcaaacaagcuauuuuuuagaguaacauuuaccggcugugu

SEQ ID NO: 288084 - RNA, 64 nt, Homo Sapiens
ugggacuaccagugcauaccaccaugccugggugauuuuuuaaauuuuuuauacagacaagguc

SEQ ID NO: 288085 - RNA, 64 nt, Homo Sapiens
cagugcauaccaccaugccugggugauuuuuuaaauuuuuuauacagacaaggucuugcuaugu

SEQ ID NO: 288086 - RNA, 64 nt, Homo Sapiens
caaaaaaguuauuuauuuuggucccuaugauuuuauuuuuuaagauaaauuaauauacuguauu

SEQ ID NO: 288087 - RNA, 64 nt, Homo Sapiens
ugauuuuauuuuuuaagauaaauuaauauacuguauuuuuuaaaguauagguuuagguuuacag

SEQ ID NO: 288088 - RNA, 64 nt, Homo Sapiens
gguuccuccaugucuuuuugugacuugauagcucauuuuuuauugcugaauaauguucauugua

SEQ ID NO: 288089 - RNA, 64 nt, Homo Sapiens
aagcagcugcugcuccugcuaugaggguguauauauuuuuuacccaaagcucuggaauuguaca

SEQ ID NO: 288090 - RNA, 64 nt, Homo Sapiens
uauuuuuuacccaaagcucuggaauuguacauuuauuuuuuaaaacucaaagagggaaagagcc

SEQ ID NO: 288091 - RNA, 64 nt, Homo Sapiens
uggaaauuauuucugcuucuuaaaaaaaccuaagauuuuuuaaaaaauugauuuguuuugauca

SEQ ID NO: 288092 - RNA, 64 nt, Homo Sapiens
cuugcagaauuuuuuuuucuauauauacauauauauuuuuuaccaaaaugaaucauuacucuau

SEQ ID NO: 288093 - RNA, 64 nt, Homo Sapiens
aaucugguuggugucuuacaagugagcugacaccauuuuuuauucuguguauuuagaaugaagu

SEQ ID NO: 288094 - RNA, 64 nt, Homo Sapiens
uuccaaaauuguguccguuuucuugagcguuuugauuuuuuacuuuuagcuuauaccagcugaa

SEQ ID NO: 288095 - RNA, 64 nt, Homo Sapiens
aauguuucuuagagccaagugucuuuuaaacauuauuuuuuauuucugauuucauaauucagaa

SEQ ID NO: 288096 - RNA, 64 nt, Homo Sapiens
uuauccaaaaugcuugggaccagaaguguuucagauuuuuuaaaauuuuggaauauuugcuuua

SEQ ID NO: 288097 - RNA, 64 nt, Homo Sapiens
cuuaagucuuuaaucccucuauuuuuaugauuuuauuuuuuacaauccuaaauguguuuuuaag

SEQ ID NO: 288098 - RNA, 64 nt, Homo Sapiens
uuacucauuuuacuuaaaagcauuuccuuuuuagauuuuuuauuuuauaggaaaauauuuguau

SEQ ID NO: 288099 - RNA, 64 nt, Homo Sapiens
cacagugaaauuucauucauuuauuuuauauaauauuuuuuauuuauuuguuauuagugauacu

SEQ ID NO: 288100 - RNA, 64 nt, Homo Sapiens
gugcaugcagaauguacauuuagcuuuugguuccauuuuuuauuuuucucaguaauguuuuugu

SEQ ID NO: 288101 - RNA, 64 nt, Homo Sapiens
cuggggagaagcagccccaaauuuauuugcugccauuuuuuacuagaagaggcugugaucuaac

SEQ ID NO: 288102 - RNA, 64 nt, Homo Sapiens
ggaacaacaaccuaaucucaaaacaaccacauggauuuuuuauaauauugaagagggggccaaa

SEQ ID NO: 288103 - RNA, 64 nt, Homo Sapiens
cauugcaguuaagagaaauguuuugguuuuuuucauuuuuuaauuuuuuuaaguugcaauaugu

SEQ ID NO: 288104 - RNA, 64 nt, Homo Sapiens
uugcaauauguuuuugguuuaccaagaugcugugauuuuuuaaguuaaaaaaaaaauuaacuaa

SEQ ID NO: 288105 - RNA, 64 nt, Homo Sapiens
aaacuaugcaugguuguccuuugaaaaaauaaacauuuuuuaaaauuggcuauugccguuuucu

SEQ ID NO: 288106 - RNA, 64 nt, Homo Sapiens
ucaaacuguuuuguucagaaaguacaaucuuuucauuuuuuaauuauacaguuuuccuuuauuc

SEQ ID NO: 288107 - RNA, 64 nt, Homo Sapiens
caggcacgggcuuccuuuucugaucaaacauaccauuuuuuauauuucacaacuauagacaguc

SEQ ID NO: 288108 - RNA, 64 nt, Homo Sapiens
guuuauguagaaaauucacaaaucuguucauuuaauuuuuuaauuugagaauuuuuauuucuuu

SEQ ID NO: 288109 - RNA, 64 nt, Homo Sapiens
acuuuuauaauuuuaauuugaagauugaauaaauauuuuuuauaaagauuguuuugagugcuga

SEQ ID NO: 288110 - RNA, 64 nt, Homo Sapiens
aaaauuaauguuuuucuuuguaacauuuauauauauuuuuuaacauuuuaaguuuaacagauug

SEQ ID NO: 288111 - RNA, 64 nt, Homo Sapiens
ccugggccuugccugcuauggaauauugagagagauuuuuuaaaaaagauuuugcauuuugucc

SEQ ID NO: 288112 - RNA, 64 nt, Homo Sapiens
ucaguguuaaaucauuugcauaagauuuaacagcauuuuuuauaaugaauguaaacauuuuaac

SEQ ID NO: 288113 - RNA, 64 nt, Homo Sapiens
cucacuguguugcccagccugggugucaauaauuauuuuuuaaaaaaaauuuuuaaaaagguuu

SEQ ID NO: 288114 - RNA, 64 nt, Homo Sapiens
gaccgcaggcacuugccaccacgccccacuaaaaauuuuuuaaauuguugccuuucuugaagug

SEQ ID NO: 288115 - RNA, 64 nt, Homo Sapiens
aacuugaagugcuaaauggaauaauccaaaggaaauuuuuuaaaugcagguucuagcugaaaaa

SEQ ID NO: 288116 - RNA, 64 nt, Homo Sapiens
guuugucagguuauauauagaauuucuauuaaggauuuuuuaaauggacaagcaauaggggguu

SEQ ID NO: 288117 - RNA, 64 nt, Homo Sapiens
ucuguauugcaacuuuucucagagauugcaaaggauuuuuuagguagagauuauuuuuccuuau

SEQ ID NO: 288118 - RNA, 64 nt, Homo Sapiens
uguuaccaaccuccaaagggcucuuuaaaaucauauuuuuuauucauuugaggaugucuuauaa

SEQ ID NO: 288119 - RNA, 64 nt, Homo Sapiens
ggcuuuaugugaacuaugauacuugugacaugagauuuuuuaagauuauuuccucuuaucaaca

SEQ ID NO: 288120 - RNA, 64 nt, Homo Sapiens
gcaauauauaauugaaacuaaugagguugcauugauuuuuuaagagaaagugaguuaaucuugu

SEQ ID NO: 288121 - RNA, 64 nt, Homo Sapiens
auguagaguuuguuuuggaggauuccuguuauacauuuuuuaaagaaguaagaccccuuccuua

SEQ ID NO: 288122 - RNA, 64 nt, Homo Sapiens
gcagaagaugcuauuuguggauuacaaaccaagaauuuuuuaaacuuuaugacuuuuaaaaaaa

SEQ ID NO: 288123 - RNA, 64 nt, Homo Sapiens
uuaagccacauugaguuuuguaauaccuaguuguauuuuuuaccguaaguuuuuacaaauuguu

SEQ ID NO: 288124 - RNA, 64 nt, Homo Sapiens
cauucaacaaauauuuauugaauuugguauaguaauuuuuuauuuauauguauguguucaugua

SEQ ID NO: 288125 - RNA, 64 nt, Homo Sapiens
uccacuugaagaguuacauuaauagacaaauuuuauuuuuuauuccuauguguauucaauagua

SEQ ID NO: 288126 - RNA, 64 nt, Homo Sapiens
aauuuaggggagggaggaggauaaauauauuuuuauuuuuuaguccauauuugucuugcacauu

SEQ ID NO: 288127 - RNA, 64 nt, Homo Sapiens
aacauagggggaucccaucucuacacacaaaaaaauuuuuuaaugaaccaggcauuguggcaug

SEQ ID NO: 288128 - RNA, 64 nt, Homo Sapiens
caacuccugcccucaagugauccgccucggucccauuuuuuauucuuuggguccuuccauccca

SEQ ID NO: 288129 - RNA, 64 nt, Homo Sapiens
cacacacacacacauuuuucucuuguagauuuuaauuuuuuaagugggaaagaacucaccuugc

SEQ ID NO: 288130 - RNA, 64 nt, Homo Sapiens
uggacauuaauguacuucuuggacauuuuaauaaauuuuuuaacaguucaaccugcccgucacc

SEQ ID NO: 288131 - RNA, 64 nt, Homo Sapiens
agucaacugcucuuccuacugacucaaauaguuuauuuuuuaaaaauacuuauauaauacaugc

SEQ ID NO: 288132 - RNA, 64 nt, Homo Sapiens
caugaauuauuuugugucuugcuuauuucacucaauuuuuuaagaucuguacauuauugcaugu

SEQ ID NO: 288133 - RNA, 64 nt, Homo Sapiens
uauauugcuguuuauccuauugauggauauuuguauuuuuuauacuuuuguguaauaauaaaaa

SEQ ID NO: 288134 - RNA, 64 nt, Homo Sapiens
uuuuugugaaguguguguugaagccuugcagauuauuuuuuaaauuagagguuuaucacuaggu

SEQ ID NO: 288135 - RNA, 64 nt, Homo Sapiens
aaagcuuuaaguuugaucacauccaauuaaucacauuuuuuaauaguuaugcuuuuauuuguuu

SEQ ID NO: 288136 - RNA, 64 nt, Homo Sapiens
uucuauauagaaaugucaucugcaaauacagaccauuuuuuaucuuucaucuuaccuguaauau

SEQ ID NO: 288137 - RNA, 64 nt, Homo Sapiens
cauccuaagucagggacugucuguauauaucugcauuuuuuagugauuguucuacuauuacagu

SEQ ID NO: 288138 - RNA, 64 nt, Homo Sapiens
uggguucuuuuguacaccuucuguuucuuugcuuauuuuuuaacgccaaagaaagacucucaga

SEQ ID NO: 288139 - RNA, 64 nt, Homo Sapiens
auguaacauacuuuuauuaaacaauuuuaaauuuauuuuuuauuuaagaguuaaugguaaguga

SEQ ID NO: 288140 - RNA, 64 nt, Homo Sapiens
gcacugaauaauuguuuuuaagcugaaaguugguauuuuuuaauaggcauaagccacugcaccc

SEQ ID NO: 288141 - RNA, 64 nt, Homo Sapiens
uuucagauuauaugugauguauaaaaugcaguauauuuuuuaaauauuuuacuaauacuuuuau

SEQ ID NO: 288142 - RNA, 64 nt, Homo Sapiens
aauuuuaaucauuaagucugcagauacaggaaaaauuuuuuaaacauacuaaaacauauuuuug

SEQ ID NO: 288143 - RNA, 64 nt, Homo Sapiens
aauuagccugauggaacaauauaacaguagagcuauuuuuuauaaaguaucuuucaguuuuaua

SEQ ID NO: 288144 - RNA, 64 nt, Homo Sapiens
uaaguucaggcauauguauguccauugguaggaaauuuuuuaggcaaauguuaauauuccaguu

SEQ ID NO: 288145 - RNA, 64 nt, Homo Sapiens
aagaaauuauauaaaaauacuuugaagcuccauuauuuuuuaaaaaaaauaccugaugcccuua

SEQ ID NO: 288146 - RNA, 64 nt, Homo Sapiens
aaugagccaggugugguagucaucucuacaaacaauuuuuuaaaugggcaacaugaugagaccc

SEQ ID NO: 288147 - RNA, 64 nt, Homo Sapiens
aucccucuuaagugccaaaacuuuuuuuuaaaccauuuuuuaucguuuuugaaggagaucuuuu

SEQ ID NO: 288148 - RNA, 64 nt, Homo Sapiens
acuucaugacagcucuuuugguggcucagaagccauuuuuuauagaaucauggaaucuagaaua

SEQ ID NO: 288149 - RNA, 64 nt, Homo Sapiens
augcaaucacccagcaaguccuaccuguuacgcaauuuuuuaucucaaaaugccgaacgagaaa

SEQ ID NO: 288150 - RNA, 64 nt, Homo Sapiens
acgcgaaucuagcuuuaacggaagcaaauucauuauuuuuuaaaugcaguggacuuuucaaaaa

SEQ ID NO: 288151 - RNA, 64 nt, Homo Sapiens
aacaccugagaacuguuacagaacgcugaucaguauuuuuuaucaauucgagcgcgugugaacu

SEQ ID NO: 288152 - RNA, 64 nt, Homo Sapiens
cuauuuaucuuccuucccuuggcaaagcaaacugauuuuuuagauauuuuuguaauagucaguu

SEQ ID NO: 288153 - RNA, 64 nt, Homo Sapiens
uagcuccacaagagagaugauacugacuuuuuaaauuuuuuacaagagucuguauuccugauau

SEQ ID NO: 288154 - RNA, 64 nt, Homo Sapiens
aaaucuccucuuugugaaaucccaucugcauuugauuuuuuauuauuuuauguucccccguuag

SEQ ID NO: 288155 - RNA, 64 nt, Homo Sapiens
aauaauauuguuaaucaguacuacauuuucgaagauuuuuuaaaccaggaccuaaaccuuuaug

SEQ ID NO: 288156 - RNA, 64 nt, Homo Sapiens
caagaauaauaaagguuggaauaagaaacaaaauauuuuuuaaaccugaauugugaaauguguc

SEQ ID NO: 288157 - RNA, 64 nt, Homo Sapiens
caggccugcggaugcaugaaauaauguuggcauuauuuuuuaauuuuuuaaaaaauaaauggua

SEQ ID NO: 288158 - RNA, 64 nt, Homo Sapiens
cggaugcaugaaauaauguuggcauuauuuuuuaauuuuuuaaaaaauaaaugguaucuuauuu

SEQ ID NO: 288159 - RNA, 64 nt, Homo Sapiens
ccuuaaugcuuauucuugauuuuauacacacaguauuuuuuauaggaaugugguuuggcauugu

SEQ ID NO: 288160 - RNA, 64 nt, Homo Sapiens
aguagucuuaugacuuuuguggcauugauugaacauuuuuuacuuuuguacugucuuuugugac

SEQ ID NO: 288161 - RNA, 64 nt, Homo Sapiens
uuuuuauuauugacauuaaguaaugguaccauauauuuuuuaaaauacauauugacuugaauug

SEQ ID NO: 288162 - RNA, 64 nt, Homo Sapiens
caacguaucuauguuguguaggggaaauuuuuucauuuuuuaaaaauucuacuuugguuuuguu

SEQ ID NO: 288163 - RNA, 64 nt, Homo Sapiens
uguuuguuugguuugaguuugauuuggcuuuuauauuuuuuaaaaucccuuuugcuaccccauc

SEQ ID NO: 288164 - RNA, 64 nt, Homo Sapiens
guuaaaauuaagggguuuguuuggaauaauauauauuuuuuaugcuuuugucuuucuuaccuga

SEQ ID NO: 288165 - RNA, 64 nt, Homo Sapiens
augguuuuuacuaaugcuaaaacuuuuaaaguuuauuuuuuaauaaauuguugaguauuacauc

SEQ ID NO: 288166 - RNA, 64 nt, Homo Sapiens
guacauggaguugacauaauacuuuguaaauugaauuuuuuaaagaaauaggcauuugauaacc

SEQ ID NO: 288167 - RNA, 64 nt, Homo Sapiens
uggauuugcauacauucuucaagaucccauuugaauuuuuuagugacuaaaccauugugcauuc

SEQ ID NO: 288168 - RNA, 64 nt, Homo Sapiens
uaauaugcuuauauuguucacuucuuuuuuuuuuauuuuuuaaagaaaucuauuucauaccaug

SEQ ID NO: 288169 - RNA, 64 nt, Homo Sapiens
uuaauuucuaaguguaagugaauuaaucaucuggauuuuuuauucuuuucagauaggcuuaaca

SEQ ID NO: 288170 - RNA, 64 nt, Homo Sapiens
ucacuuucuacuuuuuucauuuuguucuguucgaauuuuuuauaaguauguauuacuuuuguaa

SEQ ID NO: 288171 - RNA, 64 nt, Homo Sapiens
auauuggcaagaaaagaagaauaguuguuuaaauauuuuuuaaaaaacacuugaauaagaauca

SEQ ID NO: 288172 - RNA, 64 nt, Homo Sapiens
ucccaagcaguagcaggacggaacaucagaagguauuuuuuaacagaagguauucugaccuugu

SEQ ID NO: 288173 - RNA, 64 nt, Homo Sapiens
uguucaugucacauccuaaugacugacuuuuuccauuuuuuaaaaagagauacgaauuucuaua

SEQ ID NO: 288174 - RNA, 64 nt, Homo Sapiens
uggauaaaaaaaaaacucgccucauuaguuguuaauuuuuuaguuauuauuuuaaauauuugac

SEQ ID NO: 288175 - RNA, 64 nt, Homo Sapiens
uguauuaauagagucaaugguaagcauuuuugcaauuuuuuaaaugaugacucuuacauagucu

SEQ ID NO: 288176 - RNA, 64 nt, Homo Sapiens
aacaugcaguauauaaauguaauuuagugauggaauuuuuuaauaacuuugcaaaauucguaau

SEQ ID NO: 288177 - RNA, 64 nt, Homo Sapiens
cuucugaauuaaaccccacugaaaaaaauuguuuauuuuuuauucggguauuuuugugggaaua

SEQ ID NO: 288178 - RNA, 64 nt, Homo Sapiens
ggaauuugugcuauuaucuuccucuccagccccccaacuccaucccucaccacaguugucuagg

SEQ ID NO: 288179 - RNA, 64 nt, Homo Sapiens
uucaauaucuaaugucaaccaauggggagagccacaacuccaggagagguuccugagcugaguc

SEQ ID NO: 288180 - RNA, 64 nt, Homo Sapiens
guucccuugaugaagaaguugauaugccuuuucccaacuccagaaagugacaagcucacagacc

SEQ ID NO: 288181 - RNA, 64 nt, Homo Sapiens
ucugacuguuuccaucaaggguacacugccuucucaacuccaaacugacucuuaagaagacugc

SEQ ID NO: 288182 - RNA, 64 nt, Homo Sapiens
ggaggccaggcugaccccaccagccagucagcuacaacuccacaucaacuccacaugcgcccag

SEQ ID NO: 288183 - RNA, 64 nt, Homo Sapiens
ugaccccaccagccagucagcuacaacuccacaucaacuccacaugcgcccagcucgagacuga

SEQ ID NO: 288184 - RNA, 64 nt, Homo Sapiens
caucaucauuuggucaugaagaucccagaauuaucaacuccaccggugggcugggcggggcccc

SEQ ID NO: 288185 - RNA, 64 nt, Homo Sapiens
ucucaggugaucuacccuccgccaggcuggucuucaacuccagagaugggguuucaccauguug

SEQ ID NO: 288186 - RNA, 64 nt, Homo Sapiens
uccugucugucuuagacagcuuagauuuggcccccaacuccauuccuaacucagauccccuaac

SEQ ID NO: 288187 - RNA, 64 nt, Homo Sapiens
caccacuuuccugugcauuugccucuaacacuuccaacuccagccgcaagaccguagaucucag

SEQ ID NO: 288188 - RNA, 64 nt, Homo Sapiens
aaucccccacuccucgcagguucccauccauccccaacuccaauuuggcugaagcccaguuccu

SEQ ID NO: 288189 - RNA, 64 nt, Homo Sapiens
ugcccgccgcaggaaggagcacgaagcugcucagcaacuccaccugggcaucucucuccuaaug

SEQ ID NO: 288190 - RNA, 64 nt, Homo Sapiens
aucaccucuccugccccuagcucagccucauccccaacuccaugccugucuccaaucccaaccc

SEQ ID NO: 288191 - RNA, 64 nt, Homo Sapiens
gucuccaaucccaacccugcccccaaucuccccucaacuccaauccauaacccccuucaaacca

SEQ ID NO: 288192 - RNA, 64 nt, Homo Sapiens
gaaccaccaaaaagaaaauggaaaugugguaaaucaacuccacaacuccaaggaauacugagau

SEQ ID NO: 288193 - RNA, 64 nt, Homo Sapiens
gaauacugagaugaaauguguaaauguucauggucaacuccaaggcuacaaggaguuguugggu

SEQ ID NO: 288194 - RNA, 64 nt, Homo Sapiens
uucauagaaucguuggacucauuaaugaaucguucaacuccacucacugaagcccagaccuccg

SEQ ID NO: 288195 - RNA, 64 nt, Homo Sapiens
uaaugcuuucuguggacaccacugagcucugccucaacuccacccucugcgaccggaggacuau

SEQ ID NO: 288196 - RNA, 64 nt, Homo Sapiens
uauaucugcuuuaaggaguuccugacaccuccauauaccccagcgagguacugcccccacaccu

SEQ ID NO: 288197 - RNA, 64 nt, Homo Sapiens
ugauaucagagauacacaaauuuugacaaaaggaauaccccauuauguaauaacuagaaaaucc

SEQ ID NO: 288198 - RNA, 64 nt, Homo Sapiens
ccuacugaauuagaaacucucagauucuggauccauaccccauaacuugggcuaguuagagauc

SEQ ID NO: 288199 - RNA, 64 nt, Homo Sapiens
ugaaucugggaaaugggcuaguuuaugguugaggauaccccauagaaguuugucaggcagagau

SEQ ID NO: 288200 - RNA, 64 nt, Homo Sapiens
ucauccagcauccaaguguggcauggccugcuguauaccccaccccaguacuccacagcaccuu

SEQ ID NO: 288201 - RNA, 64 nt, Homo Sapiens
gcuuuaggggaacauggagaaagaaggagaccacauaccccaaagugaccuaagaacacuuuaa

SEQ ID NO: 288202 - RNA, 64 nt, Homo Sapiens
auaccuauuaaaggaaaaccucaguggguuaauuauaccccauguguaugugguauguauauuu

SEQ ID NO: 288203 - RNA, 64 nt, Homo Sapiens
aauuauugguauauuuguagugcucucagucuucauaccccagauccagcuucuagccauguag

SEQ ID NO: 288204 - RNA, 60 nt, Homo Sapiens
ccucucaucucugcccagcccccucaguggcgcugcuaugcaaggcuugugaacccccag

SEQ ID NO: 288205 - RNA, 60 nt, Homo Sapiens
ucaagacccccgagcaacauuuguaggggccgcugcuaguuagcuacccuugcccaccgc

SEQ ID NO: 288206 - RNA, 60 nt, Homo Sapiens
cacugcagcucccaccacauaggucagguacgcugcuaaauacuggcaucugauagguag

SEQ ID NO: 288207 - RNA, 60 nt, Homo Sapiens
guggacauagcccugugauacugagguucacgcugcuagcaagagguagcaaaggggcac

SEQ ID NO: 288208 - RNA, 60 nt, Homo Sapiens
ugaggggaaggccugaggucgcucuggagacgcugcuaccuaucugggaccccagaucag

SEQ ID NO: 288209 - RNA, 60 nt, Homo Sapiens
gagcuucacgcucuccgcuccggguuugcgcgcugcuacacugugcauccugcccugucc

SEQ ID NO: 288210 - RNA, 60 nt, Homo Sapiens
ggaaaaggugcccagcugccagcccagcuccgcugcuaucuuugccucacuuagucaugu

SEQ ID NO: 288211 - RNA, 60 nt, Homo Sapiens
cuugccacaggagcgaugugcuuguugaaccgcugcuaaauauagaaaguuagagaagac

SEQ ID NO: 288212 - RNA, 60 nt, Homo Sapiens
agacgggugcugccggcucagccagccucacgcugcuaggaaauggcucccugaucuauc

SEQ ID NO: 288213 - RNA, 60 nt, Homo Sapiens
auaguuaguuuggaaaugguuggcagcugacgcugcuaggucagagcucuugcuguuagc

SEQ ID NO: 288214 - RNA, 60 nt, Homo Sapiens
ggagugaccuggacguggccugagggcagacgcugcuacccuggacgauuuccuugcauc

SEQ ID NO: 288215 - RNA, 60 nt, Homo Sapiens
aagauugggguuuuuucguuauaagguaugcgcugcuacccuccuugcaaguuuccuagu

SEQ ID NO: 288216 - RNA, 60 nt, Homo Sapiens
gaugccucuuggagaccaagcaaauaccugcgcugcuaccccucaaccacuuccauuccc

SEQ ID NO: 288217 - RNA, 60 nt, Homo Sapiens
auguauuuaagaauuugcuguuuuauuuaacgcugcuacucuuaaucuucucuaaauuuu

SEQ ID NO: 288218 - RNA, 60 nt, Homo Sapiens
agggcagaaggaggugcuugcagggccucucgcugcuacugggacauccacaggaccuaa

SEQ ID NO: 288219 - RNA, 60 nt, Homo Sapiens
cuuuuuguggguggcugcugccaccaccgccgcugcuauauaguuuagguuucugagguu

SEQ ID NO: 288220 - RNA, 60 nt, Homo Sapiens
gugggccgccccggggcagggaccaccagccgcugcuacuuggggcugaccggcuguagg

SEQ ID NO: 288221 - RNA, 60 nt, Homo Sapiens
uccugaguagcugggauuacaggcacccgccgcugcuaauuuuuguauuuuuaguagaga

SEQ ID NO: 288222 - RNA, 60 nt, Homo Sapiens
aauugcacugugaaaagcacaguuuuugaacgcugcuauguucaagucaauucauaacca

SEQ ID NO: 288223 - RNA, 60 nt, Homo Sapiens
ugcaaugaacuuguauuuauccuucuucuccgcugcuauauuuuuggugugauuuuuauu

SEQ ID NO: 288224 - RNA, 60 nt, Homo Sapiens
ccaauaaguguguugaagcauacaucuuuacgcugcuaauaugucuaaauacauauguua

SEQ ID NO: 288225 - RNA, 60 nt, Homo Sapiens
ggagguagagacggcccuuucaccauguagcgcugcuacuucuggcaggcacaccugagu

SEQ ID NO: 288226 - RNA, 60 nt, Homo Sapiens
gaggcugccuccuagucuccccugaggccacgcugcuaugcugcuguccagccaggccug

SEQ ID NO: 288227 - RNA, 60 nt, Homo Sapiens
agaaucgagccuucugaauacgacaauaaacgcugcuaggacugggucaggcagaguggg

SEQ ID NO: 288228 - RNA, 60 nt, Homo Sapiens
uuucuuagccaggaaagacaaauaauccaacgcugcuagucuuaaccccagaccagagag

SEQ ID NO: 288229 - RNA, 60 nt, Homo Sapiens
agauuuuagaaauaaaugcacacaauaggccgcugcuaucgaauucuguguuuaaacgau

SEQ ID NO: 288230 - RNA, 60 nt, Homo Sapiens
gcaggcaggaagcagcccugggggacuggacgcugcuauugauucauuaaaaaaagaaaa

SEQ ID NO: 288231 - RNA, 60 nt, Homo Sapiens
gggacaggccgcagcuccauuuucuuauugcgcugcuaccguugacuuccaggcacgguu

SEQ ID NO: 288232 - RNA, 60 nt, Homo Sapiens
ggcguggagcugaggcucggcuucugugaccgcugcuauaaugcaaaacgucaaaaucug

SEQ ID NO: 288233 - RNA, 60 nt, Homo Sapiens
uccaggggacagacgaaggggcccucuucacgcugcuaacuccagagccaugagccaaga

SEQ ID NO: 288234 - RNA, 60 nt, Homo Sapiens
accaaacccuaauguuuuuuugccugaaaccgcugcuaguguuuuaagacccccaguuaa

SEQ ID NO: 288235 - RNA, 60 nt, Homo Sapiens
uuuguucaguuugguuuuuuuuuuuuuuugcgcugcuaagaagcuaaagucauccauccu

SEQ ID NO: 288236 - RNA, 60 nt, Homo Sapiens
caugguuaaaacaggaguuguguucucugucgcugcuaaauuauucuucacuugagugaa

SEQ ID NO: 288237 - RNA, 60 nt, Homo Sapiens
gaaauccaaggaggacaaagacuccagccacgcugcuaaauagggcuccucucuccucuc

SEQ ID NO: 288238 - RNA, 60 nt, Homo Sapiens
ggaucgucaccugguucgggguauggagaccgcugcuaugguggggcugcucugacugag

SEQ ID NO: 288239 - RNA, 60 nt, Homo Sapiens
cuuacucugguuacuacauuaauuugaaaacgcugcuauaucugggacauugugcucagg

SEQ ID NO: 288240 - RNA, 60 nt, Homo Sapiens
cuuuguuuuuauuuguauuucugaggccaucgcugcuacauugucccugccaucuacugu

SEQ ID NO: 288241 - RNA, 60 nt, Homo Sapiens
gcgcaccgugcugggggaagaggcagcgggcgcugcuaguccauccgcaucuuuucuuaa

SEQ ID NO: 288242 - RNA, 60 nt, Homo Sapiens
auaagcagcuggaaaugaauggccaugaggcgcugcuauuauguaaaacucuaaugauuu

SEQ ID NO: 288243 - RNA, 60 nt, Homo Sapiens
gugacucacuaauucauuaaccuugcucugcgcugcuagacauucacaucgcagauucuc

SEQ ID NO: 288244 - RNA, 60 nt, Homo Sapiens
accccuugcaaagggggugugucccacaaacgcugcuaugggugggguggggggcugggg

SEQ ID NO: 288245 - RNA, 60 nt, Homo Sapiens
uccccagacucagcuccagaauaccuucuucgcugcuagagaagggggauuggagggaag

SEQ ID NO: 288246 - RNA, 53 nt, Homo Sapiens
cucccauguaugucgauugauaucgcugcuacaucagacucuagaaaaaaggg

SEQ ID NO: 288247 - RNA, 56 nt, Homo Sapiens
aagacgccuuccugggguagcugagccgcugcuacgccuauccucgccacuaccuc

SEQ ID NO: 288248 - RNA, 60 nt, Homo Sapiens
gaccaguucauuguguguggcuccuuucuccgcugcuauaggucuccgccuccucugcuu

SEQ ID NO: 288249 - RNA, 60 nt, Homo Sapiens
agguaccccaggcugcacagcauggucguccgcugcuaucuucucauccagcaguacucu

SEQ ID NO: 288250 - RNA, 60 nt, Homo Sapiens
auggcugggacuccucgcgggaggggacugcgcugcuauagcucuugcugccucucuuga

SEQ ID NO: 288251 - RNA, 60 nt, Homo Sapiens
agcgggccggcucggcuucugaccuggcaccgcugcuacggcggccuagcaaauuccgcc

SEQ ID NO: 288252 - RNA, 60 nt, Homo Sapiens
ucuucguccgaaaggaggggaggggggacucgcugcuacaagccucgcccccugugccac

SEQ ID NO: 288253 - RNA, 60 nt, Homo Sapiens
cuccccugggccccuccccgugaaccuccccgcugcuaaugaaagggaggcgcugggguu

SEQ ID NO: 288254 - RNA, 60 nt, Homo Sapiens
ccugcagugucugcucacugcugccaucuucgcugcuagucaggguuccauccucuuucc

SEQ ID NO: 288255 - RNA, 60 nt, Homo Sapiens
guguguguuuuuuuuccuuuaaagaagaaacgcugcuaagaucccacguggcucccacgu

SEQ ID NO: 288256 - RNA, 60 nt, Homo Sapiens
gguucuugaugcucaccugaagccccuagacgcugcuaggagggggggcccuccugggcc

SEQ ID NO: 288257 - RNA, 60 nt, Homo Sapiens
cuccugggcccccaauaccccuccgcuugccgcugcuagcgcaccccugcaguccagcgu

SEQ ID NO: 288258 - RNA, 60 nt, Homo Sapiens
ucacuuuugcugcugcggggcccacacagccgcugcuacuuugggggguggggaaggggc

SEQ ID NO: 288259 - RNA, 62 nt, Homo Sapiens
agccucucaucucugcccagcccccucaguggcgcugcuaugcaaggcuugugaacccccag

SEQ ID NO: 288260 - RNA, 62 nt, Homo Sapiens
gcucaagacccccgagcaacauuuguaggggccgcugcuaguuagcuacccuugcccaccgc

SEQ ID NO: 288261 - RNA, 62 nt, Homo Sapiens
cacugcagcucccaccacauagaggucagguacgcugcuaaaaguacuggcaucugauaggu

SEQ ID NO: 288262 - RNA, 62 nt, Homo Sapiens
guggacauagcccugugauaaccugagguucacgcugcuagcaaaagagguagcaaaggggc

SEQ ID NO: 288263 - RNA, 62 nt, Homo Sapiens
ugaggggaaggccugaggucaggcucuggagacgcugcuaccgguaucugggaccccagauc

SEQ ID NO: 288264 - RNA, 62 nt, Homo Sapiens
gagcuucacgcucuccgcuccccggguuugcgcgcugcuacaggcugugcauccugcccugu

SEQ ID NO: 288265 - RNA, 62 nt, Homo Sapiens
agggaaaaggugcccagcugccagcccagcuccgcugcuaucuuugccucacuuagucaugu

SEQ ID NO: 288266 - RNA, 62 nt, Homo Sapiens
cuugccacaggagcgaugugaccuuguugaaccgcugcuaaacuuauagaaaguuagagaag

SEQ ID NO: 288267 - RNA, 62 nt, Homo Sapiens
ccagacgggugcugccggcucagccagccucacgcugcuaggaaauggcucccugaucuauc

SEQ ID NO: 288268 - RNA, 62 nt, Homo Sapiens
auaguuaguuuggaaauggugcuggcagcugacgcugcuaggccucagagcucuugcuguua

SEQ ID NO: 288269 - RNA, 62 nt, Homo Sapiens
ggagugaccuggacguggccucugagggcagacgcugcuaccggcuggacgauuuccuugca

SEQ ID NO: 288270 - RNA, 62 nt, Homo Sapiens
aagauugggguuuuuucguuguauaagguaugcgcugcuaccgucuccuugcaaguuuccua

SEQ ID NO: 288271 - RNA, 62 nt, Homo Sapiens
gaugccucuuggagaccaagcccaaauaccugcgcugcuaccccccucaaccacuuccauuc

SEQ ID NO: 288272 - RNA, 62 nt, Homo Sapiens
uaauguauuuaagaauuugcuguuuuauuuaacgcugcuacucuuaaucuucucuaaauuuu

SEQ ID NO: 288273 - RNA, 62 nt, Homo Sapiens
cuagggcagaaggaggugcuugcagggccucucgcugcuacugggacauccacaggaccuaa

SEQ ID NO: 288274 - RNA, 62 nt, Homo Sapiens
ugcuuuuuguggguggcugcugccaccaccgccgcugcuauauaguuuagguuucugagguu

SEQ ID NO: 288275 - RNA, 62 nt, Homo Sapiens
gugggccgccccggggcagggggaccaccagccgcugcuacucuuggggcugaccggcugua

SEQ ID NO: 288276 - RNA, 62 nt, Homo Sapiens
ccuccugaguagcugggauuacaggcacccgccgcugcuaauuuuuguauuuuuaguagaga

SEQ ID NO: 288277 - RNA, 62 nt, Homo Sapiens
aauugcacugugaaaagcaccaaguuuuugaacgcugcuaugccuucaagucaauucauaac

SEQ ID NO: 288278 - RNA, 62 nt, Homo Sapiens
ugugcaaugaacuuguauuuauccuucuucuccgcugcuauauuuuuggugugauuuuuauu

SEQ ID NO: 288279 - RNA, 62 nt, Homo Sapiens
ccccaauaaguguguugaagcauacaucuuuacgcugcuaauaugucuaaauacauauguua

SEQ ID NO: 288280 - RNA, 62 nt, Homo Sapiens
ggagguagagacggcccuuugucaccauguagcgcugcuacucaucuggcaggcacaccuga

SEQ ID NO: 288281 - RNA, 62 nt, Homo Sapiens
gaggcugccuccuagucuccugccugaggccacgcugcuaugugcugcuguccagccaggcc

SEQ ID NO: 288282 - RNA, 62 nt, Homo Sapiens
agaaucgagccuucugaauaggcgacaauaaacgcugcuaggacacugggucaggcagagug

SEQ ID NO: 288283 - RNA, 62 nt, Homo Sapiens
uguuucuuagccaggaaagacaaauaauccaacgcugcuagucuuaaccccagaccagagag

SEQ ID NO: 288284 - RNA, 62 nt, Homo Sapiens
agauuuuagaaauaaaugcaaucacaauaggccgcugcuaucaagaauucuguguuuaaacg

SEQ ID NO: 288285 - RNA, 62 nt, Homo Sapiens
gugcaggcaggaagcagcccugggggacuggacgcugcuauugauucauuaaaaaaagaaaa

SEQ ID NO: 288286 - RNA, 62 nt, Homo Sapiens
cggggacaggccgcagcuccauuuucuuauugcgcugcuaccguugacuuccaggcacgguu

SEQ ID NO: 288287 - RNA, 62 nt, Homo Sapiens
ggcguggagcugaggcucggugcuucugugaccgcugcuauauuaugcaaaacgucaaaauc

SEQ ID NO: 288288 - RNA, 62 nt, Homo Sapiens
uccaggggacagacgaaggggagcccucuucacgcugcuaacgguccagagccaugagccaa

SEQ ID NO: 288289 - RNA, 62 nt, Homo Sapiens
accaaacccuaauguuuuuuaaugccugaaaccgcugcuaguauguuuuaagacccccaguu

SEQ ID NO: 288290 - RNA, 62 nt, Homo Sapiens
guuuuguucaguuugguuuuuuuuuuuuuuugcgcugcuaagaagcuaaagucauccauccu

SEQ ID NO: 288291 - RNA, 62 nt, Homo Sapiens
cccaugguuaaaacaggaguuguguucucugucgcugcuaaauuauucuucacuugagugaa

SEQ ID NO: 288292 - RNA, 62 nt, Homo Sapiens
uggaaauccaaggaggacaaagacuccagccacgcugcuaaauagggcuccucucuccucuc

SEQ ID NO: 288293 - RNA, 62 nt, Homo Sapiens
ggaucgucaccugguucgggagguauggagaccgcugcuauggaguggggcugcucugacug

SEQ ID NO: 288294 - RNA, 62 nt, Homo Sapiens
cuuacucugguuacuacauuggaauuugaaaacgcugcuauagcucugggacauugugcuca

SEQ ID NO: 288295 - RNA, 62 nt, Homo Sapiens
cuuuguuuuuauuuguauuugucugaggccaucgcugcuacaguuugucccugccaucuacu

SEQ ID NO: 288296 - RNA, 60 nt, Homo Sapiens; identical to SEQ ID NO: 288241

SEQ ID NO: 288297 - RNA, 62 nt, Homo Sapiens
auaagcagcuggaaaugaauuuggccaugaggcgcugcuauuagauguaaaacucuaaugau

SEQ ID NO: 288298 - RNA, 62 nt, Homo Sapiens
gugacucacuaauucauuaaucccuugcucugcgcugcuagacucauucacaucgcagauuc

SEQ ID NO: 288299 - RNA, 62 nt, Homo Sapiens
ccaccccuugcaaagggggugugucccacaaacgcugcuaugggugggguggggggcugggg

SEQ ID NO: 288300 - RNA, 62 nt, Homo Sapiens
cuuccccagacucagcuccagaauaccuucuucgcugcuagagaagggggauuggagggaag

SEQ ID NO: 288301 - RNA, 53 nt, Homo Sapiens; identical to SEQ ID NO: 288246

SEQ ID NO: 288302 - RNA, 56 nt, Homo Sapiens; identical to SEQ ID NO: 288247

SEQ ID NO: 288303 - RNA, 62 nt, Homo Sapiens
gaccaguucauugugugugguucuccuuucuccgcugcuauacaggucuccgccuccucugc

SEQ ID NO: 288304 - RNA, 62 nt, Homo Sapiens
gaagguaccccaggcugcacagcauggucguccgcugcuaucuucucauccagcaguacucu

SEQ ID NO: 288305 - RNA, 62 nt, Homo Sapiens
ugauggcugggacuccucgcgggaggggacugcgcugcuauagcucuugcugccucucuuga

SEQ ID NO: 288306 - RNA, 62 nt, Homo Sapiens
aaagcgggccggcucggcuucugaccuggcaccgcugcuacggcggccuagcaaauuccgcc

SEQ ID NO: 288307 - RNA, 62 nt, Homo Sapiens
cuucuucguccgaaaggaggggaggggggacucgcugcuacaagccucgcccccugugccac

SEQ ID NO: 288308 - RNA, 62 nt, Homo Sapiens
cuccccugggccccuccccguuugaaccuccccgcugcuaauuggaaagggaggcgcugggg

SEQ ID NO: 288309 - RNA, 62 nt, Homo Sapiens
gcccugcagugucugcucacugcugccaucuucgcugcuagucaggguuccauccucuuucc

SEQ ID NO: 288310 - RNA, 62 nt, Homo Sapiens
guguguguguuuuuuuuccuuuaaagaagaaacgcugcuaagaucccacguggcucccacgu

SEQ ID NO: 288311 - RNA, 62 nt, Homo Sapiens
gugguucuugaugcucaccugaagccccuagacgcugcuaggagggggggcccuccugggcc

SEQ ID NO: 288312 - RNA, 62 nt, Homo Sapiens
cccuccugggcccccaauaccccuccgcuugccgcugcuagcgcaccccugcaguccagcgu

SEQ ID NO: 288313 - RNA, 62 nt, Homo Sapiens
ccucacuuuugcugcugcggggcccacacagccgcugcuacuuugggggguggggaaggggc

SEQ ID NO: 288314 - RNA, 65 nt, Homo Sapiens
ucaagccucucaucucugcccagcccccucaguggcgcugcuaugcaaggcuugugaacccccag

SEQ ID NO: 288315 - RNA, 65 nt, Homo Sapiens
gcagcucaagacccccgagcaacauuuguaggggccgcugcuaguuagcuacccuugcccaccgc

SEQ ID NO: 288316 - RNA, 65 nt, Homo Sapiens
cacugcagcucccaccacaugguagaggucagguacgcugcuaaaaacaguacuggcaucugaua

SEQ ID NO: 288317 - RNA, 65 nt, Homo Sapiens
guggacauagcccugugauaggcaccugagguucacgcugcuagcggaaaaagagguagcaaagg

SEQ ID NO: 288318 - RNA, 65 nt, Homo Sapiens
ugaggggaaggccugaggucaucaggcucuggagacgcugcuacccuggguaucugggaccccag

SEQ ID NO: 288319 - RNA, 65 nt, Homo Sapiens
gagcuucacgcucuccgcucugucccggguuugcgcgcugcuacaacuggcugugcauccugccc

SEQ ID NO: 288320 - RNA, 65 nt, Homo Sapiens
aucagggaaaaggugcccagcugccagcccagcuccgcugcuaucuuugccucacuuagucaugu

SEQ ID NO: 288321 - RNA, 65 nt, Homo Sapiens
cuugccacaggagcgaugugaagaccuuguugaaccgcugcuaaaggacuuauagaaaguuagag

SEQ ID NO: 288322 - RNA, 65 nt, Homo Sapiens
aguccagacgggugcugccggcucagccagccucacgcugcuaggaaauggcucccugaucuauc

SEQ ID NO: 288323 - RNA, 65 nt, Homo Sapiens
auaguuaguuuggaaaugguuuagcuggcagcugacgcugcuaggugcccucagagcucuugcug

SEQ ID NO: 288324 - RNA, 65 nt, Homo Sapiens
ggagugaccuggacguggccgcaucugagggcagacgcugcuacccguggcuggacgauuuccuu

SEQ ID NO: 288325 - RNA, 65 nt, Homo Sapiens
aagauugggguuuuuucguucuaguauaagguaugcgcugcuacccuggucuccuugcaaguuuc

SEQ ID NO: 288326 - RNA, 65 nt, Homo Sapiens
gaugccucuuggagaccaaguuccccaaauaccugcgcugcuaccaacccccucaaccacuucca

SEQ ID NO: 288327 - RNA, 65 nt, Homo Sapiens
ucauaauguauuuaagaauuugcuguuuuauuuaacgcugcuacucuuaaucuucucuaaauuuu

SEQ ID NO: 288328 - RNA, 65 nt, Homo Sapiens
guccuagggcagaaggaggugcuugcagggccucucgcugcuacugggacauccacaggaccuaa

SEQ ID NO: 288329 - RNA, 65 nt, Homo Sapiens
ucuugcuuuuuguggguggcugcugccaccaccgccgcugcuauauaguuuagguuucugagguu

SEQ ID NO: 288330 - RNA, 65 nt, Homo Sapiens
gugggccgccccggggcaggguagggaccaccagccgcugcuacugcucuuggggcugaccggcu

SEQ ID NO: 288331 - RNA, 65 nt, Homo Sapiens
cagccuccugaguagcugggauuacaggcacccgccgcugcuaauuuuuguauuuuuaguagaga

SEQ ID NO: 288332 - RNA, 65 nt, Homo Sapiens
aauugcacugugaaaagcacaaccaaguuuuugaacgcugcuaugccaccuucaagucaauucau

SEQ ID NO: 288333 - RNA, 65 nt, Homo Sapiens
uggugugcaaugaacuuguauuuauccuucuucuccgcugcuauauuuuuggugugauuuuuauu

SEQ ID NO: 288334 - RNA, 65 nt, Homo Sapiens
uuuccccaauaaguguguugaagcauacaucuuuacgcugcuaauaugucuaaauacauauguua

SEQ ID NO: 288335 - RNA, 65 nt, Homo Sapiens
ggagguagagacggcccuuuugagucaccauguagcgcugcuacucagcaucuggcaggcacacc

SEQ ID NO: 288336 - RNA, 65 nt, Homo Sapiens
gaggcugccuccuagucuccgccugccugaggccacgcugcuaugcccugcugcuguccagccag

SEQ ID NO: 288337 - RNA, 65 nt, Homo Sapiens
agaaucgagccuucugaauagugggcgacaauaaacgcugcuaggccaacacugggucaggcaga

SEQ ID NO: 288338 - RNA, 65 nt, Homo Sapiens
caauguuucuuagccaggaaagacaaauaauccaacgcugcuagucuuaaccccagaccagagag

SEQ ID NO: 288339 - RNA, 65 nt, Homo Sapiens
agauuuuagaaauaaaugcaacgaucacaauaggccgcugcuaucucaaagaauucuguguuuaa

SEQ ID NO: 288340 - RNA, 65 nt, Homo Sapiens
caggugcaggcaggaagcagcccugggggacuggacgcugcuauugauucauuaaaaaaagaaaa

SEQ ID NO: 288341 - RNA, 65 nt, Homo Sapiens
caccggggacaggccgcagcuccauuuucuuauugcgcugcuaccguugacuuccaggcacgguu

SEQ ID NO: 288342 - RNA, 65 nt, Homo Sapiens
ggcguggagcugaggcucggaucugcuucugugaccgcugcuauagaauuaugcaaaacgucaaa

SEQ ID NO: 288343 - RNA, 65 nt, Homo Sapiens
uccaggggacagacgaagggcaagagcccucuucacgcugcuaacgccgguccagagccaugagc

SEQ ID NO: 288344 - RNA, 65 nt, Homo Sapiens
accaaacccuaauguuuuuuguuaaugccugaaaccgcugcuagugauauguuuuaagaccccca

SEQ ID NO: 288345 - RNA, 65 nt, Homo Sapiens
uuuguuuuguucaguuugguuuuuuuuuuuuuuugcgcugcuaagaagcuaaagucauccauccu

SEQ ID NO: 288346 - RNA, 65 nt, Homo Sapiens
uuucccaugguuaaaacaggaguuguguucucugucgcugcuaaauuauucuucacuugagugaa

SEQ ID NO: 288347 - RNA, 65 nt, Homo Sapiens
auguggaaauccaaggaggacaaagacuccagccacgcugcuaaauagggcuccucucuccucuc

SEQ ID NO: 288348 - RNA, 65 nt, Homo Sapiens
ggaucgucaccugguucgggcugagguauggagaccgcugcuaugggggaguggggcugcucuga

SEQ ID NO: 288349 - RNA, 65 nt, Homo Sapiens
cuuacucugguuacuacauuucaggaauuugaaaacgcugcuauaccagcucugggacauugugc

SEQ ID NO: 288350 - RNA, 65 nt, Homo Sapiens
cuuuguuuuuauuuguauuuacugucugaggccaucgcugcuacauuaguuugucccugccaucu

SEQ ID NO: 288351 - RNA, 60 nt, Homo Sapiens; identical to SEQ ID NO: 288241

SEQ ID NO: 288352 - RNA, 65 nt, Homo Sapiens
auaagcagcuggaaaugaaugauuuggccaugaggcgcugcuauucccagauguaaaacucuaau

SEQ ID NO: 288353 - RNA, 65 nt, Homo Sapiens
gugacucacuaauucauuaauucucccuugcucugcgcugcuagacuccucauucacaucgcaga

SEQ ID NO: 288354 - RNA, 65 nt, Homo Sapiens
gggccaccccuugcaaagggggugugucccacaaacgcugcuaugggugggguggggggcugggg

SEQ ID NO: 288355 - RNA, 65 nt, Homo Sapiens
caccuuccccagacucagcuccagaauaccuucuucgcugcuagagaagggggauuggagggaag

SEQ ID NO: 288356 - RNA, 53 nt, Homo Sapiens; identical to SEQ ID NO: 288246

SEQ ID NO: 288357 - RNA, 56 nt, Homo Sapiens; identical to SEQ ID NO: 288247

SEQ ID NO: 288358 - RNA, 65 nt, Homo Sapiens
gaccaguucauuguguguggugcuucuccuuucuccgcugcuauaggucaggucuccgccuccuc

SEQ ID NO: 288359 - RNA, 65 nt, Homo Sapiens
guugaagguaccccaggcugcacagcauggucguccgcugcuaucuucucauccagcaguacucu

SEQ ID NO: 288360 - RNA, 65 nt, Homo Sapiens
cugugauggcugggacuccucgcgggaggggacugcgcugcuauagcucuugcugccucucuuga

SEQ ID NO: 288361 - RNA, 65 nt, Homo Sapiens
cgaaaagcgggccggcucggcuucugaccuggcaccgcugcuacggcggccuagcaaauuccgcc

SEQ ID NO: 288362 - RNA, 65 nt, Homo Sapiens
uuccuucuucguccgaaaggaggggaggggggacucgcugcuacaagccucgcccccugugccac

SEQ ID NO: 288363 - RNA, 65 nt, Homo Sapiens
cuccccugggccccuccccgggguuugaaccuccccgcugcuaaucuuuggaaagggaggcgcug

SEQ ID NO: 288364 - RNA, 65 nt, Homo Sapiens
gaggcccugcagugucugcucacugcugccaucuucgcugcuagucaggguuccauccucuuucc

SEQ ID NO: 288365 - RNA, 65 nt, Homo Sapiens
gguguguguguguuuuuuuuccuuuaaagaagaaacgcugcuaagaucccacguggcucccacgu

SEQ ID NO: 288366 - RNA, 65 nt, Homo Sapiens
ggagugguucuugaugcucaccugaagccccuagacgcugcuaggagggggggcccuccugggcc

SEQ ID NO: 288367 - RNA, 65 nt, Homo Sapiens
gggcccuccugggcccccaauaccccuccgcuugccgcugcuagcgcaccccugcaguccagcgu

SEQ ID NO: 288368 - RNA, 65 nt, Homo Sapiens
aggccucacuuuugcugcugcggggcccacacagccgcugcuacuuugggggguggggaaggggc

SEQ ID NO: 288369 - RNA, 64 nt, Homo Sapiens; identical to SEQ ID NO: 168843

SEQ ID NO: 288370 - RNA, 64 nt, Homo Sapiens; identical to SEQ ID NO: 168844

SEQ ID NO: 288371 - RNA, 56 nt, Homo Sapiens; identical to SEQ ID NO: 168845

SEQ ID NO: 288372 - RNA, 64 nt, Homo Sapiens; identical to SEQ ID NO: 168846

SEQ ID NO: 288373 - RNA, 64 nt, Homo Sapiens; identical to SEQ ID NO: 168847

SEQ ID NO: 288374 - RNA, 64 nt, Homo Sapiens; identical to SEQ ID NO: 168848

SEQ ID NO: 288375 - RNA, 64 nt, Homo Sapiens; identical to SEQ ID NO: 168849

SEQ ID NO: 288376 - RNA, 64 nt, Homo Sapiens; identical to SEQ ID NO: 168850

SEQ ID NO: 288377 - RNA, 64 nt, Homo Sapiens; identical to SEQ ID NO: 168851

SEQ ID NO: 288378 - RNA, 64 nt, Homo Sapiens; identical to SEQ ID NO: 168852

SEQ ID NO: 288379 - RNA, 64 nt, Homo Sapiens; identical to SEQ ID NO: 168853

SEQ ID NO: 288380 - RNA, 64 nt, Homo Sapiens; identical to SEQ ID NO: 168854

SEQ ID NO: 288381 - RNA, 64 nt, Homo Sapiens; identical to SEQ ID NO: 168855

SEQ ID NO: 288382 - RNA, 64 nt, Homo Sapiens; identical to SEQ ID NO: 168856

SEQ ID NO: 288383 - RNA, 64 nt, Homo Sapiens; identical to SEQ ID NO: 168857

SEQ ID NO: 288384 - RNA, 64 nt, Homo Sapiens; identical to SEQ ID NO: 168858

SEQ ID NO: 288385 - RNA, 64 nt, Homo Sapiens; identical to SEQ ID NO: 168859

SEQ ID NO: 288386 - RNA, 64 nt, Homo Sapiens; identical to SEQ ID NO: 168860

SEQ ID NO: 288387 - RNA, 60 nt, Homo Sapiens
uuuuaaccuagaucucccuagcucccagcaagagccaagagauuacaggugcgagcuacu

SEQ ID NO: 288388 - RNA, 60 nt, Homo Sapiens
uuuuuuuuaauauagagacaaguaaguagcagagccaagacuuaucugugguuacaagcu

SEQ ID NO: 288389 - RNA, 60 nt, Homo Sapiens
cauucuuggcccaggagcaugugcuggccaagagccaacaucuuagaguuaaaggagggg

SEQ ID NO: 288390 - RNA, 60 nt, Homo Sapiens
auguuaacucuuccuuaucauaccuggcaaagagccaaucaaaucugccuuauccuucuu

SEQ ID NO: 288391 - RNA, 60 nt, Homo Sapiens
augagagcaaugaacaggagaaggagggagagagccaaaugucugaguaaacagauaucc

SEQ ID NO: 288392 - RNA, 60 nt, Homo Sapiens
gauagaauuccaaguuauaaagcauaaaaaagagccaacagaaguaacuaauccgggaaa

SEQ ID NO: 288393 - RNA, 60 nt, Homo Sapiens
agaguaacagcaauugaaaaaagagauucaagagccaaguacucagcccuggcaggggau

SEQ ID NO: 288394 - RNA, 60 nt, Homo Sapiens
cucugaacagacugcugagauacccaaucaagagccaauccuugcuucccuagacucucc

SEQ ID NO: 288395 - RNA, 60 nt, Homo Sapiens
gccuuaaggaaaucuuuacuccuguaagcaagagccaaccucacaggauuaggagcuggg

SEQ ID NO: 288396 - RNA, 60 nt, Homo Sapiens
auaaaaguuucuuuccuaaaccauucaccaagagccaauaucuaggcauuuucuugguag

SEQ ID NO: 288397 - RNA, 64 nt, Homo Sapiens; identical to SEQ ID NO: 46031

SEQ ID NO: 288398 - RNA, 64 nt, Homo Sapiens; identical to SEQ ID NO: 46032

SEQ ID NO: 288399 - RNA, 64 nt, Homo Sapiens; identical to SEQ ID NO: 46033

SEQ ID NO: 288400 - RNA, 64 nt, Homo Sapiens; identical to SEQ ID NO: 46034

SEQ ID NO: 288401 - RNA, 64 nt, Homo Sapiens
cauguuguaguccuaugaugauguaaacuugguacuacauaaugacuugcuccacacaugcagu

SEQ ID NO: 288402 - RNA, 64 nt, Homo Sapiens
acuacauaaugacuugcuccacacaugcaguaaacuacauaaugauguacugguaaacuagaaa

SEQ ID NO: 288403 - RNA, 64 nt, Homo Sapiens
gcagcggaaucuguucacacccaacuugguuuugcuacauaauuauccaggaagggaauaaggu

SEQ ID NO: 288404 - RNA, 64 nt, Homo Sapiens
ucugcuacuuugcugcuaugguuuucuccaagagcuacauaauuuaguuucauauaaaguauca

SEQ ID NO: 288405 - RNA, 64 nt, Homo Sapiens
uacauugaaaacagauauuacagcuuauuuuuuucuacauaauugugaccaauacauuuguauu

SEQ ID NO: 288406 - RNA, 64 nt, Homo Sapiens
agcaagauauaagagauucauuugcuuaacauuucuacauaauauuuauggucuggucaguauu

SEQ ID NO: 288407 - RNA, 64 nt, Homo Sapiens
ucacugaauaucagagaauaaguuucucauaaaauucugucaauuauuuuauaguuuugaaacu

SEQ ID NO: 288408 - RNA, 64 nt, Homo Sapiens
guugacacaauccugcaagauuucuaucugccauuucugucaggaaggaugucacugcuguuca

SEQ ID NO: 288409 - RNA, 64 nt, Homo Sapiens
uauuuaauacauugaaaauuaacacagaacuuauuucugucagugggaccuuuaauuuguacag

SEQ ID NO: 288410 - RNA, 64 nt, Homo Sapiens
guaaucuuuguuguuagaaauucugaucauucaguucugucauuuuugcacaaauauuuuuaca

SEQ ID NO: 288411 - RNA, 64 nt, Homo Sapiens
auacguuuuucaguuucaacaugaauuuuuuuauuucugucaguuaugacauccacaagcauca

SEQ ID NO: 288412 - RNA, 64 nt, Homo Sapiens
cuuuguggugagaauuuuuuccccgauauucuccuucugucaaagucagaacaaauucagggaa

SEQ ID NO: 288413 - RNA, 64 nt, Homo Sapiens
guuuucuccucuuaaauguuucaaaacuacugucuucugucaaacuuaacaucaagcgcgcagu

SEQ ID NO: 288414 - RNA, 64 nt, Homo Sapiens
uaccaugcccaugagauguuacccauuaggaauuuucugucaacguccuuagucuguuaguuaa

SEQ ID NO: 288415 - RNA, 64 nt, Homo Sapiens
uuagauuuaaugagagaguaucccuuaaacuucuuucugucaaaacuuacaaagcacuccuuuu

SEQ ID NO: 288416 - RNA, 64 nt, Homo Sapiens
aauuauuuugaggccuuuuaauuaauaacacuauuucugucacucuuauuguugagcuuagcaa

SEQ ID NO: 288417 - RNA, 64 nt, Homo Sapiens
gguggagcaauaguauauuguauguuguaaaguguucugucauuuacaagaugugauucaugag

SEQ ID NO: 288418 - RNA, 64 nt, Homo Sapiens
agauguuaauuugggauauggaggcauuuuuaucuucugucacuacuacuuaaaacucugauga

SEQ ID NO: 288419 - RNA, 64 nt, Homo Sapiens
cagcuccuucaugagaucaggucagugguauuguuucugucaagaguguuuuuucugucauuuc

SEQ ID NO: 288420 - RNA, 64 nt, Homo Sapiens
aggucagugguauuguuucugucaagaguguuuuuucugucauuucuacuuuuuguauaaagga

SEQ ID NO: 288421 - RNA, 64 nt, Homo Sapiens
ggugacaccaggagagaggggagagagggacagguucugucaggucugucgggggugacaccag

SEQ ID NO: 288422 - RNA, 64 nt, Homo Sapiens
ggugacacgaggacacaggggacacagggacagguucugucaugucugucgggggugacaccag

SEQ ID NO: 288423 - RNA, 64 nt, Homo Sapiens
ggugacaccaggacacaggggagagagggacagguucugucaggcugcacaaccugcaaaccag

SEQ ID NO: 288424 - RNA, 64 nt, Homo Sapiens
ugguguugcugacacuuuccgauaucuaauuuauuucugucagcgucuuuuacuuuauguacag

SEQ ID NO: 288425 - RNA, 64 nt, Homo Sapiens
ccacuuguguuugaguaugacauaucgcugaguguucugucaccuuaaccuucguaacuaauua

SEQ ID NO: 288426 - RNA, 64 nt, Homo Sapiens
ucaguauuuaucaaugaaguuugauaauucacuuuucugucauuguuaaagcguacauacugua

SEQ ID NO: 288427 - RNA, 64 nt, Homo Sapiens
agaugauguuugaauuucaagaaaagaggcugcuuucugucagugcccucucauuagaucugug

SEQ ID NO: 288428 - RNA, 64 nt, Homo Sapiens
auuuauaucuuuuguauguaaaacuuuaacugauuucugucauucaucaaugaguagaaguaaa

SEQ ID NO: 288429 - RNA, 64 nt, Homo Sapiens
aaaguucuuuaugaccucauuuauaaacacuaaauucugucaccuccugucauuuuauuuuuua

SEQ ID NO: 288430 - RNA, 64 nt, Homo Sapiens
cacccguagaaagaccucagaugcugaaucugcauucugucagguguugcaaagucuacauuuu

SEQ ID NO: 288431 - RNA, 64 nt, Homo Sapiens
agugagauuguugaacaaacuauuugcugacuuuuucugucaugaauaauuuugucccaagucu

SEQ ID NO: 288432 - RNA, 64 nt, Homo Sapiens
guuuuucaaauccauugcuuagcuaacuuuuucauucugucacuuggcuucgauuuuuauauuu

SEQ ID NO: 288433 - RNA, 64 nt, Homo Sapiens
gauuuuucuuucuuucuuuguaaauaguucugaguucugucaaaugccgugaaaguauuugcua

SEQ ID NO: 288434 - RNA, 64 nt, Homo Sapiens
ggcuaaauggggagcuaucuggaaacucuagauuuucugucauacccacaucugucacaguacc

SEQ ID NO: 288435 - RNA, 64 nt, Homo Sapiens
uauuguacuuuuggagaauuuuuuguaggcauuuuucugucagauuuguaguaauuugugaggu

SEQ ID NO: 288436 - RNA, 64 nt, Homo Sapiens
gccuuaugcaccuaauucaaaagguggaauauaguucugucagggcuuuuacguaaaccuccac

SEQ ID NO: 288437 - RNA, 64 nt, Homo Sapiens
ucaauuuuaauaauaguccauaccauguauguguuucugucagcagaauguacauguuguacaa

SEQ ID NO: 288438 - RNA, 64 nt, Homo Sapiens
uguguguggacucugagaagcaccucugcccucauucugucaauaagauucacgcuucugcauc

SEQ ID NO: 288439 - RNA, 64 nt, Homo Sapiens
uaggcaucaucucuuccugcuucaaauugcaguguucugucacccuaaaaaacuacugccccac

SEQ ID NO: 288440 - RNA, 64 nt, Homo Sapiens
gcacuaaagcaacaaaacaacccauaguaucucauucugucaucagauccagaagaaauauccu

SEQ ID NO: 288441 - RNA, 64 nt, Homo Sapiens
agaaacucgccaccucugaccuaccuuugccuuuuucugucauggagaauacucacccuucaga

SEQ ID NO: 288442 - RNA, 64 nt, Homo Sapiens
gggaccacccugggccuccuuggcggcccugagauucugucaguggccccuuggaccgugggga

SEQ ID NO: 288443 - RNA, 64 nt, Homo Sapiens
ggugggcacuggacaggcauucccuuguacaguuuucugucacuuggcagggcugggacugcug

SEQ ID NO: 288444 - RNA, 64 nt, Homo Sapiens
cugugucucaugugcagcugaaauagugaucugcuucugucacugucacauagacagcccugca

SEQ ID NO: 288445 - RNA, 64 nt, Homo Sapiens
accacugaucugcucaggcaacuaccaaucuucuuucugucacuauagauuaauuugcauuuuu

SEQ ID NO: 288446 - RNA, 64 nt, Homo Sapiens
guagguuugccaagucuuuguggugaauugacucuucugucauuaugugaugucauuuuuuugc

SEQ ID NO: 288447 - RNA, 64 nt, Homo Sapiens
ucaaauaaucauucccuauuuuacaaugcaucaguucugucaagcuucauucaaaguguuuuuc

SEQ ID NO: 288448 - RNA, 64 nt, Homo Sapiens
ucagcuuuggagacagucuggguuuaaaucccaguucugucaauuugagcuguuuacugucucu

SEQ ID NO: 288449 - RNA, 64 nt, Homo Sapiens
ggggauacauucuuagaaaugugucacuaggcaauucugucauuguguaaacauuauagaaugu

SEQ ID NO: 288450 - RNA, 64 nt, Homo Sapiens
cauuggcuuugagugacauagauucuaguucugauucugucacuacgaguuaccagaagaugug

SEQ ID NO: 288451 - RNA, 64 nt, Homo Sapiens
uagauuugaucagggucuauccuugucuucuaccuucugucaccggguugagaguccccaaccc

SEQ ID NO: 288452 - RNA, 64 nt, Homo Sapiens; identical to SEQ ID NO: 187011

SEQ ID NO: 288453 - RNA, 64 nt, Homo Sapiens; identical to SEQ ID NO: 187012

SEQ ID NO: 288454 - RNA, 64 nt, Homo Sapiens; identical to SEQ ID NO: 187013

SEQ ID NO: 288455 - RNA, 64 nt, Homo Sapiens; identical to SEQ ID NO: 187014

SEQ ID NO: 288456 - RNA, 64 nt, Homo Sapiens; identical to SEQ ID NO: 187015

SEQ ID NO: 288457 - RNA, 64 nt, Homo Sapiens; identical to SEQ ID NO: 187016

SEQ ID NO: 288458 - RNA, 56 nt, Homo Sapiens; identical to SEQ ID NO: 187017

SEQ ID NO: 288459 - RNA, 64 nt, Homo Sapiens; identical to SEQ ID NO: 187018

SEQ ID NO: 288460 - RNA, 64 nt, Homo Sapiens; identical to SEQ ID NO: 187019

SEQ ID NO: 288461 - RNA, 64 nt, Homo Sapiens; identical to SEQ ID NO: 187020

SEQ ID NO: 288462 - RNA, 64 nt, Homo Sapiens; identical to SEQ ID NO: 187021

SEQ ID NO: 288463 - RNA, 64 nt, Homo Sapiens; identical to SEQ ID NO: 187022

SEQ ID NO: 288464 - RNA, 64 nt, Homo Sapiens; identical to SEQ ID NO: 187023

SEQ ID NO: 288465 - RNA, 64 nt, Homo Sapiens; identical to SEQ ID NO: 187024

SEQ ID NO: 288466 - RNA, 64 nt, Homo Sapiens; identical to SEQ ID NO: 187025

SEQ ID NO: 288467 - RNA, 64 nt, Homo Sapiens; identical to SEQ ID NO: 187026

SEQ ID NO: 288468 - RNA, 64 nt, Homo Sapiens; identical to SEQ ID NO: 187027

SEQ ID NO: 288469 - RNA, 64 nt, Homo Sapiens; identical to SEQ ID NO: 187028

SEQ ID NO: 288470 - RNA, 64 nt, Homo Sapiens; identical to SEQ ID NO: 187029

SEQ ID NO: 288471 - RNA, 64 nt, Homo Sapiens; identical to SEQ ID NO: 187030

SEQ ID NO: 288472 - RNA, 64 nt, Homo Sapiens; identical to SEQ ID NO: 187031

SEQ ID NO: 288473 - RNA, 64 nt, Homo Sapiens; identical to SEQ ID NO: 187032

SEQ ID NO: 288474 - RNA, 64 nt, Homo Sapiens; identical to SEQ ID NO: 187033

SEQ ID NO: 288475 - RNA, 64 nt, Homo Sapiens; identical to SEQ ID NO: 187034

SEQ ID NO: 288476 - RNA, 64 nt, Homo Sapiens; identical to SEQ ID NO: 187035

SEQ ID NO: 288477 - RNA, 64 nt, Homo Sapiens; identical to SEQ ID NO: 187036

SEQ ID NO: 288478 - RNA, 64 nt, Homo Sapiens; identical to SEQ ID NO: 187037

SEQ ID NO: 288479 - RNA, 64 nt, Homo Sapiens; identical to SEQ ID NO: 187038

SEQ ID NO: 288480 - RNA, 64 nt, Homo Sapiens; identical to SEQ ID NO: 187039

SEQ ID NO: 288481 - RNA, 64 nt, Homo Sapiens; identical to SEQ ID NO: 187040

SEQ ID NO: 288482 - RNA, 64 nt, Homo Sapiens; identical to SEQ ID NO: 187041

SEQ ID NO: 288483 - RNA, 64 nt, Homo Sapiens; identical to SEQ ID NO: 187042

SEQ ID NO: 288484 - RNA, 64 nt, Homo Sapiens; identical to SEQ ID NO: 187043

SEQ ID NO: 288485 - RNA, 64 nt, Homo Sapiens; identical to SEQ ID NO: 187044

SEQ ID NO: 288486 - RNA, 64 nt, Homo Sapiens; identical to SEQ ID NO: 187045

SEQ ID NO: 288487 - RNA, 64 nt, Homo Sapiens; identical to SEQ ID NO: 187046

SEQ ID NO: 288488 - RNA, 64 nt, Homo Sapiens; identical to SEQ ID NO: 187047

SEQ ID NO: 288489 - RNA, 64 nt, Homo Sapiens; identical to SEQ ID NO: 187048

SEQ ID NO: 288490 - RNA, 64 nt, Homo Sapiens; identical to SEQ ID NO: 187049

SEQ ID NO: 288491 - RNA, 64 nt, Homo Sapiens; identical to SEQ ID NO: 187050

SEQ ID NO: 288492 - RNA, 64 nt, Homo Sapiens; identical to SEQ ID NO: 187051

SEQ ID NO: 288493 - RNA, 64 nt, Homo Sapiens; identical to SEQ ID NO: 187052

SEQ ID NO: 288494 - RNA, 64 nt, Homo Sapiens; identical to SEQ ID NO: 187053

SEQ ID NO: 288495 - RNA, 64 nt, Homo Sapiens; identical to SEQ ID NO: 187054

SEQ ID NO: 288496 - RNA, 64 nt, Homo Sapiens; identical to SEQ ID NO: 187055

SEQ ID NO: 288497 - RNA, 64 nt, Homo Sapiens; identical to SEQ ID NO: 187056

SEQ ID NO: 288498 - RNA, 64 nt, Homo Sapiens; identical to SEQ ID NO: 187057

SEQ ID NO: 288499 - RNA, 64 nt, Homo Sapiens; identical to SEQ ID NO: 187058

SEQ ID NO: 288500 - RNA, 64 nt, Homo Sapiens; identical to SEQ ID NO: 187059

SEQ ID NO: 288501 - RNA, 64 nt, Homo Sapiens; identical to SEQ ID NO: 187060

SEQ ID NO: 288502 - RNA, 64 nt, Homo Sapiens; identical to SEQ ID NO: 187061

SEQ ID NO: 288503 - RNA, 64 nt, Homo Sapiens; identical to SEQ ID NO: 187062

SEQ ID NO: 288504 - RNA, 64 nt, Homo Sapiens; identical to SEQ ID NO: 187063

SEQ ID NO: 288505 - RNA, 64 nt, Homo Sapiens; identical to SEQ ID NO: 187064

SEQ ID NO: 288506 - RNA, 64 nt, Homo Sapiens; identical to SEQ ID NO: 187065

SEQ ID NO: 288507 - RNA, 64 nt, Homo Sapiens; identical to SEQ ID NO: 187066

SEQ ID NO: 288508 - RNA, 64 nt, Homo Sapiens; identical to SEQ ID NO: 187067

SEQ ID NO: 288509 - RNA, 64 nt, Homo Sapiens; identical to SEQ ID NO: 187068

SEQ ID NO: 288510 - RNA, 64 nt, Homo Sapiens; identical to SEQ ID NO: 187069

SEQ ID NO: 288511 - RNA, 64 nt, Homo Sapiens; identical to SEQ ID NO: 187070

SEQ ID NO: 288512 - RNA, 64 nt, Homo Sapiens; identical to SEQ ID NO: 187071

SEQ ID NO: 288513 - RNA, 64 nt, Homo Sapiens; identical to SEQ ID NO: 187072

SEQ ID NO: 288514 - RNA, 64 nt, Homo Sapiens; identical to SEQ ID NO: 187073

SEQ ID NO: 288515 - RNA, 64 nt, Homo Sapiens; identical to SEQ ID NO: 187074

SEQ ID NO: 288516 - RNA, 64 nt, Homo Sapiens; identical to SEQ ID NO: 187075

SEQ ID NO: 288517 - RNA, 64 nt, Homo Sapiens; identical to SEQ ID NO: 187076

SEQ ID NO: 288518 - RNA, 64 nt, Homo Sapiens; identical to SEQ ID NO: 187077

SEQ ID NO: 288519 - RNA, 64 nt, Homo Sapiens; identical to SEQ ID NO: 187078

SEQ ID NO: 288520 - RNA, 64 nt, Homo Sapiens; identical to SEQ ID NO: 187079

SEQ ID NO: 288521 - RNA, 64 nt, Homo Sapiens; identical to SEQ ID NO: 187080

SEQ ID NO: 288522 - RNA, 64 nt, Homo Sapiens; identical to SEQ ID NO: 187081

SEQ ID NO: 288523 - RNA, 64 nt, Homo Sapiens; identical to SEQ ID NO: 187082

SEQ ID NO: 288524 - RNA, 64 nt, Homo Sapiens; identical to SEQ ID NO: 187083

SEQ ID NO: 288525 - RNA, 57 nt, Homo Sapiens; identical to SEQ ID NO: 187084

SEQ ID NO: 288526 - RNA, 64 nt, Homo Sapiens; identical to SEQ ID NO: 187085

SEQ ID NO: 288527 - RNA, 64 nt, Homo Sapiens; identical to SEQ ID NO: 187086

SEQ ID NO: 288528 - RNA, 64 nt, Homo Sapiens; identical to SEQ ID NO: 187087

SEQ ID NO: 288529 - RNA, 64 nt, Homo Sapiens; identical to SEQ ID NO: 187088

SEQ ID NO: 288530 - RNA, 64 nt, Homo Sapiens; identical to SEQ ID NO: 187089

SEQ ID NO: 288531 - RNA, 64 nt, Homo Sapiens; identical to SEQ ID NO: 187090

SEQ ID NO: 288532 - RNA, 64 nt, Homo Sapiens; identical to SEQ ID NO: 187091

SEQ ID NO: 288533 - RNA, 64 nt, Homo Sapiens; identical to SEQ ID NO: 187092

SEQ ID NO: 288534 - RNA, 64 nt, Homo Sapiens; identical to SEQ ID NO: 187093

SEQ ID NO: 288535 - RNA, 64 nt, Homo Sapiens; identical to SEQ ID NO: 187094

SEQ ID NO: 288536 - RNA, 64 nt, Homo Sapiens; identical to SEQ ID NO: 187095

SEQ ID NO: 288537 - RNA, 64 nt, Homo Sapiens; identical to SEQ ID NO: 187096

SEQ ID NO: 288538 - RNA, 64 nt, Homo Sapiens; identical to SEQ ID NO: 187097

SEQ ID NO: 288539 - RNA, 64 nt, Homo Sapiens; identical to SEQ ID NO: 187098

SEQ ID NO: 288540 - RNA, 64 nt, Homo Sapiens; identical to SEQ ID NO: 187099

SEQ ID NO: 288541 - RNA, 64 nt, Homo Sapiens; identical to SEQ ID NO: 187100

SEQ ID NO: 288542 - RNA, 64 nt, Homo Sapiens; identical to SEQ ID NO: 187101

SEQ ID NO: 288543 - RNA, 64 nt, Homo Sapiens; identical to SEQ ID NO: 187102

SEQ ID NO: 288544 - RNA, 64 nt, Homo Sapiens; identical to SEQ ID NO: 187103

SEQ ID NO: 288545 - RNA, 64 nt, Homo Sapiens; identical to SEQ ID NO: 187104

SEQ ID NO: 288546 - RNA, 64 nt, Homo Sapiens; identical to SEQ ID NO: 187105

SEQ ID NO: 288547 - RNA, 64 nt, Homo Sapiens; identical to SEQ ID NO: 187106

SEQ ID NO: 288548 - RNA, 64 nt, Homo Sapiens; identical to SEQ ID NO: 187107

SEQ ID NO: 288549 - RNA, 64 nt, Homo Sapiens; identical to SEQ ID NO: 187108

SEQ ID NO: 288550 - RNA, 64 nt, Homo Sapiens; identical to SEQ ID NO: 187109

SEQ ID NO: 288551 - RNA, 64 nt, Homo Sapiens; identical to SEQ ID NO: 187110

SEQ ID NO: 288552 - RNA, 64 nt, Homo Sapiens; identical to SEQ ID NO: 187111

SEQ ID NO: 288553 - RNA, 64 nt, Homo Sapiens; identical to SEQ ID NO: 187112

SEQ ID NO: 288554 - RNA, 64 nt, Homo Sapiens; identical to SEQ ID NO: 187113

SEQ ID NO: 288555 - RNA, 64 nt, Homo Sapiens; identical to SEQ ID NO: 187114

SEQ ID NO: 288556 - RNA, 64 nt, Homo Sapiens
acaaauacggaugcagugcugagauaguuuaugagacuuguaccauuucacaaacucugaaauu

SEQ ID NO: 288557 - RNA, 64 nt, Homo Sapiens
acacuauccagcuaagcaaagauuccuggaggcugacuuguaucuucagacucacagagugaau

SEQ ID NO: 288558 - RNA, 64 nt, Homo Sapiens
ugacuugaccuugccaucuguggauuugaauguggacuuguaaaaauuuugcaggugggagauu

SEQ ID NO: 288559 - RNA, 64 nt, Homo Sapiens
ucacuuagcccuugggggcgcagcuacuugcaucgacuuguaccauaaacugggagaacuaugg

SEQ ID NO: 288560 - RNA, 64 nt, Homo Sapiens
auauuggcugccaugauaggaaaucagcgguacugacuuguacuuacuugcugaaugaaugcag

SEQ ID NO: 288561 - RNA, 64 nt, Homo Sapiens
uauaacucguucaucuucauuuucuccagcuucagacuuguagauccuuugaagcccagacauc

SEQ ID NO: 288562 - RNA, 64 nt, Homo Sapiens
ugaaguucuggcucugcagagaccaaaccuuacugacuuguacagacuuguacaaguaaagacu

SEQ ID NO: 288563 - RNA, 64 nt, Homo Sapiens
gcucugcagagaccaaaccuuacugacuuguacagacuuguacaaguaaagacuuauacagaua

SEQ ID NO: 288564 - RNA, 64 nt, Homo Sapiens
cuggcuauuacuauauaaugaagcccacuggcuugacuuguaaguucaaccuaaaccacaaucc

SEQ ID NO: 288565 - RNA, 64 nt, Homo Sapiens
ccagagaaacaagcauauugccucauggaugaaagacuuguaguucuaguuucagugacuuguu

SEQ ID NO: 288566 - RNA, 64 nt, Homo Sapiens; identical to SEQ ID NO: 210930

SEQ ID NO: 288567 - RNA, 64 nt, Homo Sapiens; identical to SEQ ID NO: 210931

SEQ ID NO: 288568 - RNA, 64 nt, Homo Sapiens; identical to SEQ ID NO: 210932

SEQ ID NO: 288569 - RNA, 64 nt, Homo Sapiens; identical to SEQ ID NO: 210933

SEQ ID NO: 288570 - RNA, 64 nt, Homo Sapiens; identical to SEQ ID NO: 210934

SEQ ID NO: 288571 - RNA, 64 nt, Homo Sapiens; identical to SEQ ID NO: 210935

SEQ ID NO: 288572 - RNA, 64 nt, Homo Sapiens; identical to SEQ ID NO: 210936

SEQ ID NO: 288573 - RNA, 64 nt, Homo Sapiens; identical to SEQ ID NO: 210937

SEQ ID NO: 288574 - RNA, 64 nt, Homo Sapiens; identical to SEQ ID NO: 210938

SEQ ID NO: 288575 - RNA, 64 nt, Homo Sapiens; identical to SEQ ID NO: 210939

SEQ ID NO: 288576 - RNA, 64 nt, Homo Sapiens; identical to SEQ ID NO: 210940

SEQ ID NO: 288577 - RNA, 64 nt, Homo Sapiens; identical to SEQ ID NO: 210941

SEQ ID NO: 288578 - RNA, 64 nt, Homo Sapiens; identical to SEQ ID NO: 210942

SEQ ID NO: 288579 - RNA, 64 nt, Homo Sapiens; identical to SEQ ID NO: 210943

SEQ ID NO: 288580 - RNA, 64 nt, Homo Sapiens; identical to SEQ ID NO: 210944

SEQ ID NO: 288581 - RNA, 64 nt, Homo Sapiens; identical to SEQ ID NO: 210945

SEQ ID NO: 288582 - RNA, 64 nt, Homo Sapiens; identical to SEQ ID NO: 210946

SEQ ID NO: 288583 - RNA, 64 nt, Homo Sapiens; identical to SEQ ID NO: 210947

SEQ ID NO: 288584 - RNA, 64 nt, Homo Sapiens; identical to SEQ ID NO: 261615

SEQ ID NO: 288585 - RNA, 64 nt, Homo Sapiens; identical to SEQ ID NO: 261616

SEQ ID NO: 288586 - RNA, 64 nt, Homo Sapiens; identical to SEQ ID NO: 261617

SEQ ID NO: 288587 - RNA, 64 nt, Homo Sapiens; identical to SEQ ID NO: 261618

SEQ ID NO: 288588 - RNA, 64 nt, Homo Sapiens; identical to SEQ ID NO: 261619

SEQ ID NO: 288589 - RNA, 64 nt, Homo Sapiens; identical to SEQ ID NO: 261620

SEQ ID NO: 288590 - RNA, 64 nt, Homo Sapiens; identical to SEQ ID NO: 261621

SEQ ID NO: 288591 - RNA, 64 nt, Homo Sapiens; identical to SEQ ID NO: 261622

SEQ ID NO: 288592 - RNA, 64 nt, Homo Sapiens; identical to SEQ ID NO: 261623

SEQ ID NO: 288593 - RNA, 64 nt, Homo Sapiens; identical to SEQ ID NO: 261624

SEQ ID NO: 288594 - RNA, 64 nt, Homo Sapiens; identical to SEQ ID NO: 261625

SEQ ID NO: 288595 - RNA, 64 nt, Homo Sapiens; identical to SEQ ID NO: 261626

SEQ ID NO: 288596 - RNA, 64 nt, Homo Sapiens; identical to SEQ ID NO: 261627

SEQ ID NO: 288597 - RNA, 64 nt, Homo Sapiens; identical to SEQ ID NO: 261628

SEQ ID NO: 288598 - RNA, 64 nt, Homo Sapiens; identical to SEQ ID NO: 261629

SEQ ID NO: 288599 - RNA, 64 nt, Homo Sapiens; identical to SEQ ID NO: 261630

SEQ ID NO: 288600 - RNA, 64 nt, Homo Sapiens; identical to SEQ ID NO: 261631

SEQ ID NO: 288601 - RNA, 64 nt, Homo Sapiens; identical to SEQ ID NO: 261632

SEQ ID NO: 288602 - RNA, 64 nt, Homo Sapiens; identical to SEQ ID NO: 261633

SEQ ID NO: 288603 - RNA, 64 nt, Homo Sapiens; identical to SEQ ID NO: 261634

SEQ ID NO: 288604 - RNA, 64 nt, Homo Sapiens; identical to SEQ ID NO: 126599

SEQ ID NO: 288605 - RNA, 64 nt, Homo Sapiens; identical to SEQ ID NO: 126600

SEQ ID NO: 288606 - RNA, 64 nt, Homo Sapiens; identical to SEQ ID NO: 126601

SEQ ID NO: 288607 - RNA, 64 nt, Homo Sapiens; identical to SEQ ID NO: 126602

SEQ ID NO: 288608 - RNA, 64 nt, Homo Sapiens; identical to SEQ ID NO: 126603

SEQ ID NO: 288609 - RNA, 64 nt, Homo Sapiens; identical to SEQ ID NO: 126604

SEQ ID NO: 288610 - RNA, 64 nt, Homo Sapiens; identical to SEQ ID NO: 126605

SEQ ID NO: 288611 - RNA, 64 nt, Homo Sapiens; identical to SEQ ID NO: 126606

SEQ ID NO: 288612 - RNA, 64 nt, Homo Sapiens; identical to SEQ ID NO: 126607

SEQ ID NO: 288613 - RNA, 64 nt, Homo Sapiens; identical to SEQ ID NO: 126608

SEQ ID NO: 288614 - RNA, 64 nt, Homo Sapiens; identical to SEQ ID NO: 126609

SEQ ID NO: 288615 - RNA, 64 nt, Homo Sapiens; identical to SEQ ID NO: 126610

SEQ ID NO: 288616 - RNA, 64 nt, Homo Sapiens; identical to SEQ ID NO: 126611

SEQ ID NO: 288617 - RNA, 64 nt, Homo Sapiens; identical to SEQ ID NO: 126612

SEQ ID NO: 288618 - RNA, 64 nt, Homo Sapiens; identical to SEQ ID NO: 126613

SEQ ID NO: 288619 - RNA, 64 nt, Homo Sapiens; identical to SEQ ID NO: 126614

SEQ ID NO: 288620 - RNA, 64 nt, Homo Sapiens; identical to SEQ ID NO: 126615

SEQ ID NO: 288621 - RNA, 64 nt, Homo Sapiens
accuuacauguguuaacagcuguuucaacauaaacuccauuauaaucuauauacauuuaaagac

SEQ ID NO: 288622 - RNA, 64 nt, Homo Sapiens
ucuaugguuaauucuuaaaauaaugccuuacagucuccauuaacucccuugcccuucucuugcu

SEQ ID NO: 288623 - RNA, 64 nt, Homo Sapiens
aaugcaauaaaaauaaauggcagaugacuuauuucuccauuaaauucaagcacuguuuugaaaa

SEQ ID NO: 288624 - RNA, 64 nt, Homo Sapiens
aaaauucagacagcaucuucaaagacaaguacaacuccauuagagaagaggagaaacucaauac

SEQ ID NO: 288625 - RNA, 64 nt, Homo Sapiens
ccauccaagcccugucccacuuuggcccuauccucuccauuagcuccuuccggguuuggaccau

SEQ ID NO: 288626 - RNA, 64 nt, Homo Sapiens
gacuagcccacuaaagcuccccuguaaaugggggcuccauuaguucugcugccgagacuaauaa

SEQ ID NO: 288627 - RNA, 64 nt, Homo Sapiens
gcuugauuuacuccacgugcgggauucucaggggcuccauuauguccagacugcucgccuccug

SEQ ID NO: 288628 - RNA, 64 nt, Homo Sapiens
auccagacugcucgccuccuugccuggcccuuuccuccauuaccgagauucuguuccaccugcc

SEQ ID NO: 288629 - RNA, 64 nt, Homo Sapiens
acaaggcagacuguuugaguacaagaaaaagucaggcauaaagcuggggguugcugagguaggc

SEQ ID NO: 288630 - RNA, 64 nt, Homo Sapiens
aucucucuaggccucacugucaccuggguaaucuggcauaaaaguaacaguugcauuuagguug

SEQ ID NO: 288631 - RNA, 64 nt, Homo Sapiens
cuuaaucuauuuuaaauuuaaguucuuguuuuuuggcauaaauauaaaauaaaauccuagaucc

SEQ ID NO: 288632 - RNA, 64 nt, Homo Sapiens
aagaauucugcauagaaacaucuuuuguguuuaaggcauaaaagugcccaaggcagcaacaagc

SEQ ID NO: 288633 - RNA, 64 nt, Homo Sapiens
uaaaaguuggcuaaaaauuucauguauuuuucuaggcauaaaaacacauuaguccuaaacgucc

SEQ ID NO: 288634 - RNA, 64 nt, Homo Sapiens
gagcaugaagucuguuaaagugaauacaucagcuggcauaaaagguuaagcauaucuucugaac

SEQ ID NO: 288635 - RNA, 64 nt, Homo Sapiens; identical to SEQ ID NO: 266801

SEQ ID NO: 288636 - RNA, 64 nt, Homo Sapiens; identical to SEQ ID NO: 266802

SEQ ID NO: 288637 - RNA, 64 nt, Homo Sapiens; identical to SEQ ID NO: 266803

SEQ ID NO: 288638 - RNA, 64 nt, Homo Sapiens; identical to SEQ ID NO: 266804

SEQ ID NO: 288639 - RNA, 64 nt, Homo Sapiens; identical to SEQ ID NO: 266805

SEQ ID NO: 288640 - RNA, 64 nt, Homo Sapiens; identical to SEQ ID NO: 266806

SEQ ID NO: 288641 - RNA, 64 nt, Homo Sapiens; identical to SEQ ID NO: 219912

SEQ ID NO: 288642 - RNA, 64 nt, Homo Sapiens; identical to SEQ ID NO: 219913

SEQ ID NO: 288643 - RNA, 64 nt, Homo Sapiens; identical to SEQ ID NO: 219914

SEQ ID NO: 288644 - RNA, 64 nt, Homo Sapiens; identical to SEQ ID NO: 219915

SEQ ID NO: 288645 - RNA, 64 nt, Homo Sapiens; identical to SEQ ID NO: 219916

SEQ ID NO: 288646 - RNA, 64 nt, Homo Sapiens; identical to SEQ ID NO: 219917

SEQ ID NO: 288647 - RNA, 64 nt, Homo Sapiens; identical to SEQ ID NO: 219918

SEQ ID NO: 288648 - RNA, 64 nt, Homo Sapiens; identical to SEQ ID NO: 219919

SEQ ID NO: 288649 - RNA, 64 nt, Homo Sapiens; identical to SEQ ID NO: 219920

SEQ ID NO: 288650 - RNA, 64 nt, Homo Sapiens; identical to SEQ ID NO: 219921

SEQ ID NO: 288651 - RNA, 64 nt, Homo Sapiens; identical to SEQ ID NO: 219922

SEQ ID NO: 288652 - RNA, 64 nt, Homo Sapiens; identical to SEQ ID NO: 219923

SEQ ID NO: 288653 - RNA, 64 nt, Homo Sapiens; identical to SEQ ID NO: 219924

SEQ ID NO: 288654 - RNA, 64 nt, Homo Sapiens; identical to SEQ ID NO: 219925

SEQ ID NO: 288655 - RNA, 64 nt, Homo Sapiens; identical to SEQ ID NO: 219926

SEQ ID NO: 288656 - RNA, 64 nt, Homo Sapiens; identical to SEQ ID NO: 219927

SEQ ID NO: 288657 - RNA, 64 nt, Homo Sapiens; identical to SEQ ID NO: 219928

SEQ ID NO: 288658 - RNA, 64 nt, Homo Sapiens; identical to SEQ ID NO: 219929

SEQ ID NO: 288659 - RNA, 64 nt, Homo Sapiens; identical to SEQ ID NO: 219930

SEQ ID NO: 288660 - RNA, 64 nt, Homo Sapiens; identical to SEQ ID NO: 219931

SEQ ID NO: 288661 - RNA, 64 nt, Homo Sapiens; identical to SEQ ID NO: 219932

SEQ ID NO: 288662 - RNA, 64 nt, Homo Sapiens; identical to SEQ ID NO: 219933

SEQ ID NO: 288663 - RNA, 53 nt, Homo Sapiens; identical to SEQ ID NO: 168469

SEQ ID NO: 288664 - RNA, 64 nt, Homo Sapiens; identical to SEQ ID NO: 219935

SEQ ID NO: 288665 - RNA, 64 nt, Homo Sapiens; identical to SEQ ID NO: 219936

SEQ ID NO: 288666 - RNA, 64 nt, Homo Sapiens; identical to SEQ ID NO: 219937

SEQ ID NO: 288667 - RNA, 64 nt, Homo Sapiens; identical to SEQ ID NO: 219938

SEQ ID NO: 288668 - RNA, 64 nt, Homo Sapiens; identical to SEQ ID NO: 219939

SEQ ID NO: 288669 - RNA, 64 nt, Homo Sapiens; identical to SEQ ID NO: 219940

SEQ ID NO: 288670 - RNA, 64 nt, Homo Sapiens; identical to SEQ ID NO: 219941

SEQ ID NO: 288671 - RNA, 64 nt, Homo Sapiens; identical to SEQ ID NO: 219942

SEQ ID NO: 288672 - RNA, 64 nt, Homo Sapiens; identical to SEQ ID NO: 219943

SEQ ID NO: 288673 - RNA, 64 nt, Homo Sapiens; identical to SEQ ID NO: 219944

SEQ ID NO: 288674 - RNA, 64 nt, Homo Sapiens; identical to SEQ ID NO: 219945

SEQ ID NO: 288675 - RNA, 64 nt, Homo Sapiens; identical to SEQ ID NO: 219946

SEQ ID NO: 288676 - RNA, 64 nt, Homo Sapiens; identical to SEQ ID NO: 219947

SEQ ID NO: 288677 - RNA, 64 nt, Homo Sapiens; identical to SEQ ID NO: 219948

SEQ ID NO: 288678 - RNA, 64 nt, Homo Sapiens; identical to SEQ ID NO: 219949

SEQ ID NO: 288679 - RNA, 64 nt, Homo Sapiens; identical to SEQ ID NO: 219950

SEQ ID NO: 288680 - RNA, 64 nt, Homo Sapiens; identical to SEQ ID NO: 219951

SEQ ID NO: 288681 - RNA, 64 nt, Homo Sapiens; identical to SEQ ID NO: 219952

SEQ ID NO: 288682 - RNA, 64 nt, Homo Sapiens; identical to SEQ ID NO: 219953

SEQ ID NO: 288683 - RNA, 64 nt, Homo Sapiens; identical to SEQ ID NO: 219954

SEQ ID NO: 288684 - RNA, 64 nt, Homo Sapiens; identical to SEQ ID NO: 219955

SEQ ID NO: 288685 - RNA, 64 nt, Homo Sapiens; identical to SEQ ID NO: 219956

SEQ ID NO: 288686 - RNA, 64 nt, Homo Sapiens; identical to SEQ ID NO: 219957

SEQ ID NO: 288687 - RNA, 64 nt, Homo Sapiens; identical to SEQ ID NO: 219958

SEQ ID NO: 288688 - RNA, 64 nt, Homo Sapiens; identical to SEQ ID NO: 219959

SEQ ID NO: 288689 - RNA, 64 nt, Homo Sapiens; identical to SEQ ID NO: 219960

SEQ ID NO: 288690 - RNA, 64 nt, Homo Sapiens; identical to SEQ ID NO: 219961

SEQ ID NO: 288691 - RNA, 64 nt, Homo Sapiens; identical to SEQ ID NO: 219962

SEQ ID NO: 288692 - RNA, 64 nt, Homo Sapiens; identical to SEQ ID NO: 219963

SEQ ID NO: 288693 - RNA, 64 nt, Homo Sapiens; identical to SEQ ID NO: 219964

SEQ ID NO: 288694 - RNA, 64 nt, Homo Sapiens; identical to SEQ ID NO: 219965

SEQ ID NO: 288695 - RNA, 64 nt, Homo Sapiens; identical to SEQ ID NO: 219966

SEQ ID NO: 288696 - RNA, 64 nt, Homo Sapiens; identical to SEQ ID NO: 219967

SEQ ID NO: 288697 - RNA, 64 nt, Homo Sapiens; identical to SEQ ID NO: 219968

SEQ ID NO: 288698 - RNA, 64 nt, Homo Sapiens; identical to SEQ ID NO: 219969

SEQ ID NO: 288699 - RNA, 64 nt, Homo Sapiens; identical to SEQ ID NO: 219970

SEQ ID NO: 288700 - RNA, 64 nt, Homo Sapiens; identical to SEQ ID NO: 219971

SEQ ID NO: 288701 - RNA, 64 nt, Homo Sapiens; identical to SEQ ID NO: 59668

SEQ ID NO: 288702 - RNA, 64 nt, Homo Sapiens; identical to SEQ ID NO: 59669

SEQ ID NO: 288703 - RNA, 64 nt, Homo Sapiens; identical to SEQ ID NO: 59670

SEQ ID NO: 288704 - RNA, 64 nt, Homo Sapiens; identical to SEQ ID NO: 59671

SEQ ID NO: 288705 - RNA, 64 nt, Homo Sapiens; identical to SEQ ID NO: 59672

SEQ ID NO: 288706 - RNA, 64 nt, Homo Sapiens; identical to SEQ ID NO: 59673

SEQ ID NO: 288707 - RNA, 64 nt, Homo Sapiens; identical to SEQ ID NO: 59674

SEQ ID NO: 288708 - RNA, 64 nt, Homo Sapiens; identical to SEQ ID NO: 59675

SEQ ID NO: 288709 - RNA, 64 nt, Homo Sapiens; identical to SEQ ID NO: 59676

SEQ ID NO: 288710 - RNA, 64 nt, Homo Sapiens; identical to SEQ ID NO: 59677

SEQ ID NO: 288711 - RNA, 64 nt, Homo Sapiens; identical to SEQ ID NO: 59678

SEQ ID NO: 288712 - RNA, 64 nt, Homo Sapiens; identical to SEQ ID NO: 59679

SEQ ID NO: 288713 - RNA, 64 nt, Homo Sapiens; identical to SEQ ID NO: 59680

SEQ ID NO: 288714 - RNA, 64 nt, Homo Sapiens; identical to SEQ ID NO: 59681

SEQ ID NO: 288715 - RNA, 64 nt, Homo Sapiens; identical to SEQ ID NO: 59682

SEQ ID NO: 288716 - RNA, 64 nt, Homo Sapiens; identical to SEQ ID NO: 59683

SEQ ID NO: 288717 - RNA, 64 nt, Homo Sapiens; identical to SEQ ID NO: 59684

SEQ ID NO: 288718 - RNA, 64 nt, Homo Sapiens; identical to SEQ ID NO: 59685

SEQ ID NO: 288719 - RNA, 64 nt, Homo Sapiens; identical to SEQ ID NO: 59686

SEQ ID NO: 288720 - RNA, 64 nt, Homo Sapiens; identical to SEQ ID NO: 59687

SEQ ID NO: 288721 - RNA, 64 nt, Homo Sapiens; identical to SEQ ID NO: 59688

SEQ ID NO: 288722 - RNA, 64 nt, Homo Sapiens; identical to SEQ ID NO: 59689

SEQ ID NO: 288723 - RNA, 64 nt, Homo Sapiens; identical to SEQ ID NO: 59690

SEQ ID NO: 288724 - RNA, 64 nt, Homo Sapiens; identical to SEQ ID NO: 59691

SEQ ID NO: 288725 - RNA, 64 nt, Homo Sapiens; identical to SEQ ID NO: 59692

SEQ ID NO: 288726 - RNA, 64 nt, Homo Sapiens; identical to SEQ ID NO: 59693

SEQ ID NO: 288727 - RNA, 64 nt, Homo Sapiens; identical to SEQ ID NO: 59694

SEQ ID NO: 288728 - RNA, 64 nt, Homo Sapiens; identical to SEQ ID NO: 59695

SEQ ID NO: 288729 - RNA, 64 nt, Homo Sapiens; identical to SEQ ID NO: 59696

SEQ ID NO: 288730 - RNA, 64 nt, Homo Sapiens; identical to SEQ ID NO: 59697

SEQ ID NO: 288731 - RNA, 64 nt, Homo Sapiens; identical to SEQ ID NO: 59698

SEQ ID NO: 288732 - RNA, 64 nt, Homo Sapiens; identical to SEQ ID NO: 59699

SEQ ID NO: 288733 - RNA, 64 nt, Homo Sapiens; identical to SEQ ID NO: 59700

SEQ ID NO: 288734 - RNA, 64 nt, Homo Sapiens; identical to SEQ ID NO: 59701

SEQ ID NO: 288735 - RNA, 64 nt, Homo Sapiens; identical to SEQ ID NO: 59702

SEQ ID NO: 288736 - RNA, 64 nt, Homo Sapiens; identical to SEQ ID NO: 59703

SEQ ID NO: 288737 - RNA, 64 nt, Homo Sapiens; identical to SEQ ID NO: 59704

SEQ ID NO: 288738 - RNA, 64 nt, Homo Sapiens; identical to SEQ ID NO: 59705

SEQ ID NO: 288739 - RNA, 64 nt, Homo Sapiens; identical to SEQ ID NO: 59706

SEQ ID NO: 288740 - RNA, 64 nt, Homo Sapiens; identical to SEQ ID NO: 59707

SEQ ID NO: 288741 - RNA, 64 nt, Homo Sapiens; identical to SEQ ID NO: 59708

SEQ ID NO: 288742 - RNA, 64 nt, Homo Sapiens; identical to SEQ ID NO: 59709

SEQ ID NO: 288743 - RNA, 64 nt, Homo Sapiens
auacuccaggcuguuuggggugggagccaaaaagaguugagaggccagggcccuugguggaaag

SEQ ID NO: 288744 - RNA, 64 nt, Homo Sapiens
gauuuucguguucucugcccagaugggcugggggaguugagagugugcuuauuuucacugcgau

SEQ ID NO: 288745 - RNA, 64 nt, Homo Sapiens
aaaaguaaggaacagagaauugcccaaguuugucaguugagauuaggugcucagagguacgaga

SEQ ID NO: 288746 - RNA, 64 nt, Homo Sapiens
cgcauauuugccuauucuuuauuucucuuccaacaguugagauuagacuuagacgaaagaaagg

SEQ ID NO: 288747 - RNA, 64 nt, Homo Sapiens
uguggggggacacaaccaaaggagauacaauucaaguugagauucacaacacgugggaauucug

SEQ ID NO: 288748 - RNA, 64 nt, Homo Sapiens
uggguggggacauagccaaauagauacaauuucaaguugagauuacaacacgugggaauucugg

SEQ ID NO: 288749 - RNA, 64 nt, Homo Sapiens
aagaauaauccuagggaugucaucucuguguggaaguugagacuuaagaguuuucuauuucaga

SEQ ID NO: 288750 - RNA, 64 nt, Homo Sapiens
ucauaguaauuuuagaaugccauuaauucagugaaguugagacucguggaauauauuuuauuuu

SEQ ID NO: 288751 - RNA, 64 nt, Homo Sapiens
uuggggugguggugugccaaaauauuaacucaaaaguugagauuuuuuuuaaaaauuacuuuua

SEQ ID NO: 288752 - RNA, 64 nt, Homo Sapiens
uucuaauugguuuuuacugauaauuacuaauuucaguugagaccaucuagucacauaaauggau

SEQ ID NO: 288753 - RNA, 64 nt, Homo Sapiens
augcuccaccuguaagaacagaaaaucgucuuauaguugagaauuuauccucaagagucagcug

SEQ ID NO: 288754 - RNA, 64 nt, Homo Sapiens
aucccagagcguugauaacgugaucugaucccuaaguugagaccugucuuccuguaacgcuucc

SEQ ID NO: 288755 - RNA, 64 nt, Homo Sapiens
aaaaaaaaagaccugugguuccagaaagcucauuaguugagauucugugagucuagguugacca

SEQ ID NO: 288756 - RNA, 64 nt, Homo Sapiens
ucugagauuuugcugguuccaguuugcccaauggaguugagaaucucaaugauucuagaugacu

SEQ ID NO: 288757 - RNA, 64 nt, Homo Sapiens
ugggugagguuagucucuccuuugugggcugcagaguugagaguguugccuucaguagaaggca

SEQ ID NO: 288758 - RNA, 64 nt, Homo Sapiens
cuugguggcacauggguguucaucuggcgugugcaguugagaaauuugauucucguaaaacgcg

SEQ ID NO: 288759 - RNA, 64 nt, Homo Sapiens
ccuugccucuugggacugaccaggagcugcucaugugcgugagagugggaaccaucuccuugcg

SEQ ID NO: 288760 - RNA, 64 nt, Homo Sapiens
cgaagcauuuagaauggugccuggcacacaguuggugcgugauaugguuaagcuuugugucccc

SEQ ID NO: 288761 - RNA, 64 nt, Homo Sapiens
ucuaaacacuggaagaauuaacugaagucauaacgugcgugaauuaacagcuucucuauuugau

SEQ ID NO: 288762 - RNA, 64 nt, Homo Sapiens
uaggcauauaucacuaagcuagcacaucagauccgugcgugaaggugguggcgugcauauguaa

SEQ ID NO: 288763 - RNA, 64 nt, Homo Sapiens
cucgugaccaaauggccuuggucccgcagcuugugugcgugagugcagugugaguguguguguc

SEQ ID NO: 288764 - RNA, 64 nt, Homo Sapiens
gugaaccugagacuggccugcaugaauacagggugugcgugaaugaaacugcccacaugaacuu

SEQ ID NO: 288765 - RNA, 64 nt, Homo Sapiens
uccaaccaucagcaucucaucaugauuuuaaacugugcgugauauaaacucuuaaagauauguu

SEQ ID NO: 288766 - RNA, 64 nt, Homo Sapiens
ggugugcaggcgcgguuccuguuauguugugugugugcgugagugccucucuggcugccacuug

SEQ ID NO: 288767 - RNA, 64 nt, Homo Sapiens
guauguaaugugugguggccguguuuuuuaugaagugcgugaauagccagggucucucccucag

SEQ ID NO: 288768 - RNA, 64 nt, Homo Sapiens
cggcccacgccguuagcucgugugcguguagucugugcgugagacuccuucgauuguagcucug

SEQ ID NO: 288769 - RNA, 64 nt, Homo Sapiens
aaguccucuguggccagcugcaucugucugaauggugcgugaaggcucucagaccuuacacacc

SEQ ID NO: 288770 - RNA, 64 nt, Homo Sapiens
auugggggcccggacgcccaagugcguggugcgagugcgugaauugguggggugagggaauaug

SEQ ID NO: 288771 - RNA, 64 nt, Homo Sapiens
uggucaguugccaaaggaggcaucacuaguaugugugcgugagcauauggaguuauguggauuu

SEQ ID NO: 288772 - RNA, 64 nt, Homo Sapiens
gccaugcucauugcaggggaggcugggucugggggugcgugacccaauccccuuccuccuggcc

SEQ ID NO: 288773 - RNA, 64 nt, Homo Sapiens
caggucugcuuaggggaccuccacacaggucuccgugcgugaacucgugagaugggggcuuaac

SEQ ID NO: 288774 - RNA, 64 nt, Homo Sapiens
uauauucagaacaaccuacuucccauuuaguuaagugcgugauuaacacaaguuagaaauuaua

SEQ ID NO: 288775 - RNA, 64 nt, Homo Sapiens
accaacaaagucacagucguuacagacacacccagugcgugaagaccguggacagcgcuguauu

SEQ ID NO: 288776 - RNA, 64 nt, Homo Sapiens
cccugccacgauuaaagacuguguacgugcgcgcgugcgugaggaagaucugaagccugagugu

SEQ ID NO: 288777 - RNA, 64 nt, Homo Sapiens
gguagucggcuggugucccugucguggagcuggggugcgugaucuggugcucguccacgcaggu

SEQ ID NO: 288778 - RNA, 64 nt, Homo Sapiens
gagcgccacccgcccgcccccgcccucgcuccgggugcgugaccggcccgccaccuuguacaga

SEQ ID NO: 288779 - RNA, 64 nt, Homo Sapiens
caccucagucucccaaauagcuaggacuacaggcgugcgugaccaagcccagcuaauuuuugca

SEQ ID NO: 288780 - RNA, 64 nt, Homo Sapiens
acaaacgcuuucaaaguugggcaaaaguggcccagugcgugaggucagucaacagccaaauucc

SEQ ID NO: 288781 - RNA, 64 nt, Homo Sapiens
gaggaugcuggggcccugcagugcgcucuaggcugugcgugagccgggacuguacccacagcuu

SEQ ID NO: 288782 - RNA, 64 nt, Homo Sapiens
cacacaggcuggcgggggccggccccgaggccgcgugcgugagaaccgcgccgguguccccaga

SEQ ID NO: 288783 - RNA, 64 nt, Homo Sapiens
uccggcagcacaagcugcggccuucuacacguuggugcgugagauucccagggaguggaggaug

SEQ ID NO: 288784 - RNA, 64 nt, Homo Sapiens
ugguaugacauacacacaccuugacgugccaucagugcgugauggacccaauuguguuugccug

SEQ ID NO: 288785 - RNA, 64 nt, Homo Sapiens
uuuugcagcauggguugaguguacaaagccuacugugcgugagauccucuccuuccguuucuga

SEQ ID NO: 288786 - RNA, 64 nt, Homo Sapiens
ucucagugauuuccuacaguggcuguuggggacagugcgugauucuccucccuguguuaacugg

SEQ ID NO: 288787 - RNA, 64 nt, Homo Sapiens
gagucugugucacccaggcuucacuuuuuugugugugcgugaagcuagacuuccaaguuuguuu

SEQ ID NO: 288788 - RNA, 64 nt, Homo Sapiens
ccagcaguucucaaaaugagguccucaggccacagugcgugagaacuugcuuggcuguuuguua

SEQ ID NO: 288789 - RNA, 64 nt, Homo Sapiens
uuuauugcuuuccauucugugguaugaugugcgugugcgugaguguguggccccuguuuauucc

SEQ ID NO: 288790 - RNA, 64 nt, Homo Sapiens
gaggguuccuguagaccuagggaggaccuuaucugugcgugaaacacaccaggcugugggccuc

SEQ ID NO: 288791 - RNA, 64 nt, Homo Sapiens
cucaaaguugcuaacaucauccuguauugggaaggugcgugaaaauauaagcaggaauacuuag

SEQ ID NO: 288792 - RNA, 64 nt, Homo Sapiens
gccugaaaagcaugcaggggagucugguuuuaaagugcgugacaggacacaaggcuuggcugug

SEQ ID NO: 288793 - RNA, 64 nt, Homo Sapiens
caucucucuucuaaaggaugcauuaaagucagucgugcgugaagucucuguugccugaaagagc

SEQ ID NO: 288794 - RNA, 64 nt, Homo Sapiens
cccuggacgagcgggcccugcaggacuuuccugugugcgugagcaccaagccggagcccgagga

SEQ ID NO: 288795 - RNA, 64 nt, Homo Sapiens
uccuccugccaacauucagucugguaugugaggcgugcgugaagcaagaacuccuggagcuaca

SEQ ID NO: 288796 - RNA, 64 nt, Homo Sapiens
acuuaaaacugccaaaugauuuuuguucuuuuaugugcgugauaaaaauacaaagaauggugug

SEQ ID NO: 288797 - RNA, 64 nt, Homo Sapiens
ggcuucagccugucccggggggucgggcacccaagugcgugagggugcugcccuugcugcugcu

SEQ ID NO: 288798 - RNA, 64 nt, Homo Sapiens
cagagcccuugccccugcuggugccugugcccgugugcgugagagcggcagggccggcaccugc

SEQ ID NO: 288799 - RNA, 64 nt, Homo Sapiens
ugcccuuuuucucauucccuagcccagguuccaggugcgugacccacauuugaccuuuuggcac

SEQ ID NO: 288800 - RNA, 64 nt, Homo Sapiens
ccacagaucuguggacacacaacagugugugugcgugcgugagacgcccucucuguccucugug

SEQ ID NO: 288801 - RNA, 64 nt, Homo Sapiens
ccaaacaaagacugauaauuccugguaggggugugugcgugacguacugcagccucaaccuccu

SEQ ID NO: 288802 - RNA, 64 nt, Homo Sapiens
cugucagugcuuucaggagaccuccugguccucagugcgugaccagcagagaccaguaaaggag

SEQ ID NO: 288803 - RNA, 64 nt, Homo Sapiens
guaugugugugugugaaccaguguguguguucaagugcgugacuauaggccuguguguauagcu

SEQ ID NO: 288804 - RNA, 64 nt, Homo Sapiens
uaauugagacaaguguucaaacagaaagacgcuugugcgugaauguucauggcagcccuauuca

SEQ ID NO: 288805 - RNA, 64 nt, Homo Sapiens
auccaaagcgccgagacgagcgccccguggucuggugcgugacagggaugccacuccauuccuc

SEQ ID NO: 288806 - RNA, 64 nt, Homo Sapiens
guucauggcggcccuauucaacagaaagacgcuugugcgugaauuaauugagacaaguguucaa

SEQ ID NO: 288807 - RNA, 64 nt, Homo Sapiens
uauagaauguguuuuauacccgaucguguguggugugcgugaggacaaacuccgcaggggcugu

SEQ ID NO: 288808 - RNA, 64 nt, Homo Sapiens
gugagugugugugagagagaguguguguguaucugugcgugagucaaagacuguuggugacagg

SEQ ID NO: 288809 - RNA, 64 nt, Homo Sapiens
gcuuauuuucuuuuguuuauucuaguugagcugcgugcgugaaucuacaguagucuuucuuguu

SEQ ID NO: 288810 - RNA, 64 nt, Homo Sapiens
gagugggagugugugagugugagcaggcgggcgagugcgugagugcacgccagcgcguggccca

SEQ ID NO: 288811 - RNA, 64 nt, Homo Sapiens
ccaucacagcucaguguugguggcauaguuccaggugcgugaaaguauuugcugauucuuugaa

SEQ ID NO: 288812 - RNA, 64 nt, Homo Sapiens
acauugacacguauauaaagauccacgcguggcugugcgugauaucucacacucugaauucuua

SEQ ID NO: 288813 - RNA, 64 nt, Homo Sapiens
uaucaauugugugagcuugggugcgagugcacgcgugcgugaguacggagaguauauauagauc

SEQ ID NO: 288814 - RNA, 64 nt, Homo Sapiens
uauauaaagcaaacauaagaugcaauuaauauccgugcgugauauacuuucucccucacauaaa

SEQ ID NO: 288815 - RNA, 64 nt, Homo Sapiens
ucauguguacugagcagcuaccauguucaagguaauaugccaggcgcuguaugucuccacugcc

SEQ ID NO: 288816 - RNA, 64 nt, Homo Sapiens
uaaaaguuaagggguaguuggcaccuccuuauuaauaugccagccuagaucccccccgguggag

SEQ ID NO: 288817 - RNA, 64 nt, Homo Sapiens
cuagggugcuccuguuggauggugaggucacuccauaugccaauacaaacaacaaugcggugga

SEQ ID NO: 288818 - RNA, 62 nt, Homo Sapiens
uggccuuugguucauguuuucuccccauauguauauaugccauaugugaauaugccauauau

SEQ ID NO: 288819 - RNA, 64 nt, Homo Sapiens
ccuuaauacagauuauuaugcccucuuugguacuauaugccauggaugugaauuucccauagaa

SEQ ID NO: 288820 - RNA, 64 nt, Homo Sapiens
uuuguuuguuuguuuaguuuugccuucauagguuauaugccaagauaguauuugauaagucaau

SEQ ID NO: 288821 - RNA, 64 nt, Homo Sapiens
cucuauaccaguggcugacaaggcauauagggauauaugccauccugagaggaguaaaguguuu

SEQ ID NO: 288822 - RNA, 64 nt, Homo Sapiens
uacacuaaauucacucaacuauuguaugccuaccauaugccagauuuuauccuagacccugagg

SEQ ID NO: 288823 - RNA, 64 nt, Homo Sapiens; identical to SEQ ID NO: 107704

SEQ ID NO: 288824 - RNA, 64 nt, Homo Sapiens; identical to SEQ ID NO: 107705

SEQ ID NO: 288825 - RNA, 64 nt, Homo Sapiens; identical to SEQ ID NO: 107706

SEQ ID NO: 288826 - RNA, 64 nt, Homo Sapiens; identical to SEQ ID NO: 107707

SEQ ID NO: 288827 - RNA, 64 nt, Homo Sapiens; identical to SEQ ID NO: 107708

SEQ ID NO: 288828 - RNA, 64 nt, Homo Sapiens; identical to SEQ ID NO: 107709

SEQ ID NO: 288829 - RNA, 64 nt, Homo Sapiens; identical to SEQ ID NO: 107710

SEQ ID NO: 288830 - RNA, 64 nt, Homo Sapiens; identical to SEQ ID NO: 107711

SEQ ID NO: 288831 - RNA, 64 nt, Homo Sapiens; identical to SEQ ID NO: 107712

SEQ ID NO: 288832 - RNA, 64 nt, Homo Sapiens; identical to SEQ ID NO: 107713

SEQ ID NO: 288833 - RNA, 64 nt, Homo Sapiens; identical to SEQ ID NO: 107714

SEQ ID NO: 288834 - RNA, 64 nt, Homo Sapiens; identical to SEQ ID NO: 107715

SEQ ID NO: 288835 - RNA, 64 nt, Homo Sapiens; identical to SEQ ID NO: 107716

SEQ ID NO: 288836 - RNA, 64 nt, Homo Sapiens; identical to SEQ ID NO: 107717

SEQ ID NO: 288837 - RNA, 64 nt, Homo Sapiens; identical to SEQ ID NO: 107718

SEQ ID NO: 288838 - RNA, 64 nt, Homo Sapiens; identical to SEQ ID NO: 107719

SEQ ID NO: 288839 - RNA, 64 nt, Homo Sapiens; identical to SEQ ID NO: 107720

SEQ ID NO: 288840 - RNA, 64 nt, Homo Sapiens; identical to SEQ ID NO: 107721

SEQ ID NO: 288841 - RNA, 64 nt, Homo Sapiens; identical to SEQ ID NO: 107722

SEQ ID NO: 288842 - RNA, 64 nt, Homo Sapiens; identical to SEQ ID NO: 107723

SEQ ID NO: 288843 - RNA, 64 nt, Homo Sapiens; identical to SEQ ID NO: 107724

SEQ ID NO: 288844 - RNA, 64 nt, Homo Sapiens; identical to SEQ ID NO: 107725

SEQ ID NO: 288845 - RNA, 64 nt, Homo Sapiens; identical to SEQ ID NO: 107726

SEQ ID NO: 288846 - RNA, 64 nt, Homo Sapiens; identical to SEQ ID NO: 107727

SEQ ID NO: 288847 - RNA, 64 nt, Homo Sapiens; identical to SEQ ID NO: 107728

SEQ ID NO: 288848 - RNA, 64 nt, Homo Sapiens; identical to SEQ ID NO: 107729

SEQ ID NO: 288849 - RNA, 64 nt, Homo Sapiens; identical to SEQ ID NO: 107730

SEQ ID NO: 288850 - RNA, 64 nt, Homo Sapiens; identical to SEQ ID NO: 107731

SEQ ID NO: 288851 - RNA, 64 nt, Homo Sapiens; identical to SEQ ID NO: 107732

SEQ ID NO: 288852 - RNA, 64 nt, Homo Sapiens; identical to SEQ ID NO: 107733

SEQ ID NO: 288853 - RNA, 64 nt, Homo Sapiens; identical to SEQ ID NO: 107734

SEQ ID NO: 288854 - RNA, 64 nt, Homo Sapiens; identical to SEQ ID NO: 107735

SEQ ID NO: 288855 - RNA, 64 nt, Homo Sapiens; identical to SEQ ID NO: 107736

SEQ ID NO: 288856 - RNA, 64 nt, Homo Sapiens; identical to SEQ ID NO: 107737

SEQ ID NO: 288857 - RNA, 64 nt, Homo Sapiens; identical to SEQ ID NO: 107738

SEQ ID NO: 288858 - RNA, 64 nt, Homo Sapiens; identical to SEQ ID NO: 107739

SEQ ID NO: 288859 - RNA, 60 nt, Homo Sapiens; identical to SEQ ID NO: 107740

SEQ ID NO: 288860 - RNA, 64 nt, Homo Sapiens; identical to SEQ ID NO: 107741

SEQ ID NO: 288861 - RNA, 64 nt, Homo Sapiens; identical to SEQ ID NO: 107742

SEQ ID NO: 288862 - RNA, 64 nt, Homo Sapiens; identical to SEQ ID NO: 107743

SEQ ID NO: 288863 - RNA, 64 nt, Homo Sapiens; identical to SEQ ID NO: 107744

SEQ ID NO: 288864 - RNA, 64 nt, Homo Sapiens; identical to SEQ ID NO: 107745

SEQ ID NO: 288865 - RNA, 64 nt, Homo Sapiens; identical to SEQ ID NO: 107746

SEQ ID NO: 288866 - RNA, 64 nt, Homo Sapiens; identical to SEQ ID NO: 107747

SEQ ID NO: 288867 - RNA, 64 nt, Homo Sapiens; identical to SEQ ID NO: 107748

SEQ ID NO: 288868 - RNA, 64 nt, Homo Sapiens; identical to SEQ ID NO: 107749

SEQ ID NO: 288869 - RNA, 64 nt, Homo Sapiens; identical to SEQ ID NO: 107750

SEQ ID NO: 288870 - RNA, 64 nt, Homo Sapiens; identical to SEQ ID NO: 107751

SEQ ID NO: 288871 - RNA, 64 nt, Homo Sapiens; identical to SEQ ID NO: 107752

SEQ ID NO: 288872 - RNA, 64 nt, Homo Sapiens; identical to SEQ ID NO: 107753

SEQ ID NO: 288873 - RNA, 64 nt, Homo Sapiens; identical to SEQ ID NO: 107754

SEQ ID NO: 288874 - RNA, 64 nt, Homo Sapiens; identical to SEQ ID NO: 107755

SEQ ID NO: 288875 - RNA, 64 nt, Homo Sapiens; identical to SEQ ID NO: 107756

SEQ ID NO: 288876 - RNA, 64 nt, Homo Sapiens; identical to SEQ ID NO: 107757

SEQ ID NO: 288877 - RNA, 64 nt, Homo Sapiens; identical to SEQ ID NO: 107758

SEQ ID NO: 288878 - RNA, 64 nt, Homo Sapiens; identical to SEQ ID NO: 107759

SEQ ID NO: 288879 - RNA, 64 nt, Homo Sapiens; identical to SEQ ID NO: 107760

SEQ ID NO: 288880 - RNA, 64 nt, Homo Sapiens; identical to SEQ ID NO: 107761

SEQ ID NO: 288881 - RNA, 64 nt, Homo Sapiens; identical to SEQ ID NO: 107762

SEQ ID NO: 288882 - RNA, 64 nt, Homo Sapiens; identical to SEQ ID NO: 107763

SEQ ID NO: 288883 - RNA, 64 nt, Homo Sapiens; identical to SEQ ID NO: 107764

SEQ ID NO: 288884 - RNA, 64 nt, Homo Sapiens; identical to SEQ ID NO: 107765

SEQ ID NO: 288885 - RNA, 64 nt, Homo Sapiens; identical to SEQ ID NO: 107766

SEQ ID NO: 288886 - RNA, 64 nt, Homo Sapiens; identical to SEQ ID NO: 107767

SEQ ID NO: 288887 - RNA, 64 nt, Homo Sapiens; identical to SEQ ID NO: 107768

SEQ ID NO: 288888 - RNA, 64 nt, Homo Sapiens
agguucaagauaacggggucaggccuuuaacuuccucaaacaggcccaagcaaaggcuggaaga

SEQ ID NO: 288889 - RNA, 64 nt, Homo Sapiens
cuucacugagacucagagggaaaaggaaaagagccucaaacauuuuuaggagguuguccaucau

SEQ ID NO: 288890 - RNA, 64 nt, Homo Sapiens
ucagggccucacuuguauagaauguaauguucuccucaaacauuuauguuaacucuauaaacaa

SEQ ID NO: 288891 - RNA, 64 nt, Homo Sapiens
ccaucagaauagagaccugcagaggcccagggcacucaaacauaacugugcuugucucagucaa

SEQ ID NO: 288892 - RNA, 64 nt, Homo Sapiens; identical to SEQ ID NO: 107704

SEQ ID NO: 288893 - RNA, 64 nt, Homo Sapiens; identical to SEQ ID NO: 107705

SEQ ID NO: 288894 - RNA, 64 nt, Homo Sapiens; identical to SEQ ID NO: 107706

SEQ ID NO: 288895 - RNA, 64 nt, Homo Sapiens; identical to SEQ ID NO: 107707

SEQ ID NO: 288896 - RNA, 64 nt, Homo Sapiens; identical to SEQ ID NO: 107708

SEQ ID NO: 288897 - RNA, 64 nt, Homo Sapiens; identical to SEQ ID NO: 107709

SEQ ID NO: 288898 - RNA, 64 nt, Homo Sapiens; identical to SEQ ID NO: 107710

SEQ ID NO: 288899 - RNA, 64 nt, Homo Sapiens; identical to SEQ ID NO: 107711

SEQ ID NO: 288900 - RNA, 64 nt, Homo Sapiens; identical to SEQ ID NO: 107712

SEQ ID NO: 288901 - RNA, 64 nt, Homo Sapiens; identical to SEQ ID NO: 107713

SEQ ID NO: 288902 - RNA, 64 nt, Homo Sapiens; identical to SEQ ID NO: 107714

SEQ ID NO: 288903 - RNA, 64 nt, Homo Sapiens; identical to SEQ ID NO: 107715

SEQ ID NO: 288904 - RNA, 64 nt, Homo Sapiens; identical to SEQ ID NO: 107716

SEQ ID NO: 288905 - RNA, 64 nt, Homo Sapiens; identical to SEQ ID NO: 107717

SEQ ID NO: 288906 - RNA, 64 nt, Homo Sapiens; identical to SEQ ID NO: 107718

SEQ ID NO: 288907 - RNA, 64 nt, Homo Sapiens; identical to SEQ ID NO: 107719

SEQ ID NO: 288908 - RNA, 64 nt, Homo Sapiens; identical to SEQ ID NO: 107720

SEQ ID NO: 288909 - RNA, 64 nt, Homo Sapiens; identical to SEQ ID NO: 107721

SEQ ID NO: 288910 - RNA, 64 nt, Homo Sapiens; identical to SEQ ID NO: 107722

SEQ ID NO: 288911 - RNA, 64 nt, Homo Sapiens; identical to SEQ ID NO: 107723

SEQ ID NO: 288912 - RNA, 64 nt, Homo Sapiens; identical to SEQ ID NO: 107724

SEQ ID NO: 288913 - RNA, 64 nt, Homo Sapiens; identical to SEQ ID NO: 107725

SEQ ID NO: 288914 - RNA, 64 nt, Homo Sapiens; identical to SEQ ID NO: 107726

SEQ ID NO: 288915 - RNA, 64 nt, Homo Sapiens; identical to SEQ ID NO: 107727

SEQ ID NO: 288916 - RNA, 64 nt, Homo Sapiens; identical to SEQ ID NO: 107728

SEQ ID NO: 288917 - RNA, 64 nt, Homo Sapiens; identical to SEQ ID NO: 107729

SEQ ID NO: 288918 - RNA, 64 nt, Homo Sapiens; identical to SEQ ID NO: 107730

SEQ ID NO: 288919 - RNA, 64 nt, Homo Sapiens; identical to SEQ ID NO: 107731

SEQ ID NO: 288920 - RNA, 64 nt, Homo Sapiens; identical to SEQ ID NO: 107732

SEQ ID NO: 288921 - RNA, 64 nt, Homo Sapiens; identical to SEQ ID NO: 107733

SEQ ID NO: 288922 - RNA, 64 nt, Homo Sapiens; identical to SEQ ID NO: 107734

SEQ ID NO: 288923 - RNA, 64 nt, Homo Sapiens; identical to SEQ ID NO: 107735

SEQ ID NO: 288924 - RNA, 64 nt, Homo Sapiens; identical to SEQ ID NO: 107736

SEQ ID NO: 288925 - RNA, 64 nt, Homo Sapiens; identical to SEQ ID NO: 107737

SEQ ID NO: 288926 - RNA, 64 nt, Homo Sapiens; identical to SEQ ID NO: 107738

SEQ ID NO: 288927 - RNA, 64 nt, Homo Sapiens; identical to SEQ ID NO: 107739

SEQ ID NO: 288928 - RNA, 60 nt, Homo Sapiens; identical to SEQ ID NO: 107740

SEQ ID NO: 288929 - RNA, 64 nt, Homo Sapiens; identical to SEQ ID NO: 107741

SEQ ID NO: 288930 - RNA, 64 nt, Homo Sapiens; identical to SEQ ID NO: 107742

SEQ ID NO: 288931 - RNA, 64 nt, Homo Sapiens; identical to SEQ ID NO: 107743

SEQ ID NO: 288932 - RNA, 64 nt, Homo Sapiens; identical to SEQ ID NO: 107744

SEQ ID NO: 288933 - RNA, 64 nt, Homo Sapiens; identical to SEQ ID NO: 107745

SEQ ID NO: 288934 - RNA, 64 nt, Homo Sapiens; identical to SEQ ID NO: 107746

SEQ ID NO: 288935 - RNA, 64 nt, Homo Sapiens; identical to SEQ ID NO: 107747

SEQ ID NO: 288936 - RNA, 64 nt, Homo Sapiens; identical to SEQ ID NO: 107748

SEQ ID NO: 288937 - RNA, 64 nt, Homo Sapiens; identical to SEQ ID NO: 107749

SEQ ID NO: 288938 - RNA, 64 nt, Homo Sapiens; identical to SEQ ID NO: 107750

SEQ ID NO: 288939 - RNA, 64 nt, Homo Sapiens; identical to SEQ ID NO: 107751

SEQ ID NO: 288940 - RNA, 64 nt, Homo Sapiens; identical to SEQ ID NO: 107752

SEQ ID NO: 288941 - RNA, 64 nt, Homo Sapiens; identical to SEQ ID NO: 107753

SEQ ID NO: 288942 - RNA, 64 nt, Homo Sapiens; identical to SEQ ID NO: 107754

SEQ ID NO: 288943 - RNA, 64 nt, Homo Sapiens; identical to SEQ ID NO: 107755

SEQ ID NO: 288944 - RNA, 64 nt, Homo Sapiens; identical to SEQ ID NO: 107756

SEQ ID NO: 288945 - RNA, 64 nt, Homo Sapiens; identical to SEQ ID NO: 107757

SEQ ID NO: 288946 - RNA, 64 nt, Homo Sapiens; identical to SEQ ID NO: 107758

SEQ ID NO: 288947 - RNA, 64 nt, Homo Sapiens; identical to SEQ ID NO: 107759

SEQ ID NO: 288948 - RNA, 64 nt, Homo Sapiens; identical to SEQ ID NO: 107760

SEQ ID NO: 288949 - RNA, 64 nt, Homo Sapiens; identical to SEQ ID NO: 107761

SEQ ID NO: 288950 - RNA, 64 nt, Homo Sapiens; identical to SEQ ID NO: 107762

SEQ ID NO: 288951 - RNA, 64 nt, Homo Sapiens; identical to SEQ ID NO: 107763

SEQ ID NO: 288952 - RNA, 64 nt, Homo Sapiens; identical to SEQ ID NO: 107764

SEQ ID NO: 288953 - RNA, 64 nt, Homo Sapiens; identical to SEQ ID NO: 107765

SEQ ID NO: 288954 - RNA, 64 nt, Homo Sapiens; identical to SEQ ID NO: 107766

SEQ ID NO: 288955 - RNA, 64 nt, Homo Sapiens; identical to SEQ ID NO: 107767

SEQ ID NO: 288956 - RNA, 64 nt, Homo Sapiens; identical to SEQ ID NO: 107768

SEQ ID NO: 288957 - RNA, 64 nt, Homo Sapiens; identical to SEQ ID NO: 288888

SEQ ID NO: 288958 - RNA, 64 nt, Homo Sapiens; identical to SEQ ID NO: 288889

SEQ ID NO: 288959 - RNA, 64 nt, Homo Sapiens; identical to SEQ ID NO: 288890

SEQ ID NO: 288960 - RNA, 64 nt, Homo Sapiens; identical to SEQ ID NO: 288891

SEQ ID NO: 288961 - RNA, 64 nt, Homo Sapiens
gauccuggaccugggaggccccugugagggccagcucuggaaaaaccugggaguugaugccgga

SEQ ID NO: 288962 - RNA, 64 nt, Homo Sapiens
uggcaacugucacgugugcuagaagguucgaugccucuggaaugcaugugauacucaucuccau

SEQ ID NO: 288963 - RNA, 64 nt, Homo Sapiens
caagaaaccaaagucugccgcccaccucgcuccccucuggaaucuuccccaagggccaaaccca

SEQ ID NO: 288964 - RNA, 64 nt, Homo Sapiens
ucaucuccugacccucccacucccaucuccuuaccucuggaaccccccaggcccuacaaugcuc

SEQ ID NO: 288965 - RNA, 64 nt, Homo Sapiens
ugacauuccuccauguccucacggcuggauuucucucuggaaaggauuuucauucaucauggug

SEQ ID NO: 288966 - RNA, 64 nt, Homo Sapiens
acccucuguaggccaguaguucucaaaguguggucucuggaagagcaguaucagcaucaucugg

SEQ ID NO: 288967 - RNA, 64 nt, Homo Sapiens
uccccgguugcuggucagguccccauggcuuguucucuggaaccugacuuuagauguuuuggga

SEQ ID NO: 288968 - RNA, 64 nt, Homo Sapiens
uagggguggcgcucagaccccacccuacgcucaucucuggaaggggcagcccugaguggucacu

SEQ ID NO: 288969 - RNA, 64 nt, Homo Sapiens
gccucauauggugauaugccauacuggaagccaccucuggaaaaggaagacccccuccagaagc

SEQ ID NO: 288970 - RNA, 64 nt, Homo Sapiens
gcugggcaugggucauggccugucuccccauguccucuggaacaggcccuuugccagacagcuc

SEQ ID NO: 288971 - RNA, 64 nt, Homo Sapiens
cuugcccucuccucaccuccuuuucucucagugacucuggaaccugaaugcagcuuacaagaca

SEQ ID NO: 288972 - RNA, 64 nt, Homo Sapiens
caggagcuagcagaaaauaacucaaaguugaagacucuggaagauuuugcuuuaaccuaacucg

SEQ ID NO: 288973 - RNA, 64 nt, Homo Sapiens
aggcucuggacagcagaagcgccagauucugccucucuggaaagccucacuauucuuggaccau

SEQ ID NO: 288974 - RNA, 64 nt, Homo Sapiens
uuuuucccuccccagaaucauuggccggcggcuacucuggaauggagucccuaccugcuucacg

SEQ ID NO: 288975 - RNA, 64 nt, Homo Sapiens
gcugguucaaggcuguuuggccacuaggggcagucucuggaaggagccugcacugcccaguggg

SEQ ID NO: 288976 - RNA, 64 nt, Homo Sapiens
ugggucagaaccuucucucuugugcaguuuggggcucuggaauugcagaugucacaggauuaaa

SEQ ID NO: 288977 - RNA, 64 nt, Homo Sapiens
ccuuuguaaauagguguguuccucgaaaagugggcucuggaauccucucggggucuuuccucag

SEQ ID NO: 288978 - RNA, 64 nt, Homo Sapiens
gcgccaggaaaagcuuccguuaguucgcaugguucucuggaaacaauucuggugagggacauug

SEQ ID NO: 288979 - RNA, 64 nt, Homo Sapiens
uucccucuaccacugggcacgcuuccucagacgacucuggaagcagggguagucccucucaccu

SEQ ID NO: 288980 - RNA, 52 nt, Homo Sapiens; identical to SEQ ID NO: 69449

SEQ ID NO: 288981 - RNA, 64 nt, Homo Sapiens
gccguagcaugauugcgcucauggauacagauggcucuggaaagcucaaccugcaggaguucca

SEQ ID NO: 288982 - RNA, 64 nt, Homo Sapiens
cucuggaaagcucaaccugcaggaguuccaccaccucuggaacaagauuaaggccuggcaggug

SEQ ID NO: 288983 - RNA, 64 nt, Homo Sapiens
gauguccccaccacuccuggagucccaaugacuucucuggaaagacaaagagguuaucacaaaa

SEQ ID NO: 288984 - RNA, 64 nt, Homo Sapiens
acauuguuuuauaaagaacgugauuuccagugaucucuggaagcgcuaaagcuaaaauuucugu

SEQ ID NO: 288985 - RNA, 64 nt, Homo Sapiens
gcugauuuuauggacugaggugccuggaaccuuccucuggaaguuuucucgaugugcacuguga

SEQ ID NO: 288986 - RNA, 64 nt, Homo Sapiens
acacuagugugagccuucagauuaaaacugucaccucuggaaauuaagcgucuccaauaugacu

SEQ ID NO: 288987 - RNA, 64 nt, Homo Sapiens
aaaagagccuugucugaccucuccaggccgcugucucuggaaguggccuacauucuucccgagg

SEQ ID NO: 288988 - RNA, 64 nt, Homo Sapiens
cacgucuuagcuucugaacacaugccuggccuggcucuggaagucccacagucaggggccucca

SEQ ID NO: 288989 - RNA, 64 nt, Homo Sapiens
uacccaucagcccuugcaagucccccacucaggccucuggaagguccagggaugggcucugaug

SEQ ID NO: 288990 - RNA, 64 nt, Homo Sapiens
cugcuaugaggguguauauauuuuuuacccaaagcucuggaauuguacauuuauuuuuuaaaac

SEQ ID NO: 288991 - RNA, 64 nt, Homo Sapiens
gagaacugggaacauugcauccauggguugaugucucuggaagugcaaccacccaaugucucug

SEQ ID NO: 288992 - RNA, 64 nt, Homo Sapiens
gguugaugucucuggaagugcaaccacccaaugucucuggaagugccaccuggaagugccaccu

SEQ ID NO: 288993 - RNA, 64 nt, Homo Sapiens
ggaagugccaccuggaagugccaccuggaagugucucuggaagagcacccaccacuguucagcc

SEQ ID NO: 288994 - RNA, 64 nt, Homo Sapiens
gaggcaguagcaaagagauguccuucuugugcugcucuggaagaccccgcaaguccauuuuauu

SEQ ID NO: 288995 - RNA, 64 nt, Homo Sapiens
gacaccccagccagggacgggaucaucucugucacucuggaagggcucaccuugagcagccuca

SEQ ID NO: 288996 - RNA, 64 nt, Homo Sapiens
caccguggcagaaaccgaggaagccugacagaaucucuggaaugauugagcuccaagcacagca

SEQ ID NO: 288997 - RNA, 64 nt, Homo Sapiens
ugagcuccaagcacagcaaaacgcacagccagugcucuggaaauauggagaucuuggaacugaa

SEQ ID NO: 288998 - RNA, 64 nt, Homo Sapiens
ccuauucaauacauuaugcuuaaauuagcaguuucucuggaauuccugucucuccuuuaaaaga

SEQ ID NO: 288999 - RNA, 64 nt, Homo Sapiens
uuguugauaucgucauauaaagccauugcaaggacucuggaaacugccgccaaugaccaauuuc

SEQ ID NO: 289000 - RNA, 64 nt, Homo Sapiens
ucugugauccuuugcagguuccaguucucccugacucuggaaccacucuggaaccucugugacg

SEQ ID NO: 289001 - RNA, 64 nt, Homo Sapiens
ucugugacgccaguucucccucaguucucccugacucuggaaccauuucacucagcugcuccuc

SEQ ID NO: 289002 - RNA, 64 nt, Homo Sapiens
aucucugggguuugcuuguugcauguuacauuugcucuggaaacggcucuguguacagcgcugu

SEQ ID NO: 289003 - RNA, 64 nt, Homo Sapiens
ccaaagcagcucaucccuucguagccagugagugcucuggaaaggguggaauacccaaggucau

SEQ ID NO: 289004 - RNA, 64 nt, Homo Sapiens
ucuuuguguuagggucucgauuuucuaagccacucucuggaauccauugguaagaguagcuggg

SEQ ID NO: 289005 - RNA, 64 nt, Homo Sapiens
gugcuccucacaaaguuuccggcugcugugggcccucuggaauugugucacgccaggaggcugu

SEQ ID NO: 289006 - RNA, 64 nt, Homo Sapiens
uggcaguguguaaagcacuggcacggaugauaagcucuggaagcccuuggcgucuguucuggga

SEQ ID NO: 289007 - RNA, 64 nt, Homo Sapiens
cacaguguugugcaccaggaaacugggcacuucccucuggaaaucacaacaguaucuuaaguuu

SEQ ID NO: 289008 - RNA, 64 nt, Homo Sapiens
cugauucagccagcauggauugcucuggucccaccucuggaaauggagcucuuuaaaaauaaau

SEQ ID NO: 289009 - RNA, 64 nt, Homo Sapiens
aggauauaaaagggacaaaaggguuuuaucauuuugccuaaaauguacauuccuguuauuuucu

SEQ ID NO: 289010 - RNA, 64 nt, Homo Sapiens
gaucuuuguugguaugcauauuucugaaugcaagugccuaaaaagcuuauuuauaaaaggaaug

SEQ ID NO: 289011 - RNA, 64 nt, Homo Sapiens
uacuguaccauccauaaugcaggacauuucuuacugccuaaauuucacaccauugcucuuuuaa

SEQ ID NO: 289012 - RNA, 64 nt, Homo Sapiens
auucuauaauuuauuugcuucauaaagauucaccugccuaaacaauauugaaguauccauaggg

SEQ ID NO: 289013 - RNA, 64 nt, Homo Sapiens
aguugugcuuuuuuaaaaggacuuaaccucugugugccuaaacauggguggauuuguguaaguc

SEQ ID NO: 289014 - RNA, 64 nt, Homo Sapiens
ucaguauguuccuuaaguuuauuccccuaaauuuugccuaaaauuguuuuccaucuaugucccg

SEQ ID NO: 289015 - RNA, 64 nt, Homo Sapiens
uaauaaauucuucuuaccugacguaacuucucaaugccuaaauucuguaguugaagcucugcug

SEQ ID NO: 289016 - RNA, 64 nt, Homo Sapiens
cuaauaauugagggugcuaauuuucuuaagauagugccuaaaacacuaaauuucagucaagucg

SEQ ID NO: 289017 - RNA, 64 nt, Homo Sapiens
acccugaugaaaccuugaaguucugaaauuuaacugccuaaaauguucuccuuagaugugagag

SEQ ID NO: 289018 - RNA, 64 nt, Homo Sapiens
ggagagaaaaaauuaacuagguugcuacuuuauuugccuaaauacuuuuuucuauuuuguuaga

SEQ ID NO: 289019 - RNA, 64 nt, Homo Sapiens
augcaugaugaaugaaugaauuucaguuguacauugccuaaaucauaacuugaugaugcuuggg

SEQ ID NO: 289020 - RNA, 64 nt, Homo Sapiens
agcggaauguaaaacggaaauacugaaagacuuuugccuaaaguggcauuauugacugcuggug

SEQ ID NO: 289021 - RNA, 64 nt, Homo Sapiens
ggcauuauugacugcugguguacugaaagacuuuugccuaaaguagcggaauguaaaacggaaa

SEQ ID NO: 289022 - RNA, 64 nt, Homo Sapiens
auaacuugaugaugcuuggguuucaguuguacauugccuaaaucaugcaugaugaaugaaugaa

SEQ ID NO: 289023 - RNA, 64 nt, Homo Sapiens
uagcuuauucuaggaaugccugauucuuuaauauugccuaaaucggaaccuuuuucuauguugc

SEQ ID NO: 289024 - RNA, 64 nt, Homo Sapiens
uggcggcaaguaaguaucauaguauuaagaaauuugccuaaaucugaguugugccuuucuuuac

SEQ ID NO: 289025 - RNA, 64 nt, Homo Sapiens
uaagauuccuacacuuuauuuggacuuaaguaguugccuaaauuuacuggaaggaaauauuuuc

SEQ ID NO: 289026 - RNA, 64 nt, Homo Sapiens
ccaggccccuuucucagggguggcauaccgcaggugccuaaaucguuaugccugggagugccac

SEQ ID NO: 289027 - RNA, 64 nt, Homo Sapiens
uguuacucauacucgggugggcuccuuagucagaugccuaaaacauuuugccuaaagcucgaug

SEQ ID NO: 289028 - RNA, 64 nt, Homo Sapiens
gggugggcuccuuagucagaugccuaaaacauuuugccuaaagcucgauggguucuggaggaca

SEQ ID NO: 289029 - RNA, 64 nt, Homo Sapiens; identical to SEQ ID NO: 119409

SEQ ID NO: 289030 - RNA, 64 nt, Homo Sapiens; identical to SEQ ID NO: 119410

SEQ ID NO: 289031 - RNA, 64 nt, Homo Sapiens; identical to SEQ ID NO: 119411

SEQ ID NO: 289032 - RNA, 64 nt, Homo Sapiens; identical to SEQ ID NO: 119412

SEQ ID NO: 289033 - RNA, 64 nt, Homo Sapiens; identical to SEQ ID NO: 119413

SEQ ID NO: 289034 - RNA, 64 nt, Homo Sapiens; identical to SEQ ID NO: 119414

SEQ ID NO: 289035 - RNA, 64 nt, Homo Sapiens; identical to SEQ ID NO: 119415

SEQ ID NO: 289036 - RNA, 64 nt, Homo Sapiens; identical to SEQ ID NO: 119415

SEQ ID NO: 289037 - RNA, 64 nt, Homo Sapiens; identical to SEQ ID NO: 119417

SEQ ID NO: 289038 - RNA, 64 nt, Homo Sapiens; identical to SEQ ID NO: 119418

SEQ ID NO: 289039 - RNA, 64 nt, Homo Sapiens; identical to SEQ ID NO: 119419

SEQ ID NO: 289040 - RNA, 64 nt, Homo Sapiens; identical to SEQ ID NO: 119420

SEQ ID NO: 289041 - RNA, 64 nt, Homo Sapiens; identical to SEQ ID NO: 119421

SEQ ID NO: 289042 - RNA, 64 nt, Homo Sapiens; identical to SEQ ID NO: 119422

SEQ ID NO: 289043 - RNA, 64 nt, Homo Sapiens; identical to SEQ ID NO: 119423

SEQ ID NO: 289044 - RNA, 64 nt, Homo Sapiens; identical to SEQ ID NO: 119424

SEQ ID NO: 289045 - RNA, 64 nt, Homo Sapiens; identical to SEQ ID NO: 119425

SEQ ID NO: 289046 - RNA, 64 nt, Homo Sapiens; identical to SEQ ID NO: 119426

SEQ ID NO: 289047 - RNA, 51 nt, Homo Sapiens; identical to SEQ ID NO: 119427

SEQ ID NO: 289048 - RNA, 64 nt, Homo Sapiens; identical to SEQ ID NO: 119428

SEQ ID NO: 289049 - RNA, 64 nt, Homo Sapiens
augagccaccgcgcccggcccacucugccauugucuaagccaccucugaaagcagguuuuaaca

SEQ ID NO: 289050 - RNA, 64 nt, Homo Sapiens
uagugucauccacagcaguucauccucauccacacuaagccauccuguuagcuuuuaaaggaag

SEQ ID NO: 289051 - RNA, 64 nt, Homo Sapiens
caucucucauaggugcaaccugagagugggggagcuaagccaugagguaggggcaggcaagaga

SEQ ID NO: 289052 - RNA, 64 nt, Homo Sapiens
cuuggugcugggaaccucaggguauugcuugccacuaagccaugaaaccagagacaaaaucucu

SEQ ID NO: 289053 - RNA, 50 nt, Homo Sapiens
agguguaccagauacgaugacuaagccagggccccuggaucuccucccuu

SEQ ID NO: 289054 - RNA, 64 nt, Homo Sapiens
cagacaguguacaaacuaagaaggccuaacugaacuaagccauauuuaucacccguggacagca

SEQ ID NO: 289055 - RNA, 64 nt, Homo Sapiens
uuguauaauacccuaucaugugaguauaccuuaacuaagccauucccauauucaacauuuugug

SEQ ID NO: 289056 - RNA, 64 nt, Homo Sapiens
uagugugguugguauggaauccuugcuggcuuuacuaagccagccacacuuggagucugccccc

SEQ ID NO: 289057 - RNA, 64 nt, Homo Sapiens
ggccccuuggucuugaauuuccuagccucuacaacuaagccaaauaaauuucuguuuauuauaa

SEQ ID NO: 289058 - RNA, 64 nt, Homo Sapiens
ugacagcuuuccuuggugacccaaaccuuguagccuaagccauuugucuuuuucucaguggagg

SEQ ID NO: 289059 - RNA, 64 nt, Homo Sapiens
guaauucuucagauaugagauagugggcuuagaccuaagccauacauauuucuuuucccacauu

SEQ ID NO: 289060 - RNA, 64 nt, Homo Sapiens
aucaaccacuaacaucucaagaaagcagauacaccuaagccaucucauugcucagccccaauga

SEQ ID NO: 289061 - RNA, 64 nt, Homo Sapiens
augauaaaaaaaaccuucaauucauuuaaauaaucuaagccaagaaaauggggaggcuugggau

SEQ ID NO: 289062 - RNA, 64 nt, Homo Sapiens
gggacgguggccagagaugcugaagccuccaacccuaagccacucagugccauuguuuugccag

SEQ ID NO: 289063 - RNA, 64 nt, Homo Sapiens
uaugaggguaaucgagaugaguaacagaaucaaacuaagccaugauaaugauucacagaauuua

SEQ ID NO: 289064 - RNA, 64 nt, Homo Sapiens
acauuugaccuuugacauuuucucccuuauaguccuaagccaagaccucauuauuuguccuauc

SEQ ID NO: 289065 - RNA, 64 nt, Homo Sapiens
ggcccucuaggaggggcagacccacucaacacaccuaagccagucaugggaggaggaggugggg

SEQ ID NO: 289066 - RNA, 64 nt, Homo Sapiens
cugcccugaugcuaggaagcguagcaggggccuccuaagccaggccacagaugccacuacuucu

SEQ ID NO: 289067 - RNA, 64 nt, Homo Sapiens
ucagccuuccaagcugcuuaacuggggcaccgaacuaagccagccuuuaccccagcaggcugcc

SEQ ID NO: 289068 - RNA, 64 nt, Homo Sapiens
auaugugcuuuucaaccaguguuuuuaccaagagcuaagccaauuucguuuaaauuaaucugca

SEQ ID NO: 289069 - RNA, 64 nt, Homo Sapiens
ggccgcccaugcugagcucaaggcacacucagcgcuaagccaaaaggcaggagccaguccgugc

SEQ ID NO: 289070 - RNA, 64 nt, Homo Sapiens
gugcuuacagugaggcgagaaggugcagagagcucuaagccaguagggaaggaggggaaaaggg

SEQ ID NO: 289071 - RNA, 64 nt, Homo Sapiens
uucaauaaucaguuuacugcucuuucagggauuucuaagccaccagaaucucacaugagaugug

SEQ ID NO: 289072 - RNA, 64 nt, Homo Sapiens
uguguaccaagaaccccuagcaucagccucauuccuaagccaauaacgccuguauggaguuggu

SEQ ID NO: 289073 - RNA, 64 nt, Homo Sapiens
agccagggggaaagcccagcucucuuuaaaccagcuaagccauuccagucuccugugaagccaa

SEQ ID NO: 289074 - RNA, 64 nt, Homo Sapiens
agaaguggauggacacuucgccauccaggcagaacuaagccaggcauaaccacagccaagcaga

SEQ ID NO: 289075 - RNA, 64 nt, Homo Sapiens
gcuuaaauaauacguaaugggacuagauggcccacuaagccacuguuauuuuccuuccucucug

SEQ ID NO: 289076 - RNA, 64 nt, Homo Sapiens
gcagccuccaggugcuuucauuuucacuuccagucuaagccaguggcuccugccacugcccucc

SEQ ID NO: 289077 - RNA, 64 nt, Homo Sapiens
uggccuaaagaugcaauaagucagauggguagcacuaagccagcuuggguaguaaucugggggu

SEQ ID NO: 289078 - RNA, 64 nt, Homo Sapiens
auauccccugugcccugcacccucugagcccaagcuaagccaucggaaauuacccacugucagg

SEQ ID NO: 289079 - RNA, 64 nt, Homo Sapiens
caccuccaauuuguacaacauggucagcucuggacuaagccaccgccauggaucgaugucaggg

SEQ ID NO: 289080 - RNA, 64 nt, Homo Sapiens
uugaugugaaaagcacagcucuuuccuccaagaacuaagccaacuacaauuuuagucacuaaga

SEQ ID NO: 289081 - RNA, 64 nt, Homo Sapiens
aauaaaagaaaaguagagauaaaauguugaaagccuaagccaggauauuucuucacauaucuga

SEQ ID NO: 289082 - RNA, 64 nt, Homo Sapiens
agcuguaaacucaucucuuuaauagaguuacucucuaagccagauuauguuucucaucuaauca

SEQ ID NO: 289083 - RNA, 64 nt, Homo Sapiens
auggaaaauucaccaggacuaccauuuaaggacucuaagccagaaguugggaaaacaccugacc

SEQ ID NO: 289084 - RNA, 64 nt, Homo Sapiens
cguuuuucagacugcagaauagaugucuauuuuucuaagccaaauaaugcccuuucuuuaucug

SEQ ID NO: 289085 - RNA, 64 nt, Homo Sapiens
acccagaaacucagaguugacuagugaggagugccuaagccaggucccuccuuccgggccugcu

SEQ ID NO: 289086 - RNA, 64 nt, Homo Sapiens
agugacauuuaaugcccaauauguaugaauagaucuaagccauuuaauuuuuuuuccuuaaaga

SEQ ID NO: 289087 - RNA, 64 nt, Homo Sapiens
ccuaguaguuccugaaacugugagcaccacugcacuaagccagugcggagcuguuagggacggg

SEQ ID NO: 289088 - RNA, 64 nt, Homo Sapiens
aagucagcaauuaaguguucccacuagaacugaccuaagccacugauuaauauuuaaugaggga

SEQ ID NO: 289089 - RNA, 64 nt, Homo Sapiens
auaaacaaggagaguuuuugugugugcgagaucucuaagccagcgugggagggagcgccucagg

SEQ ID NO: 289090 - RNA, 64 nt, Homo Sapiens
acccaggcucccuuugcacacagagcagcuacuucuaagccauaucgacuguuuugcagaggau

SEQ ID NO: 289091 - RNA, 64 nt, Homo Sapiens
gccaaauagaguguggauucauuucaggggcuagcuaagccaagaggcagugguuugggcuugu

SEQ ID NO: 289092 - RNA, 64 nt, Homo Sapiens
ccuucgaaaccucaacacgaggccuaagaauuuccuaagccaugucuuguaccauagugccaca

SEQ ID NO: 289093 - RNA, 64 nt, Homo Sapiens
gcugagugacuguaggcagggaaccuuaaccucucuaagccacagcuucuucaucuuuaaaaua

SEQ ID NO: 289094 - RNA, 64 nt, Homo Sapiens
caggcagucuguacauugauagacuuuugaugugcuaagccagauggugguuugagccuugauu

SEQ ID NO: 289095 - RNA, 64 nt, Homo Sapiens
ggagacacugauguaugagguucaaagugagcuccuaagccaugaguggugacugugggcucca

SEQ ID NO: 289096 - RNA, 64 nt, Homo Sapiens
uggaucucugguugucuaguuuggauaaguagggcuaagccaguuucuuauuggaaauguacuu

SEQ ID NO: 289097 - RNA, 64 nt, Homo Sapiens
caccugggcagccacuucaucuggagaucuaguccuaagccacacaaugccaacuuugugcaac

SEQ ID NO: 289098 - RNA, 64 nt, Homo Sapiens
aaauaaaaggauaaaugaaucuaucuucuaggaucuaagccacuaaaaugauuuuauagggaau

SEQ ID NO: 289099 - RNA, 64 nt, Homo Sapiens
ucaggauuuuuuuuuuuuaacauaguuuauaucacuaagccacugaaccacccacaccucucuc

SEQ ID NO: 289100 - RNA, 64 nt, Homo Sapiens
uggcugggauuuaaagccuuacaucucauggcagcuaagccacaagacaacauuucucaaaugc

SEQ ID NO: 289101 - RNA, 64 nt, Homo Sapiens
agcccccgagaggggacuugcugugcucuaggagcuaagccagcagugguggggccagagggcu

SEQ ID NO: 289102 - RNA, 64 nt, Homo Sapiens
ucccugaacucacugucuuuucuccacacuuguccuaagccaagguagauuuguacguagacag

SEQ ID NO: 289103 - RNA, 64 nt, Homo Sapiens
uucagaucagaucuggccuauuuucauauuuauccuaagccaucaaaugggguagugccucuua

SEQ ID NO: 289104 - RNA, 64 nt, Homo Sapiens
caaucauauuuucucuucuaucuuugaaauuauucuaagccaaagaaaacuaugaaugaaagua

SEQ ID NO: 289105 - RNA, 64 nt, Homo Sapiens
ucuuaagacuucucuguccuaggucaggggaaugcuaagccaguugcagaauugcuagguaaag

SEQ ID NO: 289106 - RNA, 64 nt, Homo Sapiens
aaacuuucacuuugaaaaaugagaauuuuauauucuaagccaguuuucauuuugguuuuguguu

SEQ ID NO: 289107 - RNA, 64 nt, Homo Sapiens
agaaacacaguuuugaaagaaaaauaccaugucucuaagccaacuuuaauugcuuaaaagacau

SEQ ID NO: 289108 - RNA, 64 nt, Homo Sapiens
agaaauuuauagcauuuacuguguuauuuaaaugcuaagccaaaguaucugcacuuagguauac

SEQ ID NO: 289109 - RNA, 64 nt, Homo Sapiens
aaauaauuuucaagcaaaguauugugaaaguauucuaagccaaguuuuaaauauuaucuaacag

SEQ ID NO: 289110 - RNA, 64 nt, Homo Sapiens
uccauuucauggaccaacugaucaauugccaguacuaagccacucauuguuauggcuuccuuuu

SEQ ID NO: 289111 - RNA, 64 nt, Homo Sapiens
uggggggcgggguggagaggaggacccccauuggcuaagccaagcuccaguuacaagacaacac

SEQ ID NO: 289112 - RNA, 64 nt, Homo Sapiens
gaccugguccuaaguuaagguaaauauacuuuaacuaagccaguaccuuggaaacuaucaaaua

SEQ ID NO: 289113 - RNA, 64 nt, Homo Sapiens
aagaacuccaugcuuugcuauagaaagcacuacccuaagccaugaccaaaaaggacuuuuugua

SEQ ID NO: 289114 - RNA, 64 nt, Homo Sapiens
guuuuucaacuauguuuaucgcaugucucuaccucuaagccaguuuacuguucuccaugugucg

SEQ ID NO: 289115 - RNA, 64 nt, Homo Sapiens
agaaauuugauuucuauucaacuuaacauauuuacuaagccacacaacuuucuguaaacucaaa

SEQ ID NO: 289116 - RNA, 64 nt, Homo Sapiens
cgcacugaaggaguggggagacacucccuucccccuaagccaacuccccggggaagggcagaug

SEQ ID NO: 289117 - RNA, 64 nt, Homo Sapiens
gucagaacagucaaucugcauucagccccaggcccuaagccagcccuugcucaagguccccagc

SEQ ID NO: 289118 - RNA, 64 nt, Homo Sapiens
ccauagaguuuucacagccuauaucgcaaauuuucuaagccacguccuauaggacagaggagac

SEQ ID NO: 289119 - RNA, 64 nt, Homo Sapiens
aguuuaucaaucaguuaucuuaagucagcauuuucuaagccauuguuugaggaaacagugacaa

SEQ ID NO: 289120 - RNA, 64 nt, Homo Sapiens
uaggcugcaaggaaagaggccaagggccaagcugcuaagccaaagauggccccugacaccuccc

SEQ ID NO: 289121 - RNA, 64 nt, Homo Sapiens
ggcucugcuucuccuccugagccucugucgggggcuaagccagccuggcgccccugcagauucc

SEQ ID NO: 289122 - RNA, 64 nt, Homo Sapiens
accauaacuaaauaucugcauguaccaagagucccuaagccacccccuccaaagauggagugua

SEQ ID NO: 289123 - RNA, 64 nt, Homo Sapiens
ucagagaacacggggagcgggagguuccuucaagcuaagccagccgauccgggcuugguuuugu

SEQ ID NO: 289124 - RNA, 64 nt, Homo Sapiens
uuaaguccaaggagaagaaggccgacucagggaccuaagccacggucuccucugggaggucuug

SEQ ID NO: 289125 - RNA, 64 nt, Homo Sapiens
auaugaauuagcaauucuuagaaguaaaacuauucuaagccauuuccauuauugaucacaguau

SEQ ID NO: 289126 - RNA, 64 nt, Homo Sapiens
gcauggauaaaggagacagcccuaaaggaacuuacuaagccagcccuuugggauucaguaccaa

SEQ ID NO: 289127 - RNA, 64 nt, Homo Sapiens
cuuauccaggacucugucaauuucccugacuccucuaagccacucuuccaaaggcauaagaccc

SEQ ID NO: 289128 - RNA, 64 nt, Homo Sapiens
uuuguaaggaagaucauaaaugcuaaaaauuccacuaagccauucaguucuuccuuuugccuac

SEQ ID NO: 289129 - RNA, 64 nt, Homo Sapiens
uaaagagcaauugaaucuucuagcuuuagcaaaccuaagccaaaggaaggaaagccaugaagaa

SEQ ID NO: 289130 - RNA, 64 nt, Homo Sapiens
gaaucaaguguauuucaggccuguuugccaucaucuaagccacucaagcuguuuuugagugcca

SEQ ID NO: 289131 - RNA, 64 nt, Homo Sapiens
cuguguucauccagcuacuucacugugacaaugacuaagccaagaagcuucaaagccauaugga

SEQ ID NO: 289132 - RNA, 64 nt, Homo Sapiens
ccugccuccaggccacgaaaugggaauuccagcacuaagccaggcaccgggcagaagcugggcc

SEQ ID NO: 289133 - RNA, 64 nt, Homo Sapiens
uuuuuggucuuuuaccucugaucuuguccccaaccuaagccagcuagcugcgugcucccacucc

SEQ ID NO: 289134 - RNA, 64 nt, Homo Sapiens
cagagggggacugcugcugccuggccacugcucccuaagccagccugguccaugcagggggcuc

SEQ ID NO: 289135 - RNA, 64 nt, Homo Sapiens
uaacacaacaaagugggaccaucucuauucccaucuaagccacucaaauugcugagugcuauua

SEQ ID NO: 289136 - RNA, 64 nt, Homo Sapiens
cugucugucugagucuaaaaccaagcucagguuucuaagccacaugaccuugauuguuaaaugu

SEQ ID NO: 289137 - RNA, 64 nt, Homo Sapiens
uccgcagagaaauguugcucuccauuauucccuucuaagccagagacccuuauccacugcuccu

SEQ ID NO: 289138 - RNA, 64 nt, Homo Sapiens
ccuggcuggaggagcagcagacaguugcccgaaacuaagccaggugggccaucucuuaggugag

SEQ ID NO: 289139 - RNA, 64 nt, Homo Sapiens
accccaaugcgacaaguaguuuuugcaaacccaacuaagccaggaaguuuguguguugugucca

SEQ ID NO: 289140 - RNA, 64 nt, Homo Sapiens
aguggacaugacuuuugucccuuauaaaacauaacuaagccaagucugccuuccauaccccacg

SEQ ID NO: 289141 - RNA, 64 nt, Homo Sapiens
caggucugagggguccagcucuggcagggggugucuaagccacguccaaaugguggacaguagc

SEQ ID NO: 289142 - RNA, 64 nt, Homo Sapiens
gcucagccacaucuuggggucugggaggcccaggcuaagccauguggcagggaccgucuugccc

SEQ ID NO: 289143 - RNA, 64 nt, Homo Sapiens
agaugcuggaacccucacugaaaguccagaaugucuaagccaguguuagauuuuguaaacaagu

SEQ ID NO: 289144 - RNA, 64 nt, Homo Sapiens
gaaaaagagaauuuuucuuuacuacaggcuuuuacuaagccaaggguuugccuagggacgugua

SEQ ID NO: 289145 - RNA, 64 nt, Homo Sapiens
ccaugcccaggagacugguucacauccucauucacuaagccaugaucaaaaucaaaagguaaug

SEQ ID NO: 289146 - RNA, 64 nt, Homo Sapiens
ucaaguugccacucaguauuaaccaugacaccuucuaagccaucaucuccuccuaauccuccca

SEQ ID NO: 289147 - RNA, 64 nt, Homo Sapiens
cuuuguuuacuaaggacuuuggggaggaaccaugcuaagccaugaccagugaggagaagcaaca

SEQ ID NO: 289148 - RNA, 64 nt, Homo Sapiens
uaacaccgugucugauguguaaaagacauuucaucuaagccacuuaucugauaaccaaaaaaaa

SEQ ID NO: 289149 - RNA, 64 nt, Homo Sapiens
cccaccccccacucugcuuugaccccuguuugcacuaagccacccacagcaaagggacugaacu

SEQ ID NO: 289150 - RNA, 64 nt, Homo Sapiens
uagcuauaaagugagggaugaaauaugcaugugacuaagccauggugguuguaaggcuggauug

SEQ ID NO: 289151 - RNA, 64 nt, Homo Sapiens
cucuccugcuuggggaacugauauugauggacuccuaagccaggggggaugcuucugccugcag

SEQ ID NO: 289152 - RNA, 64 nt, Homo Sapiens
aggguauaacacaggcccugucuuugcuaugucccuaagccaaccuuaguaugcucagccuccu

SEQ ID NO: 289153 - RNA, 64 nt, Homo Sapiens
aauugaguuucuggcuccccuaguguuguggaaacuaagccacucuguaccucuuuguagcacg

SEQ ID NO: 289154 - RNA, 64 nt, Homo Sapiens
ggaggcagcgcccugcagcccuagcuccagggcacuaagccacaacucaaccaagcacugcucu

SEQ ID NO: 289155 - RNA, 64 nt, Homo Sapiens
aaugcuuuucuguuaguagaaugcaaaaaccuaccuaagccacauaauaauaaaauucuuuuac

SEQ ID NO: 289156 - RNA, 64 nt, Homo Sapiens
ucuugguuuuguuuuuuuggaaaugagugggccacuaagccacacuuucccuucauccugcuua

SEQ ID NO: 289157 - RNA, 64 nt, Homo Sapiens
uuggucccuuuuccuggcccuuccuuccccacuucuaagccaaagaaaggagaggcaggugcuc

SEQ ID NO: 289158 - RNA, 64 nt, Homo Sapiens
acacagcccacugaacaaggucucagggguauugcuaagccaagaaggaacuuucccacacuac

SEQ ID NO: 289159 - RNA, 64 nt, Homo Sapiens
uccagccugagguggugaaggcaggaugcucucucuaagccagaccagagggacucagacacca

SEQ ID NO: 289160 - RNA, 64 nt, Homo Sapiens
aagcugggacuuaauuggauaauuaaugaaagagcuaagccaucccugggcagaaaaguaucuu

SEQ ID NO: 289161 - RNA, 64 nt, Homo Sapiens
ugcccccagagccacaguucugggaggccuuucccuaagccagccaccaucgucuucuuggcca

SEQ ID NO: 289162 - RNA, 64 nt, Homo Sapiens
aagauuuccucuuugcaaaaaccacacauacccucuaagccagcgaaccauacaaaauuuuucc

SEQ ID NO: 289163 - RNA, 64 nt, Homo Sapiens
augggcccuuucccccucccgcgccuuagagccccuaagccagccacagcaccugugagucugg

SEQ ID NO: 289164 - RNA, 64 nt, Homo Sapiens
aacagaaagacagcaguggcgcaggccagugggccuaagccagaccccagggagcucacgccag

SEQ ID NO: 289165 - RNA, 64 nt, Homo Sapiens
aagacaugggccaucccucccuauuggcaaagaacuaagccagggagcaagagagaauuugugu

SEQ ID NO: 289166 - RNA, 64 nt, Homo Sapiens
ggccauuuuugugggaucuuaucuuucccuaaaucuaagccaguaaugaagaacaucauauaaa

SEQ ID NO: 289167 - RNA, 64 nt, Homo Sapiens
gaccacaauuccuuccaauuucugcggcuccauccuaagccaaauaaauuauacuuuaacaaac

SEQ ID NO: 289168 - RNA, 64 nt, Homo Sapiens
cccccacccaggggauggaggucuacccuggacacuaagccaagugugucagagacagaaggga

SEQ ID NO: 289169 - RNA, 64 nt, Homo Sapiens
uacugaugagacuuccugcugccuuuggacauaacuaagccaggaaacuuuaaaagccuucuag

SEQ ID NO: 289170 - RNA, 64 nt, Homo Sapiens
ucaguaaauguccaaguaauguuuuuauaauaaacuaagccauauuuagacaauaaacauugau

SEQ ID NO: 289171 - RNA, 64 nt, Homo Sapiens
cagaaaacucccauggcucuaggaagaagugacacuaagccaacaccuuucuuuaugugggagc

SEQ ID NO: 289172 - RNA, 64 nt, Homo Sapiens
uaugcaaauaucgcugaauacaaucuagaacaaacuaagccaggacaaaaaaaaugaagacacu

SEQ ID NO: 289173 - RNA, 64 nt, Homo Sapiens
cucucccuccugacagugccacccauucccaggccuaagccagcgagccuggaguacuggcuau

SEQ ID NO: 289174 - RNA, 64 nt, Homo Sapiens
aaauaaauuuuauuccaaaaaggggucauagauccuaagccauacccauucucccucucaaggc

SEQ ID NO: 289175 - RNA, 64 nt, Homo Sapiens
uggauucuuuagcucucuuuuagaaugcccaccucuaagccaauugcaauaauuaaccauaugc

SEQ ID NO: 289176 - RNA, 64 nt, Homo Sapiens
cucacugugaaccacacgaacgcccgcugccaaucuaagccaguggagggcaucugucugccau

SEQ ID NO: 289177 - RNA, 64 nt, Homo Sapiens
ucugagugaaauuugcucauaaagcauuuggauacuaagccauuauuugccauuuuggguacuu

SEQ ID NO: 289178 - RNA, 64 nt, Homo Sapiens
auaaaaugugcagaugcaauuguuugggugauuccuaagccacuugaaauguuagucauuguua

SEQ ID NO: 289179 - RNA, 64 nt, Homo Sapiens
auaucaucccugucuuauuagggauuaccguuuccuaagccaagagucaugucaaauugcaauc

SEQ ID NO: 289180 - RNA, 64 nt, Homo Sapiens
uauccaacauguuugauguuuaagcuagcuuuaccuaagccacuucucagccuccagaauacuc

SEQ ID NO: 289181 - RNA, 64 nt, Homo Sapiens
uaccuuugcacugaaguagacuuccaacauucuccuaagccaguguauugucugaauuucuugu

SEQ ID NO: 289182 - RNA, 64 nt, Homo Sapiens
ggacauauguagacugguuuagagcaugccaauccuaagccauuagguggaccucgugcucauc

SEQ ID NO: 289183 - RNA, 64 nt, Homo Sapiens
aaaauuugcuuuaaacuguuucagagcuucuucccuaagccauaaacugucucaccuaaacaag

SEQ ID NO: 289184 - RNA, 64 nt, Homo Sapiens
gccccugcuggggcagcccguguugccggagccucuaagccaaagagcccguuggccgugguug

SEQ ID NO: 289185 - RNA, 64 nt, Homo Sapiens
cggggcaggccagcaauaaacggauggaggccagcuaagccacucccaaagcaggaagaagcuc

SEQ ID NO: 289186 - RNA, 64 nt, Homo Sapiens
caacagagccuccagcaggguacaucaagggguucuaagccacaccacacuagaggccuauugc

SEQ ID NO: 289187 - RNA, 64 nt, Homo Sapiens
cugucucuguacuguugggaugagagucuuaccacuaagccauuguuaauuuuuaccuuacaug

SEQ ID NO: 289188 - RNA, 64 nt, Homo Sapiens
acugcugcucccuggagcccgcggucuccuuccccuaagccagcgucccauuuagcccugcaca

SEQ ID NO: 289189 - RNA, 64 nt, Homo Sapiens
uuugcugaaaaacauuaugagaaggccucccuuccuaagccaccucuggucuugcuaagucuug

SEQ ID NO: 289190 - RNA, 64 nt, Homo Sapiens
cugagagcuagugaggguucagagaagccccauccuaagccagacacaugaugugggcucagcu

SEQ ID NO: 289191 - RNA, 64 nt, Homo Sapiens
ggaagaaaacaggucccuccaggggugcugcugccuaagccacccacauaaguacgcuggugcc

SEQ ID NO: 289192 - RNA, 64 nt, Homo Sapiens
cuaggcuggucucuguccguccucugagcucaagcuaagccaucauaucccagugaccugcaca

SEQ ID NO: 289193 - RNA, 64 nt, Homo Sapiens
gcugggauuacaggcgugagccacugugcccagccuaagccauuucuuaaaauaaaaaugcuaa

SEQ ID NO: 289194 - RNA, 64 nt, Homo Sapiens
cucuaggcccugggccugccuccccaagggcucacuaagccagaggccaaagugcccccucccg

SEQ ID NO: 289195 - RNA, 64 nt, Homo Sapiens
gccgcccagacaccacagacgccaccuggcggcccuaagccacucccgccacacgcucacucca

SEQ ID NO: 289196 - RNA, 64 nt, Homo Sapiens
agagccucuccagggguggaauacauguccuggacuaagccaaugacaccuuccaucuuuccag

SEQ ID NO: 289197 - RNA, 64 nt, Homo Sapiens
gagguggagguugcagugagccgucaucgcgccacuaagccaagaucgcgccacugcacuccag

SEQ ID NO: 289198 - RNA, 64 nt, Homo Sapiens
ugcgaaagaauaacaccuuuucuugcauucugagcuaagccagacagccuuuauacuagauucu

SEQ ID NO: 289199 - RNA, 64 nt, Homo Sapiens
ccccagcuggaacagcugaagucacaagccuccucuaagccaaggccaguguguucagagguga

SEQ ID NO: 289200 - RNA, 64 nt, Homo Sapiens
caaggaaggaaaauacuaccuguccccuaugccacuaagccaacgugugugucagcugguagcu

SEQ ID NO: 289201 - RNA, 64 nt, Homo Sapiens
aauaggccccugccuggcuccugggagauaaccucuaagccauuagaauaucuugccugauaag

SEQ ID NO: 289202 - RNA, 64 nt, Homo Sapiens
agaccuaagaaaaaaauauuucaugaucauuucccuaagccauuuccagaaugguaaaagguuu

SEQ ID NO: 289203 - RNA, 64 nt, Homo Sapiens
agagucugugagacugccugagaggugggcucagcuaagccacaauguguacuuugauaguaca

SEQ ID NO: 289204 - RNA, 64 nt, Homo Sapiens
ugucaggaucagaaucauggggagggcucugucucuaagccagggcuuuggaggaucaggguag

SEQ ID NO: 289205 - RNA, 64 nt, Homo Sapiens
cccggcuccccuacaccugacagggcauccauuccuaagccagaccacaucccugucacacacc

SEQ ID NO: 289206 - RNA, 64 nt, Homo Sapiens
accggaccagccuggcccaccagcaacuaucagacuaagccagcuggggguccuccuccaggga

SEQ ID NO: 289207 - RNA, 64 nt, Homo Sapiens
ggccucuugcggucccuucuccggcugcuuuucccuaagccaagcccucuccaccccauaguga

SEQ ID NO: 289208 - RNA, 64 nt, Homo Sapiens
agcuggguuaugcaccgccagacgccaaugccuccuaagccaggauggcacacaccugugccca

SEQ ID NO: 289209 - RNA, 64 nt, Homo Sapiens
ugaaacaagauucucuccaugacaaaaccccaaacuaagccauuauuauauaaugauacauuua

SEQ ID NO: 289210 - RNA, 64 nt, Homo Sapiens
cuccucucacagccucuguaacagaggcauuugacuaagccaacuaagugccaugucagugugg

SEQ ID NO: 289211 - RNA, 64 nt, Homo Sapiens
ccaugcagccuuugugccagcauagggcauaagccuaagccauagcgaugucagugagggcgau

SEQ ID NO: 289212 - RNA, 64 nt, Homo Sapiens
uccagaagaacccauagaugccaaaguagagaugcuaagccaaauuucuccauagaauuucccc

SEQ ID NO: 289213 - RNA, 64 nt, Homo Sapiens
aggcuuuaagcuccagcuuuuucuccugcuuguacuaagccaggcaggaguggaaggugaggcg

SEQ ID NO: 289214 - RNA, 64 nt, Homo Sapiens
accucugccuccuggguucaagcgauucuugugccuaagccaccugagcagcugggauuacagg

SEQ ID NO: 289215 - RNA, 64 nt, Homo Sapiens
cacuaggccacgcaucugaucuguagucacaugacuaagccaagaggaaggagcaagacucaag

SEQ ID NO: 289216 - RNA, 64 nt, Homo Sapiens
cgggacccccuggcccugccucauccaccaaucucuaagccaaaccccuaaacucaggagucaa

SEQ ID NO: 289217 - RNA, 64 nt, Homo Sapiens
gagcgaggaggaccaggcagccgccgcugccgcgcuaagccaccaccugcgcuuagguaggcgu

SEQ ID NO: 289218 - RNA, 64 nt, Homo Sapiens
gaaccaaaaaagagcccacauugccaagucaauccuaagccaaaugaauaaagccggaggcauc

SEQ ID NO: 289219 - RNA, 64 nt, Homo Sapiens
acucacacucccagccaccauguuacacuggacucuaagccacuucuuacuccaguaguaaauu

SEQ ID NO: 289220 - RNA, 64 nt, Homo Sapiens
ccacccugggcugggcccagcagaggcccaacgacuaagccagccagccacuucuaagcacaac

SEQ ID NO: 289221 - RNA, 64 nt, Homo Sapiens
cuccguuugcacguuaacucgacuucuggagcugcuaagccacccccuuccccagacagggcug

SEQ ID NO: 289222 - RNA, 64 nt, Homo Sapiens
gaagcgguuaacuuaucuuuuggguauccgaaaacuaagccaggugcaccuccccacucgaaag

SEQ ID NO: 289223 - RNA, 64 nt, Homo Sapiens
aauuucauguuauuuauuaucuuaacccugacuucuaagccauccugucugccuggcugccucc

SEQ ID NO: 289224 - RNA, 64 nt, Homo Sapiens
acccucuacgaacauucuuuguuaauaagaaacccuaagccaagguuugguuccuguucacucu

SEQ ID NO: 289225 - RNA, 64 nt, Homo Sapiens
gagaaaagucaaucugggaagaaaauaaaaauuacuaagccaaacugucacaagcuugugaaag

SEQ ID NO: 289226 - RNA, 64 nt, Homo Sapiens
aauaaugguaugcuguugcucuaccucccagugucuaagccacgcgggucucgguuauccaccc

SEQ ID NO: 289227 - RNA, 64 nt, Homo Sapiens
aggaucccacagugauaaccaggcccuucccuuccuaagccaaaacccauugugacugccuguc

SEQ ID NO: 289228 - RNA, 64 nt, Homo Sapiens
cagucaccuccucggggaccccucaguguagugacuaagccauccacaggccaacucggccaag

SEQ ID NO: 289229 - RNA, 64 nt, Homo Sapiens
uuauaaauuugacuucauuggcaguggaugaagccuaagccagcugagucucuaucauagcuga

SEQ ID NO: 289230 - RNA, 64 nt, Homo Sapiens
cagaggcagaacugaagcccucucggccccuacccuaagccagccaccccucuucacagugggu

SEQ ID NO: 289231 - RNA, 64 nt, Homo Sapiens
uuuaaaaaugguuucauuccguaaauuguuuguucuaagccacugggugcauaguaagugcuca

SEQ ID NO: 289232 - RNA, 64 nt, Homo Sapiens
acuccuuguuugagguaaaacuuucugcuucagccuaagccaguugagcagguccaggacucag

SEQ ID NO: 289233 - RNA, 64 nt, Homo Sapiens
cccagaggucccaucugaagccuccucgaggccccuaagccaccccaacagcugagcugccggg

SEQ ID NO: 289234 - RNA, 64 nt, Homo Sapiens
ucagccugaugucacaaccccuugcuuuccagcccuaagccaucgccccagugcuacacucauc

SEQ ID NO: 289235 - RNA, 64 nt, Homo Sapiens
caauuauuuuauggagggaauuucuucaucuucucuaagccaagaugagacuucuccgugcugu

SEQ ID NO: 289236 - RNA, 64 nt, Homo Sapiens
aggccaaguccacugcccggaagucuugucagcccuaagccagggaagccuggagcguggccug

SEQ ID NO: 289237 - RNA, 64 nt, Homo Sapiens
ccagaguuggagauauuacagucaacuuuggcuucuaagccaguaauuccauucuuaaauaccu

SEQ ID NO: 289238 - RNA, 64 nt, Homo Sapiens
aauaugcuuuauuuauuaaaaugugauuuaaaaucuaagccaugaaguuuucccucaucuguaa

SEQ ID NO: 289239 - RNA, 64 nt, Homo Sapiens
cucuggaaucucuuuguguuaguagcuggguuuucuaagccacuccuuuccccacauugguaag

SEQ ID NO: 289240 - RNA, 64 nt, Homo Sapiens
cuaugauaaugaauaucucuuuugugucuccuuccuaagccauccucagagaguccuuagcaga

SEQ ID NO: 289241 - RNA, 64 nt, Homo Sapiens
ccagacauccugauggggaggcagagccaggaagcuaagccagggcccagcugcguccaaccca

SEQ ID NO: 289242 - RNA, 64 nt, Homo Sapiens
guccugucuggaugacuuauguguuuuccucuuucuaagccaggcuauauuuccuagagcaccu

SEQ ID NO: 289243 - RNA, 64 nt, Homo Sapiens
uguaagaaacucuugauagcuucaccuuuaaacucuaagccaaggauuuauguggagaugauuu

SEQ ID NO: 289244 - RNA, 64 nt, Homo Sapiens
aggggaaguaauuaaggaaacuuaaguaauugaccaaauggaaauagggagugagugguaguua

SEQ ID NO: 289245 - RNA, 64 nt, Homo Sapiens
augcuggccauuuugccuuuaaacccaaaaaaagcaaauggauagaaagugcuauucacccagu

SEQ ID NO: 289246 - RNA, 64 nt, Homo Sapiens
guuggaaaauguucuuucugguagacacacucuccaaauggagugaguuguggcucucagccau

SEQ ID NO: 289247 - RNA, 64 nt, Homo Sapiens
cauacccuuccugaaaugacugugccuaaauggacaaauggaugaccuucugcugggcauagcu

SEQ ID NO: 289248 - RNA, 64 nt, Homo Sapiens
cgcccucugcaaaggccuggauucuaaucucauucaaauggagaguuaucaguggggggacuua

SEQ ID NO: 289249 - RNA, 64 nt, Homo Sapiens
gcuugugaauuugcucucaaugcgaaggucccugcaaauggauguauauaaaaugaaugcagau

SEQ ID NO: 289250 - RNA, 64 nt, Homo Sapiens
accccggaccaguuacauucguuccuggcaaaagcaaauggaaauggucuccugucuccagccu

SEQ ID NO: 289251 - RNA, 64 nt, Homo Sapiens
ccuaaaggguuuuuaagcccuaacacuugucuagcaaauggagagccuaauuuaccaaaaugaa

SEQ ID NO: 289252 - RNA, 64 nt, Homo Sapiens
gaggaggcugagaaaggggaagagaaaaacaaaccaaauggaugauguuagcuuuaggaucgug

SEQ ID NO: 289253 - RNA, 64 nt, Homo Sapiens
uuuguacauagcaccgugcuaggcucugggaucccaaauggacccuuuuaacuuucugaagaug

SEQ ID NO: 289254 - RNA, 64 nt, Homo Sapiens
uacaggaauucucuguaauggggacuuuuaucagcaaauggaguaccacaugguaauuuuuaau

SEQ ID NO: 289255 - RNA, 64 nt, Homo Sapiens
uucaguaccagagaauaaaucagccguuucuauucaaauggaaaaguuucuuucuuccacaaag

SEQ ID NO: 289256 - RNA, 64 nt, Homo Sapiens
aauaguauuauugaagauacuaaaugaugcaaaccaaauggauuuuuuccaugucaugauguaa

SEQ ID NO: 289257 - RNA, 64 nt, Homo Sapiens
uuacgauguaucugugaaaaugggaugauauugacaaauggagacuccuaccucaauaguuaau

SEQ ID NO: 289258 - RNA, 64 nt, Homo Sapiens
aggaauguauccccugccuauuuuccuuguguaacaaauggaaaacauucuccccugugagaaa

SEQ ID NO: 289259 - RNA, 64 nt, Homo Sapiens
gcugcaugggaaagcaaagcagaaaacagugccccaaauggaaaaaagauacucacacagaaca

SEQ ID NO: 289260 - RNA, 64 nt, Homo Sapiens
aaguacuugauaugguaaguuuaacaucugccugcaaauggacaacacgagccaacugcuguau

SEQ ID NO: 289261 - RNA, 64 nt, Homo Sapiens
acagaccugaaucuguugugagaaacaugaaguacaaauggaucugucaucuucaggcguaaag

SEQ ID NO: 289262 - RNA, 64 nt, Homo Sapiens
ggaggaagauugauuuucucaugcuugccuugcccaaauggaauucugaauagccccccacuga

SEQ ID NO: 289263 - RNA, 64 nt, Homo Sapiens
uauuuucuuuaggauaaccucuacuagaaaauaccaaauggauaccuugauugcgguauaugua

SEQ ID NO: 289264 - RNA, 64 nt, Homo Sapiens
guauuuuuuauuuuuuuuuuuuaguagagacaggguuucgcaauguuggccaggccgaucucga

SEQ ID NO: 289265 - RNA, 64 nt, Homo Sapiens
cugaguccacgaccuaggcaaauccugcagugggguuucgcagcuuuucuuuucccucaaucuc

SEQ ID NO: 289266 - RNA, 64 nt, Homo Sapiens
ucuguucaaaggggcaccaguuuguagucccucuguuucgcacagaguacuaugacaaggaaac

SEQ ID NO: 289267 - RNA, 64 nt, Homo Sapiens
cggaagccaggccaacugccccgcgucuucagcuguuucgcauccaccgccaccccacugagag

SEQ ID NO: 289268 - RNA, 64 nt, Homo Sapiens
ccuauuuacuuucaaaacaauuugcauuuagaguguuucgcaucagaauaacaugaguaagaug

SEQ ID NO: 289269 - RNA, 64 nt, Homo Sapiens
cggcuucucacccgcccagcacacgccaagucccguuucgcacuccguuuccuuagcgcccaug

SEQ ID NO: 289270 - RNA, 64 nt, Homo Sapiens
ucuuuuuuucccccucgcucaaaaugugucucauguuucgcaacuuuucaucugcaaacucugc

SEQ ID NO: 289271 - RNA, 64 nt, Homo Sapiens
aguccccagugugauucaauugauugccuuucacguuucgcaaauuuuccaaucucccacucac

SEQ ID NO: 289272 - RNA, 64 nt, Homo Sapiens
ugauuuucaauauuuuauagccaauaguggcugaguuucgcacuuuuuuauuuaguuucuuuag

SEQ ID NO: 289273 - RNA, 64 nt, Homo Sapiens
acccaagacugccgugacuccuaguccaaugucuguuucgcaucacaacacaguaucuuuaaca

SEQ ID NO: 289274 - RNA, 64 nt, Homo Sapiens
cugggcagacccccaggccccagcauagauuccaguuucgcaccuccugggcacuuagguguuu

SEQ ID NO: 289275 - RNA, 64 nt, Homo Sapiens
ugcgggccuggagcgccauagcacagucgauuucguuucgcagcugucuccccuccgcagcaga

SEQ ID NO: 289276 - RNA, 64 nt, Homo Sapiens
cuagguggcauacaggcagccugguagcucggucguuucgcacaaguucucauaaguucuagaa

SEQ ID NO: 289277 - RNA, 64 nt, Homo Sapiens
gcgaccgguuggagaugucuguccaaugcugcugguuucgcagauucuccucggccgaccaccu

SEQ ID NO: 289278 - RNA, 64 nt, Homo Sapiens
caaugcauuuuuuuuauuuuuuuuuugagacagaguuucgcacuucuugcccaggcuggaguac

SEQ ID NO: 289279 - RNA, 64 nt, Homo Sapiens
augcuucacuuugccuugcccaucacccuauacaguuucgcagauagucuagucacucuaugug

SEQ ID NO: 289280 - RNA, 64 nt, Homo Sapiens
uaaauacuuuuguaccaugaguaaaacuucagguguuucgcaagaaccaccauucucaaugagu

SEQ ID NO: 289281 - RNA, 64 nt, Homo Sapiens
aaaguguccccaaggaaguggcccucugaauuauguuucgcagacucagcacagccagcuccgu

SEQ ID NO: 289282 - RNA, 64 nt, Homo Sapiens
cggcguuaucuggaaaguggcuuuccuggacuguguuucgcauuagccaaguggauggaacuaa

SEQ ID NO: 289283 - RNA, 64 nt, Homo Sapiens
aaauagauuguucuaaucuuaauguugcucucugguuucgcagguuagauguucuuaagaauaa

SEQ ID NO: 289284 - RNA, 64 nt, Homo Sapiens
ccccagcucuggaugaaggcaaaaacuguacuguguuucgcauuaagcacacacaucuggcccu

SEQ ID NO: 289285 - RNA, 64 nt, Homo Sapiens
ggcucccccaccucagccagugagucagacacggguuucgcagccauguuuccuggcuccgagg

SEQ ID NO: 289286 - RNA, 64 nt, Homo Sapiens
ugguuuuuuuuuuuuuuuggccaaaucucgugguguuucgcagaaaaaaauccagaaaauuuca

SEQ ID NO: 289287 - RNA, 64 nt, Homo Sapiens
gcugucccuguuuuaaagagcuguguuuuguuuuguuucgcauuuagagagcagacaaggcacc

SEQ ID NO: 289288 - RNA, 64 nt, Homo Sapiens
gauaacacguggugaacaacugccuuuagcugguccagauuaaucauuucaaagacauccauuu

SEQ ID NO: 289289 - RNA, 64 nt, Homo Sapiens
ccagcccuacagggacugggcaaagaugauguuuccagauuacacuccagccugagucagcacc

SEQ ID NO: 289290 - RNA, 64 nt, Homo Sapiens
acuggaaccucaugauaauugacccucuggaucaccagauuaguuuaauuuaacagauaugucc

SEQ ID NO: 289291 - RNA, 64 nt, Homo Sapiens
aggacgugcuuuacaucuccagaucuguucuucaccagauuagguuaggccuaccaugugccac

SEQ ID NO: 289292 - RNA, 64 nt, Homo Sapiens
auuacugcccacucaacacauauuuaauaugugcccagauuauucuaaaaucuuaaaaaaagau

SEQ ID NO: 289293 - RNA, 64 nt, Homo Sapiens
uuacuaaaguagauaauuccaaugagaaauacuaccagauuauuguuauaaaauuaauuuacaa

SEQ ID NO: 289294 - RNA, 64 nt, Homo Sapiens
cugcucuaggcccauagucagcagcagcucugagccagauuacaggaaugaagaacuguugccu

SEQ ID NO: 289295 - RNA, 64 nt, Homo Sapiens
uaaaccgcauuaaucauggcaaucaagcccccuuccagauuacugucucuugaacaguugcaau

SEQ ID NO: 289296 - RNA, 64 nt, Homo Sapiens
cccugaugcuguauaauguauguugaauguggucccagauuauuucuguaagaagacacuccau

SEQ ID NO: 289297 - RNA, 64 nt, Homo Sapiens
aacccuuccugauccuggaguuuguagucucaucccagauuacuggguucccagugcccagcac

SEQ ID NO: 289298 - RNA, 64 nt, Homo Sapiens
uauuuguguguguguguguguuguccucauuucuccagauuaucuuuggccugaguuauugaga

SEQ ID NO: 289299 - RNA, 64 nt, Homo Sapiens
agaccucuucauguuaaaagagagaagagaccugccagauuauccucuuguuuuuuuaauuggg

SEQ ID NO: 289300 - RNA, 64 nt, Homo Sapiens
acuucaaugggacacuuuagauuguucaguucauccagauuauauaaugaagaaaacuucucuu

SEQ ID NO: 289301 - RNA, 64 nt, Homo Sapiens
aucgccauaauauaaggaaguagcauguagaauuccagauuacacaagggacauaccuuacauu

SEQ ID NO: 289302 - RNA, 64 nt, Homo Sapiens
ugcuuuugucauuugagcugcaguuuuuaugugaccagauuaaguauacuuaaaauaauuugga

SEQ ID NO: 289303 - RNA, 64 nt, Homo Sapiens
ugaugguacaaagaagcagaucacaugccauucaccagauuauuaauacacuuuugcuuuauuc

SEQ ID NO: 289304 - RNA, 64 nt, Homo Sapiens
cuucccagguguucagaauucaaccaaguuccucccagauuaaacuauauuauuaaauguaaug

SEQ ID NO: 289305 - RNA, 64 nt, Homo Sapiens
aaauacuuauuuuuaaaaugcauuacauacuaugccagauuacauucuaguuccuaacaauucu

SEQ ID NO: 289306 - RNA, 64 nt, Homo Sapiens
gcauaaagccaaggaacuacacuccagcugccucccagauuaauguaagaaugacugaaccauu

SEQ ID NO: 289307 - RNA, 64 nt, Homo Sapiens
cuguaccuggcuucucuucucugaaaauaauauuccagauuacacccaggccccauggaaaggu

SEQ ID NO: 289308 - RNA, 64 nt, Homo Sapiens
agacacaggaugaagcauuuagaccugcagacgcccagauuauggauuucaccacucaaaggcc

SEQ ID NO: 289309 - RNA, 64 nt, Homo Sapiens
gguuaaaauccaacaguacagcacaacuuuuaaaccagauuacuucauauuuuuuuguuuauuu

SEQ ID NO: 289310 - RNA, 64 nt, Homo Sapiens
uucgagaguagcccugucuuguccccuccuacccccagauuagcaccaccccucucacucuugg

SEQ ID NO: 289311 - RNA, 64 nt, Homo Sapiens
aaaauuaugauaaaaugcuuuaaaaauuaauaugccagauuaaaauaacugaauaguuuacuau

SEQ ID NO: 289312 - RNA, 64 nt, Homo Sapiens
gcugugcuugccucacaggaauagucaggucuucccagauuaucugaaggcccuggggauucca

SEQ ID NO: 289313 - RNA, 64 nt, Homo Sapiens
uuguagauuuccauguaaucauugagguuaucacccagauuagaaagacauauuuguuaucagu

SEQ ID NO: 289314 - RNA, 64 nt, Homo Sapiens
agaaaaugggcaauaaucauuguuaagucacauuccagauuaggaaugcagaacaguuuaaacu

SEQ ID NO: 289315 - RNA, 64 nt, Homo Sapiens
gacagacugacaguucaucuggugucucaucaugccagauuaaaaaagcaggccugacugacca

SEQ ID NO: 289316 - RNA, 64 nt, Homo Sapiens
ccuggaguugggcugguuugcagguggaggcgagccagauuagggaccagaaguggcaggagga

SEQ ID NO: 289317 - RNA, 64 nt, Homo Sapiens
gugaaggaacuuucuguuguguuugggcauauaaccagauuaaagcauuauuucuugauuagag

SEQ ID NO: 289318 - RNA, 64 nt, Homo Sapiens
gaauacagcucuuaaaaaauuuuauagccuguaaccagauuaagucauguaaaugauuaucucc

SEQ ID NO: 289319 - RNA, 64 nt, Homo Sapiens
aauuacauuacugaaaacuuguagaugauaaaggccagauuacagcuaauucucagaaaggcaa

SEQ ID NO: 289320 - RNA, 64 nt, Homo Sapiens
uucugugguuguuacagaaucacuaucacgagacccagauuaauugugcucuuuucacuguaga

SEQ ID NO: 289321 - RNA, 64 nt, Homo Sapiens
aggacuaacagaaagcaccugauuugcacuugaaccagauuauagauuuaaaaguauaugacau

SEQ ID NO: 289322 - RNA, 64 nt, Homo Sapiens
uccgccucccucagagcagcagccugucaaaacaccagauuacaacaaauuuaguuuaaagguc

SEQ ID NO: 289323 - RNA, 64 nt, Homo Sapiens
uauuaugguggccuaaaguaggcuucuugguacaccagauuauuuauaacauuaaauuuaugag

SEQ ID NO: 289324 - RNA, 64 nt, Homo Sapiens
caucaugguauucaggggcuagagugauuuuuuuccagauuaucuaaaguuggaugcccacacu

SEQ ID NO: 289325 - RNA, 64 nt, Homo Sapiens
cucgaccucccaggugauccucccaccucagcuuccagauuagcuggugcuauaggcaugcacc

SEQ ID NO: 289326 - RNA, 64 nt, Homo Sapiens
gaagagcaaggcauaaauuuagacuaaaauccauccagauuacacucauucuuuaggcuacucc

SEQ ID NO: 289327 - RNA, 64 nt, Homo Sapiens
ucagugucaaaauauuauagauuauagcuaaaauccagauuaauacucauuugggguuuuuuau

SEQ ID NO: 289328 - RNA, 64 nt, Homo Sapiens
aaccucuuuguccagccuuguuagaaucagcuagccagauuaguauuucauuaacucugauuaa

SEQ ID NO: 289329 - RNA, 64 nt, Homo Sapiens
auguugccagaauucacucaguuggccugagccaccagauuaugauaaaguucuagucacuucu

SEQ ID NO: 289330 - RNA, 64 nt, Homo Sapiens
uaugaugugagauuauaauacucuuuuuaaucaaccagauuaaagcuucuacaguugccacuuu

SEQ ID NO: 289331 - RNA, 64 nt, Homo Sapiens
uuucauuuggggaaugaaguaauauauaguuuguccagauuagcaucuguagagaaaucuaugc

SEQ ID NO: 289332 - RNA, 64 nt, Homo Sapiens
aguucuguggaaucaggaagcaugggcugugcuuccagauuaugaguuuguacugaaaugcuuu

SEQ ID NO: 289333 - RNA, 64 nt, Homo Sapiens
caccauuagcaucuauaucucuauaagaaacauaccagauuagcguugcaugaacaacaguuug

SEQ ID NO: 289334 - RNA, 64 nt, Homo Sapiens
uguauuuaauacacaaugcaaagcaaucgguuccccagauuacuugaucaggccgcacugucug

SEQ ID NO: 289335 - RNA, 64 nt, Homo Sapiens
gaagauaaauauaaauguaugauuucuguuuaugccagauuauuacuugaaaaauuacagguga

SEQ ID NO: 289336 - RNA, 59 nt, Homo Sapiens
ccucacaugcuagcaucagguucagucuuccagauuaugccccuagcaguaaauuguga

SEQ ID NO: 289337 - RNA, 64 nt, Homo Sapiens
cacuauaaacuggaauggauuucucaaugcgggaccagauuaugacuagaguuuuuaugccaga

SEQ ID NO: 289338 - RNA, 64 nt, Homo Sapiens
uuuuuaauauuguaugcaauaaaugaauugcuccccagauuauuagauuuugaaguaggaaaua

SEQ ID NO: 289339 - RNA, 64 nt, Homo Sapiens
uaggaaaaggcauauauuaaucagaugaaacuguccagauuaauucuucuguuaaaauaucucu

SEQ ID NO: 289340 - RNA, 64 nt, Homo Sapiens
acuugucuuuugcuaauaaacacauggcccuuucccagauuauucucuagccaagccccaccuu

SEQ ID NO: 289341 - RNA, 64 nt, Homo Sapiens
aaggagcuacgucuuaggugaaaguuaugaccaaccagauuaaacucuacccacauccugcauu

SEQ ID NO: 289342 - RNA, 64 nt, Homo Sapiens
cuuccuuagauaucaguuagcuucacaaguccugccagauuaauugccagccuacccuccacca

SEQ ID NO: 289343 - RNA, 64 nt, Homo Sapiens
auuaggaaucucagugcagaagugauggcagaggccagauuaacgccaagccccggguacccuc

SEQ ID NO: 289344 - RNA, 64 nt, Homo Sapiens
guuaggguagggaggacugguucucuauugcauuccagauuaggagaaucuaauaaguuagcca

SEQ ID NO: 289345 - RNA, 64 nt, Homo Sapiens
guggcuguccaucccuggauguggugccagaagcccagauuagggaccccauagcuggaggccu

SEQ ID NO: 289346 - RNA, 64 nt, Homo Sapiens
gcugggauuacaggcgugagccacuccacccagcccagauuaaauguuuuuauuucuaccugcc

SEQ ID NO: 289347 - RNA, 64 nt, Homo Sapiens
gugagagaggcccauggcugauuuuaccaugugcccagauuaauguauauaguugauuggaaug

SEQ ID NO: 289348 - RNA, 64 nt, Homo Sapiens
cucuuuaugugucaguauuaagaguaauauguagccagauuacuuaaaucucagaauuacuaag

SEQ ID NO: 289349 - RNA, 64 nt, Homo Sapiens
gggugaugaaauaggaguuuccuagcuauauaaaccagauuacucacccaugcauauaguaaga

SEQ ID NO: 289350 - RNA, 64 nt, Homo Sapiens
augaaaugaaugacugcccagaaugagaauuuguccagauuauucagauaaacaucauaaagca

SEQ ID NO: 289351 - RNA, 64 nt, Homo Sapiens
caagagucuaugcaaaaaaaaaaauuucuuuaccccagauuaucagauuuuuuucccucagauu

SEQ ID NO: 289352 - RNA, 64 nt, Homo Sapiens
guuuugccagauguuaaacuuugaauuuaauauaccagauuauuaaaauauuguccauuaacua

SEQ ID NO: 289353 - RNA, 64 nt, Homo Sapiens
ccuguaagaaacuugccuguucuaacuguugcuaccagauuauaucuggugguaauuguuaaug

SEQ ID NO: 289354 - RNA, 64 nt, Homo Sapiens
guacuguaggcuaaaauaaccuuaucauuuguauccagauuacugaaaggaaacguggcucucc

SEQ ID NO: 289355 - RNA, 64 nt, Homo Sapiens
augccagaauauaaugugcauuaugacuaaaguaccagauuauaaaaccuagccagcuucacga

SEQ ID NO: 289356 - RNA, 64 nt, Homo Sapiens
gagggguauugauuugccuuuggcuuauacaagaccagauuacaugggaaagacuuggaggguu

SEQ ID NO: 289357 - RNA, 64 nt, Homo Sapiens
uuuauagcagccucaaguugguauaguuacgaugccagauuagauccuuugccuuugacccuau

SEQ ID NO: 289358 - RNA, 64 nt, Homo Sapiens
uuaaacuaugaaccuucuuaacaucacugucuugccagauuaccgacacugucacuugaccaau

SEQ ID NO: 289359 - RNA, 64 nt, Homo Sapiens
cugagggauacagagaugaaauuguaaacuguauccagauuaucaaagcuaauuugacuaguuu

SEQ ID NO: 289360 - RNA, 64 nt, Homo Sapiens
uaucuccauguuuguccuuuccuuuccggugagaccagauuaacuuuucuuaugcaaaaauacu

SEQ ID NO: 289361 - RNA, 64 nt, Homo Sapiens
gcaaaauaacagagcgaguucuguuggauuaucaccagauuaauuuuauacaauguuuuuaaaa

SEQ ID NO: 289362 - RNA, 64 nt, Homo Sapiens
guaugaaguugugucuauaauucuugcauauuauccagauuauuucugaaagucaacaugaugc

SEQ ID NO: 289363 - RNA, 64 nt, Homo Sapiens
auauuucacagggguucuuaugaagguaaauuuaccagauuaauaaaaauuuaugaauauuaaa

SEQ ID NO: 289364 - RNA, 64 nt, Homo Sapiens
gccuguaaacuuuaucacuugggacccacaugcuccagauuagaggcgugugcucggugcugac

SEQ ID NO: 289365 - RNA, 64 nt, Homo Sapiens
uugaaaagaccucccauuugugugcuuggauuuuccagauuaaugcuuuucaagcuaagagucu

SEQ ID NO: 289366 - RNA, 64 nt, Homo Sapiens
aaggccaaggguaauagaaagaaguuuauagcuuccagauuacauaugcugaauugaacauuuu

SEQ ID NO: 289367 - RNA, 64 nt, Homo Sapiens
gguaaaaauuauuugaaaacaauugucaaaauuuccagauuacuuaaaaauagcaaucauuuua

SEQ ID NO: 289368 - RNA, 64 nt, Homo Sapiens
cauacaguucauuuggaauuuguaugguuuuuccccagauuaguaaaacuugauguauucugug

SEQ ID NO: 289369 - RNA, 64 nt, Homo Sapiens
ggccaaguguacauuugauuugauauacagaccuccagauuauuuucuauauuuggauucacag

SEQ ID NO: 289370 - RNA, 64 nt, Homo Sapiens
ccauuuaguaaaaauaacuaucagcagaguuguuccagauuaaaaauaguacuacaagcuugua

SEQ ID NO: 289371 - RNA, 64 nt, Homo Sapiens
ccuuuuuacuccccauacuuuguaaguaaugcuuccagauuaaccugcaaaucuuguggagcca

SEQ ID NO: 289372 - RNA, 64 nt, Homo Sapiens
aacaauaugacuuagauuuucuguauuucaucugccagauuauuugaaucacacaggaugaugu

SEQ ID NO: 289373 - RNA, 64 nt, Homo Sapiens
aaaugugacaaauuacccaacuugucgaaucauaccagauuauugaggcggggguaguuuauac

SEQ ID NO: 289374 - RNA, 64 nt, Homo Sapiens
uaaauguucccuucucaggacaugcccuucuaucccagauuacccuuaguuuguccaguccuuc

SEQ ID NO: 289375 - RNA, 64 nt, Homo Sapiens
cuuguaaugacacgaaucuguuaaaaauauauucccagauuaucauauaaaagggaggguuuuu

SEQ ID NO: 289376 - RNA, 64 nt, Homo Sapiens
aauagccaaaucaaacuuaagaaccagaucucugccagauuaaacauuuuugaagcuuuuaaaa

SEQ ID NO: 289377 - RNA, 64 nt, Homo Sapiens
cccaguuucuuaggaaacgcaaacgauuuauuauccagauuauuuggauaaguccuuuuuaaga

SEQ ID NO: 289378 - RNA, 64 nt, Homo Sapiens
caacacccuccagucuguagcagagcaguccaacccagauuagugcagcccggaggcuuagggu

SEQ ID NO: 289379 - RNA, 64 nt, Homo Sapiens
uucuugacguugacuucauuuauugguauuacaaccagauuauaaauuauuuuagaacacauug

SEQ ID NO: 289380 - RNA, 64 nt, Homo Sapiens
caaagcuaaucauggaaguucuuaggugguaaguccagauuaguugcauccuucucccagauga

SEQ ID NO: 289381 - RNA, 64 nt, Homo Sapiens
augccuuuuauacaaaaccauaaguacucuguugccagauuaccccacugugcugcuaauagga

SEQ ID NO: 289382 - RNA, 64 nt, Homo Sapiens
auacucgagaauucaaagggaaaaccuaauucccccagauuaguaaaacuguucuuuuagguuc

SEQ ID NO: 289383 - RNA, 64 nt, Homo Sapiens
uucuugucauuuuuccucaucaguauuaaaacuuccagauuauaugccuuccuuuauuacaaau

SEQ ID NO: 289384 - RNA, 64 nt, Homo Sapiens
cuaaauguaaugaaaaccucgaaugccagaucuuccagauuaggggaguuauuuuugauaugua

SEQ ID NO: 289385 - RNA, 64 nt, Homo Sapiens
uccagucaucccagugggcuucucuuugucucucccagauuagaccuuugggugagauuggcau

SEQ ID NO: 289386 - RNA, 59 nt, Homo Sapiens
auaucaucucacagcucugaggcccugggccagauuacuuccuccaccccucccuaucu

SEQ ID NO: 289387 - RNA, 64 nt, Homo Sapiens
ggcugcuuugccucuaccaguuugccaccccuguccagauuauuggguuaaacugcaggagcag

SEQ ID NO: 289388 - RNA, 64 nt, Homo Sapiens
gaggauucugugacucuugcgaauuuagagugagccagauuaugccccuguccuagugcaaagu

SEQ ID NO: 289389 - RNA, 64 nt, Homo Sapiens
ugguuauuaagaagaacaauggaaugacuuggcuccagauuacugcagggaggaggaaggcuga

SEQ ID NO: 289390 - RNA, 64 nt, Homo Sapiens
gaaccuggagacauagcaucuuugauagcauaagccagauuaucugugugugcgguggugugcg

SEQ ID NO: 289391 - RNA, 64 nt, Homo Sapiens
gaaauccaauauuuggaguacaauuucuuuuaauccagauuacaccugccuuacaaagcacccc

SEQ ID NO: 289392 - RNA, 64 nt, Homo Sapiens
aaaacaggguuuccacuagacauuacuugaaaggccagauuacucagcagaucucccauguugg

SEQ ID NO: 289393 - RNA, 64 nt, Homo Sapiens
augagugcuuugguugacuuccuaguguucccauccagauuagccauacugggguuucugucuc

SEQ ID NO: 289394 - RNA, 64 nt, Homo Sapiens
uauugacagcuauucaccuuucacggugcuggggccagauuagggaucacucccgugaggaggg

SEQ ID NO: 289395 - RNA, 64 nt, Homo Sapiens
aacagauuuauuuauagacuuaacuuguauuaaaccagauuauucacaguaggaauagggguug

SEQ ID NO: 289396 - RNA, 64 nt, Homo Sapiens
uuagggcauaacauuaacuuauugugacacuccaccagauuaagaucaauccacaguccaugaa

SEQ ID NO: 289397 - RNA, 64 nt, Homo Sapiens
uuauaugcaucaacaagaucuuuaaccauauaugccagauuacuuucugccauaacaucuugaa

SEQ ID NO: 289398 - RNA, 64 nt, Homo Sapiens
uuuagaauuccacauuaacuaaucuuaguaacuaccagauuaucuaccugugaagacauaagaa

SEQ ID NO: 289399 - RNA, 64 nt, Homo Sapiens
uagcuuauggauucugguggaauuuucaguuauuccagauuaucauuuuugaccucacugcagc

SEQ ID NO: 289400 - RNA, 64 nt, Homo Sapiens
uaccccgcuacccuguucugucuuauggagcagcccagauuaucuuuacucccucuuucucaug

SEQ ID NO: 289401 - RNA, 64 nt, Homo Sapiens
uacuaccguuauacacauauaguguacagccagaccagauuaaacuucauauguaaucucuagg

SEQ ID NO: 289402 - RNA, 64 nt, Homo Sapiens
cuuuggcuauuugcauuuugcuuccucuucuuuuccagauuacaguaugaagcuuuauuuucuu

SEQ ID NO: 289403 - RNA, 64 nt, Homo Sapiens
uagguucggagacccgcuuccacagauuccaaagccagauuaccuauagcacagugguuaugag

SEQ ID NO: 289404 - RNA, 64 nt, Homo Sapiens
cuauauucuucaucugaggauauuguguauaaaaccagauuagauuuacauuuuaaauugucuu

SEQ ID NO: 289405 - RNA, 64 nt, Homo Sapiens
auuuaaacugauaaaggaaaggcuaggucuggguccagauuaggugaaaauuaugacagucucu

SEQ ID NO: 289406 - RNA, 64 nt, Homo Sapiens
cuaaaacaccuauggcuuugacuuuguuauugauccagauuauuuuccuugcauuggggaaaau

SEQ ID NO: 289407 - RNA, 64 nt, Homo Sapiens
ugcaaaccaucugccccugucccaaaaugaugagccagauuagcauuaaaccaguacuugucag

SEQ ID NO: 289408 - RNA, 64 nt, Homo Sapiens
uugguuuaagaguagcagauugaaauauaagaagccagauuagacucuaaaauuguggccauug

SEQ ID NO: 289409 - RNA, 64 nt, Homo Sapiens
acucuuccgugucaacaaugugacuacauguucuccagauuagccacacaugcaaacaucagug

SEQ ID NO: 289410 - RNA, 64 nt, Homo Sapiens
cccaguguguccccaccucucccagccuguauacccagauuacuuuggugaacugagagcugga

SEQ ID NO: 289411 - RNA, 64 nt, Homo Sapiens
gucacuuggacuauuucagcaacagucucaucucccagauuaccucugugcacacugacacgug

SEQ ID NO: 289412 - RNA, 64 nt, Homo Sapiens
aaacuacaauuaauuauagaugucaaaacauuaaccagauuaaaguaauauauuuaagaguaaa

SEQ ID NO: 289413 - RNA, 64 nt, Homo Sapiens
guguuaccccaaaugaacggaaauucuuuuaacaccagauuagucuuuguuucaagaacacaug

SEQ ID NO: 289414 - RNA, 64 nt, Homo Sapiens
uggucuuccaagacuuugccgugccucaccagagccagauuaucugcgacacugcugcacguag

SEQ ID NO: 289415 - RNA, 64 nt, Homo Sapiens
ccuugucugaacuggagccaugggcacaaagggcccagauuaaagucuuuauccucagucugug

SEQ ID NO: 289416 - RNA, 64 nt, Homo Sapiens
aaucagcacaucguacacuggauugcagugcuucccagauuauugaaaaauguuacagacaacu

SEQ ID NO: 289417 - RNA, 64 nt, Homo Sapiens
aacacucauaguuuugccaagaggugcccucagcccagauuagcgucagcugccugcacaggca

SEQ ID NO: 289418 - RNA, 64 nt, Homo Sapiens
uuaaaugccacaggaaacaauuucuauggaccaaccagauuaauaaccaaauauacauacuuau

SEQ ID NO: 289419 - RNA, 64 nt, Homo Sapiens
aacucuucauacuuacagcauccauaauucccuuccagauuauuaggcauggguucagcuuaau

SEQ ID NO: 289420 - RNA, 64 nt, Homo Sapiens
aacccuggagacacccugaagguucacuggcucuccagauuagccucucuuccucugucaggca

SEQ ID NO: 289421 - RNA, 64 nt, Homo Sapiens
aaacccaacuuucuuucucccuauguggaagacaccagauuagcuggaauucugccaccuuccu

SEQ ID NO: 289422 - RNA, 64 nt, Homo Sapiens
gaauacaucaaagugaauuucuguucaaguuuucccagauuaucauucuuugggaugagagaac

SEQ ID NO: 289423 - RNA, 64 nt, Homo Sapiens
ugguuuuggcuugugcucuggucaaagaucuuuuccagauuaugcacagaagaacaaagaccca

SEQ ID NO: 289424 - RNA, 64 nt, Homo Sapiens
acuagggaauuauuugauaaauaacaauuauuugccagauuaacucaauucacaagauuggguu

SEQ ID NO: 289425 - RNA, 64 nt, Homo Sapiens
uuucaaagucuuagguuucggaaggugaagcccaccagauuauucccaugggcccguucugauu

SEQ ID NO: 289426 - RNA, 64 nt, Homo Sapiens
auauagaaauaacauaugauaguauggcagauccccagauuaaagguauaagccugcugaaaac

SEQ ID NO: 289427 - RNA, 64 nt, Homo Sapiens
uuggaggggacaggaggaugaacugaaggggucuccagauuaucagcagaguuaagaucuacca

SEQ ID NO: 289428 - RNA, 64 nt, Homo Sapiens
agauuuccauaucaccccaacucagagcagauucccagauuaaccuagucccuauccccaaccc

SEQ ID NO: 289429 - RNA, 64 nt, Homo Sapiens
uuuuugagauccaaaaaaaauuaggaaagugaucccagauuagauaaaacauauaauucaggua

SEQ ID NO: 289430 - RNA, 64 nt, Homo Sapiens
auuugcuuaacaaagaaaucaguuaaaaaaacagccagauuaucaaaguuauaguuuucuuaca

SEQ ID NO: 289431 - RNA, 64 nt, Homo Sapiens
ucuucugcugggauuacagcauaugccaccaugcccagauuauuuuuuuguauuuguaguagag

SEQ ID NO: 289432 - RNA, 64 nt, Homo Sapiens
uaaagagaaaaguacaagacacucuuuuguaacuccagauuauugcggucaaggcuuuggagcc

SEQ ID NO: 289433 - RNA, 64 nt, Homo Sapiens
uggagauguuacaucugguagauguaacauucuaccagauuauggauggacugaucugaaaauc

SEQ ID NO: 289434 - RNA, 64 nt, Homo Sapiens
gggcauuggcaguggguuucccuauggcuuggauccagauuagaauugaucuuuguuuucacuu

SEQ ID NO: 289435 - RNA, 64 nt, Homo Sapiens
cuagauugaaguuuguuuucugaugcuguucuuaccagauuaaaaaaaaguguaaauuacaugg

SEQ ID NO: 289436 - RNA, 64 nt, Homo Sapiens
ccuguuuuugugaccaaagauugcccccgaauguccagauuaucuugcaauuccaggagcggca

SEQ ID NO: 289437 - RNA, 64 nt, Homo Sapiens
gugcauuuaauagucaauaaauucaucuaccauuccagauuauuaaaggcccacugguuguucc

SEQ ID NO: 289438 - RNA, 64 nt, Homo Sapiens
uuguuacacaguaauagguuaauaauacacuggcccagauuaggaagguucugccauccauccc

SEQ ID NO: 289439 - RNA, 64 nt, Homo Sapiens
aauaaggauccuuaugaugacuuuuagggacuacccagauuacuccaggauaaucuccucaccu

SEQ ID NO: 289440 - RNA, 64 nt, Homo Sapiens
uaauaagagagagucuuaccugaauggcaaucgcccagauuaacaguggagacaguaaugcaau

SEQ ID NO: 289441 - RNA, 64 nt, Homo Sapiens
agaagaguaggccugauauagucuuaguuagaaaccagauuaauggggguagagguuuugggau

SEQ ID NO: 289442 - RNA, 64 nt, Homo Sapiens
ccuuccuuccaauauaacuauucugcagcugcucccagauuacuuaacuuaacucuuaccuauu

SEQ ID NO: 289443 - RNA, 64 nt, Homo Sapiens
uuauuuuuaaaugaagaagcuguagccuuugugaccagauuauacucauggucagagaugagaa

SEQ ID NO: 289444 - RNA, 64 nt, Homo Sapiens
aagcauaaaagucuuccucuaauaauuucaugguauucauuaaauuccuaacuuaguaaaguag

SEQ ID NO: 289445 - RNA, 64 nt, Homo Sapiens
cauggcucauuaaucucuucaauaguccuuggucauucauuaucaaaaaaaaaaucuaaagaug

SEQ ID NO: 289446 - RNA, 64 nt, Homo Sapiens
uaugacuguggaaauacagaggccccacuucccaauucauuagggaugugaauugguuuuuagg

SEQ ID NO: 289447 - RNA, 64 nt, Homo Sapiens
uuacuguaguguuaagagaaugauuacccgccgaauucauuaauagccaggcaagucauagaau

SEQ ID NO: 289448 - RNA, 64 nt, Homo Sapiens
auuagaaaaaaacaaacucuacuaauuuuuagauauucauuaauaggaaagauuuaauguuaca

SEQ ID NO: 289449 - RNA, 64 nt, Homo Sapiens
agguauugauugaaaaaagagaaaggggcaagaaauucauuaaagaaaaaccacagauacugaa

SEQ ID NO: 289450 - RNA, 64 nt, Homo Sapiens
uauauggaaaggcuuacaaaucaauauuguaagcauucauuauuuaagaauguacaauguauuu

SEQ ID NO: 289451 - RNA, 64 nt, Homo Sapiens
ggcauauuucuauggaaguuuaauugacagcuauauucauuauuuauuuuacaauuucauuuuu

SEQ ID NO: 289452 - RNA, 64 nt, Homo Sapiens
ccuaauugguaaccugaguuuauaucuggcaugaauucauuauggugauacacauaugugaauu

SEQ ID NO: 289453 - RNA, 64 nt, Homo Sapiens
uucugucugcauguaauuuggauuucucaaauacauucauuaguaauuuaucaguaacauuagu

SEQ ID NO: 289454 - RNA, 64 nt, Homo Sapiens
caauuaaugauucaauuaacauauaucuuauccaauucauuaugucaauucauuaauaaaauac

SEQ ID NO: 289455 - RNA, 64 nt, Homo Sapiens
aauuaacauauaucuuauccaauucauuaugucaauucauuaauaaaauaccuuuuauguagag

SEQ ID NO: 289456 - RNA, 64 nt, Homo Sapiens
uguauauuuuuuuauaaauauuauaaaauggccuauucauuauacuucaaaguuuuaacuagca

SEQ ID NO: 289457 - RNA, 64 nt, Homo Sapiens
acaaggauacauaagagacuagagauuaguaccuauucauuaaccaguggguuuuuccuagagg

SEQ ID NO: 289458 - RNA, 64 nt, Homo Sapiens
uguugcugguauuuugcauuuuaaagugaucaagauucauuaggcaaacuuugguuuaaguaaa

SEQ ID NO: 289459 - RNA, 64 nt, Homo Sapiens
cuuuguacagagguuacugcaauaaaggaaguggauucauuaaaccuauuuaauguccauucuu

SEQ ID NO: 289460 - RNA, 64 nt, Homo Sapiens
uuuaagcugaaaaggggaucgucaggugaaaggcauucauuauuauaggugaaagauaacugua

SEQ ID NO: 289461 - RNA, 64 nt, Homo Sapiens
ucuauauugaauaggugaaaaugcuauaggcaucauucauuaucuuauuaacauagaugaaggu

SEQ ID NO: 289462 - RNA, 64 nt, Homo Sapiens
auuaucuuuuaaguugucagcaaguuaccaagguauucauuaaagaacuuguaauaucaaauua

SEQ ID NO: 289463 - RNA, 64 nt, Homo Sapiens
uugaugcuaauaauaauuuucuuuaaacucuaccauucauuaugugguaacuguauugaacuua

SEQ ID NO: 289464 - RNA, 64 nt, Homo Sapiens
uacacuuuaaaauuggaaaguuuauaaagggguaauucauuaauaaaagauauuuuagaaucaa

SEQ ID NO: 289465 - RNA, 64 nt, Homo Sapiens
guuuaugaauuaaaaagaaaaucgggcacucuauauucauuaagaaaggauccauuuaguuaaa

SEQ ID NO: 289466 - RNA, 64 nt, Homo Sapiens
auaaaguacaauagugaaauaguauuacaaaauaauucauuagcauuuaccaauuuauuuucuu

SEQ ID NO: 289467 - RNA, 64 nt, Homo Sapiens
ucuguaggaacuuuuaguuccauuauuguuccaaauucauuaucacuuguaagucugauuacau

SEQ ID NO: 289468 - RNA, 64 nt, Homo Sapiens
uauuauuaaauuuauaucccuaaaauuuuuagaaaucucucaaaaucuuuccaaauguucuggu

SEQ ID NO: 289469 - RNA, 64 nt, Homo Sapiens
uguguacauuaaaucuagaaaccauuaguuugagaucucucaaaaauaaaaauaaaaauugcuu

SEQ ID NO: 289470 - RNA, 64 nt, Homo Sapiens
uuccccucuccucuuccaaacaaaacauacauugaucucucacauccagcugccaaaagaaaac

SEQ ID NO: 289471 - RNA, 64 nt, Homo Sapiens
agaaaaccccaucaaacacaguuacaccccacauaucucucacacacacacacacacgcacaca

SEQ ID NO: 289472 - RNA, 64 nt, Homo Sapiens
guggguucugccgaacccuccucuuuaaaauaccaucucucagacaucugacaggcuuaucauu

SEQ ID NO: 289473 - RNA, 64 nt, Homo Sapiens
uguucucaccccucugcagcaggaguucuauugcaucucucaccccagcugcaaaccuggccag

SEQ ID NO: 289474 - RNA, 64 nt, Homo Sapiens
uguccaaacaaggcaaggagaagaggaggaucucaucucucaucaccauucuguccugggagag

SEQ ID NO: 289475 - RNA, 64 nt, Homo Sapiens
aauuuaugugugguuuuaaaaccuuauggcaaaaaucucucagauuuacaguaagguggauggu

SEQ ID NO: 289476 - RNA, 64 nt, Homo Sapiens
ucucuuucuucucucccuucuuuuaaauccuuucaucucucaucaccucaaagaugguugccca

SEQ ID NO: 289477 - RNA, 64 nt, Homo Sapiens
ugucccucccccagccaugaccuugggaggugccaucucucaucgcugagccacaaguuggucu

SEQ ID NO: 289478 - RNA, 64 nt, Homo Sapiens
aauuuuaaaauggcucaaacaaaauaaaaauuuuaucucucacccaagcugacucuaauuuuaa

SEQ ID NO: 289479 - RNA, 64 nt, Homo Sapiens
cuacauguugcaaagguuaauacaagaacuucacaucucucagguuuuccucagaggggcaggu

SEQ ID NO: 289480 - RNA, 64 nt, Homo Sapiens
cuagccugcugcuuggagucagguugagcaucagugagaugaagacaguaccuuuuccucucac

SEQ ID NO: 289481 - RNA, 64 nt, Homo Sapiens
ggugcaaauucuuguguguguuugcauaggaaggugagaugaccaucuacuaaagaggaaguag

SEQ ID NO: 289482 - RNA, 64 nt, Homo Sapiens
cauggccacauuauugcuuuauguccaagugaagugagaugaugaucagcccagaaagcuauca

SEQ ID NO: 289483 - RNA, 64 nt, Homo Sapiens
ucucacugcacucaggcugguuauuuuuguuuuuugagaugaaguucucuguuuuguuuuguuu

SEQ ID NO: 289484 - RNA, 64 nt, Homo Sapiens
aaagaauugauaguacaaaauccaacaacaauacugagaugaucuaagaagguuauaacaaaau

SEQ ID NO: 289485 - RNA, 64 nt, Homo Sapiens
gcuaucaguuucaaauaauauuuucucuguaguaugagaugaaauuaaaaguggauagcuuuca

SEQ ID NO: 289486 - RNA, 64 nt, Homo Sapiens
caagaccaaaaguguucuuugaacauucuucuacugagaugaucuuuucaaacuccauuccuua

SEQ ID NO: 289487 - RNA, 64 nt, Homo Sapiens
acauauuaauuaaacaugcaaaaacauuuuuuucugagaugaaaaaugaacaggaaaagaugua

SEQ ID NO: 289488 - RNA, 64 nt, Homo Sapiens
gggagccccacgggccccagaggacacgcuggucugagaugagggcaggaaggagaggcagggc

SEQ ID NO: 289489 - RNA, 64 nt, Homo Sapiens
cagacggcacccaggcugugcucggcucuggcucugagaugaggggaaagggugaggggugaca

SEQ ID NO: 289490 - RNA, 64 nt, Homo Sapiens
guuaacauagugugaaugaaaaggcugagaugauugagaugaaacacaauaagcaaaucacaug

SEQ ID NO: 289491 - RNA, 64 nt, Homo Sapiens
gagaugaaaguuaacauaguaaucacaugaaggcugagaugauucuagagaaacacaauaagca

SEQ ID NO: 289492 - RNA, 64 nt, Homo Sapiens
ucugaguaugaagcuguaccgauguuuugguauuugagaugaacuuugauacauacccugauuu

SEQ ID NO: 289493 - RNA, 64 nt, Homo Sapiens
aaggcuuaaaacuugagaauuuuguuuaugucuuugagaugagaauauugauaguacauauugc

SEQ ID NO: 289494 - RNA, 64 nt, Homo Sapiens
aggccucacugguuggggucugacugauguggguugagaugaggcacuaacuggguuuaaauuu

SEQ ID NO: 289495 - RNA, 64 nt, Homo Sapiens
guugucaauuggauuuucuuacaagaaauauuugugagaugaaacucaagggcaagaaacgcaa

SEQ ID NO: 289496 - RNA, 64 nt, Homo Sapiens
acgguuucuuuuguuuaucaucuggccuuuugugugagaugaucugaccagugaccggcucgaa

SEQ ID NO: 289497 - RNA, 64 nt, Homo Sapiens
auaaguuaacccggccugacagaaucaagaaaauugagaugagauuugaaaggacccgaaaaug

SEQ ID NO: 289498 - RNA, 64 nt, Homo Sapiens
uuugggccucucuugcugucauuaugauguauuuugagaugauuagucaagagucaagguugcg

SEQ ID NO: 289499 - RNA, 64 nt, Homo Sapiens
agccuaauuuuguguauucugguggcugcugucaugagaugauaaaauguaaaacaaaacucua

SEQ ID NO: 289500 - RNA, 64 nt, Homo Sapiens
ucuauuuccaguacacgucacauuauuuuaccggugagaugagaaugucacaaacauuaaaagc

SEQ ID NO: 289501 - RNA, 64 nt, Homo Sapiens
ugaguucauggggagauucuguaaagugaugaacugagaugaaagcagccaacagcccaggagc

SEQ ID NO: 289502 - RNA, 64 nt, Homo Sapiens
gaagauggagcagagucaaaucugugcuucuaacugagaugagaguguauuaaucacguaucgc

SEQ ID NO: 289503 - RNA, 64 nt, Homo Sapiens
ggugcuguccauggaaucagcuagaguuggggagugagaugaguucccagugggaaaacgugug

SEQ ID NO: 289504 - RNA, 64 nt, Homo Sapiens
uggugguuuauggcuccagaagcaugcccugggcugagaugagagacuuuuccuggccucuccc

SEQ ID NO: 289505 - RNA, 64 nt, Homo Sapiens
gacugccggugaauguguccugcuggugggcaugugagaugaguuaggggaacgugugugcgcg

SEQ ID NO: 289506 - RNA, 64 nt, Homo Sapiens
uucucuuuucaacuucuugacuccccucaacccuugagaugauuccgcccugcuggccucccuu

SEQ ID NO: 289507 - RNA, 64 nt, Homo Sapiens
auauuuuacaugugaugacaugaggccuuugggaugagaugaaucuggaauuaacugagacuuu

SEQ ID NO: 289508 - RNA, 64 nt, Homo Sapiens
cuuuggaguuugaguuuaaagagugaugugauauugagaugacaauugagucucauccauaucu

SEQ ID NO: 289509 - RNA, 64 nt, Homo Sapiens
cucccugaggugaaacucccgagaugaagcucccugagaugaaaugcagcuuccaaaaguccca

SEQ ID NO: 289510 - RNA, 64 nt, Homo Sapiens
cucccugaagugcaacucccgagaugaaacuuccugagaugaaaugaagcuuccaaaggugccu

SEQ ID NO: 289511 - RNA, 64 nt, Homo Sapiens
cuuccugagaugaaacuccccuuccaaaggugccugagaugaaaugaaagucccugagaugaag

SEQ ID NO: 289512 - RNA, 64 nt, Homo Sapiens
cuuccaaaggugccugagaugagaugaaagucccugagaugaagugcagcugccgaaagugcca

SEQ ID NO: 289513 - RNA, 64 nt, Homo Sapiens
gguucuuuggguuacaaaguguuaccacaguccuugagaugaguuggcauggcucagccccuga

SEQ ID NO: 289514 - RNA, 64 nt, Homo Sapiens
ucauuggggugggcccucacgcagaugaucuaguugagaugaggaauugggaaauagagucuuu

SEQ ID NO: 289515 - RNA, 64 nt, Homo Sapiens
uguaucccccaaaaagacagaugggccgguuuugugagaugaauuggcagguccuuuugaggug

SEQ ID NO: 289516 - RNA, 64 nt, Homo Sapiens
uucaaauaaccuaaaaaucauuggguuuuuuaauugagaugaaaggcgggagcaguuugcgugu

SEQ ID NO: 289517 - RNA, 64 nt, Homo Sapiens
uaugugauuuucucuaaugucuguuuacggccuaugagaugaaaacauggcuuccuaaauggcc

SEQ ID NO: 289518 - RNA, 64 nt, Homo Sapiens
auagagcuccuaaaaaugagaaauauuuauugaaauaagaaaaaagcccucagacauguugaau

SEQ ID NO: 289519 - RNA, 64 nt, Homo Sapiens
guuguuuguauaaaacaauuauaaugaaguguuuauaagaaauuguaaacaaauguaaaacuaa

SEQ ID NO: 289520 - RNA, 64 nt, Homo Sapiens
gccaccgcugccagcccagaguuacccucuaaagauaagaaaaaggcuauuaauaucauacuaa

SEQ ID NO: 289521 - RNA, 64 nt, Homo Sapiens
augauuaauuaugaagaugaaacacuagagucauauaagaaauaaaaauugggcaauaaaauaa

SEQ ID NO: 289522 - RNA, 64 nt, Homo Sapiens
uugcucccuugggacaguuaugaaaugacucauaauaagaaagcauucaggggagaaaagugaa

SEQ ID NO: 289523 - RNA, 64 nt, Homo Sapiens
uucuagaaucauguuugaauaguuugacuuuaagauaagaaauucuuuauugaguaaagguuau

SEQ ID NO: 289524 - RNA, 64 nt, Homo Sapiens
uuguauagaaaugaagguuuuauggauauaaaaaauaagaaauuaggaagagucuaauaguaau

SEQ ID NO: 289525 - RNA, 64 nt, Homo Sapiens
aaggucuauuccauucuccaagcuaaaaaauaggauaagaaauuuuuuaacuuuuuuggucuuc

SEQ ID NO: 289526 - RNA, 64 nt, Homo Sapiens
agggaaaaaagagaaaaacugccaaauuuaaauuauaagaaagaccaaacuuuuagaguaaaaa

SEQ ID NO: 289527 - RNA, 64 nt, Homo Sapiens
aguucuucaggagggccgacucaaaguaggcagaauaagaaaaucuuuugggaauuuuacagag

SEQ ID NO: 289528 - RNA, 64 nt, Homo Sapiens
cagaaugcagaacaccuacauauguuucagcauuauaagaaaggguuuuaacuucuaaagaaaa

SEQ ID NO: 289529 - RNA, 64 nt, Homo Sapiens
aagucuccuacauagcaguguuauuuauguacagauaagaaaaccauaugucagccaaagauuu

SEQ ID NO: 289530 - RNA, 64 nt, Homo Sapiens
auaauaauagcccugagauguuucuaacauuuaaauaagaaaaaaaucaaaucgaagucagccu

SEQ ID NO: 289531 - RNA, 64 nt, Homo Sapiens
aaaaaucaaucuuucuuaccgcauguaucacaagauaagaaauguagugguguuuacugcugca

SEQ ID NO: 289532 - RNA, 64 nt, Homo Sapiens
uggauuuuugccuuuuuaccuauacugauuauuaauaagaaauuugauuguuauuguuggaugu

SEQ ID NO: 289533 - RNA, 64 nt, Homo Sapiens
agcaaaacacaagcugcauuuuuauuuauuuugcauaagaaagguaaaucuuuuuacaaaaaaa

SEQ ID NO: 289534 - RNA, 64 nt, Homo Sapiens
caacuguagaugauauuuuauguuuaaucuguaaauaagaaauguauuuaaauuaaaagggauc

SEQ ID NO: 289535 - RNA, 64 nt, Homo Sapiens
aaauguuuugguuauucaugaucacuugggcaguauaagaaaauguagcuucugaauauuggcc

SEQ ID NO: 289536 - RNA, 64 nt, Homo Sapiens
aacaauguuuggaugcaacgcagaauaaaagaauauaagaaauagcuuuuuguugcauuaaugu

SEQ ID NO: 289537 - RNA, 64 nt, Homo Sapiens
uaauugguauggccauuagguucaguccuugaagauaagaaacuuguucucuguuuguugucuu

SEQ ID NO: 289538 - RNA, 64 nt, Homo Sapiens
aggaauucaauguauguuuguuuuauacuguuugauaagaaaaguagguccagccuuaagcagc

SEQ ID NO: 289539 - RNA, 64 nt, Homo Sapiens
uacugcccuaccuugacuguuuauaaaacucagcauaagaaaaaaaugauaauuugcuuauguc

SEQ ID NO: 289540 - RNA, 64 nt, Homo Sapiens
uauauugcuagguagaauuuaaaaagguauguugauaagaaacccaguuugaaaccagugagga

SEQ ID NO: 289541 - RNA, 64 nt, Homo Sapiens
uguguacucuagaaauggagauaauuuuuuucaaauaagaaaauuuaacaauaagaaauaagaa

SEQ ID NO: 289542 - RNA, 64 nt, Homo Sapiens
auuuuuuucaaauaagaaaauuuaacaauaagaaauaagaaauauuacuguaaagucuauucug

SEQ ID NO: 289543 - RNA, 64 nt, Homo Sapiens
agaaauaauuuuuuucaaauuauucuguuuaacaauaagaaauaguuguuguuacuguaaaguc

SEQ ID NO: 289544 - RNA, 64 nt, Homo Sapiens
uggaagauucuuuuaaaaauuuuaaaaaaugcuaauaagaaaauagucagagaugguauuaccu

SEQ ID NO: 289545 - RNA, 64 nt, Homo Sapiens
auugcaaacacauuaaaacagaaaaaggguaaguauaagaaaaucauggauagauuuuuggaac

SEQ ID NO: 289546 - RNA, 64 nt, Homo Sapiens
uuauuaaaauuaucuuugaauuuggaacugauucauaagaaaaggaugguuggucucuaauaua

SEQ ID NO: 289547 - RNA, 64 nt, Homo Sapiens
ugacauuucacagaugcacucccaaaacaccggcauaagaaauugugaugguaauuucauuagu

SEQ ID NO: 289548 - RNA, 64 nt, Homo Sapiens
aauuuucuacuucuacacccaguaccuuuccaccauaagaaauguauucaaucagauuuuccaa

SEQ ID NO: 289549 - RNA, 64 nt, Homo Sapiens
aaucagucaauauuuccaaaaagagucuugguagauaagaaaaaacuacuucugcuguucaauc

SEQ ID NO: 289550 - RNA, 64 nt, Homo Sapiens
ugauaagaauauagaugaucgaagaauggcuaaaauaagaaacggaaaauaagguucagaugca

SEQ ID NO: 289551 - RNA, 64 nt, Homo Sapiens
ugccauagaaauguagguccucagaaaguguauaauaagaaacuuauuucucauaucaacuuag

SEQ ID NO: 289552 - RNA, 64 nt, Homo Sapiens
aauaagaaacuuauuucucauaucaacuuagucaauaagaaaauauauucuuucaaaggaacau

SEQ ID NO: 289553 - RNA, 64 nt, Homo Sapiens
ugaugcauaguauuuuagucuacuuguauuguuuauaagaaacccaagcaaaaauauauagcaa

SEQ ID NO: 289554 - RNA, 64 nt, Homo Sapiens
gauuguucagcaaccuucaguaucuauuauuuuaauaagaaagaaacuuccccuaaacuuuaga

SEQ ID NO: 289555 - RNA, 64 nt, Homo Sapiens
gcaauaucuggguacuguauuuuccuaaaaugccauaagaaaaucuuuuacaaguggcuuuaca

SEQ ID NO: 289556 - RNA, 64 nt, Homo Sapiens
aauaaagacguauguuugacugguaaucuuucaaauaagaaaaauuuccucuguaaagaucaga

SEQ ID NO: 289557 - RNA, 64 nt, Homo Sapiens
aacuacuugauauagcaaagauaguuggucuuagauaagaaaugaauacaguagcaucauaccu

SEQ ID NO: 289558 - RNA, 64 nt, Homo Sapiens
uguauuaaaguccuuuuuugacaaaauuucuggaauaagaaauuucagcuuguccagaccugga

SEQ ID NO: 289559 - RNA, 64 nt, Homo Sapiens
uaaaucuauucccaugccagaaucuuaucaauacauaagaaauuuaggaagauuaggugccaaa

SEQ ID NO: 289560 - RNA, 64 nt, Homo Sapiens
auaauguugauguaaguaaugcgguuacugaaucauaagaaaaugccaucucuuuuuaguugaa

SEQ ID NO: 289561 - RNA, 64 nt, Homo Sapiens
uauuauggaaauguugucuuuuauacuuaguuauauaagaaaaaagggaguuaugcaauuaaua

SEQ ID NO: 289562 - RNA, 64 nt, Homo Sapiens
uguuuuauuuuuuucccuuuagcauugcaugugaauaagaaaauaauguuuaaagaaaaaaaaa

SEQ ID NO: 289563 - RNA, 63 nt, Homo Sapiens
aagcuuuuaaccuaucuuaacaacuuacugaacauaagaaaauuuacacuagagagaaagccu

SEQ ID NO: 289564 - RNA, 64 nt, Homo Sapiens
aaagcuuuucaccgauacucaauccuuaguacacauaagaaaauucauacuggggagaaacccc

SEQ ID NO: 289565 - RNA, 64 nt, Homo Sapiens
aaagcuuuuaaccaguccucacaccuuaugagacauaagaaaauucauaguaaagagaaacccu

SEQ ID NO: 289566 - RNA, 64 nt, Homo Sapiens
aguuguuuuaacuaguucucgaacuuuacuaugcauaagaaaauucaaacuggagagaaacucu

SEQ ID NO: 289567 - RNA, 64 nt, Homo Sapiens
ugcuugacccugaaauauuugcguuguuuuguggauaagaaaaauaaaaauguauguugguuua

SEQ ID NO: 289568 - RNA, 64 nt, Homo Sapiens
guuuaacagaaaaaugaaauuggcaguauugacaauaagaaacauguuguaauaucaguuacag

SEQ ID NO: 289569 - RNA, 64 nt, Homo Sapiens
uauccauuuuauuaccauuugaacauauuucuuaauaagaaaaaauuugauaaagcauauuuau

SEQ ID NO: 289570 - RNA, 64 nt, Homo Sapiens
ugucaaugaguuucuucaaaagucauaaacaaauauaagaaagcaugugacuuugaggccaaug

SEQ ID NO: 289571 - RNA, 64 nt, Homo Sapiens
uguauaauaaaaaugugguguccucuuagggaacauaagaaaaaaauuuuccccaaagauaaua

SEQ ID NO: 289572 - RNA, 64 nt, Homo Sapiens
uaagauagaaaagcuuuguuggcagaagauuaagauaagaaauaguuaagaccuucauuuaaga

SEQ ID NO: 289573 - RNA, 64 nt, Homo Sapiens
ucucauauuuaguauugaauacuuacauucucuaauaagaaaaccaccccuuagauugaaguaa

SEQ ID NO: 289574 - RNA, 64 nt, Homo Sapiens
ccacuucuggucaaucaacacuaccagcguauauauaagaaagacaucuuucucuuuucuaaaa

SEQ ID NO: 289575 - RNA, 64 nt, Homo Sapiens
gccugacagacaagcagaugaccucacaggagugauaagaaacaucugcuccacgccaacuccc

SEQ ID NO: 289576 - RNA, 64 nt, Homo Sapiens
agaagacaucauugguucuguguuuccuacggaaauaagaaacgauaaauauugcacugaaugu

SEQ ID NO: 289577 - RNA, 64 nt, Homo Sapiens
aguuguaaauuuguaaagauuaccuugccacuuuauaagaaaguguauuuaacuaaaaagucau

SEQ ID NO: 289578 - RNA, 64 nt, Homo Sapiens
gcacaaaauaguacuuuguggaucauuucaagauauaagaaauuuuggaaauuccaccauaaau

SEQ ID NO: 289579 - RNA, 64 nt, Homo Sapiens
guucugguagauauauccugucacuuuagagauaauaagaaauucaggaggcuaugucucuaau

SEQ ID NO: 289580 - RNA, 64 nt, Homo Sapiens
acauuagcaagcuuaaugguuauguaaacugaaaauaagaaaauaagcaaacaaaaaaaauuug

SEQ ID NO: 289581 - RNA, 64 nt, Homo Sapiens
uaaaguaaaccagcuuaucuaauuggaaagugggauaagaaaucauucauuaauuacacuuuaa

SEQ ID NO: 289582 - RNA, 64 nt, Homo Sapiens
aucugacuaaagucaaagaacaauuuuuuuuauaauaagaaaacauuaugugaauaucccuugc

SEQ ID NO: 289583 - RNA, 64 nt, Homo Sapiens
ggugucaggcugucacuguucacacaaauuuuuaauaagaaacauuuaccaagggagcaucuuu

SEQ ID NO: 289584 - RNA, 64 nt, Homo Sapiens
ugaacuggcauccugcuuuagccugagacuugccauaagaaacugcugaguacuuggcaaaccc

SEQ ID NO: 289585 - RNA, 64 nt, Homo Sapiens
guaguauuccugagaacuuuauuuuggaaaauuuauaagaaaguaauccaaauaagaaacacga

SEQ ID NO: 289586 - RNA, 64 nt, Homo Sapiens
uuuauuuuggaaaauuuauaagaaaguaauccaaauaagaaacacgauaguugaaaauaauuuu

SEQ ID NO: 289587 - RNA, 64 nt, Homo Sapiens
cagacuugcucuugauagaaucaguuugcaaacgauaagaaaugucuguaagguggaaauuuca

SEQ ID NO: 289588 - RNA, 64 nt, Homo Sapiens
aaggagcucuuacgaaaaacccuuuccuuaaaauauaagaaauauacacaaguuuuugccuauc

SEQ ID NO: 289589 - RNA, 64 nt, Homo Sapiens
ucaugcuggagagaaacacuaaucuuuauuacacauaagaaaauaaagcuuuuaaacaguccuc

SEQ ID NO: 289590 - RNA, 64 nt, Homo Sapiens
ucauacuggagagaaaaucuucagucuaguaaacauaagaaaauguaaauccuucagcugauuc

SEQ ID NO: 289591 - RNA, 64 nt, Homo Sapiens
aaauuacaggagcaauuaagaauuaguaauaaaaauaagaaauagugacagauuuuagagcaaa

SEQ ID NO: 289592 - RNA, 64 nt, Homo Sapiens
gcuacagugacagauuuuagguuuguuaauaaaaauaagaaauaaccuaaaaggaugucuaaau

SEQ ID NO: 289593 - RNA, 64 nt, Homo Sapiens
ucuuagagguuugucuacccauuuauuauaaaugauaagaaaaacauuuaacacuugggacaac

SEQ ID NO: 289594 - RNA, 64 nt, Homo Sapiens
gggauaauuuucugaacuuugaguuuugauuuugauaagaaacuuuguuggaauugggacuuag

SEQ ID NO: 289595 - RNA, 64 nt, Homo Sapiens
ggaggcaaagaacuuaaguuaggaaauuggguuuauaagaaaauuaguagagcugcaccuaaag

SEQ ID NO: 289596 - RNA, 64 nt, Homo Sapiens
gucauguuuugugggaaaaucuucuaguccaaauauaagaaacuaaauguaucuuuauuaguga

SEQ ID NO: 289597 - RNA, 61 nt, Homo Sapiens
caacucacaaaacguagcacaaacauucauuauggagaaagcaucaggacuguugaguaac

SEQ ID NO: 289598 - RNA, 61 nt, Homo Sapiens
auuauuccuguuugaaagguggugcaugcagauggagaagugguguuggcagcaagcuuug

SEQ ID NO: 289599 - RNA, 61 nt, Homo Sapiens
caauuguugcuuaugaaagaaugagguggggauggagaagaccuucaucaugucaguucca

SEQ ID NO: 289600 - RNA, 61 nt, Homo Sapiens
gacccucaagacaaaugacccauaaauuuaaauggagaaagcaacaagagacuggaaggac

SEQ ID NO: 289601 - RNA, 61 nt, Homo Sapiens
ucuguuucgaauauagccacagaaauaaaggauggagaaaaaucugggacagguaauuuug

SEQ ID NO: 289602 - RNA, 61 nt, Homo Sapiens
ucuguuucgaacauagccacagaaauaaaggauggagaaaaaucugggacagguaauuuug

SEQ ID NO: 289603 - RNA, 61 nt, Homo Sapiens
ucuguuuugaguauagccagagaaaacaaggauggagaaaaaucuaggacagguaauuuug

SEQ ID NO: 289604 - RNA, 61 nt, Homo Sapiens
ucuuuuucgaauauaaccagaggaaaaaaggauggagaaauaucuaggaaagguaauuuug

SEQ ID NO: 289605 - RNA, 61 nt, Homo Sapiens
ucuuuuucgaauauaaccagagaaaaaaaggauggagaaauaucuaggaaagguaauuuug

SEQ ID NO: 289606 - RNA, 61 nt, Homo Sapiens
ucuguuuuggguauagccagagaaaacaaggauggagaaaaaucuaggacagguaauuuug

SEQ ID NO: 289607 - RNA, 61 nt, Homo Sapiens
cacagggcuugguagaggguauaucuagugaauggagaauacauggagaaacuuaacuaag

SEQ ID NO: 289608 - RNA, 61 nt, Homo Sapiens
guagaggguauaucuagugaauggagaauacauggagaaacuuaacuaaguuacacaagca

SEQ ID NO: 289609 - RNA, 61 nt, Homo Sapiens
cuggcugccaugugguugauccuaccagcggauggagaaucuguccccaggguagaaaugu

SEQ ID NO: 289610 - RNA, 61 nt, Homo Sapiens
ccagggaagaagcagaacuuagggccggggcauggagaagaggagagguugcagaggcugc

SEQ ID NO: 289611 - RNA, 61 nt, Homo Sapiens
uuaacugagcuccuagagaagaacaauccucauggagaaacucuggaaaccuugacaaugg

SEQ ID NO: 289612 - RNA, 61 nt, Homo Sapiens
gcucucaaggcaaugacucgaaguuugcaguauggagaacaggugagucugcauagaguca

SEQ ID NO: 289613 - RNA, 61 nt, Homo Sapiens
caaaggaugugugaggauuucccaguacuggauggagaaugagaagagaaagucagccuuu

SEQ ID NO: 289614 - RNA, 61 nt, Homo Sapiens
agaagagaacgggcagaaguacagaacagaaauggagaagcugaccacgacuccaucucuu

SEQ ID NO: 289615 - RNA, 61 nt, Homo Sapiens
agccuaggaguucgagaccagccuaggcaacauggagaaaccccgucucuaucagaaauac

SEQ ID NO: 289616 - RNA, 61 nt, Homo Sapiens
aguaagcuuggaaaaauaauuuaagaauacaauggagaaauguaaauaaguaucuauguaa

SEQ ID NO: 289617 - RNA, 61 nt, Homo Sapiens
aaaauccucaggaaauuagaaaggguuugauauggagaaacguucauguuggccaugguga

SEQ ID NO: 289618 - RNA, 61 nt, Homo Sapiens
cccgucucuacuaaaaaugcgccugaccaacauggagaagcaggucgggaguucgagacca

SEQ ID NO: 289619 - RNA, 61 nt, Homo Sapiens
guauuucaagaucuaguccaacccuguagucauggagaaaguaugcucugguuggcaggca

SEQ ID NO: 289620 - RNA, 61 nt, Homo Sapiens
gugccuguuugggggaaaacaggugggcaggauggagaacacccgaugcucuaguguuugg

SEQ ID NO: 289621 - RNA, 61 nt, Homo Sapiens
acuaaugucucuucuaacaucuuagagguccauggagaaggcauauggagaacauguuuua

SEQ ID NO: 289622 - RNA, 61 nt, Homo Sapiens
cuaacaucuuagagguccauggagaaggcauauggagaacauguuuuauacugcucuauaa

SEQ ID NO: 289623 - RNA, 61 nt, Homo Sapiens
aaaaccaauaucuaguuacagugaucuuacuauggagaagacauaaauuaucaaauaucag

SEQ ID NO: 289624 - RNA, 61 nt, Homo Sapiens
ggugcaaaaagcugacuucuuauucuguagcauggagaauguuggcuguagucucaaauuu

SEQ ID NO: 289625 - RNA, 61 nt, Homo Sapiens
auccuagaaaaggucagaccaggacagcagcauggagaaagaauuugccaugacuuccugg

SEQ ID NO: 289626 - RNA, 61 nt, Homo Sapiens
gcagagcaguccagaaccagaacaaauggccauggagaaaccucccuugcuuaucuguaga

SEQ ID NO: 289627 - RNA, 61 nt, Homo Sapiens
ucauaacaguucauucuacuaaaccuggaauauggagaauuauaguacuuuucuauguagu

SEQ ID NO: 289628 - RNA, 61 nt, Homo Sapiens
agucacuguagacuuucuucgugaacuccaaauggagaaguagguauuugcugagaugugg

SEQ ID NO: 289629 - RNA, 61 nt, Homo Sapiens
aauguuuccuggguuugcucuuugacaauaaauggagaaggaaggucacccaacuccauug

SEQ ID NO: 289630 - RNA, 61 nt, Homo Sapiens
uggccaggauggcagagacuuccuugucaucauggagaagugccagcaggggacugggaaa

SEQ ID NO: 289631 - RNA, 61 nt, Homo Sapiens
ccccgucucuacaaaaaauagccuggccaacauggagaaccaggucaggaguuugagacca

SEQ ID NO: 289632 - RNA, 61 nt, Homo Sapiens
gagugagugcugugaacggugaguggaugaaauggagaacauacagaccuuuugcaugggu

SEQ ID NO: 289633 - RNA, 61 nt, Homo Sapiens
ugaauggacaaagcucaggauggaagggccaauggagaaaaaauuucuggaagaaaggcug

SEQ ID NO: 289634 - RNA, 61 nt, Homo Sapiens
gaagcagaggaaggaaacauagguuagcccaauggagaaauugugcagacaauucucccug

SEQ ID NO: 289635 - RNA, 61 nt, Homo Sapiens
cauuuaaaauuguuuuaaauaucauagauuaauggagaaaauaucuuuuaucaguguucag

SEQ ID NO: 289636 - RNA, 61 nt, Homo Sapiens
ucugaagaauuuucaaggcguccuguaggacauggagaacuauuuuaugcuaaagguuuug

SEQ ID NO: 289637 - RNA, 61 nt, Homo Sapiens
ugacaaugccaaucauaggccuuguuuucccauggagaagaauauuuggaccuuuaaacag

SEQ ID NO: 289638 - RNA, 61 nt, Homo Sapiens
agcccaugccucacagacagaaaagacuuaaauggagaaccucagagaacuugccagauag

SEQ ID NO: 289639 - RNA, 61 nt, Homo Sapiens
ccaaagcugggcucaguggggaaggucaggaauggagaaauugccuuuucucguuagccuc

SEQ ID NO: 289640 - RNA, 61 nt, Homo Sapiens
aggucaggaguucgaaaccagccuggccaacauggagaaaccccaucucuacuaaaaauac

SEQ ID NO: 289641 - RNA, 61 nt, Homo Sapiens
agaucauuauucuaagugaaauaacucaggaauggagaaccaaauauuguacauccucacu

SEQ ID NO: 289642 - RNA, 61 nt, Homo Sapiens
cacgccgggggugaaaauguacgucuguagcauggagaagccuucaggguacauucagcuc

SEQ ID NO: 289643 - RNA, 61 nt, Homo Sapiens
ugguuccaucuuuaaggaagaagaauguuugauggagaaaauuuguggccaaugaagucug

SEQ ID NO: 289644 - RNA, 61 nt, Homo Sapiens
guuugugaaacaguaggauucucuuuuggcaauggagaauugcaucugaugguucaagugu

SEQ ID NO: 289645 - RNA, 61 nt, Homo Sapiens
gcuuuuguugaguuaaauaagaugcuauauaauggagaagaauuugaaaaugcacaaaaaa

SEQ ID NO: 289646 - RNA, 64 nt, Homo Sapiens; identical to SEQ ID NO: 250537

SEQ ID NO: 289647 - RNA, 64 nt, Homo Sapiens; identical to SEQ ID NO: 250538

SEQ ID NO: 289648 - RNA, 64 nt, Homo Sapiens; identical to SEQ ID NO: 250539

SEQ ID NO: 289649 - RNA, 64 nt, Homo Sapiens; identical to SEQ ID NO: 250540

SEQ ID NO: 289650 - RNA, 64 nt, Homo Sapiens; identical to SEQ ID NO: 250541

SEQ ID NO: 289651 - RNA, 64 nt, Homo Sapiens; identical to SEQ ID NO: 250542

SEQ ID NO: 289652 - RNA, 64 nt, Homo Sapiens; identical to SEQ ID NO: 250543

SEQ ID NO: 289653 - RNA, 64 nt, Homo Sapiens; identical to SEQ ID NO: 250544

SEQ ID NO: 289654 - RNA, 64 nt, Homo Sapiens; identical to SEQ ID NO: 250545

SEQ ID NO: 289655 - RNA, 64 nt, Homo Sapiens; identical to SEQ ID NO: 250546

SEQ ID NO: 289656 - RNA, 64 nt, Homo Sapiens; identical to SEQ ID NO: 250547

SEQ ID NO: 289657 - RNA, 64 nt, Homo Sapiens; identical to SEQ ID NO: 250548

SEQ ID NO: 289658 - RNA, 64 nt, Homo Sapiens; identical to SEQ ID NO: 250549

SEQ ID NO: 289659 - RNA, 64 nt, Homo Sapiens; identical to SEQ ID NO: 250550

SEQ ID NO: 289660 - RNA, 64 nt, Homo Sapiens; identical to SEQ ID NO: 250551

SEQ ID NO: 289661 - RNA, 64 nt, Homo Sapiens; identical to SEQ ID NO: 250552

SEQ ID NO: 289662 - RNA, 64 nt, Homo Sapiens; identical to SEQ ID NO: 250553

SEQ ID NO: 289663 - RNA, 64 nt, Homo Sapiens; identical to SEQ ID NO: 250554

SEQ ID NO: 289664 - RNA, 64 nt, Homo Sapiens; identical to SEQ ID NO: 250555

SEQ ID NO: 289665 - RNA, 64 nt, Homo Sapiens; identical to SEQ ID NO: 250556

SEQ ID NO: 289666 - RNA, 64 nt, Homo Sapiens; identical to SEQ ID NO: 250557

SEQ ID NO: 289667 - RNA, 64 nt, Homo Sapiens; identical to SEQ ID NO: 250558

SEQ ID NO: 289668 - RNA, 64 nt, Homo Sapiens; identical to SEQ ID NO: 250559

SEQ ID NO: 289669 - RNA, 64 nt, Homo Sapiens; identical to SEQ ID NO: 250560

SEQ ID NO: 289670 - RNA, 64 nt, Homo Sapiens; identical to SEQ ID NO: 250561

SEQ ID NO: 289671 - RNA, 64 nt, Homo Sapiens; identical to SEQ ID NO: 250562

SEQ ID NO: 289672 - RNA, 64 nt, Homo Sapiens; identical to SEQ ID NO: 250563

SEQ ID NO: 289673 - RNA, 64 nt, Homo Sapiens; identical to SEQ ID NO: 250564

SEQ ID NO: 289674 - RNA, 64 nt, Homo Sapiens; identical to SEQ ID NO: 250565

SEQ ID NO: 289675 - RNA, 64 nt, Homo Sapiens; identical to SEQ ID NO: 250566

SEQ ID NO: 289676 - RNA, 64 nt, Homo Sapiens; identical to SEQ ID NO: 250567

SEQ ID NO: 289677 - RNA, 64 nt, Homo Sapiens; identical to SEQ ID NO: 250568

SEQ ID NO: 289678 - RNA, 64 nt, Homo Sapiens; identical to SEQ ID NO: 250569

SEQ ID NO: 289679 - RNA, 64 nt, Homo Sapiens; identical to SEQ ID NO: 250570

SEQ ID NO: 289680 - RNA, 64 nt, Homo Sapiens; identical to SEQ ID NO: 250571

SEQ ID NO: 289681 - RNA, 64 nt, Homo Sapiens; identical to SEQ ID NO: 250572

SEQ ID NO: 289682 - RNA, 64 nt, Homo Sapiens; identical to SEQ ID NO: 250573

SEQ ID NO: 289683 - RNA, 64 nt, Homo Sapiens; identical to SEQ ID NO: 250574

SEQ ID NO: 289684 - RNA, 64 nt, Homo Sapiens; identical to SEQ ID NO: 250575

SEQ ID NO: 289685 - RNA, 64 nt, Homo Sapiens; identical to SEQ ID NO: 250576

SEQ ID NO: 289686 - RNA, 64 nt, Homo Sapiens; identical to SEQ ID NO: 250577

SEQ ID NO: 289687 - RNA, 64 nt, Homo Sapiens; identical to SEQ ID NO: 250578

SEQ ID NO: 289688 - RNA, 64 nt, Homo Sapiens; identical to SEQ ID NO: 250579

SEQ ID NO: 289689 - RNA, 64 nt, Homo Sapiens; identical to SEQ ID NO: 250580

SEQ ID NO: 289690 - RNA, 62 nt, Homo Sapiens; identical to SEQ ID NO: 250581

SEQ ID NO: 289691 - RNA, 64 nt, Homo Sapiens; identical to SEQ ID NO: 250582

SEQ ID NO: 289692 - RNA, 64 nt, Homo Sapiens; identical to SEQ ID NO: 250583

SEQ ID NO: 289693 - RNA, 64 nt, Homo Sapiens; identical to SEQ ID NO: 250584

SEQ ID NO: 289694 - RNA, 64 nt, Homo Sapiens; identical to SEQ ID NO: 250585

SEQ ID NO: 289695 - RNA, 64 nt, Homo Sapiens; identical to SEQ ID NO: 250586

SEQ ID NO: 289696 - RNA, 64 nt, Homo Sapiens; identical to SEQ ID NO: 250587

SEQ ID NO: 289697 - RNA, 64 nt, Homo Sapiens; identical to SEQ ID NO: 120044

SEQ ID NO: 289698 - RNA, 64 nt, Homo Sapiens; identical to SEQ ID NO: 120045

SEQ ID NO: 289699 - RNA, 64 nt, Homo Sapiens; identical to SEQ ID NO: 120046

SEQ ID NO: 289700 - RNA, 64 nt, Homo Sapiens; identical to SEQ ID NO: 120047

SEQ ID NO: 289701 - RNA, 64 nt, Homo Sapiens; identical to SEQ ID NO: 120048

SEQ ID NO: 289702 - RNA, 64 nt, Homo Sapiens; identical to SEQ ID NO: 120049

SEQ ID NO: 289703 - RNA, 64 nt, Homo Sapiens; identical to SEQ ID NO: 120050

SEQ ID NO: 289704 - RNA, 64 nt, Homo Sapiens; identical to SEQ ID NO: 120051

SEQ ID NO: 289705 - RNA, 64 nt, Homo Sapiens; identical to SEQ ID NO: 120052

SEQ ID NO: 289706 - RNA, 64 nt, Homo Sapiens; identical to SEQ ID NO: 120053

SEQ ID NO: 289707 - RNA, 64 nt, Homo Sapiens; identical to SEQ ID NO: 120054

SEQ ID NO: 289708 - RNA, 64 nt, Homo Sapiens; identical to SEQ ID NO: 120055

SEQ ID NO: 289709 - RNA, 64 nt, Homo Sapiens; identical to SEQ ID NO: 120056

SEQ ID NO: 289710 - RNA, 64 nt, Homo Sapiens; identical to SEQ ID NO: 120057

SEQ ID NO: 289711 - RNA, 64 nt, Homo Sapiens; identical to SEQ ID NO: 120058

SEQ ID NO: 289712 - RNA, 64 nt, Homo Sapiens; identical to SEQ ID NO: 120059

SEQ ID NO: 289713 - RNA, 64 nt, Homo Sapiens; identical to SEQ ID NO: 120060

SEQ ID NO: 289714 - RNA, 64 nt, Homo Sapiens; identical to SEQ ID NO: 120061

SEQ ID NO: 289715 - RNA, 64 nt, Homo Sapiens; identical to SEQ ID NO: 120062

SEQ ID NO: 289716 - RNA, 64 nt, Homo Sapiens; identical to SEQ ID NO: 120063

SEQ ID NO: 289717 - RNA, 64 nt, Homo Sapiens; identical to SEQ ID NO: 120064

SEQ ID NO: 289718 - RNA, 64 nt, Homo Sapiens; identical to SEQ ID NO: 120065

SEQ ID NO: 289719 - RNA, 64 nt, Homo Sapiens; identical to SEQ ID NO: 120066

SEQ ID NO: 289720 - RNA, 54 nt, Homo Sapiens; identical to SEQ ID NO: 120067

SEQ ID NO: 289721 - RNA, 64 nt, Homo Sapiens; identical to SEQ ID NO: 120068

SEQ ID NO: 289722 - RNA, 64 nt, Homo Sapiens; identical to SEQ ID NO: 120069

SEQ ID NO: 289723 - RNA, 64 nt, Homo Sapiens; identical to SEQ ID NO: 120070

SEQ ID NO: 289724 - RNA, 64 nt, Homo Sapiens; identical to SEQ ID NO: 120071

SEQ ID NO: 289725 - RNA, 64 nt, Homo Sapiens
agcuuaaaaguuuaguaaaaaucgucugggcacaguggcucacgccuguaaucccagcacuuug

SEQ ID NO: 289726 - RNA, 64 nt, Homo Sapiens
aucucaaagagaaaaaaaaaaaagaccgggugugguggcucacaccuguaaucccagcacuuug

SEQ ID NO: 289727 - RNA, 64 nt, Homo Sapiens
uaugauuaagauaaugccgggcaggccgggcacaguggcucacgccuguaauccaagcacuugg

SEQ ID NO: 289728 - RNA, 64 nt, Homo Sapiens
uuaaccugccucuugaaagauucaaccgggugugguggcucacgccuguaaucccagcacauug

SEQ ID NO: 289729 - RNA, 64 nt, Homo Sapiens
ccucuccagcuacccuuuuaccucaucagaagcaguggcucagcuaagugcucccccuagcucc

SEQ ID NO: 289730 - RNA, 64 nt, Homo Sapiens
cugggccuuucuuucaucccaaaugacaaggaauguggcucagagaaggguuuuucuuuuuuga

SEQ ID NO: 289731 - RNA, 64 nt, Homo Sapiens
caagauguagaaaauagaaaauaggcuaggcacaguggcucacgccuguaaucucaacacuuug

SEQ ID NO: 289732 - RNA, 64 nt, Homo Sapiens
gugcuguuuaaagucugaagcucggccaggugcgguggcucacgccuguaaucccaaaacuuug

SEQ ID NO: 289733 - RNA, 64 nt, Homo Sapiens
ugcuuguguaagaaacugaaauaagcugcgugugguggcucacaccuguaaucccaacacuuug

SEQ ID NO: 289734 - RNA, 64 nt, Homo Sapiens
aucucaaaggaaaaaggaaacuaggccaggcgugguggcucacgccuguaaucccaacacuuug

SEQ ID NO: 289735 - RNA, 64 nt, Homo Sapiens
uuccauuuuaaagaguguaggcaggccaggugcaguggcucaugccuguaaucccagcauuuug

SEQ ID NO: 289736 - RNA, 64 nt, Homo Sapiens
gcaaacacaagaacuauacacauggccaggcgcgguggcucacacccguaaucccagcacuuug

SEQ ID NO: 289737 - RNA, 64 nt, Homo Sapiens
ccuguaaucccagcacugggauuggccaggcgcaguggcucacguucaaaaguaauuggcagug

SEQ ID NO: 289738 - RNA, 64 nt, Homo Sapiens
ccuguaaucccagcacuuuggcaggcugggcgcgguggcucacgccgucuuaaaaaagcccaug

SEQ ID NO: 289739 - RNA, 64 nt, Homo Sapiens
gcuccuugggugcauguguaaccagggcaaagcaguggcucagggccagaaccugucgcuggaa

SEQ ID NO: 289740 - RNA, 64 nt, Homo Sapiens
uaauuuuugccauuuggccagguagagccgggcuguggcucaggagccuuggcuggaaaacugu

SEQ ID NO: 289741 - RNA, 64 nt, Homo Sapiens
ugagcacaggaguuugaggcggaggcugacguggguggcucacuccuguggucccaguuacuug

SEQ ID NO: 289742 - RNA, 64 nt, Homo Sapiens
ccuguaaucucggcacuuugaaugaccaggcacaguggcucacgacaggcauuuaaaaaauuaa

SEQ ID NO: 289743 - RNA, 64 nt, Homo Sapiens
ccuguaaucccagcacuuuguuaaaauuagccugguggcucacgcaucucaaaaaacauuauuu

SEQ ID NO: 289744 - RNA, 64 nt, Homo Sapiens
ccuguaaucccagcacuuuguuaggccgggcaugguggcucacgaacuggcaagauuaacaaaa

SEQ ID NO: 289745 - RNA, 64 nt, Homo Sapiens
ccuguaaucccaacacuuugaaacgccacguguaguggcucauguuuguacagaagaggauuca

SEQ ID NO: 289746 - RNA, 64 nt, Homo Sapiens
ccuguaaucccaguacuuggugaggccgggcacgguggcucacgacuaauuagaaaauauaguu

SEQ ID NO: 289747 - RNA, 64 nt, Homo Sapiens
ccuguaaucccagcacuuugcugagccagccgugguggcucacauguuuuaagauuuuuggguc

SEQ ID NO: 289748 - RNA, 64 nt, Homo Sapiens
ccuguaaucccagcacuugguuuggccgggcaugguggcucaugcaucaagaauagucaaguuu

SEQ ID NO: 289749 - RNA, 64 nt, Homo Sapiens
uuuuuacuuauaauaccaauuuaggcugggcgcaguggcucacgccuguaaucccagcacuuug

SEQ ID NO: 289750 - RNA, 64 nt, Homo Sapiens
aaaaaaaaacaaaaaccaguuuaggcuggguaugguggcucaccagcacuuugggaggcugagg

SEQ ID NO: 289751 - RNA, 64 nt, Homo Sapiens
cagaauuuuggaagagcaaauggggcugagugcaguggcucaugccuguaaucccagcacuuag

SEQ ID NO: 289752 - RNA, 64 nt, Homo Sapiens
agccuauuaaaaaaugcuguccaggccaggcacaguggcucacaccuguaaucccaggacuucg

SEQ ID NO: 289753 - RNA, 64 nt, Homo Sapiens
ugguuaacuauuaaauguugaccuagccagcgcaguggcucaugccuguaaucccagcacuuug

SEQ ID NO: 289754 - RNA, 64 nt, Homo Sapiens
uuaagaaacuaugacuuguaguaagccgggcgcgguggcucacgccuguaaucccaacacuuug

SEQ ID NO: 289755 - RNA, 64 nt, Homo Sapiens
ucuucauaaaaaauguuaacgugggcugggcaugguggcucaugccuguaaucccagcacucug

SEQ ID NO: 289756 - RNA, 64 nt, Homo Sapiens
aucauuucaagauaggcuuagcaggaugggcgcaguggcucacgccacuaaucccaacauuuua

SEQ ID NO: 289757 - RNA, 64 nt, Homo Sapiens
ucucuauuuuauaaauuaaaaaaggcugggugugguggcucacacccauaaucccaacacuuug

SEQ ID NO: 289758 - RNA, 64 nt, Homo Sapiens
guggacugggccuugucacuggaggucguaggcaguggcucaucacccugguagggcugauagg

SEQ ID NO: 289759 - RNA, 64 nt, Homo Sapiens
gacgaggccuccccagcccugcccggugcaggagguggcucaguuauugaaccuuuugggaagc

SEQ ID NO: 289760 - RNA, 64 nt, Homo Sapiens
ccuguaaucucagcacuuuggagggcuaggcuuaguggcucacguaguacucauuuaaaaacua

SEQ ID NO: 289761 - RNA, 64 nt, Homo Sapiens
ccuguaaucccaguacuuugguaggccgggcaugguggcucacgagucccuuauauaaaauggu

SEQ ID NO: 289762 - RNA, 64 nt, Homo Sapiens
ccuguaaucccagcacuuuguuuggcugggcaugguggcucacggccucaaaaaaugcuaaaac

SEQ ID NO: 289763 - RNA, 64 nt, Homo Sapiens
cuuguaaucccagcacuuugacuggcugggugcgguggcucacguuccauaagaagacauuuug

SEQ ID NO: 289764 - RNA, 64 nt, Homo Sapiens
ccuguaaucccagcauuuuguaaggcuggaagcuguggcucacaugcugagucaagauuuauau

SEQ ID NO: 289765 - RNA, 64 nt, Homo Sapiens
ccuguaauccgagcaauuugaugggccaggugcaguggcucacuagacagguguuaaugcaucu

SEQ ID NO: 289766 - RNA, 64 nt, Homo Sapiens
aaagcuaaauaaaaauguagacauggcuggcgcaguggcucaugcuuguaauccuagcacuuuu

SEQ ID NO: 289767 - RNA, 64 nt, Homo Sapiens
uccacaaaaaaaaugaaaaauaaaccugggugcgguggcucacaccuguaaucccagcacuuug

SEQ ID NO: 289768 - RNA, 64 nt, Homo Sapiens
uagcauauagaagaaaguuaauaggccgggcuugguggcucaugccuguaaucccagcacuuug

SEQ ID NO: 289769 - RNA, 64 nt, Homo Sapiens
agcaacaauaaaaaguagacaugggcugggugcaguggcucacuccuguagucccaggacuuug

SEQ ID NO: 289770 - RNA, 64 nt, Homo Sapiens
caccaguaauaaagaaacauaagggcugggggugguggcucaugccuguaaucccagcacuuug

SEQ ID NO: 289771 - RNA, 64 nt, Homo Sapiens
ggacauagaaaauguuuugaauaggccaggcgcaguggcucacaccuguaaucccagcacguug

SEQ ID NO: 289772 - RNA, 64 nt, Homo Sapiens
aagccauguaaaaaguaaauaaugucugggcacaguggcucacgccuguaauccuagcacuuug

SEQ ID NO: 289773 - RNA, 64 nt, Homo Sapiens
agaaagucccuggucaggucucagguagugcgguguggcucagcuggguuuuuaauuagcgcau

SEQ ID NO: 289774 - RNA, 64 nt, Homo Sapiens
ugccacuaaagagcuuuuugguuuccugggccuuguggcucagcgacaauuaauuccuggucua

SEQ ID NO: 289775 - RNA, 64 nt, Homo Sapiens
acggcccaggguggccuuggcgccguggcccgcuguggcucaccaccugcaggaugggccgcgc

SEQ ID NO: 289776 - RNA, 64 nt, Homo Sapiens
ccuauaaucccagcacuauguuuggccgggcacgguggcucacaaauaagcuuaaacaaauaac

SEQ ID NO: 289777 - RNA, 64 nt, Homo Sapiens
ccuguaaucccagcacuuugaggggccgggugugguggcucacauuucaggaaucaaaagauaa

SEQ ID NO: 289778 - RNA, 64 nt, Homo Sapiens
ccuguaaucccagcacuguaucuaggccggugcgguggcucauguguaaauuaguaguugaaau

SEQ ID NO: 289779 - RNA, 64 nt, Homo Sapiens
ccuguaaucccagcacuauguugggccaggugcgguggcucaugagaaauuagaaaaucaagcu

SEQ ID NO: 289780 - RNA, 64 nt, Homo Sapiens
caguuuuuaaaaaauugcuuguaggcugagcgcgguggcucacgccuguaaucccagcacuuug

SEQ ID NO: 289781 - RNA, 64 nt, Homo Sapiens
cucuuuaaagagaauaaauagagggccaggugugguggcucacgccugugaucccagcacuuug

SEQ ID NO: 289782 - RNA, 64 nt, Homo Sapiens
ccuguaaucccagcacuuuaauaggccauggacgguggcucacguuaaaagaugaaagagggaa

SEQ ID NO: 289783 - RNA, 64 nt, Homo Sapiens
aguuggccagcccagcagggcaaagcucaggcaaguggcucaguugugacgagacugcacaaga

SEQ ID NO: 289784 - RNA, 64 nt, Homo Sapiens
uuuuaaggauaaaaacuaacauuggccaggcacgguggcucacgccuguaaucccaacacuuua

SEQ ID NO: 289785 - RNA, 64 nt, Homo Sapiens
gucagguauuuaaaauguuacauaugccggcgcaguggcucauguguguaaucccagcacucug

SEQ ID NO: 289786 - RNA, 64 nt, Homo Sapiens
aaauacaaaaaauacaaaaaauuagccgggcgcgguggcucacaccuguaaucccagcacuuug

SEQ ID NO: 289787 - RNA, 64 nt, Homo Sapiens
acccuuagaaggauggcucugguggccgggcgcgguggcucaaaccuguaaucccagcacuuug

SEQ ID NO: 289788 - RNA, 64 nt, Homo Sapiens
acuguuuuaaaauuacggugauuggccaggugcaguggcucacaccuguaaucccagcacuuug

SEQ ID NO: 289789 - RNA, 64 nt, Homo Sapiens
aaccaucaaaguuacuaaaacauggccaggcgcaguggcucaugccuguaaucccagcacuuug

SEQ ID NO: 289790 - RNA, 64 nt, Homo Sapiens
ugagggacucccuccucuucagagaagcccuccuguggcucaggggcagcugcagggccagaug

SEQ ID NO: 289791 - RNA, 64 nt, Homo Sapiens
cacaaauuaaaacuggguuuccaggccuggugugguggcucacgccuguagccccagcuauugc

SEQ ID NO: 289792 - RNA, 64 nt, Homo Sapiens
aggcuuuuaaaaacuuucaucuaggccacgugcgguggcucaugccuguaaucccggcacuuug

SEQ ID NO: 289793 - RNA, 64 nt, Homo Sapiens
uuugcccucuagaaagcaacugaggccaggugcgguggcucacgccuguaaucccagcacuuug

SEQ ID NO: 289794 - RNA, 64 nt, Homo Sapiens
auugcaagagggagcucaaucuuggccgggcgccguggcucacgccuguaaucgcagcacuuug

SEQ ID NO: 289795 - RNA, 64 nt, Homo Sapiens
ccuguaaucccagcacuuugguuagcugggugugguggcucaugcugucucaucaaaaacugaa

SEQ ID NO: 289796 - RNA, 64 nt, Homo Sapiens
ccuguaaucccagcacuuugaauagccaggcaugguggcucaugcugaaguuagaaacaagguu

SEQ ID NO: 289797 - RNA, 64 nt, Homo Sapiens
ccuguaaucccagcacuuugccuggcugggcgugguggcucacggagacaaaaaauuugaagug

SEQ ID NO: 289798 - RNA, 64 nt, Homo Sapiens
cuuguaaucccagcacuuugcuagcccaggagcgguggcucacaaucucaaaaaaaaaagaguu

SEQ ID NO: 289799 - RNA, 64 nt, Homo Sapiens
cuuguaaucccagcacuuugcuaggcggggcgugguggcucacacuucauucucuauaagaguu

SEQ ID NO: 289800 - RNA, 64 nt, Homo Sapiens
ccuguaauccgacuguaagcacuggccaggcacaguggcucacaccugucucaaaaaaaugcag

SEQ ID NO: 289801 - RNA, 64 nt, Homo Sapiens
ccuguaaucccagcgcuuuggcaggccaggugcgguggcucacauugggcugcuuguuaaaaau

SEQ ID NO: 289802 - RNA, 64 nt, Homo Sapiens
ugcagaucauuuaagaaguaacaggccgggcgcgguggcucacgccuguaaucccagcacuuug

SEQ ID NO: 289803 - RNA, 64 nt, Homo Sapiens
gggaauuaaaaaguaaaauaauaggccaggcaugguggcucaugccuauaagcacccugggagg

SEQ ID NO: 289804 - RNA, 64 nt, Homo Sapiens
uauaaaaguaaaggagaauaacuggccgggcacgguggcucaugccuauaaaauuccagcacuu

SEQ ID NO: 289805 - RNA, 64 nt, Homo Sapiens
cucaagcuuaguuggcagcacucuccacacuucuguggcucagugauuacugcuauuacuauau

SEQ ID NO: 289806 - RNA, 64 nt, Homo Sapiens
ugaagucaacuucuaucaacuucaggccaggcccguggcucaugccuguauaaucccagcacuu

SEQ ID NO: 289807 - RNA, 64 nt, Homo Sapiens
ccuguaaucccagcacuuuguauggcuggacgcgguggcucacggaacucugaaaauguacaug

SEQ ID NO: 289808 - RNA, 64 nt, Homo Sapiens
ccuguaaucccagcacuuugucaggccagucgugguggcucaugcccaagaugaagaagccccu

SEQ ID NO: 289809 - RNA, 64 nt, Homo Sapiens
uuaauaucacuguauuaaaagucugccgggcacaguggcucacgccuguaaucccaacacuuug

SEQ ID NO: 289810 - RNA, 64 nt, Homo Sapiens
cuccacuaaaaguacaaaaaauuagcugggcgugguggcucaugccuguaaucccagcuacuca

SEQ ID NO: 289811 - RNA, 64 nt, Homo Sapiens
ucgguaagauguaaagaacucuuggccaggugugguggcucaugccuauaaucccagcacuuug

SEQ ID NO: 289812 - RNA, 64 nt, Homo Sapiens
aaaguauaagcuaauacccaucaggcugggugugguggcucacgccuguaauccuagcacuuug

SEQ ID NO: 289813 - RNA, 64 nt, Homo Sapiens
caggagugaagacugugaugugugguccccauauguggcucagcaaagacucgagagaucaucc

SEQ ID NO: 289814 - RNA, 64 nt, Homo Sapiens
ggaagaauaaaguuaaccaagcaggccaggcacgguggcucacgccuauaaucccagcacuuag

SEQ ID NO: 289815 - RNA, 64 nt, Homo Sapiens
gcaaccucugccccccaagucaggcuggagugcaguggcucaauacgggucucacucugucacc

SEQ ID NO: 289816 - RNA, 64 nt, Homo Sapiens
ccuguaaucccagcacuuugccaggccgggcacaguggcucacgaguuugcauuaauaauccuu

SEQ ID NO: 289817 - RNA, 64 nt, Homo Sapiens
ccuguaauuccagcauguugucucaccaggcgcaguggcucacgggucgggaguuugaaaccag

SEQ ID NO: 289818 - RNA, 64 nt, Homo Sapiens
ccuguaaucccagcacucugcugggccagacgcaguggcucaugguccagagaauaggggaaga

SEQ ID NO: 289819 - RNA, 64 nt, Homo Sapiens
ggagcuuucaaaaagcacaaauaggcuggacaugguggcucaugccuguaaucccaguacuuug

SEQ ID NO: 289820 - RNA, 64 nt, Homo Sapiens
accugacaguaagaaaauacucuggcuggucucaguggcucaugucuguaauucuagcauguua

SEQ ID NO: 289821 - RNA, 64 nt, Homo Sapiens
ccuguaaucccagcuacgcaaaaggccaggcacgguggcucaugagacccuguuuaaaaaagaa

SEQ ID NO: 289822 - RNA, 64 nt, Homo Sapiens
cuuguaaucccagcacuuugccugguugggugugguggcucacaacuuaaaaauguucaaauaa

SEQ ID NO: 289823 - RNA, 64 nt, Homo Sapiens
caccggccuugaagaggugauccuggcaugagcaguggcucaccaggaguauguaugaggucca

SEQ ID NO: 289824 - RNA, 64 nt, Homo Sapiens
guccacuaucacugcucaggcgucgggauggcaaguggcucaauaagagacccgggucuggcac

SEQ ID NO: 289825 - RNA, 64 nt, Homo Sapiens
gaauuuagauauuccaauuugcaucagucuuucuguggcucaaauaaugaugauuauggaauga

SEQ ID NO: 289826 - RNA, 64 nt, Homo Sapiens
gguguuccuuauaagagaagauagggcgggcaugguggcucacgccuguaaucccagcacugug

SEQ ID NO: 289827 - RNA, 64 nt, Homo Sapiens
uaagaaauuuguguuauuugauaggccgggcaugguggcucaugccuguaaucccagcacuuug

SEQ ID NO: 289828 - RNA, 64 nt, Homo Sapiens
accauuaagauuauccaaagucaggcugggcgcaguggcucacgccuguaaucccagcacuuug

SEQ ID NO: 289829 - RNA, 64 nt, Homo Sapiens
ccuguaaucccagcacuuugucuggccgggcaugguggcucaagaccguuaacaaaaaaguaag

SEQ ID NO: 289830 - RNA, 64 nt, Homo Sapiens
uaaaagaaaaaaaagguuaaaaaagagcacuucuguggcucauuuugauuugcgucaacauuau

SEQ ID NO: 289831 - RNA, 64 nt, Homo Sapiens
ucuguaauaccagcgcuuuguuaggcugggcuugguggcucacaguuuaauagagaaaugcugu

SEQ ID NO: 289832 - RNA, 64 nt, Homo Sapiens
ccuguaaucccagcacuuuguugggcugggcgcaguggcucacguuuuuuacaaaaagucacuu

SEQ ID NO: 289833 - RNA, 64 nt, Homo Sapiens
uuaucucauuuuacacaaagggaagucgggcaugguggcucaugccuguaaucucagcacuuug

SEQ ID NO: 289834 - RNA, 64 nt, Homo Sapiens
aaaaaaaaaaaaaaaaacuuuagaacugggugcaguggcucaugccuguaaucccagccagcac

SEQ ID NO: 289835 - RNA, 64 nt, Homo Sapiens
guggcuucaagaguccuuacugaagccaggcaccguggcucacgucuguaaucccagcgcuuug

SEQ ID NO: 289836 - RNA, 64 nt, Homo Sapiens
ccauuuaaaagucugccuauccuggccaggugugguggcucacaccuguaaucccagcacuuug

SEQ ID NO: 289837 - RNA, 64 nt, Homo Sapiens
ccuguaauccuagcacuuugucuggcugggcacaguggcucacaaguccagugaaaugauauau

SEQ ID NO: 289838 - RNA, 64 nt, Homo Sapiens
ccugaaauccuagcacuuugucaggcugggcacaguggcucaugcugaguucaagaaaaguacu

SEQ ID NO: 289839 - RNA, 64 nt, Homo Sapiens
ccuguaaucccagcacuuugagcagucaggcacgguggcucaugugaaaugguauuuagaaagc

SEQ ID NO: 289840 - RNA, 64 nt, Homo Sapiens
ccuguaaucccagcauuuugguuggccaggcaugguggcucauggcaaguaacuaaagguuggu

SEQ ID NO: 289841 - RNA, 64 nt, Homo Sapiens
ccuuguaaucccagcacuuuuaaggccaggagcaguggcucacacuacauacaagacuucacca

SEQ ID NO: 289842 - RNA, 64 nt, Homo Sapiens
ggacauuuaagcgaaguaaaagaggccgggugcgguggcucacgccuguaaucccaacacuuua

SEQ ID NO: 289843 - RNA, 64 nt, Homo Sapiens
acuuugucaaaguuguauggcugaggcccacacgguggcucacuucuguaaucccaucacuuug

SEQ ID NO: 289844 - RNA, 64 nt, Homo Sapiens
uagucuaucaaacaagaaaugcuggcuuggcccgguggcucaugccuguaaucccagcacugug

SEQ ID NO: 289845 - RNA, 64 nt, Homo Sapiens
agagguuuuaaaaucaaauuugaggccaggugcaguggcucaugggcggaggagggcagauuac

SEQ ID NO: 289846 - RNA, 64 nt, Homo Sapiens
ccuguaauccuagcaacucgaguugcuggguguaguggcucauguuuuuguauuacaaguugac

SEQ ID NO: 289847 - RNA, 64 nt, Homo Sapiens
ccuguaauccuagcacuuuggcaggcugggcgcgguggcucacgucuucuaugaagaaaaaaau

SEQ ID NO: 289848 - RNA, 64 nt, Homo Sapiens
cuuauguagucccaguuacuauuagccaggugugguggcucacgcucuacuaaaaaauacaaaa

SEQ ID NO: 289849 - RNA, 64 nt, Homo Sapiens
ccugcagucccagcacuuugguuggccgggcgcgguggcucacguucaucaaagagaagaccau

SEQ ID NO: 289850 - RNA, 64 nt, Homo Sapiens
ugaggucaggaauucaagacggaggcugaggcagguggcucacuccuguaauccuagcacuuug

SEQ ID NO: 289851 - RNA, 64 nt, Homo Sapiens
ccuguaauccuagcacuuugacaggccgagugcgguggcucacacaguguaugaaagucauguu

SEQ ID NO: 289852 - RNA, 64 nt, Homo Sapiens
ccuguaaucccagcucuuugggaggccgggccugguggcucacaaaaugucaagaauuaaucua

SEQ ID NO: 289853 - RNA, 64 nt, Homo Sapiens
ccuguaaucccagcacuuugcguggccgggcgugguggcucacguggauccucaaaacucagaa

SEQ ID NO: 289854 - RNA, 64 nt, Homo Sapiens
ccuguaaucccagcacuuugagcggccgggcgcaguggcucacgcuccacaaaauuuaaaaauu

SEQ ID NO: 289855 - RNA, 64 nt, Homo Sapiens
cuuguaaucccaaaacuuuagggggcugggcgccguggcucacucugcauaaagagggaguuuu

SEQ ID NO: 289856 - RNA, 64 nt, Homo Sapiens
ccuguaaucccaacacuuugaaaggccgggcaugguggcucaugaaaauaaaaauagaagaaga

SEQ ID NO: 289857 - RNA, 64 nt, Homo Sapiens
ccuguaaucucagcacuuuggagggccgggcaugguggcucacggugguccucauaaaaaucuu

SEQ ID NO: 289858 - RNA, 64 nt, Homo Sapiens
ccuauaaucccaacacuucgccuggccaguugcaguggcucacgaucaaucaaucaaucacugu

SEQ ID NO: 289859 - RNA, 64 nt, Homo Sapiens
cuugccauaaaaaggcugaaggcagccgggcgcaguggcucacgccuguaaucccagcacuuug

SEQ ID NO: 289860 - RNA, 64 nt, Homo Sapiens
agcccaguuagaaaauaagucugggccggcggcgguggcucacaccugcauaggcagugcuuug

SEQ ID NO: 289861 - RNA, 64 nt, Homo Sapiens
cucuuguuaagaagguucugccaggccgggcgcgguggcucacaccuguaaucccagcacuuug

SEQ ID NO: 289862 - RNA, 64 nt, Homo Sapiens
uugagccuguauuaaaggaaucaggccaggcacaguggcucacgccuguaaucucagcacauug

SEQ ID NO: 289863 - RNA, 64 nt, Homo Sapiens
gacuucuuuuacaaguaacucuaggcugggugugguggcucacgccuauaaucccagcacuuug

SEQ ID NO: 289864 - RNA, 64 nt, Homo Sapiens
ugaucuuaauauucaugaccacuggccaggcgagguggcucacaccuguaaucccagcacuuug

SEQ ID NO: 289865 - RNA, 64 nt, Homo Sapiens
ccuguaaucccagcacuuugagaggccgggugcgguggcucaagccaucucaaaaaaaaaaaua

SEQ ID NO: 289866 - RNA, 64 nt, Homo Sapiens
ccuguaaucccagcacuuuggcuggccagguaugguggcucacgacacaaguuaaagagguuuu

SEQ ID NO: 289867 - RNA, 64 nt, Homo Sapiens
ccuguaaucccagcacuuugugggguggggcgcaguggcucacggagcugagaucacaccaaaa

SEQ ID NO: 289868 - RNA, 64 nt, Homo Sapiens
ccuguaaucccaacacuuugaugggccuggugugguggcucacacugcaugucuaaaagaaaau

SEQ ID NO: 289869 - RNA, 64 nt, Homo Sapiens
ccuguagucccagguacuugcauggccaggugcaguggcucacggcuuagaaaguccuucacua

SEQ ID NO: 289870 - RNA, 64 nt, Homo Sapiens
ccuguaaucccagcacuuugcuuggccaggugcaguggcucacgccuagacucacaagcugguc

SEQ ID NO: 289871 - RNA, 64 nt, Homo Sapiens
ccuguaaucccagcacugaggacgggccggcacgguggcucacgccaucuuuaaaaaaaaacaa

SEQ ID NO: 289872 - RNA, 64 nt, Homo Sapiens
ccuguaaucccagcauuuugaugggccaggugcgguggcucacacuauuuauuaaaaacuuaag

SEQ ID NO: 289873 - RNA, 64 nt, Homo Sapiens
ccuguaaucccagcacuuuggccagccaggggcgguggcucauguuagggaaagaguauaaaua

SEQ ID NO: 289874 - RNA, 64 nt, Homo Sapiens
ggcuggugguggaccuggagcugguccaggggguguggcucagucccuggcccuccugcugcug

SEQ ID NO: 289875 - RNA, 64 nt, Homo Sapiens
ccaacaauaaaagacuuggccuuggcugggcaugguggcucacgccuguaaucccagcacuuug

SEQ ID NO: 289876 - RNA, 64 nt, Homo Sapiens
cacaaaaaaagacuuggccuuagggccgagugcgguggcucacgccuauaaucccagcacuuug

SEQ ID NO: 289877 - RNA, 64 nt, Homo Sapiens
auuugaacagauguuuuggcucuggcugggugugguggcucacaccuguaaucccagcacuuug

SEQ ID NO: 289878 - RNA, 64 nt, Homo Sapiens
aaauguagaagcuauauguauauuuuguuaauuaguggcucauauuuaaaauaguucucugacu

SEQ ID NO: 289879 - RNA, 64 nt, Homo Sapiens
gguguccucauaagauaaggagaggccaggccugguggcucacgccuguaaucccagcacuuua

SEQ ID NO: 289880 - RNA, 64 nt, Homo Sapiens
auuuuaaaaagacgaaaagugacggccaggugcaguggcucacgccuauaaucucagcacucug

SEQ ID NO: 289881 - RNA, 64 nt, Homo Sapiens
aauuaaaaaaagaagacgagagauagugggugugguggcucacaccugcaaucccagcacuuug

SEQ ID NO: 289882 - RNA, 64 nt, Homo Sapiens
uucucuaaaaugcaauaauaaugggccaggugaaguggcucacaccuguaaucccagcacugug

SEQ ID NO: 289883 - RNA, 64 nt, Homo Sapiens
ucuaaauaaauaaauaaaaugcgggccaggcacaguggcucacaccuguaaucccagcacuaug

SEQ ID NO: 289884 - RNA, 64 nt, Homo Sapiens
uuguauagauuuuuaaaacugguggcugggcgugguggcucacgccuguaaucccagcacuuug

SEQ ID NO: 289885 - RNA, 64 nt, Homo Sapiens
gaaaauaaaaauaaaaauaaacuggccaggugcgguggcucacgcuugcaaucccagugcuuug

SEQ ID NO: 289886 - RNA, 64 nt, Homo Sapiens
ucaggguucccacuacccccucuuuggggguagaguggcucauggaacucagagaaacauuuau

SEQ ID NO: 289887 - RNA, 64 nt, Homo Sapiens
uuaaccuuggucacauugagucauuccaggaugaguggcucaaguauuuccucagggaaaauac

SEQ ID NO: 289888 - RNA, 64 nt, Homo Sapiens
auugcuuagaauaugacaugcugaaccaggcaugguggcucaugcuuguaaaccugaugcuuug

SEQ ID NO: 289889 - RNA, 64 nt, Homo Sapiens
uagcuuuaagaaguaccugcaagggucaggcgcaguggcucacaccuguaaucccagcacuuug

SEQ ID NO: 289890 - RNA, 64 nt, Homo Sapiens
ccugugauccuagcacuuuguuuggccuggugugguggcucaugucuacaaaaaaauuaaaaaa

SEQ ID NO: 289891 - RNA, 64 nt, Homo Sapiens
ccugcaaucccagcacuguaggaggccaggugugguggcucauggccgggacuuaaaaagauaa

SEQ ID NO: 289892 - RNA, 64 nt, Homo Sapiens
ucuguaaccccagcacuuuggacgggugggugcaguggcucacaaaaaaaaagggggggcgggg

SEQ ID NO: 289893 - RNA, 64 nt, Homo Sapiens
uauguaaucccagcacuuuguauggccaggugcaguggcucacgagcuuauaagaucuaacccu

SEQ ID NO: 289894 - RNA, 64 nt, Homo Sapiens
ccuguaaucucagcacuuuguggggccaggcgugguggcucaugucuuuggucaagagucaguu

SEQ ID NO: 289895 - RNA, 64 nt, Homo Sapiens
ccuguaaucccagcacuuugcccggccaggcacaguggcucacaaacguuuaaaaacaaaguuc

SEQ ID NO: 289896 - RNA, 64 nt, Homo Sapiens
ccuguaaucccugcacuuuguuggaucaggcaggguggcucacaccgucucaaaaagaaaaagu

SEQ ID NO: 289897 - RNA, 64 nt, Homo Sapiens
ccuguaaucccagcacuuuguugggccaggcacaguggcucaugcuacguuaaaaaaaaaaagu

SEQ ID NO: 289898 - RNA, 64 nt, Homo Sapiens
ccuguaaucccagcacuuugacaggacaggugugguggcucacagaugauguugaaagugaugc

SEQ ID NO: 289899 - RNA, 64 nt, Homo Sapiens
ccuguaaucccauaauuuucugagaccagaugcuguggcucaggaagaaacaucaaauuugcga

SEQ ID NO: 289900 - RNA, 64 nt, Homo Sapiens
ccuguaaucccaguacuuugucaggccaggcacgguggcucacaaagaaugcgagaaauauaaa

SEQ ID NO: 289901 - RNA, 64 nt, Homo Sapiens
ccuguaaucccagcacuuugagaggccaggcgcgguggcucacacuuguuuugaaauugaagag

SEQ ID NO: 289902 - RNA, 64 nt, Homo Sapiens
ccuguaaugccagcacuuugacuggccgggcacaguggcucacggguaugggaagaaauucucu

SEQ ID NO: 289903 - RNA, 64 nt, Homo Sapiens
ccuguaaucccagcacuuugggacgccgggcgugguggcucacgguggauagaaaccuuacaaa

SEQ ID NO: 289904 - RNA, 64 nt, Homo Sapiens
ccuguaauaccagcacuuuguauggccgggcgcgguggcucaugcucuauuuaaaaaaagaagu

SEQ ID NO: 289905 - RNA, 64 nt, Homo Sapiens
ccuauaaucccaguacuuuaauuggcugggugugguggcucaugccuugugaauauaaaguuac

SEQ ID NO: 289906 - RNA, 64 nt, Homo Sapiens
gugugcagggggaugggccagggccaggcuaaggguggcucaguuccaucaucuggaggucaga

SEQ ID NO: 289907 - RNA, 64 nt, Homo Sapiens
gauggggcaggcugggguguggguguggccugggguggcucagggcuggaacugcugccugauu

SEQ ID NO: 289908 - RNA, 64 nt, Homo Sapiens
ccuauuaucccagcacuuugcauggccgggcaugguggcucauguguucuuagaaaagccccag

SEQ ID NO: 289909 - RNA, 64 nt, Homo Sapiens
cuagauuguggcccagaucugcagggcacuguggguggcucaccuccgcauaccccccugucca

SEQ ID NO: 289910 - RNA, 64 nt, Homo Sapiens
ccuguaaucucagaacuuuggaagccugggcacuguggcucacuaguagcugcauuacaaaaaa

SEQ ID NO: 289911 - RNA, 64 nt, Homo Sapiens
auuuggccccaugcagacccugaggugucuggcuguggcucaagcccuccaauuaaugcagccc

SEQ ID NO: 289912 - RNA, 64 nt, Homo Sapiens
ccuauuggggaccuuuuaaaagcugguuacuacuguggcucaauagagagaagagucuauuaug

SEQ ID NO: 289913 - RNA, 64 nt, Homo Sapiens
cucugaguacuguuccuguaagaacugccagaauguggcucauguuggauaaggaugcacugga

SEQ ID NO: 289914 - RNA, 64 nt, Homo Sapiens
acuauuuaaaaaugaaauuacaggcccgggcacgguggcucacaccuguaaucccagcacuuug

SEQ ID NO: 289915 - RNA, 64 nt, Homo Sapiens
uuacuuuuaaaaauauaaguuagggcuaggcacaguggcucaugccuauaaucucagcacuuuu

SEQ ID NO: 289916 - RNA, 64 nt, Homo Sapiens
agagcaacaacaaaaaauguuuaagccgggcgcgguggcucacaucuguaaucccagcacuuug

SEQ ID NO: 289917 - RNA, 64 nt, Homo Sapiens
ucucuacaaaaaauacaaaaauuagccaugcaugguggcucaugccuguagucccagcuacuug

SEQ ID NO: 289918 - RNA, 64 nt, Homo Sapiens
ggcuguagugagccagcucccucagggcagccagguggcucaugggugggccugaggugcccag

SEQ ID NO: 289919 - RNA, 64 nt, Homo Sapiens
gagagcugaacuccagggguccauggggaacuccguggcucaggcuuacucagcccuuuauggc

SEQ ID NO: 289920 - RNA, 64 nt, Homo Sapiens
ccuguaacccuagcacuuugcagggcugggcgcgguggcucaugaccauuauaaauucuuaguu

SEQ ID NO: 289921 - RNA, 64 nt, Homo Sapiens
ccuauaauccuacacuuuggucuggccgggugugguggcucaucuuuuuuuaaaaccuuaaaug

SEQ ID NO: 289922 - RNA, 64 nt, Homo Sapiens
guaggugcaccauccaaggagugccauaaauuauguggcucauaggcuaauucccccuucucug

SEQ ID NO: 289923 - RNA, 64 nt, Homo Sapiens
gguccggagguuaugucuuccaaaacaaaaguggguggcucacgagugagacuccgucucaaaa

SEQ ID NO: 289924 - RNA, 64 nt, Homo Sapiens
cugaggucaggaguucgagagguggccgggcgugguggcucacgguugguccuuaaaacugggc

SEQ ID NO: 289925 - RNA, 64 nt, Homo Sapiens; identical to SEQ ID NO: 59936

SEQ ID NO: 289926 - RNA, 64 nt, Homo Sapiens; identical to SEQ ID NO: 59937

SEQ ID NO: 289927 - RNA, 64 nt, Homo Sapiens; identical to SEQ ID NO: 59938

SEQ ID NO: 289928 - RNA, 64 nt, Homo Sapiens; identical to SEQ ID NO: 59939

SEQ ID NO: 289929 - RNA, 64 nt, Homo Sapiens; identical to SEQ ID NO: 59940

SEQ ID NO: 289930 - RNA, 64 nt, Homo Sapiens; identical to SEQ ID NO: 59941

SEQ ID NO: 289931 - RNA, 64 nt, Homo Sapiens; identical to SEQ ID NO: 59942

SEQ ID NO: 289932 - RNA, 64 nt, Homo Sapiens; identical to SEQ ID NO: 59943

SEQ ID NO: 289933 - RNA, 64 nt, Homo Sapiens; identical to SEQ ID NO: 59944

SEQ ID NO: 289934 - RNA, 64 nt, Homo Sapiens; identical to SEQ ID NO: 59945

SEQ ID NO: 289935 - RNA, 64 nt, Homo Sapiens; identical to SEQ ID NO: 59946

SEQ ID NO: 289936 - RNA, 64 nt, Homo Sapiens; identical to SEQ ID NO: 59947

SEQ ID NO: 289937 - RNA, 64 nt, Homo Sapiens; identical to SEQ ID NO: 59948

SEQ ID NO: 289938 - RNA, 64 nt, Homo Sapiens; identical to SEQ ID NO: 59949

SEQ ID NO: 289939 - RNA, 64 nt, Homo Sapiens; identical to SEQ ID NO: 59950

SEQ ID NO: 289940 - RNA, 64 nt, Homo Sapiens; identical to SEQ ID NO: 59951

SEQ ID NO: 289941 - RNA, 64 nt, Homo Sapiens; identical to SEQ ID NO: 59952

SEQ ID NO: 289942 - RNA, 64 nt, Homo Sapiens; identical to SEQ ID NO: 59953

SEQ ID NO: 289943 - RNA, 64 nt, Homo Sapiens; identical to SEQ ID NO: 59954

SEQ ID NO: 289944 - RNA, 64 nt, Homo Sapiens; identical to SEQ ID NO: 59955

SEQ ID NO: 289945 - RNA, 64 nt, Homo Sapiens; identical to SEQ ID NO: 42317

SEQ ID NO: 289946 - RNA, 64 nt, Homo Sapiens; identical to SEQ ID NO: 42318

SEQ ID NO: 289947 - RNA, 64 nt, Homo Sapiens; identical to SEQ ID NO: 42319

SEQ ID NO: 289948 - RNA, 64 nt, Homo Sapiens; identical to SEQ ID NO: 42320

SEQ ID NO: 289949 - RNA, 64 nt, Homo Sapiens; identical to SEQ ID NO: 42321

SEQ ID NO: 289950 - RNA, 64 nt, Homo Sapiens; identical to SEQ ID NO: 42322

SEQ ID NO: 289951 - RNA, 64 nt, Homo Sapiens; identical to SEQ ID NO: 42323

SEQ ID NO: 289952 - RNA, 64 nt, Homo Sapiens; identical to SEQ ID NO: 42324

SEQ ID NO: 289953 - RNA, 64 nt, Homo Sapiens; identical to SEQ ID NO: 42325

SEQ ID NO: 289954 - RNA, 64 nt, Homo Sapiens; identical to SEQ ID NO: 42326

SEQ ID NO: 289955 - RNA, 64 nt, Homo Sapiens; identical to SEQ ID NO: 42327

SEQ ID NO: 289956 - RNA, 64 nt, Homo Sapiens; identical to SEQ ID NO: 42328

SEQ ID NO: 289957 - RNA, 64 nt, Homo Sapiens; identical to SEQ ID NO: 42329

SEQ ID NO: 289958 - RNA, 64 nt, Homo Sapiens; identical to SEQ ID NO: 42330

SEQ ID NO: 289959 - RNA, 64 nt, Homo Sapiens; identical to SEQ ID NO: 42331

SEQ ID NO: 289960 - RNA, 64 nt, Homo Sapiens; identical to SEQ ID NO: 42332

SEQ ID NO: 289961 - RNA, 64 nt, Homo Sapiens; identical to SEQ ID NO: 79392

SEQ ID NO: 289962 - RNA, 64 nt, Homo Sapiens; identical to SEQ ID NO: 79393

SEQ ID NO: 289963 - RNA, 64 nt, Homo Sapiens; identical to SEQ ID NO: 79394

SEQ ID NO: 289964 - RNA, 64 nt, Homo Sapiens; identical to SEQ ID NO: 79395

SEQ ID NO: 289965 - RNA, 64 nt, Homo Sapiens; identical to SEQ ID NO: 79396

SEQ ID NO: 289966 - RNA, 64 nt, Homo Sapiens; identical to SEQ ID NO: 79397

SEQ ID NO: 289967 - RNA, 64 nt, Homo Sapiens; identical to SEQ ID NO: 79398

SEQ ID NO: 289968 - RNA, 64 nt, Homo Sapiens; identical to SEQ ID NO: 79399

SEQ ID NO: 289969 - RNA, 64 nt, Homo Sapiens; identical to SEQ ID NO: 79400

SEQ ID NO: 289970 - RNA, 64 nt, Homo Sapiens; identical to SEQ ID NO: 79401

SEQ ID NO: 289971 - RNA, 64 nt, Homo Sapiens
gaaauauuguuauacauuuauuaaauauacuucccccaugaagugaaaagguuaauuuugcuga

SEQ ID NO: 289972 - RNA, 64 nt, Homo Sapiens
uguuuuaaguugaaguuacuucauggaugucauacccaugaagugcauuuggaugagauagaag

SEQ ID NO: 289973 - RNA, 64 nt, Homo Sapiens
aauucaguuuguuaguaccuuauuacuuuguucucccaugaaagaauacuauugcucuagaaug

SEQ ID NO: 289974 - RNA, 64 nt, Homo Sapiens
gcuaauguguagugaaagaauucagcaaaacuuccccaugaacaucccugaagacuggaauuac

SEQ ID NO: 289975 - RNA, 64 nt, Homo Sapiens
uugagcauucaaaugaagaugccccccacccugccccaugaaacuuggguugcaaagcuauccc

SEQ ID NO: 289976 - RNA, 64 nt, Homo Sapiens
ucaagaauaguugucagaauagauuucccacauucccaugaauagcuaaaugaccauccaguag

SEQ ID NO: 289977 - RNA, 64 nt, Homo Sapiens
uugcuccaaaguugauaacacauuuguacaauuccccaugaaaaaggagauacauaucagagaa

SEQ ID NO: 289978 - RNA, 64 nt, Homo Sapiens
augguuuauugggaacugcucuauauaggaggaucccaugaauguuguggcgccuuccucaucu

SEQ ID NO: 289979 - RNA, 64 nt, Homo Sapiens
uggagggcuaaucaaucuuauguuagcaggacaacccaugaaaaacaagucagagagugaaggc

SEQ ID NO: 289980 - RNA, 64 nt, Homo Sapiens
auauuucuuuuaccauugaccauuauuauagggacccaugaaguaaaugucacaaucaucuuac

SEQ ID NO: 289981 - RNA, 64 nt, Homo Sapiens
auuugcccagaguuugcucaauuccaagacagugcccaugaaugggacaccuguaauguaaccc

SEQ ID NO: 289982 - RNA, 64 nt, Homo Sapiens
auuaaaauauauuuaauauguuuugccuuuguggcccaugaaagucuuacugggcccuggggaa

SEQ ID NO: 289983 - RNA, 64 nt, Homo Sapiens
ucugggcauccuggaucccugaauuauccccccccccaugaaguacuucaagggccaagcugcc

SEQ ID NO: 289984 - RNA, 64 nt, Homo Sapiens
ucaagggccaagcugccccuuucccuccucuccgcccaugaaaaugccuccaaacugagaugcu

SEQ ID NO: 289985 - RNA, 64 nt, Homo Sapiens
acucaguuguaguugcagaaagacuaaagucuuaaacaucuaagaauugauuuaaacaucaugu

SEQ ID NO: 289986 - RNA, 64 nt, Homo Sapiens
augguaauacaaagaaaaguuuguuuuuaaaggaaacaucuauuuugccucauaaacucucucu

SEQ ID NO: 289987 - RNA, 64 nt, Homo Sapiens
aaguauauaauccugugaaaaauuucuagaaacaaacaucuaauuaguaacacauauguaguau

SEQ ID NO: 289988 - RNA, 64 nt, Homo Sapiens
ccacuagaggaaaccaguuuggaacucagagaugaacaucuaacuucagaggauaaauaucaau

SEQ ID NO: 289989 - RNA, 58 nt, Homo Sapiens
gccgaguauggucacugugacguguuagaacaucuaauccacaaagguaugugaaaag

SEQ ID NO: 289990 - RNA, 64 nt, Homo Sapiens
uuucuuuuagugcacugaaauaucuuaucccaguaacaucuaaaaaugcaauucggaaaagugg

SEQ ID NO: 289991 - RNA, 64 nt, Homo Sapiens
gcauuauugcuuuagaauguugggacacuuaaguaacaucuaaauuaauuuuguuaauccuguc

SEQ ID NO: 289992 - RNA, 64 nt, Homo Sapiens
uccauugauccuagguucuucgguggcuuaaaguaacaucuauuuuugugggucucucuuucgu

SEQ ID NO: 289993 - RNA, 64 nt, Homo Sapiens
auauauauauuauaggccagagucuacuguauauaacaucuaaucuuaaacuauugacuuggua

SEQ ID NO: 289994 - RNA, 64 nt, Homo Sapiens
auauauauuacaggccaaauagucuacuguauauaacaucuaaucuuaaacuauugacuuggua

SEQ ID NO: 289995 - RNA, 64 nt, Homo Sapiens
aguggaauuuaucccaggaauucaagguugguucaacaucuaaaaaucaaauaagcuaauauac

SEQ ID NO: 289996 - RNA, 64 nt, Homo Sapiens
gaauaaaaggaaucuuccuagauaugauaaauauaacaucuaugaaaagcccacaccuaacauu

SEQ ID NO: 289997 - RNA, 64 nt, Homo Sapiens
cacagcaguuagguuaggaauucaagguuuguucaacaucuaaaaaucaaauaagcuaauaaag

SEQ ID NO: 289998 - RNA, 64 nt, Homo Sapiens
cugcagcauaucagacagcaauuuaacagcuugaaacaucuacagauaguuccuacuaaaagaa

SEQ ID NO: 289999 - RNA, 64 nt, Homo Sapiens
ggugaauucucaggugaacuuuuuucaguuauaaaacaucuauuuugaaucuguaaauauuuua

SEQ ID NO: 290000 - RNA, 64 nt, Homo Sapiens
acugaggaaaaaaaauaauuaaacaggccuaagaagaaaucaaaaaccauaagacaccuauccu

SEQ ID NO: 290001 - RNA, 64 nt, Homo Sapiens
auggcuaagaagauuugaauuauagggagggaacagaaaucauacaugaaaagguuuuacugag

SEQ ID NO: 290002 - RNA, 64 nt, Homo Sapiens
cagaucuuucuaauguguauuaaugaauugcuauagaaaucagguagcauuauuucuucagcua

SEQ ID NO: 290003 - RNA, 64 nt, Homo Sapiens
uagacucugugugccucuucucucuuuugucuggagaaaucacuugcuucuuucugucuuuccu

SEQ ID NO: 290004 - RNA, 64 nt, Homo Sapiens
cuguuagagaaauugcacuuuuccugacuuaccuagaaaucaagaauuuaggaaauuaaugugg

SEQ ID NO: 290005 - RNA, 64 nt, Homo Sapiens
uuuacaucaagauaaacccugagaagaacuacggagaaaucaaauaaaauccugucauauuuuu

SEQ ID NO: 290006 - RNA, 64 nt, Homo Sapiens
ugacugauaagcauuggaucgggauuuuucuucuagaaaucaaaagaacagccuggcuuauuug

SEQ ID NO: 290007 - RNA, 64 nt, Homo Sapiens
ggaccacgauuucaagacuugugugaccuagagaagaaaucagccgucugcuugggguuauuca

SEQ ID NO: 290008 - RNA, 64 nt, Homo Sapiens
uuuaauucuugcauuguaauuggcuguguccauaagaaaucauuuauucuucaggcuuagacau

SEQ ID NO: 290009 - RNA, 64 nt, Homo Sapiens
uuuucucacauucagacuuacacuuaaugguguuagaaaucaacaaaacuccuuuuuaaaaaga

SEQ ID NO: 290010 - RNA, 64 nt, Homo Sapiens
gcaguguguucuccaaacaugauggaacgaaauuagaaaucaauaaaauuugggaaauucacaa

SEQ ID NO: 290011 - RNA, 64 nt, Homo Sapiens
acagugauacugucucaauaaauaaauaaauagaagaaaucaugaguaaaauuggaaaacacuu

SEQ ID NO: 290012 - RNA, 64 nt, Homo Sapiens
ccuuggugcaauauucuuaaaaccugcuuugcauagaaaucacuuuugcccaggcuggagugca

SEQ ID NO: 290013 - RNA, 64 nt, Homo Sapiens
ugcugagauuaggcguuagccaccgcgcccggccagaaaucacuuuuauauugucacaugggcc

SEQ ID NO: 290014 - RNA, 64 nt, Homo Sapiens
aggccuuaucuugaaaguuaaaaaaaaaaaguaaagaaaucacaguaaguucuauuagugauga

SEQ ID NO: 290015 - RNA, 64 nt, Homo Sapiens
ucucacaaggaaaaaaacauucuauauuuguagcagaaaucagugguuugaaaagucauacuuu

SEQ ID NO: 290016 - RNA, 64 nt, Homo Sapiens
uugaugccaaaaaaaaauacaugcuaagagaaguagaaaucauagcugguucacacugaccaag

SEQ ID NO: 290017 - RNA, 64 nt, Homo Sapiens
cauucagaagaaaaagaagcaaccucaguaauuuagaaaucauuuugcaaucccuuaauauccu

SEQ ID NO: 290018 - RNA, 64 nt, Homo Sapiens
auauaauauauaauaaugaacaucugucauauccagaaaucacuugguguaagagcuaaauccu

SEQ ID NO: 290019 - RNA, 64 nt, Homo Sapiens
aauugagguacggagaaacuugcuaggucauaccagaaaucaucuucagugaaagcaguguauu

SEQ ID NO: 290020 - RNA, 64 nt, Homo Sapiens
acaaaaaaucuaauugcuguaauaaauggcaaagagaaaucaggacauuaauugaagcaucaaa

SEQ ID NO: 290021 - RNA, 64 nt, Homo Sapiens
aguuaagaaaucuacuuuaauauguccacuuaagagaaaucauccagaaugcauccuuugagau

SEQ ID NO: 290022 - RNA, 64 nt, Homo Sapiens
ggguuuuagagccccugcucuaggaaacaguuuaagaaaucauuggccccuucccagcacauug

SEQ ID NO: 290023 - RNA, 64 nt, Homo Sapiens
cuuuaggaugacacaaugaauaacaccuagucauagaaaucagucucucugguuuguuuuguau

SEQ ID NO: 290024 - RNA, 64 nt, Homo Sapiens
ucaugcuuauuucaaacucccugagugauggguaagaaaucaaacauugccucagugguaucaa

SEQ ID NO: 290025 - RNA, 64 nt, Homo Sapiens
ugagagucacgcuuuuaaauuuacagcucaucacagaaaucaucagcuauacauuaguaaaaau

SEQ ID NO: 290026 - RNA, 64 nt, Homo Sapiens
ucuucuuaauugcugaaccuacauuucucaguguagaaaucaugauccauccaacuuuaacaca

SEQ ID NO: 290027 - RNA, 64 nt, Homo Sapiens
guuuuauauuuuaguuucucuaagauguaaaaagagaaaucauauucugguguuguguccauca

SEQ ID NO: 290028 - RNA, 64 nt, Homo Sapiens
aguuugaugaguuuuuuucccaaaauaucuaauuagaaaucaacauaaccaccucaacugauag

SEQ ID NO: 290029 - RNA, 64 nt, Homo Sapiens
agugagcagucaaguuaaugcuuauucccuucacagaaaucagcucuuuaauuuuuuauguuua

SEQ ID NO: 290030 - RNA, 56 nt, Homo Sapiens
ugauccucaaggcugaugaccccaggagaaaucaagcuuuguagguaacccauuaa

SEQ ID NO: 290031 - RNA, 64 nt, Homo Sapiens
cucgcuucccuuggcacaccauguaguccacuccagaaaucauguacugaacuccagaccaugc

SEQ ID NO: 290032 - RNA, 64 nt, Homo Sapiens
cagcuuuaaagcugcuuuuauauacauuugacuaagaaaucaccuugauaaguaaaagcuucgu

SEQ ID NO: 290033 - RNA, 64 nt, Homo Sapiens
ucaguuuuuuuaaaagaaugaucuucauuuaaaaagaaaucaagcagaagagccaaaaaaaagu

SEQ ID NO: 290034 - RNA, 64 nt, Homo Sapiens
accauauuguuuaugcauaucaucugauuuugcuagaaaucacauuuuuccuugcuugcaaucu

SEQ ID NO: 290035 - RNA, 64 nt, Homo Sapiens
cuucaaccagcuugaaucacugaauaugcauuugagaaaucacauuagauugaaacccuacgaa

SEQ ID NO: 290036 - RNA, 64 nt, Homo Sapiens
gaugcagauuuuuuuauuagaguuuauacuguagagaaaucauaugaagucaauaaauguggga

SEQ ID NO: 290037 - RNA, 64 nt, Homo Sapiens
uaggcaaauagcaaggguaguauaggaguuaaggagaaaucauuuuagccaagcauggugauga

SEQ ID NO: 290038 - RNA, 64 nt, Homo Sapiens
uuucuacugcuaggcaauugaagccgaaauuccuagaaaucaggugcagcuagaguugacucag

SEQ ID NO: 290039 - RNA, 64 nt, Homo Sapiens
uacaaacuacugcaauuagaauggaaugauguaaagaaaucagagagguuuccuuucccaucau

SEQ ID NO: 290040 - RNA, 64 nt, Homo Sapiens
ugccuuguccucacggaaucaauggguguuuugaagaaaucauuccuaccacuuccaguaagaa

SEQ ID NO: 290041 - RNA, 64 nt, Homo Sapiens; identical to SEQ ID NO: 205933

SEQ ID NO: 290042 - RNA, 64 nt, Homo Sapiens; identical to SEQ ID NO: 205934

SEQ ID NO: 290043 - RNA, 64 nt, Homo Sapiens; identical to SEQ ID NO: 205935

SEQ ID NO: 290044 - RNA, 64 nt, Homo Sapiens; identical to SEQ ID NO: 205936

SEQ ID NO: 290045 - RNA, 64 nt, Homo Sapiens; identical to SEQ ID NO: 205937

SEQ ID NO: 290046 - RNA, 64 nt, Homo Sapiens; identical to SEQ ID NO: 205938

SEQ ID NO: 290047 - RNA, 64 nt, Homo Sapiens; identical to SEQ ID NO: 205939

SEQ ID NO: 290048 - RNA, 64 nt, Homo Sapiens; identical to SEQ ID NO: 205940

SEQ ID NO: 290049 - RNA, 64 nt, Homo Sapiens; identical to SEQ ID NO: 205941

SEQ ID NO: 290050 - RNA, 64 nt, Homo Sapiens; identical to SEQ ID NO: 205942

SEQ ID NO: 290051 - RNA, 64 nt, Homo Sapiens; identical to SEQ ID NO: 205943

SEQ ID NO: 290052 - RNA, 64 nt, Homo Sapiens; identical to SEQ ID NO: 205944

SEQ ID NO: 290053 - RNA, 64 nt, Homo Sapiens; identical to SEQ ID NO: 205945

SEQ ID NO: 290054 - RNA, 64 nt, Homo Sapiens; identical to SEQ ID NO: 205946

SEQ ID NO: 290055 - RNA, 64 nt, Homo Sapiens; identical to SEQ ID NO: 205947

SEQ ID NO: 290056 - RNA, 64 nt, Homo Sapiens; identical to SEQ ID NO: 205948

SEQ ID NO: 290057 - RNA, 64 nt, Homo Sapiens; identical to SEQ ID NO: 205949

SEQ ID NO: 290058 - RNA, 64 nt, Homo Sapiens; identical to SEQ ID NO: 205950

SEQ ID NO: 290059 - RNA, 64 nt, Homo Sapiens; identical to SEQ ID NO: 205951

SEQ ID NO: 290060 - RNA, 64 nt, Homo Sapiens; identical to SEQ ID NO: 205952

SEQ ID NO: 290061 - RNA, 64 nt, Homo Sapiens; identical to SEQ ID NO: 205953

SEQ ID NO: 290062 - RNA, 64 nt, Homo Sapiens; identical to SEQ ID NO: 205954

SEQ ID NO: 290063 - RNA, 64 nt, Homo Sapiens; identical to SEQ ID NO: 205955

SEQ ID NO: 290064 - RNA, 64 nt, Homo Sapiens; identical to SEQ ID NO: 205956

SEQ ID NO: 290065 - RNA, 64 nt, Homo Sapiens; identical to SEQ ID NO: 205957

SEQ ID NO: 290066 - RNA, 64 nt, Homo Sapiens; identical to SEQ ID NO: 205958

SEQ ID NO: 290067 - RNA, 64 nt, Homo Sapiens; identical to SEQ ID NO: 205959

SEQ ID NO: 290068 - RNA, 64 nt, Homo Sapiens; identical to SEQ ID NO: 205960

SEQ ID NO: 290069 - RNA, 64 nt, Homo Sapiens; identical to SEQ ID NO: 205961

SEQ ID NO: 290070 - RNA, 64 nt, Homo Sapiens; identical to SEQ ID NO: 205962

SEQ ID NO: 290071 - RNA, 64 nt, Homo Sapiens; identical to SEQ ID NO: 205963

SEQ ID NO: 290072 - RNA, 64 nt, Homo Sapiens; identical to SEQ ID NO: 205964

SEQ ID NO: 290073 - RNA, 64 nt, Homo Sapiens; identical to SEQ ID NO: 205965

SEQ ID NO: 290074 - RNA, 64 nt, Homo Sapiens; identical to SEQ ID NO: 205966

SEQ ID NO: 290075 - RNA, 64 nt, Homo Sapiens; identical to SEQ ID NO: 205967

SEQ ID NO: 290076 - RNA, 64 nt, Homo Sapiens; identical to SEQ ID NO: 205968

SEQ ID NO: 290077 - RNA, 64 nt, Homo Sapiens; identical to SEQ ID NO: 205969

SEQ ID NO: 290078 - RNA, 64 nt, Homo Sapiens; identical to SEQ ID NO: 205970

SEQ ID NO: 290079 - RNA, 64 nt, Homo Sapiens; identical to SEQ ID NO: 205971

SEQ ID NO: 290080 - RNA, 64 nt, Homo Sapiens; identical to SEQ ID NO: 205972

SEQ ID NO: 290081 - RNA, 64 nt, Homo Sapiens; identical to SEQ ID NO: 205973

SEQ ID NO: 290082 - RNA, 64 nt, Homo Sapiens; identical to SEQ ID NO: 205974

SEQ ID NO: 290083 - RNA, 64 nt, Homo Sapiens; identical to SEQ ID NO: 205975

SEQ ID NO: 290084 - RNA, 64 nt, Homo Sapiens; identical to SEQ ID NO: 205976

SEQ ID NO: 290085 - RNA, 64 nt, Homo Sapiens; identical to SEQ ID NO: 205977

SEQ ID NO: 290086 - RNA, 64 nt, Homo Sapiens; identical to SEQ ID NO: 205978

SEQ ID NO: 290087 - RNA, 64 nt, Homo Sapiens; identical to SEQ ID NO: 205979

SEQ ID NO: 290088 - RNA, 64 nt, Homo Sapiens; identical to SEQ ID NO: 205980

SEQ ID NO: 290089 - RNA, 64 nt, Homo Sapiens; identical to SEQ ID NO: 205981

SEQ ID NO: 290090 - RNA, 64 nt, Homo Sapiens; identical to SEQ ID NO: 205982

SEQ ID NO: 290091 - RNA, 64 nt, Homo Sapiens; identical to SEQ ID NO: 205983

SEQ ID NO: 290092 - RNA, 54 nt, Homo Sapiens; identical to SEQ ID NO: 205984

SEQ ID NO: 290093 - RNA, 64 nt, Homo Sapiens; identical to SEQ ID NO: 205985

SEQ ID NO: 290094 - RNA, 64 nt, Homo Sapiens; identical to SEQ ID NO: 205986

SEQ ID NO: 290095 - RNA, 64 nt, Homo Sapiens; identical to SEQ ID NO: 205987

SEQ ID NO: 290096 - RNA, 64 nt, Homo Sapiens; identical to SEQ ID NO: 205988

SEQ ID NO: 290097 - RNA, 64 nt, Homo Sapiens; identical to SEQ ID NO: 205989

SEQ ID NO: 290098 - RNA, 64 nt, Homo Sapiens; identical to SEQ ID NO: 39060

SEQ ID NO: 290099 - RNA, 64 nt, Homo Sapiens; identical to SEQ ID NO: 39061

SEQ ID NO: 290100 - RNA, 64 nt, Homo Sapiens; identical to SEQ ID NO: 39062

SEQ ID NO: 290101 - RNA, 64 nt, Homo Sapiens; identical to SEQ ID NO: 39063

SEQ ID NO: 290102 - RNA, 57 nt, Homo Sapiens; identical to SEQ ID NO: 39064

SEQ ID NO: 290103 - RNA, 64 nt, Homo Sapiens; identical to SEQ ID NO: 39065

SEQ ID NO: 290104 - RNA, 64 nt, Homo Sapiens; identical to SEQ ID NO: 39066

SEQ ID NO: 290105 - RNA, 64 nt, Homo Sapiens; identical to SEQ ID NO: 39067

SEQ ID NO: 290106 - RNA, 64 nt, Homo Sapiens; identical to SEQ ID NO: 39068

SEQ ID NO: 290107 - RNA, 64 nt, Homo Sapiens; identical to SEQ ID NO: 39069

SEQ ID NO: 290108 - RNA, 64 nt, Homo Sapiens; identical to SEQ ID NO: 39070

SEQ ID NO: 290109 - RNA, 64 nt, Homo Sapiens; identical to SEQ ID NO: 39071

SEQ ID NO: 290110 - RNA, 64 nt, Homo Sapiens; identical to SEQ ID NO: 39072

SEQ ID NO: 290111 - RNA, 64 nt, Homo Sapiens; identical to SEQ ID NO: 39073

SEQ ID NO: 290112 - RNA, 64 nt, Homo Sapiens; identical to SEQ ID NO: 39074

SEQ ID NO: 290113 - RNA, 64 nt, Homo Sapiens; identical to SEQ ID NO: 39075

SEQ ID NO: 290114 - RNA, 64 nt, Homo Sapiens; identical to SEQ ID NO: 39076

SEQ ID NO: 290115 - RNA, 64 nt, Homo Sapiens; identical to SEQ ID NO: 39077

SEQ ID NO: 290116 - RNA, 64 nt, Homo Sapiens; identical to SEQ ID NO: 39078

SEQ ID NO: 290117 - RNA, 64 nt, Homo Sapiens; identical to SEQ ID NO: 39079

SEQ ID NO: 290118 - RNA, 64 nt, Homo Sapiens; identical to SEQ ID NO: 39080

SEQ ID NO: 290119 - RNA, 64 nt, Homo Sapiens; identical to SEQ ID NO: 39081

SEQ ID NO: 290120 - RNA, 64 nt, Homo Sapiens; identical to SEQ ID NO: 39082

SEQ ID NO: 290121 - RNA, 64 nt, Homo Sapiens; identical to SEQ ID NO: 39083

SEQ ID NO: 290122 - RNA, 64 nt, Homo Sapiens; identical to SEQ ID NO: 39084

SEQ ID NO: 290123 - RNA, 64 nt, Homo Sapiens; identical to SEQ ID NO: 39085

SEQ ID NO: 290124 - RNA, 64 nt, Homo Sapiens; identical to SEQ ID NO: 39086

SEQ ID NO: 290125 - RNA, 64 nt, Homo Sapiens; identical to SEQ ID NO: 39087

SEQ ID NO: 290126 - RNA, 64 nt, Homo Sapiens; identical to SEQ ID NO: 39088

SEQ ID NO: 290127 - RNA, 64 nt, Homo Sapiens; identical to SEQ ID NO: 39089

SEQ ID NO: 290128 - RNA, 64 nt, Homo Sapiens; identical to SEQ ID NO: 39090

SEQ ID NO: 290129 - RNA, 64 nt, Homo Sapiens; identical to SEQ ID NO: 39091

SEQ ID NO: 290130 - RNA, 64 nt, Homo Sapiens; identical to SEQ ID NO: 39092

SEQ ID NO: 290131 - RNA, 64 nt, Homo Sapiens; identical to SEQ ID NO: 39093

SEQ ID NO: 290132 - RNA, 64 nt, Homo Sapiens; identical to SEQ ID NO: 39094

SEQ ID NO: 290133 - RNA, 64 nt, Homo Sapiens; identical to SEQ ID NO: 39095

SEQ ID NO: 290134 - RNA, 64 nt, Homo Sapiens; identical to SEQ ID NO: 39096

SEQ ID NO: 290135 - RNA, 64 nt, Homo Sapiens; identical to SEQ ID NO: 39097

SEQ ID NO: 290136 - RNA, 64 nt, Homo Sapiens; identical to SEQ ID NO: 39098

SEQ ID NO: 290137 - RNA, 64 nt, Homo Sapiens; identical to SEQ ID NO: 39099

SEQ ID NO: 290138 - RNA, 64 nt, Homo Sapiens; identical to SEQ ID NO: 39100

SEQ ID NO: 290139 - RNA, 64 nt, Homo Sapiens; identical to SEQ ID NO: 39101

SEQ ID NO: 290140 - RNA, 64 nt, Homo Sapiens; identical to SEQ ID NO: 39102

SEQ ID NO: 290141 - RNA, 64 nt, Homo Sapiens; identical to SEQ ID NO: 39103

SEQ ID NO: 290142 - RNA, 64 nt, Homo Sapiens; identical to SEQ ID NO: 39104

SEQ ID NO: 290143 - RNA, 64 nt, Homo Sapiens; identical to SEQ ID NO: 39105

SEQ ID NO: 290144 - RNA, 64 nt, Homo Sapiens; identical to SEQ ID NO: 39106

SEQ ID NO: 290145 - RNA, 64 nt, Homo Sapiens; identical to SEQ ID NO: 39107

SEQ ID NO: 290146 - RNA, 64 nt, Homo Sapiens; identical to SEQ ID NO: 39108

SEQ ID NO: 290147 - RNA, 64 nt, Homo Sapiens; identical to SEQ ID NO: 39109

SEQ ID NO: 290148 - RNA, 64 nt, Homo Sapiens; identical to SEQ ID NO: 39110

SEQ ID NO: 290149 - RNA, 64 nt, Homo Sapiens; identical to SEQ ID NO: 39111

SEQ ID NO: 290150 - RNA, 64 nt, Homo Sapiens; identical to SEQ ID NO: 39112

SEQ ID NO: 290151 - RNA, 64 nt, Homo Sapiens; identical to SEQ ID NO: 39113

SEQ ID NO: 290152 - RNA, 64 nt, Homo Sapiens; identical to SEQ ID NO: 39114

SEQ ID NO: 290153 - RNA, 64 nt, Homo Sapiens; identical to SEQ ID NO: 75349

SEQ ID NO: 290154 - RNA, 64 nt, Homo Sapiens; identical to SEQ ID NO: 75350

SEQ ID NO: 290155 - RNA, 64 nt, Homo Sapiens; identical to SEQ ID NO: 75351

SEQ ID NO: 290156 - RNA, 64 nt, Homo Sapiens; identical to SEQ ID NO: 75352

SEQ ID NO: 290157 - RNA, 64 nt, Homo Sapiens
guucauaauguaguugcuagaacuguaugucuugugaugggacaaucugacucacaagaaagcc

SEQ ID NO: 290158 - RNA, 64 nt, Homo Sapiens
uccacuuauuuaggccucaucccucuccaagccuugaugggaccgcccucccaacacuuucacu

SEQ ID NO: 290159 - RNA, 64 nt, Homo Sapiens
acguggcacucauaguugaagccagaccaauguuugaugggaaaagccaacaaaacaguuuguu

SEQ ID NO: 290160 - RNA, 64 nt, Homo Sapiens
uaugacuucaccaaggagcaaaaugaauggaagaugaugggaaagaaauguaugauccaacuag

SEQ ID NO: 290161 - RNA, 64 nt, Homo Sapiens
cuacuagauggacaggcugagaucacaagcugcuugaugggaacaaaccuuguacuacucagcu

SEQ ID NO: 290162 - RNA, 64 nt, Homo Sapiens
augggggugguuuccccuaugaccugaugggaggugaugggaucuccccaugugucaagggagg

SEQ ID NO: 290163 - RNA, 64 nt, Homo Sapiens
ugaugggaucauggggguggucaagggagggaccugaugggaggcaaauuguaauccccaugug

SEQ ID NO: 290164 - RNA, 64 nt, Homo Sapiens
ggggcuauucugugccuucuguucuuggaugaauugaugggaguggugagcauccgccuuuccu

SEQ ID NO: 290165 - RNA, 64 nt, Homo Sapiens
aguuugcccucauucuccugcagcacugccgacuugaugggagccugggaguuggcugcauggc

SEQ ID NO: 290166 - RNA, 64 nt, Homo Sapiens
gggcuccguccugcaggcugggugcacugugugaugaugggagggcaaggggcugcagagccca

SEQ ID NO: 290167 - RNA, 64 nt, Homo Sapiens
augagauuaccucauuuaggauaguuuaaguaggugaugggaagcagggagccgaaaggcuuaa

SEQ ID NO: 290168 - RNA, 64 nt, Homo Sapiens
gggaagggcccaggccagacccaucccaaacggaugaugggaugaugggacagcagcuccuugc

SEQ ID NO: 290169 - RNA, 64 nt, Homo Sapiens
cccaggccagacccaucccaaacggaugaugggaugaugggacagcagcuccuugcucagaagc

SEQ ID NO: 290170 - RNA, 64 nt, Homo Sapiens
guggauggauggaaggcacacagcccgugccggcugaugggacgagggucaggcauccugucug

SEQ ID NO: 290171 - RNA, 64 nt, Homo Sapiens
ccauuacuccucaggccuggcccucgggccuccgugaugggagccccccaggaggggucagaug

SEQ ID NO: 290172 - RNA, 64 nt, Homo Sapiens
aauuuuuggcauuuuuguauauuuaugcauuaggugaugggacuuuuaaagguuugaauuuauu

SEQ ID NO: 290173 - RNA, 64 nt, Homo Sapiens
uuuuuuaaagcacagauguaauugucuaauguucugaugggaacguaacacuuauuuuuauaua

SEQ ID NO: 290174 - RNA, 64 nt, Homo Sapiens
ucuucccggaaucagauucaaaggauccuggaggugaugggauagacuggggagacgaugcugu

SEQ ID NO: 290175 - RNA, 64 nt, Homo Sapiens
aucuccaagagguacagcgggcgcccugugaaccugaugggaaccucucugugacacccuccgu

SEQ ID NO: 290176 - RNA, 64 nt, Homo Sapiens
aaaaauaaaaaauaaauaauggaacacagcaaguccuaggaaguagguuaaaacuaauucuuua

SEQ ID NO: 290177 - RNA, 64 nt, Homo Sapiens
gaauuccaucccaguaccaaagccagauaggcccccuaggaaacugagguaagagcagucucua

SEQ ID NO: 290178 - RNA, 64 nt, Homo Sapiens
gauuaucaggccuugccaacaguacaucucgucaccuaggaauacuugacuuaaagguugcagc

SEQ ID NO: 290179 - RNA, 64 nt, Homo Sapiens
uucuucagaaaugcaacuuccaaagguaucucugccuaggaacaugcccauuucaguacccuuu

SEQ ID NO: 290180 - RNA, 64 nt, Homo Sapiens
agggagaaaugaaggaagggauuggugacccaacccuaggaaguguacugaagaugcuccagua

SEQ ID NO: 290181 - RNA, 64 nt, Homo Sapiens
guggcugggaaggugccuccccagugcuguuuggccuaggaacuccacuccaagccuggcccca

SEQ ID NO: 290182 - RNA, 64 nt, Homo Sapiens
auucgaagauguguugacagucgugaguguguauccuaggaaaggcgagcuggacucugucucc

SEQ ID NO: 290183 - RNA, 64 nt, Homo Sapiens
gacucugucuccaugguggcucucaccccagggaccuaggaacagccugucaccacacaauuac

SEQ ID NO: 290184 - RNA, 64 nt, Homo Sapiens
ugccccccuggggggccacagcccagagaaccagccuaggaacacucgggaugacaccccuuau

SEQ ID NO: 290185 - RNA, 64 nt, Homo Sapiens
ugcccagugggauucuccagggggccgggacuucccuaggaaguggugagccaaugcucccuga

SEQ ID NO: 290186 - RNA, 64 nt, Homo Sapiens
cguugauuuacauuuuuuaccccuccuugccuucccuaggaaacaccucaugccccuuuacauu

SEQ ID NO: 290187 - RNA, 64 nt, Homo Sapiens
auuguaggaauuuauggguaugccaccaaggccuccuaggaaaaagauuugaccucauuugcau

SEQ ID NO: 290188 - RNA, 64 nt, Homo Sapiens
acacaucagaaaauccugacguaaaauaggugggcacaaguauugcuuaaacauuuucucaauu

SEQ ID NO: 290189 - RNA, 64 nt, Homo Sapiens
gcccuuuaacaagacuucaaaucuuaaggggacccacaaguauuacacacacacacagagacac

SEQ ID NO: 290190 - RNA, 64 nt, Homo Sapiens
acauuuggccacaaaacaccaaaacucuuuggugcacaaguaacguaggcaaaucucuuuuuaa

SEQ ID NO: 290191 - RNA, 64 nt, Homo Sapiens
ggcauuguccaaaguuuauuuucuguauauagggcacaaguaaauggaaaauucuauggaauag

SEQ ID NO: 290192 - RNA, 64 nt, Homo Sapiens
guacuguucaccaaauugugaacuuuuuaucacucacaaguaguucuagccaccaccaccuuuc

SEQ ID NO: 290193 - RNA, 64 nt, Homo Sapiens
cauuccaacauugucuuuagcccccaaugaaauacacaaguaaacauuuaaaagaugggcguuu

SEQ ID NO: 290194 - RNA, 64 nt, Homo Sapiens
agaugccauuuuguacauguggaaagcuauaucuauuugagagcgugacuuaucuaccauugaa

SEQ ID NO: 290195 - RNA, 64 nt, Homo Sapiens
uucucagaauaacuaccuccguacaauaaucucuauuugagaagccccagcucucaguaguuua

SEQ ID NO: 290196 - RNA, 64 nt, Homo Sapiens
ugaaaguauauuuuccucccaguucuacaagcauauuugagaacccuuccuuucccaaguauug

SEQ ID NO: 290197 - RNA, 64 nt, Homo Sapiens
guugcuaguacuggggagaaauaauuguugauuaauuugagaauuauuccuuuccuagacuaau

SEQ ID NO: 290198 - RNA, 64 nt, Homo Sapiens
auagauggaaagugcauauugaacacaucugugcauuugagaaggcaggcuuucauaugcuguc

SEQ ID NO: 290199 - RNA, 64 nt, Homo Sapiens
gagauggaguuuugcucuuaaugauauuauuauuauuugagacagaguuuugcucuuauugccc

SEQ ID NO: 290200 - RNA, 64 nt, Homo Sapiens
cagacauuauaauuguuaacucuuaauuugauauauuugagaguuuguguucaauauuaacacu

SEQ ID NO: 290201 - RNA, 64 nt, Homo Sapiens
gugaucgccguaacaguaaauuaaagggcagaaaauuugagacgaccuagcuucaccuuauucu

SEQ ID NO: 290202 - RNA, 64 nt, Homo Sapiens
gugagacgaaugggcucuggacauaugccuguugauuugagaagaaaucuggcugguuugaggg

SEQ ID NO: 290203 - RNA, 64 nt, Homo Sapiens
guugucauccugggagacaggcaacaguagagauauuugagagccuaaagagagguuuggccug

SEQ ID NO: 290204 - RNA, 64 nt, Homo Sapiens
cguucaguuuccugggucuuuuucuuauuagcacauuugagaaaaauauuccuuuccuuuauug

SEQ ID NO: 290205 - RNA, 64 nt, Homo Sapiens
aaagaaucuccauuuucugaaggucuguuaguuaauuugagauaauuuguuaaaggcaaguaug

SEQ ID NO: 290206 - RNA, 64 nt, Homo Sapiens
uugaguucuaauguuacaucugaggaaguauguaauuugagaauuguaacuucuaagggauuca

SEQ ID NO: 290207 - RNA, 64 nt, Homo Sapiens
gcuccaucaagaaugugggaugugccgaccaaggauuugagaaaguuguacagaaauguguuca

SEQ ID NO: 290208 - RNA, 64 nt, Homo Sapiens
uauuugucgaugaaauaaacacaacucuuugaggauuugagacuacauucacccuuuauucaca

SEQ ID NO: 290209 - RNA, 64 nt, Homo Sapiens
cccguuuaucuugugcuaucucuguaguauuuucauuugagagaggaggcugaguuuccagagc

SEQ ID NO: 290210 - RNA, 64 nt, Homo Sapiens
cgugaaauccuuagcugguugaauguugcacaguauuugagaauuacgguuugaagugauuucu

SEQ ID NO: 290211 - RNA, 64 nt, Homo Sapiens
uuguagcugccuccuagaagcacauucugagcacauuugagaccucuguguuagaggggagacu

SEQ ID NO: 290212 - RNA, 64 nt, Homo Sapiens
guuuuguuuuuaucuugccuguuggcuucaauacauuugagaauacgcugaagagggaaaauuu

SEQ ID NO: 290213 - RNA, 64 nt, Homo Sapiens
uuaaccaguauggcuaacuaaaacagucaaccugauuugagaaagacucauacaauuugagaaa

SEQ ID NO: 290214 - RNA, 64 nt, Homo Sapiens
aaacagucaaccugauuugaaagggacucauacaauuugagaaaaaagugaccacaaaauuuca

SEQ ID NO: 290215 - RNA, 64 nt, Homo Sapiens
agggugaacugcaaagcuuuggcugagaccugggauuugagauaccacaaacccugcugaacac

SEQ ID NO: 290216 - RNA, 64 nt, Homo Sapiens
auaguauagaagucuggaaaaaaacaaaaacagaauuugagaaccuuggaccacuccugucccu

SEQ ID NO: 290217 - RNA, 64 nt, Homo Sapiens
cauuggagaagcgguggauaacuagccagacaaaauuugagaauacauaaacaacgcauugcca

SEQ ID NO: 290218 - RNA, 64 nt, Homo Sapiens
gcauguuuaaaaauugcagaaauacguguuuguuauuugagaaauugccuuuaaaacuuacaaa

SEQ ID NO: 290219 - RNA, 64 nt, Homo Sapiens
uauuucauuuguccacuggaauucaaauaugggaauuugagaaaagaggcaacuuuuguuuaug

SEQ ID NO: 290220 - RNA, 64 nt, Homo Sapiens
aauuuggcauuugaaaugauauaguucacuuguuauuugagauuaaaaagagauaaaauuaaua

SEQ ID NO: 290221 - RNA, 64 nt, Homo Sapiens
uuuuuuuguacagcauucauucucugcacuggucauuugagaauguaaaaacagcuauuacuaa

SEQ ID NO: 290222 - RNA, 64 nt, Homo Sapiens
guaccuuagaaaaaguuucaccgugguugaauauauuugagaugagaaaaaguuacacgcaguu

SEQ ID NO: 290223 - RNA, 64 nt, Homo Sapiens
guaccuuagaaaaaguuacaucccaggccuugugauuugagaugaaaguaaaacaauuucccaa

SEQ ID NO: 290224 - RNA, 64 nt, Homo Sapiens
cccucaaauuggugcuuucaaaauucaaaucacuauuugagaaauguuacacuguuauguccua

SEQ ID NO: 290225 - RNA, 64 nt, Homo Sapiens
ccuguucauucuugguguguuucaagaaggcauuauuugagauuguauuuuucugucaagacua

SEQ ID NO: 290226 - RNA, 64 nt, Homo Sapiens
agccuggcuaacauggcgaaaccugagaucaaguauuugagaacgaggccaaggugggcagauc

SEQ ID NO: 290227 - RNA, 64 nt, Homo Sapiens
agccuggccaacagacgggaacuugaggucaugaauuugagaccgaggccaagacagguagguc

SEQ ID NO: 290228 - RNA, 64 nt, Homo Sapiens
aauaguaauuugauuauuucucuagagggugagaauuugagagauuuaucacucugagcgaguc

SEQ ID NO: 290229 - RNA, 64 nt, Homo Sapiens
aaauauuucuauuaaugguuaaagaauauuacauauuugagagauuuggaaacuuucuuuuaca

SEQ ID NO: 290230 - RNA, 64 nt, Homo Sapiens; identical to SEQ ID NO: 174962

SEQ ID NO: 290231 - RNA, 64 nt, Homo Sapiens; identical to SEQ ID NO: 174963

SEQ ID NO: 290232 - RNA, 64 nt, Homo Sapiens; identical to SEQ ID NO: 174967

SEQ ID NO: 290233 - RNA, 64 nt, Homo Sapiens; identical to SEQ ID NO: 174968

SEQ ID NO: 290234 - RNA, 64 nt, Homo Sapiens
cagugcaggugauuuuaaaauauuaugaauagugcugcgauaaaagugcugcgauaaacagcac

SEQ ID NO: 290235 - RNA, 64 nt, Homo Sapiens
cagcacuauuaugaauaguguauuacgaauagugcugcgauaaagguugguuccauaacuuugc

SEQ ID NO: 290236 - RNA, 64 nt, Homo Sapiens
ucacuccuaaagaaauagcauguuaauacuuaaacugcgauauuagaagaacagauaacaaagc

SEQ ID NO: 290237 - RNA, 64 nt, Homo Sapiens
cucuucuguuagacauuguucaccaaagucauugcugcgauaugcgugaaccaguaucuuuuac

SEQ ID NO: 290238 - RNA, 64 nt, Homo Sapiens; identical to SEQ ID NO: 108616

SEQ ID NO: 290239 - RNA, 64 nt, Homo Sapiens; identical to SEQ ID NO: 108617

SEQ ID NO: 290240 - RNA, 64 nt, Homo Sapiens; identical to SEQ ID NO: 108618

SEQ ID NO: 290241 - RNA, 64 nt, Homo Sapiens; identical to SEQ ID NO: 108619

SEQ ID NO: 290242 - RNA, 64 nt, Homo Sapiens; identical to SEQ ID NO: 108620

SEQ ID NO: 290243 - RNA, 64 nt, Homo Sapiens; identical to SEQ ID NO: 108621

SEQ ID NO: 290244 - RNA, 64 nt, Homo Sapiens; identical to SEQ ID NO: 108622

SEQ ID NO: 290245 - RNA, 64 nt, Homo Sapiens; identical to SEQ ID NO: 108623

SEQ ID NO: 290246 - RNA, 61 nt, Homo Sapiens; identical to SEQ ID NO: 108624

SEQ ID NO: 290247 - RNA, 64 nt, Homo Sapiens; identical to SEQ ID NO: 108625

SEQ ID NO: 290248 - RNA, 64 nt, Homo Sapiens; identical to SEQ ID NO: 108626

SEQ ID NO: 290249 - RNA, 64 nt, Homo Sapiens; identical to SEQ ID NO: 108627

SEQ ID NO: 290250 - RNA, 64 nt, Homo Sapiens; identical to SEQ ID NO: 108628

SEQ ID NO: 290251 - RNA, 64 nt, Homo Sapiens; identical to SEQ ID NO: 108629

SEQ ID NO: 290252 - RNA, 64 nt, Homo Sapiens; identical to SEQ ID NO: 108630

SEQ ID NO: 290253 - RNA, 64 nt, Homo Sapiens; identical to SEQ ID NO: 108631

SEQ ID NO: 290254 - RNA, 64 nt, Homo Sapiens; identical to SEQ ID NO: 108632

SEQ ID NO: 290255 - RNA, 64 nt, Homo Sapiens; identical to SEQ ID NO: 108633

SEQ ID NO: 290256 - RNA, 64 nt, Homo Sapiens; identical to SEQ ID NO: 108634

SEQ ID NO: 290257 - RNA, 64 nt, Homo Sapiens; identical to SEQ ID NO: 108635

SEQ ID NO: 290258 - RNA, 64 nt, Homo Sapiens; identical to SEQ ID NO: 108636

SEQ ID NO: 290259 - RNA, 64 nt, Homo Sapiens; identical to SEQ ID NO: 108637

SEQ ID NO: 290260 - RNA, 64 nt, Homo Sapiens; identical to SEQ ID NO: 108638

SEQ ID NO: 290261 - RNA, 64 nt, Homo Sapiens; identical to SEQ ID NO: 108639

SEQ ID NO: 290262 - RNA, 64 nt, Homo Sapiens; identical to SEQ ID NO: 108640

SEQ ID NO: 290263 - RNA, 64 nt, Homo Sapiens; identical to SEQ ID NO: 108641

SEQ ID NO: 290264 - RNA, 64 nt, Homo Sapiens; identical to SEQ ID NO: 108642

SEQ ID NO: 290265 - RNA, 64 nt, Homo Sapiens; identical to SEQ ID NO: 108643

SEQ ID NO: 290266 - RNA, 64 nt, Homo Sapiens; identical to SEQ ID NO: 108644

SEQ ID NO: 290267 - RNA, 64 nt, Homo Sapiens; identical to SEQ ID NO: 108645

SEQ ID NO: 290268 - RNA, 64 nt, Homo Sapiens; identical to SEQ ID NO: 108646

SEQ ID NO: 290269 - RNA, 64 nt, Homo Sapiens; identical to SEQ ID NO: 108647

SEQ ID NO: 290270 - RNA, 64 nt, Homo Sapiens; identical to SEQ ID NO: 108648

SEQ ID NO: 290271 - RNA, 64 nt, Homo Sapiens; identical to SEQ ID NO: 108649

SEQ ID NO: 290272 - RNA, 64 nt, Homo Sapiens; identical to SEQ ID NO: 108650

SEQ ID NO: 290273 - RNA, 64 nt, Homo Sapiens; identical to SEQ ID NO: 108651

SEQ ID NO: 290274 - RNA, 64 nt, Homo Sapiens; identical to SEQ ID NO: 108652

SEQ ID NO: 290275 - RNA, 64 nt, Homo Sapiens; identical to SEQ ID NO: 108653

SEQ ID NO: 290276 - RNA, 64 nt, Homo Sapiens; identical to SEQ ID NO: 108654

SEQ ID NO: 290277 - RNA, 64 nt, Homo Sapiens; identical to SEQ ID NO: 108655

SEQ ID NO: 290278 - RNA, 64 nt, Homo Sapiens; identical to SEQ ID NO: 108656

SEQ ID NO: 290279 - RNA, 64 nt, Homo Sapiens; identical to SEQ ID NO: 108657

SEQ ID NO: 290280 - RNA, 64 nt, Homo Sapiens; identical to SEQ ID NO: 108658

SEQ ID NO: 290281 - RNA, 64 nt, Homo Sapiens; identical to SEQ ID NO: 108659

SEQ ID NO: 290282 - RNA, 64 nt, Homo Sapiens; identical to SEQ ID NO: 108660

SEQ ID NO: 290283 - RNA, 64 nt, Homo Sapiens; identical to SEQ ID NO: 108661

SEQ ID NO: 290284 - RNA, 64 nt, Homo Sapiens; identical to SEQ ID NO: 108662

SEQ ID NO: 290285 - RNA, 64 nt, Homo Sapiens; identical to SEQ ID NO: 108663

SEQ ID NO: 290286 - RNA, 64 nt, Homo Sapiens; identical to SEQ ID NO: 108664

SEQ ID NO: 290287 - RNA, 64 nt, Homo Sapiens; identical to SEQ ID NO: 108665

SEQ ID NO: 290288 - RNA, 64 nt, Homo Sapiens; identical to SEQ ID NO: 108666

SEQ ID NO: 290289 - RNA, 64 nt, Homo Sapiens; identical to SEQ ID NO: 108667

SEQ ID NO: 290290 - RNA, 64 nt, Homo Sapiens; identical to SEQ ID NO: 108668

SEQ ID NO: 290291 - RNA, 64 nt, Homo Sapiens; identical to SEQ ID NO: 108669

SEQ ID NO: 290292 - RNA, 64 nt, Homo Sapiens; identical to SEQ ID NO: 108670

SEQ ID NO: 290293 - RNA, 64 nt, Homo Sapiens; identical to SEQ ID NO: 108671

SEQ ID NO: 290294 - RNA, 64 nt, Homo Sapiens; identical to SEQ ID NO: 108672

SEQ ID NO: 290295 - RNA, 64 nt, Homo Sapiens; identical to SEQ ID NO: 108673

SEQ ID NO: 290296 - RNA, 64 nt, Homo Sapiens; identical to SEQ ID NO: 108674

SEQ ID NO: 290297 - RNA, 64 nt, Homo Sapiens; identical to SEQ ID NO: 108675

SEQ ID NO: 290298 - RNA, 64 nt, Homo Sapiens; identical to SEQ ID NO: 108676

SEQ ID NO: 290299 - RNA, 64 nt, Homo Sapiens; identical to SEQ ID NO: 108677

SEQ ID NO: 290300 - RNA, 64 nt, Homo Sapiens; identical to SEQ ID NO: 108678

SEQ ID NO: 290301 - RNA, 64 nt, Homo Sapiens; identical to SEQ ID NO: 108679

SEQ ID NO: 290302 - RNA, 64 nt, Homo Sapiens; identical to SEQ ID NO: 108680

SEQ ID NO: 290303 - RNA, 64 nt, Homo Sapiens; identical to SEQ ID NO: 108681

SEQ ID NO: 290304 - RNA, 64 nt, Homo Sapiens; identical to SEQ ID NO: 108682

SEQ ID NO: 290305 - RNA, 64 nt, Homo Sapiens; identical to SEQ ID NO: 108683

SEQ ID NO: 290306 - RNA, 64 nt, Homo Sapiens; identical to SEQ ID NO: 108684

SEQ ID NO: 290307 - RNA, 64 nt, Homo Sapiens; identical to SEQ ID NO: 108685

SEQ ID NO: 290308 - RNA, 64 nt, Homo Sapiens; identical to SEQ ID NO: 108686

SEQ ID NO: 290309 - RNA, 64 nt, Homo Sapiens; identical to SEQ ID NO: 108687

SEQ ID NO: 290310 - RNA, 64 nt, Homo Sapiens; identical to SEQ ID NO: 108688

SEQ ID NO: 290311 - RNA, 64 nt, Homo Sapiens; identical to SEQ ID NO: 108689

SEQ ID NO: 290312 - RNA, 64 nt, Homo Sapiens; identical to SEQ ID NO: 108690

SEQ ID NO: 290313 - RNA, 64 nt, Homo Sapiens; identical to SEQ ID NO: 108691

SEQ ID NO: 290314 - RNA, 64 nt, Homo Sapiens; identical to SEQ ID NO: 108692

SEQ ID NO: 290315 - RNA, 64 nt, Homo Sapiens; identical to SEQ ID NO: 108693

SEQ ID NO: 290316 - RNA, 64 nt, Homo Sapiens; identical to SEQ ID NO: 108694

SEQ ID NO: 290317 - RNA, 64 nt, Homo Sapiens; identical to SEQ ID NO: 108695

SEQ ID NO: 290318 - RNA, 64 nt, Homo Sapiens; identical to SEQ ID NO: 108696

SEQ ID NO: 290319 - RNA, 64 nt, Homo Sapiens; identical to SEQ ID NO: 108697

SEQ ID NO: 290320 - RNA, 64 nt, Homo Sapiens; identical to SEQ ID NO: 108698

SEQ ID NO: 290321 - RNA, 64 nt, Homo Sapiens; identical to SEQ ID NO: 108699

SEQ ID NO: 290322 - RNA, 64 nt, Homo Sapiens; identical to SEQ ID NO: 108700

SEQ ID NO: 290323 - RNA, 64 nt, Homo Sapiens; identical to SEQ ID NO: 108701

SEQ ID NO: 290324 - RNA, 64 nt, Homo Sapiens; identical to SEQ ID NO: 108702

SEQ ID NO: 290325 - RNA, 64 nt, Homo Sapiens; identical to SEQ ID NO: 108703

SEQ ID NO: 290326 - RNA, 64 nt, Homo Sapiens; identical to SEQ ID NO: 108704

SEQ ID NO: 290327 - RNA, 64 nt, Homo Sapiens; identical to SEQ ID NO: 108705

SEQ ID NO: 290328 - RNA, 64 nt, Homo Sapiens; identical to SEQ ID NO: 108706

SEQ ID NO: 290329 - RNA, 64 nt, Homo Sapiens; identical to SEQ ID NO: 108707

SEQ ID NO: 290330 - RNA, 64 nt, Homo Sapiens; identical to SEQ ID NO: 108708

SEQ ID NO: 290331 - RNA, 64 nt, Homo Sapiens; identical to SEQ ID NO: 108709

SEQ ID NO: 290332 - RNA, 64 nt, Homo Sapiens; identical to SEQ ID NO: 108710

SEQ ID NO: 290333 - RNA, 64 nt, Homo Sapiens; identical to SEQ ID NO: 108711

SEQ ID NO: 290334 - RNA, 64 nt, Homo Sapiens; identical to SEQ ID NO: 108712

SEQ ID NO: 290335 - RNA, 64 nt, Homo Sapiens; identical to SEQ ID NO: 108713

SEQ ID NO: 290336 - RNA, 64 nt, Homo Sapiens; identical to SEQ ID NO: 108714

SEQ ID NO: 290337 - RNA, 64 nt, Homo Sapiens; identical to SEQ ID NO: 108715

SEQ ID NO: 290338 - RNA, 64 nt, Homo Sapiens; identical to SEQ ID NO: 108716

SEQ ID NO: 290339 - RNA, 64 nt, Homo Sapiens; identical to SEQ ID NO: 108717

SEQ ID NO: 290340 - RNA, 64 nt, Homo Sapiens; identical to SEQ ID NO: 108718

SEQ ID NO: 290341 - RNA, 64 nt, Homo Sapiens; identical to SEQ ID NO: 108719

SEQ ID NO: 290342 - RNA, 64 nt, Homo Sapiens; identical to SEQ ID NO: 108720

SEQ ID NO: 290343 - RNA, 64 nt, Homo Sapiens; identical to SEQ ID NO: 108721

SEQ ID NO: 290344 - RNA, 64 nt, Homo Sapiens; identical to SEQ ID NO: 108722

SEQ ID NO: 290345 - RNA, 64 nt, Homo Sapiens; identical to SEQ ID NO: 108723

SEQ ID NO: 290346 - RNA, 64 nt, Homo Sapiens; identical to SEQ ID NO: 108724

SEQ ID NO: 290347 - RNA, 64 nt, Homo Sapiens; identical to SEQ ID NO: 108725

SEQ ID NO: 290348 - RNA, 64 nt, Homo Sapiens; identical to SEQ ID NO: 108726

SEQ ID NO: 290349 - RNA, 64 nt, Homo Sapiens; identical to SEQ ID NO: 108727

SEQ ID NO: 290350 - RNA, 64 nt, Homo Sapiens; identical to SEQ ID NO: 108728

SEQ ID NO: 290351 - RNA, 64 nt, Homo Sapiens; identical to SEQ ID NO: 108729

SEQ ID NO: 290352 - RNA, 64 nt, Homo Sapiens; identical to SEQ ID NO: 108730

SEQ ID NO: 290353 - RNA, 64 nt, Homo Sapiens; identical to SEQ ID NO: 108731

SEQ ID NO: 290354 - RNA, 64 nt, Homo Sapiens; identical to SEQ ID NO: 108732

SEQ ID NO: 290355 - RNA, 64 nt, Homo Sapiens; identical to SEQ ID NO: 108733

SEQ ID NO: 290356 - RNA, 64 nt, Homo Sapiens; identical to SEQ ID NO: 108734

SEQ ID NO: 290357 - RNA, 64 nt, Homo Sapiens; identical to SEQ ID NO: 108735

SEQ ID NO: 290358 - RNA, 64 nt, Homo Sapiens; identical to SEQ ID NO: 108736

SEQ ID NO: 290359 - RNA, 64 nt, Homo Sapiens; identical to SEQ ID NO: 108737

SEQ ID NO: 290360 - RNA, 64 nt, Homo Sapiens; identical to SEQ ID NO: 108738

SEQ ID NO: 290361 - RNA, 64 nt, Homo Sapiens; identical to SEQ ID NO: 108739

SEQ ID NO: 290362 - RNA, 64 nt, Homo Sapiens; identical to SEQ ID NO: 108740

SEQ ID NO: 290363 - RNA, 64 nt, Homo Sapiens; identical to SEQ ID NO: 108741

SEQ ID NO: 290364 - RNA, 64 nt, Homo Sapiens; identical to SEQ ID NO: 108742

SEQ ID NO: 290365 - RNA, 64 nt, Homo Sapiens; identical to SEQ ID NO: 108743

SEQ ID NO: 290366 - RNA, 64 nt, Homo Sapiens; identical to SEQ ID NO: 108744

SEQ ID NO: 290367 - RNA, 64 nt, Homo Sapiens; identical to SEQ ID NO: 108745

SEQ ID NO: 290368 - RNA, 64 nt, Homo Sapiens; identical to SEQ ID NO: 108746

SEQ ID NO: 290369 - RNA, 64 nt, Homo Sapiens; identical to SEQ ID NO: 108747

SEQ ID NO: 290370 - RNA, 64 nt, Homo Sapiens; identical to SEQ ID NO: 108748

SEQ ID NO: 290371 - RNA, 64 nt, Homo Sapiens; identical to SEQ ID NO: 108749

SEQ ID NO: 290372 - RNA, 64 nt, Homo Sapiens; identical to SEQ ID NO: 108750

SEQ ID NO: 290373 - RNA, 64 nt, Homo Sapiens; identical to SEQ ID NO: 108751

SEQ ID NO: 290374 - RNA, 64 nt, Homo Sapiens; identical to SEQ ID NO: 108752

SEQ ID NO: 290375 - RNA, 64 nt, Homo Sapiens; identical to SEQ ID NO: 108753

SEQ ID NO: 290376 - RNA, 64 nt, Homo Sapiens; identical to SEQ ID NO: 108754

SEQ ID NO: 290377 - RNA, 64 nt, Homo Sapiens; identical to SEQ ID NO: 108755

SEQ ID NO: 290378 - RNA, 64 nt, Homo Sapiens; identical to SEQ ID NO: 108756

SEQ ID NO: 290379 - RNA, 64 nt, Homo Sapiens; identical to SEQ ID NO: 108757

SEQ ID NO: 290380 - RNA, 64 nt, Homo Sapiens; identical to SEQ ID NO: 108758

SEQ ID NO: 290381 - RNA, 64 nt, Homo Sapiens; identical to SEQ ID NO: 108759

SEQ ID NO: 290382 - RNA, 64 nt, Homo Sapiens; identical to SEQ ID NO: 108760

SEQ ID NO: 290383 - RNA, 64 nt, Homo Sapiens; identical to SEQ ID NO: 108761

SEQ ID NO: 290384 - RNA, 64 nt, Homo Sapiens; identical to SEQ ID NO: 108762

SEQ ID NO: 290385 - RNA, 64 nt, Homo Sapiens; identical to SEQ ID NO: 108763

SEQ ID NO: 290386 - RNA, 64 nt, Homo Sapiens; identical to SEQ ID NO: 108764

SEQ ID NO: 290387 - RNA, 64 nt, Homo Sapiens; identical to SEQ ID NO: 108765

SEQ ID NO: 290388 - RNA, 64 nt, Homo Sapiens; identical to SEQ ID NO: 164887

SEQ ID NO: 290389 - RNA, 64 nt, Homo Sapiens; identical to SEQ ID NO: 164888

SEQ ID NO: 290390 - RNA, 64 nt, Homo Sapiens; identical to SEQ ID NO: 164889

SEQ ID NO: 290391 - RNA, 64 nt, Homo Sapiens; identical to SEQ ID NO: 164890

SEQ ID NO: 290392 - RNA, 64 nt, Homo Sapiens; identical to SEQ ID NO: 164891

SEQ ID NO: 290393 - RNA, 64 nt, Homo Sapiens; identical to SEQ ID NO: 164892

SEQ ID NO: 290394 - RNA, 64 nt, Homo Sapiens; identical to SEQ ID NO: 164893

SEQ ID NO: 290395 - RNA, 64 nt, Homo Sapiens; identical to SEQ ID NO: 164894

SEQ ID NO: 290396 - RNA, 64 nt, Homo Sapiens; identical to SEQ ID NO: 164895

SEQ ID NO: 290397 - RNA, 64 nt, Homo Sapiens; identical to SEQ ID NO: 164896

SEQ ID NO: 290398 - RNA, 64 nt, Homo Sapiens; identical to SEQ ID NO: 164897

SEQ ID NO: 290399 - RNA, 64 nt, Homo Sapiens; identical to SEQ ID NO: 164898

SEQ ID NO: 290400 - RNA, 64 nt, Homo Sapiens; identical to SEQ ID NO: 164899

SEQ ID NO: 290401 - RNA, 64 nt, Homo Sapiens; identical to SEQ ID NO: 164900

SEQ ID NO: 290402 - RNA, 64 nt, Homo Sapiens; identical to SEQ ID NO: 164901

SEQ ID NO: 290403 - RNA, 64 nt, Homo Sapiens; identical to SEQ ID NO: 164902

SEQ ID NO: 290404 - RNA, 64 nt, Homo Sapiens; identical to SEQ ID NO: 164903

SEQ ID NO: 290405 - RNA, 64 nt, Homo Sapiens; identical to SEQ ID NO: 164904

SEQ ID NO: 290406 - RNA, 64 nt, Homo Sapiens; identical to SEQ ID NO: 164905

SEQ ID NO: 290407 - RNA, 64 nt, Homo Sapiens; identical to SEQ ID NO: 164906

SEQ ID NO: 290408 - RNA, 64 nt, Homo Sapiens; identical to SEQ ID NO: 164907

SEQ ID NO: 290409 - RNA, 64 nt, Homo Sapiens; identical to SEQ ID NO: 164908

SEQ ID NO: 290410 - RNA, 64 nt, Homo Sapiens; identical to SEQ ID NO: 164909

SEQ ID NO: 290411 - RNA, 64 nt, Homo Sapiens; identical to SEQ ID NO: 164910

SEQ ID NO: 290412 - RNA, 64 nt, Homo Sapiens; identical to SEQ ID NO: 164911

SEQ ID NO: 290413 - RNA, 64 nt, Homo Sapiens; identical to SEQ ID NO: 164912

SEQ ID NO: 290414 - RNA, 64 nt, Homo Sapiens; identical to SEQ ID NO: 164913

SEQ ID NO: 290415 - RNA, 64 nt, Homo Sapiens; identical to SEQ ID NO: 164914

SEQ ID NO: 290416 - RNA, 64 nt, Homo Sapiens; identical to SEQ ID NO: 164915

SEQ ID NO: 290417 - RNA, 64 nt, Homo Sapiens; identical to SEQ ID NO: 164916

SEQ ID NO: 290418 - RNA, 64 nt, Homo Sapiens; identical to SEQ ID NO: 164917

SEQ ID NO: 290419 - RNA, 64 nt, Homo Sapiens; identical to SEQ ID NO: 164918

SEQ ID NO: 290420 - RNA, 64 nt, Homo Sapiens; identical to SEQ ID NO: 164919

SEQ ID NO: 290421 - RNA, 64 nt, Homo Sapiens; identical to SEQ ID NO: 164920

SEQ ID NO: 290422 - RNA, 64 nt, Homo Sapiens; identical to SEQ ID NO: 164921

SEQ ID NO: 290423 - RNA, 64 nt, Homo Sapiens; identical to SEQ ID NO: 164922

SEQ ID NO: 290424 - RNA, 64 nt, Homo Sapiens; identical to SEQ ID NO: 164923

SEQ ID NO: 290425 - RNA, 64 nt, Homo Sapiens; identical to SEQ ID NO: 164924

SEQ ID NO: 290426 - RNA, 64 nt, Homo Sapiens; identical to SEQ ID NO: 164925

SEQ ID NO: 290427 - RNA, 64 nt, Homo Sapiens; identical to SEQ ID NO: 164926

SEQ ID NO: 290428 - RNA, 64 nt, Homo Sapiens; identical to SEQ ID NO: 164927

SEQ ID NO: 290429 - RNA, 64 nt, Homo Sapiens; identical to SEQ ID NO: 164928

SEQ ID NO: 290430 - RNA, 64 nt, Homo Sapiens; identical to SEQ ID NO: 164929

SEQ ID NO: 290431 - RNA, 64 nt, Homo Sapiens; identical to SEQ ID NO: 164930

SEQ ID NO: 290432 - RNA, 64 nt, Homo Sapiens; identical to SEQ ID NO: 164931

SEQ ID NO: 290433 - RNA, 64 nt, Homo Sapiens; identical to SEQ ID NO: 164932

SEQ ID NO: 290434 - RNA, 64 nt, Homo Sapiens; identical to SEQ ID NO: 164933

SEQ ID NO: 290435 - RNA, 64 nt, Homo Sapiens; identical to SEQ ID NO: 164934

SEQ ID NO: 290436 - RNA, 64 nt, Homo Sapiens; identical to SEQ ID NO: 164935

SEQ ID NO: 290437 - RNA, 64 nt, Homo Sapiens; identical to SEQ ID NO: 164936

SEQ ID NO: 290438 - RNA, 64 nt, Homo Sapiens; identical to SEQ ID NO: 164937

SEQ ID NO: 290439 - RNA, 64 nt, Homo Sapiens; identical to SEQ ID NO: 164938

SEQ ID NO: 290440 - RNA, 64 nt, Homo Sapiens; identical to SEQ ID NO: 164939

SEQ ID NO: 290441 - RNA, 64 nt, Homo Sapiens; identical to SEQ ID NO: 164940

SEQ ID NO: 290442 - RNA, 64 nt, Homo Sapiens; identical to SEQ ID NO: 164941

SEQ ID NO: 290443 - RNA, 64 nt, Homo Sapiens; identical to SEQ ID NO: 164942

SEQ ID NO: 290444 - RNA, 64 nt, Homo Sapiens; identical to SEQ ID NO: 164943

SEQ ID NO: 290445 - RNA, 64 nt, Homo Sapiens; identical to SEQ ID NO: 164944

SEQ ID NO: 290446 - RNA, 64 nt, Homo Sapiens; identical to SEQ ID NO: 164945

SEQ ID NO: 290447 - RNA, 64 nt, Homo Sapiens; identical to SEQ ID NO: 164946

SEQ ID NO: 290448 - RNA, 64 nt, Homo Sapiens; identical to SEQ ID NO: 164947

SEQ ID NO: 290449 - RNA, 64 nt, Homo Sapiens; identical to SEQ ID NO: 164948

SEQ ID NO: 290450 - RNA, 64 nt, Homo Sapiens; identical to SEQ ID NO: 164949

SEQ ID NO: 290451 - RNA, 64 nt, Homo Sapiens; identical to SEQ ID NO: 164950

SEQ ID NO: 290452 - RNA, 64 nt, Homo Sapiens; identical to SEQ ID NO: 164951

SEQ ID NO: 290453 - RNA, 64 nt, Homo Sapiens; identical to SEQ ID NO: 164952

SEQ ID NO: 290454 - RNA, 64 nt, Homo Sapiens; identical to SEQ ID NO: 164953

SEQ ID NO: 290455 - RNA, 64 nt, Homo Sapiens; identical to SEQ ID NO: 164954

SEQ ID NO: 290456 - RNA, 64 nt, Homo Sapiens; identical to SEQ ID NO: 164955

SEQ ID NO: 290457 - RNA, 64 nt, Homo Sapiens; identical to SEQ ID NO: 164956

SEQ ID NO: 290458 - RNA, 64 nt, Homo Sapiens; identical to SEQ ID NO: 164957

SEQ ID NO: 290459 - RNA, 64 nt, Homo Sapiens; identical to SEQ ID NO: 164958

SEQ ID NO: 290460 - RNA, 64 nt, Homo Sapiens; identical to SEQ ID NO: 164959

SEQ ID NO: 290461 - RNA, 64 nt, Homo Sapiens; identical to SEQ ID NO: 164960

SEQ ID NO: 290462 - RNA, 64 nt, Homo Sapiens; identical to SEQ ID NO: 164961

SEQ ID NO: 290463 - RNA, 64 nt, Homo Sapiens; identical to SEQ ID NO: 164962

SEQ ID NO: 290464 - RNA, 64 nt, Homo Sapiens; identical to SEQ ID NO: 164963

SEQ ID NO: 290465 - RNA, 64 nt, Homo Sapiens; identical to SEQ ID NO: 164964

SEQ ID NO: 290466 - RNA, 64 nt, Homo Sapiens; identical to SEQ ID NO: 164965

SEQ ID NO: 290467 - RNA, 64 nt, Homo Sapiens; identical to SEQ ID NO: 164966

SEQ ID NO: 290468 - RNA, 64 nt, Homo Sapiens; identical to SEQ ID NO: 164967

SEQ ID NO: 290469 - RNA, 64 nt, Homo Sapiens; identical to SEQ ID NO: 164967

SEQ ID NO: 290470 - RNA, 64 nt, Homo Sapiens; identical to SEQ ID NO: 164969

SEQ ID NO: 290471 - RNA, 64 nt, Homo Sapiens; identical to SEQ ID NO: 164970

SEQ ID NO: 290472 - RNA, 64 nt, Homo Sapiens; identical to SEQ ID NO: 164971

SEQ ID NO: 290473 - RNA, 64 nt, Homo Sapiens; identical to SEQ ID NO: 164972

SEQ ID NO: 290474 - RNA, 64 nt, Homo Sapiens; identical to SEQ ID NO: 164973

SEQ ID NO: 290475 - RNA, 64 nt, Homo Sapiens; identical to SEQ ID NO: 164974

SEQ ID NO: 290476 - RNA, 64 nt, Homo Sapiens; identical to SEQ ID NO: 164975

SEQ ID NO: 290477 - RNA, 64 nt, Homo Sapiens; identical to SEQ ID NO: 164976

SEQ ID NO: 290478 - RNA, 64 nt, Homo Sapiens; identical to SEQ ID NO: 164977

SEQ ID NO: 290479 - RNA, 64 nt, Homo Sapiens; identical to SEQ ID NO: 164978

SEQ ID NO: 290480 - RNA, 64 nt, Homo Sapiens; identical to SEQ ID NO: 164979

SEQ ID NO: 290481 - RNA, 64 nt, Homo Sapiens; identical to SEQ ID NO: 164980

SEQ ID NO: 290482 - RNA, 64 nt, Homo Sapiens; identical to SEQ ID NO: 164981

SEQ ID NO: 290483 - RNA, 64 nt, Homo Sapiens; identical to SEQ ID NO: 164982

SEQ ID NO: 290484 - RNA, 64 nt, Homo Sapiens; identical to SEQ ID NO: 164983

SEQ ID NO: 290485 - RNA, 64 nt, Homo Sapiens; identical to SEQ ID NO: 164984

SEQ ID NO: 290486 - RNA, 64 nt, Homo Sapiens; identical to SEQ ID NO: 164985

SEQ ID NO: 290487 - RNA, 64 nt, Homo Sapiens; identical to SEQ ID NO: 164986

SEQ ID NO: 290488 - RNA, 64 nt, Homo Sapiens; identical to SEQ ID NO: 164987

SEQ ID NO: 290489 - RNA, 64 nt, Homo Sapiens; identical to SEQ ID NO: 164988

SEQ ID NO: 290490 - RNA, 64 nt, Homo Sapiens; identical to SEQ ID NO: 164989

SEQ ID NO: 290491 - RNA, 64 nt, Homo Sapiens; identical to SEQ ID NO: 164990

SEQ ID NO: 290492 - RNA, 64 nt, Homo Sapiens; identical to SEQ ID NO: 164991

SEQ ID NO: 290493 - RNA, 64 nt, Homo Sapiens; identical to SEQ ID NO: 164992

SEQ ID NO: 290494 - RNA, 64 nt, Homo Sapiens; identical to SEQ ID NO: 164993

SEQ ID NO: 290495 - RNA, 64 nt, Homo Sapiens; identical to SEQ ID NO: 164994

SEQ ID NO: 290496 - RNA, 64 nt, Homo Sapiens; identical to SEQ ID NO: 164995

SEQ ID NO: 290497 - RNA, 64 nt, Homo Sapiens; identical to SEQ ID NO: 164996

SEQ ID NO: 290498 - RNA, 64 nt, Homo Sapiens; identical to SEQ ID NO: 164997

SEQ ID NO: 290499 - RNA, 64 nt, Homo Sapiens; identical to SEQ ID NO: 164998

SEQ ID NO: 290500 - RNA, 64 nt, Homo Sapiens; identical to SEQ ID NO: 164999

SEQ ID NO: 290501 - RNA, 64 nt, Homo Sapiens; identical to SEQ ID NO: 165000

SEQ ID NO: 290502 - RNA, 64 nt, Homo Sapiens; identical to SEQ ID NO: 165001

SEQ ID NO: 290503 - RNA, 64 nt, Homo Sapiens; identical to SEQ ID NO: 165002

SEQ ID NO: 290504 - RNA, 64 nt, Homo Sapiens; identical to SEQ ID NO: 165003

SEQ ID NO: 290505 - RNA, 64 nt, Homo Sapiens; identical to SEQ ID NO: 165004

SEQ ID NO: 290506 - RNA, 64 nt, Homo Sapiens; identical to SEQ ID NO: 165005

SEQ ID NO: 290507 - RNA, 64 nt, Homo Sapiens; identical to SEQ ID NO: 165006

SEQ ID NO: 290508 - RNA, 64 nt, Homo Sapiens; identical to SEQ ID NO: 165007

SEQ ID NO: 290509 - RNA, 64 nt, Homo Sapiens; identical to SEQ ID NO: 165008

SEQ ID NO: 290510 - RNA, 64 nt, Homo Sapiens; identical to SEQ ID NO: 165009

SEQ ID NO: 290511 - RNA, 64 nt, Homo Sapiens; identical to SEQ ID NO: 165010

SEQ ID NO: 290512 - RNA, 64 nt, Homo Sapiens; identical to SEQ ID NO: 165011

SEQ ID NO: 290513 - RNA, 64 nt, Homo Sapiens; identical to SEQ ID NO: 165012

SEQ ID NO: 290514 - RNA, 64 nt, Homo Sapiens; identical to SEQ ID NO: 165013

SEQ ID NO: 290515 - RNA, 64 nt, Homo Sapiens; identical to SEQ ID NO: 165014

SEQ ID NO: 290516 - RNA, 64 nt, Homo Sapiens; identical to SEQ ID NO: 165015

SEQ ID NO: 290517 - RNA, 64 nt, Homo Sapiens; identical to SEQ ID NO: 165016

SEQ ID NO: 290518 - RNA, 64 nt, Homo Sapiens; identical to SEQ ID NO: 165017

SEQ ID NO: 290519 - RNA, 64 nt, Homo Sapiens; identical to SEQ ID NO: 165018

SEQ ID NO: 290520 - RNA, 64 nt, Homo Sapiens; identical to SEQ ID NO: 165019

SEQ ID NO: 290521 - RNA, 64 nt, Homo Sapiens; identical to SEQ ID NO: 165020

SEQ ID NO: 290522 - RNA, 64 nt, Homo Sapiens; identical to SEQ ID NO: 165021

SEQ ID NO: 290523 - RNA, 64 nt, Homo Sapiens; identical to SEQ ID NO: 165022

SEQ ID NO: 290524 - RNA, 64 nt, Homo Sapiens; identical to SEQ ID NO: 165023

SEQ ID NO: 290525 - RNA, 64 nt, Homo Sapiens; identical to SEQ ID NO: 165024

SEQ ID NO: 290526 - RNA, 64 nt, Homo Sapiens; identical to SEQ ID NO: 165025

SEQ ID NO: 290527 - RNA, 64 nt, Homo Sapiens; identical to SEQ ID NO: 165026

SEQ ID NO: 290528 - RNA, 64 nt, Homo Sapiens; identical to SEQ ID NO: 165027

SEQ ID NO: 290529 - RNA, 64 nt, Homo Sapiens; identical to SEQ ID NO: 165028

SEQ ID NO: 290530 - RNA, 64 nt, Homo Sapiens; identical to SEQ ID NO: 165029

SEQ ID NO: 290531 - RNA, 64 nt, Homo Sapiens; identical to SEQ ID NO: 165030

SEQ ID NO: 290532 - RNA, 64 nt, Homo Sapiens; identical to SEQ ID NO: 165031

SEQ ID NO: 290533 - RNA, 64 nt, Homo Sapiens; identical to SEQ ID NO: 165032

SEQ ID NO: 290534 - RNA, 64 nt, Homo Sapiens; identical to SEQ ID NO: 165033

SEQ ID NO: 290535 - RNA, 64 nt, Homo Sapiens; identical to SEQ ID NO: 165034

SEQ ID NO: 290536 - RNA, 64 nt, Homo Sapiens; identical to SEQ ID NO: 165035

SEQ ID NO: 290537 - RNA, 64 nt, Homo Sapiens; identical to SEQ ID NO: 165036

SEQ ID NO: 290538 - RNA, 64 nt, Homo Sapiens; identical to SEQ ID NO: 165037

SEQ ID NO: 290539 - RNA, 64 nt, Homo Sapiens; identical to SEQ ID NO: 165038

SEQ ID NO: 290540 - RNA, 64 nt, Homo Sapiens; identical to SEQ ID NO: 165039

SEQ ID NO: 290541 - RNA, 64 nt, Homo Sapiens; identical to SEQ ID NO: 165040

SEQ ID NO: 290542 - RNA, 64 nt, Homo Sapiens; identical to SEQ ID NO: 165041

SEQ ID NO: 290543 - RNA, 64 nt, Homo Sapiens; identical to SEQ ID NO: 165042

SEQ ID NO: 290544 - RNA, 64 nt, Homo Sapiens; identical to SEQ ID NO: 165043

SEQ ID NO: 290545 - RNA, 64 nt, Homo Sapiens; identical to SEQ ID NO: 165044

SEQ ID NO: 290546 - RNA, 64 nt, Homo Sapiens; identical to SEQ ID NO: 165045

SEQ ID NO: 290547 - RNA, 64 nt, Homo Sapiens; identical to SEQ ID NO: 165046

SEQ ID NO: 290548 - RNA, 64 nt, Homo Sapiens
ugguuuuucccaccccagcugccccagcacgcgggacccauagcacaccccuuagcgcuugccu

SEQ ID NO: 290549 - RNA, 64 nt, Homo Sapiens
caggaaggaagcacaaaagacaagcauugggucagacccauaaaccaccucccaaaggcuguca

SEQ ID NO: 290550 - RNA, 64 nt, Homo Sapiens
ucaguaugucugaauuccagaguaaaacacuucugacccauagcuggggauuguuugcuuuuua

SEQ ID NO: 290551 - RNA, 64 nt, Homo Sapiens
guuuacucuuaaaauuguguuucaaggauaugcugacccauauauuuacaaagucuacuuuuug

SEQ ID NO: 290552 - RNA, 64 nt, Homo Sapiens
acauuaucauuuuuauaaguaauguauucauguugacccauaaguuuucuuucucucuugccag

SEQ ID NO: 290553 - RNA, 64 nt, Homo Sapiens
gccuugaccacaucacuccacuuugagguggagagacccauaaaacuacccuagggcacuuucu

SEQ ID NO: 290554 - RNA, 57 nt, Homo Sapiens; identical to SEQ ID NO: 50453

SEQ ID NO: 290555 - RNA, 64 nt, Homo Sapiens
ugcaguuagaaaaagacaacaccuuaaacauguggacccauagguccaaaaacaucuauuugug

SEQ ID NO: 290556 - RNA, 64 nt, Homo Sapiens
acauauacauuaaaacauuuuaaugaguaccuaugacccauaacgaauaaauuaugaagcauac

SEQ ID NO: 290557 - RNA, 64 nt, Homo Sapiens
ucuauauguauguguucccaaaaucuuugguaaugacccauaucuguugugaagccauuaauau

SEQ ID NO: 290558 - RNA, 64 nt, Homo Sapiens
auuaaauacauaucauuuuuuuuucccaaaacaugacccauaguaauaauauauccuaugcuga

SEQ ID NO: 290559 - RNA, 64 nt, Homo Sapiens
caaacuauguugguaguagauauaaucggauucagacccauaacccaaguucaaauaaaauuuu

SEQ ID NO: 290560 - RNA, 64 nt, Homo Sapiens
gauuuuaguaacaucuugcuuuuuguauguuacugacccauaugaaaaauaauuucaucagguu

SEQ ID NO: 290561 - RNA, 64 nt, Homo Sapiens
ggaaaguucuagaagcaauagacacuuaaauucugacccauaaaagccucaauauuugucugaa

SEQ ID NO: 290562 - RNA, 64 nt, Homo Sapiens
gaaaaacucuugcuaccuguauuacuugaucucagacccauaccugaugguucagucuguccuu

SEQ ID NO: 290563 - RNA, 64 nt, Homo Sapiens
gaaugucauucucaaugcccagauccugagauuggacccauacccugucuccaacccugccuug

SEQ ID NO: 290564 - RNA, 64 nt, Homo Sapiens
uccaacccugacugcccacuccuccacaaaccgugacccauagccgcccccaccccauaccuug

SEQ ID NO: 290565 - RNA, 64 nt, Homo Sapiens
caaacuucgagcccaucagccgguccuuugauaagacccauaggccuagucagggaggggaugg

SEQ ID NO: 290566 - RNA, 64 nt, Homo Sapiens
acucuuguuugcuuugaaaaaaucccuguacucugacccauagcuccuguugaccuucccacac

SEQ ID NO: 290567 - RNA, 64 nt, Homo Sapiens
ugguuuuaacacuaacuagacaccaugccaggaagacccauaacuuauccacguguggauuauc

SEQ ID NO: 290568 - RNA, 64 nt, Homo Sapiens
ggccagcacacugcuaaccagucaccaaauguaagacccauaagaaacccauauuuaaaaaucu

SEQ ID NO: 290569 - RNA, 64 nt, Homo Sapiens
uuucaaaaacaaaucagaagcagaugcugauugggacccauauaccacguugcugacucacguu

SEQ ID NO: 290570 - RNA, 64 nt, Homo Sapiens
uacaucuacaaguaaguacagcugaaauucagaggacccauaagaguucacaugaaaaaaauca

SEQ ID NO: 290571 - RNA, 64 nt, Homo Sapiens
cugugucccagacagauccccuaggccuaucugagacccauacaggcccacaccugagcuccug

SEQ ID NO: 290572 - RNA, 64 nt, Homo Sapiens
ugauuacguguauguuucuucuuucuuuuaagcagacccauaccuuuccagggucaaaguacag

SEQ ID NO: 290573 - RNA, 64 nt, Homo Sapiens
agguuguacaaaccuuaaggguuuuuuccuuauggacccauacuuccuaaccauuucuacuaca

SEQ ID NO: 290574 - RNA, 64 nt, Homo Sapiens
gaucuaccuugguaggagggagucaguacuguuggacccauagguagccucaucccugccacug

SEQ ID NO: 290575 - RNA, 64 nt, Homo Sapiens
ucaauggugagcagacugcaaaucugccugauaggacccauauucccacagcacuaauucaaca

SEQ ID NO: 290576 - RNA, 64 nt, Homo Sapiens
caaauaaguugucuuuacugaaaaaugaagugaagacccauauaugcaguuaaaaaaaaguuaa

SEQ ID NO: 290577 - RNA, 64 nt, Homo Sapiens
cccaagucccagcccagaacccucuuucauuggugacccauaaccuccuccuccucuuccccuc

SEQ ID NO: 290578 - RNA, 64 nt, Homo Sapiens
caggucagaagaaugauggacugguguccagcaugacccauaaaaauuuaugugauguggauug

SEQ ID NO: 290579 - RNA, 64 nt, Homo Sapiens
aaggaacagaaacaacuuugcauugcauuggcuugacccauaaacuaaguuauauccgugggca

SEQ ID NO: 290580 - RNA, 64 nt, Homo Sapiens
ucuuuaaaacaucuacccuaaaccaucugcuauggacccauaauaagaggccuguuguauauga

SEQ ID NO: 290581 - RNA, 64 nt, Homo Sapiens
aauccccuugucgaaaacuagaaaaaaaggaguugacccauauaaauuaucucuaacgucuuug

SEQ ID NO: 290582 - RNA, 64 nt, Homo Sapiens
acgucugcucaggaaguggggccagcuccacugggacccauaguuuuacuuccuugucauuuga

SEQ ID NO: 290583 - RNA, 64 nt, Homo Sapiens
ugaacuauuagacaugaaauuacugcaugcucaggacccauagauuagacaaaggcucuacaca

SEQ ID NO: 290584 - RNA, 64 nt, Homo Sapiens
uggagaagguguacaacuuuccuucuuccacaaagacccauaucuucuucauucuccuucuucu

SEQ ID NO: 290585 - RNA, 64 nt, Homo Sapiens
aagguucuuucauucaagaucaucauucuugacagacccauaaauauuuccuauaaagacugua

SEQ ID NO: 290586 - RNA, 64 nt, Homo Sapiens
ucuucugaaaugaaacaaauguggcgggcagugggacccauagauugagaaccaggagacacgu

SEQ ID NO: 290587 - RNA, 64 nt, Homo Sapiens
agcuuugucucugucacaucuauugaagguuuuagacccauagcuugagugucauuaguuacuu

SEQ ID NO: 290588 - RNA, 64 nt, Homo Sapiens
ucagacccgacggcccggagagagacucagcaacgacccauaccuaacgcgcggccggggcggg

SEQ ID NO: 290589 - RNA, 64 nt, Homo Sapiens
cgccaaguaagauuuuaaaagcaaaccacgccaugacccauauaacagaaugauuuccaaaauu

SEQ ID NO: 290590 - RNA, 64 nt, Homo Sapiens
uuauuuauagagagcacacaugaccucccauuuggacccauaguauuuuuucucccgucuucaa

SEQ ID NO: 290591 - RNA, 64 nt, Homo Sapiens
cguuucugauucagaaucaguaccuauuucaccugacccauacuauguguaaacauagggugcc

SEQ ID NO: 290592 - RNA, 64 nt, Homo Sapiens
uuuaacucuucccagggaaaacuucacuuuguaagacccauauuaggcuucucaccuguggcca

SEQ ID NO: 290593 - RNA, 64 nt, Homo Sapiens
uucauauggcugcuccagccuuagaauucauugagacccauagcuggcuugaagacaaaugguc

SEQ ID NO: 290594 - RNA, 64 nt, Homo Sapiens
agugacgccuguggagcgcgcauaauuaaagauggacccauaagguacuuuuauuaauauuuaa

SEQ ID NO: 290595 - RNA, 64 nt, Homo Sapiens
ucucuuacuguacugucuaucugcaguaauugaggacccauaaaauuuagauaacuacaugucu

SEQ ID NO: 290596 - RNA, 64 nt, Homo Sapiens
aaaucuuguccagagacaagcgaaugaucaaggggacccauaggaagaaaccccaaacucaggc

SEQ ID NO: 290597 - RNA, 64 nt, Homo Sapiens
ggcuugccuguuuccgcuacuucuaaggggaagggacccauagaccucguucccuacccuaaaa

SEQ ID NO: 290598 - RNA, 64 nt, Homo Sapiens
aggugcccuguagaacucuguuacacauauuuuugacccauauuauuuacaaugucuugauaau

SEQ ID NO: 290599 - RNA, 64 nt, Homo Sapiens
gccucuugcuugaaugugauuucuuucucccugagacccauaagguucaucuuaugggaccuua

SEQ ID NO: 290600 - RNA, 64 nt, Homo Sapiens
uauaccuuucagguacugaauauuuucuuccauugacccauauuccuguaauaguuucaguucc

SEQ ID NO: 290601 - RNA, 64 nt, Homo Sapiens
agaauuuuccaggucacagacagaggcuguguuggacccauaguucucuccuacucucaguggu

SEQ ID NO: 290602 - RNA, 64 nt, Homo Sapiens
cauuaggaaaaugcacauauuccaugaauuuuaagacccauagaaaaguugaagaaugcuuaau

SEQ ID NO: 290603 - RNA, 64 nt, Homo Sapiens
ugccaaagucucccuucuguuucuucagcacauugacccauagcacacacauacacaccaccac

SEQ ID NO: 290604 - RNA, 64 nt, Homo Sapiens
gccgugugacgguggccuuggaggacccagcacugacccauagagggcuccucucagaugggca

SEQ ID NO: 290605 - RNA, 64 nt, Homo Sapiens
ccagccccaggcggaccagaagggggcagcgugggacccauaucaguuggguagagaagccagc

SEQ ID NO: 290606 - RNA, 64 nt, Homo Sapiens
uaccaacguagaauuuuucagaggccucauaaaugacccauaauuuuaauaggaaaaugcuaag

SEQ ID NO: 290607 - RNA, 64 nt, Homo Sapiens
caucagagaugggaaaaccauuggggaggacuaggacccauaugggaauuauuaccucucaggg

SEQ ID NO: 290608 - RNA, 64 nt, Homo Sapiens
ucccugcuaccuuaguucugcaugagaaucagcugacccauacagacuugaaaccagagaacau

SEQ ID NO: 290609 - RNA, 64 nt, Homo Sapiens
gcuagacacuuugaggcaagucccuccauggagggacccauaggcggcggcccuucucagcccc

SEQ ID NO: 290610 - RNA, 64 nt, Homo Sapiens
uuuccgagagcguucaguguuucacugaagacaggacccauagccuucauuucuggcucugugu

SEQ ID NO: 290611 - RNA, 64 nt, Homo Sapiens
cugaacucuguugauaauaccacaccauguucuggacccauagcucuggcauccucagggguug

SEQ ID NO: 290612 - RNA, 64 nt, Homo Sapiens
uaaauaugcucuguguaaagggggaggagacagagacccauaacgucugggaguuuuucugugu

SEQ ID NO: 290613 - RNA, 64 nt, Homo Sapiens
uuucaccuuguucccuuccauuuugucucaccaggacccauaccguguucucaggccccccugc

SEQ ID NO: 290614 - RNA, 64 nt, Homo Sapiens
uuuuaguggcuucuauguuggcucuugauuaauagacccauauucucuuaucauuuugaaaugg

SEQ ID NO: 290615 - RNA, 64 nt, Homo Sapiens
ccauggccuguuaggaggcgccuuggggcuggcagacccauagaagcugcugcuuuuucuuggu

SEQ ID NO: 290616 - RNA, 64 nt, Homo Sapiens
uuaucaaacuuugaaauugaugcuuuuuagaaaggacccauaugaaacuagugagagugccaag

SEQ ID NO: 290617 - RNA, 64 nt, Homo Sapiens
ugccggugacaagcugucugcugaaaucccagaggacccauaagcuacagaaguuggguauugu

SEQ ID NO: 290618 - RNA, 64 nt, Homo Sapiens
cuccacgggaaagaggucgauggauuuaccccuggacccauaagucuguucauccugcugaagu

SEQ ID NO: 290619 - RNA, 64 nt, Homo Sapiens
cauguuuuaaagucaccuucagcaucccucccccgacccauagcgccccaacuucccaaagagc

SEQ ID NO: 290620 - RNA, 64 nt, Homo Sapiens
uguucccuuggggguguugagggccaggggaggagacccauaaagggggaugggauccuaggua

SEQ ID NO: 290621 - RNA, 64 nt, Homo Sapiens
guguuguaaaaaacacuuaggauguguuuugugugacccauacaaggucuuaauccuaucuaug

SEQ ID NO: 290622 - RNA, 64 nt, Homo Sapiens
gaggugcagcgggucacccuguggcccguccugugacccauauuuagccguguuugggacuccg

SEQ ID NO: 290623 - RNA, 64 nt, Homo Sapiens
ugaggaaguaagucagggcgggcuuugagaaggggacccauauccuacaggcaaaaagcaggcu

SEQ ID NO: 290624 - RNA, 64 nt, Homo Sapiens
guaaagguugaauuauauuuucccccauauuauugacccauagugacaccaguuuugggagaug

SEQ ID NO: 290625 - RNA, 64 nt, Homo Sapiens
cagcccugggggagccucuuaaauaucaaacacggacccauagagcguucccaaagauccaccc

SEQ ID NO: 290626 - RNA, 64 nt, Homo Sapiens
ucccuaccucccaccaccuaagauugugaagacggacccauauacuuaaauaaggaagaggccc

SEQ ID NO: 290627 - RNA, 64 nt, Homo Sapiens
ucuucaauaaauauuuaauggagccaccacaccugacccauaggagugcugggauuacaggugu

SEQ ID NO: 290628 - RNA, 64 nt, Homo Sapiens
ggagguaaagcuguugggggaagaagaguuuuuggacccauagauguuuggaugaugucucuaa

SEQ ID NO: 290629 - RNA, 64 nt, Homo Sapiens
ugguuuuagcaggggaggggaccugcuaagcugagacccauaguccugcucagaguuaucccaa

SEQ ID NO: 290630 - RNA, 64 nt, Homo Sapiens
gcugaugggagcagcuggugggaggggugcuggagacccauagaucacacgccugccagaagcu

SEQ ID NO: 290631 - RNA, 64 nt, Homo Sapiens
aaucccaucagugucgucccgagcuuuauuuacagacccauaaacaacuccagugggaaagaaa

SEQ ID NO: 290632 - RNA, 64 nt, Homo Sapiens
uuuaacugaaaagggccaaauuugaacuguacuggacccauaguagaagcccuaauaucuauaa

SEQ ID NO: 290633 - RNA, 64 nt, Homo Sapiens
agccagaggcaucuuuugagccauacgaauuccugacccauagaaacugcaagacaauaaaugu

SEQ ID NO: 290634 - RNA, 64 nt, Homo Sapiens
cuguuuauaguauccauccugaaccauucguuuugacccauaauaauagugauaguauaauggc

SEQ ID NO: 290635 - RNA, 64 nt, Homo Sapiens
uaaggaaacaucaccuguccuccacuuauuaauggacccauaaccuggaaacugucgacggcca

SEQ ID NO: 290636 - RNA, 64 nt, Homo Sapiens
ccaguccacuguuauacccguugcuugaccccuggacccauaaacacugucggaguucuaucac

SEQ ID NO: 290637 - RNA, 64 nt, Homo Sapiens; identical to SEQ ID NO: 238083

SEQ ID NO: 290638 - RNA, 64 nt, Homo Sapiens; identical to SEQ ID NO: 238084

SEQ ID NO: 290639 - RNA, 64 nt, Homo Sapiens; identical to SEQ ID NO: 238085

SEQ ID NO: 290640 - RNA, 64 nt, Homo Sapiens; identical to SEQ ID NO: 238086

SEQ ID NO: 290641 - RNA, 64 nt, Homo Sapiens; identical to SEQ ID NO: 238087

SEQ ID NO: 290642 - RNA, 64 nt, Homo Sapiens; identical to SEQ ID NO: 238088

SEQ ID NO: 290643 - RNA, 64 nt, Homo Sapiens; identical to SEQ ID NO: 238089

SEQ ID NO: 290644 - RNA, 64 nt, Homo Sapiens; identical to SEQ ID NO: 238090

SEQ ID NO: 290645 - RNA, 64 nt, Homo Sapiens
uagcaagaaguucuuguucucucuguauuuauauuacccauaacuacaguccuccuucaccuua

SEQ ID NO: 290646 - RNA, 64 nt, Homo Sapiens
aucacuuucaucucaccuacauuuuucugaaagcuacccauaaauugucacuucagugcaguac

SEQ ID NO: 290647 - RNA, 64 nt, Homo Sapiens
gaccaagguguucuucccaaagaccaaaauauucuacccauaugucaggaccaggauuuucuac

SEQ ID NO: 290648 - RNA, 64 nt, Homo Sapiens
gaccaagguuaucuuccuaaagaccaaaauauucuacccauaugucaggaccgggauuuucuac

SEQ ID NO: 290649 - RNA, 64 nt, Homo Sapiens
ugaaagggauuccucccacgccagaucugcacaacgaggcaagacaggacccaccugugcgugc

SEQ ID NO: 290650 - RNA, 64 nt, Homo Sapiens
ccgcccacccucugcuagacacagccaaggccaacgaggcaagcagaagcagcggccgcagcga

SEQ ID NO: 290651 - RNA, 64 nt, Homo Sapiens
cuucuaaccaaacuaauuuuucacuguugacaagcgaggcaaggguugcacuggaccaaaggcu

SEQ ID NO: 290652 - RNA, 64 nt, Homo Sapiens
uuuuagauauuacauuuugcuuuuaugacauucacgaggcaaaaaauaaaauaucuuuuuuuga

SEQ ID NO: 290653 - RNA, 64 nt, Homo Sapiens
uguaagacaacacucauucucaguuuauuuaauacgaggcaagugaggccugcuuuucacaccu

SEQ ID NO: 290654 - RNA, 64 nt, Homo Sapiens
caaagccucccaccagacuuaaccuccaggcugacgaggcaagagcuuugcucuuucaaaacag

SEQ ID NO: 290655 - RNA, 64 nt, Homo Sapiens
agagguuauacaacuugccuaguguugaggaaaacgaggcaaaggcuauucuugucuccauuuu

SEQ ID NO: 290656 - RNA, 64 nt, Homo Sapiens
aaagaaauguugcguaacucuggagcuuccaacccgaggcaauaagggcuaagggagggggcgc

SEQ ID NO: 290657 - RNA, 64 nt, Homo Sapiens
ucugauugauuugaaucuauacgaaaaggccuagcgaggcaaauaggccucaaaaacauacgua

SEQ ID NO: 290658 - RNA, 64 nt, Homo Sapiens
uaauugccuuaauuuuaaggacgucaaaggcucucgaggcaagcugucaacgucuuguugaaaa

SEQ ID NO: 290659 - RNA, 64 nt, Homo Sapiens
auauuuaacccccaaauauaauaacauuacaagacgaggcaaaaauuuuuaaucugacuauggc

SEQ ID NO: 290660 - RNA, 64 nt, Homo Sapiens
auucaguagagauccugauggugacuuuguggaucgaggcaaggacggucauauguguucaacg

SEQ ID NO: 290661 - RNA, 64 nt, Homo Sapiens
uuauuggcaacuuauggacucgcuagugauuaaacgaggcaaugacugugagcgagccuggcag

SEQ ID NO: 290662 - RNA, 64 nt, Homo Sapiens
ccuggggugcccaggcccguuggccucugcagcucgaggcaaggucaguaccagaagugucuug

SEQ ID NO: 290663 - RNA, 64 nt, Homo Sapiens
cuguacuugaagccagaggaagcacuggggaugccgaggcaauggcaggagggcaggauccagc

SEQ ID NO: 290664 - RNA, 64 nt, Homo Sapiens
auccucauucccuauguccacuugccuuccucuccgaggcaacuacucuaaugcauuugguaug

SEQ ID NO: 290665 - RNA, 64 nt, Homo Sapiens
ugaacucagaacacuacagcccaacugggacuuccgaggcaacuuggugcgcgagagcguaucc

SEQ ID NO: 290666 - RNA, 64 nt, Homo Sapiens
gcugcccaucucccccugccggcaggcggggaaccgaggcaaaggcagcacugcagugccagga

SEQ ID NO: 290667 - RNA, 64 nt, Homo Sapiens
uuucuaagugugaaaaacccucacagaaagucaucgaggcaaaaagaggcaggcaguggagucu

SEQ ID NO: 290668 - RNA, 64 nt, Homo Sapiens
cgcucacaccuauaauccuaggaucuugggaggucgaggcaagcugaucgcuugagcccaggag

SEQ ID NO: 290669 - RNA, 50 nt, Homo Sapiens
uuugccuucuucagaagcuucgaggcaacccgguuugcacaaugguauaa

SEQ ID NO: 290670 - RNA, 64 nt, Homo Sapiens
ugucccucucuggucaaacaacauacuaaagaggcgaggcaaugacuguuggccaguucucacc

SEQ ID NO: 290671 - RNA, 64 nt, Homo Sapiens
ggcugcagaggcggggacacuuggccuugccugucgaggcaagacucccucuuuaggucggaga

SEQ ID NO: 290672 - RNA, 64 nt, Homo Sapiens
uuucugcagcuuagcuuguguccugcccuccgcccgaggcaaaacguauccugaggacuucuuc

SEQ ID NO: 290673 - RNA, 64 nt, Homo Sapiens
gaacucgaagcccacaauccucgucugaaucauccgaggcaaagagaaaagccacggaccguug

SEQ ID NO: 290674 - RNA, 64 nt, Homo Sapiens
aguuccaaaacuguucuuuuuagcaguaauuacacgaggcaaacugaaaauuugcucgggugug

SEQ ID NO: 290675 - RNA, 64 nt, Homo Sapiens
ugcucuaauuugagugaaauaaaaguuauuagugcgaggcaaacauaaaaaaaaaaaguccaug

SEQ ID NO: 290676 - RNA, 64 nt, Homo Sapiens
cuggggcccaccagccccuguggacgaccggccucgaggcaacccuuccugcugcugcucuccc

SEQ ID NO: 290677 - RNA, 64 nt, Homo Sapiens
ggacuguuagugguuuucaaguuuuucuauaaaacgaggcaacuccuaguaguucccugggccu

SEQ ID NO: 290678 - RNA, 64 nt, Homo Sapiens
acuccugucugcauucccaaauuuggcucugagucgaggcaaccugcacacaagaccccaccaa

SEQ ID NO: 290679 - RNA, 64 nt, Homo Sapiens
ucaggagcuguggacuuaaccccaagaugacuugcgaggcaaucaugcaccgcucugcuucaug

SEQ ID NO: 290680 - RNA, 64 nt, Homo Sapiens
cuucaugcugugauugaagcauccauucagaacacgaggcaauauugcaguccacagggaaugg

SEQ ID NO: 290681 - RNA, 64 nt, Homo Sapiens
uuuuguucuccaucuguuugggguagguguugagcgaggcaaauggaucucgauauuucagaug

SEQ ID NO: 290682 - RNA, 64 nt, Homo Sapiens
cucuagguccuguaggggcugcaucgacugugugcgaggcaaugaaauuaaaacccuuggcagg

SEQ ID NO: 290683 - RNA, 64 nt, Homo Sapiens
gacagaggacacgagcuguuagccacccaggcaccgaggcaagaggggggagaugugggcggca

SEQ ID NO: 290684 - RNA, 64 nt, Homo Sapiens
ucggcuccucccccagccucuagcuacccuguaucgaggcaaggggaggccaguaaaguuugcc

SEQ ID NO: 290685 - RNA, 64 nt, Homo Sapiens
aggagccaggcgcucccucuagacacccagcugccgaggcaaaacucauuauuauuuuaaaaac

SEQ ID NO: 290686 - RNA, 64 nt, Homo Sapiens
uguugaggguccucuuccaucuugcugaacuguucgaggcaaagacaaaacccaacuuugacca

SEQ ID NO: 290687 - RNA, 64 nt, Homo Sapiens
gcauuuaauucccaccccccucgcucuuuauaaacgaggcaaaaagaagggaccuccugaaaac

SEQ ID NO: 290688 - RNA, 64 nt, Homo Sapiens
gcaucacgaggucaggagaugcacuuugggaggccgaggcaagaggcucacaccuguaauccca

SEQ ID NO: 290689 - RNA, 64 nt, Homo Sapiens
cagugucucguuuacaucucacacagugacccugcgaggcaaggguuugcccaguuugcagaug

SEQ ID NO: 290690 - RNA, 64 nt, Homo Sapiens
ucugacguccagacaugaagagaugccagugccacgaggcaaauccaaauugucuuugcuuaga

SEQ ID NO: 290691 - RNA, 64 nt, Homo Sapiens
auaacucauuugaggauaaaaaaaguuauuagugcgaggcaaacauuacugcucugagugaaau

SEQ ID NO: 290692 - RNA, 64 nt, Homo Sapiens; identical to SEQ ID NO: 187115

SEQ ID NO: 290693 - RNA, 64 nt, Homo Sapiens; identical to SEQ ID NO: 187116

SEQ ID NO: 290694 - RNA, 64 nt, Homo Sapiens; identical to SEQ ID NO: 187117

SEQ ID NO: 290695 - RNA, 64 nt, Homo Sapiens; identical to SEQ ID NO: 187118

SEQ ID NO: 290696 - RNA, 64 nt, Homo Sapiens; identical to SEQ ID NO: 187119

SEQ ID NO: 290697 - RNA, 64 nt, Homo Sapiens; identical to SEQ ID NO: 187120

SEQ ID NO: 290698 - RNA, 64 nt, Homo Sapiens; identical to SEQ ID NO: 187121

SEQ ID NO: 290699 - RNA, 64 nt, Homo Sapiens; identical to SEQ ID NO: 187122

SEQ ID NO: 290700 - RNA, 64 nt, Homo Sapiens; identical to SEQ ID NO: 187123

SEQ ID NO: 290701 - RNA, 64 nt, Homo Sapiens; identical to SEQ ID NO: 187124

SEQ ID NO: 290702 - RNA, 64 nt, Homo Sapiens; identical to SEQ ID NO: 187125

SEQ ID NO: 290703 - RNA, 64 nt, Homo Sapiens; identical to SEQ ID NO: 187126

SEQ ID NO: 290704 - RNA, 64 nt, Homo Sapiens; identical to SEQ ID NO: 187127

SEQ ID NO: 290705 - RNA, 64 nt, Homo Sapiens; identical to SEQ ID NO: 187128

SEQ ID NO: 290706 - RNA, 64 nt, Homo Sapiens; identical to SEQ ID NO: 187129

SEQ ID NO: 290707 - RNA, 64 nt, Homo Sapiens; identical to SEQ ID NO: 187130

SEQ ID NO: 290708 - RNA, 64 nt, Homo Sapiens; identical to SEQ ID NO: 187131

SEQ ID NO: 290709 - RNA, 64 nt, Homo Sapiens; identical to SEQ ID NO: 187132

SEQ ID NO: 290710 - RNA, 64 nt, Homo Sapiens; identical to SEQ ID NO: 187133

SEQ ID NO: 290711 - RNA, 64 nt, Homo Sapiens; identical to SEQ ID NO: 187134

SEQ ID NO: 290712 - RNA, 64 nt, Homo Sapiens; identical to SEQ ID NO: 187135

SEQ ID NO: 290713 - RNA, 64 nt, Homo Sapiens; identical to SEQ ID NO: 187136

SEQ ID NO: 290714 - RNA, 64 nt, Homo Sapiens; identical to SEQ ID NO: 187137

SEQ ID NO: 290715 - RNA, 64 nt, Homo Sapiens; identical to SEQ ID NO: 187138

SEQ ID NO: 290716 - RNA, 64 nt, Homo Sapiens; identical to SEQ ID NO: 187139

SEQ ID NO: 290717 - RNA, 64 nt, Homo Sapiens; identical to SEQ ID NO: 187140

SEQ ID NO: 290718 - RNA, 64 nt, Homo Sapiens; identical to SEQ ID NO: 187141

SEQ ID NO: 290719 - RNA, 64 nt, Homo Sapiens; identical to SEQ ID NO: 187142

SEQ ID NO: 290720 - RNA, 64 nt, Homo Sapiens; identical to SEQ ID NO: 187143

SEQ ID NO: 290721 - RNA, 64 nt, Homo Sapiens; identical to SEQ ID NO: 187144

SEQ ID NO: 290722 - RNA, 64 nt, Homo Sapiens; identical to SEQ ID NO: 187145

SEQ ID NO: 290723 - RNA, 64 nt, Homo Sapiens; identical to SEQ ID NO: 187146

SEQ ID NO: 290724 - RNA, 64 nt, Homo Sapiens; identical to SEQ ID NO: 187147

SEQ ID NO: 290725 - RNA, 64 nt, Homo Sapiens; identical to SEQ ID NO: 187148

SEQ ID NO: 290726 - RNA, 64 nt, Homo Sapiens; identical to SEQ ID NO: 187149

SEQ ID NO: 290727 - RNA, 64 nt, Homo Sapiens; identical to SEQ ID NO: 187150

SEQ ID NO: 290728 - RNA, 64 nt, Homo Sapiens; identical to SEQ ID NO: 187151

SEQ ID NO: 290729 - RNA, 64 nt, Homo Sapiens; identical to SEQ ID NO: 187152

SEQ ID NO: 290730 - RNA, 64 nt, Homo Sapiens; identical to SEQ ID NO: 187153

SEQ ID NO: 290731 - RNA, 64 nt, Homo Sapiens; identical to SEQ ID NO: 187154

SEQ ID NO: 290732 - RNA, 64 nt, Homo Sapiens; identical to SEQ ID NO: 187155

SEQ ID NO: 290733 - RNA, 64 nt, Homo Sapiens; identical to SEQ ID NO: 187156

SEQ ID NO: 290734 - RNA, 64 nt, Homo Sapiens; identical to SEQ ID NO: 187157

SEQ ID NO: 290735 - RNA, 64 nt, Homo Sapiens; identical to SEQ ID NO: 187158

SEQ ID NO: 290736 - RNA, 64 nt, Homo Sapiens; identical to SEQ ID NO: 187159

SEQ ID NO: 290737 - RNA, 64 nt, Homo Sapiens; identical to SEQ ID NO: 187160

SEQ ID NO: 290738 - RNA, 64 nt, Homo Sapiens; identical to SEQ ID NO: 187161

SEQ ID NO: 290739 - RNA, 64 nt, Homo Sapiens; identical to SEQ ID NO: 187162

SEQ ID NO: 290740 - RNA, 64 nt, Homo Sapiens; identical to SEQ ID NO: 187163

SEQ ID NO: 290741 - RNA, 64 nt, Homo Sapiens; identical to SEQ ID NO: 187164

SEQ ID NO: 290742 - RNA, 64 nt, Homo Sapiens; identical to SEQ ID NO: 187165

SEQ ID NO: 290743 - RNA, 64 nt, Homo Sapiens; identical to SEQ ID NO: 187166

SEQ ID NO: 290744 - RNA, 64 nt, Homo Sapiens; identical to SEQ ID NO: 187167

SEQ ID NO: 290745 - RNA, 64 nt, Homo Sapiens; identical to SEQ ID NO: 187168

SEQ ID NO: 290746 - RNA, 64 nt, Homo Sapiens; identical to SEQ ID NO: 187169

SEQ ID NO: 290747 - RNA, 64 nt, Homo Sapiens; identical to SEQ ID NO: 187170

SEQ ID NO: 290748 - RNA, 64 nt, Homo Sapiens; identical to SEQ ID NO: 187171

SEQ ID NO: 290749 - RNA, 64 nt, Homo Sapiens; identical to SEQ ID NO: 187172

SEQ ID NO: 290750 - RNA, 64 nt, Homo Sapiens; identical to SEQ ID NO: 187173

SEQ ID NO: 290751 - RNA, 64 nt, Homo Sapiens; identical to SEQ ID NO: 187174

SEQ ID NO: 290752 - RNA, 64 nt, Homo Sapiens; identical to SEQ ID NO: 187175

SEQ ID NO: 290753 - RNA, 64 nt, Homo Sapiens; identical to SEQ ID NO: 187176

SEQ ID NO: 290754 - RNA, 64 nt, Homo Sapiens; identical to SEQ ID NO: 187177

SEQ ID NO: 290755 - RNA, 64 nt, Homo Sapiens
uuacuacucuggucagucuccagcuaaccucucaaucaggcaaacauucuucuuggaggaauca

SEQ ID NO: 290756 - RNA, 64 nt, Homo Sapiens
accucucaaucaggcaaacauucuucuuggaggaaucaggcaaacaucucaaaaauucucuuuc

SEQ ID NO: 290757 - RNA, 64 nt, Homo Sapiens
aacugaucagaucucaugagaagcaaaagcagaaaccccugauaggcaagaaaaaaugaggaag

SEQ ID NO: 290758 - RNA, 64 nt, Homo Sapiens
agccaucagaucuugugaaaaagcaaaaguggaaaccccugauaagcaagagaaaaugaggaag

SEQ ID NO: 290759 - RNA, 64 nt, Homo Sapiens
ggaccaagccgggaaugagcuugugugcccugauaccccugaggguggcugccuccucuggucc

SEQ ID NO: 290760 - RNA, 64 nt, Homo Sapiens
ggaagaggcaucgccugcaggacuuugcggugggaccccugaaacuggaccugcauagcuacgu

SEQ ID NO: 290761 - RNA, 64 nt, Homo Sapiens
agaacuaaaaacuccuuaacuuacuguugcuuacaccccugaaagucuguuuuuaagcaaaugg

SEQ ID NO: 290762 - RNA, 64 nt, Homo Sapiens
uuuuuaacccuuuuaaaagagaccuauguugaaaaccccugaaaauucacugaagaaaaaucau

SEQ ID NO: 290763 - RNA, 64 nt, Homo Sapiens
agauguugaaacuguuauuccuuuguguaacaugaccccugauaugaccugcacugcucaucug

SEQ ID NO: 290764 - RNA, 64 nt, Homo Sapiens
gaaugaaagccaacugaacccugggauuuaagacaccccugauguggaggggggugcuuuugua

SEQ ID NO: 290765 - RNA, 64 nt, Homo Sapiens
gggaaggagggaggaaauaugucccuugcacaccaccccugaagcacauggcaguaggaaacag

SEQ ID NO: 290766 - RNA, 64 nt, Homo Sapiens
cucuucacuccuuggggaagccaccucccaucacaccccugagcagaguuagggaggaauucua

SEQ ID NO: 290767 - RNA, 64 nt, Homo Sapiens
gcucacucccuagagccugacgccggggccccugaccccugagccucagauuccaauaccucac

SEQ ID NO: 290768 - RNA, 64 nt, Homo Sapiens
ccucacuccccagagccugaugccggggccccugaccccugaucuacggaggccugcucccgga

SEQ ID NO: 290769 - RNA, 64 nt, Homo Sapiens
gcuucugaucccagcuauuaacccucaugccuggaccccugagaugccgaccccucagaauaua

SEQ ID NO: 290770 - RNA, 64 nt, Homo Sapiens
ugggcaaagguacucaggaccuuaggaugacagcaccccugagcugaauuugauuccaagagag

SEQ ID NO: 290771 - RNA, 64 nt, Homo Sapiens
acgcccuccugggccgucugagugcaccaucucacugcaguagccugcgccaccucacugcagu

SEQ ID NO: 290772 - RNA, 64 nt, Homo Sapiens
gcaccaucucacugcaguagccugcgccaccucacugcaguaguuugugcccaagcucaccagc

SEQ ID NO: 290773 - RNA, 64 nt, Homo Sapiens
uguggccucacccugaagucauaaauaaaaagcgcugcaguagcccaucucaguaaauaaauaa

SEQ ID NO: 290774 - RNA, 64 nt, Homo Sapiens
gccagacgugguggcucacacguccuuuaaagugcugcaguauguaugagaaagaaaaagacac

SEQ ID NO: 290775 - RNA, 64 nt, Homo Sapiens
ugauguauuggggucaaaucaggucuuggugccucugcaguacuugcaguuuuagaagcagaaa

SEQ ID NO: 290776 - RNA, 64 nt, Homo Sapiens
uugccaagagcccgucugcuucagcgcucuggugcugcaguaugauauggacacuggugccaug

SEQ ID NO: 290777 - RNA, 64 nt, Homo Sapiens
acacccagcuaauuuuuugucugggaucauaggcacgcgccaccugccucagccuccugaguag

SEQ ID NO: 290778 - RNA, 64 nt, Homo Sapiens
ucccuguucagcuguuggccggcccugcuaccugacgcgccagaagcacccagcccugcccagc

SEQ ID NO: 290779 - RNA, 64 nt, Homo Sapiens
uacuaccuggcuguccccagcaccuuccugaaggacgcgccaggggaguuccugcuccgagucu

SEQ ID NO: 290780 - RNA, 64 nt, Homo Sapiens
agggcuuuuugcgcuaaaggaauuuuaauaggguacgcgccauuagaauauuggagauguccug

SEQ ID NO: 290781 - RNA, 64 nt, Homo Sapiens
ccgccuaggggcccucggggaccucacuuccugcacgcgccacugacaggccaggccugauccc

SEQ ID NO: 290782 - RNA, 64 nt, Homo Sapiens
ugccucagccucccguguagcugggacuacaggcacgcgccaccaugcccggcuaauuuuugua

SEQ ID NO: 290783 - RNA, 64 nt, Homo Sapiens
agagucuccccccacccaccgugggcuuggggcuacgcgccaggaagcucacccaccugugaua

SEQ ID NO: 290784 - RNA, 64 nt, Homo Sapiens
uggccgggagacgcacagggagcccggcgggggcacgcgccacgcgccagggggcgcccgcggg

SEQ ID NO: 290785 - RNA, 64 nt, Homo Sapiens
ugagccgugaagggacccugccuuucagggcacuacgcgccaccaguucccgguacccagggag

SEQ ID NO: 290786 - RNA, 64 nt, Homo Sapiens
acgcccagcuaauuccuguacugggauuacaggaacgcgccaccuaacucagccucuugaguag

SEQ ID NO: 290787 - RNA, 64 nt, Homo Sapiens
aaaagcuuccgugccagugaaugguucucuggaaacgcgccaggugagggacauuguaguucgc

SEQ ID NO: 290788 - RNA, 64 nt, Homo Sapiens
augcccggcuaauuuuuguacuggcacuacagacacgcgccaccugccucagccucccaaguag

SEQ ID NO: 290789 - RNA, 64 nt, Homo Sapiens
acaaaacuauaaucaaguuagacuggacagguccacgcgccauggggcacugaaacacacaauu

SEQ ID NO: 290790 - RNA, 64 nt, Homo Sapiens
aaucauccugcuuucuuuauuaccuccgauuggaacgcgccacaguggaucucugacuucuuau

SEQ ID NO: 290791 - RNA, 64 nt, Homo Sapiens
cacaguucugcaaguauauuucucugcucccaugacgcgccaggcaacuauucacuggacaagu

SEQ ID NO: 290792 - RNA, 64 nt, Homo Sapiens
ggcaguggggcucaaagccgggcaaauuggaaacacgcgccagcauuaaggugccgaugcagaa

SEQ ID NO: 290793 - RNA, 61 nt, Homo Sapiens
cgugugaauuucaagcuucaauucuggaacaacgcgccagaauguagacuuugcauuauaa

SEQ ID NO: 290794 - RNA, 64 nt, Homo Sapiens
cgccucagcuuccccagcagcugggacuacaggcacgcgccaccacagccggcuaauuuuuuau

SEQ ID NO: 290795 - RNA, 64 nt, Homo Sapiens
gagugccuucaacacagcuuccucugucaauuguacgcgccaccggaugcagaggccugcaggg

SEQ ID NO: 290796 - RNA, 64 nt, Homo Sapiens
acacccagcuaauuuuuaaacugggacuucaggcacgcgccacuucccucagccuugugaauac

SEQ ID NO: 290797 - RNA, 64 nt, Homo Sapiens
gcugccuggugacggcacccggaggcccaccaggacgcgccaccggugaaugugccucuggugg

SEQ ID NO: 290798 - RNA, 64 nt, Homo Sapiens
ugccucagccuccugaguagcugggacugcaggcacgcgccaccacgcccagcuaauuuuugua

SEQ ID NO: 290799 - RNA, 64 nt, Homo Sapiens
caggcugugggcagggcgggugggaucccaggccacgcgccagcgugggcuggugacugggucu

SEQ ID NO: 290800 - RNA, 64 nt, Homo Sapiens
ccccguacgacacgcguccuggccggggccuacgacgcgccaccgggggcggcgaggaggccau

SEQ ID NO: 290801 - RNA, 64 nt, Homo Sapiens
aagccaggcuaauuuuuguaccaggauuacaggcacgcgccaccugccucagccucccaaguag

SEQ ID NO: 290802 - RNA, 64 nt, Homo Sapiens
ugccucagccucccaaguagcugggauuacaggcacgcgccaccacaccuggcugauuuuguau

SEQ ID NO: 290803 - RNA, 64 nt, Homo Sapiens
ccugagcgucuuccaggguggcuggagagcacagacgcgccagggagcccccucugugcuccuc

SEQ ID NO: 290804 - RNA, 64 nt, Homo Sapiens
acaccuggcuaauucuauuucugggauuacaggcacgcgccaccugccucagccucccaaguag

SEQ ID NO: 290805 - RNA, 64 nt, Homo Sapiens
uccucaucccauccucccuccuggagggagacguggguccaagguuuuagacaugguugugggu

SEQ ID NO: 290806 - RNA, 64 nt, Homo Sapiens
uaauaugauucugcucccccaacacucaucccauggguccaaauccuggaaacagcaugaauaa

SEQ ID NO: 290807 - RNA, 64 nt, Homo Sapiens
gccaagagaaucccuggaccggcucuuccuggauggguccaagaauuggacagcucagauggag

SEQ ID NO: 290808 - RNA, 64 nt, Homo Sapiens
uggccgugggcaugagaccgagggugaggcuggaggguccaaagcuggcccagcgagcaccagg

SEQ ID NO: 290809 - RNA, 64 nt, Homo Sapiens
gaggcacacuccuuggccuguagcugucugaauccccaauuauuaaaaauaaaucaagaaggca

SEQ ID NO: 290810 - RNA, 64 nt, Homo Sapiens
cgugaaauugaaaaacugaaauugagaaguuugccccaauuaaguggccguggcagaugcugug

SEQ ID NO: 290811 - RNA, 64 nt, Homo Sapiens; identical to SEQ ID NO: 155290

SEQ ID NO: 290812 - RNA, 64 nt, Homo Sapiens; identical to SEQ ID NO: 155291

SEQ ID NO: 290813 - RNA, 64 nt, Homo Sapiens; identical to SEQ ID NO: 155290

SEQ ID NO: 290814 - RNA, 64 nt, Homo Sapiens; identical to SEQ ID NO: 155293

SEQ ID NO: 290815 - RNA, 64 nt, Homo Sapiens
cccugaggacauaauguguaagagaggugagaagugcucccaagcagacacaacagcagcacag

SEQ ID NO: 290816 - RNA, 64 nt, Homo Sapiens
ccccaaauccuacucccucagccucaggcaguggugcucccaucuuccuccccacaacugugcu

SEQ ID NO: 290817 - RNA, 64 nt, Homo Sapiens
acugugcucaggcuggugccagccuuucagacccugcucccagggacuuggguggaugcgcuga

SEQ ID NO: 290818 - RNA, 64 nt, Homo Sapiens
auuggggacagggacagaggacagaacucacacaugcucccagggagacugugguagaaggaag

SEQ ID NO: 290819 - RNA, 64 nt, Homo Sapiens
cuccucccagcagcagacacggcccagcagagccugcucccaccgccaaggccuggagacuggg

SEQ ID NO: 290820 - RNA, 64 nt, Homo Sapiens
ggauuguacagugaugacuucuuaucuugaucuuugcucccaguuuuuaugauauccaucacau

SEQ ID NO: 290821 - RNA, 64 nt, Homo Sapiens
ccagggcccagcacaucuccauccaguggcaaggugcucccacuccugacuggcagguuuuuua

SEQ ID NO: 290822 - RNA, 64 nt, Homo Sapiens
gguccugcagguccuggugggucagcccagcaccugcucccagugggagcuucccgggauaaac

SEQ ID NO: 290823 - RNA, 64 nt, Homo Sapiens
gaccagucccacaccgcuggucccugcccuccccugcucccagguugaggugcgcucaccucag

SEQ ID NO: 290824 - RNA, 64 nt, Homo Sapiens
ggcacggcccuccuucuuuuccuaacaugcaccuugcucccaauggugcuuggagggggaagag

SEQ ID NO: 290825 - RNA, 64 nt, Homo Sapiens
uggagggggcaagcuuugcuccuucaguucugcuugcucccaagccccugacccgcucggacuu

SEQ ID NO: 290826 - RNA, 64 nt, Homo Sapiens
aaugcccccuuuauugcugcaccaggguuggcauugcucccacugagcccuacuccacccuguc

SEQ ID NO: 290827 - RNA, 64 nt, Homo Sapiens
gcaucuccuuccaggucagcucauucacaagaguugcucccaagccuggaugaguugcaccuug

SEQ ID NO: 290828 - RNA, 64 nt, Homo Sapiens
aaggggguggcgugacaggcggggcacugcucgcugcucccaggccgugcuccaacucgggccu

SEQ ID NO: 290829 - RNA, 64 nt, Homo Sapiens
agguccaagugcagcuccaggcccaaggugccugugcucccagcuuggugaggacacacacuag

SEQ ID NO: 290830 - RNA, 64 nt, Homo Sapiens
ccauccguccugggaaagagcauccucuggcaggugcucccaccaggucagacccaguccugga

SEQ ID NO: 290831 - RNA, 64 nt, Homo Sapiens
uagccugcacccacuggcugggaagaucucuuccugcucccacgccccugucuggauccccucc

SEQ ID NO: 290832 - RNA, 64 nt, Homo Sapiens
ugagguaggaggcggaggugcccauggaagacagugcucccagcuugaggagagaaguggaagc

SEQ ID NO: 290833 - RNA, 64 nt, Homo Sapiens
uucucccucccucccauuguccauuuuauucacaugcucccaugcccugguucaguauuuaaug

SEQ ID NO: 290834 - RNA, 64 nt, Homo Sapiens
ggggcaggagaggggagaaccccauccucagagcugcucccagccagcgagucaggagcggggg

SEQ ID NO: 290835 - RNA, 64 nt, Homo Sapiens
ggggagacagggcuccagggaugaggccgcauucugcucccacagcgccuuuuccagaaaguuc

SEQ ID NO: 290836 - RNA, 64 nt, Homo Sapiens
ccauucacuacaggugaagguccuuauagacacuugcucccaaccaguucucucccuuccucuc

SEQ ID NO: 290837 - RNA, 64 nt, Homo Sapiens
ccucccuccggccauacugccucaacucuaccccugcucccauuagaggggggccaagguccug

SEQ ID NO: 290838 - RNA, 64 nt, Homo Sapiens
aggcagcuccagcuguuaccucaaggaaaagaugugcucccacccagucauuagugaauuacac

SEQ ID NO: 290839 - RNA, 64 nt, Homo Sapiens
ucaccucguuacucucaccuaaucaggcuuugucugcucccaaucugcaaaguuuucuuuccaa

SEQ ID NO: 290840 - RNA, 64 nt, Homo Sapiens
auccacggccuccacccgggacgccuuccuccucugcucccaaacaggguuuccguggccuguu

SEQ ID NO: 290841 - RNA, 64 nt, Homo Sapiens
guggggugggcaggccaggacugcuuuuuuuuaaugcucccauuucacagaggauaccaccgag

SEQ ID NO: 290842 - RNA, 64 nt, Homo Sapiens
uggcccucccacaguauuuugugcaaugaagcccugcucccagccuuucagagacagggacaca

SEQ ID NO: 290843 - RNA, 64 nt, Homo Sapiens
cuuccuucucagggucuccccagcccaguccccuugcucccaucccacucggugcuguugggua

SEQ ID NO: 290844 - RNA, 64 nt, Homo Sapiens
acagaaccauccccacugugaggcugugagagauuuguggcaggaacuguuuaugaggcucuag

SEQ ID NO: 290845 - RNA, 64 nt, Homo Sapiens
ccaugcgcuagucaggagcacaggcaaggggugcuuguggcaguggccgggcaccugagcccca

SEQ ID NO: 290846 - RNA, 64 nt, Homo Sapiens
agagccauguaggaaaugcacugauugcauguuauuguggcaagaauauccuaaaugucauuaa

SEQ ID NO: 290847 - RNA, 64 nt, Homo Sapiens
aaaugagcauuugaaauagauaauccuuuaagccuuguggcaaaauuuuuguggcuuuuguuua

SEQ ID NO: 290848 - RNA, 64 nt, Homo Sapiens
ccccugcccaucugggaaaacccucccagucaccuuguggcaagccuggacugccuugaauauc

SEQ ID NO: 290849 - RNA, 64 nt, Homo Sapiens
agcaaaagggugucugagccgaauauuguucauauuguggcacauuuaguuaaaugaggguggu

SEQ ID NO: 290850 - RNA, 64 nt, Homo Sapiens
gcccugugcgccuugugacacagaggaggagccauuguggcaguugggcaggcagaggccagua

SEQ ID NO: 290851 - RNA, 64 nt, Homo Sapiens
ugacaaagauagcuguaugccagggacuucgcuuuuguggcaagacaugcuuccggaacaguga

SEQ ID NO: 290852 - RNA, 64 nt, Homo Sapiens
ccugaguucuugaguccacccaacucccaucuucuuguggcacaggaaagcugcccucucccuc

SEQ ID NO: 290853 - RNA, 64 nt, Homo Sapiens
aaaugucccagauauuucuaugcuacuuagauauuuguggcaaagcagaaagcuuuuugacugu

SEQ ID NO: 290854 - RNA, 64 nt, Homo Sapiens
agccuacaauugacaaacuuaaaugugcauuuguuuguggcaaaauguuguacuuuguagggac

SEQ ID NO: 290855 - RNA, 64 nt, Homo Sapiens
aguuuaagcugaauaaauaauccaagugggaugguuguggcauuaagugucaggguggagugau

SEQ ID NO: 290856 - RNA, 64 nt, Homo Sapiens
ucucaaucuugggaguuuuucauggccaaaacgauuguggcaggcacuggugguuggagaaaac

SEQ ID NO: 290857 - RNA, 64 nt, Homo Sapiens
aggcaucugauggugccagggagcagacccaagcuuguggcaccggaaccccucgucccccuag

SEQ ID NO: 290858 - RNA, 64 nt, Homo Sapiens
aucagcaauuuuuuuucuuuagauuucuaaugauuuguggcaauuuugguuucagcaugucagg

SEQ ID NO: 290859 - RNA, 64 nt, Homo Sapiens
accauuaucuugucaagaucagaugguuuuacuauuguggcagaagcgagaaaacuuuguuuau

SEQ ID NO: 290860 - RNA, 64 nt, Homo Sapiens
ccuguaggcaauagauugcuauguuuuuaacaaauuguggcaaauucuaaacagcaauucuuuu

SEQ ID NO: 290861 - RNA, 64 nt, Homo Sapiens
aguucauugucauagcuucagcuucagaagcuguuuguggcauuuguaggauucaaacucaugg

SEQ ID NO: 290862 - RNA, 64 nt, Homo Sapiens
uucagggaauucaggaaaugccagcauuggaauuuuguggcauuaguuacuaccuucuuucuua

SEQ ID NO: 290863 - RNA, 64 nt, Homo Sapiens
gcguuuacuucacauucacacacaagugugaugauuguggcaaaauucauacaggagagaaacu

SEQ ID NO: 290864 - RNA, 64 nt, Homo Sapiens
gucuucagucaaguuucaucuauaaaugucaugauuguggcaagcucaugcuggagagaaaccu

SEQ ID NO: 290865 - RNA, 64 nt, Homo Sapiens
auuuuuauagcuugugugaggaaaguuuugcuuuuuguggcaacucaguuaauauuucuuagag

SEQ ID NO: 290866 - RNA, 63 nt, Homo Sapiens
cagcuaacuccucuuuaguuaauguuuuugucuuuguggcauggagauggagaccuaaaauga

SEQ ID NO: 290867 - RNA, 64 nt, Homo Sapiens
aacguuuuaucauuuauuaaucaucccugccugugucuauuauuauauucauaucucuacgcug

SEQ ID NO: 290868 - RNA, 64 nt, Homo Sapiens
auaacugagggaagagaagugacaauuccacucagucuauuagaggucuggauauaagguagcc

SEQ ID NO: 290869 - RNA, 64 nt, Homo Sapiens
ucuaagguagccaguucuguugcccauucccccagucuauuaaacccuugauaugcccccuagg

SEQ ID NO: 290870 - RNA, 64 nt, Homo Sapiens
gaaaggaggaagggagaauugagaaaauauauuagucuauuauuuuagaguucuaauacacucu

SEQ ID NO: 290871 - RNA, 64 nt, Homo Sapiens
acauuuauuuaaaauuuaauuuacuauacuuauugucuauuauaaagcucauuauaauauaaaa

SEQ ID NO: 290872 - RNA, 64 nt, Homo Sapiens
uuuauaauguauuuauuaggggaggguaccuugagucuauuauauaugcuucaucaaaacaucu

SEQ ID NO: 290873 - RNA, 64 nt, Homo Sapiens
uuuuuagaaugauguaaauaguuaaccuucaguagucuauuaaggcauuaauacuucucuggac

SEQ ID NO: 290874 - RNA, 64 nt, Homo Sapiens
uggugguggugguuuuauuauaugcaaaaucucugucuauuaugagauacuggcauugaugagc

SEQ ID NO: 290875 - RNA, 64 nt, Homo Sapiens
gucacucacacuggccacaaggacgcuggcuacugucuauuaaaauucugauguuucugugaaa

SEQ ID NO: 290876 - RNA, 64 nt, Homo Sapiens
aauacaaaaauuagcuggcuugguaaaaccccgugucuauuaaacgagacuagccuggccaaua

SEQ ID NO: 290877 - RNA, 64 nt, Homo Sapiens
gguguuuguuuaaaauggauuaguuuuauaaccagucuauuaaagccuuaaaauuguccaauua

SEQ ID NO: 290878 - RNA, 64 nt, Homo Sapiens
auauucauaucucuacgcuguccucccugccugugucuauuauuaacauuuuaucauuuauuaa

SEQ ID NO: 290879 - RNA, 64 nt, Homo Sapiens
uguagaguccaauucuuagcagagaaaaacucaagucuauuacuuauaagaaagaagggaaaaa

SEQ ID NO: 290880 - RNA, 64 nt, Homo Sapiens
uaggcacccugugcucacucgcuccccaugaaaagucuauuaagaugcucaagagcucugccgu

SEQ ID NO: 290881 - RNA, 64 nt, Homo Sapiens
uuaauuauuuaauaauauuuuuuauaugaaccaugucuauuaaucuaaugaucauauuuauuua

SEQ ID NO: 290882 - RNA, 64 nt, Homo Sapiens
uaagcuacuuggggugguaguagaggauuagguugucuauuauaaaaccaaaacucauucguuu

SEQ ID NO: 290883 - RNA, 64 nt, Homo Sapiens
acuguaccuuuauaauaagugcaauucuuucauugucuauuauuaugcuuaagaaaauauucag

SEQ ID NO: 290884 - RNA, 64 nt, Homo Sapiens
caaauagacaacguuggcauguucuuuucuguuugucuauuaaugggccugcuucuuagcaaua

SEQ ID NO: 290885 - RNA, 64 nt, Homo Sapiens
guguagacaagguaccaggucagucuucuuccaugucuauuagcuccacaaagccaaucucaau

SEQ ID NO: 290886 - RNA, 64 nt, Homo Sapiens
cauucaacucuuuuuacagauauccuugaugucugucuauuauuggaugguguuggaacuaaua

SEQ ID NO: 290887 - RNA, 64 nt, Homo Sapiens
gauauuucuuuaaauuauacgacucaucaauuuugucuauuaaauuaucaugucuauuuuugau

SEQ ID NO: 290888 - RNA, 64 nt, Homo Sapiens
uguagguggaagaaauuuaguucucagacuuguugucuauuaucuaaguuugguuagccuuagu

SEQ ID NO: 290889 - RNA, 64 nt, Homo Sapiens
ccuuguaaaacagcagcauagaccaaaugagcuggucuauuaugcuaaugauguagaaugcuuu

SEQ ID NO: 290890 - RNA, 64 nt, Homo Sapiens
cacaaaauugggaaaggaguuagggugguauuuagucuauuagcuacuuuguccuuuuuguuau

SEQ ID NO: 290891 - RNA, 64 nt, Homo Sapiens
gagacaauagugagauggcugugggguaagcucagucuauuacuaaagccguucugagggguug

SEQ ID NO: 290892 - RNA, 64 nt, Homo Sapiens
ggauuuuaaagcacaacuggaauagcuaauuacagucuauuaaaacugugaauguauguagcaa

SEQ ID NO: 290893 - RNA, 64 nt, Homo Sapiens
auuguguagagguuguucaacugaaggaauaaaugucuauuaaacuaaaacaaauggaccuucu

SEQ ID NO: 290894 - RNA, 64 nt, Homo Sapiens
auuauuuaauuuuuuagguaaugccuaucucuuggucuauuaaggaaagaagcaaucaguagag

SEQ ID NO: 290895 - RNA, 64 nt, Homo Sapiens
uagaaauaccugcaacaugacagucuaaucaguagucuauuaaaacuuguauucauaaugugua

SEQ ID NO: 290896 - RNA, 64 nt, Homo Sapiens
uuugcagaucccaaucuuucuuuuaagcuucugggucuauuaaacuagguagaucuuuucguau

SEQ ID NO: 290897 - RNA, 64 nt, Homo Sapiens
caagauucuacuaaguguaaaauuauuuaauaaugucuauuaaauugauauuuauaucuugcau

SEQ ID NO: 290898 - RNA, 64 nt, Homo Sapiens
ccccaagaauggccuuguacaacuuauccagaaugucuauuaggauucuaauguuauguccacu

SEQ ID NO: 290899 - RNA, 64 nt, Homo Sapiens
uauaauaauuuguuuugucauauuugcuuucacugucuauuaucuguuuaagucucauaacucu

SEQ ID NO: 290900 - RNA, 64 nt, Homo Sapiens
uuugaaaacuguaguuaacuaugguuuuuuauuagucuauuaaaagauacguggagauauuaaa

SEQ ID NO: 290901 - RNA, 64 nt, Homo Sapiens
gccaucuaucuaguucuaacagugaaguuuuacugucuauuaauauucaggguaaauaggaauc

SEQ ID NO: 290902 - RNA, 64 nt, Homo Sapiens
ugcucugucugugcuuucuacuuaucucuaagaugucuauuauauggcaaaaauguuuaaaaug

SEQ ID NO: 290903 - RNA, 64 nt, Homo Sapiens
uaugaauugaauggaggguccagaagagaugguggucuauuaaauguuuuuuuccugaugaagg

SEQ ID NO: 290904 - RNA, 64 nt, Homo Sapiens
guuaaaggagagauggccaagccagggacaaauugucuauuagaaaacgguccuaagagauucu

SEQ ID NO: 290905 - RNA, 64 nt, Homo Sapiens
ugcugaagcagaccauucuuccuuucuucccaaugucuauuaagaucacacauagguaaacugu

SEQ ID NO: 290906 - RNA, 64 nt, Homo Sapiens
ugcaagacgugguaauauacucauuaaacaaauugucuauuaaaaagugugaguaaaguuagua

SEQ ID NO: 290907 - RNA, 64 nt, Homo Sapiens
ggcucugguugccaacaaacagcauuuguaaauggucuauuagccuucauuuauacugccuaac

SEQ ID NO: 290908 - RNA, 64 nt, Homo Sapiens
agcucuuaaaugcuauuguaagagaaauuucuuugucuauuaacuccauuuuaguagggauuca

SEQ ID NO: 290909 - RNA, 64 nt, Homo Sapiens
auguuuuaugucaaacaauuaugcuuaauauacagucuauuaaauguaagucuuguuugagaua

SEQ ID NO: 290910 - RNA, 64 nt, Homo Sapiens
augguuuaugucaaacaauuaugcuuaauauaaagucuauuaagugguaagucuuguuugagau

SEQ ID NO: 290911 - RNA, 64 nt, Homo Sapiens
acuauauuguccaggcuagaagaauuuucuaauggucuauuacaccucccguuuuggcaaguaa

SEQ ID NO: 290912 - RNA, 64 nt, Homo Sapiens
aagaaaaauguguuuaaaguacaaaacugcuaaugucuauuagguaugucaauuuuucuuuuca

SEQ ID NO: 290913 - RNA, 64 nt, Homo Sapiens
ccaacagaagagaaaauauuuuccaggaugcaaggucuauuaucguagcaguauuguuacuucu

SEQ ID NO: 290914 - RNA, 64 nt, Homo Sapiens
cauucauucagccuucaaucaacaucucuugagugucuauuauguacaggacauguacugagac

SEQ ID NO: 290915 - RNA, 64 nt, Homo Sapiens
aacagauauucacauuugauuauagaaacuuaaugucuauuaauaauuuuaguacaaaauuuca

SEQ ID NO: 290916 - RNA, 64 nt, Homo Sapiens
auuuaauuagccagugaaaaacuauuaacaacuugucuauuaccuguuaguauuauuguugcau

SEQ ID NO: 290917 - RNA, 64 nt, Homo Sapiens
aucagggaauucccugcucccaugccacacauuugucuauuauggcuauaguaccaaaguacuu

SEQ ID NO: 290918 - RNA, 64 nt, Homo Sapiens
uuuuuuuuuucuuuuuuggugugaaggugggggggucuauuagacauuuauucaagagcguucu

SEQ ID NO: 290919 - RNA, 64 nt, Homo Sapiens
cacuagcauggcuaauugaugagauaaucuccuugucuauuagcccaucuuuggagagauuaug

SEQ ID NO: 290920 - RNA, 64 nt, Homo Sapiens
gcagaggaaauaccugccaagucuuucuaaaauugucuauuaaaugauuuucccccguuaacau

SEQ ID NO: 290921 - RNA, 64 nt, Homo Sapiens
guuuuacaacauacguauguuguguuugucauuugucuauuauacaaauaauuauuuggaauuu

SEQ ID NO: 290922 - RNA, 64 nt, Homo Sapiens
uguguugucaccuuucuaaauaucaacuucuggagucuauuaaaucaauugauaccaacagaaa

SEQ ID NO: 290923 - RNA, 64 nt, Homo Sapiens
uuuucagguacuguguggugaccgccccacuggugucuauuacaggccacuuugguaguugugu

SEQ ID NO: 290924 - RNA, 64 nt, Homo Sapiens
agacgggcuguuccugaauaccagguuguuaucugucuauuacagccccuucacuucugggcuc

SEQ ID NO: 290925 - RNA, 64 nt, Homo Sapiens
uauuuuuauguacaauauugauagugagagguaugucuauuauaauaaagauuauggcacagua

SEQ ID NO: 290926 - RNA, 64 nt, Homo Sapiens
ggaagcccuucuuguuugagugagcuauauuaaagucuauuaaagauuuucauacgauuguaaa

SEQ ID NO: 290927 - RNA, 64 nt, Homo Sapiens
augaagaauugccaaucuugaaaucuguauaaaugucuauuauuaagaaaaaaacuauaaauac

SEQ ID NO: 290928 - RNA, 64 nt, Homo Sapiens
aaaugauacacauuuuuaaauugaaaguucaggggucuauuaugauguauucucacauguaaau

SEQ ID NO: 290929 - RNA, 64 nt, Homo Sapiens
ugucucuccucuuucucuggacuggaagagaaaugucuauuaaagaagaucagacuccuacuua

SEQ ID NO: 290930 - RNA, 64 nt, Homo Sapiens
gacuguacuccuaaggaaaauagccacuucugcagucuauuaugcuuuuauaacuguuuaaagg

SEQ ID NO: 290931 - RNA, 64 nt, Homo Sapiens
uauuucagugagagcuacagugugauauuucagagucuauuaaauaaaaaugugaguuugaauu

SEQ ID NO: 290932 - RNA, 64 nt, Homo Sapiens
acacuugcaaaaaucucuacuguaauuaauuugggucuauuauuaacucucuguuccaucauag

SEQ ID NO: 290933 - RNA, 64 nt, Homo Sapiens
gucacauagauaauggugccaaugaaacccuccagucuauuauaaauaucuagaccucucuucc

SEQ ID NO: 290934 - RNA, 64 nt, Homo Sapiens
aaugggacaccaaacaaaaucuaccauaugugcugucuauuauaaaucaguuuuaaaaaaugag

SEQ ID NO: 290935 - RNA, 64 nt, Homo Sapiens
uuaggaguuaauuaaacaugacaacauucuagaagucuauuaccuucagguacaccauuaagau

SEQ ID NO: 290936 - RNA, 64 nt, Homo Sapiens
ggauuucauuaucauaugaauuuguuugacauuugucuauuauuuauacucaccugcguuuuca

SEQ ID NO: 290937 - RNA, 64 nt, Homo Sapiens
ugggugcccucuccaaaggcuggagacaaaugaggucuauuacguuuguaagagugagcucugg

SEQ ID NO: 290938 - RNA, 64 nt, Homo Sapiens
ccuagguccuuggucuaagaagucaaggauguaagucuauuaggacugaguguugaauggucuu

SEQ ID NO: 290939 - RNA, 64 nt, Homo Sapiens
ugugaugguuccguggcugcaaggaagggaaacagucuauuauacauagcccuguauauaugua

SEQ ID NO: 290940 - RNA, 64 nt, Homo Sapiens
auauuuccuuugagggggcauuugcaaaggggcugucuauuagcguugggaaggaggaauuaua

SEQ ID NO: 290941 - RNA, 64 nt, Homo Sapiens
gaaggaaagaaguggaggccuuauugcaaagagagucuauuauauaugucaaacgcauuuuucu

SEQ ID NO: 290942 - RNA, 64 nt, Homo Sapiens
auuccaucguauagaugugaaacuuuuuaaaaaugucuauuaauuauauuauuaaauauucuac

SEQ ID NO: 290943 - RNA, 64 nt, Homo Sapiens
aaaccaguguuuuuuacuuguacacuguuuuaaagucuauuaaaauugucauuugacuuuuuuc

SEQ ID NO: 290944 - RNA, 64 nt, Homo Sapiens
cccucccaccuugucacccuucugagucuccaaugucuauuauuccacacuccauguccacgug

SEQ ID NO: 290945 - RNA, 64 nt, Homo Sapiens
ucuauacauuauauauuauuauuuauacuuccuugucuauuauauuacgaauauaugcguuuau

SEQ ID NO: 290946 - RNA, 64 nt, Homo Sapiens
guuauacugauaaaauuucaucuuucaaauuauagucuauuauuuuaaagggauuuuucaguau

SEQ ID NO: 290947 - RNA, 64 nt, Homo Sapiens
agaauguugcuuucugaauuuugcuuuuuaagaugucuauuauauuuacuuauuaguuuuuaaa

SEQ ID NO: 290948 - RNA, 64 nt, Homo Sapiens
acucagcaguuccuuaaaucacaaacaaugguaggucuauuauuuucucccuggauacacuuua

SEQ ID NO: 290949 - RNA, 64 nt, Homo Sapiens
ccccuccacacgcucuagucccuucaaccuaccggucuauuaagugguggcuuuucucuccuug

SEQ ID NO: 290950 - RNA, 64 nt, Homo Sapiens
cuaauccuccauuaagcgagcauaccucaagugggucuauuagcauuuaaugaccuuuugugcc

SEQ ID NO: 290951 - RNA, 64 nt, Homo Sapiens
ugcaugugucaccuguuuggccucccuggaaugugucuauuaaaagugagugcucccucuguuc

SEQ ID NO: 290952 - RNA, 64 nt, Homo Sapiens
uugugacaauauucaaaggcccuggggagcuuuggucuauuagucaggauagaggcccauauau

SEQ ID NO: 290953 - RNA, 64 nt, Homo Sapiens
uccccugggauucugaauauucaauauuuucagagucuauuagugauuuuuacaucuugcuuaa

SEQ ID NO: 290954 - RNA, 64 nt, Homo Sapiens
guauaauuuaguaaaagaaaaauggcaaucuugagucuauuauuauuuuggguagugaagaagc

SEQ ID NO: 290955 - RNA, 64 nt, Homo Sapiens
uguugucccauaauugagaauaugaagcaaugaagucuauuauuagucaaaaauaccauuuuag

SEQ ID NO: 290956 - RNA, 64 nt, Homo Sapiens
gugaaacauguacuuugagcuucaugaauauggugucuauuauauugccaaaaccaaacccagg

SEQ ID NO: 290957 - RNA, 64 nt, Homo Sapiens
aauuaauucuaaagugacucugguuuccauuuuagucuauuagcuagaggguuuuggcuguugc

SEQ ID NO: 290958 - RNA, 64 nt, Homo Sapiens
agucagaagguguuggggaguucuuauugaguaggucuauuaggaggcaucucaagguaacaga

SEQ ID NO: 290959 - RNA, 64 nt, Homo Sapiens
agagucaccuaugacaaaaauuuugcaacaauaggucuauuauuuuugguaggauuuugacugg

SEQ ID NO: 290960 - RNA, 64 nt, Homo Sapiens
gaaauaguuuccaagaaauuagcuucauuagcuugucuauuauugcuaucgguuuagccuuuua

SEQ ID NO: 290961 - RNA, 64 nt, Homo Sapiens
ggcaugccaaguacuaaagcaccuugcagagcgugucuauuacaagaugucauuuccaccagca

SEQ ID NO: 290962 - RNA, 64 nt, Homo Sapiens
ucugcugaggcccagugcauaugcaauguauagugucuauuaucacauuaaucucaaagagauu

SEQ ID NO: 290963 - RNA, 64 nt, Homo Sapiens
uguuucauguuagauauucuucguacagaguucggucuauuaauagagaauacuguaacaaacu

SEQ ID NO: 290964 - RNA, 64 nt, Homo Sapiens
guguuggucucagcugauuuugagaaauaaacgagucuauuacuucaagcagcaaacuaaauuc

SEQ ID NO: 290965 - RNA, 64 nt, Homo Sapiens
guguuugugacuuuucagagcccagauuccuguugucuauuaaaacuugaagggaggggugaau

SEQ ID NO: 290966 - RNA, 64 nt, Homo Sapiens
cucuuccuuuaggagggaguuaucuaaaagaaaugucuauuaaggugauauauuuaaaaauauu

SEQ ID NO: 290967 - RNA, 64 nt, Homo Sapiens
agccacuugugacuccaugauaggaaauggugaagucuauuagguaaucuguagaaccuucucc

SEQ ID NO: 290968 - RNA, 64 nt, Homo Sapiens
uauccuuguauuggauacguuuuuaaauucuuuggucuauuaagguuauuccaguucccuggga

SEQ ID NO: 290969 - RNA, 64 nt, Homo Sapiens
agaauauuuccaugacccuaagaaguuuccucaugucuauuaauauucccaauccuaggcacca

SEQ ID NO: 290970 - RNA, 64 nt, Homo Sapiens
cacuaaauaaaaacacagaaauaauuagacaauugucuauuauaacaugacaacccuauuaauc

SEQ ID NO: 290971 - RNA, 64 nt, Homo Sapiens
uugguuugaauuauuaguaccuaaguggucucuugucuauuagucugcuaugguaacacuaaac

SEQ ID NO: 290972 - RNA, 64 nt, Homo Sapiens
auuauuauuuuuuaaccuggacaugcauuaaagggucuauuagcuuucuuuccgucugucucaa

SEQ ID NO: 290973 - RNA, 64 nt, Homo Sapiens
acuucacuugucccauugguuaacaucugggugggucuauuacuuacugugaugacugcugucu

SEQ ID NO: 290974 - RNA, 64 nt, Homo Sapiens
gaauuaccauuuccuuuguccuucccuuaguugggucuauuagcucagauugagagguguugcc

SEQ ID NO: 290975 - RNA, 64 nt, Homo Sapiens
ccaaaaaguuuucuugugccaauguauacaauaugucuauuaaaauguaaucaucaccaagauc

SEQ ID NO: 290976 - RNA, 64 nt, Homo Sapiens
acauuuauauucagaugaaauuaugguuugcacugucuauuaaauaucucgauuaauuuucaua

SEQ ID NO: 290977 - RNA, 64 nt, Homo Sapiens
agcugguuacuacuguggcugggaagagagaagagucuauuauggaguaauucagggaagagaa

SEQ ID NO: 290978 - RNA, 64 nt, Homo Sapiens
ugggacaaguguaaagcauggccauaauuuuucugucuauuaaaauuauaaaaugauuucccau

SEQ ID NO: 290979 - RNA, 63 nt, Homo Sapiens
uugcaacaugaauaaaaguuucaccaaaucgggagucuauuauaagcauguuuugaguuauuu

SEQ ID NO: 290980 - RNA, 64 nt, Homo Sapiens
ccccuugaggcaaauauuaaaguaauuuuuauaugucuauuauuucauuuaaagaauaugcugu

SEQ ID NO: 290981 - RNA, 64 nt, Homo Sapiens
ugggugaguccuuguggacaucuuaaccauuccagucuauuacuggggcguauguguggccagc

SEQ ID NO: 290982 - RNA, 64 nt, Homo Sapiens
ggcacuuccuuguaaaaucuaguuuuggcaagaagucuauuaggucaguuuagcaagaacaccu

SEQ ID NO: 290983 - RNA, 64 nt, Homo Sapiens
aauuuagcuaguuuuuaauaguguucucuguauugucuauuauuuagaaaugaacaaggcagga

SEQ ID NO: 290984 - RNA, 64 nt, Homo Sapiens
aaauuagggaguaaaaguuauacuuaacuugucugucuauuauuuuaaaauaugcauugaaaua

SEQ ID NO: 290985 - RNA, 64 nt, Homo Sapiens
ugcauagcaccccaucaaaaguaguucaucaaaugucuauuaaacguuuuaaagaaaaguacau

SEQ ID NO: 290986 - RNA, 64 nt, Homo Sapiens
aguuugucauaauaaaacuuggcagauucuacaagucuauuaugacaaaccaggaacuaauucu

SEQ ID NO: 290987 - RNA, 64 nt, Homo Sapiens
auucacuagccaacauaguacccauuuaucuuuugucuauuaauuuuaacauuccucuaacucc

SEQ ID NO: 290988 - RNA, 64 nt, Homo Sapiens
uaaaauuaaaaauauguguaugccuuauaccucagucuauuaugcucaaaagauaguuaauucu

SEQ ID NO: 290989 - RNA, 62 nt, Homo Sapiens
uaguaucauuguuucauuuaguauuugguacaaucuaauaaauacuaauccaguccaauacu

SEQ ID NO: 290990 - RNA, 62 nt, Homo Sapiens
auacuaauaauacuaacaguaguauugauacaaucuaauaaauaauguguuugacaguguag

SEQ ID NO: 290991 - RNA, 62 nt, Homo Sapiens
agggaagguaagauggauaagaauugugugguaucuaauaaacuuagauuuuaagaacucuu

SEQ ID NO: 290992 - RNA, 62 nt, Homo Sapiens
acaaguuuguggaaaugcaauugauuauucuaaucuaauaagcuggguaucugcaaggcuua

SEQ ID NO: 290993 - RNA, 62 nt, Homo Sapiens
acagagcacuaucucuaaccaacugggcuuauaucuaauaaugggauuugcauuaugacuug

SEQ ID NO: 290994 - RNA, 62 nt, Homo Sapiens
cugagguggccuuuacauacagacccagacaaaucuaauaucuagaugucaagaagcccuuc

SEQ ID NO: 290995 - RNA, 62 nt, Homo Sapiens
ggguuacuuucacauacagccuuaaaggcaccaucuaauagcaggaagguggugcuuacauc

SEQ ID NO: 290996 - RNA, 62 nt, Homo Sapiens
aaaaauauggaacuucuaauagaaaacugaaaaucuaauauuggccaaauuauuuguguaau

SEQ ID NO: 290997 - RNA, 62 nt, Homo Sapiens
gaaauggguuucugcuaaugaauugagcagacaucuaauauuuuauaugccuuuugagcugu

SEQ ID NO: 290998 - RNA, 62 nt, Homo Sapiens
ggaaugccuauaauacaucuuagauuccuuauaucuaauaagaguucaaagaguuaugaguu

SEQ ID NO: 290999 - RNA, 62 nt, Homo Sapiens
cauuaauguaguuccucauugaacaugugauaaucuaauaccugugaaaacugacuaaucag

SEQ ID NO: 291000 - RNA, 62 nt, Homo Sapiens
cugugaaaacugacuaaucagcugccaauaauaucuaauauuuuucaucaugcacgaauuaa

SEQ ID NO: 291001 - RNA, 62 nt, Homo Sapiens
cuccuaagaguuuuacuaguuaagugagcuuuaucuaauaucuggggaaaaagggcuauugc

SEQ ID NO: 291002 - RNA, 62 nt, Homo Sapiens
uuuuguagaaccuuccagaaccaggaaugaguaucuaauagcgcuuauuuaauuuuccagaa

SEQ ID NO: 291003 - RNA, 62 nt, Homo Sapiens
ugcugugauaaaaauaggugagagaucauaugaucuaauauuguauugauggaaguauaggu

SEQ ID NO: 291004 - RNA, 62 nt, Homo Sapiens
ccagucaagcuaguaggcugauugugaagaaaaucuaauaccuuaucuuuaucucaaaccuc

SEQ ID NO: 291005 - RNA, 62 nt, Homo Sapiens
uauauauuauaggccagcuaacuguauauaacaucuaauauaacuauugacuugguaagucu

SEQ ID NO: 291006 - RNA, 62 nt, Homo Sapiens
uauauuacaggccaaaugaaacuguauauaacaucuaauauaacuauugacuugguaagucu

SEQ ID NO: 291007 - RNA, 64 nt, Homo Sapiens
uaacuucgaauauaucuguaccaccauuuaauuucauguauaucuacugcacucuuaaacagca

SEQ ID NO: 291008 - RNA, 64 nt, Homo Sapiens
uagaacugauuacauccguaaauauugcuaaaagcauguauaguuuucaaaugugcaauuugua

SEQ ID NO: 291009 - RNA, 64 nt, Homo Sapiens
acuacacaguugcuaugauauguaacaagucacacauguauauaucacacaagucuuaccaauu

SEQ ID NO: 291010 - RNA, 64 nt, Homo Sapiens
cacucagaaggcagccaucccuagauguugguuucauguauauuacacuaucuacuacuaucca

SEQ ID NO: 291011 - RNA, 64 nt, Homo Sapiens
gguaagagugacuaaccagccuaacuuuaauacacauguauaaagauguucacagagaaagaug

SEQ ID NO: 291012 - RNA, 64 nt, Homo Sapiens
gaggacagacugauaguuucuuucuuucauaucacauguauagagaaauaauuauaucagaaac

SEQ ID NO: 291013 - RNA, 64 nt, Homo Sapiens
uugaccagaguauauuuaaguaauauuugugguucauguauauuaauuguugguagguagaagu

SEQ ID NO: 291014 - RNA, 64 nt, Homo Sapiens
uaccauuuagauucagcagucuguuugguaagcacauguauaucaaaacagaaaaauugaaaaa

SEQ ID NO: 291015 - RNA, 64 nt, Homo Sapiens
aagcacagcaguaaaacaaagguauucauuacuucauguauaucgcaggaaaaaugaauugcuu

SEQ ID NO: 291016 - RNA, 64 nt, Homo Sapiens
uguggaauacucaauguguaaccacauauuaaaccauguauaucuagaaucauaccccauggau

SEQ ID NO: 291017 - RNA, 64 nt, Homo Sapiens
aaauauauaauuuaucuuccucuaucuaaaauuacauguauauaagcaauauugaauuguucau

SEQ ID NO: 291018 - RNA, 64 nt, Homo Sapiens
ccacacuuugcaccuuaauguguagugucacaaacauguauaugaccagaagcacauccauuuu

SEQ ID NO: 291019 - RNA, 64 nt, Homo Sapiens
gcccacguguuaaacauugccgucgucaggguagcauguauaauucccccaaaaugacacccac

SEQ ID NO: 291020 - RNA, 64 nt, Homo Sapiens
guuccaucuuguuaacugcaguauguauucuaaucauguauaugguuuguguucuuuuacugug

SEQ ID NO: 291021 - RNA, 64 nt, Homo Sapiens
aguauuuugugugccuuagauuuccguuuuaagacauguauauuuuugugagccuaagguuucu

SEQ ID NO: 291022 - RNA, 64 nt, Homo Sapiens
ggauuuggagaauaaguguguacagaucacaaaacauguauauacauuauuuagaaaagaucuc

SEQ ID NO: 291023 - RNA, 64 nt, Homo Sapiens
acuuauuuuguaaacauuuuguggguacauaguacauguauauauuuacgggguaugugagaug

SEQ ID NO: 291024 - RNA, 64 nt, Homo Sapiens
ugaaaucuaggaggaaggcauacuuggcaaaccacauguauaauaugcuacuuggaaauguauc

SEQ ID NO: 291025 - RNA, 64 nt, Homo Sapiens
uauagcaucugcauuucuuuuucuuuguuagguacauguauacaccugccugaguauaaauacu

SEQ ID NO: 291026 - RNA, 64 nt, Homo Sapiens
uauauacacauauauguauguauacacauauacacauguauauauacauguguguauguauaca

SEQ ID NO: 291027 - RNA, 64 nt, Homo Sapiens
uauacacauguauauauacauguguguauguauacauguauauauauauacauacacauauaug

SEQ ID NO: 291028 - RNA, 64 nt, Homo Sapiens
uauaguaaugaaaagacuuuacugcuuuauaucucauguauauuagcaagagcaccuguguugu

SEQ ID NO: 291029 - RNA, 64 nt, Homo Sapiens
ugaauggaguaagauaaaccguugguaugcagcccauguauauguuucaguugaauaagggcca

SEQ ID NO: 291030 - RNA, 64 nt, Homo Sapiens
uugcccuuuucacgacuguauucucuuuuauaugcauguauauaaucaagguuuuguuuguuaa

SEQ ID NO: 291031 - RNA, 64 nt, Homo Sapiens
uaaggguacuauaaauaugagagguaaacuuugucauguauaggugcuaauguuuuuguuuaug

SEQ ID NO: 291032 - RNA, 64 nt, Homo Sapiens
uugugcuuuguugugguugcagcuguuuucgugucauguauaguaguagaaauggaaaucauug

SEQ ID NO: 291033 - RNA, 64 nt, Homo Sapiens
ugagggucccuguagauauuguguacaccaugcccauguauauacaaguacacacagauguaca

SEQ ID NO: 291034 - RNA, 64 nt, Homo Sapiens
uaaaauauauacuuuuccaauagacauaugcaugcauguauauggcauuacaugcauauguaug

SEQ ID NO: 291035 - RNA, 64 nt, Homo Sapiens
cacacacaccuccauauauaauaaagugaauguacauguauauaucaagcugauggaguaugug

SEQ ID NO: 291036 - RNA, 64 nt, Homo Sapiens
ugucaggucgaugucucagaacacucucccagcuguggaccacguggaccacuuagcagacuca

SEQ ID NO: 291037 - RNA, 64 nt, Homo Sapiens
gaugucucagaacacucucccagcuguggaccacguggaccacuuagcagacucaggggguagu

SEQ ID NO: 291038 - RNA, 64 nt, Homo Sapiens
ggauuccucugaauaaaguuuugagucagcagaaguggaccaaauuuguuggcaugggcagggg

SEQ ID NO: 291039 - RNA, 64 nt, Homo Sapiens
augauggugggagggggcaacuguggcccaaaugguggaccagauuuccuucauuucccuaagc

SEQ ID NO: 291040 - RNA, 64 nt, Homo Sapiens
aucagcacuugaggccuugccccacgccuucucuguggaccauucaggaccuccagugggggug

SEQ ID NO: 291041 - RNA, 64 nt, Homo Sapiens
ggacuuauuccgcuuuccacaccgaacacuaaauguggaccaguaucaagaacccuccuguccc

SEQ ID NO: 291042 - RNA, 64 nt, Homo Sapiens
agcggcagugacaccugggaucaaaguguggucuguggaccagcuaugaccagagccuugcaac

SEQ ID NO: 291043 - RNA, 64 nt, Homo Sapiens
ggauuuguagccagccagcugggcagaaggcgauguggaccacggccuugucauggccuccugg

SEQ ID NO: 291044 - RNA, 64 nt, Homo Sapiens
auuucagcuuucccugaagaaguggcuccaaucuguggaccagucuugagaaguuauauugggc

SEQ ID NO: 291045 - RNA, 64 nt, Homo Sapiens
gccuguggguacuccaggggccaaauuuaaagauguggaccaagaauuucucuccaccuggcuc

SEQ ID NO: 291046 - RNA, 64 nt, Homo Sapiens
ugggaggccggcagccaggccacagaauccacacguggaccauugugggucccugggaggccgg

SEQ ID NO: 291047 - RNA, 64 nt, Homo Sapiens
ugggaggccggcagccaggccacggaauccacacguggaccauugugggucccuugggaggcca

SEQ ID NO: 291048 - RNA, 64 nt, Homo Sapiens
ugggaggccagcagccagacuacggaauccacauguggaccaugggaagucagucucuugcgug

SEQ ID NO: 291049 - RNA, 64 nt, Homo Sapiens
gggcccccagcugaccccuacugcagauccgcauguggaccaugagccggcugccagcacuagg

SEQ ID NO: 291050 - RNA, 64 nt, Homo Sapiens
cccuugccagguggcuuuucaguuacagaguccaguggaccauuuuguagaaccaugcagcucc

SEQ ID NO: 291051 - RNA, 64 nt, Homo Sapiens
gaggucuagggaaccacaacccuuauuguccuggguggaccaauccaaaggcuaagugauagug

SEQ ID NO: 291052 - RNA, 64 nt, Homo Sapiens
aguaauagugacccuuucacguccuggagcccgaguggaccaaucggaagccuaagugacgaug

SEQ ID NO: 291053 - RNA, 64 nt, Homo Sapiens
ccugggccuggccggaggaauuuuaucugcugguguggaccacagagcuggguuucucuucccu

SEQ ID NO: 291054 - RNA, 64 nt, Homo Sapiens
ccccagcaaauuaucaccaucagggcccaggggaguggaccagccugaccacagggugagacag

SEQ ID NO: 291055 - RNA, 64 nt, Homo Sapiens
aguaguggacccaguucuauuguuggcuucagcgguggaccaagcacugguguuggcuucugca

SEQ ID NO: 291056 - RNA, 64 nt, Homo Sapiens
agcgguggaccaagcacugguguuggcuucugcaguggaccaagcaccaguggcuucagcggug

SEQ ID NO: 291057 - RNA, 64 nt, Homo Sapiens
agcgguggaccgagcacaggagcuggcuucggcgguggaccaaacacuggugcuggcuuuggug

SEQ ID NO: 291058 - RNA, 64 nt, Homo Sapiens
aaauugugaguacauaauauuaaauccuucucuagugacugaagcuuguuuccuuuuuuguuuu

SEQ ID NO: 291059 - RNA, 64 nt, Homo Sapiens
aaaguuuaaugccggcauggauguucuacuacuugugacugagaauuacuuugaauucagauua

SEQ ID NO: 291060 - RNA, 64 nt, Homo Sapiens
aagagauaacacccugucuccauacccaaugcaugugacugauagccaauccaaucggccauuu

SEQ ID NO: 291061 - RNA, 64 nt, Homo Sapiens
gcaguagaagacuuguugagacucccaggauaaagugacugagaaaaaaccaggcaaacaucug

SEQ ID NO: 291062 - RNA, 64 nt, Homo Sapiens
cugguguuuuucagccagacagaggcauaauaaagugacugauguuuacagaacccaaaugaug

SEQ ID NO: 291063 - RNA, 64 nt, Homo Sapiens
uaaguugggaaacagaaugggccagggagguugagugacugaagaccaaggguuggugcagccu

SEQ ID NO: 291064 - RNA, 64 nt, Homo Sapiens
uuguagggggggcauuuuuggguuuucaauagaggugacugagaguccauggcuuuuguuugau

SEQ ID NO: 291065 - RNA, 64 nt, Homo Sapiens
cuuggagaugucggccaggugcuggaauuggccagugacugaaugucauagagggggccaugag

SEQ ID NO: 291066 - RNA, 64 nt, Homo Sapiens
cccaugcacauugggaagacuuggggcucuuucugugacugaggacacaggcacccaggauaag

SEQ ID NO: 291067 - RNA, 64 nt, Homo Sapiens
uuauagccagguuuguguggcgcucccgacuuuugugacugacuggugucuucccauuuggacu

SEQ ID NO: 291068 - RNA, 64 nt, Homo Sapiens
gacgacgacgacgccaccaccccagcccccgucugugacugaaggcccggugggaaaagaccac

SEQ ID NO: 291069 - RNA, 64 nt, Homo Sapiens
acugucugcggcauuuuuuauaauauuguauauagugacugacaaauauuguauuacuguacau

SEQ ID NO: 291070 - RNA, 64 nt, Homo Sapiens
uccccaccucccuugaucauacagugaggcuacagugacugaggggagaauccccuccuguuca

SEQ ID NO: 291071 - RNA, 64 nt, Homo Sapiens
uucaucaagauaagcauuucuuuccugaguucaggugacugaggaagagccacaaaacaaaaca

SEQ ID NO: 291072 - RNA, 64 nt, Homo Sapiens
gguauguguccaucucagcauucaccuuuaucaagugacugauuuuuuuuucuuuucuuuccuu

SEQ ID NO: 291073 - RNA, 64 nt, Homo Sapiens
cugggauuacaggcgugagccacugcgccuggccgugacugauuuuuuuucauguagaauuguc

SEQ ID NO: 291074 - RNA, 64 nt, Homo Sapiens
uuucucaauaguacaugaaaucaagaugcuuaugagcauggaaauguauuuaaaguuuuugcuu

SEQ ID NO: 291075 - RNA, 64 nt, Homo Sapiens
uucuacgugugaguauaaaagacaaaaguugaacagcauggaaucucauugccaaauuauuagu

SEQ ID NO: 291076 - RNA, 64 nt, Homo Sapiens
gcugcuuucagguaugugugucuaucauugaaagagcauggacucaaacaucagcccugaguuc

SEQ ID NO: 291077 - RNA, 64 nt, Homo Sapiens
cuuuacccccacccaggaaaaccugcauugugcuagcauggaagaaucaugggcuuuggaauua

SEQ ID NO: 291078 - RNA, 64 nt, Homo Sapiens
uccuuuaaaaaggugcacuagucugcugcugugcagcauggaaucaggccccgaggagcccgaa

SEQ ID NO: 291079 - RNA, 64 nt, Homo Sapiens
gaggccugugcuagaagcucggaagaaaggaggcagcauggagagacagcuuauaaaaauaaag

SEQ ID NO: 291080 - RNA, 64 nt, Homo Sapiens
auguuguacuucacuccucuguccugcucugggaagcauggaggagcaggcauacagaagguuu

SEQ ID NO: 291081 - RNA, 64 nt, Homo Sapiens
ugagcucaguaggaaacuaaaacucugaaaucaaagcauggauauuuucuucuagcaccagaua

SEQ ID NO: 291082 - RNA, 64 nt, Homo Sapiens
guucaaaggcagcaaggcagugagcuaugagcccagcauggaugugucucaggcaccucauccc

SEQ ID NO: 291083 - RNA, 64 nt, Homo Sapiens
agaucacacacaccaaaccagacagaggcagggcagcauggagacagguagacagaccuccagg

SEQ ID NO: 291084 - RNA, 64 nt, Homo Sapiens
gagaguauccuugacugcuuaagucagccaguucagcauggauaccaacauuagcuuuucuucu

SEQ ID NO: 291085 - RNA, 64 nt, Homo Sapiens
cagaaguuaggaggcaacuuugggauggugcuagagcauggaaagcacagagaauuggacaaac

SEQ ID NO: 291086 - RNA, 64 nt, Homo Sapiens
ugcuucucaagggacacaguggccugcaugggccagcauggacccugggcugaucaugugcauu

SEQ ID NO: 291087 - RNA, 64 nt, Homo Sapiens
gcuucucuggggacacagugggcccacaugggccagcauggacccugggcuagagcaagcacau

SEQ ID NO: 291088 - RNA, 64 nt, Homo Sapiens
acagauuagguuagauguuccuggcuagccaaccagcauggaaaugaacuuaaccuguuucugg

SEQ ID NO: 291089 - RNA, 64 nt, Homo Sapiens
auaacccagauaacuaacccaaucugauucagccagcauggauagcucuggucccaccucugga

SEQ ID NO: 291090 - RNA, 64 nt, Homo Sapiens; identical to SEQ ID NO: 51723

SEQ ID NO: 291091 - RNA, 64 nt, Homo Sapiens; identical to SEQ ID NO: 51724

SEQ ID NO: 291092 - RNA, 64 nt, Homo Sapiens; identical to SEQ ID NO: 51725

SEQ ID NO: 291093 - RNA, 64 nt, Homo Sapiens; identical to SEQ ID NO: 51726

SEQ ID NO: 291094 - RNA, 64 nt, Homo Sapiens; identical to SEQ ID NO: 51727

SEQ ID NO: 291095 - RNA, 64 nt, Homo Sapiens; identical to SEQ ID NO: 51728

SEQ ID NO: 291096 - RNA, 64 nt, Homo Sapiens; identical to SEQ ID NO: 51729

SEQ ID NO: 291097 - RNA, 64 nt, Homo Sapiens; identical to SEQ ID NO: 51730

SEQ ID NO: 291098 - RNA, 64 nt, Homo Sapiens; identical to SEQ ID NO: 51731

SEQ ID NO: 291099 - RNA, 64 nt, Homo Sapiens; identical to SEQ ID NO: 51732

SEQ ID NO: 291100 - RNA, 64 nt, Homo Sapiens; identical to SEQ ID NO: 51733

SEQ ID NO: 291101 - RNA, 64 nt, Homo Sapiens; identical to SEQ ID NO: 51734

SEQ ID NO: 291102 - RNA, 64 nt, Homo Sapiens; identical to SEQ ID NO: 51735

SEQ ID NO: 291103 - RNA, 64 nt, Homo Sapiens; identical to SEQ ID NO: 51736

SEQ ID NO: 291104 - RNA, 64 nt, Homo Sapiens; identical to SEQ ID NO: 51737

SEQ ID NO: 291105 - RNA, 64 nt, Homo Sapiens; identical to SEQ ID NO: 51738

SEQ ID NO: 291106 - RNA, 64 nt, Homo Sapiens; identical to SEQ ID NO: 51739

SEQ ID NO: 291107 - RNA, 64 nt, Homo Sapiens; identical to SEQ ID NO: 51740

SEQ ID NO: 291108 - RNA, 64 nt, Homo Sapiens; identical to SEQ ID NO: 51741

SEQ ID NO: 291109 - RNA, 64 nt, Homo Sapiens; identical to SEQ ID NO: 51742

SEQ ID NO: 291110 - RNA, 64 nt, Homo Sapiens; identical to SEQ ID NO: 51743

SEQ ID NO: 291111 - RNA, 64 nt, Homo Sapiens; identical to SEQ ID NO: 51744

SEQ ID NO: 291112 - RNA, 64 nt, Homo Sapiens; identical to SEQ ID NO: 51745

SEQ ID NO: 291113 - RNA, 64 nt, Homo Sapiens; identical to SEQ ID NO: 51746

SEQ ID NO: 291114 - RNA, 64 nt, Homo Sapiens; identical to SEQ ID NO: 51747

SEQ ID NO: 291115 - RNA, 64 nt, Homo Sapiens; identical to SEQ ID NO: 51748

SEQ ID NO: 291116 - RNA, 64 nt, Homo Sapiens
auauguugucaugcaggguuugggccaagaaagcaugcagaaaaaaaugccaugugauuguaau

SEQ ID NO: 291117 - RNA, 64 nt, Homo Sapiens
ugauucucucacaggcuugggaaauccuguuagcaugcagaauaaugugguaacuuugucaauu

SEQ ID NO: 291118 - RNA, 64 nt, Homo Sapiens
cugaaacugagagagugaagaaccauaaaacgcuaugcagaaggaacauuauggagagaaaggg

SEQ ID NO: 291119 - RNA, 64 nt, Homo Sapiens
cucuagaaucugccacauucauuuucaaaugcaaaugcagaagacuuaccuuaguucaagggga

SEQ ID NO: 291120 - RNA, 62 nt, Homo Sapiens
aagcagaaagagcucauugaaucaugcauaccaugcagaaaguugagcuuuuagguuuuguc

SEQ ID NO: 291121 - RNA, 64 nt, Homo Sapiens
aauauagugaggaguagcauaauauuuuuuaauaaugcagaaaacaucacugaaaugagaguca

SEQ ID NO: 291122 - RNA, 64 nt, Homo Sapiens
uauggagugaaauuauuuuuugcaucauuuaaacaugcagaagauguuuaaaaauaaaaaaaaa

SEQ ID NO: 291123 - RNA, 64 nt, Homo Sapiens
ugcaacaaagacuugcuuuaaauagauuucagcuaugcagaaaaauuuagcuuaugcuuccaua

SEQ ID NO: 291124 - RNA, 64 nt, Homo Sapiens
uuauaaagaauuuggagauuuuauagcauuuuuaaugcagaaaacaaauauuuguugacuaaaa

SEQ ID NO: 291125 - RNA, 64 nt, Homo Sapiens
uauauagucuccucagauuuucucagaaaucuuaaugcagaaauugauagugccaaaaaaaaaa

SEQ ID NO: 291126 - RNA, 64 nt, Homo Sapiens
cauucgggcuugucuuccucuuccauguccccgcaugcagaauccucucuuucuucugccaggg

SEQ ID NO: 291127 - RNA, 64 nt, Homo Sapiens
uaauuaauuauagcaagugauaugaacugugauaaugcagaagguuuccuuuuaaaauaaaguu

SEQ ID NO: 291128 - RNA, 64 nt, Homo Sapiens
uuggggcuguuuacaaacccacauuaagaaguacaugcagaagugaaacacaaaaccaaggagu

SEQ ID NO: 291129 - RNA, 64 nt, Homo Sapiens
ugggaaugacaucaccacugaacaacagcaacagaugcagaaccggcucaacgggaggcucaga

SEQ ID NO: 291130 - RNA, 64 nt, Homo Sapiens
gugcauguggcuuacugugucugaagauacugacaugcagaagaaauaagugcauucuucugcu

SEQ ID NO: 291131 - RNA, 64 nt, Homo Sapiens
caaagcacccaacaaugguaaauguuuuuuaaaaaugcagaacuaagauuuuugacucuaaaga

SEQ ID NO: 291132 - RNA, 64 nt, Homo Sapiens
uaaaauuucaguuuacucuacuucuauaaauccaaugcagaauuaacaugcuaugcuuauaugu

SEQ ID NO: 291133 - RNA, 64 nt, Homo Sapiens
uguaauaaaacaaaaagcaaacugcuacauacauaugcagaaugagaucuuaaugaguaaaaca

SEQ ID NO: 291134 - RNA, 64 nt, Homo Sapiens
gaagcaagagaacaccugcaggaagugaaucaagaugcagaacacagaggaauaaucaccugcu

SEQ ID NO: 291135 - RNA, 64 nt, Homo Sapiens
cuauuuguuccuagguguaaaauuuuaauaguuaaugcagaauucuguaaucauugaaucauua

SEQ ID NO: 291136 - RNA, 64 nt, Homo Sapiens
ggaaaugauggaaggacuuaggaaguggaaccagaugcagaagaauuauaaaagauacauggaa

SEQ ID NO: 291137 - RNA, 64 nt, Homo Sapiens
acgaugccugccuuggugcugucaaggccugcauaugcagaauggacagugagcucugcugcca

SEQ ID NO: 291138 - RNA, 64 nt, Homo Sapiens
gaauuugcucaaaaaagaugcggcaaacugggacaugcagaauugugcaaaucaguggaaggag

SEQ ID NO: 291139 - RNA, 64 nt, Homo Sapiens
uugaaugaagcaagggaaggcuccugaauuuuuaaugcagaagugauuaucacagcccucuuuu

SEQ ID NO: 291140 - RNA, 64 nt, Homo Sapiens
gugagccaaauaaaccucuuuccuauacaguucuaugcagaacagcagaugccagcgccaugcu

SEQ ID NO: 291141 - RNA, 64 nt, Homo Sapiens
gggaaugagcuuccauuaugguugaagccgucucaugcagaagaaagauuccuguccuugagaa

SEQ ID NO: 291142 - RNA, 64 nt, Homo Sapiens
aggcagggcccugcuuuucuaggaauugacuccaaugcagaauagugagaaaucaacaaaaagc

SEQ ID NO: 291143 - RNA, 64 nt, Homo Sapiens
aguggucuaugaggaagagaaaagguaccugaggaugcagaaguaccuaccacaugggaaccgu

SEQ ID NO: 291144 - RNA, 64 nt, Homo Sapiens
gagagaggcgggccccagacccaugugcugggaaaugcagaaaucacguugcuggugguuuuuc

SEQ ID NO: 291145 - RNA, 64 nt, Homo Sapiens
auucaguugcuuugcccaagauaggaguucucugaugcagaaauuauugggcucuuuuagggua

SEQ ID NO: 291146 - RNA, 64 nt, Homo Sapiens
aacaaauccagucaugugugagaacuauuacaacaugcagaaacagacucccgaacucaugcuc

SEQ ID NO: 291147 - RNA, 64 nt, Homo Sapiens
gaugagugguaccgccaaaaugggacccucaauuaugcagaaugcauuuuagagacgaggaaac

SEQ ID NO: 291148 - RNA, 64 nt, Homo Sapiens
cgcaugucacuuagucuaacgcugacagaaaugaaugcagaaggaagauuuucaguccugaacg

SEQ ID NO: 291149 - RNA, 64 nt, Homo Sapiens
aaaagaaaaaaaaaaagcuuauguuucuugucaaaugcagaaauguuccuuccgccacucacug

SEQ ID NO: 291150 - RNA, 64 nt, Homo Sapiens; identical to SEQ ID NO: 161534

SEQ ID NO: 291151 - RNA, 64 nt, Homo Sapiens; identical to SEQ ID NO: 161535

SEQ ID NO: 291152 - RNA, 64 nt, Homo Sapiens; identical to SEQ ID NO: 161536

SEQ ID NO: 291153 - RNA, 64 nt, Homo Sapiens; identical to SEQ ID NO: 161537

SEQ ID NO: 291154 - RNA, 64 nt, Homo Sapiens; identical to SEQ ID NO: 161538

SEQ ID NO: 291155 - RNA, 64 nt, Homo Sapiens; identical to SEQ ID NO: 161539

SEQ ID NO: 291156 - RNA, 64 nt, Homo Sapiens; identical to SEQ ID NO: 161540

SEQ ID NO: 291157 - RNA, 64 nt, Homo Sapiens; identical to SEQ ID NO: 161541

SEQ ID NO: 291158 - RNA, 64 nt, Homo Sapiens; identical to SEQ ID NO: 161542

SEQ ID NO: 291159 - RNA, 64 nt, Homo Sapiens; identical to SEQ ID NO: 161543

SEQ ID NO: 291160 - RNA, 64 nt, Homo Sapiens; identical to SEQ ID NO: 161544

SEQ ID NO: 291161 - RNA, 64 nt, Homo Sapiens; identical to SEQ ID NO: 161545

SEQ ID NO: 291162 - RNA, 64 nt, Homo Sapiens; identical to SEQ ID NO: 161546

SEQ ID NO: 291163 - RNA, 64 nt, Homo Sapiens; identical to SEQ ID NO: 161547

SEQ ID NO: 291164 - RNA, 64 nt, Homo Sapiens; identical to SEQ ID NO: 161548

SEQ ID NO: 291165 - RNA, 64 nt, Homo Sapiens; identical to SEQ ID NO: 161549

SEQ ID NO: 291166 - RNA, 64 nt, Homo Sapiens; identical to SEQ ID NO: 161550

SEQ ID NO: 291167 - RNA, 64 nt, Homo Sapiens; identical to SEQ ID NO: 161551

SEQ ID NO: 291168 - RNA, 64 nt, Homo Sapiens; identical to SEQ ID NO: 161552

SEQ ID NO: 291169 - RNA, 64 nt, Homo Sapiens; identical to SEQ ID NO: 161553

SEQ ID NO: 291170 - RNA, 64 nt, Homo Sapiens; identical to SEQ ID NO: 161554

SEQ ID NO: 291171 - RNA, 64 nt, Homo Sapiens; identical to SEQ ID NO: 161555

SEQ ID NO: 291172 - RNA, 64 nt, Homo Sapiens; identical to SEQ ID NO: 161556

SEQ ID NO: 291173 - RNA, 64 nt, Homo Sapiens
uuucuagagguacauauuaggccuuuuaugaacacuaaaacaaugaggaaauguuggucauggg

SEQ ID NO: 291174 - RNA, 64 nt, Homo Sapiens
uggcuucucaauuuucuuccuucucugccccuaccuaaaacauucuccucggaaauuacauggu

SEQ ID NO: 291175 - RNA, 64 nt, Homo Sapiens
guugccuccccucauaugguuuuuggccaagugacuaaaacaguuuuccacaacuguaaacaaa

SEQ ID NO: 291176 - RNA, 64 nt, Homo Sapiens
uuguacuuuauuuuuuugugccuucugaaaggaucuaaaacaaaaauauuuugccuuuuuuucc

SEQ ID NO: 291177 - RNA, 64 nt, Homo Sapiens
uauaaaaauguuuuuaaacuugacaaucauuacacuaaaacagauuugauaaucuuauucacag

SEQ ID NO: 291178 - RNA, 64 nt, Homo Sapiens
acauggaaauauuaaaauuuuacacuuuuacuagcuaaaacauaaucacaaagcuuuaucgugu

SEQ ID NO: 291179 - RNA, 64 nt, Homo Sapiens
uucuaaucugagugaguuacugagcuuugguccacuaaaacaagcugagcuuugguccacuaaa

SEQ ID NO: 291180 - RNA, 64 nt, Homo Sapiens
uuugguccacuaaaacaagcugagcuuugguccacuaaaacaagaugaaaaauacaagagugac

SEQ ID NO: 291181 - RNA, 64 nt, Homo Sapiens
gacccuguauuuaaucuacuaccaagaauuaccccuaaaacagacauuuuagaauaacaagaac

SEQ ID NO: 291182 - RNA, 64 nt, Homo Sapiens
aaugaaaagaaacacuagguuuacauugaagaaacuaaaacauagauguucauagcauguuuua

SEQ ID NO: 291183 - RNA, 64 nt, Homo Sapiens
gacuuuaucugaaaaugauuccucuucccaugaccuaaaacacugugaggaaaaaucauucaag

SEQ ID NO: 291184 - RNA, 64 nt, Homo Sapiens
agcccuuugcuucuuucauuacuuauaaucuccucuaaaacaaccucugcauguuuuuuuuaaa

SEQ ID NO: 291185 - RNA, 64 nt, Homo Sapiens
augugauauauuuccccucuuuccuuuuucuacacuaaaacaauaauuguuuuacugacaauuu

SEQ ID NO: 291186 - RNA, 64 nt, Homo Sapiens
uuacauuuuaugcugaucuuaaugcaucugauuucuaaaacauauucauccaauauaucauuca

SEQ ID NO: 291187 - RNA, 64 nt, Homo Sapiens
caaaaaccuuguguguuaucuucaacugagaagccuaaaacaaauuccuuacucgauguuuucu

SEQ ID NO: 291188 - RNA, 64 nt, Homo Sapiens
ccauuguuaugguccugaauauugagaaugacaacuaaaacauuaugcagacauauaaaguaac

SEQ ID NO: 291189 - RNA, 64 nt, Homo Sapiens
cagcaaacucaaguugaaggaaucuaauuaugagcuaaaacaucuucuaaaaauucauaauccc

SEQ ID NO: 291190 - RNA, 64 nt, Homo Sapiens
ccugacuuuuauuuugccaaugaagcuguuccuccuaaaacaauuggcauccucacaauugagu

SEQ ID NO: 291191 - RNA, 64 nt, Homo Sapiens
uuacuuuauacucacuuaaaaucaagaaucccaucuaaaacacauagguaccuuaucugaaacu

SEQ ID NO: 291192 - RNA, 64 nt, Homo Sapiens
cuaagucaccgccccacccgccgcauuacauuuccuaaaacauacugcugccaaagaccaacug

SEQ ID NO: 291193 - RNA, 64 nt, Homo Sapiens
gaaaacagaacaaaugagaauccuuuaaucauaacuaaaacauuguagagaugguuuguuacca

SEQ ID NO: 291194 - RNA, 64 nt, Homo Sapiens
acagaacaaaagcaaaggaacaaauaaagacaaacuaaaacaaaaccaaccaccaaaaacuaga

SEQ ID NO: 291195 - RNA, 64 nt, Homo Sapiens
uuuaucuguauaucugaacucuugaaacuuauagcuaaaacacuaggauuuaucugcaguguuc

SEQ ID NO: 291196 - RNA, 64 nt, Homo Sapiens
caguguucagggagauaauucugccuuuaauugucuaaaacaaaaacaaaaccagccaaccuau

SEQ ID NO: 291197 - RNA, 64 nt, Homo Sapiens
acuaaaucuucagcauagaaggaaguguguuugccuaaaacaaucuaaaacaauucccuucuuu

SEQ ID NO: 291198 - RNA, 64 nt, Homo Sapiens
cagcauagaaggaaguguguuugccuaaaacaaucuaaaacaauucccuucuuuuucaucccag

SEQ ID NO: 291199 - RNA, 64 nt, Homo Sapiens
uaucagaaauuuuaauacucagaauuaguuuuuacuaaaacauuauauaugcacagacauggag

SEQ ID NO: 291200 - RNA, 64 nt, Homo Sapiens
ccagaauacccgguaguuccgcaggaaagaacuucuaaaacauugauguuuuuaaaaccuuagg

SEQ ID NO: 291201 - RNA, 64 nt, Homo Sapiens
cugcuaauuaaucauuuuaaacuuucaaaaacugcuaaaacaggugccaugaaucagguacaau

SEQ ID NO: 291202 - RNA, 64 nt, Homo Sapiens
uaccuuuaagagaagcccuuugaauaaucaagugcuaaaacaaaaucaggugcuuuuuuaaaac

SEQ ID NO: 291203 - RNA, 64 nt, Homo Sapiens
guguauuucuggaucauuuuuuaaaugaccucuucuaaaacauaacugucacuuaccugaaaug

SEQ ID NO: 291204 - RNA, 64 nt, Homo Sapiens
aaaauguaagauuuuaagauccucuaacacuguacuaaaacauuucaauaaaaucauucugacu

SEQ ID NO: 291205 - RNA, 64 nt, Homo Sapiens
auguucugguuuuggcccucuguuaacaaagacacuaaaacaguaaguuauaaauaauuauuuu

SEQ ID NO: 291206 - RNA, 64 nt, Homo Sapiens
uguggagcaucaagcaguuuuaacuuacuauuuucuaaaacacugauuacgucugcaucuuuuc

SEQ ID NO: 291207 - RNA, 59 nt, Homo Sapiens
agccagccagucuugccuagcccucccucugccccaagcgcuccuuuuguccccagggc

SEQ ID NO: 291208 - RNA, 59 nt, Homo Sapiens
ccccaaccccgcggugcucucccaugcucugccccaagcagucacagcugcagcugggc

SEQ ID NO: 291209 - RNA, 59 nt, Homo Sapiens
aguggaguagagcccaaucuugaccagugugccccaaggugcagugguugggaggagcu

SEQ ID NO: 291210 - RNA, 59 nt, Homo Sapiens
caccugcaggcaagguacccgaaaaacccugccccaaugaggcugaaccuggcccaaca

SEQ ID NO: 291211 - RNA, 59 nt, Homo Sapiens
ggaucuggaacacagguguuccacucccuugccccaaaaacauggccagugccuguucc

SEQ ID NO: 291212 - RNA, 59 nt, Homo Sapiens
cuggucucaguaaaacacugugccucauaugccccaauggaacagagcuggauuccuug

SEQ ID NO: 291213 - RNA, 59 nt, Homo Sapiens
gcaccuccaccugccccagccccugccucugccccaaguggggccagcugcccucacuu

SEQ ID NO: 291214 - RNA, 59 nt, Homo Sapiens
ggguuucugccacuuccgggucuaggcccugccccaaauccagccaguccugccccagc

SEQ ID NO: 291215 - RNA, 59 nt, Homo Sapiens
caguugaauuauggagggaaauucccuuuugccccaagcauuucuauauuuaaagcaau

SEQ ID NO: 291216 - RNA, 59 nt, Homo Sapiens
cccuaaucugaacaguuaaaacccccaaaugccccaaaauccaaaccuuccugaacgcu

SEQ ID NO: 291217 - RNA, 59 nt, Homo Sapiens
aaagcauagauuccccaaaggcaagaauaugccccaacuaaugcagagaugaggcuaag

SEQ ID NO: 291218 - RNA, 59 nt, Homo Sapiens
ccugcggugacaccacccaggggggcuacugccccaacuccugcugccugugugugccu

SEQ ID NO: 291219 - RNA, 59 nt, Homo Sapiens
ugcaagauuuuccacaagauaggagaaggugccccaaaaagguauaucauuauaacuga

SEQ ID NO: 291220 - RNA, 59 nt, Homo Sapiens
ccuggaagcuguguccuugcgaacgugacugccccaacuaggaauguuaaagucagugg

SEQ ID NO: 291221 - RNA, 59 nt, Homo Sapiens
acugggucaugcgauccccaagacuccuaugccccaaccgcauccagauccuggauccu

SEQ ID NO: 291222 - RNA, 59 nt, Homo Sapiens
auugggucaugggaucccagagacuccuaugccccaaccguacccagauccuggauccu

SEQ ID NO: 291223 - RNA, 59 nt, Homo Sapiens
cucccagccugcacuugcaggaguggugaugccccaagucugcgaauccagggugcacg

SEQ ID NO: 291224 - RNA, 59 nt, Homo Sapiens
aagcaggugcugcauggcucaccaucauaugccccaaacaacugaaaguuggcgguuau

SEQ ID NO: 291225 - RNA, 59 nt, Homo Sapiens
ccaaaugugcccagggagggcgugugggcugccccaaccggucaaucuucccaccccac

SEQ ID NO: 291226 - RNA, 59 nt, Homo Sapiens
accaaggcuuucccaucuugcccauucuaugccccaaccuuggccggccccacugcccc

SEQ ID NO: 291227 - RNA, 64 nt, Homo Sapiens; identical to SEQ ID NO: 105615

SEQ ID NO: 291228 - RNA, 64 nt, Homo Sapiens; identical to SEQ ID NO: 105616

SEQ ID NO: 291229 - RNA, 64 nt, Homo Sapiens; identical to SEQ ID NO: 105617

SEQ ID NO: 291230 - RNA, 64 nt, Homo Sapiens; identical to SEQ ID NO: 105618

SEQ ID NO: 291231 - RNA, 64 nt, Homo Sapiens; identical to SEQ ID NO: 105619

SEQ ID NO: 291232 - RNA, 64 nt, Homo Sapiens; identical to SEQ ID NO: 105620

SEQ ID NO: 291233 - RNA, 64 nt, Homo Sapiens; identical to SEQ ID NO: 105621

SEQ ID NO: 291234 - RNA, 64 nt, Homo Sapiens; identical to SEQ ID NO: 105622

SEQ ID NO: 291235 - RNA, 64 nt, Homo Sapiens; identical to SEQ ID NO: 105623

SEQ ID NO: 291236 - RNA, 64 nt, Homo Sapiens; identical to SEQ ID NO: 105624

SEQ ID NO: 291237 - RNA, 64 nt, Homo Sapiens; identical to SEQ ID NO: 96889

SEQ ID NO: 291238 - RNA, 64 nt, Homo Sapiens; identical to SEQ ID NO: 96890

SEQ ID NO: 291239 - RNA, 64 nt, Homo Sapiens; identical to SEQ ID NO: 96891

SEQ ID NO: 291240 - RNA, 64 nt, Homo Sapiens; identical to SEQ ID NO: 96892

SEQ ID NO: 291241 - RNA, 64 nt, Homo Sapiens; identical to SEQ ID NO: 96893

SEQ ID NO: 291242 - RNA, 64 nt, Homo Sapiens; identical to SEQ ID NO: 96894

SEQ ID NO: 291243 - RNA, 64 nt, Homo Sapiens; identical to SEQ ID NO: 96895

SEQ ID NO: 291244 - RNA, 64 nt, Homo Sapiens; identical to SEQ ID NO: 96896

SEQ ID NO: 291245 - RNA, 64 nt, Homo Sapiens; identical to SEQ ID NO: 96897

SEQ ID NO: 291246 - RNA, 64 nt, Homo Sapiens; identical to SEQ ID NO: 96898

SEQ ID NO: 291247 - RNA, 64 nt, Homo Sapiens; identical to SEQ ID NO: 96899

SEQ ID NO: 291248 - RNA, 64 nt, Homo Sapiens; identical to SEQ ID NO: 96900

SEQ ID NO: 291249 - RNA, 64 nt, Homo Sapiens; identical to SEQ ID NO: 96901

SEQ ID NO: 291250 - RNA, 64 nt, Homo Sapiens; identical to SEQ ID NO: 96902

SEQ ID NO: 291251 - RNA, 64 nt, Homo Sapiens; identical to SEQ ID NO: 96903

SEQ ID NO: 291252 - RNA, 64 nt, Homo Sapiens; identical to SEQ ID NO: 96904

SEQ ID NO: 291253 - RNA, 64 nt, Homo Sapiens; identical to SEQ ID NO: 96905

SEQ ID NO: 291254 - RNA, 64 nt, Homo Sapiens; identical to SEQ ID NO: 96906

SEQ ID NO: 291255 - RNA, 64 nt, Homo Sapiens; identical to SEQ ID NO: 96907

SEQ ID NO: 291256 - RNA, 64 nt, Homo Sapiens; identical to SEQ ID NO: 96908

SEQ ID NO: 291257 - RNA, 64 nt, Homo Sapiens; identical to SEQ ID NO: 96909

SEQ ID NO: 291258 - RNA, 64 nt, Homo Sapiens; identical to SEQ ID NO: 96910

SEQ ID NO: 291259 - RNA, 64 nt, Homo Sapiens; identical to SEQ ID NO: 96911

SEQ ID NO: 291260 - RNA, 64 nt, Homo Sapiens; identical to SEQ ID NO: 96912

SEQ ID NO: 291261 - RNA, 64 nt, Homo Sapiens; identical to SEQ ID NO: 96913

SEQ ID NO: 291262 - RNA, 64 nt, Homo Sapiens; identical to SEQ ID NO: 96914

SEQ ID NO: 291263 - RNA, 64 nt, Homo Sapiens; identical to SEQ ID NO: 96915

SEQ ID NO: 291264 - RNA, 64 nt, Homo Sapiens; identical to SEQ ID NO: 96916

SEQ ID NO: 291265 - RNA, 64 nt, Homo Sapiens; identical to SEQ ID NO: 290809

SEQ ID NO: 291266 - RNA, 64 nt, Homo Sapiens; identical to SEQ ID NO: 290810

SEQ ID NO: 291267 - RNA, 64 nt, Homo Sapiens; identical to SEQ ID NO: 45110

SEQ ID NO: 291268 - RNA, 64 nt, Homo Sapiens; identical to SEQ ID NO: 45111

SEQ ID NO: 291269 - RNA, 64 nt, Homo Sapiens; identical to SEQ ID NO: 45112

SEQ ID NO: 291270 - RNA, 64 nt, Homo Sapiens; identical to SEQ ID NO: 45113

SEQ ID NO: 291271 - RNA, 59 nt, Homo Sapiens; identical to SEQ ID NO: 45114

SEQ ID NO: 291272 - RNA, 64 nt, Homo Sapiens; identical to SEQ ID NO: 45115

SEQ ID NO: 291273 - RNA, 64 nt, Homo Sapiens; identical to SEQ ID NO: 45116

SEQ ID NO: 291274 - RNA, 64 nt, Homo Sapiens; identical to SEQ ID NO: 45117

SEQ ID NO: 291275 - RNA, 64 nt, Homo Sapiens; identical to SEQ ID NO: 45118

SEQ ID NO: 291276 - RNA, 64 nt, Homo Sapiens; identical to SEQ ID NO: 45119

SEQ ID NO: 291277 - RNA, 64 nt, Homo Sapiens; identical to SEQ ID NO: 45120

SEQ ID NO: 291278 - RNA, 64 nt, Homo Sapiens; identical to SEQ ID NO: 45121

SEQ ID NO: 291279 - RNA, 64 nt, Homo Sapiens; identical to SEQ ID NO: 45122

SEQ ID NO: 291280 - RNA, 64 nt, Homo Sapiens; identical to SEQ ID NO: 45123

SEQ ID NO: 291281 - RNA, 64 nt, Homo Sapiens; identical to SEQ ID NO: 45124

SEQ ID NO: 291282 - RNA, 64 nt, Homo Sapiens; identical to SEQ ID NO: 45125

SEQ ID NO: 291283 - RNA, 64 nt, Homo Sapiens; identical to SEQ ID NO: 45126

SEQ ID NO: 291284 - RNA, 64 nt, Homo Sapiens; identical to SEQ ID NO: 45127

SEQ ID NO: 291285 - RNA, 64 nt, Homo Sapiens; identical to SEQ ID NO: 45128

SEQ ID NO: 291286 - RNA, 64 nt, Homo Sapiens; identical to SEQ ID NO: 45129

SEQ ID NO: 291287 - RNA, 64 nt, Homo Sapiens; identical to SEQ ID NO: 45130

SEQ ID NO: 291288 - RNA, 64 nt, Homo Sapiens; identical to SEQ ID NO: 45131

SEQ ID NO: 291289 - RNA, 64 nt, Homo Sapiens; identical to SEQ ID NO: 45132

SEQ ID NO: 291290 - RNA, 64 nt, Homo Sapiens; identical to SEQ ID NO: 45133

SEQ ID NO: 291291 - RNA, 64 nt, Homo Sapiens; identical to SEQ ID NO: 45134

SEQ ID NO: 291292 - RNA, 64 nt, Homo Sapiens; identical to SEQ ID NO: 45135

SEQ ID NO: 291293 - RNA, 64 nt, Homo Sapiens; identical to SEQ ID NO: 45136

SEQ ID NO: 291294 - RNA, 64 nt, Homo Sapiens; identical to SEQ ID NO: 45137

SEQ ID NO: 291295 - RNA, 64 nt, Homo Sapiens; identical to SEQ ID NO: 45138

SEQ ID NO: 291296 - RNA, 64 nt, Homo Sapiens; identical to SEQ ID NO: 45139

SEQ ID NO: 291297 - RNA, 64 nt, Homo Sapiens; identical to SEQ ID NO: 45140

SEQ ID NO: 291298 - RNA, 64 nt, Homo Sapiens; identical to SEQ ID NO: 45141

SEQ ID NO: 291299 - RNA, 64 nt, Homo Sapiens; identical to SEQ ID NO: 45142

SEQ ID NO: 291300 - RNA, 64 nt, Homo Sapiens; identical to SEQ ID NO: 45143

SEQ ID NO: 291301 - RNA, 64 nt, Homo Sapiens; identical to SEQ ID NO: 45144

SEQ ID NO: 291302 - RNA, 64 nt, Homo Sapiens; identical to SEQ ID NO: 45145

SEQ ID NO: 291303 - RNA, 64 nt, Homo Sapiens; identical to SEQ ID NO: 45146

SEQ ID NO: 291304 - RNA, 64 nt, Homo Sapiens; identical to SEQ ID NO: 45147

SEQ ID NO: 291305 - RNA, 64 nt, Homo Sapiens; identical to SEQ ID NO: 45148

SEQ ID NO: 291306 - RNA, 64 nt, Homo Sapiens; identical to SEQ ID NO: 45149

SEQ ID NO: 291307 - RNA, 64 nt, Homo Sapiens; identical to SEQ ID NO: 45150

SEQ ID NO: 291308 - RNA, 64 nt, Homo Sapiens; identical to SEQ ID NO: 45151

SEQ ID NO: 291309 - RNA, 64 nt, Homo Sapiens; identical to SEQ ID NO: 45152

SEQ ID NO: 291310 - RNA, 64 nt, Homo Sapiens; identical to SEQ ID NO: 45153

SEQ ID NO: 291311 - RNA, 64 nt, Homo Sapiens; identical to SEQ ID NO: 45154

SEQ ID NO: 291312 - RNA, 64 nt, Homo Sapiens; identical to SEQ ID NO: 45155

SEQ ID NO: 291313 - RNA, 64 nt, Homo Sapiens; identical to SEQ ID NO: 45156

SEQ ID NO: 291314 - RNA, 64 nt, Homo Sapiens; identical to SEQ ID NO: 45157

SEQ ID NO: 291315 - RNA, 64 nt, Homo Sapiens; identical to SEQ ID NO: 45158

SEQ ID NO: 291316 - RNA, 64 nt, Homo Sapiens; identical to SEQ ID NO: 45159

SEQ ID NO: 291317 - RNA, 64 nt, Homo Sapiens; identical to SEQ ID NO: 45160

SEQ ID NO: 291318 - RNA, 64 nt, Homo Sapiens; identical to SEQ ID NO: 45161

SEQ ID NO: 291319 - RNA, 64 nt, Homo Sapiens; identical to SEQ ID NO: 45162

SEQ ID NO: 291320 - RNA, 64 nt, Homo Sapiens; identical to SEQ ID NO: 45163

SEQ ID NO: 291321 - RNA, 64 nt, Homo Sapiens; identical to SEQ ID NO: 45164

SEQ ID NO: 291322 - RNA, 64 nt, Homo Sapiens; identical to SEQ ID NO: 45165

SEQ ID NO: 291323 - RNA, 64 nt, Homo Sapiens; identical to SEQ ID NO: 45166

SEQ ID NO: 291324 - RNA, 64 nt, Homo Sapiens; identical to SEQ ID NO: 45167

SEQ ID NO: 291325 - RNA, 64 nt, Homo Sapiens; identical to SEQ ID NO: 45168

SEQ ID NO: 291326 - RNA, 64 nt, Homo Sapiens; identical to SEQ ID NO: 45169

SEQ ID NO: 291327 - RNA, 64 nt, Homo Sapiens; identical to SEQ ID NO: 45170

SEQ ID NO: 291328 - RNA, 64 nt, Homo Sapiens; identical to SEQ ID NO: 45171

SEQ ID NO: 291329 - RNA, 64 nt, Homo Sapiens; identical to SEQ ID NO: 45172

SEQ ID NO: 291330 - RNA, 64 nt, Homo Sapiens; identical to SEQ ID NO: 45173

SEQ ID NO: 291331 - RNA, 64 nt, Homo Sapiens; identical to SEQ ID NO: 45174

SEQ ID NO: 291332 - RNA, 64 nt, Homo Sapiens; identical to SEQ ID NO: 45175

SEQ ID NO: 291333 - RNA, 64 nt, Homo Sapiens; identical to SEQ ID NO: 45176

SEQ ID NO: 291334 - RNA, 64 nt, Homo Sapiens; identical to SEQ ID NO: 45177

SEQ ID NO: 291335 - RNA, 64 nt, Homo Sapiens; identical to SEQ ID NO: 45178

SEQ ID NO: 291336 - RNA, 64 nt, Homo Sapiens; identical to SEQ ID NO: 45179

SEQ ID NO: 291337 - RNA, 64 nt, Homo Sapiens; identical to SEQ ID NO: 45180

SEQ ID NO: 291338 - RNA, 64 nt, Homo Sapiens; identical to SEQ ID NO: 45181

SEQ ID NO: 291339 - RNA, 64 nt, Homo Sapiens; identical to SEQ ID NO: 45182

SEQ ID NO: 291340 - RNA, 64 nt, Homo Sapiens; identical to SEQ ID NO: 45183

SEQ ID NO: 291341 - RNA, 64 nt, Homo Sapiens; identical to SEQ ID NO: 45184

SEQ ID NO: 291342 - RNA, 64 nt, Homo Sapiens; identical to SEQ ID NO: 45185

SEQ ID NO: 291343 - RNA, 64 nt, Homo Sapiens; identical to SEQ ID NO: 45186

SEQ ID NO: 291344 - RNA, 64 nt, Homo Sapiens; identical to SEQ ID NO: 45187

SEQ ID NO: 291345 - RNA, 64 nt, Homo Sapiens; identical to SEQ ID NO: 45188

SEQ ID NO: 291346 - RNA, 64 nt, Homo Sapiens; identical to SEQ ID NO: 45189

SEQ ID NO: 291347 - RNA, 64 nt, Homo Sapiens; identical to SEQ ID NO: 45190

SEQ ID NO: 291348 - RNA, 64 nt, Homo Sapiens; identical to SEQ ID NO: 45191

SEQ ID NO: 291349 - RNA, 64 nt, Homo Sapiens; identical to SEQ ID NO: 45192

SEQ ID NO: 291350 - RNA, 64 nt, Homo Sapiens; identical to SEQ ID NO: 45193

SEQ ID NO: 291351 - RNA, 64 nt, Homo Sapiens; identical to SEQ ID NO: 45194

SEQ ID NO: 291352 - RNA, 64 nt, Homo Sapiens; identical to SEQ ID NO: 45195

SEQ ID NO: 291353 - RNA, 64 nt, Homo Sapiens; identical to SEQ ID NO: 45196

SEQ ID NO: 291354 - RNA, 64 nt, Homo Sapiens
cagacaguuguuucuguguccuguucuacccccacuccaguacauaacuacuauguacugugua

SEQ ID NO: 291355 - RNA, 64 nt, Homo Sapiens
ucccucugucuggaguaguccuugccucuuccugcuccaguagggccuuuucccuaccccagcc

SEQ ID NO: 291356 - RNA, 64 nt, Homo Sapiens
acaacccuuaauugccacgugugcacuuacuacucuccaguaugucuuauuacucuccaguaug

SEQ ID NO: 291357 - RNA, 64 nt, Homo Sapiens
gugcacuuacuacucuccaguaugucuuauuacucuccaguaugucacgcaucuuuaacuuuuc

SEQ ID NO: 291358 - RNA, 64 nt, Homo Sapiens
uagagccugugcagccugggcugcugucauugcccuccaguaagggcucaggguuuugcuuuua

SEQ ID NO: 291359 - RNA, 64 nt, Homo Sapiens
gaaauggguacccuaugaucccccuccccuucuccuccaguaaauaccuggaagagggaaccug

SEQ ID NO: 291360 - RNA, 64 nt, Homo Sapiens
cuauugcuggagagcgaaagacccacagagugcucaggaugauguuuguggaaggugaaggaag

SEQ ID NO: 291361 - RNA, 64 nt, Homo Sapiens
uaggagaaagcaauuuguugucauauuguaaguccaggaugaacugggcugggaaaugucucuu

SEQ ID NO: 291362 - RNA, 64 nt, Homo Sapiens
aaaugacaggaggaagacgugcacccgugagcgucaggaugagggaaggccaaggagaguccuu

SEQ ID NO: 291363 - RNA, 64 nt, Homo Sapiens
aaggccaaggagaguccuuguugcugccugaaagcaggaugaggagggauuuccccauuucugu

SEQ ID NO: 291364 - RNA, 64 nt, Homo Sapiens
ggaucaaaggagugagguugccccuuaccccggacaggaugaauccaccgauacacugggacca

SEQ ID NO: 291365 - RNA, 64 nt, Homo Sapiens
gggcugacccugggcuccaaugccaacauuugggcaggaugagacuagucuaagacccagauuc

SEQ ID NO: 291366 - RNA, 64 nt, Homo Sapiens
uaauguaaauaaagugaguaauugguaugacuugcaggaugauguacauguuaguuuguagcuc

SEQ ID NO: 291367 - RNA, 64 nt, Homo Sapiens
acuugcaggaugauguacauguuaguuuguagcucaggaugauuguuaagcaauagauuugcuc

SEQ ID NO: 291368 - RNA, 64 nt, Homo Sapiens
ccugggccuccucacaacauggugucuggauucccaggaugagcaucccaggaucgcaagagcc

SEQ ID NO: 291369 - RNA, 64 nt, Homo Sapiens
uagcuuugcucugccaacuucuucagagcugacacaggaugaaggcaaugccauccucaaacac

SEQ ID NO: 291370 - RNA, 64 nt, Homo Sapiens
uucccgaggaacucauuggccuccuuaaaagggacaggaugaccuguuuguauacaaaggggcc

SEQ ID NO: 291371 - RNA, 64 nt, Homo Sapiens
uugacugggucgguaggagccuggggcuacuaggcaggaugaaugcgcuagggguucuuagucu

SEQ ID NO: 291372 - RNA, 64 nt, Homo Sapiens
caaaaguuguggguuaggguuucucccccucccucaggaugacgcuaguuagcugacacagaug

SEQ ID NO: 291373 - RNA, 64 nt, Homo Sapiens
gacacagauggucaccuccauuaccaaguagagucaggaugaacuaugugugacuguucaacua

SEQ ID NO: 291374 - RNA, 64 nt, Homo Sapiens
cgaaggccuagacucagcugaaggaucuucaaagcaggaugaagaccuagacuuaccugaaggc

SEQ ID NO: 291375 - RNA, 64 nt, Homo Sapiens
ugaaggccuagacucagcugaaggaucuucaaagcaggaugaagaccuagacuuaccugaagga

SEQ ID NO: 291376 - RNA, 64 nt, Homo Sapiens
ugaagaccuaggcuuaccugaaggaucuucaaagcaggaugaagaccuagacuuaccugaagga

SEQ ID NO: 291377 - RNA, 64 nt, Homo Sapiens
ucucgacccuguccccuagggugagggaaggagacaggaugaggugggacucauccuugcccag

SEQ ID NO: 291378 - RNA, 64 nt, Homo Sapiens
ccccgccuuuucccccacccaaaggaggaccagucaggaugaggcugggacuuucccacccagg

SEQ ID NO: 291379 - RNA, 64 nt, Homo Sapiens; identical to SEQ ID NO: 235935

SEQ ID NO: 291380 - RNA, 64 nt, Homo Sapiens; identical to SEQ ID NO: 235936

SEQ ID NO: 291381 - RNA, 64 nt, Homo Sapiens; identical to SEQ ID NO: 235937

SEQ ID NO: 291382 - RNA, 64 nt, Homo Sapiens; identical to SEQ ID NO: 235938

SEQ ID NO: 291383 - RNA, 64 nt, Homo Sapiens; identical to SEQ ID NO: 235939

SEQ ID NO: 291384 - RNA, 64 nt, Homo Sapiens; identical to SEQ ID NO: 235940

SEQ ID NO: 291385 - RNA, 64 nt, Homo Sapiens; identical to SEQ ID NO: 235941

SEQ ID NO: 291386 - RNA, 64 nt, Homo Sapiens; identical to SEQ ID NO: 235942

SEQ ID NO: 291387 - RNA, 64 nt, Homo Sapiens; identical to SEQ ID NO: 235943

SEQ ID NO: 291388 - RNA, 64 nt, Homo Sapiens; identical to SEQ ID NO: 235944

SEQ ID NO: 291389 - RNA, 64 nt, Homo Sapiens; identical to SEQ ID NO: 235945

SEQ ID NO: 291390 - RNA, 64 nt, Homo Sapiens; identical to SEQ ID NO: 235946

SEQ ID NO: 291391 - RNA, 64 nt, Homo Sapiens; identical to SEQ ID NO: 235947

SEQ ID NO: 291392 - RNA, 64 nt, Homo Sapiens; identical to SEQ ID NO: 235948

SEQ ID NO: 291393 - RNA, 64 nt, Homo Sapiens; identical to SEQ ID NO: 235949

SEQ ID NO: 291394 - RNA, 64 nt, Homo Sapiens; identical to SEQ ID NO: 235950

SEQ ID NO: 291395 - RNA, 64 nt, Homo Sapiens; identical to SEQ ID NO: 235951

SEQ ID NO: 291396 - RNA, 64 nt, Homo Sapiens; identical to SEQ ID NO: 235952

SEQ ID NO: 291397 - RNA, 64 nt, Homo Sapiens; identical to SEQ ID NO: 235953

SEQ ID NO: 291398 - RNA, 64 nt, Homo Sapiens; identical to SEQ ID NO: 235954

SEQ ID NO: 291399 - RNA, 64 nt, Homo Sapiens; identical to SEQ ID NO: 235955

SEQ ID NO: 291400 - RNA, 64 nt, Homo Sapiens; identical to SEQ ID NO: 235956

SEQ ID NO: 291401 - RNA, 64 nt, Homo Sapiens; identical to SEQ ID NO: 235957

SEQ ID NO: 291402 - RNA, 64 nt, Homo Sapiens; identical to SEQ ID NO: 235958

SEQ ID NO: 291403 - RNA, 64 nt, Homo Sapiens; identical to SEQ ID NO: 235959

SEQ ID NO: 291404 - RNA, 64 nt, Homo Sapiens; identical to SEQ ID NO: 235960

SEQ ID NO: 291405 - RNA, 64 nt, Homo Sapiens; identical to SEQ ID NO: 235961

SEQ ID NO: 291406 - RNA, 64 nt, Homo Sapiens; identical to SEQ ID NO: 235962

SEQ ID NO: 291407 - RNA, 64 nt, Homo Sapiens; identical to SEQ ID NO: 235963

SEQ ID NO: 291408 - RNA, 64 nt, Homo Sapiens; identical to SEQ ID NO: 235964

SEQ ID NO: 291409 - RNA, 64 nt, Homo Sapiens; identical to SEQ ID NO: 235965

SEQ ID NO: 291410 - RNA, 64 nt, Homo Sapiens; identical to SEQ ID NO: 235966

SEQ ID NO: 291411 - RNA, 64 nt, Homo Sapiens; identical to SEQ ID NO: 235967

SEQ ID NO: 291412 - RNA, 64 nt, Homo Sapiens; identical to SEQ ID NO: 235968

SEQ ID NO: 291413 - RNA, 64 nt, Homo Sapiens; identical to SEQ ID NO: 235969

SEQ ID NO: 291414 - RNA, 64 nt, Homo Sapiens; identical to SEQ ID NO: 235970

SEQ ID NO: 291415 - RNA, 64 nt, Homo Sapiens; identical to SEQ ID NO: 235971

SEQ ID NO: 291416 - RNA, 64 nt, Homo Sapiens; identical to SEQ ID NO: 235972

SEQ ID NO: 291417 - RNA, 64 nt, Homo Sapiens; identical to SEQ ID NO: 235973

SEQ ID NO: 291418 - RNA, 64 nt, Homo Sapiens; identical to SEQ ID NO: 235974

SEQ ID NO: 291419 - RNA, 58 nt, Homo Sapiens; identical to SEQ ID NO: 235975

SEQ ID NO: 291420 - RNA, 64 nt, Homo Sapiens; identical to SEQ ID NO: 235976

SEQ ID NO: 291421 - RNA, 64 nt, Homo Sapiens; identical to SEQ ID NO: 235977

SEQ ID NO: 291422 - RNA, 64 nt, Homo Sapiens; identical to SEQ ID NO: 235978

SEQ ID NO: 291423 - RNA, 64 nt, Homo Sapiens; identical to SEQ ID NO: 235979

SEQ ID NO: 291424 - RNA, 64 nt, Homo Sapiens; identical to SEQ ID NO: 235980

SEQ ID NO: 291425 - RNA, 64 nt, Homo Sapiens; identical to SEQ ID NO: 235981

SEQ ID NO: 291426 - RNA, 64 nt, Homo Sapiens; identical to SEQ ID NO: 235981

SEQ ID NO: 291427 - RNA, 64 nt, Homo Sapiens; identical to SEQ ID NO: 235983

SEQ ID NO: 291428 - RNA, 64 nt, Homo Sapiens; identical to SEQ ID NO: 235984

SEQ ID NO: 291429 - RNA, 64 nt, Homo Sapiens; identical to SEQ ID NO: 235985

SEQ ID NO: 291430 - RNA, 64 nt, Homo Sapiens; identical to SEQ ID NO: 235986

SEQ ID NO: 291431 - RNA, 64 nt, Homo Sapiens; identical to SEQ ID NO: 235987

SEQ ID NO: 291432 - RNA, 64 nt, Homo Sapiens; identical to SEQ ID NO: 235988

SEQ ID NO: 291433 - RNA, 64 nt, Homo Sapiens; identical to SEQ ID NO: 235989

SEQ ID NO: 291434 - RNA, 64 nt, Homo Sapiens; identical to SEQ ID NO: 235990

SEQ ID NO: 291435 - RNA, 64 nt, Homo Sapiens; identical to SEQ ID NO: 235991

SEQ ID NO: 291436 - RNA, 64 nt, Homo Sapiens; identical to SEQ ID NO: 235992

SEQ ID NO: 291437 - RNA, 64 nt, Homo Sapiens
gagaucccuggcuucuccccauguuguucccggacaagggcagaagggaggcauggcaagggac

SEQ ID NO: 291438 - RNA, 64 nt, Homo Sapiens
guccucaucccuccccaccucccacugcuuccugcaagggcaccaguuguaugagaaaguuggc

SEQ ID NO: 291439 - RNA, 64 nt, Homo Sapiens
ggauauaaaacaggcuuuaaguuucuugguugcccaagggcagagcaaggaauaucugguguuu

SEQ ID NO: 291440 - RNA, 64 nt, Homo Sapiens
guaagccuuugcacucuguagaguacuuagaagacaagggcaacuuacuuggaguuagagccaa

SEQ ID NO: 291441 - RNA, 64 nt, Homo Sapiens
ggcaucugacagcccuuucccagagggcaccacgcaagggcagagcugggcggcauccacagcc

SEQ ID NO: 291442 - RNA, 64 nt, Homo Sapiens
gccuucuccauaccccucuccccagcaucaugagcaagggcauugccuccucucucugcucacu

SEQ ID NO: 291443 - RNA, 64 nt, Homo Sapiens
aaguggaugggaauuguaggcauagauuucauaucaagggcauuucaagacagaauuuuuauuu

SEQ ID NO: 291444 - RNA, 64 nt, Homo Sapiens
ugguggccauguucucugaauugggugcagaagacaagggcagaguggcugcggccccuauuac

SEQ ID NO: 291445 - RNA, 64 nt, Homo Sapiens
aacagaaugcucagccccucguggcaggacuugacaagggcaagcuugaccaggaagcugccau

SEQ ID NO: 291446 - RNA, 64 nt, Homo Sapiens
aggcgggcucccacccucugcuccuggccuugggcaagggcacucagcgccucgccugccccug

SEQ ID NO: 291447 - RNA, 64 nt, Homo Sapiens
aggucuccuuggcccaggccaagauugagaagaucaagggcagcaagaaggccaucaagguagu

SEQ ID NO: 291448 - RNA, 64 nt, Homo Sapiens
ugucggaucucuucaacaagcuggucaugaggcgcaagggcaucucugggaaaggaccuggggc

SEQ ID NO: 291449 - RNA, 64 nt, Homo Sapiens
uacacgaacucggcuucuuuuguccuagguacgccaagggcagguuucuggagacucccuugug

SEQ ID NO: 291450 - RNA, 64 nt, Homo Sapiens
cagguuucuggagacucccuugugcccgggauggcaagggcaccgggcuggcguuuccacaucu

SEQ ID NO: 291451 - RNA, 64 nt, Homo Sapiens
gagagaggauggacgugggaaccuggcuggcugugagucagagauaggaaugacaaggcuagaa

SEQ ID NO: 291452 - RNA, 64 nt, Homo Sapiens
gcaguggcaguccuuugccaacaucgccacaguugagucagauggcagcucggugacuccgucc

SEQ ID NO: 291453 - RNA, 64 nt, Homo Sapiens
guucuauucugcuccaggaaaaucggaaaccugugagucagagucagagaaacuuacccaagca

SEQ ID NO: 291454 - RNA, 64 nt, Homo Sapiens
uucugcuccaggaaaaucggaaaccugugagucagagucagagaaacuuacccaagcaacguaa

SEQ ID NO: 291455 - RNA, 64 nt, Homo Sapiens
ucggauucccagccucacuccauuggcagucgaggagucagaacaccuguugugugaaacauaa

SEQ ID NO: 291456 - RNA, 64 nt, Homo Sapiens
uuaguuaacaauaaugagccacaccugggcuuuggagucagauuuagaauuggaacuagaaacu

SEQ ID NO: 291457 - RNA, 64 nt, Homo Sapiens
ggaagacagagugagccaaugcucaccagccccagagucagagcuggccacaggcuggcagccu

SEQ ID NO: 291458 - RNA, 64 nt, Homo Sapiens
aguucuucauuaacauuuauacgaguuuuuugcugagucagauggacaguuggguucugaugcu

SEQ ID NO: 291459 - RNA, 64 nt, Homo Sapiens
gggcugcuguggcccagucguccgcucagccaaggagucagauggcaauggguacuccagcagg

SEQ ID NO: 291460 - RNA, 64 nt, Homo Sapiens
cugggaagauaccagcuuuuucucucaggguucugagucagaggacaccauccaagaauguugu

SEQ ID NO: 291461 - RNA, 64 nt, Homo Sapiens
uaauuuguuuuuugaagcacaguuaaacaaaaaggagucagauuauuuuuuugacuauauuauc

SEQ ID NO: 291462 - RNA, 64 nt, Homo Sapiens
gguuucuuaaaaaaaaaaaaaaaccauugguugggagucagauuguggccuuuguuaauaucgc

SEQ ID NO: 291463 - RNA, 64 nt, Homo Sapiens
acagccacuuggccucacuaccagaagaaggguggagucagaaaccaaagugaccuccagagcu

SEQ ID NO: 291464 - RNA, 64 nt, Homo Sapiens
ucccuaccauuucuagccucuauugcccagauuggagucagaggucaaaaaaggauuccaagug

SEQ ID NO: 291465 - RNA, 64 nt, Homo Sapiens; identical to SEQ ID NO: 111876

SEQ ID NO: 291466 - RNA, 64 nt, Homo Sapiens; identical to SEQ ID NO: 111877

SEQ ID NO: 291467 - RNA, 64 nt, Homo Sapiens; identical to SEQ ID NO: 111878

SEQ ID NO: 291468 - RNA, 64 nt, Homo Sapiens; identical to SEQ ID NO: 111879

SEQ ID NO: 291469 - RNA, 64 nt, Homo Sapiens; identical to SEQ ID NO: 111880

SEQ ID NO: 291470 - RNA, 64 nt, Homo Sapiens; identical to SEQ ID NO: 111881

SEQ ID NO: 291471 - RNA, 64 nt, Homo Sapiens; identical to SEQ ID NO: 45477

SEQ ID NO: 291472 - RNA, 64 nt, Homo Sapiens; identical to SEQ ID NO: 45478

SEQ ID NO: 291473 - RNA, 64 nt, Homo Sapiens; identical to SEQ ID NO: 45479

SEQ ID NO: 291474 - RNA, 64 nt, Homo Sapiens; identical to SEQ ID NO: 45480

SEQ ID NO: 291475 - RNA, 64 nt, Homo Sapiens; identical to SEQ ID NO: 45481

SEQ ID NO: 291476 - RNA, 64 nt, Homo Sapiens; identical to SEQ ID NO: 45482

SEQ ID NO: 291477 - RNA, 64 nt, Homo Sapiens; identical to SEQ ID NO: 45483

SEQ ID NO: 291478 - RNA, 64 nt, Homo Sapiens; identical to SEQ ID NO: 45484

SEQ ID NO: 291479 - RNA, 64 nt, Homo Sapiens; identical to SEQ ID NO: 45485

SEQ ID NO: 291480 - RNA, 64 nt, Homo Sapiens; identical to SEQ ID NO: 45486

SEQ ID NO: 291481 - RNA, 64 nt, Homo Sapiens; identical to SEQ ID NO: 45487

SEQ ID NO: 291482 - RNA, 56 nt, Homo Sapiens; identical to SEQ ID NO: 45488

SEQ ID NO: 291483 - RNA, 64 nt, Homo Sapiens; identical to SEQ ID NO: 45489

SEQ ID NO: 291484 - RNA, 64 nt, Homo Sapiens; identical to SEQ ID NO: 45490

SEQ ID NO: 291485 - RNA, 64 nt, Homo Sapiens; identical to SEQ ID NO: 45491

SEQ ID NO: 291486 - RNA, 64 nt, Homo Sapiens; identical to SEQ ID NO: 45492

SEQ ID NO: 291487 - RNA, 64 nt, Homo Sapiens; identical to SEQ ID NO: 45493

SEQ ID NO: 291488 - RNA, 64 nt, Homo Sapiens; identical to SEQ ID NO: 45494

SEQ ID NO: 291489 - RNA, 64 nt, Homo Sapiens; identical to SEQ ID NO: 45495

SEQ ID NO: 291490 - RNA, 64 nt, Homo Sapiens; identical to SEQ ID NO: 45496

SEQ ID NO: 291491 - RNA, 64 nt, Homo Sapiens; identical to SEQ ID NO: 45497

SEQ ID NO: 291492 - RNA, 64 nt, Homo Sapiens; identical to SEQ ID NO: 45498

SEQ ID NO: 291493 - RNA, 64 nt, Homo Sapiens; identical to SEQ ID NO: 45499

SEQ ID NO: 291494 - RNA, 64 nt, Homo Sapiens; identical to SEQ ID NO: 45500

SEQ ID NO: 291495 - RNA, 64 nt, Homo Sapiens; identical to SEQ ID NO: 45501

SEQ ID NO: 291496 - RNA, 64 nt, Homo Sapiens; identical to SEQ ID NO: 45502

SEQ ID NO: 291497 - RNA, 64 nt, Homo Sapiens; identical to SEQ ID NO: 45503

SEQ ID NO: 291498 - RNA, 64 nt, Homo Sapiens; identical to SEQ ID NO: 45504

SEQ ID NO: 291499 - RNA, 64 nt, Homo Sapiens; identical to SEQ ID NO: 45505

SEQ ID NO: 291500 - RNA, 64 nt, Homo Sapiens; identical to SEQ ID NO: 45506

SEQ ID NO: 291501 - RNA, 64 nt, Homo Sapiens; identical to SEQ ID NO: 45507

SEQ ID NO: 291502 - RNA, 64 nt, Homo Sapiens; identical to SEQ ID NO: 45508

SEQ ID NO: 291503 - RNA, 64 nt, Homo Sapiens; identical to SEQ ID NO: 45509

SEQ ID NO: 291504 - RNA, 64 nt, Homo Sapiens; identical to SEQ ID NO: 45510

SEQ ID NO: 291505 - RNA, 64 nt, Homo Sapiens; identical to SEQ ID NO: 45511

SEQ ID NO: 291506 - RNA, 64 nt, Homo Sapiens; identical to SEQ ID NO: 45512

SEQ ID NO: 291507 - RNA, 64 nt, Homo Sapiens; identical to SEQ ID NO: 45513

SEQ ID NO: 291508 - RNA, 64 nt, Homo Sapiens; identical to SEQ ID NO: 45514

SEQ ID NO: 291509 - RNA, 64 nt, Homo Sapiens; identical to SEQ ID NO: 45515

SEQ ID NO: 291510 - RNA, 64 nt, Homo Sapiens; identical to SEQ ID NO: 45516

SEQ ID NO: 291511 - RNA, 64 nt, Homo Sapiens; identical to SEQ ID NO: 45517

SEQ ID NO: 291512 - RNA, 64 nt, Homo Sapiens; identical to SEQ ID NO: 45518

SEQ ID NO: 291513 - RNA, 64 nt, Homo Sapiens; identical to SEQ ID NO: 45519

SEQ ID NO: 291514 - RNA, 64 nt, Homo Sapiens; identical to SEQ ID NO: 45520

SEQ ID NO: 291515 - RNA, 64 nt, Homo Sapiens; identical to SEQ ID NO: 45521

SEQ ID NO: 291516 - RNA, 64 nt, Homo Sapiens; identical to SEQ ID NO: 45522

SEQ ID NO: 291517 - RNA, 64 nt, Homo Sapiens; identical to SEQ ID NO: 45523

SEQ ID NO: 291518 - RNA, 64 nt, Homo Sapiens; identical to SEQ ID NO: 45524

SEQ ID NO: 291519 - RNA, 64 nt, Homo Sapiens; identical to SEQ ID NO: 45525

SEQ ID NO: 291520 - RNA, 64 nt, Homo Sapiens; identical to SEQ ID NO: 45526

SEQ ID NO: 291521 - RNA, 64 nt, Homo Sapiens; identical to SEQ ID NO: 45527

SEQ ID NO: 291522 - RNA, 64 nt, Homo Sapiens; identical to SEQ ID NO: 45528

SEQ ID NO: 291523 - RNA, 64 nt, Homo Sapiens; identical to SEQ ID NO: 45529

SEQ ID NO: 291524 - RNA, 64 nt, Homo Sapiens; identical to SEQ ID NO: 45530

SEQ ID NO: 291525 - RNA, 64 nt, Homo Sapiens; identical to SEQ ID NO: 45531

SEQ ID NO: 291526 - RNA, 64 nt, Homo Sapiens; identical to SEQ ID NO: 45532

SEQ ID NO: 291527 - RNA, 64 nt, Homo Sapiens; identical to SEQ ID NO: 45533

SEQ ID NO: 291528 - RNA, 64 nt, Homo Sapiens; identical to SEQ ID NO: 45534

SEQ ID NO: 291529 - RNA, 64 nt, Homo Sapiens; identical to SEQ ID NO: 45535

SEQ ID NO: 291530 - RNA, 64 nt, Homo Sapiens; identical to SEQ ID NO: 45536

SEQ ID NO: 291531 - RNA, 64 nt, Homo Sapiens; identical to SEQ ID NO: 45537

SEQ ID NO: 291532 - RNA, 64 nt, Homo Sapiens; identical to SEQ ID NO: 45538

SEQ ID NO: 291533 - RNA, 64 nt, Homo Sapiens; identical to SEQ ID NO: 45539

SEQ ID NO: 291534 - RNA, 64 nt, Homo Sapiens; identical to SEQ ID NO: 45540

SEQ ID NO: 291535 - RNA, 64 nt, Homo Sapiens; identical to SEQ ID NO: 45541

SEQ ID NO: 291536 - RNA, 64 nt, Homo Sapiens; identical to SEQ ID NO: 45542

SEQ ID NO: 291537 - RNA, 64 nt, Homo Sapiens; identical to SEQ ID NO: 45543

SEQ ID NO: 291538 - RNA, 64 nt, Homo Sapiens; identical to SEQ ID NO: 45544

SEQ ID NO: 291539 - RNA, 64 nt, Homo Sapiens; identical to SEQ ID NO: 45545

SEQ ID NO: 291540 - RNA, 64 nt, Homo Sapiens; identical to SEQ ID NO: 45546

SEQ ID NO: 291541 - RNA, 64 nt, Homo Sapiens; identical to SEQ ID NO: 45547

SEQ ID NO: 291542 - RNA, 64 nt, Homo Sapiens; identical to SEQ ID NO: 45548

SEQ ID NO: 291543 - RNA, 64 nt, Homo Sapiens; identical to SEQ ID NO: 45549

SEQ ID NO: 291544 - RNA, 64 nt, Homo Sapiens; identical to SEQ ID NO: 45550

SEQ ID NO: 291545 - RNA, 64 nt, Homo Sapiens; identical to SEQ ID NO: 45551

SEQ ID NO: 291546 - RNA, 64 nt, Homo Sapiens; identical to SEQ ID NO: 45552

SEQ ID NO: 291547 - RNA, 64 nt, Homo Sapiens; identical to SEQ ID NO: 45553

SEQ ID NO: 291548 - RNA, 64 nt, Homo Sapiens; identical to SEQ ID NO: 45554

SEQ ID NO: 291549 - RNA, 64 nt, Homo Sapiens; identical to SEQ ID NO: 45555

SEQ ID NO: 291550 - RNA, 64 nt, Homo Sapiens; identical to SEQ ID NO: 45556

SEQ ID NO: 291551 - RNA, 64 nt, Homo Sapiens; identical to SEQ ID NO: 45557

SEQ ID NO: 291552 - RNA, 64 nt, Homo Sapiens; identical to SEQ ID NO: 45558

SEQ ID NO: 291553 - RNA, 64 nt, Homo Sapiens; identical to SEQ ID NO: 45559

SEQ ID NO: 291554 - RNA, 64 nt, Homo Sapiens; identical to SEQ ID NO: 45560

SEQ ID NO: 291555 - RNA, 64 nt, Homo Sapiens; identical to SEQ ID NO: 45561

SEQ ID NO: 291556 - RNA, 64 nt, Homo Sapiens; identical to SEQ ID NO: 45562

SEQ ID NO: 291557 - RNA, 64 nt, Homo Sapiens; identical to SEQ ID NO: 45563

SEQ ID NO: 291558 - RNA, 64 nt, Homo Sapiens; identical to SEQ ID NO: 45564

SEQ ID NO: 291559 - RNA, 64 nt, Homo Sapiens; identical to SEQ ID NO: 45565

SEQ ID NO: 291560 - RNA, 64 nt, Homo Sapiens; identical to SEQ ID NO: 45566

SEQ ID NO: 291561 - RNA, 64 nt, Homo Sapiens; identical to SEQ ID NO: 45567

SEQ ID NO: 291562 - RNA, 64 nt, Homo Sapiens; identical to SEQ ID NO: 45568

SEQ ID NO: 291563 - RNA, 64 nt, Homo Sapiens; identical to SEQ ID NO: 45569

SEQ ID NO: 291564 - RNA, 64 nt, Homo Sapiens; identical to SEQ ID NO: 45570

SEQ ID NO: 291565 - RNA, 64 nt, Homo Sapiens; identical to SEQ ID NO: 45571

SEQ ID NO: 291566 - RNA, 64 nt, Homo Sapiens; identical to SEQ ID NO: 45572

SEQ ID NO: 291567 - RNA, 64 nt, Homo Sapiens; identical to SEQ ID NO: 45573

SEQ ID NO: 291568 - RNA, 64 nt, Homo Sapiens; identical to SEQ ID NO: 45574

SEQ ID NO: 291569 - RNA, 64 nt, Homo Sapiens; identical to SEQ ID NO: 45575

SEQ ID NO: 291570 - RNA, 64 nt, Homo Sapiens; identical to SEQ ID NO: 45576

SEQ ID NO: 291571 - RNA, 64 nt, Homo Sapiens; identical to SEQ ID NO: 45577

SEQ ID NO: 291572 - RNA, 64 nt, Homo Sapiens; identical to SEQ ID NO: 45578

SEQ ID NO: 291573 - RNA, 64 nt, Homo Sapiens; identical to SEQ ID NO: 45579

SEQ ID NO: 291574 - RNA, 64 nt, Homo Sapiens; identical to SEQ ID NO: 45580

SEQ ID NO: 291575 - RNA, 64 nt, Homo Sapiens; identical to SEQ ID NO: 45581

SEQ ID NO: 291576 - RNA, 64 nt, Homo Sapiens; identical to SEQ ID NO: 45582

SEQ ID NO: 291577 - RNA, 64 nt, Homo Sapiens; identical to SEQ ID NO: 45583

SEQ ID NO: 291578 - RNA, 64 nt, Homo Sapiens; identical to SEQ ID NO: 45584

SEQ ID NO: 291579 - RNA, 64 nt, Homo Sapiens; identical to SEQ ID NO: 45585

SEQ ID NO: 291580 - RNA, 64 nt, Homo Sapiens; identical to SEQ ID NO: 45586

SEQ ID NO: 291581 - RNA, 64 nt, Homo Sapiens; identical to SEQ ID NO: 45587

SEQ ID NO: 291582 - RNA, 64 nt, Homo Sapiens; identical to SEQ ID NO: 45588

SEQ ID NO: 291583 - RNA, 64 nt, Homo Sapiens; identical to SEQ ID NO: 45589

SEQ ID NO: 291584 - RNA, 64 nt, Homo Sapiens; identical to SEQ ID NO: 45590

SEQ ID NO: 291585 - RNA, 64 nt, Homo Sapiens; identical to SEQ ID NO: 45591

SEQ ID NO: 291586 - RNA, 64 nt, Homo Sapiens; identical to SEQ ID NO: 45592

SEQ ID NO: 291587 - RNA, 64 nt, Homo Sapiens; identical to SEQ ID NO: 45593

SEQ ID NO: 291588 - RNA, 64 nt, Homo Sapiens; identical to SEQ ID NO: 45594

SEQ ID NO: 291589 - RNA, 64 nt, Homo Sapiens; identical to SEQ ID NO: 45595

SEQ ID NO: 291590 - RNA, 64 nt, Homo Sapiens; identical to SEQ ID NO: 45596

SEQ ID NO: 291591 - RNA, 64 nt, Homo Sapiens; identical to SEQ ID NO: 45597

SEQ ID NO: 291592 - RNA, 64 nt, Homo Sapiens; identical to SEQ ID NO: 45598

SEQ ID NO: 291593 - RNA, 64 nt, Homo Sapiens; identical to SEQ ID NO: 45599

SEQ ID NO: 291594 - RNA, 64 nt, Homo Sapiens; identical to SEQ ID NO: 45600

SEQ ID NO: 291595 - RNA, 64 nt, Homo Sapiens; identical to SEQ ID NO: 45601

SEQ ID NO: 291596 - RNA, 64 nt, Homo Sapiens; identical to SEQ ID NO: 45602

SEQ ID NO: 291597 - RNA, 64 nt, Homo Sapiens; identical to SEQ ID NO: 45603

SEQ ID NO: 291598 - RNA, 64 nt, Homo Sapiens; identical to SEQ ID NO: 45604

SEQ ID NO: 291599 - RNA, 64 nt, Homo Sapiens; identical to SEQ ID NO: 45605

SEQ ID NO: 291600 - RNA, 64 nt, Homo Sapiens; identical to SEQ ID NO: 45606

SEQ ID NO: 291601 - RNA, 64 nt, Homo Sapiens; identical to SEQ ID NO: 45607

SEQ ID NO: 291602 - RNA, 64 nt, Homo Sapiens; identical to SEQ ID NO: 45608

SEQ ID NO: 291603 - RNA, 64 nt, Homo Sapiens; identical to SEQ ID NO: 45609

SEQ ID NO: 291604 - RNA, 64 nt, Homo Sapiens; identical to SEQ ID NO: 45610

SEQ ID NO: 291605 - RNA, 64 nt, Homo Sapiens; identical to SEQ ID NO: 45611

SEQ ID NO: 291606 - RNA, 64 nt, Homo Sapiens; identical to SEQ ID NO: 45612

SEQ ID NO: 291607 - RNA, 64 nt, Homo Sapiens; identical to SEQ ID NO: 45613

SEQ ID NO: 291608 - RNA, 64 nt, Homo Sapiens; identical to SEQ ID NO: 45614

SEQ ID NO: 291609 - RNA, 64 nt, Homo Sapiens; identical to SEQ ID NO: 45615

SEQ ID NO: 291610 - RNA, 64 nt, Homo Sapiens; identical to SEQ ID NO: 45616

SEQ ID NO: 291611 - RNA, 64 nt, Homo Sapiens; identical to SEQ ID NO: 45617

SEQ ID NO: 291612 - RNA, 64 nt, Homo Sapiens; identical to SEQ ID NO: 45618

SEQ ID NO: 291613 - RNA, 64 nt, Homo Sapiens; identical to SEQ ID NO: 45619

SEQ ID NO: 291614 - RNA, 64 nt, Homo Sapiens; identical to SEQ ID NO: 45620

SEQ ID NO: 291615 - RNA, 64 nt, Homo Sapiens; identical to SEQ ID NO: 45621

SEQ ID NO: 291616 - RNA, 64 nt, Homo Sapiens; identical to SEQ ID NO: 45622

SEQ ID NO: 291617 - RNA, 64 nt, Homo Sapiens; identical to SEQ ID NO: 45623

SEQ ID NO: 291618 - RNA, 64 nt, Homo Sapiens; identical to SEQ ID NO: 45624

SEQ ID NO: 291619 - RNA, 64 nt, Homo Sapiens; identical to SEQ ID NO: 45625

SEQ ID NO: 291620 - RNA, 64 nt, Homo Sapiens; identical to SEQ ID NO: 45626

SEQ ID NO: 291621 - RNA, 64 nt, Homo Sapiens; identical to SEQ ID NO: 45627

SEQ ID NO: 291622 - RNA, 64 nt, Homo Sapiens; identical to SEQ ID NO: 45628

SEQ ID NO: 291623 - RNA, 64 nt, Homo Sapiens; identical to SEQ ID NO: 45629

SEQ ID NO: 291624 - RNA, 64 nt, Homo Sapiens; identical to SEQ ID NO: 45630

SEQ ID NO: 291625 - RNA, 64 nt, Homo Sapiens; identical to SEQ ID NO: 45631

SEQ ID NO: 291626 - RNA, 64 nt, Homo Sapiens; identical to SEQ ID NO: 45632

SEQ ID NO: 291627 - RNA, 64 nt, Homo Sapiens; identical to SEQ ID NO: 45633

SEQ ID NO: 291628 - RNA, 64 nt, Homo Sapiens; identical to SEQ ID NO: 45634

SEQ ID NO: 291629 - RNA, 64 nt, Homo Sapiens; identical to SEQ ID NO: 45635

SEQ ID NO: 291630 - RNA, 64 nt, Homo Sapiens; identical to SEQ ID NO: 45636

SEQ ID NO: 291631 - RNA, 64 nt, Homo Sapiens; identical to SEQ ID NO: 45637

SEQ ID NO: 291632 - RNA, 64 nt, Homo Sapiens; identical to SEQ ID NO: 45638

SEQ ID NO: 291633 - RNA, 64 nt, Homo Sapiens; identical to SEQ ID NO: 45639

SEQ ID NO: 291634 - RNA, 64 nt, Homo Sapiens; identical to SEQ ID NO: 45640

SEQ ID NO: 291635 - RNA, 64 nt, Homo Sapiens; identical to SEQ ID NO: 45641

SEQ ID NO: 291636 - RNA, 64 nt, Homo Sapiens; identical to SEQ ID NO: 45642

SEQ ID NO: 291637 - RNA, 64 nt, Homo Sapiens; identical to SEQ ID NO: 45643

SEQ ID NO: 291638 - RNA, 64 nt, Homo Sapiens; identical to SEQ ID NO: 45644

SEQ ID NO: 291639 - RNA, 64 nt, Homo Sapiens; identical to SEQ ID NO: 45645

SEQ ID NO: 291640 - RNA, 64 nt, Homo Sapiens; identical to SEQ ID NO: 45646

SEQ ID NO: 291641 - RNA, 64 nt, Homo Sapiens; identical to SEQ ID NO: 45647

SEQ ID NO: 291642 - RNA, 64 nt, Homo Sapiens; identical to SEQ ID NO: 45648

SEQ ID NO: 291643 - RNA, 64 nt, Homo Sapiens; identical to SEQ ID NO: 45649

SEQ ID NO: 291644 - RNA, 64 nt, Homo Sapiens; identical to SEQ ID NO: 45650

SEQ ID NO: 291645 - RNA, 64 nt, Homo Sapiens; identical to SEQ ID NO: 45651

SEQ ID NO: 291646 - RNA, 64 nt, Homo Sapiens; identical to SEQ ID NO: 45652

SEQ ID NO: 291647 - RNA, 64 nt, Homo Sapiens; identical to SEQ ID NO: 45653

SEQ ID NO: 291648 - RNA, 64 nt, Homo Sapiens; identical to SEQ ID NO: 45654

SEQ ID NO: 291649 - RNA, 64 nt, Homo Sapiens; identical to SEQ ID NO: 45655

SEQ ID NO: 291650 - RNA, 64 nt, Homo Sapiens; identical to SEQ ID NO: 97987

SEQ ID NO: 291651 - RNA, 64 nt, Homo Sapiens; identical to SEQ ID NO: 97988

SEQ ID NO: 291652 - RNA, 64 nt, Homo Sapiens; identical to SEQ ID NO: 97989

SEQ ID NO: 291653 - RNA, 64 nt, Homo Sapiens; identical to SEQ ID NO: 97990

SEQ ID NO: 291654 - RNA, 64 nt, Homo Sapiens; identical to SEQ ID NO: 97991

SEQ ID NO: 291655 - RNA, 64 nt, Homo Sapiens; identical to SEQ ID NO: 97992

SEQ ID NO: 291656 - RNA, 64 nt, Homo Sapiens; identical to SEQ ID NO: 97993

SEQ ID NO: 291657 - RNA, 64 nt, Homo Sapiens; identical to SEQ ID NO: 97994

SEQ ID NO: 291658 - RNA, 64 nt, Homo Sapiens; identical to SEQ ID NO: 97995

SEQ ID NO: 291659 - RNA, 64 nt, Homo Sapiens; identical to SEQ ID NO: 97996

SEQ ID NO: 291660 - RNA, 64 nt, Homo Sapiens; identical to SEQ ID NO: 97997

SEQ ID NO: 291661 - RNA, 64 nt, Homo Sapiens; identical to SEQ ID NO: 97998

SEQ ID NO: 291662 - RNA, 64 nt, Homo Sapiens; identical to SEQ ID NO: 97999

SEQ ID NO: 291663 - RNA, 64 nt, Homo Sapiens; identical to SEQ ID NO: 98000

SEQ ID NO: 291664 - RNA, 64 nt, Homo Sapiens; identical to SEQ ID NO: 98001

SEQ ID NO: 291665 - RNA, 64 nt, Homo Sapiens; identical to SEQ ID NO: 98002

SEQ ID NO: 291666 - RNA, 64 nt, Homo Sapiens; identical to SEQ ID NO: 98003

SEQ ID NO: 291667 - RNA, 64 nt, Homo Sapiens; identical to SEQ ID NO: 98004

SEQ ID NO: 291668 - RNA, 64 nt, Homo Sapiens; identical to SEQ ID NO: 98005

SEQ ID NO: 291669 - RNA, 64 nt, Homo Sapiens; identical to SEQ ID NO: 98006

SEQ ID NO: 291670 - RNA, 64 nt, Homo Sapiens; identical to SEQ ID NO: 98007

SEQ ID NO: 291671 - RNA, 64 nt, Homo Sapiens; identical to SEQ ID NO: 98008

SEQ ID NO: 291672 - RNA, 53 nt, Homo Sapiens; identical to SEQ ID NO: 98009

SEQ ID NO: 291673 - RNA, 64 nt, Homo Sapiens; identical to SEQ ID NO: 98010

SEQ ID NO: 291674 - RNA, 64 nt, Homo Sapiens; identical to SEQ ID NO: 125533

SEQ ID NO: 291675 - RNA, 64 nt, Homo Sapiens; identical to SEQ ID NO: 125534

SEQ ID NO: 291676 - RNA, 64 nt, Homo Sapiens; identical to SEQ ID NO: 125535

SEQ ID NO: 291677 - RNA, 64 nt, Homo Sapiens; identical to SEQ ID NO: 125536

SEQ ID NO: 291678 - RNA, 64 nt, Homo Sapiens; identical to SEQ ID NO: 125537

SEQ ID NO: 291679 - RNA, 64 nt, Homo Sapiens; identical to SEQ ID NO: 125538

SEQ ID NO: 291680 - RNA, 64 nt, Homo Sapiens; identical to SEQ ID NO: 125539

SEQ ID NO: 291681 - RNA, 64 nt, Homo Sapiens; identical to SEQ ID NO: 125540

SEQ ID NO: 291682 - RNA, 64 nt, Homo Sapiens; identical to SEQ ID NO: 125541

SEQ ID NO: 291683 - RNA, 64 nt, Homo Sapiens; identical to SEQ ID NO: 125542

SEQ ID NO: 291684 - RNA, 64 nt, Homo Sapiens; identical to SEQ ID NO: 125543

SEQ ID NO: 291685 - RNA, 64 nt, Homo Sapiens; identical to SEQ ID NO: 125544

SEQ ID NO: 291686 - RNA, 64 nt, Homo Sapiens; identical to SEQ ID NO: 125545

SEQ ID NO: 291687 - RNA, 64 nt, Homo Sapiens; identical to SEQ ID NO: 125546

SEQ ID NO: 291688 - RNA, 64 nt, Homo Sapiens; identical to SEQ ID NO: 125547

SEQ ID NO: 291689 - RNA, 64 nt, Homo Sapiens; identical to SEQ ID NO: 125548

SEQ ID NO: 291690 - RNA, 64 nt, Homo Sapiens; identical to SEQ ID NO: 125549

SEQ ID NO: 291691 - RNA, 64 nt, Homo Sapiens; identical to SEQ ID NO: 125550

SEQ ID NO: 291692 - RNA, 64 nt, Homo Sapiens; identical to SEQ ID NO: 125551

SEQ ID NO: 291693 - RNA, 64 nt, Homo Sapiens; identical to SEQ ID NO: 125552

SEQ ID NO: 291694 - RNA, 64 nt, Homo Sapiens; identical to SEQ ID NO: 125553

SEQ ID NO: 291695 - RNA, 64 nt, Homo Sapiens; identical to SEQ ID NO: 125554

SEQ ID NO: 291696 - RNA, 64 nt, Homo Sapiens; identical to SEQ ID NO: 125555

SEQ ID NO: 291697 - RNA, 64 nt, Homo Sapiens; identical to SEQ ID NO: 125556

SEQ ID NO: 291698 - RNA, 64 nt, Homo Sapiens; identical to SEQ ID NO: 125557

SEQ ID NO: 291699 - RNA, 64 nt, Homo Sapiens; identical to SEQ ID NO: 125558

SEQ ID NO: 291700 - RNA, 64 nt, Homo Sapiens; identical to SEQ ID NO: 125559

SEQ ID NO: 291701 - RNA, 64 nt, Homo Sapiens; identical to SEQ ID NO: 125560

SEQ ID NO: 291702 - RNA, 64 nt, Homo Sapiens; identical to SEQ ID NO: 125561

SEQ ID NO: 291703 - RNA, 64 nt, Homo Sapiens; identical to SEQ ID NO: 125562

SEQ ID NO: 291704 - RNA, 64 nt, Homo Sapiens; identical to SEQ ID NO: 125563

SEQ ID NO: 291705 - RNA, 64 nt, Homo Sapiens; identical to SEQ ID NO: 125564

SEQ ID NO: 291706 - RNA, 64 nt, Homo Sapiens; identical to SEQ ID NO: 125565

SEQ ID NO: 291707 - RNA, 64 nt, Homo Sapiens; identical to SEQ ID NO: 125566

SEQ ID NO: 291708 - RNA, 64 nt, Homo Sapiens; identical to SEQ ID NO: 125567

SEQ ID NO: 291709 - RNA, 64 nt, Homo Sapiens; identical to SEQ ID NO: 125568

SEQ ID NO: 291710 - RNA, 64 nt, Homo Sapiens
accugaaaaucagcaauuuccugacaacgaaagugaagaguaucacagguaagccuauggcaac

SEQ ID NO: 291711 - RNA, 64 nt, Homo Sapiens
accugaaagccagcaauuuccugacacugagaaugaagaguaucacagguaagccuauggcaac

SEQ ID NO: 291712 - RNA, 64 nt, Homo Sapiens
uugugauuucauugauuuuacuaacuggaaggaagaagaguaaaauuggcauauuuagguuuuu

SEQ ID NO: 291713 - RNA, 64 nt, Homo Sapiens
auuaggaguggauuggagaaauuggggggaaauagaagaguacggagaaaggaagagauugaaa

SEQ ID NO: 291714 - RNA, 64 nt, Homo Sapiens
aaaucuuucagaaaauauaagccuuuaauacgaggaagaguauucuuaagaugaacauuacaaa

SEQ ID NO: 291715 - RNA, 64 nt, Homo Sapiens
uuauaggugggcauuauuuaugccccuuucuguggaagaguaagaaaauuaaaauacaagaugc

SEQ ID NO: 291716 - RNA, 64 nt, Homo Sapiens
acacuuaucuucuuaaguaacauuauuuauaacugaagaguauaggguauuugaaagauagaag

SEQ ID NO: 291717 - RNA, 64 nt, Homo Sapiens
uuuaccuguaaauauuagcauucuccuuuauugugaagaguagucuaucagguuucauuacaua

SEQ ID NO: 291718 - RNA, 64 nt, Homo Sapiens
agggaaaauggacauauguucuacuucauguccagaagaguaagaugauucuuuuguuuuucuu

SEQ ID NO: 291719 - RNA, 64 nt, Homo Sapiens
gaugugaaaauugauacagguuucguugaauucugaagaguaauuuggaaccuggaugagaccu

SEQ ID NO: 291720 - RNA, 64 nt, Homo Sapiens
aauaaaaacuaccaaagugaaaaucaaugaacuugaagaguaagagauacagaaaaagaagaaa

SEQ ID NO: 291721 - RNA, 64 nt, Homo Sapiens
cucaauaauguaaagaauuucagagguucauacugaagaguaguacacuugagaauaauaccua

SEQ ID NO: 291722 - RNA, 64 nt, Homo Sapiens
ucaguauauuaugcagaagauccaagagagggaagaagaguaugugcuaaaauaacauuguaca

SEQ ID NO: 291723 - RNA, 64 nt, Homo Sapiens
ccugauauauuacaucaugaaaaccagauuaauagaagaguagguuuugggaugucuuaguuag

SEQ ID NO: 291724 - RNA, 64 nt, Homo Sapiens; identical to SEQ ID NO: 77858

SEQ ID NO: 291725 - RNA, 64 nt, Homo Sapiens; identical to SEQ ID NO: 77859

SEQ ID NO: 291726 - RNA, 64 nt, Homo Sapiens; identical to SEQ ID NO: 77860

SEQ ID NO: 291727 - RNA, 64 nt, Homo Sapiens; identical to SEQ ID NO: 77861

SEQ ID NO: 291728 - RNA, 64 nt, Homo Sapiens; identical to SEQ ID NO: 77862

SEQ ID NO: 291729 - RNA, 64 nt, Homo Sapiens; identical to SEQ ID NO: 77863

SEQ ID NO: 291730 - RNA, 64 nt, Homo Sapiens; identical to SEQ ID NO: 77864

SEQ ID NO: 291731 - RNA, 64 nt, Homo Sapiens; identical to SEQ ID NO: 77865

SEQ ID NO: 291732 - RNA, 64 nt, Homo Sapiens; identical to SEQ ID NO: 77866

SEQ ID NO: 291733 - RNA, 62 nt, Homo Sapiens; identical to SEQ ID NO: 77867

SEQ ID NO: 291734 - RNA, 64 nt, Homo Sapiens; identical to SEQ ID NO: 77868

SEQ ID NO: 291735 - RNA, 64 nt, Homo Sapiens; identical to SEQ ID NO: 77869

SEQ ID NO: 291736 - RNA, 64 nt, Homo Sapiens; identical to SEQ ID NO: 77870

SEQ ID NO: 291737 - RNA, 64 nt, Homo Sapiens; identical to SEQ ID NO: 77871

SEQ ID NO: 291738 - RNA, 64 nt, Homo Sapiens; identical to SEQ ID NO: 77872

SEQ ID NO: 291739 - RNA, 64 nt, Homo Sapiens; identical to SEQ ID NO: 77873

SEQ ID NO: 291740 - RNA, 64 nt, Homo Sapiens; identical to SEQ ID NO: 77874

SEQ ID NO: 291741 - RNA, 64 nt, Homo Sapiens; identical to SEQ ID NO: 77875

SEQ ID NO: 291742 - RNA, 64 nt, Homo Sapiens; identical to SEQ ID NO: 77876

SEQ ID NO: 291743 - RNA, 64 nt, Homo Sapiens; identical to SEQ ID NO: 102479

SEQ ID NO: 291744 - RNA, 64 nt, Homo Sapiens; identical to SEQ ID NO: 102480

SEQ ID NO: 291745 - RNA, 64 nt, Homo Sapiens; identical to SEQ ID NO: 102481

SEQ ID NO: 291746 - RNA, 64 nt, Homo Sapiens; identical to SEQ ID NO: 102482

SEQ ID NO: 291747 - RNA, 64 nt, Homo Sapiens; identical to SEQ ID NO: 102483

SEQ ID NO: 291748 - RNA, 64 nt, Homo Sapiens; identical to SEQ ID NO: 102484

SEQ ID NO: 291749 - RNA, 64 nt, Homo Sapiens; identical to SEQ ID NO: 102485

SEQ ID NO: 291750 - RNA, 64 nt, Homo Sapiens; identical to SEQ ID NO: 102486

SEQ ID NO: 291751 - RNA, 64 nt, Homo Sapiens; identical to SEQ ID NO: 102487

SEQ ID NO: 291752 - RNA, 64 nt, Homo Sapiens; identical to SEQ ID NO: 102488

SEQ ID NO: 291753 - RNA, 64 nt, Homo Sapiens; identical to SEQ ID NO: 102489

SEQ ID NO: 291754 - RNA, 64 nt, Homo Sapiens; identical to SEQ ID NO: 102490

SEQ ID NO: 291755 - RNA, 64 nt, Homo Sapiens; identical to SEQ ID NO: 102491

SEQ ID NO: 291756 - RNA, 64 nt, Homo Sapiens; identical to SEQ ID NO: 102492

SEQ ID NO: 291757 - RNA, 64 nt, Homo Sapiens; identical to SEQ ID NO: 102493

SEQ ID NO: 291758 - RNA, 64 nt, Homo Sapiens; identical to SEQ ID NO: 102494

SEQ ID NO: 291759 - RNA, 64 nt, Homo Sapiens; identical to SEQ ID NO: 102495

SEQ ID NO: 291760 - RNA, 64 nt, Homo Sapiens; identical to SEQ ID NO: 102496

SEQ ID NO: 291761 - RNA, 64 nt, Homo Sapiens; identical to SEQ ID NO: 102497

SEQ ID NO: 291762 - RNA, 64 nt, Homo Sapiens; identical to SEQ ID NO: 102498

SEQ ID NO: 291763 - RNA, 64 nt, Homo Sapiens; identical to SEQ ID NO: 102499

SEQ ID NO: 291764 - RNA, 64 nt, Homo Sapiens; identical to SEQ ID NO: 102500

SEQ ID NO: 291765 - RNA, 64 nt, Homo Sapiens; identical to SEQ ID NO: 102501

SEQ ID NO: 291766 - RNA, 64 nt, Homo Sapiens; identical to SEQ ID NO: 102502

SEQ ID NO: 291767 - RNA, 64 nt, Homo Sapiens; identical to SEQ ID NO: 102503

SEQ ID NO: 291768 - RNA, 64 nt, Homo Sapiens; identical to SEQ ID NO: 102504

SEQ ID NO: 291769 - RNA, 64 nt, Homo Sapiens; identical to SEQ ID NO: 102505

SEQ ID NO: 291770 - RNA, 64 nt, Homo Sapiens; identical to SEQ ID NO: 102506

SEQ ID NO: 291771 - RNA, 64 nt, Homo Sapiens; identical to SEQ ID NO: 102507

SEQ ID NO: 291772 - RNA, 64 nt, Homo Sapiens; identical to SEQ ID NO: 102508

SEQ ID NO: 291773 - RNA, 64 nt, Homo Sapiens; identical to SEQ ID NO: 102509

SEQ ID NO: 291774 - RNA, 64 nt, Homo Sapiens; identical to SEQ ID NO: 102510

SEQ ID NO: 291775 - RNA, 64 nt, Homo Sapiens; identical to SEQ ID NO: 102511

SEQ ID NO: 291776 - RNA, 64 nt, Homo Sapiens; identical to SEQ ID NO: 102512

SEQ ID NO: 291777 - RNA, 64 nt, Homo Sapiens; identical to SEQ ID NO: 102513

SEQ ID NO: 291778 - RNA, 64 nt, Homo Sapiens; identical to SEQ ID NO: 102514

SEQ ID NO: 291779 - RNA, 64 nt, Homo Sapiens; identical to SEQ ID NO: 102515

SEQ ID NO: 291780 - RNA, 64 nt, Homo Sapiens; identical to SEQ ID NO: 102516

SEQ ID NO: 291781 - RNA, 64 nt, Homo Sapiens; identical to SEQ ID NO: 102517

SEQ ID NO: 291782 - RNA, 64 nt, Homo Sapiens; identical to SEQ ID NO: 102518

SEQ ID NO: 291783 - RNA, 64 nt, Homo Sapiens; identical to SEQ ID NO: 102519

SEQ ID NO: 291784 - RNA, 64 nt, Homo Sapiens; identical to SEQ ID NO: 102520

SEQ ID NO: 291785 - RNA, 64 nt, Homo Sapiens; identical to SEQ ID NO: 102521

SEQ ID NO: 291786 - RNA, 64 nt, Homo Sapiens; identical to SEQ ID NO: 102522

SEQ ID NO: 291787 - RNA, 64 nt, Homo Sapiens; identical to SEQ ID NO: 102523

SEQ ID NO: 291788 - RNA, 64 nt, Homo Sapiens; identical to SEQ ID NO: 102524

SEQ ID NO: 291789 - RNA, 64 nt, Homo Sapiens; identical to SEQ ID NO: 102525

SEQ ID NO: 291790 - RNA, 64 nt, Homo Sapiens; identical to SEQ ID NO: 102526

SEQ ID NO: 291791 - RNA, 64 nt, Homo Sapiens; identical to SEQ ID NO: 102527

SEQ ID NO: 291792 - RNA, 64 nt, Homo Sapiens; identical to SEQ ID NO: 102528

SEQ ID NO: 291793 - RNA, 64 nt, Homo Sapiens; identical to SEQ ID NO: 102529

SEQ ID NO: 291794 - RNA, 64 nt, Homo Sapiens; identical to SEQ ID NO: 102530

SEQ ID NO: 291795 - RNA, 64 nt, Homo Sapiens; identical to SEQ ID NO: 102531

SEQ ID NO: 291796 - RNA, 64 nt, Homo Sapiens; identical to SEQ ID NO: 102532

SEQ ID NO: 291797 - RNA, 64 nt, Homo Sapiens; identical to SEQ ID NO: 102533

SEQ ID NO: 291798 - RNA, 64 nt, Homo Sapiens; identical to SEQ ID NO: 102534

SEQ ID NO: 291799 - RNA, 64 nt, Homo Sapiens; identical to SEQ ID NO: 102535

SEQ ID NO: 291800 - RNA, 64 nt, Homo Sapiens; identical to SEQ ID NO: 102536

SEQ ID NO: 291801 - RNA, 64 nt, Homo Sapiens; identical to SEQ ID NO: 102537

SEQ ID NO: 291802 - RNA, 64 nt, Homo Sapiens; identical to SEQ ID NO: 102538

SEQ ID NO: 291803 - RNA, 64 nt, Homo Sapiens; identical to SEQ ID NO: 102539

SEQ ID NO: 291804 - RNA, 64 nt, Homo Sapiens; identical to SEQ ID NO: 102540

SEQ ID NO: 291805 - RNA, 64 nt, Homo Sapiens; identical to SEQ ID NO: 102541

SEQ ID NO: 291806 - RNA, 64 nt, Homo Sapiens; identical to SEQ ID NO: 102542

SEQ ID NO: 291807 - RNA, 64 nt, Homo Sapiens; identical to SEQ ID NO: 102543

SEQ ID NO: 291808 - RNA, 64 nt, Homo Sapiens; identical to SEQ ID NO: 102544

SEQ ID NO: 291809 - RNA, 64 nt, Homo Sapiens; identical to SEQ ID NO: 102545

SEQ ID NO: 291810 - RNA, 64 nt, Homo Sapiens; identical to SEQ ID NO: 102546

SEQ ID NO: 291811 - RNA, 64 nt, Homo Sapiens; identical to SEQ ID NO: 102547

SEQ ID NO: 291812 - RNA, 64 nt, Homo Sapiens; identical to SEQ ID NO: 102548

SEQ ID NO: 291813 - RNA, 64 nt, Homo Sapiens; identical to SEQ ID NO: 102549

SEQ ID NO: 291814 - RNA, 64 nt, Homo Sapiens; identical to SEQ ID NO: 102550

SEQ ID NO: 291815 - RNA, 64 nt, Homo Sapiens; identical to SEQ ID NO: 102551

SEQ ID NO: 291816 - RNA, 64 nt, Homo Sapiens; identical to SEQ ID NO: 102552

SEQ ID NO: 291817 - RNA, 64 nt, Homo Sapiens; identical to SEQ ID NO: 102553

SEQ ID NO: 291818 - RNA, 64 nt, Homo Sapiens; identical to SEQ ID NO: 102554

SEQ ID NO: 291819 - RNA, 64 nt, Homo Sapiens; identical to SEQ ID NO: 102555

SEQ ID NO: 291820 - RNA, 64 nt, Homo Sapiens; identical to SEQ ID NO: 102556

SEQ ID NO: 291821 - RNA, 64 nt, Homo Sapiens; identical to SEQ ID NO: 102557

SEQ ID NO: 291822 - RNA, 64 nt, Homo Sapiens; identical to SEQ ID NO: 102558

SEQ ID NO: 291823 - RNA, 64 nt, Homo Sapiens; identical to SEQ ID NO: 102559

SEQ ID NO: 291824 - RNA, 64 nt, Homo Sapiens; identical to SEQ ID NO: 102560

SEQ ID NO: 291825 - RNA, 64 nt, Homo Sapiens; identical to SEQ ID NO: 102561

SEQ ID NO: 291826 - RNA, 64 nt, Homo Sapiens; identical to SEQ ID NO: 102562

SEQ ID NO: 291827 - RNA, 64 nt, Homo Sapiens; identical to SEQ ID NO: 102563

SEQ ID NO: 291828 - RNA, 64 nt, Homo Sapiens; identical to SEQ ID NO: 102564

SEQ ID NO: 291829 - RNA, 64 nt, Homo Sapiens; identical to SEQ ID NO: 102565

SEQ ID NO: 291830 - RNA, 64 nt, Homo Sapiens; identical to SEQ ID NO: 102566

SEQ ID NO: 291831 - RNA, 64 nt, Homo Sapiens; identical to SEQ ID NO: 102567

SEQ ID NO: 291832 - RNA, 64 nt, Homo Sapiens; identical to SEQ ID NO: 102568

SEQ ID NO: 291833 - RNA, 64 nt, Homo Sapiens; identical to SEQ ID NO: 102569

SEQ ID NO: 291834 - RNA, 64 nt, Homo Sapiens; identical to SEQ ID NO: 102570

SEQ ID NO: 291835 - RNA, 64 nt, Homo Sapiens; identical to SEQ ID NO: 102571

SEQ ID NO: 291836 - RNA, 64 nt, Homo Sapiens; identical to SEQ ID NO: 102572

SEQ ID NO: 291837 - RNA, 64 nt, Homo Sapiens; identical to SEQ ID NO: 102573

SEQ ID NO: 291838 - RNA, 64 nt, Homo Sapiens; identical to SEQ ID NO: 102574

SEQ ID NO: 291839 - RNA, 64 nt, Homo Sapiens; identical to SEQ ID NO: 102575

SEQ ID NO: 291840 - RNA, 64 nt, Homo Sapiens; identical to SEQ ID NO: 102576

SEQ ID NO: 291841 - RNA, 64 nt, Homo Sapiens; identical to SEQ ID NO: 102577

SEQ ID NO: 291842 - RNA, 64 nt, Homo Sapiens; identical to SEQ ID NO: 102578

SEQ ID NO: 291843 - RNA, 64 nt, Homo Sapiens; identical to SEQ ID NO: 102579

SEQ ID NO: 291844 - RNA, 64 nt, Homo Sapiens; identical to SEQ ID NO: 102580

SEQ ID NO: 291845 - RNA, 64 nt, Homo Sapiens; identical to SEQ ID NO: 102581

SEQ ID NO: 291846 - RNA, 64 nt, Homo Sapiens; identical to SEQ ID NO: 102582

SEQ ID NO: 291847 - RNA, 64 nt, Homo Sapiens; identical to SEQ ID NO: 102583

SEQ ID NO: 291848 - RNA, 62 nt, Homo Sapiens; identical to SEQ ID NO: 102584

SEQ ID NO: 291849 - RNA, 64 nt, Homo Sapiens; identical to SEQ ID NO: 102585

SEQ ID NO: 291850 - RNA, 64 nt, Homo Sapiens; identical to SEQ ID NO: 102586

SEQ ID NO: 291851 - RNA, 64 nt, Homo Sapiens; identical to SEQ ID NO: 102587

SEQ ID NO: 291852 - RNA, 64 nt, Homo Sapiens; identical to SEQ ID NO: 102588

SEQ ID NO: 291853 - RNA, 64 nt, Homo Sapiens; identical to SEQ ID NO: 102589

SEQ ID NO: 291854 - RNA, 64 nt, Homo Sapiens; identical to SEQ ID NO: 102590

SEQ ID NO: 291855 - RNA, 64 nt, Homo Sapiens; identical to SEQ ID NO: 102591

SEQ ID NO: 291856 - RNA, 64 nt, Homo Sapiens; identical to SEQ ID NO: 102592

SEQ ID NO: 291857 - RNA, 64 nt, Homo Sapiens; identical to SEQ ID NO: 102593

SEQ ID NO: 291858 - RNA, 64 nt, Homo Sapiens; identical to SEQ ID NO: 102594

SEQ ID NO: 291859 - RNA, 64 nt, Homo Sapiens; identical to SEQ ID NO: 102595

SEQ ID NO: 291860 - RNA, 64 nt, Homo Sapiens; identical to SEQ ID NO: 102596

SEQ ID NO: 291861 - RNA, 64 nt, Homo Sapiens; identical to SEQ ID NO: 102597

SEQ ID NO: 291862 - RNA, 64 nt, Homo Sapiens; identical to SEQ ID NO: 102598

SEQ ID NO: 291863 - RNA, 64 nt, Homo Sapiens; identical to SEQ ID NO: 102599

SEQ ID NO: 291864 - RNA, 64 nt, Homo Sapiens; identical to SEQ ID NO: 102600

SEQ ID NO: 291865 - RNA, 64 nt, Homo Sapiens; identical to SEQ ID NO: 102601

SEQ ID NO: 291866 - RNA, 64 nt, Homo Sapiens; identical to SEQ ID NO: 102602

SEQ ID NO: 291867 - RNA, 64 nt, Homo Sapiens; identical to SEQ ID NO: 102603

SEQ ID NO: 291868 - RNA, 64 nt, Homo Sapiens; identical to SEQ ID NO: 102604

SEQ ID NO: 291869 - RNA, 64 nt, Homo Sapiens; identical to SEQ ID NO: 102605

SEQ ID NO: 291870 - RNA, 64 nt, Homo Sapiens; identical to SEQ ID NO: 102606

SEQ ID NO: 291871 - RNA, 64 nt, Homo Sapiens; identical to SEQ ID NO: 102607

SEQ ID NO: 291872 - RNA, 64 nt, Homo Sapiens; identical to SEQ ID NO: 102608

SEQ ID NO: 291873 - RNA, 64 nt, Homo Sapiens; identical to SEQ ID NO: 102609

SEQ ID NO: 291874 - RNA, 64 nt, Homo Sapiens; identical to SEQ ID NO: 102610

SEQ ID NO: 291875 - RNA, 64 nt, Homo Sapiens; identical to SEQ ID NO: 102611

SEQ ID NO: 291876 - RNA, 64 nt, Homo Sapiens; identical to SEQ ID NO: 102612

SEQ ID NO: 291877 - RNA, 64 nt, Homo Sapiens; identical to SEQ ID NO: 102613

SEQ ID NO: 291878 - RNA, 64 nt, Homo Sapiens; identical to SEQ ID NO: 102614

SEQ ID NO: 291879 - RNA, 64 nt, Homo Sapiens; identical to SEQ ID NO: 102615

SEQ ID NO: 291880 - RNA, 64 nt, Homo Sapiens; identical to SEQ ID NO: 102616

SEQ ID NO: 291881 - RNA, 64 nt, Homo Sapiens; identical to SEQ ID NO: 102617

SEQ ID NO: 291882 - RNA, 64 nt, Homo Sapiens; identical to SEQ ID NO: 102618

SEQ ID NO: 291883 - RNA, 64 nt, Homo Sapiens; identical to SEQ ID NO: 102619

SEQ ID NO: 291884 - RNA, 64 nt, Homo Sapiens; identical to SEQ ID NO: 102620

SEQ ID NO: 291885 - RNA, 64 nt, Homo Sapiens; identical to SEQ ID NO: 102621

SEQ ID NO: 291886 - RNA, 64 nt, Homo Sapiens; identical to SEQ ID NO: 102622

SEQ ID NO: 291887 - RNA, 64 nt, Homo Sapiens; identical to SEQ ID NO: 102623

SEQ ID NO: 291888 - RNA, 64 nt, Homo Sapiens; identical to SEQ ID NO: 102624

SEQ ID NO: 291889 - RNA, 64 nt, Homo Sapiens; identical to SEQ ID NO: 102625

SEQ ID NO: 291890 - RNA, 64 nt, Homo Sapiens; identical to SEQ ID NO: 102626

SEQ ID NO: 291891 - RNA, 64 nt, Homo Sapiens; identical to SEQ ID NO: 102627

SEQ ID NO: 291892 - RNA, 64 nt, Homo Sapiens; identical to SEQ ID NO: 102628

SEQ ID NO: 291893 - RNA, 64 nt, Homo Sapiens
cgcccggcuaauguuuguauuuuuaguagagacgggguuucaccauguuggucaggcuggucuc

SEQ ID NO: 291894 - RNA, 64 nt, Homo Sapiens
gggccagcuaauuuuuguauguuuaguagaaacgggguuucaccauguuggccaggcuguucuc

SEQ ID NO: 291895 - RNA, 64 nt, Homo Sapiens
aucuggcuaauuuuuuguauuuuuaguaaagaugggguuucaccauguuggccaggcugaucuc

SEQ ID NO: 291896 - RNA, 64 nt, Homo Sapiens
cacacccagcuaauuuuugcauuuuuacuugacaggguuucaccauguuggcuaggauaguuuc

SEQ ID NO: 291897 - RNA, 64 nt, Homo Sapiens
ugcccagcuaauuuuugcauuuuuaguagagaugggguuucaccauguuggccaggauggucuu

SEQ ID NO: 291898 - RNA, 64 nt, Homo Sapiens
cgcccggcuaauuuuuguguuuuuagcagagacaggguuucaccacguuggccaggguggucuu

SEQ ID NO: 291899 - RNA, 64 nt, Homo Sapiens
auguugccuaggcuguucuuuuuugguagagacgggguuucaucuuguuguuguuguuuuguau

SEQ ID NO: 291900 - RNA, 64 nt, Homo Sapiens
caucauggaugccaugggacgggucaccuggcgaggguuucacucuuccuuccuccgcugggcu

SEQ ID NO: 291901 - RNA, 64 nt, Homo Sapiens
auguuggccaggcugcucuuuuuuaguagagacaggguuucacccgcccaacuaauuuuuguau

SEQ ID NO: 291902 - RNA, 64 nt, Homo Sapiens
auguuggccaggcuggucucuuuuaguagagacgggguuucacccgcccggcuaauuuuuguau

SEQ ID NO: 291903 - RNA, 64 nt, Homo Sapiens
cccugcaugugggcagguguggccauuaaggaguggguuucacuuucugugguauaugugggag

SEQ ID NO: 291904 - RNA, 64 nt, Homo Sapiens
auguuggccaggcuggucucuuuuaguagagacgggguuucacccaccaggcuaauuuuuguau

SEQ ID NO: 291905 - RNA, 64 nt, Homo Sapiens
gccuggcuaauuuuuuauauuuuuaguagagacaggguuucaccauguuaaccaggauggucuc

SEQ ID NO: 291906 - RNA, 64 nt, Homo Sapiens
ccacccagcuaaguuuguauuuuuguuggagacgggguuucaccauauuggccagacuggucuc

SEQ ID NO: 291907 - RNA, 64 nt, Homo Sapiens
cgcccagcuaauuuuuguauuuuuaguagaaaugggguuucaccauguguggccaggcuggucu

SEQ ID NO: 291908 - RNA, 64 nt, Homo Sapiens
agaguccuaggaugaggcuugggcagugcugguaggguuucaaggugcuauuaguggggcaggg

SEQ ID NO: 291909 - RNA, 64 nt, Homo Sapiens
ggggagcuggcaaugaaacccuguccugggacauggguuucauguucuuguacacuuccccucu

SEQ ID NO: 291910 - RNA, 64 nt, Homo Sapiens
ugccaggcuaauuuuuguauuuuuaguaaagacaggguuucaccauauuggccaggcuggucuc

SEQ ID NO: 291911 - RNA, 64 nt, Homo Sapiens
cgcccagcuaauuuuuguauuuuucguagagacgggguuucaccacauucgucagguugguuuc

SEQ ID NO: 291912 - RNA, 64 nt, Homo Sapiens
cgcccagcuaauuuuuguauuuuuaguagagaugggguuucaucauguuggccagguuggucuc

SEQ ID NO: 291913 - RNA, 64 nt, Homo Sapiens
cccgccuaauuuuuuuguauuuuuaguagagaugggguuucaccguguuagucaggauggucuc

SEQ ID NO: 291914 - RNA, 64 nt, Homo Sapiens
agguaagcgguguugaacuuuggaaacgcuuguaggguuucaccuauucagagcgcguauggag

SEQ ID NO: 291915 - RNA, 64 nt, Homo Sapiens; identical to SEQ ID NO: 291914

SEQ ID NO: 291916 - RNA, 64 nt, Homo Sapiens
auguugaccaggcugauuuuuuuuaguagagaugggguuucacccgcccagcuaauuuuuguau

SEQ ID NO: 291917 - RNA, 64 nt, Homo Sapiens
auguugcucaggcuggucuuuuuuagucgagacgggguuucacccccagcuaauuuuguuuuuu

SEQ ID NO: 291918 - RNA, 64 nt, Homo Sapiens
guguuagccaggauggucucuuuuaguagagacgggguuucaccgcccggcuaacuuuuugugu

SEQ ID NO: 291919 - RNA, 64 nt, Homo Sapiens
guguuagccaggauggucucuuuuaguagagacgggguuucaccccuggcuaauauuuuguauu

SEQ ID NO: 291920 - RNA, 64 nt, Homo Sapiens
auguuggccaggcuggucuuuuuuaguagagacgggguuucacccacccagugaauuuuuguau

SEQ ID NO: 291921 - RNA, 64 nt, Homo Sapiens
cuauuggucaggcuggucuuuuuuaguagagaugggguuucacccgucuggcuaauuuuuguau

SEQ ID NO: 291922 - RNA, 64 nt, Homo Sapiens
agcuuuguacagucucgauggucuaccuuaaaaaggguuucaaguuuaaccuucauguagcuaa

SEQ ID NO: 291923 - RNA, 64 nt, Homo Sapiens
aaauaaaugaauuuucauauacgcuuuaaugucaggguuucacucgaaucugcuuuguguuggg

SEQ ID NO: 291924 - RNA, 64 nt, Homo Sapiens
auguuggccagggcuggucuuaguagagacgacaggguuucacccucccggcugauuuuuguau

SEQ ID NO: 291925 - RNA, 64 nt, Homo Sapiens
guguuggccaggcuggucuuuuuuaguagagaugggguuucacucacccagcuaauuuuuguau

SEQ ID NO: 291926 - RNA, 64 nt, Homo Sapiens
auguuggccaggugggucucuuuuaguagagacaggguuucauccgcccggcuaauuuuuguau

SEQ ID NO: 291927 - RNA, 64 nt, Homo Sapiens
auguuagccaggauggucucgcacaguagagacgggguuucaccacagagcuugauccagaagu

SEQ ID NO: 291928 - RNA, 64 nt, Homo Sapiens
acuuguugaaagugcagaaaagaaaacaggcucaggguuucaugcugguccccauuuauuggug

SEQ ID NO: 291929 - RNA, 55 nt, Homo Sapiens
auguuggcuaggcugaucucagauaggguuucacucuuuuuguuuuuuuaaguag

SEQ ID NO: 291930 - RNA, 64 nt, Homo Sapiens
aaaauaagguaaggauuucauaaucagguugucuggguuucagagcuguuuuuaauugacugag

SEQ ID NO: 291931 - RNA, 64 nt, Homo Sapiens
gccuggcugauuuuuuguauuuuuaguagagacaggguuucaccauguuggccaggcuggucuc

SEQ ID NO: 291932 - RNA, 64 nt, Homo Sapiens
cacaaggcuaaguuuuguauuuuuuguagagacaggguuucaacauauuauccaggcugguguc

SEQ ID NO: 291933 - RNA, 64 nt, Homo Sapiens
acucagcuaauuuuuuguauuuuuaguagagccgggguuucaccaucuuggccaggcugaucuu

SEQ ID NO: 291934 - RNA, 64 nt, Homo Sapiens
auguuggccaggcuggucucuuuuaguagagaugggguuucaccaugccuggcuaauuuuguau

SEQ ID NO: 291935 - RNA, 64 nt, Homo Sapiens
uauugucagugaaucauaugggugaaaucucgauggguuucagacacaaacuaccaaguauacu

SEQ ID NO: 291936 - RNA, 64 nt, Homo Sapiens
ugcccggcuacuuuuuguauuuuuaguagagacaggguuucaucauguuggccaggcuagucuc

SEQ ID NO: 291937 - RNA, 64 nt, Homo Sapiens
gccaaccuaauuuuuguauuauuuaguagagacaggguuucaccacauuggccaggcuggucuc

SEQ ID NO: 291938 - RNA, 64 nt, Homo Sapiens
guguuggccaggauggucucuuuuaguagagaugggguuucaccgcccgggcaaauuuuuguau

SEQ ID NO: 291939 - RNA, 64 nt, Homo Sapiens
auguuauccaggaugguuuuuuuuaguagagaugggguuucacccccagcuaauuuuuuuguau

SEQ ID NO: 291940 - RNA, 64 nt, Homo Sapiens
auguuggccaggcuggucucuuuuaguagagacaggguuucacccgcccagcuaauuccuguau

SEQ ID NO: 291941 - RNA, 64 nt, Homo Sapiens
guguuagucaggauggucucuuuuaguagagacgggguuucacccccgccuaauuuuuuguauu

SEQ ID NO: 291942 - RNA, 64 nt, Homo Sapiens
guguuagccaggauggucucuuuuaguagagacaggguuucaccccuggcuaauuuuuuuugau

SEQ ID NO: 291943 - RNA, 64 nt, Homo Sapiens
ugccuggcuaauuuuugcauuuuuaguagagacaggguuucaccauauuggccaggcugggacu

SEQ ID NO: 291944 - RNA, 64 nt, Homo Sapiens
ggcuaauuuuguuuuuguauuuuuaguagagacgggguuucaccguguuagccaggaaggucuc

SEQ ID NO: 291945 - RNA, 64 nt, Homo Sapiens
ccugccccccacaaauuauggcacuucugaacuuggguuucaugguaaucaccucaguacuuaa

SEQ ID NO: 291946 - RNA, 64 nt, Homo Sapiens
acuagaaacuguucuuaauuugauuugcguggagggguuucaaguggagccaaagguuagcagg

SEQ ID NO: 291947 - RNA, 64 nt, Homo Sapiens
cgccuggcugauuuuuguaguuuuaguggagaugggguuucaccauguuggccaggcuugucuc

SEQ ID NO: 291948 - RNA, 64 nt, Homo Sapiens
acgccuggcuaauuuuuguauuuuuaguagagacggguuucaccauguuggcuagacuagucuc

SEQ ID NO: 291949 - RNA, 64 nt, Homo Sapiens
ugcagcagagcagcucccuuggggcucugggucgggguuucauacuacacaucgcaugaguaga

SEQ ID NO: 291950 - RNA, 64 nt, Homo Sapiens
ucaaagagagggucaguggaguggaggcaauuggggguuucaggauuugaguuuuguuuugccu

SEQ ID NO: 291951 - RNA, 64 nt, Homo Sapiens
cacccagcuaauuuuuguauuuuuaguagagaugggguuucaccauauuggccaggcuggucuc

SEQ ID NO: 291952 - RNA, 64 nt, Homo Sapiens
auacaucugucauuuucauuucacaggguucacaggguuucacagucugaugagacugugccug

SEQ ID NO: 291953 - RNA, 64 nt, Homo Sapiens
cacccaacuaauuuuuguauuuuuaguagagaugggguuucaccauguuggccaggauugucuc

SEQ ID NO: 291954 - RNA, 64 nt, Homo Sapiens
auuacaggcaugagccaccacacccagcgagacgggguuucauuauguuggccaggcuggucuc

SEQ ID NO: 291955 - RNA, 64 nt, Homo Sapiens
agcuaauuuuuuguauuuuuuuuuaguagagaugggguuucaccacguuagccaggauggucuc

SEQ ID NO: 291956 - RNA, 64 nt, Homo Sapiens
acccggcuaauuuuuguauuuuuaguagagacagggguuucaccauauuggccaggcuggucuc

SEQ ID NO: 291957 - RNA, 64 nt, Homo Sapiens
cgccuggcuaauuuuuguauuuuuaguagagacgggguuucaccaucuuggccagguuggucuu

SEQ ID NO: 291958 - RNA, 64 nt, Homo Sapiens
acacccagcuaauuuuguauuuuuaguagagacgggguuucaccauguugcucaggcuggucuc

SEQ ID NO: 291959 - RNA, 64 nt, Homo Sapiens
auguugaccaggauggucucuuuuaguagagaugggguuucaccccagcuaaauuuuuuuguau

SEQ ID NO: 291960 - RNA, 64 nt, Homo Sapiens
guguuagccaggauagucuuuuuuaguggagacgggguuucaccgcccggcucauuuuuuguau

SEQ ID NO: 291961 - RNA, 64 nt, Homo Sapiens
auguuggccaggcuggucuuuuuuaguagagacgggguuucacccgcccaacuaauuuuuauau

SEQ ID NO: 291962 - RNA, 64 nt, Homo Sapiens
guguuaaccaggauggucucuuuuaguagagacgggguuucaucccggcuaauuuuuuuuguau

SEQ ID NO: 291963 - RNA, 64 nt, Homo Sapiens
auguuggccaggauggucucuuuuaguagagacaggguuucaccugccuggcuaauuuuuguau

SEQ ID NO: 291964 - RNA, 64 nt, Homo Sapiens
cccagauuauuuuuuuguauuuguaguagagacgggguuucaccaugucagucaggcuggucuu

SEQ ID NO: 291965 - RNA, 64 nt, Homo Sapiens
cgcccggcuaauuuuuguauuuuuaguagagacaggguuucaccauauuagccaggugggucuu

SEQ ID NO: 291966 - RNA, 64 nt, Homo Sapiens
acaaacuaccaaggaauugcugacuucuccaguaggguuucaggucucaguaggugccucaugc

SEQ ID NO: 291967 - RNA, 64 nt, Homo Sapiens
uuggaugaccucuagagaaacuuggagacacagaggguuucaccuuuggagaauggggaggccu

SEQ ID NO: 291968 - RNA, 64 nt, Homo Sapiens
gcuguugggaaccaggaagggucagggaaguaggggguuucaauuuuuaaaaaaugccagucug

SEQ ID NO: 291969 - RNA, 64 nt, Homo Sapiens
uuguucagucggcauuugcguccucgaguccuuuggguuucagauccucagcagaacaugucuc

SEQ ID NO: 291970 - RNA, 64 nt, Homo Sapiens
gugggcaggggguuaguuugcgggggacaucucgggguuucaggaagguggcuggacugcuggg

SEQ ID NO: 291971 - RNA, 64 nt, Homo Sapiens
gacugggggaccccuuccuccuggaggaagguggggguuucaaaacccuggcuccguggaccuu

SEQ ID NO: 291972 - RNA, 64 nt, Homo Sapiens
auauuggucaggcuggucuuuuuuaguagagacaggguuucacccaccuggcuaauuuuuguau

SEQ ID NO: 291973 - RNA, 64 nt, Homo Sapiens
auauuggucaggcuggucuuuuuuaguagagacaggguuucacccgcccggcuaauuuuuguau

SEQ ID NO: 291974 - RNA, 64 nt, Homo Sapiens
gguagcaccuguaacccuguuuccaugcucuggggaauccaaguuguucaaccugggaucagac

SEQ ID NO: 291975 - RNA, 64 nt, Homo Sapiens
gguugugaucuaaagaaucauuaagaaggaaagcgaauccaaacccaaaaugguacaccgauau

SEQ ID NO: 291976 - RNA, 64 nt, Homo Sapiens
cuauuuuuauuuuauacaguuagaguacuuuucugaauccaaucccaauuggaaauuagaacag

SEQ ID NO: 291977 - RNA, 64 nt, Homo Sapiens
auacacgggauuaauaguauuuuaaaauuagauggaauccaaagucccugaacuacugucuaua

SEQ ID NO: 291978 - RNA, 64 nt, Homo Sapiens
uccccauugcacagauggggaguuugagacuauggaauccaacccucuauugagcagagccugg

SEQ ID NO: 291979 - RNA, 64 nt, Homo Sapiens
cuugugucugccccuauguggcagauguggauuugaauccaagcucuguuuugcacccagcuug

SEQ ID NO: 291980 - RNA, 64 nt, Homo Sapiens
uucaugugguaggacagagagagaacagaaggccgaauccaaguaaguuucauguaguaggaca

SEQ ID NO: 291981 - RNA, 64 nt, Homo Sapiens
uucauguaguaggacagagacuuuagugaaggcugaauccaaguuauauguauguuucuaaaag

SEQ ID NO: 291982 - RNA, 64 nt, Homo Sapiens
gccuagugccaguuugguagucccccuuucuggccccuuggagcccacacacguuucaucuuuu

SEQ ID NO: 291983 - RNA, 64 nt, Homo Sapiens
ugccuuaaauuggcaggugguaccguacucacugcccuuggagcugugaccggcuccugccugu

SEQ ID NO: 291984 - RNA, 64 nt, Homo Sapiens
cauuuauuauucacagauggauggugacucucugcccuuggacccaaacauuuuaucauucuaa

SEQ ID NO: 291985 - RNA, 64 nt, Homo Sapiens
cucacaagguuuacuuugguugucuucccgguaucccuuggaguuuuggucuccuuuccccucc

SEQ ID NO: 291986 - RNA, 64 nt, Homo Sapiens
caccuaauccacagaaaguaaugucuuuccccuccccuuggaauuuuuguuuuguuuuuggaaa

SEQ ID NO: 291987 - RNA, 64 nt, Homo Sapiens
caggccccguccugccgugacacccuucauccuacccuuggaaccccaaggccaaguugguuca

SEQ ID NO: 291988 - RNA, 64 nt, Homo Sapiens
ggaaccgacugaguaaugaagaagaggaaggaagcccuuggaaggaacguaaaauccauuucag

SEQ ID NO: 291989 - RNA, 64 nt, Homo Sapiens
uggaaggaacguaaaauccauuucagccugccgccccuuggaauggagggucuucuagggacca

SEQ ID NO: 291990 - RNA, 64 nt, Homo Sapiens
gcggggccuggccuaccucccccauccccugcuucccuuggaggcagagggcucccuugacuac

SEQ ID NO: 291991 - RNA, 64 nt, Homo Sapiens
uugacuaccuuuguuccucuucuuugaacacugacccuuggacaacauuuaucauaauuuguca

SEQ ID NO: 291992 - RNA, 64 nt, Homo Sapiens
ccugcguguccugugcuuaccaccgcccaaggcccccuuggaucucuuggauaggaguugguga

SEQ ID NO: 291993 - RNA, 64 nt, Homo Sapiens
aggugucuuguugcauggaagggauaguuuggcucccuuggaggcuauguaggcuugucccggg

SEQ ID NO: 291994 - RNA, 64 nt, Homo Sapiens
gcagguguuggggcacaguccccaagggcucggccccuuggaucaggcugggcacucgcugugc

SEQ ID NO: 291995 - RNA, 64 nt, Homo Sapiens
ccaagcccaccauggcccagauggacgugcaaagcccuuggaauuuucuggcacuuccucucua

SEQ ID NO: 291996 - RNA, 64 nt, Homo Sapiens
cuggaacagcuuccucucacugaacggagacgcccccuuggacgaacugccuaaucguuugguu

SEQ ID NO: 291997 - RNA, 64 nt, Homo Sapiens
ggcaaugugugagcuaaggauuucaggauccucucccuuggaagaccacugagcacaugggguc

SEQ ID NO: 291998 - RNA, 64 nt, Homo Sapiens
uagaaagcaguggagaccgguaaacagaucgcaucccuuggaauagagucaccagaugaggcuc

SEQ ID NO: 291999 - RNA, 64 nt, Homo Sapiens
cacaauuagaauauuuugacuuaguguccugucccccuuggacguuccaacuugacuuaguguc

SEQ ID NO: 292000 - RNA, 64 nt, Homo Sapiens
cuuggacguuccaacuugacuuaguguccagugccccuuggacauuccaaccugguagguaagc

SEQ ID NO: 292001 - RNA, 64 nt, Homo Sapiens; identical to SEQ ID NO: 73636

SEQ ID NO: 292002 - RNA, 64 nt, Homo Sapiens; identical to SEQ ID NO: 73637

SEQ ID NO: 292003 - RNA, 64 nt, Homo Sapiens; identical to SEQ ID NO: 73638

SEQ ID NO: 292004 - RNA, 64 nt, Homo Sapiens; identical to SEQ ID NO: 73639

SEQ ID NO: 292005 - RNA, 64 nt, Homo Sapiens; identical to SEQ ID NO: 73640

SEQ ID NO: 292006 - RNA, 64 nt, Homo Sapiens; identical to SEQ ID NO: 73641

SEQ ID NO: 292007 - RNA, 64 nt, Homo Sapiens; identical to SEQ ID NO: 73642

SEQ ID NO: 292008 - RNA, 64 nt, Homo Sapiens; identical to SEQ ID NO: 73643

SEQ ID NO: 292009 - RNA, 64 nt, Homo Sapiens; identical to SEQ ID NO: 73644

SEQ ID NO: 292010 - RNA, 64 nt, Homo Sapiens; identical to SEQ ID NO: 73645

SEQ ID NO: 292011 - RNA, 64 nt, Homo Sapiens; identical to SEQ ID NO: 73646

SEQ ID NO: 292012 - RNA, 64 nt, Homo Sapiens; identical to SEQ ID NO: 73647

SEQ ID NO: 292013 - RNA, 64 nt, Homo Sapiens; identical to SEQ ID NO: 73648

SEQ ID NO: 292014 - RNA, 64 nt, Homo Sapiens; identical to SEQ ID NO: 73649

SEQ ID NO: 292015 - RNA, 64 nt, Homo Sapiens; identical to SEQ ID NO: 73650

SEQ ID NO: 292016 - RNA, 64 nt, Homo Sapiens; identical to SEQ ID NO: 73651

SEQ ID NO: 292017 - RNA, 64 nt, Homo Sapiens; identical to SEQ ID NO: 73652

SEQ ID NO: 292018 - RNA, 64 nt, Homo Sapiens; identical to SEQ ID NO: 73653

SEQ ID NO: 292019 - RNA, 64 nt, Homo Sapiens; identical to SEQ ID NO: 73654

SEQ ID NO: 292020 - RNA, 64 nt, Homo Sapiens; identical to SEQ ID NO: 73655

SEQ ID NO: 292021 - RNA, 64 nt, Homo Sapiens; identical to SEQ ID NO: 73656

SEQ ID NO: 292022 - RNA, 64 nt, Homo Sapiens; identical to SEQ ID NO: 73657

SEQ ID NO: 292023 - RNA, 64 nt, Homo Sapiens; identical to SEQ ID NO: 73658

SEQ ID NO: 292024 - RNA, 64 nt, Homo Sapiens; identical to SEQ ID NO: 73659

SEQ ID NO: 292025 - RNA, 64 nt, Homo Sapiens; identical to SEQ ID NO: 73660

SEQ ID NO: 292026 - RNA, 64 nt, Homo Sapiens; identical to SEQ ID NO: 73661

SEQ ID NO: 292027 - RNA, 64 nt, Homo Sapiens; identical to SEQ ID NO: 73662

SEQ ID NO: 292028 - RNA, 64 nt, Homo Sapiens; identical to SEQ ID NO: 73663

SEQ ID NO: 292029 - RNA, 63 nt, Homo Sapiens; identical to SEQ ID NO: 73664

SEQ ID NO: 292030 - RNA, 64 nt, Homo Sapiens; identical to SEQ ID NO: 73665

SEQ ID NO: 292031 - RNA, 64 nt, Homo Sapiens; identical to SEQ ID NO: 73666

SEQ ID NO: 292032 - RNA, 64 nt, Homo Sapiens; identical to SEQ ID NO: 73667

SEQ ID NO: 292033 - RNA, 64 nt, Homo Sapiens; identical to SEQ ID NO: 73668

SEQ ID NO: 292034 - RNA, 64 nt, Homo Sapiens; identical to SEQ ID NO: 73669

SEQ ID NO: 292035 - RNA, 64 nt, Homo Sapiens; identical to SEQ ID NO: 73670

SEQ ID NO: 292036 - RNA, 64 nt, Homo Sapiens; identical to SEQ ID NO: 73671

SEQ ID NO: 292037 - RNA, 64 nt, Homo Sapiens; identical to SEQ ID NO: 73672

SEQ ID NO: 292038 - RNA, 64 nt, Homo Sapiens; identical to SEQ ID NO: 73673

SEQ ID NO: 292039 - RNA, 64 nt, Homo Sapiens; identical to SEQ ID NO: 73674

SEQ ID NO: 292040 - RNA, 64 nt, Homo Sapiens; identical to SEQ ID NO: 73675

SEQ ID NO: 292041 - RNA, 64 nt, Homo Sapiens; identical to SEQ ID NO: 73676

SEQ ID NO: 292042 - RNA, 64 nt, Homo Sapiens; identical to SEQ ID NO: 73677

SEQ ID NO: 292043 - RNA, 64 nt, Homo Sapiens; identical to SEQ ID NO: 73678

SEQ ID NO: 292044 - RNA, 64 nt, Homo Sapiens; identical to SEQ ID NO: 73679

SEQ ID NO: 292045 - RNA, 64 nt, Homo Sapiens; identical to SEQ ID NO: 73680

SEQ ID NO: 292046 - RNA, 64 nt, Homo Sapiens; identical to SEQ ID NO: 73681

SEQ ID NO: 292047 - RNA, 64 nt, Homo Sapiens; identical to SEQ ID NO: 73682

SEQ ID NO: 292048 - RNA, 64 nt, Homo Sapiens; identical to SEQ ID NO: 73683

SEQ ID NO: 292049 - RNA, 64 nt, Homo Sapiens; identical to SEQ ID NO: 73684

SEQ ID NO: 292050 - RNA, 64 nt, Homo Sapiens; identical to SEQ ID NO: 73685

SEQ ID NO: 292051 - RNA, 64 nt, Homo Sapiens; identical to SEQ ID NO: 73686

SEQ ID NO: 292052 - RNA, 64 nt, Homo Sapiens; identical to SEQ ID NO: 73687

SEQ ID NO: 292053 - RNA, 64 nt, Homo Sapiens; identical to SEQ ID NO: 73688

SEQ ID NO: 292054 - RNA, 64 nt, Homo Sapiens; identical to SEQ ID NO: 73689

SEQ ID NO: 292055 - RNA, 64 nt, Homo Sapiens; identical to SEQ ID NO: 73690

SEQ ID NO: 292056 - RNA, 64 nt, Homo Sapiens; identical to SEQ ID NO: 73691

SEQ ID NO: 292057 - RNA, 64 nt, Homo Sapiens; identical to SEQ ID NO: 73692

SEQ ID NO: 292058 - RNA, 64 nt, Homo Sapiens; identical to SEQ ID NO: 73693

SEQ ID NO: 292059 - RNA, 64 nt, Homo Sapiens; identical to SEQ ID NO: 73694

SEQ ID NO: 292060 - RNA, 64 nt, Homo Sapiens; identical to SEQ ID NO: 73695

SEQ ID NO: 292061 - RNA, 64 nt, Homo Sapiens; identical to SEQ ID NO: 73696

SEQ ID NO: 292062 - RNA, 64 nt, Homo Sapiens; identical to SEQ ID NO: 73697

SEQ ID NO: 292063 - RNA, 64 nt, Homo Sapiens; identical to SEQ ID NO: 73698

SEQ ID NO: 292064 - RNA, 64 nt, Homo Sapiens; identical to SEQ ID NO: 73699

SEQ ID NO: 292065 - RNA, 64 nt, Homo Sapiens; identical to SEQ ID NO: 73700

SEQ ID NO: 292066 - RNA, 64 nt, Homo Sapiens; identical to SEQ ID NO: 73701

SEQ ID NO: 292067 - RNA, 64 nt, Homo Sapiens; identical to SEQ ID NO: 73702

SEQ ID NO: 292068 - RNA, 64 nt, Homo Sapiens; identical to SEQ ID NO: 73703

SEQ ID NO: 292069 - RNA, 64 nt, Homo Sapiens; identical to SEQ ID NO: 73704

SEQ ID NO: 292070 - RNA, 64 nt, Homo Sapiens; identical to SEQ ID NO: 73705

SEQ ID NO: 292071 - RNA, 64 nt, Homo Sapiens; identical to SEQ ID NO: 73706

SEQ ID NO: 292072 - RNA, 64 nt, Homo Sapiens; identical to SEQ ID NO: 73707

SEQ ID NO: 292073 - RNA, 64 nt, Homo Sapiens; identical to SEQ ID NO: 91262

SEQ ID NO: 292074 - RNA, 64 nt, Homo Sapiens; identical to SEQ ID NO: 91263

SEQ ID NO: 292075 - RNA, 64 nt, Homo Sapiens; identical to SEQ ID NO: 91264

SEQ ID NO: 292076 - RNA, 64 nt, Homo Sapiens; identical to SEQ ID NO: 91265

SEQ ID NO: 292077 - RNA, 64 nt, Homo Sapiens; identical to SEQ ID NO: 91266

SEQ ID NO: 292078 - RNA, 64 nt, Homo Sapiens; identical to SEQ ID NO: 91267

SEQ ID NO: 292079 - RNA, 64 nt, Homo Sapiens; identical to SEQ ID NO: 91268

SEQ ID NO: 292080 - RNA, 64 nt, Homo Sapiens; identical to SEQ ID NO: 91269

SEQ ID NO: 292081 - RNA, 64 nt, Homo Sapiens; identical to SEQ ID NO: 91270

SEQ ID NO: 292082 - RNA, 64 nt, Homo Sapiens; identical to SEQ ID NO: 91271

SEQ ID NO: 292083 - RNA, 64 nt, Homo Sapiens; identical to SEQ ID NO: 91272

SEQ ID NO: 292084 - RNA, 64 nt, Homo Sapiens; identical to SEQ ID NO: 91273

SEQ ID NO: 292085 - RNA, 64 nt, Homo Sapiens; identical to SEQ ID NO: 91274

SEQ ID NO: 292086 - RNA, 64 nt, Homo Sapiens; identical to SEQ ID NO: 91275

SEQ ID NO: 292087 - RNA, 64 nt, Homo Sapiens; identical to SEQ ID NO: 91276

SEQ ID NO: 292088 - RNA, 64 nt, Homo Sapiens; identical to SEQ ID NO: 91277

SEQ ID NO: 292089 - RNA, 64 nt, Homo Sapiens; identical to SEQ ID NO: 91278

SEQ ID NO: 292090 - RNA, 64 nt, Homo Sapiens; identical to SEQ ID NO: 91279

SEQ ID NO: 292091 - RNA, 64 nt, Homo Sapiens; identical to SEQ ID NO: 91280

SEQ ID NO: 292092 - RNA, 64 nt, Homo Sapiens; identical to SEQ ID NO: 91281

SEQ ID NO: 292093 - RNA, 64 nt, Homo Sapiens; identical to SEQ ID NO: 91282

SEQ ID NO: 292094 - RNA, 64 nt, Homo Sapiens; identical to SEQ ID NO: 91283

SEQ ID NO: 292095 - RNA, 64 nt, Homo Sapiens; identical to SEQ ID NO: 91284

SEQ ID NO: 292096 - RNA, 64 nt, Homo Sapiens; identical to SEQ ID NO: 91285

SEQ ID NO: 292097 - RNA, 64 nt, Homo Sapiens; identical to SEQ ID NO: 91286

SEQ ID NO: 292098 - RNA, 64 nt, Homo Sapiens; identical to SEQ ID NO: 91287

SEQ ID NO: 292099 - RNA, 64 nt, Homo Sapiens; identical to SEQ ID NO: 91288

SEQ ID NO: 292100 - RNA, 64 nt, Homo Sapiens; identical to SEQ ID NO: 91289

SEQ ID NO: 292101 - RNA, 64 nt, Homo Sapiens; identical to SEQ ID NO: 91290

SEQ ID NO: 292102 - RNA, 64 nt, Homo Sapiens; identical to SEQ ID NO: 91291

SEQ ID NO: 292103 - RNA, 64 nt, Homo Sapiens; identical to SEQ ID NO: 91292

SEQ ID NO: 292104 - RNA, 64 nt, Homo Sapiens; identical to SEQ ID NO: 91293

SEQ ID NO: 292105 - RNA, 64 nt, Homo Sapiens; identical to SEQ ID NO: 91294

SEQ ID NO: 292106 - RNA, 64 nt, Homo Sapiens; identical to SEQ ID NO: 91295

SEQ ID NO: 292107 - RNA, 64 nt, Homo Sapiens; identical to SEQ ID NO: 91296

SEQ ID NO: 292108 - RNA, 64 nt, Homo Sapiens; identical to SEQ ID NO: 91297

SEQ ID NO: 292109 - RNA, 64 nt, Homo Sapiens; identical to SEQ ID NO: 91298

SEQ ID NO: 292110 - RNA, 64 nt, Homo Sapiens; identical to SEQ ID NO: 91299

SEQ ID NO: 292111 - RNA, 64 nt, Homo Sapiens; identical to SEQ ID NO: 91300

SEQ ID NO: 292112 - RNA, 64 nt, Homo Sapiens; identical to SEQ ID NO: 91301

SEQ ID NO: 292113 - RNA, 64 nt, Homo Sapiens; identical to SEQ ID NO: 91302

SEQ ID NO: 292114 - RNA, 64 nt, Homo Sapiens; identical to SEQ ID NO: 91303

SEQ ID NO: 292115 - RNA, 64 nt, Homo Sapiens; identical to SEQ ID NO: 91304

SEQ ID NO: 292116 - RNA, 64 nt, Homo Sapiens; identical to SEQ ID NO: 91305

SEQ ID NO: 292117 - RNA, 64 nt, Homo Sapiens; identical to SEQ ID NO: 91306

SEQ ID NO: 292118 - RNA, 64 nt, Homo Sapiens; identical to SEQ ID NO: 91307

SEQ ID NO: 292119 - RNA, 64 nt, Homo Sapiens; identical to SEQ ID NO: 91308

SEQ ID NO: 292120 - RNA, 64 nt, Homo Sapiens; identical to SEQ ID NO: 91309

SEQ ID NO: 292121 - RNA, 64 nt, Homo Sapiens; identical to SEQ ID NO: 91310

SEQ ID NO: 292122 - RNA, 64 nt, Homo Sapiens; identical to SEQ ID NO: 91311

SEQ ID NO: 292123 - RNA, 64 nt, Homo Sapiens; identical to SEQ ID NO: 91312

SEQ ID NO: 292124 - RNA, 64 nt, Homo Sapiens; identical to SEQ ID NO: 91313

SEQ ID NO: 292125 - RNA, 64 nt, Homo Sapiens; identical to SEQ ID NO: 91314

SEQ ID NO: 292126 - RNA, 64 nt, Homo Sapiens; identical to SEQ ID NO: 91315

SEQ ID NO: 292127 - RNA, 64 nt, Homo Sapiens; identical to SEQ ID NO: 91316

SEQ ID NO: 292128 - RNA, 64 nt, Homo Sapiens; identical to SEQ ID NO: 91317

SEQ ID NO: 292129 - RNA, 64 nt, Homo Sapiens; identical to SEQ ID NO: 91318

SEQ ID NO: 292130 - RNA, 64 nt, Homo Sapiens; identical to SEQ ID NO: 91319

SEQ ID NO: 292131 - RNA, 64 nt, Homo Sapiens; identical to SEQ ID NO: 91320

SEQ ID NO: 292132 - RNA, 64 nt, Homo Sapiens; identical to SEQ ID NO: 91321

SEQ ID NO: 292133 - RNA, 64 nt, Homo Sapiens; identical to SEQ ID NO: 91322

SEQ ID NO: 292134 - RNA, 64 nt, Homo Sapiens; identical to SEQ ID NO: 91323

SEQ ID NO: 292135 - RNA, 64 nt, Homo Sapiens; identical to SEQ ID NO: 91324

SEQ ID NO: 292136 - RNA, 64 nt, Homo Sapiens; identical to SEQ ID NO: 91325

SEQ ID NO: 292137 - RNA, 64 nt, Homo Sapiens; identical to SEQ ID NO: 91326

SEQ ID NO: 292138 - RNA, 64 nt, Homo Sapiens; identical to SEQ ID NO: 91327

SEQ ID NO: 292139 - RNA, 64 nt, Homo Sapiens; identical to SEQ ID NO: 91328

SEQ ID NO: 292140 - RNA, 64 nt, Homo Sapiens; identical to SEQ ID NO: 91329

SEQ ID NO: 292141 - RNA, 64 nt, Homo Sapiens; identical to SEQ ID NO: 91330

SEQ ID NO: 292142 - RNA, 64 nt, Homo Sapiens; identical to SEQ ID NO: 91331

SEQ ID NO: 292143 - RNA, 64 nt, Homo Sapiens; identical to SEQ ID NO: 91332

SEQ ID NO: 292144 - RNA, 64 nt, Homo Sapiens; identical to SEQ ID NO: 91333

SEQ ID NO: 292145 - RNA, 64 nt, Homo Sapiens; identical to SEQ ID NO: 91334

SEQ ID NO: 292146 - RNA, 64 nt, Homo Sapiens; identical to SEQ ID NO: 91335

SEQ ID NO: 292147 - RNA, 64 nt, Homo Sapiens; identical to SEQ ID NO: 91336

SEQ ID NO: 292148 - RNA, 64 nt, Homo Sapiens; identical to SEQ ID NO: 91337

SEQ ID NO: 292149 - RNA, 64 nt, Homo Sapiens; identical to SEQ ID NO: 91338

SEQ ID NO: 292150 - RNA, 64 nt, Homo Sapiens; identical to SEQ ID NO: 91339

SEQ ID NO: 292151 - RNA, 64 nt, Homo Sapiens; identical to SEQ ID NO: 91340

SEQ ID NO: 292152 - RNA, 64 nt, Homo Sapiens; identical to SEQ ID NO: 91341

SEQ ID NO: 292153 - RNA, 64 nt, Homo Sapiens; identical to SEQ ID NO: 91342

SEQ ID NO: 292154 - RNA, 64 nt, Homo Sapiens; identical to SEQ ID NO: 91343

SEQ ID NO: 292155 - RNA, 64 nt, Homo Sapiens; identical to SEQ ID NO: 91344

SEQ ID NO: 292156 - RNA, 64 nt, Homo Sapiens; identical to SEQ ID NO: 91345

SEQ ID NO: 292157 - RNA, 64 nt, Homo Sapiens; identical to SEQ ID NO: 91346

SEQ ID NO: 292158 - RNA, 64 nt, Homo Sapiens; identical to SEQ ID NO: 91347

SEQ ID NO: 292159 - RNA, 64 nt, Homo Sapiens; identical to SEQ ID NO: 91348

SEQ ID NO: 292160 - RNA, 64 nt, Homo Sapiens; identical to SEQ ID NO: 91349

SEQ ID NO: 292161 - RNA, 64 nt, Homo Sapiens; identical to SEQ ID NO: 91350

SEQ ID NO: 292162 - RNA, 64 nt, Homo Sapiens; identical to SEQ ID NO: 91351

SEQ ID NO: 292163 - RNA, 64 nt, Homo Sapiens; identical to SEQ ID NO: 91352

SEQ ID NO: 292164 - RNA, 64 nt, Homo Sapiens; identical to SEQ ID NO: 91353

SEQ ID NO: 292165 - RNA, 54 nt, Homo Sapiens; identical to SEQ ID NO: 91354

SEQ ID NO: 292166 - RNA, 64 nt, Homo Sapiens; identical to SEQ ID NO: 91355

SEQ ID NO: 292167 - RNA, 64 nt, Homo Sapiens; identical to SEQ ID NO: 91356

SEQ ID NO: 292168 - RNA, 64 nt, Homo Sapiens; identical to SEQ ID NO: 91357

SEQ ID NO: 292169 - RNA, 64 nt, Homo Sapiens; identical to SEQ ID NO: 91358

SEQ ID NO: 292170 - RNA, 64 nt, Homo Sapiens; identical to SEQ ID NO: 91359

SEQ ID NO: 292171 - RNA, 64 nt, Homo Sapiens; identical to SEQ ID NO: 91360

SEQ ID NO: 292172 - RNA, 64 nt, Homo Sapiens; identical to SEQ ID NO: 91361

SEQ ID NO: 292173 - RNA, 64 nt, Homo Sapiens; identical to SEQ ID NO: 91362

SEQ ID NO: 292174 - RNA, 64 nt, Homo Sapiens; identical to SEQ ID NO: 91363

SEQ ID NO: 292175 - RNA, 64 nt, Homo Sapiens; identical to SEQ ID NO: 91364

SEQ ID NO: 292176 - RNA, 64 nt, Homo Sapiens; identical to SEQ ID NO: 91365

SEQ ID NO: 292177 - RNA, 64 nt, Homo Sapiens; identical to SEQ ID NO: 91366

SEQ ID NO: 292178 - RNA, 64 nt, Homo Sapiens; identical to SEQ ID NO: 91367

SEQ ID NO: 292179 - RNA, 64 nt, Homo Sapiens; identical to SEQ ID NO: 91368

SEQ ID NO: 292180 - RNA, 64 nt, Homo Sapiens; identical to SEQ ID NO: 91369

SEQ ID NO: 292181 - RNA, 64 nt, Homo Sapiens; identical to SEQ ID NO: 91370

SEQ ID NO: 292182 - RNA, 64 nt, Homo Sapiens; identical to SEQ ID NO: 91371

SEQ ID NO: 292183 - RNA, 64 nt, Homo Sapiens; identical to SEQ ID NO: 91372

SEQ ID NO: 292184 - RNA, 64 nt, Homo Sapiens; identical to SEQ ID NO: 91373

SEQ ID NO: 292185 - RNA, 64 nt, Homo Sapiens; identical to SEQ ID NO: 91374

SEQ ID NO: 292186 - RNA, 64 nt, Homo Sapiens; identical to SEQ ID NO: 91375

SEQ ID NO: 292187 - RNA, 64 nt, Homo Sapiens; identical to SEQ ID NO: 91376

SEQ ID NO: 292188 - RNA, 64 nt, Homo Sapiens; identical to SEQ ID NO: 91377

SEQ ID NO: 292189 - RNA, 64 nt, Homo Sapiens; identical to SEQ ID NO: 91378

SEQ ID NO: 292190 - RNA, 64 nt, Homo Sapiens; identical to SEQ ID NO: 91379

SEQ ID NO: 292191 - RNA, 64 nt, Homo Sapiens; identical to SEQ ID NO: 91380

SEQ ID NO: 292192 - RNA, 62 nt, Homo Sapiens
ugagaaucucguuaguagcauguggccuaacaaaaggaaaaaauguuuuuaaacacacacac

SEQ ID NO: 292193 - RNA, 62 nt, Homo Sapiens
ugaagaggaggaaaagugaaucacggagagagaaaggaaaggauagaaucacaggcugcguc

SEQ ID NO: 292194 - RNA, 62 nt, Homo Sapiens
ccaucauuucacacauaggcucugaaagugggaaaggaaagcugaucaagcaggggccggac

SEQ ID NO: 292195 - RNA, 62 nt, Homo Sapiens
gcauggaugguuguaaagaaacaaucagaaauaaaggaaaacugagcagaaucugucuggug

SEQ ID NO: 292196 - RNA, 62 nt, Homo Sapiens
uugcacuguguucauauuaauccucuuuuaaaaaaggaaauauacagaagacaaacauugua

SEQ ID NO: 292197 - RNA, 62 nt, Homo Sapiens
caggcuugagugacagagcaagacuguaucucaaaggaaaaaggaaacuaggccaggcgugg

SEQ ID NO: 292198 - RNA, 62 nt, Homo Sapiens
gagugacagagcaagacuguaucucaaaggaaaaaggaaacuaggccaggcgugguggcuca

SEQ ID NO: 292199 - RNA, 62 nt, Homo Sapiens
auaaacuuuuccagaagcacgagguaguuugcaaaggaaaagucugcacuguuugcucuaaa

SEQ ID NO: 292200 - RNA, 62 nt, Homo Sapiens
guuuugcuguauuucaaaauuuuccuucuguuaaaggaaaauauugugaauaaccacuggug

SEQ ID NO: 292201 - RNA, 62 nt, Homo Sapiens
ucaaacaauauagaauuaaaagggagaaaggaaaaggaaacuagagggaaagggguacacug

SEQ ID NO: 292202 - RNA, 62 nt, Homo Sapiens
gaaacuucaaacaauauagaacacugagggagaaaggaaaaggcuggcagagggaaaggggu

SEQ ID NO: 292203 - RNA, 62 nt, Homo Sapiens
cagaagcccugcugucugucaggaaaaaaaaaaaaggaaaacaaaaaaaaaaaaaaggaaaa

SEQ ID NO: 292204 - RNA, 62 nt, Homo Sapiens
aaaaaaaggaaaaccagaagaaaaaaaaggaaaaaggaaaaaaugcuuucuucuuaaaaaaa

SEQ ID NO: 292205 - RNA, 62 nt, Homo Sapiens
ggaaaaaaaaaaaaggaaaaaaaaaaaaaaaaaaaggaaaaaaaccucuaugcuuucuucuu

SEQ ID NO: 292206 - RNA, 62 nt, Homo Sapiens
gcaaguuugcucagucaaguguguuuuaaauaaaaggaaagaaguucaggaaguuuuguuuu

SEQ ID NO: 292207 - RNA, 62 nt, Homo Sapiens
aaaaauguuuuacuauguggacugauuuuuaaaaaggaaaaauagggaaaaacuuuugcccg

SEQ ID NO: 292208 - RNA, 62 nt, Homo Sapiens
gacuugaguuguuggauuaguguaauguucucaaaggaaacauuggagacuagagccaauag

SEQ ID NO: 292209 - RNA, 62 nt, Homo Sapiens
uuguguuaccuuuuuuaaaucaaggacuacuaaaaggaaaaaacuauucuaucauaacuacc

SEQ ID NO: 292210 - RNA, 62 nt, Homo Sapiens
uauuuguaagauguugcacuuucuguuuuuuuaaaggaaaacguagagagcuguugauuugu

SEQ ID NO: 292211 - RNA, 62 nt, Homo Sapiens
aagaaaccgaagccaguauuguaggaaauuugaaaggaaaaacacaaauauguaaagcaauu

SEQ ID NO: 292212 - RNA, 62 nt, Homo Sapiens
uugaaaggauugugaauacuuuuuuccccuuuaaaggaaacuuauuucuuacaagccucugu

SEQ ID NO: 292213 - RNA, 62 nt, Homo Sapiens
uuuugccuuuuguaucuuauuggaucauggguaaaggaaacauaggauucuuggagcuagcc

SEQ ID NO: 292214 - RNA, 62 nt, Homo Sapiens
agacuuaaauuuucuccuauuuuauaaaauaaaaaggaaaaccaaguauaaaauaaaauaca

SEQ ID NO: 292215 - RNA, 62 nt, Homo Sapiens
gcuauugaacuuaagcaucucggauaaguuugaaaggaaacuagacucccauuucuuaaaaa

SEQ ID NO: 292216 - RNA, 62 nt, Homo Sapiens
ugaagugccccaggagaagauaacuuagaccaaaaggaaaaauuaaaauagcuuccaauaag

SEQ ID NO: 292217 - RNA, 62 nt, Homo Sapiens
ugaaagauaagauuuauucugagguugauugcaaaggaaauuguuguaaagcucauuuuggg

SEQ ID NO: 292218 - RNA, 62 nt, Homo Sapiens
agagugaaaaaguguguuuuaugucaauugugaaaggaaaauguuaggaguaugguuuuuaa

SEQ ID NO: 292219 - RNA, 62 nt, Homo Sapiens
uugcaugcucaauuucuagguccuuugucuagaaaggaaauuugccucaguugaauuaguga

SEQ ID NO: 292220 - RNA, 62 nt, Homo Sapiens
caugccacggauaaaugaggcaaauccgaagaaaaggaaaaucgaauaaaaaauagucccac

SEQ ID NO: 292221 - RNA, 62 nt, Homo Sapiens
uucauccauacagaauuuggaugacuauguauaaaggaaaacuuaaaucuuaauuauuauca

SEQ ID NO: 292222 - RNA, 62 nt, Homo Sapiens
guuuuaaacgacuuuuguuugcggggcuuuuaaaaggaaaaccgaauuagguccacuucaau

SEQ ID NO: 292223 - RNA, 62 nt, Homo Sapiens
gaauuagguccacuucaauguccaccugugagaaaggaaaaauuuuuuuguuguuuaacuug

SEQ ID NO: 292224 - RNA, 62 nt, Homo Sapiens
cacaccguuaagccagagguucugacuucgcuaaaggaaauguaagagguuuuguugucugu

SEQ ID NO: 292225 - RNA, 62 nt, Homo Sapiens
guaaaaaaacauaaugucuucagccucauaauaaaggaaaguuaauuaaaaaaaaaaagcaa

SEQ ID NO: 292226 - RNA, 62 nt, Homo Sapiens
aaagucaaaaaaacgaaagagaaggagaagaaaaaggaaaagggcaaauugaaagucaagga

SEQ ID NO: 292227 - RNA, 62 nt, Homo Sapiens
gaaaaagcgcaaagaggagaaugaagauccagaaaggaaaauaaagaagaagggcuucggcg

SEQ ID NO: 292228 - RNA, 58 nt, Homo Sapiens
agaccgacgaggaugacuagacagcaaaaaaggaaaaguuaaacuaaaaaaaaaaagg

SEQ ID NO: 292229 - RNA, 62 nt, Homo Sapiens
aggcccugcuuuuuuucuuaaaaguacuuuaaaaaggaaauuuguuuguauuuuuuauuuac

SEQ ID NO: 292230 - RNA, 62 nt, Homo Sapiens
uuguuucaauguuuauuauaguuuacacuuugaaaggaaaucguguguaguaauagauguaa

SEQ ID NO: 292231 - RNA, 62 nt, Homo Sapiens
guacaguauucuuuuaauaaaaaauaguuuuuaaaggaaaaauuuuaccuuguaaagucaca

SEQ ID NO: 292232 - RNA, 62 nt, Homo Sapiens
aaaacaaaaaacgaaugaaaaccuaguuaaagaaaggaaaaggcuuauuuaauaugcuuaua

SEQ ID NO: 292233 - RNA, 62 nt, Homo Sapiens
uguguuuauauggaagaaagaugcuugcggcaaaaggaaagcguaggcccagucgucaucag

SEQ ID NO: 292234 - RNA, 62 nt, Homo Sapiens
ccgagcaggccguguugcaucuaaugcucuacaaaggaaaggggacaccuuuguaucucaag

SEQ ID NO: 292235 - RNA, 62 nt, Homo Sapiens
cuuaaagcaaggcggaacaggaaacagauuucaaaggaaaagagcccauauaugcgguccau

SEQ ID NO: 292236 - RNA, 62 nt, Homo Sapiens
guuuucucaaccauuuaaaaguuauuccaguaaaaggaaauaguuaccaucgcaaaggaaag

SEQ ID NO: 292237 - RNA, 62 nt, Homo Sapiens
uuauuccaguaaaaggaaauaguuaccaucgcaaaggaaaggcuauacucccaagacuacaa

SEQ ID NO: 292238 - RNA, 62 nt, Homo Sapiens
gcaugacauuguguaucgauaaaaaaaaaggaaaaggaaaaacugagcugcuuguuuaaaaa

SEQ ID NO: 292239 - RNA, 62 nt, Homo Sapiens
gaaaaagcaugacauuguguuaaaaaaaaaaaaaaggaaaagaaaucgcugagcugcuuguu

SEQ ID NO: 292240 - RNA, 62 nt, Homo Sapiens
cugauguuuccauauagcuuacguaucuuagaaaaggaaagguuuaaggaagaauuggagug

SEQ ID NO: 292241 - RNA, 62 nt, Homo Sapiens
agaauaugaucaauuccuuguaugaauuccugaaaggaaaauaggugcuauccuagggauuu

SEQ ID NO: 292242 - RNA, 62 nt, Homo Sapiens
gggucacgcacaucauguacacacacguaaggaaaggaaaggaaugucuuaauggcugugug

SEQ ID NO: 292243 - RNA, 62 nt, Homo Sapiens
ucaaagcagaaauuuuaagccaaaaacaaacgaaaggaaagcggggaggggaaaacagaccc

SEQ ID NO: 292244 - RNA, 62 nt, Homo Sapiens
uuuugugacucuuguacagcuuaaugugcaauaaaggaaaaguuauaucugucuucaguguu

SEQ ID NO: 292245 - RNA, 62 nt, Homo Sapiens
uaauuaggcuuuauuaucuuccuaaaucaaggaaaggaaaucauccccagaccauuuaugcu

SEQ ID NO: 292246 - RNA, 62 nt, Homo Sapiens
uauuaguugauucacaguacagaacaagguauaaaggaaaaaacccugcuagguaguguuau

SEQ ID NO: 292247 - RNA, 62 nt, Homo Sapiens
cagucccccaaccccagccgcucggaggccccaaaggaaaaagcacaagaagcgugagacgc

SEQ ID NO: 292248 - RNA, 62 nt, Homo Sapiens
ucauucucguagcuuuuuaaaaaaaugaaaguaaaggaaaaaaaaaaaacugcaaaucuaga

SEQ ID NO: 292249 - RNA, 62 nt, Homo Sapiens
gcaacacaagaauauuucacuuagauaugaagaaaggaaacacuagucuccauucacuugaa

SEQ ID NO: 292250 - RNA, 62 nt, Homo Sapiens
gauuuuauucuuagaaauccagaaucccuugaaaaggaaauauuuucuguuucuuauaaaua

SEQ ID NO: 292251 - RNA, 62 nt, Homo Sapiens
ccucguuuuucuuuuguuugcauuuucugcaaaaaggaaaaagaaaccacaaauuggggaaa

SEQ ID NO: 292252 - RNA, 62 nt, Homo Sapiens
ugggaagagaggagagggagaaaaauaaaaugaaaggaaaaaaaaaaguuugcaaauucaga

SEQ ID NO: 292253 - RNA, 62 nt, Homo Sapiens
ugcaguugaauggaaaauuacucaguguauagaaaggaaaaaaaccagaaauuuaaaauaga

SEQ ID NO: 292254 - RNA, 62 nt, Homo Sapiens
aauaacauaagucugaaagcaaugaaaacgucaaaggaaaauguuuauauacauccacaugu

SEQ ID NO: 292255 - RNA, 62 nt, Homo Sapiens
cauaagugcugucaguauaaaguuguggggauaaaggaaacuggauauuuuuagcacgaugu

SEQ ID NO: 292256 - RNA, 62 nt, Homo Sapiens
uucuuuuuucuaaaaaaagaaaaaaaagaaaaaaaggaaaagaagaacaaagaaacaugacu

SEQ ID NO: 292257 - RNA, 62 nt, Homo Sapiens
gcauggagaaaacccgguacgcucaaaaagaaaaaggaaaaaaaaaaaucccaucacccaca

SEQ ID NO: 292258 - RNA, 62 nt, Homo Sapiens
uuuggacauuuuaauuguuuaaaaauuguacaaaaggaaaaaauuagaauaaguacuggcga

SEQ ID NO: 292259 - RNA, 62 nt, Homo Sapiens
auauauguuagaguuuugaauaagugguggaaaaaggaaagugccgaugggggcaguggcgu

SEQ ID NO: 292260 - RNA, 62 nt, Homo Sapiens
gaaaacaggaccuagguguugauccugucucaaaaggaaaaacagcuugggcaacagagcaa

SEQ ID NO: 292261 - RNA, 62 nt, Homo Sapiens
aguuauuccuagcuccauuucaaugaagaggaaaaggaaaguaucauucaguuggauuuucc

SEQ ID NO: 292262 - RNA, 62 nt, Homo Sapiens
uaguccuaaucuuuacuaucaagcagcaccccaaaggaaauagucauucaguaauuuccuac

SEQ ID NO: 292263 - RNA, 62 nt, Homo Sapiens
aaugucuugcaaugugcuguggacguuuauuaaaaggaaaaaaagggaaacucagaguacua

SEQ ID NO: 292264 - RNA, 62 nt, Homo Sapiens
ucuaaagcacaagaaauaguuaagagaaauacaaaggaaauuggggaagaagcaagauacuu

SEQ ID NO: 292265 - RNA, 62 nt, Homo Sapiens
auaucauauaugaugauguauuccuaucuucuaaaggaaagugaccucuaaaaagcccuuug

SEQ ID NO: 292266 - RNA, 62 nt, Homo Sapiens
cuuguauggcaucgaauagcuuguuuuauguaaaaggaaaauuuuugagauguaauuuaaga

SEQ ID NO: 292267 - RNA, 62 nt, Homo Sapiens
auuuggagaauugaacucacacuuauuacuuuaaaggaaaggcauuaauaaagaugaaauaa

SEQ ID NO: 292268 - RNA, 62 nt, Homo Sapiens
auaaaucagaacuccauaaaacacuuaaaagcaaaggaaaaaucacgugcacaaagauuagc

SEQ ID NO: 292269 - RNA, 62 nt, Homo Sapiens
uuuaggaaauuacauuaaguauuaaugaggggaaaggaaaugagcucuacgaggauuucacc

SEQ ID NO: 292270 - RNA, 62 nt, Homo Sapiens
ccccacccccaucacagggcuuucaguuuggcaaaggaaaagcagauaaaaacagaacauuc

SEQ ID NO: 292271 - RNA, 62 nt, Homo Sapiens
accucagggagagcaccuguccaggucugccuaaaggaaauggcuccagugggucuaaacaa

SEQ ID NO: 292272 - RNA, 62 nt, Homo Sapiens
auuguaaauauguuuuuuagaucaaauacuuuaaaggaaaaaauguuggauuuauaaaugcu

SEQ ID NO: 292273 - RNA, 62 nt, Homo Sapiens
uaaaugcuauuuuuuauuuuacuuuuauaauaaaaggaaaagcaaauugaugaccucaccuu

SEQ ID NO: 292274 - RNA, 62 nt, Homo Sapiens
agcaagcaugaauuuuucacccaagagugaaaaaaggaaaaucuaccauggcuugaaguuaa

SEQ ID NO: 292275 - RNA, 62 nt, Homo Sapiens
uggcagguacuaugaauguaauucauaauuuaaaaggaaaacuaaaaacuauuuugauuugg

SEQ ID NO: 292276 - RNA, 62 nt, Homo Sapiens
uaucacacugauguguucaacuguuuaugggaaaaggaaacuaggaugguuuuauuugugaa

SEQ ID NO: 292277 - RNA, 62 nt, Homo Sapiens
cgcagagcagagugcugaguaaagaugucagaaaaggaaagcaauggucugguacaagucuu

SEQ ID NO: 292278 - RNA, 62 nt, Homo Sapiens
aucuucuuugaagaaaaguaagaagaaaaaagaaaggaaaagcuuuggguaccaaaccaaaa

SEQ ID NO: 292279 - RNA, 62 nt, Homo Sapiens
gcauguucugaccauuuuaggaacugccuuugaaaggaaauuccuccuugagccaaugcacu

SEQ ID NO: 292280 - RNA, 62 nt, Homo Sapiens
aagcguucaccgccacaaauuuaaaaaaauaaaaaggaaaggguuuggcaguaauugucugu

SEQ ID NO: 292281 - RNA, 62 nt, Homo Sapiens
uuuucaugccuuuagaugugggucaguugauaaaaggaaacccuauugggguaugauguuug

SEQ ID NO: 292282 - RNA, 62 nt, Homo Sapiens
aaacuaacaaccaaccaaccuauauaaauuaaaaaggaaagauauauauauauauauauaua

SEQ ID NO: 292283 - RNA, 62 nt, Homo Sapiens
uauauauauauauauauauaguauucuauucaaaaggaaauaccuagaacuucaaaauguuc

SEQ ID NO: 292284 - RNA, 62 nt, Homo Sapiens
uuuaaauagcuuaauaucaagaguugguuugcaaaggaaaaggaaaguuuaaagagggggaa

SEQ ID NO: 292285 - RNA, 62 nt, Homo Sapiens
gugauagaauaauauucaagguggaaacaugcaaaggaaaaaggaugagaaguaagcaaacu

SEQ ID NO: 292286 - RNA, 62 nt, Homo Sapiens
aaaagccuaaauguucagaauuuauugugacaaaaggaaauaagauauguuuuauauuguua

SEQ ID NO: 292287 - RNA, 62 nt, Homo Sapiens
uuucaagagucuauaucuaucaugcaagcugcaaaggaaacacuacugacaaaguaugccau

SEQ ID NO: 292288 - RNA, 62 nt, Homo Sapiens
uuauggacucuguuaagaaaucuggccuuuggaaaggaaaaauaucuguaacaucagagcug

SEQ ID NO: 292289 - RNA, 62 nt, Homo Sapiens
ccuucacacccucacagagguucacaggugcgaaaggaaaggccaagauaggccuucacacc

SEQ ID NO: 292290 - RNA, 62 nt, Homo Sapiens
aagaaguguacagaauuaaccaagggguaaaaaaaggaaagauacuauagcuuauuuucaaa

SEQ ID NO: 292291 - RNA, 62 nt, Homo Sapiens
gaccuguuaggcugagcucaggaauuguccaaaaaggaaaaagcaaaauaauuaauugagag

SEQ ID NO: 292292 - RNA, 62 nt, Homo Sapiens
cugaguccagauuucucaucaacuggcaauacaaaggaaaauaugguacaggaguuaguuag

SEQ ID NO: 292293 - RNA, 62 nt, Homo Sapiens
aaaaugacuguuuucucucucuauggaaauaaaaaggaaaaaaaaaaaggaaacuuuuuuug

SEQ ID NO: 292294 - RNA, 62 nt, Homo Sapiens
ucucucucuauggaaauaaaaaggaaaaaaaaaaaggaaacuuuuuuuguuugcucuugcau

SEQ ID NO: 292295 - RNA, 62 nt, Homo Sapiens
auuggcaagacauguauuuaaacaauaaacuaaaaggaaauaaucuccacguacuaccaucu

SEQ ID NO: 292296 - RNA, 62 nt, Homo Sapiens
uucuucaaaggcuuguuaaaccaaucauguuaaaaggaaauucuugguuuugguuuguuguu

SEQ ID NO: 292297 - RNA, 62 nt, Homo Sapiens
gugauugguugguuuguagcacuaaggucuaaaaaggaaaaccauaaaagacaucagauuac

SEQ ID NO: 292298 - RNA, 62 nt, Homo Sapiens
agggaggaugggauuaguggaagcuuaauggaaaaggaaaguuaugauccuccaagacccuu

SEQ ID NO: 292299 - RNA, 62 nt, Homo Sapiens
uaaaaacauuccacaagaaguaauaauauaagaaaggaaauuuaaaaaaaccuaaggaagaa

SEQ ID NO: 292300 - RNA, 62 nt, Homo Sapiens
cauucaggaagaaaugaccuaaaauaaaagaaaaaggaaaauuaauccuccuucaaaaaaua

SEQ ID NO: 292301 - RNA, 62 nt, Homo Sapiens
aagagugcuuuugggcauccucaucaacuuggaaaggaaacauuuaggaaauauacgaagag

SEQ ID NO: 292302 - RNA, 62 nt, Homo Sapiens
uacgaagagucaucaacuuggcccauauggaaaaaggaaauagauacuuuaaaagccaaggu

SEQ ID NO: 292303 - RNA, 62 nt, Homo Sapiens
uuaggcuuucuuuguccuuucagaaaaaaggaaaaggaaaguugcugcuuccuauuggagcc

SEQ ID NO: 292304 - RNA, 62 nt, Homo Sapiens
gaaaguuuaggcuuucuuugggagcccagaaaaaaggaaaaguguaaaugcugcuuccuauu

SEQ ID NO: 292305 - RNA, 62 nt, Homo Sapiens
ugaguuuaaauagaaacauguuuuaauuaaaaaaaggaaauuccuauguacccacaaaaauu

SEQ ID NO: 292306 - RNA, 62 nt, Homo Sapiens
ugcaugaagggauggauaccauuuguguucacaaaggaaaaacauacccuucucuucaagaa

SEQ ID NO: 292307 - RNA, 62 nt, Homo Sapiens
uaaagaagacuaugauaccaaucucucuggaaaaaggaaagcaagaaccagaaaaauaauua

SEQ ID NO: 292308 - RNA, 62 nt, Homo Sapiens
cagauuuugaaaucugacucggugagggauuaaaaggaaagguaacuugaaggcagcacaga

SEQ ID NO: 292309 - RNA, 62 nt, Homo Sapiens
gcauccuuaagauuuaaaaaaaaaaaaaaaaaaaaggaaaaaaaagugauggaagccguaag

SEQ ID NO: 292310 - RNA, 62 nt, Homo Sapiens
cuugucuauuuuuucucuucauguuguaacaaaaaggaaaaaagaaaaaaaaaucccauccc

SEQ ID NO: 292311 - RNA, 62 nt, Homo Sapiens
gcaaaauuugaaauaauuucaccaggcuaaauaaaggaaaauggaaaccaguuaagaggcac

SEQ ID NO: 292312 - RNA, 62 nt, Homo Sapiens
caaaccaaagguaaccagcuagcccaccacugaaaggaaagaucugagacaugggauuccca

SEQ ID NO: 292313 - RNA, 62 nt, Homo Sapiens
ugcaaguaaaucuuaucguuaguucuucuucaaaaggaaauugcaucuugugacuuaguaga

SEQ ID NO: 292314 - RNA, 62 nt, Homo Sapiens
uccagaagcugcagcaagagguacagcucaacaaaggaaaaccacaggacuggauaugcaac

SEQ ID NO: 292315 - RNA, 62 nt, Homo Sapiens
cagaauauucuuuuuauauucuguggaaaaauaaaggaaauucagauuguuuaaaugccuaa

SEQ ID NO: 292316 - RNA, 62 nt, Homo Sapiens
aaaguuuugagauaaguuuuguuucaauuagaaaaggaaauagguuuuagguggcauagugg

SEQ ID NO: 292317 - RNA, 62 nt, Homo Sapiens
uucuauuuugugaagggacuauauuuuuugagaaaggaaaaucucaguuagauauauuuugu

SEQ ID NO: 292318 - RNA, 62 nt, Homo Sapiens
auuuuuauuuccuguaguaggcuugcuggagcaaaggaaaugugcugcuaaaaaucaacuua

SEQ ID NO: 292319 - RNA, 62 nt, Homo Sapiens
ccgucccuuaaaaagacaaaaaaaauaaggcaaaaggaaagcaacuaagacacuggacuauc

SEQ ID NO: 292320 - RNA, 62 nt, Homo Sapiens
uaaauaccuggcaaaacuaaauaaauuaccaaaaaggaaaaaaaauccaccaaaccaugaua

SEQ ID NO: 292321 - RNA, 62 nt, Homo Sapiens
aaagaaaugcauucauaucaaaauuggaauagaaaggaaaaccuauuuuuaagauaucaacc

SEQ ID NO: 292322 - RNA, 62 nt, Homo Sapiens
ucugucauaaauuauuuccccgguaauuuuugaaaggaaaaauguauaacaaguacuauuua

SEQ ID NO: 292323 - RNA, 62 nt, Homo Sapiens
gguguuuguuuccauccccaaggcaaacaaggaaaggaaaggaaagaagaaaaggugccuua

SEQ ID NO: 292324 - RNA, 62 nt, Homo Sapiens
uuguuuccauccccaaggcaaacaaggaaaggaaaggaaagaagaaaaggugccuuaguccu

SEQ ID NO: 292325 - RNA, 62 nt, Homo Sapiens
acacuaguguucuuucaguauuuucacaacggaaaggaaagacaauuccucagaaacaacuu

SEQ ID NO: 292326 - RNA, 62 nt, Homo Sapiens
augugauucaagauauuuacagauuucagaagaaaggaaacagcugugagaauucuccuuug

SEQ ID NO: 292327 - RNA, 62 nt, Homo Sapiens
cacucuuucauugcugaauuauuggaagagagaaaggaaacaagggguuguuguguaguugc

SEQ ID NO: 292328 - RNA, 62 nt, Homo Sapiens
uuguaugaccacuguucuaugccaaauuugggaaaggaaauuaaggacaaagauguaaaaau

SEQ ID NO: 292329 - RNA, 62 nt, Homo Sapiens
aggaaauuguaagcuuuauuacacauuaaaauaaaggaaauauaucuuuaaguguuuuuuug

SEQ ID NO: 292330 - RNA, 62 nt, Homo Sapiens
gcagccuuuacuauuuuuucuaagcacuuuaaaaaggaaaagguuuuuggauauaaagcuaa

SEQ ID NO: 292331 - RNA, 62 nt, Homo Sapiens
caugcaauuuuaccuagacacaauuuuaugguaaaggaaaccaggguaaaaaaaaauugauu

SEQ ID NO: 292332 - RNA, 62 nt, Homo Sapiens
uagauagugauacugaggguuauuuuaagaaaaaaggaaaaguacaaaucaaacaauuuaaa

SEQ ID NO: 292333 - RNA, 62 nt, Homo Sapiens
auuuaugagugauugcucuacauuauuucuucaaaggaaaggaaaggaauugaagacuuugc

SEQ ID NO: 292334 - RNA, 62 nt, Homo Sapiens
ugagugauugcucuacauuauuucuucaaaggaaaggaaaggaauugaagacuuugcuacuc

SEQ ID NO: 292335 - RNA, 62 nt, Homo Sapiens
ugucauugguauaugguggcuguuuaccaauaaaaggaaaaaauucauuaaccgguugcuuc

SEQ ID NO: 292336 - RNA, 62 nt, Homo Sapiens
uuccuugucucaugaaaaccuaaauauaaaaaaaaggaaaauacuggaguuuuuauuucucu

SEQ ID NO: 292337 - RNA, 62 nt, Homo Sapiens
gacaguuauuccauaaagcauuuguauaauuaaaaggaaaacagaaaaaggaaaaguaggca

SEQ ID NO: 292338 - RNA, 62 nt, Homo Sapiens
aaagcauuuguauaauuaaaaggaaaacagaaaaaggaaaaguaggcaaaugugaaaauagu

SEQ ID NO: 292339 - RNA, 62 nt, Homo Sapiens
gcagagcuauagauagaaacagcuggaaaacuaaaggaaaaauacaaguguuuucggggcau

SEQ ID NO: 292340 - RNA, 62 nt, Homo Sapiens
cuuucccucuccccgcugccaaaaaaaaaaaaaaaggaaacguuuaucaugaaucaacaggg

SEQ ID NO: 292341 - RNA, 62 nt, Homo Sapiens
ccauuucuguuaaccucuuaucacuaagaaagaaaggaaagaaggagaugaauagaagaaag

SEQ ID NO: 292342 - RNA, 62 nt, Homo Sapiens
uaaaccacagucuggagugauagcuacuguagaaaggaaauagacuuuguaugaacucuuua

SEQ ID NO: 292343 - RNA, 62 nt, Homo Sapiens
gccuagcuccaggcuguguuuacuuuguggucaaaggaaaucgugcugaguuagacuccagg

SEQ ID NO: 292344 - RNA, 62 nt, Homo Sapiens
cuaccaguuuuuuauucagauagcaaaacaggaaaggaaaagucuagaaagccacuguuuua

SEQ ID NO: 292345 - RNA, 62 nt, Homo Sapiens
aaagacuuaaaacuggaguggggagacauaagaaaggaaagauuuaaaacuugaauauaggu

SEQ ID NO: 292346 - RNA, 60 nt, Homo Sapiens
ucuucugcuugucugcaaaugaguccuggaaaaggaaaauuggagauguaugauauuuga

SEQ ID NO: 292347 - RNA, 62 nt, Homo Sapiens
aacuaccuuuuuauaaugcaugacuuaaaacaaaaggaaagauuuaaaaaucuaccuguucc

SEQ ID NO: 292348 - RNA, 62 nt, Homo Sapiens
uugaggggggggcauuaguguuucuauaagaaaaaggaaaagagguauuguaagcuuuccau

SEQ ID NO: 292349 - RNA, 62 nt, Homo Sapiens
aauaaaauauguucguuuauguaacugauuuaaaaggaaaauuaaacagucuucauuuuuaa

SEQ ID NO: 292350 - RNA, 62 nt, Homo Sapiens
cacagaacauaucuucacauagggccaaguucaaaggaaaugaagaaaagaaaagaaaucau

SEQ ID NO: 292351 - RNA, 62 nt, Homo Sapiens
ugaucaaaaacaaaguaaggcaaaauucagcuaaaggaaaaaaguaagugcuauuggcauuc

SEQ ID NO: 292352 - RNA, 62 nt, Homo Sapiens
ugaacacuauaaaacuauuacaguauaguuagaaaggaaagcuaugauuugcacuauuagua

SEQ ID NO: 292353 - RNA, 62 nt, Homo Sapiens
agaggagagucuuacggagggcugggagcuuaaaaggaaaacaauguccuuacuuguaaaca

SEQ ID NO: 292354 - RNA, 62 nt, Homo Sapiens
cgacuucuguuucacaguucagaccggucuucaaaggaaaagccuguccgauuuuuccaugg

SEQ ID NO: 292355 - RNA, 62 nt, Homo Sapiens
cagaaaagcaaagucaguguacacucugagugaaaggaaauguaauguggauaaaggcccgc

SEQ ID NO: 292356 - RNA, 62 nt, Homo Sapiens
uuaugauaccaaaaaaauuacaguuuuguuuaaaaggaaauguugauguuuucaacuccaaa

SEQ ID NO: 292357 - RNA, 62 nt, Homo Sapiens
gcugaaaucuauucucauucuuguuugucaagaaaggaaaaucuguuauucaagguaaauua

SEQ ID NO: 292358 - RNA, 62 nt, Homo Sapiens
ccaucuuaguuuuguuaaaaaaaaaaaaaaaaaaaggaaacagccucacuuuuuugugcucc

SEQ ID NO: 292359 - RNA, 62 nt, Homo Sapiens
cagugccaaauaugagaggauuuaccuaauuaaaaggaaaggaugaagauuauaacuguuua

SEQ ID NO: 292360 - RNA, 62 nt, Homo Sapiens
aacuacugggaaauuaugcauaaggcucauuaaaaggaaagguuuaauuagucaaacuaaau

SEQ ID NO: 292361 - RNA, 62 nt, Homo Sapiens
uuuuucaacuucuucuauaugucuuuuaauaaaaaggaaauaaaaugauuaugauuaguuau

SEQ ID NO: 292362 - RNA, 62 nt, Homo Sapiens
accuuuauuuuauuuuuuuuuuuauuauuuucaaaggaaaaccauauagccagggauugaag

SEQ ID NO: 292363 - RNA, 62 nt, Homo Sapiens
uacauucccgguguuaguagguuaauauugagaaaggaaaaaaauaugaauauauaucaugu

SEQ ID NO: 292364 - RNA, 62 nt, Homo Sapiens
uuugagcugcaccuucaguuccuuggauaagaaaaggaaacuagacaaugguccuauaaugc

SEQ ID NO: 292365 - RNA, 62 nt, Homo Sapiens
gaagguaauugaauagaauagaguguugguggaaaggaaacugauagguuaggucucauuug

SEQ ID NO: 292366 - RNA, 62 nt, Homo Sapiens
gguacacuuucagauaauuucaguaaaaguaaaaaggaaaaacaacaucaccuuaaagucgu

SEQ ID NO: 292367 - RNA, 62 nt, Homo Sapiens
gaauguagcucaacuugugaguucaacucuauaaaggaaaagugcaaucaccccugccuuuu

SEQ ID NO: 292368 - RNA, 62 nt, Homo Sapiens
agacagaaugauuuccaaaauaaaccaaguucaaaggaaaauaacccuuucaaaaguguuug

SEQ ID NO: 292369 - RNA, 62 nt, Homo Sapiens
cauuuauauuaaagaauuugguucuuauuguaaaaggaaaguaaaagugggaaggugaugcu

SEQ ID NO: 292370 - RNA, 62 nt, Homo Sapiens
uugaaccuuauguaccgagcaauaaaaaaaggaaaggaaacuacauugcaaaauauaaaaua

SEQ ID NO: 292371 - RNA, 62 nt, Homo Sapiens
aaacuuugaaccuuauguacaaauaaauaaaaaaaggaaaggaaaaaacauugcaaaauaua

SEQ ID NO: 292372 - RNA, 62 nt, Homo Sapiens
ugucauucaggguuuccugacugcuaaugcagaaaggaaaaucguaaaggaaacagaaagau

SEQ ID NO: 292373 - RNA, 62 nt, Homo Sapiens
uuccugacugcuaaugcagaaaggaaaaucguaaaggaaacagaaagaugaaauaagccauu

SEQ ID NO: 292374 - RNA, 57 nt, Homo Sapiens
agaucccacuggauggguagcugaaauaaaggaaaagacagagaaaggggcuguggu

SEQ ID NO: 292375 - RNA, 62 nt, Homo Sapiens
uuaagaacuauuuuaaaguguuccagacccaaaaaggaaaaauaaaaaaaaaggaauauuug

SEQ ID NO: 292376 - RNA, 62 nt, Homo Sapiens
agcaauccugcugcuggguauauacccgaaagaaaggaaaaggaagccaguauauugaagag

SEQ ID NO: 292377 - RNA, 62 nt, Homo Sapiens
uagagaguagaagguugguuaccagaagcuggaaaggaaagugggguugggaggaagguggg

SEQ ID NO: 292378 - RNA, 62 nt, Homo Sapiens
aaagaaagaaaaagaaagaaagaaagaaagagaaaggaaauuauaaggucaaguuaacaguu

SEQ ID NO: 292379 - RNA, 62 nt, Homo Sapiens
acagauagagauaauagaagacaaagagauuaaaaggaaauaaaaaugcaugauuaaaaacu

SEQ ID NO: 292380 - RNA, 62 nt, Homo Sapiens
cuaagaauaaaaaaccuauuuuuauguuuccuaaaggaaauuguuuauucuacagccucagu

SEQ ID NO: 292381 - RNA, 62 nt, Homo Sapiens
aacaguuugaacacaaaggcgaaaaaaagaaaaaaggaaaaaagaaaaaaugaaaaaaaaag

SEQ ID NO: 292382 - RNA, 62 nt, Homo Sapiens
aagaaaaaaggaaaaaaacaaaaaugaaaaaaaaaggaaaaauugaaaucuuaaaaaaagaa

SEQ ID NO: 292383 - RNA, 62 nt, Homo Sapiens
aacugaagaaagaagauaauacacaaaggcagaaaggaaagagaggaagacuggacaaaaca

SEQ ID NO: 292384 - RNA, 62 nt, Homo Sapiens
aggaagacuggacaaaacaauuaaauaaaaaaaaaggaaaaguaguuuaagaaauuuuuuuu

SEQ ID NO: 292385 - RNA, 62 nt, Homo Sapiens
guuaauauguuucuguuguuguuaaauuugccaaaggaaacuucacaucagcauucacuucc

SEQ ID NO: 292386 - RNA, 62 nt, Homo Sapiens
aaaauuauguggugugaaacuuaaguuacauaaaaggaaaacgcauccuucuugcuuauacg

SEQ ID NO: 292387 - RNA, 62 nt, Homo Sapiens
ucauauuuauuccugcaccccccauuuuggggaaaggaaaagcucugcuuuucugucaacau

SEQ ID NO: 292388 - RNA, 62 nt, Homo Sapiens
aaauuaccacugggaaaaucaaguaaaaacagaaaggaaaagcuaacaacacugauaauagg

SEQ ID NO: 292389 - RNA, 62 nt, Homo Sapiens
cucaagccucuauucaccccguccuaccacacaaaggaaaguccaggggauuucuccuccaa

SEQ ID NO: 292390 - RNA, 62 nt, Homo Sapiens
ccaaucuuauuauggaaagcuuuuuuuuuuuuaaaggaaaucaaugcaguuuggccucuuuu

SEQ ID NO: 292391 - RNA, 62 nt, Homo Sapiens
aggcccaagugcaaaagaaauuccugaauuggaaaggaaaaguaccaggcacuuaaagccuu

SEQ ID NO: 292392 - RNA, 62 nt, Homo Sapiens
gugaacaaacuuagaaaggguuccguuuuagaaaaggaaaacaauacagucuaguuuccugg

SEQ ID NO: 292393 - RNA, 62 nt, Homo Sapiens
uuaaaacccaauacagucuaucagcuuuguccaaaggaaagcagugacaccacacauuuaau

SEQ ID NO: 292394 - RNA, 62 nt, Homo Sapiens
aaaugcacauaaauuuggaagauaccaaaaaaaaaggaaauagaagugcuaucuaaugcagu

SEQ ID NO: 292395 - RNA, 62 nt, Homo Sapiens
uacagaucaauauuuccaguaaacauuacaagaaaggaaaaccuaauaccaaagccaggcaa

SEQ ID NO: 292396 - RNA, 62 nt, Homo Sapiens
auaauugagaaaguguucauuuauagaaaaaaaaaggaaaaaaaaaaauaucauuugacuuu

SEQ ID NO: 292397 - RNA, 62 nt, Homo Sapiens
aauguauaccguaucuaucuacucgggccacgaaaggaaagagacacccgcgcguggggagg

SEQ ID NO: 292398 - RNA, 62 nt, Homo Sapiens
ugaaaaagcauaagaaauuuuuaggguuagauaaaggaaaaguaaacaggaaauuagaagug

SEQ ID NO: 292399 - RNA, 62 nt, Homo Sapiens
aacgaaugcacuucauauagauaauaauaacaaaaggaaagccuuguuacaacaauuuaaaa

SEQ ID NO: 292400 - RNA, 62 nt, Homo Sapiens
caaacuguaaauguauaaauucaaaaaagaugaaaggaaaugacaugcagaauugaauuugc

SEQ ID NO: 292401 - RNA, 62 nt, Homo Sapiens
auggaaggaaagugauucuguguagggacaggaaaggaaacagaaugaagcaagggaaggca

SEQ ID NO: 292402 - RNA, 62 nt, Homo Sapiens
aaaacaaacuuguucuuugcuucuaaauuuaaaaaggaaaaccuaauguguuguaaacaaga

SEQ ID NO: 292403 - RNA, 62 nt, Homo Sapiens
augcuggucaucacaggaacgaaaauuccucaaaaggaaauuuccugaggcugaugaauugu

SEQ ID NO: 292404 - RNA, 62 nt, Homo Sapiens
gaaaaacaaaaucuccgcaggaucggacuaaaaaaggaaaaaacccaucuggaggaaaacca

SEQ ID NO: 292405 - RNA, 62 nt, Homo Sapiens
auggggguggggggugggggcgaacaaaagggaaaggaaaaaccacuggaugagcggugaga

SEQ ID NO: 292406 - RNA, 62 nt, Homo Sapiens
cacaaauugcccccagauugaccuuugcaaagaaaggaaaaacaggagcugucuggagcucc

SEQ ID NO: 292407 - RNA, 62 nt, Homo Sapiens
uucccuuaacucuuucugcuggaacaggaaugaaaggaaaccuguucaaaagcaaaagagaa

SEQ ID NO: 292408 - RNA, 62 nt, Homo Sapiens
aguuuauuuugcuauugugaaaaacuaaauguaaaggaaaucaccuacuuucaugcaggugu

SEQ ID NO: 292409 - RNA, 62 nt, Homo Sapiens
ucaccuacuuucaugcagguguauaaucuugaaaaggaaaaaugcuuccauguugaagccag

SEQ ID NO: 292410 - RNA, 62 nt, Homo Sapiens
ugaaaagaaaaggggaaugugucccacuagugaaaggaaaacuuuucaacacuaucccugcu

SEQ ID NO: 292411 - RNA, 62 nt, Homo Sapiens
auucaaauuugauuguggcgaaucuacuucaaaaaggaaaaauaauccaacuuuguggauau

SEQ ID NO: 292412 - RNA, 62 nt, Homo Sapiens
gugagguuuauacuauuucugguuuuuaaccaaaaggaaaucaucuggaagcaggaggcaaa

SEQ ID NO: 292413 - RNA, 62 nt, Homo Sapiens
aagguugacauauuccaaaacccuucuuuuuaaaaggaaaaaggauggagagaaggauggaa

SEQ ID NO: 292414 - RNA, 62 nt, Homo Sapiens
cgaagcagaggaaaagaaacguuuucagaccuaaaggaaauguuuggucauguuaagaaaac

SEQ ID NO: 292415 - RNA, 62 nt, Homo Sapiens
gugggaggguaagaguuuugacaaguuguggcaaaggaaacuauacuuuucauuuuuaaaaa

SEQ ID NO: 292416 - RNA, 62 nt, Homo Sapiens
uugcaaacacauggcuccaucuucugcacacgaaaggaaagucccucuccuuuucuacaguc

SEQ ID NO: 292417 - RNA, 62 nt, Homo Sapiens
gaucccagggugaggagaagauugggacauagaaaggaaacugcaucagaaacaugaacaga

SEQ ID NO: 292418 - RNA, 62 nt, Homo Sapiens
aguuuucauaaaacucauggacaaaugaugugaaaggaaagucauggguguggcauucucua

SEQ ID NO: 292419 - RNA, 62 nt, Homo Sapiens
aaagguugucucuugauuucuuugcuacuuugaaaggaaaaaagccaaucuuuuauuguucc

SEQ ID NO: 292420 - RNA, 62 nt, Homo Sapiens
caaaacuaauaaaauugcuguagcaaaaucuaaaaggaaaauggagaaaauagagaacauga

SEQ ID NO: 292421 - RNA, 62 nt, Homo Sapiens
agucuuucagaaucugucaggaaacaaugcgcaaaggaaagcgagaaaggagugagaaggaa

SEQ ID NO: 292422 - RNA, 60 nt, Homo Sapiens
guggcaagauuccaucagcuaaagucuauucaaaaggaaauuuucacuuugcucucaauu

SEQ ID NO: 292423 - RNA, 62 nt, Homo Sapiens
ucaguugaucuucuucauccccuccucacuaaaaaggaaacuuucaagucugacucuccacu

SEQ ID NO: 292424 - RNA, 62 nt, Homo Sapiens
caauucugccauguuuuugcacuggguccaccaaaggaaaccagugguugggaaacucauuu

SEQ ID NO: 292425 - RNA, 62 nt, Homo Sapiens
aaugcguauauuucuauguuagcuuucuuuaaaaaggaaaaagguaacugaugauauaaaca

SEQ ID NO: 292426 - RNA, 62 nt, Homo Sapiens
agauuucuucagugacuuugccuugaaaguuaaaaggaaagcgaacuacauuuuucuuauug

SEQ ID NO: 292427 - RNA, 62 nt, Homo Sapiens
uaugguuuccagagaaaagguugauuauuaaaaaaggaaaaauucuuacauauacaucuuag

SEQ ID NO: 292428 - RNA, 62 nt, Homo Sapiens
uccccaaaguauuaaagaauuuuguuaaaggaaaaggaaaugauaguaucacuucuauucuu

SEQ ID NO: 292429 - RNA, 62 nt, Homo Sapiens
gaaauguccccaaaguauuaauucuuuuuguuaaaggaaaagcaguauauaguaucacuucu

SEQ ID NO: 292430 - RNA, 62 nt, Homo Sapiens
caggugcuuuuuaaaaaucagcaagaugaaaaaaaggaaaaguaaaagcugaaaauuuagaa

SEQ ID NO: 292431 - RNA, 62 nt, Homo Sapiens
aaggaaggagguucagugagugacuugaaggcaaaggaaacuuuaauuccagaagagaggaa

SEQ ID NO: 292432 - RNA, 62 nt, Homo Sapiens
caggacuuguggggugggugugcgcaguugggaaaggaaagcguugcagcuguaaucaauug

SEQ ID NO: 292433 - RNA, 62 nt, Homo Sapiens
guuaaacaaacaaaaaaaaauuuuaaacaaagaaaggaaaaaaauugacaauaaaagucacu

SEQ ID NO: 292434 - RNA, 62 nt, Homo Sapiens
auacacuuuacuaaucaugaaauucuaaccuaaaaggaaaacauuuuccugcuugucuuaga

SEQ ID NO: 292435 - RNA, 62 nt, Homo Sapiens
uucaauuucuacacaauauaaauauccaguauaaaggaaagcguuaagucgguaagcuagag

SEQ ID NO: 292436 - RNA, 62 nt, Homo Sapiens
uaaggcuaguguacuagauguacuuuuucuaaaaaggaaaggacagaaaaaaaugaagaaag

SEQ ID NO: 292437 - RNA, 62 nt, Homo Sapiens
uucuaaaaaggaaaggacagaaaaaaaugaagaaaggaaaggaagacaaauguaaagaaaua

SEQ ID NO: 292438 - RNA, 62 nt, Homo Sapiens
cuuguuccagcccggaguuuugggaaagaaagaaaggaaaggucacagugaccuaggauugg

SEQ ID NO: 292439 - RNA, 62 nt, Homo Sapiens
cugauuuaccgauguauuuaauguaaguaaaaaaaggaaaaaaagaaaagggcauuggagug

SEQ ID NO: 292440 - RNA, 62 nt, Homo Sapiens
aucuagggucuguaaccguuuugguuugagaaaaaggaaaggccccuugucacauccucuaa

SEQ ID NO: 292441 - RNA, 62 nt, Homo Sapiens
auauuuuagugggagccagacuauaaggaauaaaaggaaaaacuuucuuccucucucuccaa

SEQ ID NO: 292442 - RNA, 62 nt, Homo Sapiens
acagagguuacauauucuggguguucuuuuauaaaggaaacauuuuaaaucccacaaauuga

SEQ ID NO: 292443 - RNA, 62 nt, Homo Sapiens
guaugauccuuacuacuggaauuaccggguuaaaaggaaaugcuuaccacuaagaugucagu

SEQ ID NO: 292444 - RNA, 62 nt, Homo Sapiens
aguauagccccacuuauacucucaguauccugaaaggaaaaaagcugccaguuuacacauuu

SEQ ID NO: 292445 - RNA, 62 nt, Homo Sapiens
acuagcaaaaagaauagccaagaaaaaagugaaaaggaaacaaaaaaagauaaaguagaaaa

SEQ ID NO: 292446 - RNA, 62 nt, Homo Sapiens
ugucccaggauucauccuaauagugcuuuuuuaaaggaaaguuaagugucuaaacuaagguu

SEQ ID NO: 292447 - RNA, 62 nt, Homo Sapiens
agugccuguccagcagggaguguaccagggauaaaggaaagagaacagacaaguggaagggc

SEQ ID NO: 292448 - RNA, 62 nt, Homo Sapiens
aguaguuaaggauaccugauagauaguuucuaaaaggaaaucuuaugaaaaucuaacacuca

SEQ ID NO: 292449 - RNA, 62 nt, Homo Sapiens
uuauuuucaaaaaccuaaucaccauuuuccaaaaaggaaacuuaagacauuucugaauguag

SEQ ID NO: 292450 - RNA, 62 nt, Homo Sapiens
ucucaaggccuuuugaagaguuucuuaaucagaaaggaaaauaaaauauugcagugcuauuu

SEQ ID NO: 292451 - RNA, 62 nt, Homo Sapiens
uguaauaauugauaugauuuguuauuaacaaaaaaggaaaaacaagagacuuccauguccug

SEQ ID NO: 292452 - RNA, 62 nt, Homo Sapiens
agaucagucacccaugugaauaagaagccaggaaaggaaagauggggaagcccagaucacca

SEQ ID NO: 292453 - RNA, 62 nt, Homo Sapiens
gugacaaaugaacagcaggauuaugaauuaucaaaggaaaaaguauuugcugaggugaaaaa

SEQ ID NO: 292454 - RNA, 62 nt, Homo Sapiens
uaauagaauacuaguaggauagaaacaacuagaaaggaaagugugacacaguuuuuaaauuu

SEQ ID NO: 292455 - RNA, 62 nt, Homo Sapiens
auguagaaaauaaugaauuaaugagauuggugaaaggaaaucaugcaaaacauuugaaugca

SEQ ID NO: 292456 - RNA, 62 nt, Homo Sapiens
aauauuaguaaaauaaacacauuucuuuuuuuaaaggaaauuauaaaccuuuugcccccaua

SEQ ID NO: 292457 - RNA, 62 nt, Homo Sapiens
uauuuggcuccuuuaauuccagaugcauuaucaaaggaaaaauuauucaguguugcgguagc

SEQ ID NO: 292458 - RNA, 62 nt, Homo Sapiens
aaaaucuaaaacugcgaagaugguuuucgcuuaaaggaaaaauggaauuuuuuucaguggag

SEQ ID NO: 292459 - RNA, 62 nt, Homo Sapiens
uucuauucauaaucaggguaacaaguuauuaaaaaggaaaggauuggaauuuauauuaaaag

SEQ ID NO: 292460 - RNA, 62 nt, Homo Sapiens
aauaaguauucuugcaucuggucuucuauuuaaaaggaaaaguuucauaaauuuuauggcau

SEQ ID NO: 292461 - RNA, 62 nt, Homo Sapiens
aaguauauugcugcacuuuucauuucguagauaaaggaaacuguuuugaauuggaauugcac

SEQ ID NO: 292462 - RNA, 62 nt, Homo Sapiens
cagcaaaacaaaaagcaaacgucccugaguauaaaggaaaaauguuuaaguugaaagcaaga

SEQ ID NO: 292463 - RNA, 62 nt, Homo Sapiens
agauuauuguaaauauuuuaguauucaaagaaaaaggaaaaaaacauuuuugucauauucuu

SEQ ID NO: 292464 - RNA, 62 nt, Homo Sapiens
gcuuuagaaauuuuaacucccagaacaaaagcaaaggaaaauaaagacaaacuaaaacaaaa

SEQ ID NO: 292465 - RNA, 62 nt, Homo Sapiens
cugaaagcuuguucuaucacuguaaaggaaagaaaggaaaaaguuucacugugaauagugaa

SEQ ID NO: 292466 - RNA, 62 nt, Homo Sapiens
aaggaaaaacugaaagcuugaauagugaauguaaaggaaagacaugcaccuguuucacugug

SEQ ID NO: 292467 - RNA, 62 nt, Homo Sapiens
aaaacacagaguuguaaauaguaaaaucuccuaaaggaaauagaaagaaacuguauuucaga

SEQ ID NO: 292468 - RNA, 62 nt, Homo Sapiens
aaauauguaaauucuauugagaaaaccauuuuaaaggaaagaaaauugauuauacaggcuau

SEQ ID NO: 292469 - RNA, 62 nt, Homo Sapiens
acucuaguuuugcaaguauaauuuucccauuuaaaggaaaacaagccccaaggacacaaaac

SEQ ID NO: 292470 - RNA, 62 nt, Homo Sapiens
ucccuguuucaaaaucuauuaggugcaagugcaaaggaaauuuucagcauuuuuagggaccu

SEQ ID NO: 292471 - RNA, 62 nt, Homo Sapiens
auucuggaugguucuuugacuagucacuuuaaaaaggaaauggacauugaaagcgacauaaa

SEQ ID NO: 292472 - RNA, 62 nt, Homo Sapiens
uguagacucugacuuccgucaugaccauugaaaaaggaaaaaauaacuuuaauuaggaucau

SEQ ID NO: 292473 - RNA, 62 nt, Homo Sapiens
cagugggucugguggugcugaugauaccuauuaaaggaaaaccaguggguuaauuauacccc

SEQ ID NO: 292474 - RNA, 62 nt, Homo Sapiens
auggaaggguucacgcugauugucaugugaucaaaggaaaccggagaaggaaaucauaauga

SEQ ID NO: 292475 - RNA, 62 nt, Homo Sapiens
uuuuaaaacugcaacaagaggauauccaaaguaaaggaaaugaaauguaaugaauuuuauca

SEQ ID NO: 292476 - RNA, 62 nt, Homo Sapiens
acuaauaguaugcuguuaauuguguaagaaagaaaggaaauuagaaaacauauuugcauaaa

SEQ ID NO: 292477 - RNA, 62 nt, Homo Sapiens
agucugugaaaaaaaacaaaaguaaaguuauaaaaggaaaagaaaacagaggcuuuaaauua

SEQ ID NO: 292478 - RNA, 62 nt, Homo Sapiens
acgccuagcaguuucugguuccuuuaacagcaaaaggaaagagagguucugauucuuaccuc

SEQ ID NO: 292479 - RNA, 62 nt, Homo Sapiens
agcaucuccuugccuguuuucuuuauuaguccaaaggaaaacaacagcaacaaaaucuguuu

SEQ ID NO: 292480 - RNA, 62 nt, Homo Sapiens
aauauucaucauacucuaauucuagcaaguagaaaggaaaaaauauuuauggacuuugagua

SEQ ID NO: 292481 - RNA, 62 nt, Homo Sapiens
aaaauauacaugaugggauuucucaaaaacaaaaaggaaaagaguaacaaaaugagacccua

SEQ ID NO: 292482 - RNA, 62 nt, Homo Sapiens
gccacuugauccucaacauauacuauaauugcaaaggaaacaugaggccaucuucccuuguu

SEQ ID NO: 292483 - RNA, 62 nt, Homo Sapiens
aagugaccuuaacuguauuuauucucaaagggaaaggaaauaucagauguuuauuugguuau

SEQ ID NO: 292484 - RNA, 62 nt, Homo Sapiens
gguuuuaguugagucuucacauuuagaauuugaaaggaaaaacagaacauuucucaugugcu

SEQ ID NO: 292485 - RNA, 62 nt, Homo Sapiens
agaacauuucucaugugcuuuguagcuuaaaaaaaggaaaacucaccauuucauccauauuu

SEQ ID NO: 292486 - RNA, 62 nt, Homo Sapiens
cggguuagugguaguauuauuguuauuuuuuuaaaggaaacaaacagacaacaaaaagaaga

SEQ ID NO: 292487 - RNA, 62 nt, Homo Sapiens
uuacccccccacuaugcccucauuuuuuuaaaaaaggaaaaaaaaaagaaacuggguuccag

SEQ ID NO: 292488 - RNA, 62 nt, Homo Sapiens
auaaaaaaauaaauaaaaauaaaaaaaauaaaaaaggaaaaaaaaaaaagaagaaacaagac

SEQ ID NO: 292489 - RNA, 62 nt, Homo Sapiens
caucucuugugacagccuggcguccugucuguaaaggaaauugaccauggccuguuaggagg

SEQ ID NO: 292490 - RNA, 62 nt, Homo Sapiens
cugagaugguugccaggacuuggggaaucaggaaaggaaagaaaaaguggucccgcuaccau

SEQ ID NO: 292491 - RNA, 62 nt, Homo Sapiens
gguaugaguacauuuuuaaugauuuauuuaaaaaaggaaaaauugaaaagaugaaaaauaaa

SEQ ID NO: 292492 - RNA, 62 nt, Homo Sapiens
ugaauaaauggagagagagagggccacuuuacaaaggaaauugaaauuuaagucuucacuga

SEQ ID NO: 292493 - RNA, 62 nt, Homo Sapiens
gcuggggcuauauauacuggaaguugaagguuaaaggaaaagcacaagaaacuuuggaagca

SEQ ID NO: 292494 - RNA, 62 nt, Homo Sapiens
ucccuuuauaaagagugcuacaugguuuagauaaaggaaacauauaacuauugaguuacagg

SEQ ID NO: 292495 - RNA, 62 nt, Homo Sapiens
aaccugggauaauucuuuacuuuuuuugaaauaaaggaaaggaaauucagacucuuacauug

SEQ ID NO: 292496 - RNA, 62 nt, Homo Sapiens
gggauaauucuuuacuuuuuuugaaauaaaggaaaggaaauucagacucuuacauuguucuc

SEQ ID NO: 292497 - RNA, 62 nt, Homo Sapiens
agaaggcauuuaauccaguaucucuaguguacaaaggaaacuugaaguuuuaauggauuauu

SEQ ID NO: 292498 - RNA, 62 nt, Homo Sapiens
uauagcauaguauguuuauccauucgcccauuaaaggaaaucuugauugcuuccaguuuuca

SEQ ID NO: 292499 - RNA, 62 nt, Homo Sapiens
uucuggcuccugauaggguggagcaaaaguggaaaggaaaggaaagaggccuuuucucacag

SEQ ID NO: 292500 - RNA, 62 nt, Homo Sapiens
gcuccugauaggguggagcaaaaguggaaaggaaaggaaagaggccuuuucucacagccauu

SEQ ID NO: 292501 - RNA, 62 nt, Homo Sapiens
cugcucacacuccagaauuaaauucuauugaaaaaggaaaaucagcaauucagcaaaaaaua

SEQ ID NO: 292502 - RNA, 62 nt, Homo Sapiens
aaugacagauguucuguuuuuauaaccuaccaaaaggaaacuagaggcuucuuggugaagag

SEQ ID NO: 292503 - RNA, 62 nt, Homo Sapiens
auccuucccuagagcuaguauacgcuguuuaaaaaggaaaaacauccuaggcaacagaguga

SEQ ID NO: 292504 - RNA, 62 nt, Homo Sapiens
aggagaagguggaaaugggucagaaggaaaaaaaaggaaaauagagugagacuccaucucaa

SEQ ID NO: 292505 - RNA, 62 nt, Homo Sapiens
agaaaagauuuuugcagaauuaacagaagggaaaaggaaagaaaagaaaggacauugaguuu

SEQ ID NO: 292506 - RNA, 62 nt, Homo Sapiens
aaaaaaagaaaggacauugaugccuggagcaaaaaggaaaaagagcagaacaaaucgucagg

SEQ ID NO: 292507 - RNA, 62 nt, Homo Sapiens
aaaucugcugcugaacuuguuagacauuuuugaaaggaaaauuagguuagcguacaauuuau

SEQ ID NO: 292508 - RNA, 62 nt, Homo Sapiens
uuacugcaaaguuuguuuauacuuuugccuaaaaaggaaauuggaugggauacuguggcaaa

SEQ ID NO: 292509 - RNA, 62 nt, Homo Sapiens
ggcucuuuuuuuaaaagaugcgcucuaccugaaaaggaaauuggauuuuagaacuggaugug

SEQ ID NO: 292510 - RNA, 62 nt, Homo Sapiens
uaaaaccucuugcuugugugcaaaaguuccuaaaaggaaacacaaguaaugccuauccauua

SEQ ID NO: 292511 - RNA, 62 nt, Homo Sapiens
auagaaacuugaagugcuaaauggaauaauccaaaggaaauuuuuuaaaugcagguucuagc

SEQ ID NO: 292512 - RNA, 62 nt, Homo Sapiens
guuaaaccauucugggauuugggaacuucuuuaaaggaaaauuguaguagaggucaucuuga

SEQ ID NO: 292513 - RNA, 62 nt, Homo Sapiens
cauacauuucugccacauucuuaaguagcaaaaaaggaaaagugcuuuccuccucugcagga

SEQ ID NO: 292514 - RNA, 62 nt, Homo Sapiens
caacaacaaaaaaacuauauuaaacaggguuuaaaggaaauuaaaacagaacuaugagaagu

SEQ ID NO: 292515 - RNA, 62 nt, Homo Sapiens
aguguggggagucaugggguguggaggggaggaaaggaaagguauuuuguuucuuugucuau

SEQ ID NO: 292516 - RNA, 62 nt, Homo Sapiens
ugaaagcuuuaauuuagaaagaaaguucaaguaaaggaaauuauuuugauuaaauauauuuu

SEQ ID NO: 292517 - RNA, 62 nt, Homo Sapiens
aagggguggccugacacuggaaaaaaaaaaggaaaggaaagauacauaauuuguaccaaaaa

SEQ ID NO: 292518 - RNA, 62 nt, Homo Sapiens
aaagaaagggguggccugacaaaaaaaaaaaaaaaggaaagguguuuuacauaauuuguacc

SEQ ID NO: 292519 - RNA, 62 nt, Homo Sapiens
gagaccgaaaacuuagggucucuaucaaaggaaaaggaaacuguucauacagugaauaaaga

SEQ ID NO: 292520 - RNA, 62 nt, Homo Sapiens
gaaacugagaccgaaaacuuuaaagaucuaucaaaggaaaaggacucuguucauacagugaa

SEQ ID NO: 292521 - RNA, 62 nt, Homo Sapiens
aaauacauauuguuuaaaaaaaagcaagaaaaaaaggaaaacaaaggaaaauauccccaaag

SEQ ID NO: 292522 - RNA, 62 nt, Homo Sapiens
uguuuaaaaaaaagcaagaaaaaaaggaaaacaaaggaaaauauccccaaaguuguuuucua

SEQ ID NO: 292523 - RNA, 62 nt, Homo Sapiens
cauuuagucugcauuuccugaauguguaaaugaaaggaaagugggaaccacuucauucugaa

SEQ ID NO: 292524 - RNA, 62 nt, Homo Sapiens
auauguuaaugaacauauaggaaguuuuauuuaaaggaaagaaugcucacaacuaagcauag

SEQ ID NO: 292525 - RNA, 62 nt, Homo Sapiens
ucgagauuuuggaauucgugcaggaagccaugaaaggaaagaucagugaagacagcaaucac

SEQ ID NO: 292526 - RNA, 62 nt, Homo Sapiens
cuuguaauuuuaugugcuuucaucacaaauccaaaggaaagaauaaaaauuucuuaacacaa

SEQ ID NO: 292527 - RNA, 62 nt, Homo Sapiens
ucucagcaaacacgggacuguguucaguccacaaaggaaaagcguuuuugaagcucucauug

SEQ ID NO: 292528 - RNA, 62 nt, Homo Sapiens
gcaucacuauagggggucaauauuuacacaaaaaaggaaagucacaagccuguuuaaaauga

SEQ ID NO: 292529 - RNA, 62 nt, Homo Sapiens
aggcauaaaaugaccuucuauaucacugcuaaaaaggaaaaauuaauagguugcuaauuauu

SEQ ID NO: 292530 - RNA, 62 nt, Homo Sapiens
aaaaagcacuuuuuucuuaaaaaaaaagaaagaaaggaaaacacuuuucuggcaaaaaaaaa

SEQ ID NO: 292531 - RNA, 62 nt, Homo Sapiens
cagaacaugcaaaaggccuguucaggagaacaaaaggaaacaagaugaggacaugagaauaa

SEQ ID NO: 292532 - RNA, 62 nt, Homo Sapiens
agauccuccccucugcuuuuagaaaggaaaggaaaggaaaacucaaauugauacccuuaaua

SEQ ID NO: 292533 - RNA, 62 nt, Homo Sapiens
aaaacagauccuccccucuguaauaagaaaggaaaggaaagguauggucaaauugauacccu

SEQ ID NO: 292534 - RNA, 62 nt, Homo Sapiens
aaaggaaaacagauccucccacccuuaauaagaaaggaaaggugucuuauggucaaauugau

SEQ ID NO: 292535 - RNA, 62 nt, Homo Sapiens
caggcaaagggauccauauguaaaaaggaaaaaaaggaaacucugcugggucuuaacaagca

SEQ ID NO: 292536 - RNA, 62 nt, Homo Sapiens
aaggaaacucaggcaaaggguaacaagcauaaaaaggaaaaacguccauuccugcugggucu

SEQ ID NO: 292537 - RNA, 62 nt, Homo Sapiens
aggaggugccgggggccuggucagcagggaccaaaggaaaggguggcucuaggaauuggggu

SEQ ID NO: 292538 - RNA, 62 nt, Homo Sapiens
uugagguggcagagcagaccugcaguccagagaaaggaaagacuugaccugguggauguggc

SEQ ID NO: 292539 - RNA, 62 nt, Homo Sapiens
auaaauugggccagggugggagcagggaaagaaaaggaaaauaguagcaagagcugcaaagc

SEQ ID NO: 292540 - RNA, 62 nt, Homo Sapiens
agacuuuaggaucacgugugugacuaauacagaaaggaaacauggcgucggggagagggaua

SEQ ID NO: 292541 - RNA, 62 nt, Homo Sapiens
augcugguauuuuaacagauggagagacaaggaaaggaaaggaaaggccuggcaugggcauu

SEQ ID NO: 292542 - RNA, 62 nt, Homo Sapiens
gguauuuuaacagauggagagacaaggaaaggaaaggaaaggccuggcaugggcauugugag

SEQ ID NO: 292543 - RNA, 62 nt, Homo Sapiens
uuuaucccauauucaaauaaaacuuaugaauaaaaggaaaagguauacuuacaaugugaagu

SEQ ID NO: 292544 - RNA, 62 nt, Homo Sapiens
ugauuucaaacauugacaaguaccaagcauauaaaggaaaaauuucuuggaaagacucacuu

SEQ ID NO: 292545 - RNA, 62 nt, Homo Sapiens
uaccuuuuccauccuccuccucugccuucaaaaaaggaaacuuucccuugguugucuuaauu

SEQ ID NO: 292546 - RNA, 62 nt, Homo Sapiens
guaaauggcauccccuuaggcgccucuuugggaaaggaaaguggaugcuccuuugaggcagg

SEQ ID NO: 292547 - RNA, 62 nt, Homo Sapiens
cacaaagaagaaaaagaaacaguuugggaagaaaaggaaaagaaucccgcccacuaagacgc

SEQ ID NO: 292548 - RNA, 62 nt, Homo Sapiens
ucuguguuugugaggacugacucccauuuccuaaaggaaaugcccccggggaggacauuggg

SEQ ID NO: 292549 - RNA, 62 nt, Homo Sapiens
uaagcauaugugcuuucgcagcugauaauauaaaaggaaaucccacagucuagauauagccc

SEQ ID NO: 292550 - RNA, 62 nt, Homo Sapiens
accuaauuuucaagcauggaucuccauauuucaaaggaaaguuuuaaaaauguuuuuaaaac

SEQ ID NO: 292551 - RNA, 62 nt, Homo Sapiens
uggggaggucuuuuuuuucuguugugcucacgaaaggaaaaaggaauggcuuuguggucguc

SEQ ID NO: 292552 - RNA, 62 nt, Homo Sapiens
ucgggacucuauucauccacacuaccagaagaaaaggaaaccuugaaagugaaacuuugagc

SEQ ID NO: 292553 - RNA, 62 nt, Homo Sapiens
aaucaguguccguuugccaggggacacauuucaaaggaaauacuuguauaguguguuuaaau

SEQ ID NO: 292554 - RNA, 62 nt, Homo Sapiens
gacuuuuuuuuuaaacuuuacuucaguuuaaaaaaggaaaagaaaaaaaaucugaauucagc

SEQ ID NO: 292555 - RNA, 62 nt, Homo Sapiens
acagugcagaauuaaaccguacugugacaugcaaaggaaagguauuuaaugugugaacagcu

SEQ ID NO: 292556 - RNA, 62 nt, Homo Sapiens
accaguuuagacuaaguuacuaagagaggagcaaaggaaauucuuuaaauuuucccacacca

SEQ ID NO: 292557 - RNA, 62 nt, Homo Sapiens
uuuuaaaagccacguuauaguguuccagaauaaaaggaaauaauuguccuuucuccaguuuu

SEQ ID NO: 292558 - RNA, 62 nt, Homo Sapiens
uguuacagaaaagacaagaagaacauaagagaaaaggaaaccagaacauaagaacucaagga

SEQ ID NO: 292559 - RNA, 62 nt, Homo Sapiens
agaggaggauagagucaaggagagcaucagacaaaggaaaaguacagauuuagacaaagaca

SEQ ID NO: 292560 - RNA, 62 nt, Homo Sapiens
gaguuaugaagauacagauuaguccaagcauaaaaggaaaaaagaaaggccagagaaagagc

SEQ ID NO: 292561 - RNA, 62 nt, Homo Sapiens
ugcuuuaggcaugagucauaaugcagguuugaaaaggaaauguguaaaaagggaauaacugu

SEQ ID NO: 292562 - RNA, 62 nt, Homo Sapiens
cgucauuaaucuaaagacagaauaagugaaauaaaggaaacuuauuucauacuaaacuagug

SEQ ID NO: 292563 - RNA, 64 nt, Homo Sapiens; identical to SEQ ID NO: 161097

SEQ ID NO: 292564 - RNA, 64 nt, Homo Sapiens; identical to SEQ ID NO: 161098

SEQ ID NO: 292565 - RNA, 64 nt, Homo Sapiens; identical to SEQ ID NO: 161099

SEQ ID NO: 292566 - RNA, 64 nt, Homo Sapiens; identical to SEQ ID NO: 161100

SEQ ID NO: 292567 - RNA, 64 nt, Homo Sapiens; identical to SEQ ID NO: 161101

SEQ ID NO: 292568 - RNA, 64 nt, Homo Sapiens; identical to SEQ ID NO: 161102

SEQ ID NO: 292569 - RNA, 64 nt, Homo Sapiens; identical to SEQ ID NO: 161103

SEQ ID NO: 292570 - RNA, 64 nt, Homo Sapiens; identical to SEQ ID NO: 161104

SEQ ID NO: 292571 - RNA, 64 nt, Homo Sapiens; identical to SEQ ID NO: 161105

SEQ ID NO: 292572 - RNA, 64 nt, Homo Sapiens; identical to SEQ ID NO: 161106

SEQ ID NO: 292573 - RNA, 64 nt, Homo Sapiens; identical to SEQ ID NO: 161107

SEQ ID NO: 292574 - RNA, 64 nt, Homo Sapiens; identical to SEQ ID NO: 161108

SEQ ID NO: 292575 - RNA, 64 nt, Homo Sapiens; identical to SEQ ID NO: 161109

SEQ ID NO: 292576 - RNA, 64 nt, Homo Sapiens; identical to SEQ ID NO: 161110

SEQ ID NO: 292577 - RNA, 64 nt, Homo Sapiens; identical to SEQ ID NO: 161111

SEQ ID NO: 292578 - RNA, 64 nt, Homo Sapiens; identical to SEQ ID NO: 161112

SEQ ID NO: 292579 - RNA, 64 nt, Homo Sapiens; identical to SEQ ID NO: 161113

SEQ ID NO: 292580 - RNA, 64 nt, Homo Sapiens; identical to SEQ ID NO: 161114

SEQ ID NO: 292581 - RNA, 64 nt, Homo Sapiens; identical to SEQ ID NO: 161115

SEQ ID NO: 292582 - RNA, 64 nt, Homo Sapiens; identical to SEQ ID NO: 161116

SEQ ID NO: 292583 - RNA, 64 nt, Homo Sapiens; identical to SEQ ID NO: 161117

SEQ ID NO: 292584 - RNA, 64 nt, Homo Sapiens; identical to SEQ ID NO: 161118

SEQ ID NO: 292585 - RNA, 64 nt, Homo Sapiens; identical to SEQ ID NO: 161119

SEQ ID NO: 292586 - RNA, 64 nt, Homo Sapiens; identical to SEQ ID NO: 161120

SEQ ID NO: 292587 - RNA, 64 nt, Homo Sapiens; identical to SEQ ID NO: 161121

SEQ ID NO: 292588 - RNA, 64 nt, Homo Sapiens; identical to SEQ ID NO: 161122

SEQ ID NO: 292589 - RNA, 64 nt, Homo Sapiens; identical to SEQ ID NO: 161123

SEQ ID NO: 292590 - RNA, 64 nt, Homo Sapiens; identical to SEQ ID NO: 161124

SEQ ID NO: 292591 - RNA, 64 nt, Homo Sapiens; identical to SEQ ID NO: 161125

SEQ ID NO: 292592 - RNA, 64 nt, Homo Sapiens; identical to SEQ ID NO: 161126

SEQ ID NO: 292593 - RNA, 64 nt, Homo Sapiens; identical to SEQ ID NO: 161127

SEQ ID NO: 292594 - RNA, 64 nt, Homo Sapiens; identical to SEQ ID NO: 161128

SEQ ID NO: 292595 - RNA, 64 nt, Homo Sapiens; identical to SEQ ID NO: 161129

SEQ ID NO: 292596 - RNA, 64 nt, Homo Sapiens; identical to SEQ ID NO: 161130

SEQ ID NO: 292597 - RNA, 64 nt, Homo Sapiens; identical to SEQ ID NO: 161131

SEQ ID NO: 292598 - RNA, 64 nt, Homo Sapiens; identical to SEQ ID NO: 161132

SEQ ID NO: 292599 - RNA, 64 nt, Homo Sapiens; identical to SEQ ID NO: 161133

SEQ ID NO: 292600 - RNA, 64 nt, Homo Sapiens; identical to SEQ ID NO: 161134

SEQ ID NO: 292601 - RNA, 64 nt, Homo Sapiens; identical to SEQ ID NO: 161135

SEQ ID NO: 292602 - RNA, 64 nt, Homo Sapiens; identical to SEQ ID NO: 161136

SEQ ID NO: 292603 - RNA, 64 nt, Homo Sapiens; identical to SEQ ID NO: 161137

SEQ ID NO: 292604 - RNA, 64 nt, Homo Sapiens; identical to SEQ ID NO: 161138

SEQ ID NO: 292605 - RNA, 64 nt, Homo Sapiens; identical to SEQ ID NO: 161139

SEQ ID NO: 292606 - RNA, 64 nt, Homo Sapiens; identical to SEQ ID NO: 161140

SEQ ID NO: 292607 - RNA, 64 nt, Homo Sapiens; identical to SEQ ID NO: 161141

SEQ ID NO: 292608 - RNA, 64 nt, Homo Sapiens; identical to SEQ ID NO: 161142

SEQ ID NO: 292609 - RNA, 64 nt, Homo Sapiens; identical to SEQ ID NO: 161143

SEQ ID NO: 292610 - RNA, 64 nt, Homo Sapiens
uuuaaaaauacuacaauauuuuuugucuuuuucaauauacaaauguuuaucacuuaacagcuca

SEQ ID NO: 292611 - RNA, 64 nt, Homo Sapiens
aaguuucugccaucuagcuuugugaauaacccauauauacaacaccaaguuuuaaacaccuaaa

SEQ ID NO: 292612 - RNA, 64 nt, Homo Sapiens
uauacauuguuuucacuguauauauaaauaaaauauauacaauagcuacuauucaacuacacua

SEQ ID NO: 292613 - RNA, 64 nt, Homo Sapiens
ugacugagugcaguauuagaaaguacagugcaacauauacaaaugagagaaccaacguuccuaa

SEQ ID NO: 292614 - RNA, 64 nt, Homo Sapiens
auuagcugggcaucauggcaauaaaaaaauacauauauacaaaaucaugaaacaucaucucuac

SEQ ID NO: 292615 - RNA, 64 nt, Homo Sapiens
uuucauuuucucugaaagucaacauuguauguacauauacaaaaaauuugguuagaaguucuac

SEQ ID NO: 292616 - RNA, 64 nt, Homo Sapiens
uaaauugggcuaaaaauuaauaaaaccagagguuauauacaauuuuuaugccacaauuuaaaaa

SEQ ID NO: 292617 - RNA, 64 nt, Homo Sapiens
acaaggaaaaaaaugcauuuuggaaccagagguuauauacaacugcccauccaaauuugauaaa

SEQ ID NO: 292618 - RNA, 64 nt, Homo Sapiens
guuaauaguaaaacacuguuuggcuuuuaaauaaauauacaaugaugcuuuuucguauucuuua

SEQ ID NO: 292619 - RNA, 64 nt, Homo Sapiens
uaagcuuaaaacacuauaaauuaacccaguaaacauauacaaaguccugaaaagcugugacuca

SEQ ID NO: 292620 - RNA, 64 nt, Homo Sapiens
guauauuuuugcaaaauuguauacauauauacacauauacaaauuaguagauauauauauacac

SEQ ID NO: 292621 - RNA, 64 nt, Homo Sapiens
gauuuuuuaaaauaauagcauuucuuuauggucgauauacaauuuuuuuaugacuuuuauacua

SEQ ID NO: 292622 - RNA, 64 nt, Homo Sapiens
auaugcccauuccugugauaucuugccauauacaauauacaaacauuuggguuguguguauaca

SEQ ID NO: 292623 - RNA, 64 nt, Homo Sapiens
uacaaacauaugcccauuccguauacaucuugccauauacaauauguauacauuuggguugugu

SEQ ID NO: 292624 - RNA, 64 nt, Homo Sapiens
auuuauuuuaacguagacacuaaaaguaugugcaauauacaauuaaaguaggaauuuguuacug

SEQ ID NO: 292625 - RNA, 64 nt, Homo Sapiens
uacuggugaauugguuuucagguuuugagcauacauauacaauguguuucaaaugcugcuugua

SEQ ID NO: 292626 - RNA, 64 nt, Homo Sapiens
uuuauuuguuuguuuguuuuugaaaugaccauaaauauacaaauauaggacacuggguguuauc

SEQ ID NO: 292627 - RNA, 64 nt, Homo Sapiens
gggagacaacuguuuauagaauuuuauuguagauauauacaagaaaagagcgguacuuuacaug

SEQ ID NO: 292628 - RNA, 64 nt, Homo Sapiens
gucuacaaaggaauaaacauaauguguggccucuauauacaaacucuauuucugucaaugacau

SEQ ID NO: 292629 - RNA, 64 nt, Homo Sapiens
aaacuuuuaaggacuugagauaacuaauuuguuuauauacaaaaauuaauguuacuguguuacu

SEQ ID NO: 292630 - RNA, 64 nt, Homo Sapiens
auccugagauacccgauucuauauguaaaagcuaauauacaaaaaagcagauuaaauuacauga

SEQ ID NO: 292631 - RNA, 64 nt, Homo Sapiens
agcagaugccgcaacuccacacaguguguaaaauauauacaaccaaaaaucagcuuuugcaggu

SEQ ID NO: 292632 - RNA, 64 nt, Homo Sapiens
gguugggagauguggcuggaaaguacuuuggaaaauauacaaucaagauaucucauggcauauu

SEQ ID NO: 292633 - RNA, 64 nt, Homo Sapiens
agcaaacaugaaaaacugaacacaguuuuuacagauauacaauauggagugacuuauauacaaa

SEQ ID NO: 292634 - RNA, 64 nt, Homo Sapiens
acaguuuuuacagauauacaauauggagugacuuauauacaaaaugaccuuaaaaauauauuaa

SEQ ID NO: 292635 - RNA, 64 nt, Homo Sapiens
ggcuaccuuuucuaaaaucuauguaaagguaucuauauacaaaauuuaaaagucagccuaaaga

SEQ ID NO: 292636 - RNA, 64 nt, Homo Sapiens
acuguaguugaaaaaagaugucuucugguuuacuauauacaaaacauaacaggguccauacaca

SEQ ID NO: 292637 - RNA, 64 nt, Homo Sapiens
uggaaaaauauuccugugccagcaauuggcuuagauauacaaucuaaagaaaaguugcagaaca

SEQ ID NO: 292638 - RNA, 64 nt, Homo Sapiens
auauauauauacauauauauaaucacaggauaauauauacaaauagcagaggaaccauaaguag

SEQ ID NO: 292639 - RNA, 64 nt, Homo Sapiens
aaguuuaaaaauauuauuaacuuguauuuucuuaauauacaaucuaucuuuuccacaaauauga

SEQ ID NO: 292640 - RNA, 64 nt, Homo Sapiens
ucuagaaaauugaguuuugaguaccucuuuucccauauacaaucuuccuuccuuagguaauuug

SEQ ID NO: 292641 - RNA, 64 nt, Homo Sapiens
ggugccaaguccaaggccucgaugggacacggccagugccuaggccgaccagcacuugggaucu

SEQ ID NO: 292642 - RNA, 64 nt, Homo Sapiens
ccaggacccagaaacucagacugcucuagugaggagugccuaagccgacucccuccuuccgggc

SEQ ID NO: 292643 - RNA, 64 nt, Homo Sapiens
gccggggguucaggguugguagcagggaguacccagugccuacagggcugggccucuucugccu

SEQ ID NO: 292644 - RNA, 64 nt, Homo Sapiens
accccugggguagccuccuauccaccacugcuuaagugccuaugggaaugugggucugcaccuu

SEQ ID NO: 292645 - RNA, 64 nt, Homo Sapiens
gguuguuaauacuauauugcggaugucugagaucagugccuauguaacaacccauaggcacuug

SEQ ID NO: 292646 - RNA, 64 nt, Homo Sapiens
gguugucaauaguauuaacuggaugucugaaaucagugccuaugaugcguaagugguaugcaug

SEQ ID NO: 292647 - RNA, 64 nt, Homo Sapiens
guuuaguguucuagaaagagcuauuacuguggauagugccuaggggagugcuccacgcccucug

SEQ ID NO: 292648 - RNA, 64 nt, Homo Sapiens
uuuaaugugcagaagaucaaagcuacuuggaaggagugccuauaauuugccaguagccacagau

SEQ ID NO: 292649 - RNA, 64 nt, Homo Sapiens
uaagcaaucacgugcacacaggcagcauuaauggagugccuacugcaugccagcaacagggcuu

SEQ ID NO: 292650 - RNA, 64 nt, Homo Sapiens
cauucauuuuuaaaauucauucaaggauuuauugagugccuacuguguguugggugccauucca

SEQ ID NO: 292651 - RNA, 64 nt, Homo Sapiens
cacauacacacacaaacacauacacacaacacuaagugccuagacuuuaaauagaucuagcaau

SEQ ID NO: 292652 - RNA, 64 nt, Homo Sapiens
agagcuaaaacugcagcauuuuaccuuuaaaugcagugccuagagagagaguauugucucuucc

SEQ ID NO: 292653 - RNA, 64 nt, Homo Sapiens
uuuauauguauaaagcauuuugcaaauuuuaugaagugccuaccauuguugccuuuuaccaaaa

SEQ ID NO: 292654 - RNA, 64 nt, Homo Sapiens
aguuuacuaugugccuagcaauaaauguauuuugagugccuaagguucauucuuucauucauca

SEQ ID NO: 292655 - RNA, 64 nt, Homo Sapiens
ugccugcaaagccagcuaagcauguccugcuggaagugccuaguuaguggccaucuuacauucu

SEQ ID NO: 292656 - RNA, 64 nt, Homo Sapiens
uguccaccgccaccggggucucggagugcugccaagugccuaccgccccggccgggcccagccc

SEQ ID NO: 292657 - RNA, 62 nt, Homo Sapiens
cccacuccuaggcugccuuggaggguacaagauccacugaggguggccaccacagccuuggc

SEQ ID NO: 292658 - RNA, 62 nt, Homo Sapiens
ugugccgaguuaccccacuugccuugggcguguccacugagccuuccccagccagucuuguu

SEQ ID NO: 292659 - RNA, 62 nt, Homo Sapiens
aaaaccuacgcacauaccuuuaccagucuauuuccacugaacguucagugccuuccucucuc

SEQ ID NO: 292660 - RNA, 62 nt, Homo Sapiens
aaaaccuacacacauaccuuuaccagucuauuuccacugaacauucacugccuuccucucuc

SEQ ID NO: 292661 - RNA, 62 nt, Homo Sapiens
uccaaguauucuaaaugugucccaucaugcuuuccacugacccaaaauucaccacagcauuu

SEQ ID NO: 292662 - RNA, 62 nt, Homo Sapiens
uaaguuccacauagcaauuacaguaugccaguuccacugaagacaugaaaucuuuagagguu

SEQ ID NO: 292663 - RNA, 62 nt, Homo Sapiens
uccugggcagccagugaauuggagaucaggauuccacugacguccagcugucaccuccccca

SEQ ID NO: 292664 - RNA, 62 nt, Homo Sapiens
ggaggauagagccagcugucaguccugggugcuccacugauuuguuccaccucuccugcgau

SEQ ID NO: 292665 - RNA, 62 nt, Homo Sapiens
acauuuuugucauauucuugcuacugccuguuuccacugaaaggcuagugcgauuucacagu

SEQ ID NO: 292666 - RNA, 62 nt, Homo Sapiens
gagacucaucuugcucuucuucuccuguuuucuccacugaacaguuauuaggagagauacuc

SEQ ID NO: 292667 - RNA, 62 nt, Homo Sapiens
ccgggaguccaaaccaccuuggugcucugaaguccacugacucaucacaccuuucuuagccu

SEQ ID NO: 292668 - RNA, 62 nt, Homo Sapiens
agaaggggcuggucugcugggcagggcuuacauccacugaguucuaagauuccuuuccugau

SEQ ID NO: 292669 - RNA, 62 nt, Homo Sapiens
acgugggcaguguccaaauuugauggcugcuguccacugagauuccccuccugggucaccuc

SEQ ID NO: 292670 - RNA, 62 nt, Homo Sapiens
gugccgaggggcgggggcagaggcugacgugcuccacugacuuuucagagaacuguaaaccg

SEQ ID NO: 292671 - RNA, 64 nt, Homo Sapiens; identical to SEQ ID NO: 72787

SEQ ID NO: 292672 - RNA, 64 nt, Homo Sapiens; identical to SEQ ID NO: 72788

SEQ ID NO: 292673 - RNA, 64 nt, Homo Sapiens; identical to SEQ ID NO: 72789

SEQ ID NO: 292674 - RNA, 64 nt, Homo Sapiens; identical to SEQ ID NO: 72790

SEQ ID NO: 292675 - RNA, 64 nt, Homo Sapiens; identical to SEQ ID NO: 72791

SEQ ID NO: 292676 - RNA, 64 nt, Homo Sapiens; identical to SEQ ID NO: 72792

SEQ ID NO: 292677 - RNA, 64 nt, Homo Sapiens; identical to SEQ ID NO: 72793

SEQ ID NO: 292678 - RNA, 64 nt, Homo Sapiens; identical to SEQ ID NO: 72794

SEQ ID NO: 292679 - RNA, 64 nt, Homo Sapiens; identical to SEQ ID NO: 72795

SEQ ID NO: 292680 - RNA, 64 nt, Homo Sapiens; identical to SEQ ID NO: 72796

SEQ ID NO: 292681 - RNA, 64 nt, Homo Sapiens; identical to SEQ ID NO: 72797

SEQ ID NO: 292682 - RNA, 64 nt, Homo Sapiens; identical to SEQ ID NO: 72798

SEQ ID NO: 292683 - RNA, 64 nt, Homo Sapiens; identical to SEQ ID NO: 72799

SEQ ID NO: 292684 - RNA, 64 nt, Homo Sapiens; identical to SEQ ID NO: 72800

SEQ ID NO: 292685 - RNA, 64 nt, Homo Sapiens; identical to SEQ ID NO: 72801

SEQ ID NO: 292686 - RNA, 64 nt, Homo Sapiens; identical to SEQ ID NO: 72802

SEQ ID NO: 292687 - RNA, 64 nt, Homo Sapiens; identical to SEQ ID NO: 72803

SEQ ID NO: 292688 - RNA, 64 nt, Homo Sapiens; identical to SEQ ID NO: 72804

SEQ ID NO: 292689 - RNA, 64 nt, Homo Sapiens; identical to SEQ ID NO: 72805

SEQ ID NO: 292690 - RNA, 64 nt, Homo Sapiens; identical to SEQ ID NO: 72806

SEQ ID NO: 292691 - RNA, 64 nt, Homo Sapiens; identical to SEQ ID NO: 72807

SEQ ID NO: 292692 - RNA, 64 nt, Homo Sapiens; identical to SEQ ID NO: 72808

SEQ ID NO: 292693 - RNA, 64 nt, Homo Sapiens; identical to SEQ ID NO: 72809

SEQ ID NO: 292694 - RNA, 64 nt, Homo Sapiens; identical to SEQ ID NO: 72810

SEQ ID NO: 292695 - RNA, 64 nt, Homo Sapiens; identical to SEQ ID NO: 72811

SEQ ID NO: 292696 - RNA, 64 nt, Homo Sapiens; identical to SEQ ID NO: 72812

SEQ ID NO: 292697 - RNA, 64 nt, Homo Sapiens; identical to SEQ ID NO: 72813

SEQ ID NO: 292698 - RNA, 64 nt, Homo Sapiens; identical to SEQ ID NO: 72814

SEQ ID NO: 292699 - RNA, 64 nt, Homo Sapiens; identical to SEQ ID NO: 72815

SEQ ID NO: 292700 - RNA, 64 nt, Homo Sapiens; identical to SEQ ID NO: 72816

SEQ ID NO: 292701 - RNA, 64 nt, Homo Sapiens; identical to SEQ ID NO: 72817

SEQ ID NO: 292702 - RNA, 64 nt, Homo Sapiens; identical to SEQ ID NO: 72818

SEQ ID NO: 292703 - RNA, 64 nt, Homo Sapiens; identical to SEQ ID NO: 72819

SEQ ID NO: 292704 - RNA, 64 nt, Homo Sapiens; identical to SEQ ID NO: 72820

SEQ ID NO: 292705 - RNA, 64 nt, Homo Sapiens; identical to SEQ ID NO: 72821

SEQ ID NO: 292706 - RNA, 64 nt, Homo Sapiens; identical to SEQ ID NO: 72822

SEQ ID NO: 292707 - RNA, 64 nt, Homo Sapiens; identical to SEQ ID NO: 72823

SEQ ID NO: 292708 - RNA, 64 nt, Homo Sapiens; identical to SEQ ID NO: 72824

SEQ ID NO: 292709 - RNA, 64 nt, Homo Sapiens; identical to SEQ ID NO: 72825

SEQ ID NO: 292710 - RNA, 64 nt, Homo Sapiens; identical to SEQ ID NO: 72826

SEQ ID NO: 292711 - RNA, 64 nt, Homo Sapiens; identical to SEQ ID NO: 72827

SEQ ID NO: 292712 - RNA, 64 nt, Homo Sapiens; identical to SEQ ID NO: 72828

SEQ ID NO: 292713 - RNA, 64 nt, Homo Sapiens; identical to SEQ ID NO: 72829

SEQ ID NO: 292714 - RNA, 64 nt, Homo Sapiens; identical to SEQ ID NO: 72830

SEQ ID NO: 292715 - RNA, 64 nt, Homo Sapiens; identical to SEQ ID NO: 72831

SEQ ID NO: 292716 - RNA, 64 nt, Homo Sapiens; identical to SEQ ID NO: 72832

SEQ ID NO: 292717 - RNA, 64 nt, Homo Sapiens; identical to SEQ ID NO: 72833

SEQ ID NO: 292718 - RNA, 64 nt, Homo Sapiens; identical to SEQ ID NO: 72834

SEQ ID NO: 292719 - RNA, 64 nt, Homo Sapiens; identical to SEQ ID NO: 72835

SEQ ID NO: 292720 - RNA, 64 nt, Homo Sapiens; identical to SEQ ID NO: 72836

SEQ ID NO: 292721 - RNA, 64 nt, Homo Sapiens; identical to SEQ ID NO: 72837

SEQ ID NO: 292722 - RNA, 64 nt, Homo Sapiens; identical to SEQ ID NO: 72838

SEQ ID NO: 292723 - RNA, 64 nt, Homo Sapiens; identical to SEQ ID NO: 72839

SEQ ID NO: 292724 - RNA, 64 nt, Homo Sapiens; identical to SEQ ID NO: 72840

SEQ ID NO: 292725 - RNA, 64 nt, Homo Sapiens; identical to SEQ ID NO: 72841

SEQ ID NO: 292726 - RNA, 62 nt, Homo Sapiens
guuucguagggauauauucauaagccuaugagaagauagacuuaauagccaugacuauaauu

SEQ ID NO: 292727 - RNA, 62 nt, Homo Sapiens
cuuuuuucuuuuuugucauuauuauggugguaaagauagaaucaucauauaucaucaucauu

SEQ ID NO: 292728 - RNA, 62 nt, Homo Sapiens
aauugugaggcuggauucacaaugccuauuguaagauagaauacuuuagauuugggauuuaa

SEQ ID NO: 292729 - RNA, 62 nt, Homo Sapiens
auacuuuuaagacaacuugguaaucuuuuuaaaagauagaagauucuaauguaucccaaacc

SEQ ID NO: 292730 - RNA, 64 nt, Homo Sapiens; identical to SEQ ID NO: 85812

SEQ ID NO: 292731 - RNA, 64 nt, Homo Sapiens; identical to SEQ ID NO: 85813

SEQ ID NO: 292732 - RNA, 64 nt, Homo Sapiens; identical to SEQ ID NO: 85814

SEQ ID NO: 292733 - RNA, 64 nt, Homo Sapiens; identical to SEQ ID NO: 85815

SEQ ID NO: 292734 - RNA, 64 nt, Homo Sapiens; identical to SEQ ID NO: 85816

SEQ ID NO: 292735 - RNA, 64 nt, Homo Sapiens; identical to SEQ ID NO: 85817

SEQ ID NO: 292736 - RNA, 64 nt, Homo Sapiens; identical to SEQ ID NO: 85818

SEQ ID NO: 292737 - RNA, 64 nt, Homo Sapiens; identical to SEQ ID NO: 85819

SEQ ID NO: 292738 - RNA, 64 nt, Homo Sapiens; identical to SEQ ID NO: 85820

SEQ ID NO: 292739 - RNA, 64 nt, Homo Sapiens; identical to SEQ ID NO: 85821

SEQ ID NO: 292740 - RNA, 64 nt, Homo Sapiens; identical to SEQ ID NO: 21812

SEQ ID NO: 292741 - RNA, 64 nt, Homo Sapiens; identical to SEQ ID NO: 21813

SEQ ID NO: 292742 - RNA, 64 nt, Homo Sapiens; identical to SEQ ID NO: 21814

SEQ ID NO: 292743 - RNA, 64 nt, Homo Sapiens; identical to SEQ ID NO: 21815

SEQ ID NO: 292744 - RNA, 64 nt, Homo Sapiens; identical to SEQ ID NO: 21816

SEQ ID NO: 292745 - RNA, 64 nt, Homo Sapiens; identical to SEQ ID NO: 21817

SEQ ID NO: 292746 - RNA, 64 nt, Homo Sapiens; identical to SEQ ID NO: 21818

SEQ ID NO: 292747 - RNA, 64 nt, Homo Sapiens; identical to SEQ ID NO: 21819

SEQ ID NO: 292748 - RNA, 64 nt, Homo Sapiens; identical to SEQ ID NO: 21820

SEQ ID NO: 292749 - RNA, 64 nt, Homo Sapiens; identical to SEQ ID NO: 21821

SEQ ID NO: 292750 - RNA, 64 nt, Homo Sapiens; identical to SEQ ID NO: 21822

SEQ ID NO: 292751 - RNA, 64 nt, Homo Sapiens; identical to SEQ ID NO: 21823

SEQ ID NO: 292752 - RNA, 64 nt, Homo Sapiens; identical to SEQ ID NO: 21824

SEQ ID NO: 292753 - RNA, 64 nt, Homo Sapiens; identical to SEQ ID NO: 21825

SEQ ID NO: 292754 - RNA, 64 nt, Homo Sapiens; identical to SEQ ID NO: 21826

SEQ ID NO: 292755 - RNA, 64 nt, Homo Sapiens; identical to SEQ ID NO: 21827

SEQ ID NO: 292756 - RNA, 64 nt, Homo Sapiens; identical to SEQ ID NO: 21828

SEQ ID NO: 292757 - RNA, 64 nt, Homo Sapiens; identical to SEQ ID NO: 21829

SEQ ID NO: 292758 - RNA, 64 nt, Homo Sapiens; identical to SEQ ID NO: 21830

SEQ ID NO: 292759 - RNA, 64 nt, Homo Sapiens; identical to SEQ ID NO: 21831

SEQ ID NO: 292760 - RNA, 50 nt, Homo Sapiens; identical to SEQ ID NO: 21832

SEQ ID NO: 292761 - RNA, 64 nt, Homo Sapiens; identical to SEQ ID NO: 21833

SEQ ID NO: 292762 - RNA, 64 nt, Homo Sapiens; identical to SEQ ID NO: 21834

SEQ ID NO: 292763 - RNA, 64 nt, Homo Sapiens; identical to SEQ ID NO: 21835

SEQ ID NO: 292764 - RNA, 64 nt, Homo Sapiens; identical to SEQ ID NO: 21836

SEQ ID NO: 292765 - RNA, 64 nt, Homo Sapiens; identical to SEQ ID NO: 21837

SEQ ID NO: 292766 - RNA, 64 nt, Homo Sapiens; identical to SEQ ID NO: 21838

SEQ ID NO: 292767 - RNA, 64 nt, Homo Sapiens; identical to SEQ ID NO: 21839

SEQ ID NO: 292768 - RNA, 64 nt, Homo Sapiens; identical to SEQ ID NO: 21840

SEQ ID NO: 292769 - RNA, 64 nt, Homo Sapiens; identical to SEQ ID NO: 21841

SEQ ID NO: 292770 - RNA, 64 nt, Homo Sapiens; identical to SEQ ID NO: 21842

SEQ ID NO: 292771 - RNA, 64 nt, Homo Sapiens; identical to SEQ ID NO: 21843

SEQ ID NO: 292772 - RNA, 64 nt, Homo Sapiens; identical to SEQ ID NO: 21844

SEQ ID NO: 292773 - RNA, 64 nt, Homo Sapiens; identical to SEQ ID NO: 21845

SEQ ID NO: 292774 - RNA, 64 nt, Homo Sapiens; identical to SEQ ID NO: 21846

SEQ ID NO: 292775 - RNA, 64 nt, Homo Sapiens; identical to SEQ ID NO: 21847

SEQ ID NO: 292776 - RNA, 64 nt, Homo Sapiens; identical to SEQ ID NO: 21848

SEQ ID NO: 292777 - RNA, 64 nt, Homo Sapiens; identical to SEQ ID NO: 21849

SEQ ID NO: 292778 - RNA, 64 nt, Homo Sapiens; identical to SEQ ID NO: 21850

SEQ ID NO: 292779 - RNA, 64 nt, Homo Sapiens; identical to SEQ ID NO: 21851

SEQ ID NO: 292780 - RNA, 64 nt, Homo Sapiens; identical to SEQ ID NO: 21852

SEQ ID NO: 292781 - RNA, 64 nt, Homo Sapiens; identical to SEQ ID NO: 21853

SEQ ID NO: 292782 - RNA, 64 nt, Homo Sapiens; identical to SEQ ID NO: 21854

SEQ ID NO: 292783 - RNA, 64 nt, Homo Sapiens; identical to SEQ ID NO: 21855

SEQ ID NO: 292784 - RNA, 64 nt, Homo Sapiens; identical to SEQ ID NO: 21856

SEQ ID NO: 292785 - RNA, 64 nt, Homo Sapiens; identical to SEQ ID NO: 21857

SEQ ID NO: 292786 - RNA, 64 nt, Homo Sapiens; identical to SEQ ID NO: 21858

SEQ ID NO: 292787 - RNA, 64 nt, Homo Sapiens; identical to SEQ ID NO: 21859

SEQ ID NO: 292788 - RNA, 64 nt, Homo Sapiens; identical to SEQ ID NO: 21860

SEQ ID NO: 292789 - RNA, 64 nt, Homo Sapiens; identical to SEQ ID NO: 21861

SEQ ID NO: 292790 - RNA, 64 nt, Homo Sapiens; identical to SEQ ID NO: 21862

SEQ ID NO: 292791 - RNA, 64 nt, Homo Sapiens; identical to SEQ ID NO: 21863

SEQ ID NO: 292792 - RNA, 64 nt, Homo Sapiens; identical to SEQ ID NO: 21864

SEQ ID NO: 292793 - RNA, 64 nt, Homo Sapiens; identical to SEQ ID NO: 21865

SEQ ID NO: 292794 - RNA, 64 nt, Homo Sapiens; identical to SEQ ID NO: 21866

SEQ ID NO: 292795 - RNA, 64 nt, Homo Sapiens; identical to SEQ ID NO: 21867

SEQ ID NO: 292796 - RNA, 64 nt, Homo Sapiens; identical to SEQ ID NO: 21868

SEQ ID NO: 292797 - RNA, 64 nt, Homo Sapiens; identical to SEQ ID NO: 21869

SEQ ID NO: 292798 - RNA, 64 nt, Homo Sapiens; identical to SEQ ID NO: 21870

SEQ ID NO: 292799 - RNA, 64 nt, Homo Sapiens; identical to SEQ ID NO: 21871

SEQ ID NO: 292800 - RNA, 64 nt, Homo Sapiens; identical to SEQ ID NO: 21872

SEQ ID NO: 292801 - RNA, 64 nt, Homo Sapiens; identical to SEQ ID NO: 21873

SEQ ID NO: 292802 - RNA, 64 nt, Homo Sapiens; identical to SEQ ID NO: 21874

SEQ ID NO: 292803 - RNA, 61 nt, Homo Sapiens
ggacccaccagagccuauagaaucaauuccuuggacucacagccaugcagauaagcccugg

SEQ ID NO: 292804 - RNA, 64 nt, Homo Sapiens
ggccuggaccugggaugaagaugaaugaagaacauggacucauguggaugugguuuggcucaga

SEQ ID NO: 292805 - RNA, 64 nt, Homo Sapiens
cauuugugaggaggacuucuguccauggauucaauggacucauccaaaucccccccacuccaaa

SEQ ID NO: 292806 - RNA, 64 nt, Homo Sapiens
cauucuuuggaacaaauccccccacauuggccaguggacucaucggucuucucuaccccucuac

SEQ ID NO: 292807 - RNA, 64 nt, Homo Sapiens
agcauuguuucugagugugugaggauguuuucaguggacucagugaagaucugcccucagcgug

SEQ ID NO: 292808 - RNA, 64 nt, Homo Sapiens
ccuuggacaucaggacuccagguucuucggccuuuggacucaggcuugccacagaggccuccca

SEQ ID NO: 292809 - RNA, 64 nt, Homo Sapiens
uguccaaggcuuuucauccuccuuucuuuuucacuggacucaagaggcuccagacaaugccuuu

SEQ ID NO: 292810 - RNA, 64 nt, Homo Sapiens
uucaaaguucagaugaagcucagaccuugugcucuggacucaggaggcagcaugguagaguggg

SEQ ID NO: 292811 - RNA, 64 nt, Homo Sapiens
uucucuuuagguuugcaccaguggugugagcaguuggacucaguuuggacaagggggaaagggg

SEQ ID NO: 292812 - RNA, 64 nt, Homo Sapiens
gaucccuucacuggcccccucgggaggccuggguuggacucagggucuccuccagcugggggcu

SEQ ID NO: 292813 - RNA, 64 nt, Homo Sapiens
ugagggaacauacuucaauaagaaccaucuaugcuggacucacagccaaauuaauacugaacaa

SEQ ID NO: 292814 - RNA, 64 nt, Homo Sapiens
cacuuauaagugggagcuaaacauugauuacacauggacucaaagaagggaacaguagacacgg

SEQ ID NO: 292815 - RNA, 64 nt, Homo Sapiens
ggucuugggcuguguucagccacuuugccuucucuggacucaguuuccccgucugagaaaugag

SEQ ID NO: 292816 - RNA, 64 nt, Homo Sapiens
uaaggccccucaggcugggcucugaacgaggaccuggacucagagccagacagggcagccucag

SEQ ID NO: 292817 - RNA, 64 nt, Homo Sapiens
aaucacagcucaccucagugcggccuugaacuccuggacucaaucgauccucccaccucugccu

SEQ ID NO: 292818 - RNA, 64 nt, Homo Sapiens
aaucacagcucaccucagugcggccuugaacuccuggacucaauugauccucccacuucugccu

SEQ ID NO: 292819 - RNA, 64 nt, Homo Sapiens
cacgaucuauuuucaucaucgguuaauuauuugcuacaaagaaguauguuuuauucauaaaggg

SEQ ID NO: 292820 - RNA, 64 nt, Homo Sapiens
uuuguguuuuggcuuugucauaaauccuaauagguacaaagacuccuuggugagaggaucagug

SEQ ID NO: 292821 - RNA, 64 nt, Homo Sapiens
auauagggaauauauaaggaacaucgaaauuguauacaaagauuuguacauaaaaaauauacaa

SEQ ID NO: 292822 - RNA, 64 nt, Homo Sapiens
gaaauuguauacaaagauuuguacauaaaaaauauacaaagacgcuuccuaaaguaccaacuuu

SEQ ID NO: 292823 - RNA, 64 nt, Homo Sapiens
ccuuauuucagucuagcagcaaguaugauguuuauacaaagaauauaucaucuauauaacuuca

SEQ ID NO: 292824 - RNA, 64 nt, Homo Sapiens
gaaugaacuaauucuuuacaaaaaaaacucgagcuacaaagaaagcuguaaaauguucuaagau

SEQ ID NO: 292825 - RNA, 64 nt, Homo Sapiens
gauuuaaaaauuaaccaggcagagaccccaucucuacaaagaaaaaccaucuugggcuacauag

SEQ ID NO: 292826 - RNA, 64 nt, Homo Sapiens
uaaaucaccauaccacauagcagaauuuaaaacauacaaagagauuggucuacuuuucugugaa

SEQ ID NO: 292827 - RNA, 64 nt, Homo Sapiens
ugaaaauguagaaauugagugaaaaaauguuuaauacaaagagcaccaauaucuaguuacagau

SEQ ID NO: 292828 - RNA, 64 nt, Homo Sapiens
aagcagcaauauugaagcauaugccaaauaagauuacaaagaauacucugaacaugauuauauu

SEQ ID NO: 292829 - RNA, 64 nt, Homo Sapiens
acugugaaaauggacuuaauaauuagaccauuucuacaaagaacaacugaauagguggaaaaca

SEQ ID NO: 292830 - RNA, 64 nt, Homo Sapiens
agggugauugugucuggagacccuuaauuauguuuacaaagacccauguuccaaguaaguuugu

SEQ ID NO: 292831 - RNA, 64 nt, Homo Sapiens
caaacuguauaaagggauugguagucaaaacauguacaaagaaauaccuguaaaacuguuuugu

SEQ ID NO: 292832 - RNA, 64 nt, Homo Sapiens
uuacuguguuggacauauuauuuagacuuagucauacaaagaaacuuagcucuuuuuucaucuc

SEQ ID NO: 292833 - RNA, 64 nt, Homo Sapiens
uuuuaaaaagcuacauaugccuaaacaagauaguuacaaagauuaccugccuuccauuuuauuc

SEQ ID NO: 292834 - RNA, 64 nt, Homo Sapiens
uaguuuuacuucuuucuuucaagaucaugucaucuacaaagaaacuuugugauuuucuacacag

SEQ ID NO: 292835 - RNA, 64 nt, Homo Sapiens
auggccacuccagcgucaucggacucucucuuauuacaaagaucacugcccaggaccaucuucc

SEQ ID NO: 292836 - RNA, 64 nt, Homo Sapiens
uauagagaggaagauugaauauuuaucuagagaauacaaagacccacauguaaaugauagguau

SEQ ID NO: 292837 - RNA, 58 nt, Homo Sapiens; identical to SEQ ID NO: 144416

SEQ ID NO: 292838 - RNA, 64 nt, Homo Sapiens; identical to SEQ ID NO: 144417

SEQ ID NO: 292839 - RNA, 64 nt, Homo Sapiens; identical to SEQ ID NO: 144418

SEQ ID NO: 292840 - RNA, 64 nt, Homo Sapiens; identical to SEQ ID NO: 144419

SEQ ID NO: 292841 - RNA, 64 nt, Homo Sapiens; identical to SEQ ID NO: 144420

SEQ ID NO: 292842 - RNA, 64 nt, Homo Sapiens; identical to SEQ ID NO: 144421

SEQ ID NO: 292843 - RNA, 64 nt, Homo Sapiens; identical to SEQ ID NO: 144422

SEQ ID NO: 292844 - RNA, 64 nt, Homo Sapiens; identical to SEQ ID NO: 144423

SEQ ID NO: 292845 - RNA, 64 nt, Homo Sapiens; identical to SEQ ID NO: 144424

SEQ ID NO: 292846 - RNA, 64 nt, Homo Sapiens; identical to SEQ ID NO: 144425

SEQ ID NO: 292847 - RNA, 64 nt, Homo Sapiens; identical to SEQ ID NO: 144426

SEQ ID NO: 292848 - RNA, 64 nt, Homo Sapiens; identical to SEQ ID NO: 144427

SEQ ID NO: 292849 - RNA, 64 nt, Homo Sapiens; identical to SEQ ID NO: 144428

SEQ ID NO: 292850 - RNA, 64 nt, Homo Sapiens; identical to SEQ ID NO: 144429

SEQ ID NO: 292851 - RNA, 64 nt, Homo Sapiens; identical to SEQ ID NO: 144430

SEQ ID NO: 292852 - RNA, 64 nt, Homo Sapiens; identical to SEQ ID NO: 144431

SEQ ID NO: 292853 - RNA, 64 nt, Homo Sapiens; identical to SEQ ID NO: 144432

SEQ ID NO: 292854 - RNA, 64 nt, Homo Sapiens; identical to SEQ ID NO: 144433

SEQ ID NO: 292855 - RNA, 64 nt, Homo Sapiens; identical to SEQ ID NO: 144434

SEQ ID NO: 292856 - RNA, 64 nt, Homo Sapiens; identical to SEQ ID NO: 144435

SEQ ID NO: 292857 - RNA, 64 nt, Homo Sapiens; identical to SEQ ID NO: 144436

SEQ ID NO: 292858 - RNA, 64 nt, Homo Sapiens; identical to SEQ ID NO: 144437

SEQ ID NO: 292859 - RNA, 64 nt, Homo Sapiens; identical to SEQ ID NO: 144438

SEQ ID NO: 292860 - RNA, 64 nt, Homo Sapiens; identical to SEQ ID NO: 144439

SEQ ID NO: 292861 - RNA, 64 nt, Homo Sapiens; identical to SEQ ID NO: 144440

SEQ ID NO: 292862 - RNA, 64 nt, Homo Sapiens; identical to SEQ ID NO: 144441

SEQ ID NO: 292863 - RNA, 64 nt, Homo Sapiens; identical to SEQ ID NO: 144442

SEQ ID NO: 292864 - RNA, 64 nt, Homo Sapiens; identical to SEQ ID NO: 144443

SEQ ID NO: 292865 - RNA, 64 nt, Homo Sapiens; identical to SEQ ID NO: 144444

SEQ ID NO: 292866 - RNA, 64 nt, Homo Sapiens; identical to SEQ ID NO: 144445

SEQ ID NO: 292867 - RNA, 64 nt, Homo Sapiens; identical to SEQ ID NO: 144446

SEQ ID NO: 292868 - RNA, 64 nt, Homo Sapiens; identical to SEQ ID NO: 144447

SEQ ID NO: 292869 - RNA, 64 nt, Homo Sapiens; identical to SEQ ID NO: 217273

SEQ ID NO: 292870 - RNA, 64 nt, Homo Sapiens; identical to SEQ ID NO: 217274

SEQ ID NO: 292871 - RNA, 64 nt, Homo Sapiens; identical to SEQ ID NO: 217275

SEQ ID NO: 292872 - RNA, 64 nt, Homo Sapiens; identical to SEQ ID NO: 217276

SEQ ID NO: 292873 - RNA, 64 nt, Homo Sapiens; identical to SEQ ID NO: 217277

SEQ ID NO: 292874 - RNA, 64 nt, Homo Sapiens; identical to SEQ ID NO: 217278

SEQ ID NO: 292875 - RNA, 64 nt, Homo Sapiens; identical to SEQ ID NO: 217279

SEQ ID NO: 292876 - RNA, 64 nt, Homo Sapiens; identical to SEQ ID NO: 217280

SEQ ID NO: 292877 - RNA, 64 nt, Homo Sapiens; identical to SEQ ID NO: 217281

SEQ ID NO: 292878 - RNA, 64 nt, Homo Sapiens; identical to SEQ ID NO: 217282

SEQ ID NO: 292879 - RNA, 64 nt, Homo Sapiens; identical to SEQ ID NO: 217283

SEQ ID NO: 292880 - RNA, 64 nt, Homo Sapiens; identical to SEQ ID NO: 217284

SEQ ID NO: 292881 - RNA, 64 nt, Homo Sapiens; identical to SEQ ID NO: 217285

SEQ ID NO: 292882 - RNA, 64 nt, Homo Sapiens; identical to SEQ ID NO: 217286

SEQ ID NO: 292883 - RNA, 64 nt, Homo Sapiens; identical to SEQ ID NO: 217287

SEQ ID NO: 292884 - RNA, 64 nt, Homo Sapiens; identical to SEQ ID NO: 217288

SEQ ID NO: 292885 - RNA, 64 nt, Homo Sapiens; identical to SEQ ID NO: 217289

SEQ ID NO: 292886 - RNA, 64 nt, Homo Sapiens; identical to SEQ ID NO: 217290

SEQ ID NO: 292887 - RNA, 64 nt, Homo Sapiens; identical to SEQ ID NO: 217291

SEQ ID NO: 292888 - RNA, 64 nt, Homo Sapiens; identical to SEQ ID NO: 217292

SEQ ID NO: 292889 - RNA, 64 nt, Homo Sapiens; identical to SEQ ID NO: 217293

SEQ ID NO: 292890 - RNA, 64 nt, Homo Sapiens; identical to SEQ ID NO: 217294

SEQ ID NO: 292891 - RNA, 64 nt, Homo Sapiens; identical to SEQ ID NO: 217295

SEQ ID NO: 292892 - RNA, 64 nt, Homo Sapiens
caagggcaggcaaagaugcccucugggguugucugguucccagugagaggcuccugagaaaaau

SEQ ID NO: 292893 - RNA, 63 nt, Homo Sapiens
uucccagugagaggcuccugagaaaaauaaagcugguucccagagcugcuguccaucccucau

SEQ ID NO: 292894 - RNA, 64 nt, Homo Sapiens
gcacccugugccugcuucccugcucccucuuugggguucccaagcagagaugaauagccccaag

SEQ ID NO: 292895 - RNA, 64 nt, Homo Sapiens
ucagagguucugaguuaauuaaguauugcugcuugguucccaccaaccaccagaguccuuuaaa

SEQ ID NO: 292896 - RNA, 64 nt, Homo Sapiens
aaagacucaguuuuauugaggucuuaagucuucugguucccauaaugacuccugguucccauua

SEQ ID NO: 292897 - RNA, 64 nt, Homo Sapiens
agucuuaagucuucugguucggcuuaugacuccugguucccauugguguuggggaggagucucu

SEQ ID NO: 292898 - RNA, 64 nt, Homo Sapiens
ccugcaggcaggggcaguuuguugcguucuucgugguucccaggcccugggacaucucacucca

SEQ ID NO: 292899 - RNA, 64 nt, Homo Sapiens
cacaggccgagaaaaggguacagccucuaggugggguucccaaagacgccuucacgcuggacug

SEQ ID NO: 292900 - RNA, 64 nt, Homo Sapiens
ggagaacugccccacccaguaucuucugugccaugguucccacauucgcacuccauggccuccu

SEQ ID NO: 292901 - RNA, 64 nt, Homo Sapiens
ucaaaaauuagccaggugugguggugcgugcccagguucccagguacucggaggcugagaggug

SEQ ID NO: 292902 - RNA, 64 nt, Homo Sapiens
gccgcgucuguguauaaaagggccccggaggggaggucgcgagacaguauacuguauuuaucgg

SEQ ID NO: 292903 - RNA, 64 nt, Homo Sapiens
aguagagacgggguuucaccguguugcccaggcuggucgcgaacuccugagcucaggcaauccg

SEQ ID NO: 292904 - RNA, 64 nt, Homo Sapiens
agcuggucuggcuuacuguuuugccguucaaaaaggucgcgaauccgugggacugagcacgggg

SEQ ID NO: 292905 - RNA, 64 nt, Homo Sapiens
aaaucacagccaaggaagauacagagaaaacuggggucgcgaagaaaacaaaccccacucagaa

SEQ ID NO: 292906 - RNA, 64 nt, Homo Sapiens
cugcacuccagccugggugauugcagugagccaaggucgcgacauugaaccugggagguggagg

SEQ ID NO: 292907 - RNA, 64 nt, Homo Sapiens
gccccuccccgccuccucccugccuggcggcaggggucgcgaugaugggcuggagcaguuuggg

SEQ ID NO: 292908 - RNA, 64 nt, Homo Sapiens
agcagcccuauacuuuggggaucauuugccuaccauggcauauauuugaaauugcuuuggacaa

SEQ ID NO: 292909 - RNA, 64 nt, Homo Sapiens
caaacacauuuucuaugcaugugucucuguguauauggcauauaccuaguaaguauguuucugu

SEQ ID NO: 292910 - RNA, 64 nt, Homo Sapiens
ccacuuuuucagguaaacauuuuucauuuggcaaauggcauaauuauuugaaagugacaggaau

SEQ ID NO: 292911 - RNA, 64 nt, Homo Sapiens
aauuuaagaugagcuauuuggagcuuauguaauaauggcauaaagccaacuagaggauguugua

SEQ ID NO: 292912 - RNA, 64 nt, Homo Sapiens
auuauguaaauauguaugauuaugauuuuuauaaauggcauaacaugaguguacuaacuaccuu

SEQ ID NO: 292913 - RNA, 64 nt, Homo Sapiens
uguauguacaguuuacaugaauguuccucaggacauggcauacaauggccuuggagguccaaau

SEQ ID NO: 292914 - RNA, 64 nt, Homo Sapiens
ugauuaucacagauuguacuuauacaaaacuuagauggcauagccuacugcauaccuaggcuau

SEQ ID NO: 292915 - RNA, 64 nt, Homo Sapiens
acauauguaaacagagaaaaaggaaaguaaaaauauggcauaaaagauaagaauuggcucuccu

SEQ ID NO: 292916 - RNA, 64 nt, Homo Sapiens; identical to SEQ ID NO: 153638

SEQ ID NO: 292917 - RNA, 64 nt, Homo Sapiens; identical to SEQ ID NO: 153639

SEQ ID NO: 292918 - RNA, 64 nt, Homo Sapiens; identical to SEQ ID NO: 153640

SEQ ID NO: 292919 - RNA, 64 nt, Homo Sapiens; identical to SEQ ID NO: 153641

SEQ ID NO: 292920 - RNA, 64 nt, Homo Sapiens; identical to SEQ ID NO: 153642

SEQ ID NO: 292921 - RNA, 64 nt, Homo Sapiens; identical to SEQ ID NO: 153643

SEQ ID NO: 292922 - RNA, 64 nt, Homo Sapiens; identical to SEQ ID NO: 153644

SEQ ID NO: 292923 - RNA, 64 nt, Homo Sapiens; identical to SEQ ID NO: 153645

SEQ ID NO: 292924 - RNA, 64 nt, Homo Sapiens; identical to SEQ ID NO: 153646

SEQ ID NO: 292925 - RNA, 64 nt, Homo Sapiens; identical to SEQ ID NO: 153647

SEQ ID NO: 292926 - RNA, 64 nt, Homo Sapiens; identical to SEQ ID NO: 153648

SEQ ID NO: 292927 - RNA, 64 nt, Homo Sapiens; identical to SEQ ID NO: 153649

SEQ ID NO: 292928 - RNA, 64 nt, Homo Sapiens; identical to SEQ ID NO: 153650

SEQ ID NO: 292929 - RNA, 64 nt, Homo Sapiens; identical to SEQ ID NO: 153651

SEQ ID NO: 292930 - RNA, 64 nt, Homo Sapiens; identical to SEQ ID NO: 153652

SEQ ID NO: 292931 - RNA, 64 nt, Homo Sapiens; identical to SEQ ID NO: 153653

SEQ ID NO: 292932 - RNA, 64 nt, Homo Sapiens; identical to SEQ ID NO: 153654

SEQ ID NO: 292933 - RNA, 64 nt, Homo Sapiens; identical to SEQ ID NO: 153655

SEQ ID NO: 292934 - RNA, 64 nt, Homo Sapiens; identical to SEQ ID NO: 153656

SEQ ID NO: 292935 - RNA, 64 nt, Homo Sapiens; identical to SEQ ID NO: 153657

SEQ ID NO: 292936 - RNA, 64 nt, Homo Sapiens; identical to SEQ ID NO: 153658

SEQ ID NO: 292937 - RNA, 64 nt, Homo Sapiens; identical to SEQ ID NO: 153659

SEQ ID NO: 292938 - RNA, 64 nt, Homo Sapiens; identical to SEQ ID NO: 153660

SEQ ID NO: 292939 - RNA, 64 nt, Homo Sapiens; identical to SEQ ID NO: 153661

SEQ ID NO: 292940 - RNA, 64 nt, Homo Sapiens; identical to SEQ ID NO: 153662

SEQ ID NO: 292941 - RNA, 64 nt, Homo Sapiens; identical to SEQ ID NO: 153663

SEQ ID NO: 292942 - RNA, 64 nt, Homo Sapiens; identical to SEQ ID NO: 153664

SEQ ID NO: 292943 - RNA, 64 nt, Homo Sapiens; identical to SEQ ID NO: 153665

SEQ ID NO: 292944 - RNA, 64 nt, Homo Sapiens; identical to SEQ ID NO: 153666

SEQ ID NO: 292945 - RNA, 64 nt, Homo Sapiens; identical to SEQ ID NO: 153667

SEQ ID NO: 292946 - RNA, 64 nt, Homo Sapiens; identical to SEQ ID NO: 153668

SEQ ID NO: 292947 - RNA, 64 nt, Homo Sapiens; identical to SEQ ID NO: 153669

SEQ ID NO: 292948 - RNA, 64 nt, Homo Sapiens; identical to SEQ ID NO: 153670

SEQ ID NO: 292949 - RNA, 64 nt, Homo Sapiens; identical to SEQ ID NO: 153671

SEQ ID NO: 292950 - RNA, 64 nt, Homo Sapiens; identical to SEQ ID NO: 153672

SEQ ID NO: 292951 - RNA, 64 nt, Homo Sapiens; identical to SEQ ID NO: 153673

SEQ ID NO: 292952 - RNA, 64 nt, Homo Sapiens; identical to SEQ ID NO: 112230

SEQ ID NO: 292953 - RNA, 64 nt, Homo Sapiens; identical to SEQ ID NO: 112231

SEQ ID NO: 292954 - RNA, 64 nt, Homo Sapiens; identical to SEQ ID NO: 112232

SEQ ID NO: 292955 - RNA, 64 nt, Homo Sapiens; identical to SEQ ID NO: 112233

SEQ ID NO: 292956 - RNA, 64 nt, Homo Sapiens; identical to SEQ ID NO: 112234

SEQ ID NO: 292957 - RNA, 64 nt, Homo Sapiens; identical to SEQ ID NO: 112235

SEQ ID NO: 292958 - RNA, 64 nt, Homo Sapiens; identical to SEQ ID NO: 112236

SEQ ID NO: 292959 - RNA, 64 nt, Homo Sapiens; identical to SEQ ID NO: 112237

SEQ ID NO: 292960 - RNA, 64 nt, Homo Sapiens; identical to SEQ ID NO: 112238

SEQ ID NO: 292961 - RNA, 64 nt, Homo Sapiens; identical to SEQ ID NO: 112239

SEQ ID NO: 292962 - RNA, 64 nt, Homo Sapiens; identical to SEQ ID NO: 112240

SEQ ID NO: 292963 - RNA, 64 nt, Homo Sapiens; identical to SEQ ID NO: 112241

SEQ ID NO: 292964 - RNA, 64 nt, Homo Sapiens; identical to SEQ ID NO: 112242

SEQ ID NO: 292965 - RNA, 64 nt, Homo Sapiens; identical to SEQ ID NO: 112243

SEQ ID NO: 292966 - RNA, 64 nt, Homo Sapiens; identical to SEQ ID NO: 112244

SEQ ID NO: 292967 - RNA, 64 nt, Homo Sapiens; identical to SEQ ID NO: 112245

SEQ ID NO: 292968 - RNA, 64 nt, Homo Sapiens; identical to SEQ ID NO: 112246

SEQ ID NO: 292969 - RNA, 64 nt, Homo Sapiens; identical to SEQ ID NO: 112247

SEQ ID NO: 292970 - RNA, 64 nt, Homo Sapiens; identical to SEQ ID NO: 112248

SEQ ID NO: 292971 - RNA, 64 nt, Homo Sapiens; identical to SEQ ID NO: 112249

SEQ ID NO: 292972 - RNA, 64 nt, Homo Sapiens; identical to SEQ ID NO: 112250

SEQ ID NO: 292973 - RNA, 64 nt, Homo Sapiens; identical to SEQ ID NO: 112251

SEQ ID NO: 292974 - RNA, 64 nt, Homo Sapiens; identical to SEQ ID NO: 112252

SEQ ID NO: 292975 - RNA, 64 nt, Homo Sapiens; identical to SEQ ID NO: 112253

SEQ ID NO: 292976 - RNA, 64 nt, Homo Sapiens; identical to SEQ ID NO: 112254

SEQ ID NO: 292977 - RNA, 64 nt, Homo Sapiens; identical to SEQ ID NO: 112255

SEQ ID NO: 292978 - RNA, 64 nt, Homo Sapiens; identical to SEQ ID NO: 112256

SEQ ID NO: 292979 - RNA, 64 nt, Homo Sapiens; identical to SEQ ID NO: 112257

SEQ ID NO: 292980 - RNA, 64 nt, Homo Sapiens; identical to SEQ ID NO: 112258

SEQ ID NO: 292981 - RNA, 64 nt, Homo Sapiens
acccccuuccuugccuaaggugucugaguuucuggcucuugaggcauuuccagacuugaaauuc

SEQ ID NO: 292982 - RNA, 64 nt, Homo Sapiens
gcauuuccagacuugaaauucucaucaguccauugcucuugagucuuugcagagaaccucagau

SEQ ID NO: 292983 - RNA, 64 nt, Homo Sapiens
auuguuaacccgcuaggcuccagaaccaccaacugcucuugacacuuggcugaggauuguauuu

SEQ ID NO: 292984 - RNA, 64 nt, Homo Sapiens
uggacagugaguaccuuacuaguaccuuggcuuggcucuugacguguuuacucauuggaggaac

SEQ ID NO: 292985 - RNA, 64 nt, Homo Sapiens
aaaucaacugacuagugcaggaggcuguugauuggcucuugacugugaugcccgcaauucucaa

SEQ ID NO: 292986 - RNA, 64 nt, Homo Sapiens
ugaaaauguccaucuuugggaaauuuucuacccugcucuugagccugauaacccaugccagguc

SEQ ID NO: 292987 - RNA, 64 nt, Homo Sapiens
aauuuuccucauucuggugaccaugcccagcauggcucuugaagaaaugaagagagguaucauu

SEQ ID NO: 292988 - RNA, 64 nt, Homo Sapiens
aagagcagagccaggcugugcccgagggaccccagcucuugacugcaccuguuucaugccucuc

SEQ ID NO: 292989 - RNA, 64 nt, Homo Sapiens
aucccaggucuccucgaccuugcccauggaggaggcucuugaugauauuuauuugguuaucaac

SEQ ID NO: 292990 - RNA, 64 nt, Homo Sapiens
ccauaauuugguaguguuggacaagauguugcaugcucuugaggacaaugaagacuaaaacuga

SEQ ID NO: 292991 - RNA, 64 nt, Homo Sapiens
agacaaguggaagggcuguacuucugaagacagggcucuugaacagguugucucuuccgagggc

SEQ ID NO: 292992 - RNA, 64 nt, Homo Sapiens
gugauagccaucuacuuuccgccaauuccagguagcucuugaaggcaguaagcuugugauaaag

SEQ ID NO: 292993 - RNA, 64 nt, Homo Sapiens
cggaaacgagugucuucacuauuucuuaggcucagcucuugauacagccugaccaacgaugagc

SEQ ID NO: 292994 - RNA, 64 nt, Homo Sapiens
ugggcacuggccccccggacuggcgugugggaaagcucuugagcgggacaagugucagcaggau

SEQ ID NO: 292995 - RNA, 64 nt, Homo Sapiens
cauacuugagagaaauccuacaaauguaaagaauguggcaaaccuuuggaugauccacaaaccu

SEQ ID NO: 292996 - RNA, 64 nt, Homo Sapiens
uauacuguagagaaacccuggaaaugugaagaacguggcaaaguucuuuaccucauucucaaac

SEQ ID NO: 292997 - RNA, 64 nt, Homo Sapiens
augcuggagggaagcccuacacauguggcagaauguggcaaagcauuuaauugguccucaaugc

SEQ ID NO: 292998 - RNA, 64 nt, Homo Sapiens
uucaugcuggagagaaacuucacaugugaaccguguggcaaagccuuuaaaugguccucaaccc

SEQ ID NO: 292999 - RNA, 64 nt, Homo Sapiens
uauaccagagagaaacccuacacauguaaagaauguggcaaagccuucaauagguucucaaccc

SEQ ID NO: 293000 - RNA, 64 nt, Homo Sapiens
gauauuggugagaagccacaaaaauaugaaaaauguggcaaagccuucaaaugcuugucacauc

SEQ ID NO: 293001 - RNA, 64 nt, Homo Sapiens
ucguacuggagagaauccuacaaaugugaaaaauguggcaaauccuuuaacugauccucaacuu

SEQ ID NO: 293002 - RNA, 64 nt, Homo Sapiens
uauacuggagaggaacucuauaguugugaagaauguggcaaagcuuuuaaccaauccucauacc

SEQ ID NO: 293003 - RNA, 64 nt, Homo Sapiens
cauacuggagagaaagccuacaauugugaagaauguggcaaagcuuuuaaccuuccuuaacccu

SEQ ID NO: 293004 - RNA, 64 nt, Homo Sapiens
cauacuggaaagaaacccuacaaaugugaagucuguggcaaagcuuuuaacugauucucaacuc

SEQ ID NO: 293005 - RNA, 64 nt, Homo Sapiens
uacacuagagagaaagccuacaaaugugaagaauguggcaaagccuuuaaccaguuuucaaccc

SEQ ID NO: 293006 - RNA, 64 nt, Homo Sapiens
cacaguggagaaaaacccuacaaaugugaagaauguggcaaagcuuuuaaccaguccucacacc

SEQ ID NO: 293007 - RNA, 64 nt, Homo Sapiens
cauacuggagagaaaccuuacaaaugugaggaauguggcaaagguuuuagccaacucucaaacc

SEQ ID NO: 293008 - RNA, 64 nt, Homo Sapiens
caaacuggagagaaacucuacaaaugugaagaauguggcaaagcuuuuaaccaagucucaacac

SEQ ID NO: 293009 - RNA, 64 nt, Homo Sapiens
uucuaaccauuucucaaccccaagugugaagaauguggcaaaaccauacuggagagaaaccuua

SEQ ID NO: 293010 - RNA, 64 nt, Homo Sapiens
uucuaccugauccucaaaaccaaaugugaugaauguggcaaagccauacugaagagaaacagua

SEQ ID NO: 293011 - RNA, 64 nt, Homo Sapiens
uuuuaaccaaucuucaacaccaaaugugaagaauguggcaaagccauacuggagagaaacccua

SEQ ID NO: 293012 - RNA, 64 nt, Homo Sapiens
acaacuacauaaaauauguuucuauuuagaugaaguggcaaacuaaucuguaguguuaaaaauu

SEQ ID NO: 293013 - RNA, 64 nt, Homo Sapiens
ccaauagaugagaauuuuccguaucuugaucugaguggcaaauuguaaacuuaaaauauauaua

SEQ ID NO: 293014 - RNA, 64 nt, Homo Sapiens
augcuacugaaacuuaccugagaaccauaggacuguggcaaacaaaaccaauucaugaagugaa

SEQ ID NO: 293015 - RNA, 64 nt, Homo Sapiens
caucacaauuagggaaugguuaguggucucuacuguggcaaaugccaacuguuggaauucacuu

SEQ ID NO: 293016 - RNA, 55 nt, Homo Sapiens
gagaaacccuacaaaugugaagauuguggcaaagccucuaacccguccugaauuc

SEQ ID NO: 293017 - RNA, 64 nt, Homo Sapiens
cauacugaagaaaacuucuacaagugugaacaguguggcaaaacuuuuaaugaaugcucacacc

SEQ ID NO: 293018 - RNA, 55 nt, Homo Sapiens
aagagacuguacaaaagugaagaauguggcaaaggccuuuacugcuccuauuccc

SEQ ID NO: 293019 - RNA, 64 nt, Homo Sapiens
ggccuuuacugcuccuauucccuuacuaaagaauguggcaaagcuuuucaccaguacuuuaccc

SEQ ID NO: 293020 - RNA, 64 nt, Homo Sapiens
aaugcuggagagaaacccuacaaaugugaagaauguggcaaagauuucuauugauucucauacc

SEQ ID NO: 293021 - RNA, 64 nt, Homo Sapiens
cauauuggagagaaauucuacagaugugaagaauguggcaaaggcuuuaauuaguucucauccc

SEQ ID NO: 293022 - RNA, 64 nt, Homo Sapiens
cauaaaggagauaaauuauacaaaugugaagaauguggcaaagcuuuuaacaaauccucaucca

SEQ ID NO: 293023 - RNA, 64 nt, Homo Sapiens
cauacuggagagaaaaccuacaaaugugaggaauguggcaaagccuuuagccugucccuccaau

SEQ ID NO: 293024 - RNA, 64 nt, Homo Sapiens
uauacuggagagaagcccuacaaaugugaaaaauguggcaaaccuuuuaaccaauccucaaccc

SEQ ID NO: 293025 - RNA, 64 nt, Homo Sapiens
caugcuggagagaaacccuacaaaugugaaaaauguggcaaagcuuuuaaccaauuuucaaacc

SEQ ID NO: 293026 - RNA, 64 nt, Homo Sapiens
cauacuggagaaaaaucuuacaaaugugaagaauguggcaaagccuuuauccaguccucaacuc

SEQ ID NO: 293027 - RNA, 64 nt, Homo Sapiens
aaugauggagagaaaccauacaacugugaagaauguggcaaagcuuuuaaccaguccucaaacu

SEQ ID NO: 293028 - RNA, 64 nt, Homo Sapiens
cauauuggaaaaauuuccuacaaguaagaacaauguggcaaaguuuuuaacuaauacaccuuau

SEQ ID NO: 293029 - RNA, 52 nt, Homo Sapiens
guaccuuacagauggaaugaauguggcaaaaucuuuaguuagaauucacacc

SEQ ID NO: 293030 - RNA, 63 nt, Homo Sapiens
gacucaggagaaaaaccuuacaaauaucauaaauguggcaaagaauuuaguuugcauugaagc

SEQ ID NO: 293031 - RNA, 64 nt, Homo Sapiens
cauacuggagagaaaccuuacaaguguaaugaguguggcaaagccuuuagugaccagucaacac

SEQ ID NO: 293032 - RNA, 64 nt, Homo Sapiens
cauaaugaagagagaucuuccgaguguaauaaauguggcaaauuuuucagacaucguucauacc

SEQ ID NO: 293033 - RNA, 64 nt, Homo Sapiens
uuuuaaugaauacucacacccaagugugaagaauguggcaaaauucuuacuagaaaaacucuua

SEQ ID NO: 293034 - RNA, 64 nt, Homo Sapiens
auuuaacuggucccuaaauccaaauguaaagaauguggcaaagccauacuagagagaaacccua

SEQ ID NO: 293035 - RNA, 64 nt, Homo Sapiens
cuuuaacuggcucuuaaucccaaaugugauaaauguggcaaagccauacuggagagaaauccua

SEQ ID NO: 293036 - RNA, 64 nt, Homo Sapiens
uaaaauuugcaagaaaauguuagauucuuaaaguguggcaaacauucuuuguuaaaaaaaaaau

SEQ ID NO: 293037 - RNA, 55 nt, Homo Sapiens
cuuuuaccaguccucaacucaaaauguggcaaagcgagaaacccuacaaauguga

SEQ ID NO: 293038 - RNA, 64 nt, Homo Sapiens
cuuuaaccaguccuuaaggcuaauuguguggaauguggcaaagccauacuggagggaauuccua

SEQ ID NO: 293039 - RNA, 64 nt, Homo Sapiens
uuuucauuaguucucaaccccaaaugugaaaaacguggcaaagcauacuggaggaaaagcccua

SEQ ID NO: 293040 - RNA, 64 nt, Homo Sapiens
uuuuaaacaguccucaaucucaaaggugaagaauguggcaaagccauacuggagagaaaaucua

SEQ ID NO: 293041 - RNA, 64 nt, Homo Sapiens
cuuugcuucacguucacacgcaagugugaugauuguggcaaagcuauacaggagagaaaccuca

SEQ ID NO: 293042 - RNA, 64 nt, Homo Sapiens
uuucagagaucguucacauacaaguguaauaaauguggcaaauucauaaugaagagagaucuua

SEQ ID NO: 293043 - RNA, 64 nt, Homo Sapiens
cuuuggcaagcagucaacaccaaguguaaugaguguggcaaagccacacuggagagaaaccuua

SEQ ID NO: 293044 - RNA, 64 nt, Homo Sapiens
cuuuacuucauguucacacccaugugugaugauuguggcaaagccauacaggagagaaaccuca

SEQ ID NO: 293045 - RNA, 64 nt, Homo Sapiens
uuucagacaucauucauacacaaguguaauaaauguggcaaauuuauaaugaauaaagaucuaa

SEQ ID NO: 293046 - RNA, 64 nt, Homo Sapiens
guuuacuucacauucacacccaagugugaugauuguggcaaagcucauacaggagagaaacuca

SEQ ID NO: 293047 - RNA, 64 nt, Homo Sapiens
cuuuagugggcagucaccaccaagugcaaugaguguggcaaagccacacuggagagaaaccuua

SEQ ID NO: 293048 - RNA, 64 nt, Homo Sapiens
guuuacuucacauucacacccaagugugaugauuguggcaaagccauacaggagagaaaccuca

SEQ ID NO: 293049 - RNA, 64 nt, Homo Sapiens
uuucagacaucguucaugcccaaguguaauaaauguggcaaauuuccacagugaagagaucuua

SEQ ID NO: 293050 - RNA, 64 nt, Homo Sapiens
cuuuagugggcagucaccaccaagugcaaugaguguggcaaacccacacuggagagaaaccuua

SEQ ID NO: 293051 - RNA, 64 nt, Homo Sapiens
ugugagaaagagauucuugccuugaggcucugcaguggcaaaugguaggggcaauagcgcuccc

SEQ ID NO: 293052 - RNA, 64 nt, Homo Sapiens
aaaagacccacugaaucugagaaaguacuuucugguggcaaaugaauuuaucauuuuaguauag

SEQ ID NO: 293053 - RNA, 62 nt, Homo Sapiens
cugcuggcuccuugcuugauuucccucagcaaacccuugaacuugcuaggccaugaauacac

SEQ ID NO: 293054 - RNA, 62 nt, Homo Sapiens
gccccccaaaugaaugcauuuucuucccacuaacccuugauuuuucuucauucauggugaaa

SEQ ID NO: 293055 - RNA, 62 nt, Homo Sapiens
acuuagauccuucucccuuuuggcccaaaagaacccuugauuuaguuccagaauccaaccag

SEQ ID NO: 293056 - RNA, 62 nt, Homo Sapiens
ucacaaaagguucucauggugccugacagguuacccuugagggcuugugucuacuuuuuaaa

SEQ ID NO: 293057 - RNA, 62 nt, Homo Sapiens
aaaacaugggaauuuguagucuugacaugauuacccuugaguuaaagcuuccaugcuucacc

SEQ ID NO: 293058 - RNA, 62 nt, Homo Sapiens
ugauuacccuugaguaaaaccuuccaugcuucacccuugacacaaaauauuucucaguaaag

SEQ ID NO: 293059 - RNA, 62 nt, Homo Sapiens
cgccuucugggcuuucuucagaggucacuucuacccuugaagcugucggcaaaagcgagcag

SEQ ID NO: 293060 - RNA, 62 nt, Homo Sapiens
cuugacaacaaaagucagggugcagucgguccacccuugacugcucuuggcuuggucucuac

SEQ ID NO: 293061 - RNA, 64 nt, Homo Sapiens
uguggucuggcagaaacaacaaaggaacaaccauauagccaacccauuugaaaaaggaaauaua

SEQ ID NO: 293062 - RNA, 64 nt, Homo Sapiens
gucuuacaagcagcuucugaauuggugauaaaagauagccaagugagguucaccuuugugacug

SEQ ID NO: 293063 - RNA, 64 nt, Homo Sapiens
auguuuguuguaaaugguuucaaaaauacaaauuauagccaaucaaaacauugcuuugguuggu

SEQ ID NO: 293064 - RNA, 64 nt, Homo Sapiens
uaaaauagcucuuucucauuuuuagagaagucaaauagccaaccaucaaaauuaagaauaaauu

SEQ ID NO: 293065 - RNA, 64 nt, Homo Sapiens
aagcaacuuuaaaacauuuagaguuuugcugaguauagccaaaugccuguucugaaacuuauag

SEQ ID NO: 293066 - RNA, 64 nt, Homo Sapiens
agcaaaguuuuuuauuaaauuuuauaaauuuuuaauagccaauuauguccuaauuguauuuugg

SEQ ID NO: 293067 - RNA, 64 nt, Homo Sapiens
uacuuuuacuuuguuuguacaaaaacaaagacauauagccaauacaaaucaaaugccggaggug

SEQ ID NO: 293068 - RNA, 64 nt, Homo Sapiens
uuuuggcuuaugugauuuucuguuuacaaguagaauagccaauuauuuaaauguuuaguugcca

SEQ ID NO: 293069 - RNA, 64 nt, Homo Sapiens
ucccuguccagaugcagcuaaucagcugugcucaauagccaaccggggaaccaggaaucugaga

SEQ ID NO: 293070 - RNA, 64 nt, Homo Sapiens
aguucugcaaauaguucuuugacauuuauuuuuaauagccaaguaauugcauaugaagaaggca

SEQ ID NO: 293071 - RNA, 64 nt, Homo Sapiens
auaaaugaaggcaugagaggaaguaaguagcaaguugaaggacagguaguugagaugaaacacu

SEQ ID NO: 293072 - RNA, 64 nt, Homo Sapiens
cacauauuguauauaaacaaaacaauaugcuuuguugaaggaaaauuuucuuuauuggaaugug

SEQ ID NO: 293073 - RNA, 64 nt, Homo Sapiens
uuuauuuaaauuugaaguaauuugaggacucugguugaaggagaaaaggauaaaaugaacgcua

SEQ ID NO: 293074 - RNA, 64 nt, Homo Sapiens
uuauauaaaaggaugacucauguaauauggauacuugaaggacuugaucaugaggguuaaauau

SEQ ID NO: 293075 - RNA, 64 nt, Homo Sapiens
cuguugaccagccugguuucauaccgaaaagacauugaaggacugcagaaauguaugggugcac

SEQ ID NO: 293076 - RNA, 64 nt, Homo Sapiens
cuucacugcagauacaguucacucugaaagcugguugaaggagagcagcaaaaauguaucaggg

SEQ ID NO: 293077 - RNA, 64 nt, Homo Sapiens
caaguacaaguaauauuuugagaccaacagaggcuugaaggauuaaggcagugaaauggcaguu

SEQ ID NO: 293078 - RNA, 64 nt, Homo Sapiens
aguuuuuaguguguauuguacguguuacuucccuuugaaggaaagaguaauuuugaucaaaaga

SEQ ID NO: 293079 - RNA, 64 nt, Homo Sapiens
uccuggugcaccuuucucauccuucagcauuucuuugaaggauuuaaucccagcacuucuguaa

SEQ ID NO: 293080 - RNA, 64 nt, Homo Sapiens
aagacaccuugagccaaggaguuaaaagguggcuuugaaggagggacaacuacuuuugaaggaa

SEQ ID NO: 293081 - RNA, 64 nt, Homo Sapiens
uuaaaagguggcuuugaaggaaagacaacuacuuuugaaggaagucagagugauccuguauaag

SEQ ID NO: 293082 - RNA, 64 nt, Homo Sapiens
agaaaauacuucccugaaggaggaccugaccucuuugaaggaucgugcucugaaggaggucacc

SEQ ID NO: 293083 - RNA, 64 nt, Homo Sapiens
gaaggggucugagacaacaauugugauaagugcuuugaaggaaaagaaauaaagcaguuacaaa

SEQ ID NO: 293084 - RNA, 64 nt, Homo Sapiens
gcuaacuauauaguaguauacacaagagaaaucuuugaaggaggaaacugaugacagauauaca

SEQ ID NO: 293085 - RNA, 64 nt, Homo Sapiens
gaaggaggaaacugaugacagauauacagggcacuugaaggagacucugaugcuaguuauauaa

SEQ ID NO: 293086 - RNA, 64 nt, Homo Sapiens
uuagaaaucauauaucucuucuuuuuaagauuucuugaaggauugaaagccuuuuuuaagaagu

SEQ ID NO: 293087 - RNA, 64 nt, Homo Sapiens
aggagacugaaaucgauauugucaaagagaaacuuugaaggagcagaauauaagucucgccauc

SEQ ID NO: 293088 - RNA, 64 nt, Homo Sapiens
cuuggacaaccaccuaauccagaaaaucucaacauugaaggagcgccggagaacaagaagcuga

SEQ ID NO: 293089 - RNA, 64 nt, Homo Sapiens
cuggaccgaacagacucaacgcagcccguggugguugaaggaggguuccuaccaagagcccugu

SEQ ID NO: 293090 - RNA, 64 nt, Homo Sapiens
guugucuguuauguucacugaaaugagauacauuuugaaggagaucacuuagcagggauuacag

SEQ ID NO: 293091 - RNA, 64 nt, Homo Sapiens
ugcuuauuaaauacaguuccgcucaucuguguuauugaaggaggcacacugaggaaugcauuuu

SEQ ID NO: 293092 - RNA, 64 nt, Homo Sapiens
uacuuuuauuuuuuauguugcuuaacuguuuuauuugaaggaaaccugugugauuuaaaaaguu

SEQ ID NO: 293093 - RNA, 64 nt, Homo Sapiens
agagagccuuauauuuuccaauugguauaaauuuuugaaggaugugauguucauuaacauucgg

SEQ ID NO: 293094 - RNA, 64 nt, Homo Sapiens
gcccuggguuucuuuaaucuauucagcuagaacuuugaaggacaauuucuugcauuaauaaagg

SEQ ID NO: 293095 - RNA, 64 nt, Homo Sapiens
caagagggaagaaagagaaggagccaucuccaucuugaaggaacucaaagacucaagugggaac

SEQ ID NO: 293096 - RNA, 64 nt, Homo Sapiens
cagaggggcccagcugaccuuguggcaggcuuguuugaaggaccuaggucuguguccaaagcua

SEQ ID NO: 293097 - RNA, 64 nt, Homo Sapiens
cauugaucuucuggauguacggucuucaguacuauugaaggagauuccaguucugaggagagga

SEQ ID NO: 293098 - RNA, 64 nt, Homo Sapiens
ggcugaugugucugugaugguuugucaaacacuguugaaggagacuugaccuggaaugggggcc

SEQ ID NO: 293099 - RNA, 64 nt, Homo Sapiens
auuccugagucagaagucuguuaauauugcuguuuugaaggacaauccuuuauuuuacuugaga

SEQ ID NO: 293100 - RNA, 64 nt, Homo Sapiens
gaauaaccuuggccauauauuugcucaauaaagauugaaggaagcauggucauaguugcccugg

SEQ ID NO: 293101 - RNA, 64 nt, Homo Sapiens
uacagagaauagaaacaaauccauguaaacaauuuugaaggaggcaugggagcuaaaaauccug

SEQ ID NO: 293102 - RNA, 64 nt, Homo Sapiens
uacaacguaguauuuacuggcaagaaggagaaaguugaaggacucagcuaaaggaguacagcaa

SEQ ID NO: 293103 - RNA, 64 nt, Homo Sapiens
aaauguaaaggagggagaucauaaggaggaggagggagaagagaguuggaggcacaguuuuaga

SEQ ID NO: 293104 - RNA, 64 nt, Homo Sapiens
agagguccucaugggucccuagaaccucagguacggagaagaauugcaacuucuuucuguugag

SEQ ID NO: 293105 - RNA, 64 nt, Homo Sapiens
gguguuuauugaaaauuaaccaaacuuaauacuaggagaagacugaaucauuaaugaugucuca

SEQ ID NO: 293106 - RNA, 64 nt, Homo Sapiens
gcaagaaauauacugacaugaacaggcaguucuuggagaagaaagagcauuucuuuaaguaccu

SEQ ID NO: 293107 - RNA, 64 nt, Homo Sapiens
caaaaaaugaacauuuauauaucuacaaaaauauggagaagaguaauuugaaagccuacuuucu

SEQ ID NO: 293108 - RNA, 64 nt, Homo Sapiens
uuccuaaguugcaaaauguaaugaugagcuugguggagaagaaugagucguucuuggaauaccu

SEQ ID NO: 293109 - RNA, 64 nt, Homo Sapiens
aagauuaugaaaguaacaguuuaagacacugcuaggagaagauuaaauaaaguuuaaauuauca

SEQ ID NO: 293110 - RNA, 64 nt, Homo Sapiens
aagugucacgcaguugacugcgaaaggcauagaaggagaagacauuccauucagcaauaggaca

SEQ ID NO: 293111 - RNA, 64 nt, Homo Sapiens
gcaacccaaaugguggccauggagugccacuucgggagaagaaguggggccccugcaaccucgg

SEQ ID NO: 293112 - RNA, 64 nt, Homo Sapiens
cggaauucccugagucccacgaguugaaaagagaggagaagacugcuuccaagaaagaggagga

SEQ ID NO: 293113 - RNA, 64 nt, Homo Sapiens
cuuuucugauaucucuaaaaugcuguuaaguucuggagaagaacuucaggagaagaagaucuau

SEQ ID NO: 293114 - RNA, 64 nt, Homo Sapiens
cuaaaaugcuguuaaguucuggagaagaacuucaggagaagaagaucuaucagcuggcuuuuaa

SEQ ID NO: 293115 - RNA, 64 nt, Homo Sapiens
aagaauaacacuguugcuucaaugaaggagacuuggagaagaggagcugguaguccaucagcac

SEQ ID NO: 293116 - RNA, 64 nt, Homo Sapiens
cugaggggcugugaccucucugcaggcaggggaaggagaagagaaggcggggcaggcagccugu

SEQ ID NO: 293117 - RNA, 64 nt, Homo Sapiens
ucaaugucaagagaaaaugaccucugcucaaaagggagaagagucucaauuucagcaaguaccu

SEQ ID NO: 293118 - RNA, 64 nt, Homo Sapiens
gggugggccccaaauccaaugacuggcauccuuaggagaagagagaguuuugguaauagacaca

SEQ ID NO: 293119 - RNA, 64 nt, Homo Sapiens
uagguaucuggguuuauauacuaaaauuaaggguggagaagaucuuauuuuuuaaaucaugguc

SEQ ID NO: 293120 - RNA, 64 nt, Homo Sapiens
cugauaaacuguauacauugugcuccuuucugugggagaagaaagauuugguggagggaagcuu

SEQ ID NO: 293121 - RNA, 64 nt, Homo Sapiens
caaagcuacagguuuacuugaggcacgagagcugggagaagagguucccuggacuaccuucagg

SEQ ID NO: 293122 - RNA, 64 nt, Homo Sapiens
ugguggucguuucuaugcauggagugaggcagugggagaagaggagugccccugugggauggga

SEQ ID NO: 293123 - RNA, 64 nt, Homo Sapiens
uaugucagcacacacuuacaauuuuguaauaauuggagaagauugcguucugccuuccuuguua

SEQ ID NO: 293124 - RNA, 64 nt, Homo Sapiens
guuucuggagcaguggacugaaucuuccccaggaggagaagaaguuauacaguugaaaacuugu

SEQ ID NO: 293125 - RNA, 64 nt, Homo Sapiens
gcaguggauacaaggaagggccuuucucggggccggagaagagaccaagagaccaggcccgggc

SEQ ID NO: 293126 - RNA, 64 nt, Homo Sapiens
aggccaggguggaagggcggcuugagggacgccaggagaagacugaaugccaggcuaggaagga

SEQ ID NO: 293127 - RNA, 64 nt, Homo Sapiens
uuguagcagagggaaaugagggggauuggagaacggagaagaagggcuggaguauuaggggccu

SEQ ID NO: 293128 - RNA, 64 nt, Homo Sapiens
ggcugguagaccgaagccuuucgucacuggggugggagaagaggagaaacacgguuaagggagg

SEQ ID NO: 293129 - RNA, 64 nt, Homo Sapiens
ggcaccauccucucuuuccuggcacguagaguagggagaagaagcugucuuaagagaaagccaa

SEQ ID NO: 293130 - RNA, 64 nt, Homo Sapiens
uggggugggggcugauggggggcuggaggccucuggagaagaccuuccuuuggaggugggagug

SEQ ID NO: 293131 - RNA, 64 nt, Homo Sapiens
caccacuguccucgauguguagggggucaccgcuggagaagaacggcuccuccuugccuaaugc

SEQ ID NO: 293132 - RNA, 64 nt, Homo Sapiens
aucggugcccauggugacuugcccagacuugggaggagaagaguggcgaaguacccaugaagcu

SEQ ID NO: 293133 - RNA, 64 nt, Homo Sapiens
gugggaguagaaaaaucucauucccagagucagaggagaagagacauguaccuugaccaucguc

SEQ ID NO: 293134 - RNA, 64 nt, Homo Sapiens
gaaagaaugcaagaguggacugaaugugccuaauggagaagacccacgugcuaggggaugaggg

SEQ ID NO: 293135 - RNA, 64 nt, Homo Sapiens
gaacacugaaaugcagguagacaauucaaagucuggagaagagggaucaugccuggauaugauc

SEQ ID NO: 293136 - RNA, 64 nt, Homo Sapiens
uucaggcaagugaggucaauguaagaagggaaagggagaagauauuugaagaaccagaauguaa

SEQ ID NO: 293137 - RNA, 64 nt, Homo Sapiens
acacuugauuccauuucauuuuuguuuuaaauguggagaagauagcaaucaggagaagaagcac

SEQ ID NO: 293138 - RNA, 64 nt, Homo Sapiens
cacuuuguuuuaaauguggaaaagcuggcaaucaggagaagaagcuguuuuacauuucagaccu

SEQ ID NO: 293139 - RNA, 64 nt, Homo Sapiens
guguggauccaccagaagauggaaggauacacauggagaagacuucccuauaagggaaacugaa

SEQ ID NO: 293140 - RNA, 64 nt, Homo Sapiens
cugcaucagggaauguggaauaugaauucacaguggagaagacccucaggucuuaaugaacaca

SEQ ID NO: 293141 - RNA, 64 nt, Homo Sapiens
acauuccuccuggcuuaguuucaugagauacuggggagaagagauccugucuuggccuccccuu

SEQ ID NO: 293142 - RNA, 64 nt, Homo Sapiens
ccucagagcauccugaagccuggcgcccucuaguggagaagaauuucugacaggggaggugagc

SEQ ID NO: 293143 - RNA, 64 nt, Homo Sapiens
ugauaaguuccaaauauguuaagggcuuuaauacaaaaagcaaaaauugucaguguuuggauga

SEQ ID NO: 293144 - RNA, 64 nt, Homo Sapiens
cacaauaagaaugaaucucagaaaauauuaaggaaaaaagcaaguuugaagagaccacaugggg

SEQ ID NO: 293145 - RNA, 64 nt, Homo Sapiens
uaaaaauuuaggggauauuggaaguuauaccaauaaaaagcauuacaaaauaagugggaaauga

SEQ ID NO: 293146 - RNA, 64 nt, Homo Sapiens
cacugguccugcagcuuauugcauugccggggguaaaaagcacaugcccacgaaaauuagucua

SEQ ID NO: 293147 - RNA, 64 nt, Homo Sapiens
agacacacauuccuuugaaauccacccaguguuuaaaaagcaacuuggaaauuuacacauuagc

SEQ ID NO: 293148 - RNA, 64 nt, Homo Sapiens
uauccuuucuuaguuauuugcuccuugcaaauuaaaaaagcaacuaagagaaagaaaaacauug

SEQ ID NO: 293149 - RNA, 64 nt, Homo Sapiens
uugugcucugccuggagcuguuuccauaugauauaaaaagcaaguguaguauuccauuacuaug

SEQ ID NO: 293150 - RNA, 64 nt, Homo Sapiens
ugagucccucaggaaaaaaaaaaaauucuguuuuaaaaagcaaucugauucuuagcucuugaaa

SEQ ID NO: 293151 - RNA, 64 nt, Homo Sapiens
aguaccugccauuuuuacuaauuuuugucuuuaaaaaaagcaaaaaagcacauugaccuaaguu

SEQ ID NO: 293152 - RNA, 64 nt, Homo Sapiens
ccauuuuuacuaauuuuugucuuuaaaaaaagcaaaaaagcacauugaccuaaguugaaaauua

SEQ ID NO: 293153 - RNA, 64 nt, Homo Sapiens
aaaagaaaaaaagguuaagcauaaaaagaaagggaaaaagcagaaacacugcagaagacacaaa

SEQ ID NO: 293154 - RNA, 64 nt, Homo Sapiens
uagauccagugggaaaaaaaauagcguuucacauaaaaagcauagcagcagcucugaaaagaca

SEQ ID NO: 293155 - RNA, 64 nt, Homo Sapiens
aaaagugaaagagaaauugaaagggaaaaaagacaaaaagcauaaggcuccaaaacgaaagcaa

SEQ ID NO: 293156 - RNA, 64 nt, Homo Sapiens
gaaugacagcaaacagaucaagaaagcaccaaggaaaaagcagauccucaaccugcuguccucc

SEQ ID NO: 293157 - RNA, 64 nt, Homo Sapiens
gucuuauuaaccaugucuguaaauauaggcuuuaaaaaagcauauaaaaaauaaaauaaauaua

SEQ ID NO: 293158 - RNA, 64 nt, Homo Sapiens
aaugauaacaacauaguaaccauaugcuguauuuaaaaagcaaccagguuaagagauccuguuu

SEQ ID NO: 293159 - RNA, 64 nt, Homo Sapiens
ucuacuugguuuuuugaucauuuucaagacuuuuaaaaagcacuccauccuccugaagccuucg

SEQ ID NO: 293160 - RNA, 64 nt, Homo Sapiens
auacuucauaauaugugaaaaacucggaucuuuuaaaaagcaucauagaucauuuuuccauaug

SEQ ID NO: 293161 - RNA, 64 nt, Homo Sapiens
ucaaaauguguuacaugggaagaaaaagauuaagaaaaagcaagauaauuuugaagaaggacga

SEQ ID NO: 293162 - RNA, 64 nt, Homo Sapiens
caucaugaccagcaaauacucauuuuaggaaaaaaaaaagcaugaucugaaaaauacuuuuggu

SEQ ID NO: 293163 - RNA, 64 nt, Homo Sapiens
acacacacgagagaucauaaccaugugaaaaggcaaaaagcauguguuugcaacaucugauaac

SEQ ID NO: 293164 - RNA, 64 nt, Homo Sapiens
gacugaauauaucuaaaauuuccagcaauaaaaaaaaaagcauuuaacuugcaccaagcaagaa

SEQ ID NO: 293165 - RNA, 64 nt, Homo Sapiens
aacaguauucuuuauuuucuggguguuauauuuaaaaaagcaaguuuggauuuuuacaccuaau

SEQ ID NO: 293166 - RNA, 64 nt, Homo Sapiens
uccacuuuguccuuucugcucuugugaagaaaaaaaaaagcauuuucgaggaaagaauuaugca

SEQ ID NO: 293167 - RNA, 64 nt, Homo Sapiens
aaugaauuaaagcaacaaaaagauauugauuggcaaaaagcaagauauaagagauucauuugcu

SEQ ID NO: 293168 - RNA, 64 nt, Homo Sapiens
ucuuucucuccacucuggcuuguuuucagaaccuaaaaagcagacccaaguuuccuuucuccuc

SEQ ID NO: 293169 - RNA, 64 nt, Homo Sapiens
auuaauauaaaagagguaggagucuguuauuuaaaaaaagcauuaaauuuaaaaaaaaacuguc

SEQ ID NO: 293170 - RNA, 64 nt, Homo Sapiens
agcaagguaccuugccauuuuaaaguauaucuuaaaaaagcagcaauccaucugggcacucauu

SEQ ID NO: 293171 - RNA, 64 nt, Homo Sapiens
aaguacguguguguguguguucugagaaaugaauaaaaagcauguuguuucuuagggaaaacag

SEQ ID NO: 293172 - RNA, 64 nt, Homo Sapiens
gauacuaauuuuuuaagccaccacugccagcaucaaaaagcaaaacacacaacucugagaauac

SEQ ID NO: 293173 - RNA, 64 nt, Homo Sapiens
caagaucacaaauuacaguauaacaucucucgguaaaaagcagaguaccuuaguacccuucacc

SEQ ID NO: 293174 - RNA, 64 nt, Homo Sapiens
augaagaaauauuuuaaggaaaccuauuugaaaaaaaaagcaaagaccauuugauaaaagccug

SEQ ID NO: 293175 - RNA, 64 nt, Homo Sapiens
agaauaauagaaaaauucuacuuuaauuuccauuaaaaagcaaauagcauugacacauuuaaag

SEQ ID NO: 293176 - RNA, 64 nt, Homo Sapiens
acagauuuacaaguguaagcuauaugauuucuucaaaaagcaaaagcaauauaccuaauucauu

SEQ ID NO: 293177 - RNA, 64 nt, Homo Sapiens
ggucaaaacuagauuggaucuugguuugaaugaaaaaaagcauaaaauauucuugcaauaauug

SEQ ID NO: 293178 - RNA, 64 nt, Homo Sapiens
aucuaugauuguuguauaauuucucuuuguagauaaaaagcauuagggaggcugcagaagccau

SEQ ID NO: 293179 - RNA, 63 nt, Homo Sapiens
uauacuagccuaacagauugaaaugaguaacagaaaaagcacaugaacaagaaagcacaauaa

SEQ ID NO: 293180 - RNA, 64 nt, Homo Sapiens
ccuaaaugaaaguguguaaauaaagauuuucuucaaaaagcaauuuaaauuaaaauggcauucu

SEQ ID NO: 293181 - RNA, 64 nt, Homo Sapiens
gaauuccuacucacacagcuuuuucuugcaucuaaaaaagcauaaaacuugcauuauguguuaa

SEQ ID NO: 293182 - RNA, 64 nt, Homo Sapiens
ccugugaauauaauuuaauuaagcaaaaacaaacaaaaagcaagguguguuauaugacaggaca

SEQ ID NO: 293183 - RNA, 64 nt, Homo Sapiens
auuuugauugagauuuuuuacgacccaugcaaucaaaaagcaaauuguuguuuucuguggguug

SEQ ID NO: 293184 - RNA, 64 nt, Homo Sapiens
gugaauaagaaaauaauguuuaaagaaaaaaaaaaaaaagcaaaccuccaaaacguggaccuaa

SEQ ID NO: 293185 - RNA, 64 nt, Homo Sapiens
uauaugguugaagaaucaaaacaaaagcaaaaaaaaaaagcaaaaaaagaaaagagaaaaaaag

SEQ ID NO: 293186 - RNA, 64 nt, Homo Sapiens
uagaauucuugaaaaguuaacguagaaaauauccaaaaagcaguauuucuagaaaguguccaaa

SEQ ID NO: 293187 - RNA, 64 nt, Homo Sapiens
aauauccaaaaagcaguauuucuagaaaguguccaaaaagcaguauuucuuucccuugguugug

SEQ ID NO: 293188 - RNA, 64 nt, Homo Sapiens
acuuugaagagcuugaagauuugaaagauucccaaaaaagcauuuuaaaguuuacauuuaaggg

SEQ ID NO: 293189 - RNA, 64 nt, Homo Sapiens
gaaaccuacaucuggcuagugcuuacauuugcucaaaaagcauguuguaugaagcugacugcca

SEQ ID NO: 293190 - RNA, 64 nt, Homo Sapiens
uagugagagauugagaaugaugcuuaauggaucaaaaaagcaauuaggaguauguuccugauuu

SEQ ID NO: 293191 - RNA, 64 nt, Homo Sapiens
aggcgccugucaucgacauucagaggacuucccuaaaaagcacacuacaccuucacagccaccc

SEQ ID NO: 293192 - RNA, 64 nt, Homo Sapiens
uggauuuccaccugacaaauaguucuuucaggccaaaaagcaaaauguugacuucucauccccg

SEQ ID NO: 293193 - RNA, 64 nt, Homo Sapiens
caaagcaaaacaauaaacuauauauaaaugaacaaaaaagcaagaauauccauggcaagcuuug

SEQ ID NO: 293194 - RNA, 64 nt, Homo Sapiens
cuguuuauuuaccuguaaggugaucuucagauagaaaaagcaaucuucauaaaacauguaacac

SEQ ID NO: 293195 - RNA, 64 nt, Homo Sapiens
aucaaucuuuuguuugaaaauaucuuuuuuauucaaaaagcacaagugagguuggaagauaccc

SEQ ID NO: 293196 - RNA, 53 nt, Homo Sapiens
ugcuuuucagaaagacuauuuagaaaaagcacccccaggauauggaguuguag

SEQ ID NO: 293197 - RNA, 64 nt, Homo Sapiens
uugucuugucuaagguggaaaucuugugcuguuuaaaaagcagauuuuauucuuugccuuuugc

SEQ ID NO: 293198 - RNA, 64 nt, Homo Sapiens
agaaaaaugcuggaacaugcuugauguauuauguaaaaagcauauuuaaacaaggguccucaac

SEQ ID NO: 293199 - RNA, 64 nt, Homo Sapiens
aauugccccuuugcagagaaaaaaaaaaacuuaaaaaaagcacaugccuacugcugccuguccc

SEQ ID NO: 293200 - RNA, 64 nt, Homo Sapiens
agguuugacuggccuccagauuccaguuauuuuuaaaaagcaacuuaccacuaaauccuugagu

SEQ ID NO: 293201 - RNA, 64 nt, Homo Sapiens
aaaaccuuuuagugacaaaauccuaauauguggaaaaaagcauaugcauaaaggaauaauauug

SEQ ID NO: 293202 - RNA, 64 nt, Homo Sapiens
auugcuuugguuggugcauuuaaguauccaacucaaaaagcauaucaaauauuuuggguacuag

SEQ ID NO: 293203 - RNA, 64 nt, Homo Sapiens
aguugcuugaauuaugaucacaaagccauagaagaaaaagcaauaucagcauauacauuucagc

SEQ ID NO: 293204 - RNA, 64 nt, Homo Sapiens
uuugguaaguugugugugcuaagaagagcaagagaaaaagcaaauugaaaucagaagaacaaaa

SEQ ID NO: 293205 - RNA, 64 nt, Homo Sapiens
aaaagaaaaugcacucuaacgcauguuuaaaaaaaaaaagcaacuccagauuuuuuauaugucu

SEQ ID NO: 293206 - RNA, 64 nt, Homo Sapiens
aauuuuggucacuuccaagcugugaugauuauuaaaaaagcaaauugcugaauacuuuuuauaa

SEQ ID NO: 293207 - RNA, 64 nt, Homo Sapiens
uuaauaaaagaagacaaaauuuuuuaaauguuagaaaaagcagaucugucauugcaaaguaaca

SEQ ID NO: 293208 - RNA, 64 nt, Homo Sapiens
aauauauugguaguaauuacuguaauuauucaacaaaaagcauauccguucaaaaauuuuucca

SEQ ID NO: 293209 - RNA, 64 nt, Homo Sapiens
uuuuuuuccuuuguuuuaaaacugugguuuuuuaaaaaagcaauaauuaacucagaccucacua

SEQ ID NO: 293210 - RNA, 64 nt, Homo Sapiens
uucuuuguuuuucuuuuuuugggggaggaggggaaaaaagcagcaauacuguguuuggaaauua

SEQ ID NO: 293211 - RNA, 64 nt, Homo Sapiens
ccccauguaugccuauauguaaguaaccaccuuuaaaaagcaaccugauaauaucacaacccag

SEQ ID NO: 293212 - RNA, 64 nt, Homo Sapiens
aaugauuacugauaauaucaugcagaaauguauaaaaaagcaaaaucauagaaaacuugaaaaa

SEQ ID NO: 293213 - RNA, 64 nt, Homo Sapiens
guauguguagauauaacuuaaauauggagcuuucaaaaagcacaaauaggcuggacaugguggc

SEQ ID NO: 293214 - RNA, 64 nt, Homo Sapiens
gccugagugacagagagagauucaaaaaacaaaaaaaaagcaaaaauauacuuugcuauugggu

SEQ ID NO: 293215 - RNA, 64 nt, Homo Sapiens
aggaaugagggagagaagggggcuguagaguuugaaaaagcauauucaauauuaaaauaguuuu

SEQ ID NO: 293216 - RNA, 64 nt, Homo Sapiens
ugacuggggaggccucagaaucauggugggaggcaaaaagcacuucuuacauggcggcagcaag

SEQ ID NO: 293217 - RNA, 64 nt, Homo Sapiens
guaacuugugcuuugagagccccaauaaggcaagaaaaagcauaagccuugcuuuuagagaaug

SEQ ID NO: 293218 - RNA, 64 nt, Homo Sapiens
uggagugagcgaacauuuccuauguugaauuuuuaaaaagcacucaaaaauuaaaacauugcca

SEQ ID NO: 293219 - RNA, 64 nt, Homo Sapiens
aguucccuaguuaccauuuacauguugaaaggagaaaaagcacauaagaaauuugggacuuuuu

SEQ ID NO: 293220 - RNA, 64 nt, Homo Sapiens
agaaauuugggacuuuuucaauaaaggaaaagugaaaaagcauaauuagaaguguuaggguuag

SEQ ID NO: 293221 - RNA, 64 nt, Homo Sapiens
uagaauaguuucugagucugugacaccagugguaaaaaagcaagaggauuacaagcugucucuc

SEQ ID NO: 293222 - RNA, 64 nt, Homo Sapiens
aaacaaaaacaagucccaugggccaaaaaaaaccaaaaagcaaaauaggggccauaucauucau

SEQ ID NO: 293223 - RNA, 64 nt, Homo Sapiens
acaauugucuaauuuacagcaguugugaucccacaaaaagcaaguuuauaccucagauuggggu

SEQ ID NO: 293224 - RNA, 64 nt, Homo Sapiens
acaguaaauccaugucuuuguuuguuuuucuauuaaaaagcaaucaagaaagauaaugugaaaa

SEQ ID NO: 293225 - RNA, 64 nt, Homo Sapiens
aauugacuccaaugcagaauagugagaaaucaacaaaaagcaaaauaagacaauuccagacacu

SEQ ID NO: 293226 - RNA, 64 nt, Homo Sapiens
cgucuggaccacuggggaaaauauuuuucuuuucaaaaagcagccccuucagucugcguuccca

SEQ ID NO: 293227 - RNA, 64 nt, Homo Sapiens
cugguguguauucucaugugaugugggauuuuuuaaaaagcaaauaaaauuaugcagggccccu

SEQ ID NO: 293228 - RNA, 64 nt, Homo Sapiens
ugaccuuaugaggcucucgcagaaaaaaaagaaaaaaaagcacggcgaaacucugucucaaaaa

SEQ ID NO: 293229 - RNA, 64 nt, Homo Sapiens
guuauuuagguuaaauaucugccaaacaaccuucaaaaagcauucuuuuacuaccucuggguua

SEQ ID NO: 293230 - RNA, 64 nt, Homo Sapiens
gaauuguaagugugagguguacaucaauuauuacaaaaagcaguaaggaagugguguucuuuau

SEQ ID NO: 293231 - RNA, 64 nt, Homo Sapiens
caguguaaaaaaagucaucuaaagagaaguuuuuaaaaagcaaaagucacuaagcagaauuuag

SEQ ID NO: 293232 - RNA, 59 nt, Homo Sapiens
cugcaaauggucaguuguaguauuugcuaaaaaagcacgcaggacauggcuaaagaccu

SEQ ID NO: 293233 - RNA, 64 nt, Homo Sapiens
aaaugauuuucucugccuugagauuugcaucaagaaaaagcaccucucuucaccugaaagcuuu

SEQ ID NO: 293234 - RNA, 64 nt, Homo Sapiens
uugguucugugauuuggaugucaacaacuucccuaaaaagcaccaguguguuagguucuaaugu

SEQ ID NO: 293235 - RNA, 64 nt, Homo Sapiens
ggagaaaagagaaaccgggaaaaggaaaaaaagcaaaaagcaagccuaagacaugugaggagga

SEQ ID NO: 293236 - RNA, 64 nt, Homo Sapiens
aagcaagggagaaaagagaaaggaggaaaaggaaaaaaagcaaauagcaggccuaagacaugug

SEQ ID NO: 293237 - RNA, 64 nt, Homo Sapiens
aggccauugugaaccaaugcaccaacugaaggcuaaaaagcaacguugagcaauuucccccuaa

SEQ ID NO: 293238 - RNA, 64 nt, Homo Sapiens
uauuagugcagccaaguagccucuauaagauuccaaaaagcacacaaaguucaacuuggugaca

SEQ ID NO: 293239 - RNA, 64 nt, Homo Sapiens
ugauuauuuuuuuuaaauacagaacaggucuuucaaaaagcauugaauauguguggcagugaag

SEQ ID NO: 293240 - RNA, 64 nt, Homo Sapiens
aauuaaaguaguaaauucauaaacuuuuuuucaaaaaaagcacauuacuauugcucuuacuuga

SEQ ID NO: 293241 - RNA, 64 nt, Homo Sapiens
aaaauuaugguguuccugaaacaauuucaccuugaaaaagcaccaacaucuuagguauaacagc

SEQ ID NO: 293242 - RNA, 64 nt, Homo Sapiens
uucacauauuaaaagauucauucagauccuacucaaaaagcaucuugaguauugggaaaguuaa

SEQ ID NO: 293243 - RNA, 64 nt, Homo Sapiens
caaaaaaaaacugcaaaaguaaaaacagcaaaacaaaaagcaaaagagucccugaguauaaagg

SEQ ID NO: 293244 - RNA, 64 nt, Homo Sapiens
cuggagauggcagaagugaaagcuggccaucugcaaaaagcagauaagugaguuugaaccuuuu

SEQ ID NO: 293245 - RNA, 64 nt, Homo Sapiens
caagucuuuaggagaguagaaaacacaauuaacuaaaaagcagggacaucugaaagagacguau

SEQ ID NO: 293246 - RNA, 64 nt, Homo Sapiens
ucaaguacguauucagcauuauucaacugaagaaaaaaagcaagugguaaaagggaugcuagaa

SEQ ID NO: 293247 - RNA, 64 nt, Homo Sapiens
uauucccucaacaucagaacugcagucauuacagaaaaagcaaaaaaagagcucccaucugauc

SEQ ID NO: 293248 - RNA, 64 nt, Homo Sapiens
cacaagaaaucaaaauccaaccaaaggaaauccaaaaaagcaaaauaccggacacaccucugcu

SEQ ID NO: 293249 - RNA, 64 nt, Homo Sapiens
ggaagcauacuugugaacuaaaaaaguuuuuuuaaaaaagcaaauuggcuuuaaguaaaaaucc

SEQ ID NO: 293250 - RNA, 64 nt, Homo Sapiens
cccccuaugguugauauuguaaaaaaaaaaaaaaaaaaagcaaaaauuuugucucauuugccaa

SEQ ID NO: 293251 - RNA, 64 nt, Homo Sapiens
guugaggcaguguuugcuuuuaaaacaagaagauaaaaagcacucucucagguaagccauuuua

SEQ ID NO: 293252 - RNA, 64 nt, Homo Sapiens
caugcauuuauuauuaaacaugaacgucaggcuaaaaaagcagcuuccuuugguacaaaagggu

SEQ ID NO: 293253 - RNA, 64 nt, Homo Sapiens
cagucuaaauaauaaacaguucccauauauuauuaaaaagcauauacuaaugaaaauaauguuu

SEQ ID NO: 293254 - RNA, 64 nt, Homo Sapiens
gugaggcucuuucuauaaauacauauuguuuaaaaaaaagcaagaaaaaaaggaaaacaaagga

SEQ ID NO: 293255 - RNA, 64 nt, Homo Sapiens
ggcaacagagcgagacccugucuccaaaaaaaaaaaaaagcaauguuuauauuauaaaagagug

SEQ ID NO: 293256 - RNA, 64 nt, Homo Sapiens
uuggcaguguuuugguucagacaccuguucacagaaaaagcaugaugggaaaauauuuccugac

SEQ ID NO: 293257 - RNA, 64 nt, Homo Sapiens
cuuuuguaauuguguaaaaaauggaaaaaaacauaaaaagcagaauuuuaaugugaagacauuu

SEQ ID NO: 293258 - RNA, 64 nt, Homo Sapiens
caggucacuuuuaugccacauuauuuuaauugcaaaaaagcaucuauauauggaggaggguggg

SEQ ID NO: 293259 - RNA, 64 nt, Homo Sapiens
guuuccagcuuuaucaaagacauguuugaaaaauaaaaagcauccaagugagagcuggugagac

SEQ ID NO: 293260 - RNA, 64 nt, Homo Sapiens
uuucuaaaugcucaaauguucaaaucuauuagaaaaaaagcauuacugcacugcacuuauaaag

SEQ ID NO: 293261 - RNA, 64 nt, Homo Sapiens
auggccuuauaugcagggaauucuagcgcucccaaaaaagcacucacugucaaguggauggaua

SEQ ID NO: 293262 - RNA, 64 nt, Homo Sapiens
uagcacuuuuuaaaacaaacaaacaaacaaaacaaaaaagcaaaccacauuuguuaucucaaau

SEQ ID NO: 293263 - RNA, 64 nt, Homo Sapiens
agauaaugggcuuuguuagcacuuucaaaaaaaaaaaaagcaaaccauacuuguccacuguccu

SEQ ID NO: 293264 - RNA, 64 nt, Homo Sapiens
gcuuauucaaagacuagguuauuuucaacugggaaaaaagcagugcuaacaggauauuguucug

SEQ ID NO: 293265 - RNA, 64 nt, Homo Sapiens
cuccaccagggggaaggcuggcacaaggagaaaaaaaaagcaagcaucagcgaauaguauagug

SEQ ID NO: 293266 - RNA, 64 nt, Homo Sapiens
cuuauaagcuuucaugaaguucauauuuaaaggaaaaaagcaagucucuguauguuguauuuga

SEQ ID NO: 293267 - RNA, 64 nt, Homo Sapiens
uaacagguuaguauuggcaucagucuacuucuuuaaaaagcauuagacacagccgccacucccc

SEQ ID NO: 293268 - RNA, 64 nt, Homo Sapiens
uuccauuaaaaugggaauucaaaagaauucuuccaaaaagcagcaucaaagaaaugugaaauua

SEQ ID NO: 293269 - RNA, 64 nt, Homo Sapiens
augaacccucuacuuauaaaacuaauauuaauuuaaaaagcagcaggagaaguagcuuaaauuc

SEQ ID NO: 293270 - RNA, 64 nt, Homo Sapiens; identical to SEQ ID NO: 90410

SEQ ID NO: 293271 - RNA, 64 nt, Homo Sapiens; identical to SEQ ID NO: 90411

SEQ ID NO: 293272 - RNA, 64 nt, Homo Sapiens; identical to SEQ ID NO: 90412

SEQ ID NO: 293273 - RNA, 64 nt, Homo Sapiens; identical to SEQ ID NO: 90413

SEQ ID NO: 293274 - RNA, 64 nt, Homo Sapiens; identical to SEQ ID NO: 90414

SEQ ID NO: 293275 - RNA, 64 nt, Homo Sapiens; identical to SEQ ID NO: 90415

SEQ ID NO: 293276 - RNA, 64 nt, Homo Sapiens; identical to SEQ ID NO: 90416

SEQ ID NO: 293277 - RNA, 64 nt, Homo Sapiens; identical to SEQ ID NO: 90417

SEQ ID NO: 293278 - RNA, 64 nt, Homo Sapiens; identical to SEQ ID NO: 90418

SEQ ID NO: 293279 - RNA, 64 nt, Homo Sapiens; identical to SEQ ID NO: 90419

SEQ ID NO: 293280 - RNA, 64 nt, Homo Sapiens; identical to SEQ ID NO: 90420

SEQ ID NO: 293281 - RNA, 64 nt, Homo Sapiens; identical to SEQ ID NO: 90421

SEQ ID NO: 293282 - RNA, 64 nt, Homo Sapiens; identical to SEQ ID NO: 90422

SEQ ID NO: 293283 - RNA, 64 nt, Homo Sapiens; identical to SEQ ID NO: 90423

SEQ ID NO: 293284 - RNA, 64 nt, Homo Sapiens; identical to SEQ ID NO: 90424

SEQ ID NO: 293285 - RNA, 64 nt, Homo Sapiens; identical to SEQ ID NO: 90425

SEQ ID NO: 293286 - RNA, 64 nt, Homo Sapiens; identical to SEQ ID NO: 90426

SEQ ID NO: 293287 - RNA, 64 nt, Homo Sapiens; identical to SEQ ID NO: 90427

SEQ ID NO: 293288 - RNA, 64 nt, Homo Sapiens; identical to SEQ ID NO: 90428

SEQ ID NO: 293289 - RNA, 64 nt, Homo Sapiens; identical to SEQ ID NO: 90429

SEQ ID NO: 293290 - RNA, 64 nt, Homo Sapiens; identical to SEQ ID NO: 90430

SEQ ID NO: 293291 - RNA, 64 nt, Homo Sapiens; identical to SEQ ID NO: 90431

SEQ ID NO: 293292 - RNA, 64 nt, Homo Sapiens; identical to SEQ ID NO: 90432

SEQ ID NO: 293293 - RNA, 64 nt, Homo Sapiens; identical to SEQ ID NO: 90433

SEQ ID NO: 293294 - RNA, 64 nt, Homo Sapiens; identical to SEQ ID NO: 90434

SEQ ID NO: 293295 - RNA, 64 nt, Homo Sapiens; identical to SEQ ID NO: 90435

SEQ ID NO: 293296 - RNA, 64 nt, Homo Sapiens; identical to SEQ ID NO: 90436

SEQ ID NO: 293297 - RNA, 64 nt, Homo Sapiens; identical to SEQ ID NO: 90437

SEQ ID NO: 293298 - RNA, 64 nt, Homo Sapiens; identical to SEQ ID NO: 90438

SEQ ID NO: 293299 - RNA, 64 nt, Homo Sapiens; identical to SEQ ID NO: 90439

SEQ ID NO: 293300 - RNA, 64 nt, Homo Sapiens
uuccacggucuuuucugcaacauguagccuggagucaacccauuucuaagacgcacucuggagc

SEQ ID NO: 293301 - RNA, 64 nt, Homo Sapiens
uuuuggcugucuaguauucaaaaaaaaucugguaucaacccacaucuucguuucacaaauuaaa

SEQ ID NO: 293302 - RNA, 64 nt, Homo Sapiens
aaggucaagcugaaugccuccugcaacccagauuucaacccaaauugugggcaaagcugagaag

SEQ ID NO: 293303 - RNA, 64 nt, Homo Sapiens
uccugagugcccaucccaccuuccagccugggaaucaacccagugcccuggggaauggcaccag

SEQ ID NO: 293304 - RNA, 64 nt, Homo Sapiens
ugcugggucaagugucucauaacagccaaagacaucaacccaaggagaccuagguugccacggu

SEQ ID NO: 293305 - RNA, 64 nt, Homo Sapiens
cuggcacccuugccugucugcagcucccuuuggaucaacccagcaugcauggauuguaaaaaac

SEQ ID NO: 293306 - RNA, 64 nt, Homo Sapiens
uuggccaggcugaucucaaauaguagagaugggguuucgcuaugcuggcuaauuuuuguauuuu

SEQ ID NO: 293307 - RNA, 64 nt, Homo Sapiens
uuggccagacuggucuugaauaguagagacgggguuucgcuauggcuaauuuuuugugucuuuu

SEQ ID NO: 293308 - RNA, 64 nt, Homo Sapiens
gguguucaguaagacuacaaaaacauuuugccuauuucgcuaacaguuugguuuuuaauggcug

SEQ ID NO: 293309 - RNA, 64 nt, Homo Sapiens
gacucuccaccucagcauugcaucguaucaucauuuucgcuacgaauuuauuuuucaacaauaa

SEQ ID NO: 293310 - RNA, 64 nt, Homo Sapiens
aaggaacuugggagauuugaaacagugcucggguuuucgcuaggaccgguuugggcuuuguaca

SEQ ID NO: 293311 - RNA, 64 nt, Homo Sapiens
caucaauuucccauuuuuuuccucuguacuuuccuuucgcuauuaaugcaucaguauuaugauu

SEQ ID NO: 293312 - RNA, 64 nt, Homo Sapiens
ucaagcucuuugagaacauuccaaacuaguaacauuucgcuacuaaaagcuagaaaggaugaac

SEQ ID NO: 293313 - RNA, 64 nt, Homo Sapiens
aaggucuggaauccauuuggagcagauaccguguuuucgcuauuuaauaagaaguucaguagug

SEQ ID NO: 293314 - RNA, 64 nt, Homo Sapiens
cucucuucuuggcucguguacuguacuuuaaacauuucgcuauauccccgugcccggccacucu

SEQ ID NO: 293315 - RNA, 64 nt, Homo Sapiens
cuauaaaugcaguuguguccucagaacuuuguauuuucgcuaaacacuucuuuuaaggcuacuu

SEQ ID NO: 293316 - RNA, 64 nt, Homo Sapiens
auaaaaccaaaaaaaggaauuccuguuucuaaacuuucgcuacuuccaaagagugugugggcuu

SEQ ID NO: 293317 - RNA, 64 nt, Homo Sapiens
cgaguuuaguaacagugcagucaugccuccugcauuucgcuaccuaagucccaucaggacguag

SEQ ID NO: 293318 - RNA, 64 nt, Homo Sapiens
gccuggccuuuuuuucuucagagcuuguugucuuuuucgcuauauuagacuuugcaguaugccc

SEQ ID NO: 293319 - RNA, 64 nt, Homo Sapiens
ugucuguaaaguguagcaucauauauaaaaagaguuucgcuagcagcgcauuuuuuuuaguuca

SEQ ID NO: 293320 - RNA, 64 nt, Homo Sapiens
aguucccauccuuaaguuuuuuaguguaauuggauuucgcuaucuuccaaaaauuuaggaaugu

SEQ ID NO: 293321 - RNA, 64 nt, Homo Sapiens
ucaagcaguaccccaaguaaaaaugucaccauauuuucgcuagcgaagcauaguuagcaucaga

SEQ ID NO: 293322 - RNA, 64 nt, Homo Sapiens
ggaggcagccgaggccuggcuucccgugaauuuuuuucgcuaugggcaccccuuguuucuguug

SEQ ID NO: 293323 - RNA, 64 nt, Homo Sapiens
uuauaagcuauggggaguuuccauaccaguuugguuucgcuaccauacuaccgaacuuuuguuc

SEQ ID NO: 293324 - RNA, 64 nt, Homo Sapiens
gauuuuaccucaaaucagucacaccucagucauauuucgcuauaaacagcagucuaaucuagug

SEQ ID NO: 293325 - RNA, 64 nt, Homo Sapiens
uaaguuggauauuucucuacauuauggugcacuuuuucgcuauuaugacugcagugcagcagua

SEQ ID NO: 293326 - RNA, 64 nt, Homo Sapiens
aaauuaaagccauuuacuauuugcaguagugagauuucgcuaaauagcuaggacaacaaugcau

SEQ ID NO: 293327 - RNA, 64 nt, Homo Sapiens
aaccuggaugaccuucugaggucucuucagcccuuuucgcuaguggucacccaccaccaugguu

SEQ ID NO: 293328 - RNA, 64 nt, Homo Sapiens
aauaaaagguaacuguacaaaugaaaaaacccauuuucgcuauaaaaucuuuguuacucuguaa

SEQ ID NO: 293329 - RNA, 64 nt, Homo Sapiens
uuggccgggcugguuucaaauaguagagacgggguuucgcuauucuggcuaauuuuuguguuuu

SEQ ID NO: 293330 - RNA, 64 nt, Homo Sapiens; identical to SEQ ID NO: 223145

SEQ ID NO: 293331 - RNA, 64 nt, Homo Sapiens; identical to SEQ ID NO: 223146

SEQ ID NO: 293332 - RNA, 64 nt, Homo Sapiens; identical to SEQ ID NO: 223147

SEQ ID NO: 293333 - RNA, 64 nt, Homo Sapiens; identical to SEQ ID NO: 223148

SEQ ID NO: 293334 - RNA, 64 nt, Homo Sapiens; identical to SEQ ID NO: 223149

SEQ ID NO: 293335 - RNA, 64 nt, Homo Sapiens; identical to SEQ ID NO: 223150

SEQ ID NO: 293336 - RNA, 64 nt, Homo Sapiens; identical to SEQ ID NO: 223151

SEQ ID NO: 293337 - RNA, 64 nt, Homo Sapiens; identical to SEQ ID NO: 223152

SEQ ID NO: 293338 - RNA, 64 nt, Homo Sapiens; identical to SEQ ID NO: 223153

SEQ ID NO: 293339 - RNA, 64 nt, Homo Sapiens; identical to SEQ ID NO: 223154

SEQ ID NO: 293340 - RNA, 64 nt, Homo Sapiens; identical to SEQ ID NO: 223155

SEQ ID NO: 293341 - RNA, 64 nt, Homo Sapiens; identical to SEQ ID NO: 223156

SEQ ID NO: 293342 - RNA, 64 nt, Homo Sapiens; identical to SEQ ID NO: 223157

SEQ ID NO: 293343 - RNA, 64 nt, Homo Sapiens; identical to SEQ ID NO: 223158

SEQ ID NO: 293344 - RNA, 64 nt, Homo Sapiens; identical to SEQ ID NO: 223159

SEQ ID NO: 293345 - RNA, 64 nt, Homo Sapiens; identical to SEQ ID NO: 223160

SEQ ID NO: 293346 - RNA, 64 nt, Homo Sapiens; identical to SEQ ID NO: 223161

SEQ ID NO: 293347 - RNA, 64 nt, Homo Sapiens; identical to SEQ ID NO: 223162

SEQ ID NO: 293348 - RNA, 64 nt, Homo Sapiens; identical to SEQ ID NO: 223163

SEQ ID NO: 293349 - RNA, 64 nt, Homo Sapiens; identical to SEQ ID NO: 223164

SEQ ID NO: 293350 - RNA, 64 nt, Homo Sapiens; identical to SEQ ID NO: 223165

SEQ ID NO: 293351 - RNA, 64 nt, Homo Sapiens; identical to SEQ ID NO: 223166

SEQ ID NO: 293352 - RNA, 64 nt, Homo Sapiens; identical to SEQ ID NO: 223167

SEQ ID NO: 293353 - RNA, 64 nt, Homo Sapiens; identical to SEQ ID NO: 223168

SEQ ID NO: 293354 - RNA, 64 nt, Homo Sapiens; identical to SEQ ID NO: 223169

SEQ ID NO: 293355 - RNA, 64 nt, Homo Sapiens; identical to SEQ ID NO: 223170

SEQ ID NO: 293356 - RNA, 64 nt, Homo Sapiens; identical to SEQ ID NO: 223171

SEQ ID NO: 293357 - RNA, 64 nt, Homo Sapiens; identical to SEQ ID NO: 223172

SEQ ID NO: 293358 - RNA, 64 nt, Homo Sapiens; identical to SEQ ID NO: 223173

SEQ ID NO: 293359 - RNA, 64 nt, Homo Sapiens; identical to SEQ ID NO: 223174

SEQ ID NO: 293360 - RNA, 64 nt, Homo Sapiens; identical to SEQ ID NO: 223175

SEQ ID NO: 293361 - RNA, 64 nt, Homo Sapiens; identical to SEQ ID NO: 223176

SEQ ID NO: 293362 - RNA, 64 nt, Homo Sapiens; identical to SEQ ID NO: 223177

SEQ ID NO: 293363 - RNA, 64 nt, Homo Sapiens; identical to SEQ ID NO: 223178

SEQ ID NO: 293364 - RNA, 64 nt, Homo Sapiens; identical to SEQ ID NO: 223179

SEQ ID NO: 293365 - RNA, 64 nt, Homo Sapiens; identical to SEQ ID NO: 223180

SEQ ID NO: 293366 - RNA, 64 nt, Homo Sapiens; identical to SEQ ID NO: 223181

SEQ ID NO: 293367 - RNA, 64 nt, Homo Sapiens; identical to SEQ ID NO: 223182

SEQ ID NO: 293368 - RNA, 64 nt, Homo Sapiens; identical to SEQ ID NO: 223183

SEQ ID NO: 293369 - RNA, 64 nt, Homo Sapiens; identical to SEQ ID NO: 223184

SEQ ID NO: 293370 - RNA, 64 nt, Homo Sapiens; identical to SEQ ID NO: 223185

SEQ ID NO: 293371 - RNA, 64 nt, Homo Sapiens; identical to SEQ ID NO: 223186

SEQ ID NO: 293372 - RNA, 64 nt, Homo Sapiens; identical to SEQ ID NO: 223187

SEQ ID NO: 293373 - RNA, 64 nt, Homo Sapiens; identical to SEQ ID NO: 223188

SEQ ID NO: 293374 - RNA, 64 nt, Homo Sapiens; identical to SEQ ID NO: 223189

SEQ ID NO: 293375 - RNA, 64 nt, Homo Sapiens; identical to SEQ ID NO: 223190

SEQ ID NO: 293376 - RNA, 64 nt, Homo Sapiens; identical to SEQ ID NO: 223191

SEQ ID NO: 293377 - RNA, 64 nt, Homo Sapiens; identical to SEQ ID NO: 223192

SEQ ID NO: 293378 - RNA, 64 nt, Homo Sapiens; identical to SEQ ID NO: 223193

SEQ ID NO: 293379 - RNA, 64 nt, Homo Sapiens; identical to SEQ ID NO: 223194

SEQ ID NO: 293380 - RNA, 64 nt, Homo Sapiens; identical to SEQ ID NO: 223195

SEQ ID NO: 293381 - RNA, 57 nt, Homo Sapiens; identical to SEQ ID NO: 223196

SEQ ID NO: 293382 - RNA, 64 nt, Homo Sapiens; identical to SEQ ID NO: 223197

SEQ ID NO: 293383 - RNA, 54 nt, Homo Sapiens; identical to SEQ ID NO: 223198

SEQ ID NO: 293384 - RNA, 64 nt, Homo Sapiens; identical to SEQ ID NO: 161149

SEQ ID NO: 293385 - RNA, 64 nt, Homo Sapiens; identical to SEQ ID NO: 161150

SEQ ID NO: 293386 - RNA, 64 nt, Homo Sapiens; identical to SEQ ID NO: 161151

SEQ ID NO: 293387 - RNA, 64 nt, Homo Sapiens; identical to SEQ ID NO: 161152

SEQ ID NO: 293388 - RNA, 64 nt, Homo Sapiens; identical to SEQ ID NO: 161153

SEQ ID NO: 293389 - RNA, 64 nt, Homo Sapiens; identical to SEQ ID NO: 161154

SEQ ID NO: 293390 - RNA, 64 nt, Homo Sapiens; identical to SEQ ID NO: 161155

SEQ ID NO: 293391 - RNA, 64 nt, Homo Sapiens; identical to SEQ ID NO: 161156

SEQ ID NO: 293392 - RNA, 64 nt, Homo Sapiens; identical to SEQ ID NO: 161157

SEQ ID NO: 293393 - RNA, 64 nt, Homo Sapiens; identical to SEQ ID NO: 161158

SEQ ID NO: 293394 - RNA, 64 nt, Homo Sapiens; identical to SEQ ID NO: 161159

SEQ ID NO: 293395 - RNA, 64 nt, Homo Sapiens; identical to SEQ ID NO: 161160

SEQ ID NO: 293396 - RNA, 64 nt, Homo Sapiens; identical to SEQ ID NO: 161161

SEQ ID NO: 293397 - RNA, 64 nt, Homo Sapiens; identical to SEQ ID NO: 161162

SEQ ID NO: 293398 - RNA, 64 nt, Homo Sapiens; identical to SEQ ID NO: 161163

SEQ ID NO: 293399 - RNA, 64 nt, Homo Sapiens; identical to SEQ ID NO: 161164

SEQ ID NO: 293400 - RNA, 64 nt, Homo Sapiens; identical to SEQ ID NO: 161165

SEQ ID NO: 293401 - RNA, 64 nt, Homo Sapiens; identical to SEQ ID NO: 161166

SEQ ID NO: 293402 - RNA, 64 nt, Homo Sapiens; identical to SEQ ID NO: 161167

SEQ ID NO: 293403 - RNA, 64 nt, Homo Sapiens; identical to SEQ ID NO: 161168

SEQ ID NO: 293404 - RNA, 64 nt, Homo Sapiens; identical to SEQ ID NO: 161169

SEQ ID NO: 293405 - RNA, 64 nt, Homo Sapiens; identical to SEQ ID NO: 161170

SEQ ID NO: 293406 - RNA, 64 nt, Homo Sapiens; identical to SEQ ID NO: 161171

SEQ ID NO: 293407 - RNA, 64 nt, Homo Sapiens; identical to SEQ ID NO: 161172

SEQ ID NO: 293408 - RNA, 64 nt, Homo Sapiens; identical to SEQ ID NO: 161173

SEQ ID NO: 293409 - RNA, 64 nt, Homo Sapiens; identical to SEQ ID NO: 161174

SEQ ID NO: 293410 - RNA, 64 nt, Homo Sapiens; identical to SEQ ID NO: 161175

SEQ ID NO: 293411 - RNA, 64 nt, Homo Sapiens; identical to SEQ ID NO: 161176

SEQ ID NO: 293412 - RNA, 64 nt, Homo Sapiens; identical to SEQ ID NO: 161177

SEQ ID NO: 293413 - RNA, 64 nt, Homo Sapiens; identical to SEQ ID NO: 161178

SEQ ID NO: 293414 - RNA, 64 nt, Homo Sapiens; identical to SEQ ID NO: 161179

SEQ ID NO: 293415 - RNA, 64 nt, Homo Sapiens; identical to SEQ ID NO: 161180

SEQ ID NO: 293416 - RNA, 64 nt, Homo Sapiens; identical to SEQ ID NO: 161181

SEQ ID NO: 293417 - RNA, 64 nt, Homo Sapiens; identical to SEQ ID NO: 161182

SEQ ID NO: 293418 - RNA, 64 nt, Homo Sapiens; identical to SEQ ID NO: 161183

SEQ ID NO: 293419 - RNA, 64 nt, Homo Sapiens
ccuggaugcuauccacacccaccuaucccugcagcuaauuuagcugaucucuaauuuaacugag

SEQ ID NO: 293420 - RNA, 64 nt, Homo Sapiens
acccaccuaucccugcagcuaauuuagcugaucucuaauuuaacugagcucuaauuuagcugau

SEQ ID NO: 293421 - RNA, 64 nt, Homo Sapiens
agcuaauuuagcugaucucuaauuuaacugagcucuaauuuagcugaucagauuuugcuugggu

SEQ ID NO: 293422 - RNA, 64 nt, Homo Sapiens
gaucuuacuacuacaaagaauuauuacuuuuuuucuaauuuacuugaauuauaguucuaauuua

SEQ ID NO: 293423 - RNA, 64 nt, Homo Sapiens
auuacuuuuuuucuaauuuaucugaauuauaguucuaauuuauuaauauuuagugugcuacaga

SEQ ID NO: 293424 - RNA, 64 nt, Homo Sapiens
caagagaagggaaauacuaggaacuaagacauuucuaauuuauugcuuauuacuuucuuaauuu

SEQ ID NO: 293425 - RNA, 64 nt, Homo Sapiens
cagaagaauuagaggaaaagcagauacuagaauucuaauuuaauuacauauacagccgucuuug

SEQ ID NO: 293426 - RNA, 64 nt, Homo Sapiens
ccagcagaaaagugcuuagaacaaaauaauuuaacuaauuuaaauagaauuauaucuaauuuau

SEQ ID NO: 293427 - RNA, 64 nt, Homo Sapiens
caaaauaauuuaacuaauuuaaguagaauuauaucuaauuuauaaauuuuuauacauaucagaa

SEQ ID NO: 293428 - RNA, 64 nt, Homo Sapiens
uaaaaguuuguuuacaauuccacaagcaaaagcucuaauuuaaccagauuuucugacauugaag

SEQ ID NO: 293429 - RNA, 64 nt, Homo Sapiens
uaaaauucuaccuauuaggugucagguuaaaguucuaauuuaucuuuagaaauuuaugugaaaa

SEQ ID NO: 293430 - RNA, 64 nt, Homo Sapiens
auaauuucacugaaauaaacuuaauauaucauaucuaauuuaaaagguuggggcauaugggagc

SEQ ID NO: 293431 - RNA, 64 nt, Homo Sapiens
uuucauuuuagcuuuacaagaucagauaucagaccuaauuuaaauguaguguaugguaagucau

SEQ ID NO: 293432 - RNA, 64 nt, Homo Sapiens
agacaguauguauaguaauauuuuuaauccaaaacuaauuuauauuucacaauauuuuaacuga

SEQ ID NO: 293433 - RNA, 64 nt, Homo Sapiens
uugaagggaauaaaauuuguaacuaaauggguuucuaauuuaaugccaugaguauucuucccau

SEQ ID NO: 293434 - RNA, 64 nt, Homo Sapiens
auacuguauucgcauguagacgugugcuugccuccuaauuuaaagguagaguaacaccuuuaua

SEQ ID NO: 293435 - RNA, 64 nt, Homo Sapiens
uugcuuugcacuuugguuugagaagacuuggccucuaauuuauagaaguaaaucgaccgucaag

SEQ ID NO: 293436 - RNA, 64 nt, Homo Sapiens
aagcugugaacagaguugugucugaggaaugugccuaauuuaaggcaggguuuguuccaaugca

SEQ ID NO: 293437 - RNA, 64 nt, Homo Sapiens
auauuaauagguuguuuaucuuuuugccuguuugcuaauuuaaaaauauuuauuuuaucauuuu

SEQ ID NO: 293438 - RNA, 64 nt, Homo Sapiens
ugcaacaaagggcagcaagaaaugcuggguccaccuaauuuaacacaaaaugaaguugagauuc

SEQ ID NO: 293439 - RNA, 64 nt, Homo Sapiens
uucauguccagugagcagugagguggggcuuucccuaauuuaucgaggggggggggggcagggu

SEQ ID NO: 293440 - RNA, 64 nt, Homo Sapiens
uuauugcuagauaauaggguggagcugucugucucuaauuuaacuucuguagauucaugcaagu

SEQ ID NO: 293441 - RNA, 64 nt, Homo Sapiens
ggauaauaaauauuaagcucccaguuuauuuucucuaauuuaauaugaccagauguaggcuuag

SEQ ID NO: 293442 - RNA, 64 nt, Homo Sapiens
aacuuuguaaagacuggugcacugaaaguucauacuaauuuacaaacucuugccguaucaggag

SEQ ID NO: 293443 - RNA, 64 nt, Homo Sapiens
ucagauuguguuugaaaauuauauacugagcauacuaauuuaaaaagagaacuuguugaaauuu

SEQ ID NO: 293444 - RNA, 64 nt, Homo Sapiens
uccuguaguauaaauuuuauuuucacauacuuagcuaauuuagcaguaauuggcccaguuuuuu

SEQ ID NO: 293445 - RNA, 64 nt, Homo Sapiens
aagguuguccuaaacagaccaaggagacuguucccuaauuuauucucuuggcugguucucucau

SEQ ID NO: 293446 - RNA, 64 nt, Homo Sapiens
uguuaaaucaauuucuuucaaaggugguuggugucuaauuuaagauuuaggguggcagccaaua

SEQ ID NO: 293447 - RNA, 64 nt, Homo Sapiens
guggcagccaauaaaggugguguuuuaaggaaaacuaauuuaggcaguaaaagugaaauauuac

SEQ ID NO: 293448 - RNA, 64 nt, Homo Sapiens
uuacuaucauuuaugauugcaucaaugugaaggacuaauuuaaaaaggacuaauuuaaacacau

SEQ ID NO: 293449 - RNA, 64 nt, Homo Sapiens
cacauaucaaugugaaggacggcauaccuaaggacuaauuuaaaacagaacaaaaggcagaaaa

SEQ ID NO: 293450 - RNA, 64 nt, Homo Sapiens
guuguguuuuucuuaauauguacagggucaauaucuaauuuacuuuuauauuacaaaguuggca

SEQ ID NO: 293451 - RNA, 64 nt, Homo Sapiens
uuagguuaauuuauauuacagguuaaauuaaaaucuaauuuaaauuuaaaaaacuaucaaagua

SEQ ID NO: 293452 - RNA, 64 nt, Homo Sapiens
aaucucaaugcaguugaaaucuggucugaugugccuaauuuaucuguggaaaauuuaaugcuga

SEQ ID NO: 293453 - RNA, 64 nt, Homo Sapiens
uacauucacugugaguuucaaagggagucagucccuaauuuacagguuuccuuuguucacuuuc

SEQ ID NO: 293454 - RNA, 64 nt, Homo Sapiens
aaaaugaucuaaauuauuguuuuaauuuuuaaaccuaauuuauucacucagugaacauucuuac

SEQ ID NO: 293455 - RNA, 64 nt, Homo Sapiens
agggauuucugcauucuggacagcccaagacugccuaauuuaacggaggcaggcacacguccuc

SEQ ID NO: 293456 - RNA, 64 nt, Homo Sapiens
aaaaaaauuauauagauaggaccaccaagcuuggcuaauuuaaaagcugggacuacaggcaugc

SEQ ID NO: 293457 - RNA, 64 nt, Homo Sapiens
auuccaucuuucugagaaaaagggaagaucauagcuaauuuauaauagcucaaauuacuaauuu

SEQ ID NO: 293458 - RNA, 64 nt, Homo Sapiens
gaagaucauagcuaauuuauaauagcucaaauuacuaauuuaauaacugggucaccaguguuuc

SEQ ID NO: 293459 - RNA, 64 nt, Homo Sapiens
gggcccucccagcacaaaguugcauuccuccccccuaauuuauucuaauuuauuaacuuugacc

SEQ ID NO: 293460 - RNA, 64 nt, Homo Sapiens
agcacaaaguugcauuccuccccccuaauuuauucuaauuuauuaacuuugacccacccuuucu

SEQ ID NO: 293461 - RNA, 64 nt, Homo Sapiens; identical to SEQ ID NO: 161149

SEQ ID NO: 293462 - RNA, 64 nt, Homo Sapiens; identical to SEQ ID NO: 161150

SEQ ID NO: 293463 - RNA, 64 nt, Homo Sapiens; identical to SEQ ID NO: 161151

SEQ ID NO: 293464 - RNA, 64 nt, Homo Sapiens; identical to SEQ ID NO: 161152

SEQ ID NO: 293465 - RNA, 64 nt, Homo Sapiens; identical to SEQ ID NO: 161153

SEQ ID NO: 293466 - RNA, 64 nt, Homo Sapiens; identical to SEQ ID NO: 161154

SEQ ID NO: 293467 - RNA, 64 nt, Homo Sapiens; identical to SEQ ID NO: 161155

SEQ ID NO: 293468 - RNA, 64 nt, Homo Sapiens; identical to SEQ ID NO: 161156

SEQ ID NO: 293469 - RNA, 64 nt, Homo Sapiens; identical to SEQ ID NO: 161157

SEQ ID NO: 293470 - RNA, 64 nt, Homo Sapiens; identical to SEQ ID NO: 161158

SEQ ID NO: 293471 - RNA, 64 nt, Homo Sapiens; identical to SEQ ID NO: 161159

SEQ ID NO: 293472 - RNA, 64 nt, Homo Sapiens; identical to SEQ ID NO: 161160

SEQ ID NO: 293473 - RNA, 64 nt, Homo Sapiens; identical to SEQ ID NO: 161161

SEQ ID NO: 293474 - RNA, 64 nt, Homo Sapiens; identical to SEQ ID NO: 161162

SEQ ID NO: 293475 - RNA, 64 nt, Homo Sapiens; identical to SEQ ID NO: 161163

SEQ ID NO: 293476 - RNA, 64 nt, Homo Sapiens; identical to SEQ ID NO: 161164

SEQ ID NO: 293477 - RNA, 64 nt, Homo Sapiens; identical to SEQ ID NO: 161165

SEQ ID NO: 293478 - RNA, 64 nt, Homo Sapiens; identical to SEQ ID NO: 161166

SEQ ID NO: 293479 - RNA, 64 nt, Homo Sapiens; identical to SEQ ID NO: 161167

SEQ ID NO: 293480 - RNA, 64 nt, Homo Sapiens; identical to SEQ ID NO: 161168

SEQ ID NO: 293481 - RNA, 64 nt, Homo Sapiens; identical to SEQ ID NO: 161169

SEQ ID NO: 293482 - RNA, 64 nt, Homo Sapiens; identical to SEQ ID NO: 161170

SEQ ID NO: 293483 - RNA, 64 nt, Homo Sapiens; identical to SEQ ID NO: 161171

SEQ ID NO: 293484 - RNA, 64 nt, Homo Sapiens; identical to SEQ ID NO: 161172

SEQ ID NO: 293485 - RNA, 64 nt, Homo Sapiens; identical to SEQ ID NO: 161173

SEQ ID NO: 293486 - RNA, 64 nt, Homo Sapiens; identical to SEQ ID NO: 161174

SEQ ID NO: 293487 - RNA, 64 nt, Homo Sapiens; identical to SEQ ID NO: 161175

SEQ ID NO: 293488 - RNA, 64 nt, Homo Sapiens; identical to SEQ ID NO: 161176

SEQ ID NO: 293489 - RNA, 64 nt, Homo Sapiens; identical to SEQ ID NO: 161177

SEQ ID NO: 293490 - RNA, 64 nt, Homo Sapiens; identical to SEQ ID NO: 161178

SEQ ID NO: 293491 - RNA, 64 nt, Homo Sapiens; identical to SEQ ID NO: 161179

SEQ ID NO: 293492 - RNA, 64 nt, Homo Sapiens; identical to SEQ ID NO: 161180

SEQ ID NO: 293493 - RNA, 64 nt, Homo Sapiens; identical to SEQ ID NO: 161181

SEQ ID NO: 293494 - RNA, 64 nt, Homo Sapiens; identical to SEQ ID NO: 161182

SEQ ID NO: 293495 - RNA, 64 nt, Homo Sapiens; identical to SEQ ID NO: 161183

SEQ ID NO: 293496 - RNA, 64 nt, Homo Sapiens; identical to SEQ ID NO: 293419

SEQ ID NO: 293497 - RNA, 64 nt, Homo Sapiens; identical to SEQ ID NO: 293420

SEQ ID NO: 293498 - RNA, 64 nt, Homo Sapiens; identical to SEQ ID NO: 293421

SEQ ID NO: 293499 - RNA, 64 nt, Homo Sapiens; identical to SEQ ID NO: 293422

SEQ ID NO: 293500 - RNA, 64 nt, Homo Sapiens; identical to SEQ ID NO: 293423

SEQ ID NO: 293501 - RNA, 64 nt, Homo Sapiens; identical to SEQ ID NO: 293424

SEQ ID NO: 293502 - RNA, 64 nt, Homo Sapiens; identical to SEQ ID NO: 293425

SEQ ID NO: 293503 - RNA, 64 nt, Homo Sapiens; identical to SEQ ID NO: 293426

SEQ ID NO: 293504 - RNA, 64 nt, Homo Sapiens; identical to SEQ ID NO: 293427

SEQ ID NO: 293505 - RNA, 64 nt, Homo Sapiens; identical to SEQ ID NO: 293428

SEQ ID NO: 293506 - RNA, 64 nt, Homo Sapiens; identical to SEQ ID NO: 293429

SEQ ID NO: 293507 - RNA, 64 nt, Homo Sapiens; identical to SEQ ID NO: 293430

SEQ ID NO: 293508 - RNA, 64 nt, Homo Sapiens; identical to SEQ ID NO: 293431

SEQ ID NO: 293509 - RNA, 64 nt, Homo Sapiens; identical to SEQ ID NO: 293432

SEQ ID NO: 293510 - RNA, 64 nt, Homo Sapiens; identical to SEQ ID NO: 293433

SEQ ID NO: 293511 - RNA, 64 nt, Homo Sapiens; identical to SEQ ID NO: 293434

SEQ ID NO: 293512 - RNA, 64 nt, Homo Sapiens; identical to SEQ ID NO: 293435

SEQ ID NO: 293513 - RNA, 64 nt, Homo Sapiens; identical to SEQ ID NO: 293436

SEQ ID NO: 293514 - RNA, 64 nt, Homo Sapiens; identical to SEQ ID NO: 293437

SEQ ID NO: 293515 - RNA, 64 nt, Homo Sapiens; identical to SEQ ID NO: 293438

SEQ ID NO: 293516 - RNA, 64 nt, Homo Sapiens; identical to SEQ ID NO: 293439

SEQ ID NO: 293517 - RNA, 64 nt, Homo Sapiens; identical to SEQ ID NO: 293440

SEQ ID NO: 293518 - RNA, 64 nt, Homo Sapiens; identical to SEQ ID NO: 293441

SEQ ID NO: 293519 - RNA, 64 nt, Homo Sapiens; identical to SEQ ID NO: 293442

SEQ ID NO: 293520 - RNA, 64 nt, Homo Sapiens; identical to SEQ ID NO: 293443

SEQ ID NO: 293521 - RNA, 64 nt, Homo Sapiens; identical to SEQ ID NO: 293444

SEQ ID NO: 293522 - RNA, 64 nt, Homo Sapiens; identical to SEQ ID NO: 293445

SEQ ID NO: 293523 - RNA, 64 nt, Homo Sapiens; identical to SEQ ID NO: 293446

SEQ ID NO: 293524 - RNA, 64 nt, Homo Sapiens; identical to SEQ ID NO: 293447

SEQ ID NO: 293525 - RNA, 64 nt, Homo Sapiens; identical to SEQ ID NO: 293448

SEQ ID NO: 293526 - RNA, 64 nt, Homo Sapiens; identical to SEQ ID NO: 293449

SEQ ID NO: 293527 - RNA, 64 nt, Homo Sapiens; identical to SEQ ID NO: 293450

SEQ ID NO: 293528 - RNA, 64 nt, Homo Sapiens; identical to SEQ ID NO: 293451

SEQ ID NO: 293529 - RNA, 64 nt, Homo Sapiens; identical to SEQ ID NO: 293452

SEQ ID NO: 293530 - RNA, 64 nt, Homo Sapiens; identical to SEQ ID NO: 293453

SEQ ID NO: 293531 - RNA, 64 nt, Homo Sapiens; identical to SEQ ID NO: 293454

SEQ ID NO: 293532 - RNA, 64 nt, Homo Sapiens; identical to SEQ ID NO: 293455

SEQ ID NO: 293533 - RNA, 64 nt, Homo Sapiens; identical to SEQ ID NO: 293456

SEQ ID NO: 293534 - RNA, 64 nt, Homo Sapiens; identical to SEQ ID NO: 293457

SEQ ID NO: 293535 - RNA, 64 nt, Homo Sapiens; identical to SEQ ID NO: 293458

SEQ ID NO: 293536 - RNA, 64 nt, Homo Sapiens; identical to SEQ ID NO: 293459

SEQ ID NO: 293537 - RNA, 64 nt, Homo Sapiens; identical to SEQ ID NO: 293460

SEQ ID NO: 293538 - RNA, 64 nt, Homo Sapiens
cagagaauuacagggagaaauaauaacugaacuacagcaaaaggaaguagaaagugagacucaa

SEQ ID NO: 293539 - RNA, 64 nt, Homo Sapiens
ugucucucccauuuuucugauguuuccuguucaccagcaaaaaauccagaggggucuggagcuu

SEQ ID NO: 293540 - RNA, 64 nt, Homo Sapiens
auuccuuucuuuaaaaaaaaaagccaucaauauucagcaaaaugcuuuuugcauuuugguguau

SEQ ID NO: 293541 - RNA, 64 nt, Homo Sapiens
acggaugaauguagcccuucgcucccacaggcaccagcaaaacacucacagcgcagcaagugag

SEQ ID NO: 293542 - RNA, 64 nt, Homo Sapiens
cauaccaaaacaacgacaacccuccuauuuuaaucagcaaaaucgguuaucuuuuuuuuuuucc

SEQ ID NO: 293543 - RNA, 64 nt, Homo Sapiens
uuaugccuaaaguaaaucugcaaugggcuuaaaucagcaaaauacucagauuuguguguucaau

SEQ ID NO: 293544 - RNA, 64 nt, Homo Sapiens
auucaaaucugccuuuuaggaccuggcuuugugacagcaaaaaccaucuuuacaggcuccuaga

SEQ ID NO: 293545 - RNA, 64 nt, Homo Sapiens
uuuaaacuucauaaccuuuuuauaaaaguuguugcagcaaaauaauagccucgguucuaugcau

SEQ ID NO: 293546 - RNA, 64 nt, Homo Sapiens
cuuaggcagacaucgaaccucucugggauguuuccagcaaaagugagcuuuucuaaucgucuca

SEQ ID NO: 293547 - RNA, 64 nt, Homo Sapiens
guuccugacauaguaaaguuugcuuucauaacugcagcaaaaaaggucaacuugccaagucacu

SEQ ID NO: 293548 - RNA, 64 nt, Homo Sapiens
gaggggagcaaguggggaccuggccauggccccucagcaaaaaccuauucacagcgggugggga

SEQ ID NO: 293549 - RNA, 64 nt, Homo Sapiens
acucccgccucacuucgucucuacagaauguucacagcaaaacacguuuggucuguuuuuagau

SEQ ID NO: 293550 - RNA, 64 nt, Homo Sapiens
ccuuuacguuguucuaaacccaagaggaaagaagcagcaaaaugagccugggaugcugccguac

SEQ ID NO: 293551 - RNA, 64 nt, Homo Sapiens
cugaggcuguugggaccauuaaaaaauuuuccugcagcaaaaguuuaaucugugaccauugggc

SEQ ID NO: 293552 - RNA, 64 nt, Homo Sapiens
cuccagcuggagggauggguccuacuccauuucccagcaaaaggccauaaugcagagugggccc

SEQ ID NO: 293553 - RNA, 64 nt, Homo Sapiens
aauucuuagcaagcuccuugaauggggugaaaaacagcaaaauugaacagggcagcucuguuug

SEQ ID NO: 293554 - RNA, 64 nt, Homo Sapiens
caaacugcugucucuuaaauaaaauccuuacuuccagcaaaaucaagacaagugcucaagcagc

SEQ ID NO: 293555 - RNA, 64 nt, Homo Sapiens
cuuacuuccagcaaaauccagacaagugcucaagcagcaaaaucaaauggaauuacuccaaaaa

SEQ ID NO: 293556 - RNA, 64 nt, Homo Sapiens
auuguuucuuuucucuuuguuaacugugucauuacagcaaaauacuagcagucugccuaaacau

SEQ ID NO: 293557 - RNA, 64 nt, Homo Sapiens
ugggcccaaauauucuuuguaaagaaaaucgcugcagcaaaaacuguuacuguguuuauuauau

SEQ ID NO: 293558 - RNA, 64 nt, Homo Sapiens
uuaaaacagaaacuuuucaaguuaaccuuaaauccagcaaaacauauuuugauaaguauuagag

SEQ ID NO: 293559 - RNA, 64 nt, Homo Sapiens
uugggaauuuucuccugucaguccugucauuuaucagcaaaagagacauuucaacaaugauaca

SEQ ID NO: 293560 - RNA, 64 nt, Homo Sapiens
cuucaucaagaaaaaguggaaccagcugucccuccagcaaaaacagcagcccuaauagcagccc

SEQ ID NO: 293561 - RNA, 64 nt, Homo Sapiens
ggagcaaagggaggcuccggcugccccagauuggcagcaaaaauaagccgucaaguaguaagaa

SEQ ID NO: 293562 - RNA, 64 nt, Homo Sapiens
ugguacuccugacgaauauaggugccaaaauccucagcaaaauacuaguaaaccaaauccaucu

SEQ ID NO: 293563 - RNA, 64 nt, Homo Sapiens
aagugggaccuaauuaaacuaaauaacuucugcacagcaaaagaagcuauuugcagacuacaga

SEQ ID NO: 293564 - RNA, 64 nt, Homo Sapiens
ucaguauugagacacugucaagauuaaguuauaccagcaaaagugcaguagugucacuuuuuuc

SEQ ID NO: 293565 - RNA, 64 nt, Homo Sapiens
gauggauuugacacacucaccauuuaaucauuuccagcaaaauauauguuuggcugaaauuaug

SEQ ID NO: 293566 - RNA, 64 nt, Homo Sapiens
auuuuccuaggguuaacaccucaccaaguucuuccagcaaaaugcuuauuagaguuuuugucug

SEQ ID NO: 293567 - RNA, 64 nt, Homo Sapiens
acucaacccaaacaaaacuacuucgugaggcuuucagcaaaaaggcugcuuaaaagcaugaacc

SEQ ID NO: 293568 - RNA, 64 nt, Homo Sapiens
ugaugccucugcaagauacugugaggagaauugacagcaaaaguucaccaccuacucuuauuua

SEQ ID NO: 293569 - RNA, 64 nt, Homo Sapiens
gacuuuucuucauauuuugcaaagagaaauuucacagcaaaaauucauguuuugucagcuuucu

SEQ ID NO: 293570 - RNA, 64 nt, Homo Sapiens
aguugucuuuguagaaaaugaagagccuuucuuccagcaaaaaucccugcuguaugcaauagcc

SEQ ID NO: 293571 - RNA, 64 nt, Homo Sapiens
gaugagaaauaugguaacggguuuguaacugccacagcaaaacaauuugccuccaugccugaau

SEQ ID NO: 293572 - RNA, 64 nt, Homo Sapiens
guggaaggaaaggugacuguugcuuucauugucccugggauauuuucagcaucuugguugaacu

SEQ ID NO: 293573 - RNA, 64 nt, Homo Sapiens
aggucagugauguagucuugcucuccugcugcuccugggauaccaacuccuccuccuccuccuc

SEQ ID NO: 293574 - RNA, 64 nt, Homo Sapiens
aaugaagaagacauacuaauggguuuauauuaaucugggauauaagaagugauaccucuagacu

SEQ ID NO: 293575 - RNA, 64 nt, Homo Sapiens
aacuuugaaaagugucaauauagaucuaaugggucugggauaaauaauucuuucuaguaucuug

SEQ ID NO: 293576 - RNA, 64 nt, Homo Sapiens
aauuacguagucagcauuaauuacauuucaagcucugggauauaaaugucuuagacaauuaccu

SEQ ID NO: 293577 - RNA, 64 nt, Homo Sapiens
uuuuagaauauuaaauucuugaccuuuuaaauuccugggauaaaacucacuaguuuauaggccu

SEQ ID NO: 293578 - RNA, 64 nt, Homo Sapiens
ccucacuugggauucucagcaguuacaugaaaguugugcugauaaucucuucucuuguaccaau

SEQ ID NO: 293579 - RNA, 64 nt, Homo Sapiens
ugaauuuuguuuuauucuuccuaagacugaggauugugcugaguccagagucauugugguaacu

SEQ ID NO: 293580 - RNA, 64 nt, Homo Sapiens
ugcagggugggccugaucccagaguggugcuuacugugcugacuguguacuuaucuuccccaag

SEQ ID NO: 293581 - RNA, 64 nt, Homo Sapiens
ucuuuacauauuacuauauggaaaugaauugcucugugcugaaauuugaagaccagauaaugaa

SEQ ID NO: 293582 - RNA, 64 nt, Homo Sapiens
uggugacucacuguccugacugaggccuggacccugugcugagcugugcuuugucucucugugc

SEQ ID NO: 293583 - RNA, 64 nt, Homo Sapiens
ccuggacccugugcugagcugugcuuugucucucugugcugaggcuucaggcagccucucaaau

SEQ ID NO: 293584 - RNA, 64 nt, Homo Sapiens
uugggaacuuaucuuuuuccgaugagugaggagcugugcugauguaaguguccuucucucccag

SEQ ID NO: 293585 - RNA, 64 nt, Homo Sapiens
gcgcucccucaggagggccuagggagggcuuuccugugcugacaucagagaggaccuggugggg

SEQ ID NO: 293586 - RNA, 64 nt, Homo Sapiens
ugccuacuaggugaaacauaacaauaaaacuaccugugcugaaauuugggggaaguuuaggucc

SEQ ID NO: 293587 - RNA, 64 nt, Homo Sapiens
cuuucaaugauaaagguuuguuguaguugucuuaugugcugaauuugcagaugaucagaugcug

SEQ ID NO: 293588 - RNA, 64 nt, Homo Sapiens
aacaucuacacuucauuuucaaguuaaccauuuuugugcugaagaaauauuuucauguguaaga

SEQ ID NO: 293589 - RNA, 64 nt, Homo Sapiens
auuuuuuuaagcauugcagauaucaaaguucuauugugcugaauaaaugccccuuuguuaacag

SEQ ID NO: 293590 - RNA, 64 nt, Homo Sapiens
ggagacccagagagcuagggguuuaggcauccugugugcugacaaggucaccacggggucguug

SEQ ID NO: 293591 - RNA, 64 nt, Homo Sapiens
ucaccacggggucguugguuugacaagcaagggcugugcugaggacaaaggcccagcagccuuc

SEQ ID NO: 293592 - RNA, 64 nt, Homo Sapiens
gcuguacauguauuaguuccugugugccaggcuuugugcugaguggcaccuggugagagccugc

SEQ ID NO: 293593 - RNA, 64 nt, Homo Sapiens
auggcaccuggugagagccucucaaccaagcaguugugcugagaaccugccacugccacaguag

SEQ ID NO: 293594 - RNA, 64 nt, Homo Sapiens
cucgucccgugugaguugcuugcuuugcugucugugugcugaaguucagucuaagucucguauu

SEQ ID NO: 293595 - RNA, 64 nt, Homo Sapiens
auccauugccauuugguacagaaaguauuaaguuugugcugaaauacuauugcuguaguguuag

SEQ ID NO: 293596 - RNA, 64 nt, Homo Sapiens
ugccuggagcucagguacaacccaacgccccggaugugcugagcaccugcccgagguguuugcc

SEQ ID NO: 293597 - RNA, 64 nt, Homo Sapiens
aaggcccugcagugcagccucuggugcugaacucugugcugagcccggagagcugcucaacccg

SEQ ID NO: 293598 - RNA, 64 nt, Homo Sapiens
uaugacuauaaagggaugacgcaaggaguuccuuugugcugauggaacaguucuauaugauuau

SEQ ID NO: 293599 - RNA, 64 nt, Homo Sapiens
uuugauuaugagguuaagcacaugagucuuuaccugugcugaaguuguauggaccuacauacac

SEQ ID NO: 293600 - RNA, 64 nt, Homo Sapiens
ugaaccacaaguauccagcuuaaucacguaucuuacucacgauaccacugguccagaugaguuu

SEQ ID NO: 293601 - RNA, 64 nt, Homo Sapiens
cagguccuggggguauggggccugacccagacgcacucacgagcgacgcacagagaggucucuu

SEQ ID NO: 293602 - RNA, 64 nt, Homo Sapiens
aguucugaauagugucuguggaguuaauaaacacacucacgaaagccuugcccguggggaguaa

SEQ ID NO: 293603 - RNA, 64 nt, Homo Sapiens
auugaauuggauacaaggaucagaauggaaagaaacucacgaugaaauugaaccugguuuuugu

SEQ ID NO: 293604 - RNA, 64 nt, Homo Sapiens
uuauaugaggggcaguggacaguucccuaugccaacucacgacuccuacagguacuagucacuc

SEQ ID NO: 293605 - RNA, 64 nt, Homo Sapiens
uccuauuuucucauuuccagguuauuauaaugaaacucacgaaucuacggacauuuugcuuuca

SEQ ID NO: 293606 - RNA, 64 nt, Homo Sapiens
uuuuuagaaaacagugcuucuucaagaagggcagacucacgaauauggaaaauaagcuuuaugu

SEQ ID NO: 293607 - RNA, 64 nt, Homo Sapiens
acugggccgcgugguuugguugggacacagggguacucacgaaaggacgcuggguccuccucuc

SEQ ID NO: 293608 - RNA, 64 nt, Homo Sapiens
caaauuguuuaucaugaaugcaggaugugggcaaacucacgacugcuccugccaacagaagguu

SEQ ID NO: 293609 - RNA, 64 nt, Homo Sapiens
uuacauuuuuggcgucuguuuacauaugcaauaaacucacgacuggaggucagguucauuuugu

SEQ ID NO: 293610 - RNA, 64 nt, Homo Sapiens
aaauccaccugagaucagcacauccaacccuuagacucacgaacagccuaggucagccaacccc

SEQ ID NO: 293611 - RNA, 64 nt, Homo Sapiens
cuuuuuuuaagaaccauuuucaucugauuuuuaaacucacgauaccaguuaucuguuaaucaaa

SEQ ID NO: 293612 - RNA, 64 nt, Homo Sapiens
cuccgccugcuuccuccagaagacacgaaucaugacucacgauugcugaagccugagcaggucu

SEQ ID NO: 293613 - RNA, 64 nt, Homo Sapiens
uacauucucugucuuacugaugucuucuagguuaacucacgaagugugacuccugagcgugcgc

SEQ ID NO: 293614 - RNA, 64 nt, Homo Sapiens
cgccagcguggcgccuggauaguggugccucgacacucacgaacgacggcagacagcuauauuu

SEQ ID NO: 293615 - RNA, 64 nt, Homo Sapiens
gggcagccuguugaaacugaagcacagucugaccacucacgauaaagcagauuuuucucugccu

SEQ ID NO: 293616 - RNA, 64 nt, Homo Sapiens
uugagcauggcuugaguugguaaggaaagcuguaacucacgaagcccugagaccugcuaccccu

SEQ ID NO: 293617 - RNA, 64 nt, Homo Sapiens
aauaaucggcccacagcuccucccucuccugccuacucacgauaguccagcgccuagugggguc

SEQ ID NO: 293618 - RNA, 64 nt, Homo Sapiens
ggugccugagcugugagaaguguccucagccgacacucacgagggcagugcaagggagaaccug

SEQ ID NO: 293619 - RNA, 64 nt, Homo Sapiens
aaagccaguggagaaagcgcggccugggagaaagacucacgagauccuaaaugguaaucuggcc

SEQ ID NO: 293620 - RNA, 64 nt, Homo Sapiens
uuucaucccugccaagaacucugggcacuuuugaacucacgagccuugcgcaaaacccagaaga

SEQ ID NO: 293621 - RNA, 64 nt, Homo Sapiens
aaauaaauaaaauagcucugucuuucaaugaaacacucacgaugacuacugcgccuucucuuuc

SEQ ID NO: 293622 - RNA, 64 nt, Homo Sapiens
uaagagagauggaggcuguggcggacuccuuccaacucacgauuuauccucagcucagagugua

SEQ ID NO: 293623 - RNA, 64 nt, Homo Sapiens
aaagggcccagcucugagccccucacccuuccacacucacgaacucucagccgaggaaggcaag

SEQ ID NO: 293624 - RNA, 64 nt, Homo Sapiens
cucucuggcccucuaccccugaucugacauccccacucacgaauauuaugcccaguuucugccu

SEQ ID NO: 293625 - RNA, 64 nt, Homo Sapiens
cagaggcugggcgugguggcucaggggaaagaaaacucacgaaguggagaacucagagggugcc

SEQ ID NO: 293626 - RNA, 51 nt, Homo Sapiens
uaauauacuuucaguauugaaacucacgacggcaccacuaggccagaggcg

SEQ ID NO: 293627 - RNA, 64 nt, Homo Sapiens
aauggccuuucuacaaagcaggguuuaugauuauacucacgaggugggaaccauuuuugugagu

SEQ ID NO: 293628 - RNA, 64 nt, Homo Sapiens
gggcgccguccaggccgagcgcagacuguuuaggacucagcagacccagcaagaggcaucugcc

SEQ ID NO: 293629 - RNA, 64 nt, Homo Sapiens
ugccagcggacgucagcacucacggccugcagggacucagcacagcucuggauucuggaucucu

SEQ ID NO: 293630 - RNA, 64 nt, Homo Sapiens
cgggcaggacuuggggcagcugaagcucacggugacucagcagugcccaacugaccaaucuccc

SEQ ID NO: 293631 - RNA, 64 nt, Homo Sapiens
gcacaauuugcacuccccucagcuagacgcacagacucagcaauaaaccuuugcaucaggcucc

SEQ ID NO: 293632 - RNA, 64 nt, Homo Sapiens
aacuucaucuaaguccuaacuauuacaaugauggacucagcaccuccaaagcaguuaauuuuuc

SEQ ID NO: 293633 - RNA, 64 nt, Homo Sapiens
agcaaagugcacugaugugugagcucuuaagaccacucagcaugacgacugaguagacuuguuu

SEQ ID NO: 293634 - RNA, 64 nt, Homo Sapiens
acacaguuggucugcagucggcccaggacggucuacucagcacaacugacugcuucagugcugc

SEQ ID NO: 293635 - RNA, 64 nt, Homo Sapiens
uccugggcuccaucaauggcugcaucuuuucuggacucagcagucuccuugauuccauguagag

SEQ ID NO: 293636 - RNA, 64 nt, Homo Sapiens
gcuaucuaccuucacacucccacuccgccuugugacucagcaauuugacuuguuccaaauuaaa

SEQ ID NO: 293637 - RNA, 64 nt, Homo Sapiens
auauaaaagaaaaaaauguuccccaggcaucuucacucagcagggccagcugucaaguuugucc

SEQ ID NO: 293638 - RNA, 64 nt, Homo Sapiens
uccagccacagcaguccacagcagcaggguuaagacucagcacagggccagcagcagcacaacc

SEQ ID NO: 293639 - RNA, 64 nt, Homo Sapiens
gaaaagggaugagagaaaggaggugguauggaagacucagcaggaacaagguaggcuucaaaga

SEQ ID NO: 293640 - RNA, 64 nt, Homo Sapiens
gcagugcucaccccaggcuucccugacggggaugacucagcacuaccccucaacagagaugacu

SEQ ID NO: 293641 - RNA, 64 nt, Homo Sapiens
agggaugacuccgcacugccccucaacagggaugacucagcagagaugacucagcacugucccu

SEQ ID NO: 293642 - RNA, 64 nt, Homo Sapiens
acugccccucaacagggaugacucagcagagaugacucagcacugucccuuagcagggaugaca

SEQ ID NO: 293643 - RNA, 64 nt, Homo Sapiens
acugucccuuagcagggaugacacagcaaggaugacucagcacugccccucagcaaggaugacu

SEQ ID NO: 293644 - RNA, 64 nt, Homo Sapiens
aaggaugacucagcacugccccucagcaaggaugacucagcacugccgcucaacagacaugacu

SEQ ID NO: 293645 - RNA, 64 nt, Homo Sapiens
agggauggcuuaguacugccccucagcagggaugacucagcaccgccucucaacagggaugacu

SEQ ID NO: 293646 - RNA, 64 nt, Homo Sapiens
agggaugacucagcaccgccucucaacagggaugacucagcagggaugacucagcaccgccccu

SEQ ID NO: 293647 - RNA, 64 nt, Homo Sapiens
accgccucucaacagggaugacucagcagggaugacucagcaccgccccucaacaggcaugacu

SEQ ID NO: 293648 - RNA, 64 nt, Homo Sapiens
accgccccucaacaggcaugacucugcagagaugacucagcacugucccuuagcagggaugaca

SEQ ID NO: 293649 - RNA, 64 nt, Homo Sapiens; identical to SEQ ID NO: 293643

SEQ ID NO: 293650 - RNA, 64 nt, Homo Sapiens
aaggaugacucagcacugccccucagcaaggaugacucagcacugccgcucaacagggaugacu

SEQ ID NO: 293651 - RNA, 64 nt, Homo Sapiens
agggauggcuuaguacugccccucaacagggaugacucagcagggaugacucagcaccgccccu

SEQ ID NO: 293652 - RNA, 64 nt, Homo Sapiens
acugccccucaacagggaugacucagcagggaugacucagcaccgccccucaacaggcaugacu

SEQ ID NO: 293653 - RNA, 64 nt, Homo Sapiens
agggaugacucaguacugccccucagcagggaugacucagcacugccccucaacagggaugacu

SEQ ID NO: 293654 - RNA, 64 nt, Homo Sapiens
agggaugacucagcacugccccucaacagggaugacucagcagggaugacucagcacugucccu

SEQ ID NO: 293655 - RNA, 64 nt, Homo Sapiens
acugccccucaacagggaugacucagcagggaugacucagcacugucccuuagcagugaugaca

SEQ ID NO: 293656 - RNA, 64 nt, Homo Sapiens
acugucccuuagcagugaugacacagcaaggaugacucagcacugccccucagcaaggaugacu

SEQ ID NO: 293657 - RNA, 64 nt, Homo Sapiens; identical to SEQ ID NO: 293644

SEQ ID NO: 293658 - RNA, 64 nt, Homo Sapiens
agggauggcuuaguacugccccucagcagggaugacucagcaccgccccucaacagggaugacu

SEQ ID NO: 293659 - RNA, 64 nt, Homo Sapiens
agggaugacucagcaccgccccucaacagggaugacucagcacugccccucaacagggaugacu

SEQ ID NO: 293660 - RNA, 64 nt, Homo Sapiens
agggaugacucagcacugccccucaacagggaugacucagcagggaugacucagcagugucccu

SEQ ID NO: 293661 - RNA, 64 nt, Homo Sapiens
acugccccucaacagggaugacucagcagggaugacucagcagugucccuuagcagcgaugaca

SEQ ID NO: 293662 - RNA, 64 nt, Homo Sapiens
agugucccuuagcagcgaugacacagcaaggaugacucagcacugccccucaccaaggaugacu

SEQ ID NO: 293663 - RNA, 64 nt, Homo Sapiens
aaggaugacucagcacugccccucaccaaggaugacucagcacugccgcucaacagacaugacu

SEQ ID NO: 293664 - RNA, 64 nt, Homo Sapiens
agggauggcuuaguacugccccucagcagggaugacucagcagggaugacucagcaccaccccu

SEQ ID NO: 293665 - RNA, 64 nt, Homo Sapiens
acugccccucagcagggaugacucagcagggaugacucagcaccaccccucaacagggaugacu

SEQ ID NO: 293666 - RNA, 64 nt, Homo Sapiens
agggaugacucagcaccaccccucaacagggaugacucagcagggaugacucagcacugccccu

SEQ ID NO: 293667 - RNA, 64 nt, Homo Sapiens
accaccccucaacagggaugacucagcagggaugacucagcacugccccucaacagggaugacu

SEQ ID NO: 293668 - RNA, 64 nt, Homo Sapiens
gcacugccccucaacagggaugacugcagggaugacucagcacugccccucagcagggaugacu

SEQ ID NO: 293669 - RNA, 64 nt, Homo Sapiens
agggaugacucagcacugccccucagcagggaugacucagcacugccccucagcagggaugacu

SEQ ID NO: 293670 - RNA, 64 nt, Homo Sapiens
agggaugacucagcacugccccucagcagggaugacucagcagggaugacucagcaccgccccu

SEQ ID NO: 293671 - RNA, 64 nt, Homo Sapiens
acugccccucagcagggaugacucagcagggaugacucagcaccgccccucaacaggcaugacu

SEQ ID NO: 293672 - RNA, 64 nt, Homo Sapiens
accgccccucaacaggcaugacucugcagagaugacucagcacugccccucagcagggauggcu

SEQ ID NO: 293673 - RNA, 64 nt, Homo Sapiens
acugccccucagcagggauggcucagcagggaugacucagcauugccccucaacagggaugacu

SEQ ID NO: 293674 - RNA, 64 nt, Homo Sapiens
agggaugacucagcauugccccucaacagggaugacucagcagacucagcagggaugacucagc

SEQ ID NO: 293675 - RNA, 64 nt, Homo Sapiens
ucagcauugccccucaacagggaugacucagcagacucagcagggaugacucagcacugccccu

SEQ ID NO: 293676 - RNA, 64 nt, Homo Sapiens
caacagggaugacucagcagacucagcagggaugacucagcacugccccucaacagacaugacu

SEQ ID NO: 293677 - RNA, 64 nt, Homo Sapiens
agggaugacucagcacugccccucaacagacaugacucagcagggaugacucagcaccgccccu

SEQ ID NO: 293678 - RNA, 64 nt, Homo Sapiens
acugccccucaacagacaugacucagcagggaugacucagcaccgccccucagcaaggaugacu

SEQ ID NO: 293679 - RNA, 64 nt, Homo Sapiens
agggaugacucagcaccgccccucagcaaggaugacucagcagggaugauucagcagagauaac

SEQ ID NO: 293680 - RNA, 64 nt, Homo Sapiens
auuuauuucagaaggcugaacauaagagguuucuacucagcaauacuuagaugucuaacuguuu

SEQ ID NO: 293681 - RNA, 64 nt, Homo Sapiens
accuugaggcuaguuaguaucacacucaggccacacucagcacuugcccacucuuguuuacugc

SEQ ID NO: 293682 - RNA, 64 nt, Homo Sapiens
uggcauggagggcccaggcauuccaacguaggccacucagcaacgcuggggacuuguccuucuc

SEQ ID NO: 293683 - RNA, 64 nt, Homo Sapiens
uauguucccgccgcagugggcaagcacugcggccacucagcagcggggacagcccucgcccugc

SEQ ID NO: 293684 - RNA, 64 nt, Homo Sapiens
gcugacuggcaaguucgauguuagcucccgggacacucagcagcgauggugagcauuuugguuu

SEQ ID NO: 293685 - RNA, 64 nt, Homo Sapiens
acauaauggacgugaaguggggcagaaacccagaacucagcauucaaggaugcccaggagagcu

SEQ ID NO: 293686 - RNA, 64 nt, Homo Sapiens
ugggaguucuagacuagccugggcgagacuucaucucuacaaaaaaagcaacaacgacaaaaaa

SEQ ID NO: 293687 - RNA, 64 nt, Homo Sapiens
caaguccaaucugggcaacauggggaaaccccagcucuacaaaaaaaauuagccugguguggug

SEQ ID NO: 293688 - RNA, 64 nt, Homo Sapiens
gaaaggccgagcaggccgugaucucaagcuaaugcucuacaaagagucuagaggacaccuuugu

SEQ ID NO: 293689 - RNA, 64 nt, Homo Sapiens
aguuucccauaucauuguugagaaggagauacagcucuacaaggggagugcugcugagaaggcu

SEQ ID NO: 293690 - RNA, 64 nt, Homo Sapiens
uugucaccucacuuaguucagaugaaaucuguuacucuacaaggaagguguucaucauuaggag

SEQ ID NO: 293691 - RNA, 64 nt, Homo Sapiens
augauuauuguuuaauuucaaaagaauccucaggcucuacaaucuaggggugguaaauguguuu

SEQ ID NO: 293692 - RNA, 64 nt, Homo Sapiens
aaauggagaaguucaggaagagcuugauccagaccucuacaagcgaugaaggacgugucucagg

SEQ ID NO: 293693 - RNA, 64 nt, Homo Sapiens
aauaaaaacacuuaaaaauuagugagacccccaucucuacaaaagagaccagccugggcaacaa

SEQ ID NO: 293694 - RNA, 64 nt, Homo Sapiens
uucuguuugucaguucauuccuguguguucuuaccucuacaaaguaaauuacacauuuaguuuu

SEQ ID NO: 293695 - RNA, 64 nt, Homo Sapiens
caggaguuuugagaccagccugggaaacaucugucucuacaaaaaaauacaaaaauuagcuggg

SEQ ID NO: 293696 - RNA, 64 nt, Homo Sapiens
cucaggaguucgugaccagccugggcaacccugucucuacaaaaaauacaaaaauuaaccaggc

SEQ ID NO: 293697 - RNA, 64 nt, Homo Sapiens
cucacuuuaauaccucuuaggaaccaaagaaugccucuacaagcaaaaagauaguugaaaauag

SEQ ID NO: 293698 - RNA, 64 nt, Homo Sapiens
aguuuugcauuguagaauugauaaucagucuggccucuacaacauguucgagcacagaacggau

SEQ ID NO: 293699 - RNA, 64 nt, Homo Sapiens
cacauacagacacacacacuucucugugucccaucucuacaaccccaagucuguccugucuuca

SEQ ID NO: 293700 - RNA, 64 nt, Homo Sapiens
ugagacaagccuaggcaacaaaacaagacucugucucuacaaaaaguuuaagaaaugagccaga

SEQ ID NO: 293701 - RNA, 64 nt, Homo Sapiens
gcacucaagccugggcaauguagcaagauccugucucuacaagaaauuuuuuaaaaaugagcca

SEQ ID NO: 293702 - RNA, 64 nt, Homo Sapiens
ugaauuuuuuuuuccuuuucccauguggcaguccuuccugcacauaguugacauuccuaguaaa

SEQ ID NO: 293703 - RNA, 64 nt, Homo Sapiens
agaaaugagaugcaggaaagaaaaccaaaucccauuccugcaccccaguccaauaagcagauac

SEQ ID NO: 293704 - RNA, 64 nt, Homo Sapiens
gcccaauccaagacuggcauugggguccuguuccuuccugcaaacuaccccccgacuuugucuc

SEQ ID NO: 293705 - RNA, 64 nt, Homo Sapiens
caguuuugccagcuuugcuuuaccuuccucucuguuccugcagauccuuuuuucucuaauuuuc

SEQ ID NO: 293706 - RNA, 64 nt, Homo Sapiens
cugcuacguuucccuuggcaacugcugugcuggguuccugcagcugccuaggcugcggcccuuc

SEQ ID NO: 293707 - RNA, 64 nt, Homo Sapiens
gagucuccugauuacugaacauuuucuggcacucuuccugcauucucaucccacucucaguugg

SEQ ID NO: 293708 - RNA, 64 nt, Homo Sapiens
ugacagauagacucagauuugauggagaacuuauuuccugcagccacaagcucacucaagacca

SEQ ID NO: 293709 - RNA, 64 nt, Homo Sapiens
ucauggaggggcuggccuuugcugcugcugcugcuuccugcagacacaugggagcugccugccu

SEQ ID NO: 293710 - RNA, 64 nt, Homo Sapiens
cauucucaaacauacugaugugguuaccuccaccuuccugcacuuuuucuagagauggacagcu

SEQ ID NO: 293711 - RNA, 64 nt, Homo Sapiens
cuguauaaaaguaaaccaucgugugaaaucaugguuccugcaugagaaugauucauuuugcugc

SEQ ID NO: 293712 - RNA, 64 nt, Homo Sapiens
uuugaaguauaaagucauaaauauauaauuuaucuuccugcauuuaaaauuacauguauauaaa

SEQ ID NO: 293713 - RNA, 64 nt, Homo Sapiens
ccaucccauuucuacugauuuuuaaugugagauauuccugcaaagacuguaguauuaauaaggu

SEQ ID NO: 293714 - RNA, 64 nt, Homo Sapiens
ggacacugugagcacguggucucgccuucccuucuuccugcagguucccgccaagccaugugac

SEQ ID NO: 293715 - RNA, 64 nt, Homo Sapiens
guuugcuucacuuuacccaucccgaugcucuuccuuccugcagcuucaugcuccaaugagggcu

SEQ ID NO: 293716 - RNA, 64 nt, Homo Sapiens
gcugaguggggcgcccucaccuccagccagccucuuccugcagaggaguagugucagccaccuu

SEQ ID NO: 293717 - RNA, 64 nt, Homo Sapiens
acauuuucucaguuggguccaucagcaguuuuucuuccugcauuuauuguugaaaacuauuguu

SEQ ID NO: 293718 - RNA, 64 nt, Homo Sapiens
aauauugcacacccaaaccaugguauuccacguauuccugcauucucccuccccggcuuugugc

SEQ ID NO: 293719 - RNA, 64 nt, Homo Sapiens
uuuuaaaaaacaaguuuggaaaaauacgaagaaauuccugcaauuuucugguauuuuuguugau

SEQ ID NO: 293720 - RNA, 64 nt, Homo Sapiens
uaaauguccccuuuaguauuuaauggaaaauugguuccugcaaaagacaaagggugagaguuag

SEQ ID NO: 293721 - RNA, 64 nt, Homo Sapiens
guccgucuacaaccuggaaucagauuugcaaaauuuccugcacugcugucugacacuguccugu

SEQ ID NO: 293722 - RNA, 64 nt, Homo Sapiens
uucucacccccucaaccagguugggggagguacauuccugcaucaacagcucuguuguucugca

SEQ ID NO: 293723 - RNA, 64 nt, Homo Sapiens
uguuccaccugccuucggaguuggaaggaguggcuuccugcaggucugcagcccacaggcuuuu

SEQ ID NO: 293724 - RNA, 64 nt, Homo Sapiens
uuaaacaacucauuuuaagauucaaauuaacuaauuccugcauauaugacauuccuuacauaag

SEQ ID NO: 293725 - RNA, 64 nt, Homo Sapiens
uacauguucucaauucauucauauuauuaagcucuuccugcaguugauaucugagcagaguaag

SEQ ID NO: 293726 - RNA, 64 nt, Homo Sapiens
uuguauauaccuguauauguugcagucuucuguauuccugcauauuuuaaaaaaauauguaaag

SEQ ID NO: 293727 - RNA, 64 nt, Homo Sapiens
cacagugcucagccuucaguaaaauauauuuucauuccugcaaauguuuugucuguucccuaag

SEQ ID NO: 293728 - RNA, 61 nt, Homo Sapiens
ugaacuucccuacccuacccccacaacacaagcaccccagaccucaccuccaucccccucu

SEQ ID NO: 293729 - RNA, 61 nt, Homo Sapiens
uuuuuucaucuguaaaacagggauaauaacagcaccccauagaguugugacgaggauugag

SEQ ID NO: 293730 - RNA, 61 nt, Homo Sapiens
ugggcugcuagacuaccccucaugcaggcaugcaccccagauuguaugcacaaaggagacc

SEQ ID NO: 293731 - RNA, 61 nt, Homo Sapiens
ccugcccuuucuccccugcaucacaguucaagcaccccaaacuuggcuguauuucccaucu

SEQ ID NO: 293732 - RNA, 61 nt, Homo Sapiens
guggggcaggggcagggcggcugcucacagagcaccccaguuccucaccagcuacucuggc

SEQ ID NO: 293733 - RNA, 61 nt, Homo Sapiens
guugagaccauugacaacugcucguguacaggcaccccacagccccagagcauggggcaca

SEQ ID NO: 293734 - RNA, 61 nt, Homo Sapiens
agagguugcagugagccgagauugcgccacugcaccccagccuggacaacagagugagacu

SEQ ID NO: 293735 - RNA, 61 nt, Homo Sapiens
guacacucccccggugacagggugcucacuggcaccccaucuuccugugaauaacucaaau

SEQ ID NO: 293736 - RNA, 61 nt, Homo Sapiens
ccaacucuugcuguccuuucuuaccaccugugcaccccacuuggagcagugggaggaaauc

SEQ ID NO: 293737 - RNA, 61 nt, Homo Sapiens
uguugggguaaaucccacauggcagaguaaggcaccccacagaaauuaacuuggagagccu

SEQ ID NO: 293738 - RNA, 61 nt, Homo Sapiens
auugagauguguuuuuaaugaaguuacagaugcaccccaacccccugaccucaccuuugca

SEQ ID NO: 293739 - RNA, 61 nt, Homo Sapiens
aguagugcccacuugaggcucagacaccugugcaccccaugauucaggggcuccccggggg

SEQ ID NO: 293740 - RNA, 61 nt, Homo Sapiens
ccccacuccucggcaguuucuggucccacacgcaccccaggggcuucuccagccauugaac

SEQ ID NO: 293741 - RNA, 61 nt, Homo Sapiens
ugcaccugaauccucuaacuagcuccagccagcaccccauccacagugcugcuaauauccc

SEQ ID NO: 293742 - RNA, 61 nt, Homo Sapiens
ggcagggacaaugccggcagccugagcccaggcaccccagugcccgcugggcccagccugg

SEQ ID NO: 293743 - RNA, 61 nt, Homo Sapiens
cacagccccgcccguggagggucccuuuuacgcaccccaaggcccacaccuaagcuuccau

SEQ ID NO: 293744 - RNA, 61 nt, Homo Sapiens
ucagaccucggugggcauucugaacaaaucugcaccccacucccgaguaacuuucugcuga

SEQ ID NO: 293745 - RNA, 61 nt, Homo Sapiens
cagccacuccuagccuuggcaucccagcacugcaccccaggugacacuccccuugcaaacc

SEQ ID NO: 293746 - RNA, 55 nt, Homo Sapiens; identical to SEQ ID NO: 138573

SEQ ID NO: 293747 - RNA, 61 nt, Homo Sapiens
gaguuggcccugagcucuauccaccaagccagcaccccaccaucccuuugcaggggaguca

SEQ ID NO: 293748 - RNA, 61 nt, Homo Sapiens
cucccugaguccccacacagggccucacucugcaccccaccagggucccgcucacaccagg

SEQ ID NO: 293749 - RNA, 61 nt, Homo Sapiens
cuggccaccuugggcagagcugggucaugcagcaccccauccuuacccggugcccucuccu

SEQ ID NO: 293750 - RNA, 61 nt, Homo Sapiens
gguggcagagcuugggggccgggaggggacggcaccccaguagcugacugugccccgcugc

SEQ ID NO: 293751 - RNA, 61 nt, Homo Sapiens
cacaggcuguggcugcucccaagaaaucccagcaccccagcguuucucuuugaugaccagg

SEQ ID NO: 293752 - RNA, 61 nt, Homo Sapiens
cugggcaacagagcgagacuauugcaccauugcaccccagcggagguuucagugagccgag

SEQ ID NO: 293753 - RNA, 61 nt, Homo Sapiens
cuacuugcugggcugaguccccaacgcccaggcaccccagugaagcuacagguagguccac

SEQ ID NO: 293754 - RNA, 61 nt, Homo Sapiens
gaacuaaaccagggagcugucugaaaucauagcaccccauccggguggcggggagaucaac

SEQ ID NO: 293755 - RNA, 61 nt, Homo Sapiens
uggagaaagggcccaugucaagccuuguucugcaccccaagcauuggugguaggacugggu

SEQ ID NO: 293756 - RNA, 61 nt, Homo Sapiens
cccacacucacauguacgaaucucucucagggcaccccagcugacagauggguccccuuuu

SEQ ID NO: 293757 - RNA, 61 nt, Homo Sapiens
ugcccugacagaugggucccguggggguggggcaccccagccucugcucccuagucccagg

SEQ ID NO: 293758 - RNA, 64 nt, Homo Sapiens
agcuccguaggcagccgggcuccugaagcagaagaucgagcaggcgaggccaagaagauggagu

SEQ ID NO: 293759 - RNA, 64 nt, Homo Sapiens
uuuuauguaccaggcacugucucaacaaauauuuaucgagcacccaaguaaagaugacaauuua

SEQ ID NO: 293760 - RNA, 64 nt, Homo Sapiens
gugaccuuggaagacagggcaagaucaaguuuacaucgagcaaauccagugccuucugagaagg

SEQ ID NO: 293761 - RNA, 64 nt, Homo Sapiens
cccagcugcuuuucauuuauaagaggagagaugcaucgagcagucuucuccgcgucauuguugg

SEQ ID NO: 293762 - RNA, 64 nt, Homo Sapiens
ucucaccaaacuucauguauuguugucugaacuaaucgagcacugacagacaucaagugccaga

SEQ ID NO: 293763 - RNA, 64 nt, Homo Sapiens
ucacacaauguuagcaaggauugauuccauuuagaucgagcagcaauuagagguagcucuagcu

SEQ ID NO: 293764 - RNA, 64 nt, Homo Sapiens
aggcuggaaucuggagaccuuucagcagugcauaaucgagcaggaguugaauauguuccugcau

SEQ ID NO: 293765 - RNA, 64 nt, Homo Sapiens
uccccauucacacccccauuugccacaaauaagcaucgagcaccgcaucuugcaagaccuuuag

SEQ ID NO: 293766 - RNA, 64 nt, Homo Sapiens
cugacccacugccccugccugccuuggacagcguaucgagcaucuccuuucaugagaggagcag

SEQ ID NO: 293767 - RNA, 64 nt, Homo Sapiens
ggcuucaggacauggguucucgaauauugguaagaucgagcaauguagccuacuuccuuacccc

SEQ ID NO: 293768 - RNA, 64 nt, Homo Sapiens
augcugaagacuaacgaagaaacuagagacugauaucgagcauucugcccaccucgcucuguau

SEQ ID NO: 293769 - RNA, 64 nt, Homo Sapiens
guuuguauggucuuguagaagacaguccuguaagaucgagcaaccagucaugaugaaaccaagu

SEQ ID NO: 293770 - RNA, 64 nt, Homo Sapiens
uaaauauuuucuauguguguuucaguggaugacaaucgagcagcagaagaauggugugccuacc

SEQ ID NO: 293771 - RNA, 64 nt, Homo Sapiens
caauuauauacuccagggaaauucaccacacugaaucgagcauuuguguguguaugugugaagu

SEQ ID NO: 293772 - RNA, 64 nt, Homo Sapiens
auuuuauuuaccccuccccuaaagaaaauccauuaucgagcagcugggaacggacugguaugua

SEQ ID NO: 293773 - RNA, 64 nt, Homo Sapiens
cuucuucuuugggaccccucugaagaauguggggaucgagcagcgagaccugucgcugaugaga

SEQ ID NO: 293774 - RNA, 64 nt, Homo Sapiens
gagccaaggagcagcauauagauugaccagucaaaucgagcaguagaagaauaguacagcccau

SEQ ID NO: 293775 - RNA, 64 nt, Homo Sapiens
guucccugcacaccugucgccagguuaaacaaccaucgagcaugugucaauggcauugcuuggg

SEQ ID NO: 293776 - RNA, 64 nt, Homo Sapiens
uuguuuuuucauagugccuucuuccagugggauuaucgagcaugcucuuuccacuuuguuggcc

SEQ ID NO: 293777 - RNA, 64 nt, Homo Sapiens
gguugucggccgggcaccacggcucacaccuauaaucgagcacuuugggaggccaagacaggag

SEQ ID NO: 293778 - RNA, 64 nt, Homo Sapiens
agggguuaggucugcaggcccgucugcgguccccaucgagcaucaaggggacgcugugugugcu

SEQ ID NO: 293779 - RNA, 64 nt, Homo Sapiens
gccgguaaccaccacgugccacaucuccacauacaucgagcagaagaacuuccagaggaaaucg

SEQ ID NO: 293780 - RNA, 64 nt, Homo Sapiens
uccuuggacagacuguuucuuggucccuucuacaaucgagcagccagaagguucguuagccagg

SEQ ID NO: 293781 - RNA, 64 nt, Homo Sapiens
cucacagccaguaggcauaggagcgggaaugaaaaucgagcacugucagaaucuggugggcagc

SEQ ID NO: 293782 - RNA, 64 nt, Homo Sapiens
uugauuccagauaguaagaugaguggaaguguuuaucgagcaugcaaaagaaacccucacggcu

SEQ ID NO: 293783 - RNA, 64 nt, Homo Sapiens
aagcagcauggucuccacagcucgcaagacacagaucgagcaaggacaguuacagcgucagccc

SEQ ID NO: 293784 - RNA, 64 nt, Homo Sapiens
ugguuugaguuacaucuagccaaauacaucagauaucgagcaaaggagaaaaauagauggguua

SEQ ID NO: 293785 - RNA, 64 nt, Homo Sapiens
acaauguucuggcacauaguaauuaauuaagaaaaucgagcacccuuaauuaccuagaaugcag

SEQ ID NO: 293786 - RNA, 64 nt, Homo Sapiens
cccagaaucuuggcuguuuacaaaucacguguccaucgagcacgucugaaaccccugguagccc

SEQ ID NO: 293787 - RNA, 63 nt, Homo Sapiens
gagucauacuccccacaagugccacaauggccccccgcgaaguaggggcagaguuaaacauua

SEQ ID NO: 293788 - RNA, 63 nt, Homo Sapiens
aagagcgaaccaaagcgauggcgagaacccgcgcccgcgaacaauggauggauggauggauga

SEQ ID NO: 293789 - RNA, 63 nt, Homo Sapiens
gguaaauacacccaaagggaucuccucuggucccccgcgaaaacauuggaugaaguggugccc

SEQ ID NO: 293790 - RNA, 63 nt, Homo Sapiens
ggcagcagagcuggcacaccgauucugggaagccccgcgaaugauggcuuuugaauuaaugag

SEQ ID NO: 293791 - RNA, 63 nt, Homo Sapiens
ggauccuucugcuccgcucaggacccccggagccccgcgaaaacaucugccucccaggagggu

SEQ ID NO: 293792 - RNA, 63 nt, Homo Sapiens
ccucaggauuaugguuaaccaugauagugugaacccgcgaagguuuugauggcagcaguaauc

SEQ ID NO: 293793 - RNA, 63 nt, Homo Sapiens
gugccacaccucgaacugguuguagugggaagucccgcgaaacccggugcaucuggcacgugg

SEQ ID NO: 293794 - RNA, 63 nt, Homo Sapiens
auccccccaagcccuagagcucccuccacucuucccgcgaacaucacaccguuccccgaccaa

SEQ ID NO: 293795 - RNA, 63 nt, Homo Sapiens
gacaguuuacaaaauuauuuucgauccucccugcccgcgaagugagcuggggcccacguggca

SEQ ID NO: 293796 - RNA, 63 nt, Homo Sapiens
aaucucgagagaacuggcauccucgcggcagcccccgcgaagagacaggggcgagggcugcuu

SEQ ID NO: 293797 - RNA, 63 nt, Homo Sapiens
acuccccccgccucgacggcaccacuggccggccccgcgaaagacugcgcgugcguagagcac

SEQ ID NO: 293798 - RNA, 63 nt, Homo Sapiens
gcgaggccaccccccuccauccugggggaagcgcccgcgaaaaccguggagagaagccgccgc

SEQ ID NO: 293799 - RNA, 63 nt, Homo Sapiens
gccccccgccagcccgcccccgguuguccaccucccgcgaagcccaaucgcgaggccgcgagc

SEQ ID NO: 293800 - RNA, 63 nt, Homo Sapiens
ccgaggccuggcucuggagcuugccuuugguuccccgcgaagugcgccccggacgccgcgauu

SEQ ID NO: 293801 - RNA, 64 nt, Homo Sapiens
ucugaaguuugagacgagggggcuccugagcugacugacugaugugaaguugguuuuguuggau

SEQ ID NO: 293802 - RNA, 64 nt, Homo Sapiens
gaugucugaaguuugagacgggauggcuccugagcugacugacuaauaugaaguugguuuuguu

SEQ ID NO: 293803 - RNA, 64 nt, Homo Sapiens
gaaugaaugaaugaggaagauacuauuugacugacugacugaaugaacacaggaggugcucaau

SEQ ID NO: 293804 - RNA, 64 nt, Homo Sapiens
gaaugaaugaaugaaugaggcaauuacuauuugacugacugacuacuggaacacaggaggugcu

SEQ ID NO: 293805 - RNA, 64 nt, Homo Sapiens
cagaacaaagacuaaauaaugacauaauccucagcugacugacugaaaaugugacuggacgcau

SEQ ID NO: 293806 - RNA, 64 nt, Homo Sapiens
acaaagacuaaauaaugacauaauccucagcugacugacugaaaaugugacuggacgcauuccc

SEQ ID NO: 293807 - RNA, 52 nt, Homo Sapiens
ugaugcucuucucaaggugacacugacugagauguucucuuacugacugaga

SEQ ID NO: 293808 - RNA, 64 nt, Homo Sapiens
uucucaaggugacacugacugagauguucucuuacugacugagauguucucuuggcaugcuaaa

SEQ ID NO: 293809 - RNA, 64 nt, Homo Sapiens
gcaaaucugcccugcucagcagucaccauagcagcugacugaaaaucagcacugccugaguagu

SEQ ID NO: 293810 - RNA, 64 nt, Homo Sapiens
gaguaguuuugaucaguuuaacuugaaucacuaacugacugaaaauugaaugggcaaauaagug

SEQ ID NO: 293811 - RNA, 64 nt, Homo Sapiens
auuaggacuuucugcaguugacauuugcauaaagcugacugacugaaggaacagaaagugagac

SEQ ID NO: 293812 - RNA, 64 nt, Homo Sapiens
ggacuuucugcaguugacauuugcauaaagcugacugacugaaggaacagaaagugagacagac

SEQ ID NO: 293813 - RNA, 64 nt, Homo Sapiens; identical to SEQ ID NO: 234346

SEQ ID NO: 293814 - RNA, 64 nt, Homo Sapiens; identical to SEQ ID NO: 234347

SEQ ID NO: 293815 - RNA, 64 nt, Homo Sapiens; identical to SEQ ID NO: 234348

SEQ ID NO: 293816 - RNA, 64 nt, Homo Sapiens; identical to SEQ ID NO: 234349

SEQ ID NO: 293817 - RNA, 64 nt, Homo Sapiens; identical to SEQ ID NO: 234350

SEQ ID NO: 293818 - RNA, 64 nt, Homo Sapiens; identical to SEQ ID NO: 234351

SEQ ID NO: 293819 - RNA, 64 nt, Homo Sapiens; identical to SEQ ID NO: 234352

SEQ ID NO: 293820 - RNA, 64 nt, Homo Sapiens; identical to SEQ ID NO: 234353

SEQ ID NO: 293821 - RNA, 64 nt, Homo Sapiens; identical to SEQ ID NO: 234354

SEQ ID NO: 293822 - RNA, 64 nt, Homo Sapiens; identical to SEQ ID NO: 234355

SEQ ID NO: 293823 - RNA, 64 nt, Homo Sapiens; identical to SEQ ID NO: 234356

SEQ ID NO: 293824 - RNA, 64 nt, Homo Sapiens; identical to SEQ ID NO: 234357

SEQ ID NO: 293825 - RNA, 64 nt, Homo Sapiens; identical to SEQ ID NO: 99247

SEQ ID NO: 293826 - RNA, 64 nt, Homo Sapiens; identical to SEQ ID NO: 99248

SEQ ID NO: 293827 - RNA, 64 nt, Homo Sapiens; identical to SEQ ID NO: 99249

SEQ ID NO: 293828 - RNA, 64 nt, Homo Sapiens; identical to SEQ ID NO: 99250

SEQ ID NO: 293829 - RNA, 64 nt, Homo Sapiens; identical to SEQ ID NO: 99251

SEQ ID NO: 293830 - RNA, 64 nt, Homo Sapiens; identical to SEQ ID NO: 99252

SEQ ID NO: 293831 - RNA, 64 nt, Homo Sapiens; identical to SEQ ID NO: 99253

SEQ ID NO: 293832 - RNA, 64 nt, Homo Sapiens; identical to SEQ ID NO: 99254

SEQ ID NO: 293833 - RNA, 64 nt, Homo Sapiens; identical to SEQ ID NO: 99255

SEQ ID NO: 293834 - RNA, 64 nt, Homo Sapiens; identical to SEQ ID NO: 99256

SEQ ID NO: 293835 - RNA, 64 nt, Homo Sapiens; identical to SEQ ID NO: 99257

SEQ ID NO: 293836 - RNA, 64 nt, Homo Sapiens; identical to SEQ ID NO: 99258

SEQ ID NO: 293837 - RNA, 64 nt, Homo Sapiens; identical to SEQ ID NO: 99259

SEQ ID NO: 293838 - RNA, 64 nt, Homo Sapiens; identical to SEQ ID NO: 99260

SEQ ID NO: 293839 - RNA, 64 nt, Homo Sapiens; identical to SEQ ID NO: 99261

SEQ ID NO: 293840 - RNA, 64 nt, Homo Sapiens; identical to SEQ ID NO: 99262

SEQ ID NO: 293841 - RNA, 64 nt, Homo Sapiens; identical to SEQ ID NO: 99263

SEQ ID NO: 293842 - RNA, 64 nt, Homo Sapiens; identical to SEQ ID NO: 99264

SEQ ID NO: 293843 - RNA, 64 nt, Homo Sapiens; identical to SEQ ID NO: 99265

SEQ ID NO: 293844 - RNA, 64 nt, Homo Sapiens; identical to SEQ ID NO: 99266

SEQ ID NO: 293845 - RNA, 64 nt, Homo Sapiens; identical to SEQ ID NO: 99267

SEQ ID NO: 293846 - RNA, 64 nt, Homo Sapiens; identical to SEQ ID NO: 99268

SEQ ID NO: 293847 - RNA, 64 nt, Homo Sapiens; identical to SEQ ID NO: 99269

SEQ ID NO: 293848 - RNA, 64 nt, Homo Sapiens; identical to SEQ ID NO: 99270

SEQ ID NO: 293849 - RNA, 64 nt, Homo Sapiens; identical to SEQ ID NO: 99271

SEQ ID NO: 293850 - RNA, 64 nt, Homo Sapiens
ucacggagaaucuaucuaaucccacuguauuaagaggggaaaccgggccaagcgcaguggcuca

SEQ ID NO: 293851 - RNA, 64 nt, Homo Sapiens
cgaaacuccgucucaaaaaaaaauaaaaaugaagaggggaaaccagaauaaauuaucuuuugga

SEQ ID NO: 293852 - RNA, 64 nt, Homo Sapiens
uggcuuuucgacauagaaccucagcuguuaaccaaggggaaauacaucagaucugcaacacaga

SEQ ID NO: 293853 - RNA, 64 nt, Homo Sapiens
aaugggaaagccagggggcauaaaagguacagucaggggaaaauagaucuaggcagagugccuu

SEQ ID NO: 293854 - RNA, 64 nt, Homo Sapiens
aguaggauguuguugccuuuaacuuuucuuauccaggggaaaauugccauuuuagggucagcau

SEQ ID NO: 293855 - RNA, 64 nt, Homo Sapiens
ccuggaagcagcauugugugauauucucagaggcaggggaaaauagagggaaaaauagagacua

SEQ ID NO: 293856 - RNA, 64 nt, Homo Sapiens
cuggcucuggccucagguggggcgcaggagagccaggggaaaagugccucauaguuaggaaagu

SEQ ID NO: 293857 - RNA, 64 nt, Homo Sapiens
ggcccacccaacugaaggcauggcggcggggugcaggggaaaguuaaaggugaugacgaucauc

SEQ ID NO: 293858 - RNA, 64 nt, Homo Sapiens
uuugcgucagagaaaugucuguccauuuuuauucaggggaaacuugauuugagauuuuuaugcc

SEQ ID NO: 293859 - RNA, 64 nt, Homo Sapiens
cuuuuuuggacuagcacugacugaacuguaauguaggggaaaguuucaugaugguaucuauagu

SEQ ID NO: 293860 - RNA, 64 nt, Homo Sapiens
uaaacacagugaaaaaaaaaguaccccagugaauaggggaaaaauuguuguuuauuuuauccaa

SEQ ID NO: 293861 - RNA, 64 nt, Homo Sapiens
aaaggagaaaggucuaaucaaaaugguuuguaagaggggaaagagcgaguuucuaaaggcgagg

SEQ ID NO: 293862 - RNA, 64 nt, Homo Sapiens
uuuccuggaaagcccgcuagaagguuugggaacgaggggaaaguucucagaacuguuggcugcu

SEQ ID NO: 293863 - RNA, 64 nt, Homo Sapiens
cacccucauuucugccagcgcauguguccuuucaaggggaaaaugugaagcugaacccccucca

SEQ ID NO: 293864 - RNA, 64 nt, Homo Sapiens
ggaagggccaucagcgugacccucauuuucaagaaggggaaacugaggcccagggaggagagua

SEQ ID NO: 293865 - RNA, 64 nt, Homo Sapiens
ucauuuccccuggaaaagaaacaugguccauuagaggggaaagcccaggggugaaucuucacgc

SEQ ID NO: 293866 - RNA, 64 nt, Homo Sapiens
guaauuuauaagaaagaaugccauugaauuuuuuaggggaaaaacuacaaauuucuaauuuagc

SEQ ID NO: 293867 - RNA, 64 nt, Homo Sapiens
caaccugggcagcagagcaagacucugucucaaaaggggaaaaaaaaaauugcugaugugaccc

SEQ ID NO: 293868 - RNA, 64 nt, Homo Sapiens
agcaguaaccuuauacacuacuuauaaguuugaaaggggaaagguuaccuuuacaauggagaca

SEQ ID NO: 293869 - RNA, 64 nt, Homo Sapiens
guucaauaauguauauguaucaguucuguaauaaaggggaaaacacuuuuuuuaaauacucaua

SEQ ID NO: 293870 - RNA, 64 nt, Homo Sapiens
aaucuagcauagugugauuuguaugugaggggaaaggggaaauaaauacugaagccucacaguu

SEQ ID NO: 293871 - RNA, 64 nt, Homo Sapiens
ggaaauaaaucuagcauagucacaguuguaugugaggggaaaggcaugcaaaauacugaagccu

SEQ ID NO: 293872 - RNA, 64 nt, Homo Sapiens
gcccacauuuuaacuuuuaaggaugauuuguuucaggggaaaauuuguguuggggaguggcagg

SEQ ID NO: 293873 - RNA, 64 nt, Homo Sapiens
cagccaucauccaacauuauguucaucagaaugaaggggaaaaaaauaacuugaguuuuccuaa

SEQ ID NO: 293874 - RNA, 64 nt, Homo Sapiens
gacccugacccccuugauccuuccuugggagagaaggggaaauggugaugagcaagaaggcauu

SEQ ID NO: 293875 - RNA, 64 nt, Homo Sapiens
cuaggagaaugcauuccucuagcccacccuccccaggggaaaaucucccagugaccuggaagca

SEQ ID NO: 293876 - RNA, 64 nt, Homo Sapiens
cauuaaguggggugcagcccccccccaaggcaugaggggaaagcuuccuccacccaguggagac

SEQ ID NO: 293877 - RNA, 64 nt, Homo Sapiens
aguuuguaauuauuucauccuuguuuguuuuuuaaggggaaaaauuguuuguguuuuguuuggc

SEQ ID NO: 293878 - RNA, 64 nt, Homo Sapiens
ccaaccucccagucuuccacccucugugacucagaggggaaauaccugaagucugucucuagcu

SEQ ID NO: 293879 - RNA, 64 nt, Homo Sapiens
augacaaggggacggggucugugagagucaauucaggggaaagauacaagauugauuuguaaaa

SEQ ID NO: 293880 - RNA, 64 nt, Homo Sapiens
uauaaggaaauggcccaaugaacgugguugugggaggggaaagaggaaacagagcuagucagau

SEQ ID NO: 293881 - RNA, 64 nt, Homo Sapiens
uauuuuuuaagaaauauaauaaagcacuuagggcaggggaaaucaucucgguaaucauggaacc

SEQ ID NO: 293882 - RNA, 64 nt, Homo Sapiens
gugagccuuauuaagaacacuacuacaguucugaaggggaaauauaacaucuaugguuauauau

SEQ ID NO: 293883 - RNA, 64 nt, Homo Sapiens
auauauggaaaaaaaugaccauuuuuucacuuuuaggggaaaaugcaaaaguguaauacauaaa

SEQ ID NO: 293884 - RNA, 64 nt, Homo Sapiens
agcagaccaaaauuucuaauucugcuaauucugaaggggaaauagacaaaucuuaaaagcugcc

SEQ ID NO: 293885 - RNA, 64 nt, Homo Sapiens
uugugcugcuguuagugcaacugggcaaguuugaaggggaaaauccuuguuuucuugcuuuauu

SEQ ID NO: 293886 - RNA, 64 nt, Homo Sapiens
guucaggcuguuaacaauucaacuaucaaaaaugaggggaaaagcaguuacuacaucaaucugc

SEQ ID NO: 293887 - RNA, 64 nt, Homo Sapiens
uguuuggcagaaagaaaaauguccuuggauaucuaggggaaagcuacuuggagaaaagaaccaa

SEQ ID NO: 293888 - RNA, 64 nt, Homo Sapiens
uuugccucaugucauaauugugcuuuuuuaaaggaggggaaauacauuuucaagccucaguuuu

SEQ ID NO: 293889 - RNA, 64 nt, Homo Sapiens
gauaaaauaaccccuauuuuucuuguuuuuaauaaggggaaaaauuagaccuugguuugguagu

SEQ ID NO: 293890 - RNA, 64 nt, Homo Sapiens
aaugucaucuccccccaccuuuucuuuuauugcaaggggaaaaaccuuuccguuucaagaccuu

SEQ ID NO: 293891 - RNA, 64 nt, Homo Sapiens
ccuccuaaggaaaagggaguagcagauugaucugaggggaaagcacaggcugugcugucgaggc

SEQ ID NO: 293892 - RNA, 64 nt, Homo Sapiens
cccuugcuggguuuuccuuuucuuugggacugugaggggaaaugguuuuuagaggugaggguug

SEQ ID NO: 293893 - RNA, 64 nt, Homo Sapiens
cuugugggaggagcagagggcgugcccggcccaaaggggaaacuggauuacaggcgugagccac

SEQ ID NO: 293894 - RNA, 64 nt, Homo Sapiens
uuuuuuuggagaaggcgucuucauuuggggccaaaggggaaacucucugcugccagccaagucu

SEQ ID NO: 293895 - RNA, 64 nt, Homo Sapiens
ggaagagcucuuggcucccuuacuggaaauuaacaggggaaaagauaauugugcugcuacauua

SEQ ID NO: 293896 - RNA, 64 nt, Homo Sapiens
cugacaacuaacaaaaccagugagaaaacaaagaaggggaaaaaucaguggaaguuaagagggg

SEQ ID NO: 293897 - RNA, 64 nt, Homo Sapiens
ggugggauuguccagcaugcaaggggaaauggggaggggaaaaguaccaugguuugaacaaaaa

SEQ ID NO: 293898 - RNA, 64 nt, Homo Sapiens
gggaggggaaaagggugggaguuugaacaaaaaaaggggaaaugaaaucagaacucuuaccaug

SEQ ID NO: 293899 - RNA, 64 nt, Homo Sapiens
acuauuuuucuauugguauaacccgcccaccugaaggggaaagggaaaucaaauuaauuuuucu

SEQ ID NO: 293900 - RNA, 64 nt, Homo Sapiens
auauauauuguuuauaaaugcaagcuauuucuggaggggaaaaauguguguggcucuuacguuu

SEQ ID NO: 293901 - RNA, 64 nt, Homo Sapiens
guguguguacaacccaaauucauacacauacaucaggggaaaaucuggugaaucuauggacagu

SEQ ID NO: 293902 - RNA, 64 nt, Homo Sapiens
augcgguggucuagcuguaucuagccauuuuggaaggggaaaacaccacuaccucccacaauac

SEQ ID NO: 293903 - RNA, 64 nt, Homo Sapiens
cuuacaaaaugcuacaguguggaagaugauugucaggggaaaaagaaagcuuaagugggaaaaa

SEQ ID NO: 293904 - RNA, 64 nt, Homo Sapiens
aacuuucuuagacacacugggauuacaaggaaccaggggaaaaaucuuccugccccuaguauuu

SEQ ID NO: 293905 - RNA, 64 nt, Homo Sapiens
gugaagcaauggaaaagaacauuuggggccugauaggggaaaugguagcaucauuuugauuaac

SEQ ID NO: 293906 - RNA, 64 nt, Homo Sapiens
ggauaaguguuucaaggcaaacccaucccaguggaggggaaaggucaagcuguauaguuugcac

SEQ ID NO: 293907 - RNA, 64 nt, Homo Sapiens
gagcccucaaaggccucuuucccauggcuggggcaggggaaagaccccagcaucuccuggggcc

SEQ ID NO: 293908 - RNA, 64 nt, Homo Sapiens
ccagcucagaggguggucacaugguggugagaccaggggaaaggaccugugucccagcccucug

SEQ ID NO: 293909 - RNA, 64 nt, Homo Sapiens
gaaguggcucuugcagcuaguucauggagcuuuuaggggaaaauagagagacacggcuccugcc

SEQ ID NO: 293910 - RNA, 64 nt, Homo Sapiens
aaagacuuuguucuguguguuuugagccaucuagaggggaaagacguggaaaaucugaacaauc

SEQ ID NO: 293911 - RNA, 64 nt, Homo Sapiens
cuagguacugccuucuaacuccugcauccucagaaggggaaaagggacugggaaguaaagggaa

SEQ ID NO: 293912 - RNA, 64 nt, Homo Sapiens
uggcucagaccagcccaaggccuugcccaguggcaggggaaaggggcaccucacuccaccucaa

SEQ ID NO: 293913 - RNA, 64 nt, Homo Sapiens; identical to SEQ ID NO: 236179

SEQ ID NO: 293914 - RNA, 64 nt, Homo Sapiens; identical to SEQ ID NO: 236180

SEQ ID NO: 293915 - RNA, 64 nt, Homo Sapiens; identical to SEQ ID NO: 236181

SEQ ID NO: 293916 - RNA, 51 nt, Homo Sapiens; identical to SEQ ID NO: 110042

SEQ ID NO: 293917 - RNA, 64 nt, Homo Sapiens; identical to SEQ ID NO: 236183

SEQ ID NO: 293918 - RNA, 64 nt, Homo Sapiens; identical to SEQ ID NO: 236184

SEQ ID NO: 293919 - RNA, 64 nt, Homo Sapiens; identical to SEQ ID NO: 236185

SEQ ID NO: 293920 - RNA, 64 nt, Homo Sapiens; identical to SEQ ID NO: 236186

SEQ ID NO: 293921 - RNA, 64 nt, Homo Sapiens; identical to SEQ ID NO: 236187

SEQ ID NO: 293922 - RNA, 64 nt, Homo Sapiens; identical to SEQ ID NO: 236188

SEQ ID NO: 293923 - RNA, 64 nt, Homo Sapiens; identical to SEQ ID NO: 236189

SEQ ID NO: 293924 - RNA, 64 nt, Homo Sapiens; identical to SEQ ID NO: 236190

SEQ ID NO: 293925 - RNA, 64 nt, Homo Sapiens; identical to SEQ ID NO: 236191

SEQ ID NO: 293926 - RNA, 64 nt, Homo Sapiens; identical to SEQ ID NO: 236192

SEQ ID NO: 293927 - RNA, 64 nt, Homo Sapiens; identical to SEQ ID NO: 236193

SEQ ID NO: 293928 - RNA, 64 nt, Homo Sapiens; identical to SEQ ID NO: 236194

SEQ ID NO: 293929 - RNA, 64 nt, Homo Sapiens; identical to SEQ ID NO: 236195

SEQ ID NO: 293930 - RNA, 64 nt, Homo Sapiens; identical to SEQ ID NO: 236196

SEQ ID NO: 293931 - RNA, 64 nt, Homo Sapiens; identical to SEQ ID NO: 236197

SEQ ID NO: 293932 - RNA, 64 nt, Homo Sapiens; identical to SEQ ID NO: 236198

SEQ ID NO: 293933 - RNA, 64 nt, Homo Sapiens
uggggucuccaggcaggguaggaaagaaaagaaagagaagaagcaaggaauggcgugggauggg

SEQ ID NO: 293934 - RNA, 64 nt, Homo Sapiens
ggagaaaagaccaugaaauuaggggaaaaaaccugagaagaaagagagaaaauauuaauuuuca

SEQ ID NO: 293935 - RNA, 64 nt, Homo Sapiens
uaaagccaggaaagucaaaaaaacgaaagagaaggagaagaaaaaggaaaagggcaaauugaaa

SEQ ID NO: 293936 - RNA, 64 nt, Homo Sapiens
gagcagaaagguacucugaaacaugguggccugagagaagaagagcuggagaaaaugaaagaag

SEQ ID NO: 293937 - RNA, 64 nt, Homo Sapiens
acuguaugugacaauuaccuaugaagcagaaguagagaagaaagacuaaagugacacaaagaga

SEQ ID NO: 293938 - RNA, 64 nt, Homo Sapiens
aaaagaaaaaagauagaaaaaauuagaucgacuggagaagaaaauuuauuucccaauuacagga

SEQ ID NO: 293939 - RNA, 64 nt, Homo Sapiens
uggauuccccuggguagaugagagaaagauggaggagaagaacuagagagagagagagagagag

SEQ ID NO: 293940 - RNA, 64 nt, Homo Sapiens
ugcaacguggggagagggaaccaauuucggaggagagaagaaagcccagaaggaggacuuuggg

SEQ ID NO: 293941 - RNA, 64 nt, Homo Sapiens
uagugaggucauugaaccucuauugaagagaugggagaagaagauuagaagguggagaugauga

SEQ ID NO: 293942 - RNA, 64 nt, Homo Sapiens
cagacaacucagaggacaguauaaaggugaugaugagaagaauacucuguauuugcaaaugcag

SEQ ID NO: 293943 - RNA, 64 nt, Homo Sapiens
cauuuuguuuuuauuaaaugaucaugacuggugagagaagaaaauaaaucuuaaaaguguuguu

SEQ ID NO: 293944 - RNA, 64 nt, Homo Sapiens
aagaaaaguaacugguugucgauucacuguuggggagaagaaacuuaagcaccauggccuugau

SEQ ID NO: 293945 - RNA, 64 nt, Homo Sapiens
uuuucugauaucucuaaaaugcuguuaaguucuggagaagaacuucaggagaagaagaucuauc

SEQ ID NO: 293946 - RNA, 64 nt, Homo Sapiens
uaaaaugcuguuaaguucuggagaagaacuucaggagaagaagaucuaucagcuggcuuuuaaa

SEQ ID NO: 293947 - RNA, 64 nt, Homo Sapiens
uuguauuugcagcuagaggugagucaaauguuaagagaagaaacuacgauccaucucccuuugu

SEQ ID NO: 293948 - RNA, 64 nt, Homo Sapiens
ugaggcucugagcggaugcauccccucuguccacgagaagaagcauaagcgggaacccuuagga

SEQ ID NO: 293949 - RNA, 64 nt, Homo Sapiens
ggagagcagcaauuggagcuugcacccagcugaagagaagaaaucaggguccucuguaugagug

SEQ ID NO: 293950 - RNA, 64 nt, Homo Sapiens
aagucuuacauagaaaaaaaacugaaauguauaagagaagaaccaaaagguuagucuucaauag

SEQ ID NO: 293951 - RNA, 64 nt, Homo Sapiens
cuaguaucucuaagcgguaaacuuuaagaaagaagagaagaaaaauggaagaguuguaauauau

SEQ ID NO: 293952 - RNA, 64 nt, Homo Sapiens
gaauuuacuuuguuugcauuuugcuuuaagaugugagaagaaaugcauguaaacaaagauaucu

SEQ ID NO: 293953 - RNA, 64 nt, Homo Sapiens
auuugaugacaauagcugcuuaguuuccuguuaagagaagaaacuuuaucuuuuaauuaugugc

SEQ ID NO: 293954 - RNA, 64 nt, Homo Sapiens
uaguccuaguuccuuuguuacuccugugagcaccgagaagaacugggcgacucccagucccacc

SEQ ID NO: 293955 - RNA, 64 nt, Homo Sapiens
gaacauuuaauaaauguauguaccauucauauuugagaagaaaaaaguaggcucucacuagagu

SEQ ID NO: 293956 - RNA, 64 nt, Homo Sapiens
gaauuucugcacacuacacacaguuuacaggaaggagaagaacauugauuuuacagugcacuga

SEQ ID NO: 293957 - RNA, 64 nt, Homo Sapiens
gcucaggggugugccugucuguuacacuggaggagagaagaaugagccuacgcugaagauggca

SEQ ID NO: 293958 - RNA, 64 nt, Homo Sapiens
uugugaacugacaggcagccuggacauagagagggagaagaagucagagagggugacaagauag

SEQ ID NO: 293959 - RNA, 64 nt, Homo Sapiens
cccgguacugacaagcuguuaggaugaggaaaaagagaagaaacggcaugugugagcagaaggg

SEQ ID NO: 293960 - RNA, 64 nt, Homo Sapiens
aacaaaaauauuauuucuauccgagaggagaaaugagaagaaggcuggggagagccugugagga

SEQ ID NO: 293961 - RNA, 64 nt, Homo Sapiens
ggagcagcugacagggugggucucccuuaccaaagagaagaaccacucucuggcgcugggguga

SEQ ID NO: 293962 - RNA, 64 nt, Homo Sapiens
ccagcggcuugugcucacucugucugccagguaugagaagaacacguaagaccgccaccacacu

SEQ ID NO: 293963 - RNA, 64 nt, Homo Sapiens
cuuugagucucagucugaugacccacacuuccaugagaagaagcagauccccuguguggucucc

SEQ ID NO: 293964 - RNA, 64 nt, Homo Sapiens
aaggaccuuggaagagcaagggacagugaggcaggagaagaacaagaaauggauguaagccugg

SEQ ID NO: 293965 - RNA, 64 nt, Homo Sapiens
gcuccugcugaagaguuuagaaugaggcagcggugagaagaagggugggagggcgugggggccc

SEQ ID NO: 293966 - RNA, 64 nt, Homo Sapiens
auuuggacacaugaauuaaaucccaagggaaagugagaagaaaauuaauguauuagcaaccagu

SEQ ID NO: 293967 - RNA, 64 nt, Homo Sapiens
gagagaaaugcaucacuuccaaacccauguauuagagaagaagggcgugaaauuuaucaccuaa

SEQ ID NO: 293968 - RNA, 64 nt, Homo Sapiens
aggauauguuuugguaaauguagacugugcacuugagaagaauguauuuugaguuguuggguac

SEQ ID NO: 293969 - RNA, 64 nt, Homo Sapiens
cgcuggcuguaugaaacuugaugugacucucccagagaagaagcugucugaaaccgguuuuaaa

SEQ ID NO: 293970 - RNA, 64 nt, Homo Sapiens
uaaaaguuuggugguggguggaaauuccagaggggagaagaaugugcuacaauugcugugcaaa

SEQ ID NO: 293971 - RNA, 64 nt, Homo Sapiens
aauaaaaaaagaaagaaagaaaagaagaagaaaagagaagaaggagaaggagaugaaggaggag

SEQ ID NO: 293972 - RNA, 64 nt, Homo Sapiens
ggagaaggagaugaaggaggaggaggaggagaaggagaagaagaagaagaagaagaccacaaaa

SEQ ID NO: 293973 - RNA, 64 nt, Homo Sapiens
ccauggggugucccgugagugugaguguggcagugagaagaagcaucgagggcgaggggaauau

SEQ ID NO: 293974 - RNA, 64 nt, Homo Sapiens
ugggagcuguuuugucagugucuuggggucacaggagaagaaagcgggacuuuggugggaagga

SEQ ID NO: 293975 - RNA, 64 nt, Homo Sapiens
aauauguuucucaagcaaccugcaucuuuuaugagagaagaaagagugagagaagaauugccuc

SEQ ID NO: 293976 - RNA, 64 nt, Homo Sapiens
caaccugcaucuuuuaugagagaagaaagagugagagaagaauugccucuggacuaucaucaau

SEQ ID NO: 293977 - RNA, 64 nt, Homo Sapiens
auccuccaaaugcucuggagaggcccccacccuugagaagaacugacacagagaagaacauuuu

SEQ ID NO: 293978 - RNA, 64 nt, Homo Sapiens
ggagaggcccccacccuugagaagaacugacacagagaagaacauuuucucaggcucguagaga

SEQ ID NO: 293979 - RNA, 64 nt, Homo Sapiens
cccagcaguugccccacccuguguaguuguugaggagaagaagccucaacuuacccaggaggag

SEQ ID NO: 293980 - RNA, 64 nt, Homo Sapiens
gauaggccuucgagcaaaagcaaagauccaccgagagaagaagagaaagaaaagaaaaagaaaa

SEQ ID NO: 293981 - RNA, 64 nt, Homo Sapiens
caguaggaagcggacccgcuccagaaguccccacgagaagaagaagaagaggcggucccggucg

SEQ ID NO: 293982 - RNA, 64 nt, Homo Sapiens
ugacgaugaugaccagucgugccaaaaaaaaaaagagaagaagaguacauggauccaggcuucu

SEQ ID NO: 293983 - RNA, 64 nt, Homo Sapiens
uacuacaaggcaaggagccggauuggauucugaggagaagaacccuagaucagaaaucugacua

SEQ ID NO: 293984 - RNA, 64 nt, Homo Sapiens
gggaugcaaggagcugccuggguugacuggguuagagaagaaccugaaacagucuugagccugg

SEQ ID NO: 293985 - RNA, 64 nt, Homo Sapiens
cgaaccuuaagacgccagaugaauucacugugaagagaagaacccaggagacagaggcuuuuuu

SEQ ID NO: 293986 - RNA, 64 nt, Homo Sapiens
ucauauccauugugguuaguuacucaguuauguugagaagaaucuggagcuaaaagcagagaug

SEQ ID NO: 293987 - RNA, 64 nt, Homo Sapiens
uuucauuuucaaaaacuauuuaccaaaacaaauggagaagaaacauccaaaagcacauuucauu

SEQ ID NO: 293988 - RNA, 64 nt, Homo Sapiens
aauuaaugaugcuuaaagagaaaagaaaaaaagagagaagaaaaaggagagaugaaaaaggagg

SEQ ID NO: 293989 - RNA, 64 nt, Homo Sapiens
agaagaaaaaggagagaugaaaaaggaggaugaggagaagaauuaccuuuugacaaucuguuag

SEQ ID NO: 293990 - RNA, 64 nt, Homo Sapiens
cauugggugacuaugacuaacuuucugguaguaugagaagaaaucuccgacuuuauagcaggaa

SEQ ID NO: 293991 - RNA, 64 nt, Homo Sapiens
aaagagcaaaaaugagaccucuagaggcuauacagagaagaaaaagcauuggcaggaaaaagcu

SEQ ID NO: 293992 - RNA, 64 nt, Homo Sapiens
ggaaguagggcagugcaugaguuaaccugcaauagagaagaaagaaaacugccuacaggccaua

SEQ ID NO: 293993 - RNA, 64 nt, Homo Sapiens
acugccuacaggccauaguucaaaaaaaaaaaaagagaagaaaagugacagaacaagacugucu

SEQ ID NO: 293994 - RNA, 64 nt, Homo Sapiens
ccauuuggggugguugggucaugacagcuaccaugagaagaagugucccguuuuguccaguggc

SEQ ID NO: 293995 - RNA, 64 nt, Homo Sapiens
caggaggugggagguggaugguucuuauucuguggagaagaagggcgggaagaacuuccuuuca

SEQ ID NO: 293996 - RNA, 64 nt, Homo Sapiens
ccucugauaagaucgacaaaagaaacaacaaaaugagaagaagagguuccucgaaaggggggag

SEQ ID NO: 293997 - RNA, 64 nt, Homo Sapiens
acaaaaugagaagaagagguuccucgaaaggggggagaagaaauuuugagaauggaaaaauccc

SEQ ID NO: 293998 - RNA, 64 nt, Homo Sapiens
uccagcuggcacuugacagggugcagucauuggugagaagaaucagaaaaagaagacccaucag

SEQ ID NO: 293999 - RNA, 64 nt, Homo Sapiens
cuccaaaaaaagaaaauagagcuuuauaagcagagagaagaaaauaaucaucuaagaccaucuc

SEQ ID NO: 294000 - RNA, 64 nt, Homo Sapiens
gcuucucuuucuaaaaaaaaaaaaaaaaaagaaagagaagaaagaagugauuccuacccccuac

SEQ ID NO: 294001 - RNA, 64 nt, Homo Sapiens
cuuucuuagcucaagagagaggcugagaaaugcagagaagaauaagacauaaaauagcuccgac

SEQ ID NO: 294002 - RNA, 64 nt, Homo Sapiens
aaaauauuuaaguaaaaacaaaaugaugcauuuugagaagaacaaagugugcacucagcggcug

SEQ ID NO: 294003 - RNA, 64 nt, Homo Sapiens
uuaaauguguaagucacccccaccaaaaacaaaagagaagaaaaagaauagaaagaauuaucca

SEQ ID NO: 294004 - RNA, 64 nt, Homo Sapiens
ucuacucauucaaagcacauuguagauauucagagagaagaacaaauggcuggcuuggcaaauc

SEQ ID NO: 294005 - RNA, 64 nt, Homo Sapiens
caguuuuugugggugauugcaauuuuuuaaugaaaugcauuagaacaucuaagcacgucaccua

SEQ ID NO: 294006 - RNA, 64 nt, Homo Sapiens
uuuugcauugcaguauagaucugugcauagauauaugcauuaaguguagcaaaucgugauguaa

SEQ ID NO: 294007 - RNA, 64 nt, Homo Sapiens
auuaauuacuacaaugauucaucugugcugggucaugcauuagcaaggcucuucuguuuucaac

SEQ ID NO: 294008 - RNA, 64 nt, Homo Sapiens
guugauguguuuuguacuagaugugucgucaucuaugcauuagauuccuugguaucguguuauc

SEQ ID NO: 294009 - RNA, 64 nt, Homo Sapiens
uuuuccaaacuauacccauagauuccugcucugaaugcauuauauaucucucuuuauccuaugu

SEQ ID NO: 294010 - RNA, 64 nt, Homo Sapiens
gcaugguggaaaauaagguuaaguuguguauuuaaugcauuauaaucaucaauugcagacugug

SEQ ID NO: 294011 - RNA, 64 nt, Homo Sapiens
gguaaguaugcagcacauugcuuauauccuggguaugcauuauuuuaaauguuguaucauuaaa

SEQ ID NO: 294012 - RNA, 64 nt, Homo Sapiens
gauuugauucauuuuauuuaugccuaagucaucuaugcauuaacaugucauauucuuaacuuug

SEQ ID NO: 294013 - RNA, 64 nt, Homo Sapiens
cuuagagccugcuauucuuuuagacauagggaggaugcauuauccuguauucuccuccaacauc

SEQ ID NO: 294014 - RNA, 64 nt, Homo Sapiens
uacucucucugccccuuuuacuuuuuaaucuggaaugcauuacuguaaacaugaucuuucccau

SEQ ID NO: 294015 - RNA, 64 nt, Homo Sapiens
uuaagauuuuaauuauucaacuuaaaaaguagaaaugcauuauuauacauuuuuuuaagaaagg

SEQ ID NO: 294016 - RNA, 64 nt, Homo Sapiens
aaccacuaggcucuagagcucccgccgcgccccuaugcauuauguucacaaugccaaucuagau

SEQ ID NO: 294017 - RNA, 64 nt, Homo Sapiens
gaaagguuaaguaaguuuugcuuucugguacuacaugcauuagcggaagcuaaaaccauguuug

SEQ ID NO: 294018 - RNA, 64 nt, Homo Sapiens
uaaagugugacaacuucaaaugcuuuuauaaaucaugcauuacaccugcauaauauauuuuugu

SEQ ID NO: 294019 - RNA, 64 nt, Homo Sapiens
uagaagguugauaguuuaucuaaaaaaaaaggaaaugcauuaaacgagacuccaucucuauaaa

SEQ ID NO: 294020 - RNA, 64 nt, Homo Sapiens
gccaagugcaguggcucacagcuuauaaaaguaaaugcauuaaguguacuucuaaacagagaag

SEQ ID NO: 294021 - RNA, 64 nt, Homo Sapiens
auuuacaguuucaauagcacauaauuuauuuucuaugcauuauaaauggccuugcaguuggcuc

SEQ ID NO: 294022 - RNA, 64 nt, Homo Sapiens
caaaacuguaaggaaaaagaguguuaauaccaugaugcauuaacauaaaauaucaaacacacaa

SEQ ID NO: 294023 - RNA, 64 nt, Homo Sapiens
ccuuauagucaauucugugcgggaagcauuauaaaugcauuaaucucggccucugugggauuua

SEQ ID NO: 294024 - RNA, 64 nt, Homo Sapiens
uuucuuuucuccaguccucauaaaauuccuaauuaugcauuauccucuuuugggggaucaaaau

SEQ ID NO: 294025 - RNA, 64 nt, Homo Sapiens
uaauucuucaagauccaaaagaaaaaaauauacuaccucagauuuucaagaaggugaacuaaau

SEQ ID NO: 294026 - RNA, 64 nt, Homo Sapiens
uauugcaauucaagccauccaugaagccaaugucaccucagagguuucaaacauugcacaagca

SEQ ID NO: 294027 - RNA, 64 nt, Homo Sapiens
ccuguugucacucuucacaguacuugugaauauuaccucagauaucaacucuuuuuugugagcc

SEQ ID NO: 294028 - RNA, 64 nt, Homo Sapiens
uggugcagcuucucucucccgcucaccuccgaggaccucagaacuugaucagcauugaggugau

SEQ ID NO: 294029 - RNA, 64 nt, Homo Sapiens
gugaccuuguuuggaaacacuccuaacuugaagcaccucagaaugaccccaagauaggcugaag

SEQ ID NO: 294030 - RNA, 64 nt, Homo Sapiens
cagaaacgucuccaaagccagacugucuaaccagaccucagaaucagcccgggacugcccagau

SEQ ID NO: 294031 - RNA, 64 nt, Homo Sapiens
acucccguggugguguuugagagccaacaacacuaccucagagacgggucuuugggaaacuuug

SEQ ID NO: 294032 - RNA, 64 nt, Homo Sapiens
cugacagccccgggcccaagaaaaacccauaaccaccucagauggaucugacguggcuaaggga

SEQ ID NO: 294033 - RNA, 64 nt, Homo Sapiens
cacagcugcucaccuugucuggcaaacuggagggaccucagaaacuggacuccugcauguccuu

SEQ ID NO: 294034 - RNA, 64 nt, Homo Sapiens
uagcugcucucugcagccucgagggguuuuuuuaaccucagagccuugcaaaacaaaagaaagu

SEQ ID NO: 294035 - RNA, 64 nt, Homo Sapiens
uccucagcuucaaacauggggcuuguuucccugaaccucagaaaugccccucguugcaaaacga

SEQ ID NO: 294036 - RNA, 64 nt, Homo Sapiens
ucucuaucccaucccuuccucaggacugaaagagaccucagaggguaauagagucauuaaaaug

SEQ ID NO: 294037 - RNA, 64 nt, Homo Sapiens
ggcaaaaacccuccccaggacugguuccugcacaaccucagagggaagcagagaaacuguucuu

SEQ ID NO: 294038 - RNA, 64 nt, Homo Sapiens
uacugaaucagaaucucuggaauccucaggccccaccucagaccgugaacuugcuggaaauaca

SEQ ID NO: 294039 - RNA, 64 nt, Homo Sapiens
uguccucuucucuagaguggcugugggugcuaacaccucagagccugauccccuuugcgagaug

SEQ ID NO: 294040 - RNA, 64 nt, Homo Sapiens
gacagugccagaauuaagugugauaauugugccuaccucagauauucucucuaggaaauggggg

SEQ ID NO: 294041 - RNA, 64 nt, Homo Sapiens
aaugacauccuggcugagccuuccccgaggugcgaccucagacuucugaaucuagacaucgcca

SEQ ID NO: 294042 - RNA, 64 nt, Homo Sapiens
uccccacacgugccgaugucagguucauugaaauaccucagauuuguaauuguugauguuugag

SEQ ID NO: 294043 - RNA, 64 nt, Homo Sapiens
gauagcacauggguagccuaggcagugaguaaauaccucagauguccuccugcagcaagugucu

SEQ ID NO: 294044 - RNA, 64 nt, Homo Sapiens
cccuuuguggggucaggacacacaggcgucuccaaccucagaggagcauggauggggaugaagg

SEQ ID NO: 294045 - RNA, 64 nt, Homo Sapiens
cugguggugcucucagggcagaaggcaccuccucaccucagaaacucggggagcgcccuguucu

SEQ ID NO: 294046 - RNA, 64 nt, Homo Sapiens
ccugcacucaagguggcagggaaccagauuuaggaccucagaaugaaucaaacacagaaccuca

SEQ ID NO: 294047 - RNA, 64 nt, Homo Sapiens
cagauuuaggaccucagaaugaaucaaacacagaaccucagaaccuugagcugucuguacccca

SEQ ID NO: 294048 - RNA, 64 nt, Homo Sapiens
cccgugccccccgcccgggcgggguacugccugcaccucagaccucugccugggggcucccugu

SEQ ID NO: 294049 - RNA, 64 nt, Homo Sapiens
auccugucuaaagcuuuguggcacccucagugcaaccucagaacagacaaaucaugaaugagcu

SEQ ID NO: 294050 - RNA, 64 nt, Homo Sapiens
uaaaggaauuugauguugugcccuuaaaggggagaccucagaaggaauguucuauuucugccuc

SEQ ID NO: 294051 - RNA, 64 nt, Homo Sapiens
ccggggugagggggggcuccccccuccuggugccaccucagaccuggugcuggccgcccccagc

SEQ ID NO: 294052 - RNA, 64 nt, Homo Sapiens
uuuugugauauuugaauguuaugaauuuuauuuaauuacugacaagcauugaacaauguucucg

SEQ ID NO: 294053 - RNA, 64 nt, Homo Sapiens
auuaauguuucuuguuuagaaagguucuaacaguauuacugaauauaugguuaauguguaaaac

SEQ ID NO: 294054 - RNA, 64 nt, Homo Sapiens
uguguacauuucaacaaauacuuuuacauuugacauuacugaggucauucugaguuuuaggucc

SEQ ID NO: 294055 - RNA, 64 nt, Homo Sapiens
uacaugaacaaaaaguggugugcucgaaaaagacauuacugaugccuuuuuuuuauagagugga

SEQ ID NO: 294056 - RNA, 64 nt, Homo Sapiens
aguauuuuuuguuguuuuuaucaucaugugcaauauuacugauuuguuuccaugcugauugugu

SEQ ID NO: 294057 - RNA, 64 nt, Homo Sapiens
cauuaguuuuuuuuguuuguuucuuuuucaugguauuacugaagguguguauacucccuaauac

SEQ ID NO: 294058 - RNA, 62 nt, Homo Sapiens
gguugguuucuuuaauuauuaaauagacaucuguauuacugauguuuguaacuuuuuuaaua

SEQ ID NO: 294059 - RNA, 64 nt, Homo Sapiens
agaaauugacuaaacuuugacagcaugaccauuaauuacugagucauucaugugauuuaugggu

SEQ ID NO: 294060 - RNA, 64 nt, Homo Sapiens; identical to SEQ ID NO: 294056

SEQ ID NO: 294061 - RNA, 64 nt, Homo Sapiens; identical to SEQ ID NO: 294057

SEQ ID NO: 294062 - RNA, 64 nt, Homo Sapiens
gaagagaaaaugaucugauuuucccuuauacuucauuuuacaauacauauucccuuuuaacuua

SEQ ID NO: 294063 - RNA, 64 nt, Homo Sapiens
acuuaagaaccauauuuacauugcuuaacacagaauuuuacaucuaagcaaggacuggcuuuag

SEQ ID NO: 294064 - RNA, 64 nt, Homo Sapiens
gacuggcuuuagaagcaguguaguucuaccucucauuuuacagaugagaaaaccgaagcccaga

SEQ ID NO: 294065 - RNA, 64 nt, Homo Sapiens
cugauuauagagaaucauauauaguccagucuucauuuuacauacacacacauauuuuacacac

SEQ ID NO: 294066 - RNA, 64 nt, Homo Sapiens
uauaguccagucuucauuuuacauacacacacauauuuuacacacacacacauuuuacacacac

SEQ ID NO: 294067 - RNA, 64 nt, Homo Sapiens
uuuacauacacacacauauuuuacacacacacacauuuuacacacacacacacacacacacaca

SEQ ID NO: 294068 - RNA, 64 nt, Homo Sapiens
aaaacuuguuuuaaguccaccccuuaguuuccuuauuuuacaaggucucucuucagggaccaac

SEQ ID NO: 294069 - RNA, 64 nt, Homo Sapiens
agauguauccuuccaauuugggaauugguggcagauuuuacaaaaggugcuuauucucaaagca

SEQ ID NO: 294070 - RNA, 64 nt, Homo Sapiens
aggugcuuauucucaaagcauaauguuaguagaaauuuuacaaugcaugugcugugaccauuua

SEQ ID NO: 294071 - RNA, 64 nt, Homo Sapiens
auauuuucucuuuuuaaucauuuauuaaauaaauauuuuacaguguauagauuauaaaauuauu

SEQ ID NO: 294072 - RNA, 64 nt, Homo Sapiens
cugucuguuuuucuuuuuuuaaguagcaaccuucauuuuacauuaaagggaagugauaucauaa

SEQ ID NO: 294073 - RNA, 64 nt, Homo Sapiens
ucuuuuauuuccccacaagaggaauaaauguaagauuuuacaaauuuuuacuucauuauuuuua

SEQ ID NO: 294074 - RNA, 64 nt, Homo Sapiens
auucacauuuuagaauaacauuuuucuuuuugguauuuuacauuuggaggcuaugaaaugucuu

SEQ ID NO: 294075 - RNA, 64 nt, Homo Sapiens
guauaccaaauuaaaucuuaauagauuuaaugcaauuuuacagacacaauaccuucaugaauuu

SEQ ID NO: 294076 - RNA, 64 nt, Homo Sapiens
ugcacugaaagcuaacagggagagguuacacaauauuuuacaguuucuuaaacauaauuuaaug

SEQ ID NO: 294077 - RNA, 64 nt, Homo Sapiens
aagcacaaaaaaagucagcgucuucauuauuuauauuuuacaaaaagccaaauuauuucagcau

SEQ ID NO: 294078 - RNA, 64 nt, Homo Sapiens
gcaguccgaccaagcccacuggaauuauccuuuaauuuuacagauaccacuugcuguaggcugu

SEQ ID NO: 294079 - RNA, 64 nt, Homo Sapiens
cgaaaagcaaccaacuucuuuacauccgaacaaaauuuuacaucuuuaugaugaccugaaauuu

SEQ ID NO: 294080 - RNA, 64 nt, Homo Sapiens
cgaacaaaauuuuacauccguaugaugaccugaaauuuuacaucuuccuuuuuggcauaauuuu

SEQ ID NO: 294081 - RNA, 64 nt, Homo Sapiens
aggaucacacuaguuuuugccagagaaaaagaaaauuuuacaacgcacccuugcuugccuuuuu

SEQ ID NO: 294082 - RNA, 64 nt, Homo Sapiens
uagaguauuuacacuaugauaaauccauagauuuauuuuacauuuuguacuuuauuuuuguaua

SEQ ID NO: 294083 - RNA, 64 nt, Homo Sapiens
uuauaugcuucacauagcauauuuaagacugauaauuuuacaauguaaagagaaucaacuaggu

SEQ ID NO: 294084 - RNA, 64 nt, Homo Sapiens
guuuuguuuaaaauuaccauauuuccacuuagauauuuuacaugcuauagaguugggaaaaaau

SEQ ID NO: 294085 - RNA, 64 nt, Homo Sapiens
uaccgcacaucuccauucagaaaauccagaguguauuuuacacuuuuuuugguacugaaucuuc

SEQ ID NO: 294086 - RNA, 64 nt, Homo Sapiens
gcaauagaacuuuuauaaaauaauuagaacagagauuuuacaguuaagguuucaaauuguggca

SEQ ID NO: 294087 - RNA, 64 nt, Homo Sapiens
auuuuucaagagguuagccacuaagacuuuaauaauuuuacaagggaaaaagccuuuuuuuuuc

SEQ ID NO: 294088 - RNA, 64 nt, Homo Sapiens
ucagauuucacccauaaaaacgcacaauuguauuauuuuacagagauguguccagcgcccccug

SEQ ID NO: 294089 - RNA, 64 nt, Homo Sapiens
agacacuucaaugccauuuguuagacacuucaauauuuuacaugguuuucaauguacacuguac

SEQ ID NO: 294090 - RNA, 64 nt, Homo Sapiens
uguauugacuauuuucguucauuacuugauuaagauuuuacaaaagaggagcacuuccaaaauu

SEQ ID NO: 294091 - RNA, 64 nt, Homo Sapiens
gccucccuaucccucacacauccagacaucaugaauuuuacaugguacucuuguugaguucugu

SEQ ID NO: 294092 - RNA, 64 nt, Homo Sapiens
uuuguauuuuauguuguuguuaguuuaaaagguaauuuuacacaugcuggaaugacuguaauua

SEQ ID NO: 294093 - RNA, 64 nt, Homo Sapiens
acuaagugauuuaaauucaauugaugaagaugugauuuuacagaagcagaaguuucauuuucuu

SEQ ID NO: 294094 - RNA, 64 nt, Homo Sapiens
cuggaaaccaaaucuccuggcaccuugaucuuggauuuuacagccuccagaacugugagaaaau

SEQ ID NO: 294095 - RNA, 64 nt, Homo Sapiens
agaaaaguuuggggcacucaucccauucauaauuauuuuacauuuaaauuacuguuccuacuua

SEQ ID NO: 294096 - RNA, 64 nt, Homo Sapiens
uccugaucaguuugaaggacauugauaaacugugauuuuacaauaacauuaucaucugcaguua

SEQ ID NO: 294097 - RNA, 64 nt, Homo Sapiens
cuuggugauuaucaaccuguugugucuuuauuuaauuuuacaucuuuuugaagcacugccacag

SEQ ID NO: 294098 - RNA, 64 nt, Homo Sapiens
uuuauuuuguuucuggagaaacuaaaaaucauauauuuuacagauaauuuggcucuuucugcuc

SEQ ID NO: 294099 - RNA, 64 nt, Homo Sapiens
ugacauguuacuucguucuuacacuauccuggguauuuuacagguauuuugcacaucacaaauu

SEQ ID NO: 294100 - RNA, 64 nt, Homo Sapiens
accacagacaaccucugaaacugccaauagguggauuuuacaaagcuuuuaauugauuagaauu

SEQ ID NO: 294101 - RNA, 64 nt, Homo Sapiens
caggcuuuuaauugauuagaagcuagggcugggcauuuuacauccauuugaaagguaacagugg

SEQ ID NO: 294102 - RNA, 64 nt, Homo Sapiens
aagcuuuaugauaauuuuugcuugaaugaaauggauuuuacagaacagacaaggaaagaaaaaa

SEQ ID NO: 294103 - RNA, 64 nt, Homo Sapiens
cuacuuaugcagaaaaauaggcaauaagaacuucauuuuacaauuuaguuuucaaaaaaaaaau

SEQ ID NO: 294104 - RNA, 64 nt, Homo Sapiens
augucuaaacucuauguugcucaguguacuuaaaauuuuacaguuauauuuguauaacguuuau

SEQ ID NO: 294105 - RNA, 64 nt, Homo Sapiens
aucaaaauucugauuugauggcaauugaauuuucauuuuacaauagauaaaugcuugugcuacc

SEQ ID NO: 294106 - RNA, 64 nt, Homo Sapiens
aaguuuagcacuguaucagaaugaagaaacuaauauuuuacauaaaaacuaauacuuucaauuu

SEQ ID NO: 294107 - RNA, 64 nt, Homo Sapiens
gaagccugcuuaaaaaauguaguugagccccauaauuuuacaaaugggcgaacuuuuaaacuuc

SEQ ID NO: 294108 - RNA, 64 nt, Homo Sapiens
aacuucuaacucuacuuggaucaaaaccucauacauuuuacaaagggguccugacaagucagcu

SEQ ID NO: 294109 - RNA, 64 nt, Homo Sapiens
acugucagaguggggaaccccagacauucucaggauuuuacaaguagcuaccaucugauccccu

SEQ ID NO: 294110 - RNA, 64 nt, Homo Sapiens
gcaccaagcuuugcccccuaccaucaggaaguaaauuuuacaggcccccuggcuccaggccugu

SEQ ID NO: 294111 - RNA, 64 nt, Homo Sapiens
agaauaugaucaaaccuucauuuuaucugcauaaauuuuacaguucaauacaauccuuugaauu

SEQ ID NO: 294112 - RNA, 64 nt, Homo Sapiens
aauauuuuucauacaaaugguggaucugcuuuuuauuuuacaaagauuucaaauguuuuucuuc

SEQ ID NO: 294113 - RNA, 64 nt, Homo Sapiens
uucugcacaucuccauuugggaaaucugguguguauuuuacacucuuuuucauacuaagcuuuc

SEQ ID NO: 294114 - RNA, 64 nt, Homo Sapiens
cucuuuuucauacuaagcuuuauauuagugagacauuuuacauuaauauuucaacauauaaaaa

SEQ ID NO: 294115 - RNA, 64 nt, Homo Sapiens
gauuuuuccuacuuuaagaaaauaaaauaauuuaauuuuacauuagauuccacguuagauuugg

SEQ ID NO: 294116 - RNA, 64 nt, Homo Sapiens
uguuaauaaauccuaauaaauuuaaauuuuuaaaauuuuacaaaccuauuggcuaaguacauuu

SEQ ID NO: 294117 - RNA, 64 nt, Homo Sapiens
gaacaaccccgugagauaaguaguuauuauccucauuuuacacaugagggaccgaaggauagaa

SEQ ID NO: 294118 - RNA, 64 nt, Homo Sapiens
ggaaacucaaucuguuuuuaccuuuaaacagugaauuuuacaugaaugaauggguucuucacuu

SEQ ID NO: 294119 - RNA, 64 nt, Homo Sapiens
agguuuggacaaaauggaauacucuuauaucuauauuuuacauaaauuuaguauuuuguuucag

SEQ ID NO: 294120 - RNA, 64 nt, Homo Sapiens
uaaauagcuuuuuucucugauacagaaaaguugaauuuuacauggcuggagcuagaauuugaua

SEQ ID NO: 294121 - RNA, 64 nt, Homo Sapiens
uuuguuacauaaaauauaaggaaaucuuuauacuauuuuacaguaaccacaaucuaaauauuua

SEQ ID NO: 294122 - RNA, 64 nt, Homo Sapiens
uggagcuauauuuccacuuagaaaaacuaagguaauuuuacaauauaugcugagauuaaaaacc

SEQ ID NO: 294123 - RNA, 64 nt, Homo Sapiens
aauuuacuuauuauguuugaacuaaaaugauugaauuuuacaguauuucuaagaauggaauugu

SEQ ID NO: 294124 - RNA, 64 nt, Homo Sapiens
uguaaauaaaacacucuuccauaugauauucaacauuuuacaacugcaguauucaccuaaagua

SEQ ID NO: 294125 - RNA, 64 nt, Homo Sapiens
uaauuauacacacacauaugggugagaccacuaaauuuuacauaagggcccaaguccacaauuu

SEQ ID NO: 294126 - RNA, 64 nt, Homo Sapiens
aaaugcuaaaauuuauuauaaccagaaaagaaacauuuuacauauuaaaauaaagugacuauua

SEQ ID NO: 294127 - RNA, 64 nt, Homo Sapiens
ucucauauuauauggacuuuauaugaaaaugaauauuuuacaguuugcacaguauuauuuuaca

SEQ ID NO: 294128 - RNA, 64 nt, Homo Sapiens
augaaaaugaauauuuuacaguuugcacaguauuauuuuacagaaaaggaaucagagaaucuac

SEQ ID NO: 294129 - RNA, 64 nt, Homo Sapiens
auauacuuauuuuaaagaaaaucuuauauaguacauuuuacaaaaauuauaaaaaaugaauuag

SEQ ID NO: 294130 - RNA, 64 nt, Homo Sapiens
cuuagauucauaauguuaggagcauuuaaucuguauuuuacaaguuaggaagcagaggaucaga

SEQ ID NO: 294131 - RNA, 64 nt, Homo Sapiens
caggcaugagccaccacgccuggccaguuucuucauuuuacauauggucacauuggcgccuaga

SEQ ID NO: 294132 - RNA, 64 nt, Homo Sapiens
acaacagugggaggucuguauccugaauguccucauuuuacagaugaggacauugaggagaaga

SEQ ID NO: 294133 - RNA, 64 nt, Homo Sapiens
uauuaaauuuaaauguuaaugugaaaugguuuaaauuuuacaugcugaaaagcugcagagcaga

SEQ ID NO: 294134 - RNA, 64 nt, Homo Sapiens
guaacuaugaacauacacaguuuuccagaaauagauuuuacacuguuuagaauuccaacaccua

SEQ ID NO: 294135 - RNA, 64 nt, Homo Sapiens
caaagcucccauuugauuguuagucauaguugaaauuuuacaacgaagaugaguuuucaaugag

SEQ ID NO: 294136 - RNA, 64 nt, Homo Sapiens
ccacaauugauuaugaaguccuguguauuacuuuauuuuacaggauuuuguugaaaugaaaaua

SEQ ID NO: 294137 - RNA, 64 nt, Homo Sapiens
cuauuucauuuuugaauaauucuucauuuuuauaauuuuacauaucuuggcuugcuauauaaga

SEQ ID NO: 294138 - RNA, 64 nt, Homo Sapiens
aaagauuuuaaguaagaguagauacauuguacccauuuuacauuuucuuauuuuaacuacagua

SEQ ID NO: 294139 - RNA, 64 nt, Homo Sapiens
uaccacuugcuguaggcuacggaauuauccuuuaauuuuacagagcaguucuaccaagcccauu

SEQ ID NO: 294140 - RNA, 64 nt, Homo Sapiens
aagccaaaauauuucagcauucuucauuauuuauauuuuacaaaaagcacaacaaaagucagug

SEQ ID NO: 294141 - RNA, 64 nt, Homo Sapiens
aaccauaguucuuggugacuaucuggcuauuaguauuuuacagguucacauuuuauauacuagu

SEQ ID NO: 294142 - RNA, 64 nt, Homo Sapiens
gcuaacauaaagcuggcuccuacaguagcucaauauuuuacagguguaaugucauauuugcugc

SEQ ID NO: 294143 - RNA, 64 nt, Homo Sapiens
uaucuuccugaaggaaacucguaaauuguagcugauuuuacauuuuuuagugacuuuuuaacuu

SEQ ID NO: 294144 - RNA, 64 nt, Homo Sapiens
uuuaaaauaaacagguuugauuauuuucagaaccauuuuacagaccacucuugagaaguaauuu

SEQ ID NO: 294145 - RNA, 64 nt, Homo Sapiens
uuugauuuguuucuggcuuuagaaugugaggcaaauuuuacauucuugguucuauuaagauuuu

SEQ ID NO: 294146 - RNA, 64 nt, Homo Sapiens
guuggugauuuuacugaaaacuuuugagaucuucauuuuacaggcagaccugucuaacuacaag

SEQ ID NO: 294147 - RNA, 64 nt, Homo Sapiens
guauuagauuuucugauucuaaguuucuuuucuaauuuuacauucuauaucauaagcauuuuua

SEQ ID NO: 294148 - RNA, 64 nt, Homo Sapiens
augaagacauucuuuugagagugaaggaacaggcauuuuacacuaaauguuucagaauucaauc

SEQ ID NO: 294149 - RNA, 64 nt, Homo Sapiens
ggguagacaguaaaaaacaaugugaagaaaauucauuuuacauuuuuuagccuaaaguaaaggc

SEQ ID NO: 294150 - RNA, 64 nt, Homo Sapiens
aaucauuuaguuuuuuaauuuaccauauauaaacauuuuacaugcaugugauccaagcuguaua

SEQ ID NO: 294151 - RNA, 64 nt, Homo Sapiens
uguuguaauuuaaaauuuuggccacuuuuuucagauuuuacaucauucuugcugaacuucaacu

SEQ ID NO: 294152 - RNA, 64 nt, Homo Sapiens
uccugauuuuugucugaugugaaaaagccuugguauuuuacauuuugaaaauucaaagaagcuu

SEQ ID NO: 294153 - RNA, 64 nt, Homo Sapiens
auuuuuguccucauauacagaaaguucuuaauugauuuuacagucuguaaugcuugauguuuua

SEQ ID NO: 294154 - RNA, 64 nt, Homo Sapiens
ugcuuuccaagugaugaauaagaaauguaaaagaauuuuacaaaaaaaggcaaauuucaaggga

SEQ ID NO: 294155 - RNA, 64 nt, Homo Sapiens
uugaggauuaccaauuaaacuuguacuuugccuuauuuuacaaaugguuuuuacuauugaaccc

SEQ ID NO: 294156 - RNA, 64 nt, Homo Sapiens
guauuguguagaaagucaccucccuacuccuuuuauuuuacaugagugcugauguguuuuggca

SEQ ID NO: 294157 - RNA, 64 nt, Homo Sapiens
auaaaauacuaugugaaucucuuaaaaaucugacauuuuacagucuguauuagacauacuguuu

SEQ ID NO: 294158 - RNA, 64 nt, Homo Sapiens
gaugaguucuuaaaauuuugucagagccuucuucauuuuacaauauuuuguuauuuuuauuuua

SEQ ID NO: 294159 - RNA, 64 nt, Homo Sapiens
uacaauauuuuguuauuuuuauuuuaccuuuuucauuuuacaauauuucguuauuuuuauuuua

SEQ ID NO: 294160 - RNA, 64 nt, Homo Sapiens
uacaauauuucguuauuuuuauuuuaccuuuuucauuuuacaaguugcaauauauuguuucguu

SEQ ID NO: 294161 - RNA, 64 nt, Homo Sapiens
acaagauguaauuuuuacuuuaucucucacacguauuuuacaaaacgucaugagaaacauuguc

SEQ ID NO: 294162 - RNA, 64 nt, Homo Sapiens
aagaaaccuacuagcauucaaauaaucauucccuauuuuacaaugcaucaguucugucaagcuu

SEQ ID NO: 294163 - RNA, 64 nt, Homo Sapiens
aucuguacguaguucuaaucugucacaagaguaaauuuuacauauucaauuaaaauaacucaug

SEQ ID NO: 294164 - RNA, 64 nt, Homo Sapiens
aaagugacaugaaugugggaguauuggaaaauucauuuuacauucagauuuuacacuuaauagu

SEQ ID NO: 294165 - RNA, 64 nt, Homo Sapiens
uaauaguguauuggaaaauuaaaacguucagcagauuuuacacuaugaaugccuuggauuuagc

SEQ ID NO: 294166 - RNA, 64 nt, Homo Sapiens
ugggcaucuccacgcaccuguguaugugaaagucauuuuacauuucaaagcaguguguguuucu

SEQ ID NO: 294167 - RNA, 64 nt, Homo Sapiens
uguauuguacagagaacaugaacgucucuuccuaauuuuacaucuucagcaucauugcauuaaa

SEQ ID NO: 294168 - RNA, 64 nt, Homo Sapiens
acgcaccugacuuuuuggaguuugcacagcaaacauuuuacacaguuuuauuucuaauauguuu

SEQ ID NO: 294169 - RNA, 64 nt, Homo Sapiens
gcaaauuuuuguugauauguaaugcucagauugcauuuuacacuugaucuaaacauauaucgaa

SEQ ID NO: 294170 - RNA, 64 nt, Homo Sapiens
cccauaagccuacaauagaugccucccuuaaggcauuuuacaaaucuucuuugaguuguuuaug

SEQ ID NO: 294171 - RNA, 64 nt, Homo Sapiens
uaaaucuaaaaugcuuaaucuagauuuuugugucauuuuacaaugaacauuggaaauagaugau

SEQ ID NO: 294172 - RNA, 64 nt, Homo Sapiens
gcuuuuacuguugcaauaagagagauaucuuuuuauuuuacagauauuugugucgucacugucu

SEQ ID NO: 294173 - RNA, 64 nt, Homo Sapiens
ugcaaguucugggaccuuuuggggcacauguaucauuuuacaaaugagcuuucaagaccauuua

SEQ ID NO: 294174 - RNA, 64 nt, Homo Sapiens
auaccaacuguucuauauuuauuugcuugaagauauuuuacaaaacuaacagaugaagucucuc

SEQ ID NO: 294175 - RNA, 62 nt, Homo Sapiens
ccaucuuuucugaagauuguauugaacucaacauuuuacauucuuuucccuuccagaucuaa

SEQ ID NO: 294176 - RNA, 64 nt, Homo Sapiens
ucaacccaucuggcuaaaguagaugaggaugaaaauuuuacauuacaaguauuuuuucaaugca

SEQ ID NO: 294177 - RNA, 64 nt, Homo Sapiens
ucaugccauuagaagauuuuuuguugggguagagauuuuacaagcuccuagauaucaaacuaau

SEQ ID NO: 294178 - RNA, 64 nt, Homo Sapiens
uuuuuuugucaguauuuucagauuacaugauaaaauuuuacauuugagcuucuagcauugauua

SEQ ID NO: 294179 - RNA, 64 nt, Homo Sapiens
cuaauuccaaauuagcaacuucauccugcuuucuauuuuacauugaguaaaguuuuaaaaagac

SEQ ID NO: 294180 - RNA, 64 nt, Homo Sapiens
ggaaucuuaacuauuaaucuaguucaaugcccuuauuuuacagaugggaaaacugaggccugga

SEQ ID NO: 294181 - RNA, 64 nt, Homo Sapiens
acaauucuacaacauagguaucauuccaaccucuauuuuacagaugagaaaacugaagcacaga

SEQ ID NO: 294182 - RNA, 64 nt, Homo Sapiens
cugcaggcuuccuugggcuucccucuaaaagcauagggcuuagcacuagguuugguuccuucag

SEQ ID NO: 294183 - RNA, 64 nt, Homo Sapiens
auaucccagccuaccaauauaagggcagccaagcagggcuuaggguauucccaaggauggcgac

SEQ ID NO: 294184 - RNA, 64 nt, Homo Sapiens
cagaaccgccaccucaaugcgauuucaguuucccagggcuuaacaguaaaaauaggucagcaga

SEQ ID NO: 294185 - RNA, 64 nt, Homo Sapiens
cagaaccgccaccucaaugcgauuucaguuucccagggcuuaacaguaaaaauagguuggcaga

SEQ ID NO: 294186 - RNA, 64 nt, Homo Sapiens
uucuucugacuucuuggcuaauuuucaacaacccagggcuuauuaaguaaauauuuugaccacu

SEQ ID NO: 294187 - RNA, 64 nt, Homo Sapiens
guauacuguauuugcaaguauuuuacacaaaacaagggcuuagaaucgcacuguuucuaauucu

SEQ ID NO: 294188 - RNA, 64 nt, Homo Sapiens
aaauggcauaaaaauauuaagaugcauaagagcaagcaccaauacagaaauguguuugguuacu

SEQ ID NO: 294189 - RNA, 64 nt, Homo Sapiens
aauaaaaggugggaugggggacuagcauuuguuuagcaccaacaauuuauagugaaguggcugg

SEQ ID NO: 294190 - RNA, 64 nt, Homo Sapiens
gagcaaaccccugugguccggcucauucugaagcagcaccaacuuuccaguuccaagcauggag

SEQ ID NO: 294191 - RNA, 64 nt, Homo Sapiens
gagccaaggccuugggagcagauccuuccaaaccagcaccaacaucccgguuccaagccuagag

SEQ ID NO: 294192 - RNA, 64 nt, Homo Sapiens
ggauauucuaccagagcucucacuauauugucaagccuaagauugaaaaacuggaggcuuuauu

SEQ ID NO: 294193 - RNA, 64 nt, Homo Sapiens
aagaauuugugaauuauuucuggguuuguguuuugccuaagagcugaucuuauuucugauuugu

SEQ ID NO: 294194 - RNA, 64 nt, Homo Sapiens
aguggcugggguggagugggaagggagcauugcagccuaagaagaaggccagagagggaaaagg

SEQ ID NO: 294195 - RNA, 64 nt, Homo Sapiens
ggaacaaucacagggaauggccacaaaccugcccgccuaagacccugaauccguacuuggguca

SEQ ID NO: 294196 - RNA, 64 nt, Homo Sapiens; identical to SEQ ID NO: 122412

SEQ ID NO: 294197 - RNA, 64 nt, Homo Sapiens; identical to SEQ ID NO: 122413

SEQ ID NO: 294198 - RNA, 64 nt, Homo Sapiens; identical to SEQ ID NO: 122453

SEQ ID NO: 294199 - RNA, 64 nt, Homo Sapiens; identical to SEQ ID NO: 122454

SEQ ID NO: 294200 - RNA, 64 nt, Homo Sapiens; identical to SEQ ID NO: 122460

SEQ ID NO: 294201 - RNA, 64 nt, Homo Sapiens; identical to SEQ ID NO: 122461

SEQ ID NO: 294202 - RNA, 64 nt, Homo Sapiens; identical to SEQ ID NO: 122467

SEQ ID NO: 294203 - RNA, 64 nt, Homo Sapiens; identical to SEQ ID NO: 122468

SEQ ID NO: 294204 - RNA, 64 nt, Homo Sapiens; identical to SEQ ID NO: 122481

SEQ ID NO: 294205 - RNA, 64 nt, Homo Sapiens; identical to SEQ ID NO: 122482

SEQ ID NO: 294206 - RNA, 64 nt, Homo Sapiens; identical to SEQ ID NO: 122498

SEQ ID NO: 294207 - RNA, 64 nt, Homo Sapiens; identical to SEQ ID NO: 122499

SEQ ID NO: 294208 - RNA, 64 nt, Homo Sapiens; identical to SEQ ID NO: 122513

SEQ ID NO: 294209 - RNA, 64 nt, Homo Sapiens; identical to SEQ ID NO: 122514

SEQ ID NO: 294210 - RNA, 64 nt, Homo Sapiens; identical to SEQ ID NO: 122517

SEQ ID NO: 294211 - RNA, 64 nt, Homo Sapiens; identical to SEQ ID NO: 122518

SEQ ID NO: 294212 - RNA, 64 nt, Homo Sapiens; identical to SEQ ID NO: 122606

SEQ ID NO: 294213 - RNA, 64 nt, Homo Sapiens; identical to SEQ ID NO: 122607

SEQ ID NO: 294214 - RNA, 64 nt, Homo Sapiens; identical to SEQ ID NO: 122654

SEQ ID NO: 294215 - RNA, 64 nt, Homo Sapiens; identical to SEQ ID NO: 122655

SEQ ID NO: 294216 - RNA, 64 nt, Homo Sapiens; identical to SEQ ID NO: 122669

SEQ ID NO: 294217 - RNA, 64 nt, Homo Sapiens; identical to SEQ ID NO: 122670

SEQ ID NO: 294218 - RNA, 64 nt, Homo Sapiens; identical to SEQ ID NO: 122677

SEQ ID NO: 294219 - RNA, 64 nt, Homo Sapiens; identical to SEQ ID NO: 122678

SEQ ID NO: 294220 - RNA, 64 nt, Homo Sapiens; identical to SEQ ID NO: 122684

SEQ ID NO: 294221 - RNA, 64 nt, Homo Sapiens; identical to SEQ ID NO: 122685

SEQ ID NO: 294222 - RNA, 64 nt, Homo Sapiens; identical to SEQ ID NO: 122691

SEQ ID NO: 294223 - RNA, 64 nt, Homo Sapiens; identical to SEQ ID NO: 122692

SEQ ID NO: 294224 - RNA, 64 nt, Homo Sapiens; identical to SEQ ID NO: 122693

SEQ ID NO: 294225 - RNA, 64 nt, Homo Sapiens; identical to SEQ ID NO: 122709

SEQ ID NO: 294226 - RNA, 64 nt, Homo Sapiens; identical to SEQ ID NO: 122710

SEQ ID NO: 294227 - RNA, 64 nt, Homo Sapiens; identical to SEQ ID NO: 122711

SEQ ID NO: 294228 - RNA, 64 nt, Homo Sapiens; identical to SEQ ID NO: 122718

SEQ ID NO: 294229 - RNA, 64 nt, Homo Sapiens; identical to SEQ ID NO: 122719

SEQ ID NO: 294230 - RNA, 64 nt, Homo Sapiens; identical to SEQ ID NO: 122734

SEQ ID NO: 294231 - RNA, 64 nt, Homo Sapiens; identical to SEQ ID NO: 122735

SEQ ID NO: 294232 - RNA, 64 nt, Homo Sapiens; identical to SEQ ID NO: 122742

SEQ ID NO: 294233 - RNA, 64 nt, Homo Sapiens; identical to SEQ ID NO: 122743

SEQ ID NO: 294234 - RNA, 64 nt, Homo Sapiens; identical to SEQ ID NO: 122744

SEQ ID NO: 294235 - RNA, 64 nt, Homo Sapiens; identical to SEQ ID NO: 122746

SEQ ID NO: 294236 - RNA, 64 nt, Homo Sapiens; identical to SEQ ID NO: 122747

SEQ ID NO: 294237 - RNA, 64 nt, Homo Sapiens; identical to SEQ ID NO: 122749

SEQ ID NO: 294238 - RNA, 64 nt, Homo Sapiens; identical to SEQ ID NO: 122750

SEQ ID NO: 294239 - RNA, 64 nt, Homo Sapiens; identical to SEQ ID NO: 122801

SEQ ID NO: 294240 - RNA, 64 nt, Homo Sapiens; identical to SEQ ID NO: 122802

SEQ ID NO: 294241 - RNA, 64 nt, Homo Sapiens; identical to SEQ ID NO: 122837

SEQ ID NO: 294242 - RNA, 64 nt, Homo Sapiens; identical to SEQ ID NO: 122838

SEQ ID NO: 294243 - RNA, 64 nt, Homo Sapiens; identical to SEQ ID NO: 122842

SEQ ID NO: 294244 - RNA, 64 nt, Homo Sapiens; identical to SEQ ID NO: 122843

SEQ ID NO: 294245 - RNA, 64 nt, Homo Sapiens; identical to SEQ ID NO: 122853

SEQ ID NO: 294246 - RNA, 64 nt, Homo Sapiens; identical to SEQ ID NO: 122854

SEQ ID NO: 294247 - RNA, 64 nt, Homo Sapiens; identical to SEQ ID NO: 122861

SEQ ID NO: 294248 - RNA, 64 nt, Homo Sapiens; identical to SEQ ID NO: 122862

SEQ ID NO: 294249 - RNA, 64 nt, Homo Sapiens; identical to SEQ ID NO: 122909

SEQ ID NO: 294250 - RNA, 64 nt, Homo Sapiens; identical to SEQ ID NO: 122910

SEQ ID NO: 294251 - RNA, 64 nt, Homo Sapiens; identical to SEQ ID NO: 122911

SEQ ID NO: 294252 - RNA, 64 nt, Homo Sapiens; identical to SEQ ID NO: 122931

SEQ ID NO: 294253 - RNA, 64 nt, Homo Sapiens; identical to SEQ ID NO: 122932

SEQ ID NO: 294254 - RNA, 64 nt, Homo Sapiens; identical to SEQ ID NO: 122949

SEQ ID NO: 294255 - RNA, 64 nt, Homo Sapiens; identical to SEQ ID NO: 122950

SEQ ID NO: 294256 - RNA, 64 nt, Homo Sapiens; identical to SEQ ID NO: 122967

SEQ ID NO: 294257 - RNA, 64 nt, Homo Sapiens; identical to SEQ ID NO: 122968

SEQ ID NO: 294258 - RNA, 64 nt, Homo Sapiens; identical to SEQ ID NO: 122972

SEQ ID NO: 294259 - RNA, 64 nt, Homo Sapiens; identical to SEQ ID NO: 122973

SEQ ID NO: 294260 - RNA, 64 nt, Homo Sapiens; identical to SEQ ID NO: 122977

SEQ ID NO: 294261 - RNA, 64 nt, Homo Sapiens; identical to SEQ ID NO: 122978

SEQ ID NO: 294262 - RNA, 64 nt, Homo Sapiens
ucucccaaggcuaccuacugguagaauaugaaaagcucaggaucaguaaugcaaaaauaaaacg

SEQ ID NO: 294263 - RNA, 64 nt, Homo Sapiens
augcuauugcuggagagcgaaagacccacagagugcucaggaugugcuuuguggaaggugaagg

SEQ ID NO: 294264 - RNA, 64 nt, Homo Sapiens
acgggaccggccaggccaccgugugaaccgaggggcucaggaaaugaggcucagggaaaggcca

SEQ ID NO: 294265 - RNA, 64 nt, Homo Sapiens
ugggaccuccccugaggcucaggccagggcuauagcucaggaccuauuacacggaaaacggugg

SEQ ID NO: 294266 - RNA, 64 nt, Homo Sapiens
ccccugcccucuaguugguugaggcucuaacacugcucaggagauuuggccgggauggacuaau

SEQ ID NO: 294267 - RNA, 64 nt, Homo Sapiens
caaugaaaagcccccauuuacgcuguuuccaauggcucaggagacaccuggcaguggggagcau

SEQ ID NO: 294268 - RNA, 64 nt, Homo Sapiens
gcauauugcuccaauucaaacacucuuuccugaugcucaggaaacuccuuugcugugacaucac

SEQ ID NO: 294269 - RNA, 64 nt, Homo Sapiens
aggaccccaggggagaggagaucuggucccaggagcucaggagggacacucauucccauugacc

SEQ ID NO: 294270 - RNA, 64 nt, Homo Sapiens
gaaguggagaaucucucagcagaaaaccauggcugcucaggaagugugagcuguggaaugagag

SEQ ID NO: 294271 - RNA, 64 nt, Homo Sapiens
ucuugugggaaaaaaaugggugugucugaggaaugcucaggaaacugguguuaugauguugcac

SEQ ID NO: 294272 - RNA, 64 nt, Homo Sapiens
ucaagaccagcuugggaaacgguggaucacuugagcucaggagucgcuuugggaggcugaggca

SEQ ID NO: 294273 - RNA, 64 nt, Homo Sapiens
ggacccuggggcuacacuccuaaccugaccagccgcucaggacaaucugggaacuaacagcugc

SEQ ID NO: 294274 - RNA, 64 nt, Homo Sapiens
cagguacuggggaggccugaggagcccuccuggagcucaggaggccgaggcugccuuaagcugu

SEQ ID NO: 294275 - RNA, 64 nt, Homo Sapiens
gcaggggccacugggcagccugagggcugacccugcucaggacacugucugucucaggaacuca

SEQ ID NO: 294276 - RNA, 64 nt, Homo Sapiens
ccucagagggggcagguggccuggagagagaggggcucaggaacugggagccucgugggugggg

SEQ ID NO: 294277 - RNA, 64 nt, Homo Sapiens
cucccggcuuugccguucagauggggcuccugaggcucaggagugaagaugccacagagccggg

SEQ ID NO: 294278 - RNA, 64 nt, Homo Sapiens
cuaacucucccuaaaccaucggaaaucugauggugcucaggaauccuucacaaaaaaccuuaag

SEQ ID NO: 294279 - RNA, 64 nt, Homo Sapiens
aacuggggcuuugcuuauggcagaggcagccaaggcucaggaaagccugcuguguuccagauca

SEQ ID NO: 294280 - RNA, 64 nt, Homo Sapiens
cugaggcaggagaauugauucuguagucccagcugcucaggaggccgggcgucgcagcaugcgc

SEQ ID NO: 294281 - RNA, 64 nt, Homo Sapiens
uugagaccagccugggcaacggaagauugccugagcucaggagucacuuugggaggccaaggug

SEQ ID NO: 294282 - RNA, 64 nt, Homo Sapiens
gcacuuugcaggccgagguagacagauggcuugagcucaggaguucgugaccagccugggcaac

SEQ ID NO: 294283 - RNA, 64 nt, Homo Sapiens
aacuuugggaggccgaggcagguggaucauuugagcucaggaauucaagaccagccuggguaau

SEQ ID NO: 294284 - RNA, 64 nt, Homo Sapiens
agccugcugaauuuauguugacuucugaguuacagcucaggaaaacauuguuugcaggacgaaa

SEQ ID NO: 294285 - RNA, 64 nt, Homo Sapiens
uuugaggucaaauugaagacauaacaaaaacuuugcucaggacaacaaaagaacccucagcaga

SEQ ID NO: 294286 - RNA, 64 nt, Homo Sapiens
gggcuguguugcucucucaaggaauuggccaagggcucaggagacaaguccaaccaguggaccu

SEQ ID NO: 294287 - RNA, 64 nt, Homo Sapiens
ccaagaaacuggaugccaaggggagaagcagcuggcucaggaaggaagcaggaggagguaaugc

SEQ ID NO: 294288 - RNA, 64 nt, Homo Sapiens
gcaagaugaagguaacaaucccauuuuuuacugagcucaggagagggcagcaaccccugcaucc

SEQ ID NO: 294289 - RNA, 64 nt, Homo Sapiens
aggaggagaugaagguagggacauaagcaggcuggcucaggacacguggaccgggagaaugagu

SEQ ID NO: 294290 - RNA, 64 nt, Homo Sapiens
aggggugagagaccugcucaccaggccucugcuggcucaggaggcuguucugggcauggcaggg

SEQ ID NO: 294291 - RNA, 64 nt, Homo Sapiens
ucccuggaaaagggaaaugucacccaccaggccagcucaggaauuugacucuggggugcagcuu

SEQ ID NO: 294292 - RNA, 64 nt, Homo Sapiens
uugccuuaaaacugaguugggugacuugguaccugcucaggaccccccgcacugucccaauccc

SEQ ID NO: 294293 - RNA, 64 nt, Homo Sapiens
cagcuggccucacuccgcuggugacuucguaccugcucaggagcccccacugucccagucccac

SEQ ID NO: 294294 - RNA, 64 nt, Homo Sapiens
gggugaaauagcuggcagauuaagauuuuuuucugcucaggaaggagcuauuuaacacaaaucc

SEQ ID NO: 294295 - RNA, 64 nt, Homo Sapiens
ucugagguggcacccugccuauggcaguaacugggcucaggagcccaagcccccuuuuguguga

SEQ ID NO: 294296 - RNA, 64 nt, Homo Sapiens
ucgagaccagccugggucacggaggaucacuugagcucaggaaucacuuuaagaggcugaggca

SEQ ID NO: 294297 - RNA, 64 nt, Homo Sapiens
cagaacagaaaagaucaauauuaagaaaaucucagcucaggagcagauuucauccagaaagagu

SEQ ID NO: 294298 - RNA, 64 nt, Homo Sapiens
gugguggagcugggucuugaagucuugggagucugcucaggacagcugacgaggcagcuggccc

SEQ ID NO: 294299 - RNA, 64 nt, Homo Sapiens
cccuggcccaggcuuggggcccccagccgggcccgcucaggauggcccucggaccccaucccca

SEQ ID NO: 294300 - RNA, 64 nt, Homo Sapiens; identical to SEQ ID NO: 71812

SEQ ID NO: 294301 - RNA, 64 nt, Homo Sapiens; identical to SEQ ID NO: 71813

SEQ ID NO: 294302 - RNA, 64 nt, Homo Sapiens; identical to SEQ ID NO: 71814

SEQ ID NO: 294303 - RNA, 64 nt, Homo Sapiens; identical to SEQ ID NO: 71815

SEQ ID NO: 294304 - RNA, 64 nt, Homo Sapiens; identical to SEQ ID NO: 71816

SEQ ID NO: 294305 - RNA, 64 nt, Homo Sapiens; identical to SEQ ID NO: 71817

SEQ ID NO: 294306 - RNA, 64 nt, Homo Sapiens; identical to SEQ ID NO: 71818

SEQ ID NO: 294307 - RNA, 64 nt, Homo Sapiens; identical to SEQ ID NO: 71819

SEQ ID NO: 294308 - RNA, 64 nt, Homo Sapiens; identical to SEQ ID NO: 71820

SEQ ID NO: 294309 - RNA, 64 nt, Homo Sapiens; identical to SEQ ID NO: 71821

SEQ ID NO: 294310 - RNA, 64 nt, Homo Sapiens; identical to SEQ ID NO: 71822

SEQ ID NO: 294311 - RNA, 64 nt, Homo Sapiens; identical to SEQ ID NO: 71823

SEQ ID NO: 294312 - RNA, 64 nt, Homo Sapiens; identical to SEQ ID NO: 71824

SEQ ID NO: 294313 - RNA, 64 nt, Homo Sapiens; identical to SEQ ID NO: 71825

SEQ ID NO: 294314 - RNA, 64 nt, Homo Sapiens; identical to SEQ ID NO: 71826

SEQ ID NO: 294315 - RNA, 64 nt, Homo Sapiens; identical to SEQ ID NO: 71827

SEQ ID NO: 294316 - RNA, 64 nt, Homo Sapiens; identical to SEQ ID NO: 71828

SEQ ID NO: 294317 - RNA, 64 nt, Homo Sapiens; identical to SEQ ID NO: 71829

SEQ ID NO: 294318 - RNA, 64 nt, Homo Sapiens; identical to SEQ ID NO: 71830

SEQ ID NO: 294319 - RNA, 64 nt, Homo Sapiens; identical to SEQ ID NO: 71831

SEQ ID NO: 294320 - RNA, 64 nt, Homo Sapiens; identical to SEQ ID NO: 71832

SEQ ID NO: 294321 - RNA, 64 nt, Homo Sapiens; identical to SEQ ID NO: 71833

SEQ ID NO: 294322 - RNA, 64 nt, Homo Sapiens; identical to SEQ ID NO: 71834

SEQ ID NO: 294323 - RNA, 64 nt, Homo Sapiens; identical to SEQ ID NO: 71835

SEQ ID NO: 294324 - RNA, 64 nt, Homo Sapiens; identical to SEQ ID NO: 71836

SEQ ID NO: 294325 - RNA, 64 nt, Homo Sapiens; identical to SEQ ID NO: 71837

SEQ ID NO: 294326 - RNA, 64 nt, Homo Sapiens; identical to SEQ ID NO: 71838

SEQ ID NO: 294327 - RNA, 64 nt, Homo Sapiens; identical to SEQ ID NO: 71839

SEQ ID NO: 294328 - RNA, 64 nt, Homo Sapiens; identical to SEQ ID NO: 71840

SEQ ID NO: 294329 - RNA, 64 nt, Homo Sapiens; identical to SEQ ID NO: 71841

SEQ ID NO: 294330 - RNA, 64 nt, Homo Sapiens; identical to SEQ ID NO: 71842

SEQ ID NO: 294331 - RNA, 64 nt, Homo Sapiens; identical to SEQ ID NO: 71843

SEQ ID NO: 294332 - RNA, 64 nt, Homo Sapiens; identical to SEQ ID NO: 71844

SEQ ID NO: 294333 - RNA, 64 nt, Homo Sapiens; identical to SEQ ID NO: 71845

SEQ ID NO: 294334 - RNA, 64 nt, Homo Sapiens; identical to SEQ ID NO: 71846

SEQ ID NO: 294335 - RNA, 64 nt, Homo Sapiens; identical to SEQ ID NO: 71847

SEQ ID NO: 294336 - RNA, 64 nt, Homo Sapiens; identical to SEQ ID NO: 71847

SEQ ID NO: 294337 - RNA, 64 nt, Homo Sapiens; identical to SEQ ID NO: 71849

SEQ ID NO: 294338 - RNA, 64 nt, Homo Sapiens; identical to SEQ ID NO: 71850

SEQ ID NO: 294339 - RNA, 64 nt, Homo Sapiens; identical to SEQ ID NO: 71851

SEQ ID NO: 294340 - RNA, 64 nt, Homo Sapiens; identical to SEQ ID NO: 71852

SEQ ID NO: 294341 - RNA, 64 nt, Homo Sapiens; identical to SEQ ID NO: 71853

SEQ ID NO: 294342 - RNA, 64 nt, Homo Sapiens; identical to SEQ ID NO: 71854

SEQ ID NO: 294343 - RNA, 64 nt, Homo Sapiens; identical to SEQ ID NO: 71855

SEQ ID NO: 294344 - RNA, 64 nt, Homo Sapiens; identical to SEQ ID NO: 71856

SEQ ID NO: 294345 - RNA, 57 nt, Homo Sapiens; identical to SEQ ID NO: 71857

SEQ ID NO: 294346 - RNA, 64 nt, Homo Sapiens; identical to SEQ ID NO: 71858

SEQ ID NO: 294347 - RNA, 64 nt, Homo Sapiens
aauaacacaugaagcaagaauacuugucauuauauacucuuacaugauaugcauagcauuggaa

SEQ ID NO: 294348 - RNA, 64 nt, Homo Sapiens
acuuguuuguggucagcacaugccagacucuugauacucuuaaauuuuuuuuuuuuucuauuuu

SEQ ID NO: 294349 - RNA, 64 nt, Homo Sapiens
uguaauccaugucuauaaucuaccaacaaagauguacucuuaaacucaguaucaccaggcacua

SEQ ID NO: 294350 - RNA, 64 nt, Homo Sapiens
cccauuuaauaaaccauaugagaaaacccucuauuacucuuacacuuuaguuuuaccauuugag

SEQ ID NO: 294351 - RNA, 64 nt, Homo Sapiens
uggaauaaauucccaaugcauugccuuaugccuuuacucuuacaagaaacagaaggagaccugg

SEQ ID NO: 294352 - RNA, 64 nt, Homo Sapiens
uggcaguuuacuuaacuuacauuaauaacagaccuacucuuaccaugccaaguauuuuauaaag

SEQ ID NO: 294353 - RNA, 64 nt, Homo Sapiens
caaagcgauguauuuuuguacacuugaaauagaguacucuuaauuuacugggcaaaugugcuug

SEQ ID NO: 294354 - RNA, 64 nt, Homo Sapiens
agcacagccuaggaaggucagauccuguauuaauuacucuuaguggagaugccagauaucccau

SEQ ID NO: 294355 - RNA, 64 nt, Homo Sapiens
agaacuuagacacaagggaccaucccccaaacucuacucuuauacccagaaaagaacauauuuc

SEQ ID NO: 294356 - RNA, 64 nt, Homo Sapiens
agaguaucaagaaaauaaaugagcauagcaaugcuacucuuaaaaagaugcuaugccacacaac

SEQ ID NO: 294357 - RNA, 64 nt, Homo Sapiens
ucuacaaauuuuucugugguuacuugauguauuggggucaaaucaggucuuggugccucugcag

SEQ ID NO: 294358 - RNA, 64 nt, Homo Sapiens
cuagaaaaauuguuaaggugggaguucuauuuuggggucaaaugagacuguguuugguccugua

SEQ ID NO: 294359 - RNA, 64 nt, Homo Sapiens
uaaggaugucuuuacacugacugggcugucaugucuccaccacuguuucccucugcuguggguu

SEQ ID NO: 294360 - RNA, 64 nt, Homo Sapiens
aggacccugucuuuggguuuggaccuacccaggucuccaccauccucuccugugucuguccucc

SEQ ID NO: 294361 - RNA, 64 nt, Homo Sapiens
cacucaccccuagcccugguuaagacccuguguccuccaccaugggaggauucgagcaucaggc

SEQ ID NO: 294362 - RNA, 64 nt, Homo Sapiens
aaggggaccccgagaacccuaugagugcaccugccuccaccagcuggagaguacauuugcuuua

SEQ ID NO: 294363 - RNA, 64 nt, Homo Sapiens
ccuaucauuuuucuuuuuagccauauagcuugcucuccaccaggaaaaggaaaggcugauguuu

SEQ ID NO: 294364 - RNA, 64 nt, Homo Sapiens
ugaagucccucucacgcagcccuaagaacagcagcuccaccaaaagagcugggcggcguccaca

SEQ ID NO: 294365 - RNA, 64 nt, Homo Sapiens
agcugcuugugggggcaccugggaggucaaaggucuccaccacaucaaccuauuuuguuuuacc

SEQ ID NO: 294366 - RNA, 64 nt, Homo Sapiens
aaggccuuccaaacagcuccgucgccccuagcaacuccaccauugggcacugccaugcagagac

SEQ ID NO: 294367 - RNA, 64 nt, Homo Sapiens
uguacagguaacuaauucuguuauucacagacaacuccaccaaugucuauggugugacaucacc

SEQ ID NO: 294368 - RNA, 64 nt, Homo Sapiens
accaguggugccacauguggaccccuuucugccccuccaccaguuuggugggacauucuacaga

SEQ ID NO: 294369 - RNA, 64 nt, Homo Sapiens
ccccuuucugagcccuuccucugguggugaccagcuccaccaagccacaauuuagccaugucau

SEQ ID NO: 294370 - RNA, 64 nt, Homo Sapiens
cccagguggacuugcagcccagggcccucuuccccuccaccacauaugguagcuggacuucccc

SEQ ID NO: 294371 - RNA, 64 nt, Homo Sapiens
cuaaaacugagguggggauggggagaggcuuugccuccaccauucccaccccacccuccccuua

SEQ ID NO: 294372 - RNA, 64 nt, Homo Sapiens
uuucaggaauuuuguaaucucauaacuuuccaagcuccaccacuuccuaaaucuuaagaacuuu

SEQ ID NO: 294373 - RNA, 64 nt, Homo Sapiens
ugcccuuggcugccagccuacccugccugcacuccuccaccaucacaaucucacccaaacuccu

SEQ ID NO: 294374 - RNA, 64 nt, Homo Sapiens
gaggcggguuuccuggguccccucuccagcaagccuccaccagcaagcucggcccagagcuucc

SEQ ID NO: 294375 - RNA, 64 nt, Homo Sapiens
caugaccgagacccccugauccuccguggacucacuccaccagcuuccuauaacuuggacgaug

SEQ ID NO: 294376 - RNA, 64 nt, Homo Sapiens
ucggccaguuaacaagaagauggugugagguguucuccaccagucucuccuguuugagacuguu

SEQ ID NO: 294377 - RNA, 64 nt, Homo Sapiens
ccaucagaaggagaaggaagucccuggcuuguaacuccaccaacucugggacccuuuccuuccu

SEQ ID NO: 294378 - RNA, 64 nt, Homo Sapiens
caaaagucaaaaggugccugccuucuuauucucacuccaccaccccgugauguaggguaaggug

SEQ ID NO: 294379 - RNA, 64 nt, Homo Sapiens
ucucggccugccaguucucagugcagcucuggagcuccaccaaccagaguaacugcacgccuuu

SEQ ID NO: 294380 - RNA, 64 nt, Homo Sapiens
agugcugguugccuccuacucaccaggaaagccacuccaccaguggagcccucgggaccugcug

SEQ ID NO: 294381 - RNA, 64 nt, Homo Sapiens
ccuuggaugcccucuaguugcaggccugcacaggcuccaccaggugcugcuccacgaggaagcu

SEQ ID NO: 294382 - RNA, 64 nt, Homo Sapiens
ccccagcaaggucagcugccacagauugggcacacuccaccagaggggggugggggcuucaagu

SEQ ID NO: 294383 - RNA, 64 nt, Homo Sapiens
aucuauagacauuaggaagggagugagacggcuccuccaccauccucagccagugcaacccauu

SEQ ID NO: 294384 - RNA, 64 nt, Homo Sapiens
accccugaacuccugagcgacagaagccccaggccuccaccagccuugaacccuugcaaagggg

SEQ ID NO: 294385 - RNA, 64 nt, Homo Sapiens
aggguggggaggagaaaaucccaccuccccugaccuccaccaccuccaccaccaccaccaccac

SEQ ID NO: 294386 - RNA, 64 nt, Homo Sapiens
aggagaaaaucccaccuccccugaccuccaccaccuccaccaccaccaccaccaccaccaccac

SEQ ID NO: 294387 - RNA, 64 nt, Homo Sapiens
uccuaaaucuuaagaacuuucauaacuuuccaagcuccaccacuuuucaggaauuuuguaaucu

SEQ ID NO: 294388 - RNA, 64 nt, Homo Sapiens
cccacccacccuccccuuaagggagagccuuugccuccaccauucuaaaacugagguggggaug

SEQ ID NO: 294389 - RNA, 64 nt, Homo Sapiens
cugggucccaggcagcuuuccagcuucaaagcugcuccaccaugguaugcacccagaggggacu

SEQ ID NO: 294390 - RNA, 64 nt, Homo Sapiens
aacuccacccgaccccagcacugcuaucacagaacuccaccagcgcagaaaggagaugccaauu

SEQ ID NO: 294391 - RNA, 64 nt, Homo Sapiens
caaggaggugggggcaagggucccaggcuccuggcuccaccagcgccaggugugcacaggggcc

SEQ ID NO: 294392 - RNA, 64 nt, Homo Sapiens
ggaccucagcugucccuccucugcuccaggccuucuccaccacagucaucuccuuggucacccu

SEQ ID NO: 294393 - RNA, 63 nt, Homo Sapiens
cuuaagcucuuuucagacauaaaaaaugcaagcugucaggauggaggaaaaaaaaaauuaaaa

SEQ ID NO: 294394 - RNA, 63 nt, Homo Sapiens
uaaauggccuaagcaccuguagggauuccgauaugucaggaccuuauauacuuuagaaauaca

SEQ ID NO: 294395 - RNA, 63 nt, Homo Sapiens
uaaaugagguuaauguaauaagauuagaggugaugucaggacauauuaaaauguccauucugu

SEQ ID NO: 294396 - RNA, 63 nt, Homo Sapiens
caagggcucagugucaaagaauugugacuugaaugucaggauucagcagcuccgguuucuauu

SEQ ID NO: 294397 - RNA, 63 nt, Homo Sapiens
uuaagcaucucaggagaaauuguuaauaaagcuugucaggaugaauuugguaguguuggcagu

SEQ ID NO: 294398 - RNA, 63 nt, Homo Sapiens
aaauaacuucacagcuacuccaguuccacagaaugucaggaccuauggacccaagucuaugcu

SEQ ID NO: 294399 - RNA, 63 nt, Homo Sapiens
guucuccccaaagacuggaauauucuacccaaaugucaggaccaggauuuucuacccagagac

SEQ ID NO: 294400 - RNA, 63 nt, Homo Sapiens
guucuucccaaagaccaaaauauucuacccauaugucaggaccaggauuuucuacccagagac

SEQ ID NO: 294401 - RNA, 63 nt, Homo Sapiens
uaucuuccuaaagaccaaaauauucuacccauaugucaggaccgggauuuucuacccagagac

SEQ ID NO: 294402 - RNA, 63 nt, Homo Sapiens
guucucuccaacgaccagaauauucuacccaaaugucaggaccaagauuuucuaccaaaauau

SEQ ID NO: 294403 - RNA, 63 nt, Homo Sapiens
ugggggcuguaggaggaggcagggauuccagggugucaggaaggcaggggugccaggucccac

SEQ ID NO: 294404 - RNA, 63 nt, Homo Sapiens
ugggggcucuaggaggaggcagggacuccagggugucaggaaggcaggggugccgggucccac

SEQ ID NO: 294405 - RNA, 63 nt, Homo Sapiens
cguccaggugugcggcgagccgcugcgcacagaugucaggauuuccguuugggucuaguuuag

SEQ ID NO: 294406 - RNA, 63 nt, Homo Sapiens
aguuuagaaccuguccuuaaaccuagggguugcugucaggauuugcuuucagacuuuuuuuuu

SEQ ID NO: 294407 - RNA, 63 nt, Homo Sapiens
guaggaaggccuuuaggcaggaaacccuuugaaugucaggaaucagagaauucacacugguga

SEQ ID NO: 294408 - RNA, 63 nt, Homo Sapiens
gcagcaaggccuuuaagcagagaaaccuaugaaugucaggaaucuauagaacucauacuaaug

SEQ ID NO: 294409 - RNA, 63 nt, Homo Sapiens
uaccaucuuacuccugccuccccauuccuugccugucaggaccauuuuagaagaguuaccuug

SEQ ID NO: 294410 - RNA, 63 nt, Homo Sapiens
ggugcuuugucuaauuaauuacaucccauaacuugucaggauaguugcuccaacugaauugcu

SEQ ID NO: 294411 - RNA, 64 nt, Homo Sapiens; identical to SEQ ID NO: 21812

SEQ ID NO: 294412 - RNA, 64 nt, Homo Sapiens; identical to SEQ ID NO: 21813

SEQ ID NO: 294413 - RNA, 64 nt, Homo Sapiens; identical to SEQ ID NO: 21814

SEQ ID NO: 294414 - RNA, 64 nt, Homo Sapiens; identical to SEQ ID NO: 21815

SEQ ID NO: 294415 - RNA, 64 nt, Homo Sapiens; identical to SEQ ID NO: 21816

SEQ ID NO: 294416 - RNA, 64 nt, Homo Sapiens; identical to SEQ ID NO: 21817

SEQ ID NO: 294417 - RNA, 64 nt, Homo Sapiens; identical to SEQ ID NO: 21818

SEQ ID NO: 294418 - RNA, 64 nt, Homo Sapiens; identical to SEQ ID NO: 21819

SEQ ID NO: 294419 - RNA, 64 nt, Homo Sapiens; identical to SEQ ID NO: 21820

SEQ ID NO: 294420 - RNA, 64 nt, Homo Sapiens; identical to SEQ ID NO: 21821

SEQ ID NO: 294421 - RNA, 64 nt, Homo Sapiens; identical to SEQ ID NO: 21822

SEQ ID NO: 294422 - RNA, 64 nt, Homo Sapiens; identical to SEQ ID NO: 21823

SEQ ID NO: 294423 - RNA, 64 nt, Homo Sapiens; identical to SEQ ID NO: 21824

SEQ ID NO: 294424 - RNA, 64 nt, Homo Sapiens; identical to SEQ ID NO: 21825

SEQ ID NO: 294425 - RNA, 64 nt, Homo Sapiens; identical to SEQ ID NO: 21826

SEQ ID NO: 294426 - RNA, 64 nt, Homo Sapiens; identical to SEQ ID NO: 21827

SEQ ID NO: 294427 - RNA, 64 nt, Homo Sapiens; identical to SEQ ID NO: 21828

SEQ ID NO: 294428 - RNA, 64 nt, Homo Sapiens; identical to SEQ ID NO: 21829

SEQ ID NO: 294429 - RNA, 64 nt, Homo Sapiens; identical to SEQ ID NO: 21830

SEQ ID NO: 294430 - RNA, 64 nt, Homo Sapiens; identical to SEQ ID NO: 21831

SEQ ID NO: 294431 - RNA, 50 nt, Homo Sapiens; identical to SEQ ID NO: 21832

SEQ ID NO: 294432 - RNA, 64 nt, Homo Sapiens; identical to SEQ ID NO: 21833

SEQ ID NO: 294433 - RNA, 64 nt, Homo Sapiens; identical to SEQ ID NO: 21834

SEQ ID NO: 294434 - RNA, 64 nt, Homo Sapiens; identical to SEQ ID NO: 21835

SEQ ID NO: 294435 - RNA, 64 nt, Homo Sapiens; identical to SEQ ID NO: 21836

SEQ ID NO: 294436 - RNA, 64 nt, Homo Sapiens; identical to SEQ ID NO: 21837

SEQ ID NO: 294437 - RNA, 64 nt, Homo Sapiens; identical to SEQ ID NO: 21838

SEQ ID NO: 294438 - RNA, 64 nt, Homo Sapiens; identical to SEQ ID NO: 21839

SEQ ID NO: 294439 - RNA, 64 nt, Homo Sapiens; identical to SEQ ID NO: 21840

SEQ ID NO: 294440 - RNA, 64 nt, Homo Sapiens; identical to SEQ ID NO: 21841

SEQ ID NO: 294441 - RNA, 64 nt, Homo Sapiens; identical to SEQ ID NO: 21842

SEQ ID NO: 294442 - RNA, 64 nt, Homo Sapiens; identical to SEQ ID NO: 21843

SEQ ID NO: 294443 - RNA, 64 nt, Homo Sapiens; identical to SEQ ID NO: 21844

SEQ ID NO: 294444 - RNA, 64 nt, Homo Sapiens; identical to SEQ ID NO: 21845

SEQ ID NO: 294445 - RNA, 64 nt, Homo Sapiens; identical to SEQ ID NO: 21846

SEQ ID NO: 294446 - RNA, 64 nt, Homo Sapiens; identical to SEQ ID NO: 21847

SEQ ID NO: 294447 - RNA, 64 nt, Homo Sapiens; identical to SEQ ID NO: 21848

SEQ ID NO: 294448 - RNA, 64 nt, Homo Sapiens; identical to SEQ ID NO: 21849

SEQ ID NO: 294449 - RNA, 64 nt, Homo Sapiens; identical to SEQ ID NO: 21850

SEQ ID NO: 294450 - RNA, 64 nt, Homo Sapiens; identical to SEQ ID NO: 21851

SEQ ID NO: 294451 - RNA, 64 nt, Homo Sapiens; identical to SEQ ID NO: 21852

SEQ ID NO: 294452 - RNA, 64 nt, Homo Sapiens; identical to SEQ ID NO: 21853

SEQ ID NO: 294453 - RNA, 64 nt, Homo Sapiens; identical to SEQ ID NO: 21854

SEQ ID NO: 294454 - RNA, 64 nt, Homo Sapiens; identical to SEQ ID NO: 21855

SEQ ID NO: 294455 - RNA, 64 nt, Homo Sapiens; identical to SEQ ID NO: 21856

SEQ ID NO: 294456 - RNA, 64 nt, Homo Sapiens; identical to SEQ ID NO: 21857

SEQ ID NO: 294457 - RNA, 64 nt, Homo Sapiens; identical to SEQ ID NO: 21858

SEQ ID NO: 294458 - RNA, 64 nt, Homo Sapiens; identical to SEQ ID NO: 21859

SEQ ID NO: 294459 - RNA, 64 nt, Homo Sapiens; identical to SEQ ID NO: 21860

SEQ ID NO: 294460 - RNA, 64 nt, Homo Sapiens; identical to SEQ ID NO: 21861

SEQ ID NO: 294461 - RNA, 64 nt, Homo Sapiens; identical to SEQ ID NO: 21862

SEQ ID NO: 294462 - RNA, 64 nt, Homo Sapiens; identical to SEQ ID NO: 21863

SEQ ID NO: 294463 - RNA, 64 nt, Homo Sapiens; identical to SEQ ID NO: 21864

SEQ ID NO: 294464 - RNA, 64 nt, Homo Sapiens; identical to SEQ ID NO: 21865

SEQ ID NO: 294465 - RNA, 64 nt, Homo Sapiens; identical to SEQ ID NO: 21866

SEQ ID NO: 294466 - RNA, 64 nt, Homo Sapiens; identical to SEQ ID NO: 21867

SEQ ID NO: 294467 - RNA, 64 nt, Homo Sapiens; identical to SEQ ID NO: 21868

SEQ ID NO: 294468 - RNA, 64 nt, Homo Sapiens; identical to SEQ ID NO: 21869

SEQ ID NO: 294469 - RNA, 64 nt, Homo Sapiens; identical to SEQ ID NO: 21870

SEQ ID NO: 294470 - RNA, 64 nt, Homo Sapiens; identical to SEQ ID NO: 21871

SEQ ID NO: 294471 - RNA, 64 nt, Homo Sapiens; identical to SEQ ID NO: 21872

SEQ ID NO: 294472 - RNA, 64 nt, Homo Sapiens; identical to SEQ ID NO: 21873

SEQ ID NO: 294473 - RNA, 64 nt, Homo Sapiens; identical to SEQ ID NO: 21874

SEQ ID NO: 294474 - RNA, 64 nt, Homo Sapiens
agcaugaaaguaauaaugugggauuacuagaaaaccugacuaauggugucacugcuggcaaugg

SEQ ID NO: 294475 - RNA, 64 nt, Homo Sapiens
agcacggaaguacucaugucggauucccagaaaaccugacuaauggugccacugcuggcaaugg

SEQ ID NO: 294476 - RNA, 64 nt, Homo Sapiens
uggugcuaacuacuaaagauaaaaaaaguagaagccugacuacuaauucagauuagcugaaagg

SEQ ID NO: 294477 - RNA, 64 nt, Homo Sapiens
ggggcccguucauggagcuguaguagagcaguguccugacuauagaaaggauaaaauguuuuaa

SEQ ID NO: 294478 - RNA, 64 nt, Homo Sapiens
auuuuucagcuacagcaaauaaaacagugaaagcccugacuauuuacaguagugguauccuuac

SEQ ID NO: 294479 - RNA, 64 nt, Homo Sapiens
ugugaacuuauaacaggaauaagcaaaauucauaccugacuaguguucagaauguagcauucug

SEQ ID NO: 294480 - RNA, 64 nt, Homo Sapiens; identical to SEQ ID NO: 59819

SEQ ID NO: 294481 - RNA, 64 nt, Homo Sapiens; identical to SEQ ID NO: 59820

SEQ ID NO: 294482 - RNA, 64 nt, Homo Sapiens; identical to SEQ ID NO: 59821

SEQ ID NO: 294483 - RNA, 64 nt, Homo Sapiens; identical to SEQ ID NO: 59822

SEQ ID NO: 294484 - RNA, 64 nt, Homo Sapiens; identical to SEQ ID NO: 59823

SEQ ID NO: 294485 - RNA, 64 nt, Homo Sapiens; identical to SEQ ID NO: 59824

SEQ ID NO: 294486 - RNA, 64 nt, Homo Sapiens; identical to SEQ ID NO: 59825

SEQ ID NO: 294487 - RNA, 64 nt, Homo Sapiens; identical to SEQ ID NO: 59826

SEQ ID NO: 294488 - RNA, 64 nt, Homo Sapiens; identical to SEQ ID NO: 59827

SEQ ID NO: 294489 - RNA, 64 nt, Homo Sapiens; identical to SEQ ID NO: 59828

SEQ ID NO: 294490 - RNA, 64 nt, Homo Sapiens; identical to SEQ ID NO: 59829

SEQ ID NO: 294491 - RNA, 64 nt, Homo Sapiens; identical to SEQ ID NO: 59830

SEQ ID NO: 294492 - RNA, 64 nt, Homo Sapiens; identical to SEQ ID NO: 59831

SEQ ID NO: 294493 - RNA, 64 nt, Homo Sapiens; identical to SEQ ID NO: 59832

SEQ ID NO: 294494 - RNA, 64 nt, Homo Sapiens; identical to SEQ ID NO: 59833

SEQ ID NO: 294495 - RNA, 64 nt, Homo Sapiens; identical to SEQ ID NO: 59834

SEQ ID NO: 294496 - RNA, 64 nt, Homo Sapiens; identical to SEQ ID NO: 59835

SEQ ID NO: 294497 - RNA, 64 nt, Homo Sapiens; identical to SEQ ID NO: 59836

SEQ ID NO: 294498 - RNA, 64 nt, Homo Sapiens; identical to SEQ ID NO: 59837

SEQ ID NO: 294499 - RNA, 64 nt, Homo Sapiens; identical to SEQ ID NO: 59838

SEQ ID NO: 294500 - RNA, 64 nt, Homo Sapiens; identical to SEQ ID NO: 59839

SEQ ID NO: 294501 - RNA, 64 nt, Homo Sapiens; identical to SEQ ID NO: 59840

SEQ ID NO: 294502 - RNA, 64 nt, Homo Sapiens; identical to SEQ ID NO: 59841

SEQ ID NO: 294503 - RNA, 64 nt, Homo Sapiens; identical to SEQ ID NO: 59842

SEQ ID NO: 294504 - RNA, 64 nt, Homo Sapiens; identical to SEQ ID NO: 59843

SEQ ID NO: 294505 - RNA, 64 nt, Homo Sapiens; identical to SEQ ID NO: 59844

SEQ ID NO: 294506 - RNA, 64 nt, Homo Sapiens; identical to SEQ ID NO: 59845

SEQ ID NO: 294507 - RNA, 64 nt, Homo Sapiens; identical to SEQ ID NO: 59846

SEQ ID NO: 294508 - RNA, 64 nt, Homo Sapiens; identical to SEQ ID NO: 59847

SEQ ID NO: 294509 - RNA, 64 nt, Homo Sapiens; identical to SEQ ID NO: 59848

SEQ ID NO: 294510 - RNA, 64 nt, Homo Sapiens; identical to SEQ ID NO: 59849

SEQ ID NO: 294511 - RNA, 64 nt, Homo Sapiens; identical to SEQ ID NO: 59850

SEQ ID NO: 294512 - RNA, 64 nt, Homo Sapiens; identical to SEQ ID NO: 59851

SEQ ID NO: 294513 - RNA, 64 nt, Homo Sapiens; identical to SEQ ID NO: 59852

SEQ ID NO: 294514 - RNA, 64 nt, Homo Sapiens; identical to SEQ ID NO: 59853

SEQ ID NO: 294515 - RNA, 64 nt, Homo Sapiens; identical to SEQ ID NO: 59854

SEQ ID NO: 294516 - RNA, 64 nt, Homo Sapiens; identical to SEQ ID NO: 59855

SEQ ID NO: 294517 - RNA, 64 nt, Homo Sapiens; identical to SEQ ID NO: 59856

SEQ ID NO: 294518 - RNA, 64 nt, Homo Sapiens; identical to SEQ ID NO: 59857

SEQ ID NO: 294519 - RNA, 64 nt, Homo Sapiens; identical to SEQ ID NO: 59858

SEQ ID NO: 294520 - RNA, 64 nt, Homo Sapiens; identical to SEQ ID NO: 59859

SEQ ID NO: 294521 - RNA, 64 nt, Homo Sapiens; identical to SEQ ID NO: 59860

SEQ ID NO: 294522 - RNA, 64 nt, Homo Sapiens; identical to SEQ ID NO: 59861

SEQ ID NO: 294523 - RNA, 64 nt, Homo Sapiens; identical to SEQ ID NO: 59862

SEQ ID NO: 294524 - RNA, 64 nt, Homo Sapiens; identical to SEQ ID NO: 59863

SEQ ID NO: 294525 - RNA, 64 nt, Homo Sapiens; identical to SEQ ID NO: 59864

SEQ ID NO: 294526 - RNA, 64 nt, Homo Sapiens; identical to SEQ ID NO: 59865

SEQ ID NO: 294527 - RNA, 64 nt, Homo Sapiens; identical to SEQ ID NO: 59866

SEQ ID NO: 294528 - RNA, 64 nt, Homo Sapiens; identical to SEQ ID NO: 59867

SEQ ID NO: 294529 - RNA, 64 nt, Homo Sapiens; identical to SEQ ID NO: 59868

SEQ ID NO: 294530 - RNA, 64 nt, Homo Sapiens; identical to SEQ ID NO: 59869

SEQ ID NO: 294531 - RNA, 64 nt, Homo Sapiens; identical to SEQ ID NO: 59870

SEQ ID NO: 294532 - RNA, 64 nt, Homo Sapiens; identical to SEQ ID NO: 59871

SEQ ID NO: 294533 - RNA, 64 nt, Homo Sapiens; identical to SEQ ID NO: 59872

SEQ ID NO: 294534 - RNA, 64 nt, Homo Sapiens; identical to SEQ ID NO: 59873

SEQ ID NO: 294535 - RNA, 64 nt, Homo Sapiens; identical to SEQ ID NO: 59874

SEQ ID NO: 294536 - RNA, 64 nt, Homo Sapiens; identical to SEQ ID NO: 59875

SEQ ID NO: 294537 - RNA, 64 nt, Homo Sapiens
ucagcauaguggaggggagauuuacugcagaaugaacugcaagucugcagccuggcuacugcuu

SEQ ID NO: 294538 - RNA, 64 nt, Homo Sapiens
ccaacuuccugggccuuucucucccugagcugguaacugcaauguucugcugcucucuuuccuu

SEQ ID NO: 294539 - RNA, 64 nt, Homo Sapiens
aucuaucaccucuagaagguuccagagacagugaaacugcaagaugcucucaacaggauuaugu

SEQ ID NO: 294540 - RNA, 64 nt, Homo Sapiens
uguuguuucggcaaagcauuuugauggaauagggaacugcaaauguaugaugauuuugaaaagg

SEQ ID NO: 294541 - RNA, 64 nt, Homo Sapiens
uuaugaaacagccaucuuaaaaaaaaaaaaaguaaacugcaaaaguacaaaaucauuuuucaau

SEQ ID NO: 294542 - RNA, 64 nt, Homo Sapiens
caucccagugaugccuuauuugaaacugggcuuaaacugcaaaaagaaugaaguuggauuuagg

SEQ ID NO: 294543 - RNA, 64 nt, Homo Sapiens
acacugaacauauaaccaucccagcucagcaugaaacugcaaaagagauaacuccaaguuuaau

SEQ ID NO: 294544 - RNA, 64 nt, Homo Sapiens
augaucugguacaggcaugcucaaaugcccaaccaacugcaaccgguucuugaaacagcaacag

SEQ ID NO: 294545 - RNA, 64 nt, Homo Sapiens
gaaauuguuguauaucacuaaaagcaugaauuggaacugcaaugaaagucaaauuuacuuuaaa

SEQ ID NO: 294546 - RNA, 64 nt, Homo Sapiens
auaagauuccagagcucuuugaucgcuuuuaauaaacugcaaguucauuuuaaaugaagggcca

SEQ ID NO: 294547 - RNA, 64 nt, Homo Sapiens
auuaaaucuucuaucugagaaaacugacauggcuaacugcaagaacuuucugauuacucaugau

SEQ ID NO: 294548 - RNA, 64 nt, Homo Sapiens
uauuuuccuuuuauacuacauucaaauacgagauaacugcaaaaaguucucuauggcaaagucu

SEQ ID NO: 294549 - RNA, 64 nt, Homo Sapiens
auuuauuucaugucuuuacuggaccugaaauuuaaacugcaaugccaguccugcaggagugcug

SEQ ID NO: 294550 - RNA, 64 nt, Homo Sapiens
gcaaaucacaaccucuuugagccucugucaccugaacugcaaaaugaguggguuagacaaaauc

SEQ ID NO: 294551 - RNA, 64 nt, Homo Sapiens
uuuuuacuugcuagagaauccaagcguauguuuaaacugcaagaucuuguaucuaaaguggaua

SEQ ID NO: 294552 - RNA, 64 nt, Homo Sapiens
gucuaaaauacccauuggugagcaaacaaaaaaaaacugcaaaaggaaaaacagcaaaacaaaa

SEQ ID NO: 294553 - RNA, 64 nt, Homo Sapiens
uaucuacuuaccauagauaccuuucauaacugguaacugcaaagccuuuugugcuggacccagg

SEQ ID NO: 294554 - RNA, 64 nt, Homo Sapiens
uaguuugucauauaaccagguuuauccuuagucuaacugcaagggauggaaccugccccagguc

SEQ ID NO: 294555 - RNA, 64 nt, Homo Sapiens; identical to SEQ ID NO: 56762

SEQ ID NO: 294556 - RNA, 64 nt, Homo Sapiens; identical to SEQ ID NO: 56763

SEQ ID NO: 294557 - RNA, 57 nt, Homo Sapiens; identical to SEQ ID NO: 56764

SEQ ID NO: 294558 - RNA, 64 nt, Homo Sapiens; identical to SEQ ID NO: 56765

SEQ ID NO: 294559 - RNA, 62 nt, Homo Sapiens
acagcucugcguugcucccgugcugccugcgccagccccaggcugcugaggagcagaggcca

SEQ ID NO: 294560 - RNA, 62 nt, Homo Sapiens
ucccuuccccacccccaucccauccccacccccagccccagcccaguccuccuaggagcagg

SEQ ID NO: 294561 - RNA, 62 nt, Homo Sapiens
gcagccucgcagcuccguggggcccuccgccccagccccagccagccaggcccugguggaaa

SEQ ID NO: 294562 - RNA, 62 nt, Homo Sapiens
caccccaucccgacccugucuccgccaccucgcagccccauuaaagcgcucucaucugggcu

SEQ ID NO: 294563 - RNA, 62 nt, Homo Sapiens
ucuguccaccuggccuccucucgccuggccgccagccccagccccagccccagccccaggcc

SEQ ID NO: 294564 - RNA, 62 nt, Homo Sapiens
caccuggccuccucucgccuggccgccagccccagccccagccccagccccaggcccagcug

SEQ ID NO: 294565 - RNA, 62 nt, Homo Sapiens
gccuccucucgccuggccgccagccccagccccagccccagccccaggcccagcugccuuug

SEQ ID NO: 294566 - RNA, 62 nt, Homo Sapiens
ucucgccuggccgccagccccagccccagccccagccccaggcccagcugccuuuggcuuug

SEQ ID NO: 294567 - RNA, 62 nt, Homo Sapiens
gcccggcccuggacccgucaggugccuguccccagccccaaccccacucaugccccgucguc

SEQ ID NO: 294568 - RNA, 62 nt, Homo Sapiens
gggaagcaggaaccccaccgugugcccccugccagccccagagggaguggcgagcccagcug

SEQ ID NO: 294569 - RNA, 62 nt, Homo Sapiens
cccucucccuccugcaauaauucggggagucucagccccauccaggugccgcggccagcucu

SEQ ID NO: 294570 - RNA, 62 nt, Homo Sapiens
caacccuccuucccgacccccucccccuagcccagccccagucacugucagggucgggccag

SEQ ID NO: 294571 - RNA, 62 nt, Homo Sapiens
gggcaagcuuuggugcgcccccugcugaggagcagccccaggaggggaccagaggggaugcu

SEQ ID NO: 294572 - RNA, 50 nt, Homo Sapiens; identical to SEQ ID NO: 245425

SEQ ID NO: 294573 - RNA, 62 nt, Homo Sapiens
gagagggccaacaacugucccuccuugagcaccagccccacccaagcaagcagacauuuauc

SEQ ID NO: 294574 - RNA, 62 nt, Homo Sapiens
aggcagguggggucaccugaugagcuaagauccagccccagaauccuggaggagcaggaggu

SEQ ID NO: 294575 - RNA, 62 nt, Homo Sapiens
aguccccugauccccuaccucugccugcccuccagccccaucaccagcuucuugcucaggga

SEQ ID NO: 294576 - RNA, 62 nt, Homo Sapiens
gggggccaugggggugaugaaugacccuccaacagccccacauggguuguuucuguuucuuu

SEQ ID NO: 294577 - RNA, 62 nt, Homo Sapiens
ucgccaguuucuugguugggacacuccucuggcagccccagcaccaccacaaccccuugcag

SEQ ID NO: 294578 - RNA, 62 nt, Homo Sapiens
ccacccacccccuaccauugagccaccaugcccagccccaaagccucuuaauugcucuaaca

SEQ ID NO: 294579 - RNA, 62 nt, Homo Sapiens
gugcugggauuacacacgugagucaccaugcccagccccaaagccauuucuugaagaauuuc

SEQ ID NO: 294580 - RNA, 62 nt, Homo Sapiens
cugccugcagucagcucggccuccccgaccugcagccccagacucugcucucccagcacuga

SEQ ID NO: 294581 - RNA, 62 nt, Homo Sapiens
ugcucaucccagcguaugcugccucuuuagggcagccccaagggccagccagccuguacucu

SEQ ID NO: 294582 - RNA, 62 nt, Homo Sapiens
gagaaacaaaaugggucagauagcuuuggccacagccccaggcagccuuuggggccuaugac

SEQ ID NO: 294583 - RNA, 62 nt, Homo Sapiens
gccccaugggaggcggcgcucagugagaacagcagccccacggcggguugcuucagccagug

SEQ ID NO: 294584 - RNA, 62 nt, Homo Sapiens
aggcuuguguuaaggcaaugauugugagaaaacagccccaucaagacacuuuauucguuuau

SEQ ID NO: 294585 - RNA, 62 nt, Homo Sapiens
agcagccccccuaaaaaaaucaggaaacuucccagccccacccugagguaaauaauuucugc

SEQ ID NO: 294586 - RNA, 62 nt, Homo Sapiens
guaaagaagggucagauuaagguaggcagaggcagccccacuccauuuugcaccaaggacuu

SEQ ID NO: 294587 - RNA, 62 nt, Homo Sapiens
caauggccuuuugugcuuguucaugcuccauccagccccaccugcauacuuuaaggaccaga

SEQ ID NO: 294588 - RNA, 53 nt, Homo Sapiens; identical to SEQ ID NO: 245441

SEQ ID NO: 294589 - RNA, 62 nt, Homo Sapiens
uccagcccugaggacagcucgcgccucagccccagccccagcccaccucccucccagcccca

SEQ ID NO: 294590 - RNA, 62 nt, Homo Sapiens
cccagcuccagcccugaggagccccagcgccucagccccagcuuaucaccaccucccuccca

SEQ ID NO: 294591 - RNA, 62 nt, Homo Sapiens
gccucagccccagccccagcccaccucccucccagccccagcuucugcagugguucuuauca

SEQ ID NO: 294592 - RNA, 62 nt, Homo Sapiens
ucccuugacccaccccagugagugccaaagggcagccccaacaugugcaccccugcauuucc

SEQ ID NO: 294593 - RNA, 62 nt, Homo Sapiens
gagggcagccugcuguacuggccaugcugggccagccccaccuggagcucaguaaaaacugc

SEQ ID NO: 294594 - RNA, 62 nt, Homo Sapiens
ugcuccccaccacccccauggcagucccuccgcagccccagucccuggccacgcccaaggga

SEQ ID NO: 294595 - RNA, 62 nt, Homo Sapiens
gaggccccugggcagcccagccaggggagccacagccccaaggauggucuugcucugggaau

SEQ ID NO: 294596 - RNA, 62 nt, Homo Sapiens
aggggugggugauuuagggacagccagggucccagccccaaugucagcaggauagggagagc

SEQ ID NO: 294597 - RNA, 62 nt, Homo Sapiens
aggccuggcccagcucccaguucccccugcaccagccccaccccuagagucccuucuauagg

SEQ ID NO: 294598 - RNA, 62 nt, Homo Sapiens
acagacccaaacuggggcugcacggguucugccagccccagcgggcagggaagcuucaugcc

SEQ ID NO: 294599 - RNA, 62 nt, Homo Sapiens
gaugaagcaagacaugugggcaaccagaagcccagccccaagaggguguggggaugccuugc

SEQ ID NO: 294600 - RNA, 62 nt, Homo Sapiens
gggcaagaccaaaguguggccagccccagccccagccccaguccugccaguuuccccagccu

SEQ ID NO: 294601 - RNA, 62 nt, Homo Sapiens
cccagugggcaagaccaaagcagccucagccccagccccagccuaccaccugccaguuuccc

SEQ ID NO: 294602 - RNA, 62 nt, Homo Sapiens
cccagccccagugggcaagauuuccccagccucagccccagcucccuccuaccaccugccag

SEQ ID NO: 294603 - RNA, 62 nt, Homo Sapiens
cucucagcaucugcugcccucaggccgaggcucagccccagacccugcccucaccccacugc

SEQ ID NO: 294604 - RNA, 62 nt, Homo Sapiens
acugccaccuuuacaccuacuggcccccagcccagccccagucagaguguggugcuagaaac

SEQ ID NO: 294605 - RNA, 62 nt, Homo Sapiens
agaggaauuuggggccuaggcugggcuugccacagccccaggggccaagggaggugccaaca

SEQ ID NO: 294606 - RNA, 62 nt, Homo Sapiens
gagggggugcccuccggccaccuguacuguaucagccccaagcagguggugaguugggguau

SEQ ID NO: 294607 - RNA, 62 nt, Homo Sapiens
ccucaccagcccugaggcuccgccccagcccucagccccaggccccagcuggagaaaaaaca

SEQ ID NO: 294608 - RNA, 62 nt, Homo Sapiens
cacccugagaccugguagcccuagcugccuugcagccccaaaccccaggacccuaucagccc

SEQ ID NO: 294609 - RNA, 62 nt, Homo Sapiens
cggcugcacuggccucuaggacucacagcagccagccccagcuaggaacgggcaggacuugg

SEQ ID NO: 294610 - RNA, 62 nt, Homo Sapiens
gccucccugugcaguccagcccugccuugcugcagccccagcccagauggcacucagcgcuc

SEQ ID NO: 294611 - RNA, 62 nt, Homo Sapiens
gagagggccuuuccuggcugaucagagcuuaccagccccaccccaccaugguagccuuaggg

SEQ ID NO: 294612 - RNA, 62 nt, Homo Sapiens
auauauauauauguggcucuagccucaggcuccagccccagugggguacuguacaguuaacu

SEQ ID NO: 294613 - RNA, 62 nt, Homo Sapiens
gacauuaagggacagcuaacuguggccagacucagccccauguccuuggccaggcccaagga

SEQ ID NO: 294614 - RNA, 62 nt, Homo Sapiens
cuugauauaccucgagcuuccccugugcuccccagccccaggaccacuggccccuuggccug

SEQ ID NO: 294615 - RNA, 62 nt, Homo Sapiens
ucugagccuugacgcaggccuccccacucauccagccccagaacacacagauggcagacguc

SEQ ID NO: 294616 - RNA, 62 nt, Homo Sapiens
cacagcauucccuaacauggcuggagcuccagcagccccaacaacagacgaccagaggagug

SEQ ID NO: 294617 - RNA, 62 nt, Homo Sapiens
gccucugccagauggcuuugcaggccccaacacagccccaugccagcagugccucuggagcc

SEQ ID NO: 294618 - RNA, 62 nt, Homo Sapiens
gugcucaggaggcagcaucugacacggcagaucagccccauauccaucgugcccugaggccu

SEQ ID NO: 294619 - RNA, 62 nt, Homo Sapiens
ccaagucuuccaggcaauaccuggcucaggcccagccccaauccauccccuuacuuucugcc

SEQ ID NO: 294620 - RNA, 62 nt, Homo Sapiens
ugcggagcuccccugcugguuggggcucagcgcagccccagggaggugcuuccugcaccuca

SEQ ID NO: 294621 - RNA, 62 nt, Homo Sapiens
cacugaggccccuacugaggccagccccgagccagccccagacccagccccgguggcugaag

SEQ ID NO: 294622 - RNA, 62 nt, Homo Sapiens
uguagccccgggcugacccagugugugcucagcagccccaccccacccugccccuuguccuc

SEQ ID NO: 294623 - RNA, 62 nt, Homo Sapiens
gaccuuuucugccuggagagaaacuuucagaccagccccacacaccacagccaggagaggcc

SEQ ID NO: 294624 - RNA, 62 nt, Homo Sapiens
gggccaggggagagagaagaggaucagcagugcagccccaggaugccucgcagguacccugc

SEQ ID NO: 294625 - RNA, 62 nt, Homo Sapiens
gacaagauaaacggagcugguggcgggagggacagccccagagcagacccuuccuauggcgg

SEQ ID NO: 294626 - RNA, 62 nt, Homo Sapiens
agugcugugacuucagcuaaugaucuuuucuucagccccacccccuccccacuagcucgauc

SEQ ID NO: 294627 - RNA, 62 nt, Homo Sapiens
ccucuguauucccagagugggaucggggcuuucagccccacccugaugccugcccuccagga

SEQ ID NO: 294628 - RNA, 62 nt, Homo Sapiens
cuuguggcuagaguacagugggguagacccuccagccccaauagcccuaguacccagcuggc

SEQ ID NO: 294629 - RNA, 62 nt, Homo Sapiens
auguggcccagagaaggaggcugggggaucaccagccccaaggucccgaagggcaggucaga

SEQ ID NO: 294630 - RNA, 62 nt, Homo Sapiens
uguugggagcagaggaguccuacuccuugccucagccccacacgguuccuuagcugccgugu

SEQ ID NO: 294631 - RNA, 62 nt, Homo Sapiens
uuggccccacccucuaccccauuccuuccugucagccccagucugucuuggcacuggccagg

SEQ ID NO: 294632 - RNA, 62 nt, Homo Sapiens
gguuuacagaaugaggcccuggcuccccaccacagccccagcugccucagagcaggcacagc

SEQ ID NO: 294633 - RNA, 62 nt, Homo Sapiens
ugccucagagcaggcacagcacaaggcaggcccagccccaugggccgucacaaaggcuugau

SEQ ID NO: 294634 - RNA, 62 nt, Homo Sapiens
gugaggcccuucuucagguuggggugugaggacagccccaucuucaucugcccugcacucac

SEQ ID NO: 294635 - RNA, 62 nt, Homo Sapiens
ccagcugccucuuucacacccacuacagaccucagccccaguuuucuccuccucacuaggcu

SEQ ID NO: 294636 - RNA, 62 nt, Homo Sapiens
ggggaccugggagaugauggcucauuuccacccagccccaggauuuccagagcgcacaucca

SEQ ID NO: 294637 - RNA, 62 nt, Homo Sapiens
caggcccucagcccgggcugugccagcccucccagccccaggcccaucugagggaccaagac

SEQ ID NO: 294638 - RNA, 62 nt, Homo Sapiens
gccagcggcuucccagcaccugggaggggcugcagccccagcuggacuccagccugucccuc

SEQ ID NO: 294639 - RNA, 62 nt, Homo Sapiens
agucccugcuccucuuagaaguggcuaccucucagccccaaucccugccuagugggguggua

SEQ ID NO: 294640 - RNA, 62 nt, Homo Sapiens
gggggaauuugucauggggagguaugaaaauacagccccaaaaguggcggcugaucuguaga

SEQ ID NO: 294641 - RNA, 62 nt, Homo Sapiens
acagaugucaccacagcccugcccuucaugcccagccccaugggacacccgguggucuuucc

SEQ ID NO: 294642 - RNA, 62 nt, Homo Sapiens
gcuugcccuggggcacugagacaguuguuuggcagccccagcccagccaggggcucauccuu

SEQ ID NO: 294643 - RNA, 62 nt, Homo Sapiens
gccuucucugaaagcaucuuugccucccugaacagccccacccuuguagagcaaaacucuuc

SEQ ID NO: 294644 - RNA, 62 nt, Homo Sapiens
gugaggggacagacucugcucucacuggcuggcagccccaggagccuguucccuugccucuc

SEQ ID NO: 294645 - RNA, 62 nt, Homo Sapiens
gcccuaacgggggugcggcauuuucggugggacagccccaggagcgggccucuucccucagu

SEQ ID NO: 294646 - RNA, 62 nt, Homo Sapiens
gcacccaggcuccauggggagggaggaugccacagccccacagagcaguggccgcaagcgca

SEQ ID NO: 294647 - RNA, 62 nt, Homo Sapiens
acauccuggaagaggagggggagucacugugccagccccaccaacccggccccuucccccag

SEQ ID NO: 294648 - RNA, 62 nt, Homo Sapiens
caaagacacuagugcacccccugcggugccuucagccccaacccugcuccacccgaccccac

SEQ ID NO: 294649 - RNA, 62 nt, Homo Sapiens
uggcccuuucuccagcaagcugaccuuguccccagccccaccacagcuggggaagaucuugc

SEQ ID NO: 294650 - RNA, 62 nt, Homo Sapiens
acaaauggaacucccgagggccucugucuaaccagccccagcgcacagcuuccugagucacc

SEQ ID NO: 294651 - RNA, 62 nt, Homo Sapiens
ugcucauuuacauuagugugugugcauucguucagccccaugguggugaauucuguuucuuu

SEQ ID NO: 294652 - RNA, 62 nt, Homo Sapiens
uuccccuuugcuaaagcaucucacucccagggcagccccagcacccuggcauugcgggaggu

SEQ ID NO: 294653 - RNA, 62 nt, Homo Sapiens
gggauaagaacagaggaggcagcagcauugcacagccccaggcacaguggcaguuaggaugg

SEQ ID NO: 294654 - RNA, 62 nt, Homo Sapiens
agaggcuuacgaaaaacuuugccucugaugcucagccccacccccaaauagcacacaagcuu

SEQ ID NO: 294655 - RNA, 62 nt, Homo Sapiens
caguugugaucaggcaggcugugcucucaggacagccccauuuuagggaugaggagacuuca

SEQ ID NO: 294656 - RNA, 62 nt, Homo Sapiens
ggcugggaguuagggagcccuggguuggaauccagccccaccucuuuuaugccacagguuug

SEQ ID NO: 294657 - RNA, 62 nt, Homo Sapiens
gccccagggcuggcccguuucucacggaggcccagccccaaacgcugaccgacugaccucuc

SEQ ID NO: 294658 - RNA, 62 nt, Homo Sapiens
ccccacaaagccuucuggaccuuacccugacacagccccagaccuccaccaaggcagcuuuc

SEQ ID NO: 294659 - RNA, 62 nt, Homo Sapiens
uugggaagucuccccgcuggagccggcucugccagccccagacagccugcccucccugccgg

SEQ ID NO: 294660 - RNA, 62 nt, Homo Sapiens
uuccccgggagaagcuuuccccucucugccuccagccccaccucuccccagaccacaggggg

SEQ ID NO: 294661 - RNA, 62 nt, Homo Sapiens
cuccaauaucacccugugagccucgcacagcucagccccaacacagaggugagaccaggaau

SEQ ID NO: 294662 - RNA, 62 nt, Homo Sapiens
aaugcccagcagcagcucuggaaggcagugcucagccccaucaccacugucccguggaugcc

SEQ ID NO: 294663 - RNA, 62 nt, Homo Sapiens
guggcccugucacccgugcugcacgggauucacagccccagccccauggccccucuccacac

SEQ ID NO: 294664 - RNA, 62 nt, Homo Sapiens
cugucacccgugcugcacgggauucacagccccagccccauggccccucuccacaccucaaa

SEQ ID NO: 294665 - RNA, 62 nt, Homo Sapiens
gcaggaaugccaagcaccuggccagagcagcccagccccaauaugcuuaggaggagacagag

SEQ ID NO: 294666 - RNA, 62 nt, Homo Sapiens
uggaagaguuaaaugcuguucagugaagauuucagccccaggccuuugcugcaagugacccu

SEQ ID NO: 294667 - RNA, 62 nt, Homo Sapiens
gcgcuuagggagaaaugaccgaccagcaagcccagccccaggccccgcaagcuggucccauc

SEQ ID NO: 294668 - RNA, 62 nt, Homo Sapiens
gcccugagagaugguguugcgcagaaagcccccagccccacaaaaucagcuuuaaggagcug

SEQ ID NO: 294669 - RNA, 62 nt, Homo Sapiens
aaugcagaaucccacuacccccccacaucucucagccccacuuauaauggggcuggaggggc

SEQ ID NO: 294670 - RNA, 62 nt, Homo Sapiens
caccuuccuuccucuucccuaguccauacuaccagccccacccccagguccugcagcaccuu

SEQ ID NO: 294671 - RNA, 62 nt, Homo Sapiens
caaagaaaggagaggcaggugcuccuguaccccagccccacucagcacugacaguccccagc

SEQ ID NO: 294672 - RNA, 62 nt, Homo Sapiens
agcugccaaacagcagccugccgggcagggagcagccccaggccagagaggccucccggucc

SEQ ID NO: 294673 - RNA, 62 nt, Homo Sapiens
ugcugccacagcccucccccggccccagauagcagccccagggaggaugcugccuccaagag

SEQ ID NO: 294674 - RNA, 62 nt, Homo Sapiens
guuuccuaugguuuacaaagagggccccagcccagccccaccacagaucccagagauagggg

SEQ ID NO: 294675 - RNA, 62 nt, Homo Sapiens
accucuacuggcaucagucuuugguuaccccccagccccaguaggaggagagcaggcagagc

SEQ ID NO: 294676 - RNA, 62 nt, Homo Sapiens
gguggcuuucccuaccugacacagccauggcccagccccaaggccaggcugucuacccuaug

SEQ ID NO: 294677 - RNA, 62 nt, Homo Sapiens
ggcggccucugggcuugggcaccagcucaugccagccccagagggucaggguuggaggccug

SEQ ID NO: 294678 - RNA, 62 nt, Homo Sapiens
uccauggugucaugccaagacaguaucagacacagccccagaagggggcauuaugggcccug

SEQ ID NO: 294679 - RNA, 62 nt, Homo Sapiens
cacgaccccaagcccgcggaggcgcccguccccagccccacgccugaccacaaggccaacug

SEQ ID NO: 294680 - RNA, 62 nt, Homo Sapiens
gcuuugacaaccaggcguucgcuccggagccccagccccaagucaagugcugcuguggcaaa

SEQ ID NO: 294681 - RNA, 62 nt, Homo Sapiens
accuuccuucugcuggugaacaggaguguccccagccccaugucgggcaaccucaccguggc

SEQ ID NO: 294682 - RNA, 62 nt, Homo Sapiens
ccucagacucgcuucccaucuagggagaaaagcagccccaggccaagcccuggggacaggug

SEQ ID NO: 294683 - RNA, 62 nt, Homo Sapiens
gacaaagggacacacagcccccagccugaguucagccccacgugggagcccccucccugcaa

SEQ ID NO: 294684 - RNA, 62 nt, Homo Sapiens
cacuggggagccuuucggauaagugucgcucacagccccauuuccgcccuccuuuguguauc

SEQ ID NO: 294685 - RNA, 62 nt, Homo Sapiens
cgcaagccaggcugggccugcacugaccagcccagccccaucgcccguacuguggggauccu

SEQ ID NO: 294686 - RNA, 62 nt, Homo Sapiens
cuccagggccacggcggagucgagcugggagccagccccaggcuccagggagggcuggacgg

SEQ ID NO: 294687 - RNA, 62 nt, Homo Sapiens
uggggcgcucagccuggccccucgggcacagacagccccaccugaaaggggccugggggcau

SEQ ID NO: 294688 - RNA, 62 nt, Homo Sapiens
uuggcugcugagccaggagcacuucuccaucgcagccccacccaccgucccugcccagcccc

SEQ ID NO: 294689 - RNA, 62 nt, Homo Sapiens
ucuccaucgcagccccaccuaccgucccugcccagccccacuaccccagugcugcucuaagc

SEQ ID NO: 294690 - RNA, 62 nt, Homo Sapiens
agauaguggaagagucaggacagguuggucuccagccccacuucccaaauaugccucagccc

SEQ ID NO: 294691 - RNA, 62 nt, Homo Sapiens
uuggucuccagccccacuucccaaauaugccucagccccacuagcuggcaccaacuuaauuc

SEQ ID NO: 294692 - RNA, 62 nt, Homo Sapiens
ccuccccacccuuccuacucgcuguuccuucccagccccaucugggaagggagacgaggugu

SEQ ID NO: 294693 - RNA, 62 nt, Homo Sapiens
uggaaggagucccugcucuguagcugccaggccagccccaucgggggaggaggcaaucgcug

SEQ ID NO: 294694 - RNA, 62 nt, Homo Sapiens
gagcuucccugcuauaaacacccucacaccaccagccccaggcuggcauccaggcagggaca

SEQ ID NO: 294695 - RNA, 62 nt, Homo Sapiens
agguccacuccugguuccuguucauaauccuccagccccagccugagcucccugcuuccuau

SEQ ID NO: 294696 - RNA, 62 nt, Homo Sapiens
gucacuguccagcccccaccgaagucacaucccagccccagacaccugggggggcccagcac

SEQ ID NO: 294697 - RNA, 62 nt, Homo Sapiens
agcuggauucucaggcuggggaaggucaagggcagccccagccccccuguuugagguucuga

SEQ ID NO: 294698 - RNA, 62 nt, Homo Sapiens
cacccagcaaucaagccagacaucuucccgcucagccccagaauacuccaaacuuucgcagc

SEQ ID NO: 294699 - RNA, 62 nt, Homo Sapiens
ccacccucggcucugcagccuuacuugaccugcagccccagccacugcagccaaaggugcaa

SEQ ID NO: 294700 - RNA, 62 nt, Homo Sapiens
gaaccuuuuguaaaaguugguggcagcagaggcagccccaggccgggcugcaucucucugug

SEQ ID NO: 294701 - RNA, 62 nt, Homo Sapiens
acgagggcagugcaagggagaaccugccagcccagccccaccacagggagagugcgucagca

SEQ ID NO: 294702 - RNA, 62 nt, Homo Sapiens
guuagauuuuaugcuugggcucccuccaccgccagccccagacagagcccccucccucaccu

SEQ ID NO: 294703 - RNA, 62 nt, Homo Sapiens
uccuugggcgccagggucccuccgccucccugcagccccaucaacgccuggaacgcucuccg

SEQ ID NO: 294704 - RNA, 62 nt, Homo Sapiens
uggugcugcucagccuucucacaacccgcggccagccccacgcuccaggcgugcucaugccc

SEQ ID NO: 294705 - RNA, 62 nt, Homo Sapiens
gccucuccaggcgugcucauagagcuugucaccagccccauggaccuuggggucuucuggcc

SEQ ID NO: 294706 - RNA, 62 nt, Homo Sapiens
uucacacuggugaagucuguguacccauacugcagccccaucccauggggccccugaagacc

SEQ ID NO: 294707 - RNA, 62 nt, Homo Sapiens
aaggaggaagggagacugggcccacugauuuccagccccaccaugugugcuguuuucagaug

SEQ ID NO: 294708 - RNA, 62 nt, Homo Sapiens
gcacagcagaucaugcggcuuuuuccccacgacagccccacgcaagaagaggcuggggaggg

SEQ ID NO: 294709 - RNA, 62 nt, Homo Sapiens
gacugggggcgauucuguguaggcagcagccucagccccaggcuuggcccagaaggagccag

SEQ ID NO: 294710 - RNA, 62 nt, Homo Sapiens
agccacggccaggccagagggagugacagaggcagccccauucugccugcccaggccccugc

SEQ ID NO: 294711 - RNA, 62 nt, Homo Sapiens
cagugggagcugccuguucagcuccagcucaccagccccagugcccacaggaucagucugau

SEQ ID NO: 294712 - RNA, 62 nt, Homo Sapiens
agggacagaggggguggccucccaacucaccccagccccaaaacucuccucugcugcuggcu

SEQ ID NO: 294713 - RNA, 62 nt, Homo Sapiens
uggcugguuagagguucccuuugacgccaucccagccccaaugaacaauuauuuauuaaaug

SEQ ID NO: 294714 - RNA, 62 nt, Homo Sapiens
gucaccccggccaccugcggugcuaucucccccagccccauccucuguacagagcccacgcc

SEQ ID NO: 294715 - RNA, 62 nt, Homo Sapiens
cacaccaaccugugagccccgagccccacucccagccccacuccccacucacuccauccugu

SEQ ID NO: 294716 - RNA, 62 nt, Homo Sapiens
cccaccauccugugagccccgagccccacucccagccccacuccccacucccaccauccugu

SEQ ID NO: 294717 - RNA, 62 nt, Homo Sapiens
cccaccauccugugagccccgagccccacuuccagccccacuccccacucccaccauccugu

SEQ ID NO: 294718 - RNA, 62 nt, Homo Sapiens
cccaccauccugugagccccgagucccacucccagccccacuccccauucacuccauccugu

SEQ ID NO: 294719 - RNA, 62 nt, Homo Sapiens
cacuccauccugugagucccuaagacuaugcccagccccauugccccacucacuccaucuug

SEQ ID NO: 294720 - RNA, 62 nt, Homo Sapiens
cccaccauccugugagcccagagucccacucccagccccacuccccacucacuccauccugu

SEQ ID NO: 294721 - RNA, 62 nt, Homo Sapiens
cacuccauccugugagucccuaagacugugcccagccccacugccccacucccaccaucuug

SEQ ID NO: 294722 - RNA, 62 nt, Homo Sapiens
ccucccuggucuugaaagaaccugcccucuuccagccccaccuuuugaacccugcucuaucc

SEQ ID NO: 294723 - RNA, 62 nt, Homo Sapiens
cagcucaacccaguccugcugggcuuggggcacagccccaguugugugaaccaaagcgucag

SEQ ID NO: 294724 - RNA, 62 nt, Homo Sapiens
cgaaaacugccaggaugaaugaggaaaaaacccagccccacaaacgagacacacgcuggcgg

SEQ ID NO: 294725 - RNA, 62 nt, Homo Sapiens
cccuggagaccuccaggcuuuccugcccugggcagccccaccucacagccagagucaaugcc

SEQ ID NO: 294726 - RNA, 50 nt, Homo Sapiens; identical to SEQ ID NO: 245579

SEQ ID NO: 294727 - RNA, 62 nt, Homo Sapiens
aggacuaagguggcuuucccacuccuggcccacagccccagagagccugucugugcauccug

SEQ ID NO: 294728 - RNA, 62 nt, Homo Sapiens
ugaggauaagcccacuuuccugucauuaguggcagccccagauccagaccuaggccuccugg

SEQ ID NO: 294729 - RNA, 62 nt, Homo Sapiens
gccagguguugacaccuuaaagcuggcgcccccagccccacucuuggcugugcuggccaggu

SEQ ID NO: 294730 - RNA, 62 nt, Homo Sapiens
cugucucucugagggaaucagaguccagcauccagccccagcuggaacagcugaagucacaa

SEQ ID NO: 294731 - RNA, 62 nt, Homo Sapiens
acaggaaagggucacguggucccauguugcaacagccccaacaucacgcaugucauucacug

SEQ ID NO: 294732 - RNA, 62 nt, Homo Sapiens
acacaagcucucagccacaggcagcuucuccacagccccagcuucgcacaggcuccuggagg

SEQ ID NO: 294733 - RNA, 62 nt, Homo Sapiens
cucgcugaggcaacgugagacagggagccccacagccccaaggcaccuucgcgucucagccu

SEQ ID NO: 294734 - RNA, 62 nt, Homo Sapiens
cucaccaccgcaucccaccuaagccggcugcccagccccagccuuuugugccaccuuguaca

SEQ ID NO: 294735 - RNA, 62 nt, Homo Sapiens
ccucugcugaccugcugaccgcagccccagcccagccccacugcccugggagaaucgcuccu

SEQ ID NO: 294736 - RNA, 62 nt, Homo Sapiens
ccagccccacuccucugcuggaaucgcuccugcagccccagcuggcucuccuggcccuggga

SEQ ID NO: 294737 - RNA, 62 nt, Homo Sapiens
accaucguucugaauucugaucccagcacccccagccccacgagccaaccaugcccagcccc

SEQ ID NO: 294738 - RNA, 62 nt, Homo Sapiens
cuggaaggaccagguucuuuagcucgagccaccagccccagcacugaagccccagugugcgc

SEQ ID NO: 294739 - RNA, 62 nt, Homo Sapiens
aaccggcuaaaggacccugcuccgcgucuucccagccccagauacacacaguguuucauugc

SEQ ID NO: 294740 - RNA, 62 nt, Homo Sapiens
uuguacacacaguguuucaugccuccucuccccagccccaccggcccaggaccagaaucgcu

SEQ ID NO: 294741 - RNA, 62 nt, Homo Sapiens
ugccaucagauucaagcccaccacauggccaccagccccagcuccaaggcuugccccagagg

SEQ ID NO: 294742 - RNA, 62 nt, Homo Sapiens
ugucccuccccucaugagcgugcaacagggagcagccccagccagccccaccgccgccgucu

SEQ ID NO: 294743 - RNA, 62 nt, Homo Sapiens
cucaugagcgugcaacagggagcagccccagccagccccaccgccgccgucugcguggaugg

SEQ ID NO: 294744 - RNA, 62 nt, Homo Sapiens
uuucuuguuuuggugccugaccgaaccaacgacagccccaaucuucccgucuuuaugagaga

SEQ ID NO: 294745 - RNA, 62 nt, Homo Sapiens
ccuucuccuuugaggggggagagagaacagugcagccccauuuccgguccugcuaccucacc

SEQ ID NO: 294746 - RNA, 62 nt, Homo Sapiens
cugagacgcaugagugccuucuggggugagagcagccccaggguuuaaguugggcguccuag

SEQ ID NO: 294747 - RNA, 62 nt, Homo Sapiens
aaugagggcuuugcagggauuguuuucauucucagccccagcugugggagugcggguggggg

SEQ ID NO: 294748 - RNA, 62 nt, Homo Sapiens
ggguuggguggauggagcucagaaggaaaccccagccccaccacggaugacaccaucccucc

SEQ ID NO: 294749 - RNA, 62 nt, Homo Sapiens
cuccauccccaacccauccucauccccaacuacagccccaaacccagccccagacuaaucca

SEQ ID NO: 294750 - RNA, 62 nt, Homo Sapiens
cccauccucauccccaacuacagccccaaacccagccccagacuaauccacagccaucccca

SEQ ID NO: 294751 - RNA, 62 nt, Homo Sapiens
agccauccccaacucauccucauccccaacugcagccccaaacccaacccagggccaucccc

SEQ ID NO: 294752 - RNA, 62 nt, Homo Sapiens
cccuggccacauccccauccucccccaaccuccagccccaacacccaucaucccccugagcu

SEQ ID NO: 294753 - RNA, 62 nt, Homo Sapiens
ugggugguggcuuauaacuguaagggagauggcagccccaggguacagccagcaggcauuga

SEQ ID NO: 294754 - RNA, 62 nt, Homo Sapiens
ccaggagagggcuggagggagggagauggucucagccccacagaguuuggaguccucagugu

SEQ ID NO: 294755 - RNA, 62 nt, Homo Sapiens
cuccuuucccguccacuuguggcccaaaggcccagccccacaggcccagggugggguggaug

SEQ ID NO: 294756 - RNA, 62 nt, Homo Sapiens
gacgacgcgagggccccacgagacagcacaggcagccccacgagagagaaggggcccaagag

SEQ ID NO: 294757 - RNA, 62 nt, Homo Sapiens
cugcagggcugaaguucacucaucgaccgacucagccccaaccgggagccaggcagaaaaac

SEQ ID NO: 294758 - RNA, 62 nt, Homo Sapiens
augucaggcacuucccucuaacuggcaugcaacagccccaccugccugagagcccugaggug

SEQ ID NO: 294759 - RNA, 62 nt, Homo Sapiens
ccccagccucugccacccuccaccuccucggucagccccagccccagguugauaaaucuauu

SEQ ID NO: 294760 - RNA, 62 nt, Homo Sapiens
ccucugccacccuccaccuccucggucagccccagccccagguugauaaaucuauugauuga

SEQ ID NO: 294761 - RNA, 62 nt, Homo Sapiens
uucccuccugagugccccacuucuggccacaucagccccacaggacuuugaugaagaccauu

SEQ ID NO: 294762 - RNA, 62 nt, Homo Sapiens
ugacuaacuaugcaauaauccacccccaggugcagccccagggccugcggaggcgguggcag

SEQ ID NO: 294763 - RNA, 62 nt, Homo Sapiens
aggagcagccagcugggauguccccaccaagacagccccagacccacugccccaucucccuc

SEQ ID NO: 294764 - RNA, 62 nt, Homo Sapiens
acccuucccacuuggcacccagguucccaagccagccccaacuguuggaagggcagcgggua

SEQ ID NO: 294765 - RNA, 62 nt, Homo Sapiens
cucauccacaggguuuucucacugcuaugaaccagccccacagccccaggccccugucaccu

SEQ ID NO: 294766 - RNA, 62 nt, Homo Sapiens
caggguuuucucacugcuaugaaccagccccacagccccaggccccugucaccuggcuaugc

SEQ ID NO: 294767 - RNA, 62 nt, Homo Sapiens
gagggccgggugguggcucugaggaugguccccagccccacccuguccccacccuggccugu

SEQ ID NO: 294768 - RNA, 62 nt, Homo Sapiens
ccuguacuaccuccugggccaagaaacuggcacagccccacacugucagugccaagaggcug

SEQ ID NO: 294769 - RNA, 62 nt, Homo Sapiens
accacgugggggucagucgggggcaaggggcucagccccacuggacucugggcugcagaggc

SEQ ID NO: 294770 - RNA, 62 nt, Homo Sapiens
gccaggguccccuuggugaacagggggugggccagccccagguugaagugaaggaacagagg

SEQ ID NO: 294771 - RNA, 62 nt, Homo Sapiens
ucagucuccaggacauuccuccaugccuggcccagccccaccuagcgguuugaauguugguu

SEQ ID NO: 294772 - RNA, 62 nt, Homo Sapiens
ugagugcucuccggggaugcccgagcaugguccagccccauuggacagagccucagggagcc

SEQ ID NO: 294773 - RNA, 62 nt, Homo Sapiens
ccugcccucggccugguccaugagcagcugcccagccccaggggcacccccauugguucgug

SEQ ID NO: 294774 - RNA, 62 nt, Homo Sapiens
ggaccgacuccaggaguccccuuucccugucccagccccaucuguggguugcacuuacaaac

SEQ ID NO: 294775 - RNA, 62 nt, Homo Sapiens
uauuaaggagguccaaggggugagucccaacccagccccagaauauauuuguuuuugcaccu

SEQ ID NO: 294776 - RNA, 62 nt, Homo Sapiens
cucaccucugguagccauagcagccccugcuucagccccaccgcaccccuccagggggccug

SEQ ID NO: 294777 - RNA, 62 nt, Homo Sapiens
agucuguuguguggaugugcgugugugguccccagccccagacuggauuggaaaagugcaug

SEQ ID NO: 294778 - RNA, 62 nt, Homo Sapiens
acuggggcuucaggccagaggccaccuacauccagccccaaaccuugaaccuaggaccaaga

SEQ ID NO: 294779 - RNA, 62 nt, Homo Sapiens
cuaagauaucccucacaccccuacccccacgccagccccaaaacaggacaucugugaccgcc

SEQ ID NO: 294780 - RNA, 62 nt, Homo Sapiens
uugucaccugcuucucugccugggacagggagcagccccaaacgaagcaugaacagugcacc

SEQ ID NO: 294781 - RNA, 62 nt, Homo Sapiens
cuguuuugagcccugaggagugcugccaguaccagccccacccugccugcccuuuguccucc

SEQ ID NO: 294782 - RNA, 62 nt, Homo Sapiens
ccaaaacuggcaaggacgcucuggccccacaccagccccaauccacccgugguggcucaagu

SEQ ID NO: 294783 - RNA, 62 nt, Homo Sapiens
accugagcugguuuagcgcaaugugccugcaccagccccaacucugucuucuucuacacggc

SEQ ID NO: 294784 - RNA, 62 nt, Homo Sapiens
gccuacccgacucgguuucuuggauauucaaccagccccacccaccuguccauacccgaggg

SEQ ID NO: 294785 - RNA, 64 nt, Homo Sapiens
ccauggggaaacccuggagccaucccuucggagccaacaagaccgccccagggcuauagcagaa

SEQ ID NO: 294786 - RNA, 64 nt, Homo Sapiens
gacucaccaacuugccacauguucuagguuucagcaacaagacugccaggugguuggguucugc

SEQ ID NO: 294787 - RNA, 64 nt, Homo Sapiens
aaaaugaugcuuuccgcacagugucuguugagugcaacaagagcaaaacaaaaagacagugugu

SEQ ID NO: 294788 - RNA, 64 nt, Homo Sapiens
aacaacaacaauaacaacaaaaacaacaacaauacaacaagaaccucuguacaaaaacaaaaca

SEQ ID NO: 294789 - RNA, 64 nt, Homo Sapiens
guuuggaagaaaucugguuuggggaacaaacagacaacaagaagguggaagauaaacagugacg

SEQ ID NO: 294790 - RNA, 64 nt, Homo Sapiens
accuugaucuuggcgaaagccaaucccaaacuaccaacaagaggaaggaggaucgggucauaag

SEQ ID NO: 294791 - RNA, 64 nt, Homo Sapiens
gggcaguuucagucauagcucagaucuuauccugcaacaagaaguccucaccagacagaaagcc

SEQ ID NO: 294792 - RNA, 64 nt, Homo Sapiens
cugcgaagaagacaugauaaggacaucagggagccaacaagacuccuaauagccucacuacauu

SEQ ID NO: 294793 - RNA, 64 nt, Homo Sapiens
agcaagcaaacaaauccauaacaaccacaacaagcaacaagaacaagaacaacaacaagaagaa

SEQ ID NO: 294794 - RNA, 64 nt, Homo Sapiens
uaacaaccacaacaagcaacaagaacaagaacaacaacaagaagaaguugcaguauggauaucu

SEQ ID NO: 294795 - RNA, 64 nt, Homo Sapiens
cuuuaacaaagcagaaugauucuucuaaguuuggcaacaagaaggcuuggaucugagucuucua

SEQ ID NO: 294796 - RNA, 64 nt, Homo Sapiens
auggcuaugaugucagacaguggaugggcuccagcaacaagagacaaaauaacuaaaggccuuu

SEQ ID NO: 294797 - RNA, 64 nt, Homo Sapiens
ugacucauacugugaugauauuccagaugucugccaacaagaaacugcuuguaagucacagguu

SEQ ID NO: 294798 - RNA, 64 nt, Homo Sapiens
auucuugaaagagcaaagguaccuagcaugaugccaacaagacuacauauuacucuuuuuagca

SEQ ID NO: 294799 - RNA, 64 nt, Homo Sapiens
ucuagcucaacuuacugaagaaaaccacuaauaacaacaagaauaucaggaaggaacuuuucaa

SEQ ID NO: 294800 - RNA, 64 nt, Homo Sapiens
gggagaaauaaggcacaugacugcuucuugcagucaacaagaaauaccaauaacacacacagaa

SEQ ID NO: 294801 - RNA, 64 nt, Homo Sapiens
guucuaacaauucuagugugaucuauaagaacagcaacaagagauauguguauauuucuaaugg

SEQ ID NO: 294802 - RNA, 64 nt, Homo Sapiens
ucauuuccccauugguuggacacuaauuugugaacaacaagaaaccacuggcaucaccugaugc

SEQ ID NO: 294803 - RNA, 64 nt, Homo Sapiens
caaaccaaccccaggcccacccagagcgagcaaacgcugagaccugaaaggacauggaugagaa

SEQ ID NO: 294804 - RNA, 64 nt, Homo Sapiens
ugauacugcagugacugccgucagcuccgacugccgcugagaaggguugauccugcaucugggu

SEQ ID NO: 294805 - RNA, 64 nt, Homo Sapiens
ucuaauccuuaacuccaggauuagcucccaagugcgcugagacccagccagcacacuucuggcc

SEQ ID NO: 294806 - RNA, 64 nt, Homo Sapiens
augcaaauauuuguugugacggucccgcagcugccgcugagaaauggcgugucggagccaccca

SEQ ID NO: 294807 - RNA, 64 nt, Homo Sapiens
cuuccaucuaaaaaacccucaucccaaggcgaagcgcugagauuagcuuugcuuuucuccccau

SEQ ID NO: 294808 - RNA, 64 nt, Homo Sapiens
gcaggcauugcaggcgggaaccccuucuccgagacgcugagagaugacgaugagugugugaucc

SEQ ID NO: 294809 - RNA, 64 nt, Homo Sapiens
gcgcggggagaccggagccgauaaacuuugacgacgcugagagcuccaggacgcuccguggaua

SEQ ID NO: 294810 - RNA, 64 nt, Homo Sapiens
ugccuguucccagggcugccgaaugcuuaggacacgcugagagacuaguugugauuugcuauuu

SEQ ID NO: 294811 - RNA, 64 nt, Homo Sapiens
gccucuccccugcagcaaacguucucuccccugccgcugagaggucugcacugcccuagcagag

SEQ ID NO: 294812 - RNA, 64 nt, Homo Sapiens
ugggacaguuuccugggauguccacagccaggaccgcugagaacagcgaccauuucagauaccg

SEQ ID NO: 294813 - RNA, 64 nt, Homo Sapiens
auccccuaacaacaugguagggcaaagccuacaacgcugagacauugaugggauuuuaaauuca

SEQ ID NO: 294814 - RNA, 64 nt, Homo Sapiens
augccaauguuucauccaccccacugggagucaucgcugagaagggugccaaguccaaggccuc

SEQ ID NO: 294815 - RNA, 64 nt, Homo Sapiens
ugcccacaacaccaguauuucacaacuuccuggucgcugagaauauuuauucaaaaacagggau

SEQ ID NO: 294816 - RNA, 64 nt, Homo Sapiens
uggcauugcacugcuuauaucuuuugcauuuugccgcugagauacaagagggaacaaaacuguu

SEQ ID NO: 294817 - RNA, 64 nt, Homo Sapiens
cugccuccgcaccugaccgcugaauguuccccaccgcugagaggcagccugccagcaguuacug

SEQ ID NO: 294818 - RNA, 64 nt, Homo Sapiens
gccccucucgccuaaguauuugggaauaguucuccgcugagauauccacagccugcucacuucg

SEQ ID NO: 294819 - RNA, 64 nt, Homo Sapiens
uuugagaggcaccucagaguuuccuucuuuaccccgcugagacagugggagagccugaagcaga

SEQ ID NO: 294820 - RNA, 64 nt, Homo Sapiens
gguggcacaugccuguggccccagccacucugaacgcugagaugggaaggucacuugagcccag

SEQ ID NO: 294821 - RNA, 64 nt, Homo Sapiens
uggaugaaacaccaaagucugaugcugauaagcgcgcugagaggugcagcaccggccgucacag

SEQ ID NO: 294822 - RNA, 64 nt, Homo Sapiens
guaccugaaacugccgccacaugcacuccuccaccgcugagaguugaauagcuuuucuucugca

SEQ ID NO: 294823 - RNA, 64 nt, Homo Sapiens
agcuaagccugcuggggcugggugaagaaauuggcgcugagauccaggcuggauccauugcuuu

SEQ ID NO: 294824 - RNA, 64 nt, Homo Sapiens
acuguucacgccagagugcuaggcagagggagagcgcugagaagucagcaucaggaaaggagaa

SEQ ID NO: 294825 - RNA, 64 nt, Homo Sapiens
accauauguucaugacgagaaugucuucuuguugcgcugagaacacucuucaguucaagaagag

SEQ ID NO: 294826 - RNA, 64 nt, Homo Sapiens
gggggagcgaggcugacaaugacuccuguuuucacgcugagagaccccacuccccugcugagau

SEQ ID NO: 294827 - RNA, 64 nt, Homo Sapiens
uggucugucucgcuuuaucugucgccccucccagcgcugagagccuccccuggcugucagcagc

SEQ ID NO: 294828 - RNA, 64 nt, Homo Sapiens
aucacaauuuugguucagccucagaucaaaguugcgcugagagcgaugcccaccugucaagagu

SEQ ID NO: 294829 - RNA, 64 nt, Homo Sapiens
augacgacaacgugcaacagcaguuaggaaacgacgcugagagggauucucuccaacaaagguc

SEQ ID NO: 294830 - RNA, 64 nt, Homo Sapiens
ugacccucacaucucccuucuuaaagaacgccaccgcugagaacgcagucaggcugcguccccu

SEQ ID NO: 294831 - RNA, 64 nt, Homo Sapiens
caguguccaagcugcggccaagcugccccucagccgcugagaucucugcccgugggcgccccac

SEQ ID NO: 294832 - RNA, 64 nt, Homo Sapiens
gaaacacaacucagggcuuuugugaagguucccccgcugagaucuuuccuccugguuacuguga

SEQ ID NO: 294833 - RNA, 64 nt, Homo Sapiens
gugcuuggaacauacuguucacucacucuaaaggcgcugagacugugcuguuguucucguuuuu

SEQ ID NO: 294834 - RNA, 64 nt, Homo Sapiens
gccucccaggaccuggugugggaugggagaacuccgcugagacccugcaggaacacgaaacaga

SEQ ID NO: 294835 - RNA, 64 nt, Homo Sapiens
caacagccucaugugcacuugaccugacagugcucgcugagaacucucaccagguuggcgccug

SEQ ID NO: 294836 - RNA, 64 nt, Homo Sapiens
ggcaaggaacuuuccccagaucaaauucuauuaacgcugagauacaagucauccaugcacagcc

SEQ ID NO: 294837 - RNA, 64 nt, Homo Sapiens
aagcaguaggucugugcucucccugucucuaggucgcugagagaggugcuuuucuucauaaaac

SEQ ID NO: 294838 - RNA, 64 nt, Homo Sapiens
gagccagcuugggggucaggauaguacaccuuagcgcugagacugucuuuguccggacccuucc

SEQ ID NO: 294839 - RNA, 64 nt, Homo Sapiens
gaaccaucauaccccaagccgcaugaggaccugacgcugagagacgaggaaggagccaggcccg

SEQ ID NO: 294840 - RNA, 64 nt, Homo Sapiens
gaagagcgggcugaggaaacccagagggaccaagcgcugagaccaaaguugacccucggguagg

SEQ ID NO: 294841 - RNA, 64 nt, Homo Sapiens
ggauguccucaugaacauccucucaggugguuugcgcugagaaucuccucuacuuuaacugugc

SEQ ID NO: 294842 - RNA, 64 nt, Homo Sapiens
ccaguggcuucuccuuucugucaagacuuagccccgcugagaugcccuucugcuccagcuugcu

SEQ ID NO: 294843 - RNA, 64 nt, Homo Sapiens
guugccugguuacccaggaacccugacucccaggcgcugagauuggccagaguggagugcgcag

SEQ ID NO: 294844 - RNA, 64 nt, Homo Sapiens
uggguccaagcagaguugauuguugcucuccuggcgcugagagggcugcccgcguguccagccc

SEQ ID NO: 294845 - RNA, 64 nt, Homo Sapiens
ucaggugugauccgcccgccuccgccuccccaagcgcugagauuacaggugugagccaccgugc

SEQ ID NO: 294846 - RNA, 64 nt, Homo Sapiens
acucucuagggacaccuguaccagccccaccuggcgcugagaucccucagacagcauggcccag

SEQ ID NO: 294847 - RNA, 64 nt, Homo Sapiens
gaguguauugcuaacccuuccaggucuaguccagcgcugagauuuggugguucugcauguguga

SEQ ID NO: 294848 - RNA, 64 nt, Homo Sapiens
cuuguuguugaacauggcuaaauacaauggguaucgcugagacuaaguuguagaaauuaacaaa

SEQ ID NO: 294849 - RNA, 64 nt, Homo Sapiens
caaccucccaggacuguguucuuucuggaguuuucgcugagaacaaaacaguguugucuggacc

SEQ ID NO: 294850 - RNA, 64 nt, Homo Sapiens
cauacagaaauucucaggaucuucuguuuacuaucgcugagaucauuaucagaaaauagucugg

SEQ ID NO: 294851 - RNA, 64 nt, Homo Sapiens
guuugggggugggugggcggccggggccgcaggacgcugagacgccagcucgcccucccccuac

SEQ ID NO: 294852 - RNA, 64 nt, Homo Sapiens
ucgcagguucauuaaagaagucagcaagagaaagcgcugagagccaaggcuuuaaagccacauu

SEQ ID NO: 294853 - RNA, 64 nt, Homo Sapiens
cacuuucaucggcaauaaaaccagcuccccuucccgcugagagccuuccugcuucauccccuuu

SEQ ID NO: 294854 - RNA, 64 nt, Homo Sapiens
ugcuguuucugcugggggcaaaagcacauguagccgcugagaccuugucccccagccaagcucu

SEQ ID NO: 294855 - RNA, 64 nt, Homo Sapiens
ggcaccagcuccuuggacccgucccuggaaggggcgcugagaaaugccagcccgucucugugca

SEQ ID NO: 294856 - RNA, 64 nt, Homo Sapiens
acuugagccucaaggauguagguccccaagucaccgcugagagcccaucaccucaaagccagag

SEQ ID NO: 294857 - RNA, 64 nt, Homo Sapiens
cugugauccuguuccucaacaagcaagaucugcucgcugagaaaguccuugcugggaaaucgaa

SEQ ID NO: 294858 - RNA, 64 nt, Homo Sapiens
cccccaccccagguuuccccuggagggagcacgccgcugagaugccuggccugggggagaaugc

SEQ ID NO: 294859 - RNA, 64 nt, Homo Sapiens
ccuggaggaauacacaauuccuuccccuccacuccgcugagaauccugcccuccccuccccucc

SEQ ID NO: 294860 - RNA, 64 nt, Homo Sapiens
ccacgccgccucucacugccaggccagcggcuuccgcugagacucgcuggagaggcggcucccg

SEQ ID NO: 294861 - RNA, 64 nt, Homo Sapiens
ucgugccagagcgguggccacagggcugaauggucgcugagacagagauggaagccaggacaag

SEQ ID NO: 294862 - RNA, 64 nt, Homo Sapiens
ucucgauuucucucucucccccucagcaucuucccgcugagagugguggggaagagccuugucu

SEQ ID NO: 294863 - RNA, 64 nt, Homo Sapiens
cuucugcugagagcucugcccagggaggaggcgccgcugagaccagagaggcuucuauccuucc

SEQ ID NO: 294864 - RNA, 64 nt, Homo Sapiens
gcacuacuugagagagcaguaauucuagucuucacgcugagagagugauauauggguuuuaaca

SEQ ID NO: 294865 - RNA, 64 nt, Homo Sapiens
aguuuuuuuuaaaaccguggagguugcccacgggccucggcaccuggcccuggcagcacagcuc

SEQ ID NO: 294866 - RNA, 64 nt, Homo Sapiens
agugggacaaaaagaauuuagaccccaaaaguguccucggcauggaucuugaacagaaccagua

SEQ ID NO: 294867 - RNA, 64 nt, Homo Sapiens
guugcccuggaucucagaauauauucguccacccccucggcaccccauuaccccgagucccacc

SEQ ID NO: 294868 - RNA, 64 nt, Homo Sapiens
accccgagcguuccaccacacuguccgcccuuggccucggcacacgcucaccuuuucuguuggu

SEQ ID NO: 294869 - RNA, 64 nt, Homo Sapiens
cuggacacacugcccagcacgcaccagagcgugaccucggcaggggcgccacugagggcaccgc

SEQ ID NO: 294870 - RNA, 64 nt, Homo Sapiens
agucccacuccuccuggggugaaguuggggucagccucggcaggcaucagaacuuggcagccuu

SEQ ID NO: 294871 - RNA, 64 nt, Homo Sapiens
ugguuccuguccuguuuucuaaggcccgccucggccucggcagccccccaagucucuucugugc

SEQ ID NO: 294872 - RNA, 64 nt, Homo Sapiens
gaggaaaggcaguauggcggaggccaugggggccccucggcauucacacacagccuggccuccc

SEQ ID NO: 294873 - RNA, 64 nt, Homo Sapiens
auggcagaggguacggaguccuaaaaggagacucccucggcaagaauaacccuuugauuguuuu

SEQ ID NO: 294874 - RNA, 64 nt, Homo Sapiens
agucuaagaugagagccuguucaaaauauccacaccucggcaacaauugucuccccaagacagc

SEQ ID NO: 294875 - RNA, 64 nt, Homo Sapiens
cugggugggaaaggguugaugcuccucccucuacccucggcaccucagagcacuucauccacuu

SEQ ID NO: 294876 - RNA, 64 nt, Homo Sapiens
ugacgcagaaccccaacuguaggccugugaguugccucggcauaggacgcccggggucucccac

SEQ ID NO: 294877 - RNA, 64 nt, Homo Sapiens
acauguaggagacuguucaaaugguuacacauguccucggcaucagauuccuagagacguuaug

SEQ ID NO: 294878 - RNA, 64 nt, Homo Sapiens
uuuacuacuaaaauguaaaaaauuaaugugcucaccucggcagcacauauacuaaaaauuaaua

SEQ ID NO: 294879 - RNA, 64 nt, Homo Sapiens
gacacccggguucugaaaaugugcuguguuccuaccucggcaagaucaccagcacugaggggcc

SEQ ID NO: 294880 - RNA, 64 nt, Homo Sapiens
uacuguagucacucaguauuauguacuuaucuuaccucggcauggucagugauauucucccaga

SEQ ID NO: 294881 - RNA, 64 nt, Homo Sapiens
ccaauuuggggaagaagcaaaaauauugucuuagccucggcaaacuuaauuuguacacacuuuu

SEQ ID NO: 294882 - RNA, 64 nt, Homo Sapiens
aggcagcugugcagcuucacauaggucgcuggggccucggcaguuacgauuccaacccgucagc

SEQ ID NO: 294883 - RNA, 64 nt, Homo Sapiens
aucaccgucauugauggagccugaaccgugugcuccucggcagaugcuguuguuguuacuuccc

SEQ ID NO: 294884 - RNA, 64 nt, Homo Sapiens
uaaguucugaguccccggccagggucccuuaacaccucggcacagaggcuguuggcaaguguag

SEQ ID NO: 294885 - RNA, 64 nt, Homo Sapiens
aaccaccucaccagaaccauuggagcaccuguggccucggcacacugcuuaucacuugaaaaau

SEQ ID NO: 294886 - RNA, 64 nt, Homo Sapiens
ugccgugugaggggcuuaaugucauugcugcaaaccucggcaggucauuccagaaguauuaaac

SEQ ID NO: 294887 - RNA, 64 nt, Homo Sapiens
accccuggguuguugcaggucagcagccuggaagccucggcaggacccuggcaucugacacuga

SEQ ID NO: 294888 - RNA, 64 nt, Homo Sapiens
ugaaaagaagcucgcuccagaugucugcauggguccucggcacucuuggcugaggacucaaagg

SEQ ID NO: 294889 - RNA, 64 nt, Homo Sapiens
gcugccacgggcucuccugguagagguccuggcgccucggcacauagcuugggaagcuuccgcu

SEQ ID NO: 294890 - RNA, 64 nt, Homo Sapiens
gacacaacacugccccagaggucagucuguccauccucggcaagcuucaggaccguggggccug

SEQ ID NO: 294891 - RNA, 64 nt, Homo Sapiens
gguuuggggcucagagucgagggacgggguguagccucggcauuugcuugaguuucuccacucu

SEQ ID NO: 294892 - RNA, 64 nt, Homo Sapiens
gaagacacuguccccagcuaccagcuacgccaaaccucggcauuuuuuguguuauuuucugacu

SEQ ID NO: 294893 - RNA, 64 nt, Homo Sapiens
caaagggcccagggacccuguugcgcugcccuggccucggcauucgaggcuccccuagggccgu

SEQ ID NO: 294894 - RNA, 64 nt, Homo Sapiens
uuuugauugaaauauuuaguuguuaggcugaaagccucggcaguuaagaacuugccugaguuuu

SEQ ID NO: 294895 - RNA, 64 nt, Homo Sapiens
gugagccuggcuucagugucuccaagaacuguaaccucggcaagugccagaugucucuaagugg

SEQ ID NO: 294896 - RNA, 64 nt, Homo Sapiens
uccagcuguacauaaccacguccucgccacugcaccucggcauaugccaccuccaugccacugc

SEQ ID NO: 294897 - RNA, 60 nt, Homo Sapiens
accaguggcuucgugaagcccagccgagaaccucggcaucggucaguggcuagacuguag

SEQ ID NO: 294898 - RNA, 64 nt, Homo Sapiens
ccgucccagccaugcaguggggccccuggggugcccucggcagcuucgguccagccugcaucug

SEQ ID NO: 294899 - RNA, 64 nt, Homo Sapiens
ugcugcugccagccccuggcugggcagaaagugcccucggcaugggcaccuggguguggggugg

SEQ ID NO: 294900 - RNA, 64 nt, Homo Sapiens
cuucucccuccccucccaccugacuucaucuacgccucggcaccacggggugugggaccccagc

SEQ ID NO: 294901 - RNA, 51 nt, Homo Sapiens
uccacagacaaggccuccaggccucggcauuccaucuacagcaagugcuga

SEQ ID NO: 294902 - RNA, 64 nt, Homo Sapiens
cuugauuggguuuugcacuaccgcgguugccucuccucggcaccuccugagugcccaucccacc

SEQ ID NO: 294903 - RNA, 64 nt, Homo Sapiens
uucagguguagcuguggggcccccaggccccacuccucggcaguuugaacuggucccacacgca

SEQ ID NO: 294904 - RNA, 64 nt, Homo Sapiens
gcguuggaucuacuggaaugagcagcagccgcuuccucggcagccuugggaagcacgggcgacu

SEQ ID NO: 294905 - RNA, 64 nt, Homo Sapiens
gacccccuucugguccgccccaagcccagcccagccucggcauagcuccccccagacuggagag

SEQ ID NO: 294906 - RNA, 64 nt, Homo Sapiens
cauaggagcgaacacugcugcgggaagcugcucgccucggcagcugacuucaccucauggagcc

SEQ ID NO: 294907 - RNA, 64 nt, Homo Sapiens
gcggacggacacaccucaugucugugcacuggauccucggcauaccuaacucauguucugaccc

SEQ ID NO: 294908 - RNA, 64 nt, Homo Sapiens
aagacguuuccacaccucuucuaccuccucugucccucggcagacaauucuuagaggggcaguu

SEQ ID NO: 294909 - RNA, 64 nt, Homo Sapiens
ugcagccggggugucugguaaaggugagugaggcccucggcagcccgagaggccggcggcccug

SEQ ID NO: 294910 - RNA, 64 nt, Homo Sapiens
cauggcuggugccugaagacguccugacagcacuccucggcagggccuagcacggacauggucu

SEQ ID NO: 294911 - RNA, 64 nt, Homo Sapiens
uccccaggcucauuugagcacucagcucccugucccucggcacugaaccccacagcaugccugu

SEQ ID NO: 294912 - RNA, 64 nt, Homo Sapiens
uaaggauggaaggcuguccaaguuauuuggaaggccucggcagcuugggauuagcuugggagcg

SEQ ID NO: 294913 - RNA, 64 nt, Homo Sapiens
cguccagcuuugacagucaguuuugaugucagcuccucggcaggguaggccugaugacagcccu

SEQ ID NO: 294914 - RNA, 64 nt, Homo Sapiens
aaacagugucacacacgcaugaggagggacagguccucggcaauugagugccaaaagcuugggg

SEQ ID NO: 294915 - RNA, 64 nt, Homo Sapiens
gacaccccugucuccaggagggggcccagacccaccucggcacgcagccacccucuggcucagc

SEQ ID NO: 294916 - RNA, 64 nt, Homo Sapiens
aguggucacgcuucauccacggcuccuucccaccccucggcaguggcugugcaauguuuuaagu

SEQ ID NO: 294917 - RNA, 64 nt, Homo Sapiens
ucccuccaggcugucugggcgcacauacguggguccucggcagcgaagccuggcuucucuguga

SEQ ID NO: 294918 - RNA, 64 nt, Homo Sapiens
acaccauggagaucggggccgauaggcgcgggagccucggcaugcauaaagucaccuaggugag

SEQ ID NO: 294919 - RNA, 64 nt, Homo Sapiens
cacugugccccacaaaacuuucccgggggccccaccucggcacacccaccucuggguccuuggc

SEQ ID NO: 294920 - RNA, 64 nt, Homo Sapiens
auggcaaaaucuugucucuugaguuugagaccagccucggcaacggaggaucaguugaggucag

SEQ ID NO: 294921 - RNA, 64 nt, Homo Sapiens
cucugcagcgaccccuccuagacgcucccuggccccucggcacccagaaugccacauucuugug

SEQ ID NO: 294922 - RNA, 64 nt, Homo Sapiens
uguagucuuuucuugaaacaucuugauugcuuuuccucggcagcuuucaaaaaaccaaauaaua

SEQ ID NO: 294923 - RNA, 64 nt, Homo Sapiens
caggaagacuuuccuucacccaccaucccccuaaccucggcagggcuucuguccuguggaguuc

SEQ ID NO: 294924 - RNA, 64 nt, Homo Sapiens
uacggcccggcccccacgcgcccugcucucacggccucggcacaggcagcggcugcacguguuc

SEQ ID NO: 294925 - RNA, 64 nt, Homo Sapiens
ucuccaaaacguucuucccagacugcgaggaccgccucggcagguggcgguaaaagcgccccca

SEQ ID NO: 294926 - RNA, 64 nt, Homo Sapiens
agggccccgggacagaguuuucccagaccuggcuccucggcagagcugccucccgucagggccc

SEQ ID NO: 294927 - RNA, 64 nt, Homo Sapiens
ggaaagcggugaggacgcagagugcaggcuguggccucggcaucccgcaggaggucccuagaac

SEQ ID NO: 294928 - RNA, 64 nt, Homo Sapiens
acaagaaggccagcccacugggcccuggggcugcccucggcaaccguggggaggccauuugcug

SEQ ID NO: 294929 - RNA, 64 nt, Homo Sapiens
caggcauaucagcuuucacacugucccagcagucccucggcacaucuccugcuaccucccacca

SEQ ID NO: 294930 - RNA, 64 nt, Homo Sapiens
acucucugucuucucuccaccaggaagaccaaggccucggcagaggaaggcaagauuggaaaga

SEQ ID NO: 294931 - RNA, 64 nt, Homo Sapiens
uugagauggaagagcagccuccuccagcuugaggccucggcaucaguuauuagguuugaagcaa

SEQ ID NO: 294932 - RNA, 64 nt, Homo Sapiens
ucaggccaccuccugguccagucaccaccugcagccucggcagggcagguacaggggccaccuc

SEQ ID NO: 294933 - RNA, 64 nt, Homo Sapiens
aacccggcugccugccuuuuuuucugauccagacccucggcaccugcuacuuaccaacuggaaa

SEQ ID NO: 294934 - RNA, 64 nt, Homo Sapiens
ggaggaucgcuugagcccaggagucugagaccagccucggcaacaugccaagaccccgucucua

SEQ ID NO: 294935 - RNA, 64 nt, Homo Sapiens
aauuggcacagccauacggcacugaacaaggaagccucggcagauguggcugaaccgagcugga

SEQ ID NO: 294936 - RNA, 64 nt, Homo Sapiens
gacugugaucgaggcgugagccaccccucuccugccucggcagggauggcccccaaccccccac

SEQ ID NO: 294937 - RNA, 64 nt, Homo Sapiens
ccaccucccacccuccuccucuucaaccagauauccucggcaaccuuugucuugacccccaagu

SEQ ID NO: 294938 - RNA, 64 nt, Homo Sapiens
accccagucucagcagccucgcugaaccccacuuccucggcaggggcugguguccucccuccag

SEQ ID NO: 294939 - RNA, 64 nt, Homo Sapiens
agcgggaggcagaggaaggccucuccaucucucuccucggcagcuugccggcauagccccgguc

SEQ ID NO: 294940 - RNA, 64 nt, Homo Sapiens
gccgcgucacuucucugauuugcacacacguauaccucggcauggaacccuauguguccauuuc

SEQ ID NO: 294941 - RNA, 64 nt, Homo Sapiens
uuguccccccagcuucgguaacccacacaagcccccucggcagucugccugcuggggaggaggg

SEQ ID NO: 294942 - RNA, 64 nt, Homo Sapiens
ggagucccagcagcgagcuggucuggcgagggcaccucggcagcccccacggguuggcuccuac

SEQ ID NO: 294943 - RNA, 64 nt, Homo Sapiens
acuuccuccgugcaguggcccugccacagcccucccucggcacacuuugacccuuuguaggauu

SEQ ID NO: 294944 - RNA, 64 nt, Homo Sapiens
agcagacagcgagacccccagcggcagaggccucccucggcacuccaggcuuauaauuucgaac

SEQ ID NO: 294945 - RNA, 64 nt, Homo Sapiens
caucuuggagaugagggugccuguccuggacagaccucggcaugccuucuguuucuccuucaau

SEQ ID NO: 294946 - RNA, 64 nt, Homo Sapiens
agugcuggucacaccccugugugauaugugaugcccucggcaaagaaucuacuggaauagauuc

SEQ ID NO: 294947 - RNA, 53 nt, Homo Sapiens
gcgugacaugaucuucguaacggccucggcacgcuccacaccccuggagucuc

SEQ ID NO: 294948 - RNA, 64 nt, Homo Sapiens
uccggaaggacacagucagggcccucucugcaguccucggcagcuccuagaggggacaagccag

SEQ ID NO: 294949 - RNA, 64 nt, Homo Sapiens
ccauugcuccccgaaacuggcguaccccagugcgccucggcacaggagcgagcggggaacgcga

SEQ ID NO: 294950 - RNA, 64 nt, Homo Sapiens
caccaauccuuggugcugcccauaucccucacccccucggcaaguuggcaccaucucaccaccg

SEQ ID NO: 294951 - RNA, 64 nt, Homo Sapiens; identical to SEQ ID NO: 213292

SEQ ID NO: 294952 - RNA, 64 nt, Homo Sapiens; identical to SEQ ID NO: 213293

SEQ ID NO: 294953 - RNA, 64 nt, Homo Sapiens; identical to SEQ ID NO: 213294

SEQ ID NO: 294954 - RNA, 64 nt, Homo Sapiens; identical to SEQ ID NO: 213295

SEQ ID NO: 294955 - RNA, 64 nt, Homo Sapiens
agccccuggcagugguggggaauguugacugaguguucagcagaguuuauuuuuccauacuaua

SEQ ID NO: 294956 - RNA, 64 nt, Homo Sapiens
ugccuuauguccucugaguuguagaguuguaaaaguucagcagugugugcacagcuuucuuuug

SEQ ID NO: 294957 - RNA, 64 nt, Homo Sapiens
aaggaauauucuuucaauuccuucgcagcucuuuguucagcaauucagaauguuagugaauaua

SEQ ID NO: 294958 - RNA, 64 nt, Homo Sapiens
uacuucaguaggauacauagucagguuuaccucuguucagcagaccugggacaguuagaaucuu

SEQ ID NO: 294959 - RNA, 64 nt, Homo Sapiens
augagggaauuagacaauggaagucgagcacuggggaaagcaggcauucugcguggggaagagc

SEQ ID NO: 294960 - RNA, 64 nt, Homo Sapiens
gagguuggaaagagaagagaggcugggagcggauggaaagcaugacugcaucuggagccccugg

SEQ ID NO: 294961 - RNA, 64 nt, Homo Sapiens
ggaagaacaaccuucucaaccaaaacugcaaucaggaaagcagcagcccacuccuucccaugga

SEQ ID NO: 294962 - RNA, 64 nt, Homo Sapiens
gaagaagccugagauuugauccuugacaauuucuggaaagcacuggucagucacacuguccugg

SEQ ID NO: 294963 - RNA, 64 nt, Homo Sapiens
gaggccgccugucuacucaccacugugccuuucuggaaagcaggaguucaagccuuagcaagcc

SEQ ID NO: 294964 - RNA, 64 nt, Homo Sapiens
ggcugcagagcaaaagaaacagacacuguuggugggaaagcaaacuuguucagccacuauggaa

SEQ ID NO: 294965 - RNA, 64 nt, Homo Sapiens
uguuggugggaaagcaaacuuguucagccacuauggaaagcaguuuggagauuucuccaagaac

SEQ ID NO: 294966 - RNA, 64 nt, Homo Sapiens
uucagaaaugaauuauuuucccuuuacaagugaaggaaagcaaccauagugggaggagaucaga

SEQ ID NO: 294967 - RNA, 64 nt, Homo Sapiens
acauaugcaauuauauuuauggauuuuaauuuauggaaagcacauugguuugagaugcauuuga

SEQ ID NO: 294968 - RNA, 64 nt, Homo Sapiens
gguucaagucccucuuaacaagaacuccaaagcuggaaagcaggagggaacaaaggugaacaug

SEQ ID NO: 294969 - RNA, 64 nt, Homo Sapiens
cacagcuugcugagggcugcucuucuugggccagggaaagcagggcagccgggaccugcggcug

SEQ ID NO: 294970 - RNA, 64 nt, Homo Sapiens
cuguccaggcugggcuuggucucaggccagggcgggaaagcaggagauccaggacugagccagc

SEQ ID NO: 294971 - RNA, 64 nt, Homo Sapiens
acuggggagagauccaggacuagaggcaccagugggaaagcaggcagacuccacacuggggucu

SEQ ID NO: 294972 - RNA, 64 nt, Homo Sapiens
ggaugaucccugccugugagguccaggccuuggaggaaagcagagucuucccuugguccuucug

SEQ ID NO: 294973 - RNA, 64 nt, Homo Sapiens
aucagugccuggaaggcagggcagagcaagagggggaaagcaggcaagccaggcacagugagug

SEQ ID NO: 294974 - RNA, 64 nt, Homo Sapiens
ucuugccccuccuccucuggggugcacucuucauggaaagcaaccuggagcugccuucucauca

SEQ ID NO: 294975 - RNA, 64 nt, Homo Sapiens
agaggagaggcgcccuaagaauguaagcauugugggaaagcauucauaucugccaagaucguuu

SEQ ID NO: 294976 - RNA, 64 nt, Homo Sapiens
acgagagagaauccguaugaauguaaggauugugggaaagcauucagcuugcuuaauugcuuuc

SEQ ID NO: 294977 - RNA, 64 nt, Homo Sapiens
cauuaauuuuauuuuaccugauguguggaaugugggaaagcauuauuggaaagauacucuauaa

SEQ ID NO: 294978 - RNA, 64 nt, Homo Sapiens
cucuuggcucacuugccuucauguaaggaaugcaggaaagcauuacuggagagaagccguauga

SEQ ID NO: 294979 - RNA, 64 nt, Homo Sapiens
ugguuguuuccaguaccuuuauguaaauaaugugggaaagcauuaugggagagaagccauauga

SEQ ID NO: 294980 - RNA, 64 nt, Homo Sapiens
ugaucaucugggaagcuuccauguaagcaaugugggaaagcauuagugcagagaaaccccauga

SEQ ID NO: 294981 - RNA, 64 nt, Homo Sapiens
uuucuggcccaguuuauuucauguaaguugugugggaaagcauucauggagauggaccuuauaa

SEQ ID NO: 294982 - RNA, 64 nt, Homo Sapiens
uuuaaaaugauaauuuuccuucuucaaaugacauggaaagcaaaacuuucuuuuuuaaaaauuu

SEQ ID NO: 294983 - RNA, 64 nt, Homo Sapiens
uuucugucugauuuuaauugcugucuaaugacggggaaagcacgaugaaaagauguacaauccu

SEQ ID NO: 294984 - RNA, 64 nt, Homo Sapiens
uguuguucugccuguccuagucuccuuugaagugggaaagcauuuucucucauaggcaagucac

SEQ ID NO: 294985 - RNA, 64 nt, Homo Sapiens
aguugacucagagugcaagaagucuggccauuuuggaaagcaagguuuccuuucagcccugucu

SEQ ID NO: 294986 - RNA, 64 nt, Homo Sapiens
aaucagagaaggaacauaccaguauccuguuugaggaaagcaagaggauggucuuacagcaggc

SEQ ID NO: 294987 - RNA, 64 nt, Homo Sapiens
uuucaaggaaguagaaacaauuaaaaauuaaauuggaaagcagguccacugugcagguucccac

SEQ ID NO: 294988 - RNA, 64 nt, Homo Sapiens
aagcagccuccacuuuggaucaggaaauaguaaaggaaagcaguguuggggguagcggcaugca

SEQ ID NO: 294989 - RNA, 64 nt, Homo Sapiens
uccuugucaguuguaacauucuauuucaacuucaggaaagcagcaguuuucuuuuaauuuuucc

SEQ ID NO: 294990 - RNA, 64 nt, Homo Sapiens; identical to SEQ ID NO: 113583

SEQ ID NO: 294991 - RNA, 64 nt, Homo Sapiens; identical to SEQ ID NO: 113584

SEQ ID NO: 294992 - RNA, 64 nt, Homo Sapiens; identical to SEQ ID NO: 113585

SEQ ID NO: 294993 - RNA, 64 nt, Homo Sapiens; identical to SEQ ID NO: 113586

SEQ ID NO: 294994 - RNA, 64 nt, Homo Sapiens; identical to SEQ ID NO: 113587

SEQ ID NO: 294995 - RNA, 64 nt, Homo Sapiens; identical to SEQ ID NO: 113588

SEQ ID NO: 294996 - RNA, 64 nt, Homo Sapiens; identical to SEQ ID NO: 113589

SEQ ID NO: 294997 - RNA, 64 nt, Homo Sapiens; identical to SEQ ID NO: 113590

SEQ ID NO: 294998 - RNA, 64 nt, Homo Sapiens; identical to SEQ ID NO: 113591

SEQ ID NO: 294999 - RNA, 64 nt, Homo Sapiens; identical to SEQ ID NO: 113592

SEQ ID NO: 295000 - RNA, 64 nt, Homo Sapiens; identical to SEQ ID NO: 113593

SEQ ID NO: 295001 - RNA, 64 nt, Homo Sapiens; identical to SEQ ID NO: 113594

SEQ ID NO: 295002 - RNA, 64 nt, Homo Sapiens; identical to SEQ ID NO: 113595

SEQ ID NO: 295003 - RNA, 64 nt, Homo Sapiens; identical to SEQ ID NO: 113596

SEQ ID NO: 295004 - RNA, 64 nt, Homo Sapiens; identical to SEQ ID NO: 113597

SEQ ID NO: 295005 - RNA, 64 nt, Homo Sapiens; identical to SEQ ID NO: 113598

SEQ ID NO: 295006 - RNA, 64 nt, Homo Sapiens; identical to SEQ ID NO: 113599

SEQ ID NO: 295007 - RNA, 64 nt, Homo Sapiens; identical to SEQ ID NO: 113600

SEQ ID NO: 295008 - RNA, 64 nt, Homo Sapiens; identical to SEQ ID NO: 113601

SEQ ID NO: 295009 - RNA, 64 nt, Homo Sapiens; identical to SEQ ID NO: 113602

SEQ ID NO: 295010 - RNA, 64 nt, Homo Sapiens; identical to SEQ ID NO: 113603

SEQ ID NO: 295011 - RNA, 64 nt, Homo Sapiens; identical to SEQ ID NO: 113604

SEQ ID NO: 295012 - RNA, 64 nt, Homo Sapiens; identical to SEQ ID NO: 113605

SEQ ID NO: 295013 - RNA, 64 nt, Homo Sapiens; identical to SEQ ID NO: 113606

SEQ ID NO: 295014 - RNA, 64 nt, Homo Sapiens; identical to SEQ ID NO: 113607

SEQ ID NO: 295015 - RNA, 64 nt, Homo Sapiens; identical to SEQ ID NO: 113608

SEQ ID NO: 295016 - RNA, 64 nt, Homo Sapiens; identical to SEQ ID NO: 113609

SEQ ID NO: 295017 - RNA, 64 nt, Homo Sapiens; identical to SEQ ID NO: 113610

SEQ ID NO: 295018 - RNA, 64 nt, Homo Sapiens; identical to SEQ ID NO: 113611

SEQ ID NO: 295019 - RNA, 64 nt, Homo Sapiens; identical to SEQ ID NO: 113612

SEQ ID NO: 295020 - RNA, 64 nt, Homo Sapiens; identical to SEQ ID NO: 113613

SEQ ID NO: 295021 - RNA, 64 nt, Homo Sapiens; identical to SEQ ID NO: 113614

SEQ ID NO: 295022 - RNA, 64 nt, Homo Sapiens; identical to SEQ ID NO: 113615

SEQ ID NO: 295023 - RNA, 64 nt, Homo Sapiens; identical to SEQ ID NO: 113616

SEQ ID NO: 295024 - RNA, 64 nt, Homo Sapiens; identical to SEQ ID NO: 113617

SEQ ID NO: 295025 - RNA, 64 nt, Homo Sapiens; identical to SEQ ID NO: 113618

SEQ ID NO: 295026 - RNA, 64 nt, Homo Sapiens; identical to SEQ ID NO: 113619

SEQ ID NO: 295027 - RNA, 64 nt, Homo Sapiens; identical to SEQ ID NO: 113620

SEQ ID NO: 295028 - RNA, 64 nt, Homo Sapiens; identical to SEQ ID NO: 113621

SEQ ID NO: 295029 - RNA, 64 nt, Homo Sapiens; identical to SEQ ID NO: 113622

SEQ ID NO: 295030 - RNA, 64 nt, Homo Sapiens; identical to SEQ ID NO: 113623

SEQ ID NO: 295031 - RNA, 64 nt, Homo Sapiens; identical to SEQ ID NO: 113624

SEQ ID NO: 295032 - RNA, 64 nt, Homo Sapiens; identical to SEQ ID NO: 113625

SEQ ID NO: 295033 - RNA, 64 nt, Homo Sapiens; identical to SEQ ID NO: 113626

SEQ ID NO: 295034 - RNA, 64 nt, Homo Sapiens; identical to SEQ ID NO: 113627

SEQ ID NO: 295035 - RNA, 64 nt, Homo Sapiens; identical to SEQ ID NO: 113628

SEQ ID NO: 295036 - RNA, 64 nt, Homo Sapiens; identical to SEQ ID NO: 113629

SEQ ID NO: 295037 - RNA, 64 nt, Homo Sapiens; identical to SEQ ID NO: 113630

SEQ ID NO: 295038 - RNA, 64 nt, Homo Sapiens; identical to SEQ ID NO: 113631

SEQ ID NO: 295039 - RNA, 64 nt, Homo Sapiens; identical to SEQ ID NO: 113632

SEQ ID NO: 295040 - RNA, 64 nt, Homo Sapiens; identical to SEQ ID NO: 113633

SEQ ID NO: 295041 - RNA, 64 nt, Homo Sapiens; identical to SEQ ID NO: 113634

SEQ ID NO: 295042 - RNA, 64 nt, Homo Sapiens; identical to SEQ ID NO: 113635

SEQ ID NO: 295043 - RNA, 64 nt, Homo Sapiens; identical to SEQ ID NO: 113636

SEQ ID NO: 295044 - RNA, 64 nt, Homo Sapiens; identical to SEQ ID NO: 113637

SEQ ID NO: 295045 - RNA, 64 nt, Homo Sapiens; identical to SEQ ID NO: 113638

SEQ ID NO: 295046 - RNA, 64 nt, Homo Sapiens
uaugucuccacugccaaguagaagugacucaaaacccucugacaaggauauucccuuggcuaug

SEQ ID NO: 295047 - RNA, 64 nt, Homo Sapiens
ccgcucacugccaccuguggacacucugugucuacccucugagugggaacauacuucuaaguuc

SEQ ID NO: 295048 - RNA, 64 nt, Homo Sapiens
uugcccucuuugagcuauuuggcuacuucccugucccucugacuccuacugucccaauuuucuc

SEQ ID NO: 295049 - RNA, 64 nt, Homo Sapiens
cuccccccaacgcaaggaggaugcccaauuguugcccucugaaaaugcacaguucuccuggccc

SEQ ID NO: 295050 - RNA, 64 nt, Homo Sapiens
uuuuuuuuuuuuugaaauuugccgagcaguggagcccucugacaauuugcaaggcccucugaga

SEQ ID NO: 295051 - RNA, 64 nt, Homo Sapiens
gccgagcaguggagcccucugacaauuugcaaggcccucugagaaaggaagcugcuuagagcca

SEQ ID NO: 295052 - RNA, 64 nt, Homo Sapiens
cgucuuugcucauggacuugccaaaccugcccaccccucugaguaugcuccuguucuggugaua

SEQ ID NO: 295053 - RNA, 64 nt, Homo Sapiens
augagggccacagagaaggucucgggaacucugccccucugacacagucccagaggacacaucc

SEQ ID NO: 295054 - RNA, 64 nt, Homo Sapiens
guaggcagagccuuuggaugaccagaacaagguucccucugagaauuccaaggaguuccaugaa

SEQ ID NO: 295055 - RNA, 64 nt, Homo Sapiens
acugcgaucuucagagcagggguccuuggugugacccucugaaugguccaggguugaucacacu

SEQ ID NO: 295056 - RNA, 64 nt, Homo Sapiens
gggccuuagucucccaaauccaccaugcaucugccccucugagggugucuucacuuugucucug

SEQ ID NO: 295057 - RNA, 64 nt, Homo Sapiens
uagagcagcugauaaguuucccuaccugauggcccccucugacauaaacugcacaccuggggug

SEQ ID NO: 295058 - RNA, 64 nt, Homo Sapiens
agccccgugcccugacccggggaccacagggacacccucugagacgugcuggccccaggaggau

SEQ ID NO: 295059 - RNA, 64 nt, Homo Sapiens
uaucugcugacgggaacaagucauucugaaaggucccucugacccaggucaccaaauuugggcc

SEQ ID NO: 295060 - RNA, 64 nt, Homo Sapiens
ugggcgcuagcaagggcaaaaguacauuccuuuucccucugaccgguggugagggaaggguacg

SEQ ID NO: 295061 - RNA, 64 nt, Homo Sapiens
aaaugccugagugcuggggccacccaccacccuucccucugaacuagggagcuguguuguuucc

SEQ ID NO: 295062 - RNA, 64 nt, Homo Sapiens
uugcuauucuauuggaguagccucccuaggcagucccucugaagccuuggagugcagguaaaug

SEQ ID NO: 295063 - RNA, 64 nt, Homo Sapiens
guccaagaccugggucaguucuuugcuggugguccccucugaccacaagcuucugccugaagau

SEQ ID NO: 295064 - RNA, 64 nt, Homo Sapiens
cuaagaauucucucuucugguuccuucuacuccucccucugacuauagcuuuuuaaauaucuuu

SEQ ID NO: 295065 - RNA, 64 nt, Homo Sapiens
uccuucugcuaugacaaaacgagacggggcaucucccucugauuaacucaacuucuuuccucug

SEQ ID NO: 295066 - RNA, 64 nt, Homo Sapiens
ucugcucaucucuuccgugagauuugcucccagacccucugaucucccuccaacaaacccuggc

SEQ ID NO: 295067 - RNA, 64 nt, Homo Sapiens
aguggccuuguuaauuccaaguggcauguaucuucccucugagcuucauuucuucaagaugcuc

SEQ ID NO: 295068 - RNA, 64 nt, Homo Sapiens
gguuuuggucaaaauggguguaaugacagcaucucccucugaagucuugaagagguacccauca

SEQ ID NO: 295069 - RNA, 64 nt, Homo Sapiens
uauguuucgcagaaaagugucagccagcuccgugcccucugaauugcuggaccuccucucagca

SEQ ID NO: 295070 - RNA, 64 nt, Homo Sapiens
ccaacuucucuuucacccucuugaucucugaauccccucugacuccucugaccccaacuucucu

SEQ ID NO: 295071 - RNA, 64 nt, Homo Sapiens
ugcacuucaccgcugaccuuuauguuugaccccucccucugagcuagaccuauaaguucugguu

SEQ ID NO: 295072 - RNA, 64 nt, Homo Sapiens
acuuugaagcacuuuugcauccuuucaucuuuagcccucugaguagugugcuggcauuucucac

SEQ ID NO: 295073 - RNA, 64 nt, Homo Sapiens
uguuguucuuggcacauguuggcaccuucaggcccccucugacucuuugagggaaacuguggaa

SEQ ID NO: 295074 - RNA, 64 nt, Homo Sapiens
gguagguuuggaggucugccaguuacaccaaguccccucugagauucgaucaggggacuggaua

SEQ ID NO: 295075 - RNA, 64 nt, Homo Sapiens
uagacaccagcccccugcauccuucaguagaccucccucugaacaccacagccagguccugccu

SEQ ID NO: 295076 - RNA, 64 nt, Homo Sapiens
uguuuuacuuuccuguaacuuaagcacacaugaucccucugaauagaccgcaugaagauacuug

SEQ ID NO: 295077 - RNA, 64 nt, Homo Sapiens
uuggccuucggugaggaauuuaaccccuccacuccccucugagacuuggccgaagcauagauug

SEQ ID NO: 295078 - RNA, 64 nt, Homo Sapiens
aaagaguguggcugcuggacucuuuucgaaaugccccucugagucaggagccugguggggacaa

SEQ ID NO: 295079 - RNA, 64 nt, Homo Sapiens
agggcgggaggcaugcaagccagugggggaaaaccccucugaagcugggcagcccucuaccugg

SEQ ID NO: 295080 - RNA, 64 nt, Homo Sapiens
auuggaauccauuggcuugacaugcaccacgauacccucugauuagcuccaguuugacauuauu

SEQ ID NO: 295081 - RNA, 64 nt, Homo Sapiens
cuggaaacugucgacggccacgcaguaauaucuucccucugauguucgagagaagcugcccauc

SEQ ID NO: 295082 - RNA, 64 nt, Homo Sapiens
uauuucauuuugguaguggaucauacaguuuucucccucugauuuuuccucauuucauugccuc

SEQ ID NO: 295083 - RNA, 64 nt, Homo Sapiens
cugacacaauuaaggaugaaguggcugcaaauuucccucugaagaccucaugcaaaauauuggu

SEQ ID NO: 295084 - RNA, 64 nt, Homo Sapiens
uggcuccuucccagucaagggauagaaaauucaccccucugaaccuuugcuauugauguagugu

SEQ ID NO: 295085 - RNA, 64 nt, Homo Sapiens
cacuggaagagcuaguaaauuugaaacccuguaucccucugaaaaucccauucauguuagaucg

SEQ ID NO: 295086 - RNA, 64 nt, Homo Sapiens
gugaaaaaugucccuuuuauuuuggcuuugguugugauuucagagcauaaugcuauguuuuuuu

SEQ ID NO: 295087 - RNA, 64 nt, Homo Sapiens
cuuguacauuauacugauuaagucaggauuaauuugauuucaaagcugagaacagugguaaaaa

SEQ ID NO: 295088 - RNA, 64 nt, Homo Sapiens
agguuucacaauuccccaaguaugucagagcuagugauuucaaaucucaagucugguaaucuuc

SEQ ID NO: 295089 - RNA, 64 nt, Homo Sapiens
cgauccacccaccucgacuuuggucucaaacuccugauuucaaguuucaccauguuggccaggc

SEQ ID NO: 295090 - RNA, 64 nt, Homo Sapiens
aauacagggcauuuugguccgggauaaguaaguuugauuucauuaauagcagacaguguuuucu

SEQ ID NO: 295091 - RNA, 64 nt, Homo Sapiens
ucaacuguuugccuucuacugaccuaggauuucaugauuucauuaguugaaacaagaagccaca

SEQ ID NO: 295092 - RNA, 64 nt, Homo Sapiens
accaggaacuguauuacaguagaucacucuuggcugauuucagccugguuaaauaaaaaauuag

SEQ ID NO: 295093 - RNA, 64 nt, Homo Sapiens
augggauuaagaacuauauccuauuugguuuuaaugauuucaccaaacaccaauacaacuaauc

SEQ ID NO: 295094 - RNA, 64 nt, Homo Sapiens
guuaaguauuugcuacuuuaaauuguuuuacaacugauuucagcacauucuauccuuuuuuuuu

SEQ ID NO: 295095 - RNA, 64 nt, Homo Sapiens
aaaacaaauaauuucccuuggguuggaggggaagugauuucauaaauuaauuagaaagccaucu

SEQ ID NO: 295096 - RNA, 64 nt, Homo Sapiens
gaggggugaggaauggauacugucuaacagucucugauuucaacacuaacauuccaucuucuga

SEQ ID NO: 295097 - RNA, 64 nt, Homo Sapiens
ccaauuucugugguguaaauacucccaccaugguugauuucaagccaccagugguuuaauaacc

SEQ ID NO: 295098 - RNA, 64 nt, Homo Sapiens
agaauguguuuguguagaugccaagcauuuucugugauuucagguuuuuuccuuuuuuuacauu

SEQ ID NO: 295099 - RNA, 64 nt, Homo Sapiens
auuaauucuaaccaguuguuugcuuuuaaaugagugauuucauuuugggaaacagguuucaaau

SEQ ID NO: 295100 - RNA, 64 nt, Homo Sapiens
auucccaacgccaggacccacaucccuuugguauugauuucacagucagcugcucaacggaaug

SEQ ID NO: 295101 - RNA, 64 nt, Homo Sapiens
cucugaagacccaaagaugacauuacuaaugaugugauuucaggagccacagaagaaccuuacc

SEQ ID NO: 295102 - RNA, 64 nt, Homo Sapiens
uuauuaggcuaaaaggguaacuuuugaaaaucugugauuucauuuuuagaaaaguuagcacaug

SEQ ID NO: 295103 - RNA, 64 nt, Homo Sapiens
gugaagaaaauguaacagaacuuaaugccaccauugauuucaaacauugaacagcuuugauuaa

SEQ ID NO: 295104 - RNA, 64 nt, Homo Sapiens
ucacccauuucagauaccuugcagaaaauccuauugauuucaucauagaacuguuacaauggua

SEQ ID NO: 295105 - RNA, 64 nt, Homo Sapiens
cuaugcacugugaagagauucccauauugcacuuugauuucaaaagcaccaccuucucuuuuug

SEQ ID NO: 295106 - RNA, 64 nt, Homo Sapiens
uauacaaccccacuguauuauuuucuuuagauucugauuucaggaucugugcuuugauuccuug

SEQ ID NO: 295107 - RNA, 64 nt, Homo Sapiens
cugguugaauaaggguacucuaguuuuauguagaugauuucagaaugugaaggcugguuugccu

SEQ ID NO: 295108 - RNA, 64 nt, Homo Sapiens
uguuccuucaucuacauguugcaacugcauucuuugauuucacuaggcuaagcccuggcuccau

SEQ ID NO: 295109 - RNA, 64 nt, Homo Sapiens
uuugauaccguuuuccugaaauaaccaguuaaccugauuucaauauaagaggucuuagaagaaa

SEQ ID NO: 295110 - RNA, 64 nt, Homo Sapiens
gaacaggucuuuguggagaucuaaaggcagugauugauuucacagggagcucuaaucucuguga

SEQ ID NO: 295111 - RNA, 64 nt, Homo Sapiens
aggcacuguccugggaugaugagagauuauaaggugauuucauaaaaggaauccaacccugugc

SEQ ID NO: 295112 - RNA, 64 nt, Homo Sapiens
agcuaaaauggguuauuuauaggacugauggaaaugauuucaucucugccaucucuaaagcacu

SEQ ID NO: 295113 - RNA, 64 nt, Homo Sapiens
agcccaauguggguccaucucaucagcccuuugcugauuucaugauuucucacccucccuccca

SEQ ID NO: 295114 - RNA, 64 nt, Homo Sapiens
agauguaauggaagccaaauaacaaguauagccuugauuucaguauuaacacaguaucauguuu

SEQ ID NO: 295115 - RNA, 64 nt, Homo Sapiens
agagagcagcuuugaggaaucaaaauuugcaaagugauuucagguuuguuugcaaauuggucaa

SEQ ID NO: 295116 - RNA, 64 nt, Homo Sapiens
cauugacaagauagaugaguauauaaaggaaaaaugauuucaaaaaagacucacuuuaccaagc

SEQ ID NO: 295117 - RNA, 64 nt, Homo Sapiens
caaaauuaacccuuuucuccgcccuaauuguguuugauuucagacaccuguaaguuauuuauua

SEQ ID NO: 295118 - RNA, 64 nt, Homo Sapiens
gauauucagaaguguguaccagccuuugcuugacugauuucaguaauaugaugugagcuaguua

SEQ ID NO: 295119 - RNA, 64 nt, Homo Sapiens
aucaugccuaugcagaagaauugaagaccuuuugugauuucauuuaagaauaguugaagacuag

SEQ ID NO: 295120 - RNA, 64 nt, Homo Sapiens
uuuuuuuucaauugacaagacuuuaagucagggauaacaguauuaauguucucuguucuguuuc

SEQ ID NO: 295121 - RNA, 64 nt, Homo Sapiens
agggaucuucaaaguuauuuugucuugauguauguaacaguaauucuuuacaucuuuugauuuu

SEQ ID NO: 295122 - RNA, 64 nt, Homo Sapiens
aguuuaaagaaaggacaucaucauagauaugaucuaacaguauuucuaacuauauuugaucauu

SEQ ID NO: 295123 - RNA, 64 nt, Homo Sapiens
ugcgucuguuugcugaucuucagcgugggaauaauaacaguaccuacuugaaaggaucauugug

SEQ ID NO: 295124 - RNA, 64 nt, Homo Sapiens
ucagugcauuaucuacuuguguaguccuaugcaauaacaguaguguuacauguaucaagccuag

SEQ ID NO: 295125 - RNA, 64 nt, Homo Sapiens
uuugaaaaaugcacugggaaaaaguugaugucaauaacaguauaaaacagcccuauuucuugau

SEQ ID NO: 295126 - RNA, 64 nt, Homo Sapiens
augaaugagaagaaaugauucauaaauuuugaacuaacaguaauaacuucuugaaaauccaaua

SEQ ID NO: 295127 - RNA, 64 nt, Homo Sapiens
guucuugaaaaaaaauuuuuugauaugacuacucuaacaguaauaacuauaaaucucacuuuaa

SEQ ID NO: 295128 - RNA, 64 nt, Homo Sapiens
aaguggauuuuuguauauuuuuauuguuguuauuuaacaguauuuguucaggaaaucuuguagu

SEQ ID NO: 295129 - RNA, 64 nt, Homo Sapiens
uuaagcauuuuuguucacuucacuuugguguugguaacaguauucucuuugaacaucauaaaca

SEQ ID NO: 295130 - RNA, 64 nt, Homo Sapiens
cucagggugcccacaacucacucaccaagauguuuaacaguaaguaacaguaaauguaaaagau

SEQ ID NO: 295131 - RNA, 64 nt, Homo Sapiens
ccacaacucacucaccaagauguuuaacaguaaguaacaguaaauguaaaagauucauuuuggg

SEQ ID NO: 295132 - RNA, 64 nt, Homo Sapiens
aaauuaacaaauucaguggacauuuguucuggguuaacaguaaauauacacuuuacauucuugc

SEQ ID NO: 295133 - RNA, 64 nt, Homo Sapiens
cuaugcugugugcagaguauacaaguguuucuaguaacaguauuuccauacgugcccauuucac

SEQ ID NO: 295134 - RNA, 64 nt, Homo Sapiens
aucaugguuccuuuggugaucuauaagggaucuauuuaagaaguggucagguuuucgcacuucu

SEQ ID NO: 295135 - RNA, 64 nt, Homo Sapiens
guuaugaauggcauccagggauauuuggguuacuuuuaagaaagcagugugauguaguggagag

SEQ ID NO: 295136 - RNA, 64 nt, Homo Sapiens
uuaaaugaagagcuauuuauauauauuauuuuuuuuuaagaaaggaggaaaagaaaccaaaagu

SEQ ID NO: 295137 - RNA, 64 nt, Homo Sapiens
uuuaagaaaggaggaaaagaaaccaaaaguuuuuuuuaagaaaaaaaauccuucaagggagcug

SEQ ID NO: 295138 - RNA, 64 nt, Homo Sapiens
ugaaaaauacaagagugacucuauaacucuggucuuuaagaaagcugccuuuucauuuuuagac

SEQ ID NO: 295139 - RNA, 64 nt, Homo Sapiens
gcugcaauguuuuaaaaaaaauaagucaucagauuuuaagaaaaaagugaugauuucuuauuga

SEQ ID NO: 295140 - RNA, 64 nt, Homo Sapiens
auauauauauauauacacaccaccaaucaacacuuuuaagaaauccaaggaauuauucuuuucu

SEQ ID NO: 295141 - RNA, 64 nt, Homo Sapiens
ugcucugcucaguguuguuuaccuaccaggaaccuuuaagaauaaauacugaguaagauauaag

SEQ ID NO: 295142 - RNA, 64 nt, Homo Sapiens
uccagcauguugcaucucuggcuauacuguauauuuuaagaaguggcgugagccacugcgccca

SEQ ID NO: 295143 - RNA, 64 nt, Homo Sapiens
gcccugagaucaguuauuccacaucacugaaaccuuuaagaaaauguucaaauagagcuguuca

SEQ ID NO: 295144 - RNA, 64 nt, Homo Sapiens
ugguuuaagauauuggaugauuugaauaaaacaauuuaagaaauggcaagacgacaaaaguacc

SEQ ID NO: 295145 - RNA, 64 nt, Homo Sapiens
cucuuuaauacaucugggcaauugaugcauuacauuuaagaauuuuuacagauguauuaggacc

SEQ ID NO: 295146 - RNA, 64 nt, Homo Sapiens
uaaauacuugccugagauagauuucuuacuagcuuuuaagaaaucucuccacauugaucuuuuc

SEQ ID NO: 295147 - RNA, 64 nt, Homo Sapiens
cauacuucucuccacauugaaauauguacccauuuuuaagaaauuuucacaauuaaaaaacuaa

SEQ ID NO: 295148 - RNA, 64 nt, Homo Sapiens
ugaaacguuaugaugaccuguugacguuugcucauuuaagaauuguuaaugaaacaaauagcug

SEQ ID NO: 295149 - RNA, 64 nt, Homo Sapiens
aauuuuccaaccuuuggaagacuauuauagcaacuuuaagaagugcuguugcugcuacugucuu

SEQ ID NO: 295150 - RNA, 64 nt, Homo Sapiens
gaauauuuaugccuuaauauaucuauggcagacauuuaagaaugcgcuuuaucuagcucauggu

SEQ ID NO: 295151 - RNA, 64 nt, Homo Sapiens
uucuguugggagcucuccaaagaaacugguugguuuuaagaaaauaguuucaagaaguucaacu

SEQ ID NO: 295152 - RNA, 64 nt, Homo Sapiens
ugugacgauauguggacaaagaagaagaugcagguuuaagaaguuaauauuuauaaaaugugaa

SEQ ID NO: 295153 - RNA, 64 nt, Homo Sapiens
ucccuuuucuaaaaaugcaaugcacuaaaacuauuuuaagaauguaguuaauucugcuuauuca

SEQ ID NO: 295154 - RNA, 64 nt, Homo Sapiens
guaaguauuuuuauuaccaauaaauuuaaaauuuuuuaagaaaaauauuuuuauccuagggcca

SEQ ID NO: 295155 - RNA, 64 nt, Homo Sapiens
uuugaaauguaaaauuuuuaugaucugauucaguuuuaagaaaacaugaaugaacuagaagaua

SEQ ID NO: 295156 - RNA, 64 nt, Homo Sapiens
uguguguguaucaaaaguggucucaaaauauuuuuuuaagaaaaaaagcaaaaacaauguauug

SEQ ID NO: 295157 - RNA, 64 nt, Homo Sapiens
uuuucuauguagguucauguuccauguucauuuauuuaagaaauacauuuuuauugguaagcuu

SEQ ID NO: 295158 - RNA, 64 nt, Homo Sapiens
uuuauuuccccuuuucacuuaagcuaaaagauaauuuaagaacaaauuuguguguuuucgauuu

SEQ ID NO: 295159 - RNA, 64 nt, Homo Sapiens
acauuuugugugcauauuguaggacuuuauggaauuuaagaaauaucauuuugccucauguugg

SEQ ID NO: 295160 - RNA, 64 nt, Homo Sapiens
uauuggauaucaagaagcauuucaugcuaaacuuuuuaagaauguuauuuguuugauacuagga

SEQ ID NO: 295161 - RNA, 64 nt, Homo Sapiens
ucaauuucauaguauugguuaagauuacuauuacuuuaagaaaaccaacuacaaccugcaauuu

SEQ ID NO: 295162 - RNA, 64 nt, Homo Sapiens
gcaucaaaggguugauauuuaauaccuccaaauuuuuaagaaaaaaagguaugaggaauguuuu

SEQ ID NO: 295163 - RNA, 64 nt, Homo Sapiens
ggccaggugauaucacaccccacacacacagugcuuuaagaaagcacaugcacacacccauaaa

SEQ ID NO: 295164 - RNA, 64 nt, Homo Sapiens
aauuuucugcagcuuuuaguuuuucaguagaauauuuaagaacuaaaugcuagcugcucaagag

SEQ ID NO: 295165 - RNA, 64 nt, Homo Sapiens
uaaaaagcuuaagaaauuuacucauuuaaauauuuuuaagaaaacaaaaagaugagauacuaca

SEQ ID NO: 295166 - RNA, 64 nt, Homo Sapiens
gggugaauguggccaugccuaccuguuuuguuuuuuuaagaacagaaacaacuauuuuaaaaga

SEQ ID NO: 295167 - RNA, 64 nt, Homo Sapiens
uuaagaacagaaacaacuauuuuaaaagaacucuuuuaagaaauuucauaaagggacaugcauu

SEQ ID NO: 295168 - RNA, 64 nt, Homo Sapiens
ugauucaaagcaaaacaaacaaacaaaaacaaauuuuaagaacacaacaaaaaagauuugacuu

SEQ ID NO: 295169 - RNA, 64 nt, Homo Sapiens
agauuaauuuuuauaaaugaaaauauuuuaaugguuuaagaaaaugaggacaacaggauaauau

SEQ ID NO: 295170 - RNA, 64 nt, Homo Sapiens
cuagccuugcuuguuaaauuuuuuuuuuuuuuuuuuuaagaauaucuguaaugguacugacuuu

SEQ ID NO: 295171 - RNA, 64 nt, Homo Sapiens
guuauagugaauacugcuacagcaauuucuaauuuuuaagaauugaguaaugguguagaacacu

SEQ ID NO: 295172 - RNA, 64 nt, Homo Sapiens
cacaaguaacaggauuagggaaggacauaauguauuuaagaauaagugaagguuagagguuuac

SEQ ID NO: 295173 - RNA, 64 nt, Homo Sapiens
gauuuaaaaaaaucccauuuacaagcauugcaccuuuaagaagaaaacaaauaugacaguaugg

SEQ ID NO: 295174 - RNA, 64 nt, Homo Sapiens
cugaagucaugucaaguacugucuggaggguuuuuuuaagaaaaggcauuuggcauuuaacugu

SEQ ID NO: 295175 - RNA, 64 nt, Homo Sapiens
uuaggaacacugcuauuuuuuucuuaaaaauguuuuuaagaauauguucguuucuuugacuauu

SEQ ID NO: 295176 - RNA, 64 nt, Homo Sapiens
auuugggaaagaaaaagaaauuaagaagcuaauguuuaagaagcagaacuuggguuaaaaaugu

SEQ ID NO: 295177 - RNA, 64 nt, Homo Sapiens
uaauguuuaagaagcauuuguuggguuaaaaauguuuaagaagccgcaguggaccuauuagaac

SEQ ID NO: 295178 - RNA, 64 nt, Homo Sapiens
auuugggaaauauauauguugaacuggggugcuuuuuaagaaaauuucuuuauucaagauaccu

SEQ ID NO: 295179 - RNA, 64 nt, Homo Sapiens
accuuguaaugaucgaauacccgagaaacacugguuuaagaaaaauucugaugcacaguaaaau

SEQ ID NO: 295180 - RNA, 64 nt, Homo Sapiens
uuggaugacauuuccugacauuaguuauccuugcuuuaagaauaaugcugcacauguauuuuau

SEQ ID NO: 295181 - RNA, 64 nt, Homo Sapiens
gugcugugaucacuguauuaguaugccacuuuuguuuaagaacuaaaagagauauuuuuagauu

SEQ ID NO: 295182 - RNA, 64 nt, Homo Sapiens
aaaaaguccacacuugaagccuaaauuugugcuuuuuaagaauauuuuuagacuauuucuuuuu

SEQ ID NO: 295183 - RNA, 64 nt, Homo Sapiens
uucauaaaaacaagucauuuuuguauuuuucaucuuuaagaaugcuuaaaaaagcuaaucccua

SEQ ID NO: 295184 - RNA, 64 nt, Homo Sapiens
agaucugugggcuuuuaaaauuguucacagccaauuuaagaagaccccucaugaagucucaguu

SEQ ID NO: 295185 - RNA, 64 nt, Homo Sapiens
auuaguuaagauauggucacuugaauuuuuuguauuuaagaauuuucuguuuuaaugcauguua

SEQ ID NO: 295186 - RNA, 64 nt, Homo Sapiens
uggcauaguucaugagcuuaauacauagcuuucuuuuaagaaaggagccuuuuuuuucaacuag

SEQ ID NO: 295187 - RNA, 64 nt, Homo Sapiens
uuuauccaacaauuauguucauuuuaagcaaaauuuuaagaaaguuuugaaauucauaaagcau

SEQ ID NO: 295188 - RNA, 64 nt, Homo Sapiens
uuugaaauucauaaagcauuugguuuuaaacuauuuuaagaauauaguacucggucagguauga

SEQ ID NO: 295189 - RNA, 64 nt, Homo Sapiens
gcagauacucuuccugccagugguaauacgauuuuuuaagaaggcaguuugucaauuuuaaucu

SEQ ID NO: 295190 - RNA, 64 nt, Homo Sapiens
gaaaaaaagguagugaauuuuuaaucaucuggacuuuaagaaggauucuggaguauacuuaggc

SEQ ID NO: 295191 - RNA, 64 nt, Homo Sapiens
ugccucacucacagaguuacaaauuaaauaaggauuuaagaauuaugaggaaagcugucuuaug

SEQ ID NO: 295192 - RNA, 64 nt, Homo Sapiens
gacuuauuaauguggucacuuaagggguaaggaauuuaagaacuggaugagguuauuucuuccu

SEQ ID NO: 295193 - RNA, 64 nt, Homo Sapiens
aauugggaaacggggaaauucuuggaauuuuuuuuuuaagaaacuuuuuuguguuuuuuuuaau

SEQ ID NO: 295194 - RNA, 64 nt, Homo Sapiens
uuaccuuuuaucgguaguaagcuuggaaaaauaauuuaagaauacaauggagaaauguaaauaa

SEQ ID NO: 295195 - RNA, 64 nt, Homo Sapiens
agaguaaaacuuacaggauaagcauuuugcucuuuuuaagaacagcaugaaauuuagaauacca

SEQ ID NO: 295196 - RNA, 64 nt, Homo Sapiens
cagcaugaaauuuagaauaccaaugauagcuaucuuuaagaaucagaauuaguacuagaaauuu

SEQ ID NO: 295197 - RNA, 64 nt, Homo Sapiens
cgagauuuaguaaauccuauagcaauaaauuauuuuuaagaaauauaauaaaaagacuauuaag

SEQ ID NO: 295198 - RNA, 64 nt, Homo Sapiens
ugcagaaucaacuugaagcauuguacucuguuuuuuuaagaaagugaugucugggcaucagccu

SEQ ID NO: 295199 - RNA, 64 nt, Homo Sapiens
agagaugucauagccugaaguuacuuaagacuauuuuaagaaauuguuaauuuaagaaauagac

SEQ ID NO: 295200 - RNA, 64 nt, Homo Sapiens
agacuuacuuaagacuauuuauuuuuguuguuaauuuaagaaauacuuacuggcuuuaacaaua

SEQ ID NO: 295201 - RNA, 64 nt, Homo Sapiens
aaaacugggaaauagaaacacuuuuuuuuuuuccuuuaagaauuuacauaauaaacccuuucau

SEQ ID NO: 295202 - RNA, 64 nt, Homo Sapiens
uauuaauuuaugaaaugauacuuuggauuaugauuuuaagaaauuuucguauaauagauacguu

SEQ ID NO: 295203 - RNA, 64 nt, Homo Sapiens
aauuaauuuaaguacuaaaaagacaaggauuucuuuuaagaaauuuauagcauuuacuguguua

SEQ ID NO: 295204 - RNA, 64 nt, Homo Sapiens
uucaagaaaaagaaauuauguuaaauagcccuguuuuaagaaaaauauuuaugaagcaucucaa

SEQ ID NO: 295205 - RNA, 64 nt, Homo Sapiens
ucuuauugaugacuuuuuaaugcagaguaaguuguuuaagaaaggccugaauauaucagaacau

SEQ ID NO: 295206 - RNA, 64 nt, Homo Sapiens
gcuauucauucugccauuuuuaacuugagacacauuuaagaauaaaguuggauguucuuuuucu

SEQ ID NO: 295207 - RNA, 64 nt, Homo Sapiens
aagaauuugaaaguuuccuuauuuucauaauucauuuaagaacaagagaccccugucuggcagu

SEQ ID NO: 295208 - RNA, 64 nt, Homo Sapiens
guuaaaugcuauggaaauacauuuagaaccugcauuuaagaacagaacagcaaguaugaaccac

SEQ ID NO: 295209 - RNA, 64 nt, Homo Sapiens
auauuuuaggauuauuuuuguauauuuuuucuauuuuaagaaucuuuucccauugcaacagagc

SEQ ID NO: 295210 - RNA, 64 nt, Homo Sapiens
ugauuuuuuuguauuaaucaugccuuauguuaacuuuaagaaauaauauuguaucauuuauauu

SEQ ID NO: 295211 - RNA, 64 nt, Homo Sapiens
auuacaacucugaaaagcauuggaaaaucaaacguuuaagaagacaaaguggguaucugacaag

SEQ ID NO: 295212 - RNA, 64 nt, Homo Sapiens
uuaacaauauauuaacaaacccaacuaggcaguuuuuaagaauauacagagaaaaguuaaacag

SEQ ID NO: 295213 - RNA, 64 nt, Homo Sapiens
caauaugugggaaaugauuucuuguaggcucuguuuuaagaaaauauuuggugcugaauauguc

SEQ ID NO: 295214 - RNA, 64 nt, Homo Sapiens
cauggaagacaauucauguuuuccauaaguggccuuuaagaaaacauacaaaacaaauaggcuu

SEQ ID NO: 295215 - RNA, 64 nt, Homo Sapiens
uguugccuuucuacuauuacccuucuugguuucuuuuaagaauugagacugucaagauuguaua

SEQ ID NO: 295216 - RNA, 64 nt, Homo Sapiens
uauguuuugugguaaucuauagaaauuugcagaauuuaagaaauaaaccaagauuagaaacauu

SEQ ID NO: 295217 - RNA, 64 nt, Homo Sapiens
cacauugccauggcaggauuaauuuaccucgauuuuuaagaacaagacuguuuuacaccuggaa

SEQ ID NO: 295218 - RNA, 64 nt, Homo Sapiens
ggaauuggaacuuauuuuaaauuguuggaguucuuuuaagaagaauauaaauugauuauuuuuu

SEQ ID NO: 295219 - RNA, 64 nt, Homo Sapiens
uauuuaauaagaguccuagauagccagcggagacuuuaagaaucauugccucuagcugggugug

SEQ ID NO: 295220 - RNA, 54 nt, Homo Sapiens
gccacagcacaaaguuuuaaugucuuuaagaaaaagaaaucaaucugcagaaau

SEQ ID NO: 295221 - RNA, 64 nt, Homo Sapiens
ugauguuccaucauucuggaccucccaggaguuguuuaagaaugaaucucuuacaccucuacuu

SEQ ID NO: 295222 - RNA, 64 nt, Homo Sapiens
ggggacaauuuuauguaucuguguuaaggauauguuuaagaacauaauucuuuuguugcuguuu

SEQ ID NO: 295223 - RNA, 64 nt, Homo Sapiens
auguuuaagaacauaauucuuuuguugcuguuuguuuaagaagcaccuuaguuuguuuaagaag

SEQ ID NO: 295224 - RNA, 64 nt, Homo Sapiens
uuguugcuguuuguuuaagaagcaccuuaguuuguuuaagaagcaccuuauauaguauaauaua

SEQ ID NO: 295225 - RNA, 64 nt, Homo Sapiens
ugccauuucauuauuugauuugaagguuuuuuuuuuuaagaaaguguguuuacugcuggauuuu

SEQ ID NO: 295226 - RNA, 64 nt, Homo Sapiens
acaauuaaccugguuaaagaggagucuaugccauuuuaagaaaauaauaaaacuacuaaccaga

SEQ ID NO: 295227 - RNA, 64 nt, Homo Sapiens
aauauauuugucaaauaaaaauguacauaaagaauuuaagaaagugucuuauagacuuuuuaaa

SEQ ID NO: 295228 - RNA, 64 nt, Homo Sapiens
accuauagacuugaacuccucagugaagagaagauuuaagaagcgauguccuggguccuuccaa

SEQ ID NO: 295229 - RNA, 64 nt, Homo Sapiens
uauuacuggaauuaaaaauaauuuuuaacaggaauuuaagaaaacugacuuuaauauugauuau

SEQ ID NO: 295230 - RNA, 64 nt, Homo Sapiens
auuuuaaaugucaguuacaaauucuggaagauguuuuaagaagcuuuuaaaguguauuuuucgu

SEQ ID NO: 295231 - RNA, 64 nt, Homo Sapiens
uaucauguggaauauccucauauuuuuaccauauuuuaagaacuuuaagacgauuaauuguaaa

SEQ ID NO: 295232 - RNA, 64 nt, Homo Sapiens
uucugaguuuuuucaaggaauguaauacuggagcuuuaagaacauacuuaguuucucaugugaa

SEQ ID NO: 295233 - RNA, 64 nt, Homo Sapiens
aaauauuuuugagaaaaguagcugaguauacugguuuaagaaaaugcuuguuuuagauugaggu

SEQ ID NO: 295234 - RNA, 64 nt, Homo Sapiens
cuauuuucaaagcagaaaaauugacauugcugccuuuaagaauaccaugaauguaagaaauuga

SEQ ID NO: 295235 - RNA, 64 nt, Homo Sapiens
auuuuuaauugcuuauaacagucgguaaugucuuuuuaagaauacaggcuacaagagaacccgg

SEQ ID NO: 295236 - RNA, 64 nt, Homo Sapiens
guaaagacugccaguucuucaacuguuuuaaaacuuuaagaaaguucucuuuaauggaaucuac

SEQ ID NO: 295237 - RNA, 64 nt, Homo Sapiens
auuuaaguuuauucagauaaaaauacauaaauauuuuaagaaaaaauuucauuguaaaaugaac

SEQ ID NO: 295238 - RNA, 64 nt, Homo Sapiens
uuuauuuaucaaagucuuucaaaacaauuguauuuuuaagaaugcucucucuuaaauguuauaa

SEQ ID NO: 295239 - RNA, 64 nt, Homo Sapiens
cuggguuaaagacaccagcauauugaagccagucuuuaagaaaccaagucacuacaguugguuc

SEQ ID NO: 295240 - RNA, 64 nt, Homo Sapiens
aauuucugugaagugugagggcugcagugccaguuuuaagaaagagggauauuguaaaugaaag

SEQ ID NO: 295241 - RNA, 64 nt, Homo Sapiens
auaaugauaagcauuauucauaaaacuuguuaccuuuaagaagguggaaguggcaaaccauacu

SEQ ID NO: 295242 - RNA, 64 nt, Homo Sapiens
ugcuuuuauagauuuuacuauauaggaaucaagauuuaagaaauuuugcauuaaaaauagugua

SEQ ID NO: 295243 - RNA, 64 nt, Homo Sapiens
cccagagcugccuuuuucuuuucuuuuuaaaaauuuuaagaaguuuucuuuguggggcugggga

SEQ ID NO: 295244 - RNA, 64 nt, Homo Sapiens
cugcagugacuugaugcucuaaaacaguguaggauuuaagaauagaugguuuuuaauccuggaa

SEQ ID NO: 295245 - RNA, 64 nt, Homo Sapiens
aucacaccaaaacuaugcaauugguacaugguuguuuaagaagaaaccguauuuuuccaugaua

SEQ ID NO: 295246 - RNA, 64 nt, Homo Sapiens
guuaacaauuggaauaacuuuauucugcagaucauuuaagaaguaacaggccgggcgcgguggc

SEQ ID NO: 295247 - RNA, 64 nt, Homo Sapiens
agcugccaaaaauuaaagugcaauauuguauauuuuuaagaacaaauuuaaaauagaauuuuga

SEQ ID NO: 295248 - RNA, 64 nt, Homo Sapiens
gaacuaggggcuggaagaagaaauccagaaagcauuuaagaauucaagcugcaugcuuuucaca

SEQ ID NO: 295249 - RNA, 64 nt, Homo Sapiens
uuauuucuucauacgacauaaaaaaacuauuauauuuaagaacuuuucuuugguugaugcaaac

SEQ ID NO: 295250 - RNA, 64 nt, Homo Sapiens
uccagauaccggguggaagacugguuuugaucaguuuaagaaguauucuaaacuguucuagaug

SEQ ID NO: 295251 - RNA, 64 nt, Homo Sapiens
caucaagccauggauucuugguuuggcgcuaucuuuuaagaagagaugauguugaaccugcucc

SEQ ID NO: 295252 - RNA, 64 nt, Homo Sapiens
auguuagaauuuacacugaggagaaaauugucaauuuaagaaaucuaaagugaaaauuuugcuu

SEQ ID NO: 295253 - RNA, 64 nt, Homo Sapiens
auaauuuauagauguauauuguggaauguaaagcuuuaagaacuuaaacaaagguaauaauuaa

SEQ ID NO: 295254 - RNA, 64 nt, Homo Sapiens
gaacagagguguugaguugcaggauaucuagcaauuuaagaaaauguggaaaaaauauuuuuau

SEQ ID NO: 295255 - RNA, 64 nt, Homo Sapiens
ggaacagauggcuucacugaaguuauuccaaauauuuaagaaauaauaccaggcuuuuauaaac

SEQ ID NO: 295256 - RNA, 64 nt, Homo Sapiens
uuagcaugcuugucaaccuugagugagugucauuuuuaagaacaguuguagcccuucugauuau

SEQ ID NO: 295257 - RNA, 64 nt, Homo Sapiens
auguaaaauaauuaaaugaauugugaaauggauguuuaagaaaauauaggcuuaaaaaguaaau

SEQ ID NO: 295258 - RNA, 64 nt, Homo Sapiens
aaauagcguguuguucaguaugcaaaucaauuauuuuaagaaucgcuuuuguaaauaucuuugu

SEQ ID NO: 295259 - RNA, 64 nt, Homo Sapiens
uccauguaucauguuccguguagccauuuuauuuuuuaagaaacugcuaauacuuucucccuaa

SEQ ID NO: 295260 - RNA, 58 nt, Homo Sapiens
aagguauggucgauggauaaauaguuauuuuaagaaacuaauuccacugaaccuaaaa

SEQ ID NO: 295261 - RNA, 64 nt, Homo Sapiens
gggagccuuuaucugucauuagaaaucuuucucauuuaagaacuuaugaauaugcugaagauuu

SEQ ID NO: 295262 - RNA, 64 nt, Homo Sapiens
ggaguuguuucugugauguaaauuaugaucauuauuuaagaagucaaauccugaucuugaagug

SEQ ID NO: 295263 - RNA, 64 nt, Homo Sapiens
gguagaucagauugggggauguagcaaacuggacuuuaagaacuggaaagagguuuuacaaaag

SEQ ID NO: 295264 - RNA, 64 nt, Homo Sapiens
uuaguauacacuggcacauaauuuuuuaaaaaguuuuaagaaaagauucauuuggaauuuuauu

SEQ ID NO: 295265 - RNA, 64 nt, Homo Sapiens
guaccguuuuugagguucagucuuaaacauuugcuuuaagaaaacagucuugaauuucacaugc

SEQ ID NO: 295266 - RNA, 64 nt, Homo Sapiens
cacccgagaaaucuuaaauagacacuuugcaauauuuaagaaccuaaugcuguuuaauuuuggu

SEQ ID NO: 295267 - RNA, 64 nt, Homo Sapiens
aauaauuaaaauaaccucacagcuuuaagaauuuuuuaagaaguauguacauuguggaauguaa

SEQ ID NO: 295268 - RNA, 64 nt, Homo Sapiens
uuuuaagaaguaauaauuaaguggaauguaaagcuuuaagaauuauaauuuauagauguacauu

SEQ ID NO: 295269 - RNA, 64 nt, Homo Sapiens
cuaaagugaaaauuuugcuugagaaaauugucaauuuaagaaauauguuagcauuuacacugag

SEQ ID NO: 295270 - RNA, 64 nt, Homo Sapiens
cauuccuccagaagaguaucugcaggcacaacaguuuaagaaugcauccuggcaaaaacaaagu

SEQ ID NO: 295271 - RNA, 64 nt, Homo Sapiens
ugagaguaaaagcaacaauauguuugacuagcguuuuaagaacuaaagucuuguuggauaauag

SEQ ID NO: 295272 - RNA, 64 nt, Homo Sapiens
aauguguuugauauaaggccgaugagcuucucacuuuaagaauaacucuccucuagcuauccuu

SEQ ID NO: 295273 - RNA, 64 nt, Homo Sapiens
ugggugguauuggagaaagaaaagcuaaauaaccuuuaagaaugucuacguauccuuguggaga

SEQ ID NO: 295274 - RNA, 64 nt, Homo Sapiens
ggagaaggaaaaauagcuuuuaaaaauuaaaugcuuuaagaaauaauuaugaacauuuuuuuca

SEQ ID NO: 295275 - RNA, 64 nt, Homo Sapiens
gauuuauuacaaaauuaugucuccacauccacccuuuaagaauugagcgugacauuaugcauua

SEQ ID NO: 295276 - RNA, 64 nt, Homo Sapiens
aaaaagugaugaaucaaaauuagaaauuaagaguuuuaagaaaacauguggccuuuuauuaaua

SEQ ID NO: 295277 - RNA, 64 nt, Homo Sapiens
gaaggaaacauuugugcuuuccuauauuuuuaauuuuaagaauaggauuucggaaggcgacaga

SEQ ID NO: 295278 - RNA, 64 nt, Homo Sapiens
agaaccgcuuguaugauuuuuaaacacaccuaacuuuaagaaaauagaaauuuuuaauugagug

SEQ ID NO: 295279 - RNA, 64 nt, Homo Sapiens
guagagcugcuuucaauaucuauuuugugaauauuuuaagaacuuucauuuaauuuuaauuuua

SEQ ID NO: 295280 - RNA, 64 nt, Homo Sapiens
acaucaacauuuuuugugcugaucugaagcauaauuuaagaaaagaaauuauacaaucaaacua

SEQ ID NO: 295281 - RNA, 64 nt, Homo Sapiens
cuuuuuuuuuaagcugagaaauugaacuuuuuuuuuuaagaauaucaggaauacugccucaguu

SEQ ID NO: 295282 - RNA, 64 nt, Homo Sapiens
uugauuguuauuuacucccacuuucuagcauaucuuuaagaaaagaaauuggaaguacuaacua

SEQ ID NO: 295283 - RNA, 64 nt, Homo Sapiens
guuaguaucaugguguuuuuguuuuuguuuuuguuuuaagaaccugcaguuugacucuucaucg

SEQ ID NO: 295284 - RNA, 64 nt, Homo Sapiens
gccaaauaccugauguauugugaaagccacugauuuuaagaauggagagaaagggauuuuuuac

SEQ ID NO: 295285 - RNA, 64 nt, Homo Sapiens
ugguucuggguacaccagaaacccauggaaaugguuuaagaaaaauaaauagauaaaaauaaaa

SEQ ID NO: 295286 - RNA, 64 nt, Homo Sapiens
uauauuacucuaauaagaugaauaugcuaucuucuuuaagaaauucauguguuagaugugugua

SEQ ID NO: 295287 - RNA, 64 nt, Homo Sapiens
ugcuuuuuugaacuuuauucagcacucuuuuacuuuuaagaaauaaauacuuaaagaccucaga

SEQ ID NO: 295288 - RNA, 64 nt, Homo Sapiens
uuaucuguauguuagaaauguuuuguuuuguuuuuuuaagaaacagaauaagugaacuuuuuug

SEQ ID NO: 295289 - RNA, 64 nt, Homo Sapiens
gaaaaaagaaaaaaaaaucauuccuuuuuuuuuuuuuaagaaaguggcaauuuaauuuauuuac

SEQ ID NO: 295290 - RNA, 64 nt, Homo Sapiens
gccugaucauggcuaucucacccccccucuuuuuuuuaagaaugacaaacuccaccuacugccc

SEQ ID NO: 295291 - RNA, 64 nt, Homo Sapiens
caaauguauaaaauuccauuaauaucugucaaaauuuaagaaaagcaguuuuaacuuucugaag

SEQ ID NO: 295292 - RNA, 64 nt, Homo Sapiens
uauuuuuugucauuuuuugucaugcuuuugugccuuuaagaaaauacaacucucauuuaauauu

SEQ ID NO: 295293 - RNA, 64 nt, Homo Sapiens
auuaauaauaaugcucugaaggcccugcauuuaauuuaagaaggauuccacgugcagcaugcuu

SEQ ID NO: 295294 - RNA, 64 nt, Homo Sapiens
uaucuuaaaaaugcaaggaaugcugaucaggaaauuuaagaauuuggaacucuccuacgaguuc

SEQ ID NO: 295295 - RNA, 64 nt, Homo Sapiens
ccagaauuuucuggccuuucauggcaaugaaaauuuuaagaagaaagauuuaaaguauuuuaau

SEQ ID NO: 295296 - RNA, 64 nt, Homo Sapiens
auuuccuuuuguccacuuguaagaaugucaggaauuuaagaauuuguuuaaauuaggcauaucu

SEQ ID NO: 295297 - RNA, 64 nt, Homo Sapiens
uuuaaaaauugguuuucuaacugaaaacacugcauuuaagaauuucugacuugguaacuauguu

SEQ ID NO: 295298 - RNA, 64 nt, Homo Sapiens
uagucuuauuucguuguaaauuuuucaaacuaauuuuaagaauuauguaaacaaacugcagguu

SEQ ID NO: 295299 - RNA, 64 nt, Homo Sapiens
ucauccuuuugccaaaaugggguuuauaaacaguuuuaagaauuauacagucuuuacuauauua

SEQ ID NO: 295300 - RNA, 64 nt, Homo Sapiens
uaugaaagcuuaaggaauuauucauuuccuugcauuuaagaaaaggagauuuagugcuuuuaua

SEQ ID NO: 295301 - RNA, 64 nt, Homo Sapiens
uuggcuagggaguuuaucccuuuuucgaauuauuuuuaagaagaugccaauauaauuuuuguaa

SEQ ID NO: 295302 - RNA, 64 nt, Homo Sapiens
ucauggaauauauucugcguuuauaaaacuaguuuuuaagaagaaauuuuuuuuggccuaugaa

SEQ ID NO: 295303 - RNA, 64 nt, Homo Sapiens
uaagggaguggccucauuucacuagagacaaaucuuuaagaauaguucuaaaauugggcuugug

SEQ ID NO: 295304 - RNA, 64 nt, Homo Sapiens
uuuuuuuuuuuuacauguuuccaucauuucugucuuuaagaacuaauucguacauaauaaguuu

SEQ ID NO: 295305 - RNA, 64 nt, Homo Sapiens
cugagcagaggugucucauaaauuaugcuugaaguuuaagaaaguugcugcaauuugccccguu

SEQ ID NO: 295306 - RNA, 64 nt, Homo Sapiens
aaaacacagcaccuuuacccugauugguuacuuauuuaagaagcuaugcugcagauuuuauaau

SEQ ID NO: 295307 - RNA, 64 nt, Homo Sapiens
uguuacauuaaaacucuaaccaaggaaaggguucuuuaagaacauucccuuagagggauaaagu

SEQ ID NO: 295308 - RNA, 64 nt, Homo Sapiens
uguauauaacacuaucugucuguaaaauacuuuuuuuaagaaagcauuuauauuuauaugacag

SEQ ID NO: 295309 - RNA, 64 nt, Homo Sapiens
aagaacauaauuuucugcugccuaucgagauuuauuuaagaaugugauugaccaucaacuccau

SEQ ID NO: 295310 - RNA, 64 nt, Homo Sapiens
agagaaggcucucuuuucucaguuuccugucuuauuuaagaaaauccagcaagggaaauaaugc

SEQ ID NO: 295311 - RNA, 64 nt, Homo Sapiens
uucacacuuaggcaagcauacacaggcacauggcuuuaagaaccacacugaugccuugauaauu

SEQ ID NO: 295312 - RNA, 64 nt, Homo Sapiens
uagguccuguaucauacuuuuuucuuuaagacuuuuuaagaaauauuacuuaaacauguggcuu

SEQ ID NO: 295313 - RNA, 64 nt, Homo Sapiens
cauuaugcaaaaagucacuugugagaguucuuuuuuuaagaaaguguuugguaaaaauguuuuu

SEQ ID NO: 295314 - RNA, 64 nt, Homo Sapiens
aguagaguugcaacuggaaauuugauuuauucuuuuuaagaagguguucauguuguaggguaau

SEQ ID NO: 295315 - RNA, 64 nt, Homo Sapiens
guaauauuaauuuccacuaaaaaauuaaaugucuuuuaagaaacauucuuuuccacuuguuaaa

SEQ ID NO: 295316 - RNA, 64 nt, Homo Sapiens
acuuguuaaaaaaauuaaauauauuuuaaagcacuuuaagaauaugaaacuuucauauauguua

SEQ ID NO: 295317 - RNA, 64 nt, Homo Sapiens
acccacgucuucugaugcgaguuggaaguacaccuuuaagaauguuucugaaguuacguuuugu

SEQ ID NO: 295318 - RNA, 64 nt, Homo Sapiens
ucuuuuccaaacugcuuuguguauuguauauuuuuuuaagaaaaagaaaagccuuauuugacuu

SEQ ID NO: 295319 - RNA, 64 nt, Homo Sapiens
acaauucuacauugucaagcgugguuacacacuuuuuaagaaaucuuuugcagcccagacaaau

SEQ ID NO: 295320 - RNA, 64 nt, Homo Sapiens
aauaacacacauauaaacauaaagcugcaggcuguuuaagaaaaucagugauguaccaugaaac

SEQ ID NO: 295321 - RNA, 64 nt, Homo Sapiens
gaggcuuucacugagauuugaaugugaguuuuuuuuuaagaaauacauuuuaaguuguuaagca

SEQ ID NO: 295322 - RNA, 64 nt, Homo Sapiens
agcuuuugcugaggaguuguaagcaaguucuauuuuuaagaaauuuuucugaauauuaagugaa

SEQ ID NO: 295323 - RNA, 64 nt, Homo Sapiens
aaagguuuucgaaugggauacgcuguaggcacguuuuaagaaguauucuguuccuaaaguccag

SEQ ID NO: 295324 - RNA, 64 nt, Homo Sapiens
guuugauauucaugaacaugaauacauguauuuuuuuaagaaauaaguauuguguaacacuaug

SEQ ID NO: 295325 - RNA, 64 nt, Homo Sapiens
ugaaagauuauuuuucuacauuguuguuuuguuuuuuaagaaagugcuuuagggcuguuguuuu

SEQ ID NO: 295326 - RNA, 64 nt, Homo Sapiens
ucuucaucuauuucauaucuugaaugugauuaaauuuaagaaaacuucauaauugagaaagccu

SEQ ID NO: 295327 - RNA, 64 nt, Homo Sapiens
auuuuuggaaaaauuuucuuuaaaccaucugguuuuuaagaaauuugguaccaaaaauugauga

SEQ ID NO: 295328 - RNA, 64 nt, Homo Sapiens
uauauuuuccaguugaaaacaaacuaagaaguccuuuaagaauuuauaauccguuccccauuaa

SEQ ID NO: 295329 - RNA, 64 nt, Homo Sapiens
uggcuuuuccauuguuuuugcuucucuuaaaaaguuuaagaagaauaugaccucauuaaaugug

SEQ ID NO: 295330 - RNA, 64 nt, Homo Sapiens
uuaauuuuuuguaauuuuuaugugguuuuagcacuuuaagaagugguuuucauuuauggcuuuu

SEQ ID NO: 295331 - RNA, 64 nt, Homo Sapiens
uuuaucucagccaguaggcaauucaguaaaguuuuuuaagaaugaaagauauguuaauuacuuu

SEQ ID NO: 295332 - RNA, 64 nt, Homo Sapiens
uaauaccaauuuagacucuaaacuacaaaauccuuuuaagaaaguagauguauuaaaaaaacga

SEQ ID NO: 295333 - RNA, 64 nt, Homo Sapiens
cuuguuaauggugggguuuucugcuuuguuuuuauuuaagaaaauaaacacgacauauuuaaag

SEQ ID NO: 295334 - RNA, 64 nt, Homo Sapiens
gcuggggauuggaugaaagucaaagguugucuacuuuaagaaaauaaaauacccugaauggagc

SEQ ID NO: 295335 - RNA, 64 nt, Homo Sapiens
acuagcuuaucaugagagcccucaggggaaaggguuuaagaaaaacaacuccucuuucccauag

SEQ ID NO: 295336 - RNA, 64 nt, Homo Sapiens
acaguauucuuucuacaugauccuuuuuuguacauuuaagaauauuuugauuauauuaaacaag

SEQ ID NO: 295337 - RNA, 64 nt, Homo Sapiens
aaaauuuuuaccuggugaacuuguuuaagcauaauuuaagaaaaagacuuguuuuuuauuauug

SEQ ID NO: 295338 - RNA, 64 nt, Homo Sapiens
auauuaacaaaauaaaggagauaauuguucaauguuuaagaauauugccaaauaacaauaauua

SEQ ID NO: 295339 - RNA, 64 nt, Homo Sapiens
accaaaaaguaagcuuuuguuguacuaaaagucauuuaagaaauaacaacuuaauauaauaaau

SEQ ID NO: 295340 - RNA, 64 nt, Homo Sapiens
ugcagucauggucuuucaguauacauucuguuucuuuaagaagaauucucucuuugagugauuc

SEQ ID NO: 295341 - RNA, 63 nt, Homo Sapiens
uagauggaagcauuuccuauccagugugaauaaaaagaacaguuguaguaaauuauuauaaag

SEQ ID NO: 295342 - RNA, 63 nt, Homo Sapiens
caaacacuaugucagauggggguaaaauccauuaaagaacaggaaaaaauaauuauaagauga

SEQ ID NO: 295343 - RNA, 63 nt, Homo Sapiens
agugugcuaacaucgaauauagagaaaacugguaaagaacauuccaguaggaaaagaaaagaa

SEQ ID NO: 295344 - RNA, 63 nt, Homo Sapiens
aaaacugguaaagaacauuccaguaggaaaagaaaagaacaaucuuccauuucugggcuuggc

SEQ ID NO: 295345 - RNA, 63 nt, Homo Sapiens
ggaauuuuguuuuugguuucgccucuuaacuuaaaagaacauacauccaaauaggagucuucu

SEQ ID NO: 295346 - RNA, 63 nt, Homo Sapiens
guugaaauuggaaaggacuucuguaguggcaaaaaagaacaguuaacaccaucuggagucuuc

SEQ ID NO: 295347 - RNA, 63 nt, Homo Sapiens
uugauauuugugcugaggugauauuccugucuaaaagaacaacauugucuuucuuuucuagca

SEQ ID NO: 295348 - RNA, 63 nt, Homo Sapiens
cagucauuguuaguucuugucuaguuuucauuaaaagaacaaagaucuuuuauauggauaucu

SEQ ID NO: 295349 - RNA, 63 nt, Homo Sapiens
ucagcuuauauuuuuuaucuguaaaaccaacaaaaagaacaaagguugucuaaguguuuuuau

SEQ ID NO: 295350 - RNA, 63 nt, Homo Sapiens
auaucucagguugucuaaguuuuuaaucaucaaaaagaacaaccgcccggccuuaaauguuuu

SEQ ID NO: 295351 - RNA, 63 nt, Homo Sapiens
uguuuccuugaaugcuugcuaauauuucaagauaaagaacaaagaaaaaaaucucugcucauu

SEQ ID NO: 295352 - RNA, 63 nt, Homo Sapiens
aagaagacauaagacuucagaaaccaaauguggaaagaacacaucaaugagaaucuguucacc

SEQ ID NO: 295353 - RNA, 63 nt, Homo Sapiens
uaauaaauguauguguggggauauuugagaagaaaagaacauuucucacuagaguuaccauuc

SEQ ID NO: 295354 - RNA, 63 nt, Homo Sapiens
acugaaaaaguucaucugauuaauuauugaaaaaaagaacacgaccuauggcaguugguugaa

SEQ ID NO: 295355 - RNA, 63 nt, Homo Sapiens
gaagguggucauuccuucaacuaaagaagcuguaaagaacauuuuuuuuuuuuuuaaguaaca

SEQ ID NO: 295356 - RNA, 63 nt, Homo Sapiens
uugucaaucugaacagagcaugcgcccggccaaaaagaacauuggauuacaggcgugagccac

SEQ ID NO: 295357 - RNA, 63 nt, Homo Sapiens
uaaaagcuuucuguaguugcuuccuuuaucagaaaagaacauuugauaccaugguauaucauu

SEQ ID NO: 295358 - RNA, 63 nt, Homo Sapiens
uuugauaccaugguauaucauuuccucuucauuaaagaacagcuuuucuaaauguugggggaa

SEQ ID NO: 295359 - RNA, 63 nt, Homo Sapiens
auuuuuacuuuuuuauuauaauuuugauauuaaaaagaacagagauggggucuugcuuuguug

SEQ ID NO: 295360 - RNA, 63 nt, Homo Sapiens
auuuuuguauuuuaauagucuacaggcuauauaaaagaacauggcuuuuugacugauaaaagu

SEQ ID NO: 295361 - RNA, 63 nt, Homo Sapiens
cucugucaccccgccgccacagcccagugacagaaagaacagcccgcugcuccugccccuugg

SEQ ID NO: 295362 - RNA, 63 nt, Homo Sapiens
uucucauugauguugugaaauuauucagacuuuaaagaacaauaaagaaaagcuagaauuuau

SEQ ID NO: 295363 - RNA, 63 nt, Homo Sapiens
auucaagccuguugucuuaacauuuuguauaaaaaagaacaacagaaauuaucugucauuuga

SEQ ID NO: 295364 - RNA, 63 nt, Homo Sapiens
agaaucuaaaagauaacagauuauuugcuuaugaaagaacaauauagucugggaaucccagaa

SEQ ID NO: 295365 - RNA, 63 nt, Homo Sapiens
ccugggucaacucuuuuaauuuauauacaaagcaaagaacaacauuaauggagaugcacaaug

SEQ ID NO: 295366 - RNA, 63 nt, Homo Sapiens
aagauuuuuuucuauuuaaaaccccauuuuccuaaagaacaaaguaguaaaauaaaaaaaaau

SEQ ID NO: 295367 - RNA, 63 nt, Homo Sapiens
augaacauguuuauugcagauucuucuuuuuugaaagaacaacagcaaaacauccacaacucu

SEQ ID NO: 295368 - RNA, 63 nt, Homo Sapiens
uuaucuauugucaguauuuuauguugaauauguaaagaacauuaaaguccuaaaacaucuaag

SEQ ID NO: 295369 - RNA, 63 nt, Homo Sapiens
gucccugaugcaguauguuuauuugugauguuuaaagaacauuucuuggcugggcgcugcggc

SEQ ID NO: 295370 - RNA, 63 nt, Homo Sapiens
uaaauagaaagagagagagaggaaaaaaaaagaaaagaacacuucuuuauuugagggacuuuc

SEQ ID NO: 295371 - RNA, 63 nt, Homo Sapiens
cgacuuuucauggauauugagagagaacaaguuaaagaacaacaaaggcaaaaagaacaaaag

SEQ ID NO: 295372 - RNA, 63 nt, Homo Sapiens
gagagagaacaaguuaaagaacaacaaaggcaaaaagaacaaaagaagaaaauugaaaaguaa

SEQ ID NO: 295373 - RNA, 63 nt, Homo Sapiens
uguuaauauuuuuuaaaaauuuaagcacaagauaaagaacagcaauuuauaccuauuugugua

SEQ ID NO: 295374 - RNA, 63 nt, Homo Sapiens
ugccuaaauuauaaauugguaccagucauuuucaaagaacagggguggcaguuuauuucucaa

SEQ ID NO: 295375 - RNA, 63 nt, Homo Sapiens
aauuauaagcauaaaaacucgggcuuuuuuuucaaagaacaaauaauguuuuacuaugauuua

SEQ ID NO: 295376 - RNA, 63 nt, Homo Sapiens
auuuauguauuguaugacagaauauccuuuuuuaaagaacagaaaagugcucauugcuucuuc

SEQ ID NO: 295377 - RNA, 63 nt, Homo Sapiens
cuuguaaaguuucuuaacuguuuuuuugaggagaaagaacagauuuauuuauagacuuaacuu

SEQ ID NO: 295378 - RNA, 63 nt, Homo Sapiens
uaaaaacccaaaguuccuuauuuugaaauugucaaagaacaaagcgguguuuuucuuuuaaac

SEQ ID NO: 295379 - RNA, 63 nt, Homo Sapiens
gaguacacaaguauaguggcccaggauguagugaaagaacaaauccuagagucuuugaaauuu

SEQ ID NO: 295380 - RNA, 63 nt, Homo Sapiens
aaugucaagucuacaucgacugguaaaacauucaaagaacaaacugacaaugauguucuaccu

SEQ ID NO: 295381 - RNA, 63 nt, Homo Sapiens
auguuauguagacauuauaccucuguacuuucuaaagaacaaauccugugaucuaugcaggac

SEQ ID NO: 295382 - RNA, 63 nt, Homo Sapiens
aaaagaugaaugaaagaaccauuuuacuuuuuuaaagaacagauugagauauuccaaaguuuu

SEQ ID NO: 295383 - RNA, 63 nt, Homo Sapiens
ucugaaaaucaccauuuuaaauacugccugaccaaagaacaaagacuucuuucagagagcuuu

SEQ ID NO: 295384 - RNA, 63 nt, Homo Sapiens
aaagagaaaagccuucuguguugcugguucaggaaagaacagguccagucaggguccugaagu

SEQ ID NO: 295385 - RNA, 63 nt, Homo Sapiens
acaucagaaugcuccucucuuuauagaaauuccaaagaacagcguucuguguuuauuuuuuaa

SEQ ID NO: 295386 - RNA, 63 nt, Homo Sapiens
aaagcacagcucucacuggccaguagcugccaaaaagaacacccaucguauaaggaaauccag

SEQ ID NO: 295387 - RNA, 63 nt, Homo Sapiens
ucucucauguggggauguuugugcugcagacaaaaagaacaaaaaaaaauuuuuaaauaccac

SEQ ID NO: 295388 - RNA, 63 nt, Homo Sapiens
auguaaauucaugaauaaugucucaacagcagaaaagaacaaagugugugugaaacagugaag

SEQ ID NO: 295389 - RNA, 63 nt, Homo Sapiens
cagugauuugaaaaaggaaaacuggugacuaccaaagaacaagcaggaaacuguagcuucuua

SEQ ID NO: 295390 - RNA, 63 nt, Homo Sapiens
auuaggaagcauuucgaaccugcgcaacagaccaaagaacaguacaaagaacauccguguacc

SEQ ID NO: 295391 - RNA, 63 nt, Homo Sapiens
uucgaaccugcgcaacagaccaaagaacaguacaaagaacauccguguacccaguacccugac

SEQ ID NO: 295392 - RNA, 63 nt, Homo Sapiens
uggaaagcacugcagcgauuucucaaagacauaaaagaacauagcauucaacccagcauccca

SEQ ID NO: 295393 - RNA, 63 nt, Homo Sapiens
cauauacaccauggaauacuaugcagccauaaaaaagaacaagacuguguccuuuacagcaac

SEQ ID NO: 295394 - RNA, 63 nt, Homo Sapiens
aaaaaaaaaagaacuuguacaaaagguuaaaaaaaagaacaaacaaaggguuaagucuauuug

SEQ ID NO: 295395 - RNA, 63 nt, Homo Sapiens
caaaauaaacucagugcucauuuauuagaaaucaaagaacacugcacaugauuuuuaaaggua

SEQ ID NO: 295396 - RNA, 63 nt, Homo Sapiens
acuguguauuggucauggauaauaagaucuugcaaagaacaguguauaacauuuguauaauuu

SEQ ID NO: 295397 - RNA, 63 nt, Homo Sapiens
ugaaaaaugauauuuugucuguugaaaggcacaaaagaacaccuuuaucaaguuauaaaauau

SEQ ID NO: 295398 - RNA, 63 nt, Homo Sapiens
cugugcaaagccccaguagucggauuccggggaaaagaacaaguaucuaguuuugaugacaau

SEQ ID NO: 295399 - RNA, 63 nt, Homo Sapiens
auuugagcuggucuggagcagaguuucucccucaaagaacacagagaaaucagagaguggcug

SEQ ID NO: 295400 - RNA, 63 nt, Homo Sapiens
gaucaaugacuguagcuuuuuagacuguuggucaaagaacauucuacuucacaguaauagcuc

SEQ ID NO: 295401 - RNA, 63 nt, Homo Sapiens
acugaauugaaucaaccaguuugcauuuaaauaaaagaacaggcucaguggucuuccuguaga

SEQ ID NO: 295402 - RNA, 64 nt, Homo Sapiens; identical to SEQ ID NO: 214333

SEQ ID NO: 295403 - RNA, 64 nt, Homo Sapiens; identical to SEQ ID NO: 214334

SEQ ID NO: 295404 - RNA, 64 nt, Homo Sapiens; identical to SEQ ID NO: 172152

SEQ ID NO: 295405 - RNA, 64 nt, Homo Sapiens; identical to SEQ ID NO: 172153

SEQ ID NO: 295406 - RNA, 64 nt, Homo Sapiens; identical to SEQ ID NO: 172154

SEQ ID NO: 295407 - RNA, 64 nt, Homo Sapiens; identical to SEQ ID NO: 172155

SEQ ID NO: 295408 - RNA, 64 nt, Homo Sapiens; identical to SEQ ID NO: 172156

SEQ ID NO: 295409 - RNA, 64 nt, Homo Sapiens; identical to SEQ ID NO: 172157

SEQ ID NO: 295410 - RNA, 64 nt, Homo Sapiens; identical to SEQ ID NO: 172158

SEQ ID NO: 295411 - RNA, 64 nt, Homo Sapiens; identical to SEQ ID NO: 172159

SEQ ID NO: 295412 - RNA, 64 nt, Homo Sapiens; identical to SEQ ID NO: 172160

SEQ ID NO: 295413 - RNA, 64 nt, Homo Sapiens; identical to SEQ ID NO: 172161

SEQ ID NO: 295414 - RNA, 64 nt, Homo Sapiens; identical to SEQ ID NO: 172162

SEQ ID NO: 295415 - RNA, 64 nt, Homo Sapiens; identical to SEQ ID NO: 172163

SEQ ID NO: 295416 - RNA, 64 nt, Homo Sapiens; identical to SEQ ID NO: 172164

SEQ ID NO: 295417 - RNA, 64 nt, Homo Sapiens; identical to SEQ ID NO: 172165

SEQ ID NO: 295418 - RNA, 64 nt, Homo Sapiens; identical to SEQ ID NO: 214349

SEQ ID NO: 295419 - RNA, 64 nt, Homo Sapiens; identical to SEQ ID NO: 214350

SEQ ID NO: 295420 - RNA, 64 nt, Homo Sapiens; identical to SEQ ID NO: 214351

SEQ ID NO: 295421 - RNA, 64 nt, Homo Sapiens; identical to SEQ ID NO: 214352

SEQ ID NO: 295422 - RNA, 64 nt, Homo Sapiens; identical to SEQ ID NO: 214353

SEQ ID NO: 295423 - RNA, 64 nt, Homo Sapiens; identical to SEQ ID NO: 214354

SEQ ID NO: 295424 - RNA, 64 nt, Homo Sapiens; identical to SEQ ID NO: 214355

SEQ ID NO: 295425 - RNA, 64 nt, Homo Sapiens; identical to SEQ ID NO: 214356

SEQ ID NO: 295426 - RNA, 64 nt, Homo Sapiens; identical to SEQ ID NO: 214357

SEQ ID NO: 295427 - RNA, 64 nt, Homo Sapiens; identical to SEQ ID NO: 214358

SEQ ID NO: 295428 - RNA, 50 nt, Homo Sapiens; identical to SEQ ID NO: 214359

SEQ ID NO: 295429 - RNA, 64 nt, Homo Sapiens; identical to SEQ ID NO: 214360

SEQ ID NO: 295430 - RNA, 64 nt, Homo Sapiens; identical to SEQ ID NO: 214361

SEQ ID NO: 295431 - RNA, 64 nt, Homo Sapiens; identical to SEQ ID NO: 214362

SEQ ID NO: 295432 - RNA, 64 nt, Homo Sapiens; identical to SEQ ID NO: 214363

SEQ ID NO: 295433 - RNA, 64 nt, Homo Sapiens; identical to SEQ ID NO: 214364

SEQ ID NO: 295434 - RNA, 64 nt, Homo Sapiens; identical to SEQ ID NO: 214365

SEQ ID NO: 295435 - RNA, 64 nt, Homo Sapiens; identical to SEQ ID NO: 214366

SEQ ID NO: 295436 - RNA, 64 nt, Homo Sapiens; identical to SEQ ID NO: 214367

SEQ ID NO: 295437 - RNA, 64 nt, Homo Sapiens; identical to SEQ ID NO: 214368

SEQ ID NO: 295438 - RNA, 64 nt, Homo Sapiens; identical to SEQ ID NO: 214369

SEQ ID NO: 295439 - RNA, 64 nt, Homo Sapiens; identical to SEQ ID NO: 214370

SEQ ID NO: 295440 - RNA, 64 nt, Homo Sapiens; identical to SEQ ID NO: 214371

SEQ ID NO: 295441 - RNA, 64 nt, Homo Sapiens; identical to SEQ ID NO: 214372

SEQ ID NO: 295442 - RNA, 64 nt, Homo Sapiens; identical to SEQ ID NO: 214373

SEQ ID NO: 295443 - RNA, 64 nt, Homo Sapiens; identical to SEQ ID NO: 214374

SEQ ID NO: 295444 - RNA, 64 nt, Homo Sapiens; identical to SEQ ID NO: 214375

SEQ ID NO: 295445 - RNA, 64 nt, Homo Sapiens; identical to SEQ ID NO: 214376

SEQ ID NO: 295446 - RNA, 64 nt, Homo Sapiens; identical to SEQ ID NO: 214377

SEQ ID NO: 295447 - RNA, 64 nt, Homo Sapiens; identical to SEQ ID NO: 214378

SEQ ID NO: 295448 - RNA, 64 nt, Homo Sapiens; identical to SEQ ID NO: 214379

SEQ ID NO: 295449 - RNA, 64 nt, Homo Sapiens; identical to SEQ ID NO: 214380

SEQ ID NO: 295450 - RNA, 64 nt, Homo Sapiens; identical to SEQ ID NO: 214381

SEQ ID NO: 295451 - RNA, 64 nt, Homo Sapiens; identical to SEQ ID NO: 214382

SEQ ID NO: 295452 - RNA, 64 nt, Homo Sapiens; identical to SEQ ID NO: 214383

SEQ ID NO: 295453 - RNA, 64 nt, Homo Sapiens; identical to SEQ ID NO: 214384

SEQ ID NO: 295454 - RNA, 64 nt, Homo Sapiens; identical to SEQ ID NO: 214385

SEQ ID NO: 295455 - RNA, 64 nt, Homo Sapiens; identical to SEQ ID NO: 214386

SEQ ID NO: 295456 - RNA, 64 nt, Homo Sapiens; identical to SEQ ID NO: 214387

SEQ ID NO: 295457 - RNA, 64 nt, Homo Sapiens; identical to SEQ ID NO: 214388

SEQ ID NO: 295458 - RNA, 64 nt, Homo Sapiens; identical to SEQ ID NO: 214389

SEQ ID NO: 295459 - RNA, 64 nt, Homo Sapiens; identical to SEQ ID NO: 214390

SEQ ID NO: 295460 - RNA, 64 nt, Homo Sapiens; identical to SEQ ID NO: 214391

SEQ ID NO: 295461 - RNA, 64 nt, Homo Sapiens; identical to SEQ ID NO: 214392

SEQ ID NO: 295462 - RNA, 64 nt, Homo Sapiens; identical to SEQ ID NO: 214393

SEQ ID NO: 295463 - RNA, 64 nt, Homo Sapiens; identical to SEQ ID NO: 214394

SEQ ID NO: 295464 - RNA, 64 nt, Homo Sapiens; identical to SEQ ID NO: 214395

SEQ ID NO: 295465 - RNA, 64 nt, Homo Sapiens; identical to SEQ ID NO: 214396

SEQ ID NO: 295466 - RNA, 64 nt, Homo Sapiens; identical to SEQ ID NO: 214397

SEQ ID NO: 295467 - RNA, 64 nt, Homo Sapiens; identical to SEQ ID NO: 214398

SEQ ID NO: 295468 - RNA, 64 nt, Homo Sapiens; identical to SEQ ID NO: 214399

SEQ ID NO: 295469 - RNA, 64 nt, Homo Sapiens; identical to SEQ ID NO: 214400

SEQ ID NO: 295470 - RNA, 64 nt, Homo Sapiens; identical to SEQ ID NO: 214401

SEQ ID NO: 295471 - RNA, 64 nt, Homo Sapiens; identical to SEQ ID NO: 214402

SEQ ID NO: 295472 - RNA, 64 nt, Homo Sapiens; identical to SEQ ID NO: 214403

SEQ ID NO: 295473 - RNA, 64 nt, Homo Sapiens; identical to SEQ ID NO: 214404

SEQ ID NO: 295474 - RNA, 64 nt, Homo Sapiens; identical to SEQ ID NO: 214405

SEQ ID NO: 295475 - RNA, 64 nt, Homo Sapiens; identical to SEQ ID NO: 214406

SEQ ID NO: 295476 - RNA, 64 nt, Homo Sapiens; identical to SEQ ID NO: 214407

SEQ ID NO: 295477 - RNA, 64 nt, Homo Sapiens; identical to SEQ ID NO: 214408

SEQ ID NO: 295478 - RNA, 64 nt, Homo Sapiens; identical to SEQ ID NO: 214409

SEQ ID NO: 295479 - RNA, 64 nt, Homo Sapiens; identical to SEQ ID NO: 214410

SEQ ID NO: 295480 - RNA, 64 nt, Homo Sapiens; identical to SEQ ID NO: 214411

SEQ ID NO: 295481 - RNA, 64 nt, Homo Sapiens; identical to SEQ ID NO: 214412

SEQ ID NO: 295482 - RNA, 64 nt, Homo Sapiens; identical to SEQ ID NO: 214413

SEQ ID NO: 295483 - RNA, 64 nt, Homo Sapiens; identical to SEQ ID NO: 214414

SEQ ID NO: 295484 - RNA, 64 nt, Homo Sapiens; identical to SEQ ID NO: 214415

SEQ ID NO: 295485 - RNA, 64 nt, Homo Sapiens; identical to SEQ ID NO: 214416

SEQ ID NO: 295486 - RNA, 64 nt, Homo Sapiens; identical to SEQ ID NO: 214417

SEQ ID NO: 295487 - RNA, 64 nt, Homo Sapiens; identical to SEQ ID NO: 214418

SEQ ID NO: 295488 - RNA, 64 nt, Homo Sapiens; identical to SEQ ID NO: 214419

SEQ ID NO: 295489 - RNA, 64 nt, Homo Sapiens; identical to SEQ ID NO: 214420

SEQ ID NO: 295490 - RNA, 64 nt, Homo Sapiens; identical to SEQ ID NO: 214421

SEQ ID NO: 295491 - RNA, 64 nt, Homo Sapiens; identical to SEQ ID NO: 214422

SEQ ID NO: 295492 - RNA, 64 nt, Homo Sapiens; identical to SEQ ID NO: 214423

SEQ ID NO: 295493 - RNA, 64 nt, Homo Sapiens; identical to SEQ ID NO: 214424

SEQ ID NO: 295494 - RNA, 64 nt, Homo Sapiens; identical to SEQ ID NO: 214425

SEQ ID NO: 295495 - RNA, 64 nt, Homo Sapiens; identical to SEQ ID NO: 214426

SEQ ID NO: 295496 - RNA, 64 nt, Homo Sapiens; identical to SEQ ID NO: 214427

SEQ ID NO: 295497 - RNA, 64 nt, Homo Sapiens; identical to SEQ ID NO: 214428

SEQ ID NO: 295498 - RNA, 64 nt, Homo Sapiens; identical to SEQ ID NO: 214429

SEQ ID NO: 295499 - RNA, 62 nt, Homo Sapiens; identical to SEQ ID NO: 214430

SEQ ID NO: 295500 - RNA, 64 nt, Homo Sapiens; identical to SEQ ID NO: 214431

SEQ ID NO: 295501 - RNA, 64 nt, Homo Sapiens; identical to SEQ ID NO: 214432

SEQ ID NO: 295502 - RNA, 64 nt, Homo Sapiens; identical to SEQ ID NO: 214433

SEQ ID NO: 295503 - RNA, 64 nt, Homo Sapiens; identical to SEQ ID NO: 214434

SEQ ID NO: 295504 - RNA, 64 nt, Homo Sapiens; identical to SEQ ID NO: 214435

SEQ ID NO: 295505 - RNA, 64 nt, Homo Sapiens; identical to SEQ ID NO: 214436

SEQ ID NO: 295506 - RNA, 53 nt, Homo Sapiens; identical to SEQ ID NO: 214437

SEQ ID NO: 295507 - RNA, 64 nt, Homo Sapiens; identical to SEQ ID NO: 214438

SEQ ID NO: 295508 - RNA, 64 nt, Homo Sapiens; identical to SEQ ID NO: 214439

SEQ ID NO: 295509 - RNA, 64 nt, Homo Sapiens; identical to SEQ ID NO: 214440

SEQ ID NO: 295510 - RNA, 64 nt, Homo Sapiens; identical to SEQ ID NO: 214441

SEQ ID NO: 295511 - RNA, 64 nt, Homo Sapiens; identical to SEQ ID NO: 214442

SEQ ID NO: 295512 - RNA, 64 nt, Homo Sapiens; identical to SEQ ID NO: 214443

SEQ ID NO: 295513 - RNA, 64 nt, Homo Sapiens; identical to SEQ ID NO: 214444

SEQ ID NO: 295514 - RNA, 64 nt, Homo Sapiens; identical to SEQ ID NO: 214445

SEQ ID NO: 295515 - RNA, 64 nt, Homo Sapiens; identical to SEQ ID NO: 214446

SEQ ID NO: 295516 - RNA, 64 nt, Homo Sapiens; identical to SEQ ID NO: 214447

SEQ ID NO: 295517 - RNA, 64 nt, Homo Sapiens; identical to SEQ ID NO: 214448

SEQ ID NO: 295518 - RNA, 64 nt, Homo Sapiens; identical to SEQ ID NO: 214449

SEQ ID NO: 295519 - RNA, 64 nt, Homo Sapiens; identical to SEQ ID NO: 214450

SEQ ID NO: 295520 - RNA, 64 nt, Homo Sapiens; identical to SEQ ID NO: 214451

SEQ ID NO: 295521 - RNA, 64 nt, Homo Sapiens; identical to SEQ ID NO: 214452

SEQ ID NO: 295522 - RNA, 64 nt, Homo Sapiens; identical to SEQ ID NO: 214453

SEQ ID NO: 295523 - RNA, 64 nt, Homo Sapiens; identical to SEQ ID NO: 214454

SEQ ID NO: 295524 - RNA, 64 nt, Homo Sapiens; identical to SEQ ID NO: 214455

SEQ ID NO: 295525 - RNA, 64 nt, Homo Sapiens; identical to SEQ ID NO: 214456

SEQ ID NO: 295526 - RNA, 64 nt, Homo Sapiens; identical to SEQ ID NO: 214457

SEQ ID NO: 295527 - RNA, 64 nt, Homo Sapiens; identical to SEQ ID NO: 214458

SEQ ID NO: 295528 - RNA, 64 nt, Homo Sapiens; identical to SEQ ID NO: 214459

SEQ ID NO: 295529 - RNA, 64 nt, Homo Sapiens; identical to SEQ ID NO: 214460

SEQ ID NO: 295530 - RNA, 63 nt, Homo Sapiens; identical to SEQ ID NO: 214461

SEQ ID NO: 295531 - RNA, 64 nt, Homo Sapiens; identical to SEQ ID NO: 214462

SEQ ID NO: 295532 - RNA, 64 nt, Homo Sapiens; identical to SEQ ID NO: 214463

SEQ ID NO: 295533 - RNA, 64 nt, Homo Sapiens; identical to SEQ ID NO: 214464

SEQ ID NO: 295534 - RNA, 64 nt, Homo Sapiens; identical to SEQ ID NO: 214465

SEQ ID NO: 295535 - RNA, 64 nt, Homo Sapiens; identical to SEQ ID NO: 214466

SEQ ID NO: 295536 - RNA, 64 nt, Homo Sapiens; identical to SEQ ID NO: 214467

SEQ ID NO: 295537 - RNA, 64 nt, Homo Sapiens; identical to SEQ ID NO: 214468

SEQ ID NO: 295538 - RNA, 64 nt, Homo Sapiens; identical to SEQ ID NO: 214469

SEQ ID NO: 295539 - RNA, 64 nt, Homo Sapiens; identical to SEQ ID NO: 214470

SEQ ID NO: 295540 - RNA, 64 nt, Homo Sapiens; identical to SEQ ID NO: 214471

SEQ ID NO: 295541 - RNA, 64 nt, Homo Sapiens; identical to SEQ ID NO: 214472

SEQ ID NO: 295542 - RNA, 64 nt, Homo Sapiens; identical to SEQ ID NO: 214473

SEQ ID NO: 295543 - RNA, 64 nt, Homo Sapiens; identical to SEQ ID NO: 214474

SEQ ID NO: 295544 - RNA, 64 nt, Homo Sapiens; identical to SEQ ID NO: 214475

SEQ ID NO: 295545 - RNA, 64 nt, Homo Sapiens; identical to SEQ ID NO: 214476

SEQ ID NO: 295546 - RNA, 64 nt, Homo Sapiens; identical to SEQ ID NO: 214477

SEQ ID NO: 295547 - RNA, 64 nt, Homo Sapiens; identical to SEQ ID NO: 214478

SEQ ID NO: 295548 - RNA, 64 nt, Homo Sapiens; identical to SEQ ID NO: 214479

SEQ ID NO: 295549 - RNA, 64 nt, Homo Sapiens; identical to SEQ ID NO: 214480

SEQ ID NO: 295550 - RNA, 64 nt, Homo Sapiens; identical to SEQ ID NO: 214481

SEQ ID NO: 295551 - RNA, 64 nt, Homo Sapiens; identical to SEQ ID NO: 214482

SEQ ID NO: 295552 - RNA, 64 nt, Homo Sapiens; identical to SEQ ID NO: 214483

SEQ ID NO: 295553 - RNA, 64 nt, Homo Sapiens; identical to SEQ ID NO: 214484

SEQ ID NO: 295554 - RNA, 64 nt, Homo Sapiens; identical to SEQ ID NO: 214485

SEQ ID NO: 295555 - RNA, 64 nt, Homo Sapiens; identical to SEQ ID NO: 214486

SEQ ID NO: 295556 - RNA, 64 nt, Homo Sapiens; identical to SEQ ID NO: 214487

SEQ ID NO: 295557 - RNA, 64 nt, Homo Sapiens; identical to SEQ ID NO: 214488

SEQ ID NO: 295558 - RNA, 64 nt, Homo Sapiens; identical to SEQ ID NO: 214489

SEQ ID NO: 295559 - RNA, 64 nt, Homo Sapiens; identical to SEQ ID NO: 214490

SEQ ID NO: 295560 - RNA, 64 nt, Homo Sapiens; identical to SEQ ID NO: 214491

SEQ ID NO: 295561 - RNA, 64 nt, Homo Sapiens; identical to SEQ ID NO: 214492

SEQ ID NO: 295562 - RNA, 64 nt, Homo Sapiens; identical to SEQ ID NO: 214493

SEQ ID NO: 295563 - RNA, 64 nt, Homo Sapiens; identical to SEQ ID NO: 214494

SEQ ID NO: 295564 - RNA, 64 nt, Homo Sapiens; identical to SEQ ID NO: 214495

SEQ ID NO: 295565 - RNA, 64 nt, Homo Sapiens; identical to SEQ ID NO: 214496

SEQ ID NO: 295566 - RNA, 64 nt, Homo Sapiens; identical to SEQ ID NO: 214497

SEQ ID NO: 295567 - RNA, 64 nt, Homo Sapiens; identical to SEQ ID NO: 214498

SEQ ID NO: 295568 - RNA, 64 nt, Homo Sapiens; identical to SEQ ID NO: 214499

SEQ ID NO: 295569 - RNA, 64 nt, Homo Sapiens; identical to SEQ ID NO: 214500

SEQ ID NO: 295570 - RNA, 64 nt, Homo Sapiens; identical to SEQ ID NO: 214501

SEQ ID NO: 295571 - RNA, 64 nt, Homo Sapiens; identical to SEQ ID NO: 214502

SEQ ID NO: 295572 - RNA, 64 nt, Homo Sapiens; identical to SEQ ID NO: 214503

SEQ ID NO: 295573 - RNA, 64 nt, Homo Sapiens; identical to SEQ ID NO: 214504

SEQ ID NO: 295574 - RNA, 64 nt, Homo Sapiens; identical to SEQ ID NO: 214505

SEQ ID NO: 295575 - RNA, 64 nt, Homo Sapiens; identical to SEQ ID NO: 214506

SEQ ID NO: 295576 - RNA, 64 nt, Homo Sapiens; identical to SEQ ID NO: 214507

SEQ ID NO: 295577 - RNA, 64 nt, Homo Sapiens; identical to SEQ ID NO: 214508

SEQ ID NO: 295578 - RNA, 64 nt, Homo Sapiens; identical to SEQ ID NO: 214509

SEQ ID NO: 295579 - RNA, 64 nt, Homo Sapiens; identical to SEQ ID NO: 214510

SEQ ID NO: 295580 - RNA, 64 nt, Homo Sapiens; identical to SEQ ID NO: 214511

SEQ ID NO: 295581 - RNA, 64 nt, Homo Sapiens; identical to SEQ ID NO: 214512

SEQ ID NO: 295582 - RNA, 64 nt, Homo Sapiens; identical to SEQ ID NO: 214513

SEQ ID NO: 295583 - RNA, 64 nt, Homo Sapiens; identical to SEQ ID NO: 214514

SEQ ID NO: 295584 - RNA, 64 nt, Homo Sapiens; identical to SEQ ID NO: 214515

SEQ ID NO: 295585 - RNA, 64 nt, Homo Sapiens; identical to SEQ ID NO: 214516

SEQ ID NO: 295586 - RNA, 64 nt, Homo Sapiens; identical to SEQ ID NO: 214517

SEQ ID NO: 295587 - RNA, 64 nt, Homo Sapiens; identical to SEQ ID NO: 214518

SEQ ID NO: 295588 - RNA, 64 nt, Homo Sapiens; identical to SEQ ID NO: 214519

SEQ ID NO: 295589 - RNA, 64 nt, Homo Sapiens; identical to SEQ ID NO: 214520

SEQ ID NO: 295590 - RNA, 64 nt, Homo Sapiens; identical to SEQ ID NO: 214521

SEQ ID NO: 295591 - RNA, 64 nt, Homo Sapiens; identical to SEQ ID NO: 214522

SEQ ID NO: 295592 - RNA, 64 nt, Homo Sapiens; identical to SEQ ID NO: 214523

SEQ ID NO: 295593 - RNA, 64 nt, Homo Sapiens; identical to SEQ ID NO: 214524

SEQ ID NO: 295594 - RNA, 64 nt, Homo Sapiens; identical to SEQ ID NO: 214525

SEQ ID NO: 295595 - RNA, 64 nt, Homo Sapiens; identical to SEQ ID NO: 214526

SEQ ID NO: 295596 - RNA, 64 nt, Homo Sapiens; identical to SEQ ID NO: 214527

SEQ ID NO: 295597 - RNA, 64 nt, Homo Sapiens; identical to SEQ ID NO: 214528

SEQ ID NO: 295598 - RNA, 64 nt, Homo Sapiens; identical to SEQ ID NO: 214529

SEQ ID NO: 295599 - RNA, 64 nt, Homo Sapiens; identical to SEQ ID NO: 214530

SEQ ID NO: 295600 - RNA, 64 nt, Homo Sapiens; identical to SEQ ID NO: 214531

SEQ ID NO: 295601 - RNA, 64 nt, Homo Sapiens; identical to SEQ ID NO: 214532

SEQ ID NO: 295602 - RNA, 64 nt, Homo Sapiens; identical to SEQ ID NO: 214533

SEQ ID NO: 295603 - RNA, 64 nt, Homo Sapiens; identical to SEQ ID NO: 214534

SEQ ID NO: 295604 - RNA, 64 nt, Homo Sapiens; identical to SEQ ID NO: 214535

SEQ ID NO: 295605 - RNA, 64 nt, Homo Sapiens; identical to SEQ ID NO: 214536

SEQ ID NO: 295606 - RNA, 64 nt, Homo Sapiens; identical to SEQ ID NO: 214537

SEQ ID NO: 295607 - RNA, 64 nt, Homo Sapiens; identical to SEQ ID NO: 214538

SEQ ID NO: 295608 - RNA, 64 nt, Homo Sapiens; identical to SEQ ID NO: 214539

SEQ ID NO: 295609 - RNA, 64 nt, Homo Sapiens; identical to SEQ ID NO: 214540

SEQ ID NO: 295610 - RNA, 62 nt, Homo Sapiens; identical to SEQ ID NO: 214541

SEQ ID NO: 295611 - RNA, 62 nt, Homo Sapiens; identical to SEQ ID NO: 214542

SEQ ID NO: 295612 - RNA, 62 nt, Homo Sapiens; identical to SEQ ID NO: 214543

SEQ ID NO: 295613 - RNA, 62 nt, Homo Sapiens; identical to SEQ ID NO: 214544

SEQ ID NO: 295614 - RNA, 62 nt, Homo Sapiens; identical to SEQ ID NO: 214545

SEQ ID NO: 295615 - RNA, 62 nt, Homo Sapiens; identical to SEQ ID NO: 214546

SEQ ID NO: 295616 - RNA, 62 nt, Homo Sapiens; identical to SEQ ID NO: 214547

SEQ ID NO: 295617 - RNA, 62 nt, Homo Sapiens; identical to SEQ ID NO: 214548

SEQ ID NO: 295618 - RNA, 62 nt, Homo Sapiens; identical to SEQ ID NO: 214549

SEQ ID NO: 295619 - RNA, 62 nt, Homo Sapiens; identical to SEQ ID NO: 214550

SEQ ID NO: 295620 - RNA, 62 nt, Homo Sapiens; identical to SEQ ID NO: 214551

SEQ ID NO: 295621 - RNA, 62 nt, Homo Sapiens; identical to SEQ ID NO: 214552

SEQ ID NO: 295622 - RNA, 62 nt, Homo Sapiens; identical to SEQ ID NO: 214553

SEQ ID NO: 295623 - RNA, 62 nt, Homo Sapiens; identical to SEQ ID NO: 214554

SEQ ID NO: 295624 - RNA, 62 nt, Homo Sapiens; identical to SEQ ID NO: 214555

SEQ ID NO: 295625 - RNA, 62 nt, Homo Sapiens; identical to SEQ ID NO: 214556

SEQ ID NO: 295626 - RNA, 62 nt, Homo Sapiens; identical to SEQ ID NO: 214557

SEQ ID NO: 295627 - RNA, 62 nt, Homo Sapiens; identical to SEQ ID NO: 214558

SEQ ID NO: 295628 - RNA, 62 nt, Homo Sapiens; identical to SEQ ID NO: 214559

SEQ ID NO: 295629 - RNA, 62 nt, Homo Sapiens; identical to SEQ ID NO: 214560

SEQ ID NO: 295630 - RNA, 62 nt, Homo Sapiens; identical to SEQ ID NO: 214561

SEQ ID NO: 295631 - RNA, 54 nt, Homo Sapiens; identical to SEQ ID NO: 214562

SEQ ID NO: 295632 - RNA, 62 nt, Homo Sapiens; identical to SEQ ID NO: 214563

SEQ ID NO: 295633 - RNA, 62 nt, Homo Sapiens; identical to SEQ ID NO: 214564

SEQ ID NO: 295634 - RNA, 62 nt, Homo Sapiens; identical to SEQ ID NO: 214565

SEQ ID NO: 295635 - RNA, 62 nt, Homo Sapiens; identical to SEQ ID NO: 214566

SEQ ID NO: 295636 - RNA, 62 nt, Homo Sapiens; identical to SEQ ID NO: 214567

SEQ ID NO: 295637 - RNA, 62 nt, Homo Sapiens; identical to SEQ ID NO: 214568

SEQ ID NO: 295638 - RNA, 62 nt, Homo Sapiens; identical to SEQ ID NO: 214569

SEQ ID NO: 295639 - RNA, 62 nt, Homo Sapiens; identical to SEQ ID NO: 214570

SEQ ID NO: 295640 - RNA, 62 nt, Homo Sapiens; identical to SEQ ID NO: 214571

SEQ ID NO: 295641 - RNA, 62 nt, Homo Sapiens; identical to SEQ ID NO: 214572

SEQ ID NO: 295642 - RNA, 62 nt, Homo Sapiens; identical to SEQ ID NO: 214573

SEQ ID NO: 295643 - RNA, 62 nt, Homo Sapiens; identical to SEQ ID NO: 214574

SEQ ID NO: 295644 - RNA, 62 nt, Homo Sapiens; identical to SEQ ID NO: 214575

SEQ ID NO: 295645 - RNA, 62 nt, Homo Sapiens; identical to SEQ ID NO: 214576

SEQ ID NO: 295646 - RNA, 62 nt, Homo Sapiens; identical to SEQ ID NO: 214577

SEQ ID NO: 295647 - RNA, 62 nt, Homo Sapiens; identical to SEQ ID NO: 214578

SEQ ID NO: 295648 - RNA, 62 nt, Homo Sapiens; identical to SEQ ID NO: 214579

SEQ ID NO: 295649 - RNA, 62 nt, Homo Sapiens; identical to SEQ ID NO: 214580

SEQ ID NO: 295650 - RNA, 62 nt, Homo Sapiens; identical to SEQ ID NO: 214581

SEQ ID NO: 295651 - RNA, 62 nt, Homo Sapiens; identical to SEQ ID NO: 214582

SEQ ID NO: 295652 - RNA, 62 nt, Homo Sapiens; identical to SEQ ID NO: 214583

SEQ ID NO: 295653 - RNA, 62 nt, Homo Sapiens; identical to SEQ ID NO: 214584

SEQ ID NO: 295654 - RNA, 62 nt, Homo Sapiens; identical to SEQ ID NO: 214585

SEQ ID NO: 295655 - RNA, 62 nt, Homo Sapiens; identical to SEQ ID NO: 214586

SEQ ID NO: 295656 - RNA, 62 nt, Homo Sapiens; identical to SEQ ID NO: 214587

SEQ ID NO: 295657 - RNA, 62 nt, Homo Sapiens; identical to SEQ ID NO: 214588

SEQ ID NO: 295658 - RNA, 62 nt, Homo Sapiens; identical to SEQ ID NO: 214589

SEQ ID NO: 295659 - RNA, 62 nt, Homo Sapiens; identical to SEQ ID NO: 214590

SEQ ID NO: 295660 - RNA, 62 nt, Homo Sapiens; identical to SEQ ID NO: 214591

SEQ ID NO: 295661 - RNA, 62 nt, Homo Sapiens; identical to SEQ ID NO: 214592

SEQ ID NO: 295662 - RNA, 62 nt, Homo Sapiens; identical to SEQ ID NO: 214593

SEQ ID NO: 295663 - RNA, 62 nt, Homo Sapiens; identical to SEQ ID NO: 214594

SEQ ID NO: 295664 - RNA, 62 nt, Homo Sapiens; identical to SEQ ID NO: 214595

SEQ ID NO: 295665 - RNA, 62 nt, Homo Sapiens; identical to SEQ ID NO: 214596

SEQ ID NO: 295666 - RNA, 62 nt, Homo Sapiens; identical to SEQ ID NO: 214597

SEQ ID NO: 295667 - RNA, 62 nt, Homo Sapiens; identical to SEQ ID NO: 214598

SEQ ID NO: 295668 - RNA, 62 nt, Homo Sapiens; identical to SEQ ID NO: 214599

SEQ ID NO: 295669 - RNA, 62 nt, Homo Sapiens; identical to SEQ ID NO: 214600

SEQ ID NO: 295670 - RNA, 62 nt, Homo Sapiens; identical to SEQ ID NO: 214601

SEQ ID NO: 295671 - RNA, 62 nt, Homo Sapiens; identical to SEQ ID NO: 214602

SEQ ID NO: 295672 - RNA, 62 nt, Homo Sapiens; identical to SEQ ID NO: 214603

SEQ ID NO: 295673 - RNA, 62 nt, Homo Sapiens; identical to SEQ ID NO: 214604

SEQ ID NO: 295674 - RNA, 62 nt, Homo Sapiens; identical to SEQ ID NO: 214605

SEQ ID NO: 295675 - RNA, 62 nt, Homo Sapiens; identical to SEQ ID NO: 214606

SEQ ID NO: 295676 - RNA, 62 nt, Homo Sapiens; identical to SEQ ID NO: 214607

SEQ ID NO: 295677 - RNA, 62 nt, Homo Sapiens; identical to SEQ ID NO: 214608

SEQ ID NO: 295678 - RNA, 62 nt, Homo Sapiens; identical to SEQ ID NO: 214609

SEQ ID NO: 295679 - RNA, 62 nt, Homo Sapiens; identical to SEQ ID NO: 214610

SEQ ID NO: 295680 - RNA, 62 nt, Homo Sapiens; identical to SEQ ID NO: 214611

SEQ ID NO: 295681 - RNA, 62 nt, Homo Sapiens; identical to SEQ ID NO: 214612

SEQ ID NO: 295682 - RNA, 62 nt, Homo Sapiens; identical to SEQ ID NO: 214613

SEQ ID NO: 295683 - RNA, 62 nt, Homo Sapiens; identical to SEQ ID NO: 214614

SEQ ID NO: 295684 - RNA, 62 nt, Homo Sapiens; identical to SEQ ID NO: 214615

SEQ ID NO: 295685 - RNA, 62 nt, Homo Sapiens; identical to SEQ ID NO: 214616

SEQ ID NO: 295686 - RNA, 62 nt, Homo Sapiens; identical to SEQ ID NO: 214617

SEQ ID NO: 295687 - RNA, 62 nt, Homo Sapiens; identical to SEQ ID NO: 214618

SEQ ID NO: 295688 - RNA, 62 nt, Homo Sapiens; identical to SEQ ID NO: 214619

SEQ ID NO: 295689 - RNA, 62 nt, Homo Sapiens; identical to SEQ ID NO: 214620

SEQ ID NO: 295690 - RNA, 62 nt, Homo Sapiens; identical to SEQ ID NO: 214621

SEQ ID NO: 295691 - RNA, 62 nt, Homo Sapiens; identical to SEQ ID NO: 214622

SEQ ID NO: 295692 - RNA, 62 nt, Homo Sapiens; identical to SEQ ID NO: 214623

SEQ ID NO: 295693 - RNA, 62 nt, Homo Sapiens; identical to SEQ ID NO: 214624

SEQ ID NO: 295694 - RNA, 62 nt, Homo Sapiens; identical to SEQ ID NO: 214625

SEQ ID NO: 295695 - RNA, 62 nt, Homo Sapiens; identical to SEQ ID NO: 214626

SEQ ID NO: 295696 - RNA, 62 nt, Homo Sapiens; identical to SEQ ID NO: 214627

SEQ ID NO: 295697 - RNA, 62 nt, Homo Sapiens; identical to SEQ ID NO: 214628

SEQ ID NO: 295698 - RNA, 62 nt, Homo Sapiens; identical to SEQ ID NO: 214629

SEQ ID NO: 295699 - RNA, 62 nt, Homo Sapiens; identical to SEQ ID NO: 214630

SEQ ID NO: 295700 - RNA, 62 nt, Homo Sapiens; identical to SEQ ID NO: 214631

SEQ ID NO: 295701 - RNA, 62 nt, Homo Sapiens; identical to SEQ ID NO: 214632

SEQ ID NO: 295702 - RNA, 62 nt, Homo Sapiens; identical to SEQ ID NO: 214633

SEQ ID NO: 295703 - RNA, 62 nt, Homo Sapiens; identical to SEQ ID NO: 214634

SEQ ID NO: 295704 - RNA, 62 nt, Homo Sapiens; identical to SEQ ID NO: 214635

SEQ ID NO: 295705 - RNA, 62 nt, Homo Sapiens; identical to SEQ ID NO: 214636

SEQ ID NO: 295706 - RNA, 62 nt, Homo Sapiens; identical to SEQ ID NO: 214637

SEQ ID NO: 295707 - RNA, 62 nt, Homo Sapiens; identical to SEQ ID NO: 214638

SEQ ID NO: 295708 - RNA, 62 nt, Homo Sapiens; identical to SEQ ID NO: 214639

SEQ ID NO: 295709 - RNA, 62 nt, Homo Sapiens; identical to SEQ ID NO: 214640

SEQ ID NO: 295710 - RNA, 62 nt, Homo Sapiens; identical to SEQ ID NO: 214641

SEQ ID NO: 295711 - RNA, 62 nt, Homo Sapiens; identical to SEQ ID NO: 214642

SEQ ID NO: 295712 - RNA, 62 nt, Homo Sapiens; identical to SEQ ID NO: 214643

SEQ ID NO: 295713 - RNA, 62 nt, Homo Sapiens; identical to SEQ ID NO: 214644

SEQ ID NO: 295714 - RNA, 62 nt, Homo Sapiens; identical to SEQ ID NO: 214645

SEQ ID NO: 295715 - RNA, 62 nt, Homo Sapiens; identical to SEQ ID NO: 214646

SEQ ID NO: 295716 - RNA, 62 nt, Homo Sapiens; identical to SEQ ID NO: 214647

SEQ ID NO: 295717 - RNA, 62 nt, Homo Sapiens; identical to SEQ ID NO: 214648

SEQ ID NO: 295718 - RNA, 62 nt, Homo Sapiens; identical to SEQ ID NO: 214649

SEQ ID NO: 295719 - RNA, 62 nt, Homo Sapiens; identical to SEQ ID NO: 214650

SEQ ID NO: 295720 - RNA, 62 nt, Homo Sapiens; identical to SEQ ID NO: 214651

SEQ ID NO: 295721 - RNA, 62 nt, Homo Sapiens; identical to SEQ ID NO: 214652

SEQ ID NO: 295722 - RNA, 62 nt, Homo Sapiens; identical to SEQ ID NO: 214653

SEQ ID NO: 295723 - RNA, 62 nt, Homo Sapiens; identical to SEQ ID NO: 214654

SEQ ID NO: 295724 - RNA, 62 nt, Homo Sapiens; identical to SEQ ID NO: 214655

SEQ ID NO: 295725 - RNA, 62 nt, Homo Sapiens; identical to SEQ ID NO: 214656

SEQ ID NO: 295726 - RNA, 62 nt, Homo Sapiens; identical to SEQ ID NO: 214657

SEQ ID NO: 295727 - RNA, 62 nt, Homo Sapiens; identical to SEQ ID NO: 214658

SEQ ID NO: 295728 - RNA, 62 nt, Homo Sapiens; identical to SEQ ID NO: 214659

SEQ ID NO: 295729 - RNA, 62 nt, Homo Sapiens; identical to SEQ ID NO: 214660

SEQ ID NO: 295730 - RNA, 62 nt, Homo Sapiens; identical to SEQ ID NO: 214661

SEQ ID NO: 295731 - RNA, 62 nt, Homo Sapiens; identical to SEQ ID NO: 214662

SEQ ID NO: 295732 - RNA, 62 nt, Homo Sapiens; identical to SEQ ID NO: 214663

SEQ ID NO: 295733 - RNA, 62 nt, Homo Sapiens; identical to SEQ ID NO: 214664

SEQ ID NO: 295734 - RNA, 62 nt, Homo Sapiens; identical to SEQ ID NO: 214665

SEQ ID NO: 295735 - RNA, 62 nt, Homo Sapiens; identical to SEQ ID NO: 214666

SEQ ID NO: 295736 - RNA, 62 nt, Homo Sapiens; identical to SEQ ID NO: 214667

SEQ ID NO: 295737 - RNA, 62 nt, Homo Sapiens; identical to SEQ ID NO: 214668

SEQ ID NO: 295738 - RNA, 62 nt, Homo Sapiens; identical to SEQ ID NO: 214669

SEQ ID NO: 295739 - RNA, 62 nt, Homo Sapiens; identical to SEQ ID NO: 214670

SEQ ID NO: 295740 - RNA, 62 nt, Homo Sapiens; identical to SEQ ID NO: 214671

SEQ ID NO: 295741 - RNA, 61 nt, Homo Sapiens; identical to SEQ ID NO: 214672

SEQ ID NO: 295742 - RNA, 61 nt, Homo Sapiens; identical to SEQ ID NO: 214673

SEQ ID NO: 295743 - RNA, 61 nt, Homo Sapiens; identical to SEQ ID NO: 214674

SEQ ID NO: 295744 - RNA, 61 nt, Homo Sapiens; identical to SEQ ID NO: 214675

SEQ ID NO: 295745 - RNA, 61 nt, Homo Sapiens; identical to SEQ ID NO: 214676

SEQ ID NO: 295746 - RNA, 61 nt, Homo Sapiens; identical to SEQ ID NO: 214677

SEQ ID NO: 295747 - RNA, 61 nt, Homo Sapiens; identical to SEQ ID NO: 214678

SEQ ID NO: 295748 - RNA, 61 nt, Homo Sapiens; identical to SEQ ID NO: 214679

SEQ ID NO: 295749 - RNA, 61 nt, Homo Sapiens; identical to SEQ ID NO: 214680

SEQ ID NO: 295750 - RNA, 61 nt, Homo Sapiens; identical to SEQ ID NO: 214681

SEQ ID NO: 295751 - RNA, 61 nt, Homo Sapiens; identical to SEQ ID NO: 214682

SEQ ID NO: 295752 - RNA, 61 nt, Homo Sapiens; identical to SEQ ID NO: 214683

SEQ ID NO: 295753 - RNA, 61 nt, Homo Sapiens; identical to SEQ ID NO: 214684

SEQ ID NO: 295754 - RNA, 55 nt, Homo Sapiens; identical to SEQ ID NO: 214685

SEQ ID NO: 295755 - RNA, 61 nt, Homo Sapiens; identical to SEQ ID NO: 214686

SEQ ID NO: 295756 - RNA, 61 nt, Homo Sapiens; identical to SEQ ID NO: 214687

SEQ ID NO: 295757 - RNA, 61 nt, Homo Sapiens; identical to SEQ ID NO: 214688

SEQ ID NO: 295758 - RNA, 61 nt, Homo Sapiens; identical to SEQ ID NO: 214689

SEQ ID NO: 295759 - RNA, 61 nt, Homo Sapiens; identical to SEQ ID NO: 214690

SEQ ID NO: 295760 - RNA, 61 nt, Homo Sapiens; identical to SEQ ID NO: 214691

SEQ ID NO: 295761 - RNA, 61 nt, Homo Sapiens; identical to SEQ ID NO: 214692

SEQ ID NO: 295762 - RNA, 61 nt, Homo Sapiens; identical to SEQ ID NO: 214693

SEQ ID NO: 295763 - RNA, 61 nt, Homo Sapiens; identical to SEQ ID NO: 214694

SEQ ID NO: 295764 - RNA, 61 nt, Homo Sapiens; identical to SEQ ID NO: 214695

SEQ ID NO: 295765 - RNA, 61 nt, Homo Sapiens; identical to SEQ ID NO: 214696

SEQ ID NO: 295766 - RNA, 61 nt, Homo Sapiens; identical to SEQ ID NO: 214697

SEQ ID NO: 295767 - RNA, 61 nt, Homo Sapiens; identical to SEQ ID NO: 214698

SEQ ID NO: 295768 - RNA, 61 nt, Homo Sapiens; identical to SEQ ID NO: 214699

SEQ ID NO: 295769 - RNA, 61 nt, Homo Sapiens; identical to SEQ ID NO: 214700

SEQ ID NO: 295770 - RNA, 61 nt, Homo Sapiens; identical to SEQ ID NO: 214701

SEQ ID NO: 295771 - RNA, 61 nt, Homo Sapiens; identical to SEQ ID NO: 214702

SEQ ID NO: 295772 - RNA, 61 nt, Homo Sapiens; identical to SEQ ID NO: 214703

SEQ ID NO: 295773 - RNA, 61 nt, Homo Sapiens; identical to SEQ ID NO: 214704

SEQ ID NO: 295774 - RNA, 61 nt, Homo Sapiens; identical to SEQ ID NO: 214705

SEQ ID NO: 295775 - RNA, 61 nt, Homo Sapiens; identical to SEQ ID NO: 214706

SEQ ID NO: 295776 - RNA, 61 nt, Homo Sapiens; identical to SEQ ID NO: 214707

SEQ ID NO: 295777 - RNA, 61 nt, Homo Sapiens; identical to SEQ ID NO: 214708

SEQ ID NO: 295778 - RNA, 61 nt, Homo Sapiens; identical to SEQ ID NO: 214709

SEQ ID NO: 295779 - RNA, 61 nt, Homo Sapiens; identical to SEQ ID NO: 214710

SEQ ID NO: 295780 - RNA, 61 nt, Homo Sapiens; identical to SEQ ID NO: 214711

SEQ ID NO: 295781 - RNA, 61 nt, Homo Sapiens; identical to SEQ ID NO: 214712

SEQ ID NO: 295782 - RNA, 61 nt, Homo Sapiens; identical to SEQ ID NO: 214713

SEQ ID NO: 295783 - RNA, 61 nt, Homo Sapiens; identical to SEQ ID NO: 214714

SEQ ID NO: 295784 - RNA, 61 nt, Homo Sapiens; identical to SEQ ID NO: 214715

SEQ ID NO: 295785 - RNA, 61 nt, Homo Sapiens; identical to SEQ ID NO: 214716

SEQ ID NO: 295786 - RNA, 61 nt, Homo Sapiens; identical to SEQ ID NO: 214717

SEQ ID NO: 295787 - RNA, 61 nt, Homo Sapiens; identical to SEQ ID NO: 214718

SEQ ID NO: 295788 - RNA, 61 nt, Homo Sapiens; identical to SEQ ID NO: 214719

SEQ ID NO: 295789 - RNA, 61 nt, Homo Sapiens; identical to SEQ ID NO: 214720

SEQ ID NO: 295790 - RNA, 61 nt, Homo Sapiens; identical to SEQ ID NO: 214721

SEQ ID NO: 295791 - RNA, 61 nt, Homo Sapiens; identical to SEQ ID NO: 214722

SEQ ID NO: 295792 - RNA, 61 nt, Homo Sapiens; identical to SEQ ID NO: 214723

SEQ ID NO: 295793 - RNA, 61 nt, Homo Sapiens; identical to SEQ ID NO: 214724

SEQ ID NO: 295794 - RNA, 61 nt, Homo Sapiens; identical to SEQ ID NO: 214725

SEQ ID NO: 295795 - RNA, 61 nt, Homo Sapiens; identical to SEQ ID NO: 214726

SEQ ID NO: 295796 - RNA, 61 nt, Homo Sapiens; identical to SEQ ID NO: 214727

SEQ ID NO: 295797 - RNA, 61 nt, Homo Sapiens; identical to SEQ ID NO: 214728

SEQ ID NO: 295798 - RNA, 61 nt, Homo Sapiens; identical to SEQ ID NO: 214729

SEQ ID NO: 295799 - RNA, 61 nt, Homo Sapiens; identical to SEQ ID NO: 214730

SEQ ID NO: 295800 - RNA, 61 nt, Homo Sapiens; identical to SEQ ID NO: 214731

SEQ ID NO: 295801 - RNA, 61 nt, Homo Sapiens; identical to SEQ ID NO: 214732

SEQ ID NO: 295802 - RNA, 61 nt, Homo Sapiens; identical to SEQ ID NO: 214733

SEQ ID NO: 295803 - RNA, 61 nt, Homo Sapiens; identical to SEQ ID NO: 214734

SEQ ID NO: 295804 - RNA, 61 nt, Homo Sapiens; identical to SEQ ID NO: 214735

SEQ ID NO: 295805 - RNA, 61 nt, Homo Sapiens; identical to SEQ ID NO: 214736

SEQ ID NO: 295806 - RNA, 61 nt, Homo Sapiens; identical to SEQ ID NO: 214737

SEQ ID NO: 295807 - RNA, 61 nt, Homo Sapiens; identical to SEQ ID NO: 214738

SEQ ID NO: 295808 - RNA, 61 nt, Homo Sapiens; identical to SEQ ID NO: 214739

SEQ ID NO: 295809 - RNA, 61 nt, Homo Sapiens; identical to SEQ ID NO: 214740

SEQ ID NO: 295810 - RNA, 61 nt, Homo Sapiens; identical to SEQ ID NO: 214741

SEQ ID NO: 295811 - RNA, 61 nt, Homo Sapiens; identical to SEQ ID NO: 214742

SEQ ID NO: 295812 - RNA, 61 nt, Homo Sapiens; identical to SEQ ID NO: 214743

SEQ ID NO: 295813 - RNA, 61 nt, Homo Sapiens; identical to SEQ ID NO: 214744

SEQ ID NO: 295814 - RNA, 61 nt, Homo Sapiens; identical to SEQ ID NO: 214745

SEQ ID NO: 295815 - RNA, 61 nt, Homo Sapiens; identical to SEQ ID NO: 214746

SEQ ID NO: 295816 - RNA, 61 nt, Homo Sapiens; identical to SEQ ID NO: 214747

SEQ ID NO: 295817 - RNA, 61 nt, Homo Sapiens; identical to SEQ ID NO: 214748

SEQ ID NO: 295818 - RNA, 61 nt, Homo Sapiens; identical to SEQ ID NO: 214749

SEQ ID NO: 295819 - RNA, 61 nt, Homo Sapiens; identical to SEQ ID NO: 214750

SEQ ID NO: 295820 - RNA, 61 nt, Homo Sapiens; identical to SEQ ID NO: 214751

SEQ ID NO: 295821 - RNA, 61 nt, Homo Sapiens; identical to SEQ ID NO: 214752

SEQ ID NO: 295822 - RNA, 61 nt, Homo Sapiens; identical to SEQ ID NO: 214753

SEQ ID NO: 295823 - RNA, 61 nt, Homo Sapiens; identical to SEQ ID NO: 214754

SEQ ID NO: 295824 - RNA, 61 nt, Homo Sapiens; identical to SEQ ID NO: 214755

SEQ ID NO: 295825 - RNA, 61 nt, Homo Sapiens; identical to SEQ ID NO: 214756

SEQ ID NO: 295826 - RNA, 61 nt, Homo Sapiens; identical to SEQ ID NO: 214757

SEQ ID NO: 295827 - RNA, 61 nt, Homo Sapiens; identical to SEQ ID NO: 214758

SEQ ID NO: 295828 - RNA, 61 nt, Homo Sapiens; identical to SEQ ID NO: 214759

SEQ ID NO: 295829 - RNA, 61 nt, Homo Sapiens; identical to SEQ ID NO: 214760

SEQ ID NO: 295830 - RNA, 61 nt, Homo Sapiens; identical to SEQ ID NO: 214761

SEQ ID NO: 295831 - RNA, 61 nt, Homo Sapiens; identical to SEQ ID NO: 214762

SEQ ID NO: 295832 - RNA, 61 nt, Homo Sapiens; identical to SEQ ID NO: 214763

SEQ ID NO: 295833 - RNA, 61 nt, Homo Sapiens; identical to SEQ ID NO: 214764

SEQ ID NO: 295834 - RNA, 61 nt, Homo Sapiens; identical to SEQ ID NO: 214765

SEQ ID NO: 295835 - RNA, 61 nt, Homo Sapiens; identical to SEQ ID NO: 214766

SEQ ID NO: 295836 - RNA, 61 nt, Homo Sapiens; identical to SEQ ID NO: 214767

SEQ ID NO: 295837 - RNA, 61 nt, Homo Sapiens; identical to SEQ ID NO: 214768

SEQ ID NO: 295838 - RNA, 61 nt, Homo Sapiens; identical to SEQ ID NO: 214769

SEQ ID NO: 295839 - RNA, 61 nt, Homo Sapiens; identical to SEQ ID NO: 214770

SEQ ID NO: 295840 - RNA, 61 nt, Homo Sapiens; identical to SEQ ID NO: 214771

SEQ ID NO: 295841 - RNA, 61 nt, Homo Sapiens; identical to SEQ ID NO: 214772

SEQ ID NO: 295842 - RNA, 61 nt, Homo Sapiens; identical to SEQ ID NO: 214773

SEQ ID NO: 295843 - RNA, 61 nt, Homo Sapiens; identical to SEQ ID NO: 214774

SEQ ID NO: 295844 - RNA, 61 nt, Homo Sapiens; identical to SEQ ID NO: 214775

SEQ ID NO: 295845 - RNA, 61 nt, Homo Sapiens; identical to SEQ ID NO: 214776

SEQ ID NO: 295846 - RNA, 61 nt, Homo Sapiens; identical to SEQ ID NO: 214777

SEQ ID NO: 295847 - RNA, 61 nt, Homo Sapiens; identical to SEQ ID NO: 214778

SEQ ID NO: 295848 - RNA, 61 nt, Homo Sapiens; identical to SEQ ID NO: 214779

SEQ ID NO: 295849 - RNA, 61 nt, Homo Sapiens; identical to SEQ ID NO: 214780

SEQ ID NO: 295850 - RNA, 61 nt, Homo Sapiens; identical to SEQ ID NO: 214781

SEQ ID NO: 295851 - RNA, 61 nt, Homo Sapiens; identical to SEQ ID NO: 214782

SEQ ID NO: 295852 - RNA, 61 nt, Homo Sapiens; identical to SEQ ID NO: 214783

SEQ ID NO: 295853 - RNA, 58 nt, Homo Sapiens; identical to SEQ ID NO: 214784

SEQ ID NO: 295854 - RNA, 61 nt, Homo Sapiens; identical to SEQ ID NO: 214785

SEQ ID NO: 295855 - RNA, 61 nt, Homo Sapiens; identical to SEQ ID NO: 214786

SEQ ID NO: 295856 - RNA, 61 nt, Homo Sapiens; identical to SEQ ID NO: 214787

SEQ ID NO: 295857 - RNA, 61 nt, Homo Sapiens; identical to SEQ ID NO: 214788

SEQ ID NO: 295858 - RNA, 61 nt, Homo Sapiens; identical to SEQ ID NO: 214789

SEQ ID NO: 295859 - RNA, 61 nt, Homo Sapiens; identical to SEQ ID NO: 214790

SEQ ID NO: 295860 - RNA, 61 nt, Homo Sapiens; identical to SEQ ID NO: 214791

SEQ ID NO: 295861 - RNA, 61 nt, Homo Sapiens; identical to SEQ ID NO: 214792

SEQ ID NO: 295862 - RNA, 61 nt, Homo Sapiens; identical to SEQ ID NO: 214793

SEQ ID NO: 295863 - RNA, 61 nt, Homo Sapiens; identical to SEQ ID NO: 214794

SEQ ID NO: 295864 - RNA, 61 nt, Homo Sapiens; identical to SEQ ID NO: 214795

SEQ ID NO: 295865 - RNA, 61 nt, Homo Sapiens; identical to SEQ ID NO: 214796

SEQ ID NO: 295866 - RNA, 61 nt, Homo Sapiens; identical to SEQ ID NO: 214797

SEQ ID NO: 295867 - RNA, 61 nt, Homo Sapiens; identical to SEQ ID NO: 214798

SEQ ID NO: 295868 - RNA, 61 nt, Homo Sapiens; identical to SEQ ID NO: 214799

SEQ ID NO: 295869 - RNA, 61 nt, Homo Sapiens; identical to SEQ ID NO: 214800

SEQ ID NO: 295870 - RNA, 61 nt, Homo Sapiens; identical to SEQ ID NO: 214801

SEQ ID NO: 295871 - RNA, 61 nt, Homo Sapiens; identical to SEQ ID NO: 214802

SEQ ID NO: 295872 - RNA, 61 nt, Homo Sapiens; identical to SEQ ID NO: 214803

SEQ ID NO: 295873 - RNA, 61 nt, Homo Sapiens; identical to SEQ ID NO: 214804

SEQ ID NO: 295874 - RNA, 61 nt, Homo Sapiens; identical to SEQ ID NO: 214805

SEQ ID NO: 295875 - RNA, 61 nt, Homo Sapiens; identical to SEQ ID NO: 214806

SEQ ID NO: 295876 - RNA, 61 nt, Homo Sapiens; identical to SEQ ID NO: 214807

SEQ ID NO: 295877 - RNA, 61 nt, Homo Sapiens; identical to SEQ ID NO: 214808

SEQ ID NO: 295878 - RNA, 61 nt, Homo Sapiens; identical to SEQ ID NO: 214809

SEQ ID NO: 295879 - RNA, 61 nt, Homo Sapiens; identical to SEQ ID NO: 214810

SEQ ID NO: 295880 - RNA, 61 nt, Homo Sapiens; identical to SEQ ID NO: 214811

SEQ ID NO: 295881 - RNA, 61 nt, Homo Sapiens; identical to SEQ ID NO: 214812

SEQ ID NO: 295882 - RNA, 61 nt, Homo Sapiens; identical to SEQ ID NO: 214813

SEQ ID NO: 295883 - RNA, 61 nt, Homo Sapiens; identical to SEQ ID NO: 214814

SEQ ID NO: 295884 - RNA, 61 nt, Homo Sapiens; identical to SEQ ID NO: 214815

SEQ ID NO: 295885 - RNA, 61 nt, Homo Sapiens; identical to SEQ ID NO: 214816

SEQ ID NO: 295886 - RNA, 61 nt, Homo Sapiens; identical to SEQ ID NO: 214817

SEQ ID NO: 295887 - RNA, 61 nt, Homo Sapiens; identical to SEQ ID NO: 214818

SEQ ID NO: 295888 - RNA, 61 nt, Homo Sapiens; identical to SEQ ID NO: 214819

SEQ ID NO: 295889 - RNA, 61 nt, Homo Sapiens; identical to SEQ ID NO: 214820

SEQ ID NO: 295890 - RNA, 61 nt, Homo Sapiens; identical to SEQ ID NO: 214821

SEQ ID NO: 295891 - RNA, 61 nt, Homo Sapiens; identical to SEQ ID NO: 214822

SEQ ID NO: 295892 - RNA, 61 nt, Homo Sapiens; identical to SEQ ID NO: 214823

SEQ ID NO: 295893 - RNA, 61 nt, Homo Sapiens; identical to SEQ ID NO: 214824

SEQ ID NO: 295894 - RNA, 61 nt, Homo Sapiens; identical to SEQ ID NO: 214825

SEQ ID NO: 295895 - RNA, 58 nt, Homo Sapiens; identical to SEQ ID NO: 214826

SEQ ID NO: 295896 - RNA, 61 nt, Homo Sapiens; identical to SEQ ID NO: 214827

SEQ ID NO: 295897 - RNA, 61 nt, Homo Sapiens; identical to SEQ ID NO: 214828

SEQ ID NO: 295898 - RNA, 61 nt, Homo Sapiens; identical to SEQ ID NO: 214829

SEQ ID NO: 295899 - RNA, 61 nt, Homo Sapiens; identical to SEQ ID NO: 214830

SEQ ID NO: 295900 - RNA, 61 nt, Homo Sapiens; identical to SEQ ID NO: 214831

SEQ ID NO: 295901 - RNA, 61 nt, Homo Sapiens; identical to SEQ ID NO: 214832

SEQ ID NO: 295902 - RNA, 61 nt, Homo Sapiens; identical to SEQ ID NO: 214833

SEQ ID NO: 295903 - RNA, 61 nt, Homo Sapiens; identical to SEQ ID NO: 214834

SEQ ID NO: 295904 - RNA, 61 nt, Homo Sapiens; identical to SEQ ID NO: 214835

SEQ ID NO: 295905 - RNA, 61 nt, Homo Sapiens; identical to SEQ ID NO: 214836

SEQ ID NO: 295906 - RNA, 61 nt, Homo Sapiens; identical to SEQ ID NO: 214837

SEQ ID NO: 295907 - RNA, 61 nt, Homo Sapiens; identical to SEQ ID NO: 214838

SEQ ID NO: 295908 - RNA, 61 nt, Homo Sapiens; identical to SEQ ID NO: 214839

SEQ ID NO: 295909 - RNA, 64 nt, Homo Sapiens
aguagauaucuuaaauucaauaaaaucacuggaaguuuuucaugauaacuuauuuuaagaugcc

SEQ ID NO: 295910 - RNA, 64 nt, Homo Sapiens
aagguauuguauuucaacaauggacuaugccuugguuuuucacuaaucaaaaucaaaauuacuc

SEQ ID NO: 295911 - RNA, 64 nt, Homo Sapiens
uauaaaauugucaagcuagcuuuacucacuucauguuuuucacccaucuuugugguuuaguuua

SEQ ID NO: 295912 - RNA, 64 nt, Homo Sapiens
gauaaggaaaaauauuuugcccucuacuuaauuuguuuuucagauaaagugcauuuuuaaauuu

SEQ ID NO: 295913 - RNA, 64 nt, Homo Sapiens
aguucugaacuuuuuaguauuuauauaaacuuuuguuuuucagcuuucaccccuuggcuuuauu

SEQ ID NO: 295914 - RNA, 64 nt, Homo Sapiens
ccuuggcuuuauuuuauauauaauacauuugauaguuuuucaccuauuuggcuuuagaugguuu

SEQ ID NO: 295915 - RNA, 64 nt, Homo Sapiens
cccucuccacuuccuucagagucaucuuaaacugguuuuucaguuauucuuuguuuuaccugug

SEQ ID NO: 295916 - RNA, 64 nt, Homo Sapiens
ugccacaucucaaaauaaaaucaacaugaccaauguuuuucaucauuuggacaacucaaaucca

SEQ ID NO: 295917 - RNA, 64 nt, Homo Sapiens
cagccaccacgccuggccugauaguuuccacauaguuuuucaugacuuagaagauaucauugcc

SEQ ID NO: 295918 - RNA, 64 nt, Homo Sapiens
gaggaaaaauaguucaaggaguuuuugccucuuuguuuuucaauagauuauucugccauuuuuu

SEQ ID NO: 295919 - RNA, 64 nt, Homo Sapiens
ggaacauuacugcuaaucugcuguuaagugaacgguuuuucauuuuacccuuuuguuuuucagu

SEQ ID NO: 295920 - RNA, 64 nt, Homo Sapiens
cuguuaagugaacgguuuuucauuuuacccuuuuguuuuucaguccagguuggagaucguagcu

SEQ ID NO: 295921 - RNA, 64 nt, Homo Sapiens
uguuacaguuuucuucaucaaugagugugauccaguuuuucauaagauauuuuauuuugaaaug

SEQ ID NO: 295922 - RNA, 64 nt, Homo Sapiens
cgacuuguucuugauagccucauuaaagcauuugguuuuucacauagugguggccuauuguguu

SEQ ID NO: 295923 - RNA, 64 nt, Homo Sapiens
gcugaguacugcuucauugaguuuuuguuuuuauguuuuucauuugugguagcaugugucacga

SEQ ID NO: 295924 - RNA, 64 nt, Homo Sapiens
caaugaauguuuauaccuuuaacuuuaugacauuguuuuucaacccccccacagauacggggac

SEQ ID NO: 295925 - RNA, 64 nt, Homo Sapiens
gcucgugugcuccuuggccgcuuacuggaagggcguuuuucagagcugcagggacagggugagc

SEQ ID NO: 295926 - RNA, 64 nt, Homo Sapiens
uccaaaauauguacauucagcuguuugguuuuucguuuuucauuguuauuauugugagaaugcu

SEQ ID NO: 295927 - RNA, 64 nt, Homo Sapiens
guguguagccuguggaaagcccauucggaacaauguuuuucacuuggaggauggugaacccuac

SEQ ID NO: 295928 - RNA, 64 nt, Homo Sapiens
ggaauugugaaucagaagauuauaccccccaauuguuuuucaauccccuuuucucaaauaauaa

SEQ ID NO: 295929 - RNA, 64 nt, Homo Sapiens
gcuauuacaauccucucucuacuuaaaaaaacauguuuuucaugaaaaucuaaauucuuuuguu

SEQ ID NO: 295930 - RNA, 64 nt, Homo Sapiens
guuguuaacauuguguaauagggcauuuuguauuguuuuucauguuuucuacuuguuaaaugga

SEQ ID NO: 295931 - RNA, 64 nt, Homo Sapiens
uguauuauagaaugcuuuugaucuuguuuuguguguuuuucacacucccacuacaucaagacua

SEQ ID NO: 295932 - RNA, 64 nt, Homo Sapiens
ggucuguuuuuccuuucaugagaauauuuacguaguuuuucauaaccugucuuccuguuucuca

SEQ ID NO: 295933 - RNA, 64 nt, Homo Sapiens
uuuaaagaauauuauuaugggugugcucuuuacuguuuuucauuuguugugaguaaauaaaaau

SEQ ID NO: 295934 - RNA, 64 nt, Homo Sapiens
uaauaugugaccaauauacuuauuuguuauuuaaguuuuucagaauacauucuuuuaaaaagua

SEQ ID NO: 295935 - RNA, 64 nt, Homo Sapiens
uuauaguguaucuuguucuuaaauaaaagcaucuguuuuucacuuaaguuguuuccaauacaau

SEQ ID NO: 295936 - RNA, 64 nt, Homo Sapiens
aaauuuauauuguuuugcuauuguuuguaauuuuguuuuucagcguucuguuaaguucuuucau

SEQ ID NO: 295937 - RNA, 64 nt, Homo Sapiens
uauugaguuuagaugccuacuuaacaucacauuuguuuuucagguuuaaaauuucagauguaau

SEQ ID NO: 295938 - RNA, 64 nt, Homo Sapiens
uugucauauugaaaaaugauccuaaaguguguaaguuuuucauuagauaaguauuaagcgcuac

SEQ ID NO: 295939 - RNA, 64 nt, Homo Sapiens
cuguggcccagcacuggucauuuaaaggaauggaguuuuucagcccuuuaagcaucauuuaaau

SEQ ID NO: 295940 - RNA, 64 nt, Homo Sapiens
auuucauuagguaaauaauggcugaauauguauaguuuuucacaggaccaaauuaaaacauuuu

SEQ ID NO: 295941 - RNA, 64 nt, Homo Sapiens
gcauaugcugcacaagaacauggaacagcagcaaguuuuucagugucccuaucauuucagcaag

SEQ ID NO: 295942 - RNA, 64 nt, Homo Sapiens
uguugcuaugaaugauuuugcaaccaauuuuuuuguuuuucagucauuguacagacaugggaaa

SEQ ID NO: 295943 - RNA, 64 nt, Homo Sapiens
aauguccugcuguauuuaccacuacaaggcagcuguuuuucaauauacuuguacuguauuuugu

SEQ ID NO: 295944 - RNA, 64 nt, Homo Sapiens
uagaaucucuauccacguaucagguuauagacugguuuuucaaaagugaacaauccugugauaa

SEQ ID NO: 295945 - RNA, 64 nt, Homo Sapiens
ucauauggucugauuagugacauaaguagcagccguuuuucaacuucaguuucauucacuacca

SEQ ID NO: 295946 - RNA, 64 nt, Homo Sapiens
aguaguuuaaaucuuuuguuaaugcuccuccgaaguuuuucaggggguaaaaguaacaucagug

SEQ ID NO: 295947 - RNA, 64 nt, Homo Sapiens
ccugcauauuuuuucuuaaauauuucccaauuguguuuuucauuauuucuuuucaauauauaac

SEQ ID NO: 295948 - RNA, 64 nt, Homo Sapiens
ugauuucaguguuuaugacuuuaucuaggaguuuguuuuucauuuuguuuuuuuaaaguauuag

SEQ ID NO: 295949 - RNA, 64 nt, Homo Sapiens
uguggcucauauuuaggaagcuauauaaaauucaguuuuucauuuaacauuugcucuuuugcau

SEQ ID NO: 295950 - RNA, 64 nt, Homo Sapiens
aucuuuaaaauauaagacaggcguuaaaaauuguguuuuucagauuugauggcggacuacauaa

SEQ ID NO: 295951 - RNA, 64 nt, Homo Sapiens
aaguccugugccauuucaccucuucuccuaaccaguuuuucaccaccugggcuuuucucuuucc

SEQ ID NO: 295952 - RNA, 64 nt, Homo Sapiens
guacuugucuugaucuuuuucauuugaaggaccaguuuuucauggcccucaauuuucccccuuu

SEQ ID NO: 295953 - RNA, 64 nt, Homo Sapiens
ugacguggaagcccuggguggguuuauguguuugguuuuucagcaugcccguugggcaaacuua

SEQ ID NO: 295954 - RNA, 64 nt, Homo Sapiens
cuccucaacucuguugauauuuggggaaaauucuguuuuucauagauucuuugagaugcugaug

SEQ ID NO: 295955 - RNA, 64 nt, Homo Sapiens
ggacuaacaccugguuugguacagagacugagaaguuuuucauucuggugucaaaguuuuguua

SEQ ID NO: 295956 - RNA, 64 nt, Homo Sapiens
cagcugccaccugcuucucaaaaggcaaauugcuguuuuucaguuuucagagaacaccuuuauc

SEQ ID NO: 295957 - RNA, 64 nt, Homo Sapiens
guguauguguguguauauguugcaggguuuggguguuuuucaguauuuuacuguuucuggugca

SEQ ID NO: 295958 - RNA, 64 nt, Homo Sapiens
aguaaaauuuaagauuaaaaguugaagugcacauguuuuucaagugaguggccuuagugaguuu

SEQ ID NO: 295959 - RNA, 64 nt, Homo Sapiens
aaauauuuugaaacauguuuugucaugguaaauuguuuuucaauguauguuugugguauaggaa

SEQ ID NO: 295960 - RNA, 64 nt, Homo Sapiens
ugaacuugugcagccuuagccaagacaaagcaguguuuuucagcagacggcugaugggacagga

SEQ ID NO: 295961 - RNA, 64 nt, Homo Sapiens
aaucugcagucuccugcugcaguucaacucugcuguuuuucagucauuuccuacugugagugga

SEQ ID NO: 295962 - RNA, 64 nt, Homo Sapiens
cuccagcuaacuuccagggucucagcaaacugcuguuuuucacgaguaucaacuuucauacuga

SEQ ID NO: 295963 - RNA, 64 nt, Homo Sapiens
ugugugugacauucucucaugggacaauguugggguuuuucagacugacaggacugcaagaggg

SEQ ID NO: 295964 - RNA, 64 nt, Homo Sapiens
aagccaaauucuguuuacggugaaaaaggauuuuguuuuucacccaauuugggaggcgggaggg

SEQ ID NO: 295965 - RNA, 64 nt, Homo Sapiens
auucuuaacucuuuacgccuaaugaacaagcacaguuuuucaauggugaagaaaaaagcaccag

SEQ ID NO: 295966 - RNA, 64 nt, Homo Sapiens
gcaucuaaagauugauuagaaaguuugugcgcauguuuuucauuauaacaaugaaaacacaaaa

SEQ ID NO: 295967 - RNA, 64 nt, Homo Sapiens
ggaaccuguuggcuaaccauuggggccuuacacuguuuuucaaaugguugcaacauuuaacuuc

SEQ ID NO: 295968 - RNA, 64 nt, Homo Sapiens
ugucguggacccccagguuguaaaauggcgaguuguuuuucaguucugguucaacuuuguguaa

SEQ ID NO: 295969 - RNA, 64 nt, Homo Sapiens
aaaaguguccuccucuuucucuuuucuaguuguuguuuuucaauugccucucucuuccccauag

SEQ ID NO: 295970 - RNA, 64 nt, Homo Sapiens
cuugucaguuuuuuuaaugaggcagggauacucuguuuuucacacuaaacauaugaaugcagca

SEQ ID NO: 295971 - RNA, 64 nt, Homo Sapiens
aagaaauauuuggauguuaaauuaacucacuaugguuuuucaccugggaaggaaacaaauuacg

SEQ ID NO: 295972 - RNA, 64 nt, Homo Sapiens
uacugggagccgggggcucaggcaguaggaccugguuuuucagggcccaagagagcauccagaa

SEQ ID NO: 295973 - RNA, 64 nt, Homo Sapiens
gugugccuccccgagccucacaagguaggcuuguguuuuucaguauguuucuucaucucaucgc

SEQ ID NO: 295974 - RNA, 64 nt, Homo Sapiens
aacauaacuaugaaaaaacuuugcuaauaucuguguuuuucagauuucauuuuuuguaaaauca

SEQ ID NO: 295975 - RNA, 64 nt, Homo Sapiens
ggauaaaguaugguuuuauuuugguguaauuuagguuuuucaacaaagcccuugucuaaaauaa

SEQ ID NO: 295976 - RNA, 64 nt, Homo Sapiens
auuagggaaagguaauauaaguaucaguuuuaguguuuuucaguagaaaugucucaaaugucuc

SEQ ID NO: 295977 - RNA, 64 nt, Homo Sapiens
cuuaugucagagcaguuggggguuugcauuugcuguuuuucacugugauucacuuuaaccugau

SEQ ID NO: 295978 - RNA, 64 nt, Homo Sapiens
aggcuucaauuacaaacaguaaacauacaaauguguuuuucaguaacuguuagaucucuuuagu

SEQ ID NO: 295979 - RNA, 64 nt, Homo Sapiens
gugccuaagcaaaaggacaggcuguccaagguagaaacuguacauagccggugaccgaaugcga

SEQ ID NO: 295980 - RNA, 64 nt, Homo Sapiens
aaguuuauguguauaaagcgaagcuguuucugugaaacuguauauuuuguaaauaaauauauug

SEQ ID NO: 295981 - RNA, 64 nt, Homo Sapiens
acuuaaaacugaaaaauuuuuuuguuuuuaaaucaaacuguaaaauuuugaaauuuguuucugu

SEQ ID NO: 295982 - RNA, 64 nt, Homo Sapiens
auuaagcaacacaagacaccauacaaaauguacgaaacuguaugcuguagagugaggaauaucu

SEQ ID NO: 295983 - RNA, 64 nt, Homo Sapiens
gccagagaguaguacaacgucaucaggaaguaggaaacuguaggcaguuacaguuuccaggaaa

SEQ ID NO: 295984 - RNA, 64 nt, Homo Sapiens
aaauggcaaagugaggcucucuuuuuuuuuauucaaacuguauguuuucuuuuucucuaagguu

SEQ ID NO: 295985 - RNA, 64 nt, Homo Sapiens
gucuuuuuuacucacuuuuuacaaggaaauagauaaacuguaagcuauaccguaucuuucuagc

SEQ ID NO: 295986 - RNA, 64 nt, Homo Sapiens
auuuuguauagcuuuuuauuucauguuaauuaauaaacuguauuaauaaaauaugaaauauuag

SEQ ID NO: 295987 - RNA, 64 nt, Homo Sapiens
gcuaaggacauuuuaagaguuuuguuaagaccacaaacuguauuaaggaauacuacuguuuugu

SEQ ID NO: 295988 - RNA, 64 nt, Homo Sapiens
caaagcaaugccuuagcguugugacucaggauaaaaacuguaaaauguaguugaaacaucugau

SEQ ID NO: 295989 - RNA, 64 nt, Homo Sapiens
gugcuguccuuccacauuuaauugcauuuugcucaaacuguagaaugcccuacauuccccccac

SEQ ID NO: 295990 - RNA, 64 nt, Homo Sapiens
auguacauucaggacaaaugauuagcccuaaaugaaacuguaauaauuucaguggaaacucaau

SEQ ID NO: 295991 - RNA, 64 nt, Homo Sapiens
cuccaaaaacauuuuuuuaaauguucuguaagauaaacuguauauuucauauguaccuguuaag

SEQ ID NO: 295992 - RNA, 64 nt, Homo Sapiens
uuuaauguauagaugauuucuaaugucuccugacaaacuguaaauacugcauuucuuuugcgua

SEQ ID NO: 295993 - RNA, 64 nt, Homo Sapiens
uauuuccacuaagugaaaaaagaacuguguuuuuaaacuguaggagaauuuaauaaaucagcaa

SEQ ID NO: 295994 - RNA, 64 nt, Homo Sapiens
guuuaucugauaauguuuaaauaauuuacaauauaaacuguaaaacuuauuaggcaugaaauca

SEQ ID NO: 295995 - RNA, 64 nt, Homo Sapiens
aauuaucaauaauuuuuuuuaaaaagaggaucccaaacuguaaaagauugaaauaaucuuucuc

SEQ ID NO: 295996 - RNA, 64 nt, Homo Sapiens
uaauaaaauuccuucacgaccugguacccuugugaaacuguaaaauauaucauauggggggagu

SEQ ID NO: 295997 - RNA, 64 nt, Homo Sapiens
uugaaccuuuuauauguuaugcauugauucuaacaaacuguaaugcccucaacagaacuaauuu

SEQ ID NO: 295998 - RNA, 64 nt, Homo Sapiens
cacagcauuuacacugaauacaauuucauuuguaaaacuguaaauaagagcuuuuguacuagcc

SEQ ID NO: 295999 - RNA, 64 nt, Homo Sapiens
ccauggucuuccagaugggugccagccuaggcggaaacuguacacuggaguacuuccuagugca

SEQ ID NO: 296000 - RNA, 64 nt, Homo Sapiens
cauuuucuuccuuguacaaaaggaguaagaucauaaacuguauuagugacaucagguauuugga

SEQ ID NO: 296001 - RNA, 64 nt, Homo Sapiens
uguaagggcuuuucaaaaugcaauuacauauuuaaaacuguauccucaagaaaaugccacauuu

SEQ ID NO: 296002 - RNA, 64 nt, Homo Sapiens
ugucacagggcaauuucuuuaugauaaugcuuccaaacuguagcagugagagcugaaaagagaa

SEQ ID NO: 296003 - RNA, 64 nt, Homo Sapiens
gaaaccagcugaauguuugaauaacuccugacagaaacuguaaguauaaaugugaucagauaaa

SEQ ID NO: 296004 - RNA, 64 nt, Homo Sapiens
ucagaguaaaaucuccuaaagugggggaagaaagaaacuguauuuuuagcccagauuucaaaua

SEQ ID NO: 296005 - RNA, 64 nt, Homo Sapiens
cuggccuacuuuucuauuuuagcaauuacccuuaaaacuguacuuuaucuauacuguauaaaaa

SEQ ID NO: 296006 - RNA, 64 nt, Homo Sapiens
cugugccuuccaucaugauuagaguggggacgugaaacuguauuugugcuuuuuugaaaauuua

SEQ ID NO: 296007 - RNA, 64 nt, Homo Sapiens
guucaauugugaaaaugaauuuuguaucuuuuuuaaacuguaaaugaacaacuguuugucuuuu

SEQ ID NO: 296008 - RNA, 64 nt, Homo Sapiens
aucuuugccaaguaagagugcauuuaacucuuugaaacuguaucgucuccaaguaguccaccuu

SEQ ID NO: 296009 - RNA, 64 nt, Homo Sapiens
auuuguauauacauuuucaauaaagaauauguauaaacuguacagaucuagaucuacaaccuau

SEQ ID NO: 296010 - RNA, 64 nt, Homo Sapiens
cuuuaauaguuuaguguaaaguacaucagaaauaaaacuguaucugacauuuuaagccuguagu

SEQ ID NO: 296011 - RNA, 64 nt, Homo Sapiens
uuguaauguauaacuugauauuuaauuuaugauuaaacuguaauuuuguaacauaaacuguggu

SEQ ID NO: 296012 - RNA, 64 nt, Homo Sapiens; identical to SEQ ID NO: 255810

SEQ ID NO: 296013 - RNA, 64 nt, Homo Sapiens; identical to SEQ ID NO: 255811

SEQ ID NO: 296014 - RNA, 64 nt, Homo Sapiens; identical to SEQ ID NO: 255812

SEQ ID NO: 296015 - RNA, 64 nt, Homo Sapiens; identical to SEQ ID NO: 255813

SEQ ID NO: 296016 - RNA, 64 nt, Homo Sapiens; identical to SEQ ID NO: 255814

SEQ ID NO: 296017 - RNA, 64 nt, Homo Sapiens; identical to SEQ ID NO: 255815

SEQ ID NO: 296018 - RNA, 64 nt, Homo Sapiens; identical to SEQ ID NO: 255816

SEQ ID NO: 296019 - RNA, 64 nt, Homo Sapiens; identical to SEQ ID NO: 255817

SEQ ID NO: 296020 - RNA, 64 nt, Homo Sapiens; identical to SEQ ID NO: 255818

SEQ ID NO: 296021 - RNA, 64 nt, Homo Sapiens; identical to SEQ ID NO: 255819

SEQ ID NO: 296022 - RNA, 64 nt, Homo Sapiens; identical to SEQ ID NO: 255820

SEQ ID NO: 296023 - RNA, 64 nt, Homo Sapiens; identical to SEQ ID NO: 255821

SEQ ID NO: 296024 - RNA, 64 nt, Homo Sapiens; identical to SEQ ID NO: 255822

SEQ ID NO: 296025 - RNA, 64 nt, Homo Sapiens; identical to SEQ ID NO: 255823

SEQ ID NO: 296026 - RNA, 64 nt, Homo Sapiens; identical to SEQ ID NO: 255824

SEQ ID NO: 296027 - RNA, 64 nt, Homo Sapiens; identical to SEQ ID NO: 255825

SEQ ID NO: 296028 - RNA, 64 nt, Homo Sapiens; identical to SEQ ID NO: 255826

SEQ ID NO: 296029 - RNA, 64 nt, Homo Sapiens; identical to SEQ ID NO: 255827

SEQ ID NO: 296030 - RNA, 64 nt, Homo Sapiens; identical to SEQ ID NO: 255828

SEQ ID NO: 296031 - RNA, 64 nt, Homo Sapiens; identical to SEQ ID NO: 255829

SEQ ID NO: 296032 - RNA, 64 nt, Homo Sapiens; identical to SEQ ID NO: 255830

SEQ ID NO: 296033 - RNA, 64 nt, Homo Sapiens; identical to SEQ ID NO: 255831

SEQ ID NO: 296034 - RNA, 64 nt, Homo Sapiens; identical to SEQ ID NO: 255832

SEQ ID NO: 296035 - RNA, 64 nt, Homo Sapiens; identical to SEQ ID NO: 255833

SEQ ID NO: 296036 - RNA, 64 nt, Homo Sapiens; identical to SEQ ID NO: 255834

SEQ ID NO: 296037 - RNA, 64 nt, Homo Sapiens; identical to SEQ ID NO: 255835

SEQ ID NO: 296038 - RNA, 64 nt, Homo Sapiens; identical to SEQ ID NO: 255836

SEQ ID NO: 296039 - RNA, 64 nt, Homo Sapiens; identical to SEQ ID NO: 255837

SEQ ID NO: 296040 - RNA, 64 nt, Homo Sapiens; identical to SEQ ID NO: 255838

SEQ ID NO: 296041 - RNA, 64 nt, Homo Sapiens; identical to SEQ ID NO: 255839

SEQ ID NO: 296042 - RNA, 64 nt, Homo Sapiens; identical to SEQ ID NO: 255840

SEQ ID NO: 296043 - RNA, 64 nt, Homo Sapiens; identical to SEQ ID NO: 255841

SEQ ID NO: 296044 - RNA, 64 nt, Homo Sapiens; identical to SEQ ID NO: 255842

SEQ ID NO: 296045 - RNA, 64 nt, Homo Sapiens
ucucagggguuuuuauucuuggagaggcgcacagaaggcccaguagagagucaggagagcagca

SEQ ID NO: 296046 - RNA, 64 nt, Homo Sapiens
cuuguccgggcacaguggcuugguguuguaagaaaaggcccauguuccaaggacuucuuccugu

SEQ ID NO: 296047 - RNA, 64 nt, Homo Sapiens
cuccaugguggaaguuaaagaggcaagugggauaaaggcccagaacucauaacagucuuacugc

SEQ ID NO: 296048 - RNA, 64 nt, Homo Sapiens
auuaaacacaaagcuguugauuaaucuggaauuuaaggcccaaccuugacacuauucacuaaaa

SEQ ID NO: 296049 - RNA, 64 nt, Homo Sapiens
gcagugugucaggugcugcagagcguucuuggagaaggcccacugaggcagguucgugcccugc

SEQ ID NO: 296050 - RNA, 64 nt, Homo Sapiens
agcaacauaaaacaaugaaggaaaaccucacuugaaggcccaggucaacaucuaagccuguuga

SEQ ID NO: 296051 - RNA, 64 nt, Homo Sapiens
ugggacagucuaauacccauaacugucugaggcuaaggcccacgaaaggucacaaaagcaaaau

SEQ ID NO: 296052 - RNA, 64 nt, Homo Sapiens
acuuuuaagguaugugcuguuucauguguaagaaaaggcccauucuauaaccaauaccuuuguu

SEQ ID NO: 296053 - RNA, 64 nt, Homo Sapiens
gucugagucccagcccugagaaguuuggagucaaaaggcccagaccucucucucgaggccacug

SEQ ID NO: 296054 - RNA, 64 nt, Homo Sapiens
guaacugcgaaugaagcaauucugggagaacuuaaaggcccauagugggauuugcagggacuuu

SEQ ID NO: 296055 - RNA, 64 nt, Homo Sapiens
caccaccgucaacacagcccgaggccuggcacacaaggcccaagggccagggaggggacccaga

SEQ ID NO: 296056 - RNA, 64 nt, Homo Sapiens
gcucuuccugcccaccagggccuuuccuaugggcaaggcccagucgagaggggacuuggcuggg

SEQ ID NO: 296057 - RNA, 64 nt, Homo Sapiens
cuggcccccaucugaacccaccugcaggacccacaaggcccauaaggcaaggacagagaaggua

SEQ ID NO: 296058 - RNA, 64 nt, Homo Sapiens
ccuggggcugggcaguguaggggaagaggugaggaaggcccaccgcugagacugaaaaucaaga

SEQ ID NO: 296059 - RNA, 64 nt, Homo Sapiens
gcaguggggacgggucccagggcucggagggagaaaggcccaggcucagccuaaccaggaaagg

SEQ ID NO: 296060 - RNA, 64 nt, Homo Sapiens
ucuucugcaacauuugacaaaacuaaccuugaauaaggcccacuguaauacguagcucucuuaa

SEQ ID NO: 296061 - RNA, 64 nt, Homo Sapiens
aucccaacuacguaauaggaaaauguaggaucaaaaggcccauguauauaaguacugaccacug

SEQ ID NO: 296062 - RNA, 64 nt, Homo Sapiens
uucaugaagcagcaaacccaguucaugaccuccgaaggcccaaaccugugacugcccugcaugu

SEQ ID NO: 296063 - RNA, 64 nt, Homo Sapiens
cugaugggggaggaggagggacuucaggagacagaaggcccauguggagcguuccacugagucu

SEQ ID NO: 296064 - RNA, 64 nt, Homo Sapiens
ccugucugcauauacacacggggaaugccagaagaaggcccagucugcaccaggcgucugguca

SEQ ID NO: 296065 - RNA, 64 nt, Homo Sapiens
gcacuguucacucugugucuuuugaagugccuugaaggcccagaugaaauuuuaaagggagggg

SEQ ID NO: 296066 - RNA, 64 nt, Homo Sapiens
caagcgcaugagagguguuuccuuggccuuccagaaggcccacuguggagccagccucccuaug

SEQ ID NO: 296067 - RNA, 64 nt, Homo Sapiens
augggcuguaggggagaguguggcaggugacccaaaggcccaaagagggccguggggccugagg

SEQ ID NO: 296068 - RNA, 64 nt, Homo Sapiens
cucacuguuuucgugguuguaacuaauauguggaaaggcccauuuccagguuugcguagaagag

SEQ ID NO: 296069 - RNA, 64 nt, Homo Sapiens
acucagcagcgauggugagcauuuugguuuccuuaaggcccagcaagacuuccagggacaucuc

SEQ ID NO: 296070 - RNA, 64 nt, Homo Sapiens
gccauguaacuaacuuuaaauugugucccucugaaaggcccaauguuucaaucuaguccuagag

SEQ ID NO: 296071 - RNA, 64 nt, Homo Sapiens
guugagaugcuaugaagcuuguaauaauuuugacaaggcccaaaaaccccaaaaguccaaaaau

SEQ ID NO: 296072 - RNA, 64 nt, Homo Sapiens
ccuuccuguuaaugaauuaaugguuuuaaaccuugugcucuacuguuuucauuugaugucguac

SEQ ID NO: 296073 - RNA, 64 nt, Homo Sapiens; identical to SEQ ID NO: 296072

SEQ ID NO: 296074 - RNA, 64 nt, Homo Sapiens
gccuucccagagccccgucuugcuucucuuccaggugcucuauccccucgagacccucuggugc

SEQ ID NO: 296075 - RNA, 64 nt, Homo Sapiens
ccuggccucuccugggggaggcugcuguucuuaggugcucuaagcuuaaucccucagaaugugu

SEQ ID NO: 296076 - RNA, 64 nt, Homo Sapiens
uuauaaugcaaagaccagcuccuuugcgguggcagugcucuagggcugccauuacacggucuug

SEQ ID NO: 296077 - RNA, 64 nt, Homo Sapiens
uagguuuucuauuaaggucucugccccaggcauggugcucuauaucuuggccaaauaaauuacu

SEQ ID NO: 296078 - RNA, 64 nt, Homo Sapiens; identical to SEQ ID NO: 245291

SEQ ID NO: 296079 - RNA, 64 nt, Homo Sapiens; identical to SEQ ID NO: 245292

SEQ ID NO: 296080 - RNA, 64 nt, Homo Sapiens; identical to SEQ ID NO: 245293

SEQ ID NO: 296081 - RNA, 64 nt, Homo Sapiens; identical to SEQ ID NO: 245294

SEQ ID NO: 296082 - RNA, 64 nt, Homo Sapiens; identical to SEQ ID NO: 183694

SEQ ID NO: 296083 - RNA, 64 nt, Homo Sapiens; identical to SEQ ID NO: 183695

SEQ ID NO: 296084 - RNA, 64 nt, Homo Sapiens; identical to SEQ ID NO: 183696

SEQ ID NO: 296085 - RNA, 64 nt, Homo Sapiens; identical to SEQ ID NO: 183697

SEQ ID NO: 296086 - RNA, 64 nt, Homo Sapiens; identical to SEQ ID NO: 183698

SEQ ID NO: 296087 - RNA, 64 nt, Homo Sapiens; identical to SEQ ID NO: 183699

SEQ ID NO: 296088 - RNA, 64 nt, Homo Sapiens; identical to SEQ ID NO: 183700

SEQ ID NO: 296089 - RNA, 64 nt, Homo Sapiens; identical to SEQ ID NO: 183701

SEQ ID NO: 296090 - RNA, 64 nt, Homo Sapiens; identical to SEQ ID NO: 183702

SEQ ID NO: 296091 - RNA, 64 nt, Homo Sapiens; identical to SEQ ID NO: 183703

SEQ ID NO: 296092 - RNA, 64 nt, Homo Sapiens; identical to SEQ ID NO: 183704

SEQ ID NO: 296093 - RNA, 64 nt, Homo Sapiens; identical to SEQ ID NO: 183705

SEQ ID NO: 296094 - RNA, 64 nt, Homo Sapiens; identical to SEQ ID NO: 183706

SEQ ID NO: 296095 - RNA, 64 nt, Homo Sapiens; identical to SEQ ID NO: 183707

SEQ ID NO: 296096 - RNA, 64 nt, Homo Sapiens; identical to SEQ ID NO: 183708

SEQ ID NO: 296097 - RNA, 64 nt, Homo Sapiens; identical to SEQ ID NO: 183709

SEQ ID NO: 296098 - RNA, 64 nt, Homo Sapiens; identical to SEQ ID NO: 183710

SEQ ID NO: 296099 - RNA, 64 nt, Homo Sapiens; identical to SEQ ID NO: 183711

SEQ ID NO: 296100 - RNA, 64 nt, Homo Sapiens; identical to SEQ ID NO: 183712

SEQ ID NO: 296101 - RNA, 64 nt, Homo Sapiens; identical to SEQ ID NO: 183713

SEQ ID NO: 296102 - RNA, 64 nt, Homo Sapiens; identical to SEQ ID NO: 183714

SEQ ID NO: 296103 - RNA, 64 nt, Homo Sapiens; identical to SEQ ID NO: 183715

SEQ ID NO: 296104 - RNA, 64 nt, Homo Sapiens; identical to SEQ ID NO: 183716

SEQ ID NO: 296105 - RNA, 64 nt, Homo Sapiens; identical to SEQ ID NO: 183717

SEQ ID NO: 296106 - RNA, 64 nt, Homo Sapiens; identical to SEQ ID NO: 183718

SEQ ID NO: 296107 - RNA, 64 nt, Homo Sapiens; identical to SEQ ID NO: 183719

SEQ ID NO: 296108 - RNA, 64 nt, Homo Sapiens; identical to SEQ ID NO: 183720

SEQ ID NO: 296109 - RNA, 64 nt, Homo Sapiens; identical to SEQ ID NO: 183721

SEQ ID NO: 296110 - RNA, 64 nt, Homo Sapiens; identical to SEQ ID NO: 183722

SEQ ID NO: 296111 - RNA, 64 nt, Homo Sapiens; identical to SEQ ID NO: 183723

SEQ ID NO: 296112 - RNA, 64 nt, Homo Sapiens; identical to SEQ ID NO: 183724

SEQ ID NO: 296113 - RNA, 64 nt, Homo Sapiens; identical to SEQ ID NO: 183725

SEQ ID NO: 296114 - RNA, 64 nt, Homo Sapiens; identical to SEQ ID NO: 183726

SEQ ID NO: 296115 - RNA, 64 nt, Homo Sapiens; identical to SEQ ID NO: 183727

SEQ ID NO: 296116 - RNA, 64 nt, Homo Sapiens; identical to SEQ ID NO: 183728

SEQ ID NO: 296117 - RNA, 64 nt, Homo Sapiens; identical to SEQ ID NO: 183729

SEQ ID NO: 296118 - RNA, 64 nt, Homo Sapiens; identical to SEQ ID NO: 183730

SEQ ID NO: 296119 - RNA, 64 nt, Homo Sapiens; identical to SEQ ID NO: 183731

SEQ ID NO: 296120 - RNA, 64 nt, Homo Sapiens; identical to SEQ ID NO: 183732

SEQ ID NO: 296121 - RNA, 64 nt, Homo Sapiens; identical to SEQ ID NO: 183733

SEQ ID NO: 296122 - RNA, 64 nt, Homo Sapiens; identical to SEQ ID NO: 183734

SEQ ID NO: 296123 - RNA, 64 nt, Homo Sapiens; identical to SEQ ID NO: 183735

SEQ ID NO: 296124 - RNA, 64 nt, Homo Sapiens
aaauuuaauauauuuguucacuugagucuuaagaguaggucaggccaaggcagguggaucaccu

SEQ ID NO: 296125 - RNA, 64 nt, Homo Sapiens
aacaaaaaugaaacuccgucucaaaaaaaaaaaaguaggucaauucguaacaguuuauuuugga

SEQ ID NO: 296126 - RNA, 64 nt, Homo Sapiens
gaggacugggcacuauuuggacuuuauccaucauguaggucaggggaugaacaucagugcccua

SEQ ID NO: 296127 - RNA, 64 nt, Homo Sapiens
aacagucacccgugcuggcugacugcaagagaggguaggucaugucggcauuuguccacaguca

SEQ ID NO: 296128 - RNA, 64 nt, Homo Sapiens
uaugagaaucaguggaaaauaaggguauaauuuuguaggucauaugauugaagaaaauauuauu

SEQ ID NO: 296129 - RNA, 64 nt, Homo Sapiens
accuguauaaaagauacauuuuauggugguuucaguaggucauuuuaaaaaccaaugugcauua

SEQ ID NO: 296130 - RNA, 64 nt, Homo Sapiens
ccuccccugagggauuaacauuggcuucauaaacagcugugaacgaucuugcccagaaccucuc

SEQ ID NO: 296131 - RNA, 64 nt, Homo Sapiens
uugcccagaaccucucuugggggccuguuuccccagcugugaucgacaccagggagcagggccu

SEQ ID NO: 296132 - RNA, 64 nt, Homo Sapiens
ggaguucagaaauuggcacaaacuugaaauuuauagcugugauaaauucauucagauggucaau

SEQ ID NO: 296133 - RNA, 64 nt, Homo Sapiens
caguauucauuuaagaggcacuugccucagaaggagcugugagccuguuugcaaagucacagac

SEQ ID NO: 296134 - RNA, 64 nt, Homo Sapiens
aagcagcacaaggaauuucccuguguggaugcugagcugugauggcgggcacuggguacccaag

SEQ ID NO: 296135 - RNA, 64 nt, Homo Sapiens
gacaugagucuguaggagcaagggcacaaacugcagcugugagugcgugugugugauuuggugu

SEQ ID NO: 296136 - RNA, 64 nt, Homo Sapiens
ccuugcguugaguuccuucucccuguccuuggaaagcugugaagacggccacuccagagccggu

SEQ ID NO: 296137 - RNA, 64 nt, Homo Sapiens
gagcaggccacacaaaguccguaauucucccaggagcugugauagaugcccugggcucagaucu

SEQ ID NO: 296138 - RNA, 64 nt, Homo Sapiens
aagaaagugugguaaaaagcugcagggaacacuaagcugugaugagugagcaaaaggaucagaa

SEQ ID NO: 296139 - RNA, 64 nt, Homo Sapiens
ugaaagacuuaccggaccaccaucauuaaaccucagcugugacaccucugcuuuccuccacugc

SEQ ID NO: 296140 - RNA, 64 nt, Homo Sapiens
gggccucugauggugagaggugacggggucccucagcugugagaugcaaggggcgccuugcagc

SEQ ID NO: 296141 - RNA, 64 nt, Homo Sapiens
cauauccauuaggugccaguagcacccccgcuagagcugugaaaaauucucuccagacauaguc

SEQ ID NO: 296142 - RNA, 64 nt, Homo Sapiens
uaacaaaugccaagauuucuggagcagauuguacagcugugacuuuggaaaacagaaaguaaga

SEQ ID NO: 296143 - RNA, 64 nt, Homo Sapiens
uuccaugcuuaagacaaaaaugucuuaaauauaaagcugugauuauaucaaaaauccagauaaa

SEQ ID NO: 296144 - RNA, 64 nt, Homo Sapiens
gaggcuguacuauaugaagccugcauauacugugagcugugauuggggaacaccaaugcagagg

SEQ ID NO: 296145 - RNA, 64 nt, Homo Sapiens
agaaaucaugacccugaaagagagaugaaauucaagcugugagccaggcaggagcucaguaugg

SEQ ID NO: 296146 - RNA, 64 nt, Homo Sapiens
ggauuuuguagcuguuuaaaaaaaaaaaaaagguagcugugauacaaaccccaggacacccacc

SEQ ID NO: 296147 - RNA, 64 nt, Homo Sapiens
gguuuuuguguaagauucuugcuguagcguggauagcugugauuggugagucaaccgucugugg

SEQ ID NO: 296148 - RNA, 64 nt, Homo Sapiens
ucuucuuggaccuguugucuguucgucaugauugagcugugaagcugugaggaaacagccacau

SEQ ID NO: 296149 - RNA, 64 nt, Homo Sapiens
gagaugguacaagaggcuggucuuccuugccugcagcugugaucaguagcugggauuugacuuu

SEQ ID NO: 296150 - RNA, 64 nt, Homo Sapiens
agccuggauucgaaucugggcucuuucacauacuagcugugacccuggacaaagagcuuuaacc

SEQ ID NO: 296151 - RNA, 64 nt, Homo Sapiens
uaaggaguggaaaaguguaggcugcccuuggugaagcugugacaagggagugaccauccauccc

SEQ ID NO: 296152 - RNA, 64 nt, Homo Sapiens
ugguaacuagcagggagaaacagggugggauuugagcugugaguggcgauacuguuuuccccug

SEQ ID NO: 296153 - RNA, 64 nt, Homo Sapiens
aaucaaaacguugaucacuuuuagaggcuuucaaagcugugaaaauccaaaauggaaaagccag

SEQ ID NO: 296154 - RNA, 64 nt, Homo Sapiens
guagcugaagcaggagguuacagggcaaaagggcagcugugaugauguggaaaugagguugggg

SEQ ID NO: 296155 - RNA, 64 nt, Homo Sapiens
cauucucccagucucugucguggagccauugaacagcugugagccaugccucccugggccaccu

SEQ ID NO: 296156 - RNA, 64 nt, Homo Sapiens
uuuuuaagccacuuaauuguggccaaagcuauucagcugugauaauaguaucucacagggaaac

SEQ ID NO: 296157 - RNA, 64 nt, Homo Sapiens
ugauuuuuuuuuuuccaaucaaacagagcaguauagcugugacuauggaucuggcagauucuuu

SEQ ID NO: 296158 - RNA, 64 nt, Homo Sapiens
gugaaacuucucuauuggagugucuguuucuuuaagcugugaauacugaaauuaugccuugucu

SEQ ID NO: 296159 - RNA, 64 nt, Homo Sapiens
cauggucugagacuaaguaaaggaaauuuccuaaagcugugaaauuugaauuuugcuuuaaaua

SEQ ID NO: 296160 - RNA, 64 nt, Homo Sapiens
cagcaugguaaggggacagagcccagcagaucccagcugugaagaggccacugcauggcugaca

SEQ ID NO: 296161 - RNA, 64 nt, Homo Sapiens
uucccagagccaccaaaaaccuucuuagcaggacagcugugagaggcaucagaaccucacguuc

SEQ ID NO: 296162 - RNA, 64 nt, Homo Sapiens
cacccaggaacuaugaguugggggaugugguagaagcugugaggcacagccaggaccgggccuu

SEQ ID NO: 296163 - RNA, 64 nt, Homo Sapiens
ccucuggcagugggaggagcagcaccgaggucggagcugugaggacuuccagaacuggaaacgc

SEQ ID NO: 296164 - RNA, 64 nt, Homo Sapiens
ggccugccacuucucacagacccuagguauccacagcugugacaugggggcaagcggcuuuguu

SEQ ID NO: 296165 - RNA, 64 nt, Homo Sapiens
ugccugggcuccaaugccagcucugccacuugcuagcugugagacuguggacaaaccacucagc

SEQ ID NO: 296166 - RNA, 64 nt, Homo Sapiens
ucuccugcagacaggagggccugagucccacaccagcugugaauagcugugaauggccuagggg

SEQ ID NO: 296167 - RNA, 64 nt, Homo Sapiens
ggccuaggggcugagucccaacagagccagacaaagcugugaaugccccgugcugaaugaaugu

SEQ ID NO: 296168 - RNA, 64 nt, Homo Sapiens
cuccaaggagacaaccccaggggccaacagccccagcugugacccccaggcuuccacaugaacu

SEQ ID NO: 296169 - RNA, 64 nt, Homo Sapiens
ugagagagguguggggaaccgcccaaggucacccagcugugaaugaacguggucagaacacaga

SEQ ID NO: 296170 - RNA, 64 nt, Homo Sapiens
uguaugccugcccaguucccuuuuuauuugcagaagcugugaguuuuguucacaauuagguucc

SEQ ID NO: 296171 - RNA, 64 nt, Homo Sapiens
ugaaaccacaugaaaugacuuaugggggauggugagcugugacugcuuugcugaccauuuugga

SEQ ID NO: 296172 - RNA, 64 nt, Homo Sapiens
ggggugguguggagggcccuacuccacacccuagagcugugaugcugagcaaggugccuguggc

SEQ ID NO: 296173 - RNA, 64 nt, Homo Sapiens
uguuccugugggugacagagaugagaaccagggaagcugugauccacuggccaggacaagucaa

SEQ ID NO: 296174 - RNA, 64 nt, Homo Sapiens
uuucuauuucuccuaguuuuugcucugugguaccagcugugacugacagcugugaaguugggcg

SEQ ID NO: 296175 - RNA, 64 nt, Homo Sapiens
uugggcgugcucugugguacuccuaagaggagacagcugugaagucucucacccuagccaaagg

SEQ ID NO: 296176 - RNA, 64 nt, Homo Sapiens; identical to SEQ ID NO: 211358

SEQ ID NO: 296177 - RNA, 64 nt, Homo Sapiens; identical to SEQ ID NO: 211359

SEQ ID NO: 296178 - RNA, 64 nt, Homo Sapiens; identical to SEQ ID NO: 211360

SEQ ID NO: 296179 - RNA, 64 nt, Homo Sapiens; identical to SEQ ID NO: 211361

SEQ ID NO: 296180 - RNA, 64 nt, Homo Sapiens; identical to SEQ ID NO: 211362

SEQ ID NO: 296181 - RNA, 64 nt, Homo Sapiens; identical to SEQ ID NO: 211363

SEQ ID NO: 296182 - RNA, 64 nt, Homo Sapiens; identical to SEQ ID NO: 211364

SEQ ID NO: 296183 - RNA, 64 nt, Homo Sapiens; identical to SEQ ID NO: 211365

SEQ ID NO: 296184 - RNA, 64 nt, Homo Sapiens; identical to SEQ ID NO: 211366

SEQ ID NO: 296185 - RNA, 64 nt, Homo Sapiens; identical to SEQ ID NO: 211367

SEQ ID NO: 296186 - RNA, 64 nt, Homo Sapiens; identical to SEQ ID NO: 211368

SEQ ID NO: 296187 - RNA, 64 nt, Homo Sapiens; identical to SEQ ID NO: 211369

SEQ ID NO: 296188 - RNA, 64 nt, Homo Sapiens; identical to SEQ ID NO: 211370

SEQ ID NO: 296189 - RNA, 64 nt, Homo Sapiens; identical to SEQ ID NO: 211371

SEQ ID NO: 296190 - RNA, 64 nt, Homo Sapiens; identical to SEQ ID NO: 211372

SEQ ID NO: 296191 - RNA, 64 nt, Homo Sapiens; identical to SEQ ID NO: 211373

SEQ ID NO: 296192 - RNA, 64 nt, Homo Sapiens; identical to SEQ ID NO: 211374

SEQ ID NO: 296193 - RNA, 64 nt, Homo Sapiens; identical to SEQ ID NO: 211375

SEQ ID NO: 296194 - RNA, 50 nt, Homo Sapiens; identical to SEQ ID NO: 178066

SEQ ID NO: 296195 - RNA, 64 nt, Homo Sapiens; identical to SEQ ID NO: 211377

SEQ ID NO: 296196 - RNA, 64 nt, Homo Sapiens; identical to SEQ ID NO: 211378

SEQ ID NO: 296197 - RNA, 64 nt, Homo Sapiens; identical to SEQ ID NO: 211379

SEQ ID NO: 296198 - RNA, 64 nt, Homo Sapiens; identical to SEQ ID NO: 211380

SEQ ID NO: 296199 - RNA, 64 nt, Homo Sapiens; identical to SEQ ID NO: 211381

SEQ ID NO: 296200 - RNA, 64 nt, Homo Sapiens; identical to SEQ ID NO: 211382

SEQ ID NO: 296201 - RNA, 64 nt, Homo Sapiens; identical to SEQ ID NO: 211383

SEQ ID NO: 296202 - RNA, 64 nt, Homo Sapiens; identical to SEQ ID NO: 211384

SEQ ID NO: 296203 - RNA, 64 nt, Homo Sapiens; identical to SEQ ID NO: 211385

SEQ ID NO: 296204 - RNA, 64 nt, Homo Sapiens; identical to SEQ ID NO: 211386

SEQ ID NO: 296205 - RNA, 64 nt, Homo Sapiens; identical to SEQ ID NO: 211387

SEQ ID NO: 296206 - RNA, 64 nt, Homo Sapiens; identical to SEQ ID NO: 211388

SEQ ID NO: 296207 - RNA, 64 nt, Homo Sapiens; identical to SEQ ID NO: 211389

SEQ ID NO: 296208 - RNA, 64 nt, Homo Sapiens; identical to SEQ ID NO: 211390

SEQ ID NO: 296209 - RNA, 64 nt, Homo Sapiens; identical to SEQ ID NO: 211391

SEQ ID NO: 296210 - RNA, 64 nt, Homo Sapiens; identical to SEQ ID NO: 211392

SEQ ID NO: 296211 - RNA, 64 nt, Homo Sapiens; identical to SEQ ID NO: 211393

SEQ ID NO: 296212 - RNA, 64 nt, Homo Sapiens; identical to SEQ ID NO: 211394

SEQ ID NO: 296213 - RNA, 64 nt, Homo Sapiens; identical to SEQ ID NO: 211395

SEQ ID NO: 296214 - RNA, 64 nt, Homo Sapiens; identical to SEQ ID NO: 211396

SEQ ID NO: 296215 - RNA, 64 nt, Homo Sapiens; identical to SEQ ID NO: 211397

SEQ ID NO: 296216 - RNA, 64 nt, Homo Sapiens; identical to SEQ ID NO: 211398

SEQ ID NO: 296217 - RNA, 64 nt, Homo Sapiens; identical to SEQ ID NO: 211399

SEQ ID NO: 296218 - RNA, 64 nt, Homo Sapiens; identical to SEQ ID NO: 211400

SEQ ID NO: 296219 - RNA, 64 nt, Homo Sapiens; identical to SEQ ID NO: 211401

SEQ ID NO: 296220 - RNA, 64 nt, Homo Sapiens; identical to SEQ ID NO: 211402

SEQ ID NO: 296221 - RNA, 64 nt, Homo Sapiens; identical to SEQ ID NO: 211403

SEQ ID NO: 296222 - RNA, 64 nt, Homo Sapiens; identical to SEQ ID NO: 211404

SEQ ID NO: 296223 - RNA, 64 nt, Homo Sapiens; identical to SEQ ID NO: 211405

SEQ ID NO: 296224 - RNA, 64 nt, Homo Sapiens; identical to SEQ ID NO: 211406

SEQ ID NO: 296225 - RNA, 64 nt, Homo Sapiens; identical to SEQ ID NO: 211407

SEQ ID NO: 296226 - RNA, 64 nt, Homo Sapiens; identical to SEQ ID NO: 211408

SEQ ID NO: 296227 - RNA, 64 nt, Homo Sapiens; identical to SEQ ID NO: 211409

SEQ ID NO: 296228 - RNA, 64 nt, Homo Sapiens; identical to SEQ ID NO: 211410

SEQ ID NO: 296229 - RNA, 64 nt, Homo Sapiens; identical to SEQ ID NO: 211411

SEQ ID NO: 296230 - RNA, 64 nt, Homo Sapiens; identical to SEQ ID NO: 211412

SEQ ID NO: 296231 - RNA, 64 nt, Homo Sapiens; identical to SEQ ID NO: 211413

SEQ ID NO: 296232 - RNA, 64 nt, Homo Sapiens; identical to SEQ ID NO: 211414

SEQ ID NO: 296233 - RNA, 64 nt, Homo Sapiens; identical to SEQ ID NO: 211415

SEQ ID NO: 296234 - RNA, 64 nt, Homo Sapiens; identical to SEQ ID NO: 211416

SEQ ID NO: 296235 - RNA, 64 nt, Homo Sapiens; identical to SEQ ID NO: 211417

SEQ ID NO: 296236 - RNA, 64 nt, Homo Sapiens; identical to SEQ ID NO: 211418

SEQ ID NO: 296237 - RNA, 64 nt, Homo Sapiens; identical to SEQ ID NO: 211419

SEQ ID NO: 296238 - RNA, 64 nt, Homo Sapiens; identical to SEQ ID NO: 211420

SEQ ID NO: 296239 - RNA, 64 nt, Homo Sapiens; identical to SEQ ID NO: 211421

SEQ ID NO: 296240 - RNA, 64 nt, Homo Sapiens; identical to SEQ ID NO: 211422

SEQ ID NO: 296241 - RNA, 64 nt, Homo Sapiens; identical to SEQ ID NO: 211423

SEQ ID NO: 296242 - RNA, 64 nt, Homo Sapiens; identical to SEQ ID NO: 211424

SEQ ID NO: 296243 - RNA, 64 nt, Homo Sapiens; identical to SEQ ID NO: 211425

SEQ ID NO: 296244 - RNA, 64 nt, Homo Sapiens; identical to SEQ ID NO: 211426

SEQ ID NO: 296245 - RNA, 64 nt, Homo Sapiens; identical to SEQ ID NO: 211427

SEQ ID NO: 296246 - RNA, 64 nt, Homo Sapiens; identical to SEQ ID NO: 211428

SEQ ID NO: 296247 - RNA, 64 nt, Homo Sapiens; identical to SEQ ID NO: 211429

SEQ ID NO: 296248 - RNA, 64 nt, Homo Sapiens; identical to SEQ ID NO: 211430

SEQ ID NO: 296249 - RNA, 64 nt, Homo Sapiens; identical to SEQ ID NO: 211431

SEQ ID NO: 296250 - RNA, 64 nt, Homo Sapiens; identical to SEQ ID NO: 211432

SEQ ID NO: 296251 - RNA, 64 nt, Homo Sapiens; identical to SEQ ID NO: 211433

SEQ ID NO: 296252 - RNA, 64 nt, Homo Sapiens; identical to SEQ ID NO: 211434

SEQ ID NO: 296253 - RNA, 64 nt, Homo Sapiens; identical to SEQ ID NO: 211435

SEQ ID NO: 296254 - RNA, 64 nt, Homo Sapiens; identical to SEQ ID NO: 211436

SEQ ID NO: 296255 - RNA, 64 nt, Homo Sapiens; identical to SEQ ID NO: 211437

SEQ ID NO: 296256 - RNA, 64 nt, Homo Sapiens; identical to SEQ ID NO: 211438

SEQ ID NO: 296257 - RNA, 64 nt, Homo Sapiens; identical to SEQ ID NO: 211439

SEQ ID NO: 296258 - RNA, 64 nt, Homo Sapiens; identical to SEQ ID NO: 211440

SEQ ID NO: 296259 - RNA, 64 nt, Homo Sapiens; identical to SEQ ID NO: 211441

SEQ ID NO: 296260 - RNA, 64 nt, Homo Sapiens; identical to SEQ ID NO: 211442

SEQ ID NO: 296261 - RNA, 64 nt, Homo Sapiens; identical to SEQ ID NO: 211443

SEQ ID NO: 296262 - RNA, 64 nt, Homo Sapiens; identical to SEQ ID NO: 211444

SEQ ID NO: 296263 - RNA, 64 nt, Homo Sapiens; identical to SEQ ID NO: 211445

SEQ ID NO: 296264 - RNA, 64 nt, Homo Sapiens; identical to SEQ ID NO: 211446

SEQ ID NO: 296265 - RNA, 64 nt, Homo Sapiens; identical to SEQ ID NO: 211447

SEQ ID NO: 296266 - RNA, 64 nt, Homo Sapiens; identical to SEQ ID NO: 211448

SEQ ID NO: 296267 - RNA, 64 nt, Homo Sapiens; identical to SEQ ID NO: 211449

SEQ ID NO: 296268 - RNA, 64 nt, Homo Sapiens; identical to SEQ ID NO: 211450

SEQ ID NO: 296269 - RNA, 64 nt, Homo Sapiens; identical to SEQ ID NO: 211451

SEQ ID NO: 296270 - RNA, 64 nt, Homo Sapiens; identical to SEQ ID NO: 211452

SEQ ID NO: 296271 - RNA, 64 nt, Homo Sapiens; identical to SEQ ID NO: 211453

SEQ ID NO: 296272 - RNA, 64 nt, Homo Sapiens; identical to SEQ ID NO: 211454

SEQ ID NO: 296273 - RNA, 64 nt, Homo Sapiens; identical to SEQ ID NO: 211455

SEQ ID NO: 296274 - RNA, 64 nt, Homo Sapiens; identical to SEQ ID NO: 211456

SEQ ID NO: 296275 - RNA, 64 nt, Homo Sapiens; identical to SEQ ID NO: 211457

SEQ ID NO: 296276 - RNA, 64 nt, Homo Sapiens; identical to SEQ ID NO: 211458

SEQ ID NO: 296277 - RNA, 64 nt, Homo Sapiens; identical to SEQ ID NO: 211459

SEQ ID NO: 296278 - RNA, 64 nt, Homo Sapiens; identical to SEQ ID NO: 211460

SEQ ID NO: 296279 - RNA, 64 nt, Homo Sapiens; identical to SEQ ID NO: 211461

SEQ ID NO: 296280 - RNA, 64 nt, Homo Sapiens; identical to SEQ ID NO: 211462

SEQ ID NO: 296281 - RNA, 64 nt, Homo Sapiens; identical to SEQ ID NO: 211463

SEQ ID NO: 296282 - RNA, 64 nt, Homo Sapiens; identical to SEQ ID NO: 211464

SEQ ID NO: 296283 - RNA, 64 nt, Homo Sapiens; identical to SEQ ID NO: 211465

SEQ ID NO: 296284 - RNA, 64 nt, Homo Sapiens; identical to SEQ ID NO: 211466

SEQ ID NO: 296285 - RNA, 64 nt, Homo Sapiens; identical to SEQ ID NO: 211467

SEQ ID NO: 296286 - RNA, 64 nt, Homo Sapiens; identical to SEQ ID NO: 211468

SEQ ID NO: 296287 - RNA, 64 nt, Homo Sapiens; identical to SEQ ID NO: 211469

SEQ ID NO: 296288 - RNA, 64 nt, Homo Sapiens; identical to SEQ ID NO: 211470

SEQ ID NO: 296289 - RNA, 64 nt, Homo Sapiens; identical to SEQ ID NO: 211471

SEQ ID NO: 296290 - RNA, 64 nt, Homo Sapiens; identical to SEQ ID NO: 211472

SEQ ID NO: 296291 - RNA, 64 nt, Homo Sapiens; identical to SEQ ID NO: 211473

SEQ ID NO: 296292 - RNA, 64 nt, Homo Sapiens; identical to SEQ ID NO: 211474

SEQ ID NO: 296293 - RNA, 64 nt, Homo Sapiens; identical to SEQ ID NO: 211475

SEQ ID NO: 296294 - RNA, 64 nt, Homo Sapiens; identical to SEQ ID NO: 211476

SEQ ID NO: 296295 - RNA, 64 nt, Homo Sapiens; identical to SEQ ID NO: 211477

SEQ ID NO: 296296 - RNA, 64 nt, Homo Sapiens; identical to SEQ ID NO: 211478

SEQ ID NO: 296297 - RNA, 64 nt, Homo Sapiens; identical to SEQ ID NO: 211479

SEQ ID NO: 296298 - RNA, 64 nt, Homo Sapiens; identical to SEQ ID NO: 211480

SEQ ID NO: 296299 - RNA, 64 nt, Homo Sapiens; identical to SEQ ID NO: 211481

SEQ ID NO: 296300 - RNA, 64 nt, Homo Sapiens; identical to SEQ ID NO: 211482

SEQ ID NO: 296301 - RNA, 64 nt, Homo Sapiens; identical to SEQ ID NO: 211483

SEQ ID NO: 296302 - RNA, 64 nt, Homo Sapiens; identical to SEQ ID NO: 211484

SEQ ID NO: 296303 - RNA, 64 nt, Homo Sapiens; identical to SEQ ID NO: 211485

SEQ ID NO: 296304 - RNA, 64 nt, Homo Sapiens; identical to SEQ ID NO: 211486

SEQ ID NO: 296305 - RNA, 64 nt, Homo Sapiens; identical to SEQ ID NO: 211487

SEQ ID NO: 296306 - RNA, 64 nt, Homo Sapiens; identical to SEQ ID NO: 211488

SEQ ID NO: 296307 - RNA, 64 nt, Homo Sapiens; identical to SEQ ID NO: 211489

SEQ ID NO: 296308 - RNA, 64 nt, Homo Sapiens; identical to SEQ ID NO: 211490

SEQ ID NO: 296309 - RNA, 64 nt, Homo Sapiens; identical to SEQ ID NO: 211491

SEQ ID NO: 296310 - RNA, 64 nt, Homo Sapiens; identical to SEQ ID NO: 211492

SEQ ID NO: 296311 - RNA, 64 nt, Homo Sapiens; identical to SEQ ID NO: 211493

SEQ ID NO: 296312 - RNA, 64 nt, Homo Sapiens; identical to SEQ ID NO: 211494

SEQ ID NO: 296313 - RNA, 64 nt, Homo Sapiens; identical to SEQ ID NO: 211495

SEQ ID NO: 296314 - RNA, 64 nt, Homo Sapiens; identical to SEQ ID NO: 211496

SEQ ID NO: 296315 - RNA, 64 nt, Homo Sapiens; identical to SEQ ID NO: 211497

SEQ ID NO: 296316 - RNA, 64 nt, Homo Sapiens; identical to SEQ ID NO: 211498

SEQ ID NO: 296317 - RNA, 64 nt, Homo Sapiens; identical to SEQ ID NO: 211499

SEQ ID NO: 296318 - RNA, 64 nt, Homo Sapiens; identical to SEQ ID NO: 211500

SEQ ID NO: 296319 - RNA, 64 nt, Homo Sapiens; identical to SEQ ID NO: 211501

SEQ ID NO: 296320 - RNA, 64 nt, Homo Sapiens; identical to SEQ ID NO: 211502

SEQ ID NO: 296321 - RNA, 64 nt, Homo Sapiens; identical to SEQ ID NO: 211503

SEQ ID NO: 296322 - RNA, 64 nt, Homo Sapiens; identical to SEQ ID NO: 211504

SEQ ID NO: 296323 - RNA, 64 nt, Homo Sapiens; identical to SEQ ID NO: 211505

SEQ ID NO: 296324 - RNA, 64 nt, Homo Sapiens; identical to SEQ ID NO: 211506

SEQ ID NO: 296325 - RNA, 64 nt, Homo Sapiens; identical to SEQ ID NO: 211507

SEQ ID NO: 296326 - RNA, 64 nt, Homo Sapiens; identical to SEQ ID NO: 211508

SEQ ID NO: 296327 - RNA, 64 nt, Homo Sapiens; identical to SEQ ID NO: 211509

SEQ ID NO: 296328 - RNA, 64 nt, Homo Sapiens; identical to SEQ ID NO: 211510

SEQ ID NO: 296329 - RNA, 64 nt, Homo Sapiens; identical to SEQ ID NO: 211511

SEQ ID NO: 296330 - RNA, 64 nt, Homo Sapiens; identical to SEQ ID NO: 211512

SEQ ID NO: 296331 - RNA, 64 nt, Homo Sapiens; identical to SEQ ID NO: 211513

SEQ ID NO: 296332 - RNA, 64 nt, Homo Sapiens; identical to SEQ ID NO: 211514

SEQ ID NO: 296333 - RNA, 64 nt, Homo Sapiens; identical to SEQ ID NO: 211515

SEQ ID NO: 296334 - RNA, 64 nt, Homo Sapiens; identical to SEQ ID NO: 211516

SEQ ID NO: 296335 - RNA, 64 nt, Homo Sapiens; identical to SEQ ID NO: 211517

SEQ ID NO: 296336 - RNA, 64 nt, Homo Sapiens; identical to SEQ ID NO: 211518

SEQ ID NO: 296337 - RNA, 64 nt, Homo Sapiens; identical to SEQ ID NO: 211519

SEQ ID NO: 296338 - RNA, 64 nt, Homo Sapiens; identical to SEQ ID NO: 211520

SEQ ID NO: 296339 - RNA, 64 nt, Homo Sapiens; identical to SEQ ID NO: 211521

SEQ ID NO: 296340 - RNA, 64 nt, Homo Sapiens; identical to SEQ ID NO: 211522

SEQ ID NO: 296341 - RNA, 64 nt, Homo Sapiens; identical to SEQ ID NO: 211523

SEQ ID NO: 296342 - RNA, 64 nt, Homo Sapiens; identical to SEQ ID NO: 211524

SEQ ID NO: 296343 - RNA, 64 nt, Homo Sapiens; identical to SEQ ID NO: 211525

SEQ ID NO: 296344 - RNA, 64 nt, Homo Sapiens; identical to SEQ ID NO: 211526

SEQ ID NO: 296345 - RNA, 64 nt, Homo Sapiens; identical to SEQ ID NO: 211527

SEQ ID NO: 296346 - RNA, 64 nt, Homo Sapiens; identical to SEQ ID NO: 211528

SEQ ID NO: 296347 - RNA, 64 nt, Homo Sapiens; identical to SEQ ID NO: 211529

SEQ ID NO: 296348 - RNA, 64 nt, Homo Sapiens; identical to SEQ ID NO: 211530

SEQ ID NO: 296349 - RNA, 64 nt, Homo Sapiens; identical to SEQ ID NO: 211531

SEQ ID NO: 296350 - RNA, 64 nt, Homo Sapiens; identical to SEQ ID NO: 211532

SEQ ID NO: 296351 - RNA, 64 nt, Homo Sapiens; identical to SEQ ID NO: 211533

SEQ ID NO: 296352 - RNA, 64 nt, Homo Sapiens; identical to SEQ ID NO: 211534

SEQ ID NO: 296353 - RNA, 64 nt, Homo Sapiens; identical to SEQ ID NO: 211535

SEQ ID NO: 296354 - RNA, 64 nt, Homo Sapiens; identical to SEQ ID NO: 211536

SEQ ID NO: 296355 - RNA, 64 nt, Homo Sapiens; identical to SEQ ID NO: 211537

SEQ ID NO: 296356 - RNA, 64 nt, Homo Sapiens; identical to SEQ ID NO: 211538

SEQ ID NO: 296357 - RNA, 64 nt, Homo Sapiens; identical to SEQ ID NO: 211539

SEQ ID NO: 296358 - RNA, 64 nt, Homo Sapiens; identical to SEQ ID NO: 211540

SEQ ID NO: 296359 - RNA, 64 nt, Homo Sapiens; identical to SEQ ID NO: 211541

SEQ ID NO: 296360 - RNA, 64 nt, Homo Sapiens; identical to SEQ ID NO: 211542

SEQ ID NO: 296361 - RNA, 64 nt, Homo Sapiens; identical to SEQ ID NO: 211543

SEQ ID NO: 296362 - RNA, 64 nt, Homo Sapiens; identical to SEQ ID NO: 211544

SEQ ID NO: 296363 - RNA, 64 nt, Homo Sapiens; identical to SEQ ID NO: 211545

SEQ ID NO: 296364 - RNA, 64 nt, Homo Sapiens; identical to SEQ ID NO: 211546

SEQ ID NO: 296365 - RNA, 64 nt, Homo Sapiens; identical to SEQ ID NO: 211547

SEQ ID NO: 296366 - RNA, 64 nt, Homo Sapiens; identical to SEQ ID NO: 211548

SEQ ID NO: 296367 - RNA, 64 nt, Homo Sapiens; identical to SEQ ID NO: 211549

SEQ ID NO: 296368 - RNA, 64 nt, Homo Sapiens; identical to SEQ ID NO: 211550

SEQ ID NO: 296369 - RNA, 64 nt, Homo Sapiens; identical to SEQ ID NO: 211551

SEQ ID NO: 296370 - RNA, 64 nt, Homo Sapiens; identical to SEQ ID NO: 211552

SEQ ID NO: 296371 - RNA, 64 nt, Homo Sapiens; identical to SEQ ID NO: 211553

SEQ ID NO: 296372 - RNA, 64 nt, Homo Sapiens; identical to SEQ ID NO: 211554

SEQ ID NO: 296373 - RNA, 64 nt, Homo Sapiens; identical to SEQ ID NO: 211555

SEQ ID NO: 296374 - RNA, 64 nt, Homo Sapiens; identical to SEQ ID NO: 211556

SEQ ID NO: 296375 - RNA, 64 nt, Homo Sapiens; identical to SEQ ID NO: 211557

SEQ ID NO: 296376 - RNA, 64 nt, Homo Sapiens; identical to SEQ ID NO: 211558

SEQ ID NO: 296377 - RNA, 64 nt, Homo Sapiens; identical to SEQ ID NO: 211559

SEQ ID NO: 296378 - RNA, 64 nt, Homo Sapiens; identical to SEQ ID NO: 211560

SEQ ID NO: 296379 - RNA, 64 nt, Homo Sapiens
gaaagccucauuuguguggagacacugugguugcaaaacccacggaacccuucugauugucuua

SEQ ID NO: 296380 - RNA, 64 nt, Homo Sapiens
uugucuuggugggagugggugccucaucuuucccaaaacccacuuuggcucaccaacccugcag

SEQ ID NO: 296381 - RNA, 64 nt, Homo Sapiens
acuccacacacaaaacuccuaugaugucuguuggaaaacccaggccuaaucucagaaugcugga

SEQ ID NO: 296382 - RNA, 64 nt, Homo Sapiens
uauuuguguuguccauucacauuaaaaaacaaaaaaaacccaccggcuauuuuaaauucauauu

SEQ ID NO: 296383 - RNA, 64 nt, Homo Sapiens
caaucugcaauucaaaucagacuacaaagaaaaaaaaacccaacucuaauuuacugaucuuacu

SEQ ID NO: 296384 - RNA, 64 nt, Homo Sapiens
aauaaugcaugcauaauuuauuuaaaaauaaaaaaaaacccaaaaguauuaaauacauaucauu

SEQ ID NO: 296385 - RNA, 64 nt, Homo Sapiens
uagaugccucuaggggcacacacaagucaggagcaaaacccaagcagaaaaacagaguuaucca

SEQ ID NO: 296386 - RNA, 64 nt, Homo Sapiens
ccuggcuguuuacucaggcugcagccauucaaggaaaacccagcgcagauuuuaaccccaucug

SEQ ID NO: 296387 - RNA, 64 nt, Homo Sapiens
aacuuuucugauaaaauaauauuuuaaauuuucaaaaacccauuccugaggagaacuacuucua

SEQ ID NO: 296388 - RNA, 64 nt, Homo Sapiens
uuagauguuuauugauaugagacuaugugguuaaaaaacccaaguauguccauguguuucuuau

SEQ ID NO: 296389 - RNA, 64 nt, Homo Sapiens
ugagcaucagcuuacuuugucacuuagagcaagcaaaacccagugcaagagucucguucagcuc

SEQ ID NO: 296390 - RNA, 64 nt, Homo Sapiens
aucacugacucaucccuacccauauucuuuucauaaaacccacucaccagguacaauagaaacu

SEQ ID NO: 296391 - RNA, 64 nt, Homo Sapiens
auuaugugaacaagcaaaauagagaaggggaaaaaaaacccaaacgacugagagaagucagaac

SEQ ID NO: 296392 - RNA, 64 nt, Homo Sapiens
uugccugucuuugucucuguaagggugagagccuaaaacccagcccagcacaauuuggaguguc

SEQ ID NO: 296393 - RNA, 64 nt, Homo Sapiens
cauugaucuguguacgugucccaggauaaaauuaaaaacccaagugcgaacuugaucagcuucu

SEQ ID NO: 296394 - RNA, 64 nt, Homo Sapiens
uuuucaucaagaagguagcuugagccugaaaugcaaaacccauggaggaauucugaagccauug

SEQ ID NO: 296395 - RNA, 64 nt, Homo Sapiens
cagaacucuguguugugaaugucauucacaacagaaaacccaaaauauuaugcaaacuacugua

SEQ ID NO: 296396 - RNA, 64 nt, Homo Sapiens
aaguuuucuuuacuguugguaaaaaagaaacaaaaaaacccaaacaagggugagacuccaucuc

SEQ ID NO: 296397 - RNA, 64 nt, Homo Sapiens
agaauguaauucaguauuugucuagagccuuuaaaaaacccagcgacacaagauguuuuuauag

SEQ ID NO: 296398 - RNA, 64 nt, Homo Sapiens
aaauacaggauuugauaauauuuugaaggcaggaaaaacccaaauuguuucuucuuugagaguc

SEQ ID NO: 296399 - RNA, 64 nt, Homo Sapiens
uauuuguaaaaaaacaaaaagcaaaaaaauucccaaaacccagauaacaaccagagcaaaacug

SEQ ID NO: 296400 - RNA, 64 nt, Homo Sapiens
cuccuagagaagcacaacugauucuuuuuuuaaaaaaacccaacucacguaugguucacagaua

SEQ ID NO: 296401 - RNA, 64 nt, Homo Sapiens
ccucuggaagauaccuucaccagauugaaaugcaaaaacccacauguugguccguagcauggag

SEQ ID NO: 296402 - RNA, 64 nt, Homo Sapiens
cuuaccuugagucugagaaacucacauaggugaaaaaacccauaucuugugguacaucagggaa

SEQ ID NO: 296403 - RNA, 64 nt, Homo Sapiens
cugaggaaagacugcaagugugcacccaaaaaaaaaaacccaauuggagagccuuacuuggguu

SEQ ID NO: 296404 - RNA, 64 nt, Homo Sapiens
cuggggagaagccccagcaaucauuggaccucagaaaacccacccugcagacaguaugaacauc

SEQ ID NO: 296405 - RNA, 64 nt, Homo Sapiens
caccuaguuaauugagggauuagguagaaaagacaaaacccaaaauuuuuguacauaguagcau

SEQ ID NO: 296406 - RNA, 64 nt, Homo Sapiens
cucuugcaagaagcuaaaaaucauucuucccuucaaaacccagcuauuucuauaauugagauac

SEQ ID NO: 296407 - RNA, 64 nt, Homo Sapiens
cacuauaauccucuuuagggugauuuuuuaaaucaaaacccagugaaucucauuacuccuaaga

SEQ ID NO: 296408 - RNA, 64 nt, Homo Sapiens
uucuggaucauuaauaaaguagcaagauccucaaaaaacccaaaaacaccauucucuaauaguc

SEQ ID NO: 296409 - RNA, 64 nt, Homo Sapiens
auugaacuuccaggaaagugaagaguuuaaacaaaaaacccacagcuuuaaaacaaagggaaaa

SEQ ID NO: 296410 - RNA, 64 nt, Homo Sapiens
guuuuucuuuuuuucuuuuuaaaaagcaaaucagaaaacccacgccauuucuggggggagaaaa

SEQ ID NO: 296411 - RNA, 64 nt, Homo Sapiens; identical to SEQ ID NO: 296402

SEQ ID NO: 296412 - RNA, 64 nt, Homo Sapiens; identical to SEQ ID NO: 296403

SEQ ID NO: 296413 - RNA, 64 nt, Homo Sapiens; identical to SEQ ID NO: 296404

SEQ ID NO: 296414 - RNA, 64 nt, Homo Sapiens
guguucgcccuagaguuauuacaaagccagugccaaaacccagccaugggcucuuugcaaccuc

SEQ ID NO: 296415 - RNA, 64 nt, Homo Sapiens
cugugggugaacaacugcccacuaaccagacuggaaaacccagaaagaugggccuuccaugaau

SEQ ID NO: 296416 - RNA, 64 nt, Homo Sapiens
aagaguaagaccuguuguuuuccugaauuuccuuaaaacccaguuuucuggguagaaggagacu

SEQ ID NO: 296417 - RNA, 64 nt, Homo Sapiens
ccugucuaagguuacugugugaaguguuguguuuaaaacccaagaagcaaaagacagggacaga

SEQ ID NO: 296418 - RNA, 64 nt, Homo Sapiens
gagcaaagugcauuacuuaaaagguagaauggaaaaaacccagauuaauuaaugcacuuuaaau

SEQ ID NO: 296419 - RNA, 64 nt, Homo Sapiens
cccaccccuacccuaccccagucucagugccuucaaaacccaccagggcagcaugggacccagu

SEQ ID NO: 296420 - RNA, 64 nt, Homo Sapiens
gaaaugguuuaagaaaauggaauagauaaaaauaaaaacccaugagacuccaucucaaaaaaua

SEQ ID NO: 296421 - RNA, 64 nt, Homo Sapiens
gagccgggugcgguggcucagacagcuguauuuaaaaacccaugacuugaggaaaaggagaguu

SEQ ID NO: 296422 - RNA, 64 nt, Homo Sapiens
uuggauaauuuucauuaucuuacagaagaacucaaaaacccaauauuuaggguagagcacucuu

SEQ ID NO: 296423 - RNA, 64 nt, Homo Sapiens
ccugcauggucaaguggugcagagaagaaaaaccaaaacccaacaacuuugagaccagaauuac

SEQ ID NO: 296424 - RNA, 64 nt, Homo Sapiens
aggaaacacagacacauccuuguaagagaugagaaaaacccaacaaaaauugaaguuuguauga

SEQ ID NO: 296425 - RNA, 64 nt, Homo Sapiens
agacuguacuuagcauugucacccagaacaaagcaaaacccagcacaaaaaaaacccaacaaca

SEQ ID NO: 296426 - RNA, 64 nt, Homo Sapiens
aacaacccagaacaaagcaaacaaacaaacaaaaaaaacccaaccaagaaaaccaaaaaccaaa

SEQ ID NO: 296427 - RNA, 64 nt, Homo Sapiens
gggcccugugguuggacuucaccucucagcacugaaaacccaaaacccagcuggccuuaacacu

SEQ ID NO: 296428 - RNA, 64 nt, Homo Sapiens
gugguuggacuucaccucucagcacugaaaacccaaaacccagcuggccuuaacacuccuuaaa

SEQ ID NO: 296429 - RNA, 64 nt, Homo Sapiens
uaacacuccuuaaagacagaagucacacuugaacaaaacccacacacaacaaaaccugauuugg

SEQ ID NO: 296430 - RNA, 64 nt, Homo Sapiens
uucgcuauaaauaaaagguaacucuguaaaugaaaaaacccauuuuuaaagaaaaaucuuuguu

SEQ ID NO: 296431 - RNA, 64 nt, Homo Sapiens
uauggccacgcucccccucgugagcgugcuuuccaaaacccaaauccccguccacagggcagcc

SEQ ID NO: 296432 - RNA, 64 nt, Homo Sapiens
gaaaagucuaggaccuaucauuucaucagagacaugaucagaaaagaaacugcuucugccccau

SEQ ID NO: 296433 - RNA, 64 nt, Homo Sapiens
acagacaaagccauugcuagaaaugucauuccaaugaucagaucuggaaacaggcugccauaac

SEQ ID NO: 296434 - RNA, 64 nt, Homo Sapiens
cuaggaagauuccugauguugcacccauuguaagugaucagaaaccaucuguaucaaagucugg

SEQ ID NO: 296435 - RNA, 64 nt, Homo Sapiens
cauccuaccauaaaagagaaaaaaauucggaaagugaucagagcacuuauucaaaauacaguga

SEQ ID NO: 296436 - RNA, 64 nt, Homo Sapiens
cacagaaucaucagacauagcacagaguagaauuugaucagaaugucgcaaauuugaucagagu

SEQ ID NO: 296437 - RNA, 64 nt, Homo Sapiens
cacagaguagaauuugaucaaacugucgcaaauuugaucagaguaauauaagacuuaauagauu

SEQ ID NO: 296438 - RNA, 64 nt, Homo Sapiens
agauguuuccagaaaucccuguuguaacaucaagugaucagaacuaaguuacugggaugacaau

SEQ ID NO: 296439 - RNA, 64 nt, Homo Sapiens
ccuacgcaccagaacagaaggaggguggaggaagugaucagagggaacgagcuguagguuugca

SEQ ID NO: 296440 - RNA, 64 nt, Homo Sapiens
uuugccacagaaaauggaggcuuucacaaggguuugaucagaauuaaaaccccaaacccgcccu

SEQ ID NO: 296441 - RNA, 64 nt, Homo Sapiens
aaguugaccuugugucacuauuuauuuuaugcccugaucagacuagcaacuuagauaagugaaa

SEQ ID NO: 296442 - RNA, 64 nt, Homo Sapiens
uaucaaauagacaaaaacagcuucacuuuagcaaugaucagauuguuaaucuacagauuuuauu

SEQ ID NO: 296443 - RNA, 64 nt, Homo Sapiens
uaaaauuucuauuguugucuauugguaauguuuuugaucagaauaaagaggguaaagggaaaaa

SEQ ID NO: 296444 - RNA, 64 nt, Homo Sapiens
ucuguuuucuuuuagcgaccccccaccgccaggcugaucagaagcugaugacucguggacaaau

SEQ ID NO: 296445 - RNA, 64 nt, Homo Sapiens
cacauuggcuugugggcuuguucuuccugccaaaugaucagagaggaacauuccauuuauuugu

SEQ ID NO: 296446 - RNA, 64 nt, Homo Sapiens
acuccuuguaaaaaaggaaaguccuauuauaauaaaaggugaggauuacaaucauuuauuuuau

SEQ ID NO: 296447 - RNA, 64 nt, Homo Sapiens
aaccacaacacaggucuaaagaugccaaaaaaacaaaggugagaccuucagccuaaggcacaag

SEQ ID NO: 296448 - RNA, 64 nt, Homo Sapiens
uuuguuaauucuauaaagguaucuguuagauauuaaaggugagaauuagggcagguuaaucaaa

SEQ ID NO: 296449 - RNA, 64 nt, Homo Sapiens
aaucagauuaacagauacagguuucauagagaacaaaggugaucauuugaagggcaugcuguaa

SEQ ID NO: 296450 - RNA, 64 nt, Homo Sapiens
ucaacugaaguaaaugaugucugaguguuacaguaaaggugaccaagucucuuucuuaaaguca

SEQ ID NO: 296451 - RNA, 64 nt, Homo Sapiens
ugaauuugguauauguguauuagugaaacauuguaaaggugaacuucuaccucuguaucuaaau

SEQ ID NO: 296452 - RNA, 64 nt, Homo Sapiens
uuauguuucauauacaccuuauauacaauaaccuaaaggugauuuuauaugauauuuugaguaa

SEQ ID NO: 296453 - RNA, 64 nt, Homo Sapiens
caaaagcacacaaguauuuugggaaaaaauccuaaaaggugacuuaauuugaugccuuaaauuc

SEQ ID NO: 296454 - RNA, 64 nt, Homo Sapiens
guggaagucauaguuuauauauuucgagguugccaaaggugacuucagauuaaagccuucugug

SEQ ID NO: 296455 - RNA, 64 nt, Homo Sapiens
uucagaccuugacuauuugguguuuccaguucacaaaggugaugaagacugucuugggagcagc

SEQ ID NO: 296456 - RNA, 64 nt, Homo Sapiens
ccaggcccucagguugaauccagagcuguagagguuacaguagcaucaccagccuugggggucc

SEQ ID NO: 296457 - RNA, 64 nt, Homo Sapiens
acuggugccauagacacagguuuauaguuuuaacuuacaguauuguuugaaauuuaccuguuuu

SEQ ID NO: 296458 - RNA, 64 nt, Homo Sapiens
cuagaaaauacguuugaaagcuuuaucuuauuauuuacaguauuuuuauauuucuuacauuauc

SEQ ID NO: 296459 - RNA, 64 nt, Homo Sapiens
gggggaaaaggcuucaguaaagcagaggcuagaauuacaguauuuauacauagcaacuuuucau

SEQ ID NO: 296460 - RNA, 64 nt, Homo Sapiens
agacacgaucaugguuuuagguacgcuaaaaggcuuacaguaucuugaauguugacccauuuga

SEQ ID NO: 296461 - RNA, 64 nt, Homo Sapiens
cccaucuuuccuuaacgaaauguaaaagauugaauuacaguaaaauaacuugcaaguaauuuuu

SEQ ID NO: 296462 - RNA, 64 nt, Homo Sapiens
aucuccaucaacugaaguaaaugaugucugaguguuacaguaaaggugaccaagucucuuucuu

SEQ ID NO: 296463 - RNA, 64 nt, Homo Sapiens
guuuauucacauuguagaacagcaaaugacauuuuuacaguauuuuuuuguaaagcaaacuauu

SEQ ID NO: 296464 - RNA, 64 nt, Homo Sapiens
aaauaagaccccugucuaauucaucccuuuacucuuacaguagcugccugccaccccuucccag

SEQ ID NO: 296465 - RNA, 64 nt, Homo Sapiens
aagcauagaccccugucuaaucaacccuuuacccuuacaguagcucccuaccaucccuucucag

SEQ ID NO: 296466 - RNA, 64 nt, Homo Sapiens
auucaaccuuuauuuucuaauguauauuguacaguuacaguaaaugauuucccuuuggacuuca

SEQ ID NO: 296467 - RNA, 64 nt, Homo Sapiens
gaggauuuuuucuuucuuuuauuaaucaggaauauuacaguaauugaaaaaccaacauagcauc

SEQ ID NO: 296468 - RNA, 64 nt, Homo Sapiens
uguaaagucggaguuuuaguuaaauuuguucuuguuacaguaacaaauuuaaauggugggucua

SEQ ID NO: 296469 - RNA, 64 nt, Homo Sapiens
ggguacauacaaggguaaaaucuuaaaaauacguuuacaguauuguuaaauuuagugcacucug

SEQ ID NO: 296470 - RNA, 64 nt, Homo Sapiens
agacucugagucugauuacgaaaaguacucuauguuacaguaaagcuaccacucuggcugcuag

SEQ ID NO: 296471 - RNA, 64 nt, Homo Sapiens
uuuuuuuauuuugauauuugucuuuuuuuaaauuuuacaguagucauugaaaguuauguuucuu

SEQ ID NO: 296472 - RNA, 64 nt, Homo Sapiens
auguacuuuuacuuuuugcauuguccagacuucuuuauuagauggagauguuucuuuuucuguc

SEQ ID NO: 296473 - RNA, 64 nt, Homo Sapiens
guguuaaauaaauguguaaaguaaccaccaaauguuauuagaauuuuucuucuagcauuuauaa

SEQ ID NO: 296474 - RNA, 64 nt, Homo Sapiens
uucuguauuggauuuuaccaaaauaacuuaugguuuauuagauaagcagaaucuauucucagua

SEQ ID NO: 296475 - RNA, 64 nt, Homo Sapiens
uagugacuugcuuaauuagugugcaaacaggugcuuauuagaggucauccugcugcugagggca

SEQ ID NO: 296476 - RNA, 64 nt, Homo Sapiens
acuuuuaaggaggguggauagaaauuuuggugauuuauuagaaguuccauccuguuggugcaga

SEQ ID NO: 296477 - RNA, 64 nt, Homo Sapiens
guaugucucagaagaugguuuacuguugauacauuuauuagaaugacccuucguugacuaucag

SEQ ID NO: 296478 - RNA, 64 nt, Homo Sapiens
uucuuguuaaaauguaguuuuucauuuccuacauuuauuagauuuucauuuucuauuaacaauu

SEQ ID NO: 296479 - RNA, 64 nt, Homo Sapiens
acaauugaauaccauuucaguuuauagacuuguuuuauuagauuuuaccaaugaauuuuucaaa

SEQ ID NO: 296480 - RNA, 64 nt, Homo Sapiens
acgcuuaaaggaagucaguaagauaacacacuuuuuauuagauauacuguguggaacuuuuauu

SEQ ID NO: 296481 - RNA, 64 nt, Homo Sapiens
acacacuuuuuauuagauaaacuguguggaacuuuuauuagauaaugaauuaagacgguuaaau

SEQ ID NO: 296482 - RNA, 64 nt, Homo Sapiens
cuguuagggucuuucccagggucaguaggauacauuauuagaaaaaccgccaccucaaugcauu

SEQ ID NO: 296483 - RNA, 64 nt, Homo Sapiens
cuguuaaggucuuucccggggucaguagaauacauuauuagaaaaaccgccaccucaaugcauu

SEQ ID NO: 296484 - RNA, 64 nt, Homo Sapiens
aaauauuucaguuggaaggccucuugaagcuaauuuauuagaaauaaaauuaucuuugaaacac

SEQ ID NO: 296485 - RNA, 64 nt, Homo Sapiens
auuugaauauugguaccuuuuguuauauauguauuuauuagagcauaguuacuuuuuucacuuu

SEQ ID NO: 296486 - RNA, 64 nt, Homo Sapiens
aaaaucucaaucuucaguuucugaaaaccuaucuuuauuagaggaacaucuuauauugaagauu

SEQ ID NO: 296487 - RNA, 64 nt, Homo Sapiens
gaaugaaaaaccacuuuccuuuaucccugcacaauuauuagaguuguuuuauuuuuucucuagc

SEQ ID NO: 296488 - RNA, 64 nt, Homo Sapiens
cagaaacagauuggaaacaggcuuaccugguauuuuauuagauguauguauaaaacugccaaau

SEQ ID NO: 296489 - RNA, 64 nt, Homo Sapiens
auacaaguugcuaagcacuuggcaguucuccauuuuauuagaaaggauugcuuuguacagucaa

SEQ ID NO: 296490 - RNA, 64 nt, Homo Sapiens
uuaccuccugagaaaaaagggggcacucugcuuguuauuagagaaccagcgaggaggcuccaga

SEQ ID NO: 296491 - RNA, 64 nt, Homo Sapiens
gucuuuccacggagccacucuuauuguacuugccuuauuagaguagcagcuuagacuaaggcca

SEQ ID NO: 296492 - RNA, 64 nt, Homo Sapiens
uaaaaaaaaaguguuuuuuuuccaccguugcugauuauuagacaguaggaaauagcuguuuucu

SEQ ID NO: 296493 - RNA, 64 nt, Homo Sapiens
gauuccuuuuuucaauaaucuuaauucaaaagcauuauuagacuugaaaggguuugauaaucuc

SEQ ID NO: 296494 - RNA, 64 nt, Homo Sapiens
guuauauaagguguauugaaaccugcagugcugauuauuagaaaggauuugucagauuuuugaa

SEQ ID NO: 296495 - RNA, 64 nt, Homo Sapiens
cuauauggaccuuauaaaauugauuucuuauuuauuauuagacauuacuacuaaaagguacauc

SEQ ID NO: 296496 - RNA, 64 nt, Homo Sapiens
ugauugauauaaccuaacaaaucugagccaguuauuauuagaguugcagaauagaaacuugaag

SEQ ID NO: 296497 - RNA, 64 nt, Homo Sapiens
agugaaagcuuguuguaaagauauuuucuuuuuguuauuagaaggaaauacaaagagaaaaauu

SEQ ID NO: 296498 - RNA, 64 nt, Homo Sapiens
uagccaguauuucugauuaacuaaguugaaacucuuauuagaaacuuucaguuggugauauugu

SEQ ID NO: 296499 - RNA, 64 nt, Homo Sapiens
cuucuuagugucgaguguauuuauuaauaaaagcuuauuagaguguagaaaugccagcaagagu

SEQ ID NO: 296500 - RNA, 64 nt, Homo Sapiens
auagaauaacauguuauuuauugguauugacuucuuauuagacagagcucauaguauuuguuuu

SEQ ID NO: 296501 - RNA, 64 nt, Homo Sapiens
auuccaggcuaaugaaugcagguaaaguucuucuuuauuagaaagggcaaccagaaguuaagga

SEQ ID NO: 296502 - RNA, 53 nt, Homo Sapiens
ucuuccuuugcgaauuuuauuaauuauuagaacgaauucauaauguaacuuaa

SEQ ID NO: 296503 - RNA, 64 nt, Homo Sapiens
guuaacaccucaccaaguucuuccagcaaaaugcuuauuagaguuuuugucugagcacaguagc

SEQ ID NO: 296504 - RNA, 64 nt, Homo Sapiens
ggccugauuaaagcuuaucgaacuagacauuuguuuauuagaugagcucggcauuauuauuuuc

SEQ ID NO: 296505 - RNA, 62 nt, Homo Sapiens
aacugaucagaucucaugaggcaaaagcagaaaccccugauacaagaaaaaaugaggaagaa

SEQ ID NO: 296506 - RNA, 62 nt, Homo Sapiens
agccaucagaucuugugaaagcaaaaguggaaaccccugauacaagagaaaaugaggaagaa

SEQ ID NO: 296507 - RNA, 62 nt, Homo Sapiens
accaagccgggaaugagcuugugugcccugauaccccugaggguggcugccuccucuggucc

SEQ ID NO: 296508 - RNA, 62 nt, Homo Sapiens
aagaggcaucgccugcaggacuuugcggugggaccccugaaacuggaccugcauagcuacgu

SEQ ID NO: 296509 - RNA, 62 nt, Homo Sapiens
aacuaaaaacuccuuaacuuacuguugcuuacaccccugaaagucuguuuuuaagcaaaugg

SEQ ID NO: 296510 - RNA, 62 nt, Homo Sapiens
uuuaacccuuuuaaaagagaccuauguugaaaaccccugaaaauucacugaagaaaaaucau

SEQ ID NO: 296511 - RNA, 62 nt, Homo Sapiens
agauguugaaacuguuauucuuguguaacaugaccccugauaaccugcacugcucaucugcu

SEQ ID NO: 296512 - RNA, 62 nt, Homo Sapiens
gaaugaaagccaacugaaccgggauuuaagacaccccugauggaggggggugcuuuuguacu

SEQ ID NO: 296513 - RNA, 62 nt, Homo Sapiens
gaaggagggaggaaauaugucccuugcacaccaccccugaagcacauggcaguaggaaacag

SEQ ID NO: 296514 - RNA, 62 nt, Homo Sapiens
cuucacuccuuggggaagccaccucccaucacaccccugagcagaguuagggaggaauucua

SEQ ID NO: 296515 - RNA, 62 nt, Homo Sapiens
ucacucccuagagccugacgccggggccccugaccccugagccucagauuccaauaccucac

SEQ ID NO: 296516 - RNA, 62 nt, Homo Sapiens
ucacuccccagagccugaugccggggccccugaccccugaucuacggaggccugcucccgga

SEQ ID NO: 296517 - RNA, 62 nt, Homo Sapiens
gcuucugaucccagcuauuaccucaugccuggaccccugagaccgaccccucagaauauaac

SEQ ID NO: 296518 - RNA, 62 nt, Homo Sapiens
ugggcaaagguacucaggacuaggaugacagcaccccugagcaauuugauuccaagagagcu

SEQ ID NO: 296519 - RNA, 64 nt, Homo Sapiens; identical to SEQ ID NO: 249425

SEQ ID NO: 296520 - RNA, 64 nt, Homo Sapiens; identical to SEQ ID NO: 249426

SEQ ID NO: 296521 - RNA, 64 nt, Homo Sapiens; identical to SEQ ID NO: 249427

SEQ ID NO: 296522 - RNA, 64 nt, Homo Sapiens; identical to SEQ ID NO: 249428

SEQ ID NO: 296523 - RNA, 64 nt, Homo Sapiens; identical to SEQ ID NO: 249429

SEQ ID NO: 296524 - RNA, 64 nt, Homo Sapiens; identical to SEQ ID NO: 249430

SEQ ID NO: 296525 - RNA, 64 nt, Homo Sapiens; identical to SEQ ID NO: 249431

SEQ ID NO: 296526 - RNA, 64 nt, Homo Sapiens; identical to SEQ ID NO: 249432

SEQ ID NO: 296527 - RNA, 64 nt, Homo Sapiens; identical to SEQ ID NO: 249433

SEQ ID NO: 296528 - RNA, 64 nt, Homo Sapiens; identical to SEQ ID NO: 249434

SEQ ID NO: 296529 - RNA, 64 nt, Homo Sapiens; identical to SEQ ID NO: 249435

SEQ ID NO: 296530 - RNA, 64 nt, Homo Sapiens; identical to SEQ ID NO: 249436

SEQ ID NO: 296531 - RNA, 64 nt, Homo Sapiens; identical to SEQ ID NO: 249437

SEQ ID NO: 296532 - RNA, 64 nt, Homo Sapiens; identical to SEQ ID NO: 249438

SEQ ID NO: 296533 - RNA, 64 nt, Homo Sapiens; identical to SEQ ID NO: 249439

SEQ ID NO: 296534 - RNA, 64 nt, Homo Sapiens; identical to SEQ ID NO: 249440

SEQ ID NO: 296535 - RNA, 64 nt, Homo Sapiens; identical to SEQ ID NO: 249441

SEQ ID NO: 296536 - RNA, 64 nt, Homo Sapiens; identical to SEQ ID NO: 249442

SEQ ID NO: 296537 - RNA, 64 nt, Homo Sapiens; identical to SEQ ID NO: 249443

SEQ ID NO: 296538 - RNA, 64 nt, Homo Sapiens; identical to SEQ ID NO: 249444

SEQ ID NO: 296539 - RNA, 64 nt, Homo Sapiens; identical to SEQ ID NO: 249445

SEQ ID NO: 296540 - RNA, 64 nt, Homo Sapiens; identical to SEQ ID NO: 249446

SEQ ID NO: 296541 - RNA, 64 nt, Homo Sapiens; identical to SEQ ID NO: 249447

SEQ ID NO: 296542 - RNA, 64 nt, Homo Sapiens; identical to SEQ ID NO: 249448

SEQ ID NO: 296543 - RNA, 64 nt, Homo Sapiens; identical to SEQ ID NO: 249449

SEQ ID NO: 296544 - RNA, 64 nt, Homo Sapiens; identical to SEQ ID NO: 249450

SEQ ID NO: 296545 - RNA, 64 nt, Homo Sapiens; identical to SEQ ID NO: 249451

SEQ ID NO: 296546 - RNA, 64 nt, Homo Sapiens; identical to SEQ ID NO: 249452

SEQ ID NO: 296547 - RNA, 64 nt, Homo Sapiens; identical to SEQ ID NO: 249453

SEQ ID NO: 296548 - RNA, 64 nt, Homo Sapiens; identical to SEQ ID NO: 249454

SEQ ID NO: 296549 - RNA, 64 nt, Homo Sapiens; identical to SEQ ID NO: 249455

SEQ ID NO: 296550 - RNA, 64 nt, Homo Sapiens; identical to SEQ ID NO: 249456

SEQ ID NO: 296551 - RNA, 64 nt, Homo Sapiens; identical to SEQ ID NO: 249457

SEQ ID NO: 296552 - RNA, 64 nt, Homo Sapiens; identical to SEQ ID NO: 249458

SEQ ID NO: 296553 - RNA, 64 nt, Homo Sapiens; identical to SEQ ID NO: 249459

SEQ ID NO: 296554 - RNA, 64 nt, Homo Sapiens; identical to SEQ ID NO: 249460

SEQ ID NO: 296555 - RNA, 64 nt, Homo Sapiens; identical to SEQ ID NO: 249461

SEQ ID NO: 296556 - RNA, 64 nt, Homo Sapiens; identical to SEQ ID NO: 249462

SEQ ID NO: 296557 - RNA, 64 nt, Homo Sapiens; identical to SEQ ID NO: 249463

SEQ ID NO: 296558 - RNA, 64 nt, Homo Sapiens; identical to SEQ ID NO: 249464

SEQ ID NO: 296559 - RNA, 64 nt, Homo Sapiens; identical to SEQ ID NO: 249465

SEQ ID NO: 296560 - RNA, 64 nt, Homo Sapiens; identical to SEQ ID NO: 249466

SEQ ID NO: 296561 - RNA, 64 nt, Homo Sapiens; identical to SEQ ID NO: 249467

SEQ ID NO: 296562 - RNA, 64 nt, Homo Sapiens; identical to SEQ ID NO: 249468

SEQ ID NO: 296563 - RNA, 64 nt, Homo Sapiens; identical to SEQ ID NO: 249469

SEQ ID NO: 296564 - RNA, 64 nt, Homo Sapiens; identical to SEQ ID NO: 249470

SEQ ID NO: 296565 - RNA, 64 nt, Homo Sapiens; identical to SEQ ID NO: 249471

SEQ ID NO: 296566 - RNA, 64 nt, Homo Sapiens; identical to SEQ ID NO: 249472

SEQ ID NO: 296567 - RNA, 64 nt, Homo Sapiens; identical to SEQ ID NO: 249473

SEQ ID NO: 296568 - RNA, 64 nt, Homo Sapiens; identical to SEQ ID NO: 249474

SEQ ID NO: 296569 - RNA, 64 nt, Homo Sapiens; identical to SEQ ID NO: 249475

SEQ ID NO: 296570 - RNA, 64 nt, Homo Sapiens; identical to SEQ ID NO: 249476

SEQ ID NO: 296571 - RNA, 64 nt, Homo Sapiens; identical to SEQ ID NO: 249477

SEQ ID NO: 296572 - RNA, 64 nt, Homo Sapiens; identical to SEQ ID NO: 249478

SEQ ID NO: 296573 - RNA, 64 nt, Homo Sapiens; identical to SEQ ID NO: 249479

SEQ ID NO: 296574 - RNA, 64 nt, Homo Sapiens; identical to SEQ ID NO: 249480

SEQ ID NO: 296575 - RNA, 64 nt, Homo Sapiens; identical to SEQ ID NO: 249481

SEQ ID NO: 296576 - RNA, 64 nt, Homo Sapiens; identical to SEQ ID NO: 249482

SEQ ID NO: 296577 - RNA, 64 nt, Homo Sapiens; identical to SEQ ID NO: 249483

SEQ ID NO: 296578 - RNA, 64 nt, Homo Sapiens; identical to SEQ ID NO: 249484

SEQ ID NO: 296579 - RNA, 64 nt, Homo Sapiens
gcccagcccucagauggcucuccuacaugauggugcuuuagaaacaaagguaaaauuugccugu

SEQ ID NO: 296580 - RNA, 64 nt, Homo Sapiens
ugaucccaguguccuuuuccaaaugagugcuguagcuuuagaaguggcccucuauagaaagaag

SEQ ID NO: 296581 - RNA, 64 nt, Homo Sapiens
caguucacuuuuacacgguagccuugaagugaaggcuuuagaugugggaccccccuaauguaau

SEQ ID NO: 296582 - RNA, 64 nt, Homo Sapiens
ccauuucgguagagaacacacuacacugaacccugcuuuagagcuguguguugagcuaaaaaua

SEQ ID NO: 296583 - RNA, 64 nt, Homo Sapiens
gacaaguagaauaaauguugcuguggaaugccaugcuuuagaacaaacccuuuuugaucuuaau

SEQ ID NO: 296584 - RNA, 64 nt, Homo Sapiens
uggggagcguucgccguagucuuuggaagcuuuggcuuuagauuuaccaagccccgccuccccg

SEQ ID NO: 296585 - RNA, 64 nt, Homo Sapiens
uggauguguacuucaccucugggguuuuaucuuugcuuuagaagacuauaaguacaaaguuuuu

SEQ ID NO: 296586 - RNA, 64 nt, Homo Sapiens
auuauuuuagauccuacauauacuuggaccagaggcuuuagauuagccuaauguagaagguggu

SEQ ID NO: 296587 - RNA, 64 nt, Homo Sapiens
ugcugcccccaccccucuuuuccaguccuugccuuccaaccaaaagaaauggauguuuuggugg

SEQ ID NO: 296588 - RNA, 64 nt, Homo Sapiens
cauuuuuagaguguauaaaauucugucuuucauuuccaaccauuuuucaagagaagcugcuacu

SEQ ID NO: 296589 - RNA, 64 nt, Homo Sapiens
guucaucuucccucgauugguuaacuccuuaguuucagaccacagacucaagauuggcucuucc

SEQ ID NO: 296590 - RNA, 64 nt, Homo Sapiens
agggagcagggcaggggcugaaaggggcacugauucagaccagggaggcaacuacacaccaacc

SEQ ID NO: 296591 - RNA, 64 nt, Homo Sapiens
accacuguaggagugaugacagaccaugggaccaucagaccaugauaaauagauugggaccauc

SEQ ID NO: 296592 - RNA, 64 nt, Homo Sapiens
ggaccaucagaccaugaccaauagauugggaccaucagaccaugaauguuggauggauggauaa

SEQ ID NO: 296593 - RNA, 64 nt, Homo Sapiens
agcauccuccuggccagccaucugcaauaagcucucagaccaucaagggcaccugcagacacuu

SEQ ID NO: 296594 - RNA, 64 nt, Homo Sapiens
agcauccuccuggccagcugucugcaauucacucucagaccaucaagggcacaugcacacauuu

SEQ ID NO: 296595 - RNA, 64 nt, Homo Sapiens
aaacucaagcagauucgcaagugcugugcgcuugucagaccaucagaccagggccaaccaauca

SEQ ID NO: 296596 - RNA, 64 nt, Homo Sapiens
gcagauucgcaagugcugugcgcuugucagaccaucagaccagggccaaccaaucagaaggcaa

SEQ ID NO: 296597 - RNA, 64 nt, Homo Sapiens
ccuuauuugguuacauggcaccugagaguuucacucagaccagggaucuuccuuaggaggguca

SEQ ID NO: 296598 - RNA, 64 nt, Homo Sapiens
ccagggaucuuccuuaggagggucaaagugcagaucagaccaugcagguaaggugaaccagcug

SEQ ID NO: 296599 - RNA, 64 nt, Homo Sapiens
cugccccagugcucucuugccgucgggguccagaucaggucacuagacucugaucugaggaccc

SEQ ID NO: 296600 - RNA, 64 nt, Homo Sapiens
agcuggaaguucaccugcaguguguguggggaugucaggucaggaaaugcucagagagcaagcc

SEQ ID NO: 296601 - RNA, 64 nt, Homo Sapiens
uugccucaccccugcauggucggaaaucuucguuucaggucagaacagccuggggucugugggu

SEQ ID NO: 296602 - RNA, 64 nt, Homo Sapiens
uuuuaaaaaauuuauuaaacauuauuaaacuugaucaggucaggccaaauaaaguuuuauugga

SEQ ID NO: 296603 - RNA, 64 nt, Homo Sapiens
gcccuugcugagauuguagagauugagugcucuggaccgcaaaagccaggcuaguccuuguagg

SEQ ID NO: 296604 - RNA, 64 nt, Homo Sapiens
ugccaaggacaucccccuucagagcagaauccaggaccgcaaacaaguggacccugagccuaga

SEQ ID NO: 296605 - RNA, 64 nt, Homo Sapiens
guggcugguguuuguaguugacauaaaggauuaagaccgcaaauuguccuucauggguagaguc

SEQ ID NO: 296606 - RNA, 64 nt, Homo Sapiens
ucaaccauguuggucaggcuggucucgaacuccugaccgcaagugauccacacgccuuggucuc

SEQ ID NO: 296607 - RNA, 64 nt, Homo Sapiens
ccugaauccuggguuuuguacaguggaguggaaagaccgcaacaacacuguuaguguaacgugc

SEQ ID NO: 296608 - RNA, 64 nt, Homo Sapiens
aaaaggggacacagaagcacuggcugcugcuacagaccgcaaaagcagaaaguuucgugaaaau

SEQ ID NO: 296609 - RNA, 64 nt, Homo Sapiens
uugccacaugauaaucacccuucaucagaaaugggaccgcaagugguaggcagugucccuucug

SEQ ID NO: 296610 - RNA, 64 nt, Homo Sapiens
aacuuucuacagaggaacgcaaguacgaauuaaagaccgcaauauacaccaacuucuaaaaaga

SEQ ID NO: 296611 - RNA, 64 nt, Homo Sapiens
caaggaggggaagaaagucagacaugaccuucacgaccgcaauggccucaugcaagucaucccc

SEQ ID NO: 296612 - RNA, 64 nt, Homo Sapiens
cgaggaaugugguggccacguguacuacggugccgaccgcaaugguucacaggggcuagccacc

SEQ ID NO: 296613 - RNA, 64 nt, Homo Sapiens
agucuagagcugguauucuagcccaaaucugucugaccgcaauacacagauucuuuauuccuau

SEQ ID NO: 296614 - RNA, 64 nt, Homo Sapiens
gauucacccaccucagccucagucucgaacucgugaccgcaagcuucaccauguuggucaggcu

SEQ ID NO: 296615 - RNA, 64 nt, Homo Sapiens
ucagccugagggccugcggagccucaagaagccagaccgcaagaagcgcuacaccguggugggc

SEQ ID NO: 296616 - RNA, 64 nt, Homo Sapiens
auucacuccuggagaucuccaaugaugaacaugagaccgcaaaaagaugugguauaugaucuua

SEQ ID NO: 296617 - RNA, 64 nt, Homo Sapiens
ccugugguuugccauccgcuguggcugcagcuuggaccgcaagggcaaauacacccugacccca

SEQ ID NO: 296618 - RNA, 64 nt, Homo Sapiens
uucaccguguuggccaggcugaucucgaacuccugaccgcaagugauccacccgccucggucuc

SEQ ID NO: 296619 - RNA, 64 nt, Homo Sapiens
ggugccuuacacacugccccaguguggcugggcugaccgcaaaaggcauucucucuggcgaugg

SEQ ID NO: 296620 - RNA, 64 nt, Homo Sapiens
gauccacccgccuccgccucggucucgaacuccugaccgcaaguuucaccacguuggccaggcu

SEQ ID NO: 296621 - RNA, 64 nt, Homo Sapiens
gaaaagccuuacccauuuugguuuucacuauugagaccgcaacugcuugcacugaucauuuugg

SEQ ID NO: 296622 - RNA, 64 nt, Homo Sapiens
cacacauucccccaccagcucgugcauucacauugaccgcaacuguagccgggcucugcaccca

SEQ ID NO: 296623 - RNA, 64 nt, Homo Sapiens
auuaaaauuaaaagcaaaaccacaagaagggaaagaccgcaacucggacagcccagcgacuucc

SEQ ID NO: 296624 - RNA, 64 nt, Homo Sapiens
aucuuuucuuguauucccauaccaccagacaccugaccgcaaauaugaacuguacuggcuguug

SEQ ID NO: 296625 - RNA, 64 nt, Homo Sapiens
cuagacugaaaugauacaaacuuccaucuggucugaccgcaaacaguguuuauuuggggacagg

SEQ ID NO: 296626 - RNA, 64 nt, Homo Sapiens
gagauccgugcgcccgaccagcaccagcaucgcggaccgcaaaggccgcccgucccgucaaaca

SEQ ID NO: 296627 - RNA, 64 nt, Homo Sapiens
cuaaguuucuagauaaacaggccagggaacauaagaccgcaauucaaagccccuggucauacag

SEQ ID NO: 296628 - RNA, 64 nt, Homo Sapiens
gugcauuuauugccucuaugugcaacugacagaugaccgcaauaaugaaugagcaguuagaaau

SEQ ID NO: 296629 - RNA, 64 nt, Homo Sapiens
acaaauguuuuuauuaaauguuucauugacccaaguaauuuaaaaguaauauguuaccuauguc

SEQ ID NO: 296630 - RNA, 64 nt, Homo Sapiens
agcugaucuguaaaugacuuuaaaagcuauuuuaguaauuuaaauaaauuuacuuucuugguuu

SEQ ID NO: 296631 - RNA, 64 nt, Homo Sapiens
aauaugaauauaaaucuuguuauuuuuauuauauguaauuuagucaauacauuuaacacuauug

SEQ ID NO: 296632 - RNA, 64 nt, Homo Sapiens
guggcaugagauaagaugggucuucaguuacuuuguaauuuauuacaaaagcugcaguaaccug

SEQ ID NO: 296633 - RNA, 64 nt, Homo Sapiens
cuugucuucuauaccacccuuguccucaucucagguaauuuaugaaaucuauguaaacuugaaa

SEQ ID NO: 296634 - RNA, 64 nt, Homo Sapiens
augaaucuugguauccugugaaacagaauaauucguaauuuaagaaagcccuuaucccgguaac

SEQ ID NO: 296635 - RNA, 64 nt, Homo Sapiens
auaauauucugaauucauucaaagaggauggguuguaauuuagcuauugcuguuagaaguccua

SEQ ID NO: 296636 - RNA, 64 nt, Homo Sapiens
ugaaaguaguguuaaacucacauuaacuuccuuuguaauuuauuccacauccaccuucggaaua

SEQ ID NO: 296637 - RNA, 64 nt, Homo Sapiens
uauucauuuauauccuauccuauuuuccuuggcuguaauuuaugucucauagauaauuuucaaa

SEQ ID NO: 296638 - RNA, 64 nt, Homo Sapiens
gacugagugacaguacucagaccacccucuggggguaauuuacauuuaaggaaugaggaaacaa

SEQ ID NO: 296639 - RNA, 64 nt, Homo Sapiens
uauuucacuuguauucauuuuccucuauuucauuguaauuuauaccaggacagagccacaaucu

SEQ ID NO: 296640 - RNA, 64 nt, Homo Sapiens
aaaaacauuacuguucuaauuuuuuuuuuuuuuaguaauuuagcgaguucuucuuucuuucuuu

SEQ ID NO: 296641 - RNA, 64 nt, Homo Sapiens
auuguuuuauguaaaaggaaauuauuuuugagauguaauuuaagcaucaagaaaaguguaagaa

SEQ ID NO: 296642 - RNA, 64 nt, Homo Sapiens
uaaacauggguuuuuaacuucaagaucugccccaguaauuuaccaaagguagcaaaauaauagu

SEQ ID NO: 296643 - RNA, 64 nt, Homo Sapiens
aggugucuaaaucuccagucugucuguuguacugguaauuuaacucuguaauggaauaguuugc

SEQ ID NO: 296644 - RNA, 64 nt, Homo Sapiens
guugagcugaugucaauugggagggcccagcaagguaauuuauguuucauugggcaacagcuaa

SEQ ID NO: 296645 - RNA, 64 nt, Homo Sapiens
uguaccuuauuuuuuuuuucaucagcuuuggaaaguaauuuaaaaaaaaagaaaagacaaaaaa

SEQ ID NO: 296646 - RNA, 64 nt, Homo Sapiens
ggaaaauaucuuauuucuuuaauuucaauuuucaguaauuuaguucaucaacagucaacauaaa

SEQ ID NO: 296647 - RNA, 64 nt, Homo Sapiens
uauaaaguaaaauaaugggcacuuuucuacugguguaauuuaaguuaaacuauuaauaagcaua

SEQ ID NO: 296648 - RNA, 64 nt, Homo Sapiens
aaaaauguauaauaagauaacagcuauugacuuuguaauuuagguuuguagcagaauauauuug

SEQ ID NO: 296649 - RNA, 64 nt, Homo Sapiens
uacaggaaauguuaaugagaaauuauuauuugaaguaauuuauucuuauguccacccuuuuaaa

SEQ ID NO: 296650 - RNA, 64 nt, Homo Sapiens
aagaaaagaaauuuauuuucauacgacagacuggguaauuuaaauuuucugcuacuauaacaga

SEQ ID NO: 296651 - RNA, 64 nt, Homo Sapiens
agucaaagacaggaagagauaccuuuuugcuaaaguaauuuacaaacaagagagggugagauua

SEQ ID NO: 296652 - RNA, 64 nt, Homo Sapiens
uucuuuauuauugacggcuguauugaugggauugguaauuuaguccuucauauuaaucucuauu

SEQ ID NO: 296653 - RNA, 64 nt, Homo Sapiens
uagcccuauuugauacuugacagugcaaguuucuguaauuuaaaaagaugugguggccugacac

SEQ ID NO: 296654 - RNA, 64 nt, Homo Sapiens
aucacauuuguuuuucagguuuaaaauuucagauguaauuuaacuuggauuuuuaaauacauuu

SEQ ID NO: 296655 - RNA, 64 nt, Homo Sapiens
aaucacuggauugcuuuauuccuuuauuucauaaguaauuuaaauauuuuacaucuuauuuuug

SEQ ID NO: 296656 - RNA, 64 nt, Homo Sapiens
ugauucauauaccacugcuaacauuuuguuggagguaauuuauguuuuuucuaauacauggaau

SEQ ID NO: 296657 - RNA, 64 nt, Homo Sapiens
auuaauaaugccaguuuuccgaaaacuuugcuugguaauuuaaaauccauguauaaaauagaua

SEQ ID NO: 296658 - RNA, 64 nt, Homo Sapiens
ucugguauugugagugguuacccuaguuaaucauguaauuuaauagggcaaaaugugucagaug

SEQ ID NO: 296659 - RNA, 64 nt, Homo Sapiens
aauaaauaagccugcuacauguaguauuguuuuuguaauuuaacugaguuaaucuguuguaauu

SEQ ID NO: 296660 - RNA, 64 nt, Homo Sapiens
cacaugggaaagauucuagaucuuucuugcaagaguaauuuaagaaguuauucaaagaauguua

SEQ ID NO: 296661 - RNA, 64 nt, Homo Sapiens
uauaaugccagaaggaaaacacaaaaaccuuaauguaauuuacuaaauacuauaugugagacug

SEQ ID NO: 296662 - RNA, 64 nt, Homo Sapiens
uagaauaaaagcauuaaaaaauuagccuaugguaguaauuuaugaguuuauuugcuuuuuaaac

SEQ ID NO: 296663 - RNA, 64 nt, Homo Sapiens
uuugauaacggcucuuaaacuaucuugaaaaaauguaauuuauuccaucauagcagcauuucug

SEQ ID NO: 296664 - RNA, 64 nt, Homo Sapiens
uguuuauguuacccacguuguuaagaugacuuuaguaauuuaacuucauugaaguauuuugguc

SEQ ID NO: 296665 - RNA, 64 nt, Homo Sapiens
uguuuuuaauaugccauuuuuacagagcuuaaauguaauuuauauauuuuuguuaagaaucaug

SEQ ID NO: 296666 - RNA, 64 nt, Homo Sapiens
uauagcacaucucauguuuuaucauuuggauggaguaauuuaaaaugaauuaaauuccagagaa

SEQ ID NO: 296667 - RNA, 64 nt, Homo Sapiens
caaaaugaaaucaauguuuaguucacaaguagauguaauuuacuaaagaaugauacacccauau

SEQ ID NO: 296668 - RNA, 64 nt, Homo Sapiens
uauacuaucaagaaaaaauucugugaauuaagauguaauuuauaaaauaacauuucaauggggg

SEQ ID NO: 296669 - RNA, 64 nt, Homo Sapiens
agauauuacauggacuaaauuuugucaauuucauguaauuuacccuuugcaauaaaaaugauuc

SEQ ID NO: 296670 - RNA, 64 nt, Homo Sapiens
uuuuauuaugcuuuaaacacagcacuuuuguauuguaauuuauuuuagugucuccuuccuaaag

SEQ ID NO: 296671 - RNA, 64 nt, Homo Sapiens
aaaaaaauugugaaacagcaacuggaaucauuaaguaauuuaauaagucuaugcucauuugcag

SEQ ID NO: 296672 - RNA, 64 nt, Homo Sapiens
gcauuauuuuucuuaauaucuauuuacuaaguauguaauuuaauauacauuaauuauuuuuuga

SEQ ID NO: 296673 - RNA, 64 nt, Homo Sapiens
ucaaucuguucaguuuaccaagguucagaaauacguaauuuagcaggaaacuauaaauaccagu

SEQ ID NO: 296674 - RNA, 64 nt, Homo Sapiens
aauguugaaccucacacuuuuauguggugacaguguaauuuaauuaaaagguguaaauguuuuc

SEQ ID NO: 296675 - RNA, 64 nt, Homo Sapiens
aucccuacguguugugggagggacccagugggcaguaauuuaaucaugguggugguuacccuca

SEQ ID NO: 296676 - RNA, 64 nt, Homo Sapiens
ugacagguaaaacuccuauuuugugacaauuagaguaauuuacaacaagcuaauugaauuaggc

SEQ ID NO: 296677 - RNA, 64 nt, Homo Sapiens
uaaacuuuuuaaauguagaaaaguugcaauucauguaauuuauauuucauuuugauuuuuauga

SEQ ID NO: 296678 - RNA, 64 nt, Homo Sapiens
uguguccaguuuugccugucuauaaaagaugauaguaauuuaccaagugacauuugcagagaaa

SEQ ID NO: 296679 - RNA, 64 nt, Homo Sapiens
uuaaugaaauauuuuauaauuugcaaauuuuuaaguaauuuaugaaaaaccuagaucaguggau

SEQ ID NO: 296680 - RNA, 64 nt, Homo Sapiens
auaaaacagggaugucacuuuuccuuagaggucgguaauuuaacgugucucuacaugccuuuga

SEQ ID NO: 296681 - RNA, 64 nt, Homo Sapiens
aaauuguuuaaaauguugguaaaaggaacaacgaguaauuuauaguugagaaagaaacacuaac

SEQ ID NO: 296682 - RNA, 64 nt, Homo Sapiens
auuucuaauuuucuaauguguauuuuucuacaaaguaauuuauguacagaaggaagggagggau

SEQ ID NO: 296683 - RNA, 64 nt, Homo Sapiens
uuucaugguacuguagaggccuggagagaaguaaguaauuuagguuccuccaccuaggauuaag

SEQ ID NO: 296684 - RNA, 64 nt, Homo Sapiens
gcaaaagguguccacaguguauuagugacauucuuucauugacagcugacauaauucauugagu

SEQ ID NO: 296685 - RNA, 64 nt, Homo Sapiens
auuagugacauucuuucauugacagcugacauaauucauugagugaaauauuuuaagccaaaaa

SEQ ID NO: 296686 - RNA, 64 nt, Homo Sapiens
uuggauguauuuuccacauauauauaucaaacauuucauugaguuaugaaacauauaagcuaac

SEQ ID NO: 296687 - RNA, 64 nt, Homo Sapiens
uaaacagugugauuugugauaaaugugacauguuuucauugauuacagaggaugacacauaggc

SEQ ID NO: 296688 - RNA, 64 nt, Homo Sapiens
uaucgauggacaccuggguuauugaauagauuuguucauugaccucauugcugaguacugcuuc

SEQ ID NO: 296689 - RNA, 64 nt, Homo Sapiens
agauuuguucauugaccuauuugcugaguacugcuucauugaauuuuuguuuuuauguuuuuca

SEQ ID NO: 296690 - RNA, 64 nt, Homo Sapiens
ugaguagugcauuuaauuauggaaaacgaaaaauuucauugagauuagaaaguucuagaaaaua

SEQ ID NO: 296691 - RNA, 61 nt, Homo Sapiens
ugaaauuuauuuuggaugaaguuauuuacuuuucauugaauugucauuuauagaucccuaa

SEQ ID NO: 296692 - RNA, 64 nt, Homo Sapiens
gcagaaagaacucagauguacuagauuuucauuguucauugauaugcucaguaugcugccacau

SEQ ID NO: 296693 - RNA, 64 nt, Homo Sapiens
uucuuuaaaguuuucugacgugcauaaugcauaauucauugaaaagcaugauagcaauguggca

SEQ ID NO: 296694 - RNA, 64 nt, Homo Sapiens
uuuugcuauggaaacuuuuguuuauuuuguguuguucauugaacuguucuuuguauuugguaaa

SEQ ID NO: 296695 - RNA, 64 nt, Homo Sapiens
cguaugccagcucaccuuuuacauggaaaugauuuucauugauuaaggaaugaaaacugguuca

SEQ ID NO: 296696 - RNA, 64 nt, Homo Sapiens
cacuauucccucuauuuuccagaaagagaggcuguucauugaucaguggaauuucuucaaacag

SEQ ID NO: 296697 - RNA, 64 nt, Homo Sapiens
uugagaagacuccaccugugugauauuuuuuucauucauugacugacaauauuguggcucgucc

SEQ ID NO: 296698 - RNA, 64 nt, Homo Sapiens
uugggcaauaaugcauaggaguucuugauaccccuucauugauuacuguguaucaguucuuugu

SEQ ID NO: 296699 - RNA, 64 nt, Homo Sapiens
aaccaauuuuuaacuuucucuucucauuccuguuuucauugauuucccacauguaguccuuuug

SEQ ID NO: 296700 - RNA, 64 nt, Homo Sapiens
aaccacaaugccucauuguaaugggauauugaaguucauugaagaauuacuagguugccaugug

SEQ ID NO: 296701 - RNA, 64 nt, Homo Sapiens
guuaaaauggaaccuuacgguuguguuuuaaguauucauugaaaccagcuucagaaaacaagau

SEQ ID NO: 296702 - RNA, 64 nt, Homo Sapiens
accaaguaucauuugguuaucuuacugggacauuuucauugauauucuauacaccaaaguuuug

SEQ ID NO: 296703 - RNA, 64 nt, Homo Sapiens
uauuauauauaaaauauaguuccccgucccccuuuucauugaguuugauauucuucaguaaagc

SEQ ID NO: 296704 - RNA, 64 nt, Homo Sapiens
guaguugaucuaauaaaugagagcagggaggagauucauugacucugaaaugauuuuuauuuuu

SEQ ID NO: 296705 - RNA, 64 nt, Homo Sapiens
uugacugacauaguuaaaaacuacucauuauguguucauugaauuuccuuuacagugccuagug

SEQ ID NO: 296706 - RNA, 64 nt, Homo Sapiens
uuuuuucuuccuugccuuugcucugccucggaauuucauugaguuggccuuugguugauagauc

SEQ ID NO: 296707 - RNA, 64 nt, Homo Sapiens
guggugcugcguucuggccaguaaauuccauguuuuuggcuauaucucauccaaacugagcagu

SEQ ID NO: 296708 - RNA, 64 nt, Homo Sapiens
uacuuaaaaaaaaaaggauauguuuacauuuaauuuuggcuaccaggaguuuaguuuauuuuau

SEQ ID NO: 296709 - RNA, 64 nt, Homo Sapiens
uguacuuccccauuauggcacucaauugcuggccuuuggcuaccgauaguuucucuaaugcugu

SEQ ID NO: 296710 - RNA, 64 nt, Homo Sapiens
gauuagacaauuauaccuaccaucaagggcacacuuuggcuacuucaguuauaggggugauuag

SEQ ID NO: 296711 - RNA, 64 nt, Homo Sapiens
ggguaaugauuagcacuaauucaucugauaaucuuuuggcuaaacacuuuuagagauugucuau

SEQ ID NO: 296712 - RNA, 64 nt, Homo Sapiens
auucuuagaaucaaugaaugguuguuguucuuuuuuuggcuaagaguguuguuguuguuguuuu

SEQ ID NO: 296713 - RNA, 64 nt, Homo Sapiens
aguuuaaaccgaguucuucauuaacugcaacugcuuuggcuaccuuuauacucuggacauaguu

SEQ ID NO: 296714 - RNA, 64 nt, Homo Sapiens
guugcgguuccccuguaaagcuagccgugguccuuuuggcuaugaaauaaaaguuugauguuug

SEQ ID NO: 296715 - RNA, 64 nt, Homo Sapiens
gcagaguccuuauucuucucauaaaucuuuuuacuuuggcuacaaauagaugaugguaugauuc

SEQ ID NO: 296716 - RNA, 64 nt, Homo Sapiens
agcuuauuacagaaaaaccccguuucccugaacuuuuggcuaacagaaauuaauuuaacugaca

SEQ ID NO: 296717 - RNA, 64 nt, Homo Sapiens
auguucaguuuuaacuaaaacuaaauuuauguuauuuggcuaaauguuaugaugcagucuagua

SEQ ID NO: 296718 - RNA, 64 nt, Homo Sapiens
ucaacaguuaaagacuauggugguuuuuucagaguuuggcuaagaauguuguuaccaucuucuu

SEQ ID NO: 296719 - RNA, 64 nt, Homo Sapiens
uagaguauuugcagaaggaaaccauuucugguuauuuggcuauaaaaagucagcauaaaauaug

SEQ ID NO: 296720 - RNA, 64 nt, Homo Sapiens
ugcgaaugauuugauauuuucauccuuauuucucuuuggcuacaauuuauauugaguuauaucu

SEQ ID NO: 296721 - RNA, 64 nt, Homo Sapiens
uauuugaguuugcagaauuaucuaauagucuuuuuuuggcuaauauuuuuauaacgugguucuu

SEQ ID NO: 296722 - RNA, 64 nt, Homo Sapiens
uggugaauuacuaaacugauugacuuucagccuuuuuggcuagauccugagaggcuauuuuucu

SEQ ID NO: 296723 - RNA, 64 nt, Homo Sapiens
uugcuuagcugaucaccaccugaaauuacuucuguuuggcuaguaaaguaaaagugacuuaauu

SEQ ID NO: 296724 - RNA, 64 nt, Homo Sapiens
augaucgcuauguguuccuuauuucccaacauuuuuuggcuauuaaaaaaacccacccuuuuuc

SEQ ID NO: 296725 - RNA, 63 nt, Homo Sapiens
ccccugggcucugccccagcucuggcuuccagaaaaccccagcauccuuuucugcagaggggc

SEQ ID NO: 296726 - RNA, 63 nt, Homo Sapiens
uaggaguucgagaccagccuggccaacaugguaaaaccccaucucuacuaaaaauacagaaau

SEQ ID NO: 296727 - RNA, 63 nt, Homo Sapiens
uacccaaccauccacccaagaccccaaaccaggaaaccccaccagagggcccuugucugagaa

SEQ ID NO: 296728 - RNA, 63 nt, Homo Sapiens
ccaggaaaccccaccuacccgcccuugucugagaaaccccaaacagggcacccucccuagagg

SEQ ID NO: 296729 - RNA, 63 nt, Homo Sapiens
acaaaggccuagaccagccugggcaacauggugaaaccccaucucuacaaaaaauuuuuaaaa

SEQ ID NO: 296730 - RNA, 63 nt, Homo Sapiens
caggagaucaagaccauccuggccaacauggugaaaccccaucucuacugaauacacaaaaau

SEQ ID NO: 296731 - RNA, 63 nt, Homo Sapiens
ucuauuaaaaauacaaaaaucgccaacaaggugaaaccccacccaagagaucaagaccauccu

SEQ ID NO: 296732 - RNA, 63 nt, Homo Sapiens
ucuacuaaaaauacaaaaauggccaauaugaugaaaccccauccaggaguucgagagcagccu

SEQ ID NO: 296733 - RNA, 63 nt, Homo Sapiens
cucugaaguaauucccagaauacgguccuuccuaaaccccagaaauugccuuuuucagaguuu

SEQ ID NO: 296734 - RNA, 63 nt, Homo Sapiens
uaaaccauguguagagcuuuaaaaacagaaaaaaaaccccauauacuuaugaccaucuuaaau

SEQ ID NO: 296735 - RNA, 63 nt, Homo Sapiens
ccuugaucuaccauccauccucuuccccaauccaaaccccacagucucuucucucccacaccc

SEQ ID NO: 296736 - RNA, 63 nt, Homo Sapiens
uaauauuuaaaauucaaauauuaaaacucaaauaaaccccaaagaacuuuuggaaaacaaaag

SEQ ID NO: 296737 - RNA, 63 nt, Homo Sapiens
uccacaaaaaaauucaaaaaggacaucaugacgaaaccccauccaggauuuugagaacagcuu

SEQ ID NO: 296738 - RNA, 63 nt, Homo Sapiens
ucuacuaaaaauacaaaaaaggccagcauggcgaaaccccaucccggaguucgaggcugguuu

SEQ ID NO: 296739 - RNA, 63 nt, Homo Sapiens
gaugggucaucuaagugcugagcagggacugagaaaccccaaguaccugcaugcaggcaccag

SEQ ID NO: 296740 - RNA, 63 nt, Homo Sapiens
ccucauuugccuucccuaccuaaacaagaaagaaaaccccaguucauuuccuuuuuguauuuu

SEQ ID NO: 296741 - RNA, 63 nt, Homo Sapiens
cuugguacccauucccauuucacaaacuccuccaaaccccaaaccccaaacggaaaucucugg

SEQ ID NO: 296742 - RNA, 63 nt, Homo Sapiens
cccauucccauuucacaaacuccuccaaaccccaaaccccaaacggaaaucucugggacaaug

SEQ ID NO: 296743 - RNA, 63 nt, Homo Sapiens
ccuggauucugaguuuuucagcauaguacugggaaaccccagacacaguacugggaaauggga

SEQ ID NO: 296744 - RNA, 63 nt, Homo Sapiens
cuccaucaagguccugccuggucuucuacccugaaaccccacccaggugccccugugauccag

SEQ ID NO: 296745 - RNA, 63 nt, Homo Sapiens
caagaugacaugacaucacucccaauucucuccaaaccccagagaaauacugacgaaguuuuc

SEQ ID NO: 296746 - RNA, 63 nt, Homo Sapiens
auguucaucuuguaaucauagcaaaaagucugcaaaccccagggucaagccugcucugccaca

SEQ ID NO: 296747 - RNA, 63 nt, Homo Sapiens
agacaccucugcccuggccacccaacauuuaagaaaccccaaucaugucccaaggcauaacuu

SEQ ID NO: 296748 - RNA, 63 nt, Homo Sapiens
ucuacuaaaaauacaaaaaaggccaacauggugaaaccccaucuaggaguucaagaccagccu

SEQ ID NO: 296749 - RNA, 63 nt, Homo Sapiens
cuuauuacacauaagauaauucauagcggagagaaaccccacaaaugugaagaauguggcaga

SEQ ID NO: 296750 - RNA, 63 nt, Homo Sapiens
cuuaguacacauaagaaaauucauacuggggagaaaccccacaaauguggagaaugcggaaaa

SEQ ID NO: 296751 - RNA, 63 nt, Homo Sapiens
cuuucugcacauaauauaauucauacuggagagaaaccccacaaauaugaagaaugugguaau

SEQ ID NO: 296752 - RNA, 63 nt, Homo Sapiens
caggaguucgagaccagccuggucaagauggugaaaccccaucucuacuaaaauuacaaaaau

SEQ ID NO: 296753 - RNA, 63 nt, Homo Sapiens
caggaguuugaaaccagccuggccaacauggugaaaccccaucucuacuaaaaaaacaaaacu

SEQ ID NO: 296754 - RNA, 63 nt, Homo Sapiens
ugcuucaaaugcacacaggccuaguugaaguuuaaaccccagcaaaacauuccucccuguaaa

SEQ ID NO: 296755 - RNA, 63 nt, Homo Sapiens
auugaaugggggugggggcucguguguccugggaaaccccaucagucccuucauuucuugaga

SEQ ID NO: 296756 - RNA, 63 nt, Homo Sapiens
ucuacuaaaaauacaaaauuuaccaacauggagaaaccccauccgggaguucgagaccagccu

SEQ ID NO: 296757 - RNA, 62 nt, Homo Sapiens
cacccauuaaacaaguccugggaggaaaaccaaaaccccaagaggaggaggaggaagaauaa

SEQ ID NO: 296758 - RNA, 63 nt, Homo Sapiens
uuucccaggguaaucaugaaacaaagcaugaagaaaccccauugauuggcaaaaaagauuggc

SEQ ID NO: 296759 - RNA, 63 nt, Homo Sapiens
uaaguuguccuucaacuguuaucucuucccuccaaaccccaagugaucuguugauaucuuuga

SEQ ID NO: 296760 - RNA, 63 nt, Homo Sapiens
cacgcugucucagaaaacgaaaacggaggaaaaaaaccccaaaccccaaacaaucuuaauaaa

SEQ ID NO: 296761 - RNA, 63 nt, Homo Sapiens
ucucagaaaacgaaaacggaggaaaaaaaccccaaaccccaaacaaucuuaauaaacacgacu

SEQ ID NO: 296762 - RNA, 63 nt, Homo Sapiens
gauggguauggacagcaugccuuuccauuuaacaaaccccagugggagaggccggccucaaau

SEQ ID NO: 296763 - RNA, 63 nt, Homo Sapiens
accuggaucccaggagacaauccucccccgaccaaaccccaagggucccaaggccccgcagcu

SEQ ID NO: 296764 - RNA, 63 nt, Homo Sapiens
uccaaaaauauaauaauaauaagcaacauagugaaaccccauccaggaguugaaguccagccu

SEQ ID NO: 296765 - RNA, 63 nt, Homo Sapiens
ucuacuaaaaauacaaaaauggccaacauggugaaaccccauccaggagauccagcccauccu

SEQ ID NO: 296766 - RNA, 63 nt, Homo Sapiens
ucuacuaaaaaaaaauacaaggccaacacggugaaaccccauccaggagcucgagaccagccu

SEQ ID NO: 296767 - RNA, 63 nt, Homo Sapiens
ucuacuaaaaaaaaaaaaaaggccaacauggugaaaccccauccaggagcucaagaccagccu

SEQ ID NO: 296768 - RNA, 63 nt, Homo Sapiens
caggaguuccagaccagccuggccaacauggcgaaaccccaucucuacuaaaaauacaaaaau

SEQ ID NO: 296769 - RNA, 63 nt, Homo Sapiens
caggaguucgagaccagccuggccaauauggugaaaccccaucucuacuaaaaauauaaaaau

SEQ ID NO: 296770 - RNA, 63 nt, Homo Sapiens
aauuggugugugguauagaagaaaaacggguucaaaccccacuucugccaccuaccagcuaua

SEQ ID NO: 296771 - RNA, 63 nt, Homo Sapiens
uaggaguuugagaccagccuggccaacauggugaaaccccaucucuacuaaaaaaaaaaaaaa

SEQ ID NO: 296772 - RNA, 63 nt, Homo Sapiens
gcuagcaauaguuggcuucuccccugucaguggaaaccccacuucugcccggcccuugagcuu

SEQ ID NO: 296773 - RNA, 63 nt, Homo Sapiens
uuguauguacccugugcuuaauucuauaacaguaaaccccauacgcaggugggagggaggaac

SEQ ID NO: 296774 - RNA, 63 nt, Homo Sapiens
uuuagggugaggguuuguaauuuuuuagagcccaaaccccagggaucugcuucccuaaauuac

SEQ ID NO: 296775 - RNA, 63 nt, Homo Sapiens
cagaaacagagaaaacugggccaggaaaaaaacaaaccccacuccugacccuguguguacaau

SEQ ID NO: 296776 - RNA, 63 nt, Homo Sapiens
cucccgaacucaugcucagaaccgccaaaauucaaaccccagaaugcagaauggaugaguggu

SEQ ID NO: 296777 - RNA, 63 nt, Homo Sapiens
ucuacuaaaaauagaaaaaugaccaauauggugaaaccccauccaggaguucgagaccagccu

SEQ ID NO: 296778 - RNA, 63 nt, Homo Sapiens
ucuguuugcagacgauaugauucuauaucuagaaaaccccaugaucuuggcccaaaagcuccu

SEQ ID NO: 296779 - RNA, 63 nt, Homo Sapiens
aucaacucaagauggauuaaagacuuaaauguaaaaccccaaacuauaaaaacucuggaagau

SEQ ID NO: 296780 - RNA, 63 nt, Homo Sapiens
caggaguucgagaccauccugucuaacacggugaaaccccaucucuacuaaaaauacaaaaaa

SEQ ID NO: 296781 - RNA, 63 nt, Homo Sapiens
caggaguucaagaccagccuggccaacauggugaaaccccaucucuacuaaaaauacaaaaau

SEQ ID NO: 296782 - RNA, 63 nt, Homo Sapiens
cgcgagacaggccaggcucguggcucggaagacaaaccccacacacacucaaggggucgaaaa

SEQ ID NO: 296783 - RNA, 63 nt, Homo Sapiens
acaaaccccacacacacucaaggggucgaaaacaaaccccacacgagggcucucaccuccuuc

SEQ ID NO: 296784 - RNA, 63 nt, Homo Sapiens
acauccaggugaugugcucugguauggaauuugaaaccccaauggggccuuggcacuaagacu

SEQ ID NO: 296785 - RNA, 63 nt, Homo Sapiens
gcuggcucgaugauguuaacaguauuaaaaauuaaaccccauaaaccaacuaagccuuaugga

SEQ ID NO: 296786 - RNA, 63 nt, Homo Sapiens
caggaguucaacaccagccugagcaacaugguaaaaccccaucucuaccaaaaauacaaaaau

SEQ ID NO: 296787 - RNA, 63 nt, Homo Sapiens
cuaguuacagaacgguuucuuucucccccaaagaaaccccaucgccaucagcacucacucccc

SEQ ID NO: 296788 - RNA, 63 nt, Homo Sapiens
ucuacuaaaacaaaaauuagggccaacauggugaaaccccauccuggaguuugagaccacccu

SEQ ID NO: 296789 - RNA, 63 nt, Homo Sapiens
ucuacuaaaaauacagaaauggccaacauagugaaaccccauccaggaguucgagaccagccu

SEQ ID NO: 296790 - RNA, 63 nt, Homo Sapiens
ucuacuaaaaauacaaaaguggcuaacauggugaaaccccauccagaaguucaagagcacccu

SEQ ID NO: 296791 - RNA, 63 nt, Homo Sapiens
ucuacuaaaaauauaaaauaggcuaacacggugaaaccccauccaggagaucgagaccguccu

SEQ ID NO: 296792 - RNA, 63 nt, Homo Sapiens
ucuacuaaaaauacaaacuuggccagcauagugaaaccccaucaagucaggagagaccagccu

SEQ ID NO: 296793 - RNA, 63 nt, Homo Sapiens
uguacuaaaaauacaaaauugaccaacauggagaaaccccaaucgggaguucgagaccagccu

SEQ ID NO: 296794 - RNA, 63 nt, Homo Sapiens
acuuuuuagcucucuuuuaaaugaaauaaggagaaaccccauauugcuccuugaguuuucaag

SEQ ID NO: 296795 - RNA, 63 nt, Homo Sapiens
ucuacuaaaaauacaaaauugaccaacauggagaaaccccauccaggaguucgagaccagccu

SEQ ID NO: 296796 - RNA, 63 nt, Homo Sapiens
guaaauugcaaauuuuaaaaaauuauuaauuuaaaaccccaaaaaauugcaugagauuagcaa

SEQ ID NO: 296797 - RNA, 63 nt, Homo Sapiens
cagaaaagaaaauggaauaauggcuucuggcccaaaccccaaguuuccaguauugguacaucu

SEQ ID NO: 296798 - RNA, 63 nt, Homo Sapiens
aaauuugcaacuuaacaguuaauaauaaagcagaaaccccaagucugcuguggauaucaagga

SEQ ID NO: 296799 - RNA, 63 nt, Homo Sapiens
gguuuguauaucaguagaauauugugccaacugaaaccccagaguuaguacaaguugaacuug

SEQ ID NO: 296800 - RNA, 63 nt, Homo Sapiens
caggaguucaagaucagccugggcaauauagugaaaccccaucucuuaaagaaaaaguuagcc

SEQ ID NO: 296801 - RNA, 63 nt, Homo Sapiens
ucaguuucagacauuuucaccacuccaaaaaagaaaccccacaucgacuagcaguuacucauu

SEQ ID NO: 296802 - RNA, 64 nt, Homo Sapiens
auuccccacaaagccguucgcagcuuccgggagaaggggccagagcccgguggggccaguuucu

SEQ ID NO: 296803 - RNA, 64 nt, Homo Sapiens
ccggugccaugcuccucccugugucuuguaugaaaggggccacugugugucuuccuccccggcg

SEQ ID NO: 296804 - RNA, 64 nt, Homo Sapiens
gggguggccucaagagcacacagagaagggaagaaggggccaucacaggaugccagccccugcc

SEQ ID NO: 296805 - RNA, 64 nt, Homo Sapiens
ugccacuuugacucagaggcugggagcauagcagaggggccaggcccaggcagagcugacggga

SEQ ID NO: 296806 - RNA, 64 nt, Homo Sapiens
gaggccacaggcccggccauuggaagggaaggagaggggccaggauggagugcagggagccagc

SEQ ID NO: 296807 - RNA, 64 nt, Homo Sapiens
gggauccuagauuugucuucuauggcugcuggaaaggggccaguauaucuguggcaucaugggc

SEQ ID NO: 296808 - RNA, 64 nt, Homo Sapiens
gugcaggggagggggcaauggaacagguggggucaggggccagagauaaauugccaaagagugg

SEQ ID NO: 296809 - RNA, 64 nt, Homo Sapiens
ugaucuuccuuagccaauccagggcuagggcuggaggggccaggaucacagugacaaaagagcc

SEQ ID NO: 296810 - RNA, 64 nt, Homo Sapiens
aguccucccugucccaugccugggccacaguaggaggggccagccuggccugaacccgccggug

SEQ ID NO: 296811 - RNA, 64 nt, Homo Sapiens
uggacauuucccuguuucgagccaggcucuuccaaggggccagcuggguccccggagucagucc

SEQ ID NO: 296812 - RNA, 64 nt, Homo Sapiens
ccacugucaccuguaccaagugccaaaacagcagaggggccaguuagagcaagagcucuggggg

SEQ ID NO: 296813 - RNA, 64 nt, Homo Sapiens
ucugccccuuccagcuggagccgcccgugccuccaggggccaagaggaugaugucguggccucc

SEQ ID NO: 296814 - RNA, 64 nt, Homo Sapiens
gaccggugucuugcucuagggcaacccagggcagaggggccaggucugcccagcguuuaccacu

SEQ ID NO: 296815 - RNA, 64 nt, Homo Sapiens
cuaaguguaaccucaguauuuauguaauuuguacaggggccaugccccaccccccuccuccccc

SEQ ID NO: 296816 - RNA, 64 nt, Homo Sapiens
auggguggcuuucaaggcuggggcauggcaaaucaggggccagagagcaggggagcuugggacu

SEQ ID NO: 296817 - RNA, 64 nt, Homo Sapiens
caggucagaagagggagaggaggggcugggggugaggggccaggccauggccaaggggccagcu

SEQ ID NO: 296818 - RNA, 64 nt, Homo Sapiens
gaggggcugggggugaggggccaggccauggccaaggggccagcugccccucauuuaucacucu

SEQ ID NO: 296819 - RNA, 64 nt, Homo Sapiens
ggagucuagacuggaccuaggagcuugaguugucaggggccaggacuggccccacugcagugcc

SEQ ID NO: 296820 - RNA, 64 nt, Homo Sapiens
caaagaaauauaggaugcuuagaaagcauacaggaggggccaggcgugguggcucaugccugua

SEQ ID NO: 296821 - RNA, 64 nt, Homo Sapiens
cucucccggggucucaugcuuucaccccacacccaggggccagggcagcccccucccgggcagc

SEQ ID NO: 296822 - RNA, 64 nt, Homo Sapiens
gauguggacaccauggaggguguaggugaauuacaggggccaugacuauaaaguacguggcaug

SEQ ID NO: 296823 - RNA, 64 nt, Homo Sapiens
cccccucagcacacacacaguccccaggcggccuaggggccaaggcuggggcggcuuugguccc

SEQ ID NO: 296824 - RNA, 64 nt, Homo Sapiens
ucccgguccagcucagggaugcuccugccagcacaggggccagggacuccuggagcaggcacau

SEQ ID NO: 296825 - RNA, 64 nt, Homo Sapiens
cugccucccaucacugccugcuggcugcucucccaggggccagguggagagcagugccccccga

SEQ ID NO: 296826 - RNA, 64 nt, Homo Sapiens
cucugagcagggcccaaggcagccaggggccuggaggggccagaggaggguggggucagggccg

SEQ ID NO: 296827 - RNA, 64 nt, Homo Sapiens
ccuccccucuugauugcugggcugggcugguagcaggggccagugaugaaucaaaugacugccg

SEQ ID NO: 296828 - RNA, 64 nt, Homo Sapiens
aagcccccuggagagagauguuccuccuggcaucaggggccauggguagcccggguuuggacuc

SEQ ID NO: 296829 - RNA, 64 nt, Homo Sapiens
ucacuucccacuggaaaucuggacauagccagggaggggccacaucagcgcaggggccagccag

SEQ ID NO: 296830 - RNA, 64 nt, Homo Sapiens
cagggacauagccagggagggcucugaucagcgcaggggccagcaaaguggcccacuuucugug

SEQ ID NO: 296831 - RNA, 64 nt, Homo Sapiens
acuaauuuuggcucaaacuuaugaggcaggaaauaggggccaacaguaaaugggggaggccucc

SEQ ID NO: 296832 - RNA, 64 nt, Homo Sapiens
cuuccucucugaaccaacaguucccuucucugacaggggccauccucuaucuuccauccagcgg

SEQ ID NO: 296833 - RNA, 64 nt, Homo Sapiens
auucagccgcagccucugggccggggcggcccccaggggccaggagagagcccuggagucccgc

SEQ ID NO: 296834 - RNA, 64 nt, Homo Sapiens
aagccaccuucucuugccccuuggccccuuugucaggggccaggggucugccgggugggggugc

SEQ ID NO: 296835 - RNA, 64 nt, Homo Sapiens
auauguaugauguguugugcuuuuuuaaccaaggaggggccaguggauucccacagcacaaccg

SEQ ID NO: 296836 - RNA, 64 nt, Homo Sapiens
augugccuuguccaggaacugccugggccaugcgaggggccagcagagggcgccaccaccaccu

SEQ ID NO: 296837 - RNA, 64 nt, Homo Sapiens
cccuccuuagacugagcugucagagcaagcaauuaggggccagccugccuccaccucccacccc

SEQ ID NO: 296838 - RNA, 64 nt, Homo Sapiens
agagagcuguuuagguuuuccgaucuuuuugcucaggggccaaacacugaaggcacguacugcc

SEQ ID NO: 296839 - RNA, 64 nt, Homo Sapiens
ggagaagggcaggggcaggagagggcugcggaggaggggccacggugcagcaggccguggggac

SEQ ID NO: 296840 - RNA, 64 nt, Homo Sapiens
cuggcaccaacaagccccccaggugccggggaagaggggccaggccugggggccgcccagcucc

SEQ ID NO: 296841 - RNA, 64 nt, Homo Sapiens
ugcccuaaagggcucuugagccucugggaaugggaggggccaagagaaggaaaacccugucuuu

SEQ ID NO: 296842 - RNA, 64 nt, Homo Sapiens
cuuggggauggcacuccacacacgacagagaugcaggggccagggaagcccagcgcucggugcc

SEQ ID NO: 296843 - RNA, 64 nt, Homo Sapiens
gccucuucaggaccaacuggggagggcccuuguaaggggccauacuagaccuugaugccugggu

SEQ ID NO: 296844 - RNA, 64 nt, Homo Sapiens
ggggggcuggggucuccagggagaggcuggcacuaggggccacugcacuguuugaagaggagca

SEQ ID NO: 296845 - RNA, 64 nt, Homo Sapiens
ggaagggcggcacuggagagaugggcccaucauuaggggccagcaucccaggaacuggaccuuu

SEQ ID NO: 296846 - RNA, 64 nt, Homo Sapiens
agcugggcggccggggcaggcuuagggcacaguuaggggccaaggagagggaaggccagggccc

SEQ ID NO: 296847 - RNA, 64 nt, Homo Sapiens
cuggggugcugcucagcugugcaucaaccaaggaaggggccaugcccucagcccagcagagagg

SEQ ID NO: 296848 - RNA, 64 nt, Homo Sapiens
ggcccugaccaggaagacagauuggccugcugcuaggggccagggaacccugugccccaccagg

SEQ ID NO: 296849 - RNA, 64 nt, Homo Sapiens
ggcccucccaggcgaucuugagccagagcguuagaggggccagcggacuugucccaagucugac

SEQ ID NO: 296850 - RNA, 64 nt, Homo Sapiens
guuuucuaugaaucuauuuugcaggcccccggggaggggccagaaagauguugaggcgagcagg

SEQ ID NO: 296851 - RNA, 64 nt, Homo Sapiens; identical to SEQ ID NO: 128944

SEQ ID NO: 296852 - RNA, 64 nt, Homo Sapiens; identical to SEQ ID NO: 128945

SEQ ID NO: 296853 - RNA, 64 nt, Homo Sapiens; identical to SEQ ID NO: 128946

SEQ ID NO: 296854 - RNA, 64 nt, Homo Sapiens; identical to SEQ ID NO: 128947

SEQ ID NO: 296855 - RNA, 64 nt, Homo Sapiens
cuccccgccccuuccuggagcuggcagagcuaacgcccugcaggaggaccccggccucucgagg

SEQ ID NO: 296856 - RNA, 64 nt, Homo Sapiens
aaagccuuucgagaggcccaagguggccucgccagcccugcaguauugaugugcaguauugcac

SEQ ID NO: 296857 - RNA, 64 nt, Homo Sapiens
agcacccucgcuccucuccuggcuacuagcucuggcccugcaccuacucucacuggccaccucu

SEQ ID NO: 296858 - RNA, 64 nt, Homo Sapiens
guccugcuucccacccccugccugcccagccugggcccugcaguguggagagacacauaagccu

SEQ ID NO: 296859 - RNA, 64 nt, Homo Sapiens
ucaucaacaagguggugugauggcuccugcacaggcccugcacauaggaugagggcaucugcuc

SEQ ID NO: 296860 - RNA, 64 nt, Homo Sapiens
ggaaaggcccagugacagguguggacaggugccagcccugcaagccgccucuucucgguagaag

SEQ ID NO: 296861 - RNA, 64 nt, Homo Sapiens
ucaggccagggcagugcugcugcagagcuagaaggcccugcagcuacagcugcuucauucccug

SEQ ID NO: 296862 - RNA, 64 nt, Homo Sapiens
cuugcauacacugagcgggcuacagagcuagaaggcccugcagcuacagcugcuucauucccug

SEQ ID NO: 296863 - RNA, 64 nt, Homo Sapiens
ccccagggggccauagggugcgguggaacugcaggcccugcagaugacggcagccagcugcuuc

SEQ ID NO: 296864 - RNA, 64 nt, Homo Sapiens
acaggcugaauuagaugagcuccugccgcagggggcccugcacacugaugucagcucaccaguc

SEQ ID NO: 296865 - RNA, 64 nt, Homo Sapiens
uguaaguguugagguuucugcaaagagggcgcaggcccugcagugacgguucagauauugauaa

SEQ ID NO: 296866 - RNA, 64 nt, Homo Sapiens
ucacaccugaacgcugcugccagccgaugccccagcccugcacgccacccacuaucccggcacg

SEQ ID NO: 296867 - RNA, 64 nt, Homo Sapiens
cagcuggauggccacgugcaggggucaaggcugggcccugcaguggggcgggccgccagcccca

SEQ ID NO: 296868 - RNA, 64 nt, Homo Sapiens
aagaaaauguuuucucuccuauguaguagaacaugcccugcaggagaagggauucagaaauaug

SEQ ID NO: 296869 - RNA, 64 nt, Homo Sapiens
cacaguguucuguuggagaacuucacacuaccaggcccugcagcuuuauaugucaguugcugcc

SEQ ID NO: 296870 - RNA, 64 nt, Homo Sapiens
ugcccauggggacacggcccaggacagcccgggggcccugcagcuucaggucccuaugggcgca

SEQ ID NO: 296871 - RNA, 64 nt, Homo Sapiens
gggcgcagcugcuccgugagcugagucucccacugcccugcacaccaccacauuggaccugugc

SEQ ID NO: 296872 - RNA, 64 nt, Homo Sapiens
uccccuccugccaguccuucgccugucccuugacgcccugcauccuccucccugacucgcagcc

SEQ ID NO: 296873 - RNA, 64 nt, Homo Sapiens
cgccccguaguugcucuuucgguaguggcgaugcgcccugcaugucuccucacccguggaucgu

SEQ ID NO: 296874 - RNA, 64 nt, Homo Sapiens
ugucugucauccccacugacgcuacgagcugcuggcccugcacccccaaccgaggcugucaggu

SEQ ID NO: 296875 - RNA, 64 nt, Homo Sapiens
ccuuccugcucgugcacuccggggaggcgaggaggcccugcaugugucaacaccagccccgagc

SEQ ID NO: 296876 - RNA, 64 nt, Homo Sapiens
ccugcggccagccagggagguggaccgcaugcuggcccugcagccccgccuucgccugcgccug

SEQ ID NO: 296877 - RNA, 64 nt, Homo Sapiens
gucuccccgcugagcccaggcacuugcccaggccgcccugcaggaccacugcaauaaacgccuu

SEQ ID NO: 296878 - RNA, 64 nt, Homo Sapiens
agcaggagcaggggcaggggcaggggcagggagagcccugcauuuccucuacgcccagguuccg

SEQ ID NO: 296879 - RNA, 64 nt, Homo Sapiens
gggcaacagcacccuaguuucauucucaacucuagcccugcacacucaccuguggcacggaaug

SEQ ID NO: 296880 - RNA, 64 nt, Homo Sapiens
uuucugcaaguccacuggggcuggccccagccaggcccugcagggcuggucagggugucugggg

SEQ ID NO: 296881 - RNA, 64 nt, Homo Sapiens
auguggguggcacugaccuguucuguugacuggggcccugcagacucuggcagagcugagaagg

SEQ ID NO: 296882 - RNA, 64 nt, Homo Sapiens
uuggacguaagccccucaugcugacucagggugggcccugcaugugaugacugggcccuuccag

SEQ ID NO: 296883 - RNA, 64 nt, Homo Sapiens
gcaugggggcgugccugugugggggacagggagggcccugcauggauuuuccuccuuccuaugc

SEQ ID NO: 296884 - RNA, 64 nt, Homo Sapiens
gucaagacuugaggccauugagacuuuagacccugcccugcagaacagaggaagcuuuagauag

SEQ ID NO: 296885 - RNA, 64 nt, Homo Sapiens
uucuucacuguguucaagugcuucuuggcccugugcccugcacuccucucucuccucagauuuc

SEQ ID NO: 296886 - RNA, 64 nt, Homo Sapiens
guaucccuucucacagcacagcugccuucugacggcccugcaauuccuuggccuagcccacccu

SEQ ID NO: 296887 - RNA, 64 nt, Homo Sapiens
guucgcuuggcuccaugcuccuucaccccggcaggcccugcaguccuggguggaucggccuccu

SEQ ID NO: 296888 - RNA, 64 nt, Homo Sapiens
gggggagccugggccuaauaccaacaggcacccagcccugcauggcauaaggcugucuuggauc

SEQ ID NO: 296889 - RNA, 64 nt, Homo Sapiens
gaugcagggcgggagggagagggcgcccacacuggcccugcagugcugcaggagcaggugcagu

SEQ ID NO: 296890 - RNA, 64 nt, Homo Sapiens
cuuucuggccuggcugggccccccguccugccgagcccugcagagugggcucugugugcuggcu

SEQ ID NO: 296891 - RNA, 64 nt, Homo Sapiens
agagaggccugccuuccggauuccaggcgggcaugcccugcaaaccccgccugggccucccuug

SEQ ID NO: 296892 - RNA, 64 nt, Homo Sapiens
uuuuauuuaaauauuuagcuuuccuucacuacaugcccugcauuaaaauccuacugugcccagu

SEQ ID NO: 296893 - RNA, 64 nt, Homo Sapiens
uauuuuacaaccuaguaauauuauucuauaauuugcccugcacucgacuugaauguuuauacuu

SEQ ID NO: 296894 - RNA, 64 nt, Homo Sapiens
cuucccagccacuccugcugggaguuugcugugggcccugcaacgggcuucaaaggaaggcuau

SEQ ID NO: 296895 - RNA, 64 nt, Homo Sapiens
accucccuccgggccacaccggagaugccaaggugcccugcaggcccagcugcuggaggagagg

SEQ ID NO: 296896 - RNA, 64 nt, Homo Sapiens
cagauaccugccucguccgaugccuccagcuguggcccugcaucgcagcuccuugaagguccuc

SEQ ID NO: 296897 - RNA, 64 nt, Homo Sapiens
uguccggcgcagccgugggagaguggaagccagagcccugcaggggcgccagcagccucugcca

SEQ ID NO: 296898 - RNA, 64 nt, Homo Sapiens
ccuugccucaggccgggcugucugccuaggcaaggcccugcaucugccucggagagcaucauuc

SEQ ID NO: 296899 - RNA, 64 nt, Homo Sapiens
ccucgguagccgcccuguuauccaugguaacugugcccugcaccucuguguaguguuuuacguc

SEQ ID NO: 296900 - RNA, 64 nt, Homo Sapiens
gcucccugcacucugguguucaugccgcccccgugcccugcacaaaaaccaccaccagcagcuc

SEQ ID NO: 296901 - RNA, 64 nt, Homo Sapiens
agccgccuggacucagccauggcugugugcuuuggcccugcagcucugggccaccugcuggugu

SEQ ID NO: 296902 - RNA, 59 nt, Homo Sapiens
acuccgcaucucaagaauaggaaggcacggcccugcaauauggacucagcucuggcucu

SEQ ID NO: 296903 - RNA, 64 nt, Homo Sapiens
ccuggaagagacccccguguucagagugcuggcagcccugcacguguccagggacacugcauuu

SEQ ID NO: 296904 - RNA, 64 nt, Homo Sapiens
ccacccccacacucccugcucagcuccucgugcugcccugcaugcccaggcuugugagccaagc

SEQ ID NO: 296905 - RNA, 64 nt, Homo Sapiens
augccugcccagggacccccagcccccucccguugcccugcagcuuuaacagagugaaccaugu

SEQ ID NO: 296906 - RNA, 64 nt, Homo Sapiens
gcaugcacaaacuucgugagaccaacacagccgugcccugcaggcaccagcacgugcuuuucag

SEQ ID NO: 296907 - RNA, 64 nt, Homo Sapiens
gacuccaggggguccuggcuccccugucccugcagcccugcaggucagugcaugaucuggguuc

SEQ ID NO: 296908 - RNA, 64 nt, Homo Sapiens
gugauucaggccagcuggagaagcuuccagaagggcccugcacugcuacccucuauuucccacu

SEQ ID NO: 296909 - RNA, 64 nt, Homo Sapiens
gacccaccuuguguagugccugacccaaagccuggcccugcacacugucucugacucacagcaa

SEQ ID NO: 296910 - RNA, 64 nt, Homo Sapiens
ggggaagccgggcuugaguugcccauaggccccugcccugcaccauccuguccagugcccugcg

SEQ ID NO: 296911 - RNA, 64 nt, Homo Sapiens
uuuccuaggcaggggcguggcagagcagguaggcgcccugcagccucccugcucccagcccaag

SEQ ID NO: 296912 - RNA, 64 nt, Homo Sapiens
gggccaugccuuccagguggcccagacagcccaagcccugcacuggaucgugaggacgcugcgg

SEQ ID NO: 296913 - RNA, 64 nt, Homo Sapiens
uccugagccuggccaggacucaggcuguuccugggcccugcacaugaugggguuugguggaccc

SEQ ID NO: 296914 - RNA, 64 nt, Homo Sapiens
acccgccacaugugcccccgaggcccugcccccagcccugcaggccugcagaacuggaugcuca

SEQ ID NO: 296915 - RNA, 64 nt, Homo Sapiens
cugcucugaagagaaggaggaccggccggacgaugcccugcagacuucccuccaggaaaugagg

SEQ ID NO: 296916 - RNA, 64 nt, Homo Sapiens
ggcaggagcaccccccagacuccccgugcccgcagcccugcagcaccccggcuuucccgggucu

SEQ ID NO: 296917 - RNA, 64 nt, Homo Sapiens
ccccuccggacccgcagagcuggggacauggcaugcccugcacucagucaccccgagggcugag

SEQ ID NO: 296918 - RNA, 64 nt, Homo Sapiens
cggagaucugaggugcucugugcccaccguuguggcccugcagcccuggcccgcucucuaccuc

SEQ ID NO: 296919 - RNA, 64 nt, Homo Sapiens
cuggcccgcucucuaccucuacucggacacuucugcccugcaccacaccuggauguggacuugg

SEQ ID NO: 296920 - RNA, 64 nt, Homo Sapiens
cccugcagcuaguccuagugaaccucaccccgaggcccugcaugggccagccccuccaucugua

SEQ ID NO: 296921 - RNA, 64 nt, Homo Sapiens
ugacugguuaucacaccaucgcuggccccuuugggcccugcauguagugugggaggcuccuguu

SEQ ID NO: 296922 - RNA, 64 nt, Homo Sapiens
guucuuauccugaucaaagucaggaacuugccucgcccugcaacagcccagaccucuucggcuu

SEQ ID NO: 296923 - RNA, 64 nt, Homo Sapiens
cccaguauugccaaggaccgaguccaagcuccaggcccugcauggggggugcugccugaugggc

SEQ ID NO: 296924 - RNA, 64 nt, Homo Sapiens
uuaucccauuguauuuuuuaauugcugcauuucucagcauaaacuguuuucuucaacuguauuu

SEQ ID NO: 296925 - RNA, 64 nt, Homo Sapiens
aauaacucgcauaugaaguaauaguuaaauccuacagcauaaucaguugccuuuuagugcugua

SEQ ID NO: 296926 - RNA, 64 nt, Homo Sapiens
aaaauacugcccuaccuugaugucuuauaaaacucagcauaagauuuaaaugauaauuugcuua

SEQ ID NO: 296927 - RNA, 64 nt, Homo Sapiens
uuucaugagucuguauuacuuucagcauuuuuugcagcauaacuagaucauuuaucagaggagg

SEQ ID NO: 296928 - RNA, 64 nt, Homo Sapiens
agcuaagugucaugcauauuuuugaagugcuuaucagcauaaugccuacugaccuuuucuuuug

SEQ ID NO: 296929 - RNA, 64 nt, Homo Sapiens
ccauccuaggaaaggggaugacguugaguaacagcagcauaauuucucccucacugaacccugc

SEQ ID NO: 296930 - RNA, 64 nt, Homo Sapiens
uucuaccuuguaauauguaaauuugaggaguaagcagcauaaccgugaucgacuuagaauccaa

SEQ ID NO: 296931 - RNA, 64 nt, Homo Sapiens
gaaguuugcuaaaauauuugaggaaagucacugacagcauaagaaaccaaaucacugugacuca

SEQ ID NO: 296932 - RNA, 64 nt, Homo Sapiens
aucuuguuuagagaauccacuuucuggaaguucucagcauaauuaguguugagagugguucagu

SEQ ID NO: 296933 - RNA, 64 nt, Homo Sapiens
auuagauguuuauaaagaaauggguuuauuuuuccagcauaaaccucagaauuuaaggaaagaa

SEQ ID NO: 296934 - RNA, 64 nt, Homo Sapiens
acagagcccuccauuccaaguuuaguuuuugucaaaauaugaaucauuuuauuugacuguacua

SEQ ID NO: 296935 - RNA, 64 nt, Homo Sapiens
ccaguguaauauuugccuuucuguaaaugggauuaaauaugauuuguaaauaaaggacaucuga

SEQ ID NO: 296936 - RNA, 64 nt, Homo Sapiens
aguagcaaaggacuuaaaauuaccaaaugcuucuaaauaugaaggagagguuggggacacgcac

SEQ ID NO: 296937 - RNA, 64 nt, Homo Sapiens
uaaauaaauagauguucuguagcauuggucagggaaauaugaauuaggaccacaaugagauucc

SEQ ID NO: 296938 - RNA, 64 nt, Homo Sapiens
gucguguaagaaggaugcuggucagagcugcagaaaauaugaggcaauuaaaagucuuuagcug

SEQ ID NO: 296939 - RNA, 64 nt, Homo Sapiens
ugugguuuauuuauggcaugaaccauguaacuugaaauaugaacuuacaaggaggggcacucau

SEQ ID NO: 296940 - RNA, 64 nt, Homo Sapiens
uuuuugguaaauacuuuaguggcauuucacugucaaauaugaaguucaaggcaaaauaguauuu

SEQ ID NO: 296941 - RNA, 64 nt, Homo Sapiens
gaaaaauuaugcaucuagcacauuuaaacugugcaaauaugaaaauuuuucgaggauuacauuu

SEQ ID NO: 296942 - RNA, 64 nt, Homo Sapiens
ucucaaucccucaaaacaaucuugucauacuugaaaauaugacacucuagucaaagccuuggua

SEQ ID NO: 296943 - RNA, 64 nt, Homo Sapiens
aaagaaagagaaguuuucuugacuuuugaaaacaaaauaugaaaagaaucggcaauguuucaaa

SEQ ID NO: 296944 - RNA, 64 nt, Homo Sapiens
cucagacaugcagcugugugcauuuuaaauauuuaaauaugaucacuaagacagacuguagaug

SEQ ID NO: 296945 - RNA, 64 nt, Homo Sapiens
gcccaaaauuuauuaaaaagugaaaacaagacugaaauaugaugaggugaucguauucuuccag

SEQ ID NO: 296946 - RNA, 64 nt, Homo Sapiens
aggcaaaugaugugaggauuggucaagacgagggaaauaugagacugcauaacaggcaccagau

SEQ ID NO: 296947 - RNA, 64 nt, Homo Sapiens
cuggcauggcaaucagaccaacccuucacagauaaaauaugauguaguuuuccacaaccaagcc

SEQ ID NO: 296948 - RNA, 64 nt, Homo Sapiens
aaguauuaaaacuauauacauccauauaaagaugaaauaugaacuaucucauuagaagucauag

SEQ ID NO: 296949 - RNA, 64 nt, Homo Sapiens
ucuugucacaugauuucuuuucuugauggaugaaaaauaugaaaggaaacuuuuauaucuguug

SEQ ID NO: 296950 - RNA, 64 nt, Homo Sapiens
ggcguguuuaaccauuaagaaaugcuguauucuuaaauaugaaacaguuaaucuaaagucuuau

SEQ ID NO: 296951 - RNA, 64 nt, Homo Sapiens
ccauuuacaagcauugcaccuuuaagaagaaaacaaauaugacaguaugguagcuauacuugug

SEQ ID NO: 296952 - RNA, 64 nt, Homo Sapiens
ccaacugauccuacccucccuacuccugcaccccaaauaugaacaacugcagcaggugccacca

SEQ ID NO: 296953 - RNA, 64 nt, Homo Sapiens
ccacuacccuuguaacuacugcuucuacuacccaaaauaugaauuccaacacugcuuccaagag

SEQ ID NO: 296954 - RNA, 64 nt, Homo Sapiens
uaauaaagaaaaacuccauucuuccuugauuuagaaauaugauaauuuaaguauauaauuucag

SEQ ID NO: 296955 - RNA, 64 nt, Homo Sapiens
ucaaaacuguauuuacuuuuuagaaguuccauuuaaauaugaguuugaaagcuguacaaaguaa

SEQ ID NO: 296956 - RNA, 64 nt, Homo Sapiens
uuucacauaaaaccucauucugagugguuauugaaaauaugaugugcagaauguuuuuaaaaua

SEQ ID NO: 296957 - RNA, 64 nt, Homo Sapiens
gguuauugaaaauaugaugugcagaauguuuuuaaaauaugaguagguagauuuuguuugguau

SEQ ID NO: 296958 - RNA, 64 nt, Homo Sapiens
guccuuuuaggaauauguucaaugcaaaguaaaaaaauaugaauuguccccaaucccggucaug

SEQ ID NO: 296959 - RNA, 64 nt, Homo Sapiens
auaaggccagaaacuccuuuugcugucuuucucuaaauaugauuacuuuaaaauaaaaaaguaa

SEQ ID NO: 296960 - RNA, 64 nt, Homo Sapiens
guuacuuaaaaauugugaauucuguuguugugauaaauaugagcaaaugaaguguaauaucuau

SEQ ID NO: 296961 - RNA, 64 nt, Homo Sapiens
aguuaaaauauguuggauuguuaaacauuuggggaaauaugaacuguauuuuaaauuuguuagg

SEQ ID NO: 296962 - RNA, 64 nt, Homo Sapiens
cauacccccuauuuuacagaaucuugcuuuaaccaaauaugaaaugaaagacaguuuuaguuuu

SEQ ID NO: 296963 - RNA, 64 nt, Homo Sapiens
gagcuauauaugugugcucugaguaaaauuaugcaaauaugacagagguguuuugagguucuga

SEQ ID NO: 296964 - RNA, 64 nt, Homo Sapiens
uguauaucuccacauaccuccauuacuaacaaugaaauaugaaugcaaguuaagcuacacuuga

SEQ ID NO: 296965 - RNA, 64 nt, Homo Sapiens
cccaucagccggaacuagccuagacauacggugcaaauaugacacuucuaacgauuaacaacag

SEQ ID NO: 296966 - RNA, 64 nt, Homo Sapiens
aaauaccacuguuacagauaaauggggccuuuaaaaauaugaaaaacaaacuugugaaaaugua

SEQ ID NO: 296967 - RNA, 64 nt, Homo Sapiens
gucuccucuauuaagaguauuuaaaaucauauuuaaauaugaaucuauucaugcuaacauuauu

SEQ ID NO: 296968 - RNA, 64 nt, Homo Sapiens
uaguagaacaugcccugcagaagaagggauucagaaauaugaugucagagagugaccgaauagg

SEQ ID NO: 296969 - RNA, 64 nt, Homo Sapiens
guuguguuucuggggggguuaacuuaagagcuuuaaauaugaggaguuugagaccgcuacccug

SEQ ID NO: 296970 - RNA, 64 nt, Homo Sapiens
guguagacaacuguaguuguuguuggcacgucaaaaauaugaauguuucauguagaaugcaaaa

SEQ ID NO: 296971 - RNA, 64 nt, Homo Sapiens
agaaaccuccaaaaccagcaaugccgcugucaucaaauaugaggcuguuuuauuacagcuggua

SEQ ID NO: 296972 - RNA, 64 nt, Homo Sapiens
guucugcaucugaaguauuagauuguuagcagcaaaauaugaaagaugagguggacaguccucu

SEQ ID NO: 296973 - RNA, 64 nt, Homo Sapiens
ucuguuauuuucuguacauugugguagguccaggaaauaugacauuuucccccuugauguguua

SEQ ID NO: 296974 - RNA, 64 nt, Homo Sapiens
auaagucaaaaauguauuuaugaucauaaguugaaaauaugauccccaucauaaguugaaaaua

SEQ ID NO: 296975 - RNA, 64 nt, Homo Sapiens
auaaguugaaaauaugaucaccaucauaaguugaaaauaugaucggguuugcauccugauaaac

SEQ ID NO: 296976 - RNA, 64 nt, Homo Sapiens
auaucaauagguacagaaaagcaguucaaagauuaaauaugaucgcaauccauugcaugcauua

SEQ ID NO: 296977 - RNA, 64 nt, Homo Sapiens
aguucuguuuugaguuugauuuugcuuagaaauaaaauaugacaaagaaaucuaaagugaaaau

SEQ ID NO: 296978 - RNA, 64 nt, Homo Sapiens
uauuaaacucauuauaguaguuaauaucuaaguaaaauaugaugaaauuuaauagagaauucac

SEQ ID NO: 296979 - RNA, 64 nt, Homo Sapiens
uuguuuuggauaaugaagucagcagaggaaaaaaaaauaugaccaucucaaaagaugccaacgu

SEQ ID NO: 296980 - RNA, 64 nt, Homo Sapiens
aguaaugaagacugauucccagacucugcacuuaaaauaugaacugauuuuggauuuuuucuuu

SEQ ID NO: 296981 - RNA, 64 nt, Homo Sapiens
aaacacauccuauauaucaugucaaucuggcaagaaauaugacuugcuuuuugcugagcuuaau

SEQ ID NO: 296982 - RNA, 64 nt, Homo Sapiens
acauaagagaauucauaccauagagaaauccuacaaauaugaagaaugugacaaagcuuuuaac

SEQ ID NO: 296983 - RNA, 64 nt, Homo Sapiens
acguaagauaauucauacuggaaggaaacccuacaaauaugaggaaugucucaaagcuuuuuac

SEQ ID NO: 296984 - RNA, 64 nt, Homo Sapiens
aucucgcaguguuucugugaauagauuuuuuuguaaauaugaccuuuaagauauuguauuaugu

SEQ ID NO: 296985 - RNA, 64 nt, Homo Sapiens
ucuuccuuucuaauauauggaguuucgaagaauaaaauaugagagcaauauuuaaauucucagg

SEQ ID NO: 296986 - RNA, 64 nt, Homo Sapiens
uaugauuuugcuucauaaaaggaaaugccuccauaaauaugaucuuucaguuuucuuucaaacu

SEQ ID NO: 296987 - RNA, 64 nt, Homo Sapiens
uuaaauuugugauagcgcucucacauacuguaacaaauaugaauagaggcuuuucuuaacuauu

SEQ ID NO: 296988 - RNA, 64 nt, Homo Sapiens
uuaauggugacugugguauaaguuaaauaacaauaaauaugacgcuguauauguuuuccugagc

SEQ ID NO: 296989 - RNA, 64 nt, Homo Sapiens
acuuaacucugcuguguguuuuauugcacauguaaaauaugaaaugggaaagaaaacgaaaaug

SEQ ID NO: 296990 - RNA, 64 nt, Homo Sapiens
uguccaccaauaugauuucugagugguaaaccucaaauaugaauuuuaaacuggugaacuaaag

SEQ ID NO: 296991 - RNA, 64 nt, Homo Sapiens
ggugaacuaaaggaaaucuugaggucauauacugaaauaugaauaaauuaaaauaaugaauuca

SEQ ID NO: 296992 - RNA, 64 nt, Homo Sapiens
acuugcauccauuuuguauuuuuguaauauuuguaaauaugaacuuuuuaaauugcugcaaaga

SEQ ID NO: 296993 - RNA, 64 nt, Homo Sapiens
ugagcuaguuaagccuuugccuaggguaguucaaaaauaugauggugagacagucaauuauugc

SEQ ID NO: 296994 - RNA, 64 nt, Homo Sapiens
uucuauauggagugagaaaagggacuggcuucccaaauaugauuucuacaauauucggucuuuu

SEQ ID NO: 296995 - RNA, 64 nt, Homo Sapiens; identical to SEQ ID NO: 193898

SEQ ID NO: 296996 - RNA, 64 nt, Homo Sapiens; identical to SEQ ID NO: 193899

SEQ ID NO: 296997 - RNA, 64 nt, Homo Sapiens; identical to SEQ ID NO: 193900

SEQ ID NO: 296998 - RNA, 64 nt, Homo Sapiens; identical to SEQ ID NO: 193901

SEQ ID NO: 296999 - RNA, 64 nt, Homo Sapiens; identical to SEQ ID NO: 193902

SEQ ID NO: 297000 - RNA, 64 nt, Homo Sapiens; identical to SEQ ID NO: 193903

SEQ ID NO: 297001 - RNA, 64 nt, Homo Sapiens; identical to SEQ ID NO: 193904

SEQ ID NO: 297002 - RNA, 64 nt, Homo Sapiens; identical to SEQ ID NO: 193905

SEQ ID NO: 297003 - RNA, 64 nt, Homo Sapiens; identical to SEQ ID NO: 193906

SEQ ID NO: 297004 - RNA, 64 nt, Homo Sapiens; identical to SEQ ID NO: 193907

SEQ ID NO: 297005 - RNA, 64 nt, Homo Sapiens; identical to SEQ ID NO: 193908

SEQ ID NO: 297006 - RNA, 64 nt, Homo Sapiens; identical to SEQ ID NO: 193909

SEQ ID NO: 297007 - RNA, 64 nt, Homo Sapiens; identical to SEQ ID NO: 193910

SEQ ID NO: 297008 - RNA, 64 nt, Homo Sapiens; identical to SEQ ID NO: 193911

SEQ ID NO: 297009 - RNA, 64 nt, Homo Sapiens; identical to SEQ ID NO: 193912

SEQ ID NO: 297010 - RNA, 64 nt, Homo Sapiens; identical to SEQ ID NO: 193913

SEQ ID NO: 297011 - RNA, 64 nt, Homo Sapiens; identical to SEQ ID NO: 193914

SEQ ID NO: 297012 - RNA, 64 nt, Homo Sapiens; identical to SEQ ID NO: 193915

SEQ ID NO: 297013 - RNA, 64 nt, Homo Sapiens; identical to SEQ ID NO: 193916

SEQ ID NO: 297014 - RNA, 64 nt, Homo Sapiens; identical to SEQ ID NO: 193917

SEQ ID NO: 297015 - RNA, 64 nt, Homo Sapiens; identical to SEQ ID NO: 193918

SEQ ID NO: 297016 - RNA, 64 nt, Homo Sapiens; identical to SEQ ID NO: 193919

SEQ ID NO: 297017 - RNA, 64 nt, Homo Sapiens
aacaaggcugaagaccuucaaauuuccuggcuuacugguuuagucacaucauuuuuccuguuca

SEQ ID NO: 297018 - RNA, 64 nt, Homo Sapiens
gucaauuggcaacauggagagggugaccuggcugcugguuuaccacuguaccaacaucucugga

SEQ ID NO: 297019 - RNA, 64 nt, Homo Sapiens
aaacaagccaacuaguaacaaugcagcaacacuucugguuuagcuaaauuauuuuuccaaugua

SEQ ID NO: 297020 - RNA, 64 nt, Homo Sapiens
uuaacuauauuuuaaagcugugacauuuaucuaccugguuuauggaauagaauuuauugcugaa

SEQ ID NO: 297021 - RNA, 64 nt, Homo Sapiens
agaagaacccuggccugagaagguuugguccagccugguuuagccuggauguugcugugcacgg

SEQ ID NO: 297022 - RNA, 64 nt, Homo Sapiens
guuccuggaacagcgcucaccuuuguuuagaacacugguuuaaagggauaaucaucucugucac

SEQ ID NO: 297023 - RNA, 64 nt, Homo Sapiens
ugaaucagaagcucugagaguaaggccuaccaaucugguuuaacaagcccgucaggugauucug

SEQ ID NO: 297024 - RNA, 64 nt, Homo Sapiens
gggcaguauuagaaaacacacugguuuucacuaucugguuuacaaacacuaucauuauuuuacc

SEQ ID NO: 297025 - RNA, 64 nt, Homo Sapiens
cagaaugcagaagucuuacaucuugggcaggaaacugguuuauuccuauacucuuguuuccucu

SEQ ID NO: 297026 - RNA, 64 nt, Homo Sapiens
acuagguuuuccauugucaccauuggaugaaccucugguuuagccacaguugugaaaauaaaug

SEQ ID NO: 297027 - RNA, 64 nt, Homo Sapiens
uucugucauauuucacuucuugcauuuauaucugcugguuuaaaaaaaauauacacauaggugc

SEQ ID NO: 297028 - RNA, 64 nt, Homo Sapiens
uggcuucaggagacuucaguagauuuuggaacggcugguuuaaaacuaacaaaguggucgcagg

SEQ ID NO: 297029 - RNA, 64 nt, Homo Sapiens
ggccgcauucaggauggcucuauacacagcagugcugguuuauguagaguucagcagucacuuc

SEQ ID NO: 297030 - RNA, 64 nt, Homo Sapiens
ccccuacccguuguggcucccacccugccucggacugguuuacguguccugguucacacccagg

SEQ ID NO: 297031 - RNA, 64 nt, Homo Sapiens
cagugggaaaaaucucucucccucgccuuuuuuucugguuuagucaaauaacgggugaacauag

SEQ ID NO: 297032 - RNA, 64 nt, Homo Sapiens
uuugcuuuuauuaucaauuaugaauaugaauugucugguuuacuaauguagucauuuguucauc

SEQ ID NO: 297033 - RNA, 64 nt, Homo Sapiens
uuggaccccucccuccgagcuacaccugcaaguccugguuuauauaugagucccauuuuacuuc

SEQ ID NO: 297034 - RNA, 64 nt, Homo Sapiens
uuugaccccucccucugagcuagaccuauaaguucugguuuaugcaugaaucccauuuuaccuc

SEQ ID NO: 297035 - RNA, 64 nt, Homo Sapiens
uuaaaauguacagauucuuccagcgcauugugcacugguuuacuaaugggggagggcccagggc

SEQ ID NO: 297036 - RNA, 64 nt, Homo Sapiens
uugggauuuuuuguuguuggauggcaugaaaucucugguuuauuuuugcucugacuuuauuuau

SEQ ID NO: 297037 - RNA, 64 nt, Homo Sapiens
agucuugugccaauaagagaguaauacaacccaucuaucuuauuagaagucuuagauuuuaaga

SEQ ID NO: 297038 - RNA, 64 nt, Homo Sapiens
uuuucuuuuggauuggaaagaaauaauaaagucacuaucuuaugccuccuguuuauucaggaaa

SEQ ID NO: 297039 - RNA, 64 nt, Homo Sapiens
ugacuaaguggaaagagauuuuacauuucaauuucuaucuuauuucccacagaaaucaguaagu

SEQ ID NO: 297040 - RNA, 64 nt, Homo Sapiens
uauccuuagguuucugugaaccuaaccaauauagcuaucuuaagaaaaagagccugcuuuuuuc

SEQ ID NO: 297041 - RNA, 64 nt, Homo Sapiens; identical to SEQ ID NO: 76027

SEQ ID NO: 297042 - RNA, 64 nt, Homo Sapiens; identical to SEQ ID NO: 76028

SEQ ID NO: 297043 - RNA, 64 nt, Homo Sapiens; identical to SEQ ID NO: 76029

SEQ ID NO: 297044 - RNA, 64 nt, Homo Sapiens; identical to SEQ ID NO: 76030

SEQ ID NO: 297045 - RNA, 64 nt, Homo Sapiens; identical to SEQ ID NO: 76031

SEQ ID NO: 297046 - RNA, 64 nt, Homo Sapiens; identical to SEQ ID NO: 76032

SEQ ID NO: 297047 - RNA, 64 nt, Homo Sapiens; identical to SEQ ID NO: 76033

SEQ ID NO: 297048 - RNA, 64 nt, Homo Sapiens; identical to SEQ ID NO: 76034

SEQ ID NO: 297049 - RNA, 64 nt, Homo Sapiens; identical to SEQ ID NO: 76035

SEQ ID NO: 297050 - RNA, 64 nt, Homo Sapiens; identical to SEQ ID NO: 76036

SEQ ID NO: 297051 - RNA, 64 nt, Homo Sapiens; identical to SEQ ID NO: 76037

SEQ ID NO: 297052 - RNA, 64 nt, Homo Sapiens; identical to SEQ ID NO: 76038

SEQ ID NO: 297053 - RNA, 64 nt, Homo Sapiens; identical to SEQ ID NO: 76039

SEQ ID NO: 297054 - RNA, 64 nt, Homo Sapiens; identical to SEQ ID NO: 76040

SEQ ID NO: 297055 - RNA, 64 nt, Homo Sapiens; identical to SEQ ID NO: 76041

SEQ ID NO: 297056 - RNA, 64 nt, Homo Sapiens; identical to SEQ ID NO: 76042

SEQ ID NO: 297057 - RNA, 64 nt, Homo Sapiens; identical to SEQ ID NO: 76043

SEQ ID NO: 297058 - RNA, 64 nt, Homo Sapiens; identical to SEQ ID NO: 76044

SEQ ID NO: 297059 - RNA, 64 nt, Homo Sapiens; identical to SEQ ID NO: 76045

SEQ ID NO: 297060 - RNA, 64 nt, Homo Sapiens; identical to SEQ ID NO: 76046

SEQ ID NO: 297061 - RNA, 64 nt, Homo Sapiens; identical to SEQ ID NO: 76047

SEQ ID NO: 297062 - RNA, 64 nt, Homo Sapiens; identical to SEQ ID NO: 76048

SEQ ID NO: 297063 - RNA, 64 nt, Homo Sapiens; identical to SEQ ID NO: 76049

SEQ ID NO: 297064 - RNA, 64 nt, Homo Sapiens; identical to SEQ ID NO: 76050

SEQ ID NO: 297065 - RNA, 64 nt, Homo Sapiens; identical to SEQ ID NO: 76051

SEQ ID NO: 297066 - RNA, 64 nt, Homo Sapiens; identical to SEQ ID NO: 76052

SEQ ID NO: 297067 - RNA, 64 nt, Homo Sapiens; identical to SEQ ID NO: 76053

SEQ ID NO: 297068 - RNA, 64 nt, Homo Sapiens; identical to SEQ ID NO: 76054

SEQ ID NO: 297069 - RNA, 64 nt, Homo Sapiens; identical to SEQ ID NO: 76055

SEQ ID NO: 297070 - RNA, 64 nt, Homo Sapiens; identical to SEQ ID NO: 76056

SEQ ID NO: 297071 - RNA, 64 nt, Homo Sapiens; identical to SEQ ID NO: 76057

SEQ ID NO: 297072 - RNA, 64 nt, Homo Sapiens; identical to SEQ ID NO: 76058

SEQ ID NO: 297073 - RNA, 52 nt, Homo Sapiens; identical to SEQ ID NO: 76059

SEQ ID NO: 297074 - RNA, 64 nt, Homo Sapiens; identical to SEQ ID NO: 76060

SEQ ID NO: 297075 - RNA, 64 nt, Homo Sapiens; identical to SEQ ID NO: 76061

SEQ ID NO: 297076 - RNA, 64 nt, Homo Sapiens; identical to SEQ ID NO: 76062

SEQ ID NO: 297077 - RNA, 64 nt, Homo Sapiens; identical to SEQ ID NO: 76062

SEQ ID NO: 297078 - RNA, 64 nt, Homo Sapiens; identical to SEQ ID NO: 76064

SEQ ID NO: 297079 - RNA, 64 nt, Homo Sapiens; identical to SEQ ID NO: 76065

SEQ ID NO: 297080 - RNA, 64 nt, Homo Sapiens; identical to SEQ ID NO: 76066

SEQ ID NO: 297081 - RNA, 64 nt, Homo Sapiens; identical to SEQ ID NO: 76067

SEQ ID NO: 297082 - RNA, 64 nt, Homo Sapiens; identical to SEQ ID NO: 76068

SEQ ID NO: 297083 - RNA, 64 nt, Homo Sapiens; identical to SEQ ID NO: 76069

SEQ ID NO: 297084 - RNA, 64 nt, Homo Sapiens; identical to SEQ ID NO: 76070

SEQ ID NO: 297085 - RNA, 64 nt, Homo Sapiens; identical to SEQ ID NO: 76071

SEQ ID NO: 297086 - RNA, 64 nt, Homo Sapiens; identical to SEQ ID NO: 76072

SEQ ID NO: 297087 - RNA, 64 nt, Homo Sapiens; identical to SEQ ID NO: 76073

SEQ ID NO: 297088 - RNA, 64 nt, Homo Sapiens; identical to SEQ ID NO: 76074

SEQ ID NO: 297089 - RNA, 64 nt, Homo Sapiens; identical to SEQ ID NO: 76075

SEQ ID NO: 297090 - RNA, 64 nt, Homo Sapiens; identical to SEQ ID NO: 76076

SEQ ID NO: 297091 - RNA, 64 nt, Homo Sapiens; identical to SEQ ID NO: 76077

SEQ ID NO: 297092 - RNA, 64 nt, Homo Sapiens; identical to SEQ ID NO: 76078

SEQ ID NO: 297093 - RNA, 64 nt, Homo Sapiens; identical to SEQ ID NO: 76079

SEQ ID NO: 297094 - RNA, 64 nt, Homo Sapiens; identical to SEQ ID NO: 76080

SEQ ID NO: 297095 - RNA, 64 nt, Homo Sapiens; identical to SEQ ID NO: 76081

SEQ ID NO: 297096 - RNA, 64 nt, Homo Sapiens; identical to SEQ ID NO: 76082

SEQ ID NO: 297097 - RNA, 64 nt, Homo Sapiens; identical to SEQ ID NO: 76083

SEQ ID NO: 297098 - RNA, 64 nt, Homo Sapiens; identical to SEQ ID NO: 76084

SEQ ID NO: 297099 - RNA, 64 nt, Homo Sapiens; identical to SEQ ID NO: 76085

SEQ ID NO: 297100 - RNA, 64 nt, Homo Sapiens; identical to SEQ ID NO: 76086

SEQ ID NO: 297101 - RNA, 64 nt, Homo Sapiens; identical to SEQ ID NO: 76087

SEQ ID NO: 297102 - RNA, 64 nt, Homo Sapiens; identical to SEQ ID NO: 76088

SEQ ID NO: 297103 - RNA, 64 nt, Homo Sapiens; identical to SEQ ID NO: 76089

SEQ ID NO: 297104 - RNA, 64 nt, Homo Sapiens; identical to SEQ ID NO: 76090

SEQ ID NO: 297105 - RNA, 64 nt, Homo Sapiens; identical to SEQ ID NO: 76090

SEQ ID NO: 297106 - RNA, 64 nt, Homo Sapiens; identical to SEQ ID NO: 238399

SEQ ID NO: 297107 - RNA, 64 nt, Homo Sapiens; identical to SEQ ID NO: 238400

SEQ ID NO: 297108 - RNA, 64 nt, Homo Sapiens; identical to SEQ ID NO: 238401

SEQ ID NO: 297109 - RNA, 64 nt, Homo Sapiens; identical to SEQ ID NO: 238402

SEQ ID NO: 297110 - RNA, 64 nt, Homo Sapiens; identical to SEQ ID NO: 238403

SEQ ID NO: 297111 - RNA, 64 nt, Homo Sapiens; identical to SEQ ID NO: 238404

SEQ ID NO: 297112 - RNA, 64 nt, Homo Sapiens; identical to SEQ ID NO: 238405

SEQ ID NO: 297113 - RNA, 64 nt, Homo Sapiens; identical to SEQ ID NO: 238406

SEQ ID NO: 297114 - RNA, 64 nt, Homo Sapiens; identical to SEQ ID NO: 238407

SEQ ID NO: 297115 - RNA, 64 nt, Homo Sapiens; identical to SEQ ID NO: 238408

SEQ ID NO: 297116 - RNA, 64 nt, Homo Sapiens; identical to SEQ ID NO: 238409

SEQ ID NO: 297117 - RNA, 64 nt, Homo Sapiens; identical to SEQ ID NO: 238410

SEQ ID NO: 297118 - RNA, 64 nt, Homo Sapiens; identical to SEQ ID NO: 238411

SEQ ID NO: 297119 - RNA, 64 nt, Homo Sapiens; identical to SEQ ID NO: 238412

SEQ ID NO: 297120 - RNA, 64 nt, Homo Sapiens; identical to SEQ ID NO: 238413

SEQ ID NO: 297121 - RNA, 64 nt, Homo Sapiens; identical to SEQ ID NO: 238414

SEQ ID NO: 297122 - RNA, 64 nt, Homo Sapiens; identical to SEQ ID NO: 238415

SEQ ID NO: 297123 - RNA, 64 nt, Homo Sapiens; identical to SEQ ID NO: 238416

SEQ ID NO: 297124 - RNA, 64 nt, Homo Sapiens; identical to SEQ ID NO: 238417

SEQ ID NO: 297125 - RNA, 64 nt, Homo Sapiens; identical to SEQ ID NO: 238418

SEQ ID NO: 297126 - RNA, 64 nt, Homo Sapiens; identical to SEQ ID NO: 238419

SEQ ID NO: 297127 - RNA, 64 nt, Homo Sapiens; identical to SEQ ID NO: 238420

SEQ ID NO: 297128 - RNA, 64 nt, Homo Sapiens
cagggccaggcaggcagcuuuuaugaaagacaucacauggcauccuuccagcagugccuucccu

SEQ ID NO: 297129 - RNA, 64 nt, Homo Sapiens
gcaaagacguuugugaugaauauuuuuguaaugcacauggcaaaaagcaagccauaguuaguuu

SEQ ID NO: 297130 - RNA, 64 nt, Homo Sapiens
aaugaaaggaauuuuauagugccucaacuuguucacauggcauaauucaccuuggaaaugcacc

SEQ ID NO: 297131 - RNA, 64 nt, Homo Sapiens
acugugacacuggcccucccgucaagcuuuucucacauggcaucuucccaggcuccaguggcug

SEQ ID NO: 297132 - RNA, 64 nt, Homo Sapiens
gaacacuguaucucuugagagagguggccauaagacauggcacacaauucccaauuucacaaau

SEQ ID NO: 297133 - RNA, 64 nt, Homo Sapiens
gugagucaucaaaaagucaaagucagccuggccaacauggcaaaacuccgucucugcaaaaaau

SEQ ID NO: 297134 - RNA, 64 nt, Homo Sapiens
ugacuuaaauuauuagcuaugguuugcauuuaguacauggcagauugccuguaagucuguucau

SEQ ID NO: 297135 - RNA, 64 nt, Homo Sapiens
acuugaggucaggaguucgagaccagccuggccaacauggcaaaaccccgucucuaugaaaaau

SEQ ID NO: 297136 - RNA, 64 nt, Homo Sapiens
aacuguuguuuucucaggauucuuucagcugggaacauggcaggugagcagagcuuggugccuc

SEQ ID NO: 297137 - RNA, 64 nt, Homo Sapiens
cauggaauuuguucuaauaaaucauucuucuaucacauggcagcacgcuggagccugucaccuu

SEQ ID NO: 297138 - RNA, 64 nt, Homo Sapiens
acuugagcccaggaguuugaaaccagccuggguaacauggcaaaauccugucuuuacaaaaaau

SEQ ID NO: 297139 - RNA, 64 nt, Homo Sapiens
accugaagucagaaguuugagaccagccuggcaaacauggcaaaacugucucuauuaaaaauac

SEQ ID NO: 297140 - RNA, 64 nt, Homo Sapiens
cccccgccgccccuccggacccgcagagcuggggacauggcaugcccugcacucagucaccccg

SEQ ID NO: 297141 - RNA, 64 nt, Homo Sapiens
uaccagaccucaugggaccagaccccuugggaccacauggcacaaugggaccucuguuguacau

SEQ ID NO: 297142 - RNA, 64 nt, Homo Sapiens
guuucaaagagcucuuggccgugagugcuauuguacauggcaaauaaaaaauuuaaaaaaaauu

SEQ ID NO: 297143 - RNA, 64 nt, Homo Sapiens
ccuggaauccugcagcccucgcagcacccauugcacauggcagguggugcccagaagaaagagg

SEQ ID NO: 297144 - RNA, 64 nt, Homo Sapiens
uuuugucauuguuuucaggugaagcauaaacaucacauggcaugcuguaaaucauaauguaacu

SEQ ID NO: 297145 - RNA, 62 nt, Homo Sapiens
ugauuugggcagagcgaugggaagucuuuuccacauggcagauuuuccaggacacaauguag

SEQ ID NO: 297146 - RNA, 64 nt, Homo Sapiens; identical to SEQ ID NO: 248259

SEQ ID NO: 297147 - RNA, 64 nt, Homo Sapiens; identical to SEQ ID NO: 248260

SEQ ID NO: 297148 - RNA, 64 nt, Homo Sapiens; identical to SEQ ID NO: 248261

SEQ ID NO: 297149 - RNA, 64 nt, Homo Sapiens; identical to SEQ ID NO: 248262

SEQ ID NO: 297150 - RNA, 64 nt, Homo Sapiens; identical to SEQ ID NO: 248263

SEQ ID NO: 297151 - RNA, 64 nt, Homo Sapiens; identical to SEQ ID NO: 248264

SEQ ID NO: 297152 - RNA, 64 nt, Homo Sapiens; identical to SEQ ID NO: 248265

SEQ ID NO: 297153 - RNA, 64 nt, Homo Sapiens; identical to SEQ ID NO: 248266

SEQ ID NO: 297154 - RNA, 64 nt, Homo Sapiens; identical to SEQ ID NO: 248267

SEQ ID NO: 297155 - RNA, 64 nt, Homo Sapiens; identical to SEQ ID NO: 248268

SEQ ID NO: 297156 - RNA, 64 nt, Homo Sapiens; identical to SEQ ID NO: 248269

SEQ ID NO: 297157 - RNA, 64 nt, Homo Sapiens; identical to SEQ ID NO: 248270

SEQ ID NO: 297158 - RNA, 64 nt, Homo Sapiens; identical to SEQ ID NO: 248271

SEQ ID NO: 297159 - RNA, 64 nt, Homo Sapiens; identical to SEQ ID NO: 248272

SEQ ID NO: 297160 - RNA, 64 nt, Homo Sapiens; identical to SEQ ID NO: 248273

SEQ ID NO: 297161 - RNA, 64 nt, Homo Sapiens; identical to SEQ ID NO: 248274

SEQ ID NO: 297162 - RNA, 64 nt, Homo Sapiens; identical to SEQ ID NO: 248275

SEQ ID NO: 297163 - RNA, 64 nt, Homo Sapiens; identical to SEQ ID NO: 248276

SEQ ID NO: 297164 - RNA, 64 nt, Homo Sapiens; identical to SEQ ID NO: 248277

SEQ ID NO: 297165 - RNA, 64 nt, Homo Sapiens; identical to SEQ ID NO: 248278

SEQ ID NO: 297166 - RNA, 64 nt, Homo Sapiens; identical to SEQ ID NO: 248279

SEQ ID NO: 297167 - RNA, 64 nt, Homo Sapiens; identical to SEQ ID NO: 248280

SEQ ID NO: 297168 - RNA, 64 nt, Homo Sapiens; identical to SEQ ID NO: 248281

SEQ ID NO: 297169 - RNA, 64 nt, Homo Sapiens; identical to SEQ ID NO: 248282

SEQ ID NO: 297170 - RNA, 64 nt, Homo Sapiens; identical to SEQ ID NO: 248283

SEQ ID NO: 297171 - RNA, 64 nt, Homo Sapiens; identical to SEQ ID NO: 248284

SEQ ID NO: 297172 - RNA, 64 nt, Homo Sapiens; identical to SEQ ID NO: 248285

SEQ ID NO: 297173 - RNA, 64 nt, Homo Sapiens; identical to SEQ ID NO: 248286

SEQ ID NO: 297174 - RNA, 64 nt, Homo Sapiens; identical to SEQ ID NO: 248287

SEQ ID NO: 297175 - RNA, 64 nt, Homo Sapiens; identical to SEQ ID NO: 248288

SEQ ID NO: 297176 - RNA, 64 nt, Homo Sapiens; identical to SEQ ID NO: 248289

SEQ ID NO: 297177 - RNA, 64 nt, Homo Sapiens; identical to SEQ ID NO: 248290

SEQ ID NO: 297178 - RNA, 54 nt, Homo Sapiens; identical to SEQ ID NO: 248291

SEQ ID NO: 297179 - RNA, 64 nt, Homo Sapiens; identical to SEQ ID NO: 248292

SEQ ID NO: 297180 - RNA, 64 nt, Homo Sapiens; identical to SEQ ID NO: 248293

SEQ ID NO: 297181 - RNA, 64 nt, Homo Sapiens; identical to SEQ ID NO: 248294

SEQ ID NO: 297182 - RNA, 64 nt, Homo Sapiens; identical to SEQ ID NO: 248295

SEQ ID NO: 297183 - RNA, 64 nt, Homo Sapiens; identical to SEQ ID NO: 248296

SEQ ID NO: 297184 - RNA, 64 nt, Homo Sapiens; identical to SEQ ID NO: 248297

SEQ ID NO: 297185 - RNA, 64 nt, Homo Sapiens; identical to SEQ ID NO: 248298

SEQ ID NO: 297186 - RNA, 64 nt, Homo Sapiens; identical to SEQ ID NO: 248299

SEQ ID NO: 297187 - RNA, 64 nt, Homo Sapiens; identical to SEQ ID NO: 297128

SEQ ID NO: 297188 - RNA, 64 nt, Homo Sapiens; identical to SEQ ID NO: 297129

SEQ ID NO: 297189 - RNA, 64 nt, Homo Sapiens; identical to SEQ ID NO: 297130

SEQ ID NO: 297190 - RNA, 64 nt, Homo Sapiens; identical to SEQ ID NO: 297131

SEQ ID NO: 297191 - RNA, 64 nt, Homo Sapiens; identical to SEQ ID NO: 297132

SEQ ID NO: 297192 - RNA, 64 nt, Homo Sapiens; identical to SEQ ID NO: 297133

SEQ ID NO: 297193 - RNA, 64 nt, Homo Sapiens; identical to SEQ ID NO: 297134

SEQ ID NO: 297194 - RNA, 64 nt, Homo Sapiens; identical to SEQ ID NO: 297135

SEQ ID NO: 297195 - RNA, 64 nt, Homo Sapiens; identical to SEQ ID NO: 297136

SEQ ID NO: 297196 - RNA, 64 nt, Homo Sapiens; identical to SEQ ID NO: 297137

SEQ ID NO: 297197 - RNA, 64 nt, Homo Sapiens; identical to SEQ ID NO: 297138

SEQ ID NO: 297198 - RNA, 64 nt, Homo Sapiens; identical to SEQ ID NO: 297139

SEQ ID NO: 297199 - RNA, 64 nt, Homo Sapiens; identical to SEQ ID NO: 297140

SEQ ID NO: 297200 - RNA, 64 nt, Homo Sapiens; identical to SEQ ID NO: 297141

SEQ ID NO: 297201 - RNA, 64 nt, Homo Sapiens; identical to SEQ ID NO: 297142

SEQ ID NO: 297202 - RNA, 64 nt, Homo Sapiens; identical to SEQ ID NO: 297143

SEQ ID NO: 297203 - RNA, 64 nt, Homo Sapiens; identical to SEQ ID NO: 297144

SEQ ID NO: 297204 - RNA, 62 nt, Homo Sapiens; identical to SEQ ID NO: 297145

SEQ ID NO: 297205 - RNA, 64 nt, Homo Sapiens; identical to SEQ ID NO: 248259

SEQ ID NO: 297206 - RNA, 64 nt, Homo Sapiens; identical to SEQ ID NO: 248260

SEQ ID NO: 297207 - RNA, 64 nt, Homo Sapiens; identical to SEQ ID NO: 248261

SEQ ID NO: 297208 - RNA, 64 nt, Homo Sapiens; identical to SEQ ID NO: 248262

SEQ ID NO: 297209 - RNA, 64 nt, Homo Sapiens; identical to SEQ ID NO: 248263

SEQ ID NO: 297210 - RNA, 64 nt, Homo Sapiens; identical to SEQ ID NO: 248264

SEQ ID NO: 297211 - RNA, 64 nt, Homo Sapiens; identical to SEQ ID NO: 248265

SEQ ID NO: 297212 - RNA, 64 nt, Homo Sapiens; identical to SEQ ID NO: 248266

SEQ ID NO: 297213 - RNA, 64 nt, Homo Sapiens; identical to SEQ ID NO: 248267

SEQ ID NO: 297214 - RNA, 64 nt, Homo Sapiens; identical to SEQ ID NO: 248268

SEQ ID NO: 297215 - RNA, 64 nt, Homo Sapiens; identical to SEQ ID NO: 248269

SEQ ID NO: 297216 - RNA, 64 nt, Homo Sapiens; identical to SEQ ID NO: 248270

SEQ ID NO: 297217 - RNA, 64 nt, Homo Sapiens; identical to SEQ ID NO: 248271

SEQ ID NO: 297218 - RNA, 64 nt, Homo Sapiens; identical to SEQ ID NO: 248272

SEQ ID NO: 297219 - RNA, 64 nt, Homo Sapiens; identical to SEQ ID NO: 248273

SEQ ID NO: 297220 - RNA, 64 nt, Homo Sapiens; identical to SEQ ID NO: 248274

SEQ ID NO: 297221 - RNA, 64 nt, Homo Sapiens; identical to SEQ ID NO: 248275

SEQ ID NO: 297222 - RNA, 64 nt, Homo Sapiens; identical to SEQ ID NO: 248276

SEQ ID NO: 297223 - RNA, 64 nt, Homo Sapiens; identical to SEQ ID NO: 248277

SEQ ID NO: 297224 - RNA, 64 nt, Homo Sapiens; identical to SEQ ID NO: 248278

SEQ ID NO: 297225 - RNA, 64 nt, Homo Sapiens; identical to SEQ ID NO: 248279

SEQ ID NO: 297226 - RNA, 64 nt, Homo Sapiens; identical to SEQ ID NO: 248280

SEQ ID NO: 297227 - RNA, 64 nt, Homo Sapiens; identical to SEQ ID NO: 248281

SEQ ID NO: 297228 - RNA, 64 nt, Homo Sapiens; identical to SEQ ID NO: 248282

SEQ ID NO: 297229 - RNA, 64 nt, Homo Sapiens; identical to SEQ ID NO: 248283

SEQ ID NO: 297230 - RNA, 64 nt, Homo Sapiens; identical to SEQ ID NO: 248284

SEQ ID NO: 297231 - RNA, 64 nt, Homo Sapiens; identical to SEQ ID NO: 248285

SEQ ID NO: 297232 - RNA, 64 nt, Homo Sapiens; identical to SEQ ID NO: 248286

SEQ ID NO: 297233 - RNA, 64 nt, Homo Sapiens; identical to SEQ ID NO: 248287

SEQ ID NO: 297234 - RNA, 64 nt, Homo Sapiens; identical to SEQ ID NO: 248288

SEQ ID NO: 297235 - RNA, 64 nt, Homo Sapiens; identical to SEQ ID NO: 248289

SEQ ID NO: 297236 - RNA, 64 nt, Homo Sapiens; identical to SEQ ID NO: 248290

SEQ ID NO: 297237 - RNA, 54 nt, Homo Sapiens; identical to SEQ ID NO: 248291

SEQ ID NO: 297238 - RNA, 64 nt, Homo Sapiens; identical to SEQ ID NO: 248292

SEQ ID NO: 297239 - RNA, 64 nt, Homo Sapiens; identical to SEQ ID NO: 248293

SEQ ID NO: 297240 - RNA, 64 nt, Homo Sapiens; identical to SEQ ID NO: 248294

SEQ ID NO: 297241 - RNA, 64 nt, Homo Sapiens; identical to SEQ ID NO: 248295

SEQ ID NO: 297242 - RNA, 64 nt, Homo Sapiens; identical to SEQ ID NO: 248296

SEQ ID NO: 297243 - RNA, 64 nt, Homo Sapiens; identical to SEQ ID NO: 248297

SEQ ID NO: 297244 - RNA, 64 nt, Homo Sapiens; identical to SEQ ID NO: 248298

SEQ ID NO: 297245 - RNA, 64 nt, Homo Sapiens; identical to SEQ ID NO: 248299

SEQ ID NO: 297246 - RNA, 64 nt, Homo Sapiens; identical to SEQ ID NO: 285102

SEQ ID NO: 297247 - RNA, 64 nt, Homo Sapiens; identical to SEQ ID NO: 285103

SEQ ID NO: 297248 - RNA, 64 nt, Homo Sapiens; identical to SEQ ID NO: 285104

SEQ ID NO: 297249 - RNA, 64 nt, Homo Sapiens; identical to SEQ ID NO: 285105

SEQ ID NO: 297250 - RNA, 64 nt, Homo Sapiens; identical to SEQ ID NO: 285106

SEQ ID NO: 297251 - RNA, 64 nt, Homo Sapiens; identical to SEQ ID NO: 285107

SEQ ID NO: 297252 - RNA, 64 nt, Homo Sapiens; identical to SEQ ID NO: 285108

SEQ ID NO: 297253 - RNA, 64 nt, Homo Sapiens; identical to SEQ ID NO: 285109

SEQ ID NO: 297254 - RNA, 64 nt, Homo Sapiens; identical to SEQ ID NO: 285110

SEQ ID NO: 297255 - RNA, 64 nt, Homo Sapiens; identical to SEQ ID NO: 285111

SEQ ID NO: 297256 - RNA, 64 nt, Homo Sapiens; identical to SEQ ID NO: 285112

SEQ ID NO: 297257 - RNA, 64 nt, Homo Sapiens; identical to SEQ ID NO: 285113

SEQ ID NO: 297258 - RNA, 64 nt, Homo Sapiens; identical to SEQ ID NO: 285114

SEQ ID NO: 297259 - RNA, 64 nt, Homo Sapiens; identical to SEQ ID NO: 285115

SEQ ID NO: 297260 - RNA, 64 nt, Homo Sapiens; identical to SEQ ID NO: 285116

SEQ ID NO: 297261 - RNA, 64 nt, Homo Sapiens; identical to SEQ ID NO: 285117

SEQ ID NO: 297262 - RNA, 64 nt, Homo Sapiens; identical to SEQ ID NO: 285118

SEQ ID NO: 297263 - RNA, 64 nt, Homo Sapiens; identical to SEQ ID NO: 285119

SEQ ID NO: 297264 - RNA, 64 nt, Homo Sapiens; identical to SEQ ID NO: 285120

SEQ ID NO: 297265 - RNA, 64 nt, Homo Sapiens; identical to SEQ ID NO: 285121

SEQ ID NO: 297266 - RNA, 64 nt, Homo Sapiens; identical to SEQ ID NO: 285122

SEQ ID NO: 297267 - RNA, 64 nt, Homo Sapiens; identical to SEQ ID NO: 285123

SEQ ID NO: 297268 - RNA, 64 nt, Homo Sapiens; identical to SEQ ID NO: 285124

SEQ ID NO: 297269 - RNA, 64 nt, Homo Sapiens; identical to SEQ ID NO: 285125

SEQ ID NO: 297270 - RNA, 64 nt, Homo Sapiens; identical to SEQ ID NO: 285126

SEQ ID NO: 297271 - RNA, 64 nt, Homo Sapiens; identical to SEQ ID NO: 285127

SEQ ID NO: 297272 - RNA, 64 nt, Homo Sapiens; identical to SEQ ID NO: 285128

SEQ ID NO: 297273 - RNA, 64 nt, Homo Sapiens; identical to SEQ ID NO: 285129

SEQ ID NO: 297274 - RNA, 64 nt, Homo Sapiens; identical to SEQ ID NO: 285130

SEQ ID NO: 297275 - RNA, 64 nt, Homo Sapiens; identical to SEQ ID NO: 285131

SEQ ID NO: 297276 - RNA, 64 nt, Homo Sapiens; identical to SEQ ID NO: 285132

SEQ ID NO: 297277 - RNA, 64 nt, Homo Sapiens; identical to SEQ ID NO: 285133

SEQ ID NO: 297278 - RNA, 64 nt, Homo Sapiens; identical to SEQ ID NO: 285134

SEQ ID NO: 297279 - RNA, 64 nt, Homo Sapiens; identical to SEQ ID NO: 285135

SEQ ID NO: 297280 - RNA, 64 nt, Homo Sapiens; identical to SEQ ID NO: 285136

SEQ ID NO: 297281 - RNA, 64 nt, Homo Sapiens; identical to SEQ ID NO: 285137

SEQ ID NO: 297282 - RNA, 64 nt, Homo Sapiens; identical to SEQ ID NO: 285138

SEQ ID NO: 297283 - RNA, 64 nt, Homo Sapiens; identical to SEQ ID NO: 285139

SEQ ID NO: 297284 - RNA, 64 nt, Homo Sapiens; identical to SEQ ID NO: 285140

SEQ ID NO: 297285 - RNA, 64 nt, Homo Sapiens; identical to SEQ ID NO: 285141

SEQ ID NO: 297286 - RNA, 64 nt, Homo Sapiens; identical to SEQ ID NO: 285142

SEQ ID NO: 297287 - RNA, 64 nt, Homo Sapiens; identical to SEQ ID NO: 285143

SEQ ID NO: 297288 - RNA, 64 nt, Homo Sapiens; identical to SEQ ID NO: 285144

SEQ ID NO: 297289 - RNA, 64 nt, Homo Sapiens; identical to SEQ ID NO: 285145

SEQ ID NO: 297290 - RNA, 64 nt, Homo Sapiens; identical to SEQ ID NO: 285146

SEQ ID NO: 297291 - RNA, 64 nt, Homo Sapiens; identical to SEQ ID NO: 285147

SEQ ID NO: 297292 - RNA, 64 nt, Homo Sapiens; identical to SEQ ID NO: 285148

SEQ ID NO: 297293 - RNA, 64 nt, Homo Sapiens; identical to SEQ ID NO: 285149

SEQ ID NO: 297294 - RNA, 64 nt, Homo Sapiens; identical to SEQ ID NO: 285150

SEQ ID NO: 297295 - RNA, 64 nt, Homo Sapiens; identical to SEQ ID NO: 285151

SEQ ID NO: 297296 - RNA, 64 nt, Homo Sapiens; identical to SEQ ID NO: 285152

SEQ ID NO: 297297 - RNA, 64 nt, Homo Sapiens; identical to SEQ ID NO: 285153

SEQ ID NO: 297298 - RNA, 64 nt, Homo Sapiens; identical to SEQ ID NO: 285154

SEQ ID NO: 297299 - RNA, 64 nt, Homo Sapiens; identical to SEQ ID NO: 285155

SEQ ID NO: 297300 - RNA, 64 nt, Homo Sapiens; identical to SEQ ID NO: 285156

SEQ ID NO: 297301 - RNA, 64 nt, Homo Sapiens; identical to SEQ ID NO: 285157

SEQ ID NO: 297302 - RNA, 64 nt, Homo Sapiens; identical to SEQ ID NO: 285158

SEQ ID NO: 297303 - RNA, 64 nt, Homo Sapiens; identical to SEQ ID NO: 285159

SEQ ID NO: 297304 - RNA, 64 nt, Homo Sapiens; identical to SEQ ID NO: 193171

SEQ ID NO: 297305 - RNA, 64 nt, Homo Sapiens; identical to SEQ ID NO: 193172

SEQ ID NO: 297306 - RNA, 64 nt, Homo Sapiens; identical to SEQ ID NO: 193173

SEQ ID NO: 297307 - RNA, 64 nt, Homo Sapiens; identical to SEQ ID NO: 193174

SEQ ID NO: 297308 - RNA, 64 nt, Homo Sapiens; identical to SEQ ID NO: 193175

SEQ ID NO: 297309 - RNA, 64 nt, Homo Sapiens; identical to SEQ ID NO: 193176

SEQ ID NO: 297310 - RNA, 64 nt, Homo Sapiens; identical to SEQ ID NO: 193177

SEQ ID NO: 297311 - RNA, 64 nt, Homo Sapiens; identical to SEQ ID NO: 193178

SEQ ID NO: 297312 - RNA, 64 nt, Homo Sapiens; identical to SEQ ID NO: 193179

SEQ ID NO: 297313 - RNA, 64 nt, Homo Sapiens; identical to SEQ ID NO: 193180

SEQ ID NO: 297314 - RNA, 64 nt, Homo Sapiens; identical to SEQ ID NO: 193181

SEQ ID NO: 297315 - RNA, 64 nt, Homo Sapiens; identical to SEQ ID NO: 193182

SEQ ID NO: 297316 - RNA, 64 nt, Homo Sapiens; identical to SEQ ID NO: 193183

SEQ ID NO: 297317 - RNA, 64 nt, Homo Sapiens; identical to SEQ ID NO: 193184

SEQ ID NO: 297318 - RNA, 64 nt, Homo Sapiens; identical to SEQ ID NO: 193185

SEQ ID NO: 297319 - RNA, 64 nt, Homo Sapiens; identical to SEQ ID NO: 193186

SEQ ID NO: 297320 - RNA, 64 nt, Homo Sapiens; identical to SEQ ID NO: 193187

SEQ ID NO: 297321 - RNA, 64 nt, Homo Sapiens; identical to SEQ ID NO: 193188

SEQ ID NO: 297322 - RNA, 64 nt, Homo Sapiens; identical to SEQ ID NO: 193188

SEQ ID NO: 297323 - RNA, 64 nt, Homo Sapiens; identical to SEQ ID NO: 193190

SEQ ID NO: 297324 - RNA, 64 nt, Homo Sapiens; identical to SEQ ID NO: 193191

SEQ ID NO: 297325 - RNA, 64 nt, Homo Sapiens; identical to SEQ ID NO: 193192

SEQ ID NO: 297326 - RNA, 64 nt, Homo Sapiens; identical to SEQ ID NO: 193193

SEQ ID NO: 297327 - RNA, 64 nt, Homo Sapiens; identical to SEQ ID NO: 193194

SEQ ID NO: 297328 - RNA, 64 nt, Homo Sapiens; identical to SEQ ID NO: 193195

SEQ ID NO: 297329 - RNA, 64 nt, Homo Sapiens; identical to SEQ ID NO: 193196

SEQ ID NO: 297330 - RNA, 64 nt, Homo Sapiens; identical to SEQ ID NO: 193197

SEQ ID NO: 297331 - RNA, 64 nt, Homo Sapiens; identical to SEQ ID NO: 193198

SEQ ID NO: 297332 - RNA, 64 nt, Homo Sapiens; identical to SEQ ID NO: 193199

SEQ ID NO: 297333 - RNA, 64 nt, Homo Sapiens; identical to SEQ ID NO: 193200

SEQ ID NO: 297334 - RNA, 64 nt, Homo Sapiens; identical to SEQ ID NO: 97744

SEQ ID NO: 297335 - RNA, 64 nt, Homo Sapiens; identical to SEQ ID NO: 97745

SEQ ID NO: 297336 - RNA, 64 nt, Homo Sapiens; identical to SEQ ID NO: 97746

SEQ ID NO: 297337 - RNA, 64 nt, Homo Sapiens; identical to SEQ ID NO: 97747

SEQ ID NO: 297338 - RNA, 64 nt, Homo Sapiens; identical to SEQ ID NO: 97748

SEQ ID NO: 297339 - RNA, 64 nt, Homo Sapiens; identical to SEQ ID NO: 97749

SEQ ID NO: 297340 - RNA, 64 nt, Homo Sapiens; identical to SEQ ID NO: 97750

SEQ ID NO: 297341 - RNA, 64 nt, Homo Sapiens; identical to SEQ ID NO: 97751

SEQ ID NO: 297342 - RNA, 64 nt, Homo Sapiens; identical to SEQ ID NO: 97752

SEQ ID NO: 297343 - RNA, 64 nt, Homo Sapiens; identical to SEQ ID NO: 97753

SEQ ID NO: 297344 - RNA, 64 nt, Homo Sapiens; identical to SEQ ID NO: 97754

SEQ ID NO: 297345 - RNA, 64 nt, Homo Sapiens; identical to SEQ ID NO: 97755

SEQ ID NO: 297346 - RNA, 64 nt, Homo Sapiens; identical to SEQ ID NO: 97756

SEQ ID NO: 297347 - RNA, 64 nt, Homo Sapiens; identical to SEQ ID NO: 97757

SEQ ID NO: 297348 - RNA, 64 nt, Homo Sapiens; identical to SEQ ID NO: 97758

SEQ ID NO: 297349 - RNA, 64 nt, Homo Sapiens; identical to SEQ ID NO: 97759

SEQ ID NO: 297350 - RNA, 64 nt, Homo Sapiens; identical to SEQ ID NO: 97760

SEQ ID NO: 297351 - RNA, 64 nt, Homo Sapiens; identical to SEQ ID NO: 97761

SEQ ID NO: 297352 - RNA, 64 nt, Homo Sapiens; identical to SEQ ID NO: 97762

SEQ ID NO: 297353 - RNA, 64 nt, Homo Sapiens; identical to SEQ ID NO: 97763

SEQ ID NO: 297354 - RNA, 64 nt, Homo Sapiens; identical to SEQ ID NO: 97764

SEQ ID NO: 297355 - RNA, 64 nt, Homo Sapiens; identical to SEQ ID NO: 97765

SEQ ID NO: 297356 - RNA, 64 nt, Homo Sapiens; identical to SEQ ID NO: 97766

SEQ ID NO: 297357 - RNA, 64 nt, Homo Sapiens; identical to SEQ ID NO: 97767

SEQ ID NO: 297358 - RNA, 64 nt, Homo Sapiens; identical to SEQ ID NO: 97768

SEQ ID NO: 297359 - RNA, 64 nt, Homo Sapiens; identical to SEQ ID NO: 97769

SEQ ID NO: 297360 - RNA, 64 nt, Homo Sapiens; identical to SEQ ID NO: 97770

SEQ ID NO: 297361 - RNA, 64 nt, Homo Sapiens; identical to SEQ ID NO: 97771

SEQ ID NO: 297362 - RNA, 64 nt, Homo Sapiens; identical to SEQ ID NO: 97772

SEQ ID NO: 297363 - RNA, 64 nt, Homo Sapiens; identical to SEQ ID NO: 97773

SEQ ID NO: 297364 - RNA, 64 nt, Homo Sapiens; identical to SEQ ID NO: 97774

SEQ ID NO: 297365 - RNA, 64 nt, Homo Sapiens; identical to SEQ ID NO: 97775

SEQ ID NO: 297366 - RNA, 64 nt, Homo Sapiens; identical to SEQ ID NO: 97776

SEQ ID NO: 297367 - RNA, 64 nt, Homo Sapiens; identical to SEQ ID NO: 97777

SEQ ID NO: 297368 - RNA, 64 nt, Homo Sapiens; identical to SEQ ID NO: 97778

SEQ ID NO: 297369 - RNA, 64 nt, Homo Sapiens; identical to SEQ ID NO: 97779

SEQ ID NO: 297370 - RNA, 64 nt, Homo Sapiens; identical to SEQ ID NO: 97780

SEQ ID NO: 297371 - RNA, 64 nt, Homo Sapiens; identical to SEQ ID NO: 97781

SEQ ID NO: 297372 - RNA, 64 nt, Homo Sapiens; identical to SEQ ID NO: 97782

SEQ ID NO: 297373 - RNA, 64 nt, Homo Sapiens; identical to SEQ ID NO: 97783

SEQ ID NO: 297374 - RNA, 64 nt, Homo Sapiens; identical to SEQ ID NO: 97784

SEQ ID NO: 297375 - RNA, 64 nt, Homo Sapiens; identical to SEQ ID NO: 97785

SEQ ID NO: 297376 - RNA, 64 nt, Homo Sapiens; identical to SEQ ID NO: 265947

SEQ ID NO: 297377 - RNA, 64 nt, Homo Sapiens; identical to SEQ ID NO: 265948

SEQ ID NO: 297378 - RNA, 64 nt, Homo Sapiens; identical to SEQ ID NO: 265949

SEQ ID NO: 297379 - RNA, 64 nt, Homo Sapiens; identical to SEQ ID NO: 265950

SEQ ID NO: 297380 - RNA, 64 nt, Homo Sapiens; identical to SEQ ID NO: 265951

SEQ ID NO: 297381 - RNA, 64 nt, Homo Sapiens; identical to SEQ ID NO: 265952

SEQ ID NO: 297382 - RNA, 64 nt, Homo Sapiens; identical to SEQ ID NO: 265953

SEQ ID NO: 297383 - RNA, 64 nt, Homo Sapiens; identical to SEQ ID NO: 265954

SEQ ID NO: 297384 - RNA, 64 nt, Homo Sapiens; identical to SEQ ID NO: 265955

SEQ ID NO: 297385 - RNA, 64 nt, Homo Sapiens; identical to SEQ ID NO: 265956

SEQ ID NO: 297386 - RNA, 64 nt, Homo Sapiens; identical to SEQ ID NO: 265957

SEQ ID NO: 297387 - RNA, 64 nt, Homo Sapiens; identical to SEQ ID NO: 265958

SEQ ID NO: 297388 - RNA, 64 nt, Homo Sapiens; identical to SEQ ID NO: 265959

SEQ ID NO: 297389 - RNA, 64 nt, Homo Sapiens; identical to SEQ ID NO: 265960

SEQ ID NO: 297390 - RNA, 64 nt, Homo Sapiens; identical to SEQ ID NO: 265961

SEQ ID NO: 297391 - RNA, 64 nt, Homo Sapiens; identical to SEQ ID NO: 265962

SEQ ID NO: 297392 - RNA, 64 nt, Homo Sapiens; identical to SEQ ID NO: 265963

SEQ ID NO: 297393 - RNA, 64 nt, Homo Sapiens; identical to SEQ ID NO: 265964

SEQ ID NO: 297394 - RNA, 64 nt, Homo Sapiens; identical to SEQ ID NO: 265965

SEQ ID NO: 297395 - RNA, 64 nt, Homo Sapiens; identical to SEQ ID NO: 265966

SEQ ID NO: 297396 - RNA, 64 nt, Homo Sapiens; identical to SEQ ID NO: 265967

SEQ ID NO: 297397 - RNA, 64 nt, Homo Sapiens; identical to SEQ ID NO: 265968

SEQ ID NO: 297398 - RNA, 64 nt, Homo Sapiens; identical to SEQ ID NO: 265969

SEQ ID NO: 297399 - RNA, 64 nt, Homo Sapiens; identical to SEQ ID NO: 265970

SEQ ID NO: 297400 - RNA, 64 nt, Homo Sapiens; identical to SEQ ID NO: 265971

SEQ ID NO: 297401 - RNA, 64 nt, Homo Sapiens; identical to SEQ ID NO: 265972

SEQ ID NO: 297402 - RNA, 64 nt, Homo Sapiens; identical to SEQ ID NO: 265973

SEQ ID NO: 297403 - RNA, 64 nt, Homo Sapiens; identical to SEQ ID NO: 265974

SEQ ID NO: 297404 - RNA, 64 nt, Homo Sapiens; identical to SEQ ID NO: 265975

SEQ ID NO: 297405 - RNA, 64 nt, Homo Sapiens; identical to SEQ ID NO: 265976

SEQ ID NO: 297406 - RNA, 64 nt, Homo Sapiens; identical to SEQ ID NO: 265977

SEQ ID NO: 297407 - RNA, 64 nt, Homo Sapiens; identical to SEQ ID NO: 265978

SEQ ID NO: 297408 - RNA, 64 nt, Homo Sapiens; identical to SEQ ID NO: 265979

SEQ ID NO: 297409 - RNA, 64 nt, Homo Sapiens; identical to SEQ ID NO: 265980

SEQ ID NO: 297410 - RNA, 64 nt, Homo Sapiens; identical to SEQ ID NO: 265981

SEQ ID NO: 297411 - RNA, 64 nt, Homo Sapiens; identical to SEQ ID NO: 265982

SEQ ID NO: 297412 - RNA, 64 nt, Homo Sapiens; identical to SEQ ID NO: 265983

SEQ ID NO: 297413 - RNA, 64 nt, Homo Sapiens; identical to SEQ ID NO: 265984

SEQ ID NO: 297414 - RNA, 64 nt, Homo Sapiens; identical to SEQ ID NO: 265985

SEQ ID NO: 297415 - RNA, 64 nt, Homo Sapiens; identical to SEQ ID NO: 265986

SEQ ID NO: 297416 - RNA, 64 nt, Homo Sapiens; identical to SEQ ID NO: 265987

SEQ ID NO: 297417 - RNA, 64 nt, Homo Sapiens; identical to SEQ ID NO: 265988

SEQ ID NO: 297418 - RNA, 64 nt, Homo Sapiens; identical to SEQ ID NO: 265989

SEQ ID NO: 297419 - RNA, 64 nt, Homo Sapiens; identical to SEQ ID NO: 265990

SEQ ID NO: 297420 - RNA, 64 nt, Homo Sapiens; identical to SEQ ID NO: 265991

SEQ ID NO: 297421 - RNA, 64 nt, Homo Sapiens; identical to SEQ ID NO: 265992

SEQ ID NO: 297422 - RNA, 64 nt, Homo Sapiens; identical to SEQ ID NO: 265993

SEQ ID NO: 297423 - RNA, 64 nt, Homo Sapiens; identical to SEQ ID NO: 265994

SEQ ID NO: 297424 - RNA, 64 nt, Homo Sapiens; identical to SEQ ID NO: 265995

SEQ ID NO: 297425 - RNA, 64 nt, Homo Sapiens; identical to SEQ ID NO: 265996

SEQ ID NO: 297426 - RNA, 64 nt, Homo Sapiens; identical to SEQ ID NO: 265997

SEQ ID NO: 297427 - RNA, 64 nt, Homo Sapiens; identical to SEQ ID NO: 265998

SEQ ID NO: 297428 - RNA, 64 nt, Homo Sapiens; identical to SEQ ID NO: 265999

SEQ ID NO: 297429 - RNA, 64 nt, Homo Sapiens; identical to SEQ ID NO: 266000

SEQ ID NO: 297430 - RNA, 64 nt, Homo Sapiens; identical to SEQ ID NO: 266001

SEQ ID NO: 297431 - RNA, 64 nt, Homo Sapiens; identical to SEQ ID NO: 266002

SEQ ID NO: 297432 - RNA, 64 nt, Homo Sapiens; identical to SEQ ID NO: 266003

SEQ ID NO: 297433 - RNA, 64 nt, Homo Sapiens; identical to SEQ ID NO: 266004

SEQ ID NO: 297434 - RNA, 64 nt, Homo Sapiens; identical to SEQ ID NO: 266005

SEQ ID NO: 297435 - RNA, 64 nt, Homo Sapiens; identical to SEQ ID NO: 266006

SEQ ID NO: 297436 - RNA, 64 nt, Homo Sapiens; identical to SEQ ID NO: 266007

SEQ ID NO: 297437 - RNA, 64 nt, Homo Sapiens; identical to SEQ ID NO: 266008

SEQ ID NO: 297438 - RNA, 64 nt, Homo Sapiens; identical to SEQ ID NO: 266009

SEQ ID NO: 297439 - RNA, 64 nt, Homo Sapiens; identical to SEQ ID NO: 266010

SEQ ID NO: 297440 - RNA, 64 nt, Homo Sapiens; identical to SEQ ID NO: 266011

SEQ ID NO: 297441 - RNA, 64 nt, Homo Sapiens; identical to SEQ ID NO: 266012

SEQ ID NO: 297442 - RNA, 64 nt, Homo Sapiens; identical to SEQ ID NO: 266013

SEQ ID NO: 297443 - RNA, 64 nt, Homo Sapiens; identical to SEQ ID NO: 266014

SEQ ID NO: 297444 - RNA, 64 nt, Homo Sapiens; identical to SEQ ID NO: 266015

SEQ ID NO: 297445 - RNA, 64 nt, Homo Sapiens; identical to SEQ ID NO: 266016

SEQ ID NO: 297446 - RNA, 64 nt, Homo Sapiens; identical to SEQ ID NO: 266017

SEQ ID NO: 297447 - RNA, 64 nt, Homo Sapiens; identical to SEQ ID NO: 266018

SEQ ID NO: 297448 - RNA, 64 nt, Homo Sapiens; identical to SEQ ID NO: 266019

SEQ ID NO: 297449 - RNA, 64 nt, Homo Sapiens; identical to SEQ ID NO: 266020

SEQ ID NO: 297450 - RNA, 64 nt, Homo Sapiens; identical to SEQ ID NO: 266021

SEQ ID NO: 297451 - RNA, 64 nt, Homo Sapiens; identical to SEQ ID NO: 266022

SEQ ID NO: 297452 - RNA, 64 nt, Homo Sapiens; identical to SEQ ID NO: 266023

SEQ ID NO: 297453 - RNA, 64 nt, Homo Sapiens; identical to SEQ ID NO: 266024

SEQ ID NO: 297454 - RNA, 64 nt, Homo Sapiens; identical to SEQ ID NO: 266025

SEQ ID NO: 297455 - RNA, 64 nt, Homo Sapiens; identical to SEQ ID NO: 266026

SEQ ID NO: 297456 - RNA, 64 nt, Homo Sapiens; identical to SEQ ID NO: 266027

SEQ ID NO: 297457 - RNA, 64 nt, Homo Sapiens; identical to SEQ ID NO: 266028

SEQ ID NO: 297458 - RNA, 64 nt, Homo Sapiens; identical to SEQ ID NO: 266029

SEQ ID NO: 297459 - RNA, 64 nt, Homo Sapiens; identical to SEQ ID NO: 266030

SEQ ID NO: 297460 - RNA, 64 nt, Homo Sapiens; identical to SEQ ID NO: 266031

SEQ ID NO: 297461 - RNA, 64 nt, Homo Sapiens; identical to SEQ ID NO: 266032

SEQ ID NO: 297462 - RNA, 64 nt, Homo Sapiens; identical to SEQ ID NO: 266033

SEQ ID NO: 297463 - RNA, 64 nt, Homo Sapiens; identical to SEQ ID NO: 266034

SEQ ID NO: 297464 - RNA, 64 nt, Homo Sapiens; identical to SEQ ID NO: 266035

SEQ ID NO: 297465 - RNA, 64 nt, Homo Sapiens; identical to SEQ ID NO: 266036

SEQ ID NO: 297466 - RNA, 64 nt, Homo Sapiens; identical to SEQ ID NO: 266037

SEQ ID NO: 297467 - RNA, 64 nt, Homo Sapiens; identical to SEQ ID NO: 266038

SEQ ID NO: 297468 - RNA, 64 nt, Homo Sapiens; identical to SEQ ID NO: 266039

SEQ ID NO: 297469 - RNA, 64 nt, Homo Sapiens; identical to SEQ ID NO: 266040

SEQ ID NO: 297470 - RNA, 64 nt, Homo Sapiens; identical to SEQ ID NO: 266041

SEQ ID NO: 297471 - RNA, 64 nt, Homo Sapiens; identical to SEQ ID NO: 266042

SEQ ID NO: 297472 - RNA, 64 nt, Homo Sapiens; identical to SEQ ID NO: 266043

SEQ ID NO: 297473 - RNA, 64 nt, Homo Sapiens; identical to SEQ ID NO: 266044

SEQ ID NO: 297474 - RNA, 64 nt, Homo Sapiens; identical to SEQ ID NO: 266045

SEQ ID NO: 297475 - RNA, 64 nt, Homo Sapiens; identical to SEQ ID NO: 266046

SEQ ID NO: 297476 - RNA, 64 nt, Homo Sapiens; identical to SEQ ID NO: 266047

SEQ ID NO: 297477 - RNA, 64 nt, Homo Sapiens; identical to SEQ ID NO: 266048

SEQ ID NO: 297478 - RNA, 64 nt, Homo Sapiens; identical to SEQ ID NO: 266049

SEQ ID NO: 297479 - RNA, 64 nt, Homo Sapiens; identical to SEQ ID NO: 266050

SEQ ID NO: 297480 - RNA, 64 nt, Homo Sapiens; identical to SEQ ID NO: 266051

SEQ ID NO: 297481 - RNA, 64 nt, Homo Sapiens; identical to SEQ ID NO: 266052

SEQ ID NO: 297482 - RNA, 64 nt, Homo Sapiens; identical to SEQ ID NO: 266053

SEQ ID NO: 297483 - RNA, 64 nt, Homo Sapiens; identical to SEQ ID NO: 266054

SEQ ID NO: 297484 - RNA, 64 nt, Homo Sapiens; identical to SEQ ID NO: 266055

SEQ ID NO: 297485 - RNA, 64 nt, Homo Sapiens; identical to SEQ ID NO: 266056

SEQ ID NO: 297486 - RNA, 64 nt, Homo Sapiens; identical to SEQ ID NO: 266057

SEQ ID NO: 297487 - RNA, 64 nt, Homo Sapiens; identical to SEQ ID NO: 266058

SEQ ID NO: 297488 - RNA, 64 nt, Homo Sapiens; identical to SEQ ID NO: 266059

SEQ ID NO: 297489 - RNA, 64 nt, Homo Sapiens; identical to SEQ ID NO: 266060

SEQ ID NO: 297490 - RNA, 64 nt, Homo Sapiens; identical to SEQ ID NO: 266061

SEQ ID NO: 297491 - RNA, 64 nt, Homo Sapiens; identical to SEQ ID NO: 266062

SEQ ID NO: 297492 - RNA, 64 nt, Homo Sapiens; identical to SEQ ID NO: 266063

SEQ ID NO: 297493 - RNA, 64 nt, Homo Sapiens; identical to SEQ ID NO: 266064

SEQ ID NO: 297494 - RNA, 64 nt, Homo Sapiens; identical to SEQ ID NO: 266065

SEQ ID NO: 297495 - RNA, 64 nt, Homo Sapiens; identical to SEQ ID NO: 266066

SEQ ID NO: 297496 - RNA, 64 nt, Homo Sapiens; identical to SEQ ID NO: 266067

SEQ ID NO: 297497 - RNA, 64 nt, Homo Sapiens; identical to SEQ ID NO: 266068

SEQ ID NO: 297498 - RNA, 64 nt, Homo Sapiens; identical to SEQ ID NO: 266069

SEQ ID NO: 297499 - RNA, 64 nt, Homo Sapiens; identical to SEQ ID NO: 266070

SEQ ID NO: 297500 - RNA, 64 nt, Homo Sapiens; identical to SEQ ID NO: 266071

SEQ ID NO: 297501 - RNA, 64 nt, Homo Sapiens; identical to SEQ ID NO: 266072

SEQ ID NO: 297502 - RNA, 64 nt, Homo Sapiens; identical to SEQ ID NO: 266073

SEQ ID NO: 297503 - RNA, 64 nt, Homo Sapiens; identical to SEQ ID NO: 266074

SEQ ID NO: 297504 - RNA, 64 nt, Homo Sapiens; identical to SEQ ID NO: 266075

SEQ ID NO: 297505 - RNA, 64 nt, Homo Sapiens; identical to SEQ ID NO: 266076

SEQ ID NO: 297506 - RNA, 64 nt, Homo Sapiens; identical to SEQ ID NO: 266077

SEQ ID NO: 297507 - RNA, 64 nt, Homo Sapiens; identical to SEQ ID NO: 266078

SEQ ID NO: 297508 - RNA, 64 nt, Homo Sapiens; identical to SEQ ID NO: 266079

SEQ ID NO: 297509 - RNA, 64 nt, Homo Sapiens; identical to SEQ ID NO: 266080

SEQ ID NO: 297510 - RNA, 64 nt, Homo Sapiens; identical to SEQ ID NO: 266081

SEQ ID NO: 297511 - RNA, 64 nt, Homo Sapiens; identical to SEQ ID NO: 266082

SEQ ID NO: 297512 - RNA, 64 nt, Homo Sapiens; identical to SEQ ID NO: 266083

SEQ ID NO: 297513 - RNA, 64 nt, Homo Sapiens; identical to SEQ ID NO: 266084

SEQ ID NO: 297514 - RNA, 64 nt, Homo Sapiens; identical to SEQ ID NO: 266085

SEQ ID NO: 297515 - RNA, 64 nt, Homo Sapiens; identical to SEQ ID NO: 266086

SEQ ID NO: 297516 - RNA, 64 nt, Homo Sapiens; identical to SEQ ID NO: 266087

SEQ ID NO: 297517 - RNA, 64 nt, Homo Sapiens; identical to SEQ ID NO: 266088

SEQ ID NO: 297518 - RNA, 64 nt, Homo Sapiens; identical to SEQ ID NO: 266089

SEQ ID NO: 297519 - RNA, 64 nt, Homo Sapiens; identical to SEQ ID NO: 266090

SEQ ID NO: 297520 - RNA, 64 nt, Homo Sapiens; identical to SEQ ID NO: 266091

SEQ ID NO: 297521 - RNA, 64 nt, Homo Sapiens; identical to SEQ ID NO: 266092

SEQ ID NO: 297522 - RNA, 64 nt, Homo Sapiens; identical to SEQ ID NO: 266093

SEQ ID NO: 297523 - RNA, 64 nt, Homo Sapiens; identical to SEQ ID NO: 266094

SEQ ID NO: 297524 - RNA, 64 nt, Homo Sapiens; identical to SEQ ID NO: 266095

SEQ ID NO: 297525 - RNA, 64 nt, Homo Sapiens; identical to SEQ ID NO: 266096

SEQ ID NO: 297526 - RNA, 64 nt, Homo Sapiens; identical to SEQ ID NO: 266097

SEQ ID NO: 297527 - RNA, 64 nt, Homo Sapiens; identical to SEQ ID NO: 266098

SEQ ID NO: 297528 - RNA, 64 nt, Homo Sapiens; identical to SEQ ID NO: 266099

SEQ ID NO: 297529 - RNA, 64 nt, Homo Sapiens; identical to SEQ ID NO: 266100

SEQ ID NO: 297530 - RNA, 64 nt, Homo Sapiens; identical to SEQ ID NO: 266101

SEQ ID NO: 297531 - RNA, 64 nt, Homo Sapiens; identical to SEQ ID NO: 266102

SEQ ID NO: 297532 - RNA, 64 nt, Homo Sapiens; identical to SEQ ID NO: 266103

SEQ ID NO: 297533 - RNA, 64 nt, Homo Sapiens; identical to SEQ ID NO: 266104

SEQ ID NO: 297534 - RNA, 64 nt, Homo Sapiens; identical to SEQ ID NO: 266105

SEQ ID NO: 297535 - RNA, 64 nt, Homo Sapiens; identical to SEQ ID NO: 266106

SEQ ID NO: 297536 - RNA, 64 nt, Homo Sapiens; identical to SEQ ID NO: 266107

SEQ ID NO: 297537 - RNA, 64 nt, Homo Sapiens; identical to SEQ ID NO: 266108

SEQ ID NO: 297538 - RNA, 64 nt, Homo Sapiens; identical to SEQ ID NO: 266109

SEQ ID NO: 297539 - RNA, 64 nt, Homo Sapiens; identical to SEQ ID NO: 266110

SEQ ID NO: 297540 - RNA, 64 nt, Homo Sapiens; identical to SEQ ID NO: 266111

SEQ ID NO: 297541 - RNA, 64 nt, Homo Sapiens; identical to SEQ ID NO: 266112

SEQ ID NO: 297542 - RNA, 64 nt, Homo Sapiens; identical to SEQ ID NO: 266113

SEQ ID NO: 297543 - RNA, 64 nt, Homo Sapiens; identical to SEQ ID NO: 266114

SEQ ID NO: 297544 - RNA, 64 nt, Homo Sapiens; identical to SEQ ID NO: 266115

SEQ ID NO: 297545 - RNA, 64 nt, Homo Sapiens
ccagaacuaagaaugccaagguuuuauauauguguguauauauauauauauauauauauauaua

SEQ ID NO: 297546 - RNA, 64 nt, Homo Sapiens
uauauauauauauauauauauauauguuuguguguguauauauauauauauauauauauguuug

SEQ ID NO: 297547 - RNA, 64 nt, Homo Sapiens
uguauauauauauauauauauauauguuuguguguguauauauauguuuguguauauauauaca

SEQ ID NO: 297548 - RNA, 64 nt, Homo Sapiens
uauauauauguuuguguguguauauauauguuuguguauauauauacacauaugcauacauaug

SEQ ID NO: 297549 - RNA, 64 nt, Homo Sapiens
uuggcuauaucucauccaaacugagcaguuucuguguauauauagaagguagaaaugaaaagug

SEQ ID NO: 297550 - RNA, 64 nt, Homo Sapiens
ucugaaugagcgagaaaaauguggauguacuguuuguauauauuguauauauuaaaacagagau

SEQ ID NO: 297551 - RNA, 64 nt, Homo Sapiens
gcgagaaaaauguggauguacuguuuguauauauuguauauauuaaaacagagauaugugcaug

SEQ ID NO: 297552 - RNA, 64 nt, Homo Sapiens
uauaagaaauuauagagugaguguauuuuccuuguguauauauuaaacacacccauacaaacau

SEQ ID NO: 297553 - RNA, 64 nt, Homo Sapiens
auuuguaucuguuuaacucauauucugcacgaucuguauauaguacaucaaacuuagaggugug

SEQ ID NO: 297554 - RNA, 64 nt, Homo Sapiens
ugagcuaugauaugugcuuguguguaugucuauguguauauauuauauauacauuagacacaca

SEQ ID NO: 297555 - RNA, 64 nt, Homo Sapiens
uauauauacauuagacacacauauacauuauuucuguauauagaugucuguguauacauaugua

SEQ ID NO: 297556 - RNA, 64 nt, Homo Sapiens
uguaaauauugucuugguuaaggugggagucuuuuguauauaguauggaccaaagguuaugcac

SEQ ID NO: 297557 - RNA, 64 nt, Homo Sapiens
gugcuaaauucaaaguagcagggaagucuagagauguauauaauuaucuuagacuauacuuuuu

SEQ ID NO: 297558 - RNA, 64 nt, Homo Sapiens
gagauaauuuauuuaauauaaauauuguucuauuuguauauauugauuuucuauuuauguaggu

SEQ ID NO: 297559 - RNA, 64 nt, Homo Sapiens
auuuuuuaaaaagguuuucuucuaugguugacauuguauauauagauuuaagguacuuaaagcu

SEQ ID NO: 297560 - RNA, 64 nt, Homo Sapiens
uauauacauacacauauacauauacagauguguguguauauauaugaauauauacauguaugua

SEQ ID NO: 297561 - RNA, 64 nt, Homo Sapiens
gauguguguguauauauauaaauauauacauguauguauauacacuuuauauguauauaauuug

SEQ ID NO: 297562 - RNA, 64 nt, Homo Sapiens
uugaauauauacauguaugucaaauaucuuuauauguauauaaucccuauauaucuugaaucua

SEQ ID NO: 297563 - RNA, 64 nt, Homo Sapiens
cccaaauauauugaauguacaagauguauauagauguauauaugagagauaauauauauauaga

SEQ ID NO: 297564 - RNA, 64 nt, Homo Sapiens
uguauauaugcccaaauauauauauauagaaagauguauauagaagaaagaaacagagauaaua

SEQ ID NO: 297565 - RNA, 64 nt, Homo Sapiens
guucacauaucuggaucuguugguuguauagauauguauauaugguuugugaaagucuaaauaa

SEQ ID NO: 297566 - RNA, 64 nt, Homo Sapiens
accuuuccuauggaaauguggcugaaguguauaguguauauauauuuuggguccacauuucaag

SEQ ID NO: 297567 - RNA, 64 nt, Homo Sapiens
cuaugauuagaaaauaugcaucuguauuuacaucuguauauacagcaucauugcacacauugac

SEQ ID NO: 297568 - RNA, 64 nt, Homo Sapiens
uuucaaaacuucuuuuucaaaaaugaaaccuauguguauauaacaaaagauugcugcauaauuu

SEQ ID NO: 297569 - RNA, 64 nt, Homo Sapiens
ugugugugucuauaucucuauauuuguguguauauguauauaugaaauagaauguguaugcaua

SEQ ID NO: 297570 - RNA, 64 nt, Homo Sapiens
ucuaagacagcaagcgggaccauugucuuuucacuguauauacugaaaaggaggcagauguuac

SEQ ID NO: 297571 - RNA, 64 nt, Homo Sapiens
acucugcacuauaucccuucauauauguauaucauguauauauuaagacuauaccuauguguau

SEQ ID NO: 297572 - RNA, 64 nt, Homo Sapiens
uguauaucauguauauauuaagacuauaccuauguguauauauacauauauacauguagagaca

SEQ ID NO: 297573 - RNA, 64 nt, Homo Sapiens
guuaaaugcaaaaaggagauuauuuauuuuauauuguauauauuaauguccauuuguguaaaug

SEQ ID NO: 297574 - RNA, 64 nt, Homo Sapiens
gcuuucacucaaucaucucuuaauuuuuaaaugcuguauauauguucaagaauauagauaaguc

SEQ ID NO: 297575 - RNA, 64 nt, Homo Sapiens
augaaaguagucauuaaaguuuuuauuauauauauguauauaauguggcaguuccuguuuuuga

SEQ ID NO: 297576 - RNA, 64 nt, Homo Sapiens
gguaacaacgcuaagcuuuucauuuuauuacuucuguauauagaucuauccauuguuuugugug

SEQ ID NO: 297577 - RNA, 64 nt, Homo Sapiens
uacacaguugcuaugauauguaacaagucacacauguauauaucacacaagucuuaccaauucu

SEQ ID NO: 297578 - RNA, 64 nt, Homo Sapiens
cagacgugcacuggucugcauuugggggcuaaaguguauauauuccauuuaaaauggaauuugu

SEQ ID NO: 297579 - RNA, 64 nt, Homo Sapiens
aacauuuuuaucuucauaauuuaaaaaauauauauguauauauugcauauucacuuuuuccuuu

SEQ ID NO: 297580 - RNA, 64 nt, Homo Sapiens
uggaauacaauugucugccguuuccccuucuuaauguauauauugugaguauuuauuagauucg

SEQ ID NO: 297581 - RNA, 64 nt, Homo Sapiens
gagauauauauauauacacacacacacacauauguguauauauguauauauauaugugaguaua

SEQ ID NO: 297582 - RNA, 64 nt, Homo Sapiens
uauauauacacacacacacacauauguguauauauguauauauauaugugaguauauauacaca

SEQ ID NO: 297583 - RNA, 64 nt, Homo Sapiens
caguguuuauuaaaggaacaugcacagauguaucuguauauagguauugauauagccacaguua

SEQ ID NO: 297584 - RNA, 64 nt, Homo Sapiens
aauaguccaaauguuucugaagaauuuucaauguuguauauagaaaauacagaauuucauggug

SEQ ID NO: 297585 - RNA, 64 nt, Homo Sapiens
caacuuuauuaagguauaguggauaauuuaaaacuguauauauugacgguacagauggucccca

SEQ ID NO: 297586 - RNA, 64 nt, Homo Sapiens
auaagacaaggagaaucauauacaacuugauauguguauauacaguaaaguguucaccacaagc

SEQ ID NO: 297587 - RNA, 64 nt, Homo Sapiens
aauaauaaaauuucaagggauaguuuuuauucaauguauauaagacagguagugccugauuuac

SEQ ID NO: 297588 - RNA, 64 nt, Homo Sapiens
gacccuaagggagagauuugugugauaaaaguauuguauauaauagaucagcgauuuuuguaag

SEQ ID NO: 297589 - RNA, 64 nt, Homo Sapiens
aguguaaagaagccucauaagaucauaaggaaaauguauauaugcuuuucacagcuuucuagaa

SEQ ID NO: 297590 - RNA, 64 nt, Homo Sapiens
gcauuucauuucaacacugcuucaagguuucuuuuguauauaauucuuagaaugcucauuucuu

SEQ ID NO: 297591 - RNA, 64 nt, Homo Sapiens
gaaagugacagacaaauucuuacagccaaaauaauguauauaugagugacacuuuucacccuug

SEQ ID NO: 297592 - RNA, 64 nt, Homo Sapiens
uguauaauguugagauuacuaaaugugaugucuuuguauauaucauagauguacacacgaauuu

SEQ ID NO: 297593 - RNA, 64 nt, Homo Sapiens
caggcacaucuuuuuuacuuugugugcgcgcauauguauauagaccuaauuuugugugcgugug

SEQ ID NO: 297594 - RNA, 63 nt, Homo Sapiens
uguaaaauauauguagcauaaggaaugauaaacuguauauaacgccauaguccagugggauaa

SEQ ID NO: 297595 - RNA, 64 nt, Homo Sapiens
uacauauguaauuguuguaaauguacagaaauauuguauauacugcccuaaaaugucucuggca

SEQ ID NO: 297596 - RNA, 64 nt, Homo Sapiens
auuauaguccuuauuuuuuucagguuuauagagauguauauagaucuacaaccccauagcacaa

SEQ ID NO: 297597 - RNA, 64 nt, Homo Sapiens
guuugcagacauuauuguucaaauauguauuauguguauauauuuuuauauuaagucuuguuuu

SEQ ID NO: 297598 - RNA, 64 nt, Homo Sapiens
guucauucuuguuuauauuaugaaaaaauugacauguauauacuuaaauuguauuucaaaacag

SEQ ID NO: 297599 - RNA, 64 nt, Homo Sapiens
uuauuauauuuguacuuuggaacaugcuaacugcuguauauauaauucuuauucugugccaggc

SEQ ID NO: 297600 - RNA, 64 nt, Homo Sapiens
uacauagauuaaggaaauagcuauauuguauguauguauauaaauguuuuuugcaucaacuuuu

SEQ ID NO: 297601 - RNA, 64 nt, Homo Sapiens
uaguuuauauuuacacacuaccaaaggcacauuauguauauaauucuuuuauuuuacaacuggg

SEQ ID NO: 297602 - RNA, 64 nt, Homo Sapiens
gagagagcugagaguuauucuauguauguguauguguauauagauguguauauauguauacaua

SEQ ID NO: 297603 - RNA, 64 nt, Homo Sapiens
uauacauauauguauguguaagcuguacaguguguguauauaugguacacgugcauguacacac

SEQ ID NO: 297604 - RNA, 64 nt, Homo Sapiens
ggagauuuuuagaaaaaucaguacauauggauuuuguauauauaggcaacagcuggaucuccaa

SEQ ID NO: 297605 - RNA, 64 nt, Homo Sapiens
uuaaaauuauaaauagauaaguuuuugagcuggcuguauauauuuguugaugggguuuguuguu

SEQ ID NO: 297606 - RNA, 64 nt, Homo Sapiens
gaaucuggugcuugucaggguguuugguaagaacuguauauagucagaauuaccuaaaucaccu

SEQ ID NO: 297607 - RNA, 64 nt, Homo Sapiens
uaaaucaccuagagguaccguuuacaugguuuuguguauauagaguuggcuugcauuuuagggg

SEQ ID NO: 297608 - RNA, 64 nt, Homo Sapiens
auguguuugguuucaaugguuuuuuauauucagauguauauauggugcucacuuuaggaucagc

SEQ ID NO: 297609 - RNA, 64 nt, Homo Sapiens
uguggaaaaacagucuuguauuuuucuguauguguguauauauauauaauuauguacuucuggc

SEQ ID NO: 297610 - RNA, 64 nt, Homo Sapiens
augagaauucuuaucacucaccuuuauauuaaaauguauauauauguauauauuuuuuccuuug

SEQ ID NO: 297611 - RNA, 64 nt, Homo Sapiens
uuaucacucaccuuuauauuaaaauguauauauauguauauauuuuuuccuuuggaucacuuac

SEQ ID NO: 297612 - RNA, 64 nt, Homo Sapiens
ugguuagaguaaaggacgaggucauuagccauauuguauauaucgucaagcaacacacacaaaa

SEQ ID NO: 297613 - RNA, 64 nt, Homo Sapiens
aacgucuagggagaagguugacuuuuugcacuucuguauauagucaaaagagagaaaccuguau

SEQ ID NO: 297614 - RNA, 64 nt, Homo Sapiens
aguauuucuuuuagggcucacuuaaauacauguuuguauauacuguauucuagccagaauaauu

SEQ ID NO: 297615 - RNA, 64 nt, Homo Sapiens
uugaaacugguaaaaucaguuuuuugauaguguguguauauaagaaaaaauagauacacacauu

SEQ ID NO: 297616 - RNA, 64 nt, Homo Sapiens
aucuccuuuuucuuuuuaugacacgcauacuaaguguauauaguuacauauacuagaucuggac

SEQ ID NO: 297617 - RNA, 64 nt, Homo Sapiens
uauauauuuaugcaucuauaugucuguagguguguguauauauacacauguauacguauguacg

SEQ ID NO: 297618 - RNA, 64 nt, Homo Sapiens
uugaacuuucuaaaaaaaaauaugucuguauauauguauauauuucugcacauguggauguaca

SEQ ID NO: 297619 - RNA, 64 nt, Homo Sapiens
uauauauuuugaacuuucuagauguacauaugucuguauauaugugccugugucugcacaugug

SEQ ID NO: 297620 - RNA, 64 nt, Homo Sapiens
uauauacaccacauuuucuucagucaucuggauauguauauaagaguauauacaccacauuauc

SEQ ID NO: 297621 - RNA, 64 nt, Homo Sapiens
uauauacaccacauuauccauauguguauguguauguauauaaguguguguguguguaugcaua

SEQ ID NO: 297622 - RNA, 64 nt, Homo Sapiens
cacuuuaauaucuuauuuauaacuuuucugguauuguauauauguuuuugcuguucccaaucua

SEQ ID NO: 297623 - RNA, 64 nt, Homo Sapiens
gucaaagucaggcucaaaagaaagcacaaaauguuguauauagaccagucucuguucagaucca

SEQ ID NO: 297624 - RNA, 64 nt, Homo Sapiens
ucaucagccaccauccuauugcaaagguuccaacuguauauauucccaauagcaacguagcuuc

SEQ ID NO: 297625 - RNA, 64 nt, Homo Sapiens
uugaauuggagagaaggccucccuagccagcacuuguauauacgcaucuauaaauuguccgugu

SEQ ID NO: 297626 - RNA, 64 nt, Homo Sapiens
uuucuuuaaucacagucacugggaaguaaggagauguauauauguguauauaugguaacaaagc

SEQ ID NO: 297627 - RNA, 64 nt, Homo Sapiens
cacagucacugggaaguaaggagauguauauauguguauauaugguaacaaagcauagcaguuc

SEQ ID NO: 297628 - RNA, 64 nt, Homo Sapiens
uuuguagcugccaggcuuucuguaaaaauuguauuguauauaaugugauuuuuacacauacaua

SEQ ID NO: 297629 - RNA, 64 nt, Homo Sapiens
guguguuuguguaugugcucugugccauggcugguguauauaugugcaauguuagaaggcaaaa

SEQ ID NO: 297630 - RNA, 64 nt, Homo Sapiens
ugucauuuaacucugccugagacuuucagugcacuguauauagaagucuaaaacacaccuaaga

SEQ ID NO: 297631 - RNA, 64 nt, Homo Sapiens
uuucauucagguauuuguaauagugacauauauauguauauacauaucaccuccuauucucuua

SEQ ID NO: 297632 - RNA, 64 nt, Homo Sapiens
gaguacagcagaaaaucuuuuacuaguguguguguguauauauauaaacaauuguaaauuucuu

SEQ ID NO: 297633 - RNA, 64 nt, Homo Sapiens
auagaauuauaaaugucauuugacuaugucaaucuguauauauuguaccuuaauaugaaaaaca

SEQ ID NO: 297634 - RNA, 64 nt, Homo Sapiens
augucaaucaagacaaaugaaauauauauguauguguauauauauacauguauguaugaaauau

SEQ ID NO: 297635 - RNA, 64 nt, Homo Sapiens
guauguaugaaauauauauaugugcguguguguguguauauauauauauauauauauauauuuc

SEQ ID NO: 297636 - RNA, 64 nt, Homo Sapiens
uaauaaagaguacuuguacaaacaccuguauauauguauauauucuaguaaaauuagguccagu

SEQ ID NO: 297637 - RNA, 64 nt, Homo Sapiens
uauauauuuaauaaagaguagguccaguaacaccuguauauaugaauugauucuaguaaaauua

SEQ ID NO: 297638 - RNA, 64 nt, Homo Sapiens
aaaugccacacuguauguuuugcgagcaagggaguguauauacuagcgauuaggauuuuucgcu

SEQ ID NO: 297639 - RNA, 64 nt, Homo Sapiens
ucgaaaugucaaauuaauuuaaugacugaaaggauguauauauauuuagcauuguuaacauuua

SEQ ID NO: 297640 - RNA, 64 nt, Homo Sapiens
ugcaacaucugauaacuucauggccuuugauaaauguauauauguauaugugcauggacugugu

SEQ ID NO: 297641 - RNA, 64 nt, Homo Sapiens
uauauauauauguguguguguguguguguguguguguauauauauauauauauauauauauaua

SEQ ID NO: 297642 - RNA, 64 nt, Homo Sapiens
uauauauauauauauauauauauauauauguguguguauauauauauauauguguauauauaua

SEQ ID NO: 297643 - RNA, 64 nt, Homo Sapiens
uauauauauauguguguguauauauauauauauguguauauauauauguauauacauauaugua

SEQ ID NO: 297644 - RNA, 64 nt, Homo Sapiens
uguguguauauauauauauauguguauauauauauguauauacauauauguauauauaugcaca

SEQ ID NO: 297645 - RNA, 64 nt, Homo Sapiens
uauauauguguauauauauauguauauacauauauguauauauaugcacauauauauauguauu

SEQ ID NO: 297646 - RNA, 64 nt, Homo Sapiens
uauuagucuaaaugugguucuggugcuggugcccuguauauauguaacaauauaggaccccucc

SEQ ID NO: 297647 - RNA, 64 nt, Homo Sapiens
cucacgugucugucaugaauagcaaaugagaaaauguauauaaaagcacuuuguaaauuguaaa

SEQ ID NO: 297648 - RNA, 64 nt, Homo Sapiens
aagggauuuaugucuacauauuuguguguguguguguauauauauguaauaugcauacacagau

SEQ ID NO: 297649 - RNA, 64 nt, Homo Sapiens
auauauauguaauaugcauacacagaugcauauguguauauauaaugaaauuuauguugcuggu

SEQ ID NO: 297650 - RNA, 64 nt, Homo Sapiens
uauuacacacuacuguuguuauauauaguacauguguauauauauauauauauaguacauguau

SEQ ID NO: 297651 - RNA, 64 nt, Homo Sapiens
uaguacauguguauauauauauauauauaguacauguauauauauguguguaauauauauaugu

SEQ ID NO: 297652 - RNA, 64 nt, Homo Sapiens
uaguacauguauauauauagguguaauauauauauguauauauaauauaugugugugugugugu

SEQ ID NO: 297653 - RNA, 64 nt, Homo Sapiens
cuuuuuucccccugaaccauuguuuguuuguguauguauauaugugcauauauaugcauauaug

SEQ ID NO: 297654 - RNA, 64 nt, Homo Sapiens
auaauauacacagugaauuauucauugugcaguauguauauagcgaauuaagaucauuuuguug

SEQ ID NO: 297655 - RNA, 64 nt, Homo Sapiens
guaaagauuaaaauggggaacacaaaaacuguguuguauauaauaggcaugggguugccaguac

SEQ ID NO: 297656 - RNA, 64 nt, Homo Sapiens
cauauauauauauauaaauauacguauacauaucuguauauauaacuucuguuuuauauauaua

SEQ ID NO: 297657 - RNA, 64 nt, Homo Sapiens
gcagcauuagcaauaugguuguuuugguuuugaguguauauaauuuuuauacaguauuuguuuu

SEQ ID NO: 297658 - RNA, 64 nt, Homo Sapiens
uuugcuaauguuccagcaacaaagguaacuggaauguauauacuuaugugauuauggcuaaauc

SEQ ID NO: 297659 - RNA, 64 nt, Homo Sapiens
caaagacugaagaaauuucacagcaguuuauuaauguauauaaacuuauaaauauuucuccagc

SEQ ID NO: 297660 - RNA, 64 nt, Homo Sapiens
gucauuauggcauccuuaauuuuucuucuccuucuguauauaggguaagggacuguucugaaga

SEQ ID NO: 297661 - RNA, 64 nt, Homo Sapiens
aguuugaaaagaaauuaauuugcaguguuuggauuguauauauggugcuaaaaauaaauuaauu

SEQ ID NO: 297662 - RNA, 64 nt, Homo Sapiens
uacauucuugcuuccuuaaauuaauauguuuguguguauauaugugccucacaccugaauugaa

SEQ ID NO: 297663 - RNA, 64 nt, Homo Sapiens
guuuuuuuauuucuuuugugaaaaaacaauugguuguauauaaagauguuauuuuuguauuuuu

SEQ ID NO: 297664 - RNA, 64 nt, Homo Sapiens
ucaaauugucagcaugacaauuuucuccugcauguguauauaugccagaucacugaauuggaac

SEQ ID NO: 297665 - RNA, 64 nt, Homo Sapiens
aaugcauuauuacacauacaugcacguaucuauauguauauauauauuuguuuauauacauaua

SEQ ID NO: 297666 - RNA, 64 nt, Homo Sapiens
cacguauguauagaugugugguguacuuauuauauguauauauauacauaauauauacauacgu

SEQ ID NO: 297667 - RNA, 64 nt, Homo Sapiens
gaccauaauuauaugguccuuuguauauaaguuguguauauagaggcugugacuucucucuaaa

SEQ ID NO: 297668 - RNA, 64 nt, Homo Sapiens
uuguguauauagagaccauaacuucucucuaaauuguauauaagccagggcacugggggcugug

SEQ ID NO: 297669 - RNA, 64 nt, Homo Sapiens
auacauacacauacacacacaacguauacauauguguauauauggauacacacucauguaugua

SEQ ID NO: 297670 - RNA, 64 nt, Homo Sapiens
auacacacucauguauguaaaacacacacauagauguauauagggauggauguaauauauguag

SEQ ID NO: 297671 - RNA, 64 nt, Homo Sapiens
ucaguguuuaaggauucuaccuaaugcagauauauguauauaucuauauagaggucuuucuaua

SEQ ID NO: 297672 - RNA, 64 nt, Homo Sapiens
auuagaaaagauagguuuaacaaaaaaauuuacuuguauauaaugcaccuucaggaggacuaug

SEQ ID NO: 297673 - RNA, 64 nt, Homo Sapiens
uguuuaaaauugcuuugagugauucauacagagauguauauaugcauacauguauauauucaua

SEQ ID NO: 297674 - RNA, 64 nt, Homo Sapiens
gagugauucauacagagauguauauaugcauacauguauauauucauaaggaauauaagcuucc

SEQ ID NO: 297675 - RNA, 64 nt, Homo Sapiens
uauuguguauuagcuaagguucugaaauauucuauguauauaucauuuacaggugguauaaaau

SEQ ID NO: 297676 - RNA, 64 nt, Homo Sapiens
auauucaauauauuucccaccaaguaccuauauauguauauaaacaaacacauuaucuauauau

SEQ ID NO: 297677 - RNA, 64 nt, Homo Sapiens
aucuauaugauuaaagaaaaccugucuugucuauuguauauauacuguccauuaucuauauagu

SEQ ID NO: 297678 - RNA, 64 nt, Homo Sapiens
uuuuuaaaaaucuaccuguuuguguguguuagcuuguauauauaggggcauuagugcugauagc

SEQ ID NO: 297679 - RNA, 64 nt, Homo Sapiens
uaugcuuauaaguuugcauuauuugguagcaucauguauauauucucuuagugguuacauugcc

SEQ ID NO: 297680 - RNA, 64 nt, Homo Sapiens
uauguauauuuaaggaagucuauaucuguauauauguauauauguaaaacagaacuguguacug

SEQ ID NO: 297681 - RNA, 64 nt, Homo Sapiens
uauauauguauguauauuuaguguacuguauaucuguauauaugagggguauuaaaacagaacu

SEQ ID NO: 297682 - RNA, 64 nt, Homo Sapiens
caccauuuacgcuacaugugauuuuuuuaauguauguauauauauauauucucaaauugcucua

SEQ ID NO: 297683 - RNA, 64 nt, Homo Sapiens
aaaauaggaacgacucuaauuaauaggcuuucuguguauauaauuaaauuuagcugcugcaacc

SEQ ID NO: 297684 - RNA, 64 nt, Homo Sapiens
uuagcuaauuagaaauauucaugauuaaaaaauguguauauauaugauuugccuguaauuuugg

SEQ ID NO: 297685 - RNA, 64 nt, Homo Sapiens
ccaguucacuuagacaacuuuguuuaaucagcgauguauauaaggauacuucccaaagcccuua

SEQ ID NO: 297686 - RNA, 64 nt, Homo Sapiens
aauaugcuacuugccuccucgaauaucaagaaaauguauauagggcauuguugaaagacaacca

SEQ ID NO: 297687 - RNA, 64 nt, Homo Sapiens
uccucaaucucugaaguaaaauaaauuaauuuguuguauauaguauguuaucccuauggugaaa

SEQ ID NO: 297688 - RNA, 64 nt, Homo Sapiens
uauuaagguguggcuguuuauaucgguaucuugauguauauauauucuuuacuaucuaaaaguu

SEQ ID NO: 297689 - RNA, 64 nt, Homo Sapiens
uauguguguuaaaucaccaagcuccaaacuacuguguauauaugugguguuuugccuauauauu

SEQ ID NO: 297690 - RNA, 64 nt, Homo Sapiens
aucuauuguacaagauguguuacuggcauuuccauguauauauguauauaaaugcaggaaacca

SEQ ID NO: 297691 - RNA, 64 nt, Homo Sapiens
uacaagauguguuacuggcauuuccauguauauauguauauaaaugcaggaaaccaacauguca

SEQ ID NO: 297692 - RNA, 64 nt, Homo Sapiens
ccugagaagcauguaauguuaauguuauaucauauguauauauauauaugcacuauguauauac

SEQ ID NO: 297693 - RNA, 64 nt, Homo Sapiens
auguuauaucauauguauauauauauaugcacuauguauauacauauauauuaauacugguauu

SEQ ID NO: 297694 - RNA, 64 nt, Homo Sapiens
uacaaaauuuuccucuuuuguuuauugacuagauuguauauaauuuucuuuuuuccaaaauauu

SEQ ID NO: 297695 - RNA, 64 nt, Homo Sapiens
gguuauaaagggagguaccuaaauacucaaauaauguauauauucuuuuucauaacauauggaa

SEQ ID NO: 297696 - RNA, 64 nt, Homo Sapiens
uuuugaaauauggcugagaaccuggcauaaagaauguauauauaagagcagaguucccuauucc

SEQ ID NO: 297697 - RNA, 64 nt, Homo Sapiens
auauugcagguuaaauuacuccuccuuccaaaguuguauauauaucaaccuguaaaacaccacu

SEQ ID NO: 297698 - RNA, 64 nt, Homo Sapiens
cauuggaacuugcauccuguauuguaaauauaaauguauauauuaugcauuaaaucacucugca

SEQ ID NO: 297699 - RNA, 64 nt, Homo Sapiens
auuuggagaauaaguguguacagaucacaaaacauguauauacauuauuuagaaaagaucucaa

SEQ ID NO: 297700 - RNA, 64 nt, Homo Sapiens
uuauuuuguaaacauuuuguggguacauaguacauguauauauuuacgggguaugugagauguu

SEQ ID NO: 297701 - RNA, 64 nt, Homo Sapiens
uagguauauguagauagaugugcauguauguguuuguauauauaauuuuauaaguuucacgcau

SEQ ID NO: 297702 - RNA, 64 nt, Homo Sapiens
augccugugugcauacauauguaugggauauauuuguauauauauguacagguaauaaacaucc

SEQ ID NO: 297703 - RNA, 64 nt, Homo Sapiens
gugcauguccauagugaggcuacagauggcuuauuguauauaauuacaauguaaauagcuuuuu

SEQ ID NO: 297704 - RNA, 64 nt, Homo Sapiens
ucuccuuguccaugccauagcugguuucuacuuauguauauaaagggggguggggggaggggcu

SEQ ID NO: 297705 - RNA, 64 nt, Homo Sapiens
agccugagcacacuuauuuuugaaaaugauauaauguauauauaugggaggaaaggccacauuu

SEQ ID NO: 297706 - RNA, 64 nt, Homo Sapiens
uauggcuuuccaauaaccacuguauguauauauauguauauauauguauauacacauauauaug

SEQ ID NO: 297707 - RNA, 64 nt, Homo Sapiens
uguauauauauauggcuuuccauauauauguguauguauauauacacacacacauguauauaca

SEQ ID NO: 297708 - RNA, 64 nt, Homo Sapiens
cauauauauguguauguauauacacacacacacauguauauacacagcuggagguguguauaua

SEQ ID NO: 297709 - RNA, 64 nt, Homo Sapiens
cacacacacacauguauauauacagcuggagguguguauauauacugcugagcucugguuaggu

SEQ ID NO: 297710 - RNA, 64 nt, Homo Sapiens
uuuuagacaaaaaugcacacuauacacuuuaaaauguauauacagauccauaguauccuaugcc

SEQ ID NO: 297711 - RNA, 64 nt, Homo Sapiens
guaagacugaaagcuuugauuaugaaugcauugcuguauauacuaaaaaaauacccuuuuacaa

SEQ ID NO: 297712 - RNA, 64 nt, Homo Sapiens
acaacauguaacccauucauucauaucuuagaauuguauauaaaucauuuauugaauaccaggg

SEQ ID NO: 297713 - RNA, 64 nt, Homo Sapiens
auauaggcauauaccucauaauauucauguaucuuguauauaaaauauguacaugaauauauau

SEQ ID NO: 297714 - RNA, 64 nt, Homo Sapiens
uacucauucuucacaaaauucugagauuauaaaauguauauaguuaauauuuguuugagcuugu

SEQ ID NO: 297715 - RNA, 64 nt, Homo Sapiens
agacuuuaaaaaguuaucuugguacaacaccguguguauauacacuuggaagcuuaaaaaggug

SEQ ID NO: 297716 - RNA, 64 nt, Homo Sapiens
uuugugcaguaccaaugacauguauauauuucuuuguauauaauuaacuaauacuugaacauuu

SEQ ID NO: 297717 - RNA, 64 nt, Homo Sapiens
ucuuuguauauaauuuugugauacuugaacauuuuguauauauucuugaauugaaauuuaacua

SEQ ID NO: 297718 - RNA, 64 nt, Homo Sapiens
uauuauauauauaauauauauaauauaauauauguguauauauauauauauguguguauauaua

SEQ ID NO: 297719 - RNA, 64 nt, Homo Sapiens
uaauauaauauauguguauaauauuauauauguguguauauauaaggauuguuucuccauauau

SEQ ID NO: 297720 - RNA, 64 nt, Homo Sapiens
uauaugaaaauauauauauaccuuuauauauguauguauauauauguaaauuugcaaauuguuu

SEQ ID NO: 297721 - RNA, 64 nt, Homo Sapiens
guuuugucagguguguaaauugcauacauauguguguauauaugugugugucugucugugugua

SEQ ID NO: 297722 - RNA, 64 nt, Homo Sapiens
guguaaguggauguauauguacuuaaacuggcuuuguauauauguauaaaugcuggugguggug

SEQ ID NO: 297723 - RNA, 64 nt, Homo Sapiens
uaagcuuuccauuuuauucauaaucuaauguguguguauauauguauguguguaugugugugua

SEQ ID NO: 297724 - RNA, 64 nt, Homo Sapiens
aauguguguguauauauguauguguguauguguguguauauauagauguauauauauacacaca

SEQ ID NO: 297725 - RNA, 64 nt, Homo Sapiens
uauauguauguguguauguguguguauauauagauguauauauauacacacacagagauauaua

SEQ ID NO: 297726 - RNA, 64 nt, Homo Sapiens
ucucucucucucuccauauauauauguguguguguguauauauauauauaugugugugugugug

SEQ ID NO: 297727 - RNA, 64 nt, Homo Sapiens
uacacauauauacacacacacauacauauacauguguauauauauaccaucccauauauaugug

SEQ ID NO: 297728 - RNA, 64 nt, Homo Sapiens
gcaguauauuuuuuacauugaacuuuucuucacuuguauauaaagauuauauauaaguacuuau

SEQ ID NO: 297729 - RNA, 64 nt, Homo Sapiens
acugauuuuguuuuaauuguaaguuguuaacuccuguauauaucauuaaaauaaaucugaaguu

SEQ ID NO: 297730 - RNA, 64 nt, Homo Sapiens
gacagauccuagaccaauguaaagaauguguaucuguauauaaauaauuuaucaaauaguuuuc

SEQ ID NO: 297731 - RNA, 64 nt, Homo Sapiens
cccgccccuugccuuaguaagaggagcagugaaauguauauaguugauguucaguauuuccaag

SEQ ID NO: 297732 - RNA, 64 nt, Homo Sapiens
aucaguggcuaaaguugaaaagggguugguuuccuguauauauauguauguauauacacacgua

SEQ ID NO: 297733 - RNA, 64 nt, Homo Sapiens
uugaaaagggguugguuuccuguauauauauguauguauauacacacguacauacauucauaua

SEQ ID NO: 297734 - RNA, 64 nt, Homo Sapiens
ccuuuuaaaauauauauauauauacacauauauauguauauauacacauauauguauguauaca

SEQ ID NO: 297735 - RNA, 64 nt, Homo Sapiens
uauacacauauauguauguauacacauauacacauguauauauacauguguguauguauacaug

SEQ ID NO: 297736 - RNA, 64 nt, Homo Sapiens
uacacauguauauauacauguguguauguauacauguauauauauauacauacacauauaugua

SEQ ID NO: 297737 - RNA, 64 nt, Homo Sapiens
guaaauauccccacuguacuguguauuaacuuuguguauauagugaagaccuuugagaaccugg

SEQ ID NO: 297738 - RNA, 64 nt, Homo Sapiens
ccuguaaguuucuuaacugcgucuuggguucaaguguauauauuguauauaaugucagguuugg

SEQ ID NO: 297739 - RNA, 64 nt, Homo Sapiens
gucagguuugggucuuggguauuuguaaauagguuguauauaauuauauugucuguccauaugu

SEQ ID NO: 297740 - RNA, 64 nt, Homo Sapiens
ccuuugauguauuuuccccuagaacuucuauaauuguauauauguccaugcuacauguacaaua

SEQ ID NO: 297741 - RNA, 64 nt, Homo Sapiens
uuuuaaaaaucuauauuuuguucuauauauuguauguauauauuuaguuuugcauaauuucagc

SEQ ID NO: 297742 - RNA, 64 nt, Homo Sapiens
gcaucacccaaucaauaaaaaacaaauauauauauguauauauauguauguaugugugugugua

SEQ ID NO: 297743 - RNA, 64 nt, Homo Sapiens
uauauauauguauauauauguauguauguguguguguauauauauauauauauauauauauaua

SEQ ID NO: 297744 - RNA, 64 nt, Homo Sapiens
uaaaauuggaugcuagagaaucaaguuuauuuuauguauauauuuuucugauuauaagaguaau

SEQ ID NO: 297745 - RNA, 64 nt, Homo Sapiens
auuuccuacguauuuuauuuuacauagaucauauuguauauaguuaguaucuuuauuaauuuuu

SEQ ID NO: 297746 - RNA, 64 nt, Homo Sapiens
ccacaucacacuugcuuuguggaucuaauuuuucuguauauagcuccucuuguguucuugagaa

SEQ ID NO: 297747 - RNA, 64 nt, Homo Sapiens
caguagauacagauuguauugugcuuucaaguuuuguauauaagaaagauuuucagauccuggu

SEQ ID NO: 297748 - RNA, 64 nt, Homo Sapiens
gaaauuuuguuauauuuuuauguaauguaauguuuguauauaauuguuuuuaaccuguacauug

SEQ ID NO: 297749 - RNA, 64 nt, Homo Sapiens
aauaugcaagaugugccuuaaccgguuucaguguuguauauauagagaagccccuaaguuauug

SEQ ID NO: 297750 - RNA, 64 nt, Homo Sapiens
auacauaucugccccaguguuuuaaaaaaauaguuguauauaaccccaacauggauauaaguuu

SEQ ID NO: 297751 - RNA, 64 nt, Homo Sapiens
cgaggggaacuguauaaagauguaguuauaucaguguauauacauuaauuaguggcuuuuaaau

SEQ ID NO: 297752 - RNA, 64 nt, Homo Sapiens
ggaccuacugcuucucugaggccauauauaugucuguauauauggucuucucuuucaaaccaga

SEQ ID NO: 297753 - RNA, 64 nt, Homo Sapiens
auauauaaacauuuuacaugcaugugauccaagcuguauauaccgacaguuuuauucuuagacu

SEQ ID NO: 297754 - RNA, 64 nt, Homo Sapiens
uggagguggauuucaugcccugugguguuuacaguguauauaaugguuguguuuucauggggcu

SEQ ID NO: 297755 - RNA, 64 nt, Homo Sapiens
ggccccucugugaauagcacgauuaaaauccaguuguauauaauggacagcuaacggaacaaua

SEQ ID NO: 297756 - RNA, 64 nt, Homo Sapiens
ugaaugugugaacguguguauguaaauguauguguguauauauuaaaaaauguauauagauguc

SEQ ID NO: 297757 - RNA, 64 nt, Homo Sapiens
uguauguaaauguauguguguauauauuaaaaaauguauauagaugucugaguguugucuggag

SEQ ID NO: 297758 - RNA, 64 nt, Homo Sapiens
aucuaauauauauauauuaucuugguaagucuacuguauauaacuugauugcuuaaacuauuga

SEQ ID NO: 297759 - RNA, 64 nt, Homo Sapiens
aucuaauauauauauuacagcuugguaagucuacuguauauaacuugauugcuuaaacuauuga

SEQ ID NO: 297760 - RNA, 64 nt, Homo Sapiens
uaaaaaacuaugaaucacuccucuuuucuauguauguauauauaucugcaggauauuugggauc

SEQ ID NO: 297761 - RNA, 64 nt, Homo Sapiens
uguuuauuagacauggcauguguucuaguuuuuguguauauaugaacucgguuucacaugauuu

SEQ ID NO: 297762 - RNA, 64 nt, Homo Sapiens
gcuuuuuucuuuugccccagaucaaacugaacaauguauauaacacuaucugucuguaaaauac

SEQ ID NO: 297763 - RNA, 64 nt, Homo Sapiens
uauauuuauaugacagcuugaacugacaacauuguguauauagaucaucuugaaguauuauuuc

SEQ ID NO: 297764 - RNA, 64 nt, Homo Sapiens
uggcuauauaggaaaaugcuguggaaaugaacuguguauauacuucugggaggaacaaauuuaa

SEQ ID NO: 297765 - RNA, 64 nt, Homo Sapiens
aaggguauugcuaaaaggauguuuccaaaaaucuuguauauaagauagcaacagugauugauga

SEQ ID NO: 297766 - RNA, 64 nt, Homo Sapiens
aaacaugacuauacagaaauuuaaauagaaauaguguauauacauauaaaauacaagcuauguu

SEQ ID NO: 297767 - RNA, 64 nt, Homo Sapiens
auaucaggcaugcauguggcauauguauauaauauguauauacauaauagcugacuguguguac

SEQ ID NO: 297768 - RNA, 64 nt, Homo Sapiens
auguauauacaauaucaggcacuguguguacauauguauauaauaguggcuuaaauaauagcug

SEQ ID NO: 297769 - RNA, 64 nt, Homo Sapiens
ggacauuuuaucuucuggccaggguuuguauauauguauauauggauuuaagaggguaggaauu

SEQ ID NO: 297770 - RNA, 64 nt, Homo Sapiens
uauauaugggacauuuuaucuaggaauuaggguuuguauauaugaacuagaggauuuaagaggg

SEQ ID NO: 297771 - RNA, 64 nt, Homo Sapiens
cgaaguguauuaguaccaucauacccaaagaucauguauauaaugguuaaacugauugucauga

SEQ ID NO: 297772 - RNA, 64 nt, Homo Sapiens
uguaacaucacauugauuuugaagaaucagaucauguauauaauggucagagaagccuuuagga

SEQ ID NO: 297773 - RNA, 64 nt, Homo Sapiens
gcuuuuccuucuuuuguuuaucauauugcugucuuguauauacaugcugcaaacagcuaaacug

SEQ ID NO: 297774 - RNA, 64 nt, Homo Sapiens
aaaggcacuuaaauugguuacuuucauguccagcuguauauaaguccaguguguucaucuagau

SEQ ID NO: 297775 - RNA, 64 nt, Homo Sapiens
auauugacacaauuuuaaaaaaucaguaaaggaauguauauaauauugcucucguguuuuacag

SEQ ID NO: 297776 - RNA, 64 nt, Homo Sapiens
ccuguguaccccucuauauauauguuacauagaauguauauauguugggaacaugcucgcuucu

SEQ ID NO: 297777 - RNA, 64 nt, Homo Sapiens
aaacguguguauuauaucuggccucguuauauaguguauauauauguauacauauacauauaua

SEQ ID NO: 297778 - RNA, 64 nt, Homo Sapiens
gugcccuucugaugcuaagaccaccaacuguagauguauauaugcuggcaaugacuuguauugg

SEQ ID NO: 297779 - RNA, 64 nt, Homo Sapiens
aucuccgguuuauaaaaccucuguugauugaagauguauauaauagcaguggagguggggguug

SEQ ID NO: 297780 - RNA, 64 nt, Homo Sapiens
cagugccucaguucagcuucggagccuguauauauguauauacuuccccagcgggcaggcgggc

SEQ ID NO: 297781 - RNA, 64 nt, Homo Sapiens
uauauacucagugccucaguaggcgggcggagccuguauauauggccccaucuccccagcgggc

SEQ ID NO: 297782 - RNA, 64 nt, Homo Sapiens
ugugcccuggacuguuucaaucuuuguauauauguguauauaugauuaugcacgugucugggua

SEQ ID NO: 297783 - RNA, 64 nt, Homo Sapiens
uguauauaugugugcccuggugucuggguaucuuuguauauauguggagccugcauuaugcacg

SEQ ID NO: 297784 - RNA, 64 nt, Homo Sapiens
cauccuuauauuauuuuuuucuuaugcaugauuuuguauauaugguuauuuuucuuuccauaaa

SEQ ID NO: 297785 - RNA, 64 nt, Homo Sapiens
gguuauuuuucuuuccauaaaaaugguauuaaacuguauauacuguuuuguagccuacauauuu

SEQ ID NO: 297786 - RNA, 64 nt, Homo Sapiens
caucucaguuuagaaauuuauucaaagcuaaagauguauauauacauauacuuuuguguguaua

SEQ ID NO: 297787 - RNA, 64 nt, Homo Sapiens
aagcuaaagauguauauauacauauacuuuuguguguauauauacacauauguguguaugcagu

SEQ ID NO: 297788 - RNA, 64 nt, Homo Sapiens
gaaaaguaauaacuauggcacaaauguucaggaguguauauaaaaauaugugggcucucgauuu

SEQ ID NO: 297789 - RNA, 64 nt, Homo Sapiens
auuuuguaugaauuguuucuaacaaaccuugaucuguauauacuugugagggguuguuugguug

SEQ ID NO: 297790 - RNA, 64 nt, Homo Sapiens
auacaaaugaaguauggagguguguauguuuauauguauauaacaaaauauuuucauugugacc

SEQ ID NO: 297791 - RNA, 64 nt, Homo Sapiens
uaaggacuucacugcaaguuuuaguuaagagguuuguauauaaaucuguuauagaacaggcuga

SEQ ID NO: 297792 - RNA, 64 nt, Homo Sapiens
gugaaacuauauguauucacaguugauacauaguuguauauagaaaaugcuaaagaauccauaa

SEQ ID NO: 297793 - RNA, 64 nt, Homo Sapiens
aaguauuaaaacaguauuugaguuuaaaagaguuuguauauauuuaaaugaauaacuuuuuaua

SEQ ID NO: 297794 - RNA, 64 nt, Homo Sapiens
uuuuuuuuuuuuuuuaagaaaaggaauucuuuuguguauauauagauacuugcaugauauacug

SEQ ID NO: 297795 - RNA, 64 nt, Homo Sapiens
cuuaguuuuucuugaaaucauuguuuuauguaaguguauauauuaagugaauuauuccuuuuuu

SEQ ID NO: 297796 - RNA, 64 nt, Homo Sapiens
auccugcacugaaucuguguguuuuagguuuuauuguauauaaauuucauuuugguggaguuua

SEQ ID NO: 297797 - RNA, 64 nt, Homo Sapiens
cauauuuuuauacuuuauuguauugugacuucacuguauauaaauaaauuucccaguuaaagau

SEQ ID NO: 297798 - RNA, 64 nt, Homo Sapiens
uauuauucaaaaaaucauguagauguauuuuugauguauauaucgcacuaaccaaugccuuuuu

SEQ ID NO: 297799 - RNA, 64 nt, Homo Sapiens
agccucaacuagucauuuuuuuagaagcaaugaauguauauaaauccuuauuguuaaaaacaug

SEQ ID NO: 297800 - RNA, 64 nt, Homo Sapiens
uuaagaggucacgggggcuagaguauuugaaaaauguauauauauuguucaaacgggauucaca

SEQ ID NO: 297801 - RNA, 64 nt, Homo Sapiens
uagaaaauaauacaaacagauuugucuaaacauuuguauauaacuuuaaaaauagaauauuuuu

SEQ ID NO: 297802 - RNA, 64 nt, Homo Sapiens
uuauuuuucuuaauuuuuguggauacauaauauguguauauauguaugccauauaugguauauu

SEQ ID NO: 297803 - RNA, 64 nt, Homo Sapiens
uaggacaauauuuuaugugugugugugcgccuuauguauauaagcauauauauaauauauaagc

SEQ ID NO: 297804 - RNA, 64 nt, Homo Sapiens
aaccuguauguacguauauuucuguaucuauguauguauauauaugcauaugcagacauaugua

SEQ ID NO: 297805 - RNA, 64 nt, Homo Sapiens
cuuggagguuaugauuugccacguaguucuaaucuguauauaguguaaauuuuacauaaucugu

SEQ ID NO: 297806 - RNA, 64 nt, Homo Sapiens
caguucccaaaaguggagugggauugaaaggauauguauauacuauuauguaaaacuaaagaau

SEQ ID NO: 297807 - RNA, 64 nt, Homo Sapiens
guauauacacuauauacuggacacacacaauauauguauauauaauauauauauauacacacac

SEQ ID NO: 297808 - RNA, 64 nt, Homo Sapiens
gugugauguauaugugugugauauacuauauguguguauauaguauguauacuauacauaucac

SEQ ID NO: 297809 - RNA, 64 nt, Homo Sapiens
guaugugugauguauacuauauauacacauauaguguauauaguacacuauauacauauagugu

SEQ ID NO: 297810 - RNA, 64 nt, Homo Sapiens
cauauaguguauauaguguacuauauacauauaguguauauacacacacacacacacacacaca

SEQ ID NO: 297811 - RNA, 64 nt, Homo Sapiens
ccacauauguauuccauauaccauauaccauauauguauauauuauuccauauauguauauauu

SEQ ID NO: 297812 - RNA, 64 nt, Homo Sapiens
ccauauaccauauauguauaauguauuccauauauguauauauuuuccauguauguaugcauau

SEQ ID NO: 297813 - RNA, 64 nt, Homo Sapiens
ccacauauguauacauuccaauacauuccacguguguauauauuuguauauaguccccauaugu

SEQ ID NO: 297814 - RNA, 64 nt, Homo Sapiens
ccccauauguauacauuccaauacauuccacguguguauauaguuguauauauuccacauaugu

SEQ ID NO: 297815 - RNA, 64 nt, Homo Sapiens
ccacauauguauacauuccaguauguauuccacauguauauauucauguguauauauuccacgu

SEQ ID NO: 297816 - RNA, 64 nt, Homo Sapiens
ccacguguauguauuccacaauauauuccacauguguauauauuuccacauguguguaugugga

SEQ ID NO: 297817 - RNA, 64 nt, Homo Sapiens
ggaggguauuuuuuauuuguggguucaaaaaaucuguauauacagucuauguguuuagaauuug

SEQ ID NO: 297818 - RNA, 64 nt, Homo Sapiens
ccuuugccugaacacccauguagcugcuguguuguguauauauuacucuuaagaggagugugug

SEQ ID NO: 297819 - RNA, 64 nt, Homo Sapiens
aaauauauauacauauguagacuauauacauguguguauauauguguauauauacauacacuug

SEQ ID NO: 297820 - RNA, 64 nt, Homo Sapiens
acauauguagacuauauacauguguguauauauguguauauauacauacacuuguauaaaugua

SEQ ID NO: 297821 - RNA, 64 nt, Homo Sapiens
uauauauguguauauauacauacacuuguauaaauguauauacacauauaccuauaaugugugu

SEQ ID NO: 297822 - RNA, 64 nt, Homo Sapiens
ccguuucuuaaaaaacauauauguguguggcguguguauauauauguauauauauuuuuucauu

SEQ ID NO: 297823 - RNA, 64 nt, Homo Sapiens
aaaaacauauauguguguggcguguguauauauauguauauauauuuuuucauuguauuauuac

SEQ ID NO: 297824 - RNA, 64 nt, Homo Sapiens
gacagaaaccuuauccuacaccauugcugguuuguguauauaugacuguugcagauuccuucag

SEQ ID NO: 297825 - RNA, 64 nt, Homo Sapiens
aaucucuuagauuuuaauuuauccuguaaauuucuguauauauaauuuaauaacagaagccucc

SEQ ID NO: 297826 - RNA, 64 nt, Homo Sapiens
uacauacagacauacugaaggauacacacacuuguguauauaugcauguagagcuacagaucca

SEQ ID NO: 297827 - RNA, 64 nt, Homo Sapiens
gcgcauguagagcuacagaucauaugucuguagcuguauauaaauguguauauauguaugugug

SEQ ID NO: 297828 - RNA, 64 nt, Homo Sapiens
uaugugugcauaugucuguauucucaaccacguguguauauauggauacacacacaugcacagg

SEQ ID NO: 297829 - RNA, 64 nt, Homo Sapiens
uuucaaggucuguuuuucuagccccacuguauuauguauauauugggacuuuuagagccagcag

SEQ ID NO: 297830 - RNA, 64 nt, Homo Sapiens
uagcauaucaugggggacugccauccugggaguguguauauauggugcccguggcgucugcuuc

SEQ ID NO: 297831 - RNA, 64 nt, Homo Sapiens
uguacuucagaaaaaaauaauaauuuccauguuuuguauauaucugacaaaacuggcaacaucu

SEQ ID NO: 297832 - RNA, 64 nt, Homo Sapiens
aucugauuauauauauuuuauauauacuuauguauguauauauaauauauauagaaaucuggau

SEQ ID NO: 297833 - RNA, 64 nt, Homo Sapiens
gcuuuugggggucagcauccagugugagauacuguguauauaaacuauauauaauguauauaaa

SEQ ID NO: 297834 - RNA, 64 nt, Homo Sapiens
agugugagauacuguguauauaaacuauauauaauguauauaaacugggauguaaguuugugua

SEQ ID NO: 297835 - RNA, 64 nt, Homo Sapiens
agcuaaaauaguuacuucaaauuuucagaaaagauguauauagucaaaauuuaagauacaauuc

SEQ ID NO: 297836 - RNA, 64 nt, Homo Sapiens
uaccuuauuccaauacuauauuguugauaaaauuuguauauacauuuucaauaaagaauaugua

SEQ ID NO: 297837 - RNA, 64 nt, Homo Sapiens
uucuuuucagauaggcuuaacaaauggagcuuucuguauauaaauguggagauuagaguuaauc

SEQ ID NO: 297838 - RNA, 64 nt, Homo Sapiens
uucaugugaguuuuuaccguuaggaugauuaagauguauauaggacaaaauguuaagucuuucc

SEQ ID NO: 297839 - RNA, 64 nt, Homo Sapiens
acgggcuaagguaggguagaguggguguagugaguguauauaaugugauuuggcccuguguauu

SEQ ID NO: 297840 - RNA, 64 nt, Homo Sapiens
aggggcuaguauaucaguaggauauacuaugggauguauauauaucauugcuguuagagaaaug

SEQ ID NO: 297841 - RNA, 64 nt, Homo Sapiens
uaugguuauuggcuagaaauccugaguuuucaacuguauauaucuauaguuuguaaaaagaaca

SEQ ID NO: 297842 - RNA, 64 nt, Homo Sapiens
ggggcauccauuuagcuucagguugucuuguuucuguauauagugacauagcauucugcugcca

SEQ ID NO: 297843 - RNA, 64 nt, Homo Sapiens
uaugugaaauauuauuaucuugagagugauucucuguauauaaaugcuuaucuuggguuaaauu

SEQ ID NO: 297844 - RNA, 64 nt, Homo Sapiens
ugugaguuuaaacaaaaaccguaaaaaagaaaaauguauauagcaacuauauuuaagagacuuu

SEQ ID NO: 297845 - RNA, 64 nt, Homo Sapiens
cacagacacaugcauauacauauguacauauacauguauauacauguguauauauaugcaaaua

SEQ ID NO: 297846 - RNA, 64 nt, Homo Sapiens
ugcaaauauauguacauauaauuauaaaugcauguguauauauauagauaugcaugucuauaua

SEQ ID NO: 297847 - RNA, 64 nt, Homo Sapiens
agaaauguauuuuuaucugcuguagaaaucuacauguauauacagagcugaaucuuuucuuuca

SEQ ID NO: 297848 - RNA, 64 nt, Homo Sapiens
cucuagagacaucuuaggccgacacucacuuguguguauauaaacaaaaacaaaacaaaacagu

SEQ ID NO: 297849 - RNA, 64 nt, Homo Sapiens; identical to SEQ ID NO: 297835

SEQ ID NO: 297850 - RNA, 64 nt, Homo Sapiens; identical to SEQ ID NO: 297836

SEQ ID NO: 297851 - RNA, 64 nt, Homo Sapiens
uuaucuuuuucccuguuacaccauuuucaucuuaagacugcaugucacucucuuccuuuuugua

SEQ ID NO: 297852 - RNA, 64 nt, Homo Sapiens
uggagaaugaggaacugaagaaacugccgcucugagacugcacauccaggaaaaaagacuagga

SEQ ID NO: 297853 - RNA, 64 nt, Homo Sapiens
acuguauccaugcaugcaugauaaugcguggcagagacugcaacagggauuguguguucagaga

SEQ ID NO: 297854 - RNA, 64 nt, Homo Sapiens
cuguccguuuccaauagguaaagccauaucaguuagacugcaauacuuuaaacacgagacaaaa

SEQ ID NO: 297855 - RNA, 64 nt, Homo Sapiens
uccaagcaaguauuagaauaccacaggaaccacaagacugcacaucaaaauaugccccauucaa

SEQ ID NO: 297856 - RNA, 64 nt, Homo Sapiens
cacugccuucucaacuccaaacugacucuuaagaagacugcauuauauuuauuacuguaagaaa

SEQ ID NO: 297857 - RNA, 64 nt, Homo Sapiens
aucugaguuagaagccuauuaaauauaguugaguagacugcaucacacuuaagugugaauuuuu

SEQ ID NO: 297858 - RNA, 64 nt, Homo Sapiens
cagagugaggugagcaccauuugugauccucaggagacugcagagacauaggacaagcacaggu

SEQ ID NO: 297859 - RNA, 64 nt, Homo Sapiens
cgggguacuuuccuuaugguaaauguaaacauguagacugcauucgaggugaccuaaaguagag

SEQ ID NO: 297860 - RNA, 64 nt, Homo Sapiens
cuaacuuggcaugggcaaguugaaguucauccuuagacugcagcguucugagcauggcugaagu

SEQ ID NO: 297861 - RNA, 64 nt, Homo Sapiens
ugagacagagcagccacaggcagggagagccuucagacugcaacgcuggccugauacgugucaa

SEQ ID NO: 297862 - RNA, 64 nt, Homo Sapiens
gagggauagaggaggauugaauagaaggagacuaagacugcagcucuaagaaagucucagccaa

SEQ ID NO: 297863 - RNA, 64 nt, Homo Sapiens
accccuucccccccugcaucgauuggaggcagacagacugcacccuuaggcuuggagagcccca

SEQ ID NO: 297864 - RNA, 64 nt, Homo Sapiens
aacggagggguccugcagggacucagagagagcaagacugcagggggcaccuguuuccccagug

SEQ ID NO: 297865 - RNA, 64 nt, Homo Sapiens
acugugccucucaucaggugucacgauuuuucugccacuucaccuuagggagcuuccagugauu

SEQ ID NO: 297866 - RNA, 64 nt, Homo Sapiens
ggccuuggccacaucccuauuaacagaggcagcuccacuucagacagggacaaggcuuccugcu

SEQ ID NO: 297867 - RNA, 64 nt, Homo Sapiens
cuuaggcagauuugaccuuuaugugaauggccuuccacuucaguaacccuguggucugcacuac

SEQ ID NO: 297868 - RNA, 64 nt, Homo Sapiens
ggaagacgucaaacaagcugcguauguuuacaaaccacuucacuccaguagaagacagaaggaa

SEQ ID NO: 297869 - RNA, 64 nt, Homo Sapiens
gguggaaggaguuugggguuuuucaguagucccaccacuucauaauuaagcuuuuguaauuauu

SEQ ID NO: 297870 - RNA, 64 nt, Homo Sapiens
gcugaguucaguauacacaaucccagcaucuucuccacuucagcggcacagaccagugucugga

SEQ ID NO: 297871 - RNA, 64 nt, Homo Sapiens
agaaacuuaguuuuuagaauaaauauuaauuuuuccacuucaguuuuauucuagaaaauacccu

SEQ ID NO: 297872 - RNA, 64 nt, Homo Sapiens
uuacaauuauguugacuagaaacugccuuuuucuccacuucauuucuagcaauuauuuaccaag

SEQ ID NO: 297873 - RNA, 64 nt, Homo Sapiens
cugauuaaaaauucuuccauagucuagaaaacgcccacuucauuaauauuuuauuuucauggug

SEQ ID NO: 297874 - RNA, 64 nt, Homo Sapiens
uauuuuucgucaugguacuuuguuagugucuaggccacuucauuuucuuuaacucagauauuuu

SEQ ID NO: 297875 - RNA, 64 nt, Homo Sapiens
ccagagagauuauaagaacucugcaaugaagcagccacuucagcuuuuuaaacaagguccaacc

SEQ ID NO: 297876 - RNA, 64 nt, Homo Sapiens
caagcccagagaaguguggguuugccagagguggccacuucagcgcugggcucuguucccagcg

SEQ ID NO: 297877 - RNA, 64 nt, Homo Sapiens
ccucggugggcauucacaccaacaaaucugcaccccacuucagacgaguaacuuucugcugaug

SEQ ID NO: 297878 - RNA, 64 nt, Homo Sapiens
ccccugaugggcccugacucggaggcacccuuagccacuucauucacuuguggcuauuagagcu

SEQ ID NO: 297879 - RNA, 64 nt, Homo Sapiens
aucuacaaaaugggccucauggaauggaaugucuccacuucacuccagcaucaacaagugggga

SEQ ID NO: 297880 - RNA, 64 nt, Homo Sapiens
uuccuucaagccaagucauccccuugggcucucaccacuucaguuuauaccuugccuguagucc

SEQ ID NO: 297881 - RNA, 64 nt, Homo Sapiens
gucccucaccaacaagccaacugccacagaugacccacuucauaccacauucacaucuuuccac

SEQ ID NO: 297882 - RNA, 64 nt, Homo Sapiens
gcuguucuugaacuccuggccucaaaugaucuucccacuucagccucccaaagugcagggauua

SEQ ID NO: 297883 - RNA, 64 nt, Homo Sapiens
agucccccuaacaaacagcccuucacuuccucucccacuucagcaauuuguauuuugaugccau

SEQ ID NO: 297884 - RNA, 64 nt, Homo Sapiens
uuuuacucucacccugcuccuguaccagcaggggccacuucaaagccaagguacagggugauaa

SEQ ID NO: 297885 - RNA, 64 nt, Homo Sapiens
guagcuggugauacccuguccuguggaaggacuuccacuucaacacuuccacuucaacaguucc

SEQ ID NO: 297886 - RNA, 64 nt, Homo Sapiens
ccuguccuguggaaggacuuccacuucaacacuuccacuucaacaguucccgcacggccugaac

SEQ ID NO: 297887 - RNA, 64 nt, Homo Sapiens
acgagugacucuggguggacaguggugucaugacccacuucaaggggccuaccuccugccaguu

SEQ ID NO: 297888 - RNA, 64 nt, Homo Sapiens
gaagugccaucaggguggccgcagcugcagagagccacuucaccugagaccacgcccuuccugg

SEQ ID NO: 297889 - RNA, 64 nt, Homo Sapiens
cuguaaauauugcauauuuuauguauuuggaccaaaagguuacaaguaauuagacaaaaguggu

SEQ ID NO: 297890 - RNA, 64 nt, Homo Sapiens
caccauacuguaagcauuuuagguagauugccuuaaagguuaugggagggcaugagggaacacu

SEQ ID NO: 297891 - RNA, 64 nt, Homo Sapiens
ggcuggaugccagaagguucuuugagccaguuucaaagguuacuuguuuuuuuuuuuuuuuuuu

SEQ ID NO: 297892 - RNA, 64 nt, Homo Sapiens
ccuucuuucugcaaggcagaggaauaauauuuuuaaagguuauuuuguuuuaguuuuaaauagc

SEQ ID NO: 297893 - RNA, 64 nt, Homo Sapiens
gaaacggucccaagaaaaucauauugugaagggcaaagguuacauggcaaaaccaauauuuucu

SEQ ID NO: 297894 - RNA, 64 nt, Homo Sapiens
uuuucugccacaugaaguagcuguaaaauggggaaaagguuaccaggucuguaacugguuuugu

SEQ ID NO: 297895 - RNA, 64 nt, Homo Sapiens
uacauggcagaauacauguagauacauaauuuggaaagguuauuugacaugaugcaaauagacu

SEQ ID NO: 297896 - RNA, 64 nt, Homo Sapiens
auugacaucccaauauuuugccagccauuuuuaaaaagguuauuuauuuucucugucugaagaa

SEQ ID NO: 297897 - RNA, 64 nt, Homo Sapiens
auuggugacaaugucacauaaugaaugcuauugaaaagguuaacagauacagcucggaguugug

SEQ ID NO: 297898 - RNA, 64 nt, Homo Sapiens
uguagaguggcccagaauugcauucugaaugaauaaagguuaaaaaaaaauccccagugcaugu

SEQ ID NO: 297899 - RNA, 64 nt, Homo Sapiens
uuaaacuuaccuaagaagaucuagaaagaugaacaaagguuaaucuuuuuaauuauuuaaaacu

SEQ ID NO: 297900 - RNA, 64 nt, Homo Sapiens
ggucugaagcagcuguuuagacuaucccuuuucuaaagguuaaaagacguguuuuuaaaauucc

SEQ ID NO: 297901 - RNA, 64 nt, Homo Sapiens
ggcuuccacauuccugaagcacacagaucucaggaaagguuauuuuugcacuucauauuuguuu

SEQ ID NO: 297902 - RNA, 64 nt, Homo Sapiens
auuucuaauuuuuuucacauaaaacaauuauccuaaagguuaauaguugaucgaaacagaauaa

SEQ ID NO: 297903 - RNA, 64 nt, Homo Sapiens
guggaggcauaaguagaagaaggaaaacaaguacaaagguuacgguucugacacuuuccccagg

SEQ ID NO: 297904 - RNA, 64 nt, Homo Sapiens
aggccagguuacccaccaguuugcuugcuauuaaaaagguuaaggauugcauuacuucuguaug

SEQ ID NO: 297905 - RNA, 64 nt, Homo Sapiens
uaccuauauuuuauacuguuucaauguacaggagaaagguuacuguaaacuguguuauguuggu

SEQ ID NO: 297906 - RNA, 64 nt, Homo Sapiens
aucccuaauauuuaaaaaaaaaaacaaaacaaaaaaagguuacaaaguuuguuaacuugcuauc

SEQ ID NO: 297907 - RNA, 64 nt, Homo Sapiens
uucugaaagaaaaauaacuguagguuacuacaaaaaagguuauaauuaaguccuauugcuagaa

SEQ ID NO: 297908 - RNA, 64 nt, Homo Sapiens
gaacuggagggggugagcuuuuaaucccaagggaaaagguuaugaaguaugacagagcagggcc

SEQ ID NO: 297909 - RNA, 64 nt, Homo Sapiens
acgaauuuuguuguacaaaauucuaaaaaugauaaaagguuauuuuaucuauauauuuaaaguu

SEQ ID NO: 297910 - RNA, 64 nt, Homo Sapiens
uguacaguuccuauuuuagcuuuuaauaccauaaaaagguuauauuagccagcuaaguucaucu

SEQ ID NO: 297911 - RNA, 64 nt, Homo Sapiens
auuauauucuuucguguuuuuaaauauagaaaaaugaaaccaucucauuaggaucacacagagu

SEQ ID NO: 297912 - RNA, 64 nt, Homo Sapiens
uaaagaauucuuuugaggaugguuaagcagcuuaugaaaccauauuagcugacguaaccagcuu

SEQ ID NO: 297913 - RNA, 64 nt, Homo Sapiens
aggaaucaaaagagaaaaaaguuucugaaaacaaugaaaccauaaaagauaauauucuaaaaac

SEQ ID NO: 297914 - RNA, 64 nt, Homo Sapiens
guggaaguuaagguguugaccacugugccugaaaugaaaccacaaggcuugagaauagaaauua

SEQ ID NO: 297915 - RNA, 64 nt, Homo Sapiens
aguccaggaguccaaguagaucucgaaguaaaucugaaaccaaaucaagacacagaacaagguc

SEQ ID NO: 297916 - RNA, 64 nt, Homo Sapiens
uuacuacuuuuuuuaaacuuguuucuaaauucuuugaaaccacugcuaaucuauagacaccaca

SEQ ID NO: 297917 - RNA, 64 nt, Homo Sapiens
ggaugcacagucuaaaugaauggcuguucaucuuugaaaccaggcauaugucugaggcacaagu

SEQ ID NO: 297918 - RNA, 64 nt, Homo Sapiens
ccuaaauaauuacaccaacuaggucucauuacaaugaaaccaaugaauccaagugacugugaaa

SEQ ID NO: 297919 - RNA, 64 nt, Homo Sapiens
uuuuaaguguuaaaugaaucuuuaauuuuuuaaaugaaaccauauuuugaaguguugaaguauu

SEQ ID NO: 297920 - RNA, 64 nt, Homo Sapiens
cuuuggggaauuuuggccaggagacccugaaacaugaaaccaaacaggcuuugauauuuuuuuu

SEQ ID NO: 297921 - RNA, 64 nt, Homo Sapiens
gcuguggcuuugagaaguuaacuuuuguggaauaugaaaccaaaggaagaauuuccauguagau

SEQ ID NO: 297922 - RNA, 64 nt, Homo Sapiens
ucaugggaauuacauaaggauaaugaggcccaacugaaaccaaguuucagucugccuuaccuuu

SEQ ID NO: 297923 - RNA, 64 nt, Homo Sapiens
cuaagccugaugaaaugugcuccuucaaucuccaugaaaccaucguaacauggaggccucagcu

SEQ ID NO: 297924 - RNA, 64 nt, Homo Sapiens
acuaaaaggauucagaugcaauuuucaacuauucugaaaccagcaggacacaccugacuuuaau

SEQ ID NO: 297925 - RNA, 64 nt, Homo Sapiens
gcagaucugacugggccuaaauuaaguagcuuaaugaaaccauguaauuacuuguucuccuuuc

SEQ ID NO: 297926 - RNA, 64 nt, Homo Sapiens
cagcuccucaggaggcugaggcaggagaauugcuugaaaccaggaggcggagguugcagugagc

SEQ ID NO: 297927 - RNA, 64 nt, Homo Sapiens
gccgauggagguuucaaagauguagcuagcauuuugaaaccauaugggcaaaacccggcaacca

SEQ ID NO: 297928 - RNA, 64 nt, Homo Sapiens
gacaaccgugggggaacacaccacuuuuuacuguugaaaccaacacaacguugaaauccaggcu

SEQ ID NO: 297929 - RNA, 64 nt, Homo Sapiens
caaugugguugacuaccuuuugauaagcaaaauuugaaaccauuuaaagaccacuguauuuuaa

SEQ ID NO: 297930 - RNA, 64 nt, Homo Sapiens
uggcccuucugaaacuuauggucaucucucccacugaaaccaaggucuuuucaaauguggcuaa

SEQ ID NO: 297931 - RNA, 64 nt, Homo Sapiens
ucuaaccugcuuaaauaagaguuuggugagaaagugaaaccaccugaucuugaaucaauguuga

SEQ ID NO: 297932 - RNA, 64 nt, Homo Sapiens
acagggugaggcccugcuucuuuuccuaagagucugaaaccauuccauuucauuuuggugaaau

SEQ ID NO: 297933 - RNA, 64 nt, Homo Sapiens
uggcucauggagaaaacaaaugacuuagggaacuugaaaccaacacugccgcaagaccacuaca

SEQ ID NO: 297934 - RNA, 64 nt, Homo Sapiens
uugaaugaauagauugguuugugaagaucgcuugugaaaccauuuuguagauaaccccaaagau

SEQ ID NO: 297935 - RNA, 64 nt, Homo Sapiens
gcccaugguuuuauuucagaagcacaugagggugugaaaccacucuguuaccuuucuguauugu

SEQ ID NO: 297936 - RNA, 64 nt, Homo Sapiens
cuggguaucuagcuuacuguuuuaacaucauuguugaaaccagacccuguaguccaguggugcu

SEQ ID NO: 297937 - RNA, 64 nt, Homo Sapiens
uaaaaugugcuguuucagcauguguguacaccuaugaaaccaccacagucaagauauccaacac

SEQ ID NO: 297938 - RNA, 64 nt, Homo Sapiens
aagcaacagcaagcauuuucuauaauuuuauaaaugaaaccauaugguguguacuuuuuagggg

SEQ ID NO: 297939 - RNA, 64 nt, Homo Sapiens
cugcagccucaacaccaugggucuguaaaaugugugaaaccaaauacugauugcugucucgugu

SEQ ID NO: 297940 - RNA, 64 nt, Homo Sapiens
uucucuacaaaaaauacauaccugggcagaauggugaaaccaccgccccgguacucaagaccag

SEQ ID NO: 297941 - RNA, 64 nt, Homo Sapiens
uucgaggcuccuucuggacuuaaauuccaccucaugaaaccacucacagcaucuucaccaggag

SEQ ID NO: 297942 - RNA, 64 nt, Homo Sapiens
cuggacaacauauagcaagaugagcucaggaguuugaaaccagcgccaaggcaggaagauugcu

SEQ ID NO: 297943 - RNA, 64 nt, Homo Sapiens
ugaucauucugauaaaggaacgaguucucaaaggugaaaccagauuuuacaugggguuguagau

SEQ ID NO: 297944 - RNA, 64 nt, Homo Sapiens
aucauguucuucuaaaguguagaggucuugcuuuugaaaccaaaggccccuucugccuuccagg

SEQ ID NO: 297945 - RNA, 64 nt, Homo Sapiens; identical to SEQ ID NO: 124124

SEQ ID NO: 297946 - RNA, 64 nt, Homo Sapiens; identical to SEQ ID NO: 124125

SEQ ID NO: 297947 - RNA, 64 nt, Homo Sapiens; identical to SEQ ID NO: 124126

SEQ ID NO: 297948 - RNA, 64 nt, Homo Sapiens; identical to SEQ ID NO: 124127

SEQ ID NO: 297949 - RNA, 64 nt, Homo Sapiens; identical to SEQ ID NO: 124128

SEQ ID NO: 297950 - RNA, 64 nt, Homo Sapiens; identical to SEQ ID NO: 124129

SEQ ID NO: 297951 - RNA, 64 nt, Homo Sapiens; identical to SEQ ID NO: 124130

SEQ ID NO: 297952 - RNA, 64 nt, Homo Sapiens; identical to SEQ ID NO: 124131

SEQ ID NO: 297953 - RNA, 64 nt, Homo Sapiens; identical to SEQ ID NO: 124132

SEQ ID NO: 297954 - RNA, 64 nt, Homo Sapiens; identical to SEQ ID NO: 124133

SEQ ID NO: 297955 - RNA, 64 nt, Homo Sapiens; identical to SEQ ID NO: 124134

SEQ ID NO: 297956 - RNA, 64 nt, Homo Sapiens; identical to SEQ ID NO: 124135

SEQ ID NO: 297957 - RNA, 64 nt, Homo Sapiens; identical to SEQ ID NO: 124136

SEQ ID NO: 297958 - RNA, 64 nt, Homo Sapiens; identical to SEQ ID NO: 124137

SEQ ID NO: 297959 - RNA, 64 nt, Homo Sapiens; identical to SEQ ID NO: 124138

SEQ ID NO: 297960 - RNA, 64 nt, Homo Sapiens; identical to SEQ ID NO: 124139

SEQ ID NO: 297961 - RNA, 64 nt, Homo Sapiens; identical to SEQ ID NO: 124140

SEQ ID NO: 297962 - RNA, 64 nt, Homo Sapiens; identical to SEQ ID NO: 124141

SEQ ID NO: 297963 - RNA, 64 nt, Homo Sapiens; identical to SEQ ID NO: 124142

SEQ ID NO: 297964 - RNA, 64 nt, Homo Sapiens; identical to SEQ ID NO: 124143

SEQ ID NO: 297965 - RNA, 64 nt, Homo Sapiens; identical to SEQ ID NO: 124144

SEQ ID NO: 297966 - RNA, 61 nt, Homo Sapiens; identical to SEQ ID NO: 124145

SEQ ID NO: 297967 - RNA, 64 nt, Homo Sapiens; identical to SEQ ID NO: 124146

SEQ ID NO: 297968 - RNA, 64 nt, Homo Sapiens; identical to SEQ ID NO: 124147

SEQ ID NO: 297969 - RNA, 64 nt, Homo Sapiens
aauuuuuuuaaaauucaccuuuuaagaauuguuccuuggggaaaucuucccuguaacugaaagu

SEQ ID NO: 297970 - RNA, 64 nt, Homo Sapiens
gguaaagauugugaguaaauggaacaaauuuguacuuggggauuuuauggcaguuuauaauaua

SEQ ID NO: 297971 - RNA, 64 nt, Homo Sapiens
agugaggccagucugcccggaggucauuuggacacuuggggaaaccaguguccccagcacuuuu

SEQ ID NO: 297972 - RNA, 64 nt, Homo Sapiens
gcuuuuuaucugaauuaucaaaauuuuguccucucuuggggacucaggguguuuggaucagauc

SEQ ID NO: 297973 - RNA, 64 nt, Homo Sapiens
ugggcuuguucuuguggcuucugaugauuucugacuuggggaaaaauggggaagaguugaaaua

SEQ ID NO: 297974 - RNA, 64 nt, Homo Sapiens
uggagggugagggcugagugcccuggcuuccucacuuggggagaccaugggucucuguagaaau

SEQ ID NO: 297975 - RNA, 64 nt, Homo Sapiens
uguuuucugaaccaguucuuuucuguuggagaaacuuggggaagcaggcccugcagccacagug

SEQ ID NO: 297976 - RNA, 64 nt, Homo Sapiens
aagaggccugcugugggggcauggagaggaaaaacuuggggagguaaaauagugcuuuuuugaa

SEQ ID NO: 297977 - RNA, 64 nt, Homo Sapiens
cuugggaaucauucuggcuuacaaacagcccuuccuuggggaaaacuccuccgagacccaggag

SEQ ID NO: 297978 - RNA, 64 nt, Homo Sapiens
ucuggucaaccccacaagcaauggcgcuaggggacuuggggauuaggcacaacuucagcagggg

SEQ ID NO: 297979 - RNA, 64 nt, Homo Sapiens
gagucuguguuugagagggggucugccauuccugcuuggggacugguggggaagagggccagga

SEQ ID NO: 297980 - RNA, 64 nt, Homo Sapiens
gaggcuccaccuccaagcucagacagggcccaggcuuggggaacagagagagcagguguacacc

SEQ ID NO: 297981 - RNA, 64 nt, Homo Sapiens
cugccucgugucgucuuuauccgccccgccuccacuuggggacccgcccccauccucucacguc

SEQ ID NO: 297982 - RNA, 64 nt, Homo Sapiens
cuggguggugguuacacaguaucugggcugcucucuuggggacaggucucgugguggagccaug

SEQ ID NO: 297983 - RNA, 64 nt, Homo Sapiens
auagccgauagagagacuugcucuaaaaagaaaacuuggggaucuauuaucagcaucauaguuu

SEQ ID NO: 297984 - RNA, 64 nt, Homo Sapiens
agauccaagucuaaacacaaacauaaugagguaucuuggggaugauuugggaauauuugcaugu

SEQ ID NO: 297985 - RNA, 64 nt, Homo Sapiens
aagcaauuucuaucuguccccuucacuuucaggccuuggggagucucugcuccuaccugacucu

SEQ ID NO: 297986 - RNA, 64 nt, Homo Sapiens
gggggcagcagcagccuccugaccaaugcccgcucuuggggagugaggauucugcacguggaug

SEQ ID NO: 297987 - RNA, 64 nt, Homo Sapiens
gagucaggagaacuguuccuugugguuuccgucccuuggggaccacaggcaucagcagucccau

SEQ ID NO: 297988 - RNA, 64 nt, Homo Sapiens
gguuaucaccagacugugaguuucuggcaaguagcuuggggaagcugaauaaacucuaggccca

SEQ ID NO: 297989 - RNA, 64 nt, Homo Sapiens
cagaaaagcuguauuuaacucuugcuauuuguaacuuggggauggucuccccugccccagggca

SEQ ID NO: 297990 - RNA, 64 nt, Homo Sapiens
aaaugacacccuuccucgccuguuggugcuggcccuuggggagcuggagcccagcaugcugggg

SEQ ID NO: 297991 - RNA, 64 nt, Homo Sapiens
cagcgcccagguccaagucugagccugaccuccccuuggggaccuagccuggagucaggacaaa

SEQ ID NO: 297992 - RNA, 64 nt, Homo Sapiens
ugaguuugggugggguggcacugugucucugucucuuggggaccccacguggaacagacagccc

SEQ ID NO: 297993 - RNA, 64 nt, Homo Sapiens
cuggaacuugccugcuaaaugauggagccagaggcuuggggaauacuucagcugcugguguucu

SEQ ID NO: 297994 - RNA, 58 nt, Homo Sapiens
ggaguaugccaagaacucacgggccucccuccggaagugcucagucauguucauaggu

SEQ ID NO: 297995 - RNA, 58 nt, Homo Sapiens
aguccuguggugaagagacuuguuucaucuccggaaaugcaaaaccauuuauagcaug

SEQ ID NO: 297996 - RNA, 58 nt, Homo Sapiens
guguccugcuagccagccgaacacuucucuccggaagcaggcugguucgacugugagg

SEQ ID NO: 297997 - RNA, 58 nt, Homo Sapiens
cucuggccccaagcuggccggcgcccuucuccggaaggcguccgccccgggcuuggac

SEQ ID NO: 297998 - RNA, 58 nt, Homo Sapiens
cucgcuguggcucccccgcucuugcaggcuccggaaccagcugagcccgggacuccgc

SEQ ID NO: 297999 - RNA, 58 nt, Homo Sapiens
caccaccuuucccuucagcacugugugccuccggaagauguguaaccuguaagaugua

SEQ ID NO: 298000 - RNA, 58 nt, Homo Sapiens
cggggcgggggaggggagguaggacccgcuccggaaggcgcuguuugaagcuugucgg

SEQ ID NO: 298001 - RNA, 58 nt, Homo Sapiens
gccaagggaacggauucuccucuagagucuccggaaggaacacagcucuugacacaug

SEQ ID NO: 298002 - RNA, 58 nt, Homo Sapiens
gaaucugaaugcuauacuggauacucugcuccggaaagaugagcuuuuuauucuacua

SEQ ID NO: 298003 - RNA, 58 nt, Homo Sapiens
aagccccguuccuccgcagacccaggcccuccggaaggggugaguggggaggggcuuu

SEQ ID NO: 298004 - RNA, 58 nt, Homo Sapiens
cuggcaucugcuugguuucuggggaggccuccggaagcuuauagucaugacagaaggu

SEQ ID NO: 298005 - RNA, 58 nt, Homo Sapiens
cuuucuguuuuuacuggaaaaucauggacuccggaaagagccaugacacgauggccag

SEQ ID NO: 298006 - RNA, 58 nt, Homo Sapiens
uuccuaccacugcugcaugaguauaaugcuccggaauuaucagaaagcauaaugcaga

SEQ ID NO: 298007 - RNA, 58 nt, Homo Sapiens
ccuggggaagcagucccggcccccaccccuccggaaucucccaccccccacccuccuc

SEQ ID NO: 298008 - RNA, 58 nt, Homo Sapiens
gccguccgcgcuccgcucugacccaggacuccggaaaaggccaaggcgccagaugcag

SEQ ID NO: 298009 - RNA, 58 nt, Homo Sapiens
caauauguaagguuuucaguaguuuacccuccggaacccaaguuguauguauguauac

SEQ ID NO: 298010 - RNA, 58 nt, Homo Sapiens
ggaaugcuagcagggcauggcacgugagcuccggaauagaugucuucaucacuucuuc

SEQ ID NO: 298011 - RNA, 58 nt, Homo Sapiens
cuaaacaagauacuucuugguuaaggcccuccggaagggaaaggcuacggggcaugug

SEQ ID NO: 298012 - RNA, 58 nt, Homo Sapiens
aggagaaacauugcaguggcgaggaaagcuccggaagagaguacaugugagacuaugg

SEQ ID NO: 298013 - RNA, 58 nt, Homo Sapiens
augacucuccuguggccucaacugauaacuccggaagacuccagugauggauggaugg

SEQ ID NO: 298014 - RNA, 58 nt, Homo Sapiens
gugcuguccuggagugccugguguuguccuccggaaugcuggugccggaacucgcuau

SEQ ID NO: 298015 - RNA, 58 nt, Homo Sapiens
ccacucaggcuucauccugcacaauaaacuccggaagcaagucaguagagcuggcucc

SEQ ID NO: 298016 - RNA, 58 nt, Homo Sapiens
ugucgacuucaugacaagcacucgcagccuccggaagcugugggcauuucuugcgagc

SEQ ID NO: 298017 - RNA, 58 nt, Homo Sapiens
cugccaccugugacugucugcagaccaccuccggaaucugcccugguggugggggggc

SEQ ID NO: 298018 - RNA, 58 nt, Homo Sapiens
gccuugcacaaauaggcgcugcugcccucuccggaagugggcgaggccugagcugcgg

SEQ ID NO: 298019 - RNA, 58 nt, Homo Sapiens
cauaccuaguggcuguguagcaggaaugcuccggaauuguggcggcuccggcggaugu

SEQ ID NO: 298020 - RNA, 58 nt, Homo Sapiens
ccacugggcccugccuucagccuccucacuccggaaaugcauguuuccuugaugcagg

SEQ ID NO: 298021 - RNA, 58 nt, Homo Sapiens
guggagguuucucuucuaagcuaacgugcuccggaagggcagugagagagggaaggga

SEQ ID NO: 298022 - RNA, 58 nt, Homo Sapiens
cacaggcgagucccugcccuacagccgccuccggaauggugccucacugccaccaggc

SEQ ID NO: 298023 - RNA, 58 nt, Homo Sapiens
auguguuuccuugaugcaggcuuccucacuccggaaacccucuaggcccugccuucag

SEQ ID NO: 298024 - RNA, 58 nt, Homo Sapiens
agacacaggccaggccuggggcgcauggcuccggaagccauucaucccagcacaggca

SEQ ID NO: 298025 - RNA, 58 nt, Homo Sapiens
auuauagcuaaguuuugucagcagcauacuccggaaagucucauacuucuugggaguc

SEQ ID NO: 298026 - RNA, 58 nt, Homo Sapiens
uaucuagauaaguuuguuuacuuaugcccuccggaaaucaugcaagacugcucccugc

SEQ ID NO: 298027 - RNA, 58 nt, Homo Sapiens
ugcucuugccauaaucaacuagcagcuucuccggaagcgcugcccccagccagcuccc

SEQ ID NO: 298028 - RNA, 58 nt, Homo Sapiens
accagcaugauauuuucagagcauagaacuccggaaugaucuuuuaauaugcuguggg

SEQ ID NO: 298029 - RNA, 58 nt, Homo Sapiens
agacgucuccacggagcccugaacgggacuccggaagagcugcugcuaucuuccaaga

SEQ ID NO: 298030 - RNA, 58 nt, Homo Sapiens
gauuuuuuguuucucuagguaaagaauucuccggaaauccuaucaaggucucauuugc

SEQ ID NO: 298031 - RNA, 58 nt, Homo Sapiens
cacacaaaugaguggguugcugugcugucuccggaagauucugucguugcccuuggcc

SEQ ID NO: 298032 - RNA, 58 nt, Homo Sapiens
caagcugccacuggucggccaguacagccuccggaagcagcccuacaacaaccugaag

SEQ ID NO: 298033 - RNA, 58 nt, Homo Sapiens
ucugaccucuguuuccuccgcugcccaccuccggaacuaaugaucuguuaacaaagga

SEQ ID NO: 298034 - RNA, 58 nt, Homo Sapiens
aaagagaacgggccaagacugucaucugcuccggaaggcacugaaccgagaagggacg

SEQ ID NO: 298035 - RNA, 58 nt, Homo Sapiens
ugagcuccccuucccuucuccccuccagcuccggaaccccaggccuuccuggacuccu

SEQ ID NO: 298036 - RNA, 58 nt, Homo Sapiens
ugguggcacaugccuguaaucccagcuacuccggaagcugaggcaggagaauggcuug

SEQ ID NO: 298037 - RNA, 58 nt, Homo Sapiens
ggccuuucccugcgccgugcccacccuccuccggaaucucccuucccuuccuggccac

SEQ ID NO: 298038 - RNA, 58 nt, Homo Sapiens
cccccacgaccuucuguacggauuugcucuccggaaggaauucugguuucgcgugauc

SEQ ID NO: 298039 - RNA, 58 nt, Homo Sapiens
guggccggaggacccgcccccuccuuugcuccggaaucucuccucccucgcccggccc

SEQ ID NO: 298040 - RNA, 58 nt, Homo Sapiens
cuuuuuaauuuauggacuagucucauuacuccggaauuaugcucuuguaccugugugg

SEQ ID NO: 298041 - RNA, 58 nt, Homo Sapiens
ugguagguaauaaaucuguaucagaugacuccggaaaugugggaggagagaauuacug

SEQ ID NO: 298042 - RNA, 58 nt, Homo Sapiens
cacuuacccucuggggccucagcuuucccuccggaaggcugggaggaggugggcuaga

SEQ ID NO: 298043 - RNA, 58 nt, Homo Sapiens
cuuggggagcacuuguccacgcuuccgucuccggaaucuguugcagccugcagcaagu

SEQ ID NO: 298044 - RNA, 58 nt, Homo Sapiens
cucaaggugccuccuccucuagccucgacuccggaaguugggcuggggaacccuggag

SEQ ID NO: 298045 - RNA, 58 nt, Homo Sapiens
acacagucaggggccgggcacucggcagcuccggaagggccaggcccucucugcaguc

SEQ ID NO: 298046 - RNA, 58 nt, Homo Sapiens
uguaguccugcccuaacccaaucaucaccuccggaaagcaccaccaccacucaccacc

SEQ ID NO: 298047 - RNA, 64 nt, Homo Sapiens; identical to SEQ ID NO: 211620

SEQ ID NO: 298048 - RNA, 64 nt, Homo Sapiens; identical to SEQ ID NO: 211621

SEQ ID NO: 298049 - RNA, 64 nt, Homo Sapiens; identical to SEQ ID NO: 211622

SEQ ID NO: 298050 - RNA, 64 nt, Homo Sapiens; identical to SEQ ID NO: 211623

SEQ ID NO: 298051 - RNA, 64 nt, Homo Sapiens; identical to SEQ ID NO: 211624

SEQ ID NO: 298052 - RNA, 64 nt, Homo Sapiens; identical to SEQ ID NO: 211625

SEQ ID NO: 298053 - RNA, 64 nt, Homo Sapiens; identical to SEQ ID NO: 211626

SEQ ID NO: 298054 - RNA, 64 nt, Homo Sapiens; identical to SEQ ID NO: 211627

SEQ ID NO: 298055 - RNA, 64 nt, Homo Sapiens; identical to SEQ ID NO: 211628

SEQ ID NO: 298056 - RNA, 64 nt, Homo Sapiens; identical to SEQ ID NO: 211629

SEQ ID NO: 298057 - RNA, 64 nt, Homo Sapiens; identical to SEQ ID NO: 211630

SEQ ID NO: 298058 - RNA, 64 nt, Homo Sapiens; identical to SEQ ID NO: 211631

SEQ ID NO: 298059 - RNA, 64 nt, Homo Sapiens; identical to SEQ ID NO: 211632

SEQ ID NO: 298060 - RNA, 64 nt, Homo Sapiens; identical to SEQ ID NO: 211633

SEQ ID NO: 298061 - RNA, 64 nt, Homo Sapiens; identical to SEQ ID NO: 211634

SEQ ID NO: 298062 - RNA, 64 nt, Homo Sapiens; identical to SEQ ID NO: 211635

SEQ ID NO: 298063 - RNA, 64 nt, Homo Sapiens; identical to SEQ ID NO: 211636

SEQ ID NO: 298064 - RNA, 64 nt, Homo Sapiens; identical to SEQ ID NO: 211637

SEQ ID NO: 298065 - RNA, 64 nt, Homo Sapiens; identical to SEQ ID NO: 211638

SEQ ID NO: 298066 - RNA, 64 nt, Homo Sapiens; identical to SEQ ID NO: 91879

SEQ ID NO: 298067 - RNA, 64 nt, Homo Sapiens; identical to SEQ ID NO: 91880

SEQ ID NO: 298068 - RNA, 64 nt, Homo Sapiens; identical to SEQ ID NO: 91881

SEQ ID NO: 298069 - RNA, 64 nt, Homo Sapiens; identical to SEQ ID NO: 91882

SEQ ID NO: 298070 - RNA, 64 nt, Homo Sapiens; identical to SEQ ID NO: 91883

SEQ ID NO: 298071 - RNA, 64 nt, Homo Sapiens; identical to SEQ ID NO: 91884

SEQ ID NO: 298072 - RNA, 64 nt, Homo Sapiens; identical to SEQ ID NO: 91885

SEQ ID NO: 298073 - RNA, 64 nt, Homo Sapiens; identical to SEQ ID NO: 91886

SEQ ID NO: 298074 - RNA, 64 nt, Homo Sapiens; identical to SEQ ID NO: 91887

SEQ ID NO: 298075 - RNA, 64 nt, Homo Sapiens; identical to SEQ ID NO: 91888

SEQ ID NO: 298076 - RNA, 64 nt, Homo Sapiens; identical to SEQ ID NO: 91889

SEQ ID NO: 298077 - RNA, 64 nt, Homo Sapiens; identical to SEQ ID NO: 91890

SEQ ID NO: 298078 - RNA, 64 nt, Homo Sapiens; identical to SEQ ID NO: 91891

SEQ ID NO: 298079 - RNA, 64 nt, Homo Sapiens; identical to SEQ ID NO: 91892

SEQ ID NO: 298080 - RNA, 64 nt, Homo Sapiens; identical to SEQ ID NO: 91893

SEQ ID NO: 298081 - RNA, 64 nt, Homo Sapiens; identical to SEQ ID NO: 91894

SEQ ID NO: 298082 - RNA, 64 nt, Homo Sapiens; identical to SEQ ID NO: 91895

SEQ ID NO: 298083 - RNA, 64 nt, Homo Sapiens; identical to SEQ ID NO: 91896

SEQ ID NO: 298084 - RNA, 64 nt, Homo Sapiens
auuaauacugguucauuuguaaauuauuauucauauagaccacuguaguagauaaaacucuaug

SEQ ID NO: 298085 - RNA, 64 nt, Homo Sapiens
cagacuuuuuuggaaguuuccgagaggagggucuauagaccauuugucagaaaucagaucagcc

SEQ ID NO: 298086 - RNA, 64 nt, Homo Sapiens
ucuuuggauaauuuucaucgcauauccagcaacuauagaccaaaguuugcuuaagguuugaccc

SEQ ID NO: 298087 - RNA, 64 nt, Homo Sapiens
aaggaaaguuaugauccuccaagacccuuaauugauagaccauaccagguucugcaggucagca

SEQ ID NO: 298088 - RNA, 64 nt, Homo Sapiens
ucuugaggugacuuauuuugcauagaggauauggauagaccaacaguaaggguuguggguuaua

SEQ ID NO: 298089 - RNA, 64 nt, Homo Sapiens
ucucuaaagaaucuuuaguuuccgacguugaauuauagaccaguuugaguaaguacugcuuuuu

SEQ ID NO: 298090 - RNA, 64 nt, Homo Sapiens
cucugugauguucauacaguaucaucagggucuguguaaguauaguguaacaggcuauauacau

SEQ ID NO: 298091 - RNA, 64 nt, Homo Sapiens
uguucagaagaauaaaauaugauugagauuacuuuguaaguagcacaugauuuauaauuucacu

SEQ ID NO: 298092 - RNA, 64 nt, Homo Sapiens
guaaaauaauccaccguuuuagacccagccucuuuguaaguacaugcuguuuaagugcaggcug

SEQ ID NO: 298093 - RNA, 64 nt, Homo Sapiens
acguggcucaacuagauaucuaauaggcuugcuauguaaguagagaucuguuaugcuagugguu

SEQ ID NO: 298094 - RNA, 64 nt, Homo Sapiens
gaagaaaaugguuauauaaucuaaaauuggcacauguaaguauuuaucauacugugguuucugc

SEQ ID NO: 298095 - RNA, 64 nt, Homo Sapiens
cuucccugcaguccaagugauaauugccuuguauuguaaguauucuuuuuucuuuuuuuuuuuu

SEQ ID NO: 298096 - RNA, 64 nt, Homo Sapiens
aguacaaacauuauuuccacaugaguccggacuguguaaguaaaauuaucaguguuuuagaaac

SEQ ID NO: 298097 - RNA, 64 nt, Homo Sapiens
aggauaaauccaagaaacuuccuauuacuaaugauguaaguacgcaaauuugagaugcauuauu

SEQ ID NO: 298098 - RNA, 64 nt, Homo Sapiens
auauuucuggaauuucacacuuucuuauaauugcuguaaguauuccuagagugaauacuacccc

SEQ ID NO: 298099 - RNA, 64 nt, Homo Sapiens
gccaaucugcaaaacuguauaacguuugcagaaauguaaguaaauauauuuuuauuuugggaaa

SEQ ID NO: 298100 - RNA, 64 nt, Homo Sapiens
acauugcaacaacaaucaugugucagucauucauuguaaguagcaggaucccuagcuuguuuuc

SEQ ID NO: 298101 - RNA, 64 nt, Homo Sapiens
cuugccaaagguaaaggggcgaaguuguaugaguuguaaguaauaaauaguucucagauauuaa

SEQ ID NO: 298102 - RNA, 64 nt, Homo Sapiens
uacuguuuucaccuuuuguuuauauguaaauguuuguaaguauaugggccuaucuguaagugga

SEQ ID NO: 298103 - RNA, 64 nt, Homo Sapiens
ggauaaggacaaugaugagguuacugguuuggauuguaaguagaggacuuuuauuaauugguuu

SEQ ID NO: 298104 - RNA, 64 nt, Homo Sapiens
cauuaaaauacucacugaagagaagcccuaugaauguaaguaacgugggaaagcaugaaauucu

SEQ ID NO: 298105 - RNA, 64 nt, Homo Sapiens
uacaugaaagaauucuagagagaagccauauacauguaaguaacaugggaaagcuuucaaucau

SEQ ID NO: 298106 - RNA, 64 nt, Homo Sapiens
uuugaaaacuucuaauacagcaaaauccuauaaauguaaguacuucaaaaagccucaugcauag

SEQ ID NO: 298107 - RNA, 64 nt, Homo Sapiens
aaucucacaaagaaauguuaaauugauauaauccuguaaguaaucugaaagcaauagugcauga

SEQ ID NO: 298108 - RNA, 64 nt, Homo Sapiens
cuguauauacagucuauguguuuagaauuuguguuguaaguaaacuacagcuuugaguuggaaa

SEQ ID NO: 298109 - RNA, 64 nt, Homo Sapiens
gccuucuaugcauccacaccaaaauccugcagaauguaaguaagcucugcuuuauaagaugggu

SEQ ID NO: 298110 - RNA, 64 nt, Homo Sapiens
aauuggacaauggcucuuuagagaguuaucugaguguaaguaaauuaauguucucauuuagauu

SEQ ID NO: 298111 - RNA, 64 nt, Homo Sapiens
uugguccaaacugaacauauggaaauagauuuauuguaaguauuuacuuagagcuuuuucuuaa

SEQ ID NO: 298112 - RNA, 64 nt, Homo Sapiens; identical to SEQ ID NO: 115740

SEQ ID NO: 298113 - RNA, 64 nt, Homo Sapiens; identical to SEQ ID NO: 115741

SEQ ID NO: 298114 - RNA, 64 nt, Homo Sapiens; identical to SEQ ID NO: 115742

SEQ ID NO: 298115 - RNA, 64 nt, Homo Sapiens; identical to SEQ ID NO: 115743

SEQ ID NO: 298116 - RNA, 64 nt, Homo Sapiens; identical to SEQ ID NO: 115744

SEQ ID NO: 298117 - RNA, 64 nt, Homo Sapiens; identical to SEQ ID NO: 115745

SEQ ID NO: 298118 - RNA, 64 nt, Homo Sapiens; identical to SEQ ID NO: 115746

SEQ ID NO: 298119 - RNA, 64 nt, Homo Sapiens; identical to SEQ ID NO: 115747

SEQ ID NO: 298120 - RNA, 64 nt, Homo Sapiens; identical to SEQ ID NO: 115748

SEQ ID NO: 298121 - RNA, 64 nt, Homo Sapiens; identical to SEQ ID NO: 115749

SEQ ID NO: 298122 - RNA, 64 nt, Homo Sapiens; identical to SEQ ID NO: 115750

SEQ ID NO: 298123 - RNA, 64 nt, Homo Sapiens; identical to SEQ ID NO: 115751

SEQ ID NO: 298124 - RNA, 64 nt, Homo Sapiens; identical to SEQ ID NO: 115752

SEQ ID NO: 298125 - RNA, 64 nt, Homo Sapiens; identical to SEQ ID NO: 115753

SEQ ID NO: 298126 - RNA, 64 nt, Homo Sapiens; identical to SEQ ID NO: 115754

SEQ ID NO: 298127 - RNA, 64 nt, Homo Sapiens; identical to SEQ ID NO: 115755

SEQ ID NO: 298128 - RNA, 64 nt, Homo Sapiens; identical to SEQ ID NO: 115756

SEQ ID NO: 298129 - RNA, 64 nt, Homo Sapiens; identical to SEQ ID NO: 115757

SEQ ID NO: 298130 - RNA, 64 nt, Homo Sapiens; identical to SEQ ID NO: 115758

SEQ ID NO: 298131 - RNA, 64 nt, Homo Sapiens; identical to SEQ ID NO: 115759

SEQ ID NO: 298132 - RNA, 64 nt, Homo Sapiens; identical to SEQ ID NO: 115760

SEQ ID NO: 298133 - RNA, 64 nt, Homo Sapiens; identical to SEQ ID NO: 115761

SEQ ID NO: 298134 - RNA, 64 nt, Homo Sapiens; identical to SEQ ID NO: 115762

SEQ ID NO: 298135 - RNA, 64 nt, Homo Sapiens; identical to SEQ ID NO: 115763

SEQ ID NO: 298136 - RNA, 64 nt, Homo Sapiens; identical to SEQ ID NO: 115764

SEQ ID NO: 298137 - RNA, 64 nt, Homo Sapiens; identical to SEQ ID NO: 115765

SEQ ID NO: 298138 - RNA, 64 nt, Homo Sapiens; identical to SEQ ID NO: 115766

SEQ ID NO: 298139 - RNA, 64 nt, Homo Sapiens; identical to SEQ ID NO: 115767

SEQ ID NO: 298140 - RNA, 64 nt, Homo Sapiens; identical to SEQ ID NO: 115768

SEQ ID NO: 298141 - RNA, 64 nt, Homo Sapiens; identical to SEQ ID NO: 115769

SEQ ID NO: 298142 - RNA, 64 nt, Homo Sapiens; identical to SEQ ID NO: 115770

SEQ ID NO: 298143 - RNA, 64 nt, Homo Sapiens; identical to SEQ ID NO: 115771

SEQ ID NO: 298144 - RNA, 64 nt, Homo Sapiens; identical to SEQ ID NO: 115772

SEQ ID NO: 298145 - RNA, 64 nt, Homo Sapiens; identical to SEQ ID NO: 115773

SEQ ID NO: 298146 - RNA, 64 nt, Homo Sapiens; identical to SEQ ID NO: 115774

SEQ ID NO: 298147 - RNA, 64 nt, Homo Sapiens; identical to SEQ ID NO: 115775

SEQ ID NO: 298148 - RNA, 64 nt, Homo Sapiens; identical to SEQ ID NO: 115776

SEQ ID NO: 298149 - RNA, 64 nt, Homo Sapiens; identical to SEQ ID NO: 115777

SEQ ID NO: 298150 - RNA, 64 nt, Homo Sapiens
ccacacaggcacugccccaggacaacacaacaaggacagucacaacaaggacaacaaggacaca

SEQ ID NO: 298151 - RNA, 64 nt, Homo Sapiens
aggacaacaaggacacaacacaacacacaacaaggacagucacaacaagccuagagccagaaag

SEQ ID NO: 298152 - RNA, 64 nt, Homo Sapiens
gucaggggaaggaaggagccugugucccugggacgacagucaacuggagcuagguguugaccuc

SEQ ID NO: 298153 - RNA, 64 nt, Homo Sapiens
ucuguuucuaggugcuguuuucaaaaccccagaugacagucauagaaaauuuggaacuuaggaa

SEQ ID NO: 298154 - RNA, 64 nt, Homo Sapiens
aucagauaggccccaaaccuagagagacuuccgggacagucauugagugaaacugucucaaaaa

SEQ ID NO: 298155 - RNA, 64 nt, Homo Sapiens
aguggggacacuuucagcuuuucugacaaggcaggacagucaagcggugucacagauugcaggg

SEQ ID NO: 298156 - RNA, 64 nt, Homo Sapiens
aucgcuggugcugagcccugcccugggccccacggacagucagccugccggccucccugcagcu

SEQ ID NO: 298157 - RNA, 64 nt, Homo Sapiens
aaguaacaugugcaaaagcuccccguccagcuuugacagucaguuuugaugucagcuccucggc

SEQ ID NO: 298158 - RNA, 64 nt, Homo Sapiens
cauguagaagcuaaaaguuuagagggagugaggguuuucucaagaccuuccucaagcauuuuau

SEQ ID NO: 298159 - RNA, 64 nt, Homo Sapiens
cuauauaaaagaaagauaaaacacaggucaccaauuuucucauuucaccccauuuaccuuguau

SEQ ID NO: 298160 - RNA, 64 nt, Homo Sapiens
ucugaguuucuugaaaugucuuuaaaacagacauuuuucucaccaaacaguuugaguaucuuua

SEQ ID NO: 298161 - RNA, 64 nt, Homo Sapiens
auccaaacuuuuauaaaauauuaauuauucuuguuuuucucacacaggcauacuccaaaugcuu

SEQ ID NO: 298162 - RNA, 64 nt, Homo Sapiens
uuuagguguaauaucgaaguccuggcuuuucucguuuucucacuugcucucuuguucucuguuu

SEQ ID NO: 298163 - RNA, 64 nt, Homo Sapiens
acccuuucuguauugagugcaguguuuuuuacucuuuucucaugcacauguuacguuggagaaa

SEQ ID NO: 298164 - RNA, 64 nt, Homo Sapiens
aauauaguuauaaucaggcuacauucacauuuucuuuucucaucuuaaaacccuuuauguucaa

SEQ ID NO: 298165 - RNA, 64 nt, Homo Sapiens
uucccuaauuucccaguccuugucuugaacaaucuuuucucaguacaacagccauagugauucu

SEQ ID NO: 298166 - RNA, 64 nt, Homo Sapiens
uuuacugaguaggcacagaagugggcaaaaauuauuuucucaauggggugauauuuuuauagaa

SEQ ID NO: 298167 - RNA, 64 nt, Homo Sapiens
gccauuaguaaugacugaugcaagccgccugacuuuuucucauucuguuaacaugggagucaca

SEQ ID NO: 298168 - RNA, 64 nt, Homo Sapiens
gcccuuucaguuacaaccacuuuuauucaaagccuuuucucaaauuggcuagguggaugacuag

SEQ ID NO: 298169 - RNA, 64 nt, Homo Sapiens
guacacagauaaagcaugguuucuuguggauggauuuucucaaagaaacugacgcuuggcuccu

SEQ ID NO: 298170 - RNA, 64 nt, Homo Sapiens
aaaaugugucaugccaguaagagauguuauauucuuuucucauuucuuccccacccaaaaauaa

SEQ ID NO: 298171 - RNA, 64 nt, Homo Sapiens
gaagauuauaccccccaauuguuuuucaauccccuuuucucaaauaauaaauuaguuaaaucag

SEQ ID NO: 298172 - RNA, 64 nt, Homo Sapiens
uaagauauguauaaugcuggccauuuuaaagggguuuucucaaaaguuaaacuuuugcuaugac

SEQ ID NO: 298173 - RNA, 64 nt, Homo Sapiens
uuuccaguguuuucugcauguucucauuuguucuuuuucucaguugaaugcaccaacugguuug

SEQ ID NO: 298174 - RNA, 64 nt, Homo Sapiens
gcuggacuuuaaaaaaacaauucaggaccaaauuuuuucucaguguguguguuuauuccuuaua

SEQ ID NO: 298175 - RNA, 64 nt, Homo Sapiens
aaaaaaagacaagagagaugaaaacguuugauuauuuucucaguguauuuuuguaaaaaauaua

SEQ ID NO: 298176 - RNA, 64 nt, Homo Sapiens
auggaaagauccuggccugugguagugguagcaguuuucucaaauaauguggugacagucacua

SEQ ID NO: 298177 - RNA, 64 nt, Homo Sapiens
guuuuuuguuguuguuuuuuguuuuuguuuuuguuuuucucagucuuaccugugauguuguuua

SEQ ID NO: 298178 - RNA, 64 nt, Homo Sapiens
uauuugaaaaaaaaaaaaugugauucuuggauuguuuucucaugaugaucauuucuuccugcag

SEQ ID NO: 298179 - RNA, 64 nt, Homo Sapiens
guggacauacaauuuuacugauuguuuauuuuccuuuucucaugauauuugcugcauuuuuuuc

SEQ ID NO: 298180 - RNA, 64 nt, Homo Sapiens
uuguauaaaaaacaccagugcucuuucguuguauuuuucucauuuuugcuuuuuaaaauuccuu

SEQ ID NO: 298181 - RNA, 64 nt, Homo Sapiens
cugcauuucuuuugcguauauaauugcuuacagcuuuucucauuugauauauagcauuguacau

SEQ ID NO: 298182 - RNA, 64 nt, Homo Sapiens
cuggaguuuucuggaauaaauuuucagcaccugcuuuucucagcuuggcccuuccccgggugag

SEQ ID NO: 298183 - RNA, 64 nt, Homo Sapiens
ucucuaaacagaucugauauugcugcuccugugguuuucucaaaauuaacuuugccgugguuuu

SEQ ID NO: 298184 - RNA, 64 nt, Homo Sapiens
agcaucuuucccccaaauguucuccuucugucccuuuucucaaagagggggaaaugacuucuuu

SEQ ID NO: 298185 - RNA, 64 nt, Homo Sapiens
caggguaaguuuccccugagauuucucgagcuguuuuucucauccccuggguggacagaauuua

SEQ ID NO: 298186 - RNA, 64 nt, Homo Sapiens
ucuaugccuccuauauuaagcacguccggccaauuuuucucauuggauuacaggugugagccac

SEQ ID NO: 298187 - RNA, 64 nt, Homo Sapiens
uauuuuuucugagacggaguuucagguuuaaaauuuuucucauuuaacuuagguuuaauuuuuu

SEQ ID NO: 298188 - RNA, 64 nt, Homo Sapiens
ccaaggugauuccugcgacugcaggcacuggucauuuucucauguagcugucuuuucaguuaug

SEQ ID NO: 298189 - RNA, 64 nt, Homo Sapiens
acagacagguuugccaguuugcagaaacuaacucuuuucucacaucaacauuuguaaaauugau

SEQ ID NO: 298190 - RNA, 64 nt, Homo Sapiens
guaucaaguugaauuucugcgauuccacuguuuauuuucucauuugccauuugggugaggauuu

SEQ ID NO: 298191 - RNA, 64 nt, Homo Sapiens
caaaacucucuggugauuuuuaaguacugucacguuuucucaugccuuaggugcugaguuucau

SEQ ID NO: 298192 - RNA, 64 nt, Homo Sapiens
cuuucucucaucacucaccuguucucauucuuccuuuucucacuaggccaggaccagcucaugc

SEQ ID NO: 298193 - RNA, 64 nt, Homo Sapiens
cagacauaguaguaucaacuauucaauuuuuuuuuuuucucagaauguaugccuuuuuauuuuc

SEQ ID NO: 298194 - RNA, 64 nt, Homo Sapiens
ggaaguuuggucagagugaauggcucaccguggauuuucucauacugccuuguacuuuucauuu

SEQ ID NO: 298195 - RNA, 64 nt, Homo Sapiens
uggggagggggguaauagugcggaaacaaaauccuuuucucauuggagaagcugauccaguuuc

SEQ ID NO: 298196 - RNA, 64 nt, Homo Sapiens
cauuauaaaaauugacaaugauuuauuaaauauguuuucucaauuguaacgacuucuccaucuc

SEQ ID NO: 298197 - RNA, 64 nt, Homo Sapiens
uguggaugcuucaugugcugccugcaagcuucuuuuuucucauuaaauauaaaauauuuuguaa

SEQ ID NO: 298198 - RNA, 64 nt, Homo Sapiens
caaaugccucuuuuguacauguucauguuuaguguuuucucagaaucagcaacucaagguacua

SEQ ID NO: 298199 - RNA, 64 nt, Homo Sapiens
ucucagaaucagcaacucaagguacuaugaggauuuuucucacugacauaauuugauuacauac

SEQ ID NO: 298200 - RNA, 64 nt, Homo Sapiens
uuuuuuuaacuuaaaauucaagagacugaaucacuuuucucauugauuaaauguaaagauuauu

SEQ ID NO: 298201 - RNA, 64 nt, Homo Sapiens
ugagaaaccuauaguaaaugaaauuugugagauguuuucucaaauauaugcugugccuguacuu

SEQ ID NO: 298202 - RNA, 64 nt, Homo Sapiens
uaacauuuugguaguauacuaaacuauuuucagcuuuucucaauaugugauaaugaguaaacua

SEQ ID NO: 298203 - RNA, 64 nt, Homo Sapiens
caaaauuuucuucuagcauguuaccucuucaguguuuucucauggaaaaaucuggauuaaaaaa

SEQ ID NO: 298204 - RNA, 64 nt, Homo Sapiens
auuauaaguuaucaucaucuuauucuucaaauuuuuuucucacaauuucucuaaucuuuacuca

SEQ ID NO: 298205 - RNA, 64 nt, Homo Sapiens
acagucugaaaauugauagcauuuagcauuucuuuuuucucaaaaagaaacuguaggaaauaca

SEQ ID NO: 298206 - RNA, 64 nt, Homo Sapiens
auuaaugcuuuagaagcaaguugaaaagaauucuuuuucucacuauuuucuaaaaugggucacu

SEQ ID NO: 298207 - RNA, 64 nt, Homo Sapiens
ucaggugauauaaugaugguugaaaacucuagauuuuucucauagcuuccauuuagcaaauguu

SEQ ID NO: 298208 - RNA, 64 nt, Homo Sapiens
uugggaggccugagguagaggggagugguauguguuuucucaguggaagcagcacaugaguggg

SEQ ID NO: 298209 - RNA, 64 nt, Homo Sapiens
aauaugggaagggucuccuauuuauucaauagaguuuucucaguuauuuuccucccuugcccuu

SEQ ID NO: 298210 - RNA, 64 nt, Homo Sapiens
caguaucuaagucacauacaugaugucuugggcauuuucucagccauggagaacucugaaagga

SEQ ID NO: 298211 - RNA, 64 nt, Homo Sapiens
agccauggagaacucugaaaggaagaaucgcugcuuuucucaagcaaaucgguuucuugauguc

SEQ ID NO: 298212 - RNA, 64 nt, Homo Sapiens
aauuuugugaccaugaauuucuuucuuuuauaaauuuucucauuuaaaaaucaaaaaucuugca

SEQ ID NO: 298213 - RNA, 64 nt, Homo Sapiens
auaaaucuucuuacuuaaauuuugaauauuuaguuuuucucaguuacccauuugugugugugug

SEQ ID NO: 298214 - RNA, 64 nt, Homo Sapiens
agaacaaugaauuauccagcucugcagaucaagauuuucucauuagccuagaaaaugaucccua

SEQ ID NO: 298215 - RNA, 64 nt, Homo Sapiens
gaagaaaugaacaucugccacaguccugguuucuuuuucucaugcagaaggcuaggaauuuuag

SEQ ID NO: 298216 - RNA, 64 nt, Homo Sapiens
uuaaauaauucgagguuacaucguagguuuugauuuuucucaauuuaagauacagaaauacagc

SEQ ID NO: 298217 - RNA, 64 nt, Homo Sapiens
aauuuagaaaaauuauacuaaagugagaugcauuuuuucucauuuucagcaagacuccucuaag

SEQ ID NO: 298218 - RNA, 64 nt, Homo Sapiens
auuguagcagaaaucauuuuuuaaugaacacauuuuuucucaacucuguagacauguguucaua

SEQ ID NO: 298219 - RNA, 64 nt, Homo Sapiens
ugcuuuuccacgcacugugguaagauccugugauuuuucucaccuuucaaacagaaagagggaa

SEQ ID NO: 298220 - RNA, 64 nt, Homo Sapiens
gcaguucccuuaggggagcugaaauaaauucacauuuucucaaagucucauagcuuuggaggag

SEQ ID NO: 298221 - RNA, 64 nt, Homo Sapiens
ucaguuaucuaaacuagauuagauccaagccaaguuuucucaacagagagcaaagggccaggca

SEQ ID NO: 298222 - RNA, 64 nt, Homo Sapiens
aaguaacuaaaaaauuguguuauuuauuuuuaaauuuucucaaacucuaaucagcauuucaaug

SEQ ID NO: 298223 - RNA, 64 nt, Homo Sapiens
uggaccacaucaucucucacggaagaaaacagacuuuucucaaagaaauuggaaugugauuuaa

SEQ ID NO: 298224 - RNA, 64 nt, Homo Sapiens
uuagugaaaauugugaccuuauuacauauauguguuuucucagagauuucauuaacuuuuaaau

SEQ ID NO: 298225 - RNA, 64 nt, Homo Sapiens
uauacuagaaaauuucauaaccuuucaauuauauuuuucucaguauagaugauaugauuuauua

SEQ ID NO: 298226 - RNA, 64 nt, Homo Sapiens
uggacuuggaccagggacaccaucagggccuugguuuucucacgcauaaaauggagaguggauu

SEQ ID NO: 298227 - RNA, 64 nt, Homo Sapiens
ggaaaagaguccccgagcccggaucuugugcugcuuuucucacugacguguugccuuuuuucuu

SEQ ID NO: 298228 - RNA, 64 nt, Homo Sapiens
agcauuugaauucaacuuauuaauauacauugccuuuucucagcucaguacuaccacagaacua

SEQ ID NO: 298229 - RNA, 64 nt, Homo Sapiens
auaugaguuuuguacaauggauuagcuauuagauuuuucucaaaaucauaugguguuggagacu

SEQ ID NO: 298230 - RNA, 56 nt, Homo Sapiens
gucggucaguaucuucuuaaagacaauuuucucaccucuguaaauuuuagucucaa

SEQ ID NO: 298231 - RNA, 64 nt, Homo Sapiens
guguucucugccugucuuugucacaaaauuucauuuuucucauaguuaauuucaucucuccggu

SEQ ID NO: 298232 - RNA, 64 nt, Homo Sapiens
aaaugggauuaguuggggguaaaggaagacuucauuuucucaagagcagcaaacauucuuccua

SEQ ID NO: 298233 - RNA, 64 nt, Homo Sapiens
gaaagaauaguaguuagguuggacuuggggugcauuuucucacaaaguuuuuagucaacuuuug

SEQ ID NO: 298234 - RNA, 64 nt, Homo Sapiens
uguaagucaccgccaguaccaaaacaaauuuuuuuuuucucacuuucuuucuuggccauuuaaa

SEQ ID NO: 298235 - RNA, 64 nt, Homo Sapiens
cgcuucaacauuguaagcgaaugcugagugugcguuuucucaacaaucuaaagauguuagacag

SEQ ID NO: 298236 - RNA, 64 nt, Homo Sapiens
uucauucucagugauguuuucucugaggacaucuuuuucucaccauucucuuauuuuuugcuuc

SEQ ID NO: 298237 - RNA, 64 nt, Homo Sapiens
uaggauauaguuaucuucuauagauccuauuaccuuuucucauccuaggcacuuuaucaccauu

SEQ ID NO: 298238 - RNA, 64 nt, Homo Sapiens
acagguauguuuuuguuucagaaauauguauugcuuuucucauauuuuuugcaaauuguauugu

SEQ ID NO: 298239 - RNA, 63 nt, Homo Sapiens
ccuguucuuaauguaacaguaaaaguuuucacauuuuucucagaacuguuaucuggaagcucu

SEQ ID NO: 298240 - RNA, 64 nt, Homo Sapiens
ugcuuuguaugguaugaaggaugaauugacauuauuuucucauugaacuagguuugggguagaa

SEQ ID NO: 298241 - RNA, 64 nt, Homo Sapiens
gucauaaaaggcucuaauuaauaugaaaaacaaauuuucucacuaaggggagauaggugagaug

SEQ ID NO: 298242 - RNA, 64 nt, Homo Sapiens
auaagcuccuaaauuauagagccucaauuuugguuuuucucauuugaaauguuuuugauuuauc

SEQ ID NO: 298243 - RNA, 64 nt, Homo Sapiens
agguuguccuauuggcauaaaacaaaccagcaacuuuucucauguguuuggaguuaaaaugugu

SEQ ID NO: 298244 - RNA, 64 nt, Homo Sapiens
acuauggcgacaaaggggaaaaggccaccacucguuuucucacugauucaugccaauuaagccu

SEQ ID NO: 298245 - RNA, 64 nt, Homo Sapiens
uaagaagaaaggaagaaagccccagacgcuugguuuuucucagaacccccaaaagaugugcaau

SEQ ID NO: 298246 - RNA, 64 nt, Homo Sapiens
ucguuuguggguuuuuuuuuuuguuuguauguuuuuuucucauuugauuuuaucacucuauuau

SEQ ID NO: 298247 - RNA, 64 nt, Homo Sapiens
caguuuugggaggaaaagggaagugcugacuuuguuuucucauuuauguggccacugguuuaag

SEQ ID NO: 298248 - RNA, 64 nt, Homo Sapiens
uagauuuuaucuuaucuuuugguguugucuugguuuuucucauagacuuuauaaguuugaacug

SEQ ID NO: 298249 - RNA, 64 nt, Homo Sapiens
acagaccuccaagacuuucuucuccaccucuucuuuuucucaugcccugccuucaucugucucc

SEQ ID NO: 298250 - RNA, 64 nt, Homo Sapiens; identical to SEQ ID NO: 104452

SEQ ID NO: 298251 - RNA, 64 nt, Homo Sapiens; identical to SEQ ID NO: 104453

SEQ ID NO: 298252 - RNA, 64 nt, Homo Sapiens; identical to SEQ ID NO: 104454

SEQ ID NO: 298253 - RNA, 64 nt, Homo Sapiens; identical to SEQ ID NO: 104455

SEQ ID NO: 298254 - RNA, 64 nt, Homo Sapiens; identical to SEQ ID NO: 104456

SEQ ID NO: 298255 - RNA, 64 nt, Homo Sapiens; identical to SEQ ID NO: 104457

SEQ ID NO: 298256 - RNA, 64 nt, Homo Sapiens; identical to SEQ ID NO: 104458

SEQ ID NO: 298257 - RNA, 64 nt, Homo Sapiens; identical to SEQ ID NO: 104459

SEQ ID NO: 298258 - RNA, 64 nt, Homo Sapiens; identical to SEQ ID NO: 104460

SEQ ID NO: 298259 - RNA, 64 nt, Homo Sapiens; identical to SEQ ID NO: 104461

SEQ ID NO: 298260 - RNA, 64 nt, Homo Sapiens; identical to SEQ ID NO: 104462

SEQ ID NO: 298261 - RNA, 64 nt, Homo Sapiens; identical to SEQ ID NO: 104463

SEQ ID NO: 298262 - RNA, 64 nt, Homo Sapiens; identical to SEQ ID NO: 104464

SEQ ID NO: 298263 - RNA, 64 nt, Homo Sapiens; identical to SEQ ID NO: 104465

SEQ ID NO: 298264 - RNA, 64 nt, Homo Sapiens; identical to SEQ ID NO: 104466

SEQ ID NO: 298265 - RNA, 64 nt, Homo Sapiens; identical to SEQ ID NO: 104467

SEQ ID NO: 298266 - RNA, 64 nt, Homo Sapiens; identical to SEQ ID NO: 104468

SEQ ID NO: 298267 - RNA, 64 nt, Homo Sapiens; identical to SEQ ID NO: 104469

SEQ ID NO: 298268 - RNA, 64 nt, Homo Sapiens; identical to SEQ ID NO: 104470

SEQ ID NO: 298269 - RNA, 64 nt, Homo Sapiens; identical to SEQ ID NO: 104471

SEQ ID NO: 298270 - RNA, 64 nt, Homo Sapiens; identical to SEQ ID NO: 104472

SEQ ID NO: 298271 - RNA, 64 nt, Homo Sapiens; identical to SEQ ID NO: 104473

SEQ ID NO: 298272 - RNA, 64 nt, Homo Sapiens; identical to SEQ ID NO: 104474

SEQ ID NO: 298273 - RNA, 64 nt, Homo Sapiens; identical to SEQ ID NO: 104475

SEQ ID NO: 298274 - RNA, 64 nt, Homo Sapiens; identical to SEQ ID NO: 104476

SEQ ID NO: 298275 - RNA, 64 nt, Homo Sapiens; identical to SEQ ID NO: 104477

SEQ ID NO: 298276 - RNA, 64 nt, Homo Sapiens; identical to SEQ ID NO: 104478

SEQ ID NO: 298277 - RNA, 64 nt, Homo Sapiens; identical to SEQ ID NO: 104479

SEQ ID NO: 298278 - RNA, 64 nt, Homo Sapiens; identical to SEQ ID NO: 104480

SEQ ID NO: 298279 - RNA, 64 nt, Homo Sapiens; identical to SEQ ID NO: 39289

SEQ ID NO: 298280 - RNA, 64 nt, Homo Sapiens; identical to SEQ ID NO: 39290

SEQ ID NO: 298281 - RNA, 64 nt, Homo Sapiens; identical to SEQ ID NO: 39291

SEQ ID NO: 298282 - RNA, 64 nt, Homo Sapiens; identical to SEQ ID NO: 39292

SEQ ID NO: 298283 - RNA, 64 nt, Homo Sapiens; identical to SEQ ID NO: 39293

SEQ ID NO: 298284 - RNA, 64 nt, Homo Sapiens; identical to SEQ ID NO: 39294

SEQ ID NO: 298285 - RNA, 64 nt, Homo Sapiens; identical to SEQ ID NO: 39295

SEQ ID NO: 298286 - RNA, 64 nt, Homo Sapiens; identical to SEQ ID NO: 39296

SEQ ID NO: 298287 - RNA, 64 nt, Homo Sapiens; identical to SEQ ID NO: 39297

SEQ ID NO: 298288 - RNA, 64 nt, Homo Sapiens; identical to SEQ ID NO: 39298

SEQ ID NO: 298289 - RNA, 64 nt, Homo Sapiens; identical to SEQ ID NO: 39299

SEQ ID NO: 298290 - RNA, 64 nt, Homo Sapiens; identical to SEQ ID NO: 39300

SEQ ID NO: 298291 - RNA, 64 nt, Homo Sapiens; identical to SEQ ID NO: 39301

SEQ ID NO: 298292 - RNA, 64 nt, Homo Sapiens; identical to SEQ ID NO: 39302

SEQ ID NO: 298293 - RNA, 64 nt, Homo Sapiens; identical to SEQ ID NO: 39303

SEQ ID NO: 298294 - RNA, 64 nt, Homo Sapiens; identical to SEQ ID NO: 39304

SEQ ID NO: 298295 - RNA, 64 nt, Homo Sapiens; identical to SEQ ID NO: 39305

SEQ ID NO: 298296 - RNA, 64 nt, Homo Sapiens; identical to SEQ ID NO: 39306

SEQ ID NO: 298297 - RNA, 64 nt, Homo Sapiens; identical to SEQ ID NO: 39307

SEQ ID NO: 298298 - RNA, 64 nt, Homo Sapiens; identical to SEQ ID NO: 39308

SEQ ID NO: 298299 - RNA, 64 nt, Homo Sapiens; identical to SEQ ID NO: 39309

SEQ ID NO: 298300 - RNA, 64 nt, Homo Sapiens; identical to SEQ ID NO: 39310

SEQ ID NO: 298301 - RNA, 64 nt, Homo Sapiens; identical to SEQ ID NO: 39311

SEQ ID NO: 298302 - RNA, 64 nt, Homo Sapiens; identical to SEQ ID NO: 39312

SEQ ID NO: 298303 - RNA, 64 nt, Homo Sapiens; identical to SEQ ID NO: 39313

SEQ ID NO: 298304 - RNA, 64 nt, Homo Sapiens; identical to SEQ ID NO: 39314

SEQ ID NO: 298305 - RNA, 64 nt, Homo Sapiens; identical to SEQ ID NO: 39315

SEQ ID NO: 298306 - RNA, 64 nt, Homo Sapiens; identical to SEQ ID NO: 39316

SEQ ID NO: 298307 - RNA, 64 nt, Homo Sapiens; identical to SEQ ID NO: 39317

SEQ ID NO: 298308 - RNA, 64 nt, Homo Sapiens; identical to SEQ ID NO: 39318

SEQ ID NO: 298309 - RNA, 64 nt, Homo Sapiens; identical to SEQ ID NO: 39319

SEQ ID NO: 298310 - RNA, 64 nt, Homo Sapiens; identical to SEQ ID NO: 39320

SEQ ID NO: 298311 - RNA, 64 nt, Homo Sapiens; identical to SEQ ID NO: 39321

SEQ ID NO: 298312 - RNA, 64 nt, Homo Sapiens; identical to SEQ ID NO: 39322

SEQ ID NO: 298313 - RNA, 64 nt, Homo Sapiens; identical to SEQ ID NO: 39323

SEQ ID NO: 298314 - RNA, 64 nt, Homo Sapiens; identical to SEQ ID NO: 39324

SEQ ID NO: 298315 - RNA, 64 nt, Homo Sapiens; identical to SEQ ID NO: 39325

SEQ ID NO: 298316 - RNA, 64 nt, Homo Sapiens; identical to SEQ ID NO: 39326

SEQ ID NO: 298317 - RNA, 64 nt, Homo Sapiens; identical to SEQ ID NO: 39327

SEQ ID NO: 298318 - RNA, 64 nt, Homo Sapiens; identical to SEQ ID NO: 39328

SEQ ID NO: 298319 - RNA, 64 nt, Homo Sapiens; identical to SEQ ID NO: 39329

SEQ ID NO: 298320 - RNA, 64 nt, Homo Sapiens; identical to SEQ ID NO: 39330

SEQ ID NO: 298321 - RNA, 64 nt, Homo Sapiens; identical to SEQ ID NO: 39331

SEQ ID NO: 298322 - RNA, 64 nt, Homo Sapiens; identical to SEQ ID NO: 39332

SEQ ID NO: 298323 - RNA, 61 nt, Homo Sapiens; identical to SEQ ID NO: 39333

SEQ ID NO: 298324 - RNA, 64 nt, Homo Sapiens; identical to SEQ ID NO: 39334

SEQ ID NO: 298325 - RNA, 64 nt, Homo Sapiens; identical to SEQ ID NO: 39335

SEQ ID NO: 298326 - RNA, 64 nt, Homo Sapiens; identical to SEQ ID NO: 39336

SEQ ID NO: 298327 - RNA, 64 nt, Homo Sapiens; identical to SEQ ID NO: 39337

SEQ ID NO: 298328 - RNA, 64 nt, Homo Sapiens; identical to SEQ ID NO: 39338

SEQ ID NO: 298329 - RNA, 64 nt, Homo Sapiens; identical to SEQ ID NO: 39339

SEQ ID NO: 298330 - RNA, 64 nt, Homo Sapiens; identical to SEQ ID NO: 39340

SEQ ID NO: 298331 - RNA, 64 nt, Homo Sapiens; identical to SEQ ID NO: 39341

SEQ ID NO: 298332 - RNA, 64 nt, Homo Sapiens; identical to SEQ ID NO: 39342

SEQ ID NO: 298333 - RNA, 64 nt, Homo Sapiens; identical to SEQ ID NO: 39343

SEQ ID NO: 298334 - RNA, 64 nt, Homo Sapiens; identical to SEQ ID NO: 39344

SEQ ID NO: 298335 - RNA, 64 nt, Homo Sapiens; identical to SEQ ID NO: 39345

SEQ ID NO: 298336 - RNA, 64 nt, Homo Sapiens; identical to SEQ ID NO: 39346

SEQ ID NO: 298337 - RNA, 64 nt, Homo Sapiens; identical to SEQ ID NO: 144314

SEQ ID NO: 298338 - RNA, 64 nt, Homo Sapiens; identical to SEQ ID NO: 144315

SEQ ID NO: 298339 - RNA, 64 nt, Homo Sapiens; identical to SEQ ID NO: 144316

SEQ ID NO: 298340 - RNA, 64 nt, Homo Sapiens; identical to SEQ ID NO: 144317

SEQ ID NO: 298341 - RNA, 64 nt, Homo Sapiens; identical to SEQ ID NO: 144318

SEQ ID NO: 298342 - RNA, 64 nt, Homo Sapiens; identical to SEQ ID NO: 144319

SEQ ID NO: 298343 - RNA, 64 nt, Homo Sapiens; identical to SEQ ID NO: 144320

SEQ ID NO: 298344 - RNA, 64 nt, Homo Sapiens; identical to SEQ ID NO: 144321

SEQ ID NO: 298345 - RNA, 64 nt, Homo Sapiens
uuugaacuggccuuacuuugaggaggcaagaccugugggucaauuacuccccauggcagcaugg

SEQ ID NO: 298346 - RNA, 64 nt, Homo Sapiens
uaacccuguggcagugacacgcccacaugcagcagugggucagaaaauuuugacagcucuuuaa

SEQ ID NO: 298347 - RNA, 64 nt, Homo Sapiens
cuugcuguggagauccauucgggucauccuugcugugggucaucguuccccauguccuugccgu

SEQ ID NO: 298348 - RNA, 64 nt, Homo Sapiens
cuugcugugggucauccuugcccauguccuugccgugggucaucgguggcugugauacagguuc

SEQ ID NO: 298349 - RNA, 64 nt, Homo Sapiens
aauuaggagaaaucccaaaucacugcccaauagggugggucaucaggaauacuuugcuaugccu

SEQ ID NO: 298350 - RNA, 64 nt, Homo Sapiens
ugaacccaggaguuugacauggaggccaaggugggugggucacuccaaaagaccucuuacuuug

SEQ ID NO: 298351 - RNA, 64 nt, Homo Sapiens
uuuuugcuguggugacacauaggaguguguucaagugggucaugauuuauccggugggugggac

SEQ ID NO: 298352 - RNA, 64 nt, Homo Sapiens
caggacaaggagaaagcaggccuaggaugggacagugggucaggggugugacaugaggaccguu

SEQ ID NO: 298353 - RNA, 64 nt, Homo Sapiens; identical to SEQ ID NO: 218440

SEQ ID NO: 298354 - RNA, 64 nt, Homo Sapiens; identical to SEQ ID NO: 218441

SEQ ID NO: 298355 - RNA, 57 nt, Homo Sapiens; identical to SEQ ID NO: 54899

SEQ ID NO: 298356 - RNA, 64 nt, Homo Sapiens; identical to SEQ ID NO: 218443

SEQ ID NO: 298357 - RNA, 64 nt, Homo Sapiens; identical to SEQ ID NO: 218444

SEQ ID NO: 298358 - RNA, 64 nt, Homo Sapiens; identical to SEQ ID NO: 218445

SEQ ID NO: 298359 - RNA, 64 nt, Homo Sapiens; identical to SEQ ID NO: 218446

SEQ ID NO: 298360 - RNA, 64 nt, Homo Sapiens; identical to SEQ ID NO: 218447

SEQ ID NO: 298361 - RNA, 64 nt, Homo Sapiens; identical to SEQ ID NO: 218448

SEQ ID NO: 298362 - RNA, 64 nt, Homo Sapiens; identical to SEQ ID NO: 218449

SEQ ID NO: 298363 - RNA, 64 nt, Homo Sapiens; identical to SEQ ID NO: 218450

SEQ ID NO: 298364 - RNA, 64 nt, Homo Sapiens; identical to SEQ ID NO: 218451

SEQ ID NO: 298365 - RNA, 64 nt, Homo Sapiens; identical to SEQ ID NO: 218452

SEQ ID NO: 298366 - RNA, 64 nt, Homo Sapiens; identical to SEQ ID NO: 218453

SEQ ID NO: 298367 - RNA, 64 nt, Homo Sapiens; identical to SEQ ID NO: 218454

SEQ ID NO: 298368 - RNA, 64 nt, Homo Sapiens; identical to SEQ ID NO: 218455

SEQ ID NO: 298369 - RNA, 64 nt, Homo Sapiens; identical to SEQ ID NO: 218456

SEQ ID NO: 298370 - RNA, 64 nt, Homo Sapiens; identical to SEQ ID NO: 218457

SEQ ID NO: 298371 - RNA, 64 nt, Homo Sapiens; identical to SEQ ID NO: 218458

SEQ ID NO: 298372 - RNA, 64 nt, Homo Sapiens; identical to SEQ ID NO: 218459

SEQ ID NO: 298373 - RNA, 64 nt, Homo Sapiens; identical to SEQ ID NO: 218460

SEQ ID NO: 298374 - RNA, 64 nt, Homo Sapiens; identical to SEQ ID NO: 218461

SEQ ID NO: 298375 - RNA, 64 nt, Homo Sapiens; identical to SEQ ID NO: 218462

SEQ ID NO: 298376 - RNA, 64 nt, Homo Sapiens; identical to SEQ ID NO: 218463

SEQ ID NO: 298377 - RNA, 64 nt, Homo Sapiens; identical to SEQ ID NO: 218464

SEQ ID NO: 298378 - RNA, 64 nt, Homo Sapiens; identical to SEQ ID NO: 218465

SEQ ID NO: 298379 - RNA, 64 nt, Homo Sapiens; identical to SEQ ID NO: 218466

SEQ ID NO: 298380 - RNA, 64 nt, Homo Sapiens; identical to SEQ ID NO: 218467

SEQ ID NO: 298381 - RNA, 64 nt, Homo Sapiens; identical to SEQ ID NO: 218468

SEQ ID NO: 298382 - RNA, 64 nt, Homo Sapiens; identical to SEQ ID NO: 218469

SEQ ID NO: 298383 - RNA, 64 nt, Homo Sapiens; identical to SEQ ID NO: 218470

SEQ ID NO: 298384 - RNA, 64 nt, Homo Sapiens; identical to SEQ ID NO: 218471

SEQ ID NO: 298385 - RNA, 64 nt, Homo Sapiens; identical to SEQ ID NO: 218472

SEQ ID NO: 298386 - RNA, 64 nt, Homo Sapiens; identical to SEQ ID NO: 218473

SEQ ID NO: 298387 - RNA, 64 nt, Homo Sapiens; identical to SEQ ID NO: 218474

SEQ ID NO: 298388 - RNA, 64 nt, Homo Sapiens; identical to SEQ ID NO: 218475

SEQ ID NO: 298389 - RNA, 64 nt, Homo Sapiens; identical to SEQ ID NO: 218476

SEQ ID NO: 298390 - RNA, 64 nt, Homo Sapiens; identical to SEQ ID NO: 218477

SEQ ID NO: 298391 - RNA, 64 nt, Homo Sapiens; identical to SEQ ID NO: 218478

SEQ ID NO: 298392 - RNA, 64 nt, Homo Sapiens; identical to SEQ ID NO: 218479

SEQ ID NO: 298393 - RNA, 64 nt, Homo Sapiens; identical to SEQ ID NO: 218480

SEQ ID NO: 298394 - RNA, 64 nt, Homo Sapiens; identical to SEQ ID NO: 218481

SEQ ID NO: 298395 - RNA, 64 nt, Homo Sapiens; identical to SEQ ID NO: 218482

SEQ ID NO: 298396 - RNA, 64 nt, Homo Sapiens; identical to SEQ ID NO: 218483

SEQ ID NO: 298397 - RNA, 64 nt, Homo Sapiens; identical to SEQ ID NO: 218484

SEQ ID NO: 298398 - RNA, 64 nt, Homo Sapiens; identical to SEQ ID NO: 218485

SEQ ID NO: 298399 - RNA, 64 nt, Homo Sapiens; identical to SEQ ID NO: 218486

SEQ ID NO: 298400 - RNA, 64 nt, Homo Sapiens; identical to SEQ ID NO: 218487

SEQ ID NO: 298401 - RNA, 64 nt, Homo Sapiens; identical to SEQ ID NO: 218488

SEQ ID NO: 298402 - RNA, 64 nt, Homo Sapiens; identical to SEQ ID NO: 218489

SEQ ID NO: 298403 - RNA, 64 nt, Homo Sapiens; identical to SEQ ID NO: 218490

SEQ ID NO: 298404 - RNA, 64 nt, Homo Sapiens; identical to SEQ ID NO: 218491

SEQ ID NO: 298405 - RNA, 64 nt, Homo Sapiens; identical to SEQ ID NO: 150627

SEQ ID NO: 298406 - RNA, 64 nt, Homo Sapiens; identical to SEQ ID NO: 150628

SEQ ID NO: 298407 - RNA, 64 nt, Homo Sapiens; identical to SEQ ID NO: 150629

SEQ ID NO: 298408 - RNA, 64 nt, Homo Sapiens; identical to SEQ ID NO: 150630

SEQ ID NO: 298409 - RNA, 64 nt, Homo Sapiens; identical to SEQ ID NO: 150631

SEQ ID NO: 298410 - RNA, 64 nt, Homo Sapiens; identical to SEQ ID NO: 150632

SEQ ID NO: 298411 - RNA, 64 nt, Homo Sapiens; identical to SEQ ID NO: 150633

SEQ ID NO: 298412 - RNA, 64 nt, Homo Sapiens; identical to SEQ ID NO: 150634

SEQ ID NO: 298413 - RNA, 64 nt, Homo Sapiens; identical to SEQ ID NO: 150635

SEQ ID NO: 298414 - RNA, 64 nt, Homo Sapiens; identical to SEQ ID NO: 150636

SEQ ID NO: 298415 - RNA, 64 nt, Homo Sapiens; identical to SEQ ID NO: 150637

SEQ ID NO: 298416 - RNA, 64 nt, Homo Sapiens; identical to SEQ ID NO: 150638

SEQ ID NO: 298417 - RNA, 64 nt, Homo Sapiens; identical to SEQ ID NO: 150639

SEQ ID NO: 298418 - RNA, 64 nt, Homo Sapiens; identical to SEQ ID NO: 150640

SEQ ID NO: 298419 - RNA, 64 nt, Homo Sapiens; identical to SEQ ID NO: 150641

SEQ ID NO: 298420 - RNA, 64 nt, Homo Sapiens; identical to SEQ ID NO: 150642

SEQ ID NO: 298421 - RNA, 64 nt, Homo Sapiens; identical to SEQ ID NO: 150643

SEQ ID NO: 298422 - RNA, 64 nt, Homo Sapiens; identical to SEQ ID NO: 150644

SEQ ID NO: 298423 - RNA, 64 nt, Homo Sapiens; identical to SEQ ID NO: 150645

SEQ ID NO: 298424 - RNA, 64 nt, Homo Sapiens; identical to SEQ ID NO: 150646

SEQ ID NO: 298425 - RNA, 64 nt, Homo Sapiens; identical to SEQ ID NO: 150647

SEQ ID NO: 298426 - RNA, 64 nt, Homo Sapiens; identical to SEQ ID NO: 150648

SEQ ID NO: 298427 - RNA, 64 nt, Homo Sapiens; identical to SEQ ID NO: 150649

SEQ ID NO: 298428 - RNA, 64 nt, Homo Sapiens; identical to SEQ ID NO: 150650

SEQ ID NO: 298429 - RNA, 64 nt, Homo Sapiens; identical to SEQ ID NO: 150651

SEQ ID NO: 298430 - RNA, 64 nt, Homo Sapiens; identical to SEQ ID NO: 150652

SEQ ID NO: 298431 - RNA, 64 nt, Homo Sapiens; identical to SEQ ID NO: 150653

SEQ ID NO: 298432 - RNA, 64 nt, Homo Sapiens; identical to SEQ ID NO: 150654

SEQ ID NO: 298433 - RNA, 64 nt, Homo Sapiens; identical to SEQ ID NO: 150655

SEQ ID NO: 298434 - RNA, 64 nt, Homo Sapiens; identical to SEQ ID NO: 150656

SEQ ID NO: 298435 - RNA, 64 nt, Homo Sapiens; identical to SEQ ID NO: 150657

SEQ ID NO: 298436 - RNA, 64 nt, Homo Sapiens; identical to SEQ ID NO: 150658

SEQ ID NO: 298437 - RNA, 64 nt, Homo Sapiens; identical to SEQ ID NO: 150659

SEQ ID NO: 298438 - RNA, 64 nt, Homo Sapiens; identical to SEQ ID NO: 150660

SEQ ID NO: 298439 - RNA, 64 nt, Homo Sapiens; identical to SEQ ID NO: 150661

SEQ ID NO: 298440 - RNA, 64 nt, Homo Sapiens; identical to SEQ ID NO: 150662

SEQ ID NO: 298441 - RNA, 64 nt, Homo Sapiens; identical to SEQ ID NO: 150663

SEQ ID NO: 298442 - RNA, 64 nt, Homo Sapiens; identical to SEQ ID NO: 150664

SEQ ID NO: 298443 - RNA, 64 nt, Homo Sapiens; identical to SEQ ID NO: 150665

SEQ ID NO: 298444 - RNA, 64 nt, Homo Sapiens; identical to SEQ ID NO: 150666

SEQ ID NO: 298445 - RNA, 64 nt, Homo Sapiens; identical to SEQ ID NO: 150667

SEQ ID NO: 298446 - RNA, 64 nt, Homo Sapiens; identical to SEQ ID NO: 150668

SEQ ID NO: 298447 - RNA, 64 nt, Homo Sapiens; identical to SEQ ID NO: 150669

SEQ ID NO: 298448 - RNA, 64 nt, Homo Sapiens; identical to SEQ ID NO: 150670

SEQ ID NO: 298449 - RNA, 64 nt, Homo Sapiens; identical to SEQ ID NO: 150671

SEQ ID NO: 298450 - RNA, 64 nt, Homo Sapiens; identical to SEQ ID NO: 150672

SEQ ID NO: 298451 - RNA, 64 nt, Homo Sapiens; identical to SEQ ID NO: 150673

SEQ ID NO: 298452 - RNA, 64 nt, Homo Sapiens; identical to SEQ ID NO: 150674

SEQ ID NO: 298453 - RNA, 64 nt, Homo Sapiens; identical to SEQ ID NO: 150675

SEQ ID NO: 298454 - RNA, 64 nt, Homo Sapiens; identical to SEQ ID NO: 150676

SEQ ID NO: 298455 - RNA, 64 nt, Homo Sapiens; identical to SEQ ID NO: 150677

SEQ ID NO: 298456 - RNA, 64 nt, Homo Sapiens; identical to SEQ ID NO: 150678

SEQ ID NO: 298457 - RNA, 64 nt, Homo Sapiens; identical to SEQ ID NO: 150679

SEQ ID NO: 298458 - RNA, 64 nt, Homo Sapiens; identical to SEQ ID NO: 150680

SEQ ID NO: 298459 - RNA, 64 nt, Homo Sapiens; identical to SEQ ID NO: 150681

SEQ ID NO: 298460 - RNA, 64 nt, Homo Sapiens; identical to SEQ ID NO: 150682

SEQ ID NO: 298461 - RNA, 64 nt, Homo Sapiens; identical to SEQ ID NO: 150683

SEQ ID NO: 298462 - RNA, 64 nt, Homo Sapiens; identical to SEQ ID NO: 150684

SEQ ID NO: 298463 - RNA, 64 nt, Homo Sapiens; identical to SEQ ID NO: 150685

SEQ ID NO: 298464 - RNA, 64 nt, Homo Sapiens; identical to SEQ ID NO: 150686

SEQ ID NO: 298465 - RNA, 64 nt, Homo Sapiens; identical to SEQ ID NO: 150687

SEQ ID NO: 298466 - RNA, 64 nt, Homo Sapiens; identical to SEQ ID NO: 150688

SEQ ID NO: 298467 - RNA, 64 nt, Homo Sapiens; identical to SEQ ID NO: 150689

SEQ ID NO: 298468 - RNA, 64 nt, Homo Sapiens; identical to SEQ ID NO: 150690

SEQ ID NO: 298469 - RNA, 64 nt, Homo Sapiens; identical to SEQ ID NO: 150691

SEQ ID NO: 298470 - RNA, 64 nt, Homo Sapiens; identical to SEQ ID NO: 150692

SEQ ID NO: 298471 - RNA, 64 nt, Homo Sapiens; identical to SEQ ID NO: 150693

SEQ ID NO: 298472 - RNA, 64 nt, Homo Sapiens; identical to SEQ ID NO: 150694

SEQ ID NO: 298473 - RNA, 64 nt, Homo Sapiens; identical to SEQ ID NO: 150695

SEQ ID NO: 298474 - RNA, 64 nt, Homo Sapiens
augcaacaguggaauccauguaaaacucucugugcaucuaaauacuucuggagggcgacagauu

SEQ ID NO: 298475 - RNA, 64 nt, Homo Sapiens
cuuguuccucugucuacuguguguuugggggugacaucuaaauuccauuucuucuucuuguuua

SEQ ID NO: 298476 - RNA, 64 nt, Homo Sapiens
auaucaaauaaaauuauuugguuaugguuauguucaucuaaacacaacaauaacuuuuauauua

SEQ ID NO: 298477 - RNA, 64 nt, Homo Sapiens
uucuacaccuccuuuaagauuuacuuaauugcuacaucuaaauucugauaauuuaaaauccauu

SEQ ID NO: 298478 - RNA, 64 nt, Homo Sapiens
uaaauaaauagaaaacaccauaguaaaaugcugacaucuaaaacugaagugagaggaccaagua

SEQ ID NO: 298479 - RNA, 64 nt, Homo Sapiens
aauggcuuucaaacaaagcaaucuacauaucugucaucuaaauauuuuuuauuuauccaguuau

SEQ ID NO: 298480 - RNA, 64 nt, Homo Sapiens
acacacauuucuuauccccauuuuacaaccaaggcaucuaaagcaacaagaaaugaacuugccc

SEQ ID NO: 298481 - RNA, 64 nt, Homo Sapiens
auacuuuuagauauauuuaaaauuuuaacauuggcaucuaaaguguuauuugaaaauaaaauua

SEQ ID NO: 298482 - RNA, 64 nt, Homo Sapiens
caggccaccaaauuuaaaaagugaagaucacugucaucuaaaaggggagacaggugcagaugag

SEQ ID NO: 298483 - RNA, 64 nt, Homo Sapiens
ccagccacugucagcaaagcaugaagguaacaaucaucuaaaagacugagcucaggagagcaag

SEQ ID NO: 298484 - RNA, 64 nt, Homo Sapiens
acucacuggaaauccaauuauuauuaucacuaaucaucuaaacaugcuauggauuuaccauucc

SEQ ID NO: 298485 - RNA, 64 nt, Homo Sapiens
agaaaucagugacaacaaguguaucuucgucacacaucuaaauguacuugcccuuacaggugga

SEQ ID NO: 298486 - RNA, 64 nt, Homo Sapiens
uggaauuuaucccaggaauucaagguugguucaacaucuaaaaaucaaauaagcuaauauacag

SEQ ID NO: 298487 - RNA, 64 nt, Homo Sapiens
cagcaguuagguuaggaauucaagguuuguucaacaucuaaaaaucaaauaagcuaauaaagaa

SEQ ID NO: 298488 - RNA, 64 nt, Homo Sapiens
guuaguggcuuuugcuuggguuguguggacuucucaucuaaaagcaauccucccuaacaauucg

SEQ ID NO: 298489 - RNA, 64 nt, Homo Sapiens
aguaagguauuaggcccuuuuuugagcuauuuuucaucuaaaagcuucuugcauguugaagaua

SEQ ID NO: 298490 - RNA, 64 nt, Homo Sapiens; identical to SEQ ID NO: 21144

SEQ ID NO: 298491 - RNA, 64 nt, Homo Sapiens; identical to SEQ ID NO: 21145

SEQ ID NO: 298492 - RNA, 64 nt, Homo Sapiens; identical to SEQ ID NO: 21146

SEQ ID NO: 298493 - RNA, 64 nt, Homo Sapiens; identical to SEQ ID NO: 21147

SEQ ID NO: 298494 - RNA, 64 nt, Homo Sapiens; identical to SEQ ID NO: 21148

SEQ ID NO: 298495 - RNA, 64 nt, Homo Sapiens; identical to SEQ ID NO: 21149

SEQ ID NO: 298496 - RNA, 64 nt, Homo Sapiens; identical to SEQ ID NO: 183939

SEQ ID NO: 298497 - RNA, 64 nt, Homo Sapiens; identical to SEQ ID NO: 183940

SEQ ID NO: 298498 - RNA, 64 nt, Homo Sapiens; identical to SEQ ID NO: 183941

SEQ ID NO: 298499 - RNA, 64 nt, Homo Sapiens; identical to SEQ ID NO: 183942

SEQ ID NO: 298500 - RNA, 64 nt, Homo Sapiens; identical to SEQ ID NO: 183943

SEQ ID NO: 298501 - RNA, 64 nt, Homo Sapiens; identical to SEQ ID NO: 183944

SEQ ID NO: 298502 - RNA, 64 nt, Homo Sapiens; identical to SEQ ID NO: 183945

SEQ ID NO: 298503 - RNA, 64 nt, Homo Sapiens; identical to SEQ ID NO: 183946

SEQ ID NO: 298504 - RNA, 64 nt, Homo Sapiens; identical to SEQ ID NO: 183947

SEQ ID NO: 298505 - RNA, 64 nt, Homo Sapiens; identical to SEQ ID NO: 183948

SEQ ID NO: 298506 - RNA, 64 nt, Homo Sapiens; identical to SEQ ID NO: 183949

SEQ ID NO: 298507 - RNA, 64 nt, Homo Sapiens; identical to SEQ ID NO: 183950

SEQ ID NO: 298508 - RNA, 64 nt, Homo Sapiens; identical to SEQ ID NO: 183951

SEQ ID NO: 298509 - RNA, 64 nt, Homo Sapiens; identical to SEQ ID NO: 183952

SEQ ID NO: 298510 - RNA, 64 nt, Homo Sapiens; identical to SEQ ID NO: 183953

SEQ ID NO: 298511 - RNA, 64 nt, Homo Sapiens; identical to SEQ ID NO: 183954

SEQ ID NO: 298512 - RNA, 64 nt, Homo Sapiens; identical to SEQ ID NO: 183955

SEQ ID NO: 298513 - RNA, 64 nt, Homo Sapiens; identical to SEQ ID NO: 183956

SEQ ID NO: 298514 - RNA, 64 nt, Homo Sapiens; identical to SEQ ID NO: 183957

SEQ ID NO: 298515 - RNA, 64 nt, Homo Sapiens; identical to SEQ ID NO: 183958

SEQ ID NO: 298516 - RNA, 64 nt, Homo Sapiens; identical to SEQ ID NO: 183959

SEQ ID NO: 298517 - RNA, 64 nt, Homo Sapiens; identical to SEQ ID NO: 183960

SEQ ID NO: 298518 - RNA, 64 nt, Homo Sapiens; identical to SEQ ID NO: 183961

SEQ ID NO: 298519 - RNA, 64 nt, Homo Sapiens; identical to SEQ ID NO: 183962

SEQ ID NO: 298520 - RNA, 64 nt, Homo Sapiens; identical to SEQ ID NO: 183963

SEQ ID NO: 298521 - RNA, 64 nt, Homo Sapiens; identical to SEQ ID NO: 183964

SEQ ID NO: 298522 - RNA, 64 nt, Homo Sapiens; identical to SEQ ID NO: 183965

SEQ ID NO: 298523 - RNA, 64 nt, Homo Sapiens; identical to SEQ ID NO: 183966

SEQ ID NO: 298524 - RNA, 60 nt, Homo Sapiens
ugaagagaugccuugcgguguggccagcugugaggagaaagcagcuggcaguguuaggac

SEQ ID NO: 298525 - RNA, 60 nt, Homo Sapiens
cauuuaaacaccuuuuguguuuuacuucagugaggagauuggagucugaauggaucuguu

SEQ ID NO: 298526 - RNA, 60 nt, Homo Sapiens
ugugucggacaagcaacuucuuuuccucugugaggagacaagacuuggagacucagcgau

SEQ ID NO: 298527 - RNA, 60 nt, Homo Sapiens
uuuguagguauuuuuuuauaaccccagugcugaggagaaaggaggggcaguggcuucccc

SEQ ID NO: 298528 - RNA, 60 nt, Homo Sapiens
ggaagaagaagaggaaguaguugaaaaugaugaggagauagccuuuucaggcaaggacaa

SEQ ID NO: 298529 - RNA, 60 nt, Homo Sapiens
aggcaaggacaagccagcuucagagaauagugaggagaagcugaucaguaaguuugacaa

SEQ ID NO: 298530 - RNA, 60 nt, Homo Sapiens
uaguuuuuaaaaauguuuuuaguuaaacguugaggagaaaaaaaaaaaaggcuuuucccc

SEQ ID NO: 298531 - RNA, 60 nt, Homo Sapiens
uguguuggggggaugcuuggcagcugggggugaggagacaacaaaccucgggaacuggag

SEQ ID NO: 298532 - RNA, 60 nt, Homo Sapiens
agauagggggcugugguccuuccuuucuccugaggagaaaguccuugcucuggugaccug

SEQ ID NO: 298533 - RNA, 60 nt, Homo Sapiens
ucugacaugauuuacuuuuaaggaaaguuaugaggagagaauacaaaaagcaugcaccaa

SEQ ID NO: 298534 - RNA, 60 nt, Homo Sapiens
augaugucacccuggccauguguacugacuugaggagaucuugcaacauggccaugugca

SEQ ID NO: 298535 - RNA, 60 nt, Homo Sapiens
gccaacuaaacuacucuuuaggcagccuucugaggagaaaagcaacccuguuucaaaucc

SEQ ID NO: 298536 - RNA, 60 nt, Homo Sapiens
caugugaaagcgucucuuugucuggagcuuugaggagauguuuuccuucacuuuaguuuc

SEQ ID NO: 298537 - RNA, 60 nt, Homo Sapiens
ccgcaagaagccaggcccggcccuggccuuugaggagaagugcucuacacugaagguacc

SEQ ID NO: 298538 - RNA, 60 nt, Homo Sapiens
uguuguauugcuuaccauguccccauacuaugaggagaaguuuuguggugccgcugguga

SEQ ID NO: 298539 - RNA, 60 nt, Homo Sapiens
uucuugguucugcaggaacuucucaagggaugaggagacagaaccccuacuuccaagugc

SEQ ID NO: 298540 - RNA, 60 nt, Homo Sapiens
ggaccaagucgugggggaggggggcgguguugaggagagguauuuuuaaagaucuggcaa

SEQ ID NO: 298541 - RNA, 60 nt, Homo Sapiens
aaaaggagggaagcuguagcuguuuggaugugaggagaaugaaacuacaaaaaaaaauaa

SEQ ID NO: 298542 - RNA, 60 nt, Homo Sapiens
cuucuuggugauucaaagguuaauagaggcugaggagauugcaggggaaacacccuugcu

SEQ ID NO: 298543 - RNA, 60 nt, Homo Sapiens
gcaaugggaaagugaugagugcgggaguccugaggagauguggccugcagacaacaugca

SEQ ID NO: 298544 - RNA, 60 nt, Homo Sapiens
gggcuaguuaguucuuggagcagcugcuuuugaggagaaaauauauagcuuuggacacga

SEQ ID NO: 298545 - RNA, 60 nt, Homo Sapiens
cuggaucuaaagaaauuacccagugagcagugaggagaaacaaggagcuagaaaacauug

SEQ ID NO: 298546 - RNA, 60 nt, Homo Sapiens
aaugggacucaucuuuuccugccuugcuuuugaggagaugguugaauuuaagcuaacagg

SEQ ID NO: 298547 - RNA, 60 nt, Homo Sapiens
cuggcaagaugcuuuaggaagauaaaaguuugaggagaacaaacaggaauucugaauuaa

SEQ ID NO: 298548 - RNA, 60 nt, Homo Sapiens
gucauaaauggauaaaaggaauuuacaacuugaggagaaaaccuuuacaauuuccuaugg

SEQ ID NO: 298549 - RNA, 60 nt, Homo Sapiens
cuucucuuuagucagggcaugcuuuauuagugaggagaaaacaauuccuuagaagucuua

SEQ ID NO: 298550 - RNA, 60 nt, Homo Sapiens
uuccguaccccugaggaaacaaaaaggaaaugaggagagaaaguuacuguuaaggguggu

SEQ ID NO: 298551 - RNA, 60 nt, Homo Sapiens
gguuuuaguccauugguagcauuguguguaugaggagauucaacaccacagacagcugca

SEQ ID NO: 298552 - RNA, 60 nt, Homo Sapiens
uucuuucaagauuaucuaaaaaaggggaagugaggagaauuuugaugaaagauggaggau

SEQ ID NO: 298553 - RNA, 60 nt, Homo Sapiens
accagggaugcugggcuggguggccugaacugaggagaugaggggucucggaugacaccc

SEQ ID NO: 298554 - RNA, 60 nt, Homo Sapiens
guguauagucauggguucugcccuccggcuugaggagagauugccaaagcccucauaaag

SEQ ID NO: 298555 - RNA, 60 nt, Homo Sapiens
gauguauaaagcaacaugaagguucuguauugaggagaagguuaggaaaauuacauuccu

SEQ ID NO: 298556 - RNA, 60 nt, Homo Sapiens
ccacagacugaaaagugagugaggcugcauugaggagacuugauggaaccacccucccca

SEQ ID NO: 298557 - RNA, 60 nt, Homo Sapiens
agaagccuccauuuuuaaagcugccagccuugaggagagccaugccugaucucuucuuua

SEQ ID NO: 298558 - RNA, 60 nt, Homo Sapiens
gagguccaggguggguuacaggcagaaagaugaggagacagcugaccccuggggcucuug

SEQ ID NO: 298559 - RNA, 60 nt, Homo Sapiens
cggccaaagauucuuuauauguagaaccagugaggagaugaaaggguuaauagccagaua

SEQ ID NO: 298560 - RNA, 60 nt, Homo Sapiens
acacaggauuugaagucagaccucaggcuuugaggagaaugugcccccaacccugggcau

SEQ ID NO: 298561 - RNA, 60 nt, Homo Sapiens
uugacagauuuugaaaaugaaauuuaaugcugaggagagugauuaguuaaagggauaauu

SEQ ID NO: 298562 - RNA, 60 nt, Homo Sapiens
uagccaugcugacucaugaaucuuuuaucaugaggagaggccagaacucagcaacccagc

SEQ ID NO: 298563 - RNA, 60 nt, Homo Sapiens
guaaauugagguuuggggaugagggauacaugaggagagaacuacagaggggaaccauuu

SEQ ID NO: 298564 - RNA, 60 nt, Homo Sapiens
gugacauguggggagaggacggggagaggcugaggagagugaggagggagagcaggguug

SEQ ID NO: 298565 - RNA, 60 nt, Homo Sapiens
uuuaauauuuugcccuugaacagagaagaaugaggagaagacuggggggaauguucucag

SEQ ID NO: 298566 - RNA, 60 nt, Homo Sapiens
aaggagaaaagggaaaagcaguaaagagaaugaggagaaagagggucacauagguagaug

SEQ ID NO: 298567 - RNA, 60 nt, Homo Sapiens
agacccugcucugguggagcguuccuggcaugaggagagacccuacccccacuucucuca

SEQ ID NO: 298568 - RNA, 60 nt, Homo Sapiens
gggcacaggagagagggcagcaacaggggcugaggagagagacgcaucucagccuggaac

SEQ ID NO: 298569 - RNA, 60 nt, Homo Sapiens
gcugaggagggcagaagggcaagagagccaugaggagagggcacauuuggagggaaagac

SEQ ID NO: 298570 - RNA, 60 nt, Homo Sapiens
gacagagagagagaauggaucuccaggucuugaggagagauuuggagcacuguucuggga

SEQ ID NO: 298571 - RNA, 60 nt, Homo Sapiens
gggaggugaaauggggaaaugcuccaggagugaggagacuauccaagugcagagcucuuu

SEQ ID NO: 298572 - RNA, 60 nt, Homo Sapiens
caaauaagaccauaaagggauugucuuuucugaggagaaauguuuauacagcucagcuuu

SEQ ID NO: 298573 - RNA, 60 nt, Homo Sapiens
ucgaauuuacugcuuuuuccagcaaguagcugaggagaggugaggccaguuucuaugaag

SEQ ID NO: 298574 - RNA, 60 nt, Homo Sapiens
gggacaggugaauggaggaggcacagugggugaggagaugacccaggaugauuuccuggg

SEQ ID NO: 298575 - RNA, 60 nt, Homo Sapiens
ccccuaagaggugaaagagagauggcugugugaggagaguuuaaagaccaacuucccuuu

SEQ ID NO: 298576 - RNA, 60 nt, Homo Sapiens
ggguaacugccuuuagguccgcaaaugaggugaggagauggcaaugucugaauggaauug

SEQ ID NO: 298577 - RNA, 60 nt, Homo Sapiens
acaaaguguuucacuaggaauuauacauuuugaggagaaacuaaggaguaaacagcuuau

SEQ ID NO: 298578 - RNA, 60 nt, Homo Sapiens
acaggaaacgggcuuucucuggcaaaguggugaggagaaacaggguuggugugaugccaa

SEQ ID NO: 298579 - RNA, 60 nt, Homo Sapiens
gcuccaagcguacaggagaugggccauaccugaggagagaauguaugagaucaaaaaaga

SEQ ID NO: 298580 - RNA, 60 nt, Homo Sapiens
caauacuggaaccaccgggugcgauggcagugaggagacugcccagugccuuuggggcug

SEQ ID NO: 298581 - RNA, 60 nt, Homo Sapiens
uaauauuuuaaauuuucaaaaacccauuccugaggagaacuacuucuagcauuccuuuuc

SEQ ID NO: 298582 - RNA, 60 nt, Homo Sapiens
gcaaaugugauuauguuaaggaucuugaaaugaggagacaauccuggguuauccuugugg

SEQ ID NO: 298583 - RNA, 60 nt, Homo Sapiens
cuaaaugccuucuauagaaguaauuuuugaugaggagaaaugguacaauacuaauuaaca

SEQ ID NO: 298584 - RNA, 60 nt, Homo Sapiens
gaaaccaaccauacagacgagccgaugcggugaggagaagcgucaggcggcgcuuugaug

SEQ ID NO: 298585 - RNA, 60 nt, Homo Sapiens
uguugggaugugaaauuuauuuucuaaaauugaggagaaggaaguuauauauuugcagaa

SEQ ID NO: 298586 - RNA, 60 nt, Homo Sapiens
caacucugcccagccgccccgucugagaagugaggagacccuccgccuggcaaccgcccc

SEQ ID NO: 298587 - RNA, 60 nt, Homo Sapiens
caaaucucugucaccaguggacuguaucccugaggagaacaacucagcccacccuuccuu

SEQ ID NO: 298588 - RNA, 60 nt, Homo Sapiens
guaaacaaacccuguuaugcuguauuauuaugaggagauucuucauuguuuucuuuccuu

SEQ ID NO: 298589 - RNA, 60 nt, Homo Sapiens
uacuacacuuugcuccucuggcccaaggcaugaggagagaggcugugucagaaacugaag

SEQ ID NO: 298590 - RNA, 60 nt, Homo Sapiens
gaauggaguaaugaaauucuugccaugugcugaggagauagccagcauuaggugacaauc

SEQ ID NO: 298591 - RNA, 54 nt, Homo Sapiens
uugcagaggcugcagggccgguccugaggagagguauccugcugcucacuguga

SEQ ID NO: 298592 - RNA, 60 nt, Homo Sapiens
aagacauagucuaauuugauaaauauauuuugaggagaaauucugaauucugaguuuuga

SEQ ID NO: 298593 - RNA, 60 nt, Homo Sapiens
gucuaguucauugcuacugccaccucugcuugaggagaaauugcugagcagcuuuuaaua

SEQ ID NO: 298594 - RNA, 60 nt, Homo Sapiens
gaacugcucggaagacauugagaggagguuugaggagagagugagggugaguaaagaggu

SEQ ID NO: 298595 - RNA, 60 nt, Homo Sapiens
cccaauggcuaccuagacuacugacacugcugaggagaaaguugcuguuuuuauuaccag

SEQ ID NO: 298596 - RNA, 60 nt, Homo Sapiens
uacuaacuggacugacccuaucaccauuugugaggagaaaagccauccuggaguugauau

SEQ ID NO: 298597 - RNA, 60 nt, Homo Sapiens
caaaaacaugcagccuuaaggucguuauaaugaggagaguaucuucccaggcaaucuugu

SEQ ID NO: 298598 - RNA, 60 nt, Homo Sapiens
uuuaaaagagaagaaacacugaagauguccugaggagaaaagcuggacauauacugggcu

SEQ ID NO: 298599 - RNA, 60 nt, Homo Sapiens
ggcagacccagggggaagaaaggagggcugugaggagauaccucauuaaacuuggcuuag

SEQ ID NO: 298600 - RNA, 60 nt, Homo Sapiens
cagccaucgaguacuguauguauuuccaccugaggagaaggccuggggaggccacagugc

SEQ ID NO: 298601 - RNA, 60 nt, Homo Sapiens
cauccccuuggccacagagccauugugauaugaggagauacuggcucuucuggaaaagag

SEQ ID NO: 298602 - RNA, 60 nt, Homo Sapiens
agaauggaacaguggggagcuaacugugaaugaggagaguaccugcugcaggaccuggag

SEQ ID NO: 298603 - RNA, 60 nt, Homo Sapiens
ggauguucaaacagggaacacugucagggcugaggagaacagaagcucugguaagcgaau

SEQ ID NO: 298604 - RNA, 60 nt, Homo Sapiens
ugaaaaaugauacuuagagaugaggcgacaugaggagauauauuauucaucauagauggc

SEQ ID NO: 298605 - RNA, 60 nt, Homo Sapiens
uagaaaucauucuuuacaguuuugcauugcugaggagagagaaaaaacaauuuuuuugca

SEQ ID NO: 298606 - RNA, 60 nt, Homo Sapiens
agccacgguggggcuuuuuucuccucaguuugaggagaaaaaucuugaugucauuacucc

SEQ ID NO: 298607 - RNA, 60 nt, Homo Sapiens
accccuggaacuggcggguauucuggucauugaggagacaccauaguggaaacuggggcu

SEQ ID NO: 298608 - RNA, 60 nt, Homo Sapiens
ugggugcugaagcaagaaaccgacagauguugaggagaauggugugaccuaggagucagc

SEQ ID NO: 298609 - RNA, 60 nt, Homo Sapiens
aaaagagauggagggagaucuucauuucuuugaggagaucaguauuguaacguaugugaa

SEQ ID NO: 298610 - RNA, 60 nt, Homo Sapiens
ccaccuaguggagacauuggauggaggaaaugaggagacaagcagggagguuuguaggcc

SEQ ID NO: 298611 - RNA, 60 nt, Homo Sapiens
gugggcugcgccccacagaacugagggccgugaggagaagacgcccugccgcuacuucac

SEQ ID NO: 298612 - RNA, 60 nt, Homo Sapiens
agaaagcacacugccuaaauuugcuuuaacugaggagaaauagaaauauuggccaaggug

SEQ ID NO: 298613 - RNA, 60 nt, Homo Sapiens
agauuuuucagguguagcuauaaguucaucugaggagaaaugguggucucuugaauuuug

SEQ ID NO: 298614 - RNA, 60 nt, Homo Sapiens
ccaucuccaggugugcuuucacuuuagcuuugaggagauaaaacacuugaacacuugaug

SEQ ID NO: 298615 - RNA, 60 nt, Homo Sapiens
ucugauucucccauccgggacugacccaaaugaggagagcaccucgugagccagccaccc

SEQ ID NO: 298616 - RNA, 60 nt, Homo Sapiens
cagauggcuggaguggguauaaguugggguugaggagagcccacucccuuggaggaacug

SEQ ID NO: 298617 - RNA, 60 nt, Homo Sapiens
ggcuggaagcccugggcauucacccaagggugaggagaggcaaaucaguguuggauggac

SEQ ID NO: 298618 - RNA, 60 nt, Homo Sapiens
gaguaguaagcagaacuaagaagcugucguugaggagaagaguucacuucuggaugcugg

SEQ ID NO: 298619 - RNA, 60 nt, Homo Sapiens
gaagaaggccugcuggggcucugacugcucugaggagaggucucagcuacuccagggcac

SEQ ID NO: 298620 - RNA, 60 nt, Homo Sapiens
gacaucacuguauuuggaauaaugcccuauugaggagaaggauggcagaacccccaagcg

SEQ ID NO: 298621 - RNA, 60 nt, Homo Sapiens
agcagcaaaacauaaccauaagcacauguaugaggagaccaguagugcucucguugauga

SEQ ID NO: 298622 - RNA, 60 nt, Homo Sapiens
gagaaucaagacgaggacccgucaguuauaugaggagaguggaacgugcagucaucaaug

SEQ ID NO: 298623 - RNA, 60 nt, Homo Sapiens
cacucugaauucaguggcagagagccacacugaggagaaguuuuuuucuuugauacauag

SEQ ID NO: 298624 - RNA, 60 nt, Homo Sapiens
guggggauaaucccugaagagcaugcuuucugaggagauauagaugauauaacaaagaaa

SEQ ID NO: 298625 - RNA, 60 nt, Homo Sapiens
ccacauccuauaaagaagccgagucucuugugaggagaauuaccuugaacuugcccugca

SEQ ID NO: 298626 - RNA, 60 nt, Homo Sapiens
cuuuuccacuuuggaaugaccagggagcccugaggagaugcaauggcuccaccauucccc

SEQ ID NO: 298627 - RNA, 60 nt, Homo Sapiens
cgggaguggcugauggaagcuguucuuggcugaggagaagggaagugacaggacuuucau

SEQ ID NO: 298628 - RNA, 60 nt, Homo Sapiens
acaacuguauuuauuaacgcuuacuagaugugaggagagucugaauauuuucagugaucu

SEQ ID NO: 298629 - RNA, 60 nt, Homo Sapiens
aaaccagcaggauacaaguugcaaaugaaaugaggagaaacaguuucaacucugaaagug

SEQ ID NO: 298630 - RNA, 60 nt, Homo Sapiens
cuucaauaauguucaacugaaucucacagaugaggagagagaagaaacggaagaggaagu

SEQ ID NO: 298631 - RNA, 60 nt, Homo Sapiens
acagugugugguaagagcugccuguuacagugaggagaucaaacaucaaccgggucucaa

SEQ ID NO: 298632 - RNA, 60 nt, Homo Sapiens
gacaccccauauuacaugauaauaaaugcuugaggagaugaauggauuguuuguaacaca

SEQ ID NO: 298633 - RNA, 60 nt, Homo Sapiens
uaaaggaguauuaucaguaagcaaacgucaugaggagaaucuugcuuggaaaccccacau

SEQ ID NO: 298634 - RNA, 60 nt, Homo Sapiens
acauuucaacuuuguuccuaauuguuuauuugaggagauagauaucagaguuauuuaaaa

SEQ ID NO: 298635 - RNA, 60 nt, Homo Sapiens
cccuaaacucgagguggugugggcuagaagugaggagaauuguuaguuuauccaaaguuu

SEQ ID NO: 298636 - RNA, 60 nt, Homo Sapiens
cucugugugaacaggaaacuuuagggcagaugaggagaaugaauugguuaucagagugga

SEQ ID NO: 298637 - RNA, 60 nt, Homo Sapiens
gcuuugcucuuugucugcauuaagagaggaugaggagagcuggucaaacauuccuugugu

SEQ ID NO: 298638 - RNA, 60 nt, Homo Sapiens
auguuuacguuuucaaagaaaucaaguauaugaggagagcgagcgagcgugagagaacac

SEQ ID NO: 298639 - RNA, 50 nt, Homo Sapiens
ccaucguucacacucuaugaugaggagauucagacuccacaguguauaua

SEQ ID NO: 298640 - RNA, 60 nt, Homo Sapiens
aauuuuuauugaaugaacaaaugagguguaugaggagagaugguuuucuccugcucagcu

SEQ ID NO: 298641 - RNA, 60 nt, Homo Sapiens
cuuccauuauugaguuccuccuaaggaaauugaggagagggacugaauagaagcccaaau

SEQ ID NO: 298642 - RNA, 60 nt, Homo Sapiens
ugcugggcaccaggacgcugcgagggacacugaggagaggccugauccggucugugggga

SEQ ID NO: 298643 - RNA, 60 nt, Homo Sapiens
uccccuguuuucuguuuaaucaggcuggggugaggagagcgccauuggggagcacagggc

SEQ ID NO: 298644 - RNA, 60 nt, Homo Sapiens
cuugaagaauuuggauucaggagaacacacugaggagauacaaaagggauccuuucauag

SEQ ID NO: 298645 - RNA, 60 nt, Homo Sapiens
augccguugagcuuggcuacucguuccuccugaggagacccauauaguucugauuggauu

SEQ ID NO: 298646 - RNA, 60 nt, Homo Sapiens
gcuagcucuagcaugaagcuuguaaguuucugaggagaaaccauagggauguuuuuagga

SEQ ID NO: 298647 - RNA, 60 nt, Homo Sapiens
guuggggggcauuuauaaugaauucaggguugaggagacuuuuuggugcauuacuugguc

SEQ ID NO: 298648 - RNA, 60 nt, Homo Sapiens
guucuggaacuagauaguggccauuuggggugaggagaaacagccauauguauggggcuu

SEQ ID NO: 298649 - RNA, 60 nt, Homo Sapiens
cugaacauuuugcaaaacuugacaagacacugaggagauauggaccugucucuaccuaag

SEQ ID NO: 298650 - RNA, 60 nt, Homo Sapiens
ggcgccaucuucugcccaccguggcuucuuugaggagaagugggaagguccuggaagagg

SEQ ID NO: 298651 - RNA, 60 nt, Homo Sapiens
aaaaugaaacuaugagcugugggaagggggugaggagaugucccugcucagcgcuccccu

SEQ ID NO: 298652 - RNA, 60 nt, Homo Sapiens
auucagaaguggagauuucaguucagcgguugaggagaauugcggcgagacaagcaugga

SEQ ID NO: 298653 - RNA, 60 nt, Homo Sapiens
acugccaugagaaacacaggggaaaccugaugaggagaaggauaagacugcguaaggaga

SEQ ID NO: 298654 - RNA, 60 nt, Homo Sapiens
cggccugccucccaccuggaagucugggaaugaggagauugagauaaacuuuugaaaucc

SEQ ID NO: 298655 - RNA, 60 nt, Homo Sapiens
aguagaagcuuuccucuccccuucucaccuugaggagauaaaaauucucuaggcaggaaa

SEQ ID NO: 298656 - RNA, 60 nt, Homo Sapiens
gacuauucaacaacuucuuugcugaagcacugaggagauuuguaauacuccuaaaggaag

SEQ ID NO: 298657 - RNA, 60 nt, Homo Sapiens
uuacuuaaaguugauuuugaacuuuuuauuugaggagacgaagugaaaacaaaucuauaa

SEQ ID NO: 298658 - RNA, 60 nt, Homo Sapiens
gggcugugucccccucagacuggggcugccugaggagaugaaugaaacuuacuaagaaua

SEQ ID NO: 298659 - RNA, 60 nt, Homo Sapiens
ugauggagggagggagccccccaaccucagugaggagagccccgagccggccccggggca

SEQ ID NO: 298660 - RNA, 60 nt, Homo Sapiens
caaguuuuuccaggccagcuccaguuucagugaggagagugugggcuuucuauuccccaa

SEQ ID NO: 298661 - RNA, 60 nt, Homo Sapiens
auaauuuugaaccaauuuauuauuguguacugaggagaaauaauguauaguagaggacag

SEQ ID NO: 298662 - RNA, 60 nt, Homo Sapiens
gcaauggaguggagugucuccuggagagagugaggagagugugugauagcuagaaagaga

SEQ ID NO: 298663 - RNA, 60 nt, Homo Sapiens
aguaacuuucauuggagguugggaaggaagugaggagaaaguguucuuguuuaguguuuu

SEQ ID NO: 298664 - RNA, 60 nt, Homo Sapiens
cgugacagaugaagaaaccaagggggcugcugaggagaccuggugcagggacuaauccug

SEQ ID NO: 298665 - RNA, 60 nt, Homo Sapiens
uguggaaagugagaaaaaccuccauuguggugaggagaauacuucaaugucccuuguccu

SEQ ID NO: 298666 - RNA, 60 nt, Homo Sapiens
aacagaugcagacauguguguugguaguagugaggagauugguauuagcaucaagucuuc

SEQ ID NO: 298667 - RNA, 60 nt, Homo Sapiens
agggcagggucucaaacagugaggugggagugaggagauguagugggguggaggcugcug

SEQ ID NO: 298668 - RNA, 60 nt, Homo Sapiens
aaagcacaagcuugccugaagagcccacuuugaggagagcuaagcgcucauuaagcagag

SEQ ID NO: 298669 - RNA, 60 nt, Homo Sapiens
auugcuuguaaaauccugagcuggugaaacugaggagagcauauaguacuggacacagua

SEQ ID NO: 298670 - RNA, 60 nt, Homo Sapiens
cugccaggagcaugggacucaccugugccuugaggagaugcuuuugcaggggaucugggc

SEQ ID NO: 298671 - RNA, 60 nt, Homo Sapiens
uuuuuuugguuuugggguuucaauuuagggugaggagacucaggguucaauagaaauccu

SEQ ID NO: 298672 - RNA, 60 nt, Homo Sapiens
aaauguagcuggcugcaaacgaucauaggcugaggagaaaaaugguauguauuaauaacu

SEQ ID NO: 298673 - RNA, 60 nt, Homo Sapiens
cauaucagagaacauuuguagucuuucuagugaggagauacuucauauauguuuaagguu

SEQ ID NO: 298674 - RNA, 60 nt, Homo Sapiens
uuacaauguguaauggaaacagucaagaguugaggagacaaaauguucaagucaugccug

SEQ ID NO: 298675 - RNA, 60 nt, Homo Sapiens
ccuuuggagugacagguaugaccuggcugcugaggagaguauccuccccugcuucauccu

SEQ ID NO: 298676 - RNA, 60 nt, Homo Sapiens
gagaaugauaauccuggacaugggugaacaugaggagaaccagcaaaaucugugguguuu

SEQ ID NO: 298677 - RNA, 60 nt, Homo Sapiens
aaaaaaaaaaccacaccuaaaauagaccacugaggagaccauagagcggaugcuuucaug

SEQ ID NO: 298678 - RNA, 60 nt, Homo Sapiens
uuaucaagggcugguggggcaguggaggauugaggagauauuggucaaaauuuacaaaau

SEQ ID NO: 298679 - RNA, 60 nt, Homo Sapiens
gauuauaaauguaauaagcauguaugugugugaggagauucagucauaacccaacgcuca

SEQ ID NO: 298680 - RNA, 60 nt, Homo Sapiens
uuuaaggcauggagcugagaagucugggagugaggagaucccaguccggcuaagcuuggu

SEQ ID NO: 298681 - RNA, 60 nt, Homo Sapiens
cacauuacguggaccuggucccaggcucagugaggagauggccucagcuguggggcuggu

SEQ ID NO: 298682 - RNA, 60 nt, Homo Sapiens
aagcuuccuucaaccugcauagccggugggugaggagauucccaccuuccauagccucca

SEQ ID NO: 298683 - RNA, 60 nt, Homo Sapiens
aucugacuuugagucacagaaaccuuaaacugaggagacaauaguucagaaccuuuuuaa

SEQ ID NO: 298684 - RNA, 60 nt, Homo Sapiens
uuugcucuugccaaagugagauagauguacugaggagauaauugaaaagucagacucugu

SEQ ID NO: 298685 - RNA, 60 nt, Homo Sapiens
aaaagggacaggacccuucggaggugccugugaggagaggggagcaggaccucucccucc

SEQ ID NO: 298686 - RNA, 60 nt, Homo Sapiens
cuuuuaauucgaagauuuuaaccuaugacuugaggagaaauuagaaucaguguaucagug

SEQ ID NO: 298687 - RNA, 60 nt, Homo Sapiens
gguagagaggagaggagagacaccuggcacugaggagaaucaguggguggaaucuguccc

SEQ ID NO: 298688 - RNA, 60 nt, Homo Sapiens
uucugucuuucaaaagguaagaaaacaauaugaggagacauuguuaugucuagaaaguaa

SEQ ID NO: 298689 - RNA, 60 nt, Homo Sapiens
uuccuaucauuaacaaaaauuugaacuuacugaggagauacuucccuguuauaaaauggu

SEQ ID NO: 298690 - RNA, 60 nt, Homo Sapiens
augagguuaggacugagaagggugugcaugugaggagaagcuggggcaguaucuucugau

SEQ ID NO: 298691 - RNA, 60 nt, Homo Sapiens
aggggacacucgaguccaggugcgugcaggugaggagagaccaggucugcuuaggggacc

SEQ ID NO: 298692 - RNA, 60 nt, Homo Sapiens
accagaucaggagagcaagggaaggcgggcugaggagacaggcuguuuugccuccccacg

SEQ ID NO: 298693 - RNA, 60 nt, Homo Sapiens
ccagugcagugcccucuucccuuccugcacugaggagauuaacugaagugacagauuaga

SEQ ID NO: 298694 - RNA, 60 nt, Homo Sapiens
uugcagagcaaacaaagcagaggcaagaacugaggagaaguaucagagacaaacgggacu

SEQ ID NO: 298695 - RNA, 60 nt, Homo Sapiens
caccucaugaugcaguggcuccucucugguugaggagagggaaaauuggaaaaacugguc

SEQ ID NO: 298696 - RNA, 60 nt, Homo Sapiens
ccacucccaagaaauucaggaaagaaagacugaggagaaggugugggaacauucuggaug

SEQ ID NO: 298697 - RNA, 60 nt, Homo Sapiens
augauuguuaccauaaauuagugcuaaugcugaggagaacuacaguuuuucuuuugaauu

SEQ ID NO: 298698 - RNA, 60 nt, Homo Sapiens
ugaaauugugcgauguauuugugagauggaugaggagaauggcuucaugauccagguaau

SEQ ID NO: 298699 - RNA, 60 nt, Homo Sapiens
ccuccaaaaccagcauuucaucaucaaauaugaggagaaauacagcugguaaugccgcug

SEQ ID NO: 298700 - RNA, 60 nt, Homo Sapiens
gcuaacggaacacauccaaacagaaaguacugaggagaaaagagaaaaaaaagucucccu

SEQ ID NO: 298701 - RNA, 60 nt, Homo Sapiens
guggcaucaggagcugcucacuggggagugugaggagaggcugcccuccugccaaaagau

SEQ ID NO: 298702 - RNA, 60 nt, Homo Sapiens
ugaaaaccagggcgguagaaggcaccauguugaggagagaaccuggacauugagccucca

SEQ ID NO: 298703 - RNA, 60 nt, Homo Sapiens
augccucaaaaagaguagcuaacuggaagcugaggagaauugauguguuuaucaaaugau

SEQ ID NO: 298704 - RNA, 60 nt, Homo Sapiens
agcaguucaguuuacaaaacuucuugcggcugaggagaggaagacugucuuccuaucugc

SEQ ID NO: 298705 - RNA, 60 nt, Homo Sapiens
acccuaggcagccugcaggggugaucuguuugaggagagccauagaugcaggaggcucag

SEQ ID NO: 298706 - RNA, 60 nt, Homo Sapiens
ggaaacucaagucucaccauaggagaagagugaggagaaagcacagcagcucccucaagg

SEQ ID NO: 298707 - RNA, 60 nt, Homo Sapiens
aaaagaaguguauucucuugcacucuaagaugaggagaacaguuguaucugcugugcauu

SEQ ID NO: 298708 - RNA, 60 nt, Homo Sapiens
uagcaugcccuauuggcagugcagacugggugaggagaccauuaaccuaagacacagaag

SEQ ID NO: 298709 - RNA, 60 nt, Homo Sapiens
aagcauaaaaauauagcauaucauagacuuugaggagagagcauaagugccauccuuuaa

SEQ ID NO: 298710 - RNA, 60 nt, Homo Sapiens
uccuuuuucccuuuguuuuuaaaaauuacaugaggagaaauuuugcuacauagucuacuc

SEQ ID NO: 298711 - RNA, 60 nt, Homo Sapiens
cugauccaguuuccggaaacccucuuuaacugaggagaagcagccgcccacuucccguuu

SEQ ID NO: 298712 - RNA, 60 nt, Homo Sapiens
uuccagaaccauccccuuuucaaacugcauugaggagaaggcuuuguaccagagcaccuc

SEQ ID NO: 298713 - RNA, 60 nt, Homo Sapiens
auuuucugugcguuuugacccugaggcaucugaggagaggccacaucuuguguaugcccu

SEQ ID NO: 298714 - RNA, 60 nt, Homo Sapiens
cagguaccuauuauuguucccuggugaaacugaggagaaaaguuaaucaaccagguuacu

SEQ ID NO: 298715 - RNA, 60 nt, Homo Sapiens
accaucguaacauggaggccucagcugcucugaggagagaaaucagacuuuguuuuuuga

SEQ ID NO: 298716 - RNA, 60 nt, Homo Sapiens
ccccagcugcaaacugagugugccggacccugaggagaggcuggacucggggcaugugug

SEQ ID NO: 298717 - RNA, 60 nt, Homo Sapiens
agcccaagauggccaauggggagccccaggugaggagagaagcaucugggggcacuccaa

SEQ ID NO: 298718 - RNA, 60 nt, Homo Sapiens
gcuuugauccugagaaccuugcuguugcucugaggagauauaauucugggagaaagaauc

SEQ ID NO: 298719 - RNA, 60 nt, Homo Sapiens
ugugcucucaggacagccccauuuuagggaugaggagacuucaccacgcccuccccuccc

SEQ ID NO: 298720 - RNA, 60 nt, Homo Sapiens
ugaauguccucauuuuacagaugaggacauugaggagaagagacuuacccaggcucacac

SEQ ID NO: 298721 - RNA, 60 nt, Homo Sapiens
gccucugcuccccugaaccugggagacagaugaggagacuggcucagcaaggccccugga

SEQ ID NO: 298722 - RNA, 60 nt, Homo Sapiens
uccccacgugaacaaaaugggaaggagccgugaggagaggagugaggcaacaggcacccg

SEQ ID NO: 298723 - RNA, 60 nt, Homo Sapiens
guagcugggccagacuucucauuucacaggugaggagacuggugccccacagggauuaag

SEQ ID NO: 298724 - RNA, 60 nt, Homo Sapiens
cagugcccggaauggcccuaggaggcccucugaggagagcuagagucccagcaaagggug

SEQ ID NO: 298725 - RNA, 60 nt, Homo Sapiens
uugugcccgggcccauggggaggacgauggugaggagauccuguuggacacccagugcca

SEQ ID NO: 298726 - RNA, 60 nt, Homo Sapiens
cccauuuccuccuucauccuguggagucugugaggagaacaggugggcgugcuggugacc

SEQ ID NO: 298727 - RNA, 60 nt, Homo Sapiens
uggauucacacugggcccauuuggugaauuugaggagagaugggugccaagugucccucc

SEQ ID NO: 298728 - RNA, 60 nt, Homo Sapiens
uucccgcggguuccgcaggccuuacuacacugaggagagaacaggaugcuggccuuugcu

SEQ ID NO: 298729 - RNA, 60 nt, Homo Sapiens
ccucucugccauucuuccaacccauggcuuugaggagaauuaagauucacauccauagcc

SEQ ID NO: 298730 - RNA, 60 nt, Homo Sapiens
aucuagacaggugggccuaagacccaccacugaggagaggggaagcugguuucagcccag

SEQ ID NO: 298731 - RNA, 60 nt, Homo Sapiens
guuuauuuuuuaauucuuuugcugguuuugugaggagauuacaaaauuacauggaggcca

SEQ ID NO: 298732 - RNA, 60 nt, Homo Sapiens
aggcagguccagcgcacaucacggguccccugaggagacaccuuuugugaaagugucauc

SEQ ID NO: 298733 - RNA, 60 nt, Homo Sapiens
gccuagacacuggcuggccuuuggggaaauugaggagacagaggaaugugaggcacauua

SEQ ID NO: 298734 - RNA, 60 nt, Homo Sapiens
augcaaauaagguuauguuagaauuuacacugaggagaaaauugucaauuuaagaaaucu

SEQ ID NO: 298735 - RNA, 60 nt, Homo Sapiens
cauuagagaagguauuuauaaaaauaggaaugaggagagcuagaaaaccuggaguguggc

SEQ ID NO: 298736 - RNA, 60 nt, Homo Sapiens
guaauauuuuggacugcuguuuuccauuaaugaggagagcaacaggccccugauuauaca

SEQ ID NO: 298737 - RNA, 60 nt, Homo Sapiens
gaggccuugagcucuuuguuuuuauauuaaugaggagaaaaguaugaaaacaagaagucu

SEQ ID NO: 298738 - RNA, 60 nt, Homo Sapiens
cugaagccuucacacaugugagauccaugcugaggagaagcaaaauggcacagggcuagu

SEQ ID NO: 298739 - RNA, 60 nt, Homo Sapiens
uggggaggaaccaugcuaagccaugaccagugaggagaagcaacagagccugucuguccc

SEQ ID NO: 298740 - RNA, 60 nt, Homo Sapiens
caguguugugccccuucacucauuuuuuuuugaggagaagggggucucuguuaacaucua

SEQ ID NO: 298741 - RNA, 60 nt, Homo Sapiens
acaccuuauggagauaaugccucugcugcgugaggagacagagaacuuuaguuggacuac

SEQ ID NO: 298742 - RNA, 60 nt, Homo Sapiens
uucuggaagguuccggucccaaaaccugacugaggagacauccgcauucccucccccuug

SEQ ID NO: 298743 - RNA, 60 nt, Homo Sapiens
auugucaauuuaagaaaucugcauuuacacugaggagaaacuacaaauaggauuauguua

SEQ ID NO: 298744 - RNA, 60 nt, Homo Sapiens
uuaccaaucccguucgcucucuguuucacaugaggagaugccucugaauaugauaacagc

SEQ ID NO: 298745 - RNA, 60 nt, Homo Sapiens
guaaacauaggcccggagauccaggggcuuugaggagaggccugcucugccugggcuggg

SEQ ID NO: 298746 - RNA, 60 nt, Homo Sapiens
cccccugugugcugggugagccugggagcgugaggagaggccugggggccauccuggugg

SEQ ID NO: 298747 - RNA, 60 nt, Homo Sapiens
gggucggcucagcaggaggauagaacagggugaggagagggguggcccagguggugcagg

SEQ ID NO: 298748 - RNA, 60 nt, Homo Sapiens
gauggucaccaccacaauuaucuuuuucuuugaggagaauguguuuuucucuucuuucuc

SEQ ID NO: 298749 - RNA, 60 nt, Homo Sapiens
aagggaggcgugccugagaaguguccucgcugaggagagagacugggugggugaagcacc

SEQ ID NO: 298750 - RNA, 60 nt, Homo Sapiens
cugccuuugccaggugacugugagacgucaugaggagauuucugguguuggacaagcuuc

SEQ ID NO: 298751 - RNA, 60 nt, Homo Sapiens
cagugacuguuccugccacacucaccaaaaugaggagagaccauuaugugggacccauuc

SEQ ID NO: 298752 - RNA, 60 nt, Homo Sapiens
cgaguuggacuggcuacccccugggggugcugaggagagcgcgggacuggugacccaugg

SEQ ID NO: 298753 - RNA, 60 nt, Homo Sapiens
gggguaucuggaaaaggaaagaauauauggugaggagaauuagagggccuucugcccucu

SEQ ID NO: 298754 - RNA, 60 nt, Homo Sapiens
cugggguggcagggagggaggacuauaugaugaggagaaaaucagacuggaaaaaaggau

SEQ ID NO: 298755 - RNA, 60 nt, Homo Sapiens
gaguacuugguagaagauucuuuaacaaauugaggagauugauucauaauucacauguca

SEQ ID NO: 298756 - RNA, 60 nt, Homo Sapiens
cuuucaccucagauuuucuggacuuagucaugaggagagggugaggcccacucuguuccu

SEQ ID NO: 298757 - RNA, 60 nt, Homo Sapiens
auuucuuuugggucaauauuuuuaagugugugaggagaugcucaguagcagcagccuaug

SEQ ID NO: 298758 - RNA, 60 nt, Homo Sapiens
acccucuguauugacugcaauguaagcugcugaggagacugguucuguuggucagucagg

SEQ ID NO: 298759 - RNA, 60 nt, Homo Sapiens
ugguagggcaauccuaccaauugaugggggugaggagacuguugggcccuuauucucuua

SEQ ID NO: 298760 - RNA, 60 nt, Homo Sapiens
ggaguuuguucaugaaugcugaucccagggugaggagaagauugggacauagaaaggaaa

SEQ ID NO: 298761 - RNA, 60 nt, Homo Sapiens
caccugaggcugguuucuuugagacagaaaugaggagacacuggaagcugaaguuuagau

SEQ ID NO: 298762 - RNA, 60 nt, Homo Sapiens
ggguacugugcccaccacacccccagaggcugaggagaggccugccuaccuccugccugu

SEQ ID NO: 298763 - RNA, 60 nt, Homo Sapiens
gcuggagccccaccaugcccggucccugggugaggagacgggcagugcccauuccugugg

SEQ ID NO: 298764 - RNA, 60 nt, Homo Sapiens
uaggaguugaagggagaggagaugguuuauugaggagagagcaccuugacccagggaugu

SEQ ID NO: 298765 - RNA, 60 nt, Homo Sapiens
aaagcagggaggucuccuggagcagaggcgugaggagaggggcggcaggaucagagugaa

SEQ ID NO: 298766 - RNA, 60 nt, Homo Sapiens
aggugcagacuccacacuggcuguucguguugaggagaugcuguguuugaggaccaauau

SEQ ID NO: 298767 - RNA, 60 nt, Homo Sapiens
auggagugaagggaauucuucaccaauaucugaggagaagugaaaguuugggaggagauu

SEQ ID NO: 298768 - RNA, 60 nt, Homo Sapiens
gaagaaaauggcugcccauuaacagaguugugaggagaaaugcuuugcaaggcuucagga

SEQ ID NO: 298769 - RNA, 60 nt, Homo Sapiens
ggggaaggguacagagaaacaauaggggccugaggagagaccaagauaucaggaaugagg

SEQ ID NO: 298770 - RNA, 60 nt, Homo Sapiens
ggggucagauugcagcgggcuuuccugcccugaggagagaccaaacugucugacucugug

SEQ ID NO: 298771 - RNA, 60 nt, Homo Sapiens
uggggaccccaccccucaucccucaaaccuugaggagaagcugacccccuccccccaauc

SEQ ID NO: 298772 - RNA, 60 nt, Homo Sapiens
uggaagugggcgaaaaaucuccuuugaugcugaggagaaacacuucuuaccaugcacuuu

SEQ ID NO: 298773 - RNA, 60 nt, Homo Sapiens
ugcuuucagcccucaccuaagguccccaugugaggagauccagaaaagaccuccuagcua

SEQ ID NO: 298774 - RNA, 60 nt, Homo Sapiens
gggcaauuaaaaagcugaaaaucuacugugugaggagagaaguucauaggaguggcagua

SEQ ID NO: 298775 - RNA, 60 nt, Homo Sapiens
uuucuuaaauugaaaccuuauacaguccccugaggagaacuagcucuauauaugucccuu

SEQ ID NO: 298776 - RNA, 60 nt, Homo Sapiens
auugcuggaagugugacggagcaggcgggcugaggagaguggaaaaggaagcgacccaga

SEQ ID NO: 298777 - RNA, 60 nt, Homo Sapiens
ggcggcagugaggugucaccccccuccagcugaggagaccaggcccaguggcagggguuu

SEQ ID NO: 298778 - RNA, 60 nt, Homo Sapiens
gggaagugagaggaaagaggcgggggcgggugaggagacuggccccaggccccagccacg

SEQ ID NO: 298779 - RNA, 60 nt, Homo Sapiens
cugggggcuauguauagucuguauacguuuugaggagaaauuugauaaugacacuguuuc

SEQ ID NO: 298780 - RNA, 60 nt, Homo Sapiens
aaggucuuuucaaauguggcuaaauggggaugaggagacacggguaggacuuucuuggug

SEQ ID NO: 298781 - RNA, 60 nt, Homo Sapiens
agacucacuuuucugaaaaaucuccauuguugaggagaggcugcucaaucgacaccccga

SEQ ID NO: 298782 - RNA, 60 nt, Homo Sapiens
cccagcaguugccccacccuguguaguuguugaggagaagaagccucaacuuacccagga

SEQ ID NO: 298783 - RNA, 60 nt, Homo Sapiens
uccucugccggaagcagaagcugggaaaauugaggagaguccuuucagugucgagguaua

SEQ ID NO: 298784 - RNA, 60 nt, Homo Sapiens
aaccuacuacaaggcaaggagauuggauucugaggagaagcuagaucagaaaucugacua

SEQ ID NO: 298785 - RNA, 60 nt, Homo Sapiens
cugcugcuuugggaggauuugggaggagacugaggagacccgacugugacagccugacuu

SEQ ID NO: 298786 - RNA, 60 nt, Homo Sapiens
uagugcuuacguugaaaaauugaacaagguugaggagaaauaagaugauccauuaaaaac

SEQ ID NO: 298787 - RNA, 60 nt, Homo Sapiens
aguggaagccccauggaagauuccccagguugaggagagagcaggcacugcccugugguc

SEQ ID NO: 298788 - RNA, 60 nt, Homo Sapiens
ugucuacaguggaauaggggaaaaaauucgugaggagagcgggaguccuuggguucuuuc

SEQ ID NO: 298789 - RNA, 60 nt, Homo Sapiens
gauagagagugaagcagaaaguauugagacugaggagaaucagagggugcgauugaauga

SEQ ID NO: 298790 - RNA, 60 nt, Homo Sapiens
gcggcacguucuagcugcguagcagcguccugaggagacaccccagcccaucuuacugca

SEQ ID NO: 298791 - RNA, 60 nt, Homo Sapiens
ggggccccaccggggucuaagggcuccugaugaggagaaaugaaagaggagccaggccuu

SEQ ID NO: 298792 - RNA, 60 nt, Homo Sapiens
gcuggaaccugcaaaaaauacuuuuucuaaugaggagagaaaauauauguauuuuuauau

SEQ ID NO: 298793 - RNA, 60 nt, Homo Sapiens
aauucuuguaaaguuucuuaacuguuuuuuugaggagaaagaacagauuuauuuauagac

SEQ ID NO: 298794 - RNA, 60 nt, Homo Sapiens
gacaguaaagacauuacucccauaaaaaugugaggagagagacucaguucagcaacuguu

SEQ ID NO: 298795 - RNA, 60 nt, Homo Sapiens
agaagaaaaaggagagaugaaaaaggaggaugaggagaagaauuaccuuuugacaaucug

SEQ ID NO: 298796 - RNA, 60 nt, Homo Sapiens
aaaaaccuagucaaacaaggaagcuguaggugaggagaucuguauaauauucuaauuuaa

SEQ ID NO: 298797 - RNA, 60 nt, Homo Sapiens
gaaagccuccgcugggcuucuuucugccacugaggagacauacuuuuucccaucuggcuu

SEQ ID NO: 298798 - RNA, 60 nt, Homo Sapiens
aguuuucuccauaucaaaacaaugcaguccugaggagaggagaaagcugagaagaaugaa

SEQ ID NO: 298799 - RNA, 60 nt, Homo Sapiens
gcacacugggaacacaauccgcaagauggcugaggagaaaggacuggaggcaguugcuuu

SEQ ID NO: 298800 - RNA, 60 nt, Homo Sapiens
ucuuuuuugcuuaaagccccuucuucaaguugaggagaguccagggagcuugccacacuc

SEQ ID NO: 298801 - RNA, 60 nt, Homo Sapiens
cuucacucaggaguucaugcugagucacgcugaggagaggaaugccugaggaaauguucc

SEQ ID NO: 298802 - RNA, 60 nt, Homo Sapiens
agcaauaaugaauaaaaggaaugcgccucuugaggagaaaacaaagcagagauggaaaua

SEQ ID NO: 298803 - RNA, 60 nt, Homo Sapiens
ccuaaaccgccuuacagcugaguuagaagaugaggagaggcagcagggauuucccugccu

SEQ ID NO: 298804 - RNA, 60 nt, Homo Sapiens
aaguuauuacauuuacuguauugggaaacuugaggagaacucuuuaguucauaaagcuuc

SEQ ID NO: 298805 - RNA, 60 nt, Homo Sapiens
cugaagaggccuggaaacgagagucuuaauugaggagaugggagacucgaacucuagccc

SEQ ID NO: 298806 - RNA, 60 nt, Homo Sapiens
cauuaaucuuguuucagagcuuuagcugccugaggagauagguuuuccuuaagccuugau

SEQ ID NO: 298807 - RNA, 60 nt, Homo Sapiens
auuggcugaagcccaguuccccugggagacugaggagagcuagaggugcccauuccauac

SEQ ID NO: 298808 - RNA, 60 nt, Homo Sapiens
ugugccagcgaaguuucucugucccugcucugaggagacgaugaagagcaaugagaccag

SEQ ID NO: 298809 - RNA, 60 nt, Homo Sapiens
aaggaagacuggaauaauguugggagcccaugaggagaaagcugcgacucaagaauaaua

SEQ ID NO: 298810 - RNA, 60 nt, Homo Sapiens
ucuggugaucucuguggaggugacucccagugaggagaaucuggggcccuggauggcaca

SEQ ID NO: 298811 - RNA, 60 nt, Homo Sapiens
auugcagggacuuuucccugcaagagggagugaggagaggccgcagacacccuggcaucu

SEQ ID NO: 298812 - RNA, 60 nt, Homo Sapiens
gagggaacagagaugaccuuauaugaugcgugaggagaggacccaguacuguggcucagg

SEQ ID NO: 298813 - RNA, 57 nt, Homo Sapiens
uugaagcagaccgaagguaaacuuccuugaggagaagugaaguuucacugugguaug

SEQ ID NO: 298814 - RNA, 60 nt, Homo Sapiens
ccuugccagagguugagccgccccaggguaugaggagaugaauaacuccacagcuccucc

SEQ ID NO: 298815 - RNA, 60 nt, Homo Sapiens
ugaaacccucuacaaugagcacaagagcugugaggagaagucagugaagaacaccagcau

SEQ ID NO: 298816 - RNA, 60 nt, Homo Sapiens
ccaagcagaugacaggcacaggccaccgcaugaggagauggagggcgggacugggccgcc

SEQ ID NO: 298817 - RNA, 60 nt, Homo Sapiens
aacauuuauuuccauugcaauuucuguggcugaggagacuuaaacuuuacaaguauuauc

SEQ ID NO: 298818 - RNA, 60 nt, Homo Sapiens
aucccuggcuugcugugcuucucuuggauuugaggagaguuuaugaauccaucccccugu

SEQ ID NO: 298819 - RNA, 60 nt, Homo Sapiens
gauacuauggaggagagagugauggagggcugaggagaggccucagguuguuauuugguu

SEQ ID NO: 298820 - RNA, 60 nt, Homo Sapiens
uuaaauacucugagggcguuguaauuaaagugaggagaaauccacugugcuucuuaaugu

SEQ ID NO: 298821 - RNA, 60 nt, Homo Sapiens
aggucuucaguacuauugaacuuccaguucugaggagaggaaaucugaacaagcccaagu

SEQ ID NO: 298822 - RNA, 60 nt, Homo Sapiens
agugaaaaauuuuugcuucagaagcugccuugaggagacaguccuauaaugaacaaaggu

SEQ ID NO: 298823 - RNA, 60 nt, Homo Sapiens
aaauaccgacagcgccaccuagacagacauugaggagagcagacaaagugcguuccuuaa

SEQ ID NO: 298824 - RNA, 60 nt, Homo Sapiens
gaagggggugacuuucccuucuugauccacugaggagaggcucgcuucccccauuuucaa

SEQ ID NO: 298825 - RNA, 60 nt, Homo Sapiens
caacaggaggcauucuguggcagagccuucugaggagaggacgaccaccucgaccugaug

SEQ ID NO: 298826 - RNA, 60 nt, Homo Sapiens
gugguggcgcaugcccauaaucccagcuacugaggagacuugagguaggagaaucacuug

SEQ ID NO: 298827 - RNA, 60 nt, Homo Sapiens
cugccucugaccuggcuugcaaugcauaggugaggagaagcagagagcuugucauaugca

SEQ ID NO: 298828 - RNA, 60 nt, Homo Sapiens
accugcuggagcccagccugugccgcccucugaggagaggccuggggggacagcugggca

SEQ ID NO: 298829 - RNA, 60 nt, Homo Sapiens
gcccauccaaauaaaucuccaugagaaacuugaggagacuucauaacaagaaucuggcau

SEQ ID NO: 298830 - RNA, 60 nt, Homo Sapiens
uuaguuucaucaccuguuaucuguguuugcugaggagaguggaacagaagggguggaguu

SEQ ID NO: 298831 - RNA, 60 nt, Homo Sapiens
gacucccagugguacuacuauucuugcuuuugaggagacacacacauguguaccugaaca

SEQ ID NO: 298832 - RNA, 60 nt, Homo Sapiens
cguagggauggugaggagggguagggauggugaggagacgaucaggaaagucagucacgc

SEQ ID NO: 298833 - RNA, 60 nt, Homo Sapiens
aaucacccccaaaggaguggggcuacaacuugaggagaaaucaguuacggacaaaauguu

SEQ ID NO: 298834 - RNA, 60 nt, Homo Sapiens
cugugauguuuaugaucccuggcuugacuuugaggagaggaucuggggaccuagcaguua

SEQ ID NO: 298835 - RNA, 60 nt, Homo Sapiens
augccgggcgcgcacacacgcccggcgggaugaggagaccgcccccagagccucacuggc

SEQ ID NO: 298836 - RNA, 60 nt, Homo Sapiens
ggcccauucaccuuucuccuccuugggcacugaggagagggggcugccucaguccugucc

SEQ ID NO: 298837 - RNA, 60 nt, Homo Sapiens
aaaccucuuccccacaagccagauuguuucugaggagagagcuagcuaggggcugggaaa

SEQ ID NO: 298838 - RNA, 60 nt, Homo Sapiens
gacaaauggauacagccuugacccucccagugaggagaccccaauucagcaauaagucuc

SEQ ID NO: 298839 - RNA, 60 nt, Homo Sapiens
uggcuguggucaagcccagcugcugucaugugaggagaugcucacuguggucuuguugag

SEQ ID NO: 298840 - RNA, 60 nt, Homo Sapiens
uucauaugguggguaugucccgcagcagagugaggagaugaagcuuacguguccugacgu

SEQ ID NO: 298841 - RNA, 60 nt, Homo Sapiens
cgucucugucuggccaccccgucugagaagugaggagaccuccgcccggcagccgcccug

SEQ ID NO: 298842 - RNA, 60 nt, Homo Sapiens
caguaucagcuugaccuugcaaggucaagcugaggagacuaaguuagccaugugggcagu

SEQ ID NO: 298843 - RNA, 60 nt, Homo Sapiens
gggaguugcagaaagagagggcagugagggugaggagaggggaucuggggacuugggugu

SEQ ID NO: 298844 - RNA, 60 nt, Homo Sapiens
gguucugcgaagaggcaguggaagaaggcaugaggagagggucucuugagaauuugccaa

SEQ ID NO: 298845 - RNA, 60 nt, Homo Sapiens
ggcuccuggagcugacaagcgaccccguggugaggagaaaugggggccuugaugcucacc

SEQ ID NO: 298846 - RNA, 60 nt, Homo Sapiens
aauucuuccugaauaaugucuucaguuucuugaggagacuccuaguuuugguuuucaaau

SEQ ID NO: 298847 - RNA, 60 nt, Homo Sapiens
uguuguaaaaggcagccuggccuuugcuacugaggagaaagauggagccugggucucaag

SEQ ID NO: 298848 - RNA, 60 nt, Homo Sapiens
uuugaccagcaaccaaguaaaaucaguaauugaggagagcagggcacaaaggggcugcag

SEQ ID NO: 298849 - RNA, 60 nt, Homo Sapiens
uccauagagcaugacagcaucgauucucauugaggagaaaccuugggcagcuccggccag

SEQ ID NO: 298850 - RNA, 60 nt, Homo Sapiens
auuggggaaacggggugaacuucagguggaugaggagacagaauagagugauaggaagcg

SEQ ID NO: 298851 - RNA, 60 nt, Homo Sapiens
aagugcccuuggggacagccgagaacuccuugaggagaacugcacggccgcacccuccca

SEQ ID NO: 298852 - RNA, 60 nt, Homo Sapiens
gacucuauguugcccaggcuuggaagcuugugaggagacgucuaauaccugagccaagaa

SEQ ID NO: 298853 - RNA, 60 nt, Homo Sapiens
aucaccucgaccagaacucccaccauggugugaggagaccugccgucaccaguuagaggc

SEQ ID NO: 298854 - RNA, 60 nt, Homo Sapiens
ggagagagcuggugauuccaccugggccacugaggagaggggaugccccccacccucucu

SEQ ID NO: 298855 - RNA, 60 nt, Homo Sapiens
ccuguggggauggugccccccucugagcucugaggagaguccacucaaugcagcugguau

SEQ ID NO: 298856 - RNA, 60 nt, Homo Sapiens
gagacagaggaggcagagaggagagagauaugaggagagaaaagagagguggggagaggg

SEQ ID NO: 298857 - RNA, 54 nt, Homo Sapiens
guucagagacugcccagcccgggcugaggagacuagcccacauguugcccauga

SEQ ID NO: 298858 - RNA, 60 nt, Homo Sapiens
cggguccagguucuuaagaagagacgcuggugaggagagcguccuuucucugugcagcug

SEQ ID NO: 298859 - RNA, 60 nt, Homo Sapiens
gagcagccuggaccacaagcugcuggcaccugaggagaguuucaaaauuuccucuccauc

SEQ ID NO: 298860 - RNA, 60 nt, Homo Sapiens
ggcggggaagcuuccucagccuauggugguugaggagaaagucugugccaugucccgucu

SEQ ID NO: 298861 - RNA, 60 nt, Homo Sapiens
caaggacagcaacucagcugaaaaucagaaugaggagaguguugucccgaaaccccaaga

SEQ ID NO: 298862 - RNA, 60 nt, Homo Sapiens
guaggaugcugauuuuccuacagauggaauugaggagagagauuuggguugguggauuaa

SEQ ID NO: 298863 - RNA, 60 nt, Homo Sapiens
guuauuuaaagagaauucccggccaugaagugaggagaugcucuuguuugucccuggacu

SEQ ID NO: 298864 - RNA, 60 nt, Homo Sapiens
cuggcaugagguucagucauagugagggggugaggagaggcaagggggugucuugugggc

SEQ ID NO: 298865 - RNA, 60 nt, Homo Sapiens
ccucccuagcccagauggcaggauuccuguugaggagaugugugcucuaaacccugcuca

SEQ ID NO: 298866 - RNA, 60 nt, Homo Sapiens
uaucugacaaugcugagguuaugaacaaagugaggagaaugaaauguaugugcucuuagc

SEQ ID NO: 298867 - RNA, 60 nt, Homo Sapiens
cuucuaguuuuuuuguacacauucuuucugugaggagauugaguacucugcagcuggcga

SEQ ID NO: 298868 - RNA, 60 nt, Homo Sapiens
aucagaaaaaguauuuuuauguuucuagcuugaggagaagggcuuuagggcuaaccagag

SEQ ID NO: 298869 - RNA, 60 nt, Homo Sapiens
augcuucccagaagaaaggaaagaaggaggugaggagaggacgagcaaggacgggacgga

SEQ ID NO: 298870 - RNA, 60 nt, Homo Sapiens
acaauagcuuugaggagcucacaaucuagcugaggagacaagacacauccaaugcugcaa

SEQ ID NO: 298871 - RNA, 60 nt, Homo Sapiens
uguaugugugaauuaagaaugcuaauauuuugaggagaagaauccucaguuggaaucauu

SEQ ID NO: 298872 - RNA, 60 nt, Homo Sapiens
cccucuggccgccucaacgccuuucaggccugaggagaggaugcacggggagaagggcga

SEQ ID NO: 298873 - RNA, 60 nt, Homo Sapiens
caauggccacggcccauuuugcugggaacgugaggagaggaucagaaggacauggugaag

SEQ ID NO: 298874 - RNA, 60 nt, Homo Sapiens
aaauauagaauuccuggauauugcugggguugaggagagacaaccccacuuuuauuuuuc

SEQ ID NO: 298875 - RNA, 60 nt, Homo Sapiens
uuuaagaugauucagauuauccuuguacuuugaggagaaguuucuuauuuggagucuuuu

SEQ ID NO: 298876 - RNA, 60 nt, Homo Sapiens
gacggcaccugguaugcgggaggaacagagugaggagaggagggcagggcgugcagggcc

SEQ ID NO: 298877 - RNA, 60 nt, Homo Sapiens
aagcacaaagggacuccgauguggguggggugaggagagaggcagccccggccugaccgg

SEQ ID NO: 298878 - RNA, 60 nt, Homo Sapiens
cugaugggugggcccagggcggccucucucugaggagaccucacccacuccucgcucagu

SEQ ID NO: 298879 - RNA, 60 nt, Homo Sapiens
uugggauuucugugaaucuauagaucaaucugaggagacuuaauaaugauauugauucuc

SEQ ID NO: 298880 - RNA, 60 nt, Homo Sapiens
uauuccucaaaggucuggucugugggccucugaggagaaaacaggucuagccaagacagg

SEQ ID NO: 298881 - RNA, 60 nt, Homo Sapiens
aaagagauucaagauggcagguaggcccuuugaggagagauggggacagggcagugggug

SEQ ID NO: 298882 - RNA, 60 nt, Homo Sapiens
agcccauaaaagacccagacucagcugcagugaggagagaaaucacccugcugugggggu

SEQ ID NO: 298883 - RNA, 60 nt, Homo Sapiens
agcugaagcucccacacugucuuccagggcugaggagaugcucuccuuuucuacugacca

SEQ ID NO: 298884 - RNA, 60 nt, Homo Sapiens
agccugagccagagaaccagcucugaguccugaggagacacaggccuggggacaggaagg

SEQ ID NO: 298885 - RNA, 60 nt, Homo Sapiens
gcugccgcagcaucucacaccccgagggccugaggagagggagcugugggccacgccugg

SEQ ID NO: 298886 - RNA, 60 nt, Homo Sapiens
aaaacugguaagugugacccagaucaagugugaggagaugaggcuggggauagucagggg

SEQ ID NO: 298887 - RNA, 60 nt, Homo Sapiens
uguccucccucgcccuaccaagagggcaccugaggagacuuuggggacagggcaggggca

SEQ ID NO: 298888 - RNA, 51 nt, Homo Sapiens
ccggauuugaugcaccaugaaugaggagaaauggccucccgucuugugaac

SEQ ID NO: 298889 - RNA, 60 nt, Homo Sapiens
cuuucaacccacaugagucuccucgagaagugaggagaggcaguuuggagcagaauggag

SEQ ID NO: 298890 - RNA, 60 nt, Homo Sapiens
aaagaccaaagguagauaaauucacgaagaugaggagaaaccagugcaaaaagccugaaa

SEQ ID NO: 298891 - RNA, 60 nt, Homo Sapiens
acugcugagaaggcuguccuuccuaacuugugaggagaugaauccuuaauaauaaguaaa

SEQ ID NO: 298892 - RNA, 60 nt, Homo Sapiens
gugaggacauucccaaaaccaaaggacaacugaggagacugcccagcacauaaugaauaa

SEQ ID NO: 298893 - RNA, 60 nt, Homo Sapiens
ugugggccaccuauugucuagggugggcccugaggagaccguguggugugucuacuguga

SEQ ID NO: 298894 - RNA, 60 nt, Homo Sapiens
ugcugucugcuggagccucuucuaucccugugaggagagguggugucuuucuccugggcu

SEQ ID NO: 298895 - RNA, 60 nt, Homo Sapiens
caggccuggggacagggaggcucugaguccugaggagacaagccugagccagagaaccag

SEQ ID NO: 298896 - RNA, 60 nt, Homo Sapiens
acaaguguuugggguggcugaccauuaaacugaggagagaguuuggcaaucucacuaacc

SEQ ID NO: 298897 - RNA, 60 nt, Homo Sapiens
cggcuugaagcagggcuccagaucccuaggugaggagaaguccuuuucacccaccacccc

SEQ ID NO: 298898 - RNA, 60 nt, Homo Sapiens
augauauaacauguguauguagacauguugugaggagacucaaugacgugccuaccucuu

SEQ ID NO: 298899 - RNA, 60 nt, Homo Sapiens
aaggccgggacccccugcccacaggugcacugaggagaugccuagagucucaggaacaag

SEQ ID NO: 298900 - RNA, 60 nt, Homo Sapiens
cugggaacuugugggacucaacacagaccaugaggagacgccagucagccuggaccccua

SEQ ID NO: 298901 - RNA, 60 nt, Homo Sapiens
cugggaacuuugggacucacacaaagaccaugaggagaugccagucagccuggaccccua

SEQ ID NO: 298902 - RNA, 60 nt, Homo Sapiens
ggauucggcccaaacucagaacuguuccccugaggagaagcgguggccucuuugcagauc

SEQ ID NO: 298903 - RNA, 60 nt, Homo Sapiens
uuggguguuuuguguugagacuggcugaaaugaggagacuuugaccaugugacgugucaa

SEQ ID NO: 298904 - RNA, 60 nt, Homo Sapiens
uccagcuccagccaccaccaggcugagcagugaggagagaaaguuucugccuggcccugc

SEQ ID NO: 298905 - RNA, 60 nt, Homo Sapiens
uccaaagcucagcacaguuuccuccugggaugaggagaggaaucagaaaccccacuuugg

SEQ ID NO: 298906 - RNA, 60 nt, Homo Sapiens
acuaacccuugccuagauuuaaggccacugugaggagagggguugccccagaaggcaggg

SEQ ID NO: 298907 - RNA, 60 nt, Homo Sapiens
cuuugaguaccaaauccacaagccauuuuuugaggagagugaaagagaguaccaugcugg

SEQ ID NO: 298908 - RNA, 60 nt, Homo Sapiens
gcgggcccugagccugcggcucuuccagacugaggagaagaucgagcgaacccagcggga

SEQ ID NO: 298909 - RNA, 60 nt, Homo Sapiens
cccguggacaucggaggucacguucugagcugaggagaguuauuuuuaaauaaaagacgu

SEQ ID NO: 298910 - RNA, 60 nt, Homo Sapiens
uaauuguauccaaggcagguaauaguguguugaggagacugaauguaaguuuggcgauaa

SEQ ID NO: 298911 - RNA, 60 nt, Homo Sapiens
aagaggaaccagaagaagucgugcucuuggugaggagagcuauugcugcugggcacaucu

SEQ ID NO: 298912 - RNA, 60 nt, Homo Sapiens
gaaaaugaugcaauguaugaaaaacugcuuugaggagaaaaacaacacaguguguuuuug

SEQ ID NO: 298913 - RNA, 60 nt, Homo Sapiens
gagugcuucaagcagagcauggugggucauugaggagacccaggaaucucaucugagaac

SEQ ID NO: 298914 - RNA, 60 nt, Homo Sapiens
ugguguaggaaaugagacccucucugaagcugaggagagcacguugaucugaacuuuaaa

SEQ ID NO: 298915 - RNA, 60 nt, Homo Sapiens
agaaggugcagauucaaagugagcggcuccugaggagagccgccaaggcugcucgccuuc

SEQ ID NO: 298916 - RNA, 60 nt, Homo Sapiens
gagcaguugacucacugaugaaggcccuggugaggagaaagcacucuguucuucgccuac

SEQ ID NO: 298917 - RNA, 60 nt, Homo Sapiens
ggcggacugugaggcagccaugcugaacugugaggagagauaaugcucuuccgaauaaag

SEQ ID NO: 298918 - RNA, 60 nt, Homo Sapiens
gaaauccagaaacucuguguagagagauuuugaggagaaucacccacuguggacuggggc

SEQ ID NO: 298919 - RNA, 60 nt, Homo Sapiens
ugaccagcccucaucauuccacuuuugucaugaggagaacaacacagggaagucgguuug

SEQ ID NO: 298920 - RNA, 60 nt, Homo Sapiens
aucuacggagucuucuaagagauuuugcaaugaggagaagcauuguuuucaaacuauaua

SEQ ID NO: 298921 - RNA, 60 nt, Homo Sapiens
ucccagcugcccgcaggggguucccccugcugaggagagaccagguggaccccagcugcc

SEQ ID NO: 298922 - RNA, 60 nt, Homo Sapiens
acgaguccugaggagagaaccggugcguccugaggagagaaccggcgcugggcaacacgg

SEQ ID NO: 298923 - RNA, 60 nt, Homo Sapiens
ccagggcgcgggggccgccagccgcacuucugaggagaccagcagucaugcaucgugcac

SEQ ID NO: 298924 - RNA, 60 nt, Homo Sapiens
agcuauguaucgggaaccaugaucuauuuaugaggagaaggaaagccgauucuuuggaag

SEQ ID NO: 298925 - RNA, 60 nt, Homo Sapiens
aacaauggccaacgaagcacugaugcggucugaggagacagcugaccuguuggcugaaaa

SEQ ID NO: 298926 - RNA, 60 nt, Homo Sapiens
guaggguuccuuagagaagugacauggccuugaggagauucagggcaccuuuccucagug

SEQ ID NO: 298927 - RNA, 60 nt, Homo Sapiens
ccccugcccuacgugcacuacaggaaggggugaggagagcagccagaggaaaaccagccc

SEQ ID NO: 298928 - RNA, 60 nt, Homo Sapiens
ucuuucucagccagguuucccaggaugcccugaggagaaccaucuucccucuggggggau

SEQ ID NO: 298929 - RNA, 60 nt, Homo Sapiens
uggacucgcucaucuguucucuugggagcaugaggagagccacuguggcuccaggaggcc

SEQ ID NO: 298930 - RNA, 60 nt, Homo Sapiens
cagagagaggucugggaacuuacuuaaacuugaggagaggaaaaagaauguucgauuuga

SEQ ID NO: 298931 - RNA, 60 nt, Homo Sapiens
ccagguggaccccagcugccuucccccugcugaggagagaucccagcugcccgcaggggg

SEQ ID NO: 298932 - RNA, 60 nt, Homo Sapiens
uauuuauaggcccccagcagucuaguggccugaggagauggcgggaccuccaggggcgac

SEQ ID NO: 298933 - RNA, 60 nt, Homo Sapiens
guguagggucucccaacgucggccuuugccugaggagaguagcuaggacaggucuggcag

SEQ ID NO: 298934 - RNA, 60 nt, Homo Sapiens
cuggacuuuuuacccauuuuucacacagauugaggagacaguaggcaaccaccuucaccu

SEQ ID NO: 298935 - RNA, 60 nt, Homo Sapiens
acccaggagugugggggcauaaggguucugugaggagaggcagggggccuuggccagguc

SEQ ID NO: 298936 - RNA, 60 nt, Homo Sapiens
gcuaguucauguguucuccacucugucacaugaggagaguccaugugggucagauguacu

SEQ ID NO: 298937 - RNA, 60 nt, Homo Sapiens
cuguaggcugugccugucgcucuguccuccugaggagagggcucaaaugcgaugaccccc

SEQ ID NO: 298938 - RNA, 60 nt, Homo Sapiens
gagcguccccagccccaccuagcaaagugaugaggagacugacacaccuguaucccagag

SEQ ID NO: 298939 - RNA, 60 nt, Homo Sapiens
aguuguacugguuagauucauuagguugaaugaggagaggggcuuaccuguucucuaguu

SEQ ID NO: 298940 - RNA, 60 nt, Homo Sapiens
cauguaacgaaacacuucaauaauuguccaugaggagaaaaaaagcaugugucaugcaug

SEQ ID NO: 298941 - RNA, 60 nt, Homo Sapiens
caauuuucuugaugccucugcaagauacugugaggagaauugacagcaaaaguucaccac

SEQ ID NO: 298942 - RNA, 60 nt, Homo Sapiens
augggguugaagcagcccacugagccaaguugaggagacuggaggaaaagagagcugguc

SEQ ID NO: 298943 - RNA, 60 nt, Homo Sapiens
gagaggacugguucugaggccagaaaggugugaggagagaggaggaaaagucuuccuaau

SEQ ID NO: 298944 - RNA, 60 nt, Homo Sapiens
auuaaaauuugaacauuauggugauuauggugaggagaaugggauauuaacauaaaauua

SEQ ID NO: 298945 - RNA, 60 nt, Homo Sapiens
aauuuaaaaugcuguugaauaugauacuuuugaggagagagugugcucagaacuuagacg

SEQ ID NO: 298946 - RNA, 60 nt, Homo Sapiens
uccagaugcuacuaucauucacgauggccaugaggagaagauggaaaauggucagaucac

SEQ ID NO: 298947 - RNA, 60 nt, Homo Sapiens
ccugccugggucuccacauccccagcuguaugaggagagcuucaggccccaggacugugg

SEQ ID NO: 298948 - RNA, 60 nt, Homo Sapiens
acucgucaucucuuaugcuuaauuaagaccugaggagaugugagcuccuggaaauaguag

SEQ ID NO: 298949 - RNA, 60 nt, Homo Sapiens
caggcuggggccucgagaagauuuggggucugaggagaaagguaggauguuuccuagacc

SEQ ID NO: 298950 - RNA, 60 nt, Homo Sapiens
uaugaaggagccugagccaugaaggcaggaugaggagagguucaucccccgcuagagcug

SEQ ID NO: 298951 - RNA, 57 nt, Homo Sapiens
guggaagaagcaaaacugcuccugugaugaggagagacccugauuucagacacuuag

SEQ ID NO: 298952 - RNA, 60 nt, Homo Sapiens
gacuuuuucacuucuuuguuuaaaauguuuugaggagaaaauggcuguggaaaaacgaau

SEQ ID NO: 298953 - RNA, 60 nt, Homo Sapiens
aaaggaucagauugcuguuucguuaaugauugaggagagaacaccccaaaugcauaaucu

SEQ ID NO: 298954 - RNA, 60 nt, Homo Sapiens
aucugggaggagcugaguguaaugcgucccugaggagaaacaugauugcaauggagggca

SEQ ID NO: 298955 - RNA, 60 nt, Homo Sapiens
ggacgcuuuucuuccuucuggagaagccccugaggagaagcacagggcuuuguuagcaga

SEQ ID NO: 298956 - RNA, 60 nt, Homo Sapiens
acaccguucacuauuguagagauuuguuucugaggagaguccuucucucgcgcgccuauu

SEQ ID NO: 298957 - RNA, 60 nt, Homo Sapiens
aagcccagcaaugguggcagugaagacaguugaggagaucgaccaucuuguuccagccuc

SEQ ID NO: 298958 - RNA, 60 nt, Homo Sapiens
ccugcaugaaagcauucuuccaaaaagaagugaggagaaauuccuuccaauauaacuagg

SEQ ID NO: 298959 - RNA, 64 nt, Homo Sapiens; identical to SEQ ID NO: 254984

SEQ ID NO: 298960 - RNA, 64 nt, Homo Sapiens; identical to SEQ ID NO: 254985

SEQ ID NO: 298961 - RNA, 64 nt, Homo Sapiens; identical to SEQ ID NO: 255009

SEQ ID NO: 298962 - RNA, 64 nt, Homo Sapiens; identical to SEQ ID NO: 255010

SEQ ID NO: 298963 - RNA, 64 nt, Homo Sapiens; identical to SEQ ID NO: 255053

SEQ ID NO: 298964 - RNA, 64 nt, Homo Sapiens; identical to SEQ ID NO: 255054

SEQ ID NO: 298965 - RNA, 64 nt, Homo Sapiens; identical to SEQ ID NO: 255069

SEQ ID NO: 298966 - RNA, 64 nt, Homo Sapiens; identical to SEQ ID NO: 255070

SEQ ID NO: 298967 - RNA, 64 nt, Homo Sapiens; identical to SEQ ID NO: 255075

SEQ ID NO: 298968 - RNA, 64 nt, Homo Sapiens; identical to SEQ ID NO: 255076

SEQ ID NO: 298969 - RNA, 64 nt, Homo Sapiens; identical to SEQ ID NO: 255122

SEQ ID NO: 298970 - RNA, 64 nt, Homo Sapiens; identical to SEQ ID NO: 255123

SEQ ID NO: 298971 - RNA, 64 nt, Homo Sapiens; identical to SEQ ID NO: 255160

SEQ ID NO: 298972 - RNA, 64 nt, Homo Sapiens; identical to SEQ ID NO: 255161

SEQ ID NO: 298973 - RNA, 64 nt, Homo Sapiens; identical to SEQ ID NO: 255171

SEQ ID NO: 298974 - RNA, 64 nt, Homo Sapiens; identical to SEQ ID NO: 255172

SEQ ID NO: 298975 - RNA, 64 nt, Homo Sapiens
uccucccuuuuuccuuguccccacacuccuacaccuaacucaccuaacucauacugugcuggag

SEQ ID NO: 298976 - RNA, 64 nt, Homo Sapiens
uuuccuuguccccacacuccuacaccuaacucaccuaacucauacugugcuggagccacuaacu

SEQ ID NO: 298977 - RNA, 64 nt, Homo Sapiens
gacuaguugaucuggaugagccuucccaaaaaucagugucuaggagucaguaauucucuuacau

SEQ ID NO: 298978 - RNA, 64 nt, Homo Sapiens
gacugguugaucuagaugagccuucccaaaaaucagugucuagggucaguaauucucuaaaaau

SEQ ID NO: 298979 - RNA, 64 nt, Homo Sapiens; identical to SEQ ID NO: 179944

SEQ ID NO: 298980 - RNA, 64 nt, Homo Sapiens; identical to SEQ ID NO: 179945

SEQ ID NO: 298981 - RNA, 64 nt, Homo Sapiens
accuggagaauguuuuugcgugggaugaugugcuggucaggagccccuugggcaucgcuucccc

SEQ ID NO: 298982 - RNA, 64 nt, Homo Sapiens
cacagugagcagguggccccagcuggguuucccaggucaggaaugugggccccaggcaaggugc

SEQ ID NO: 298983 - RNA, 64 nt, Homo Sapiens
ugaccaagccuuggcccgguugcuccccugccgaggucaggagcccuucccagagucccccggg

SEQ ID NO: 298984 - RNA, 64 nt, Homo Sapiens
caccagcuuguguugcagacgggggccagggcugggucaggauugagggccugccugggacuga

SEQ ID NO: 298985 - RNA, 64 nt, Homo Sapiens
ucgagaccauccuggcuaaccggguggaucacgaggucaggagaagcacuuugggaggccgagg

SEQ ID NO: 298986 - RNA, 64 nt, Homo Sapiens
ucgagaccauccuggcgaacugggcggaucacaaggucaggagaagcacuuugggaggccaagg

SEQ ID NO: 298987 - RNA, 64 nt, Homo Sapiens
ucgagaccagccugaccaacgguggaucaccugaggucaggaguuacuuugggaggccgaggca

SEQ ID NO: 298988 - RNA, 64 nt, Homo Sapiens
ucuagaccagccuggcuaacagaugaucaccugaggucaggagugcacucugggaggccaaggc

SEQ ID NO: 298989 - RNA, 64 nt, Homo Sapiens
uugagaccagccugaccaacugggcagaucacgaggucaggaguagcacuuugggaggccgagg

SEQ ID NO: 298990 - RNA, 64 nt, Homo Sapiens
ucaagaccagcccgggcaacggcagaucgcuugaggucaggagucacuuugggaggcugaggcg

SEQ ID NO: 298991 - RNA, 64 nt, Homo Sapiens
ucaagaccagccuggccaacgguggaucaccugaggucaggaguuacuuugggaggccgaguca

SEQ ID NO: 298992 - RNA, 64 nt, Homo Sapiens
ucgagaccagccuaaacaacugggugaaucaugaggucaggaguagcacuuugggaggccgaga

SEQ ID NO: 298993 - RNA, 64 nt, Homo Sapiens
gagacaaaaaugaggaaaacaccauguguuacuuggucaggacaucagcuggcugggucaaggc

SEQ ID NO: 298994 - RNA, 64 nt, Homo Sapiens
ucuguuugccucuuagagacagcuagggcagaggggucaggaugccagcaucucccacccaccc

SEQ ID NO: 298995 - RNA, 64 nt, Homo Sapiens
ggcuggggggcccacuagcaggcagaggagggguggucaggaugguggaggccacguagaaggg

SEQ ID NO: 298996 - RNA, 64 nt, Homo Sapiens
ucaagaccagccugaccaacggugaaucacaugaggucaggagucacuguaggcggccgaggug

SEQ ID NO: 298997 - RNA, 64 nt, Homo Sapiens
ucgagaccagccuggccaacggaggaucuccagaggucaggagucacuaugggaggccagggag

SEQ ID NO: 298998 - RNA, 64 nt, Homo Sapiens
cacuuugggaggccgaggcaggaggaucaccugaggucaggaguuugagaccagucuggccaaa

SEQ ID NO: 298999 - RNA, 64 nt, Homo Sapiens
ucucccugccucucucucugggggcgauggggaaggucaggaguccagcccauucccagggugu

SEQ ID NO: 299000 - RNA, 64 nt, Homo Sapiens
cacuuugggaggccgaggcagacagaucaccugaggucaggaguuugagaccagccuggccaac

SEQ ID NO: 299001 - RNA, 64 nt, Homo Sapiens
agcacuuugggaggccaaggcgggcagaucacgaggucaggaguuucagaccaauauggugaaa

SEQ ID NO: 299002 - RNA, 64 nt, Homo Sapiens
augcggucgugcacacgcgcuagguagcagcgucggucaggacugucucgaggccacacucgcu

SEQ ID NO: 299003 - RNA, 64 nt, Homo Sapiens
gcaggauuaugcgaucacggaucagucagagcagggucaggagacggggcugacggcacgggug

SEQ ID NO: 299004 - RNA, 64 nt, Homo Sapiens
ucaagacuagccuggccaacgguggaucaccugaggucaggagucacuuugggaggcaggggcg

SEQ ID NO: 299005 - RNA, 64 nt, Homo Sapiens
ucaagaccagccuguccaacguaggaucaccugaggucaggagucacuuugagaggcugaggug

SEQ ID NO: 299006 - RNA, 64 nt, Homo Sapiens
aauaaaccaaugaguuagcuaguaaaacaccuuaggucaggaauagauaccuauggagagggga

SEQ ID NO: 299007 - RNA, 64 nt, Homo Sapiens
ucaagaccaaucuggccaacgguguaucacuugaggucaggagucccuuugggaggcugaggug

SEQ ID NO: 299008 - RNA, 64 nt, Homo Sapiens
ucgagaccagccuggccaacaaucacuugauugaggucaggaguuugggaggcugaggcgggug

SEQ ID NO: 299009 - RNA, 64 nt, Homo Sapiens
ucgagaccagccugaccaacgguggaucacuugaggucaggagucacuuugcaaggccgaggag

SEQ ID NO: 299010 - RNA, 64 nt, Homo Sapiens
cacuuugguagaccgaagugggcagaucaccugaggucaggaguucacgaccagccuggccaac

SEQ ID NO: 299011 - RNA, 64 nt, Homo Sapiens
agcacuuugggaggcugaggugaguggauuacaaggucaggaguuccagaccagccuggcuaau

SEQ ID NO: 299012 - RNA, 64 nt, Homo Sapiens
agaacacacugagugaggagcacccccaccucaaggucaggaugaacagacucaaugucccccu

SEQ ID NO: 299013 - RNA, 64 nt, Homo Sapiens
ucgagagcagccuggccaacggaggauccccugaggucaggagucacuuugggaagcugaggca

SEQ ID NO: 299014 - RNA, 64 nt, Homo Sapiens
cacuuugggaggccaaggcugguggaucaccugaggucaggaguucgagaccagccuggccaac

SEQ ID NO: 299015 - RNA, 64 nt, Homo Sapiens
cacuuugggaggcuuaggcggcuggaucaccugaggucaggaguucaagaccagccuggucaac

SEQ ID NO: 299016 - RNA, 64 nt, Homo Sapiens
uugagaccagccuggccaacggcggaucuuuugaggucaggagucacuuuggcaggccgagaug

SEQ ID NO: 299017 - RNA, 64 nt, Homo Sapiens
uaggacucauagccugaaagcucuuuuaggacagggucaggauuagacuuuggaaauuuccuuu

SEQ ID NO: 299018 - RNA, 64 nt, Homo Sapiens
ccuugguggggucugucuuuuccuugaggucagaggucaggagcagggcuggggucaggaugac

SEQ ID NO: 299019 - RNA, 64 nt, Homo Sapiens
uuuccuugaggucagaggucaggagcagggcuggggucaggaugacgaggccugggguccuggu

SEQ ID NO: 299020 - RNA, 64 nt, Homo Sapiens
ucgagaccagccuggccaacggcggaucacuugaggucaggagccacuuugggaggcugaggca

SEQ ID NO: 299021 - RNA, 64 nt, Homo Sapiens
ucaagaccagccuggccaacggcggaucacuugaggucaggagccauuuugggaggccaaggcg

SEQ ID NO: 299022 - RNA, 64 nt, Homo Sapiens
uagagaccaucauugcuaaccagguggaucacaaggucaggagaagcacuuugggaggccgagg

SEQ ID NO: 299023 - RNA, 64 nt, Homo Sapiens
gcugcgggcaaugaagccuuuuucagaguguggaggucaggauggagacuucagggcuugucac

SEQ ID NO: 299024 - RNA, 64 nt, Homo Sapiens
cacuuuaggaguccaaggcgggcggaucacuugaggucaggaguucaagaccagcuuggccaag

SEQ ID NO: 299025 - RNA, 64 nt, Homo Sapiens
agcacuuugggaggccaaggugggcggaucacaaggucaggaguucgagaccagccuggccaau

SEQ ID NO: 299026 - RNA, 64 nt, Homo Sapiens
agcacuuugggaggccgaggcgggcggaucacaaggucaggaguucgagaccauccugucuaac

SEQ ID NO: 299027 - RNA, 64 nt, Homo Sapiens
cacauugggaggcugaggugggcggaucaccugaggucaggaguucaagaccagccuggccaac

SEQ ID NO: 299028 - RNA, 64 nt, Homo Sapiens
cacuuugggaggccaaggcgggcggaucagcugaggucaggaguuggagaccagcguggccaac

SEQ ID NO: 299029 - RNA, 64 nt, Homo Sapiens
aacacuuugggaggcugaggcaggcggaucacgaggucaggagaucgagaccauccuggccaac

SEQ ID NO: 299030 - RNA, 64 nt, Homo Sapiens
ucacucugaagccaaagcugggcucaguggggaaggucaggaauggagaaauugccuuuucucg

SEQ ID NO: 299031 - RNA, 64 nt, Homo Sapiens
cacuuugggaggccaaggcggacagaccaccugaggucaggaguucgaaaccagccuggccaac

SEQ ID NO: 299032 - RNA, 64 nt, Homo Sapiens
ucgagaccauccuggcuaacugggcagaucacgaggucaggagaagcucuuugggaggccgagg

SEQ ID NO: 299033 - RNA, 64 nt, Homo Sapiens
gaacuaccucauucggcaaaaccaugccuggagaggucaggauggcuccugucuucccagaccc

SEQ ID NO: 299034 - RNA, 64 nt, Homo Sapiens
ucacgccuguaaucccagcacuuugggaggccgaggucaggaguuagagaccauucugaccaau

SEQ ID NO: 299035 - RNA, 64 nt, Homo Sapiens
agcacuuugggaggccgaggcgggcggaucacuaggucaggaaauggagaccauccuggccaac

SEQ ID NO: 299036 - RNA, 64 nt, Homo Sapiens
ucgagaccauccuggccaacggggaggaucacggggucaggagauuugggaggucgggggggug

SEQ ID NO: 299037 - RNA, 64 nt, Homo Sapiens
cugagaccauccuggcuaaccgggcggaucacgaggucaggagaagcacuaugggaggccgaga

SEQ ID NO: 299038 - RNA, 64 nt, Homo Sapiens
ucgcgaccauccuggcuaaccgggcggaucaugaggucaggagaagcacuuugggagacugagg

SEQ ID NO: 299039 - RNA, 64 nt, Homo Sapiens
uugagaccauccuggcuaaucagguagaucacaaggucaggaaaagcucuuugggaggccaagg

SEQ ID NO: 299040 - RNA, 64 nt, Homo Sapiens
ucgagaccagccuggccaacguggcucacgcugaggucaggagucugggcgguggccgggcgug

SEQ ID NO: 299041 - RNA, 64 nt, Homo Sapiens
ucgagaccagccuggccaacggcagaucagcugaggucaggagacacuuugggaggccgaggug

SEQ ID NO: 299042 - RNA, 64 nt, Homo Sapiens
gggcuaggacugugggcuuuuagcagcccacaggugauccuaacauaucaggccauggacucag

SEQ ID NO: 299043 - RNA, 64 nt, Homo Sapiens
uuuuguucuggccuucuguacugaucuguguuccugauccuaauuccuaucugucuaacgugga

SEQ ID NO: 299044 - RNA, 64 nt, Homo Sapiens
aguuccucauuagcauuuugcuaaaugugaaugaugauccuaggcauuugcugaauacagaggc

SEQ ID NO: 299045 - RNA, 64 nt, Homo Sapiens
uugaggguggcugggaaugugauauacagcacccugauccuaacaggugugauuguuacguaag

SEQ ID NO: 299046 - RNA, 64 nt, Homo Sapiens
agguaacuuggguccucuuccauugcaguccugaugauccuaaccugcagcacggugguuuuac

SEQ ID NO: 299047 - RNA, 64 nt, Homo Sapiens
agugauuaguggcuauugaguguuuuuguugaaaugauccuaccccgcgcccggcccaaucaug

SEQ ID NO: 299048 - RNA, 64 nt, Homo Sapiens
ccauucccuccugcugcgguggcaguccuucuggugauccuauuagagacacacuggcagguua

SEQ ID NO: 299049 - RNA, 64 nt, Homo Sapiens
accuacugcuaccuuccuuauggaaccaaggugcugauccuaccaaaaugacuggcgugaugcc

SEQ ID NO: 299050 - RNA, 64 nt, Homo Sapiens
gucuuagaaagcuagauuacgaaagugaaggggaugauccuaauggaauucacuuauugagaau

SEQ ID NO: 299051 - RNA, 64 nt, Homo Sapiens
aucaaauucaaucugaugucuucaagaaaugaggugauccuauucacacagaaacauugcuggu

SEQ ID NO: 299052 - RNA, 64 nt, Homo Sapiens
auaugacggaaacuuuggcugguaaaaguuagagugauccuacuaaauagaagugauaguagua

SEQ ID NO: 299053 - RNA, 64 nt, Homo Sapiens
ccugggcucccuggaggacuugaacugugaguccugauccuaaccugugccccaccuguugucc

SEQ ID NO: 299054 - RNA, 64 nt, Homo Sapiens
aggaaaguucuguucuauuuucugaagagucacaugauccuaagucuauucaucugcacaaaau

SEQ ID NO: 299055 - RNA, 64 nt, Homo Sapiens
aaguuaaacaaauugauuuacuucagagcaaauaugauccuauuaaaauaauauaggguaaaua

SEQ ID NO: 299056 - RNA, 64 nt, Homo Sapiens
ccauauguuuugagaauuuguaaagugagagacaugauccuauuaaaauaagaaggcaaaaaug

SEQ ID NO: 299057 - RNA, 64 nt, Homo Sapiens
gcaugcagcuugcagccccucuuucucacacgugugauccuagcgugagaggucauccugcccu

SEQ ID NO: 299058 - RNA, 64 nt, Homo Sapiens
aucagcaaauguggugccugauuauagaaauuugugauccuauauacaauauaggacuuuuaaa

SEQ ID NO: 299059 - RNA, 64 nt, Homo Sapiens
cuuuuuaucuugggugccuagcauucuguuuuuuugauccuaugucauaauuuuuugagaaaau

SEQ ID NO: 299060 - RNA, 64 nt, Homo Sapiens
gauggcuccauucccaaguaccccaacucacugcugauccuauuaaaggaaugaguccugcuac

SEQ ID NO: 299061 - RNA, 64 nt, Homo Sapiens
uguucuccugaaagaaugacugauuuuucaucuaugauccuagagacaguucuaaaucggggcu

SEQ ID NO: 299062 - RNA, 64 nt, Homo Sapiens
gaucuuaagguauuuacaugaauauuauccuuauugauccuauuaagacuaaauuuugauaacu

SEQ ID NO: 299063 - RNA, 64 nt, Homo Sapiens
aauugccuagaaauaucuuuucacuuuuuccaaaugauccuaguauuuuaaauauccacaguac

SEQ ID NO: 299064 - RNA, 64 nt, Homo Sapiens
gacagagcagaacuuucaccuucauauauuuguaugauccuaaugaaugcauaaaauguuaagu

SEQ ID NO: 299065 - RNA, 64 nt, Homo Sapiens
gucacaguauagagccugcagucucaacucauugugauccuaauggucugggugauuggauggu

SEQ ID NO: 299066 - RNA, 64 nt, Homo Sapiens
auuggugggaccaaggauguuuugcaggaugcccugauccuaagaagggggccugggggugcgu

SEQ ID NO: 299067 - RNA, 64 nt, Homo Sapiens
uuucuauaaauauauuuuuaggaaaaaaagucagugauccuaauuguaucacauuauaagaaag

SEQ ID NO: 299068 - RNA, 64 nt, Homo Sapiens
ucaugcuuaaguacaaauuccaugaaaagcucacugauccuaauucuuucccuuugaggucucu

SEQ ID NO: 299069 - RNA, 64 nt, Homo Sapiens
ugagccuguuuccacaccuguaaaguggggaugaugauccuaucucacugcuuuugugaggauu

SEQ ID NO: 299070 - RNA, 64 nt, Homo Sapiens
gugcuccuuuuguuuuacagguugucuacuuuuuugauccuaggaucuuaaucuaagcuccaaa

SEQ ID NO: 299071 - RNA, 64 nt, Homo Sapiens
cuggaccuccauuuuucccuguaaauucuccaacugauccuacccucccuacuccugcacccca

SEQ ID NO: 299072 - RNA, 64 nt, Homo Sapiens
aaauucuuugaauauuuuguuucuuggaacccaaugauccuaagaaaauuauguacuuuuaccu

SEQ ID NO: 299073 - RNA, 64 nt, Homo Sapiens
aauauuguuuaaugucugaauaugaaagaguucuugauccuaaagaaauuuaguggcacagaaa

SEQ ID NO: 299074 - RNA, 64 nt, Homo Sapiens
acugacaucaacuaaaauuuccucaugauccuuuugauccuauguggucauuaacagggacaug

SEQ ID NO: 299075 - RNA, 64 nt, Homo Sapiens
auuguuuccuaaaucagcaucauaguuauuaaugugauccuaaaagaugauaaccuaacacuau

SEQ ID NO: 299076 - RNA, 64 nt, Homo Sapiens
uaguuaaaaagauaauuuugaaggauuuugaagcugauccuauuuagauaaaaacaucuccaaa

SEQ ID NO: 299077 - RNA, 64 nt, Homo Sapiens
ugccuagaaaggacacugugcacacagugaucgaugauccuaugaauucugauuagccugcguc

SEQ ID NO: 299078 - RNA, 64 nt, Homo Sapiens
agaauuuuucagcacuuaacuacuuuguuggcauugauccuagugucuuuaaauacuucaugag

SEQ ID NO: 299079 - RNA, 64 nt, Homo Sapiens
ucuagguaaaaagauggaaaaaaauuguauuaugugauccuaaggacaggaauagcagaccagc

SEQ ID NO: 299080 - RNA, 64 nt, Homo Sapiens
uaugacagugggcagcaccuguagaaagcuaaagugauccuaaagcaaguuaacuuggaaauca

SEQ ID NO: 299081 - RNA, 64 nt, Homo Sapiens
uuuugaaaaccacuuuuagaauaaucucuaaauaugauccuaucaaggagccacggaagaaaug

SEQ ID NO: 299082 - RNA, 64 nt, Homo Sapiens
aauuggcaugaugcuuuucucuuccaaguagaggugauccuaacucacguacaacuuucuuugc

SEQ ID NO: 299083 - RNA, 64 nt, Homo Sapiens
gaauucaaagaugucgguugggagaaacuagcucugauccuaacaggccacguuaaacugccca

SEQ ID NO: 299084 - RNA, 64 nt, Homo Sapiens
caaguacaugccaauguuguuuaagaaacaguuaugauccuaaacuuuuuggauaaucuuuuau

SEQ ID NO: 299085 - RNA, 64 nt, Homo Sapiens
uacuugggaggcugagguggauggugugcaccugugauccuagcuuaaaaauuauccaggugua

SEQ ID NO: 299086 - RNA, 64 nt, Homo Sapiens
ucaaugcuaggcaaauaauguuuugcagcuaucaugauccuaguugaaaaaugucucauacaua

SEQ ID NO: 299087 - RNA, 64 nt, Homo Sapiens
aauauuaagauaauuuuaggccaaggaaauauugugauccuaagucagaucacuuucaaauugc

SEQ ID NO: 299088 - RNA, 64 nt, Homo Sapiens
guugaguuaggaaaauaugguugccuuaccaucaugauccuacuaugguaaaaauaacuugcau

SEQ ID NO: 299089 - RNA, 64 nt, Homo Sapiens
uuagauugaugacuucugugaauagaaaucauccugauccuauuuuaccuggccuccagggccu

SEQ ID NO: 299090 - RNA, 51 nt, Homo Sapiens
gugaguauggcaaaacuuaauugauccuacaagcuuacuacacauaggaaa

SEQ ID NO: 299091 - RNA, 64 nt, Homo Sapiens
auggaacguauuuauuugaaagcauuaaaauaaaugauccuagagcaugugcauaaugagagga

SEQ ID NO: 299092 - RNA, 64 nt, Homo Sapiens
aaagaucagaugaaacagaagaugauaguaaaagugauccuaaguaagaacauaauguaaaauu

SEQ ID NO: 299093 - RNA, 64 nt, Homo Sapiens
gcccccgguucccuuguggggcgcagaccuaaacugauccuaaauugggcggcaucgcaucaac

SEQ ID NO: 299094 - RNA, 64 nt, Homo Sapiens
acuuugcgaggccgagguggguggcucaugccugugauccuagcaacaagacugacugggcgug

SEQ ID NO: 299095 - RNA, 64 nt, Homo Sapiens
gacuacaugaaauugugugccccuauuuucuuucugauccuaaaucauuuuguuuuauaaauca

SEQ ID NO: 299096 - RNA, 64 nt, Homo Sapiens
uauauaucucguaacaagaucuuaacaucuuucuugauccuaaauguuucuccuauacuuuguc

SEQ ID NO: 299097 - RNA, 64 nt, Homo Sapiens
ccaaacucuuaaauagaaucccccucauaggcagugauccuagauaccgggcauucccugaagc

SEQ ID NO: 299098 - RNA, 64 nt, Homo Sapiens
guuaacagcaugaauuaacagauucuaugcacugugauccuaagaccccaacuguuuauauuug

SEQ ID NO: 299099 - RNA, 64 nt, Homo Sapiens
gaccuuugagaggauuugaaauugcuucauauugugauccuaaauuuuauauucacuauauucc

SEQ ID NO: 299100 - RNA, 64 nt, Homo Sapiens
cugcuguucguacacagaaacaggacugcucaaaugauccuauuuguauuuucugaugcuauca

SEQ ID NO: 299101 - RNA, 64 nt, Homo Sapiens
uauuagcaagaaauaagaauaguauuagaagaauugauccuauuuugaaccccucuccaguauc

SEQ ID NO: 299102 - RNA, 64 nt, Homo Sapiens
uucuugagcgaucuaauguuucuuguaauauugaugauccuacuaauuauccugcuguucuuua

SEQ ID NO: 299103 - RNA, 64 nt, Homo Sapiens
gaucauacaaauaaucuaagauuauacagucuagugauccuagauuacacaaguaaucuaagcu

SEQ ID NO: 299104 - RNA, 64 nt, Homo Sapiens
aggguuauugacacuagagaaaugaauucucauuugauccuaauuuuccccguauucuacuuga

SEQ ID NO: 299105 - RNA, 64 nt, Homo Sapiens
ugauggccuaaauaaacaccuacguuauuuauuaugauccuagucuguuauuacauuaguauau

SEQ ID NO: 299106 - RNA, 64 nt, Homo Sapiens
gucaccaaaaggauuagaaagaggccaucauagcugauccuaugugcuaauaccaaaagugaaa

SEQ ID NO: 299107 - RNA, 64 nt, Homo Sapiens
cacagcuuccucaugaacuuuuacuucucuggacugauccuauuacggugaaaauaaaagaguu

SEQ ID NO: 299108 - RNA, 64 nt, Homo Sapiens
uucuuccugacugcuuucucacaucuauuuccauugauccuagguucgucgguggcuuaaagua

SEQ ID NO: 299109 - RNA, 64 nt, Homo Sapiens
ccugcaugugggcuccucaguuauugaguuuuugugauccuaucucagucugggggggaacauu

SEQ ID NO: 299110 - RNA, 64 nt, Homo Sapiens
uuuggaaaucagcaucgugggcacugcugaggaaugauccuagugguaggucagaagaagaugc

SEQ ID NO: 299111 - RNA, 64 nt, Homo Sapiens
aagaaauuugggaugcaaaguaccuaaagaucucugauccuaagaaguuacuucuggccaggcg

SEQ ID NO: 299112 - RNA, 64 nt, Homo Sapiens
uagggagauucugacaaacuucuacucuugauugugauccuaauucaaggaauaucaaguccca

SEQ ID NO: 299113 - RNA, 64 nt, Homo Sapiens
caggcaccuuaggaguauagugcccuccagagacugauccuagcacaacggaacccccuuuccc

SEQ ID NO: 299114 - RNA, 64 nt, Homo Sapiens
cucuauuuaaaagauaaccuaggucccagcucccugauccuauggaaguuaucaguggcuagug

SEQ ID NO: 299115 - RNA, 64 nt, Homo Sapiens
gcgauaauguaugugugcccucuggacacguuccugauccuauuaaaaagucaugcaacauguu

SEQ ID NO: 299116 - RNA, 64 nt, Homo Sapiens
caaagcugauucacaaacccaaauccaagagaaaugauccuaucuagggacagagccuaguggu

SEQ ID NO: 299117 - RNA, 64 nt, Homo Sapiens
aaacaaaaaaaugcuuauuuccuuggaagcucccugauccuacacaucaaaaagguaucaaaug

SEQ ID NO: 299118 - RNA, 64 nt, Homo Sapiens
auugguaguaaagguauuauacugaaccuugaauugauccuaagauuccagauacauuccuuuu

SEQ ID NO: 299119 - RNA, 64 nt, Homo Sapiens
agggaaaauugccuugguaagucuguagucuuuaugauccuaaagaaaaagaaaaaaagcuuaa

SEQ ID NO: 299120 - RNA, 64 nt, Homo Sapiens
auuuacaaaguccuuuuacaucuguuuuuucauuugauccuaucgacaaucauaauaauaauaa

SEQ ID NO: 299121 - RNA, 64 nt, Homo Sapiens
uuuuauacuucuuccauuauuaaucuuuaaaucaugauccuaauuagcuguccuuacuuuaacu

SEQ ID NO: 299122 - RNA, 64 nt, Homo Sapiens
acauauuagugcaauccaguccagauuggaccuuugauccuauguggaagggcuguuuuuuaag

SEQ ID NO: 299123 - RNA, 64 nt, Homo Sapiens
aggaacaagcagaagaugccugcagguaucacuuugauccuaugugggagcgacugaaaauaga

SEQ ID NO: 299124 - RNA, 64 nt, Homo Sapiens
gcuuucugaguacgucucuuggggucgcuggaggugauccuaggaucugucucugagaccaaug

SEQ ID NO: 299125 - RNA, 64 nt, Homo Sapiens
agguagccucuucauaggaauaucacuccauaagugauccuaaagcuggguuggggacagggag

SEQ ID NO: 299126 - RNA, 64 nt, Homo Sapiens
ggucuacacugugcugagucugaaggcuggguucugauccuaguuccaccaucaagccaccaac

SEQ ID NO: 299127 - RNA, 64 nt, Homo Sapiens
gcugcugcuuuuucuuggucucugccuugggaaaugauccuauagggcccugugcugucagaau

SEQ ID NO: 299128 - RNA, 64 nt, Homo Sapiens
gacucaggagucugccacuugucaaagaaggugcugauccuaagaauuuuucauucucagaauu

SEQ ID NO: 299129 - RNA, 64 nt, Homo Sapiens
ggaggccucccacgaagggcgaagauggccgagaugauccuaaaaauaaccgaagaaagagagg

SEQ ID NO: 299130 - RNA, 64 nt, Homo Sapiens
aucccaaaacuaccuuggcagguaguuuuaacucugauccuaacuuaacucaauagccauagau

SEQ ID NO: 299131 - RNA, 64 nt, Homo Sapiens
auggauacauguuaaucuucugaaaucuucaauuugauccuaauauggaucuuggaagaaauuu

SEQ ID NO: 299132 - RNA, 64 nt, Homo Sapiens
cuuuuagccugcucucuagaaggauaugcccauuugauccuaacauuauauggauuucuuuaaa

SEQ ID NO: 299133 - RNA, 64 nt, Homo Sapiens
cuaucaagucaguuucaauuggacuggugauaaaugauccuaaaaaaucaacuacaaguacaug

SEQ ID NO: 299134 - RNA, 64 nt, Homo Sapiens
aauguacaguugagcucaggcucucuccccaaagugauccuaagcucuuucucaccuuucccac

SEQ ID NO: 299135 - RNA, 64 nt, Homo Sapiens
acuggagagacuguuccaaaccccaagaguugucugauccuagucuguucccuucugcuucuua

SEQ ID NO: 299136 - RNA, 64 nt, Homo Sapiens
ugccggggcccacaggcagcccugccaccaguggugauccuauccaaagcggccuacagucucc

SEQ ID NO: 299137 - RNA, 64 nt, Homo Sapiens
cuuccacuucagaagcuucugagagggaaugggaugauccuaccaguugccuuuucagaccuga

SEQ ID NO: 299138 - RNA, 64 nt, Homo Sapiens
ccauguggccugcagagcccaaauaucuacugucugauccuacacagaaaaugugugugauccc

SEQ ID NO: 299139 - RNA, 64 nt, Homo Sapiens
acuuugggaguuaaaauacaguggcucaugccugugauccuagcaaaaaauuuggccuggugug

SEQ ID NO: 299140 - RNA, 64 nt, Homo Sapiens
gcucccagcaaccucuacauacacgcccaguggaugauccuacuacaggccuguagugguggag

SEQ ID NO: 299141 - RNA, 64 nt, Homo Sapiens
auaugucucgcuagugauguuuuuaugauaucccugauccuaacugaagagacaguuauuuaua

SEQ ID NO: 299142 - RNA, 64 nt, Homo Sapiens
aauuuauaugcugauauuguuugauucaugaacuugauccuauuuauaauauauguaugcuauc

SEQ ID NO: 299143 - RNA, 64 nt, Homo Sapiens
auaagcuucaucuccgggcuagagcgugcacuugugauccuaaaaaagucauccuccgucuacc

SEQ ID NO: 299144 - RNA, 64 nt, Homo Sapiens
ucacugcaaccuugaacuucggagugcaguggcgugauccuagcgucucacuguuacccaggcu

SEQ ID NO: 299145 - RNA, 64 nt, Homo Sapiens
ucuucacccuucauucuuucugggggugccugauugauccuaucuauaaguuuuccuuuugucc

SEQ ID NO: 299146 - RNA, 64 nt, Homo Sapiens
uucugaugagugauaggugguuaaaggaaugugaugauccuagguguagggugggcuuuuccau

SEQ ID NO: 299147 - RNA, 64 nt, Homo Sapiens
ugacucacauuucuuuuacugugacacaauaaugugauccuaaaacuggcuuauccuugagugu

SEQ ID NO: 299148 - RNA, 64 nt, Homo Sapiens
augugagagauuuuccugauugccuuuuaauauuugauccuauuugaaaauuauuucuugggga

SEQ ID NO: 299149 - RNA, 64 nt, Homo Sapiens
gcccagccccaguacacucuucucuggaccagaucugucccaguccuggaugccuccuccuacu

SEQ ID NO: 299150 - RNA, 64 nt, Homo Sapiens
uuccuccuccuuucuuugggaucccuggguugcccugucccaaccuccuuguuaggugcuuucc

SEQ ID NO: 299151 - RNA, 64 nt, Homo Sapiens
uucuucauagacuccuuuuccugcucuguucauucugucccacugagcgucugucuuuguauuu

SEQ ID NO: 299152 - RNA, 64 nt, Homo Sapiens
agaggagaaugcacaaguguacucuggaccuagccugucccagaaggggcuugucugaaaagcc

SEQ ID NO: 299153 - RNA, 64 nt, Homo Sapiens
uucaucuuguccugagauuuguaguaggaggagccugucccagcaaggcaugcaugcgucacug

SEQ ID NO: 299154 - RNA, 64 nt, Homo Sapiens
caacuccgucaccccagcucgggccagugguagccugucccagacaggguuccgugacuccagu

SEQ ID NO: 299155 - RNA, 64 nt, Homo Sapiens
uugcuaagugaacagaacuacaaacccugugucacugucccaagguggaaaagaaaguacagaa

SEQ ID NO: 299156 - RNA, 64 nt, Homo Sapiens
cguucccucacagcaaagcacacaaacacuuuuucugucccaacaaauugaaguuucagagcua

SEQ ID NO: 299157 - RNA, 64 nt, Homo Sapiens
uguggcaaaugcuggagccuagcagaaaaauuggcugucccacccuacuuucaaagcaaagauc

SEQ ID NO: 299158 - RNA, 64 nt, Homo Sapiens
caacucaguggccugaacacagcaauggccuuagcugucccacacuggcaaggcccuguugacu

SEQ ID NO: 299159 - RNA, 64 nt, Homo Sapiens
cuacacacucgaaaaagagaaaccagcugcgguacugucccauuuuugucaucagcaccagugu

SEQ ID NO: 299160 - RNA, 64 nt, Homo Sapiens
aacuuguaugcuaggcacuuuuguccagagccugcugucccauggagaaaaaguuuuaagcacu

SEQ ID NO: 299161 - RNA, 64 nt, Homo Sapiens
agcuucugccaggcaccucagagcaccagcuccccugucccagggccuaaccacagauccugga

SEQ ID NO: 299162 - RNA, 64 nt, Homo Sapiens
gaacugggagugaggcucagagaaguugagggaccugucccagcaucacauggcugaugacaag

SEQ ID NO: 299163 - RNA, 64 nt, Homo Sapiens
gcuugguuucauguuacaaagcuuucucuucuuacugucccacaugcgugcagugucuugccuu

SEQ ID NO: 299164 - RNA, 64 nt, Homo Sapiens
aagugucuggcgggcgugggguucuccuucugugcugucccaggcugucaccuugaagcauccu

SEQ ID NO: 299165 - RNA, 64 nt, Homo Sapiens
ugugcagaguccauugccccguauuguuccuuaacugucccaucacuuccaucgcgucugucgg

SEQ ID NO: 299166 - RNA, 64 nt, Homo Sapiens
uccaggagacaaggaagguaugcgagcucugugacugucccacgaggacgaacaggugggacuu

SEQ ID NO: 299167 - RNA, 64 nt, Homo Sapiens
agagcuuuccugccuaaugaggauuugcacaccacugucccacauucuucccauugagguccua

SEQ ID NO: 299168 - RNA, 64 nt, Homo Sapiens
acaacugaaccagaagagagggcgugaaggcacacugucccaccgaggaggaauuucugcaugg

SEQ ID NO: 299169 - RNA, 64 nt, Homo Sapiens
uaccaagucagacaccaaggaacuuuucuuggaacugucccagcgaagaaccacugucuagagc

SEQ ID NO: 299170 - RNA, 64 nt, Homo Sapiens
uguggcaacuaaaccaaucgggugcguggcuucccugucccaguauucaaggcucagaaggaau

SEQ ID NO: 299171 - RNA, 64 nt, Homo Sapiens
ccggcccagaugugucccccauaucuccauggcccugucccaggagaggagugcagccuucucc

SEQ ID NO: 299172 - RNA, 64 nt, Homo Sapiens
cccggcaagccacaggaagguugaaaccucagggcugucccagcgagccgcggggaagcuggcu

SEQ ID NO: 299173 - RNA, 64 nt, Homo Sapiens
auggacccagggacaagagacaaccgagaaguuccugucccagagggguacagccccucucuuc

SEQ ID NO: 299174 - RNA, 64 nt, Homo Sapiens
ugauggauggcuucuccaugcccuggcccugguucugucccagccccucagagccccagcgcgc

SEQ ID NO: 299175 - RNA, 64 nt, Homo Sapiens
ugcucagcccucauaugcaugucaggaaccaucucugucccagggccccagcagauggggcugg

SEQ ID NO: 299176 - RNA, 64 nt, Homo Sapiens
ugcagccacacuacucgcucugccaaugccagcccugucccaucggaggccuuggaaccugagc

SEQ ID NO: 299177 - RNA, 64 nt, Homo Sapiens
gaggacgggcuucuguagagaaccccugccccugcugucccaggugacccuccuuuaucuugca

SEQ ID NO: 299178 - RNA, 64 nt, Homo Sapiens
gcagucauucacacaugugauuuaaccauauguucugucccauaauguugcugucgcuccuguu

SEQ ID NO: 299179 - RNA, 64 nt, Homo Sapiens
aaugugggcagagauuggaaugggcagcucaucucugucccacuuggcaucagcuggcgucaug

SEQ ID NO: 299180 - RNA, 64 nt, Homo Sapiens
accaggcaaagcaagugauugggacagagguuaucugucccagguuaucugggcauagaugcag

SEQ ID NO: 299181 - RNA, 64 nt, Homo Sapiens
guucucuccgucucaucggcaguauggggggcagcugucccagugucaauguuuacucaagggu

SEQ ID NO: 299182 - RNA, 64 nt, Homo Sapiens
cagcauuuggccauguucuuuuguuuuucuauuccugucccaaaucaaagagcaugguucucag

SEQ ID NO: 299183 - RNA, 64 nt, Homo Sapiens
gcccacacuucaggggcccagacuuacacccugacugucccaccuucuguccuuguccuggacc

SEQ ID NO: 299184 - RNA, 64 nt, Homo Sapiens
cuccaagaccuggugucucccacugugagcccagcugucccacaggcaguccccauggaccuag

SEQ ID NO: 299185 - RNA, 64 nt, Homo Sapiens
ccuugccucuaugaaccucugcugggcccagccccugucccagcucccgaccugcacuuccugc

SEQ ID NO: 299186 - RNA, 64 nt, Homo Sapiens
acaucugggacugacuuuccgaagucaccccuuucugucccacuccagggcuauagggugugau

SEQ ID NO: 299187 - RNA, 64 nt, Homo Sapiens
ucugcccgcuccauggaaaaugacuggaggaggccugucccaauuccugcgcccugugcccgac

SEQ ID NO: 299188 - RNA, 64 nt, Homo Sapiens
uucaguucaugaauacuccucuguggucagucuccugucccagcuccuucagugagcagaauca

SEQ ID NO: 299189 - RNA, 64 nt, Homo Sapiens
cuguggugccacccucucugagcagguagaccaccugucccaggguaucugaagugggagaaga

SEQ ID NO: 299190 - RNA, 64 nt, Homo Sapiens
aaaggggaaugaagccauucacuucacucaguuccugucccauuuaaccgccccgauccuugau

SEQ ID NO: 299191 - RNA, 64 nt, Homo Sapiens
ccuccaggugucugcagugguuguccccucaaagcugucccacacccuccuccgaggacccuuu

SEQ ID NO: 299192 - RNA, 64 nt, Homo Sapiens
cagaaaaaguuugcugacuugugauugagaccuacugucccauugugagguggccugaagaauc

SEQ ID NO: 299193 - RNA, 64 nt, Homo Sapiens
ugggugacuugguaccugcucaggaccccccgcacugucccaaucccacucaggcccaccucca

SEQ ID NO: 299194 - RNA, 64 nt, Homo Sapiens
cgcuggugacuucguaccugcucaggagcccccacugucccagucccacucaggcccaucucug

SEQ ID NO: 299195 - RNA, 64 nt, Homo Sapiens
cccugcacugcuacccucuauuucccacucagggcugucccagagagaaggcagccgaacugag

SEQ ID NO: 299196 - RNA, 64 nt, Homo Sapiens
guguucucuggucuucucucacaaugcugcaucccugucccauuuuuagggucccugucuauca

SEQ ID NO: 299197 - RNA, 64 nt, Homo Sapiens
cagcaggugccccauccucugcccacagcagacucugucccauggcucuccgggcaguagagug

SEQ ID NO: 299198 - RNA, 64 nt, Homo Sapiens
ugaacccugaguguugcaggcccagcagacccugcugucccaagcccaccccuccucccaccau

SEQ ID NO: 299199 - RNA, 64 nt, Homo Sapiens
aauaccaccaccaaccaccuucuuccucucaacucugucccacaggccugucugguauuugugg

SEQ ID NO: 299200 - RNA, 64 nt, Homo Sapiens
agugaaacuguuuacaauaaccucauacaaccuucugucccaucuccugguucagccuaggugu

SEQ ID NO: 299201 - RNA, 64 nt, Homo Sapiens
cuaggaucacuuuuuaaaaaaucaccacuuguggcugucccagagugcgguuguacauccuccc

SEQ ID NO: 299202 - RNA, 64 nt, Homo Sapiens
gcuuucuggaggacgcgcugccuugggcucucuucugucccaggccgacccaagggagugucag

SEQ ID NO: 299203 - RNA, 64 nt, Homo Sapiens
ccgacccaagggagugucagcggaguuccccugucugucccaggaugccaaagggguuccccug

SEQ ID NO: 299204 - RNA, 64 nt, Homo Sapiens
cagccauggccuggguggaggcaccugaagacgucugucccaaacucccccagcccugagcugg

SEQ ID NO: 299205 - RNA, 64 nt, Homo Sapiens
ugugacuguccugugcgggccauagggcagggcccugucccagcagaugggcuugggagggggc

SEQ ID NO: 299206 - RNA, 64 nt, Homo Sapiens
ccucucuaccaaccccacccgaucauaaucccuccugucccacuauacagcccugucacauuga

SEQ ID NO: 299207 - RNA, 64 nt, Homo Sapiens
acuauuaagugguuuauuaauguacagcuaguuccugucccacaccaagaaucugucugaaacu

SEQ ID NO: 299208 - RNA, 64 nt, Homo Sapiens
aacucugcacuccauggccaccccuggauguccccugucccaccucaccagcaacaucucgagc

SEQ ID NO: 299209 - RNA, 64 nt, Homo Sapiens
gcuuauuggccacugggucugggcgcccauucgucugucccagacccaacagaaggaaggagga

SEQ ID NO: 299210 - RNA, 64 nt, Homo Sapiens
uuuuguaguguucuccacuaauacugguuauccugugcuacagagaaaaucaaagcagucauaa

SEQ ID NO: 299211 - RNA, 64 nt, Homo Sapiens
augaggcaguuaaauaauaauaguuaaugaaggugugcuacagaaaauaaucugguguucuugc

SEQ ID NO: 299212 - RNA, 64 nt, Homo Sapiens
ucaccugcuugcugaugucuaugguguuacagaagugcuacacgggcuacagcugaagauugga

SEQ ID NO: 299213 - RNA, 64 nt, Homo Sapiens
cugccaguacucaugugaguuguaugugcccccagugcuacauacgcagguaugcguaagugug

SEQ ID NO: 299214 - RNA, 64 nt, Homo Sapiens
guuucaaugaaacaauguaucuuguuggcaaagagugcuacaccggccaacaauucuaguaugg

SEQ ID NO: 299215 - RNA, 64 nt, Homo Sapiens
gggugaaaccguugguccaugaagacgucuuguagugcuacauuuaaagacccuuauggaacug

SEQ ID NO: 299216 - RNA, 64 nt, Homo Sapiens
ucagugaaacaggucuuugccauaacuuuaugaagugcuacagaaagcacaaagaauugauuca

SEQ ID NO: 299217 - RNA, 64 nt, Homo Sapiens
uuauuuuaauugguuuaaagucccuuuauaaagagugcuacaugguuuagauaaaggaaacaua

SEQ ID NO: 299218 - RNA, 64 nt, Homo Sapiens
caaaagugucuguacagcagccauccaaguugccccuacuuaguggcuugcccucugccugccu

SEQ ID NO: 299219 - RNA, 64 nt, Homo Sapiens
gcacacaaguauaagacuuuuuguauuacugcucccuacuuaacauacuugaauucucaaauuu

SEQ ID NO: 299220 - RNA, 64 nt, Homo Sapiens
caacuggauguugacuguuaacuagaagcucuguccuacuuacagcacuuuggaucaucaaaaa

SEQ ID NO: 299221 - RNA, 64 nt, Homo Sapiens
uauauuuuccuguuacuacuguauaaagcuuaaaccuacuuaaacaacuacaagcuuuaagguu

SEQ ID NO: 299222 - RNA, 64 nt, Homo Sapiens
aaacucucucauuuggagggaucaugugaguuggccuacuuacaaguagugaaaguucccuuuu

SEQ ID NO: 299223 - RNA, 64 nt, Homo Sapiens
gggcuuccuuauggcuuugcuucccacugggauuccuacuuaggugucugcccucaggggucca

SEQ ID NO: 299224 - RNA, 64 nt, Homo Sapiens
ugucucacaccagccucauuuccaacuccgacuuccuacuuagaauguggcaguggcuuuguga

SEQ ID NO: 299225 - RNA, 64 nt, Homo Sapiens
guccucugcaagcuucuugcugaucagaguuccuccuacuuacaacccagggugugaacauguu

SEQ ID NO: 299226 - RNA, 64 nt, Homo Sapiens
aagugagacaaacaguuguaaagaugaguuuccaccuacuuauaccagagugcuaagaggaaau

SEQ ID NO: 299227 - RNA, 64 nt, Homo Sapiens
augauccuugagucuccucuugggaaccccguucccuacuuagcguugaaugccugaggacgug

SEQ ID NO: 299228 - RNA, 64 nt, Homo Sapiens
uuuauaaagguucucuaguccaaggguuuucaagccuacuuaccaaauaagacugcucaguuuc

SEQ ID NO: 299229 - RNA, 64 nt, Homo Sapiens
ugauuucauaaggaaaaccacuuuccagaugguuccuacuuaaaccugccguuuccacaguaac

SEQ ID NO: 299230 - RNA, 64 nt, Homo Sapiens
agcugccucauugcaagggcugcuagaccgcugcccuacuuaaccucuccaaggaaugggcuug

SEQ ID NO: 299231 - RNA, 64 nt, Homo Sapiens
auuuccuuuaaauauauacugauuuuguucauuaccuacuuaauauaaguaaaauuucaaaauu

SEQ ID NO: 299232 - RNA, 64 nt, Homo Sapiens
agauauguugcuuuuuacuuuuacugauaacaaaccuacuuaagauaauuuacauucgauagug

SEQ ID NO: 299233 - RNA, 64 nt, Homo Sapiens
uucaaguuaaaaaggcugauuccuaugacuggcuccuacuuacagcacacacaaugcacacaac

SEQ ID NO: 299234 - RNA, 64 nt, Homo Sapiens
guaauucaggacuccaaccaaaaacagauaccccccuacuuaauaagccgaaaguaaaaacaca

SEQ ID NO: 299235 - RNA, 64 nt, Homo Sapiens
auagaacaugguuuuggcuaaggaaaaaaaagaaccuacuuaagaaaaaaaagaaaaaagaggg

SEQ ID NO: 299236 - RNA, 64 nt, Homo Sapiens
uuuugugacuuuguuucucaggaaaaaaaauauuccuacuuaaauuuuaagucuauaauucaau

SEQ ID NO: 299237 - RNA, 64 nt, Homo Sapiens
ccacacauuucaaaguugcccuauggaaaugaauccuacuuagugacaagucaucaaauguuug

SEQ ID NO: 299238 - RNA, 64 nt, Homo Sapiens
ugcuggccacugauuccuuugagucucacaaaacccuacuuaggucaucagggcaggaguucuc

SEQ ID NO: 299239 - RNA, 64 nt, Homo Sapiens
cccaugaaaaagugcucaugacauauugagaagaccuacuuacaaaguggcauauauugcaauu

SEQ ID NO: 299240 - RNA, 64 nt, Homo Sapiens
cgaccuucaacuuugcuguaaaccuuuugguuuuccuacuuacucuucuucuguggaguuaucc

SEQ ID NO: 299241 - RNA, 64 nt, Homo Sapiens
accaaaaaauucuuaccguaauauuauaucuugcccuacuuauuuacaaaauaauauguuucug

SEQ ID NO: 299242 - RNA, 64 nt, Homo Sapiens
cugagcugagggaacacugacuguggacagucggccuacuuacuacuguuuuggauccaaggac

SEQ ID NO: 299243 - RNA, 55 nt, Homo Sapiens; identical to SEQ ID NO: 143234

SEQ ID NO: 299244 - RNA, 64 nt, Homo Sapiens
uauaaacagcucacuacacuucuguuggaauuugccuacuuaccgacaaauguauauaaaauuc

SEQ ID NO: 299245 - RNA, 64 nt, Homo Sapiens
cuagugucauauguaaaauggaauagaaucccugccuacuuaaguaacuguuggacaaaugaua

SEQ ID NO: 299246 - RNA, 64 nt, Homo Sapiens
aaaagcuucauucucuucagugucuucuagaugcccuacuuaaagagaacauuuucuuaugucu

SEQ ID NO: 299247 - RNA, 64 nt, Homo Sapiens
gauauucuagaaaaugucacuuuuuccuuagucuccuacuuagauuuuacuuuuuauaaaguuu

SEQ ID NO: 299248 - RNA, 64 nt, Homo Sapiens
auggugcucaacacuuguuaguauuuauugagcaccuacuuauuggcuuucaucauucauucau

SEQ ID NO: 299249 - RNA, 64 nt, Homo Sapiens
cagucaauuaagaguaaguuauacaguaguggacccuacuuauuaauaaaauuugauuguuaag

SEQ ID NO: 299250 - RNA, 64 nt, Homo Sapiens
cuucuaccucugccguuuuccugcaauuccgcuuccuacuuaggcaguucagagagaacaauuc

SEQ ID NO: 299251 - RNA, 64 nt, Homo Sapiens
ccauucauaauuauuuuacauuuaaauuacuguuccuacuuaaguggugagcuugguaaccauu

SEQ ID NO: 299252 - RNA, 64 nt, Homo Sapiens
ucugucaauaacugugcauggucugagauuuuacccuacuuauaagcuaacaaguuagccuguu

SEQ ID NO: 299253 - RNA, 64 nt, Homo Sapiens
gcacugacggguuaacagaaaugcuuugguaauaccuacuuaguuaauuggaggaaguaguaaa

SEQ ID NO: 299254 - RNA, 64 nt, Homo Sapiens
cgcgagaugacauauauagaauuaaaaaguauagccuacuuaaaaacacagaaguuuuuauuuu

SEQ ID NO: 299255 - RNA, 64 nt, Homo Sapiens
aucuaaaauuuguuauucaacaaagaaguuauggccuacuuagauuuauaaaucaauuguuuug

SEQ ID NO: 299256 - RNA, 64 nt, Homo Sapiens
cagauauuuuugggagugacaaacauucucucauccuacuuagccuaccuagauuucucaugac

SEQ ID NO: 299257 - RNA, 64 nt, Homo Sapiens
gagcaucuccaggcaaugaguuuuucaaagaaugccuacuuaguaguaagaugaagcucaggau

SEQ ID NO: 299258 - RNA, 64 nt, Homo Sapiens
cagcuucaaucacugucauuauucuaauccuacuccuacuuaaauuuuaaguuaugagguuuau

SEQ ID NO: 299259 - RNA, 64 nt, Homo Sapiens
aucuccuaauaacguuuugcuuuuuagauguuuuccuacuuaguguagcuaaaauggucagucu

SEQ ID NO: 299260 - RNA, 64 nt, Homo Sapiens
agugcuguguaacccccagucaaaacuuaucacgccuacuuaagaggagauacugaacauuuug

SEQ ID NO: 299261 - RNA, 64 nt, Homo Sapiens
cucaggacuugauacccucuugggaguuuuguuuccuacuuaagauuuauguucaaauuuuagu

SEQ ID NO: 299262 - RNA, 64 nt, Homo Sapiens
agaugaaugcaaaucagaaccaaugaucccuuggccuacuuaguuaaaaccaguucauacaucc

SEQ ID NO: 299263 - RNA, 64 nt, Homo Sapiens
uguuugugaguuuccaguugauuuguagcaaaugccuacuuaguucuuuguggauuguucuaga

SEQ ID NO: 299264 - RNA, 64 nt, Homo Sapiens
aaagcacuuacuucguguccgacucuucugagcaccuacuuacaugcauuacugcaugcacuuc

SEQ ID NO: 299265 - RNA, 64 nt, Homo Sapiens
ugcugcagcucccuggcuucuguggggccccucaccuacuuacccaggugggucccggcucugu

SEQ ID NO: 299266 - RNA, 64 nt, Homo Sapiens
auaacuuaagaauuuuuauaccaucuacaucuauccuacuuaugcagaaaaauaggcaauaaga

SEQ ID NO: 299267 - RNA, 64 nt, Homo Sapiens
augaauuuugcaguaacugguauucuuggguuuuccuacuuaauacacaguaauucagaacuug

SEQ ID NO: 299268 - RNA, 64 nt, Homo Sapiens
uccccaaauauagaucuuauuucugcucauuuccccuacuuauuaaaaucacaccaaacacuua

SEQ ID NO: 299269 - RNA, 64 nt, Homo Sapiens
uacugcguuuacaguucuuuggauuugcgaaaauccuacuuaguaggcauaaacaguuacuugg

SEQ ID NO: 299270 - RNA, 64 nt, Homo Sapiens
agcugaaacguggguaaggagagugaagcaucaaccuacuuagaaauuaauuggacgggagaca

SEQ ID NO: 299271 - RNA, 64 nt, Homo Sapiens
gauaauuuaucguguuaggagaagaacgaugauaccuacuuaacaccucagcaucugcgucgug

SEQ ID NO: 299272 - RNA, 64 nt, Homo Sapiens
agauuuuuuuaaaagccaccuggguugacaccuuccuacuuauccacuagaugucaucagaggu

SEQ ID NO: 299273 - RNA, 64 nt, Homo Sapiens
augugguguaaucaaacccgaugcuuucagaugaccuacuuacaucuucaauguggauaagaua

SEQ ID NO: 299274 - RNA, 64 nt, Homo Sapiens
auacgguaccaauccuaggaacuguauacuaguuccuacuuagaacaaaaguaucaaguuugca

SEQ ID NO: 299275 - RNA, 64 nt, Homo Sapiens
cgauguuagaauaagacuaccauucuaaauaucaccuacuuaugaauaacauguaauaauuuuu

SEQ ID NO: 299276 - RNA, 64 nt, Homo Sapiens
uuuauuaaugcuaucaucucgaccaagcucaaagccuacuuauuagaaacaaugaaguucacaa

SEQ ID NO: 299277 - RNA, 64 nt, Homo Sapiens
cuccgcauuuccaguuguauuagccaauagauuuccuacuuauuuaagcuauuugagcuccggg

SEQ ID NO: 299278 - RNA, 64 nt, Homo Sapiens
auuugcaucaguauaauauauuuuauuuuuaugcccuacuuaauaaaauucuaucuuugauaaa

SEQ ID NO: 299279 - RNA, 64 nt, Homo Sapiens
gaaaaggagaaaauaauuaagacauaaagaaaauccuacuuauauaguuaccaaguccuauuug

SEQ ID NO: 299280 - RNA, 64 nt, Homo Sapiens
uggaagagaaaugucuauuauagaagaucagacuccuacuuaacaagacaaauaaacuauuuug

SEQ ID NO: 299281 - RNA, 64 nt, Homo Sapiens
ggugaagucgcugcauaugugacugucaugagauccuacuuaguaugauccuggcuagaaugau

SEQ ID NO: 299282 - RNA, 64 nt, Homo Sapiens
uuucagauccuagcucaucaucagugaaguccagccuacuuacuuguaacuauuaaccuuucua

SEQ ID NO: 299283 - RNA, 64 nt, Homo Sapiens
aaguaucuucucagcccugcuacugucugcugcuccuacuuagaaguugcaggcaauauccugu

SEQ ID NO: 299284 - RNA, 64 nt, Homo Sapiens
aaguagaaauggugagauugagaguccuaguuuuccuacuuauaugucuguuuugagcuuauuu

SEQ ID NO: 299285 - RNA, 64 nt, Homo Sapiens
uauuucaugugcuauagacaaaccacugcacccaccuacuuagaggucucccaauacaggcaug

SEQ ID NO: 299286 - RNA, 64 nt, Homo Sapiens
gaguggaaaccaggagguuaguugcuuugggaagccuacuuaugugaagaaaauuuaguuguua

SEQ ID NO: 299287 - RNA, 64 nt, Homo Sapiens
aaaaaaaggguagcacuuauaaaauauuuuuaugccuacuuagguggaaaacaagaaggaaaug

SEQ ID NO: 299288 - RNA, 64 nt, Homo Sapiens
uuaaaauuuuaggauaaugaagaguacauaauguccuacuuaauauuuauguuaauaggacuua

SEQ ID NO: 299289 - RNA, 64 nt, Homo Sapiens
ccggcugccccagaggacaguggguggagugguaccuacuuauuaaaugucucagaccccucuc

SEQ ID NO: 299290 - RNA, 64 nt, Homo Sapiens
aacuacuuuuuuauaauuguuaaagaaaaauaauccuacuuauaaauaugaucuuggaaaauuu

SEQ ID NO: 299291 - RNA, 64 nt, Homo Sapiens
uguuuacucuaaucaaggcaggagaugcagcaguccuacuuauugccauguggacuugugggaa

SEQ ID NO: 299292 - RNA, 64 nt, Homo Sapiens
gccagagaaaaaaaucguauugaauggccauuucccuacuuauaagaugucucaaucugaauuu

SEQ ID NO: 299293 - RNA, 64 nt, Homo Sapiens
uggcccugcaaauguuuacagaaaugaaauucuuccuacuuauauaagaaaucucacacugaga

SEQ ID NO: 299294 - RNA, 64 nt, Homo Sapiens
uguguguguguguguguccacacuggccagccucccuacuuaccaagguucuccacugcuuacc

SEQ ID NO: 299295 - RNA, 64 nt, Homo Sapiens
ugucauucgcucauguaagagcaaaguucaagugccuacuuauguucuuaaaccaggugaaaga

SEQ ID NO: 299296 - RNA, 64 nt, Homo Sapiens
cuaugguguguacuuuuuguccuaauaucaggcgccuacuuaacuuagaugaauuauugaucuu

SEQ ID NO: 299297 - RNA, 64 nt, Homo Sapiens
ucaguucgauauuuuacuuuagaaccuggaaucuccuacuuaauauaugaccaugacuuugaaa

SEQ ID NO: 299298 - RNA, 64 nt, Homo Sapiens
acauuuuuaggagaaaguaaguugcuuugcaccgccuacuuaauucuuuuccauauauugugau

SEQ ID NO: 299299 - RNA, 64 nt, Homo Sapiens
cuuaucuaugauugaguguccguguaaauaaauuccuacuuagacuuaccacuuugugugugcu

SEQ ID NO: 299300 - RNA, 64 nt, Homo Sapiens
uggccaccauacaguggccucaaagcaaccauggccuacuuaaaaaccaaaccaaaaauaaaga

SEQ ID NO: 299301 - RNA, 64 nt, Homo Sapiens
cccuggcagaggggaugccaggaggguaguugugccuacuuauccugagcaugccauuuugagg

SEQ ID NO: 299302 - RNA, 64 nt, Homo Sapiens
ucagauucaccuccauuaaccaucggggauuccaccuacuuauuaauacucuuccaaaagccug

SEQ ID NO: 299303 - RNA, 64 nt, Homo Sapiens
ccucaaugcacaugauugauuaaacaccauuuacccuacuuaucccuuucuuuagaaugcuguu

SEQ ID NO: 299304 - RNA, 64 nt, Homo Sapiens
ucuuaaagauggacagccugaagaaaucuuccuuccuacuuaugcaguuaacgggugaugaagc

SEQ ID NO: 299305 - RNA, 64 nt, Homo Sapiens
aauacugccccacuuuaauauauguaagcaacuuccuacuuauacacgacguguuccuaaaaca

SEQ ID NO: 299306 - RNA, 64 nt, Homo Sapiens
gaaagguguggugcuggaacaucgaugaaggagcccuacuuacugagcuuaguuauggacuuuu

SEQ ID NO: 299307 - RNA, 64 nt, Homo Sapiens
ucuuuaaugaggaauaauaugcauguagaaaagaccuacuuaaagucuucauuuauauucuuuc

SEQ ID NO: 299308 - RNA, 64 nt, Homo Sapiens
auuuacuuaaacguacuuucaggagugagcaaguccuacuuauaaaccuauauuaacuuuauuu

SEQ ID NO: 299309 - RNA, 64 nt, Homo Sapiens
aucacuacaagaaaacugagggagcacagcauccccuacuuacucuguaagagaaaugcaguca

SEQ ID NO: 299310 - RNA, 64 nt, Homo Sapiens
auuuuccacucuaucuuuguuccauguauuuuuuccuacuuaggcuguugcucauuugcccuuu

SEQ ID NO: 299311 - RNA, 64 nt, Homo Sapiens
uugcucauaaagccuuuucuggggagacacuacuccuacuuaucaagugaaaaacuguguuggg

SEQ ID NO: 299312 - RNA, 64 nt, Homo Sapiens
uccaaaauaccuguauccaacccuucacuuaacuccuacuuagcguuuucagaggcauucccag

SEQ ID NO: 299313 - RNA, 64 nt, Homo Sapiens
gaucugaguucuucaguuccucagggguaccccaccuacuuaggaaugaaauguggcaguccuc

SEQ ID NO: 299314 - RNA, 64 nt, Homo Sapiens
ugaugugauuuauuaauauauguuauugaaacuuccuacuuauuuuucaauguaucuacaggcu

SEQ ID NO: 299315 - RNA, 64 nt, Homo Sapiens
aauuagggaacuucaaauagugcguagacuuuucccuacuuaccauuggguucaauugauguag

SEQ ID NO: 299316 - RNA, 50 nt, Homo Sapiens; identical to SEQ ID NO: 143307

SEQ ID NO: 299317 - RNA, 64 nt, Homo Sapiens
ucuguggcagcaaagaaaagggcuuaauuuucccccuacuuaguacagguuaaaugaaccccug

SEQ ID NO: 299318 - RNA, 64 nt, Homo Sapiens
ccugugaggaacaggccucaggcccuugccacgaccuacuuaggcuacaauuuccuuuaaggca

SEQ ID NO: 299319 - RNA, 64 nt, Homo Sapiens
cuguuaaaugcaguuuuaaauuuauaucguaacaccuacuuaagugccugacacaguagguauu

SEQ ID NO: 299320 - RNA, 64 nt, Homo Sapiens
uggaagaugaacacuugaggacuucagcuucucaccuacuuaguacaguugggaaccauacacu

SEQ ID NO: 299321 - RNA, 64 nt, Homo Sapiens
ggcacaacuaaaugcuuuauacaaaaaaaauuagccuacuuaaaagacuccaucucaaaacaaa

SEQ ID NO: 299322 - RNA, 64 nt, Homo Sapiens
auuguuuauucucaauuuacaauuauccaauaauccuacuuacugccauacauacauuucauuu

SEQ ID NO: 299323 - RNA, 64 nt, Homo Sapiens
uacuaccugcgacuuucuuuuuuucaugugcccaccuacuuaccguuggacagagcagcuuggc

SEQ ID NO: 299324 - RNA, 64 nt, Homo Sapiens
uggggaccccggcuggggcaggcugcauucagccccuacuuaccgccuguccagcggccucuuu

SEQ ID NO: 299325 - RNA, 64 nt, Homo Sapiens
uggagggugccaucgagggcuccggaucccuuauccuacuuagcaguguuggucucuggggcug

SEQ ID NO: 299326 - RNA, 64 nt, Homo Sapiens
gauucaaggaaggaagugggaacaagguuggaugccuacuuaugagcuugaccaucacagcuau

SEQ ID NO: 299327 - RNA, 64 nt, Homo Sapiens
cacggccaccacugcagccgggggcuggccuucuccuacuuagggaagaaaaagcaaguguuca

SEQ ID NO: 299328 - RNA, 64 nt, Homo Sapiens
ucugauaaaccugucuaagcguaugaguguugugccuacuuaaucuggaaaugcuuuucugaaa

SEQ ID NO: 299329 - RNA, 64 nt, Homo Sapiens
aaagaagauuaauuaauuuccuauccuaaucccuccuacuuauacuuccccaaaaaacaagcuu

SEQ ID NO: 299330 - RNA, 64 nt, Homo Sapiens
uggaggucagcccguuacccccauaacugauuuaccuacuuaccauacugggagguagaagaga

SEQ ID NO: 299331 - RNA, 64 nt, Homo Sapiens
aagaaaaauauuguauuuuuuuagaauguuuaguccuacuuaguuuuuguuuuccaguagggga

SEQ ID NO: 299332 - RNA, 64 nt, Homo Sapiens
guugaccaagcugcuuaaagcugcucucuagaacccuacuuacauuugauccuaaccuuuuagc

SEQ ID NO: 299333 - RNA, 64 nt, Homo Sapiens
uuguucacuuuacuugccugccugucucagcggaccuacuuaaguaccauaauccccaccgcuu

SEQ ID NO: 299334 - RNA, 64 nt, Homo Sapiens
uccuuagcaaagagacccugcccugccucuuuccccuacuuagcuugguccugcugggagcucc

SEQ ID NO: 299335 - RNA, 64 nt, Homo Sapiens
aaaaugccuuuuacucaggggagccuggacacguccuacuuaagcacccccaggacugcugcug

SEQ ID NO: 299336 - RNA, 64 nt, Homo Sapiens
guuggauucugcagacugaaacgaguaaagcuugccuacuuaauacacucaaguguggggaguc

SEQ ID NO: 299337 - RNA, 64 nt, Homo Sapiens
ccuuaaauaaguuuagauuuucaaugcacguuauccuacuuaauuacuugauucuuuuagcaaa

SEQ ID NO: 299338 - RNA, 64 nt, Homo Sapiens
gccucuccaccucucacccacucucuccuaauccccuacuuaaguagggcuugccccacuucag

SEQ ID NO: 299339 - RNA, 64 nt, Homo Sapiens
uauaacacaucacaucuaagaauaaaggcugccuccuacuuaauugcuauauaacaauugucca

SEQ ID NO: 299340 - RNA, 64 nt, Homo Sapiens
gauauaccuuguauauuuacaucaccgaauaauuccuacuuacuacguuguccuaguuucugga

SEQ ID NO: 299341 - RNA, 64 nt, Homo Sapiens
auuuaugcaugagaacuaaauagauuuuuagauuccuacuuaaacaaaaacuuuccaugacagu

SEQ ID NO: 299342 - RNA, 64 nt, Homo Sapiens
ugcagaaugagcccaccuggcuuugaaucugggcccuacuuaacuuaucagcuaugugguuuug

SEQ ID NO: 299343 - RNA, 64 nt, Homo Sapiens
cagcugccagccuucuguccugggcaaacuacucccuacuuaagggaauaggccaggcuccauc

SEQ ID NO: 299344 - RNA, 64 nt, Homo Sapiens
aacuccuuguuugcacauuauuauggaacacuuuccuacuuaggcaguuacucuuccauguuua

SEQ ID NO: 299345 - RNA, 64 nt, Homo Sapiens
aaaagcagcaccugugggccauacuaaaagauccccuacuuacguucugguugucauguuuccc

SEQ ID NO: 299346 - RNA, 64 nt, Homo Sapiens
augaauucuuccuagauagucgcccacuccaccuccuacuuaaccugagacucauuauuuagcu

SEQ ID NO: 299347 - RNA, 64 nt, Homo Sapiens
uuugguaccuaugaaccuagaacuugaagugacuccuacuuaucacguaaauuuuuaugucuga

SEQ ID NO: 299348 - RNA, 64 nt, Homo Sapiens
augagaauguacuuauauuuuguuuugcuauuaaccuacuuacgggguuagggauuugcggggg

SEQ ID NO: 299349 - RNA, 64 nt, Homo Sapiens
caaugcggaugcccaacugucacuagggucuccaccuacuuauacauauccuucaaaagaacca

SEQ ID NO: 299350 - RNA, 64 nt, Homo Sapiens
cccagucauucuagagggaugccugcccugucucccuacuuagaacaccaguccacgccggguc

SEQ ID NO: 299351 - RNA, 64 nt, Homo Sapiens
uguguuuuuaguuacacacacacacacacacacaccuacuuaaauggaaucuaaacauuuuuag

SEQ ID NO: 299352 - RNA, 64 nt, Homo Sapiens
auuccauuuuaauugauaugaggguguuaaaguaccuacuuaauggguugauuacuaucaaaau

SEQ ID NO: 299353 - RNA, 64 nt, Homo Sapiens
uuuccaccuaccgcuuaccugaaaugcaggaucaccuacuuacuguauucuacauuauuauaug

SEQ ID NO: 299354 - RNA, 64 nt, Homo Sapiens
ccacauaagagaugcauuuuacugguaacuaagaccuacuuaugauucaucgagcucuaucaac

SEQ ID NO: 299355 - RNA, 64 nt, Homo Sapiens
ccguaaggggaaaugaaggcguaagacgauauaaccuacuuacuuaagggagacauuuuaguca

SEQ ID NO: 299356 - RNA, 64 nt, Homo Sapiens
uaguugaaauaucaaggaggcugaaaacuagaguccuacuuacaggggaaauuauauaccguga

SEQ ID NO: 299357 - RNA, 64 nt, Homo Sapiens; identical to SEQ ID NO: 235738

SEQ ID NO: 299358 - RNA, 64 nt, Homo Sapiens; identical to SEQ ID NO: 235739

SEQ ID NO: 299359 - RNA, 64 nt, Homo Sapiens
ucagucagucucuguaguuaaaacuuuuucuuuaaaauucaauuaagguacuucucccucaggg

SEQ ID NO: 299360 - RNA, 64 nt, Homo Sapiens
ucagucagucucuguaguuaaaacuuuuucuuuaaaauucaauuaaguuacaccagaauuuaca

SEQ ID NO: 299361 - RNA, 64 nt, Homo Sapiens
gaaaacugaauuuugacuuuaaauaaaaauuuaaaaauucaauuugcuguguauuguauuuuuc

SEQ ID NO: 299362 - RNA, 64 nt, Homo Sapiens
uuucuggcccugaacucauacauaguugaagcuuaaauucaaguaaucacaaacuaguaagaga

SEQ ID NO: 299363 - RNA, 64 nt, Homo Sapiens
ccuuuauuuugugucuugggaucaaacuauaagaaaauucaaguuagucaguaaaauguuagaa

SEQ ID NO: 299364 - RNA, 64 nt, Homo Sapiens
agcuuugcaaauacuaguuggaagaucaacagaaaaauucaaguaucauuauuuaacaacaagu

SEQ ID NO: 299365 - RNA, 64 nt, Homo Sapiens
uaaaaaaccaguauauauagucuguucauauguaaaauucaauggaagagagguggaacagugc

SEQ ID NO: 299366 - RNA, 64 nt, Homo Sapiens
aggguuaugcaauucccggccuggagcauuuuugaaauucaaauugucuguccuguggagcagg

SEQ ID NO: 299367 - RNA, 64 nt, Homo Sapiens
cucugauuguccucagccuccacuuccccagaguaaauucaaauugaaucgagcucugcugcuc

SEQ ID NO: 299368 - RNA, 64 nt, Homo Sapiens
uuaagacaaggucaugcuggaugaagguagaccuaaauucaauaugacugguuuccuuguauga

SEQ ID NO: 299369 - RNA, 64 nt, Homo Sapiens
uuuuugugucuguuuuuuuuuuuuuucuuggacuaaauucaacugcauggaagcgguggucaga

SEQ ID NO: 299370 - RNA, 64 nt, Homo Sapiens
uauguaugguuugaaaauauuuucauuauacaugaaauucaacuuuccaaauaaaaguucuacu

SEQ ID NO: 299371 - RNA, 64 nt, Homo Sapiens
auaauuguggauauaaaagaacaccagagaucagaaauucaaaaacucagaauaaaaaugaaaa

SEQ ID NO: 299372 - RNA, 64 nt, Homo Sapiens
aaaagauaagacaguggcauagaguuaauauuuaaaauucaaauauuaaaacucaaauaaaccc

SEQ ID NO: 299373 - RNA, 64 nt, Homo Sapiens
uuaaacuaauuguauucugagguaaccacaaaauaaauucaaccaaacugggguccaccaagug

SEQ ID NO: 299374 - RNA, 64 nt, Homo Sapiens
ugguuuggcagugcaagaauucuguaacauuaacaaauucaauaaaaaguaaauauauggauuu

SEQ ID NO: 299375 - RNA, 64 nt, Homo Sapiens
aagcuuucuguuuguguuccauauauauauauauaaauucaauacacaagcuaccaucucagau

SEQ ID NO: 299376 - RNA, 64 nt, Homo Sapiens
cuugccaauaaaugaauagcugcaugcuaaaugaaaauucaaaauuuaucacauguagcucuuu

SEQ ID NO: 299377 - RNA, 64 nt, Homo Sapiens
uugaaucauuugucauguauuauuugauccuuuuaaauucaaauauuuugcuuuccuggcuaau

SEQ ID NO: 299378 - RNA, 64 nt, Homo Sapiens
uugguuuaugcaaauacagcccaucaagugucugaaauucaauaaauacaguugucuagccaag

SEQ ID NO: 299379 - RNA, 64 nt, Homo Sapiens
ggaauaagaaaggauuaaacaguuacaagccuccaaauucaaauaaaauuaaaucacaguucag

SEQ ID NO: 299380 - RNA, 64 nt, Homo Sapiens
acggucucaccgaugcaguuuucauggacauagaaaauucaaauagaauauauaauauugaauu

SEQ ID NO: 299381 - RNA, 64 nt, Homo Sapiens
gaauuuguaacauuguuaaugcacuaagugauuuaaauucaauugaugaagaugugauuuuaca

SEQ ID NO: 299382 - RNA, 64 nt, Homo Sapiens
uagcucaauuuugagauaauggaaaauugacuggaaauucaaaacucaaacuacuaucuuuaga

SEQ ID NO: 299383 - RNA, 64 nt, Homo Sapiens
guuugugcucaauuucagacacucauuuauaaacaaauucaaccaagggauauuuacugcuuua

SEQ ID NO: 299384 - RNA, 64 nt, Homo Sapiens
aauuauuuugcauuaauacaguauacacauuuguaaauucaacaggaaauuauugaguuuugga

SEQ ID NO: 299385 - RNA, 64 nt, Homo Sapiens
uuuaacuaguucucgaacuuuacuaugcauaagaaaauucaaacuggagagaaacucuacaaau

SEQ ID NO: 299386 - RNA, 64 nt, Homo Sapiens
acauaagauaauuuauacuggagcaaaaccuuggaaauucaaagaaugugguaaaacuuacaau

SEQ ID NO: 299387 - RNA, 64 nt, Homo Sapiens
ucauuuggaggauuuucuucuuuguaauguaaagaaauucaaaguuaucaaaguuccuuaaaug

SEQ ID NO: 299388 - RNA, 64 nt, Homo Sapiens
gaccuguaauauccacauugugaagcuguguaugaaauucaacuauaauaugaauaaauuugaa

SEQ ID NO: 299389 - RNA, 64 nt, Homo Sapiens
guuuauuuuuuuuuucuuggauugaaaaguacugaaauucaaugugacauuaaaaugcaaauuu

SEQ ID NO: 299390 - RNA, 64 nt, Homo Sapiens
auauuucauuagcuugaauuguauagauuuuuaaaaauucaaugaaagcauguuguuuaauuuc

SEQ ID NO: 299391 - RNA, 64 nt, Homo Sapiens
aaugauguugagugggagauuuugccaaaaacuaaaauucaacaaagaacaaacagaaacgaga

SEQ ID NO: 299392 - RNA, 64 nt, Homo Sapiens
cuuauuuucugaauucauaauguccccauucuauaaauucaacaucguucugggucagcuugaa

SEQ ID NO: 299393 - RNA, 64 nt, Homo Sapiens
uugugucaaaaugauauagcuuaguauaaaaauaaaauucaacguuuuggccaaaauguuuguu

SEQ ID NO: 299394 - RNA, 64 nt, Homo Sapiens
aaauguuuguuuuucacuggauucugaauauaauaaauucaaaguacccuuuuuuuagaguuuc

SEQ ID NO: 299395 - RNA, 64 nt, Homo Sapiens
uagaauuacccuaugauucaggagguucgucacaaaauucaacacugcuguuggaaaacgcuau

SEQ ID NO: 299396 - RNA, 64 nt, Homo Sapiens
aaagaacguugaaccaaauaggauguagaaaauaaaauucaagacauccacaaaaauaugcaau

SEQ ID NO: 299397 - RNA, 64 nt, Homo Sapiens
cuacgauauuuucuuauugcucucuuggcauuccaaauucaaggaguuucuauuaucuccaacc

SEQ ID NO: 299398 - RNA, 64 nt, Homo Sapiens
caaauuugcagaacccuguaaaaauuuuuuaauuaaauucaaguugggagucguuuuuuuuaaa

SEQ ID NO: 299399 - RNA, 64 nt, Homo Sapiens
caauuucaaggaaaaacaucuaggcgagcaaauaaaauucaaauucuggauaguaggauuuuaa

SEQ ID NO: 299400 - RNA, 64 nt, Homo Sapiens
cauggggagauuccugcuaggaaaggcuuagggaaaauucaaguuuuagacucauggaauauga

SEQ ID NO: 299401 - RNA, 64 nt, Homo Sapiens
aaucaaauccaauccaaucauuaauuacuuacucaaauucaaugaacccaaguggaaucaucac

SEQ ID NO: 299402 - RNA, 64 nt, Homo Sapiens
agucauauuaaaaauauacaucacacuuaucuggaaauucaauagugagaauauacuuagaaaa

SEQ ID NO: 299403 - RNA, 64 nt, Homo Sapiens
auuuaggaaugugaccuuuaaaguggugcuuagaaaauucaagcuaggaaauucuugaaaauau

SEQ ID NO: 299404 - RNA, 64 nt, Homo Sapiens
uauacaucuugggaguacaaacagcuuuacuuuaaaauucaaguccuucuucuaguuuuaugcg

SEQ ID NO: 299405 - RNA, 64 nt, Homo Sapiens
uauuguuuaguacagagacugagcaaauacuacaaaauucaacuuaaccuucauuucauugguu

SEQ ID NO: 299406 - RNA, 64 nt, Homo Sapiens
gacuucccugacuacuaccuucauauuucauuucaaauucaaacuucugagguugcagcauaua

SEQ ID NO: 299407 - RNA, 64 nt, Homo Sapiens
aauguuguaacugaaagcacuguuuuagagaaggaaauucaaaaauggacaccucugcugugaa

SEQ ID NO: 299408 - RNA, 64 nt, Homo Sapiens
caugucacccaagcucuguuugugguaagguugcaaauucaaaauuuuaugauguucaucacag

SEQ ID NO: 299409 - RNA, 64 nt, Homo Sapiens
gaauuuauuuguguguucuuuguuccaaauuaucaaauucaaguggcacuguauucauugccaa

SEQ ID NO: 299410 - RNA, 64 nt, Homo Sapiens
aaauguguuacaaagauacuugucuuaguuauaaaaauucaaagaucugauaaaaaaauuuucu

SEQ ID NO: 299411 - RNA, 64 nt, Homo Sapiens
auuucagcuagauuuggaaaaggaaagguacuacaaauucaaaagauuucacuuuuaacacugg

SEQ ID NO: 299412 - RNA, 64 nt, Homo Sapiens
aucaucucaauagauacagaaaaggcuuuugauaaaauucaacuugacuucauguuaaaaaccc

SEQ ID NO: 299413 - RNA, 64 nt, Homo Sapiens
aguuccauuuucucucuugugaaaaacaucuuuaaaauucaaacuuccauauguuacugaaucu

SEQ ID NO: 299414 - RNA, 64 nt, Homo Sapiens
cauuggucacacuaauaacaauuuuauucuuuggaaauucaauguacaguacugaaguaaucug

SEQ ID NO: 299415 - RNA, 64 nt, Homo Sapiens
gaagagaaaaagaaaaacagggucuacuuuaaaaaaauucaaaucuuaaauaaagaaaguguga

SEQ ID NO: 299416 - RNA, 64 nt, Homo Sapiens
uugcucuguuuugcuuuuccauauagcucgagcaaaauucaaaaagaacuaaauaugcaauaua

SEQ ID NO: 299417 - RNA, 64 nt, Homo Sapiens
gaugcccuguugguuucacagauaacauaaauaaaaauucaaccacagauuuauacaaggguua

SEQ ID NO: 299418 - RNA, 64 nt, Homo Sapiens
acggugcuuaagguuucaugauugccacauucuaaaauucaaauauauauuuacuguuauauag

SEQ ID NO: 299419 - RNA, 64 nt, Homo Sapiens
aaagagaggagagaauugaaaaaccuuguuucccaaauucaauuaaauauuguaucccuuuguc

SEQ ID NO: 299420 - RNA, 64 nt, Homo Sapiens
ccuuuacuccuuaaaaaagaaaggaaagaucucuaaauucaaagcuagauuguaaauaggcauu

SEQ ID NO: 299421 - RNA, 64 nt, Homo Sapiens
ucuccuuuuuucggaauugaaacauuuuaauuucaaauucaaauagaacauuuaaaaugauuuc

SEQ ID NO: 299422 - RNA, 64 nt, Homo Sapiens
gguguuuuuuuguaaaacacaauguggcuaguccaaauucaaauauugaguuauugagcacuga

SEQ ID NO: 299423 - RNA, 64 nt, Homo Sapiens
aauggaagaguaaauuacauucccaguuuagagaaaauucaagguuuaagccucaagagccaac

SEQ ID NO: 299424 - RNA, 64 nt, Homo Sapiens
gcugcagguggagcuggagcaagaauaccaagacaaauucaaaagacugccccucgagauuuug

SEQ ID NO: 299425 - RNA, 64 nt, Homo Sapiens
auguaugugagauuuuuguuuucuuuccaauagcaaauucaaagcaagcaacuugcaggcucca

SEQ ID NO: 299426 - RNA, 64 nt, Homo Sapiens
ucuuaagauauggaccuuuucauugauaagcccuaaauucaaauccaccccuguauuucaagau

SEQ ID NO: 299427 - RNA, 64 nt, Homo Sapiens
aaaaaauguuuuacucuuauuuuuaauuaguucuaaauucaaccauuuaaagcuaccauaaugc

SEQ ID NO: 299428 - RNA, 64 nt, Homo Sapiens; identical to SEQ ID NO: 21903

SEQ ID NO: 299429 - RNA, 64 nt, Homo Sapiens; identical to SEQ ID NO: 21904

SEQ ID NO: 299430 - RNA, 64 nt, Homo Sapiens; identical to SEQ ID NO: 21905

SEQ ID NO: 299431 - RNA, 64 nt, Homo Sapiens; identical to SEQ ID NO: 21906

SEQ ID NO: 299432 - RNA, 64 nt, Homo Sapiens; identical to SEQ ID NO: 21907

SEQ ID NO: 299433 - RNA, 64 nt, Homo Sapiens; identical to SEQ ID NO: 21908

SEQ ID NO: 299434 - RNA, 64 nt, Homo Sapiens; identical to SEQ ID NO: 21909

SEQ ID NO: 299435 - RNA, 64 nt, Homo Sapiens; identical to SEQ ID NO: 21910

SEQ ID NO: 299436 - RNA, 64 nt, Homo Sapiens; identical to SEQ ID NO: 21911

SEQ ID NO: 299437 - RNA, 64 nt, Homo Sapiens; identical to SEQ ID NO: 21912

SEQ ID NO: 299438 - RNA, 64 nt, Homo Sapiens; identical to SEQ ID NO: 21913

SEQ ID NO: 299439 - RNA, 64 nt, Homo Sapiens; identical to SEQ ID NO: 21914

SEQ ID NO: 299440 - RNA, 64 nt, Homo Sapiens; identical to SEQ ID NO: 21915

SEQ ID NO: 299441 - RNA, 64 nt, Homo Sapiens; identical to SEQ ID NO: 21916

SEQ ID NO: 299442 - RNA, 64 nt, Homo Sapiens; identical to SEQ ID NO: 21917

SEQ ID NO: 299443 - RNA, 64 nt, Homo Sapiens; identical to SEQ ID NO: 21918

SEQ ID NO: 299444 - RNA, 64 nt, Homo Sapiens; identical to SEQ ID NO: 21919

SEQ ID NO: 299445 - RNA, 64 nt, Homo Sapiens; identical to SEQ ID NO: 21920

SEQ ID NO: 299446 - RNA, 64 nt, Homo Sapiens; identical to SEQ ID NO: 21921

SEQ ID NO: 299447 - RNA, 64 nt, Homo Sapiens; identical to SEQ ID NO: 21922

SEQ ID NO: 299448 - RNA, 64 nt, Homo Sapiens; identical to SEQ ID NO: 21923

SEQ ID NO: 299449 - RNA, 64 nt, Homo Sapiens; identical to SEQ ID NO: 21924

SEQ ID NO: 299450 - RNA, 64 nt, Homo Sapiens; identical to SEQ ID NO: 21925

SEQ ID NO: 299451 - RNA, 64 nt, Homo Sapiens; identical to SEQ ID NO: 21926

SEQ ID NO: 299452 - RNA, 64 nt, Homo Sapiens; identical to SEQ ID NO: 21927

SEQ ID NO: 299453 - RNA, 64 nt, Homo Sapiens; identical to SEQ ID NO: 21928

SEQ ID NO: 299454 - RNA, 64 nt, Homo Sapiens; identical to SEQ ID NO: 21929

SEQ ID NO: 299455 - RNA, 64 nt, Homo Sapiens; identical to SEQ ID NO: 21930

SEQ ID NO: 299456 - RNA, 64 nt, Homo Sapiens; identical to SEQ ID NO: 21931

SEQ ID NO: 299457 - RNA, 64 nt, Homo Sapiens; identical to SEQ ID NO: 21932

SEQ ID NO: 299458 - RNA, 64 nt, Homo Sapiens; identical to SEQ ID NO: 21933

SEQ ID NO: 299459 - RNA, 64 nt, Homo Sapiens; identical to SEQ ID NO: 21934

SEQ ID NO: 299460 - RNA, 64 nt, Homo Sapiens; identical to SEQ ID NO: 21935

SEQ ID NO: 299461 - RNA, 64 nt, Homo Sapiens; identical to SEQ ID NO: 21936

SEQ ID NO: 299462 - RNA, 64 nt, Homo Sapiens
uuagagacauuggcauugccaugcccucuuuggaggguagaagaggcaaaacacuuuuuucacc

SEQ ID NO: 299463 - RNA, 64 nt, Homo Sapiens
aaaacacuuuuuucacccuuuggaaucauaguauggguagaaguuaugauuuaucuugaaauaa

SEQ ID NO: 299464 - RNA, 64 nt, Homo Sapiens
uuguugcccuggggcuuaucugauuaugggacgaggguagaaaguaagaagcacuuuugaauuu

SEQ ID NO: 299465 - RNA, 64 nt, Homo Sapiens
aggguagaaaguaagaagcacuuuugaauuugugggguagaacuucaacaauaagucaguucua

SEQ ID NO: 299466 - RNA, 64 nt, Homo Sapiens
uagcagauuggaugggcagguggagaaugccuggggguagaaauguuagaucuugcaacaucag

SEQ ID NO: 299467 - RNA, 64 nt, Homo Sapiens
guaaacuauccuagguaauuucagguacuuucucuuaugcaauuaauuuuauuaacugauuucu

SEQ ID NO: 299468 - RNA, 64 nt, Homo Sapiens
gaccccagccccaucccaaucucuagcgaaaggguuaugcaaaucucaggguguugccucuaaa

SEQ ID NO: 299469 - RNA, 64 nt, Homo Sapiens
uucuaagcccaaacaugacucauucuguguaacauuaugcaaacguuucggaagauaucauaau

SEQ ID NO: 299470 - RNA, 64 nt, Homo Sapiens
gcaccuauguguaacuucccaauaguuuggauaguuaugcaaauuguacuugugaaaacaguaa

SEQ ID NO: 299471 - RNA, 64 nt, Homo Sapiens
acauaugucugucuuugcaaagcaauuuauaucuuuaugcaaaaacuaaauuaguuuaaaauga

SEQ ID NO: 299472 - RNA, 64 nt, Homo Sapiens
ggaaaccugugaaagcugcaaaaagacaccugccuuaugcaagggcaacauuaccuugucuuuc

SEQ ID NO: 299473 - RNA, 64 nt, Homo Sapiens
uacagaaauuuaauucagaaccccaacuacuguguuaugcaaaagcaagcugauuaaaugacac

SEQ ID NO: 299474 - RNA, 64 nt, Homo Sapiens
agggagaagugacauugcaucaaagcaucuugcauuaugcaauuuuuauauuaaccagauauau

SEQ ID NO: 299475 - RNA, 64 nt, Homo Sapiens
uuauaaugggaucauguuaaguagaaguagcuuuuuaugcaaauacaugcauuuaugcaauauu

SEQ ID NO: 299476 - RNA, 64 nt, Homo Sapiens
aaguagaaguagcuuuuuaugcaaauacaugcauuuaugcaauauuaauguaagggcucuaaaa

SEQ ID NO: 299477 - RNA, 64 nt, Homo Sapiens
ugugugugaauauguguuacaccuaggaugggcauuaugcaaaagcacaaagauuauauaugac

SEQ ID NO: 299478 - RNA, 64 nt, Homo Sapiens
cguuuucugucaaaguuccuuuugcaugaaacaauuaugcaaacuuauaauuauuagugcugaa

SEQ ID NO: 299479 - RNA, 64 nt, Homo Sapiens
uagggucuauguauuuaugacuguuugaugcuauuuaugcaagucuuggaucgcuaagcuggcu

SEQ ID NO: 299480 - RNA, 64 nt, Homo Sapiens
uauuucuccaguugggacucaggugguauguaauuuaugcaagguuuaagcuccuugaguaaaa

SEQ ID NO: 299481 - RNA, 64 nt, Homo Sapiens
gaaaugcugcaaagggaagcgugccauccagucuuuaugcaaauaucagagauggagcaaacca

SEQ ID NO: 299482 - RNA, 64 nt, Homo Sapiens
uugaacuagcuucuuuguucauagcagggaugauuuaugcaaauuaccuaggagaaucuaagcu

SEQ ID NO: 299483 - RNA, 64 nt, Homo Sapiens; identical to SEQ ID NO: 146945

SEQ ID NO: 299484 - RNA, 64 nt, Homo Sapiens; identical to SEQ ID NO: 146946

SEQ ID NO: 299485 - RNA, 64 nt, Homo Sapiens; identical to SEQ ID NO: 146947

SEQ ID NO: 299486 - RNA, 64 nt, Homo Sapiens; identical to SEQ ID NO: 146948

SEQ ID NO: 299487 - RNA, 64 nt, Homo Sapiens; identical to SEQ ID NO: 146949

SEQ ID NO: 299488 - RNA, 64 nt, Homo Sapiens; identical to SEQ ID NO: 146950

SEQ ID NO: 299489 - RNA, 64 nt, Homo Sapiens; identical to SEQ ID NO: 146951

SEQ ID NO: 299490 - RNA, 64 nt, Homo Sapiens; identical to SEQ ID NO: 146952

SEQ ID NO: 299491 - RNA, 64 nt, Homo Sapiens; identical to SEQ ID NO: 146953

SEQ ID NO: 299492 - RNA, 64 nt, Homo Sapiens; identical to SEQ ID NO: 146954

SEQ ID NO: 299493 - RNA, 64 nt, Homo Sapiens; identical to SEQ ID NO: 146955

SEQ ID NO: 299494 - RNA, 64 nt, Homo Sapiens; identical to SEQ ID NO: 146956

SEQ ID NO: 299495 - RNA, 64 nt, Homo Sapiens; identical to SEQ ID NO: 146957

SEQ ID NO: 299496 - RNA, 64 nt, Homo Sapiens; identical to SEQ ID NO: 146958

SEQ ID NO: 299497 - RNA, 64 nt, Homo Sapiens; identical to SEQ ID NO: 146959

SEQ ID NO: 299498 - RNA, 64 nt, Homo Sapiens; identical to SEQ ID NO: 146960

SEQ ID NO: 299499 - RNA, 64 nt, Homo Sapiens; identical to SEQ ID NO: 146961

SEQ ID NO: 299500 - RNA, 64 nt, Homo Sapiens; identical to SEQ ID NO: 146962

SEQ ID NO: 299501 - RNA, 64 nt, Homo Sapiens; identical to SEQ ID NO: 146963

SEQ ID NO: 299502 - RNA, 64 nt, Homo Sapiens; identical to SEQ ID NO: 56583

SEQ ID NO: 299503 - RNA, 64 nt, Homo Sapiens; identical to SEQ ID NO: 56584

SEQ ID NO: 299504 - RNA, 64 nt, Homo Sapiens; identical to SEQ ID NO: 56585

SEQ ID NO: 299505 - RNA, 64 nt, Homo Sapiens; identical to SEQ ID NO: 56586

SEQ ID NO: 299506 - RNA, 64 nt, Homo Sapiens; identical to SEQ ID NO: 56587

SEQ ID NO: 299507 - RNA, 64 nt, Homo Sapiens; identical to SEQ ID NO: 56588

SEQ ID NO: 299508 - RNA, 64 nt, Homo Sapiens; identical to SEQ ID NO: 56589

SEQ ID NO: 299509 - RNA, 64 nt, Homo Sapiens; identical to SEQ ID NO: 56590

SEQ ID NO: 299510 - RNA, 64 nt, Homo Sapiens; identical to SEQ ID NO: 56591

SEQ ID NO: 299511 - RNA, 64 nt, Homo Sapiens; identical to SEQ ID NO: 56592

SEQ ID NO: 299512 - RNA, 64 nt, Homo Sapiens; identical to SEQ ID NO: 56593

SEQ ID NO: 299513 - RNA, 64 nt, Homo Sapiens; identical to SEQ ID NO: 56594

SEQ ID NO: 299514 - RNA, 64 nt, Homo Sapiens; identical to SEQ ID NO: 56595

SEQ ID NO: 299515 - RNA, 64 nt, Homo Sapiens; identical to SEQ ID NO: 56596

SEQ ID NO: 299516 - RNA, 64 nt, Homo Sapiens; identical to SEQ ID NO: 56597

SEQ ID NO: 299517 - RNA, 64 nt, Homo Sapiens; identical to SEQ ID NO: 56598

SEQ ID NO: 299518 - RNA, 64 nt, Homo Sapiens; identical to SEQ ID NO: 146945

SEQ ID NO: 299519 - RNA, 64 nt, Homo Sapiens; identical to SEQ ID NO: 146946

SEQ ID NO: 299520 - RNA, 64 nt, Homo Sapiens; identical to SEQ ID NO: 146947

SEQ ID NO: 299521 - RNA, 64 nt, Homo Sapiens; identical to SEQ ID NO: 146948

SEQ ID NO: 299522 - RNA, 64 nt, Homo Sapiens; identical to SEQ ID NO: 146949

SEQ ID NO: 299523 - RNA, 64 nt, Homo Sapiens; identical to SEQ ID NO: 146950

SEQ ID NO: 299524 - RNA, 64 nt, Homo Sapiens; identical to SEQ ID NO: 146951

SEQ ID NO: 299525 - RNA, 64 nt, Homo Sapiens; identical to SEQ ID NO: 146952

SEQ ID NO: 299526 - RNA, 64 nt, Homo Sapiens; identical to SEQ ID NO: 146953

SEQ ID NO: 299527 - RNA, 64 nt, Homo Sapiens; identical to SEQ ID NO: 146954

SEQ ID NO: 299528 - RNA, 64 nt, Homo Sapiens; identical to SEQ ID NO: 146955

SEQ ID NO: 299529 - RNA, 64 nt, Homo Sapiens; identical to SEQ ID NO: 146956

SEQ ID NO: 299530 - RNA, 64 nt, Homo Sapiens; identical to SEQ ID NO: 146957

SEQ ID NO: 299531 - RNA, 64 nt, Homo Sapiens; identical to SEQ ID NO: 146958

SEQ ID NO: 299532 - RNA, 64 nt, Homo Sapiens; identical to SEQ ID NO: 146959

SEQ ID NO: 299533 - RNA, 64 nt, Homo Sapiens; identical to SEQ ID NO: 146960

SEQ ID NO: 299534 - RNA, 64 nt, Homo Sapiens; identical to SEQ ID NO: 146961

SEQ ID NO: 299535 - RNA, 64 nt, Homo Sapiens; identical to SEQ ID NO: 146962

SEQ ID NO: 299536 - RNA, 64 nt, Homo Sapiens; identical to SEQ ID NO: 146963

SEQ ID NO: 299537 - RNA, 63 nt, Homo Sapiens
acaucaagccagcuucauucacucacuuuacuuagaacagagauauaagggccugggaugcau

SEQ ID NO: 299538 - RNA, 63 nt, Homo Sapiens
gugagacacaagaucucucuuuuaccaaaguugagaacagagcugguggauuaauuaauaguc

SEQ ID NO: 299539 - RNA, 63 nt, Homo Sapiens
ggcaacuuaaauaacuccugagcaguuggcacuagaacagaauacuuggaaugacaccaaagu

SEQ ID NO: 299540 - RNA, 63 nt, Homo Sapiens
gcaaagaucaugauuaacugucaagacacugguagaacagaacaagcaaaagauuaagaguuc

SEQ ID NO: 299541 - RNA, 63 nt, Homo Sapiens
gggauuucagugaggccuuuugaucuguccaggagaacagaagggaaaaaaagauacuugaaa

SEQ ID NO: 299542 - RNA, 63 nt, Homo Sapiens
acuaaaggccgaaagaaucucuugcugcugcaaagaacagauuuuauauuucuuccucuaauc

SEQ ID NO: 299543 - RNA, 63 nt, Homo Sapiens
uuauuuuauccugaaguaaggugcccggccaaaagaacagaaagauuacaggugugagccacu

SEQ ID NO: 299544 - RNA, 63 nt, Homo Sapiens
aaaauccugccaucuuggaucccagcagggaccagaacagauggcugguguguuugccagaga

SEQ ID NO: 299545 - RNA, 63 nt, Homo Sapiens
cuugaaauaugcacuuagcauuuaaacauauucagaacagaugcuuuuguaacuuacuguggc

SEQ ID NO: 299546 - RNA, 63 nt, Homo Sapiens
uuacccuuucaccuaccucacagucaccuggaaagaacagagacagggaagccugugcagaug

SEQ ID NO: 299547 - RNA, 61 nt, Homo Sapiens
ugcaaauguguuauauacaaauaaaauaugcacagaacagaauaaaauuuuuauuuauuca

SEQ ID NO: 299548 - RNA, 63 nt, Homo Sapiens
cuguccuucacuguaagagcaauugugacuuaaagaacagaauuuuuuugaucaguguagcuc

SEQ ID NO: 299549 - RNA, 63 nt, Homo Sapiens
ggcuuucaaugaguuccuauguggauuuuuaaaagaacagaacaguaaugaaauauuugaagu

SEQ ID NO: 299550 - RNA, 63 nt, Homo Sapiens
aaaagcuauaugcagaguuuuguauaaaacaauagaacagaaauuugggacauuuuucuagga

SEQ ID NO: 299551 - RNA, 63 nt, Homo Sapiens
ucucugugcaauaacuugugaagagucuggcuuagaacagaccucucacaccuccuuagcugu

SEQ ID NO: 299552 - RNA, 63 nt, Homo Sapiens
auuauacagagauggaauggcguaucuuggugcagaacagauagcugucugagucuaaagcac

SEQ ID NO: 299553 - RNA, 63 nt, Homo Sapiens
cauuuaaaauggaaaagagaaaauccccccuucagaacagagggaccagaaacagggacaaag

SEQ ID NO: 299554 - RNA, 63 nt, Homo Sapiens
gaccaaauugcuucuaggagcccugcacaguuuagaacagagguucuuugcagagccuuuuac

SEQ ID NO: 299555 - RNA, 63 nt, Homo Sapiens
aggggaaagcaagagaggacuuaauucuuccugagaacagaagaaaauuccaugauuuuguau

SEQ ID NO: 299556 - RNA, 63 nt, Homo Sapiens
gcacuaaaaaaauuuuuuuuuucuagucacuuuagaacagaugguaaaaacacuauuaccugu

SEQ ID NO: 299557 - RNA, 63 nt, Homo Sapiens
gaccuuacuucauuucaaauaauuuauuacuccagaacagaaagaauaauuauugcauaguag

SEQ ID NO: 299558 - RNA, 63 nt, Homo Sapiens
ucuuucaggggaaaguagaucgguuuuugccacagaacagagaaaauugacucuucaaacccu

SEQ ID NO: 299559 - RNA, 63 nt, Homo Sapiens
gagaauucagcagcucaacaguaaugaaagugaagaacagaguccauuuuccuuccuggggcc

SEQ ID NO: 299560 - RNA, 63 nt, Homo Sapiens
ugccagucucuccagugugggcaccagccggccagaacagaugcgagcaguccaugacucugg

SEQ ID NO: 299561 - RNA, 63 nt, Homo Sapiens
cuagguguggcugggggccaggagagcaggaacagaacagagaaaugcccuuggaagaagugg

SEQ ID NO: 299562 - RNA, 63 nt, Homo Sapiens
cacuauuuuacuuuuuuaaaaucauaaaacggcagaacagauuugguuaguuuagaagaaaag

SEQ ID NO: 299563 - RNA, 63 nt, Homo Sapiens
acagguuauauguggcauagcauaaccacaguaagaacagaacagauauucagcagaaaacuu

SEQ ID NO: 299564 - RNA, 63 nt, Homo Sapiens
uuauauguggcauagcauaaccacaguaagaacagaacagauauucagcagaaaacuuuuuau

SEQ ID NO: 299565 - RNA, 63 nt, Homo Sapiens
gcagaaguguggcaaaugcaucaggaaccgguuagaacagaacagagaaacccugacugucua

SEQ ID NO: 299566 - RNA, 63 nt, Homo Sapiens
aguguggcaaaugcaucaggaaccgguuagaacagaacagagaaacccugacugucuacagau

SEQ ID NO: 299567 - RNA, 63 nt, Homo Sapiens
cguuggaagcuuaacuuuugauuuccgguugagagaacagauuccugauuggaaauagaagac

SEQ ID NO: 299568 - RNA, 63 nt, Homo Sapiens
gaggaaguuggccaauuacagguugcuauuccaagaacagaagugcuaacugcuuuuugucuc

SEQ ID NO: 299569 - RNA, 63 nt, Homo Sapiens
gguacugguaccaaaacagagauauagaucaauagaacagaacagagcccucagaaauaaugc

SEQ ID NO: 299570 - RNA, 63 nt, Homo Sapiens
ugguaccaaaacagagauauagaucaauagaacagaacagagcccucagaaauaaugccacau

SEQ ID NO: 299571 - RNA, 63 nt, Homo Sapiens
ugagauuugacaaaaaaaaaugugaaaacuaggagaacagagauuuauuccuguaaauauuuc

SEQ ID NO: 299572 - RNA, 63 nt, Homo Sapiens
gaggaaaugugucucccuccaccacugugcaggagaacagacaucuccugugggcuuuuuacc

SEQ ID NO: 299573 - RNA, 63 nt, Homo Sapiens
ccaaaacccuuacucacaugaggauggaggaacagaacagaggacuugggaaaagucucaacu

SEQ ID NO: 299574 - RNA, 63 nt, Homo Sapiens
auguacuuagaauagguuuugaaugggagagguagaacagagagagaauuaagaagggaucug

SEQ ID NO: 299575 - RNA, 64 nt, Homo Sapiens; identical to SEQ ID NO: 146945

SEQ ID NO: 299576 - RNA, 64 nt, Homo Sapiens; identical to SEQ ID NO: 146946

SEQ ID NO: 299577 - RNA, 64 nt, Homo Sapiens; identical to SEQ ID NO: 146947

SEQ ID NO: 299578 - RNA, 64 nt, Homo Sapiens; identical to SEQ ID NO: 146948

SEQ ID NO: 299579 - RNA, 64 nt, Homo Sapiens; identical to SEQ ID NO: 146949

SEQ ID NO: 299580 - RNA, 64 nt, Homo Sapiens; identical to SEQ ID NO: 146950

SEQ ID NO: 299581 - RNA, 64 nt, Homo Sapiens; identical to SEQ ID NO: 146951

SEQ ID NO: 299582 - RNA, 64 nt, Homo Sapiens; identical to SEQ ID NO: 146952

SEQ ID NO: 299583 - RNA, 64 nt, Homo Sapiens; identical to SEQ ID NO: 146953

SEQ ID NO: 299584 - RNA, 64 nt, Homo Sapiens; identical to SEQ ID NO: 146954

SEQ ID NO: 299585 - RNA, 64 nt, Homo Sapiens; identical to SEQ ID NO: 146955

SEQ ID NO: 299586 - RNA, 64 nt, Homo Sapiens; identical to SEQ ID NO: 146956

SEQ ID NO: 299587 - RNA, 64 nt, Homo Sapiens; identical to SEQ ID NO: 146957

SEQ ID NO: 299588 - RNA, 64 nt, Homo Sapiens; identical to SEQ ID NO: 146958

SEQ ID NO: 299589 - RNA, 64 nt, Homo Sapiens; identical to SEQ ID NO: 146959

SEQ ID NO: 299590 - RNA, 64 nt, Homo Sapiens; identical to SEQ ID NO: 146960

SEQ ID NO: 299591 - RNA, 64 nt, Homo Sapiens; identical to SEQ ID NO: 146961

SEQ ID NO: 299592 - RNA, 64 nt, Homo Sapiens; identical to SEQ ID NO: 146962

SEQ ID NO: 299593 - RNA, 64 nt, Homo Sapiens; identical to SEQ ID NO: 146963

SEQ ID NO: 299594 - RNA, 63 nt, Homo Sapiens; identical to SEQ ID NO: 299537

SEQ ID NO: 299595 - RNA, 63 nt, Homo Sapiens; identical to SEQ ID NO: 299538

SEQ ID NO: 299596 - RNA, 63 nt, Homo Sapiens; identical to SEQ ID NO: 299539

SEQ ID NO: 299597 - RNA, 63 nt, Homo Sapiens; identical to SEQ ID NO: 299540

SEQ ID NO: 299598 - RNA, 63 nt, Homo Sapiens; identical to SEQ ID NO: 299541

SEQ ID NO: 299599 - RNA, 63 nt, Homo Sapiens; identical to SEQ ID NO: 299542

SEQ ID NO: 299600 - RNA, 63 nt, Homo Sapiens; identical to SEQ ID NO: 299543

SEQ ID NO: 299601 - RNA, 63 nt, Homo Sapiens; identical to SEQ ID NO: 299544

SEQ ID NO: 299602 - RNA, 63 nt, Homo Sapiens; identical to SEQ ID NO: 299545

SEQ ID NO: 299603 - RNA, 63 nt, Homo Sapiens; identical to SEQ ID NO: 299546

SEQ ID NO: 299604 - RNA, 61 nt, Homo Sapiens; identical to SEQ ID NO: 299547

SEQ ID NO: 299605 - RNA, 63 nt, Homo Sapiens; identical to SEQ ID NO: 299548

SEQ ID NO: 299606 - RNA, 63 nt, Homo Sapiens; identical to SEQ ID NO: 299549

SEQ ID NO: 299607 - RNA, 63 nt, Homo Sapiens; identical to SEQ ID NO: 299550

SEQ ID NO: 299608 - RNA, 63 nt, Homo Sapiens; identical to SEQ ID NO: 299551

SEQ ID NO: 299609 - RNA, 63 nt, Homo Sapiens; identical to SEQ ID NO: 299552

SEQ ID NO: 299610 - RNA, 63 nt, Homo Sapiens; identical to SEQ ID NO: 299553

SEQ ID NO: 299611 - RNA, 63 nt, Homo Sapiens; identical to SEQ ID NO: 299554

SEQ ID NO: 299612 - RNA, 63 nt, Homo Sapiens; identical to SEQ ID NO: 299555

SEQ ID NO: 299613 - RNA, 63 nt, Homo Sapiens; identical to SEQ ID NO: 299556

SEQ ID NO: 299614 - RNA, 63 nt, Homo Sapiens; identical to SEQ ID NO: 299557

SEQ ID NO: 299615 - RNA, 63 nt, Homo Sapiens; identical to SEQ ID NO: 299558

SEQ ID NO: 299616 - RNA, 63 nt, Homo Sapiens; identical to SEQ ID NO: 299559

SEQ ID NO: 299617 - RNA, 63 nt, Homo Sapiens; identical to SEQ ID NO: 299560

SEQ ID NO: 299618 - RNA, 63 nt, Homo Sapiens; identical to SEQ ID NO: 299561

SEQ ID NO: 299619 - RNA, 63 nt, Homo Sapiens; identical to SEQ ID NO: 299562

SEQ ID NO: 299620 - RNA, 63 nt, Homo Sapiens; identical to SEQ ID NO: 299563

SEQ ID NO: 299621 - RNA, 63 nt, Homo Sapiens; identical to SEQ ID NO: 299564

SEQ ID NO: 299622 - RNA, 63 nt, Homo Sapiens; identical to SEQ ID NO: 299565

SEQ ID NO: 299623 - RNA, 63 nt, Homo Sapiens; identical to SEQ ID NO: 299566

SEQ ID NO: 299624 - RNA, 63 nt, Homo Sapiens; identical to SEQ ID NO: 299567

SEQ ID NO: 299625 - RNA, 63 nt, Homo Sapiens; identical to SEQ ID NO: 299568

SEQ ID NO: 299626 - RNA, 63 nt, Homo Sapiens; identical to SEQ ID NO: 299569

SEQ ID NO: 299627 - RNA, 63 nt, Homo Sapiens; identical to SEQ ID NO: 299570

SEQ ID NO: 299628 - RNA, 63 nt, Homo Sapiens; identical to SEQ ID NO: 299571

SEQ ID NO: 299629 - RNA, 63 nt, Homo Sapiens; identical to SEQ ID NO: 299572

SEQ ID NO: 299630 - RNA, 63 nt, Homo Sapiens; identical to SEQ ID NO: 299573

SEQ ID NO: 299631 - RNA, 63 nt, Homo Sapiens; identical to SEQ ID NO: 299574

SEQ ID NO: 299632 - RNA, 64 nt, Homo Sapiens
cuugcagaggacaaggcuggagccuguaugcagcccagugcagcaaccagacaccugagacagg

SEQ ID NO: 299633 - RNA, 64 nt, Homo Sapiens
cccuaggaaauccgggagguaacuggcauaaaauccagugcacuaagaaaacuguggguaauca

SEQ ID NO: 299634 - RNA, 51 nt, Homo Sapiens
ccacucugcuggcucuguaacccagugcaccucccuccccagcuccggagg

SEQ ID NO: 299635 - RNA, 64 nt, Homo Sapiens
agugcuuucucuuuuacacuccccuguccccaccccagugcacucuucuggcccaggcagcaag

SEQ ID NO: 299636 - RNA, 64 nt, Homo Sapiens
cugcagcaccgaggggccuuuguucuggggggacccagugcagaauguaagugggcccacccgg

SEQ ID NO: 299637 - RNA, 64 nt, Homo Sapiens
agggccauggcucaggguggucucuucuuggggcccagugcaugguggccagaggugucaccca

SEQ ID NO: 299638 - RNA, 64 nt, Homo Sapiens
agacacacaccuacccucccaccgaggcccccuaccagugcaugaccucaagaacugccugugg

SEQ ID NO: 299639 - RNA, 64 nt, Homo Sapiens
ugguauuagucaucagccagacugcagaaugaagccagugcacaaugcaagcguuuccauugcc

SEQ ID NO: 299640 - RNA, 64 nt, Homo Sapiens
cucaagcucugcuccuucagauccuccaggacgaccagugcaucaacauggacacucaugaguc

SEQ ID NO: 299641 - RNA, 64 nt, Homo Sapiens
agcccucucagaacagagggguagggagggugcaccagugcaccaggaaggcugugugggucug

SEQ ID NO: 299642 - RNA, 64 nt, Homo Sapiens
aggugauucacacguacacacauaaacacacccaccagugcagccugaaguaacucccacagaa

SEQ ID NO: 299643 - RNA, 64 nt, Homo Sapiens
ccacccccgucuugccugggccacccccauagcuccagugcacggagagacccgagcauccucc

SEQ ID NO: 299644 - RNA, 64 nt, Homo Sapiens
agaaaccaccugcguccacaccccacccuccccaccagugcaacccccagaggaccgggaggca

SEQ ID NO: 299645 - RNA, 64 nt, Homo Sapiens
cguucucucugggccacgaagccuuccuaaacagccagugcagauugucuuucaaacacccuga

SEQ ID NO: 299646 - RNA, 64 nt, Homo Sapiens
ucugaggcuaggggaauaggaccucaaagcauggccagugcaauccaagaggggucugaguggg

SEQ ID NO: 299647 - RNA, 64 nt, Homo Sapiens
gccgcccccagagcccaggugacaucacugcaguccagugcaaaagggcccccugcuggggcug

SEQ ID NO: 299648 - RNA, 64 nt, Homo Sapiens
caaugacccccucccuuggggcccccucugccucccagugcaccccugccccgcaagcaaaccu

SEQ ID NO: 299649 - RNA, 64 nt, Homo Sapiens; identical to SEQ ID NO: 257800

SEQ ID NO: 299650 - RNA, 64 nt, Homo Sapiens; identical to SEQ ID NO: 257801

SEQ ID NO: 299651 - RNA, 64 nt, Homo Sapiens; identical to SEQ ID NO: 257802

SEQ ID NO: 299652 - RNA, 64 nt, Homo Sapiens; identical to SEQ ID NO: 257803

SEQ ID NO: 299653 - RNA, 64 nt, Homo Sapiens; identical to SEQ ID NO: 257804

SEQ ID NO: 299654 - RNA, 64 nt, Homo Sapiens; identical to SEQ ID NO: 257805

SEQ ID NO: 299655 - RNA, 64 nt, Homo Sapiens; identical to SEQ ID NO: 257806

SEQ ID NO: 299656 - RNA, 64 nt, Homo Sapiens; identical to SEQ ID NO: 257807

SEQ ID NO: 299657 - RNA, 64 nt, Homo Sapiens; identical to SEQ ID NO: 257808

SEQ ID NO: 299658 - RNA, 64 nt, Homo Sapiens; identical to SEQ ID NO: 257809

SEQ ID NO: 299659 - RNA, 64 nt, Homo Sapiens; identical to SEQ ID NO: 257810

SEQ ID NO: 299660 - RNA, 64 nt, Homo Sapiens; identical to SEQ ID NO: 257811

SEQ ID NO: 299661 - RNA, 64 nt, Homo Sapiens; identical to SEQ ID NO: 257812

SEQ ID NO: 299662 - RNA, 64 nt, Homo Sapiens; identical to SEQ ID NO: 257813

SEQ ID NO: 299663 - RNA, 64 nt, Homo Sapiens; identical to SEQ ID NO: 257814

SEQ ID NO: 299664 - RNA, 64 nt, Homo Sapiens; identical to SEQ ID NO: 257815

SEQ ID NO: 299665 - RNA, 64 nt, Homo Sapiens; identical to SEQ ID NO: 257816

SEQ ID NO: 299666 - RNA, 64 nt, Homo Sapiens; identical to SEQ ID NO: 257817

SEQ ID NO: 299667 - RNA, 64 nt, Homo Sapiens; identical to SEQ ID NO: 257818

SEQ ID NO: 299668 - RNA, 64 nt, Homo Sapiens; identical to SEQ ID NO: 257819

SEQ ID NO: 299669 - RNA, 64 nt, Homo Sapiens; identical to SEQ ID NO: 257820

SEQ ID NO: 299670 - RNA, 64 nt, Homo Sapiens; identical to SEQ ID NO: 257821

SEQ ID NO: 299671 - RNA, 64 nt, Homo Sapiens; identical to SEQ ID NO: 257822

SEQ ID NO: 299672 - RNA, 64 nt, Homo Sapiens; identical to SEQ ID NO: 257823

SEQ ID NO: 299673 - RNA, 64 nt, Homo Sapiens; identical to SEQ ID NO: 257824

SEQ ID NO: 299674 - RNA, 64 nt, Homo Sapiens; identical to SEQ ID NO: 257825

SEQ ID NO: 299675 - RNA, 64 nt, Homo Sapiens; identical to SEQ ID NO: 257826

SEQ ID NO: 299676 - RNA, 64 nt, Homo Sapiens; identical to SEQ ID NO: 257827

SEQ ID NO: 299677 - RNA, 64 nt, Homo Sapiens; identical to SEQ ID NO: 257828

SEQ ID NO: 299678 - RNA, 64 nt, Homo Sapiens; identical to SEQ ID NO: 257829

SEQ ID NO: 299679 - RNA, 64 nt, Homo Sapiens; identical to SEQ ID NO: 257830

SEQ ID NO: 299680 - RNA, 64 nt, Homo Sapiens; identical to SEQ ID NO: 257831

SEQ ID NO: 299681 - RNA, 64 nt, Homo Sapiens
acugccuugugaggucaaggugguggccaaggacaccagccaccccacugacccucugaccucc

SEQ ID NO: 299682 - RNA, 64 nt, Homo Sapiens
cgcuuccuaacugcugcuucucagggaauccgacaccagccaaccauuuuaagccucuaaaaga

SEQ ID NO: 299683 - RNA, 64 nt, Homo Sapiens
uuacacaggcauuaacucuccccacaaacagaucaccagccagcgugccgccacccuggcaugc

SEQ ID NO: 299684 - RNA, 64 nt, Homo Sapiens
augcucugcucacagucaguauaggccauggcacaccagccaagcaauauuuugcacaccugua

SEQ ID NO: 299685 - RNA, 64 nt, Homo Sapiens
uacugcuguguaaugguuacacuaaccaaaagacaccagccacucagaguucuauacuguaaag

SEQ ID NO: 299686 - RNA, 64 nt, Homo Sapiens
gacacugucuuauggauucauuuauaagaagagaaccagccauauacacuuggggagauuugcc

SEQ ID NO: 299687 - RNA, 64 nt, Homo Sapiens
ucaguggcuucaucugucaagugggaucugucacaccagccauacuuaucucucugugcugugg

SEQ ID NO: 299688 - RNA, 64 nt, Homo Sapiens
cacggacucuuacugcuaacuuuuguguaucguaaccagccagauccucuugguuauuuguuua

SEQ ID NO: 299689 - RNA, 64 nt, Homo Sapiens
ugaucccucugugccaccacaggcagccaaggugaccagccagcggcccagcuggcuggagucc

SEQ ID NO: 299690 - RNA, 64 nt, Homo Sapiens
ccaagcauuuucuccugggauuccccaauuccccaccagccaauuugcagaguuauuuuugaug

SEQ ID NO: 299691 - RNA, 64 nt, Homo Sapiens
aggacagcaggaggggcccacaccucaagccuggaccagccaccucaaggccuuggggagcuua

SEQ ID NO: 299692 - RNA, 64 nt, Homo Sapiens
uuuuggcuuggccccaggaauuuccugugacuccaccagccaucaugggugccagccagggucc

SEQ ID NO: 299693 - RNA, 53 nt, Homo Sapiens
aguuugagauggacauuuaaagcaccagccaucguguggagcacuaccaaggg

SEQ ID NO: 299694 - RNA, 64 nt, Homo Sapiens
aggggccccucagggccuuccugggaggagucccaccagccaggccuuaugaaagugaucauac

SEQ ID NO: 299695 - RNA, 64 nt, Homo Sapiens
uucccuaggacuagaugcauaccguuuugugaaaaccagccauaggaaaacaugugagcaacaa

SEQ ID NO: 299696 - RNA, 64 nt, Homo Sapiens
ccaaauuuugugcauauauuuuuuauuuaaucugaccagccacccaaaccauggguauuuuugu

SEQ ID NO: 299697 - RNA, 64 nt, Homo Sapiens
cccggugggggcacagcacaagcaccucccaccaaccagccacaugccccccaguaugggaacc

SEQ ID NO: 299698 - RNA, 64 nt, Homo Sapiens
cccagugggggcacagcacaagcaccucccaccaaccagccacaugccccccggugugggaacc

SEQ ID NO: 299699 - RNA, 64 nt, Homo Sapiens
cccgguggggacacagcacaagcaccucccaccaaccagccacuggcccccgggugcagaaaac

SEQ ID NO: 299700 - RNA, 64 nt, Homo Sapiens
aauucugccuuuaauugucuaaaacaaaaacaaaaccagccaaccuauguuacacgugagauua

SEQ ID NO: 299701 - RNA, 64 nt, Homo Sapiens
gucuccucucucuccuccuuugaccuucuccucgaccagccaucaugacauuuaccaugaauuu

SEQ ID NO: 299702 - RNA, 64 nt, Homo Sapiens
gugccauccugcaggcccugacuacaacgugcagaccagccagggcgccugcugcggcucagug

SEQ ID NO: 299703 - RNA, 64 nt, Homo Sapiens
ggaaugccaccucuucucagcccucaggaccagcaccagccaaguucccccggguggaacccag

SEQ ID NO: 299704 - RNA, 64 nt, Homo Sapiens
ccagggcucuucccagggucagggcugcaucucuaccagccagcgccggcuccugcaggguccg

SEQ ID NO: 299705 - RNA, 64 nt, Homo Sapiens
gaagcacuuccugggcacggcaaacacaaucagaaccagccaaaccucacccaaggccaaacuc

SEQ ID NO: 299706 - RNA, 64 nt, Homo Sapiens
ccccgcccaagccaaugcagacacugaccucaagaccagccacaccaagucugugcacugccca

SEQ ID NO: 299707 - RNA, 64 nt, Homo Sapiens
cucuuagcuucucaguaaagaggauacucucccaaccagccaaggaauaaaagcugaucuguau

SEQ ID NO: 299708 - RNA, 64 nt, Homo Sapiens
ccucccagccucucccaagaccuccccccucgucaccagccaucccucuggaccaggcagaggg

SEQ ID NO: 299709 - RNA, 64 nt, Homo Sapiens
ugggcaggggccugaggguggcucgggccagcccaccagccaauggaccccuccucaggccgcc

SEQ ID NO: 299710 - RNA, 64 nt, Homo Sapiens
gaaacucucgaccuugaucucaggcuaugaauggaccagccaggaaaacaauucccuguuccuu

SEQ ID NO: 299711 - RNA, 64 nt, Homo Sapiens
gccaagggcccaagcagaaguccuuuucaaccuaaccagccacaugcuccaaaaggcccaggcu

SEQ ID NO: 299712 - RNA, 64 nt, Homo Sapiens
cuguaucacagguaucucgggggagcuuugugccuugauggaucaaguucaucauaugcagcac

SEQ ID NO: 299713 - RNA, 64 nt, Homo Sapiens
caucggucacuucuccaggcugcccuaaauuagguugauggagugagacaugccaaacauccac

SEQ ID NO: 299714 - RNA, 64 nt, Homo Sapiens
gguauagccagauaagagaaacaaacuauuuuuuuugauggauugcaguaaacgaucacugaag

SEQ ID NO: 299715 - RNA, 64 nt, Homo Sapiens
augaaagauuauuauacaaaaaauuguauacuacuugauggaaccaacuuuguacaucuuggcc

SEQ ID NO: 299716 - RNA, 64 nt, Homo Sapiens
uguuuuccuuuuauucacauuuaggguacuuuuauugauggauaguaacagguccuucccagau

SEQ ID NO: 299717 - RNA, 64 nt, Homo Sapiens
uagugguccucauucuugggcguaugaugugauauugauggagaggagcaucuuguaugaucuc

SEQ ID NO: 299718 - RNA, 64 nt, Homo Sapiens
augcucuccugcucaaggcauuaaguugacaggauugauggaacucucagaagcagacccaccc

SEQ ID NO: 299719 - RNA, 64 nt, Homo Sapiens
ccugagcaagucaccugguuccaagaaauuagcuuugauggaaggagagaugccuggccucugc

SEQ ID NO: 299720 - RNA, 64 nt, Homo Sapiens
ugguggcccacuggguacugugaggacugcuacauugauggauguuauuggcuaauccacugca

SEQ ID NO: 299721 - RNA, 64 nt, Homo Sapiens
ucuguguaacaccuuuuuuggcccauugggugcuuugauggacaucauacuggguaggugacaa

SEQ ID NO: 299722 - RNA, 64 nt, Homo Sapiens
uucuaauggaaagaggccucuacugcugucugagcacuagaaauaauauagcccuuguuuggau

SEQ ID NO: 299723 - RNA, 64 nt, Homo Sapiens
aggucgcuucucuuuuccucgaaaacaguuuugacacuagaacaauugaacguaaauaacuuug

SEQ ID NO: 299724 - RNA, 64 nt, Homo Sapiens
aaggcaguuacauaucaauacagagacucaaggucacuagaaaugggccagcugggucaaugug

SEQ ID NO: 299725 - RNA, 64 nt, Homo Sapiens
cucccgaacccagggucaaccugccuaccacaggcacuagaaggacgaaucugccuacugccca

SEQ ID NO: 299726 - RNA, 64 nt, Homo Sapiens
ggcccaggagugggagcccaggcccucccuccaggguagagaugcaccgaauggaaauugcacu

SEQ ID NO: 299727 - RNA, 64 nt, Homo Sapiens
uuccuccuagggggagcugguccccuuccuaugugguagagagacugguguaagaguguggggu

SEQ ID NO: 299728 - RNA, 64 nt, Homo Sapiens
aaucagaaaggaaacacgaaagaaaagucaggaagguagagagagaaaaagggagggaaggaga

SEQ ID NO: 299729 - RNA, 64 nt, Homo Sapiens
gaugcgcuucauguuuucucugacucauggaucugguagagaccauagacaugauauagacuaa

SEQ ID NO: 299730 - RNA, 64 nt, Homo Sapiens
uuacccguuugauucuccuagcaccucccuuggagguagagaucaugaacccauuuaacagacg

SEQ ID NO: 299731 - RNA, 64 nt, Homo Sapiens
aggccuuacauuuaaucggcuuucucugcggugggguagagaauggagcucccgccuugcgggc

SEQ ID NO: 299732 - RNA, 64 nt, Homo Sapiens
ugggccccaaggcuugccaagacucauugcuggagguagagaggugucaaccagagaacagcuc

SEQ ID NO: 299733 - RNA, 64 nt, Homo Sapiens
ugcaguggacggagagccuuggcgagggcagcaggguagagaggacaaagaauguggggcuggu

SEQ ID NO: 299734 - RNA, 64 nt, Homo Sapiens
ucucuauaggacucuuuaauuuuuuuuuuuuuuugguagagauggggucuugcuguguugccca

SEQ ID NO: 299735 - RNA, 64 nt, Homo Sapiens
auuuucuaaucucaaagagcuuauauucuagugggguagagauaagugauuuaucuugguguag

SEQ ID NO: 299736 - RNA, 64 nt, Homo Sapiens
gguugcuauaaaacgagcauauuuggagaacuaggguagagagaccugaggaaggcagaaguga

SEQ ID NO: 299737 - RNA, 64 nt, Homo Sapiens
augagggcugguggcuggggaaaccagagcacuggguagagaggagcagucaggagacaagcau

SEQ ID NO: 299738 - RNA, 64 nt, Homo Sapiens
acuccugccaggaaguguuuauuugccucuaauugggccugagagaccauagggagguuggggc

SEQ ID NO: 299739 - RNA, 64 nt, Homo Sapiens
cuggcuaguuaccacuaggcuaccaggucucuaggggccugagagaggcccucuagagaaucca

SEQ ID NO: 299740 - RNA, 64 nt, Homo Sapiens
cucucccuacucccucagccucccagccaaggaggggccugaggggacgcaggagaucaucuga

SEQ ID NO: 299741 - RNA, 64 nt, Homo Sapiens
guccgacugagaagacugcuucuugcuuuucugugggccugaagcagcacccauguaaauaccu

SEQ ID NO: 299742 - RNA, 64 nt, Homo Sapiens
gcugagcccaccccgcuggcucccagaucagggugggccugaggcaggcagccgaccugaggcc

SEQ ID NO: 299743 - RNA, 64 nt, Homo Sapiens
gccugggcagcugggugggccugggcagcugggugggccugagcuagggcagcagggccuggcu

SEQ ID NO: 299744 - RNA, 64 nt, Homo Sapiens
auuuuggggagacaaagggaaaugcagccauagagggccugaugacauccaauacagaguucug

SEQ ID NO: 299745 - RNA, 64 nt, Homo Sapiens
aauuaagugacuugguaugcuuuauuuaauuguagggccugagguuuuccauucucauuuuucu

SEQ ID NO: 299746 - RNA, 64 nt, Homo Sapiens
agagggaaccuagggcccuuguguguggcuaagugggccugaacucuggauauggccagggugg

SEQ ID NO: 299747 - RNA, 64 nt, Homo Sapiens
cacguccucuaggagcagcuccugccccaggagcgggccugagcccucaugccaccgccaaccc

SEQ ID NO: 299748 - RNA, 64 nt, Homo Sapiens
uuuaccacugcaggggcugcuccuucugucuccagggccugaucaggugagauucaaaccuuca

SEQ ID NO: 299749 - RNA, 64 nt, Homo Sapiens
ugugaaagcccagggcuccaacgcagugugcuuagggccugaggugcagagccacguggccgcc

SEQ ID NO: 299750 - RNA, 64 nt, Homo Sapiens
ccccuuggacugugugcagcacgaugcaauuucugggccugaaugucaugcucccuggggcagg

SEQ ID NO: 299751 - RNA, 64 nt, Homo Sapiens
acccauaaccuggaauucccuguuuccuuguccagggccugaggaaauggcuccccaggucugu

SEQ ID NO: 299752 - RNA, 64 nt, Homo Sapiens
cccaggggaugaaaaugcaaggaugagucugcuugggccugagaguuugaucugcaggggcagg

SEQ ID NO: 299753 - RNA, 64 nt, Homo Sapiens
agaacauggcugguagaggcucuagcugugugcggggccugaaggggaguggguucucgcccaa

SEQ ID NO: 299754 - RNA, 64 nt, Homo Sapiens
gaacagaccaccagacgccagggcugauuggugggggccugagaccccgguugcccauucaugg

SEQ ID NO: 299755 - RNA, 64 nt, Homo Sapiens
cagcaggcagggagggaggcaaggcaggggaguggggccugagcugagcacugcccccucaccc

SEQ ID NO: 299756 - RNA, 64 nt, Homo Sapiens
ucuggcuggggucuuggcacugucuuccuggccggggccugaaaccuuagcccccagccggccu

SEQ ID NO: 299757 - RNA, 64 nt, Homo Sapiens
aaagcacaaugcccuggucacuuggcaagcggcugggccugacggaggccgaggggcagaccgg

SEQ ID NO: 299758 - RNA, 64 nt, Homo Sapiens
agcagcggccucuagcuccgucucccggggaccugggccugagggagggcuggagucgcacgcg

SEQ ID NO: 299759 - RNA, 64 nt, Homo Sapiens
ccucugaacaccacagccagguccugccuucugggggccugaauauuccagagcugaugugaug

SEQ ID NO: 299760 - RNA, 64 nt, Homo Sapiens
ucuguacacgugguccagauacuccucugaggcagggccugaagcgguccuggacucccgcagg

SEQ ID NO: 299761 - RNA, 64 nt, Homo Sapiens
uagcagugggucacuuugauaggucacaccaucugggccugaggacauuauaugauuuccacgc

SEQ ID NO: 299762 - RNA, 64 nt, Homo Sapiens
uccccaaacuaccccacagcuaaucuuccuucuggggccugaguagaacauuucugagccaaag

SEQ ID NO: 299763 - RNA, 64 nt, Homo Sapiens
ugugauguccacaagagcuacacaacagcagcaggggccugaaaucuggacucuguuccuauac

SEQ ID NO: 299764 - RNA, 64 nt, Homo Sapiens; identical to SEQ ID NO: 211302

SEQ ID NO: 299765 - RNA, 64 nt, Homo Sapiens; identical to SEQ ID NO: 211303

SEQ ID NO: 299766 - RNA, 64 nt, Homo Sapiens; identical to SEQ ID NO: 211304

SEQ ID NO: 299767 - RNA, 64 nt, Homo Sapiens; identical to SEQ ID NO: 211305

SEQ ID NO: 299768 - RNA, 64 nt, Homo Sapiens; identical to SEQ ID NO: 211306

SEQ ID NO: 299769 - RNA, 64 nt, Homo Sapiens; identical to SEQ ID NO: 211307

SEQ ID NO: 299770 - RNA, 64 nt, Homo Sapiens; identical to SEQ ID NO: 211308

SEQ ID NO: 299771 - RNA, 64 nt, Homo Sapiens; identical to SEQ ID NO: 211309

SEQ ID NO: 299772 - RNA, 64 nt, Homo Sapiens; identical to SEQ ID NO: 211310

SEQ ID NO: 299773 - RNA, 64 nt, Homo Sapiens; identical to SEQ ID NO: 211311

SEQ ID NO: 299774 - RNA, 64 nt, Homo Sapiens; identical to SEQ ID NO: 211312

SEQ ID NO: 299775 - RNA, 64 nt, Homo Sapiens; identical to SEQ ID NO: 211313

SEQ ID NO: 299776 - RNA, 64 nt, Homo Sapiens; identical to SEQ ID NO: 211314

SEQ ID NO: 299777 - RNA, 64 nt, Homo Sapiens; identical to SEQ ID NO: 211315

SEQ ID NO: 299778 - RNA, 64 nt, Homo Sapiens; identical to SEQ ID NO: 211316

SEQ ID NO: 299779 - RNA, 64 nt, Homo Sapiens; identical to SEQ ID NO: 211317

SEQ ID NO: 299780 - RNA, 64 nt, Homo Sapiens; identical to SEQ ID NO: 211318

SEQ ID NO: 299781 - RNA, 64 nt, Homo Sapiens; identical to SEQ ID NO: 211319

SEQ ID NO: 299782 - RNA, 64 nt, Homo Sapiens; identical to SEQ ID NO: 211320

SEQ ID NO: 299783 - RNA, 64 nt, Homo Sapiens; identical to SEQ ID NO: 211321

SEQ ID NO: 299784 - RNA, 64 nt, Homo Sapiens; identical to SEQ ID NO: 211322

SEQ ID NO: 299785 - RNA, 64 nt, Homo Sapiens; identical to SEQ ID NO: 211323

SEQ ID NO: 299786 - RNA, 64 nt, Homo Sapiens; identical to SEQ ID NO: 211324

SEQ ID NO: 299787 - RNA, 64 nt, Homo Sapiens; identical to SEQ ID NO: 211325

SEQ ID NO: 299788 - RNA, 57 nt, Homo Sapiens; identical to SEQ ID NO: 211326

SEQ ID NO: 299789 - RNA, 64 nt, Homo Sapiens; identical to SEQ ID NO: 211327

SEQ ID NO: 299790 - RNA, 64 nt, Homo Sapiens; identical to SEQ ID NO: 211328

SEQ ID NO: 299791 - RNA, 64 nt, Homo Sapiens; identical to SEQ ID NO: 211329

SEQ ID NO: 299792 - RNA, 64 nt, Homo Sapiens; identical to SEQ ID NO: 211330

SEQ ID NO: 299793 - RNA, 64 nt, Homo Sapiens; identical to SEQ ID NO: 211331

SEQ ID NO: 299794 - RNA, 64 nt, Homo Sapiens; identical to SEQ ID NO: 211332

SEQ ID NO: 299795 - RNA, 64 nt, Homo Sapiens; identical to SEQ ID NO: 211333

SEQ ID NO: 299796 - RNA, 64 nt, Homo Sapiens; identical to SEQ ID NO: 211334

SEQ ID NO: 299797 - RNA, 64 nt, Homo Sapiens; identical to SEQ ID NO: 211335

SEQ ID NO: 299798 - RNA, 64 nt, Homo Sapiens; identical to SEQ ID NO: 211336

SEQ ID NO: 299799 - RNA, 64 nt, Homo Sapiens; identical to SEQ ID NO: 211337

SEQ ID NO: 299800 - RNA, 64 nt, Homo Sapiens; identical to SEQ ID NO: 211338

SEQ ID NO: 299801 - RNA, 64 nt, Homo Sapiens; identical to SEQ ID NO: 211339

SEQ ID NO: 299802 - RNA, 64 nt, Homo Sapiens; identical to SEQ ID NO: 211340

SEQ ID NO: 299803 - RNA, 64 nt, Homo Sapiens; identical to SEQ ID NO: 211341

SEQ ID NO: 299804 - RNA, 64 nt, Homo Sapiens; identical to SEQ ID NO: 211342

SEQ ID NO: 299805 - RNA, 64 nt, Homo Sapiens; identical to SEQ ID NO: 211343

SEQ ID NO: 299806 - RNA, 64 nt, Homo Sapiens; identical to SEQ ID NO: 211344

SEQ ID NO: 299807 - RNA, 64 nt, Homo Sapiens; identical to SEQ ID NO: 211345

SEQ ID NO: 299808 - RNA, 64 nt, Homo Sapiens; identical to SEQ ID NO: 211346

SEQ ID NO: 299809 - RNA, 64 nt, Homo Sapiens; identical to SEQ ID NO: 211347

SEQ ID NO: 299810 - RNA, 64 nt, Homo Sapiens; identical to SEQ ID NO: 211348

SEQ ID NO: 299811 - RNA, 64 nt, Homo Sapiens; identical to SEQ ID NO: 211349

SEQ ID NO: 299812 - RNA, 64 nt, Homo Sapiens; identical to SEQ ID NO: 211350

SEQ ID NO: 299813 - RNA, 64 nt, Homo Sapiens; identical to SEQ ID NO: 211351

SEQ ID NO: 299814 - RNA, 64 nt, Homo Sapiens; identical to SEQ ID NO: 211352

SEQ ID NO: 299815 - RNA, 64 nt, Homo Sapiens; identical to SEQ ID NO: 211353

SEQ ID NO: 299816 - RNA, 64 nt, Homo Sapiens; identical to SEQ ID NO: 211354

SEQ ID NO: 299817 - RNA, 64 nt, Homo Sapiens; identical to SEQ ID NO: 211355

SEQ ID NO: 299818 - RNA, 64 nt, Homo Sapiens; identical to SEQ ID NO: 211356

SEQ ID NO: 299819 - RNA, 64 nt, Homo Sapiens; identical to SEQ ID NO: 211357

SEQ ID NO: 299820 - RNA, 63 nt, Homo Sapiens
aggguggggagagcuggcaggcccagggcuuguccugcugaccccagcagacccuccuguugg

SEQ ID NO: 299821 - RNA, 63 nt, Homo Sapiens
aggaucuggccuuguggucacuggcaucugagcccugcugauggcuggggcucucgggcaugc

SEQ ID NO: 299822 - RNA, 63 nt, Homo Sapiens
guuucuggaggcagcuggucccccacaccgcguccugcugagccugcccccuggauuggcugu

SEQ ID NO: 299823 - RNA, 63 nt, Homo Sapiens
uuucggaucuucugucccagauccugcucccucccugcugagccugggguuccccuggcauug

SEQ ID NO: 299824 - RNA, 63 nt, Homo Sapiens
gcuggaugucacacaugaagagacugacuucuuccugcugacaggagacuguggaggcagugg

SEQ ID NO: 299825 - RNA, 63 nt, Homo Sapiens
cugugccagacuccauugcuuacucuuccuccaccugcugagccugcugcuuuccugacagcu

SEQ ID NO: 299826 - RNA, 61 nt, Homo Sapiens; identical to SEQ ID NO: 240071

SEQ ID NO: 299827 - RNA, 63 nt, Homo Sapiens
cuggugguaggugggaagcaugguguccaccugccugcugaccacuggacgcugcuccaugcu

SEQ ID NO: 299828 - RNA, 63 nt, Homo Sapiens
gauuuccaaagagaaaaaaagauguaaacagugccugcugaauuagagauauggcagcgaaag

SEQ ID NO: 299829 - RNA, 63 nt, Homo Sapiens
gacccaaggaggaaaaacagaggcacgaacccaccugcugagacuucccaucacuggagcacc

SEQ ID NO: 299830 - RNA, 63 nt, Homo Sapiens
acccaaacguggucucccguggccgcaccccuuccugcugaucccugggguauccgggaggau

SEQ ID NO: 299831 - RNA, 63 nt, Homo Sapiens
uuaguuuugggaagcgcuucgaugauugcuuugccugcugaggugccugggcuucuuuggcga

SEQ ID NO: 299832 - RNA, 63 nt, Homo Sapiens
caggggaccucugcccgagacuuccaaucaggcccugcugagggcucaaggccaucgucuccu

SEQ ID NO: 299833 - RNA, 63 nt, Homo Sapiens
ggcgucaggccaggcuugaccuggcccagggccccugcugaggguucugaugaaaacugacug

SEQ ID NO: 299834 - RNA, 63 nt, Homo Sapiens
ggcaacauuuuuggggugcuagaagaaaauuaaccugcugacauaucuacuucuuuuaaaguu

SEQ ID NO: 299835 - RNA, 63 nt, Homo Sapiens
cucuucaacugauuuuuaaagaaccuagaagcaccugcugacaaccugggggcucacagcaca

SEQ ID NO: 299836 - RNA, 63 nt, Homo Sapiens
uauugguacuagcaacuuaauuucauucauaucccugcugaaaaugagcuaaguuguuauuuc

SEQ ID NO: 299837 - RNA, 63 nt, Homo Sapiens
cugguacuuucugcacagcccugacuagaugccccugcugaauuggggagcaaagagggcagc

SEQ ID NO: 299838 - RNA, 63 nt, Homo Sapiens
uggcccugacaggcagccguaugggaugcucugccugcugaugccuagugccugaguuugggg

SEQ ID NO: 299839 - RNA, 63 nt, Homo Sapiens
acagacaugcagcagcgggcgggucugccuccuccugcugaaggcucccccaugcgaggaucc

SEQ ID NO: 299840 - RNA, 63 nt, Homo Sapiens
cacauggccggcucugugcaucaagcgcacagcccugcugagccaaggacgucugcuuccacc

SEQ ID NO: 299841 - RNA, 63 nt, Homo Sapiens
gaggacggcgaguucgcccacacugcggcacuuccugcugaugccuggaggcgcacuaugagg

SEQ ID NO: 299842 - RNA, 64 nt, Homo Sapiens
gccuccagggcgcagccuccugaguagcugggaggacaggcauaugccaccacaucacugagaa

SEQ ID NO: 299843 - RNA, 64 nt, Homo Sapiens
ucuacaaaaaauuuaaaaauuagccaaguauggugacaggcaccuaugguuccagcuacucagg

SEQ ID NO: 299844 - RNA, 64 nt, Homo Sapiens
aaaaugugaaguaauagugaaccuaacagucagagacaggcagcaugcucuuaacuagugcucu

SEQ ID NO: 299845 - RNA, 64 nt, Homo Sapiens
ugccaggggagccucacugugaagucuaggcucagacaggcaucaacaaaccuauucaccccac

SEQ ID NO: 299846 - RNA, 64 nt, Homo Sapiens
cuucuccauggcugcuuccugcugaauaaauagggacaggcauaauggauaggaaugaaugaac

SEQ ID NO: 299847 - RNA, 64 nt, Homo Sapiens
cauagccuuaauagcccuaguugucauccugggagacaggcaacaguagagauauuugagagcc

SEQ ID NO: 299848 - RNA, 64 nt, Homo Sapiens
ggaaucuuccugagugacaggaauucauaaaacugacaggcaggacagguagacuugguuuuua

SEQ ID NO: 299849 - RNA, 64 nt, Homo Sapiens
guuuuccgugcuguguccucauaaaugcugaagagacaggcauugggccugggagcucagugac

SEQ ID NO: 299850 - RNA, 64 nt, Homo Sapiens
uguaagaaaccaaaauuugcugaauuacagucaugacaggcacaccuuccuggagcagucauaa

SEQ ID NO: 299851 - RNA, 64 nt, Homo Sapiens
aauauauuggccccauuagcuggaugugccacaugacaggcaaugacgccucagccccuuaaca

SEQ ID NO: 299852 - RNA, 64 nt, Homo Sapiens
cggaucagccugagaugaucccagcugugcucuggacaggcauguucucugaggacacuaacca

SEQ ID NO: 299853 - RNA, 64 nt, Homo Sapiens
ggugucaccugaagacucauucuucuguacgucugacaggcaaugcuggcuguuggcugggggc

SEQ ID NO: 299854 - RNA, 64 nt, Homo Sapiens
uccagacccggcugcgugguugaugaucuuugcagacaggcaagcaccuccugccucgaacugg

SEQ ID NO: 299855 - RNA, 64 nt, Homo Sapiens
ucucgucccaaccaucauucaggcacuggcugaagacaggcaacgucccgcccacauaugagac

SEQ ID NO: 299856 - RNA, 64 nt, Homo Sapiens
ggcugaagacaggcaacucuccgcccacauaugagacaggcacucugccaggcugcucagaguc

SEQ ID NO: 299857 - RNA, 64 nt, Homo Sapiens
gaccgacgcagccugaaagagacccagacagagagacaggcagacacagccuaaaacagaccug

SEQ ID NO: 299858 - RNA, 64 nt, Homo Sapiens
gacaggcagacacagccuaaaacagaccuggacagacaggcagacguagucugaaacagaccug

SEQ ID NO: 299859 - RNA, 64 nt, Homo Sapiens
agaaauuauaaaaguauuaagagauugcaguaaagacaggcauaaucuuuacaauuuauguuua

SEQ ID NO: 299860 - RNA, 64 nt, Homo Sapiens
ggaaaucacaaggguauugagagauuaaaguaaagacaggcauauccucagcugacaggauuga

SEQ ID NO: 299861 - RNA, 64 nt, Homo Sapiens
auguauuuuagacuuccuguagggggcgauauacuaaauguauauaguacauuuauacuaaaug

SEQ ID NO: 299862 - RNA, 64 nt, Homo Sapiens
ggcgauauacuaaauguauauaguacauuuauacuaaauguauuccuguagggggcgauauacu

SEQ ID NO: 299863 - RNA, 64 nt, Homo Sapiens
uauacuaaauguauuccuguagggggcgauauacuaaauguauuuuagacuuccuguagggggc

SEQ ID NO: 299864 - RNA, 64 nt, Homo Sapiens
cuaaguuuccugaguuauuaguaagauugcucccuaaauguaaccagggauuuucccauuaugu

SEQ ID NO: 299865 - RNA, 64 nt, Homo Sapiens
uauccaccuuguuuuuuuauugucuacaaaccauuaaauguaaauauuguuuuuagagucaguc

SEQ ID NO: 299866 - RNA, 64 nt, Homo Sapiens
uuuaacgucuuuccucuaguacuaccaguauucauaaauguauaccccuuacuguaauuuguuc

SEQ ID NO: 299867 - RNA, 64 nt, Homo Sapiens
cuuaaauuuaguucaucuuucuuuaaaagaacauuaaauguaaccauuuugucagauccaugua

SEQ ID NO: 299868 - RNA, 64 nt, Homo Sapiens
cgauauuugauaauuauauuuguauuucaccaccuaaauguaauguugauuccucaagaaugaa

SEQ ID NO: 299869 - RNA, 64 nt, Homo Sapiens
cuauuauuuuugguuaucauuauagaauaaauaauaaauguaaaggguuugggacagcaccugg

SEQ ID NO: 299870 - RNA, 64 nt, Homo Sapiens
cuaaucuuauguauguuuaaaacuuucaauguaauaaauguaucaucuauaacuuauaaacacc

SEQ ID NO: 299871 - RNA, 64 nt, Homo Sapiens
caaauaccaauaacagaucucauucuugucacaauaaauguauucuuaugaauauuuauaacag

SEQ ID NO: 299872 - RNA, 64 nt, Homo Sapiens
ugauguaccugaugcuaugguuagacuuuagaaauaaauguaccgcaguaaaaacuguucucua

SEQ ID NO: 299873 - RNA, 64 nt, Homo Sapiens
aauacacgauucugucaccuuuaucuuccgcagauaaauguagauucucacuuuuuauuguauu

SEQ ID NO: 299874 - RNA, 64 nt, Homo Sapiens
aguacugaauguauauauuuuuuaaaugaauacauaaauguagauauuuuacuacaguacagag

SEQ ID NO: 299875 - RNA, 64 nt, Homo Sapiens
guguuugugugugaugccauauuucuuuuucagguaaauguagucuuccuuauaaaaaugaaau

SEQ ID NO: 299876 - RNA, 64 nt, Homo Sapiens
aauuugaaaugcuauguauucacuuuucacucuguaaauguaauucuuuacaaugacuuuauuu

SEQ ID NO: 299877 - RNA, 64 nt, Homo Sapiens
ucuuuuuuguguuucucuaaagucauuuauacauuaaauguaauuauagcaacugugggguucu

SEQ ID NO: 299878 - RNA, 64 nt, Homo Sapiens
uuugucuggcuuuuguuuucuuuuucuuuaaaaauaaauguacaguaaaacuacaagcaaaagu

SEQ ID NO: 299879 - RNA, 64 nt, Homo Sapiens
acaaugaauuccagcuuucucuaacuuacuuaccuaaauguaaccuaauaagucuccuagguua

SEQ ID NO: 299880 - RNA, 64 nt, Homo Sapiens
aaaaucaaccauguuuucucggccgauuuucauauaaauguaugauacaacugugaaauaauaa

SEQ ID NO: 299881 - RNA, 64 nt, Homo Sapiens
caccuuguaagcaauaguuaucuaugugauguacuaaauguauauuuuccaaaacuuaguggac

SEQ ID NO: 299882 - RNA, 64 nt, Homo Sapiens
aaauauaaggauuacuuuuguuuuauaugcuguauaaauguauaguggcauaaucagugauauc

SEQ ID NO: 299883 - RNA, 64 nt, Homo Sapiens
caaacacaauugggaggcaauaguaucaauauccuaaauguagaaauuaaaagauacuguauaa

SEQ ID NO: 299884 - RNA, 64 nt, Homo Sapiens
uuugggaccagauguauuuggggauagaauucuuuaaauguaugggacuucaugcuuccugauu

SEQ ID NO: 299885 - RNA, 64 nt, Homo Sapiens
uugaugggcaguaaaacaaauucuuuucuauuuauaaauguauuuucucuuguuaccauacuga

SEQ ID NO: 299886 - RNA, 64 nt, Homo Sapiens
auugcuucucuuguuaccauuuggaaguuuccguuaaauguaauaucauguuguaauuaauuuu

SEQ ID NO: 299887 - RNA, 64 nt, Homo Sapiens
uauuuaauaaugucauguauuauuaaauguauacuaaauguauaauagaaagcccucugcaaua

SEQ ID NO: 299888 - RNA, 64 nt, Homo Sapiens
cuaaauguauauauuuaauaccucugcaauauauuaaauguauacaguaugcuaaauagaaagc

SEQ ID NO: 299889 - RNA, 64 nt, Homo Sapiens
acccaaguuucuggacuacuuauaaaccugauucuaaauguaggaggauuugggauuucugugc

SEQ ID NO: 299890 - RNA, 64 nt, Homo Sapiens
uuggugugugaaaugcucugauugaagauaaauauaaauguaugauuucuguuuaugccagauu

SEQ ID NO: 299891 - RNA, 64 nt, Homo Sapiens
uaacauagcgcggucaggcuccuugaguacacauuaaauguacaagugcuaguaauuuuuuccu

SEQ ID NO: 299892 - RNA, 64 nt, Homo Sapiens
auaauuugccuuuuaaccuuacaucuuuauucucuaaauguaguauuaaggguugacaauuacu

SEQ ID NO: 299893 - RNA, 64 nt, Homo Sapiens
ucguuaguucgaaagccucuaugcuaauuauuauuaaauguaagcauaaacuauauucugugac

SEQ ID NO: 299894 - RNA, 64 nt, Homo Sapiens
ugagacauauuagucuuugacuuuguacuguagcuaaauguacccuaggugcuauuuucuuauc

SEQ ID NO: 299895 - RNA, 64 nt, Homo Sapiens
guuacuucacugcuuugaauacauacuauggauauaaauguaggcaaaaugaaagauuaugacu

SEQ ID NO: 299896 - RNA, 64 nt, Homo Sapiens
cuaguggaggaaguuagacaagcauuuuaaguaauaaauguauagagagugucaagugaugagu

SEQ ID NO: 299897 - RNA, 64 nt, Homo Sapiens
auucuuaauuuucauuaaguuguuauuucaguuuuaaauguaccuucagaauaagcuuccccac

SEQ ID NO: 299898 - RNA, 64 nt, Homo Sapiens
guuaauauucauuuuuguuauccuuuuuuaaaaguaaauguacaggaugccaguaaaaaaaaaa

SEQ ID NO: 299899 - RNA, 64 nt, Homo Sapiens
uguuugcaacaucugauaacuucauggccuuugauaaauguauauauguauaugugcauggacu

SEQ ID NO: 299900 - RNA, 64 nt, Homo Sapiens
cuuauuccaauucuaugcauguuacugguauuuauaaauguaugaguuuuuuugcgguauaaua

SEQ ID NO: 299901 - RNA, 64 nt, Homo Sapiens
uauuuauaaauguaugaguuuuuuugcgguauaauaaauguaaauuuucuuuguauucuaauug

SEQ ID NO: 299902 - RNA, 64 nt, Homo Sapiens
uuuugugguuuaaucuuaugcccuuaaugccauuuaaauguaguuccagaagauagacuucaga

SEQ ID NO: 299903 - RNA, 64 nt, Homo Sapiens
guuuuacuaagguuuagcacaaauugcauagggauaaauguacauccauuuaauuuaaaugaca

SEQ ID NO: 299904 - RNA, 64 nt, Homo Sapiens
aagccaaaugugcagaugcuuuuuuauaaauguauaaauguaucgaacucuaagaccacagagu

SEQ ID NO: 299905 - RNA, 64 nt, Homo Sapiens
aauguaucaagccaaaugugcacagaguuuuuuauaaauguauaaguagcaggaacucuaagac

SEQ ID NO: 299906 - RNA, 64 nt, Homo Sapiens
accgaugcuccauccucguauuucuuuuuccuuguaaauguaaucagaugccauuuuauaugug

SEQ ID NO: 299907 - RNA, 64 nt, Homo Sapiens
agggcuagaguuuuaacuuuuaauuuuuuauauuuaaauguagacuuuugacacuuuuaaaaaa

SEQ ID NO: 299908 - RNA, 64 nt, Homo Sapiens
aggugaaaaagcacuauuaucaguucugccuagguaaauguaagauagaauuaaauggcagugc

SEQ ID NO: 299909 - RNA, 64 nt, Homo Sapiens
aaaguuucaaaagaaaauguuuauuuguucucauuaaauguauuuuagcaaacucagcucuucc

SEQ ID NO: 299910 - RNA, 64 nt, Homo Sapiens
auuauguuaaugaagaaaagagaaaauugaagcauaaauguauuuuugaaguaguuauucggua

SEQ ID NO: 299911 - RNA, 64 nt, Homo Sapiens
uuucaaccgaaaaguaagcauuuaacccggugaauaaauguagauccugccauucauugguauu

SEQ ID NO: 299912 - RNA, 64 nt, Homo Sapiens
uuaaauuucuaaccacaagaccucucuauaaugguaaauguaagacaucaccauuuuaucacuc

SEQ ID NO: 299913 - RNA, 64 nt, Homo Sapiens
gcuuacugucaaagcuucauaaugccugccuguguaaauguaugggcgacugcagaaaauugac

SEQ ID NO: 299914 - RNA, 64 nt, Homo Sapiens
uccuuuuuaguguuaauguccaaaugguccauguuaaauguaaaagaaguguuugcccacacag

SEQ ID NO: 299915 - RNA, 64 nt, Homo Sapiens
ucuucauugcuagguacuaaaauguguauauuuauaaauguaugauuuaccuuaucaaaccuag

SEQ ID NO: 299916 - RNA, 64 nt, Homo Sapiens
uuuguacaauguuguuauggcaugcaugugauuguaaauguaaauuuuuuuuuuaacuguagau

SEQ ID NO: 299917 - RNA, 64 nt, Homo Sapiens
acuacaaaaacagaauaauuuugaaguuuuagaauaaauguaauauauuuacuauaauucuaaa

SEQ ID NO: 299918 - RNA, 64 nt, Homo Sapiens
aaguuucuaaugugguauuuuaaauaaaguaucauaaauguaauaaguaaauauuuauuuagga

SEQ ID NO: 299919 - RNA, 64 nt, Homo Sapiens
uuugcuaccacuuaaugaaucucaaaauuuugaguaaauguaccucagucuaaucagacuuuuu

SEQ ID NO: 299920 - RNA, 64 nt, Homo Sapiens
agcaggcugauugcaauagacucagacaugcgaauaaauguaauugagagucuauucaugguga

SEQ ID NO: 299921 - RNA, 64 nt, Homo Sapiens
aaaauguuugauuccuugggaauggccuuaaaaauaaauguaauaaagucagaguggugguaug

SEQ ID NO: 299922 - RNA, 64 nt, Homo Sapiens
uggugguaugaaaacauuccuagugaucauguaguaaauguaggguuaagcauggacagccaga

SEQ ID NO: 299923 - RNA, 64 nt, Homo Sapiens
accuauauaguaucccuguggccaaugagcauaauaaauguaaauguuguuucugguuuuguuu

SEQ ID NO: 299924 - RNA, 64 nt, Homo Sapiens
uauuaagcuaaaaugcaaauaugaaaagaaguaauaaauguaacugcuagaacacacauuuuua

SEQ ID NO: 299925 - RNA, 64 nt, Homo Sapiens
uauauuuuaaaaugccugagagcuccaaaaauauuaaauguauauuaugauccaaugcaaauac

SEQ ID NO: 299926 - RNA, 64 nt, Homo Sapiens
cagauuuaguuaaguagcaugccaaucccuucauuaaauguauagacaguugguauauguacca

SEQ ID NO: 299927 - RNA, 64 nt, Homo Sapiens
uauaauuccauuuacaugaagcauccagaaaagauaaauguauagggacaaaaaguagauucau

SEQ ID NO: 299928 - RNA, 64 nt, Homo Sapiens
aaaguuggauuguagagauggcugcacaacucaguaaauguacuaaaaaucuuuuaacuuaaaa

SEQ ID NO: 299929 - RNA, 64 nt, Homo Sapiens
uacaaaguuauuucuucaucuugaccuguuuuuuuaaauguaaacuuuuaaggacuugagauaa

SEQ ID NO: 299930 - RNA, 64 nt, Homo Sapiens
gcuaauauacaaaaaagcagauuaaauuacaugauaaauguagcugaucaucaguguuuaauug

SEQ ID NO: 299931 - RNA, 64 nt, Homo Sapiens
auguacacuuaaaacaucugaggguuguugguaauaaauguaugugcccaauuuuggaguugag

SEQ ID NO: 299932 - RNA, 64 nt, Homo Sapiens
uauuauaaauaucuguaaccuuaacauauaguuuuaaauguaugaucauauuccauuguaucag

SEQ ID NO: 299933 - RNA, 64 nt, Homo Sapiens
aaaaaucuuuuaacuuaaaagcugcacaacucaguaaauguacuaaaguuggauuguagagaug

SEQ ID NO: 299934 - RNA, 64 nt, Homo Sapiens
gggacaaaaaguagauucaugcauccagaaaagauaaauguauauauaauuccauuuacaugaa

SEQ ID NO: 299935 - RNA, 64 nt, Homo Sapiens
uuguauuguauguacauuuuaaacuguaaauguauaaauguauaaaaaagaugaaaggaaaugc

SEQ ID NO: 299936 - RNA, 64 nt, Homo Sapiens
aauguauauuguauuguaugggaaaugcaaacuguaaauguauauuugcucaaaaaagaugaaa

SEQ ID NO: 299937 - RNA, 64 nt, Homo Sapiens
auucagcauuagaacaucuauacauauggugaucuaaauguacaaaauguaaaauguauaaguc

SEQ ID NO: 299938 - RNA, 64 nt, Homo Sapiens
uguauaaaaaguuuauuuugcuauugugaaaaacuaaauguaaaggaaaucaccuacuuucaug

SEQ ID NO: 299939 - RNA, 64 nt, Homo Sapiens
aacuugggauuguuuuguggguuuuuguuuguuuuaaauguaaauugagaaucuuuuauaagaa

SEQ ID NO: 299940 - RNA, 64 nt, Homo Sapiens
uuccaaagcuuguaaacacugccaucuucaaauuuaaauguaauuuaggaaauggaagcuuuua

SEQ ID NO: 299941 - RNA, 64 nt, Homo Sapiens
acuuauaaauacgaauaguuacuacucugacuuguaaauguagcugcuaaaguaugagguauau

SEQ ID NO: 299942 - RNA, 64 nt, Homo Sapiens
gguuuugaguuagcuggaaaagugaucagauuaauaaauguauauugguaguugaauuuagcaa

SEQ ID NO: 299943 - RNA, 64 nt, Homo Sapiens
ucuuccaaagcacuauuuguuguaauaacuuuucuaaauguagugccuuuaaaggaaaaaugaa

SEQ ID NO: 299944 - RNA, 64 nt, Homo Sapiens
gauaguuauaggccacuguucuuaaggugcacaguaaauguacacacacugucaaauucuuuuc

SEQ ID NO: 299945 - RNA, 64 nt, Homo Sapiens
gaaauaaaauauuagauuuaauauugaaucauauuaaauguacacauacaugagacugcagauu

SEQ ID NO: 299946 - RNA, 64 nt, Homo Sapiens
augccaucauccaccauuuauucuuuuuagcuguuaaauguacuuaauuauucacaugugcauu

SEQ ID NO: 299947 - RNA, 64 nt, Homo Sapiens
gguauugacuuuucguaucuaaaaaccuaggagauaaauguagaucacaauauuccgaaaacaa

SEQ ID NO: 299948 - RNA, 64 nt, Homo Sapiens
uaaucuaugccuguagaacauaaacauuuuccuguaaauguaugugugcauuuggggauaagua

SEQ ID NO: 299949 - RNA, 64 nt, Homo Sapiens
uaaaugucaagagaguauauccaauauuaggauauaaauguaugugucucaaguuuaacucuac

SEQ ID NO: 299950 - RNA, 64 nt, Homo Sapiens
auuaaauauuacugaagauuucgacuuccacuguuaaauguacaagauacaugaaauauuaaag

SEQ ID NO: 299951 - RNA, 64 nt, Homo Sapiens
uagaaaaagaacaaaugcuaaauagaguaacaguuaaauguauguguacacucuucccaaaugc

SEQ ID NO: 299952 - RNA, 64 nt, Homo Sapiens
cauguuauuuuauucauuguuggucagcguuguuuaaauguaauuaaauguaaaugguuucaaa

SEQ ID NO: 299953 - RNA, 64 nt, Homo Sapiens
ugguuucaaauggucagcgugcccuuacaaacauuaaauguaaauucuguacuaagugucaaca

SEQ ID NO: 299954 - RNA, 64 nt, Homo Sapiens
cuuaaaaauguuuagaucuuccuuuuaaagacauuaaauguaaaaacuuauagcuuuuaaaaga

SEQ ID NO: 299955 - RNA, 64 nt, Homo Sapiens
cauuugugcaacaauuuuugccauacagauaccuuaaauguaugaaagaucaauaugagaaaua

SEQ ID NO: 299956 - RNA, 64 nt, Homo Sapiens
ugucaaaaauguuauucagcuggggaaauuucucuaaauguacacugauucugugugugugauu

SEQ ID NO: 299957 - RNA, 64 nt, Homo Sapiens
cuagggaaaaccaggggguucugcuucacuagguuaaauguagguuuuguagaggagaucugca

SEQ ID NO: 299958 - RNA, 64 nt, Homo Sapiens
ccuagcuauauauuacguugucuuccuuacuacauaaauguacuucuuuaaucuugugauuaca

SEQ ID NO: 299959 - RNA, 64 nt, Homo Sapiens
cuguaauucuguuguguguguguguguuauaugauaaauguacauacauggaccacuuguuuau

SEQ ID NO: 299960 - RNA, 64 nt, Homo Sapiens
caccccucauccaggcaguucugagguguaaagguaaauguauuugugaaauuccauguguuug

SEQ ID NO: 299961 - RNA, 64 nt, Homo Sapiens
uuagaacuaggauaaucgguuuggacuuggugaauaaauguaccaagaguguuuggcucccagu

SEQ ID NO: 299962 - RNA, 64 nt, Homo Sapiens
cacacauaagaauacacucuggagaaagaccuuauaaauguaagacaugugggaaaggcuuuua

SEQ ID NO: 299963 - RNA, 64 nt, Homo Sapiens
cacacguaagaaugcacucuguagaaagaccuuauaaauguaagauaugugggaaaggcuuuua

SEQ ID NO: 299964 - RNA, 64 nt, Homo Sapiens
gucacacaugaauguguaguggagagaaccuugguaaauguaaagagugugggagagccuuuag

SEQ ID NO: 299965 - RNA, 64 nt, Homo Sapiens
gucauuugaaaacuucuaauacagcaaaauccuauaaauguaaguacuucaaaaagccucaugc

SEQ ID NO: 299966 - RNA, 64 nt, Homo Sapiens
acagcaucaaauucucacauaacaauauuagcuuuaaauguaaaugggcuaaaugcuccaauua

SEQ ID NO: 299967 - RNA, 64 nt, Homo Sapiens
gggaugcaaggcugguucaacauacgcaaaucaauaaauguaauccagcauauaaacagaacca

SEQ ID NO: 299968 - RNA, 64 nt, Homo Sapiens
uaucgaaaguuuuucaauuucugaauagaaacuauaaauguaaaccaugugaagaaagugcacg

SEQ ID NO: 299969 - RNA, 64 nt, Homo Sapiens
gauuguggcaacgccuucauggagagaaaccuuauaaauguaagugcacaugagaaugcacacu

SEQ ID NO: 299970 - RNA, 64 nt, Homo Sapiens
aaaugugggaaacccuucagggagagaagccauauaaauguaaguguauaagugucaggaauau

SEQ ID NO: 299971 - RNA, 64 nt, Homo Sapiens
ugugggaaagccuuuagugaagggagaaaaucuauaaauguaaagacaugaaaggacucacacu

SEQ ID NO: 299972 - RNA, 64 nt, Homo Sapiens
auaugugggaaaggcuuugaagagauggaccucauaaauguaaggacacaugauaaggcacacu

SEQ ID NO: 299973 - RNA, 64 nt, Homo Sapiens
uugugugggaaagcauuuuuggagauggaccuuauaaauguaaggacacauggcagugcagcau

SEQ ID NO: 299974 - RNA, 64 nt, Homo Sapiens
guaauuugcaaucacaagagcgaaagucacaggauaaauguaagcagaucagggaagaucaaua

SEQ ID NO: 299975 - RNA, 64 nt, Homo Sapiens
aaacauacaugacaguucuugauguuuuuauauuuaaauguagcgaagcuuuauaagucgugag

SEQ ID NO: 299976 - RNA, 64 nt, Homo Sapiens
uccacaauuaguguauuaaggcauacaaaauuuuuaaauguaauuaauuuuuacaaaauuuagu

SEQ ID NO: 299977 - RNA, 64 nt, Homo Sapiens
cguguauguauaaaauaaaggacaccaugacuaguaaauguaaacuucguuguguuaacaaguu

SEQ ID NO: 299978 - RNA, 64 nt, Homo Sapiens
aacauggugaacaguaguaauguaugguaguaaguaaauguauuuucugccgugacuguucagg

SEQ ID NO: 299979 - RNA, 64 nt, Homo Sapiens
auucauugugaacuaugaaaaauaauuuguuuaauaaauguauugagaaaucauguaggaaaga

SEQ ID NO: 299980 - RNA, 64 nt, Homo Sapiens
gaauauggaaaauuuuucugggaguaaaaucuuauaaauguaauaaacugugaguauguauaga

SEQ ID NO: 299981 - RNA, 64 nt, Homo Sapiens
acauugaagaaggcuagaaaauaguagccaaaguuaaauguaucuacauuuucuuuuguucuug

SEQ ID NO: 299982 - RNA, 64 nt, Homo Sapiens
uauauuaagaaaaauaucaaauuuuuuaauuauuuaaauguacucagacauuuauguguugaua

SEQ ID NO: 299983 - RNA, 64 nt, Homo Sapiens
uuaccgaugcaaacuguggaauaaauggaacacuuaaauguauacuuuucugaugcauuuaaaa

SEQ ID NO: 299984 - RNA, 64 nt, Homo Sapiens
aauagagucaauggaacuuuuuuuugcaauuuuuuaaauguauucucuuacauagucuuaagca

SEQ ID NO: 299985 - RNA, 64 nt, Homo Sapiens; identical to SEQ ID NO: 246588

SEQ ID NO: 299986 - RNA, 64 nt, Homo Sapiens; identical to SEQ ID NO: 246589

SEQ ID NO: 299987 - RNA, 64 nt, Homo Sapiens; identical to SEQ ID NO: 246590

SEQ ID NO: 299988 - RNA, 64 nt, Homo Sapiens; identical to SEQ ID NO: 246591

SEQ ID NO: 299989 - RNA, 64 nt, Homo Sapiens; identical to SEQ ID NO: 246592

SEQ ID NO: 299990 - RNA, 64 nt, Homo Sapiens; identical to SEQ ID NO: 246593

SEQ ID NO: 299991 - RNA, 64 nt, Homo Sapiens
acuauguuuucuggagagcuguguaagcugucuuguugcuuaguugcaauauaagaaauaguga

SEQ ID NO: 299992 - RNA, 64 nt, Homo Sapiens
aacaaauucaaccaagggauauuuacugcuuuauguugcuuaugauaauuauuuugcauuaaua

SEQ ID NO: 299993 - RNA, 64 nt, Homo Sapiens
ucuuuaauagaugaggaaaaauagcaacaagcaaguugcuuauaauaaaauaauuugugauucu

SEQ ID NO: 299994 - RNA, 64 nt, Homo Sapiens
gguguguaacucuaaaucuuguauaugcaucuuuguugcuuauuacauauuuacacacacaacc

SEQ ID NO: 299995 - RNA, 59 nt, Homo Sapiens
acuacauuuucucauauacauuuuuuuuuuccaggaacauugguaaaauccaagucuuu

SEQ ID NO: 299996 - RNA, 59 nt, Homo Sapiens
agaaugcacauugaauggauaacagauauuccaggaaaauguuccugagaagggugggu

SEQ ID NO: 299997 - RNA, 59 nt, Homo Sapiens
gcccaaaucaaccucugaaaaaagguuuuuccaggaagauuuacauuuagguuuaauau

SEQ ID NO: 299998 - RNA, 59 nt, Homo Sapiens
uguguugcuaaaacacaugcuaugagcacuccaggaaacacuauauuuuuuccaaaaaa

SEQ ID NO: 299999 - RNA, 59 nt, Homo Sapiens
augcuggaaacugauaguucguacuuuguuccaggaacucgcuacuaguuauucagagc

SEQ ID NO: 300000 - RNA, 59 nt, Homo Sapiens
augcuagaaacugucucucucuacuguguuccaggaacuacuacauaguuauucagagc

SEQ ID NO: 300001 - RNA, 59 nt, Homo Sapiens
gccagagaagauaauguucuuuaauguuguccaggaaacccuggcuugcuugccgagcc

SEQ ID NO: 300002 - RNA, 59 nt, Homo Sapiens
ucuuguagaagauggacucugaaaaacauuccaggaaaccauggcagcauggagagccu

SEQ ID NO: 300003 - RNA, 59 nt, Homo Sapiens
ccuggaggagauccgcaucuggggaccccuccaggaagaugcugacauccaggucagca

SEQ ID NO: 300004 - RNA, 59 nt, Homo Sapiens
gugcauggacucugcccucagggugccuguccaggaagagcuguguggccuggcaagca

SEQ ID NO: 300005 - RNA, 59 nt, Homo Sapiens
uauugaucaccaugaaagaaccuuuuguuuccaggaaaaguuaaauuggauugagaaug

SEQ ID NO: 300006 - RNA, 59 nt, Homo Sapiens
aaacuugcagcuuuaaccuguugccauuguccaggaaagcucucuuagaauuggaggau

SEQ ID NO: 300007 - RNA, 59 nt, Homo Sapiens
cucuuagcauguuugauuuaagaaaagccuccaggaaaucuugagagccugucuuggca

SEQ ID NO: 300008 - RNA, 59 nt, Homo Sapiens
gcuccccagucucuaccugucaggaugacuccaggaagacagcuggaguacugcauuug

SEQ ID NO: 300009 - RNA, 59 nt, Homo Sapiens
uuacauccaccuuugaggcuggucauaccuccaggaacaauacagagccagucaacuuc

SEQ ID NO: 300010 - RNA, 59 nt, Homo Sapiens
gagcgcaccaccaccuggcguguagaaucuccaggaagccuggcugcagcuucccauuu

SEQ ID NO: 300011 - RNA, 59 nt, Homo Sapiens
uagacuguuuuaccuccacaaugcaggcuuccaggaacauuuagaucuuggcuacuguc

SEQ ID NO: 300012 - RNA, 59 nt, Homo Sapiens
guuccuacguuguguauuacuaauaucccuccaggaauggagaaugcaggcaguuaacu

SEQ ID NO: 300013 - RNA, 59 nt, Homo Sapiens
cagagccacauuagaaguuccccacccacuccaggaaccuuccccgaguggagcuucga

SEQ ID NO: 300014 - RNA, 59 nt, Homo Sapiens
ugaacugcaggggcagagccgacagccacuccaggaacuuuuaaagacagguggccacu

SEQ ID NO: 300015 - RNA, 59 nt, Homo Sapiens
gcgggaccucuuguaacccaucggcaucuuccaggaauccgccgagugacuugaggaag

SEQ ID NO: 300016 - RNA, 59 nt, Homo Sapiens
cccugguggccuucaguuucaguuucucauccaggaagguaaccuugggcauuggcagu

SEQ ID NO: 300017 - RNA, 64 nt, Homo Sapiens; identical to SEQ ID NO: 247720

SEQ ID NO: 300018 - RNA, 64 nt, Homo Sapiens; identical to SEQ ID NO: 247721

SEQ ID NO: 300019 - RNA, 64 nt, Homo Sapiens; identical to SEQ ID NO: 247722

SEQ ID NO: 300020 - RNA, 64 nt, Homo Sapiens; identical to SEQ ID NO: 247723

SEQ ID NO: 300021 - RNA, 64 nt, Homo Sapiens; identical to SEQ ID NO: 247724

SEQ ID NO: 300022 - RNA, 64 nt, Homo Sapiens; identical to SEQ ID NO: 247725

SEQ ID NO: 300023 - RNA, 64 nt, Homo Sapiens; identical to SEQ ID NO: 247726

SEQ ID NO: 300024 - RNA, 64 nt, Homo Sapiens; identical to SEQ ID NO: 247727

SEQ ID NO: 300025 - RNA, 64 nt, Homo Sapiens; identical to SEQ ID NO: 247728

SEQ ID NO: 300026 - RNA, 64 nt, Homo Sapiens; identical to SEQ ID NO: 247729

SEQ ID NO: 300027 - RNA, 64 nt, Homo Sapiens; identical to SEQ ID NO: 247730

SEQ ID NO: 300028 - RNA, 64 nt, Homo Sapiens; identical to SEQ ID NO: 247731

SEQ ID NO: 300029 - RNA, 64 nt, Homo Sapiens; identical to SEQ ID NO: 247732

SEQ ID NO: 300030 - RNA, 64 nt, Homo Sapiens; identical to SEQ ID NO: 247733

SEQ ID NO: 300031 - RNA, 64 nt, Homo Sapiens; identical to SEQ ID NO: 247734

SEQ ID NO: 300032 - RNA, 64 nt, Homo Sapiens; identical to SEQ ID NO: 247735

SEQ ID NO: 300033 - RNA, 64 nt, Homo Sapiens; identical to SEQ ID NO: 247736

SEQ ID NO: 300034 - RNA, 64 nt, Homo Sapiens; identical to SEQ ID NO: 247737

SEQ ID NO: 300035 - RNA, 64 nt, Homo Sapiens; identical to SEQ ID NO: 247738

SEQ ID NO: 300036 - RNA, 64 nt, Homo Sapiens; identical to SEQ ID NO: 247739

SEQ ID NO: 300037 - RNA, 64 nt, Homo Sapiens; identical to SEQ ID NO: 247740

SEQ ID NO: 300038 - RNA, 64 nt, Homo Sapiens; identical to SEQ ID NO: 247741

SEQ ID NO: 300039 - RNA, 64 nt, Homo Sapiens; identical to SEQ ID NO: 247742

SEQ ID NO: 300040 - RNA, 64 nt, Homo Sapiens; identical to SEQ ID NO: 247743

SEQ ID NO: 300041 - RNA, 64 nt, Homo Sapiens; identical to SEQ ID NO: 247744

SEQ ID NO: 300042 - RNA, 64 nt, Homo Sapiens; identical to SEQ ID NO: 247745

SEQ ID NO: 300043 - RNA, 64 nt, Homo Sapiens; identical to SEQ ID NO: 247746

SEQ ID NO: 300044 - RNA, 64 nt, Homo Sapiens; identical to SEQ ID NO: 247747

SEQ ID NO: 300045 - RNA, 64 nt, Homo Sapiens; identical to SEQ ID NO: 247748

SEQ ID NO: 300046 - RNA, 64 nt, Homo Sapiens; identical to SEQ ID NO: 247749

SEQ ID NO: 300047 - RNA, 64 nt, Homo Sapiens; identical to SEQ ID NO: 247750

SEQ ID NO: 300048 - RNA, 64 nt, Homo Sapiens; identical to SEQ ID NO: 247751

SEQ ID NO: 300049 - RNA, 64 nt, Homo Sapiens; identical to SEQ ID NO: 247752

SEQ ID NO: 300050 - RNA, 64 nt, Homo Sapiens; identical to SEQ ID NO: 247753

SEQ ID NO: 300051 - RNA, 64 nt, Homo Sapiens; identical to SEQ ID NO: 247754

SEQ ID NO: 300052 - RNA, 64 nt, Homo Sapiens; identical to SEQ ID NO: 247755

SEQ ID NO: 300053 - RNA, 64 nt, Homo Sapiens; identical to SEQ ID NO: 247756

SEQ ID NO: 300054 - RNA, 64 nt, Homo Sapiens; identical to SEQ ID NO: 247757

SEQ ID NO: 300055 - RNA, 64 nt, Homo Sapiens; identical to SEQ ID NO: 247758

SEQ ID NO: 300056 - RNA, 64 nt, Homo Sapiens; identical to SEQ ID NO: 247759

SEQ ID NO: 300057 - RNA, 64 nt, Homo Sapiens; identical to SEQ ID NO: 247760

SEQ ID NO: 300058 - RNA, 64 nt, Homo Sapiens; identical to SEQ ID NO: 247761

SEQ ID NO: 300059 - RNA, 64 nt, Homo Sapiens; identical to SEQ ID NO: 247762

SEQ ID NO: 300060 - RNA, 64 nt, Homo Sapiens; identical to SEQ ID NO: 247763

SEQ ID NO: 300061 - RNA, 64 nt, Homo Sapiens; identical to SEQ ID NO: 247764

SEQ ID NO: 300062 - RNA, 64 nt, Homo Sapiens; identical to SEQ ID NO: 247765

SEQ ID NO: 300063 - RNA, 64 nt, Homo Sapiens; identical to SEQ ID NO: 247766

SEQ ID NO: 300064 - RNA, 64 nt, Homo Sapiens; identical to SEQ ID NO: 247767

SEQ ID NO: 300065 - RNA, 64 nt, Homo Sapiens; identical to SEQ ID NO: 247768

SEQ ID NO: 300066 - RNA, 64 nt, Homo Sapiens; identical to SEQ ID NO: 247769

SEQ ID NO: 300067 - RNA, 64 nt, Homo Sapiens; identical to SEQ ID NO: 247770

SEQ ID NO: 300068 - RNA, 64 nt, Homo Sapiens; identical to SEQ ID NO: 247771

SEQ ID NO: 300069 - RNA, 64 nt, Homo Sapiens; identical to SEQ ID NO: 247772

SEQ ID NO: 300070 - RNA, 64 nt, Homo Sapiens; identical to SEQ ID NO: 247773

SEQ ID NO: 300071 - RNA, 64 nt, Homo Sapiens; identical to SEQ ID NO: 247774

SEQ ID NO: 300072 - RNA, 64 nt, Homo Sapiens; identical to SEQ ID NO: 247775

SEQ ID NO: 300073 - RNA, 64 nt, Homo Sapiens; identical to SEQ ID NO: 247776

SEQ ID NO: 300074 - RNA, 64 nt, Homo Sapiens; identical to SEQ ID NO: 247777

SEQ ID NO: 300075 - RNA, 64 nt, Homo Sapiens; identical to SEQ ID NO: 247778

SEQ ID NO: 300076 - RNA, 64 nt, Homo Sapiens; identical to SEQ ID NO: 247779

SEQ ID NO: 300077 - RNA, 64 nt, Homo Sapiens; identical to SEQ ID NO: 247780

SEQ ID NO: 300078 - RNA, 64 nt, Homo Sapiens; identical to SEQ ID NO: 247781

SEQ ID NO: 300079 - RNA, 64 nt, Homo Sapiens; identical to SEQ ID NO: 247782

SEQ ID NO: 300080 - RNA, 64 nt, Homo Sapiens; identical to SEQ ID NO: 247783

SEQ ID NO: 300081 - RNA, 64 nt, Homo Sapiens; identical to SEQ ID NO: 247784

SEQ ID NO: 300082 - RNA, 64 nt, Homo Sapiens; identical to SEQ ID NO: 247785

SEQ ID NO: 300083 - RNA, 64 nt, Homo Sapiens; identical to SEQ ID NO: 247786

SEQ ID NO: 300084 - RNA, 64 nt, Homo Sapiens; identical to SEQ ID NO: 247787

SEQ ID NO: 300085 - RNA, 64 nt, Homo Sapiens; identical to SEQ ID NO: 247788

SEQ ID NO: 300086 - RNA, 64 nt, Homo Sapiens; identical to SEQ ID NO: 247789

SEQ ID NO: 300087 - RNA, 64 nt, Homo Sapiens; identical to SEQ ID NO: 247790

SEQ ID NO: 300088 - RNA, 64 nt, Homo Sapiens; identical to SEQ ID NO: 247791

SEQ ID NO: 300089 - RNA, 64 nt, Homo Sapiens; identical to SEQ ID NO: 247792

SEQ ID NO: 300090 - RNA, 64 nt, Homo Sapiens; identical to SEQ ID NO: 247793

SEQ ID NO: 300091 - RNA, 53 nt, Homo Sapiens; identical to SEQ ID NO: 247794

SEQ ID NO: 300092 - RNA, 64 nt, Homo Sapiens
uauguauacacacauauacauauauauauacacauacauacacauacauacauacauacauaua

SEQ ID NO: 300093 - RNA, 64 nt, Homo Sapiens
cacauauacauauauauauacacauacauacacauacauacauacauacauauauaucugauaa

SEQ ID NO: 300094 - RNA, 64 nt, Homo Sapiens
uauacauauauauauacacauacauacacauacauacauacauacauauauaucugauaaaauu

SEQ ID NO: 300095 - RNA, 64 nt, Homo Sapiens
cauauauauauacacauacauacacauacauacauacauacauauauaucugauaaaauuguga

SEQ ID NO: 300096 - RNA, 64 nt, Homo Sapiens
ccugugugccaagugacagcuauauauauacacauacauacaaaccacaccauacauacauaca

SEQ ID NO: 300097 - RNA, 64 nt, Homo Sapiens
uauauauacacauacauacaacccacaccauacauacauacauagguaauuuuuaagacuaugu

SEQ ID NO: 300098 - RNA, 64 nt, Homo Sapiens
cauauauauauacacauacaauguacccacaccauacauacauaacuggguaauuuuuaagacu

SEQ ID NO: 300099 - RNA, 64 nt, Homo Sapiens
uaaauaaauguuguccucuuaaguaauuuuuauuuacauacaaccguuuuccccucauguaucc

SEQ ID NO: 300100 - RNA, 64 nt, Homo Sapiens
cuagagaugacaguguuguuaagaucuuaaggacuacauacauuuuggggagauguaaugcugg

SEQ ID NO: 300101 - RNA, 64 nt, Homo Sapiens
uguuauguuaaagaauuacuauguacuguacuucuacauacaaauacuguacuucuacauacaa

SEQ ID NO: 300102 - RNA, 64 nt, Homo Sapiens
uguacuguacuucuacauacguauacuguacuucuacauacaaauauuguaaauucuuaucucu

SEQ ID NO: 300103 - RNA, 64 nt, Homo Sapiens
ccuccuucaccuuacucuguaaguuggaaaaauauacauacaguuuccuuucuaguaucuucuc

SEQ ID NO: 300104 - RNA, 64 nt, Homo Sapiens
uguauacuuaugcaugcauaauaauaguuauauauacauacaggauacacagacuaucacuaaa

SEQ ID NO: 300105 - RNA, 64 nt, Homo Sapiens
uuuaauuuauuaccuuuacaacauuuauuuacauuacauacauacauuuacaacauuuauuaau

SEQ ID NO: 300106 - RNA, 64 nt, Homo Sapiens
auuuauuaccuuuacaacauuuauuuacauuacauacauacauuuacaacauuuauuaauuuau

SEQ ID NO: 300107 - RNA, 64 nt, Homo Sapiens
cauacauauaauuuuuuuuuuauauacauauauauacauacacacauacauacauauauauaua

SEQ ID NO: 300108 - RNA, 64 nt, Homo Sapiens
uauauauauauauacauauacacacacacauacauacauacauacacacacacacacacacaca

SEQ ID NO: 300109 - RNA, 64 nt, Homo Sapiens
cauauauauauauauauacacacacacacacacauacauacauauauacacacacacacacaca

SEQ ID NO: 300110 - RNA, 64 nt, Homo Sapiens
uuauagguauuuaucagagaugauuauuuugugcuacauacagguuggcuaaugagcucuagug

SEQ ID NO: 300111 - RNA, 64 nt, Homo Sapiens
aaauuauuuuguaaauccaugacuuaaaacaagauacauacauaguauaacacaccucacagug

SEQ ID NO: 300112 - RNA, 64 nt, Homo Sapiens
uauauauauuuuuguaaauauuaauauauauacauacauacacacaugggagggagcugagggg

SEQ ID NO: 300113 - RNA, 64 nt, Homo Sapiens
cacauauauauauuuuuguagggguuaauauauauacauacauaugaucaugggagggagcuga

SEQ ID NO: 300114 - RNA, 64 nt, Homo Sapiens
uauguauauguaaugguuauguaacuaauauacauacauacagguauacuguacauauguauau

SEQ ID NO: 300115 - RNA, 64 nt, Homo Sapiens
cagguauguauauguaauggauauguaacuaauauacauacauauguauauacuguacauaugu

SEQ ID NO: 300116 - RNA, 64 nt, Homo Sapiens
gacacacacagaaagacacacagagacacaccauuacauacacacacgcagccccuccccgcca

SEQ ID NO: 300117 - RNA, 64 nt, Homo Sapiens
gacacgcaaucgcagauacgcagagacacaccauuacauacacacacacacacccuccccgcca

SEQ ID NO: 300118 - RNA, 64 nt, Homo Sapiens
gacacacacagaaagacacacacagagacaccauuacauacacacacacacacacccuccccgc

SEQ ID NO: 300119 - RNA, 64 nt, Homo Sapiens
gacacacacagaaagacacacacagagacaccauuacauacacacacacacacccccuccccac

SEQ ID NO: 300120 - RNA, 64 nt, Homo Sapiens
gaaacugacauuccuuuaaaaauauaaauauaaauacauacauacauagauauauacccagacu

SEQ ID NO: 300121 - RNA, 64 nt, Homo Sapiens
cugacauuccuuuaaaaauauaaauauaaauacauacauacauagauauauacccagacuuggg

SEQ ID NO: 300122 - RNA, 64 nt, Homo Sapiens
cuuacuauuugaauagaaauguguauguauaauauacauacauacauaagcauauaugugugug

SEQ ID NO: 300123 - RNA, 64 nt, Homo Sapiens
cuauuugaauagaaauguguauguauaauauacauacauacauaagcauauaugugugugugug

SEQ ID NO: 300124 - RNA, 64 nt, Homo Sapiens
uggugaaauaacaaccaaaauacugaaucugauguacauacagguuucuacaggaagagauggu

SEQ ID NO: 300125 - RNA, 64 nt, Homo Sapiens
cauaggcuaucuuggcacacuauacauauauacauacauacaaagaaacacacacagagauauc

SEQ ID NO: 300126 - RNA, 64 nt, Homo Sapiens
caaacauaggcuaucuuggcuaucuauacauauauacauacauauggggaaacacacacagaga

SEQ ID NO: 300127 - RNA, 64 nt, Homo Sapiens
cacauauacacauaacaaguguagaaguauauauuacauacauacacucacucugucugguaua

SEQ ID NO: 300128 - RNA, 64 nt, Homo Sapiens
uauacacauaacaaguguagaaguauauauuacauacauacacucacucugucugguauaggcu

SEQ ID NO: 300129 - RNA, 64 nt, Homo Sapiens
aaaaccgaaugagcugguucaauaaauacauacauacauacaauagagugagauucugucucaa

SEQ ID NO: 300130 - RNA, 64 nt, Homo Sapiens
caauaaaaccgaaugagcugucaaaauaaauacauacauacauacgacagagugagauucuguc

SEQ ID NO: 300131 - RNA, 64 nt, Homo Sapiens
cauacaauaaaaccgaaugaugucucaaaauaaauacauacauauggacgacagagugagauuc

SEQ ID NO: 300132 - RNA, 64 nt, Homo Sapiens
uauauguauauauauucucacacacauacauacauacauacaaagaagaaauuauacguacaua

SEQ ID NO: 300133 - RNA, 64 nt, Homo Sapiens
caaauauauguauauauauucauacacacauacauacauacauaagcugaagaaauuauacgua

SEQ ID NO: 300134 - RNA, 64 nt, Homo Sapiens
cauacaaauauauguauauacguacauacacacauacauacauagcugagcugaagaaauuaua

SEQ ID NO: 300135 - RNA, 64 nt, Homo Sapiens
cauacauacauacauacaaagaagaaauuauacguacauacacauucucucugaaugcugagcu

SEQ ID NO: 300136 - RNA, 64 nt, Homo Sapiens
guaaauaaggacaugaguuaaauauauuuauauguacauacauauauauaucccuuuacauaua

SEQ ID NO: 300137 - RNA, 64 nt, Homo Sapiens
augugggugugaguguguauguguggguguguguuacauacacagaaucaggcacuuaccugca

SEQ ID NO: 300138 - RNA, 64 nt, Homo Sapiens
auucuuccaaaagagagaggcuuuucagccuuuguacauacaaaaauaaaucuacccaaugaga

SEQ ID NO: 300139 - RNA, 64 nt, Homo Sapiens
cacaugcaaacauaccuacacaagcacuugcacauacauacaaacauacucacaaacacacaca

SEQ ID NO: 300140 - RNA, 64 nt, Homo Sapiens
auccuuuguacaaagcuccucuuuucccuuuuuuuacauacacaagauccucuuggcaggugga

SEQ ID NO: 300141 - RNA, 64 nt, Homo Sapiens
ugacaacuaagaaguagacaccaugcuaaagacuuacauacaaucuccuugaaucuucucaaua

SEQ ID NO: 300142 - RNA, 64 nt, Homo Sapiens
uucacauacauauauauauacacacauauauauguacauacacauacauacauauuaccauacu

SEQ ID NO: 300143 - RNA, 64 nt, Homo Sapiens
uauauauauacacacauauauauguacauacacauacauacauauuaccauacugaagggaaau

SEQ ID NO: 300144 - RNA, 64 nt, Homo Sapiens
uaccauuuuauaugaaaaaaaauucagaguuacauacauacagccugauauauauauauauuuu

SEQ ID NO: 300145 - RNA, 64 nt, Homo Sapiens
cagcuaccauuuuauaugaauuuuaauucagaguuacauacauagugacugauauauauauaua

SEQ ID NO: 300146 - RNA, 64 nt, Homo Sapiens
uacacacaugcacauaugucaaaguguguauacauacauacacaaacaaggguuugguguuuuu

SEQ ID NO: 300147 - RNA, 64 nt, Homo Sapiens
cacauacacacaugcacauauuuuaaaguguguauacauacauauauaaacaaggguuuggugu

SEQ ID NO: 300148 - RNA, 64 nt, Homo Sapiens
cugagccagcaaguccugcuuggcacaguguccuugugcccacacucaccacucacucaaccag

SEQ ID NO: 300149 - RNA, 64 nt, Homo Sapiens
gcuuccgcccacagaccucccagccauguccaccugugcccacagccuaugaccccacgucuga

SEQ ID NO: 300150 - RNA, 64 nt, Homo Sapiens
acacugcagcucccagugccccaguguccugcccugugcccagccccagcugcauggacucuga

SEQ ID NO: 300151 - RNA, 64 nt, Homo Sapiens
uccaggcugugcaagccccugaggucuugagagaugugcccacugcccgugcagccuccuucag

SEQ ID NO: 300152 - RNA, 64 nt, Homo Sapiens
cugcagagacgaacggugaucugugacccgguggugugcccaccgcccagcugcccacacccgg

SEQ ID NO: 300153 - RNA, 64 nt, Homo Sapiens
gcacugugagaaggugcaguguccccggcuggccugugcccagccugugcgugucaaccccacc

SEQ ID NO: 300154 - RNA, 64 nt, Homo Sapiens
gggccugggcacgugucucuuauguucaagugggugugcccauaucugagcuggcuccugaaua

SEQ ID NO: 300155 - RNA, 64 nt, Homo Sapiens
cagacuugguuugggccaccgauguuggccuuucugugcccaccgaaugguugcuccuagccaa

SEQ ID NO: 300156 - RNA, 64 nt, Homo Sapiens
accguguugcucacgaagaaggcucagcuuugcgugugcccagccgugugcacagcucguccca

SEQ ID NO: 300157 - RNA, 64 nt, Homo Sapiens
cucccaaagugcugagauuacaggcaugaaccacugugcccagccgaaaacaaccaagaauuuu

SEQ ID NO: 300158 - RNA, 64 nt, Homo Sapiens
gaacaugcucauguguacacuccccucuccugcgugugcccacucgcucagcacacaugcaucc

SEQ ID NO: 300159 - RNA, 64 nt, Homo Sapiens
guaaggaucuggcuuuucuccuuguugugcucuuugugcccaaguuuucuccuccuauaucacu

SEQ ID NO: 300160 - RNA, 64 nt, Homo Sapiens
uuccaugcugacugaugguugacucccaggacccugugcccagcaauguguggcauauggaagg

SEQ ID NO: 300161 - RNA, 64 nt, Homo Sapiens
gucucuuccacuuggucuggggcugccuggcccaugugcccacucucucuaacccacagguguu

SEQ ID NO: 300162 - RNA, 64 nt, Homo Sapiens
cuguucuauguuuuuaagcucaggcaugagccacugugcccagccucacaaaguguugagacua

SEQ ID NO: 300163 - RNA, 64 nt, Homo Sapiens
cagcugccaagcacucccucuggacugaggggagugugcccaggguauaauuucgccuggcaac

SEQ ID NO: 300164 - RNA, 64 nt, Homo Sapiens
uucaauccuuggaacugccuaguccccaugacugugugcccaccgagcuccugaguguucucau

SEQ ID NO: 300165 - RNA, 64 nt, Homo Sapiens
cuaugacucuucacauugucuuuauguacaucucugugcccaaguuuucccuuuuuauuaagac

SEQ ID NO: 300166 - RNA, 64 nt, Homo Sapiens
agcgagcuccugcuuagggaaggucagcaggcacugugcccaggaagagccugcggccucggcg

SEQ ID NO: 300167 - RNA, 64 nt, Homo Sapiens
gccgccccucccuguggcagcagcaggacaggugugugcccagcacccucccuaccugggccug

SEQ ID NO: 300168 - RNA, 64 nt, Homo Sapiens
gggggccccacccuuugccggcaaaugcagggcaugugcccaagaggggccuccccgcaggcac

SEQ ID NO: 300169 - RNA, 64 nt, Homo Sapiens
caagaggggccuccccgcaggcacuugcccccacugugcccaggagcucucuaggaggggccug

SEQ ID NO: 300170 - RNA, 64 nt, Homo Sapiens
auuacauaaugacagaaauacugagaagguucugugugcccauuugaaaggagugggaggaaua

SEQ ID NO: 300171 - RNA, 64 nt, Homo Sapiens
guccugguucgucuguguguggugugaccaauggugugcccagagcacuacucucaaaaucacu

SEQ ID NO: 300172 - RNA, 64 nt, Homo Sapiens
aucaggguuggcaucaucugauggcauguccaagugugcccagcagcggaugcugaagcaccag

SEQ ID NO: 300173 - RNA, 64 nt, Homo Sapiens
cagaccugacacccaacggggggaugugguggccugugcccaccuucucucccuccucccgacc

SEQ ID NO: 300174 - RNA, 64 nt, Homo Sapiens
uggcgggggcuggcagagccacaccccaagugccugugcccagagggcuucagucagccgcuca

SEQ ID NO: 300175 - RNA, 64 nt, Homo Sapiens
aggcucuuguguccucacucagguuugcuuccccugugcccacugcuguaugaucugggggcca

SEQ ID NO: 300176 - RNA, 64 nt, Homo Sapiens
aggagucaggcuaagaaacgccagcagggugggcugugcccagcggaaccuccagucacugugc

SEQ ID NO: 300177 - RNA, 64 nt, Homo Sapiens
agggugggcugugcccagcagaaccuccagucacugugcccagcgccagggacugugcagccug

SEQ ID NO: 300178 - RNA, 64 nt, Homo Sapiens
uccuagggaaggggaaggagccccugaaccacugugugcccauugcagcgucagccaaagcugg

SEQ ID NO: 300179 - RNA, 64 nt, Homo Sapiens
ugcugcccacuccugaugccuucaugggguaccuugugcccaggcacugccagggaggugggca

SEQ ID NO: 300180 - RNA, 64 nt, Homo Sapiens
ggaugggaacagggaggcacauaguuuggccuggugugcccacagauggugggauuuuuaucca

SEQ ID NO: 300181 - RNA, 64 nt, Homo Sapiens
accagcuccugguccguagggagcucaaggaaucugugcccaccaaguggcgccugcugcguca

SEQ ID NO: 300182 - RNA, 64 nt, Homo Sapiens
aauugggaggaaccaagcccucuucaucuguucaugugcccagcauuuauuaagcaccugcugu

SEQ ID NO: 300183 - RNA, 64 nt, Homo Sapiens
cacccaaagugcuaggguuacaggcaugagccacugugcccagcccaggcucugggaauauuga

SEQ ID NO: 300184 - RNA, 64 nt, Homo Sapiens
uuuggucccccuucccaacuagcagacccagaccugugcccagcauuccuccuggcuuaguugu

SEQ ID NO: 300185 - RNA, 64 nt, Homo Sapiens
agucugaucugcugggguacgaguuuccucuuagugugcccagguaccuggccccauuuguguu

SEQ ID NO: 300186 - RNA, 64 nt, Homo Sapiens
aaaauucuuuuuaauuaaaaauuguuauaccauaugugcccauuguaauuaauguuauuauuug

SEQ ID NO: 300187 - RNA, 64 nt, Homo Sapiens
auauaaaaguguggaacuuuccacucuuaaaaauugugcccaaaaagugaaaaccugccuuuug

SEQ ID NO: 300188 - RNA, 64 nt, Homo Sapiens
gaggggggggaacccaaggcgccccaaccccaaaugugcccaggcccaccccaccgugugggcu

SEQ ID NO: 300189 - RNA, 64 nt, Homo Sapiens
accuguggcuucauccagccugucuggccuauccugugcccaccgagucccccaaagucccuuc

SEQ ID NO: 300190 - RNA, 64 nt, Homo Sapiens
uaaaauuuucaugagaguagggcuacugucuguaugugcccagacaugaguaaauuuuguucag

SEQ ID NO: 300191 - RNA, 64 nt, Homo Sapiens
guuuuaacuugugugaaacagaaaccacagcuuuugugcccauuugauuuaauaugcuuuuguu

SEQ ID NO: 300192 - RNA, 64 nt, Homo Sapiens; identical to SEQ ID NO: 153734

SEQ ID NO: 300193 - RNA, 64 nt, Homo Sapiens; identical to SEQ ID NO: 153735

SEQ ID NO: 300194 - RNA, 64 nt, Homo Sapiens; identical to SEQ ID NO: 153736

SEQ ID NO: 300195 - RNA, 64 nt, Homo Sapiens; identical to SEQ ID NO: 153737

SEQ ID NO: 300196 - RNA, 64 nt, Homo Sapiens; identical to SEQ ID NO: 153738

SEQ ID NO: 300197 - RNA, 64 nt, Homo Sapiens; identical to SEQ ID NO: 153739

SEQ ID NO: 300198 - RNA, 64 nt, Homo Sapiens; identical to SEQ ID NO: 153740

SEQ ID NO: 300199 - RNA, 64 nt, Homo Sapiens; identical to SEQ ID NO: 153741

SEQ ID NO: 300200 - RNA, 64 nt, Homo Sapiens; identical to SEQ ID NO: 153742

SEQ ID NO: 300201 - RNA, 64 nt, Homo Sapiens; identical to SEQ ID NO: 153743

SEQ ID NO: 300202 - RNA, 64 nt, Homo Sapiens; identical to SEQ ID NO: 153744

SEQ ID NO: 300203 - RNA, 64 nt, Homo Sapiens; identical to SEQ ID NO: 153745

SEQ ID NO: 300204 - RNA, 64 nt, Homo Sapiens; identical to SEQ ID NO: 153746

SEQ ID NO: 300205 - RNA, 64 nt, Homo Sapiens; identical to SEQ ID NO: 153747

SEQ ID NO: 300206 - RNA, 64 nt, Homo Sapiens; identical to SEQ ID NO: 153748

SEQ ID NO: 300207 - RNA, 64 nt, Homo Sapiens; identical to SEQ ID NO: 153749

SEQ ID NO: 300208 - RNA, 64 nt, Homo Sapiens; identical to SEQ ID NO: 153750

SEQ ID NO: 300209 - RNA, 64 nt, Homo Sapiens; identical to SEQ ID NO: 153751

SEQ ID NO: 300210 - RNA, 64 nt, Homo Sapiens; identical to SEQ ID NO: 153752

SEQ ID NO: 300211 - RNA, 64 nt, Homo Sapiens; identical to SEQ ID NO: 153753

SEQ ID NO: 300212 - RNA, 64 nt, Homo Sapiens; identical to SEQ ID NO: 153754

SEQ ID NO: 300213 - RNA, 64 nt, Homo Sapiens; identical to SEQ ID NO: 153755

SEQ ID NO: 300214 - RNA, 64 nt, Homo Sapiens; identical to SEQ ID NO: 153756

SEQ ID NO: 300215 - RNA, 64 nt, Homo Sapiens; identical to SEQ ID NO: 153757

SEQ ID NO: 300216 - RNA, 64 nt, Homo Sapiens; identical to SEQ ID NO: 153758

SEQ ID NO: 300217 - RNA, 64 nt, Homo Sapiens; identical to SEQ ID NO: 153759

SEQ ID NO: 300218 - RNA, 64 nt, Homo Sapiens; identical to SEQ ID NO: 153760

SEQ ID NO: 300219 - RNA, 64 nt, Homo Sapiens; identical to SEQ ID NO: 153761

SEQ ID NO: 300220 - RNA, 64 nt, Homo Sapiens; identical to SEQ ID NO: 153762

SEQ ID NO: 300221 - RNA, 64 nt, Homo Sapiens; identical to SEQ ID NO: 153763

SEQ ID NO: 300222 - RNA, 64 nt, Homo Sapiens; identical to SEQ ID NO: 153764

SEQ ID NO: 300223 - RNA, 64 nt, Homo Sapiens; identical to SEQ ID NO: 153765

SEQ ID NO: 300224 - RNA, 64 nt, Homo Sapiens; identical to SEQ ID NO: 153766

SEQ ID NO: 300225 - RNA, 64 nt, Homo Sapiens; identical to SEQ ID NO: 153767

SEQ ID NO: 300226 - RNA, 64 nt, Homo Sapiens; identical to SEQ ID NO: 153768

SEQ ID NO: 300227 - RNA, 64 nt, Homo Sapiens; identical to SEQ ID NO: 153769

SEQ ID NO: 300228 - RNA, 64 nt, Homo Sapiens; identical to SEQ ID NO: 153770

SEQ ID NO: 300229 - RNA, 64 nt, Homo Sapiens; identical to SEQ ID NO: 153771

SEQ ID NO: 300230 - RNA, 64 nt, Homo Sapiens; identical to SEQ ID NO: 153772

SEQ ID NO: 300231 - RNA, 64 nt, Homo Sapiens; identical to SEQ ID NO: 153773

SEQ ID NO: 300232 - RNA, 64 nt, Homo Sapiens; identical to SEQ ID NO: 153774

SEQ ID NO: 300233 - RNA, 64 nt, Homo Sapiens; identical to SEQ ID NO: 153775

SEQ ID NO: 300234 - RNA, 64 nt, Homo Sapiens; identical to SEQ ID NO: 153776

SEQ ID NO: 300235 - RNA, 64 nt, Homo Sapiens; identical to SEQ ID NO: 153777

SEQ ID NO: 300236 - RNA, 64 nt, Homo Sapiens; identical to SEQ ID NO: 153778

SEQ ID NO: 300237 - RNA, 64 nt, Homo Sapiens; identical to SEQ ID NO: 153779

SEQ ID NO: 300238 - RNA, 64 nt, Homo Sapiens; identical to SEQ ID NO: 153780

SEQ ID NO: 300239 - RNA, 64 nt, Homo Sapiens; identical to SEQ ID NO: 153781

SEQ ID NO: 300240 - RNA, 64 nt, Homo Sapiens; identical to SEQ ID NO: 153782

SEQ ID NO: 300241 - RNA, 64 nt, Homo Sapiens; identical to SEQ ID NO: 153783

SEQ ID NO: 300242 - RNA, 64 nt, Homo Sapiens; identical to SEQ ID NO: 153784

SEQ ID NO: 300243 - RNA, 64 nt, Homo Sapiens; identical to SEQ ID NO: 153785

SEQ ID NO: 300244 - RNA, 64 nt, Homo Sapiens; identical to SEQ ID NO: 153786

SEQ ID NO: 300245 - RNA, 64 nt, Homo Sapiens; identical to SEQ ID NO: 153787

SEQ ID NO: 300246 - RNA, 64 nt, Homo Sapiens; identical to SEQ ID NO: 153788

SEQ ID NO: 300247 - RNA, 64 nt, Homo Sapiens; identical to SEQ ID NO: 153789

SEQ ID NO: 300248 - RNA, 64 nt, Homo Sapiens; identical to SEQ ID NO: 153790

SEQ ID NO: 300249 - RNA, 64 nt, Homo Sapiens; identical to SEQ ID NO: 153791

SEQ ID NO: 300250 - RNA, 64 nt, Homo Sapiens; identical to SEQ ID NO: 153792

SEQ ID NO: 300251 - RNA, 64 nt, Homo Sapiens; identical to SEQ ID NO: 153793

SEQ ID NO: 300252 - RNA, 64 nt, Homo Sapiens; identical to SEQ ID NO: 153794

SEQ ID NO: 300253 - RNA, 64 nt, Homo Sapiens; identical to SEQ ID NO: 153795

SEQ ID NO: 300254 - RNA, 64 nt, Homo Sapiens; identical to SEQ ID NO: 153796

SEQ ID NO: 300255 - RNA, 64 nt, Homo Sapiens; identical to SEQ ID NO: 153797

SEQ ID NO: 300256 - RNA, 64 nt, Homo Sapiens; identical to SEQ ID NO: 153798

SEQ ID NO: 300257 - RNA, 64 nt, Homo Sapiens; identical to SEQ ID NO: 153799

SEQ ID NO: 300258 - RNA, 64 nt, Homo Sapiens; identical to SEQ ID NO: 153800

SEQ ID NO: 300259 - RNA, 64 nt, Homo Sapiens; identical to SEQ ID NO: 153801

SEQ ID NO: 300260 - RNA, 64 nt, Homo Sapiens; identical to SEQ ID NO: 153802

SEQ ID NO: 300261 - RNA, 64 nt, Homo Sapiens; identical to SEQ ID NO: 153803

SEQ ID NO: 300262 - RNA, 64 nt, Homo Sapiens; identical to SEQ ID NO: 153804

SEQ ID NO: 300263 - RNA, 64 nt, Homo Sapiens; identical to SEQ ID NO: 153805

SEQ ID NO: 300264 - RNA, 64 nt, Homo Sapiens; identical to SEQ ID NO: 153806

SEQ ID NO: 300265 - RNA, 64 nt, Homo Sapiens; identical to SEQ ID NO: 153807

SEQ ID NO: 300266 - RNA, 64 nt, Homo Sapiens; identical to SEQ ID NO: 153808

SEQ ID NO: 300267 - RNA, 64 nt, Homo Sapiens; identical to SEQ ID NO: 153809

SEQ ID NO: 300268 - RNA, 64 nt, Homo Sapiens; identical to SEQ ID NO: 153810

SEQ ID NO: 300269 - RNA, 64 nt, Homo Sapiens; identical to SEQ ID NO: 153811

SEQ ID NO: 300270 - RNA, 64 nt, Homo Sapiens; identical to SEQ ID NO: 153812

SEQ ID NO: 300271 - RNA, 64 nt, Homo Sapiens; identical to SEQ ID NO: 153813

SEQ ID NO: 300272 - RNA, 64 nt, Homo Sapiens; identical to SEQ ID NO: 153814

SEQ ID NO: 300273 - RNA, 64 nt, Homo Sapiens; identical to SEQ ID NO: 153815

SEQ ID NO: 300274 - RNA, 64 nt, Homo Sapiens; identical to SEQ ID NO: 153816

SEQ ID NO: 300275 - RNA, 64 nt, Homo Sapiens; identical to SEQ ID NO: 153817

SEQ ID NO: 300276 - RNA, 64 nt, Homo Sapiens; identical to SEQ ID NO: 153818

SEQ ID NO: 300277 - RNA, 64 nt, Homo Sapiens; identical to SEQ ID NO: 153819

SEQ ID NO: 300278 - RNA, 64 nt, Homo Sapiens; identical to SEQ ID NO: 153820

SEQ ID NO: 300279 - RNA, 64 nt, Homo Sapiens; identical to SEQ ID NO: 153821

SEQ ID NO: 300280 - RNA, 64 nt, Homo Sapiens; identical to SEQ ID NO: 153822

SEQ ID NO: 300281 - RNA, 64 nt, Homo Sapiens; identical to SEQ ID NO: 153823

SEQ ID NO: 300282 - RNA, 64 nt, Homo Sapiens; identical to SEQ ID NO: 153824

SEQ ID NO: 300283 - RNA, 64 nt, Homo Sapiens; identical to SEQ ID NO: 153825

SEQ ID NO: 300284 - RNA, 64 nt, Homo Sapiens; identical to SEQ ID NO: 153826

SEQ ID NO: 300285 - RNA, 64 nt, Homo Sapiens; identical to SEQ ID NO: 153827

SEQ ID NO: 300286 - RNA, 64 nt, Homo Sapiens; identical to SEQ ID NO: 153828

SEQ ID NO: 300287 - RNA, 64 nt, Homo Sapiens; identical to SEQ ID NO: 153829

SEQ ID NO: 300288 - RNA, 64 nt, Homo Sapiens; identical to SEQ ID NO: 153830

SEQ ID NO: 300289 - RNA, 64 nt, Homo Sapiens; identical to SEQ ID NO: 153831

SEQ ID NO: 300290 - RNA, 64 nt, Homo Sapiens; identical to SEQ ID NO: 153832

SEQ ID NO: 300291 - RNA, 64 nt, Homo Sapiens; identical to SEQ ID NO: 153833

SEQ ID NO: 300292 - RNA, 64 nt, Homo Sapiens; identical to SEQ ID NO: 153834

SEQ ID NO: 300293 - RNA, 64 nt, Homo Sapiens; identical to SEQ ID NO: 153835

SEQ ID NO: 300294 - RNA, 64 nt, Homo Sapiens; identical to SEQ ID NO: 153836

SEQ ID NO: 300295 - RNA, 64 nt, Homo Sapiens; identical to SEQ ID NO: 153837

SEQ ID NO: 300296 - RNA, 64 nt, Homo Sapiens; identical to SEQ ID NO: 153838

SEQ ID NO: 300297 - RNA, 64 nt, Homo Sapiens; identical to SEQ ID NO: 153839

SEQ ID NO: 300298 - RNA, 64 nt, Homo Sapiens; identical to SEQ ID NO: 153840

SEQ ID NO: 300299 - RNA, 64 nt, Homo Sapiens; identical to SEQ ID NO: 153841

SEQ ID NO: 300300 - RNA, 64 nt, Homo Sapiens; identical to SEQ ID NO: 153842

SEQ ID NO: 300301 - RNA, 64 nt, Homo Sapiens; identical to SEQ ID NO: 153843

SEQ ID NO: 300302 - RNA, 64 nt, Homo Sapiens; identical to SEQ ID NO: 153844

SEQ ID NO: 300303 - RNA, 64 nt, Homo Sapiens; identical to SEQ ID NO: 153845

SEQ ID NO: 300304 - RNA, 64 nt, Homo Sapiens; identical to SEQ ID NO: 153846

SEQ ID NO: 300305 - RNA, 64 nt, Homo Sapiens; identical to SEQ ID NO: 259466

SEQ ID NO: 300306 - RNA, 64 nt, Homo Sapiens; identical to SEQ ID NO: 259467

SEQ ID NO: 300307 - RNA, 64 nt, Homo Sapiens; identical to SEQ ID NO: 259468

SEQ ID NO: 300308 - RNA, 64 nt, Homo Sapiens; identical to SEQ ID NO: 259469

SEQ ID NO: 300309 - RNA, 64 nt, Homo Sapiens; identical to SEQ ID NO: 259470

SEQ ID NO: 300310 - RNA, 64 nt, Homo Sapiens; identical to SEQ ID NO: 259471

SEQ ID NO: 300311 - RNA, 64 nt, Homo Sapiens; identical to SEQ ID NO: 259472

SEQ ID NO: 300312 - RNA, 64 nt, Homo Sapiens; identical to SEQ ID NO: 259473

SEQ ID NO: 300313 - RNA, 64 nt, Homo Sapiens; identical to SEQ ID NO: 259474

SEQ ID NO: 300314 - RNA, 64 nt, Homo Sapiens; identical to SEQ ID NO: 259475

SEQ ID NO: 300315 - RNA, 64 nt, Homo Sapiens; identical to SEQ ID NO: 259476

SEQ ID NO: 300316 - RNA, 64 nt, Homo Sapiens; identical to SEQ ID NO: 259477

SEQ ID NO: 300317 - RNA, 64 nt, Homo Sapiens; identical to SEQ ID NO: 259478

SEQ ID NO: 300318 - RNA, 64 nt, Homo Sapiens; identical to SEQ ID NO: 259479

SEQ ID NO: 300319 - RNA, 64 nt, Homo Sapiens; identical to SEQ ID NO: 259480

SEQ ID NO: 300320 - RNA, 64 nt, Homo Sapiens; identical to SEQ ID NO: 259481

SEQ ID NO: 300321 - RNA, 64 nt, Homo Sapiens; identical to SEQ ID NO: 259482

SEQ ID NO: 300322 - RNA, 64 nt, Homo Sapiens; identical to SEQ ID NO: 259483

SEQ ID NO: 300323 - RNA, 64 nt, Homo Sapiens; identical to SEQ ID NO: 259484

SEQ ID NO: 300324 - RNA, 64 nt, Homo Sapiens; identical to SEQ ID NO: 259485

SEQ ID NO: 300325 - RNA, 64 nt, Homo Sapiens; identical to SEQ ID NO: 259486

SEQ ID NO: 300326 - RNA, 64 nt, Homo Sapiens; identical to SEQ ID NO: 259487

SEQ ID NO: 300327 - RNA, 64 nt, Homo Sapiens; identical to SEQ ID NO: 259488

SEQ ID NO: 300328 - RNA, 64 nt, Homo Sapiens; identical to SEQ ID NO: 259489

SEQ ID NO: 300329 - RNA, 64 nt, Homo Sapiens; identical to SEQ ID NO: 259490

SEQ ID NO: 300330 - RNA, 64 nt, Homo Sapiens; identical to SEQ ID NO: 259491

SEQ ID NO: 300331 - RNA, 64 nt, Homo Sapiens; identical to SEQ ID NO: 259492

SEQ ID NO: 300332 - RNA, 64 nt, Homo Sapiens; identical to SEQ ID NO: 259493

SEQ ID NO: 300333 - RNA, 64 nt, Homo Sapiens; identical to SEQ ID NO: 259494

SEQ ID NO: 300334 - RNA, 64 nt, Homo Sapiens; identical to SEQ ID NO: 259495

SEQ ID NO: 300335 - RNA, 64 nt, Homo Sapiens; identical to SEQ ID NO: 259496

SEQ ID NO: 300336 - RNA, 64 nt, Homo Sapiens; identical to SEQ ID NO: 259497

SEQ ID NO: 300337 - RNA, 64 nt, Homo Sapiens; identical to SEQ ID NO: 259498

SEQ ID NO: 300338 - RNA, 64 nt, Homo Sapiens; identical to SEQ ID NO: 259499

SEQ ID NO: 300339 - RNA, 64 nt, Homo Sapiens; identical to SEQ ID NO: 259500

SEQ ID NO: 300340 - RNA, 64 nt, Homo Sapiens; identical to SEQ ID NO: 259501

SEQ ID NO: 300341 - RNA, 64 nt, Homo Sapiens; identical to SEQ ID NO: 259502

SEQ ID NO: 300342 - RNA, 64 nt, Homo Sapiens; identical to SEQ ID NO: 259503

SEQ ID NO: 300343 - RNA, 64 nt, Homo Sapiens; identical to SEQ ID NO: 259504

SEQ ID NO: 300344 - RNA, 64 nt, Homo Sapiens; identical to SEQ ID NO: 259505

SEQ ID NO: 300345 - RNA, 64 nt, Homo Sapiens; identical to SEQ ID NO: 259506

SEQ ID NO: 300346 - RNA, 64 nt, Homo Sapiens; identical to SEQ ID NO: 259507

SEQ ID NO: 300347 - RNA, 64 nt, Homo Sapiens; identical to SEQ ID NO: 259508

SEQ ID NO: 300348 - RNA, 64 nt, Homo Sapiens; identical to SEQ ID NO: 259509

SEQ ID NO: 300349 - RNA, 64 nt, Homo Sapiens; identical to SEQ ID NO: 259510

SEQ ID NO: 300350 - RNA, 64 nt, Homo Sapiens; identical to SEQ ID NO: 259511

SEQ ID NO: 300351 - RNA, 64 nt, Homo Sapiens; identical to SEQ ID NO: 259512

SEQ ID NO: 300352 - RNA, 64 nt, Homo Sapiens; identical to SEQ ID NO: 259513

SEQ ID NO: 300353 - RNA, 64 nt, Homo Sapiens; identical to SEQ ID NO: 259514

SEQ ID NO: 300354 - RNA, 64 nt, Homo Sapiens; identical to SEQ ID NO: 259515

SEQ ID NO: 300355 - RNA, 64 nt, Homo Sapiens; identical to SEQ ID NO: 259516

SEQ ID NO: 300356 - RNA, 64 nt, Homo Sapiens; identical to SEQ ID NO: 259517

SEQ ID NO: 300357 - RNA, 64 nt, Homo Sapiens; identical to SEQ ID NO: 259518

SEQ ID NO: 300358 - RNA, 64 nt, Homo Sapiens; identical to SEQ ID NO: 259519

SEQ ID NO: 300359 - RNA, 64 nt, Homo Sapiens; identical to SEQ ID NO: 259520

SEQ ID NO: 300360 - RNA, 64 nt, Homo Sapiens; identical to SEQ ID NO: 259521

SEQ ID NO: 300361 - RNA, 64 nt, Homo Sapiens; identical to SEQ ID NO: 259522

SEQ ID NO: 300362 - RNA, 64 nt, Homo Sapiens; identical to SEQ ID NO: 259523

SEQ ID NO: 300363 - RNA, 64 nt, Homo Sapiens; identical to SEQ ID NO: 259524

SEQ ID NO: 300364 - RNA, 64 nt, Homo Sapiens; identical to SEQ ID NO: 68703

SEQ ID NO: 300365 - RNA, 64 nt, Homo Sapiens; identical to SEQ ID NO: 68704

SEQ ID NO: 300366 - RNA, 64 nt, Homo Sapiens; identical to SEQ ID NO: 68705

SEQ ID NO: 300367 - RNA, 64 nt, Homo Sapiens; identical to SEQ ID NO: 68706

SEQ ID NO: 300368 - RNA, 64 nt, Homo Sapiens; identical to SEQ ID NO: 68707

SEQ ID NO: 300369 - RNA, 64 nt, Homo Sapiens; identical to SEQ ID NO: 68708

SEQ ID NO: 300370 - RNA, 64 nt, Homo Sapiens; identical to SEQ ID NO: 68709

SEQ ID NO: 300371 - RNA, 64 nt, Homo Sapiens; identical to SEQ ID NO: 68710

SEQ ID NO: 300372 - RNA, 64 nt, Homo Sapiens; identical to SEQ ID NO: 68711

SEQ ID NO: 300373 - RNA, 64 nt, Homo Sapiens; identical to SEQ ID NO: 68712

SEQ ID NO: 300374 - RNA, 64 nt, Homo Sapiens; identical to SEQ ID NO: 68713

SEQ ID NO: 300375 - RNA, 64 nt, Homo Sapiens; identical to SEQ ID NO: 68714

SEQ ID NO: 300376 - RNA, 64 nt, Homo Sapiens; identical to SEQ ID NO: 68715

SEQ ID NO: 300377 - RNA, 64 nt, Homo Sapiens; identical to SEQ ID NO: 68716

SEQ ID NO: 300378 - RNA, 64 nt, Homo Sapiens; identical to SEQ ID NO: 68717

SEQ ID NO: 300379 - RNA, 64 nt, Homo Sapiens; identical to SEQ ID NO: 68718

SEQ ID NO: 300380 - RNA, 64 nt, Homo Sapiens; identical to SEQ ID NO: 68719

SEQ ID NO: 300381 - RNA, 64 nt, Homo Sapiens; identical to SEQ ID NO: 68720

SEQ ID NO: 300382 - RNA, 64 nt, Homo Sapiens; identical to SEQ ID NO: 68721

SEQ ID NO: 300383 - RNA, 64 nt, Homo Sapiens; identical to SEQ ID NO: 68722

SEQ ID NO: 300384 - RNA, 64 nt, Homo Sapiens; identical to SEQ ID NO: 68723

SEQ ID NO: 300385 - RNA, 64 nt, Homo Sapiens; identical to SEQ ID NO: 68724

SEQ ID NO: 300386 - RNA, 64 nt, Homo Sapiens; identical to SEQ ID NO: 68725

SEQ ID NO: 300387 - RNA, 64 nt, Homo Sapiens; identical to SEQ ID NO: 68726

SEQ ID NO: 300388 - RNA, 64 nt, Homo Sapiens; identical to SEQ ID NO: 68727

SEQ ID NO: 300389 - RNA, 64 nt, Homo Sapiens; identical to SEQ ID NO: 68728

SEQ ID NO: 300390 - RNA, 64 nt, Homo Sapiens; identical to SEQ ID NO: 68729

SEQ ID NO: 300391 - RNA, 64 nt, Homo Sapiens; identical to SEQ ID NO: 68730

SEQ ID NO: 300392 - RNA, 64 nt, Homo Sapiens; identical to SEQ ID NO: 68731

SEQ ID NO: 300393 - RNA, 64 nt, Homo Sapiens; identical to SEQ ID NO: 68732

SEQ ID NO: 300394 - RNA, 64 nt, Homo Sapiens; identical to SEQ ID NO: 68733

SEQ ID NO: 300395 - RNA, 64 nt, Homo Sapiens; identical to SEQ ID NO: 68734

SEQ ID NO: 300396 - RNA, 64 nt, Homo Sapiens; identical to SEQ ID NO: 68735

SEQ ID NO: 300397 - RNA, 64 nt, Homo Sapiens; identical to SEQ ID NO: 68736

SEQ ID NO: 300398 - RNA, 64 nt, Homo Sapiens; identical to SEQ ID NO: 68737

SEQ ID NO: 300399 - RNA, 64 nt, Homo Sapiens; identical to SEQ ID NO: 68738

SEQ ID NO: 300400 - RNA, 64 nt, Homo Sapiens; identical to SEQ ID NO: 68739

SEQ ID NO: 300401 - RNA, 64 nt, Homo Sapiens; identical to SEQ ID NO: 68740

SEQ ID NO: 300402 - RNA, 64 nt, Homo Sapiens; identical to SEQ ID NO: 68741

SEQ ID NO: 300403 - RNA, 64 nt, Homo Sapiens; identical to SEQ ID NO: 68742

SEQ ID NO: 300404 - RNA, 64 nt, Homo Sapiens; identical to SEQ ID NO: 68743

SEQ ID NO: 300405 - RNA, 64 nt, Homo Sapiens; identical to SEQ ID NO: 68744

SEQ ID NO: 300406 - RNA, 64 nt, Homo Sapiens; identical to SEQ ID NO: 68745

SEQ ID NO: 300407 - RNA, 64 nt, Homo Sapiens; identical to SEQ ID NO: 68746

SEQ ID NO: 300408 - RNA, 64 nt, Homo Sapiens; identical to SEQ ID NO: 156063

SEQ ID NO: 300409 - RNA, 64 nt, Homo Sapiens; identical to SEQ ID NO: 156064

SEQ ID NO: 300410 - RNA, 64 nt, Homo Sapiens; identical to SEQ ID NO: 156065

SEQ ID NO: 300411 - RNA, 64 nt, Homo Sapiens; identical to SEQ ID NO: 156066

SEQ ID NO: 300412 - RNA, 64 nt, Homo Sapiens; identical to SEQ ID NO: 156067

SEQ ID NO: 300413 - RNA, 64 nt, Homo Sapiens; identical to SEQ ID NO: 156068

SEQ ID NO: 300414 - RNA, 64 nt, Homo Sapiens; identical to SEQ ID NO: 156069

SEQ ID NO: 300415 - RNA, 64 nt, Homo Sapiens; identical to SEQ ID NO: 156070

SEQ ID NO: 300416 - RNA, 64 nt, Homo Sapiens; identical to SEQ ID NO: 156071

SEQ ID NO: 300417 - RNA, 64 nt, Homo Sapiens; identical to SEQ ID NO: 156072

SEQ ID NO: 300418 - RNA, 64 nt, Homo Sapiens; identical to SEQ ID NO: 156073

SEQ ID NO: 300419 - RNA, 64 nt, Homo Sapiens; identical to SEQ ID NO: 156074

SEQ ID NO: 300420 - RNA, 64 nt, Homo Sapiens; identical to SEQ ID NO: 156075

SEQ ID NO: 300421 - RNA, 64 nt, Homo Sapiens; identical to SEQ ID NO: 156076

SEQ ID NO: 300422 - RNA, 64 nt, Homo Sapiens; identical to SEQ ID NO: 156077

SEQ ID NO: 300423 - RNA, 64 nt, Homo Sapiens; identical to SEQ ID NO: 156078

SEQ ID NO: 300424 - RNA, 64 nt, Homo Sapiens; identical to SEQ ID NO: 156079

SEQ ID NO: 300425 - RNA, 64 nt, Homo Sapiens; identical to SEQ ID NO: 156080

SEQ ID NO: 300426 - RNA, 64 nt, Homo Sapiens; identical to SEQ ID NO: 156081

SEQ ID NO: 300427 - RNA, 64 nt, Homo Sapiens; identical to SEQ ID NO: 156082

SEQ ID NO: 300428 - RNA, 64 nt, Homo Sapiens; identical to SEQ ID NO: 156083

SEQ ID NO: 300429 - RNA, 64 nt, Homo Sapiens; identical to SEQ ID NO: 156084

SEQ ID NO: 300430 - RNA, 64 nt, Homo Sapiens; identical to SEQ ID NO: 156085

SEQ ID NO: 300431 - RNA, 64 nt, Homo Sapiens; identical to SEQ ID NO: 156086

SEQ ID NO: 300432 - RNA, 64 nt, Homo Sapiens; identical to SEQ ID NO: 156087

SEQ ID NO: 300433 - RNA, 64 nt, Homo Sapiens; identical to SEQ ID NO: 156088

SEQ ID NO: 300434 - RNA, 64 nt, Homo Sapiens; identical to SEQ ID NO: 156089

SEQ ID NO: 300435 - RNA, 64 nt, Homo Sapiens; identical to SEQ ID NO: 156090

SEQ ID NO: 300436 - RNA, 64 nt, Homo Sapiens; identical to SEQ ID NO: 156091

SEQ ID NO: 300437 - RNA, 64 nt, Homo Sapiens; identical to SEQ ID NO: 156092

SEQ ID NO: 300438 - RNA, 64 nt, Homo Sapiens; identical to SEQ ID NO: 156093

SEQ ID NO: 300439 - RNA, 64 nt, Homo Sapiens; identical to SEQ ID NO: 156094

SEQ ID NO: 300440 - RNA, 64 nt, Homo Sapiens; identical to SEQ ID NO: 156095

SEQ ID NO: 300441 - RNA, 64 nt, Homo Sapiens; identical to SEQ ID NO: 156096

SEQ ID NO: 300442 - RNA, 64 nt, Homo Sapiens; identical to SEQ ID NO: 156097

SEQ ID NO: 300443 - RNA, 64 nt, Homo Sapiens; identical to SEQ ID NO: 156098

SEQ ID NO: 300444 - RNA, 64 nt, Homo Sapiens; identical to SEQ ID NO: 156099

SEQ ID NO: 300445 - RNA, 64 nt, Homo Sapiens; identical to SEQ ID NO: 156100

SEQ ID NO: 300446 - RNA, 64 nt, Homo Sapiens; identical to SEQ ID NO: 156101

SEQ ID NO: 300447 - RNA, 64 nt, Homo Sapiens; identical to SEQ ID NO: 156102

SEQ ID NO: 300448 - RNA, 64 nt, Homo Sapiens; identical to SEQ ID NO: 156103

SEQ ID NO: 300449 - RNA, 64 nt, Homo Sapiens; identical to SEQ ID NO: 156104

SEQ ID NO: 300450 - RNA, 64 nt, Homo Sapiens; identical to SEQ ID NO: 156105

SEQ ID NO: 300451 - RNA, 64 nt, Homo Sapiens; identical to SEQ ID NO: 156106

SEQ ID NO: 300452 - RNA, 64 nt, Homo Sapiens; identical to SEQ ID NO: 156107

SEQ ID NO: 300453 - RNA, 64 nt, Homo Sapiens; identical to SEQ ID NO: 156108

SEQ ID NO: 300454 - RNA, 64 nt, Homo Sapiens; identical to SEQ ID NO: 156109

SEQ ID NO: 300455 - RNA, 64 nt, Homo Sapiens; identical to SEQ ID NO: 156110

SEQ ID NO: 300456 - RNA, 64 nt, Homo Sapiens; identical to SEQ ID NO: 156111

SEQ ID NO: 300457 - RNA, 64 nt, Homo Sapiens
acauauuuuuauauuauguuugucuuaaaaaaagaggauucaacugggugacagagcaagaccc

SEQ ID NO: 300458 - RNA, 64 nt, Homo Sapiens
acgccacguguaguggcucaucuuuguacagaagaggauucaaauccuaaggacucagauugua

SEQ ID NO: 300459 - RNA, 56 nt, Homo Sapiens
ccagcacuaugagauacugaagaccaaggauucagcauuagaacaucuauacauau

SEQ ID NO: 300460 - RNA, 64 nt, Homo Sapiens
auuucuugagauuugauggaagugggaguugggaaggauucaccauacuuguguucuccucccu

SEQ ID NO: 300461 - RNA, 64 nt, Homo Sapiens
ucaaucaacaauucugucuuauugaagaguugcuaggauucagaguaaaacucaaaggauucag

SEQ ID NO: 300462 - RNA, 64 nt, Homo Sapiens
uugaagaguugcuaggauucagaguaaaacucaaaggauucaguuugagccuagaaugaugguu

SEQ ID NO: 300463 - RNA, 64 nt, Homo Sapiens
acgaguagaugguaaacauugcaaucuccuuggaaggauucagcaccuggagauaaacgcugga

SEQ ID NO: 300464 - RNA, 64 nt, Homo Sapiens
gagcgggaucagauuaccaggaggaugaauuaccaggauucaugcauaauguggauaggauagg

SEQ ID NO: 300465 - RNA, 64 nt, Homo Sapiens
uuuugccuuuuuuuccccacguguaucugaacauuaagcagauuggcucagacacaaugaaaag

SEQ ID NO: 300466 - RNA, 64 nt, Homo Sapiens
gguagaaaaaugaugagaaaugaacugagagcauuaagcagagaggguugauaggcuggccgug

SEQ ID NO: 300467 - RNA, 64 nt, Homo Sapiens
gcucggucagucugccuccguguguccucugaaauaagcagaugaagaugaaagggcaacuuug

SEQ ID NO: 300468 - RNA, 64 nt, Homo Sapiens
aacuuuguuuucuucuuuuuccugaugugaauguuaagcagaagggagagaguccuuacucccu

SEQ ID NO: 300469 - RNA, 64 nt, Homo Sapiens
uaucuaaaugggauuuugagagugugcuuuuggauaagcagaaauuggugguuuaguuucaccc

SEQ ID NO: 300470 - RNA, 64 nt, Homo Sapiens
uuauuucucccuacacuuccgaccuugaccauuauaagcagaccaacuucagggcuucuccaua

SEQ ID NO: 300471 - RNA, 64 nt, Homo Sapiens
uuuauuuuagugagggcaauuacagagaaaagaguaagcagaaauguccuucugaguacuggcc

SEQ ID NO: 300472 - RNA, 64 nt, Homo Sapiens
guuugcugcagaauucacugcauagcaggagauguaagcagaugaguuauuuuuuaagagaauc

SEQ ID NO: 300473 - RNA, 64 nt, Homo Sapiens
aagcuuuugucuguaggugaccaaggcauugauugcacuugauucccagauugcugcaaagauc

SEQ ID NO: 300474 - RNA, 64 nt, Homo Sapiens
augaggaacugcaccuuuagagguuacccgagaagcacuugagcgaaggagcagucacugggag

SEQ ID NO: 300475 - RNA, 64 nt, Homo Sapiens
aacacaacacugcaaacagagacuuaauuuucaagcacuugauucugagggcacuugagcaacu

SEQ ID NO: 300476 - RNA, 64 nt, Homo Sapiens
aacugacuuaauuuucaagccuucuaagcugagggcacuugagcgguauuuguuucaggaagcu

SEQ ID NO: 300477 - RNA, 64 nt, Homo Sapiens
gacaaaggugccagccuuuagugguuuuccuuuugcacuugaaggaaaaguuuugauuagcacu

SEQ ID NO: 300478 - RNA, 64 nt, Homo Sapiens
gguuuuuuggugaccucccuuacugggcuaaucagcacuugaucggaaguccagguuaguaugu

SEQ ID NO: 300479 - RNA, 64 nt, Homo Sapiens
cguguagaagcauuuuaaaaaucauuucuagcaagcacuugacaucuagucagcucucuacucc

SEQ ID NO: 300480 - RNA, 64 nt, Homo Sapiens
uugugccuuguucuaaaacuuuuauuaaguaggugcacuugacaguauugaggucauuuguuau

SEQ ID NO: 300481 - RNA, 64 nt, Homo Sapiens
agaaacuugaccaaaagacaguacaaaaacacuggcacuugaauguugaaugucaccguaugcg

SEQ ID NO: 300482 - RNA, 64 nt, Homo Sapiens
guauugugccuuguucuaaaacuuuuaaguaggugcacuugacaguauugaggucauuuguuaa

SEQ ID NO: 300483 - RNA, 64 nt, Homo Sapiens
gaaacuugaccaaaagacaguacaaaaaacacuggcacuugaauguugaaugucaccguaugug

SEQ ID NO: 300484 - RNA, 64 nt, Homo Sapiens
ucuuguaauauguugauucaguguuuuguaaaugaagucguauguauuuucagaguauuuuugu

SEQ ID NO: 300485 - RNA, 64 nt, Homo Sapiens
gauacuucaugauuaaauuauuuuuguugcuuaaaagucguauuagacaagacuaaaucauucu

SEQ ID NO: 300486 - RNA, 64 nt, Homo Sapiens
agcugaauagcccagcuugccagucugaauaaugaagucguacccacuaaguacuugagaguua

SEQ ID NO: 300487 - RNA, 64 nt, Homo Sapiens
auauauuuucuuacuguacauaaagauguuccuuaagucguacagaagguggcgcggcaaaggg

SEQ ID NO: 300488 - RNA, 64 nt, Homo Sapiens
ugccuuaucgaaaugcuucuagaacugucuguauaagucguauuucagacaguacuaaauacuu

SEQ ID NO: 300489 - RNA, 64 nt, Homo Sapiens
uuaacagugaacaacuguguuaaguauaugaaaaaagucguaucgagagaaugcaaauggccac

SEQ ID NO: 300490 - RNA, 64 nt, Homo Sapiens
cuacgcugccucaacacugaagguugacacaggaaagucguacuguucacacacacaguuugag

SEQ ID NO: 300491 - RNA, 64 nt, Homo Sapiens
ucuaauguucagaauuugguguacagauuuaauaaagucguaccuuggauaaaugggucagaaa

SEQ ID NO: 300492 - RNA, 64 nt, Homo Sapiens
auggaacaccuuucuguuuacaaacugagauuucaagucguacuuuuuccuagaaaaccaaaau

SEQ ID NO: 300493 - RNA, 64 nt, Homo Sapiens
aguacaagguuuuuauuuuugacaaggagggaguaagucguaggcucauggaggagugggugga

SEQ ID NO: 300494 - RNA, 51 nt, Homo Sapiens
ucccccgcucccugggaaagaaagucguaguaaaaguuauuuugugacuag

SEQ ID NO: 300495 - RNA, 64 nt, Homo Sapiens
acauugaaucugauucuaccuguuaacuuuuaaaaagucguaaguuuggaugaaagugcaagau

SEQ ID NO: 300496 - RNA, 64 nt, Homo Sapiens
uuaacauuccuaaaaugcuucacuguacguaguuaagucguagcuauaacuucaaauuuuuuaa

SEQ ID NO: 300497 - RNA, 64 nt, Homo Sapiens
uugguuguguguuuuauuaaggaucagugcaguuaagucguauuuuaaaguguuaccuccccuc

SEQ ID NO: 300498 - RNA, 64 nt, Homo Sapiens
cuuaagauagugccuaaaacacuaaauuucagucaagucguaaguaggauuuucuuuuugauca

SEQ ID NO: 300499 - RNA, 64 nt, Homo Sapiens
acuuuguuucagaacuggaagauaacaaucuuucaagucguagcggggguguggauguacagcg

SEQ ID NO: 300500 - RNA, 64 nt, Homo Sapiens
gcagcuauggaaaccacugguuuagucaucucggaagucguagggugauagaguccuugguggg

SEQ ID NO: 300501 - RNA, 64 nt, Homo Sapiens
ucauggcaguugaaaaagggccucauuggagauaaagucguaggauaaaauugggaacaggaau

SEQ ID NO: 300502 - RNA, 64 nt, Homo Sapiens
cucgcuaaagguugagaacuacugcuuuagaaugaagucguauaauaaagucucugaaaaggcc

SEQ ID NO: 300503 - RNA, 64 nt, Homo Sapiens
gaguggggaaacacugagucggaagagcuagguuaagucguaacgggggaggggauuggguuua

SEQ ID NO: 300504 - RNA, 64 nt, Homo Sapiens
aggagugcaguucauuuuuuucacccuguuuuugaagucguauuauucacuuguaaaaaugauu

SEQ ID NO: 300505 - RNA, 64 nt, Homo Sapiens
gaucucagcucuggccuggauggagaauucccuaucagcacagggccccaggcugucuggaagu

SEQ ID NO: 300506 - RNA, 64 nt, Homo Sapiens
cacugccaacagauaugauggaauuuucaaaugaucagcacagcuuuucuuccaaaucugagug

SEQ ID NO: 300507 - RNA, 64 nt, Homo Sapiens
ucauaaagaaucagcuagaguugucaugauaaagucagcacacacaaaaaggcuucuuacacau

SEQ ID NO: 300508 - RNA, 64 nt, Homo Sapiens
ccugacuuuuuauauccagucauaaaguugacuuucagcacaaaagauacuuauaaacaaauaa

SEQ ID NO: 300509 - RNA, 64 nt, Homo Sapiens
uuccugaaagcgaaagcuuuaccuccugcaaaugucagcacauguaguaggacaccaguauccu

SEQ ID NO: 300510 - RNA, 64 nt, Homo Sapiens
acucugaaagacagaagcuucguccagccacucuucagcacauuccuuuacuaagcaguuuaaa

SEQ ID NO: 300511 - RNA, 64 nt, Homo Sapiens
gagcggcuuccccaucgccuucuggcugcugcagucagcacagaggacagcuuccccaucgccu

SEQ ID NO: 300512 - RNA, 64 nt, Homo Sapiens
gagcggcuuccccauugccuucuggccgcugcagucagcacagaggacggcuuccccaucgccu

SEQ ID NO: 300513 - RNA, 64 nt, Homo Sapiens
ccugcuucauacucuugagcacauccuuaaaauaucagcacaaguugggggaggcaggcaaugg

SEQ ID NO: 300514 - RNA, 64 nt, Homo Sapiens
gagagugcauggcaccugguguguaacgacacaaucagcacaacuggagagaggcauuaaagaa

SEQ ID NO: 300515 - RNA, 64 nt, Homo Sapiens
acaguuggucugcagucggcccaggacggucuacucagcacaacugacugcuucagugcugcua

SEQ ID NO: 300516 - RNA, 64 nt, Homo Sapiens
uugaccuuuuuaaaacgaaaagagagacaaagucucagcacauuccaaggagugguagaaacag

SEQ ID NO: 300517 - RNA, 64 nt, Homo Sapiens
cccaggaaacuugggucuugcugcccauccuuccucagcacagggaacccggaagcccguugca

SEQ ID NO: 300518 - RNA, 64 nt, Homo Sapiens
cggguucgugcauacaugcggggaccccagacugucagcacagggaagauggaucccauccuaa

SEQ ID NO: 300519 - RNA, 64 nt, Homo Sapiens
uuuacucugcuacaggguggauuccaaaacuggcucagcacauugcauguaguugagccacauu

SEQ ID NO: 300520 - RNA, 64 nt, Homo Sapiens
uagguacuggugaaaauuguuuuuguuuaugcugucagcacauuugugugggucucucauuguc

SEQ ID NO: 300521 - RNA, 64 nt, Homo Sapiens
ugccuguaguccagucucuccagcaucaauuccaucagcacaaagacauaauuuaauuccuucu

SEQ ID NO: 300522 - RNA, 64 nt, Homo Sapiens
uuaggcauucuaagucacaggaugagacaggaggucagcacaagauacacgucacaaagaccuu

SEQ ID NO: 300523 - RNA, 64 nt, Homo Sapiens
aggagcacaaggaaaccaagcagcagaggccccaucagcacagagggccucguuccacgaacgu

SEQ ID NO: 300524 - RNA, 64 nt, Homo Sapiens
acccucucucguccaucucuguugccucugcacaucagcacacacugacuccaccugggcuggc

SEQ ID NO: 300525 - RNA, 64 nt, Homo Sapiens
cagauugaacaccugcaaaacugcuagcguaaucucagcacauacgcagcuaggaaguuuguca

SEQ ID NO: 300526 - RNA, 64 nt, Homo Sapiens
gcaugugagaacauagcaguagggaccaaaagucucagcacacuuaccuccgauuaugccuuaa

SEQ ID NO: 300527 - RNA, 64 nt, Homo Sapiens
aggagcagccccagccacagagccucagcacagcucagcacagauuggaccucccagcccaccc

SEQ ID NO: 300528 - RNA, 64 nt, Homo Sapiens
ucagcacagaaggagcagcccagcccacccagccucagcacagccugccaguccuuggaccucc

SEQ ID NO: 300529 - RNA, 64 nt, Homo Sapiens
agcgcuuccuuugcacagaagcggccaccaggucucagcacaagugcuuucgaaguggccagcu

SEQ ID NO: 300530 - RNA, 64 nt, Homo Sapiens
cuuugagacgucuggacccuaguugugugauguaucagcacagggggugugcaggcgucugcua

SEQ ID NO: 300531 - RNA, 64 nt, Homo Sapiens
guaaaacugucuacuagcaaaugaaaugacauacaagcuucaggugaacugcucagagcuugag

SEQ ID NO: 300532 - RNA, 64 nt, Homo Sapiens
caccaucaucagaaagaaggaccuuucucaaagaaagcuucaacuuuuucucagaauaccucuu

SEQ ID NO: 300533 - RNA, 64 nt, Homo Sapiens
gacaauaagauguuaaaaagcuuccuccauacauaagcuucaagguugcucuuuugguuuuuaa

SEQ ID NO: 300534 - RNA, 64 nt, Homo Sapiens
gggaaauacagcaauuauuucuuaucagaauaacaagcuucaguaugaaagcauuugaauuugg

SEQ ID NO: 300535 - RNA, 64 nt, Homo Sapiens
auaccauguuugcauaguuugaagggcucuuuugaagcuucagugcuaauagaucauuggauac

SEQ ID NO: 300536 - RNA, 64 nt, Homo Sapiens
aacuaaagaaaaaggaacuuaccaugucaucuacaagcuucagugaggggagagagguaccuag

SEQ ID NO: 300537 - RNA, 64 nt, Homo Sapiens
cagaaauggacuuaccgugaagccaauaaaguucaagcuucagggaucucucuugcacgggccu

SEQ ID NO: 300538 - RNA, 64 nt, Homo Sapiens
uuuguauuguuuuucuuaaagaggaaccucguauaagcuucaagccucacaaaccuucuagccu

SEQ ID NO: 300539 - RNA, 64 nt, Homo Sapiens
acccaauuccagcaccguugccuccugacauaccaagcuucaaccucauuggugacagccuguc

SEQ ID NO: 300540 - RNA, 64 nt, Homo Sapiens
cugugucuuccuagugugacccagccaggagcggaagcuucaggcguuuguaaagugaggucug

SEQ ID NO: 300541 - RNA, 64 nt, Homo Sapiens
auaacgugcuucauuugaccuuuguacagucuuugugaaauaaaccccauguuuuauaaggaau

SEQ ID NO: 300542 - RNA, 64 nt, Homo Sapiens
guaaauaugaaagaacuuguauaccugugaauaugugaaauaguccuuccuccuggcucucuau

SEQ ID NO: 300543 - RNA, 64 nt, Homo Sapiens
uuaaauucauaagacuuaauuuguacaauaguuugugaaauaucuuguuacugcuuuuauuuag

SEQ ID NO: 300544 - RNA, 64 nt, Homo Sapiens
agcagacuguggacuguaauaaaguauauaaauugugaaauauaaaaacuuggaacuuauucaa

SEQ ID NO: 300545 - RNA, 64 nt, Homo Sapiens
uacguaauuauacuuaaaauauccacuggacacugugaaauacacuaacaggauggcuggguag

SEQ ID NO: 300546 - RNA, 64 nt, Homo Sapiens
aguucauuuccugagguggauuuacugagagaaggugaaauaaagccauauuuaguauaccaga

SEQ ID NO: 300547 - RNA, 64 nt, Homo Sapiens
aagugacugcuuucaagcaguuucaaaaaccuuagugaaauagcuaucauauguuaaacuaagc

SEQ ID NO: 300548 - RNA, 64 nt, Homo Sapiens
ucuacuuucccucccauaucuccgcugagugucugugaaauaccgaacacuggcuuggcccugc

SEQ ID NO: 300549 - RNA, 64 nt, Homo Sapiens
uaauauuucaucuuuugcuuauuucuacaagucagugaaauaaauuguauuuaggaagugucag

SEQ ID NO: 300550 - RNA, 64 nt, Homo Sapiens
uugucugugucaagaaguucaccuucucaagccagugaaauacagacuuaauuugucaugacug

SEQ ID NO: 300551 - RNA, 64 nt, Homo Sapiens
uguccuguuauauguauaucaggaauacaaggaugugaaauaaaacuguaaauuugcauaacug

SEQ ID NO: 300552 - RNA, 64 nt, Homo Sapiens
uguaaauuugcauaacuggauguacuuagauaaugugaaauaaacauuaaagacaaggucuauu

SEQ ID NO: 300553 - RNA, 64 nt, Homo Sapiens
guccuauauggggaaaaaacguacacaguuuucugugaaauaugaugcuguaugugguugugau

SEQ ID NO: 300554 - RNA, 64 nt, Homo Sapiens
agggcugucuuccuuucuccccuuuggaugguuggugaaauacuuuaauugcccugucugcuca

SEQ ID NO: 300555 - RNA, 64 nt, Homo Sapiens
uuuaucaaggguagcuaaugacaugaaaauaauugugaaauauggaauuauuucugacacauga

SEQ ID NO: 300556 - RNA, 64 nt, Homo Sapiens
guauggagaacucaccaagaaagaauucaauacugugaaauaugcagcaagaagauuggucuuu

SEQ ID NO: 300557 - RNA, 64 nt, Homo Sapiens
acaagaauaguguuucagcuaucuccaugaaaucgugaaauaagaucuguuuagauuaucuuua

SEQ ID NO: 300558 - RNA, 64 nt, Homo Sapiens
acuaccuuacgugauagcauuuccauuuuuuaaggugaaauaguucuuaggcugaaauuugucu

SEQ ID NO: 300559 - RNA, 64 nt, Homo Sapiens
cagcugucccuuuaaaaauauuaauaguauauacgugaaauacuacaccaaaaauuuagaugcc

SEQ ID NO: 300560 - RNA, 64 nt, Homo Sapiens
cugguucacuaguagagaaauuagaguuugcuaagugaaauaaagauuauauauuucccucaau

SEQ ID NO: 300561 - RNA, 64 nt, Homo Sapiens
augugccauacuaguauguguaacaucacuuuuagugaaauaaagucuacaagacauucacguu

SEQ ID NO: 300562 - RNA, 64 nt, Homo Sapiens
auaagaugagaauggaaagaaacuaaauuuuugagugaaauaucaaauguguuuuggggugggu

SEQ ID NO: 300563 - RNA, 64 nt, Homo Sapiens
acaugcuuuaaaggaaguauauuuaauuucuugugugaaauagacaauuuuaaaaguagcucac

SEQ ID NO: 300564 - RNA, 64 nt, Homo Sapiens
cagucuaaagaagagguguuuuuuuaugaucaaggugaaauaaaugaauguaguauucaaugau

SEQ ID NO: 300565 - RNA, 64 nt, Homo Sapiens
uuaauuaucaaucaguagauccuucugguucacagugaaauaauuuuugcuuucuaaauacuag

SEQ ID NO: 300566 - RNA, 64 nt, Homo Sapiens
ggaaaacuacauuuguuauuuccauuaauaauaggugaaauacagaaauuuugccauucuguuu

SEQ ID NO: 300567 - RNA, 64 nt, Homo Sapiens
uaccuaucaaauagcauuuauuacaugucuuucagugaaauacuuaguuguuccaggcaccuaa

SEQ ID NO: 300568 - RNA, 64 nt, Homo Sapiens
ugcauguuugcaugggguuauugagacauuggaugugaaauaccuaggaagacauguauggaga

SEQ ID NO: 300569 - RNA, 64 nt, Homo Sapiens
aguacacagguucucccuuguucuuuuaaauuuugugaaauauaacuuacaaauaaguacuuaa

SEQ ID NO: 300570 - RNA, 64 nt, Homo Sapiens
cuauguguccaggguauugcguuuguucacuaaugugaaauaaggaacuuuauaaaaaucuuga

SEQ ID NO: 300571 - RNA, 64 nt, Homo Sapiens
uauaugcauaaauggcaaagaugcaucuucuucggugaaauauuuugcauuuguuuauugaaug

SEQ ID NO: 300572 - RNA, 64 nt, Homo Sapiens
aaaaaugaaauaacuggaccuguuugcugaaaaugugaaauaguacccuguuugcaccucgauu

SEQ ID NO: 300573 - RNA, 64 nt, Homo Sapiens
cccuguuugcaccucgauuuguuaauauauuaaugugaaauaaauuuauuugacaaaaaaucca

SEQ ID NO: 300574 - RNA, 64 nt, Homo Sapiens
uuguuuuugaaaguuagcauaauuuuagaugccugugaaauaguacugcacuuacauaaaguga

SEQ ID NO: 300575 - RNA, 64 nt, Homo Sapiens
agguucugagauaaguguuauguuuguagauagagugaaauauauuuauauauauauaaauaua

SEQ ID NO: 300576 - RNA, 64 nt, Homo Sapiens
augaaaacaauuuccucccuauuucacugaaacagugaaauaaauucacugaaaccagugaaau

SEQ ID NO: 300577 - RNA, 64 nt, Homo Sapiens
ucacugaaacagugaaauaauuucacugaaaccagugaaauauuaaauuuucuaaaauuacaug

SEQ ID NO: 300578 - RNA, 64 nt, Homo Sapiens
gcacgugggcguaguggggacaaggccagcccgacccugacacuccagucuggauccaggucug

SEQ ID NO: 300579 - RNA, 64 nt, Homo Sapiens
ccaaaaccaucuucccacauuccugccaggagcgcccugacauccaagggcuugcugccuuguu

SEQ ID NO: 300580 - RNA, 64 nt, Homo Sapiens
ugcagcugccuugccuugcccgucgcccccuagacccugacagcugggagggcgccgagcccac

SEQ ID NO: 300581 - RNA, 64 nt, Homo Sapiens
cuccuuccagcucucccuaagaauugggagugcacccugacagucugcccuggcuuucagcgua

SEQ ID NO: 300582 - RNA, 64 nt, Homo Sapiens
gucuauaauugaguucaggccuuuagucaaacagcccugacagagauaugggaucccuuagcca

SEQ ID NO: 300583 - RNA, 64 nt, Homo Sapiens
ucucugggcugcacagcagauucucccucuccuucccugacacuaaaauauguauuucccccau

SEQ ID NO: 300584 - RNA, 64 nt, Homo Sapiens
uggagcaggccucaugauguggggggacucgacccccugacauggggcagcccauagcaggccu

SEQ ID NO: 300585 - RNA, 64 nt, Homo Sapiens
cauagcaggccuugugcaguggggggacucgacccccugacauggggcugccuggagcaggccg

SEQ ID NO: 300586 - RNA, 64 nt, Homo Sapiens
gacugggcaggguguccaaagagggguguuggugcccugacaggccaagccaccauuugagagg

SEQ ID NO: 300587 - RNA, 64 nt, Homo Sapiens
ugggcuauggagagguuggcccucaccagcaccucccugacaccccuccugagucacugggguc

SEQ ID NO: 300588 - RNA, 64 nt, Homo Sapiens
gcccacacuuuggaggggguccauguccaagagacccugacaaggaaggaguugagcccugggu

SEQ ID NO: 300589 - RNA, 64 nt, Homo Sapiens
gcugagaucucccuuuguggaacuccgagagccgcccugacagucccagccgccacccaaggag

SEQ ID NO: 300590 - RNA, 64 nt, Homo Sapiens
ugacaucuaccucccgaccuuucaggccaagugacccugacauggaacuggauccaaaaaacca

SEQ ID NO: 300591 - RNA, 64 nt, Homo Sapiens
auccagugugcauacauccagcagauggugauuucccugacaccuccugggcuggggcaagaca

SEQ ID NO: 300592 - RNA, 64 nt, Homo Sapiens
ccuggacuguguggcugaagcucggcccuuuaaucccugacagaccuuaccaccccuuuuccug

SEQ ID NO: 300593 - RNA, 64 nt, Homo Sapiens
ggccucaaggagcugcagguugccaauagacagccccugacaguggcucauuguggcagguuuc

SEQ ID NO: 300594 - RNA, 64 nt, Homo Sapiens
accagcagcccaggaagcagcacacgcggccguggggaggcaggcaccgggcaugucggcgccu

SEQ ID NO: 300595 - RNA, 64 nt, Homo Sapiens
uguacgugugucaagccuagccaccucagcugcagggaggcagaaggcaaggcaggccccacgg

SEQ ID NO: 300596 - RNA, 64 nt, Homo Sapiens
uugggaggcugaggcaggagaaucgcuugaacccgggaggcacagguuccagugagccaagguu

SEQ ID NO: 300597 - RNA, 64 nt, Homo Sapiens
uugggaggcugaggcaggagaaucgcuugaaccugggaggcagagguugcaguaagccaagauc

SEQ ID NO: 300598 - RNA, 64 nt, Homo Sapiens
aguugcagugagccgagauuaauugcuugaaccggggaggcagaucgggaggcugaggcaggag

SEQ ID NO: 300599 - RNA, 64 nt, Homo Sapiens
gcuugcagugagcugagauuaauggcaugaaccugggaggcagauugggaggcugaggcaggag

SEQ ID NO: 300600 - RNA, 64 nt, Homo Sapiens
uuuggaauggugcgaguaugauggcagggugugagggaggcaggaagacggcaccucuuccccc

SEQ ID NO: 300601 - RNA, 64 nt, Homo Sapiens
ggaggaagacggcaccucuuggagauccugggaagggaggcacuucuggcugagcccagggugg

SEQ ID NO: 300602 - RNA, 64 nt, Homo Sapiens
aguugcagugagcugagauuaaucgcuugaaccugggaggcagauugggaggcugaggcaggag

SEQ ID NO: 300603 - RNA, 64 nt, Homo Sapiens
ggugggcggaucacaaggucaauuccagcacuuugggaggcagaguacaguggcucaugccuau

SEQ ID NO: 300604 - RNA, 64 nt, Homo Sapiens
cggcgggcgcgacgugaucguggaccugugggaggggaggcacguggcgcgcgugggcccgcug

SEQ ID NO: 300605 - RNA, 64 nt, Homo Sapiens
uucaguccaggcuggagagguuggggccgggguagggaggcaggagccaugucaguucugaagg

SEQ ID NO: 300606 - RNA, 64 nt, Homo Sapiens
cagaugauuuguguaaccugaggccaggauuaaggggaggcaaucaaugcaccuagggaaaaaa

SEQ ID NO: 300607 - RNA, 64 nt, Homo Sapiens
ucaggaggcugaggcaggagaagggugggaacccgggaggcagagcuugcagugagccgagauu

SEQ ID NO: 300608 - RNA, 64 nt, Homo Sapiens
agugaagggauguaucaagugggguggugggagggggaggcaagguuauaugcacuuucucaug

SEQ ID NO: 300609 - RNA, 64 nt, Homo Sapiens
agcugguauguucaguaggaacuguacauguguugggaggcauaaagacuaauuagcaaccaua

SEQ ID NO: 300610 - RNA, 64 nt, Homo Sapiens
ggcgggaggauugcuugaggaauuccaacacuuugggaggcagagugcaauggcucacaccugu

SEQ ID NO: 300611 - RNA, 64 nt, Homo Sapiens
gguugcagugagccaagauuaaucgcuugaaccugggaggcagaucaagaggcugaggcaggag

SEQ ID NO: 300612 - RNA, 64 nt, Homo Sapiens
gcaggcugcagucagucccucaccccagcagcuagggaggcaaagcuggugcccuauuuccagc

SEQ ID NO: 300613 - RNA, 64 nt, Homo Sapiens
cagcggggcgugaugcagugcgggaagaggcagagggaggcagcucugugagugugcgucugua

SEQ ID NO: 300614 - RNA, 64 nt, Homo Sapiens
cacaaacuaggaagacuagcuuuuuuuuuaauuugggaggcaagcauuuuuggcacauaacaac

SEQ ID NO: 300615 - RNA, 64 nt, Homo Sapiens
auuaaugguaccagccuguccuagauauuggucugggaggcaacucauuuauauuuuacaaaug

SEQ ID NO: 300616 - RNA, 64 nt, Homo Sapiens
uggacgcugcagaccccaggcauguggagcgagagggaggcaggcccaggaaaggacggcugag

SEQ ID NO: 300617 - RNA, 64 nt, Homo Sapiens
cacagggaagcucacacaucgggacagcugugccgggaggcagcggggcgcgaugucaaagguc

SEQ ID NO: 300618 - RNA, 64 nt, Homo Sapiens
aucccucccccagcagaauggaggcaggggacaagggaggcaguggcuaguggggugaacagcu

SEQ ID NO: 300619 - RNA, 64 nt, Homo Sapiens
ccucuuugcccccgacggcugugacgcagccggagggaggcacuagucaccgacagcggccuug

SEQ ID NO: 300620 - RNA, 64 nt, Homo Sapiens
gcccuggggcggggggcgugccugucacugccuggggaggcauuugccucuguaccaucgccuu

SEQ ID NO: 300621 - RNA, 64 nt, Homo Sapiens
cgcccccgcucaggugagcccgaaggcaggagccgggaggcacuccucccaaacacuccacuca

SEQ ID NO: 300622 - RNA, 64 nt, Homo Sapiens
gcaugucagaaacggaccuuaaggaagggaggcagggaggcaaauuugugccgguagaauaagg

SEQ ID NO: 300623 - RNA, 64 nt, Homo Sapiens
gaggcaaagcaugucagaaagaauaaggaaggaagggaggcaggaagaucccuuugugccggua

SEQ ID NO: 300624 - RNA, 64 nt, Homo Sapiens
gacuggcagcugccaccccccaugcuggugggaagggaggcaggcuugcuggggaggcagcaag

SEQ ID NO: 300625 - RNA, 64 nt, Homo Sapiens
aagcaugcuggugggaagggggcuuuucuugcuggggaggcagccccucaugaccuaaacucug

SEQ ID NO: 300626 - RNA, 64 nt, Homo Sapiens
ggugagaggauggaauugugccugggccuggcgggggaggcaggaucuuucuuuuaaggcuguu

SEQ ID NO: 300627 - RNA, 64 nt, Homo Sapiens
gacggggggaggggaagccuuugcacgcccggccgggaggcagacccggccccgcaccugccau

SEQ ID NO: 300628 - RNA, 64 nt, Homo Sapiens
ucgggaggcugaggcacaagaaucacuugaacccgggaggcagagguuguagugagcccagauu

SEQ ID NO: 300629 - RNA, 64 nt, Homo Sapiens
agugagcccagauugugccacugcucuccagccugggaggcacagcaaacugucccccaaaaaa

SEQ ID NO: 300630 - RNA, 64 nt, Homo Sapiens
cacgagucugggacucauucgcagaugggggcccgggaggcacagaaguccucuucuggaagcu

SEQ ID NO: 300631 - RNA, 64 nt, Homo Sapiens
auuucugguuucugguuccuuccagacaagagcugggaggcaaggcacucugagguuucuaucu

SEQ ID NO: 300632 - RNA, 64 nt, Homo Sapiens
ugggguugcaggaccgagacacccgcguccaccugggaggcauuuggggagccaauccacccag

SEQ ID NO: 300633 - RNA, 64 nt, Homo Sapiens
gggggccuuguuggcagcuggaagugggucuccagggaggcaguccucugcugaagagggggau

SEQ ID NO: 300634 - RNA, 64 nt, Homo Sapiens
ccacccuccccaccagugcagcccccagaggaccgggaggcaccuggcagcagccccgagggac

SEQ ID NO: 300635 - RNA, 64 nt, Homo Sapiens
ggagcagaaaacccaagggcagguggagaguccagggaggcaggauggaucaccagacaccuaa

SEQ ID NO: 300636 - RNA, 64 nt, Homo Sapiens
augcuuagcaucuacucuguauaacgcaugagaggggaggcaaagaagaaaaagacacacagaa

SEQ ID NO: 300637 - RNA, 64 nt, Homo Sapiens
cguucuucagcccgacuggaggaacagcagcucugggaggcacagagugcaggucucaggggca

SEQ ID NO: 300638 - RNA, 64 nt, Homo Sapiens
aggauucauggaugaaugaaagcuagaccugauggggaggcauuaugacuaaauaggcccagcc

SEQ ID NO: 300639 - RNA, 64 nt, Homo Sapiens
ucucucuggauggaacgggcaugggccucucugggggaggcagggcuggaaugggagaccuguu

SEQ ID NO: 300640 - RNA, 64 nt, Homo Sapiens
uggaauaucuuauauugggcgauuugggggcucggggaggcagagaaucucuugggagucuugg

SEQ ID NO: 300641 - RNA, 64 nt, Homo Sapiens
gcagcaucuuuagaccuagaucugucuaacucuggggaggcacauugacauuuccauuacacac

SEQ ID NO: 300642 - RNA, 64 nt, Homo Sapiens
cagggagcagcugagccauuuguucuugaacucugggaggcagaaguccccgcacccaucaugc

SEQ ID NO: 300643 - RNA, 64 nt, Homo Sapiens
ccuagggcucauggcaugggcccccacugggggagggaggcaucuuguuucuugugguucccug

SEQ ID NO: 300644 - RNA, 64 nt, Homo Sapiens
cagggaguggaaauggggaagggggccuggagaggggaggcaggggccccugugcucucugaac

SEQ ID NO: 300645 - RNA, 64 nt, Homo Sapiens
gccuucagcccuggagugggcagagaguauuguggggaggcauggccagugggacuaguguucc

SEQ ID NO: 300646 - RNA, 64 nt, Homo Sapiens
caggcauggggcuacauuccagugccugacuauagggaggcacuccugauuccauggagcagcc

SEQ ID NO: 300647 - RNA, 64 nt, Homo Sapiens
gcacagggagaugcucagggaaguaguaaacugggggaggcagggcagcagcagcaggauggug

SEQ ID NO: 300648 - RNA, 64 nt, Homo Sapiens
cucacuggccauuuucccuacccuagguggcugggggaggcaggaccuuucccucccaggaguc

SEQ ID NO: 300649 - RNA, 64 nt, Homo Sapiens
uccgccagagcuuuuccacugauuguacucagcggggaggcaggggaggcagaggggcagccuc

SEQ ID NO: 300650 - RNA, 64 nt, Homo Sapiens
gcuuuuccacugauuguacucagcggggaggcaggggaggcagaggggcagccucucuaaugcu

SEQ ID NO: 300651 - RNA, 64 nt, Homo Sapiens
gguugcagugagcugagaucaauggcgggaacccgggaggcagauugguaggcugaggcaggag

SEQ ID NO: 300652 - RNA, 64 nt, Homo Sapiens
ccagaucccugcucaugcguggacacacagcagggggaggcagcaggcccaaggagguugucag

SEQ ID NO: 300653 - RNA, 64 nt, Homo Sapiens
uaccccagggcagcaggcucgcugaccggcuuuggggaggcaggaucucccugccacaggugga

SEQ ID NO: 300654 - RNA, 64 nt, Homo Sapiens
ccugcugccugcccucgaucggccaaaggggcuggggaggcaggcgggugggggcugaggcuga

SEQ ID NO: 300655 - RNA, 64 nt, Homo Sapiens
uggagcccauaggccaccucccaaaugcagggaggggaggcagagggagaaguucuugauucag

SEQ ID NO: 300656 - RNA, 64 nt, Homo Sapiens
agacugggagccacuucuccagacugauaacuuggggaggcaagcugucugcuaggcgcugggg

SEQ ID NO: 300657 - RNA, 64 nt, Homo Sapiens
cagaagccugccacucuuuacugccaccuccccugggaggcacccucuuuauagaagcacauuu

SEQ ID NO: 300658 - RNA, 64 nt, Homo Sapiens
uagagccccccuauuuuaguaggccagggggcuggggaggcaaaugucuacccacccugccucc

SEQ ID NO: 300659 - RNA, 64 nt, Homo Sapiens
cccuguaagcugggugagcuacugaagccaaggugggaggcagcugacaacaccacccacggcc

SEQ ID NO: 300660 - RNA, 64 nt, Homo Sapiens
aggcugggagaccagguccucugugcaugggcccgggaggcagaccugccccaagggugaugca

SEQ ID NO: 300661 - RNA, 64 nt, Homo Sapiens
uucaagauuguuugaaaaaaaaaaaaggggagcagggaggcagaaaguccuggaaaaguaaauu

SEQ ID NO: 300662 - RNA, 64 nt, Homo Sapiens
acugcuguccacaugaccuccugugguaggggcagggaggcaacguggccaaauaggagggaga

SEQ ID NO: 300663 - RNA, 64 nt, Homo Sapiens
uccaggcaggccaggcugccuggccagcucugaggggaggcacccugccugaucccugaacccc

SEQ ID NO: 300664 - RNA, 64 nt, Homo Sapiens
gggcuccuuaaccugaaggcaaauugcuacuugcaagacugacugacuucaaggaaucagaaau

SEQ ID NO: 300665 - RNA, 64 nt, Homo Sapiens
cagccaugauuuugucacugacaucugugagccaaagacugagccuuuuuggcaggaauaauaa

SEQ ID NO: 300666 - RNA, 64 nt, Homo Sapiens
gcauuccaaauuaggcuuaguuauuggccuggguaagacugaaaucagaugaggcaagaaaauu

SEQ ID NO: 300667 - RNA, 64 nt, Homo Sapiens
aaacaguaggaugacaguuuauaguauugcagggaagacugagaugaggaugucugaggaggga

SEQ ID NO: 300668 - RNA, 64 nt, Homo Sapiens
agcacaaaucucuacuccucaugacaugaagaaaaagacugaaugugaagggaguuucuguacu

SEQ ID NO: 300669 - RNA, 64 nt, Homo Sapiens
aaaagccggggucaaaaaaaguaguuuaagucuuaagacugaauaugcauuaaaguaugcaggu

SEQ ID NO: 300670 - RNA, 64 nt, Homo Sapiens
acuuccccacuccacccuacgccugggcagucugaagacugauagacccagcacagggucuugg

SEQ ID NO: 300671 - RNA, 64 nt, Homo Sapiens
cccgccagcuggggugcccauccacauuguaccaaagacugaccgcccccggcacaccaaagug

SEQ ID NO: 300672 - RNA, 64 nt, Homo Sapiens
cugaagaauugacggcucugagggcaauagagggaagacugagguucuucccuauguccaggag

SEQ ID NO: 300673 - RNA, 64 nt, Homo Sapiens
ugcagaggcuggacuuggggggucagccucucccaagacugaaguaagagccucugggcugcag

SEQ ID NO: 300674 - RNA, 64 nt, Homo Sapiens
uuagauauuuugagcuaauaauugcaaaaauuagaagacugaaaauggacccaugagaguauau

SEQ ID NO: 300675 - RNA, 64 nt, Homo Sapiens
ucacugccuuuccuucccacagaccugagugugaaagacugagaguugaggaguuacuuugugg

SEQ ID NO: 300676 - RNA, 64 nt, Homo Sapiens
uuucaugauuuuauuucccagcagugcugaugacaagacugaauguuaccuuuucuuucugaca

SEQ ID NO: 300677 - RNA, 64 nt, Homo Sapiens
accucucauaguagguauauaugaguuuucacagaagacugaaaaauaaugcaugauauuuguu

SEQ ID NO: 300678 - RNA, 64 nt, Homo Sapiens
cggccccauugccuggucuaaguacagacgucucaagacugaaaguugaaucaggggcaaacgg

SEQ ID NO: 300679 - RNA, 64 nt, Homo Sapiens
cccguucgcccccaugugacaacacucaacaauaaagacugagaucaacuuggaaaaagaaaga

SEQ ID NO: 300680 - RNA, 64 nt, Homo Sapiens
gguaacuuucaaaugaggguugaaagauuucauuaagacugaugaucuauauauuuuuucuuuu

SEQ ID NO: 300681 - RNA, 64 nt, Homo Sapiens
guguuaaugaauuuaaugagaugcccgugaagagaagacugaauaagaucuaaagcucuugaaa

SEQ ID NO: 300682 - RNA, 64 nt, Homo Sapiens
cucaugcuuauuuucauggugauugugguuuuacaagacugaagacccagaguauacuuuuucu

SEQ ID NO: 300683 - RNA, 64 nt, Homo Sapiens
acuguggcuucuugugcugcagaagcucguugacaagacugaggaggauuucaagagcaaccaa

SEQ ID NO: 300684 - RNA, 64 nt, Homo Sapiens
auguaucucguguuuaugugcacagugccaaaagaagacugacuggguggaggcucugccuugc

SEQ ID NO: 300685 - RNA, 64 nt, Homo Sapiens
auuuaaaauuguacagaacaaaaaaauaaaaucaaagacugaucuuguacagauauuaguguua

SEQ ID NO: 300686 - RNA, 64 nt, Homo Sapiens
acaguguuuggccaaaaauugauuuguagcgugaaagacugaauugacaagugguaaugacaca

SEQ ID NO: 300687 - RNA, 64 nt, Homo Sapiens
cccugguucagaacaccaucccucuauggacuccaagacugacaucuccuugaugaagccaccg

SEQ ID NO: 300688 - RNA, 64 nt, Homo Sapiens
caagcuugugcuaagauggaccauuucaaaaaaaaagacugaaacugggugacagagcgagacu

SEQ ID NO: 300689 - RNA, 64 nt, Homo Sapiens
caagcaggccagauguggugaagucguuccucuuaagacugaaauuaccugugaaugaacaaug

SEQ ID NO: 300690 - RNA, 64 nt, Homo Sapiens
cuugaaggaaaauacugacuuuaagauguauuuuaagacugaaauuuuguucuuuaguacuuuu

SEQ ID NO: 300691 - RNA, 64 nt, Homo Sapiens
ccuaucacagacaauggaauucgucaguggugguaagacugaaauccugaugcuuuucacacuu

SEQ ID NO: 300692 - RNA, 64 nt, Homo Sapiens
uccaaacaugguuuauuggucaguagucauuuucaagacugaauggaacagugcuacugaaagg

SEQ ID NO: 300693 - RNA, 64 nt, Homo Sapiens
ucaggggucuuaccuugaacgagauuuggggcuaaagacugaucagagggccauugaacucuga

SEQ ID NO: 300694 - RNA, 64 nt, Homo Sapiens
uuccugcaaaggguuaaaaauuuaacugguuuuuacuacugaugacuugauuuaaaaaaaauac

SEQ ID NO: 300695 - RNA, 64 nt, Homo Sapiens
agcguuuuguuguuguuguuuuuucaugccccauacuacugaauaaacuaguucugugcgggua

SEQ ID NO: 300696 - RNA, 64 nt, Homo Sapiens
caaacacuuuuuaaaaaauuguuugcuugaaaauacuacugaauauaaauaagaaugugcacag

SEQ ID NO: 300697 - RNA, 64 nt, Homo Sapiens
agaacucuucaaaaugggcucuucuaaugaggucacuacugaacaaaauuguucccucuucugu

SEQ ID NO: 300698 - RNA, 64 nt, Homo Sapiens
cacugggugaccagcuggcagacucgggaccaauacuacugacguccucccugaucccaccccc

SEQ ID NO: 300699 - RNA, 64 nt, Homo Sapiens
gagccacagucacuggauugacuuugcugucaaaacuacugacagggagcagcccccgggccgc

SEQ ID NO: 300700 - RNA, 64 nt, Homo Sapiens
uuuaucaaauaccuuuuaaguacuacugaaaaugacuacugaauauuuccuauccauuuauagc

SEQ ID NO: 300701 - RNA, 64 nt, Homo Sapiens
augacuacugaauuuuaucaauccauuuauagcuacuacugaaaccuuuuuaagccuauuuccu

SEQ ID NO: 300702 - RNA, 64 nt, Homo Sapiens
gcauuuaaauaaaaaccucagcuucugcccuaugaccacugagucuucgccccagcuagcuuga

SEQ ID NO: 300703 - RNA, 64 nt, Homo Sapiens
ucuccucaccaugcccuuccgaugguaauucuucaccacugaucagucucagccacucugcuuu

SEQ ID NO: 300704 - RNA, 64 nt, Homo Sapiens
ccacuaguguauaagugaucacuggaacggagugaccacugagaugcugggggucacugggccu

SEQ ID NO: 300705 - RNA, 64 nt, Homo Sapiens
ugccuggaacagggugauuugcuggaauggaguuaccacugagaugccaaagguugcugggucu

SEQ ID NO: 300706 - RNA, 64 nt, Homo Sapiens
gguaguaaugguuuucugugaggauagaagaucaaccacugacuauauugcagauaaguagaua

SEQ ID NO: 300707 - RNA, 64 nt, Homo Sapiens
gcaaaucucucuccaaaauuauuuuguauaaagcaccacugauauuauguuaucagauuaugcu

SEQ ID NO: 300708 - RNA, 64 nt, Homo Sapiens
aacacacaaaauaccaaaggaacuuacgcaacacaccacugaguccucuaacuaaucauaugug

SEQ ID NO: 300709 - RNA, 64 nt, Homo Sapiens
gguuuguacucucacuuaugucacuguuuauaccaccacugacugcugccugcuuuauuauuuc

SEQ ID NO: 300710 - RNA, 64 nt, Homo Sapiens
cacucuuccuucucccucuccccgucccaucccaaccacugaucugcucaggcaacuaccaauc

SEQ ID NO: 300711 - RNA, 64 nt, Homo Sapiens
gggugacuuguguuuuuagguauuuaaauaauaaaauuucaagggauaguuuuuauucaaugua

SEQ ID NO: 300712 - RNA, 64 nt, Homo Sapiens
acucuagacaaaaccuucuauuuuagcuuuagugaauuucaaaaguaaugggucuuggaguaua

SEQ ID NO: 300713 - RNA, 64 nt, Homo Sapiens
caagugcaauauaacaauguaaccaaaucuagauaauuucaaaguugucauuaauuuaguaagc

SEQ ID NO: 300714 - RNA, 64 nt, Homo Sapiens
aaaguaaacauggcguuuuaacuuuucaucagaaaauuucaaacggaauguuaaguuacaaaag

SEQ ID NO: 300715 - RNA, 64 nt, Homo Sapiens
uagaaucacucuaugcuuaguuucuacuauggauaauuucaaaguuaauuagugacacuccuaa

SEQ ID NO: 300716 - RNA, 64 nt, Homo Sapiens
auaagugcaauguaaauaauuauguaaaagagauaauuucaagcaaaauaagguaagaaguaaa

SEQ ID NO: 300717 - RNA, 64 nt, Homo Sapiens
uauugguacauuuuauagguaauccaucauuuuuaauuucaagagacaucugagaacacagaau

SEQ ID NO: 300718 - RNA, 64 nt, Homo Sapiens
aaaaugacacagaacuauauacacacauuguaccaauuucaauuuccugguuuugacauuauag

SEQ ID NO: 300719 - RNA, 64 nt, Homo Sapiens
guaccaucuuuguaacuuccugugaauuuauaauaauuucaaaauaaaacaaguuaaaaaaaaa

SEQ ID NO: 300720 - RNA, 64 nt, Homo Sapiens
uaauuugggaauuuguuguguugaaauggcauuuaauuucaaccuaaauacugacugcuggaca

SEQ ID NO: 300721 - RNA, 64 nt, Homo Sapiens
uacuaaauauauauuaugcaagucaggaaucauuaauuucaaaauuuaaagccaugcuaaaauu

SEQ ID NO: 300722 - RNA, 64 nt, Homo Sapiens
cuucuuuuagucagaaaugauuauuauccuucacaauuucaauggggauuuguugaaaucuuuu

SEQ ID NO: 300723 - RNA, 64 nt, Homo Sapiens
auguuucaguuauagagguaacaagccugaaaguaauuucaagaauuugcguaaaugguuuuca

SEQ ID NO: 300724 - RNA, 64 nt, Homo Sapiens
uucaguaauuuaguggaaaaacagucaacauaaaaauuucaauucauuggcuuuucagucauca

SEQ ID NO: 300725 - RNA, 64 nt, Homo Sapiens
ugucaguauagaggcucuaccuaagcagaaaguaaauuucaauauguuuacauaacagaaaagg

SEQ ID NO: 300726 - RNA, 64 nt, Homo Sapiens
gacgggaguauucuguuggugugcucuuaauggaaauuucaaagcugguauaauuacccccauu

SEQ ID NO: 300727 - RNA, 64 nt, Homo Sapiens
uuuaauuaauauaauuaaaaucucuuugcauuaaaauuucaaagcagcgucacaagccagcaac

SEQ ID NO: 300728 - RNA, 64 nt, Homo Sapiens
gaauauugaaagguuuuaaaaauucauauuuauuaauuucaaggaaguuuugugcauuaaucuu

SEQ ID NO: 300729 - RNA, 64 nt, Homo Sapiens
gcuuuuuuauaucuaaaaauuguguauguacuuuaauuucaaauaaagagaauuagaaguuaac

SEQ ID NO: 300730 - RNA, 64 nt, Homo Sapiens
uggagguugaauauccuacuguguaacaggucagaauuucaagcucuggguaauaacugcugau

SEQ ID NO: 300731 - RNA, 64 nt, Homo Sapiens
caagcucuggguaauaacugcugauauuuuuucuaauuucaaauuuaccucuuuuggcuauguc

SEQ ID NO: 300732 - RNA, 64 nt, Homo Sapiens
uagaaaaaaaaaaacuguguauuuagguaacuagaauuucaaaauauuuauccaacuacuguau

SEQ ID NO: 300733 - RNA, 64 nt, Homo Sapiens
aauggaaguuguagaucaaugaagacuucucuauaauuucaauuaaaucuuuaauuaaaacagu

SEQ ID NO: 300734 - RNA, 64 nt, Homo Sapiens
auuguuuauuguuuugacuauucucaacuuuuuuaauuucaaaagaaaaaaaugaauuucaaga

SEQ ID NO: 300735 - RNA, 64 nt, Homo Sapiens
uucucaacuuuuuuaauuucuacugaaaaaaaugaauuucaagaugcugcuuauuguuuuauuc

SEQ ID NO: 300736 - RNA, 64 nt, Homo Sapiens
cugcaugucaggauugcacaguauguuacaauacaauuucaaagagaacccacauuugugagau

SEQ ID NO: 300737 - RNA, 64 nt, Homo Sapiens
uucuacugccaaacuucuggcaaauuuaccugugaauuucaaaauguuauaaaaucucuugaua

SEQ ID NO: 300738 - RNA, 64 nt, Homo Sapiens
accaucuucagguaugggauuucugaacguuucaaauuucaaucaaugagcacugucaacaccc

SEQ ID NO: 300739 - RNA, 64 nt, Homo Sapiens
cuuuuguuucaaaauauuauauuauuucauaaauaauuucaagcaaauacagacauccacaaug

SEQ ID NO: 300740 - RNA, 64 nt, Homo Sapiens
uguaauuuuaucuacauuauugaaauaaaaucagaauuucaaccccucgguuuauuuaucauuu

SEQ ID NO: 300741 - RNA, 64 nt, Homo Sapiens
gcccugcagacauaguaccuuggacuguuucuuuaauuucaaaagggucugacuggagcccucc

SEQ ID NO: 300742 - RNA, 64 nt, Homo Sapiens
uccucaccacuccuucauuuaaaacaaugggaacaauuucaaggccauguccaagcccagagag

SEQ ID NO: 300743 - RNA, 64 nt, Homo Sapiens
aaggggaccuccagcuaaaucccacaccagcauuaauuucaauguggguuuccaggguuggcag

SEQ ID NO: 300744 - RNA, 64 nt, Homo Sapiens
ccagcauuugacaugcauuuuaacuuuuugguucaauuucaagucugcuguggcuaauaguggu

SEQ ID NO: 300745 - RNA, 64 nt, Homo Sapiens
agccucuggauggcuggcugccuuaaacacaaucaauuucaaagcuccauuucauaaaggggcu

SEQ ID NO: 300746 - RNA, 64 nt, Homo Sapiens
auugaaauguuugauauggcaagauagguaugguaauuucaaagugaauugggaauuccucugg

SEQ ID NO: 300747 - RNA, 64 nt, Homo Sapiens
guauucuugagauacaaaaaaaaaaaguaaauacaauuucaaaaaaaaaguuccggaucuguuu

SEQ ID NO: 300748 - RNA, 64 nt, Homo Sapiens
uuccugcacuucgagaagaaucaaaauguuccugaauuucaaauaccucaugcaaaaugucucc

SEQ ID NO: 300749 - RNA, 64 nt, Homo Sapiens
uacaauguacaauuguuucauuucagaaaauaaaaauuucaaaucaugaauaccuugugguuuu

SEQ ID NO: 300750 - RNA, 64 nt, Homo Sapiens
auaucacauccucuugaaaaugaauugucuacaaaauuucaaaugcaaaguauuacagccaaau

SEQ ID NO: 300751 - RNA, 64 nt, Homo Sapiens
aacuaugagucucuaaaucucucuguaagaaaaaaauuucaaaguaaagauuuuacucuugcaa

SEQ ID NO: 300752 - RNA, 64 nt, Homo Sapiens
ucauuuucuccuuuuuucggaauugaaacauuuuaauuucaaauucaaauagaacauuuaaaau

SEQ ID NO: 300753 - RNA, 64 nt, Homo Sapiens
auauuuagaaaauaauaaugaaaagcauccccaaaauuucaaugaugugaauuuuuaaauuacc

SEQ ID NO: 300754 - RNA, 64 nt, Homo Sapiens
gaauccggcaaaguuuuugacuggaaaaagaucgaauuucaaaacagauauuacuaauuucaau

SEQ ID NO: 300755 - RNA, 64 nt, Homo Sapiens
uggaaaaagguuagacauuucuacagauauuacuaauuucaauccagugaugaugaagaaacuu

SEQ ID NO: 300756 - RNA, 64 nt, Homo Sapiens
auuaaaauuuuucauuauuauuucaaguucuuaaaauuucaaaaugucauuaccagcaucugaa

SEQ ID NO: 300757 - RNA, 64 nt, Homo Sapiens
ucuuaaaauuucaaaaauuaauuaccagcaucugaauuucaagucucuuuuuuauucugguguc

SEQ ID NO: 300758 - RNA, 64 nt, Homo Sapiens
uaaaaaguuguuccuuucaucuggauucugaugcaauuucaauagaaguuauaacuuugcuacc

SEQ ID NO: 300759 - RNA, 64 nt, Homo Sapiens
uaauucauugucaacaaaacggauuguucuaaacaauuucaauuuuccuuccccaccaaaauug

SEQ ID NO: 300760 - RNA, 64 nt, Homo Sapiens
auagugucaugcagaguauuaaaacuuagcaucuaauuucaauuguguucagccacugagggac

SEQ ID NO: 300761 - RNA, 64 nt, Homo Sapiens
ccugccuuuggcacucugacaaugccaaagaaugaauuucaacggcucuggucuauaccuuaag

SEQ ID NO: 300762 - RNA, 64 nt, Homo Sapiens
gggcucgugacccaaaaaagauaauguucugcuaaauuucaaauccuuucuggggagauagucc

SEQ ID NO: 300763 - RNA, 64 nt, Homo Sapiens; identical to SEQ ID NO: 165047

SEQ ID NO: 300764 - RNA, 64 nt, Homo Sapiens; identical to SEQ ID NO: 165048

SEQ ID NO: 300765 - RNA, 64 nt, Homo Sapiens; identical to SEQ ID NO: 165049

SEQ ID NO: 300766 - RNA, 64 nt, Homo Sapiens; identical to SEQ ID NO: 165050

SEQ ID NO: 300767 - RNA, 64 nt, Homo Sapiens; identical to SEQ ID NO: 165051

SEQ ID NO: 300768 - RNA, 64 nt, Homo Sapiens; identical to SEQ ID NO: 165052

SEQ ID NO: 300769 - RNA, 64 nt, Homo Sapiens; identical to SEQ ID NO: 165053

SEQ ID NO: 300770 - RNA, 64 nt, Homo Sapiens; identical to SEQ ID NO: 165054

SEQ ID NO: 300771 - RNA, 64 nt, Homo Sapiens; identical to SEQ ID NO: 165055

SEQ ID NO: 300772 - RNA, 64 nt, Homo Sapiens; identical to SEQ ID NO: 165056

SEQ ID NO: 300773 - RNA, 64 nt, Homo Sapiens; identical to SEQ ID NO: 165057

SEQ ID NO: 300774 - RNA, 64 nt, Homo Sapiens; identical to SEQ ID NO: 165058

SEQ ID NO: 300775 - RNA, 64 nt, Homo Sapiens; identical to SEQ ID NO: 165059

SEQ ID NO: 300776 - RNA, 64 nt, Homo Sapiens; identical to SEQ ID NO: 165060

SEQ ID NO: 300777 - RNA, 64 nt, Homo Sapiens; identical to SEQ ID NO: 165061

SEQ ID NO: 300778 - RNA, 64 nt, Homo Sapiens; identical to SEQ ID NO: 165062

SEQ ID NO: 300779 - RNA, 63 nt, Homo Sapiens
cuauccuuccaagucccggguagcagaaggguugccauagaucucaguuugaucaaaaagaag

SEQ ID NO: 300780 - RNA, 63 nt, Homo Sapiens
aaacauuucgauuuuccuucaucugugacuggugccauagacacagguuuauaguuuuaacuu

SEQ ID NO: 300781 - RNA, 63 nt, Homo Sapiens
acacuucugcuuugagaccaggaugggguguaagccauagaguaagguuaacaaaaagaauaa

SEQ ID NO: 300782 - RNA, 63 nt, Homo Sapiens
ucugcucgcuguucucccguuguuuuugccucugccauagagcucaccucauuuugccuugua

SEQ ID NO: 300783 - RNA, 63 nt, Homo Sapiens
aucagaacugcagccccuggaaaagaagagacagccauagacgaggagccagagugggggcag

SEQ ID NO: 300784 - RNA, 63 nt, Homo Sapiens
cccugaagagccuguccaugucauuuuccuacugccauagauacccuaagcccagggccccuu

SEQ ID NO: 300785 - RNA, 63 nt, Homo Sapiens
uggcagauuaagaagauugacacuggguacucugccauagaaaacacaccaaacaagauguuu

SEQ ID NO: 300786 - RNA, 63 nt, Homo Sapiens
gagaaacaaagcucaggguuugauauguauuuagccauagaugaccuuuuuauuugguuagag

SEQ ID NO: 300787 - RNA, 63 nt, Homo Sapiens
aauguaaauagaggucuguaaagaaaaauaauugccauagaaaguauaauuucagugcaguaa

SEQ ID NO: 300788 - RNA, 63 nt, Homo Sapiens
cauaucuggaagggcacuauauuuuugggaggagccauagauuccugguuauccuauuuuuaa

SEQ ID NO: 300789 - RNA, 64 nt, Homo Sapiens
gaacuaaccuaccccaacucugcccuucucccauccaagagaaaccagcaaaaugauaaagaag

SEQ ID NO: 300790 - RNA, 64 nt, Homo Sapiens
gaaaauuaauuucaguuucuauugggaguuuauaccaagagauucuucuagaucucauugaucc

SEQ ID NO: 300791 - RNA, 64 nt, Homo Sapiens
cagcacuucccaaagugcacugaggaagguggccccaagagaagcucucuaaacaaaggaguac

SEQ ID NO: 300792 - RNA, 64 nt, Homo Sapiens
uacagcaguuuuugucaggggaacauaaaaauauccaagagagguuagggcuuagauuuaaaag

SEQ ID NO: 300793 - RNA, 64 nt, Homo Sapiens
aaaaguuguagcuaaauguuuuuugaugcuggacccaagagaggauguucaugaauaucaaauc

SEQ ID NO: 300794 - RNA, 64 nt, Homo Sapiens
cuuggauucagugguacacuggcacauaggcuacccaagagagcuguucacauaccauccaaga

SEQ ID NO: 300795 - RNA, 64 nt, Homo Sapiens
auagaaaggcugcuuuagugugauaacuaggucuccaagagaaacaaauuuguucuuccugaua

SEQ ID NO: 300796 - RNA, 64 nt, Homo Sapiens
aauccucacuuauuaacucugacaguagcugucuccaagagaaagaccuccaguucucccugau

SEQ ID NO: 300797 - RNA, 64 nt, Homo Sapiens
uggaaaucuucucgcuccagcaagcucgaccaugccaagagacuggccgggacaagauaaacgg

SEQ ID NO: 300798 - RNA, 64 nt, Homo Sapiens
ccuauggcggcccugagugugaguaucccugccaccaagagagcaaugggcagggaaggaaggg

SEQ ID NO: 300799 - RNA, 64 nt, Homo Sapiens
auagaagaacauccaaggagaaacagagacaggcccaagagaugaagagugagagggcaugcgc

SEQ ID NO: 300800 - RNA, 64 nt, Homo Sapiens
gaugaagagugagagggcaugcgcacaaggcugaccaagagagaaagaaguaggcaugagggau

SEQ ID NO: 300801 - RNA, 64 nt, Homo Sapiens
gggacuucucuuccaguuucaaaaaaaagaauuaccaagagaagauaucccagcuuuaaaaaga

SEQ ID NO: 300802 - RNA, 64 nt, Homo Sapiens
ggcuuacaggcauggacaugccuuucuuccuuggccaagagaagggguuucuuuuuucuuucuu

SEQ ID NO: 300803 - RNA, 64 nt, Homo Sapiens
ucugcaguccaggucucccuucucccacuugccuacccucaaugccacacuguuuuugaagugg

SEQ ID NO: 300804 - RNA, 64 nt, Homo Sapiens
uccccacuuuauuaguuaauuuaaauuggaaaaaacccucaaacuaauauucuugucuguucca

SEQ ID NO: 300805 - RNA, 64 nt, Homo Sapiens
cuaguuuugaaucuguucugaauggaguuuuuauacccucaauuucuggccuuuggcuauuuua

SEQ ID NO: 300806 - RNA, 64 nt, Homo Sapiens
ugagagcaguccucucacccuaccacaguuccacacccucaagguaaacuuauaacuuauaauu

SEQ ID NO: 300807 - RNA, 64 nt, Homo Sapiens
cagaucaaaaaugggcagccuugacaaauaaguuacccucaacuuuaaaccuguuaaauuaauu

SEQ ID NO: 300808 - RNA, 64 nt, Homo Sapiens
ccaagaaacgugucccuggcugcuuucauugaagacccucaaugugucgaucuuagauugccac

SEQ ID NO: 300809 - RNA, 64 nt, Homo Sapiens
gagagaucaccggcguucuguugauuccagaaauacccucaaugaucuccugaagcaucugaau

SEQ ID NO: 300810 - RNA, 64 nt, Homo Sapiens
uuguaucuuuuuuaaugguacggcauaaaaaguaacccucaagugaagugucucuauacuguuu

SEQ ID NO: 300811 - RNA, 64 nt, Homo Sapiens
ggacauuaccaccaaccccacagaaauacgaaaaacccucaaagauuacuauaaacaccuguau

SEQ ID NO: 300812 - RNA, 64 nt, Homo Sapiens
uuuuaauaaaauucaacaucccuucauuuuaaaaacccucaacaaauuacacauugagggaaca

SEQ ID NO: 300813 - RNA, 64 nt, Homo Sapiens
ccucaccuugcugcuccccugcccuaaguccccaacccucaacuugaaaccccauucccuuaag

SEQ ID NO: 300814 - RNA, 64 nt, Homo Sapiens
ucacuccaucccucuccuaccccucccucccccaacccucaauguauaaauugcuucuugaugc

SEQ ID NO: 300815 - RNA, 64 nt, Homo Sapiens; identical to SEQ ID NO: 198310

SEQ ID NO: 300816 - RNA, 64 nt, Homo Sapiens; identical to SEQ ID NO: 198311

SEQ ID NO: 300817 - RNA, 64 nt, Homo Sapiens; identical to SEQ ID NO: 198312

SEQ ID NO: 300818 - RNA, 64 nt, Homo Sapiens; identical to SEQ ID NO: 198313

SEQ ID NO: 300819 - RNA, 64 nt, Homo Sapiens; identical to SEQ ID NO: 198314

SEQ ID NO: 300820 - RNA, 64 nt, Homo Sapiens; identical to SEQ ID NO: 198315

SEQ ID NO: 300821 - RNA, 64 nt, Homo Sapiens; identical to SEQ ID NO: 198316

SEQ ID NO: 300822 - RNA, 64 nt, Homo Sapiens; identical to SEQ ID NO: 198317

SEQ ID NO: 300823 - RNA, 64 nt, Homo Sapiens; identical to SEQ ID NO: 198318

SEQ ID NO: 300824 - RNA, 64 nt, Homo Sapiens; identical to SEQ ID NO: 198319

SEQ ID NO: 300825 - RNA, 64 nt, Homo Sapiens; identical to SEQ ID NO: 198320

SEQ ID NO: 300826 - RNA, 64 nt, Homo Sapiens; identical to SEQ ID NO: 198321

SEQ ID NO: 300827 - RNA, 64 nt, Homo Sapiens; identical to SEQ ID NO: 198322

SEQ ID NO: 300828 - RNA, 64 nt, Homo Sapiens; identical to SEQ ID NO: 198323

SEQ ID NO: 300829 - RNA, 64 nt, Homo Sapiens; identical to SEQ ID NO: 198324

SEQ ID NO: 300830 - RNA, 64 nt, Homo Sapiens; identical to SEQ ID NO: 198325

SEQ ID NO: 300831 - RNA, 64 nt, Homo Sapiens; identical to SEQ ID NO: 198326

SEQ ID NO: 300832 - RNA, 64 nt, Homo Sapiens; identical to SEQ ID NO: 198327

SEQ ID NO: 300833 - RNA, 64 nt, Homo Sapiens; identical to SEQ ID NO: 198328

SEQ ID NO: 300834 - RNA, 64 nt, Homo Sapiens; identical to SEQ ID NO: 198329

SEQ ID NO: 300835 - RNA, 64 nt, Homo Sapiens; identical to SEQ ID NO: 198330

SEQ ID NO: 300836 - RNA, 64 nt, Homo Sapiens; identical to SEQ ID NO: 198331

SEQ ID NO: 300837 - RNA, 64 nt, Homo Sapiens
uugcauaaaagcagagguuugggggcucagaugggacaagaagccgccucuggacuaucucccc

SEQ ID NO: 300838 - RNA, 64 nt, Homo Sapiens
ggaugcugcuggcuagagaugaggcuuuaccucagacaagaagagcuggcaccaaaacuagcca

SEQ ID NO: 300839 - RNA, 64 nt, Homo Sapiens
ccuggccucccaggccaccaaggacggcaagaaggacaagaaggaggaagacaagaagugagac

SEQ ID NO: 300840 - RNA, 64 nt, Homo Sapiens
caccaaggacggcaagaaggacaagaaggaggaagacaagaagugagacuggagggaaagggua

SEQ ID NO: 300841 - RNA, 64 nt, Homo Sapiens
uugaucaauuuuaacuacauaaaaauguuuauaggacaagaaaaaccccaccauaacccaaggc

SEQ ID NO: 300842 - RNA, 64 nt, Homo Sapiens
augccuguaacuccagcuacucgggagacugaaggacaagaaucacuugaaccugggaagccga

SEQ ID NO: 300843 - RNA, 64 nt, Homo Sapiens
gucuuuggccauugugggaagucauuauucuggagacaagaaaaucaucacucuggugccuugg

SEQ ID NO: 300844 - RNA, 64 nt, Homo Sapiens
aagcugacuuuucuugccagaaaguuuuccuugugacaagaaauuugcaagcuuuucaaucuca

SEQ ID NO: 300845 - RNA, 64 nt, Homo Sapiens
aacugauucuaaccagaaguccgcaaguacuguggacaagaaugcuuaaccaugcugcuucagc

SEQ ID NO: 300846 - RNA, 64 nt, Homo Sapiens
gacagggaugaggguccaaggaauaagcaugaaugacaagaaaacaagggaaagaguuaaccug

SEQ ID NO: 300847 - RNA, 64 nt, Homo Sapiens
uuauccuuaugaccucaucacccucagacuuuaagacaagaagccaccaucaaaacaaaggaug

SEQ ID NO: 300848 - RNA, 64 nt, Homo Sapiens
uccuacuuuuuagacaggacagauacucucaacagacaagaaaaaagauuuagcuuaucacaag

SEQ ID NO: 300849 - RNA, 64 nt, Homo Sapiens
uauguguaaguccucaucaaaugaaaagcagaaagacaagaacaauuagucaagagcaguagcc

SEQ ID NO: 300850 - RNA, 64 nt, Homo Sapiens
acgugaguuucuuaugugcccuuaaagacuguuagacaagaaaagcauucacuggcuaauaauc

SEQ ID NO: 300851 - RNA, 64 nt, Homo Sapiens
ucccucuuccuccaugggauugacugcaaaaggggacaagaaaaucuccagugacaguguccug

SEQ ID NO: 300852 - RNA, 64 nt, Homo Sapiens
aacccaugacagcaccugcuggcuugacuggguggacaagaaugcauauaggcccguccacaca

SEQ ID NO: 300853 - RNA, 64 nt, Homo Sapiens
gcucacacacaguucagauuuccaccucuuuauagacaagaagugaauuugccuggggcagaac

SEQ ID NO: 300854 - RNA, 64 nt, Homo Sapiens
gaaggaagaagaaaaaaggauccuugauguuugugacaagaaaaugagaaaguuaguaucugca

SEQ ID NO: 300855 - RNA, 64 nt, Homo Sapiens; identical to SEQ ID NO: 54296

SEQ ID NO: 300856 - RNA, 64 nt, Homo Sapiens; identical to SEQ ID NO: 54297

SEQ ID NO: 300857 - RNA, 64 nt, Homo Sapiens; identical to SEQ ID NO: 54298

SEQ ID NO: 300858 - RNA, 64 nt, Homo Sapiens; identical to SEQ ID NO: 54299

SEQ ID NO: 300859 - RNA, 64 nt, Homo Sapiens; identical to SEQ ID NO: 54300

SEQ ID NO: 300860 - RNA, 64 nt, Homo Sapiens; identical to SEQ ID NO: 54301

SEQ ID NO: 300861 - RNA, 64 nt, Homo Sapiens; identical to SEQ ID NO: 54302

SEQ ID NO: 300862 - RNA, 64 nt, Homo Sapiens; identical to SEQ ID NO: 54303

SEQ ID NO: 300863 - RNA, 64 nt, Homo Sapiens; identical to SEQ ID NO: 54304

SEQ ID NO: 300864 - RNA, 64 nt, Homo Sapiens; identical to SEQ ID NO: 54305

SEQ ID NO: 300865 - RNA, 64 nt, Homo Sapiens; identical to SEQ ID NO: 54306

SEQ ID NO: 300866 - RNA, 64 nt, Homo Sapiens; identical to SEQ ID NO: 54307

SEQ ID NO: 300867 - RNA, 64 nt, Homo Sapiens; identical to SEQ ID NO: 54308

SEQ ID NO: 300868 - RNA, 64 nt, Homo Sapiens; identical to SEQ ID NO: 54309

SEQ ID NO: 300869 - RNA, 64 nt, Homo Sapiens; identical to SEQ ID NO: 54310

SEQ ID NO: 300870 - RNA, 64 nt, Homo Sapiens; identical to SEQ ID NO: 54311

SEQ ID NO: 300871 - RNA, 64 nt, Homo Sapiens; identical to SEQ ID NO: 54312

SEQ ID NO: 300872 - RNA, 64 nt, Homo Sapiens; identical to SEQ ID NO: 54313

SEQ ID NO: 300873 - RNA, 64 nt, Homo Sapiens; identical to SEQ ID NO: 54314

SEQ ID NO: 300874 - RNA, 64 nt, Homo Sapiens; identical to SEQ ID NO: 54315

SEQ ID NO: 300875 - RNA, 64 nt, Homo Sapiens; identical to SEQ ID NO: 54316

SEQ ID NO: 300876 - RNA, 64 nt, Homo Sapiens; identical to SEQ ID NO: 54317

SEQ ID NO: 300877 - RNA, 64 nt, Homo Sapiens; identical to SEQ ID NO: 54318

SEQ ID NO: 300878 - RNA, 64 nt, Homo Sapiens; identical to SEQ ID NO: 54319

SEQ ID NO: 300879 - RNA, 64 nt, Homo Sapiens; identical to SEQ ID NO: 54320

SEQ ID NO: 300880 - RNA, 64 nt, Homo Sapiens; identical to SEQ ID NO: 54321

SEQ ID NO: 300881 - RNA, 64 nt, Homo Sapiens; identical to SEQ ID NO: 54322

SEQ ID NO: 300882 - RNA, 64 nt, Homo Sapiens; identical to SEQ ID NO: 54323

SEQ ID NO: 300883 - RNA, 64 nt, Homo Sapiens; identical to SEQ ID NO: 54324

SEQ ID NO: 300884 - RNA, 64 nt, Homo Sapiens; identical to SEQ ID NO: 54324

SEQ ID NO: 300885 - RNA, 64 nt, Homo Sapiens; identical to SEQ ID NO: 54326

SEQ ID NO: 300886 - RNA, 64 nt, Homo Sapiens; identical to SEQ ID NO: 54327

SEQ ID NO: 300887 - RNA, 64 nt, Homo Sapiens; identical to SEQ ID NO: 250961

SEQ ID NO: 300888 - RNA, 64 nt, Homo Sapiens; identical to SEQ ID NO: 250962

SEQ ID NO: 300889 - RNA, 64 nt, Homo Sapiens; identical to SEQ ID NO: 250963

SEQ ID NO: 300890 - RNA, 64 nt, Homo Sapiens; identical to SEQ ID NO: 250964

SEQ ID NO: 300891 - RNA, 64 nt, Homo Sapiens; identical to SEQ ID NO: 250965

SEQ ID NO: 300892 - RNA, 64 nt, Homo Sapiens; identical to SEQ ID NO: 250966

SEQ ID NO: 300893 - RNA, 64 nt, Homo Sapiens; identical to SEQ ID NO: 250967

SEQ ID NO: 300894 - RNA, 64 nt, Homo Sapiens; identical to SEQ ID NO: 250968

SEQ ID NO: 300895 - RNA, 64 nt, Homo Sapiens; identical to SEQ ID NO: 250969

SEQ ID NO: 300896 - RNA, 64 nt, Homo Sapiens; identical to SEQ ID NO: 250970

SEQ ID NO: 300897 - RNA, 64 nt, Homo Sapiens; identical to SEQ ID NO: 250971

SEQ ID NO: 300898 - RNA, 64 nt, Homo Sapiens; identical to SEQ ID NO: 250972

SEQ ID NO: 300899 - RNA, 64 nt, Homo Sapiens; identical to SEQ ID NO: 250973

SEQ ID NO: 300900 - RNA, 64 nt, Homo Sapiens; identical to SEQ ID NO: 250974

SEQ ID NO: 300901 - RNA, 64 nt, Homo Sapiens; identical to SEQ ID NO: 250975

SEQ ID NO: 300902 - RNA, 64 nt, Homo Sapiens; identical to SEQ ID NO: 250976

SEQ ID NO: 300903 - RNA, 64 nt, Homo Sapiens; identical to SEQ ID NO: 250977

SEQ ID NO: 300904 - RNA, 64 nt, Homo Sapiens; identical to SEQ ID NO: 250978

SEQ ID NO: 300905 - RNA, 64 nt, Homo Sapiens; identical to SEQ ID NO: 250979

SEQ ID NO: 300906 - RNA, 64 nt, Homo Sapiens; identical to SEQ ID NO: 250980

SEQ ID NO: 300907 - RNA, 64 nt, Homo Sapiens; identical to SEQ ID NO: 250981

SEQ ID NO: 300908 - RNA, 64 nt, Homo Sapiens; identical to SEQ ID NO: 250982

SEQ ID NO: 300909 - RNA, 64 nt, Homo Sapiens; identical to SEQ ID NO: 250983

SEQ ID NO: 300910 - RNA, 64 nt, Homo Sapiens; identical to SEQ ID NO: 250984

SEQ ID NO: 300911 - RNA, 64 nt, Homo Sapiens; identical to SEQ ID NO: 250985

SEQ ID NO: 300912 - RNA, 64 nt, Homo Sapiens; identical to SEQ ID NO: 250986

SEQ ID NO: 300913 - RNA, 64 nt, Homo Sapiens
ugagaaggcacaccguaagacuaaguaggaaaaauccaaguaaggaguguuucugagacuuuga

SEQ ID NO: 300914 - RNA, 64 nt, Homo Sapiens
cuuucuuggcccucaguuugcaguauacacacuuuccaaguacucuuguagcauccuguuugua

SEQ ID NO: 300915 - RNA, 64 nt, Homo Sapiens
gaaucaaacaaaaggaaauguuguggaauauuuuuccaaguaguuuugguucacuauucacagg

SEQ ID NO: 300916 - RNA, 64 nt, Homo Sapiens
aaaacaguaaaugaacaaaaacaucaacauggaguccaaguaaugaauuuauagaggaaaaugu

SEQ ID NO: 300917 - RNA, 64 nt, Homo Sapiens
ugagaaaaggacagagcucuagacacuacaugacuccaaguauaagaacguuguggauugagag

SEQ ID NO: 300918 - RNA, 64 nt, Homo Sapiens
uuuuuuuuuuuaauuuuuaauagcacuuauucauuccaaguacuccuacuuaggaaaaaaaggg

SEQ ID NO: 300919 - RNA, 64 nt, Homo Sapiens
auguuuccuuuuacaaucaauuucuacuaaaauguccaaguagagagcuccuucccucuagcaa

SEQ ID NO: 300920 - RNA, 64 nt, Homo Sapiens
auguacgccaggagcuccuuuaucuucucuucuauccaaguagaguccaguucuccuccugugc

SEQ ID NO: 300921 - RNA, 64 nt, Homo Sapiens
uucuuggaguucuuuggcuucuggacaaaucuuguccaaguauugcagacagcaaucuucacuc

SEQ ID NO: 300922 - RNA, 64 nt, Homo Sapiens
ggagacccuuaauuauguuuacaaagacccauguuccaaguaaguuuguauucacaugaucuga

SEQ ID NO: 300923 - RNA, 64 nt, Homo Sapiens
uuuaucuguucaaaggagcaagaacuuucauauaggaauagaaacaugcuggccgaagauuuca

SEQ ID NO: 300924 - RNA, 64 nt, Homo Sapiens
uauuuggcaacuacugggacucuucagcacaaaaggaauagaucuaugauugacccugauuuua

SEQ ID NO: 300925 - RNA, 64 nt, Homo Sapiens
aaaucaaaaggcugccucuauuacaauccucaguggaauagauggcuaucuuucuuggcuaaca

SEQ ID NO: 300926 - RNA, 64 nt, Homo Sapiens
uuuuaaagcugugacauuuaucuaccugguuuauggaauagaauuuauugcugaaucaugcucc

SEQ ID NO: 300927 - RNA, 64 nt, Homo Sapiens
uggccaggcccccagcgacuccaugcuuaguacuggaauagaggucuccuggccaaggcucuga

SEQ ID NO: 300928 - RNA, 64 nt, Homo Sapiens
cuuucaaagagguugcccagggcauggggaacagggaauagaacuccagucaguuuuuaagcaa

SEQ ID NO: 300929 - RNA, 64 nt, Homo Sapiens
uuacuuaaaaauuggggagagauggguagcaaauggaauagaacaauuuguguucauaaguuca

SEQ ID NO: 300930 - RNA, 64 nt, Homo Sapiens
uugaacuguaauaauguuuuuuaagaacauuuuuggaauagauauuugauguuauuguugggac

SEQ ID NO: 300931 - RNA, 64 nt, Homo Sapiens
aguauagccagagaaaacaaggauggagaaaaaucuaggacagugucuucucggaaaaaaccag

SEQ ID NO: 300932 - RNA, 64 nt, Homo Sapiens
gguauagccagagaaaacaaggauggagaaaaaucuaggacagugucuucugagaaaccaccag

SEQ ID NO: 300933 - RNA, 64 nt, Homo Sapiens
ugauuuccccaugcucugcauuucuaggauauuucuaggacaccuggauuggcuccaucacauc

SEQ ID NO: 300934 - RNA, 64 nt, Homo Sapiens
cuuggcuucagccagcccccagccagaguccuggcuaggacagugaccugaucuccuccucaug

SEQ ID NO: 300935 - RNA, 62 nt, Homo Sapiens
gcagagugaggaagacccccagucuugguugugacuccaagaggacuucguugguuuuuugg

SEQ ID NO: 300936 - RNA, 62 nt, Homo Sapiens
gcagagcagggaagagcccaaguguuggucaugacuccaagagggacuuuguuggcuuuuag

SEQ ID NO: 300937 - RNA, 64 nt, Homo Sapiens
gcugcuucucucguaagggucuuggggagaaguaagcccgcagccugccucugcaccucguucc

SEQ ID NO: 300938 - RNA, 64 nt, Homo Sapiens
cgcucaucuuucuucguuuucgugagacaagcccagcccgcacgccacccuguccggaggcggg

SEQ ID NO: 300939 - RNA, 64 nt, Homo Sapiens
caagccccccgagugaggacgcaccgccgccaccagcccgcaacucuccagccgaagcugcagg

SEQ ID NO: 300940 - RNA, 64 nt, Homo Sapiens
cucccagcucucuugcacugcaggcccuggggccagcccgcacacaccaugccuccugucucaa

SEQ ID NO: 300941 - RNA, 64 nt, Homo Sapiens
uuguccgugugucuuagcccugcaggggccccaaagcccgcacucauggcccucgcucugucua

SEQ ID NO: 300942 - RNA, 64 nt, Homo Sapiens
ccaagcgagguggaccccgaaacggacggcccggagcccgcaccagccccgcgccuacccgggc

SEQ ID NO: 300943 - RNA, 64 nt, Homo Sapiens
ccacgccuucucgaccgcgcgcagaggcgagcagagcccgcagcggagcugcucuaaggcgccu

SEQ ID NO: 300944 - RNA, 64 nt, Homo Sapiens
ugugcgccuaaacugcugaugcugcugcuuucugagcccgcaccuccagaacacgccggagauu

SEQ ID NO: 300945 - RNA, 64 nt, Homo Sapiens
aaaaaaaaagcacauaacuuuuaacacuagaaucagcccgcaagaugcuugccccgcuaguggc

SEQ ID NO: 300946 - RNA, 64 nt, Homo Sapiens
ccaggcccaguuaaugcuaguuaugucaaaguuaagcccgcacggucuaaaauaaucgcuagug

SEQ ID NO: 300947 - RNA, 64 nt, Homo Sapiens
agccguccacagcccugccucgaggaagagcuggagcccgcagagaaagcgcugagcugaggga

SEQ ID NO: 300948 - RNA, 64 nt, Homo Sapiens
ccugcgccuggguguugagaggcaacacagaggcagcccgcacaguaugacaguauuauacgcu

SEQ ID NO: 300949 - RNA, 64 nt, Homo Sapiens
gguggggugcuggggcugcagaggggagguggccagcccgcagaaggauccuggccugagaauu

SEQ ID NO: 300950 - RNA, 64 nt, Homo Sapiens
uuuucucuuuuugccaaaauuaacuguuuggugaagcccgcaaaaccuccucgcuuugcaugca

SEQ ID NO: 300951 - RNA, 64 nt, Homo Sapiens
gccacccggaaugugaagggcgcuccgggcucugagcccgcagcuuuuacgacuucucccugcc

SEQ ID NO: 300952 - RNA, 64 nt, Homo Sapiens
aaaggacacggcucagcaagggggacauugcccaagcccgcaagcuuuacaagugcccagguca

SEQ ID NO: 300953 - RNA, 64 nt, Homo Sapiens
agacgaggagcuggacugggccuuggcuucccugagcccgcacuccaaccagcagcuggauucc

SEQ ID NO: 300954 - RNA, 64 nt, Homo Sapiens
gugcagacaaccucaguccugugcugcguagguuagcccgcauccaguauccgagucucgugca

SEQ ID NO: 300955 - RNA, 64 nt, Homo Sapiens
augaguggacggcagacagcgccuuuugaagaagagcccgcauauccccgccgggucccaccuu

SEQ ID NO: 300956 - RNA, 64 nt, Homo Sapiens
caggccuuggggacaaccuuggcuuggcccuggcagcccgcaucagcugcucagaucccacuuu

SEQ ID NO: 300957 - RNA, 64 nt, Homo Sapiens
ccaagguugggacccaaggaucggggggcccagcagcccgcaccgaucgagccggacucucggc

SEQ ID NO: 300958 - RNA, 64 nt, Homo Sapiens
ugccagcgaugccaggaaacccaguugcuucugcagcccgcagacuuccugcccauauauuaua

SEQ ID NO: 300959 - RNA, 64 nt, Homo Sapiens
gggcuggcccacuggguugcaagagugaguuuggagcccgcauuuuuagucccucagcuugaua

SEQ ID NO: 300960 - RNA, 64 nt, Homo Sapiens
ucagaugggaaaucugccuaugucauaccgugacagcccgcaggaucaggugacuucuagcaga

SEQ ID NO: 300961 - RNA, 64 nt, Homo Sapiens
guaacuuauguucaaugugccaacaccaguggggagcccgcaggccuauguggcagcgucacca

SEQ ID NO: 300962 - RNA, 64 nt, Homo Sapiens
uugucuuuaaacaacccuaaauacacgucuguuuagcccgcaauuggaaaggauauauguggca

SEQ ID NO: 300963 - RNA, 64 nt, Homo Sapiens
agaaggugaaaccagguuaucugggaaucuuuccagcccgcaggucgccacggccaucccuuug

SEQ ID NO: 300964 - RNA, 64 nt, Homo Sapiens
ccccggcccugccuccccagaccgaugcccgcagagcccgcaccgaccccaagcccgcggaggc

SEQ ID NO: 300965 - RNA, 54 nt, Homo Sapiens
cagccccacacccgccgccuacgcagcccgcagguggagaacuacugcaacuag

SEQ ID NO: 300966 - RNA, 64 nt, Homo Sapiens
cauuuguggcuccacaauuaaagaguuauuaaagagcccgcauguuucaccccccuccccaaca

SEQ ID NO: 300967 - RNA, 64 nt, Homo Sapiens
uugucacugcugggccaagagacgaugccacugcagcccgcaccccuugacugcgcucuccugu

SEQ ID NO: 300968 - RNA, 64 nt, Homo Sapiens
ugagugaaggauuuccacguagacaccuaggaagagcccgcaugcccuagacucacuccagagg

SEQ ID NO: 300969 - RNA, 64 nt, Homo Sapiens
acauuuccgcuguccgucagagcccccccacuccagcccgcagcauuguguuuuccuuguuuuc

SEQ ID NO: 300970 - RNA, 64 nt, Homo Sapiens
agggaucuugucaggguuccuuacugaccagaggagcccgcagcaaucuccacagccuccuggg

SEQ ID NO: 300971 - RNA, 64 nt, Homo Sapiens
gccaucaggagacuugaguugguauuuggaccugagcccgcacauuccacucccauucucccuc

SEQ ID NO: 300972 - RNA, 64 nt, Homo Sapiens
gaguucaccuuggaagggcguucuagguaggaagagcccgcagggccaugcagaccucaugccc

SEQ ID NO: 300973 - RNA, 59 nt, Homo Sapiens
uaaaggauuucuuccucugaggacaccaaagcccgcaguggacugaugccuucgauggg

SEQ ID NO: 300974 - RNA, 64 nt, Homo Sapiens
gucgugcuuuguuuuuggaagaucugguaacagcagcccgcauuagcagagagcuguagcugag

SEQ ID NO: 300975 - RNA, 64 nt, Homo Sapiens
gggcugaggauggagccgcccccagccgacuccaagcccgcagagggcagacgccacccuggac

SEQ ID NO: 300976 - RNA, 64 nt, Homo Sapiens
ugccccugagaacuucguggugacugccuuugggagcccgcagguggccagaggcagggguagc

SEQ ID NO: 300977 - RNA, 64 nt, Homo Sapiens
gugcugguuucucauauugucuguaggcucacucagcccgcaguuuaugugugugcuuuuuucu

SEQ ID NO: 300978 - RNA, 64 nt, Homo Sapiens
auccagcacgagauggaccagcgagcgggugggcagcccgcaucgagaacaggugguguggcag

SEQ ID NO: 300979 - RNA, 64 nt, Homo Sapiens
gagugccccaccugccacuaggcugggugcccacagcccgcaugcagcagcuugcugcacccca

SEQ ID NO: 300980 - RNA, 64 nt, Homo Sapiens
uuccgacaaccgaugcuccagccaaccccuguggagcccgcacccccacccuuuggggggggcc

SEQ ID NO: 300981 - RNA, 64 nt, Homo Sapiens
cccccgaccccucccagauccuggggaccaauaaagcccgcagcgggucucggcuggcguccug

SEQ ID NO: 300982 - RNA, 64 nt, Homo Sapiens
gcaaagguggaaacacgugccccggaggaggcgaagcccgcagacgcuuuccaggagccccagg

SEQ ID NO: 300983 - RNA, 64 nt, Homo Sapiens
ugguggccauguggcacgcuggagggcagcaggcagcccgcagagagagggccaaggacaauug

SEQ ID NO: 300984 - RNA, 64 nt, Homo Sapiens
auuuuaagacgguucuuuagaaaagacaaggcaaagcccgcauacuuucccccgaccuaaacau

SEQ ID NO: 300985 - RNA, 64 nt, Homo Sapiens
uggacucggagccgagggccagagacugguccagagcccgcaaaacacaugggaugggggaggc

SEQ ID NO: 300986 - RNA, 64 nt, Homo Sapiens
cgaugugacguugacaauuacuggaucugcaaaaagcccgcagccugcuucagagacgaauagu

SEQ ID NO: 300987 - RNA, 64 nt, Homo Sapiens
cgggcccggggccuuggcuggcaaauaaagcguuagcccgcagcgcgacugugucuguguccca

SEQ ID NO: 300988 - RNA, 64 nt, Homo Sapiens
cccagaccaagcugaaucacgcuuucuccaagacagcccgcaggcuaagugcauuccuuccccu

SEQ ID NO: 300989 - RNA, 64 nt, Homo Sapiens
auuucagggacaggcucuucucguguucccucccagcccgcaguaggggcacaggacccugccc

SEQ ID NO: 300990 - RNA, 64 nt, Homo Sapiens
uggauuuccaccguucagagcguagggcccagcuagcccgcaccacacccugcgagaccuggag

SEQ ID NO: 300991 - RNA, 64 nt, Homo Sapiens
uuugagaccacccugggcaaaggaagaucacuugagcccgcaaggcacuuugggaggccaaggc

SEQ ID NO: 300992 - RNA, 64 nt, Homo Sapiens
augacuaggcguggaccugcccauggugccugucagcccgcagagcccaucuacgcccaacaca

SEQ ID NO: 300993 - RNA, 64 nt, Homo Sapiens
gggccuguaaauaguccggcgguggccaagguacagcccgcaauagcugagcaccgugccggga

SEQ ID NO: 300994 - RNA, 64 nt, Homo Sapiens
cagccgagcccccccugcccgagacgcuggucugagcccgcaccacaaccccgaugcccugccc

SEQ ID NO: 300995 - RNA, 64 nt, Homo Sapiens; identical to SEQ ID NO: 245168

SEQ ID NO: 300996 - RNA, 64 nt, Homo Sapiens; identical to SEQ ID NO: 245169

SEQ ID NO: 300997 - RNA, 64 nt, Homo Sapiens; identical to SEQ ID NO: 245170

SEQ ID NO: 300998 - RNA, 64 nt, Homo Sapiens; identical to SEQ ID NO: 245171

SEQ ID NO: 300999 - RNA, 64 nt, Homo Sapiens; identical to SEQ ID NO: 245172

SEQ ID NO: 301000 - RNA, 55 nt, Homo Sapiens; identical to SEQ ID NO: 245173

SEQ ID NO: 301001 - RNA, 64 nt, Homo Sapiens; identical to SEQ ID NO: 245174

SEQ ID NO: 301002 - RNA, 64 nt, Homo Sapiens; identical to SEQ ID NO: 245175

SEQ ID NO: 301003 - RNA, 64 nt, Homo Sapiens; identical to SEQ ID NO: 245176

SEQ ID NO: 301004 - RNA, 64 nt, Homo Sapiens; identical to SEQ ID NO: 245177

SEQ ID NO: 301005 - RNA, 64 nt, Homo Sapiens; identical to SEQ ID NO: 245178

SEQ ID NO: 301006 - RNA, 64 nt, Homo Sapiens; identical to SEQ ID NO: 245179

SEQ ID NO: 301007 - RNA, 64 nt, Homo Sapiens; identical to SEQ ID NO: 245180

SEQ ID NO: 301008 - RNA, 64 nt, Homo Sapiens; identical to SEQ ID NO: 245181

SEQ ID NO: 301009 - RNA, 64 nt, Homo Sapiens; identical to SEQ ID NO: 245182

SEQ ID NO: 301010 - RNA, 64 nt, Homo Sapiens; identical to SEQ ID NO: 245183

SEQ ID NO: 301011 - RNA, 64 nt, Homo Sapiens; identical to SEQ ID NO: 245184

SEQ ID NO: 301012 - RNA, 64 nt, Homo Sapiens; identical to SEQ ID NO: 245185

SEQ ID NO: 301013 - RNA, 64 nt, Homo Sapiens; identical to SEQ ID NO: 245186

SEQ ID NO: 301014 - RNA, 64 nt, Homo Sapiens; identical to SEQ ID NO: 245187

SEQ ID NO: 301015 - RNA, 64 nt, Homo Sapiens; identical to SEQ ID NO: 245188

SEQ ID NO: 301016 - RNA, 62 nt, Homo Sapiens; identical to SEQ ID NO: 245189

SEQ ID NO: 301017 - RNA, 64 nt, Homo Sapiens; identical to SEQ ID NO: 245190

SEQ ID NO: 301018 - RNA, 64 nt, Homo Sapiens; identical to SEQ ID NO: 245191

SEQ ID NO: 301019 - RNA, 64 nt, Homo Sapiens; identical to SEQ ID NO: 245192

SEQ ID NO: 301020 - RNA, 64 nt, Homo Sapiens; identical to SEQ ID NO: 245193

SEQ ID NO: 301021 - RNA, 64 nt, Homo Sapiens; identical to SEQ ID NO: 245194

SEQ ID NO: 301022 - RNA, 64 nt, Homo Sapiens; identical to SEQ ID NO: 245195

SEQ ID NO: 301023 - RNA, 64 nt, Homo Sapiens; identical to SEQ ID NO: 245196

SEQ ID NO: 301024 - RNA, 64 nt, Homo Sapiens; identical to SEQ ID NO: 245197

SEQ ID NO: 301025 - RNA, 64 nt, Homo Sapiens; identical to SEQ ID NO: 245198

SEQ ID NO: 301026 - RNA, 64 nt, Homo Sapiens; identical to SEQ ID NO: 245199

SEQ ID NO: 301027 - RNA, 64 nt, Homo Sapiens; identical to SEQ ID NO: 245200

SEQ ID NO: 301028 - RNA, 64 nt, Homo Sapiens; identical to SEQ ID NO: 245201

SEQ ID NO: 301029 - RNA, 64 nt, Homo Sapiens; identical to SEQ ID NO: 245202

SEQ ID NO: 301030 - RNA, 64 nt, Homo Sapiens; identical to SEQ ID NO: 245203

SEQ ID NO: 301031 - RNA, 64 nt, Homo Sapiens; identical to SEQ ID NO: 245204

SEQ ID NO: 301032 - RNA, 64 nt, Homo Sapiens; identical to SEQ ID NO: 245205

SEQ ID NO: 301033 - RNA, 64 nt, Homo Sapiens; identical to SEQ ID NO: 245206

SEQ ID NO: 301034 - RNA, 64 nt, Homo Sapiens; identical to SEQ ID NO: 245207

SEQ ID NO: 301035 - RNA, 64 nt, Homo Sapiens; identical to SEQ ID NO: 245208

SEQ ID NO: 301036 - RNA, 64 nt, Homo Sapiens; identical to SEQ ID NO: 245209

SEQ ID NO: 301037 - RNA, 64 nt, Homo Sapiens; identical to SEQ ID NO: 245210

SEQ ID NO: 301038 - RNA, 64 nt, Homo Sapiens; identical to SEQ ID NO: 245211

SEQ ID NO: 301039 - RNA, 64 nt, Homo Sapiens; identical to SEQ ID NO: 209315

SEQ ID NO: 301040 - RNA, 64 nt, Homo Sapiens; identical to SEQ ID NO: 209316

SEQ ID NO: 301041 - RNA, 64 nt, Homo Sapiens; identical to SEQ ID NO: 209317

SEQ ID NO: 301042 - RNA, 64 nt, Homo Sapiens; identical to SEQ ID NO: 209318

SEQ ID NO: 301043 - RNA, 64 nt, Homo Sapiens; identical to SEQ ID NO: 209319

SEQ ID NO: 301044 - RNA, 64 nt, Homo Sapiens; identical to SEQ ID NO: 209320

SEQ ID NO: 301045 - RNA, 64 nt, Homo Sapiens; identical to SEQ ID NO: 209321

SEQ ID NO: 301046 - RNA, 64 nt, Homo Sapiens; identical to SEQ ID NO: 209322

SEQ ID NO: 301047 - RNA, 64 nt, Homo Sapiens; identical to SEQ ID NO: 209323

SEQ ID NO: 301048 - RNA, 64 nt, Homo Sapiens; identical to SEQ ID NO: 209324

SEQ ID NO: 301049 - RNA, 64 nt, Homo Sapiens; identical to SEQ ID NO: 209325

SEQ ID NO: 301050 - RNA, 64 nt, Homo Sapiens; identical to SEQ ID NO: 209326

SEQ ID NO: 301051 - RNA, 64 nt, Homo Sapiens; identical to SEQ ID NO: 209327

SEQ ID NO: 301052 - RNA, 64 nt, Homo Sapiens; identical to SEQ ID NO: 209328

SEQ ID NO: 301053 - RNA, 64 nt, Homo Sapiens; identical to SEQ ID NO: 209329

SEQ ID NO: 301054 - RNA, 64 nt, Homo Sapiens; identical to SEQ ID NO: 209330

SEQ ID NO: 301055 - RNA, 64 nt, Homo Sapiens; identical to SEQ ID NO: 209331

SEQ ID NO: 301056 - RNA, 64 nt, Homo Sapiens; identical to SEQ ID NO: 209332

SEQ ID NO: 301057 - RNA, 64 nt, Homo Sapiens; identical to SEQ ID NO: 209333

SEQ ID NO: 301058 - RNA, 64 nt, Homo Sapiens; identical to SEQ ID NO: 209334

SEQ ID NO: 301059 - RNA, 64 nt, Homo Sapiens; identical to SEQ ID NO: 209335

SEQ ID NO: 301060 - RNA, 64 nt, Homo Sapiens; identical to SEQ ID NO: 209336

SEQ ID NO: 301061 - RNA, 64 nt, Homo Sapiens; identical to SEQ ID NO: 209337

SEQ ID NO: 301062 - RNA, 64 nt, Homo Sapiens; identical to SEQ ID NO: 209338

SEQ ID NO: 301063 - RNA, 64 nt, Homo Sapiens; identical to SEQ ID NO: 209339

SEQ ID NO: 301064 - RNA, 64 nt, Homo Sapiens; identical to SEQ ID NO: 209340

SEQ ID NO: 301065 - RNA, 64 nt, Homo Sapiens; identical to SEQ ID NO: 209341

SEQ ID NO: 301066 - RNA, 64 nt, Homo Sapiens; identical to SEQ ID NO: 209342

SEQ ID NO: 301067 - RNA, 64 nt, Homo Sapiens; identical to SEQ ID NO: 209343

SEQ ID NO: 301068 - RNA, 64 nt, Homo Sapiens; identical to SEQ ID NO: 209344

SEQ ID NO: 301069 - RNA, 64 nt, Homo Sapiens; identical to SEQ ID NO: 209345

SEQ ID NO: 301070 - RNA, 64 nt, Homo Sapiens; identical to SEQ ID NO: 209346

SEQ ID NO: 301071 - RNA, 64 nt, Homo Sapiens; identical to SEQ ID NO: 209347

SEQ ID NO: 301072 - RNA, 64 nt, Homo Sapiens; identical to SEQ ID NO: 209348

SEQ ID NO: 301073 - RNA, 64 nt, Homo Sapiens; identical to SEQ ID NO: 209349

SEQ ID NO: 301074 - RNA, 64 nt, Homo Sapiens; identical to SEQ ID NO: 209350

SEQ ID NO: 301075 - RNA, 64 nt, Homo Sapiens; identical to SEQ ID NO: 209351

SEQ ID NO: 301076 - RNA, 64 nt, Homo Sapiens; identical to SEQ ID NO: 209352

SEQ ID NO: 301077 - RNA, 64 nt, Homo Sapiens; identical to SEQ ID NO: 175237

SEQ ID NO: 301078 - RNA, 64 nt, Homo Sapiens; identical to SEQ ID NO: 175238

SEQ ID NO: 301079 - RNA, 64 nt, Homo Sapiens; identical to SEQ ID NO: 175239

SEQ ID NO: 301080 - RNA, 64 nt, Homo Sapiens; identical to SEQ ID NO: 175240

SEQ ID NO: 301081 - RNA, 64 nt, Homo Sapiens; identical to SEQ ID NO: 175241

SEQ ID NO: 301082 - RNA, 64 nt, Homo Sapiens; identical to SEQ ID NO: 175242

SEQ ID NO: 301083 - RNA, 64 nt, Homo Sapiens; identical to SEQ ID NO: 175243

SEQ ID NO: 301084 - RNA, 64 nt, Homo Sapiens; identical to SEQ ID NO: 175244

SEQ ID NO: 301085 - RNA, 64 nt, Homo Sapiens; identical to SEQ ID NO: 175245

SEQ ID NO: 301086 - RNA, 64 nt, Homo Sapiens; identical to SEQ ID NO: 175246

SEQ ID NO: 301087 - RNA, 64 nt, Homo Sapiens; identical to SEQ ID NO: 175247

SEQ ID NO: 301088 - RNA, 64 nt, Homo Sapiens; identical to SEQ ID NO: 175248

SEQ ID NO: 301089 - RNA, 64 nt, Homo Sapiens; identical to SEQ ID NO: 175249

SEQ ID NO: 301090 - RNA, 64 nt, Homo Sapiens; identical to SEQ ID NO: 175250

SEQ ID NO: 301091 - RNA, 64 nt, Homo Sapiens; identical to SEQ ID NO: 175251

SEQ ID NO: 301092 - RNA, 64 nt, Homo Sapiens; identical to SEQ ID NO: 175252

SEQ ID NO: 301093 - RNA, 64 nt, Homo Sapiens; identical to SEQ ID NO: 175253

SEQ ID NO: 301094 - RNA, 64 nt, Homo Sapiens; identical to SEQ ID NO: 175254

SEQ ID NO: 301095 - RNA, 64 nt, Homo Sapiens; identical to SEQ ID NO: 175255

SEQ ID NO: 301096 - RNA, 64 nt, Homo Sapiens; identical to SEQ ID NO: 175256

SEQ ID NO: 301097 - RNA, 64 nt, Homo Sapiens; identical to SEQ ID NO: 175257

SEQ ID NO: 301098 - RNA, 64 nt, Homo Sapiens; identical to SEQ ID NO: 175258

SEQ ID NO: 301099 - RNA, 64 nt, Homo Sapiens; identical to SEQ ID NO: 175259

SEQ ID NO: 301100 - RNA, 64 nt, Homo Sapiens; identical to SEQ ID NO: 175260

SEQ ID NO: 301101 - RNA, 64 nt, Homo Sapiens; identical to SEQ ID NO: 175261

SEQ ID NO: 301102 - RNA, 64 nt, Homo Sapiens; identical to SEQ ID NO: 175262

SEQ ID NO: 301103 - RNA, 64 nt, Homo Sapiens; identical to SEQ ID NO: 175263

SEQ ID NO: 301104 - RNA, 64 nt, Homo Sapiens; identical to SEQ ID NO: 175264

SEQ ID NO: 301105 - RNA, 64 nt, Homo Sapiens; identical to SEQ ID NO: 175265

SEQ ID NO: 301106 - RNA, 64 nt, Homo Sapiens; identical to SEQ ID NO: 175266

SEQ ID NO: 301107 - RNA, 64 nt, Homo Sapiens; identical to SEQ ID NO: 175267

SEQ ID NO: 301108 - RNA, 64 nt, Homo Sapiens; identical to SEQ ID NO: 175268

SEQ ID NO: 301109 - RNA, 64 nt, Homo Sapiens; identical to SEQ ID NO: 175269

SEQ ID NO: 301110 - RNA, 64 nt, Homo Sapiens; identical to SEQ ID NO: 175270

SEQ ID NO: 301111 - RNA, 64 nt, Homo Sapiens; identical to SEQ ID NO: 175271

SEQ ID NO: 301112 - RNA, 64 nt, Homo Sapiens; identical to SEQ ID NO: 175272

SEQ ID NO: 301113 - RNA, 64 nt, Homo Sapiens; identical to SEQ ID NO: 175273

SEQ ID NO: 301114 - RNA, 64 nt, Homo Sapiens; identical to SEQ ID NO: 175274

SEQ ID NO: 301115 - RNA, 64 nt, Homo Sapiens; identical to SEQ ID NO: 175275

SEQ ID NO: 301116 - RNA, 64 nt, Homo Sapiens; identical to SEQ ID NO: 175276

SEQ ID NO: 301117 - RNA, 64 nt, Homo Sapiens; identical to SEQ ID NO: 175277

SEQ ID NO: 301118 - RNA, 64 nt, Homo Sapiens; identical to SEQ ID NO: 175278

SEQ ID NO: 301119 - RNA, 64 nt, Homo Sapiens; identical to SEQ ID NO: 277339

SEQ ID NO: 301120 - RNA, 64 nt, Homo Sapiens; identical to SEQ ID NO: 277340

SEQ ID NO: 301121 - RNA, 64 nt, Homo Sapiens; identical to SEQ ID NO: 277341

SEQ ID NO: 301122 - RNA, 64 nt, Homo Sapiens; identical to SEQ ID NO: 277342

SEQ ID NO: 301123 - RNA, 64 nt, Homo Sapiens; identical to SEQ ID NO: 277343

SEQ ID NO: 301124 - RNA, 64 nt, Homo Sapiens; identical to SEQ ID NO: 277344

SEQ ID NO: 301125 - RNA, 64 nt, Homo Sapiens; identical to SEQ ID NO: 277345

SEQ ID NO: 301126 - RNA, 64 nt, Homo Sapiens; identical to SEQ ID NO: 277346

SEQ ID NO: 301127 - RNA, 64 nt, Homo Sapiens; identical to SEQ ID NO: 277347

SEQ ID NO: 301128 - RNA, 64 nt, Homo Sapiens; identical to SEQ ID NO: 277348

SEQ ID NO: 301129 - RNA, 64 nt, Homo Sapiens; identical to SEQ ID NO: 277349

SEQ ID NO: 301130 - RNA, 64 nt, Homo Sapiens; identical to SEQ ID NO: 277350

SEQ ID NO: 301131 - RNA, 64 nt, Homo Sapiens; identical to SEQ ID NO: 277351

SEQ ID NO: 301132 - RNA, 64 nt, Homo Sapiens; identical to SEQ ID NO: 277352

SEQ ID NO: 301133 - RNA, 64 nt, Homo Sapiens; identical to SEQ ID NO: 277353

SEQ ID NO: 301134 - RNA, 64 nt, Homo Sapiens; identical to SEQ ID NO: 277354

SEQ ID NO: 301135 - RNA, 64 nt, Homo Sapiens; identical to SEQ ID NO: 277355

SEQ ID NO: 301136 - RNA, 64 nt, Homo Sapiens; identical to SEQ ID NO: 277356

SEQ ID NO: 301137 - RNA, 64 nt, Homo Sapiens; identical to SEQ ID NO: 277357

SEQ ID NO: 301138 - RNA, 64 nt, Homo Sapiens; identical to SEQ ID NO: 277358

SEQ ID NO: 301139 - RNA, 64 nt, Homo Sapiens; identical to SEQ ID NO: 277359

SEQ ID NO: 301140 - RNA, 64 nt, Homo Sapiens; identical to SEQ ID NO: 277360

SEQ ID NO: 301141 - RNA, 64 nt, Homo Sapiens; identical to SEQ ID NO: 277361

SEQ ID NO: 301142 - RNA, 64 nt, Homo Sapiens; identical to SEQ ID NO: 277362

SEQ ID NO: 301143 - RNA, 64 nt, Homo Sapiens; identical to SEQ ID NO: 277363

SEQ ID NO: 301144 - RNA, 64 nt, Homo Sapiens; identical to SEQ ID NO: 277364

SEQ ID NO: 301145 - RNA, 64 nt, Homo Sapiens; identical to SEQ ID NO: 277365

SEQ ID NO: 301146 - RNA, 64 nt, Homo Sapiens; identical to SEQ ID NO: 277366

SEQ ID NO: 301147 - RNA, 64 nt, Homo Sapiens; identical to SEQ ID NO: 277367

SEQ ID NO: 301148 - RNA, 64 nt, Homo Sapiens; identical to SEQ ID NO: 277368

SEQ ID NO: 301149 - RNA, 64 nt, Homo Sapiens; identical to SEQ ID NO: 277369

SEQ ID NO: 301150 - RNA, 64 nt, Homo Sapiens; identical to SEQ ID NO: 277370

SEQ ID NO: 301151 - RNA, 64 nt, Homo Sapiens; identical to SEQ ID NO: 277371

SEQ ID NO: 301152 - RNA, 64 nt, Homo Sapiens; identical to SEQ ID NO: 277372

SEQ ID NO: 301153 - RNA, 64 nt, Homo Sapiens; identical to SEQ ID NO: 277373

SEQ ID NO: 301154 - RNA, 64 nt, Homo Sapiens; identical to SEQ ID NO: 277374

SEQ ID NO: 301155 - RNA, 64 nt, Homo Sapiens; identical to SEQ ID NO: 277375

SEQ ID NO: 301156 - RNA, 64 nt, Homo Sapiens; identical to SEQ ID NO: 277376

SEQ ID NO: 301157 - RNA, 58 nt, Homo Sapiens; identical to SEQ ID NO: 277377

SEQ ID NO: 301158 - RNA, 64 nt, Homo Sapiens; identical to SEQ ID NO: 277378

SEQ ID NO: 301159 - RNA, 64 nt, Homo Sapiens; identical to SEQ ID NO: 277379

SEQ ID NO: 301160 - RNA, 64 nt, Homo Sapiens; identical to SEQ ID NO: 277380

SEQ ID NO: 301161 - RNA, 64 nt, Homo Sapiens; identical to SEQ ID NO: 277381

SEQ ID NO: 301162 - RNA, 64 nt, Homo Sapiens; identical to SEQ ID NO: 277382

SEQ ID NO: 301163 - RNA, 64 nt, Homo Sapiens; identical to SEQ ID NO: 277383

SEQ ID NO: 301164 - RNA, 64 nt, Homo Sapiens; identical to SEQ ID NO: 277384

SEQ ID NO: 301165 - RNA, 64 nt, Homo Sapiens; identical to SEQ ID NO: 277385

SEQ ID NO: 301166 - RNA, 64 nt, Homo Sapiens; identical to SEQ ID NO: 277386

SEQ ID NO: 301167 - RNA, 64 nt, Homo Sapiens; identical to SEQ ID NO: 277387

SEQ ID NO: 301168 - RNA, 64 nt, Homo Sapiens; identical to SEQ ID NO: 277388

SEQ ID NO: 301169 - RNA, 64 nt, Homo Sapiens; identical to SEQ ID NO: 277389

SEQ ID NO: 301170 - RNA, 64 nt, Homo Sapiens; identical to SEQ ID NO: 277390

SEQ ID NO: 301171 - RNA, 64 nt, Homo Sapiens; identical to SEQ ID NO: 277391

SEQ ID NO: 301172 - RNA, 64 nt, Homo Sapiens; identical to SEQ ID NO: 277392

SEQ ID NO: 301173 - RNA, 64 nt, Homo Sapiens; identical to SEQ ID NO: 277393

SEQ ID NO: 301174 - RNA, 64 nt, Homo Sapiens; identical to SEQ ID NO: 277394

SEQ ID NO: 301175 - RNA, 64 nt, Homo Sapiens; identical to SEQ ID NO: 277395

SEQ ID NO: 301176 - RNA, 64 nt, Homo Sapiens; identical to SEQ ID NO: 277396

SEQ ID NO: 301177 - RNA, 64 nt, Homo Sapiens; identical to SEQ ID NO: 277397

SEQ ID NO: 301178 - RNA, 64 nt, Homo Sapiens; identical to SEQ ID NO: 277398

SEQ ID NO: 301179 - RNA, 64 nt, Homo Sapiens; identical to SEQ ID NO: 277399

SEQ ID NO: 301180 - RNA, 64 nt, Homo Sapiens; identical to SEQ ID NO: 277400

SEQ ID NO: 301181 - RNA, 64 nt, Homo Sapiens; identical to SEQ ID NO: 277401

SEQ ID NO: 301182 - RNA, 64 nt, Homo Sapiens; identical to SEQ ID NO: 277402

SEQ ID NO: 301183 - RNA, 64 nt, Homo Sapiens; identical to SEQ ID NO: 277403

SEQ ID NO: 301184 - RNA, 64 nt, Homo Sapiens; identical to SEQ ID NO: 277404

SEQ ID NO: 301185 - RNA, 64 nt, Homo Sapiens; identical to SEQ ID NO: 277405

SEQ ID NO: 301186 - RNA, 64 nt, Homo Sapiens; identical to SEQ ID NO: 277406

SEQ ID NO: 301187 - RNA, 64 nt, Homo Sapiens; identical to SEQ ID NO: 277407

SEQ ID NO: 301188 - RNA, 64 nt, Homo Sapiens; identical to SEQ ID NO: 277408

SEQ ID NO: 301189 - RNA, 64 nt, Homo Sapiens; identical to SEQ ID NO: 277409

SEQ ID NO: 301190 - RNA, 64 nt, Homo Sapiens; identical to SEQ ID NO: 277410

SEQ ID NO: 301191 - RNA, 64 nt, Homo Sapiens; identical to SEQ ID NO: 277411

SEQ ID NO: 301192 - RNA, 64 nt, Homo Sapiens; identical to SEQ ID NO: 277412

SEQ ID NO: 301193 - RNA, 64 nt, Homo Sapiens; identical to SEQ ID NO: 277413

SEQ ID NO: 301194 - RNA, 64 nt, Homo Sapiens; identical to SEQ ID NO: 277414

SEQ ID NO: 301195 - RNA, 64 nt, Homo Sapiens; identical to SEQ ID NO: 277415

SEQ ID NO: 301196 - RNA, 64 nt, Homo Sapiens; identical to SEQ ID NO: 277416

SEQ ID NO: 301197 - RNA, 64 nt, Homo Sapiens; identical to SEQ ID NO: 277417

SEQ ID NO: 301198 - RNA, 64 nt, Homo Sapiens; identical to SEQ ID NO: 277418

SEQ ID NO: 301199 - RNA, 64 nt, Homo Sapiens; identical to SEQ ID NO: 277419

SEQ ID NO: 301200 - RNA, 64 nt, Homo Sapiens; identical to SEQ ID NO: 277420

SEQ ID NO: 301201 - RNA, 60 nt, Homo Sapiens; identical to SEQ ID NO: 277421

SEQ ID NO: 301202 - RNA, 61 nt, Homo Sapiens
gagacugauuugcugaauuuccuucuaaaugucacucaaaaauuucuuuuccaugucauuc

SEQ ID NO: 301203 - RNA, 61 nt, Homo Sapiens
gagccuguuccauuuucccguggaaccuguuucacucaaugccaggcagugcagcauuuag

SEQ ID NO: 301204 - RNA, 61 nt, Homo Sapiens
cccagcacuuugggaggccgaggcagguggaucacucaaggucacaaguuugagaccaguc

SEQ ID NO: 301205 - RNA, 61 nt, Homo Sapiens
aaauuuuaaaucuguagccuggguguacguuucacucaaguucuccuacugaggacucuug

SEQ ID NO: 301206 - RNA, 61 nt, Homo Sapiens
aaucaaugauacugugagcucuugacuaaaaucacucaauucagccauguaucaauauuca

SEQ ID NO: 301207 - RNA, 61 nt, Homo Sapiens
guucagugcucauacguaucuucugguugauucacucaagaugcguggaucugggucuuag

SEQ ID NO: 301208 - RNA, 61 nt, Homo Sapiens
uugaaguuucgccgcuuuugaacaagcagcaucacucaagucugcugccuggcaaacugca

SEQ ID NO: 301209 - RNA, 61 nt, Homo Sapiens
cauaagcagauuuuacuguucccuucccacaucacucaagguaaauaaaugaguacaucuc

SEQ ID NO: 301210 - RNA, 61 nt, Homo Sapiens
guuuaguugcaacaaucucuugugacuaaugucacucaaagcaucuuguaaauccuagggc

SEQ ID NO: 301211 - RNA, 61 nt, Homo Sapiens
gacucuguccccacacucaaaaagacucagcucacucaaugagagaaugugauuuacuuua

SEQ ID NO: 301212 - RNA, 64 nt, Homo Sapiens
ggguaaaauguuaugguaagcaugcacaguuugcagucuacaguuuuuuuauguagcacaaaau

SEQ ID NO: 301213 - RNA, 64 nt, Homo Sapiens
aaaaaccucacauucuacuugauuuacacuuccuagucuacauuacaugugguugaagguuuua

SEQ ID NO: 301214 - RNA, 64 nt, Homo Sapiens
agaguggggaacagggccagcaagacagaccaccagccagaaaucucugauaucaaccucaugu

SEQ ID NO: 301215 - RNA, 64 nt, Homo Sapiens
uggggaagaaauaccccagacccaacaaaccuccagccagaaagccagcuauuuugcauuugaa

SEQ ID NO: 301216 - RNA, 64 nt, Homo Sapiens
uuuccaucugcuuguauuuuccauacacauccccagccagaaguuaguguccgaagaccgaauu

SEQ ID NO: 301217 - RNA, 64 nt, Homo Sapiens
acagggccuagcuuucauuugacacacagacuacagccagaagcccauggagcagggaugucac

SEQ ID NO: 301218 - RNA, 64 nt, Homo Sapiens
uacauacacacacaaauacacaaucucuaggguaagccagaaggcaagaucagauuaaaaacac

SEQ ID NO: 301219 - RNA, 64 nt, Homo Sapiens
acucagggcuaaagucauccagugaaacuuuuagagccagaaguaacuuugucccaguccuaca

SEQ ID NO: 301220 - RNA, 64 nt, Homo Sapiens
auaagaaacaccgcaacaggcauaaucaggcuccagccagaaaaccguggugaggccauguucu

SEQ ID NO: 301221 - RNA, 64 nt, Homo Sapiens
ccgauuccgggagcuugggauagaccaggccugcagccagaacgucucacagaagcugcgacuc

SEQ ID NO: 301222 - RNA, 64 nt, Homo Sapiens
cagaucuggaggcagcagugugcuggguggagagagccagaaaacauagauccgagggcagcag

SEQ ID NO: 301223 - RNA, 64 nt, Homo Sapiens
cauagauccgagggcagcaguggggcgaggagagagccagaaaagggggcuaaauuaauuggag

SEQ ID NO: 301224 - RNA, 64 nt, Homo Sapiens
uuaucuagugauaugaccucacugucuugaccaaagccagaauagaaggcaggauuccugaauu

SEQ ID NO: 301225 - RNA, 64 nt, Homo Sapiens
gaauaauaugcagagaugcauauuaggaaugugaagccagaaugggucaguuguagcugcugca

SEQ ID NO: 301226 - RNA, 64 nt, Homo Sapiens
aauugaggauguuuccuuucuuccuguggcaucuagccagaagauuuccuuugggauaauuuau

SEQ ID NO: 301227 - RNA, 64 nt, Homo Sapiens
ggccuugucugaagaggacuaaaggaugaauacaagccagaaaaggaacaguucuuuacuugca

SEQ ID NO: 301228 - RNA, 64 nt, Homo Sapiens
ugugaguuucugggcucuggccuccugaagaaccagccagaagaagaaaaguagagguggcuuu

SEQ ID NO: 301229 - RNA, 64 nt, Homo Sapiens
ccagcccucucccuuccacuggugccuugcuuagagccagaagggaugaagccgggggaucuau

SEQ ID NO: 301230 - RNA, 64 nt, Homo Sapiens
uacaccaaauuaaaauuuucaugucaaacuucaaagccagaaagcugcuaaauacgugucuggc

SEQ ID NO: 301231 - RNA, 64 nt, Homo Sapiens
uuuauccucccuguuauacuuuggagcacagcacagccagaaaggggcugcauuugugcccagg

SEQ ID NO: 301232 - RNA, 64 nt, Homo Sapiens
agcuuuauucccuauuaauagaaaaccgucacagugacccuagaucccuccgaguuaaugaguu

SEQ ID NO: 301233 - RNA, 64 nt, Homo Sapiens
uugaggucaugaccucccacugccgcucaggggcugacccuauuuaggaaaccaaagagggugg

SEQ ID NO: 301234 - RNA, 64 nt, Homo Sapiens; identical to SEQ ID NO: 58312

SEQ ID NO: 301235 - RNA, 64 nt, Homo Sapiens; identical to SEQ ID NO: 58313

SEQ ID NO: 301236 - RNA, 64 nt, Homo Sapiens; identical to SEQ ID NO: 58314

SEQ ID NO: 301237 - RNA, 64 nt, Homo Sapiens; identical to SEQ ID NO: 58315

SEQ ID NO: 301238 - RNA, 64 nt, Homo Sapiens; identical to SEQ ID NO: 58316

SEQ ID NO: 301239 - RNA, 64 nt, Homo Sapiens; identical to SEQ ID NO: 58317

SEQ ID NO: 301240 - RNA, 64 nt, Homo Sapiens; identical to SEQ ID NO: 58318

SEQ ID NO: 301241 - RNA, 64 nt, Homo Sapiens; identical to SEQ ID NO: 58319

SEQ ID NO: 301242 - RNA, 64 nt, Homo Sapiens; identical to SEQ ID NO: 58320

SEQ ID NO: 301243 - RNA, 64 nt, Homo Sapiens; identical to SEQ ID NO: 58321

SEQ ID NO: 301244 - RNA, 64 nt, Homo Sapiens; identical to SEQ ID NO: 58322

SEQ ID NO: 301245 - RNA, 64 nt, Homo Sapiens; identical to SEQ ID NO: 58323

SEQ ID NO: 301246 - RNA, 64 nt, Homo Sapiens; identical to SEQ ID NO: 58324

SEQ ID NO: 301247 - RNA, 64 nt, Homo Sapiens; identical to SEQ ID NO: 58325

SEQ ID NO: 301248 - RNA, 64 nt, Homo Sapiens; identical to SEQ ID NO: 58326

SEQ ID NO: 301249 - RNA, 64 nt, Homo Sapiens; identical to SEQ ID NO: 58327

SEQ ID NO: 301250 - RNA, 64 nt, Homo Sapiens; identical to SEQ ID NO: 58328

SEQ ID NO: 301251 - RNA, 64 nt, Homo Sapiens; identical to SEQ ID NO: 58329

SEQ ID NO: 301252 - RNA, 64 nt, Homo Sapiens; identical to SEQ ID NO: 58330

SEQ ID NO: 301253 - RNA, 64 nt, Homo Sapiens; identical to SEQ ID NO: 58331

SEQ ID NO: 301254 - RNA, 64 nt, Homo Sapiens; identical to SEQ ID NO: 58332

SEQ ID NO: 301255 - RNA, 64 nt, Homo Sapiens; identical to SEQ ID NO: 58333

SEQ ID NO: 301256 - RNA, 64 nt, Homo Sapiens; identical to SEQ ID NO: 58334

SEQ ID NO: 301257 - RNA, 64 nt, Homo Sapiens; identical to SEQ ID NO: 58335

SEQ ID NO: 301258 - RNA, 64 nt, Homo Sapiens; identical to SEQ ID NO: 58336

SEQ ID NO: 301259 - RNA, 64 nt, Homo Sapiens; identical to SEQ ID NO: 58337

SEQ ID NO: 301260 - RNA, 64 nt, Homo Sapiens; identical to SEQ ID NO: 58338

SEQ ID NO: 301261 - RNA, 64 nt, Homo Sapiens; identical to SEQ ID NO: 58339

SEQ ID NO: 301262 - RNA, 64 nt, Homo Sapiens; identical to SEQ ID NO: 58340

SEQ ID NO: 301263 - RNA, 64 nt, Homo Sapiens; identical to SEQ ID NO: 58341

SEQ ID NO: 301264 - RNA, 64 nt, Homo Sapiens; identical to SEQ ID NO: 58342

SEQ ID NO: 301265 - RNA, 64 nt, Homo Sapiens; identical to SEQ ID NO: 58343

SEQ ID NO: 301266 - RNA, 64 nt, Homo Sapiens; identical to SEQ ID NO: 58344

SEQ ID NO: 301267 - RNA, 64 nt, Homo Sapiens; identical to SEQ ID NO: 58345

SEQ ID NO: 301268 - RNA, 64 nt, Homo Sapiens; identical to SEQ ID NO: 58346

SEQ ID NO: 301269 - RNA, 64 nt, Homo Sapiens; identical to SEQ ID NO: 58347

SEQ ID NO: 301270 - RNA, 64 nt, Homo Sapiens; identical to SEQ ID NO: 58348

SEQ ID NO: 301271 - RNA, 64 nt, Homo Sapiens; identical to SEQ ID NO: 58349

SEQ ID NO: 301272 - RNA, 64 nt, Homo Sapiens; identical to SEQ ID NO: 58350

SEQ ID NO: 301273 - RNA, 64 nt, Homo Sapiens; identical to SEQ ID NO: 58351

SEQ ID NO: 301274 - RNA, 64 nt, Homo Sapiens; identical to SEQ ID NO: 58352

SEQ ID NO: 301275 - RNA, 64 nt, Homo Sapiens; identical to SEQ ID NO: 58353

SEQ ID NO: 301276 - RNA, 64 nt, Homo Sapiens; identical to SEQ ID NO: 58354

SEQ ID NO: 301277 - RNA, 64 nt, Homo Sapiens; identical to SEQ ID NO: 58355

SEQ ID NO: 301278 - RNA, 64 nt, Homo Sapiens; identical to SEQ ID NO: 58356

SEQ ID NO: 301279 - RNA, 64 nt, Homo Sapiens; identical to SEQ ID NO: 58357

SEQ ID NO: 301280 - RNA, 64 nt, Homo Sapiens; identical to SEQ ID NO: 58358

SEQ ID NO: 301281 - RNA, 64 nt, Homo Sapiens; identical to SEQ ID NO: 58359

SEQ ID NO: 301282 - RNA, 64 nt, Homo Sapiens; identical to SEQ ID NO: 58360

SEQ ID NO: 301283 - RNA, 64 nt, Homo Sapiens; identical to SEQ ID NO: 58361

SEQ ID NO: 301284 - RNA, 64 nt, Homo Sapiens; identical to SEQ ID NO: 58362

SEQ ID NO: 301285 - RNA, 64 nt, Homo Sapiens; identical to SEQ ID NO: 58363

SEQ ID NO: 301286 - RNA, 64 nt, Homo Sapiens; identical to SEQ ID NO: 58364

SEQ ID NO: 301287 - RNA, 64 nt, Homo Sapiens; identical to SEQ ID NO: 58365

SEQ ID NO: 301288 - RNA, 64 nt, Homo Sapiens; identical to SEQ ID NO: 58366

SEQ ID NO: 301289 - RNA, 64 nt, Homo Sapiens; identical to SEQ ID NO: 58367

SEQ ID NO: 301290 - RNA, 64 nt, Homo Sapiens; identical to SEQ ID NO: 58368

SEQ ID NO: 301291 - RNA, 64 nt, Homo Sapiens; identical to SEQ ID NO: 58369

SEQ ID NO: 301292 - RNA, 64 nt, Homo Sapiens; identical to SEQ ID NO: 58370

SEQ ID NO: 301293 - RNA, 64 nt, Homo Sapiens; identical to SEQ ID NO: 58371

SEQ ID NO: 301294 - RNA, 64 nt, Homo Sapiens; identical to SEQ ID NO: 58372

SEQ ID NO: 301295 - RNA, 64 nt, Homo Sapiens; identical to SEQ ID NO: 58373

SEQ ID NO: 301296 - RNA, 64 nt, Homo Sapiens; identical to SEQ ID NO: 58374

SEQ ID NO: 301297 - RNA, 64 nt, Homo Sapiens; identical to SEQ ID NO: 58375

SEQ ID NO: 301298 - RNA, 64 nt, Homo Sapiens; identical to SEQ ID NO: 58376

SEQ ID NO: 301299 - RNA, 64 nt, Homo Sapiens; identical to SEQ ID NO: 58377

SEQ ID NO: 301300 - RNA, 64 nt, Homo Sapiens; identical to SEQ ID NO: 58378

SEQ ID NO: 301301 - RNA, 64 nt, Homo Sapiens; identical to SEQ ID NO: 58379

SEQ ID NO: 301302 - RNA, 64 nt, Homo Sapiens; identical to SEQ ID NO: 58380

SEQ ID NO: 301303 - RNA, 64 nt, Homo Sapiens; identical to SEQ ID NO: 58381

SEQ ID NO: 301304 - RNA, 64 nt, Homo Sapiens; identical to SEQ ID NO: 58382

SEQ ID NO: 301305 - RNA, 64 nt, Homo Sapiens; identical to SEQ ID NO: 58383

SEQ ID NO: 301306 - RNA, 64 nt, Homo Sapiens; identical to SEQ ID NO: 58384

SEQ ID NO: 301307 - RNA, 64 nt, Homo Sapiens; identical to SEQ ID NO: 58385

SEQ ID NO: 301308 - RNA, 64 nt, Homo Sapiens; identical to SEQ ID NO: 58386

SEQ ID NO: 301309 - RNA, 64 nt, Homo Sapiens; identical to SEQ ID NO: 58387

SEQ ID NO: 301310 - RNA, 64 nt, Homo Sapiens; identical to SEQ ID NO: 58388

SEQ ID NO: 301311 - RNA, 64 nt, Homo Sapiens; identical to SEQ ID NO: 58389

SEQ ID NO: 301312 - RNA, 64 nt, Homo Sapiens; identical to SEQ ID NO: 58390

SEQ ID NO: 301313 - RNA, 64 nt, Homo Sapiens; identical to SEQ ID NO: 58391

SEQ ID NO: 301314 - RNA, 64 nt, Homo Sapiens; identical to SEQ ID NO: 58392

SEQ ID NO: 301315 - RNA, 64 nt, Homo Sapiens; identical to SEQ ID NO: 58393

SEQ ID NO: 301316 - RNA, 64 nt, Homo Sapiens; identical to SEQ ID NO: 58394

SEQ ID NO: 301317 - RNA, 64 nt, Homo Sapiens; identical to SEQ ID NO: 58395

SEQ ID NO: 301318 - RNA, 64 nt, Homo Sapiens; identical to SEQ ID NO: 58396

SEQ ID NO: 301319 - RNA, 64 nt, Homo Sapiens; identical to SEQ ID NO: 58397

SEQ ID NO: 301320 - RNA, 64 nt, Homo Sapiens; identical to SEQ ID NO: 58398

SEQ ID NO: 301321 - RNA, 64 nt, Homo Sapiens; identical to SEQ ID NO: 58399

SEQ ID NO: 301322 - RNA, 64 nt, Homo Sapiens; identical to SEQ ID NO: 58400

SEQ ID NO: 301323 - RNA, 64 nt, Homo Sapiens; identical to SEQ ID NO: 58401

SEQ ID NO: 301324 - RNA, 64 nt, Homo Sapiens; identical to SEQ ID NO: 58402

SEQ ID NO: 301325 - RNA, 64 nt, Homo Sapiens; identical to SEQ ID NO: 58403

SEQ ID NO: 301326 - RNA, 64 nt, Homo Sapiens; identical to SEQ ID NO: 58404

SEQ ID NO: 301327 - RNA, 64 nt, Homo Sapiens; identical to SEQ ID NO: 58405

SEQ ID NO: 301328 - RNA, 64 nt, Homo Sapiens; identical to SEQ ID NO: 58406

SEQ ID NO: 301329 - RNA, 64 nt, Homo Sapiens; identical to SEQ ID NO: 58407

SEQ ID NO: 301330 - RNA, 64 nt, Homo Sapiens; identical to SEQ ID NO: 58408

SEQ ID NO: 301331 - RNA, 64 nt, Homo Sapiens; identical to SEQ ID NO: 58409

SEQ ID NO: 301332 - RNA, 64 nt, Homo Sapiens; identical to SEQ ID NO: 58410

SEQ ID NO: 301333 - RNA, 64 nt, Homo Sapiens; identical to SEQ ID NO: 58411

SEQ ID NO: 301334 - RNA, 64 nt, Homo Sapiens; identical to SEQ ID NO: 58412

SEQ ID NO: 301335 - RNA, 64 nt, Homo Sapiens; identical to SEQ ID NO: 58413

SEQ ID NO: 301336 - RNA, 64 nt, Homo Sapiens; identical to SEQ ID NO: 58414

SEQ ID NO: 301337 - RNA, 64 nt, Homo Sapiens; identical to SEQ ID NO: 58415

SEQ ID NO: 301338 - RNA, 64 nt, Homo Sapiens; identical to SEQ ID NO: 58416

SEQ ID NO: 301339 - RNA, 64 nt, Homo Sapiens; identical to SEQ ID NO: 58417

SEQ ID NO: 301340 - RNA, 64 nt, Homo Sapiens; identical to SEQ ID NO: 58418

SEQ ID NO: 301341 - RNA, 64 nt, Homo Sapiens; identical to SEQ ID NO: 58419

SEQ ID NO: 301342 - RNA, 64 nt, Homo Sapiens; identical to SEQ ID NO: 58420

SEQ ID NO: 301343 - RNA, 64 nt, Homo Sapiens; identical to SEQ ID NO: 58421

SEQ ID NO: 301344 - RNA, 64 nt, Homo Sapiens; identical to SEQ ID NO: 58422

SEQ ID NO: 301345 - RNA, 64 nt, Homo Sapiens; identical to SEQ ID NO: 58423

SEQ ID NO: 301346 - RNA, 64 nt, Homo Sapiens; identical to SEQ ID NO: 58424

SEQ ID NO: 301347 - RNA, 64 nt, Homo Sapiens; identical to SEQ ID NO: 58425

SEQ ID NO: 301348 - RNA, 64 nt, Homo Sapiens; identical to SEQ ID NO: 58426

SEQ ID NO: 301349 - RNA, 64 nt, Homo Sapiens; identical to SEQ ID NO: 58427

SEQ ID NO: 301350 - RNA, 64 nt, Homo Sapiens; identical to SEQ ID NO: 58428

SEQ ID NO: 301351 - RNA, 64 nt, Homo Sapiens; identical to SEQ ID NO: 58429

SEQ ID NO: 301352 - RNA, 64 nt, Homo Sapiens; identical to SEQ ID NO: 58430

SEQ ID NO: 301353 - RNA, 64 nt, Homo Sapiens; identical to SEQ ID NO: 58431

SEQ ID NO: 301354 - RNA, 64 nt, Homo Sapiens; identical to SEQ ID NO: 58432

SEQ ID NO: 301355 - RNA, 64 nt, Homo Sapiens; identical to SEQ ID NO: 58433

SEQ ID NO: 301356 - RNA, 64 nt, Homo Sapiens; identical to SEQ ID NO: 58434

SEQ ID NO: 301357 - RNA, 64 nt, Homo Sapiens; identical to SEQ ID NO: 58435

SEQ ID NO: 301358 - RNA, 50 nt, Homo Sapiens; identical to SEQ ID NO: 58436

SEQ ID NO: 301359 - RNA, 64 nt, Homo Sapiens; identical to SEQ ID NO: 58437

SEQ ID NO: 301360 - RNA, 64 nt, Homo Sapiens; identical to SEQ ID NO: 58438

SEQ ID NO: 301361 - RNA, 64 nt, Homo Sapiens; identical to SEQ ID NO: 58439

SEQ ID NO: 301362 - RNA, 64 nt, Homo Sapiens; identical to SEQ ID NO: 58440

SEQ ID NO: 301363 - RNA, 64 nt, Homo Sapiens; identical to SEQ ID NO: 58441

SEQ ID NO: 301364 - RNA, 64 nt, Homo Sapiens; identical to SEQ ID NO: 58442

SEQ ID NO: 301365 - RNA, 64 nt, Homo Sapiens; identical to SEQ ID NO: 58443

SEQ ID NO: 301366 - RNA, 64 nt, Homo Sapiens; identical to SEQ ID NO: 58444

SEQ ID NO: 301367 - RNA, 64 nt, Homo Sapiens; identical to SEQ ID NO: 58445

SEQ ID NO: 301368 - RNA, 64 nt, Homo Sapiens; identical to SEQ ID NO: 58446

SEQ ID NO: 301369 - RNA, 64 nt, Homo Sapiens; identical to SEQ ID NO: 58447

SEQ ID NO: 301370 - RNA, 64 nt, Homo Sapiens; identical to SEQ ID NO: 58448

SEQ ID NO: 301371 - RNA, 64 nt, Homo Sapiens; identical to SEQ ID NO: 58449

SEQ ID NO: 301372 - RNA, 64 nt, Homo Sapiens; identical to SEQ ID NO: 58450

SEQ ID NO: 301373 - RNA, 64 nt, Homo Sapiens; identical to SEQ ID NO: 58451

SEQ ID NO: 301374 - RNA, 64 nt, Homo Sapiens; identical to SEQ ID NO: 58452

SEQ ID NO: 301375 - RNA, 64 nt, Homo Sapiens; identical to SEQ ID NO: 58453

SEQ ID NO: 301376 - RNA, 64 nt, Homo Sapiens; identical to SEQ ID NO: 58454

SEQ ID NO: 301377 - RNA, 64 nt, Homo Sapiens; identical to SEQ ID NO: 58455

SEQ ID NO: 301378 - RNA, 64 nt, Homo Sapiens; identical to SEQ ID NO: 58456

SEQ ID NO: 301379 - RNA, 64 nt, Homo Sapiens; identical to SEQ ID NO: 58457

SEQ ID NO: 301380 - RNA, 64 nt, Homo Sapiens; identical to SEQ ID NO: 58458

SEQ ID NO: 301381 - RNA, 64 nt, Homo Sapiens; identical to SEQ ID NO: 58459

SEQ ID NO: 301382 - RNA, 64 nt, Homo Sapiens; identical to SEQ ID NO: 58460

SEQ ID NO: 301383 - RNA, 64 nt, Homo Sapiens; identical to SEQ ID NO: 58461

SEQ ID NO: 301384 - RNA, 64 nt, Homo Sapiens; identical to SEQ ID NO: 58462

SEQ ID NO: 301385 - RNA, 64 nt, Homo Sapiens; identical to SEQ ID NO: 58463

SEQ ID NO: 301386 - RNA, 64 nt, Homo Sapiens; identical to SEQ ID NO: 58464

SEQ ID NO: 301387 - RNA, 64 nt, Homo Sapiens; identical to SEQ ID NO: 58465

SEQ ID NO: 301388 - RNA, 64 nt, Homo Sapiens; identical to SEQ ID NO: 58466

SEQ ID NO: 301389 - RNA, 64 nt, Homo Sapiens; identical to SEQ ID NO: 58467

SEQ ID NO: 301390 - RNA, 64 nt, Homo Sapiens
auguuaaccuuaaacucuaggccuuacuggaagccacugauaggggacacuucacuaccagaug

SEQ ID NO: 301391 - RNA, 64 nt, Homo Sapiens
acuuaauuuuuucucuguauuuuuguuacaaagccacugauacgugcacaauuguaauuaagua

SEQ ID NO: 301392 - RNA, 64 nt, Homo Sapiens
uaucuucaugguggggcaggcaugugaaaaugaucacugauaaaguacuaaauaaauaaaaauu

SEQ ID NO: 301393 - RNA, 64 nt, Homo Sapiens
ugggacccacuccagagauugagccuuuauaagacacugauacuguguguuagucuucccuggg

SEQ ID NO: 301394 - RNA, 64 nt, Homo Sapiens
aguuguguuugguaaaauucccacuugaaugugacacugauaauaauuaugcugauuuuuagca

SEQ ID NO: 301395 - RNA, 64 nt, Homo Sapiens
aauaguagcucauucucucuaaaaauuuacugcccacugauaggauguuuuguuuccuugauaa

SEQ ID NO: 301396 - RNA, 64 nt, Homo Sapiens
uaauccuuaaaaccccuuuacagaauaguagacacacugauauuagcccucuaugugguccagg

SEQ ID NO: 301397 - RNA, 64 nt, Homo Sapiens
uuucaaggucuuguuuuagggauccuucgaacagcacugauacacuucuccaccuucauugcua

SEQ ID NO: 301398 - RNA, 64 nt, Homo Sapiens
auuagacagaacgagaaugcugucaaaacagccccacugauaaucgcugcuucugagacuucuc

SEQ ID NO: 301399 - RNA, 64 nt, Homo Sapiens
cccccuuuaguuauucugaaacaacauaacuuaccacugauacuuuuuuguucuuuuuuccagc

SEQ ID NO: 301400 - RNA, 64 nt, Homo Sapiens
aaaucucucuccaaaauucuuuuguauaaagcaccacugauagcauguuaucagauuaugcuau

SEQ ID NO: 301401 - RNA, 64 nt, Homo Sapiens
auguacuggauaaugccacagaaugaauagacuacacugauaaaaaaauuaccguuuuagacca

SEQ ID NO: 301402 - RNA, 64 nt, Homo Sapiens
caacacauagcaggugugcaagcugggguguuuucacugauaaaccaucagagcuuugugaauc

SEQ ID NO: 301403 - RNA, 64 nt, Homo Sapiens
ccuuuggaaaauggugcgcuacaugucagcugcccacugauacuauaaauauuccauaguggug

SEQ ID NO: 301404 - RNA, 64 nt, Homo Sapiens
uccgaauacauaaaauguuuaagccauuaguugacacugauaaccuucuuagacaaaaacacac

SEQ ID NO: 301405 - RNA, 64 nt, Homo Sapiens
uuuuaaaaacacccuaguugcuauuuuggauguucacugauaauugaacgcauugggaacaauu

SEQ ID NO: 301406 - RNA, 64 nt, Homo Sapiens
uauuagguggaaauuuuauauguaaauguguuagcacugauaguccuuuuuccaauguuuuauu

SEQ ID NO: 301407 - RNA, 64 nt, Homo Sapiens
ccccucucucccugguccccucccccauccccaccacugauaucauggggaguaauaggaccag

SEQ ID NO: 301408 - RNA, 64 nt, Homo Sapiens
gaccacugcccaagcccugcccgccucuccccccacgcucaaccugcccacuuguccaggccug

SEQ ID NO: 301409 - RNA, 64 nt, Homo Sapiens
cccuguccacauauacaaccgacacaagacacacacgcucaaacaauccauccaugcauacaua

SEQ ID NO: 301410 - RNA, 64 nt, Homo Sapiens
ucaggucuucacgcgggggggagaacagaaauccacgcucaauccccuugcugcagaguuggug

SEQ ID NO: 301411 - RNA, 64 nt, Homo Sapiens
aaggaugccuuaucucuucuuccaggccugggucacgcucaaggccuauucugccaugggagag

SEQ ID NO: 301412 - RNA, 64 nt, Homo Sapiens
aacuccggacugaagaugcaucaggccuggucucacgcucaauaaaaccuggccccugcaggag

SEQ ID NO: 301413 - RNA, 64 nt, Homo Sapiens
aggagaguaagaaacagcauggagaaaacccgguacgcucaaaaagaaaaaggaaaaaaaaaaa

SEQ ID NO: 301414 - RNA, 64 nt, Homo Sapiens
ggcccccauuuuauuagucgguguguucaguaucacgcucaagacaagggccaaccuauuacuu

SEQ ID NO: 301415 - RNA, 64 nt, Homo Sapiens
gagugugggggguuucaaggguguguuaggaacaacgcucaaaauccuaaggaaacugaacacu

SEQ ID NO: 301416 - RNA, 64 nt, Homo Sapiens
ugacaucaauuaacagucuuuaaagauguuacauacgcucaaagcaaugugauuaagacuuuuu

SEQ ID NO: 301417 - RNA, 64 nt, Homo Sapiens
cccugggguaugagcugccaagucuauuuuaaagacgcucaagaauccucugggguucaucuag

SEQ ID NO: 301418 - RNA, 64 nt, Homo Sapiens
cccaguaaaauuucaggauuggccuuuccucugcacgcucaauguucuuugucauucaguucua

SEQ ID NO: 301419 - RNA, 64 nt, Homo Sapiens
ucuccuguuuguauuuuguauucuagagcaagauacgcucaaauuuaucauuuuggaggauucu

SEQ ID NO: 301420 - RNA, 64 nt, Homo Sapiens
uuagucccgucuuccucaccgccccagcaggggaacgcucaagccugguugaaaugcugccucu

SEQ ID NO: 301421 - RNA, 64 nt, Homo Sapiens
uuuggcccagccaucgccgacccuagucccacccacgcucaaccacuccuggcccucggccccu

SEQ ID NO: 301422 - RNA, 62 nt, Homo Sapiens
aggauauggaaacaaaaguuuugcuuucuagaagacgcucaaccagaaggcagaaucaagcu

SEQ ID NO: 301423 - RNA, 64 nt, Homo Sapiens
guuuuaucaggauaauugucucaugaccaaauccacgcucaauuagagccauucaaaauuccuu

SEQ ID NO: 301424 - RNA, 64 nt, Homo Sapiens
cuuacgaccagagaaggauuaaacaaaaaacaaaacgcucaagcugcagucuguagcacugaac

SEQ ID NO: 301425 - RNA, 64 nt, Homo Sapiens
gcucacaugccuucaaaagugaaagcucaacucuacgcucaagcauaugacguauguuacacuu

SEQ ID NO: 301426 - RNA, 64 nt, Homo Sapiens
caacagcuguucuguucuaucuaccccucauuucacgcucaaggagucauaccuagaauaguua

SEQ ID NO: 301427 - RNA, 64 nt, Homo Sapiens
uccuaaggaaauugaauacuguguauuaggaauaacgcucaaaaugaguguggggguuucaagg

SEQ ID NO: 301428 - RNA, 64 nt, Homo Sapiens
caaguauggaggguaggagugcaacccaggagcaacgcucaagguggccgagaugcagggagga

SEQ ID NO: 301429 - RNA, 64 nt, Homo Sapiens
cccaucuaccugcugacagagcaugacaaagaugacgcucaaaaguaaugccauuacuucuuuu

SEQ ID NO: 301430 - RNA, 64 nt, Homo Sapiens
caccaagaagaaucuucuggcuacaucuucucucacgcucaagugacaugaacacuguacugaa

SEQ ID NO: 301431 - RNA, 64 nt, Homo Sapiens
uuuuuaaaugguuaaugugagucaucuaaugcaaacgcucaaccuuccucuacuauuuuucaau

SEQ ID NO: 301432 - RNA, 64 nt, Homo Sapiens
ccuucacccacggaucugcccaggcugaaggcacacgcucaaugccccacgugccuucuccagg

SEQ ID NO: 301433 - RNA, 64 nt, Homo Sapiens
cagagaggcagauuccuuccccucccguccccucacgcucaaacccccacuuccugccccaggc

SEQ ID NO: 301434 - RNA, 64 nt, Homo Sapiens
cagguggggccccuggggcaauggcagugguagaacgcucaacuugguugcgguaccaucagcc

SEQ ID NO: 301435 - RNA, 64 nt, Homo Sapiens
gggcacccggggggcccuggcuggcaacgauuccacgcucaaagcgauagcagggagccaugac

SEQ ID NO: 301436 - RNA, 64 nt, Homo Sapiens
cccgcccuuagaccaggcagcgcuaguuccauccacgcucaagagggaacucgccaccugccca

SEQ ID NO: 301437 - RNA, 64 nt, Homo Sapiens
ccaaguccuuuaugcuuuguuugagcccacacacacgcucaaccgacagcacuugcauggucac

SEQ ID NO: 301438 - RNA, 64 nt, Homo Sapiens
uuccaccucgugcacagcgcucugcacagacaacacgcucaauaaaaguucagccauagcagca

SEQ ID NO: 301439 - RNA, 64 nt, Homo Sapiens
uuucuaugauaaacauguaucuuuguauuacuuagguucuuaaauuaaagguaauccuuacuuu

SEQ ID NO: 301440 - RNA, 64 nt, Homo Sapiens
uaaagguaauccuuacuuuccuuuguauuacuuagguucuuaauuuaaagguaauccuuacuuu

SEQ ID NO: 301441 - RNA, 64 nt, Homo Sapiens
uggugaucugggauuaggccagagcaagggaagugguucuuagaaagcaucucauuuugaguag

SEQ ID NO: 301442 - RNA, 64 nt, Homo Sapiens
gcuugguccuugauuuaucauugaaagaagaaaagguucuuacuaacugauggauaucccuacc

SEQ ID NO: 301443 - RNA, 64 nt, Homo Sapiens
uaguucaugugaaaaucauggaaacuagguaacagguucuuaaaugugaugagucuugaagcug

SEQ ID NO: 301444 - RNA, 64 nt, Homo Sapiens
cuggccuuggaaggguaucaagaauaacaucugagguucuuaacuauaauucuccacuguguuu

SEQ ID NO: 301445 - RNA, 64 nt, Homo Sapiens
aggagugguucucauuuggucugccagaauacuggguucuuaguugacaaccuagaaugucaga

SEQ ID NO: 301446 - RNA, 64 nt, Homo Sapiens
ggagcuacugaugaaaucugcuagaaaguuaggggguucuuauuuugcauuccagaaucuugac

SEQ ID NO: 301447 - RNA, 64 nt, Homo Sapiens
gccucccauuugccaucauacuucgagcacgccagguucuuauuccaccaaugccaaaguagca

SEQ ID NO: 301448 - RNA, 64 nt, Homo Sapiens
gcuaacaauggcauugcagcaaagugauugagaagguucuuauuuuacucgcuuugggggaaau

SEQ ID NO: 301449 - RNA, 64 nt, Homo Sapiens; identical to SEQ ID NO: 111876

SEQ ID NO: 301450 - RNA, 64 nt, Homo Sapiens; identical to SEQ ID NO: 111877

SEQ ID NO: 301451 - RNA, 64 nt, Homo Sapiens; identical to SEQ ID NO: 111878

SEQ ID NO: 301452 - RNA, 64 nt, Homo Sapiens; identical to SEQ ID NO: 111879

SEQ ID NO: 301453 - RNA, 64 nt, Homo Sapiens; identical to SEQ ID NO: 111880

SEQ ID NO: 301454 - RNA, 64 nt, Homo Sapiens; identical to SEQ ID NO: 111881

SEQ ID NO: 301455 - RNA, 64 nt, Homo Sapiens; identical to SEQ ID NO: 24937

SEQ ID NO: 301456 - RNA, 64 nt, Homo Sapiens; identical to SEQ ID NO: 24938

SEQ ID NO: 301457 - RNA, 64 nt, Homo Sapiens; identical to SEQ ID NO: 24939

SEQ ID NO: 301458 - RNA, 64 nt, Homo Sapiens; identical to SEQ ID NO: 24940

SEQ ID NO: 301459 - RNA, 64 nt, Homo Sapiens; identical to SEQ ID NO: 24941

SEQ ID NO: 301460 - RNA, 64 nt, Homo Sapiens; identical to SEQ ID NO: 24942

SEQ ID NO: 301461 - RNA, 64 nt, Homo Sapiens; identical to SEQ ID NO: 24943

SEQ ID NO: 301462 - RNA, 64 nt, Homo Sapiens; identical to SEQ ID NO: 24944

SEQ ID NO: 301463 - RNA, 64 nt, Homo Sapiens; identical to SEQ ID NO: 24945

SEQ ID NO: 301464 - RNA, 64 nt, Homo Sapiens; identical to SEQ ID NO: 24946

SEQ ID NO: 301465 - RNA, 64 nt, Homo Sapiens; identical to SEQ ID NO: 24947

SEQ ID NO: 301466 - RNA, 64 nt, Homo Sapiens; identical to SEQ ID NO: 24948

SEQ ID NO: 301467 - RNA, 64 nt, Homo Sapiens; identical to SEQ ID NO: 24949

SEQ ID NO: 301468 - RNA, 64 nt, Homo Sapiens; identical to SEQ ID NO: 24950

SEQ ID NO: 301469 - RNA, 64 nt, Homo Sapiens; identical to SEQ ID NO: 24951

SEQ ID NO: 301470 - RNA, 64 nt, Homo Sapiens; identical to SEQ ID NO: 24952

SEQ ID NO: 301471 - RNA, 64 nt, Homo Sapiens; identical to SEQ ID NO: 219184

SEQ ID NO: 301472 - RNA, 64 nt, Homo Sapiens; identical to SEQ ID NO: 219185

SEQ ID NO: 301473 - RNA, 64 nt, Homo Sapiens; identical to SEQ ID NO: 219186

SEQ ID NO: 301474 - RNA, 64 nt, Homo Sapiens; identical to SEQ ID NO: 219187

SEQ ID NO: 301475 - RNA, 64 nt, Homo Sapiens; identical to SEQ ID NO: 219188

SEQ ID NO: 301476 - RNA, 64 nt, Homo Sapiens; identical to SEQ ID NO: 219189

SEQ ID NO: 301477 - RNA, 64 nt, Homo Sapiens; identical to SEQ ID NO: 219190

SEQ ID NO: 301478 - RNA, 64 nt, Homo Sapiens; identical to SEQ ID NO: 219191

SEQ ID NO: 301479 - RNA, 64 nt, Homo Sapiens; identical to SEQ ID NO: 219192

SEQ ID NO: 301480 - RNA, 64 nt, Homo Sapiens; identical to SEQ ID NO: 219193

SEQ ID NO: 301481 - RNA, 64 nt, Homo Sapiens; identical to SEQ ID NO: 219194

SEQ ID NO: 301482 - RNA, 64 nt, Homo Sapiens; identical to SEQ ID NO: 219195

SEQ ID NO: 301483 - RNA, 64 nt, Homo Sapiens; identical to SEQ ID NO: 219196

SEQ ID NO: 301484 - RNA, 64 nt, Homo Sapiens; identical to SEQ ID NO: 219197

SEQ ID NO: 301485 - RNA, 64 nt, Homo Sapiens; identical to SEQ ID NO: 219198

SEQ ID NO: 301486 - RNA, 64 nt, Homo Sapiens; identical to SEQ ID NO: 219199

SEQ ID NO: 301487 - RNA, 64 nt, Homo Sapiens; identical to SEQ ID NO: 219200

SEQ ID NO: 301488 - RNA, 64 nt, Homo Sapiens; identical to SEQ ID NO: 219201

SEQ ID NO: 301489 - RNA, 64 nt, Homo Sapiens; identical to SEQ ID NO: 219202

SEQ ID NO: 301490 - RNA, 64 nt, Homo Sapiens; identical to SEQ ID NO: 219203

SEQ ID NO: 301491 - RNA, 64 nt, Homo Sapiens; identical to SEQ ID NO: 219204

SEQ ID NO: 301492 - RNA, 64 nt, Homo Sapiens; identical to SEQ ID NO: 219205

SEQ ID NO: 301493 - RNA, 64 nt, Homo Sapiens; identical to SEQ ID NO: 219206

SEQ ID NO: 301494 - RNA, 64 nt, Homo Sapiens; identical to SEQ ID NO: 219207

SEQ ID NO: 301495 - RNA, 64 nt, Homo Sapiens; identical to SEQ ID NO: 219208

SEQ ID NO: 301496 - RNA, 64 nt, Homo Sapiens; identical to SEQ ID NO: 219209

SEQ ID NO: 301497 - RNA, 64 nt, Homo Sapiens; identical to SEQ ID NO: 219210

SEQ ID NO: 301498 - RNA, 64 nt, Homo Sapiens; identical to SEQ ID NO: 219211

SEQ ID NO: 301499 - RNA, 64 nt, Homo Sapiens; identical to SEQ ID NO: 219212

SEQ ID NO: 301500 - RNA, 64 nt, Homo Sapiens; identical to SEQ ID NO: 219213

SEQ ID NO: 301501 - RNA, 64 nt, Homo Sapiens
caguuuuccugguucccucacuuggucugaccccuuggccuauccuccuggaaccaccucucug

SEQ ID NO: 301502 - RNA, 64 nt, Homo Sapiens
guggcaaauggaacuucucugccgcuuaccuagcuuggccuagaccacaaugcuucauggcucu

SEQ ID NO: 301503 - RNA, 64 nt, Homo Sapiens; identical to SEQ ID NO: 73933

SEQ ID NO: 301504 - RNA, 64 nt, Homo Sapiens; identical to SEQ ID NO: 73934

SEQ ID NO: 301505 - RNA, 64 nt, Homo Sapiens; identical to SEQ ID NO: 73935

SEQ ID NO: 301506 - RNA, 64 nt, Homo Sapiens; identical to SEQ ID NO: 73936

SEQ ID NO: 301507 - RNA, 64 nt, Homo Sapiens; identical to SEQ ID NO: 73937

SEQ ID NO: 301508 - RNA, 64 nt, Homo Sapiens; identical to SEQ ID NO: 73938

SEQ ID NO: 301509 - RNA, 64 nt, Homo Sapiens; identical to SEQ ID NO: 73939

SEQ ID NO: 301510 - RNA, 64 nt, Homo Sapiens; identical to SEQ ID NO: 73940

SEQ ID NO: 301511 - RNA, 64 nt, Homo Sapiens; identical to SEQ ID NO: 73941

SEQ ID NO: 301512 - RNA, 64 nt, Homo Sapiens; identical to SEQ ID NO: 73942

SEQ ID NO: 301513 - RNA, 64 nt, Homo Sapiens; identical to SEQ ID NO: 73943

SEQ ID NO: 301514 - RNA, 64 nt, Homo Sapiens; identical to SEQ ID NO: 73944

SEQ ID NO: 301515 - RNA, 64 nt, Homo Sapiens; identical to SEQ ID NO: 73945

SEQ ID NO: 301516 - RNA, 64 nt, Homo Sapiens; identical to SEQ ID NO: 73946

SEQ ID NO: 301517 - RNA, 64 nt, Homo Sapiens; identical to SEQ ID NO: 73947

SEQ ID NO: 301518 - RNA, 64 nt, Homo Sapiens; identical to SEQ ID NO: 73948

SEQ ID NO: 301519 - RNA, 64 nt, Homo Sapiens; identical to SEQ ID NO: 73949

SEQ ID NO: 301520 - RNA, 64 nt, Homo Sapiens; identical to SEQ ID NO: 73950

SEQ ID NO: 301521 - RNA, 64 nt, Homo Sapiens; identical to SEQ ID NO: 73951

SEQ ID NO: 301522 - RNA, 64 nt, Homo Sapiens; identical to SEQ ID NO: 73952

SEQ ID NO: 301523 - RNA, 64 nt, Homo Sapiens; identical to SEQ ID NO: 73953

SEQ ID NO: 301524 - RNA, 64 nt, Homo Sapiens; identical to SEQ ID NO: 73954

SEQ ID NO: 301525 - RNA, 64 nt, Homo Sapiens; identical to SEQ ID NO: 73955

SEQ ID NO: 301526 - RNA, 64 nt, Homo Sapiens
ccuuucccaccuggagagaaacuuccagaccagccccucauaccacagccaagaggggccuuuc

SEQ ID NO: 301527 - RNA, 64 nt, Homo Sapiens; identical to SEQ ID NO: 301526

SEQ ID NO: 301528 - RNA, 64 nt, Homo Sapiens
cugacuuuccuaguuguuuuuuuauugagagccacccucauacccuguaauuuugucccaaauc

SEQ ID NO: 301529 - RNA, 64 nt, Homo Sapiens
guugagcagcauaauaaucccgggagaaugauuccccucauagaaagacaaaagcauccauccc

SEQ ID NO: 301530 - RNA, 64 nt, Homo Sapiens
ugauuccccucauagaaagacaaaagcauccauccccucauaguuaaguagccacugguguccu

SEQ ID NO: 301531 - RNA, 64 nt, Homo Sapiens
cccacuuucuaggaucauuuuuauguaaagucacauaucccaggcccucagguugaauccagag

SEQ ID NO: 301532 - RNA, 64 nt, Homo Sapiens
aaauuuggaaauccuucccaugccugaugaguuuauaucccagaaacauugagccaucagaaug

SEQ ID NO: 301533 - RNA, 64 nt, Homo Sapiens
gauggaagacuccagggggcaaggaccaagggccauaucccaagugacuuuguacccagaaaau

SEQ ID NO: 301534 - RNA, 64 nt, Homo Sapiens
uuauuuaccgaacaguuggaaaguaaaacuuugaauaucccagcgaagaaauggauaaauggua

SEQ ID NO: 301535 - RNA, 64 nt, Homo Sapiens
ggagccuucuucaccagcuccuugggacaauggaauaucccaggguggugacagcagauggagc

SEQ ID NO: 301536 - RNA, 64 nt, Homo Sapiens
uucucucuugaucuuaaagauuguaucuuauugaauaucccacuguauauuauuuuuauaugua

SEQ ID NO: 301537 - RNA, 64 nt, Homo Sapiens
acccuuccccacacauaccaccuuggcuucuucuauaucccaccccgaugcucucccagguggg

SEQ ID NO: 301538 - RNA, 64 nt, Homo Sapiens
uggaucgugaauuuuuuucauguaacuccuauucauaucccauagaucuaguauuguacagcac

SEQ ID NO: 301539 - RNA, 64 nt, Homo Sapiens
gcgaagcgcugagauucuucuugcuuuucuccccauaucccaagcgaaggcauucuuguuagcu

SEQ ID NO: 301540 - RNA, 64 nt, Homo Sapiens
gcccuugccucauaauagaugggauggugggaacauaucccaguuagccuacucuuguguuuag

SEQ ID NO: 301541 - RNA, 64 nt, Homo Sapiens
uaauaaagagcucacacagaaauggauauggaauauaucccaauuuucuaaaaauaugagugag

SEQ ID NO: 301542 - RNA, 64 nt, Homo Sapiens
uauuuaauaugucaaaaaggcucuugccuuaaauauaucccauaucauuuggauugccuuacuu

SEQ ID NO: 301543 - RNA, 64 nt, Homo Sapiens
uacgcugauuugaucuuuacauuuaaggugacagauaucccaacaacauaaagaaaagacgaau

SEQ ID NO: 301544 - RNA, 64 nt, Homo Sapiens
aacacucucccagcucccauuaagggaggugcuuauaucccaccucaagcugccaaacaggucu

SEQ ID NO: 301545 - RNA, 64 nt, Homo Sapiens
cagaaacauucagguuugaauuuuuuuuugcaacauaucccacuaacuuggaucuaguuuaauu

SEQ ID NO: 301546 - RNA, 64 nt, Homo Sapiens
cuagaucagggaacaaaauccucuccuuguggaaauaucccaugcaguuuguugauacaacuua

SEQ ID NO: 301547 - RNA, 64 nt, Homo Sapiens
gcaggaacuggaguaaaugcaauacuguguuguaauaucccaacaaaaaucagacaaaaaaugg

SEQ ID NO: 301548 - RNA, 64 nt, Homo Sapiens
ucuuguauggcuuugguaggcauacuuggagaacauaucccacauuaggaauugauuuaagccu

SEQ ID NO: 301549 - RNA, 64 nt, Homo Sapiens
ugcuaagagaaaaaaaagacuuguuucugaucuaauaucccagaaaaaguaacucauugcucug

SEQ ID NO: 301550 - RNA, 64 nt, Homo Sapiens
ggcacuuuauacuguucacuguauaaauauauguauaucccagcaccucgguauauauauaugu

SEQ ID NO: 301551 - RNA, 64 nt, Homo Sapiens
aaaugccacucauccccacuucaacuuuacacccauaucccagcguugaaccuucaugaccuua

SEQ ID NO: 301552 - RNA, 64 nt, Homo Sapiens
cacaagaucguauacccauagcugcucugauuggauaucccaccaaucguuacgcaacucuuug

SEQ ID NO: 301553 - RNA, 64 nt, Homo Sapiens
ccauugccagcuccacucucccugcugagugaacauaucccagauacugcuacuugggcagcuc

SEQ ID NO: 301554 - RNA, 64 nt, Homo Sapiens
uguuuuuuguuugucaccuccaauaagaacgcacauaucccagcucaagugccccuauuuauuu

SEQ ID NO: 301555 - RNA, 64 nt, Homo Sapiens
cuguuuaacuaucucuuccaugaggauuuccuucauaucccauggaaugcaaaauuaauacugc

SEQ ID NO: 301556 - RNA, 64 nt, Homo Sapiens
uuucuaaauguuauaaaagcauauuuacuggaaaauaucccaggagucauugcauaccaaaacc

SEQ ID NO: 301557 - RNA, 64 nt, Homo Sapiens
ugguaaagacugaagggaaacucuugccacaucaauaucccagauuuuacuuuauuuccagguu

SEQ ID NO: 301558 - RNA, 64 nt, Homo Sapiens
cucuugcaaacgauugugaauggcuuucuaugguauaucccaguaacugguaacagguuguaga

SEQ ID NO: 301559 - RNA, 64 nt, Homo Sapiens
agcaccccaguuccucaccagcuacucuggccauauaucccacaccagaaggaacaaguguggc

SEQ ID NO: 301560 - RNA, 64 nt, Homo Sapiens
acuguaaaugcaauguaaagacacacagccacacauaucccacagauauuuucauuguguucuu

SEQ ID NO: 301561 - RNA, 60 nt, Homo Sapiens
caccaccucucacaauuuaggcagaagcugauaucccagaaagacuauauauuguuuuuu

SEQ ID NO: 301562 - RNA, 64 nt, Homo Sapiens
ucuuaauaggauagauacccacauacaguauaauauaucccauucagguuucagaguuuucuaa

SEQ ID NO: 301563 - RNA, 64 nt, Homo Sapiens
auuacugccaaacuggaauuuucaaguuauuauaauaucccaggccccuugauaaaagcugagg

SEQ ID NO: 301564 - RNA, 64 nt, Homo Sapiens
guuccagccggugccaaccugugaacuucccaccauaucccagaaucugcuauuccccaaacca

SEQ ID NO: 301565 - RNA, 64 nt, Homo Sapiens
uagcccugccacuauuggcuacuuacccucauuaauaucccacuugagaaaaauugugagacua

SEQ ID NO: 301566 - RNA, 64 nt, Homo Sapiens
uucaacaagccuaggcuaucucguaaguugaaaaauaucccacuauaguugcuucaugaguaug

SEQ ID NO: 301567 - RNA, 64 nt, Homo Sapiens
uagagauauggccuuuaacuauuaauuuuuuuuaauaucccagcuuagaauuugggcuggugag

SEQ ID NO: 301568 - RNA, 64 nt, Homo Sapiens
cuaccaauaugcucauucgaaagcagggcuuaggauaucccagcggauggcgacaagggcagcc

SEQ ID NO: 301569 - RNA, 64 nt, Homo Sapiens
gguuaucuguauggacugacagaguggcuugaauauaucccaugaaugaccaucgauggcucaa

SEQ ID NO: 301570 - RNA, 64 nt, Homo Sapiens
cccugguuacuggcauuccuguugugauaugcaaauaucccauuaguguauuuagccuguagau

SEQ ID NO: 301571 - RNA, 64 nt, Homo Sapiens
aucaccucaaacccaaucacauauuaccuggccaauaucccaccgucaucacuugguccaugaa

SEQ ID NO: 301572 - RNA, 64 nt, Homo Sapiens
agaagaggcaagggcauccagcacuaccacuaagauaucccagaagguagucauuagggagcag

SEQ ID NO: 301573 - RNA, 64 nt, Homo Sapiens
gguggggguucccagcauugauuuguaguccugaauaucccagucagagcuuucaacucucuga

SEQ ID NO: 301574 - RNA, 64 nt, Homo Sapiens
cuaguuguguauuaaauuugguucaauaaaggucauaucccaaaauuuccacucugguggauaa

SEQ ID NO: 301575 - RNA, 64 nt, Homo Sapiens
caauccaguauaccacccuugaauauguauuaaaauaucccaaguauauuugucauuuucucuu

SEQ ID NO: 301576 - RNA, 64 nt, Homo Sapiens
ugaaaacugcuguauggaaaacuacaguguaaacauaucccagaugggggcagucaaggaauaa

SEQ ID NO: 301577 - RNA, 64 nt, Homo Sapiens
agcauacgcaggagccuauccugaauuuuguaaaauaucccaacaguucuuaaaugaaaacugg

SEQ ID NO: 301578 - RNA, 64 nt, Homo Sapiens
auacagcaagugcaccuauauucaccauuaacuuauaucccaaguccauuuuuuccuguacacu

SEQ ID NO: 301579 - RNA, 64 nt, Homo Sapiens
ugagccccugaguuguggggguagggugaagagcauaucccacaagaggccccacagggagcag

SEQ ID NO: 301580 - RNA, 64 nt, Homo Sapiens
aagauaauuuggguucuugaguuguuuuggaguaauaucccacaacugggguaggaagcucagg

SEQ ID NO: 301581 - RNA, 64 nt, Homo Sapiens
gccccgaacacuuucccacuguuauucuuuccucauaucccaacacucagaacucuugugacau

SEQ ID NO: 301582 - RNA, 64 nt, Homo Sapiens
aauuagaaaccuuaauauguauuuauuaguuaauauaucccagaaugggagaguagauggugaa

SEQ ID NO: 301583 - RNA, 64 nt, Homo Sapiens
ccuauuaaaucacaaucuuuccaaagcucaggccauaucccagguugagaauccuuuaaaaauu

SEQ ID NO: 301584 - RNA, 64 nt, Homo Sapiens
agucaaaaaggcaaaaugaaggagaaaagagaagauaucccagaauaggcuaggaauugagcca

SEQ ID NO: 301585 - RNA, 64 nt, Homo Sapiens
caagagaguaguuucaaguguaaaacagcuugaaauaucccaugucccugcuccuugcccauag

SEQ ID NO: 301586 - RNA, 64 nt, Homo Sapiens
agcccaagaaagauggcucauuuggaaaggccuaauaucccaaguugcuuaccuagaagaacuu

SEQ ID NO: 301587 - RNA, 64 nt, Homo Sapiens
uuaucaugggaaaagaccagggcuuuucccaggaauaucccaaacuucggaaacaaguuauucu

SEQ ID NO: 301588 - RNA, 64 nt, Homo Sapiens
ucaaacgagacggauagaagcuacuuuuuaaagaauaucccacugcaucugcaaauuuaguuuu

SEQ ID NO: 301589 - RNA, 64 nt, Homo Sapiens
ucuacuuuagaaguacuaauuggagaugacuuuuauaucccauuuugguaauuauucauacaua

SEQ ID NO: 301590 - RNA, 64 nt, Homo Sapiens
gaccaaugcuuaagguggacuuuguucguaaacaauaucccaauagauuuguugacuugagguc

SEQ ID NO: 301591 - RNA, 64 nt, Homo Sapiens
ucuaacucgaaggcgccugaaaagaucaaauucuauaucccagauaccuuccguaagucuuuau

SEQ ID NO: 301592 - RNA, 64 nt, Homo Sapiens
cccagauugcacaguaaguuaccaaaggcuugcaauaucccacuagaaaucauugaaugugcug

SEQ ID NO: 301593 - RNA, 64 nt, Homo Sapiens
gcacugagagggcucaaucagaaagggguauuguauaucccacuucaugggguggggagaugcu

SEQ ID NO: 301594 - RNA, 64 nt, Homo Sapiens
ugggagaaguccagugcccacaagcacauacacuauaucccauagugcaugccuugggcacaaa

SEQ ID NO: 301595 - RNA, 64 nt, Homo Sapiens
cauugccuaaacagauuacauccagauacaaaccauaucccagcgauuauuaugauucccauac

SEQ ID NO: 301596 - RNA, 64 nt, Homo Sapiens
uuggaagggaccccagauacaagggaucugcuugauaucccaagaccaagaacauaaacccucc

SEQ ID NO: 301597 - RNA, 64 nt, Homo Sapiens
gucuucagguuucccaagacccuuggccuucugaauaucccagucaacaggauaagcuggaucc

SEQ ID NO: 301598 - RNA, 64 nt, Homo Sapiens
auccuauuucauguauaguuauguuaaaaacugaauaucccaucaauagcuauaguauauguau

SEQ ID NO: 301599 - RNA, 64 nt, Homo Sapiens
uuuuucugcaggacuuuaaagcuuugaaaggccaauaucccauaggcuaacuuuaaacauguau

SEQ ID NO: 301600 - RNA, 64 nt, Homo Sapiens
uuacuaaauuggguucauuaucuuuuauuuuucaauaucccaguaaacccauguauauuaucac

SEQ ID NO: 301601 - RNA, 64 nt, Homo Sapiens
gcccucgucccgaggccguguguggcucagucacauaucccaggaauuggcacccgaauguugc

SEQ ID NO: 301602 - RNA, 64 nt, Homo Sapiens
uuuaaaaagaaaaaaaaagaccuuccucuguaagauaucccagcaguaaaaaagguuaauuuuu

SEQ ID NO: 301603 - RNA, 64 nt, Homo Sapiens
aaauugggaucacaugcuuuaaaugcaggagaggauaucccagcacacugagugaagguguuug

SEQ ID NO: 301604 - RNA, 64 nt, Homo Sapiens
uaguucuucuacgcauagcuaauacagcacuugaauaucccaagaucuauaggcuuaucguuca

SEQ ID NO: 301605 - RNA, 64 nt, Homo Sapiens
gaggcccugugucuaccaggcagaacaaagaacaauaucccaaauuuccuggugagcacagaau

SEQ ID NO: 301606 - RNA, 64 nt, Homo Sapiens
ggaaccagaucacgauuuuuagccauggaacaauauaucccaugggagaagaccuuucagugug

SEQ ID NO: 301607 - RNA, 64 nt, Homo Sapiens
aguacuugguaaguuacuuaaaauuuuuacaaaaauaucccacucaaugccaaaucuuucaguc

SEQ ID NO: 301608 - RNA, 64 nt, Homo Sapiens
uuuuaggauuauagguugcaaauuauccaaauauauaucccauuuuuuaaagcauaauaucuuu

SEQ ID NO: 301609 - RNA, 64 nt, Homo Sapiens
ugaacuugagcccuguuuggauagggucuaugucauaucccaagggguuagaucacacauaaca

SEQ ID NO: 301610 - RNA, 64 nt, Homo Sapiens
auucugcaauggcagcauucggcuucuguaaucaauaucccaacaagaaaauugcaugaaacua

SEQ ID NO: 301611 - RNA, 64 nt, Homo Sapiens
aacagggcaugaggguucugggugacacaauuuuauaucccauccccaaacuguuuuccaaugu

SEQ ID NO: 301612 - RNA, 64 nt, Homo Sapiens
uuagaguuuacagggacaguuuauauuguucuucauaucccaaauggcaccagcaacuacuucu

SEQ ID NO: 301613 - RNA, 64 nt, Homo Sapiens
uaguuaagugcgugauuuauacaaguuagaaauuauaucccauuauuauuucuucacuuuuaac

SEQ ID NO: 301614 - RNA, 64 nt, Homo Sapiens
ccaccuguacauacauuguauaggccaucuguaaauaucccagagaacaaucacuauucuuaag

SEQ ID NO: 301615 - RNA, 64 nt, Homo Sapiens
uccagccagcaccccaucugccacagugcugcuaauaucccagcuccuggcacuacccagauuu

SEQ ID NO: 301616 - RNA, 64 nt, Homo Sapiens
accacaaguguauuuuuagucaucuacacgucaaauaucccaagacagauuaugcuaaauacau

SEQ ID NO: 301617 - RNA, 64 nt, Homo Sapiens
auucauacuguagaaaccagcucauguguaccucauaucccauccuuaagagaagaaauguuau

SEQ ID NO: 301618 - RNA, 64 nt, Homo Sapiens
uguaugccgggagcuaaguggucuaugggugaacauaucccaccuugcuuccugaguccuuggu

SEQ ID NO: 301619 - RNA, 64 nt, Homo Sapiens
guagcuuuucaccuuuacuuuagaagcacaguaaauaucccaaacugugaugaagccgaccuua

SEQ ID NO: 301620 - RNA, 64 nt, Homo Sapiens
uauauuuguuaagaggaaauaaucaagaucacucauaucccaacugaaucugagguuuuauaaa

SEQ ID NO: 301621 - RNA, 64 nt, Homo Sapiens
uuuaaaaauuggaauaauguauuaaggucaaauaauaucccauaaaauauauauuucugcuaau

SEQ ID NO: 301622 - RNA, 64 nt, Homo Sapiens
cuauaucagacuuuaccugaguguuauauuuuagauaucccaaguugacccuagaguagcccug

SEQ ID NO: 301623 - RNA, 64 nt, Homo Sapiens
uauagaugggggaaagcaaaagguaguaccuuuuauaucccauuuucuucacugcaacaugaug

SEQ ID NO: 301624 - RNA, 64 nt, Homo Sapiens
agcauccaaacuccauuaaguucccauucacucaauaucccauacucugaccucucaucaaauc

SEQ ID NO: 301625 - RNA, 64 nt, Homo Sapiens
gaguuucuuacuucuguuucagguccccaauuacauaucccaaaagcagcugggaaggugucug

SEQ ID NO: 301626 - RNA, 64 nt, Homo Sapiens
auuucuuuuuuuuuuaauugugaauuagacuuguauaucccacugggagcacuuuguaggcauu

SEQ ID NO: 301627 - RNA, 64 nt, Homo Sapiens
auuccccacccagcgugucuccagauauugucaaauaucccaucgggugcaaaaugaucccugg

SEQ ID NO: 301628 - RNA, 64 nt, Homo Sapiens
uucagacucagcagggugacuugccucagaggcuauaucccagugggggaacaaagaggagccu

SEQ ID NO: 301629 - RNA, 64 nt, Homo Sapiens
ggaaugaaccacucccugcccauucccuauaagaauaucccaagacccaggcaauuuugccccu

SEQ ID NO: 301630 - RNA, 64 nt, Homo Sapiens
uuuuggugcugauacaagagaaauguauuuuuaaauaucccacauccuggaucuuuguugggua

SEQ ID NO: 301631 - RNA, 64 nt, Homo Sapiens
gggccccugugcccuaaguccacgggcugucuuuauaucccacugcccugcugugugacaguuu

SEQ ID NO: 301632 - RNA, 64 nt, Homo Sapiens
auacuguuuguaaauaaucuccucugccuucaucauaucccaggcuauccuccaagccagccca

SEQ ID NO: 301633 - RNA, 64 nt, Homo Sapiens
gggagaaaggaguuuugcaagcuauguccuaauaauaucccacucccacggccuuucuagccug

SEQ ID NO: 301634 - RNA, 64 nt, Homo Sapiens
ugagugguacauuauauaagccccucccagaagcauaucccagacagcccaagcagggaguguc

SEQ ID NO: 301635 - RNA, 64 nt, Homo Sapiens
cguacugaaugaaacugauugccagucucauucuauaucccaaacuguuuacaaauaaaacuca

SEQ ID NO: 301636 - RNA, 64 nt, Homo Sapiens
cacauacaaaacuuaugaaugauuuacaacccuaauaucccaggcauuuuucaucuuuaauugu

SEQ ID NO: 301637 - RNA, 64 nt, Homo Sapiens
uuuuaaaaacauggacuguaucuuaucuaccacuauaucccaaauaccuaagauagugcuuacg

SEQ ID NO: 301638 - RNA, 64 nt, Homo Sapiens
cccuuuugccccaagcauuucuauauuuaaagcaauaucccaggagaauauguuagacuuagga

SEQ ID NO: 301639 - RNA, 64 nt, Homo Sapiens
uucuucuuccagguuguaucacccccgaguuagcauaucccaggcucgcagacucaacacagca

SEQ ID NO: 301640 - RNA, 64 nt, Homo Sapiens
ucuggaaggccaaguucaucgcagcauguucaccauaucccagccuccaaaucuauccuccuac

SEQ ID NO: 301641 - RNA, 64 nt, Homo Sapiens
aagucaaaaauauugucaguugaaaauacauuuaauaucccaauuaacccaucauaaaguugaa

SEQ ID NO: 301642 - RNA, 64 nt, Homo Sapiens
uuggugugucauaauacuuccggugguuauucugauaucccauugaguacaagcucauuuuucu

SEQ ID NO: 301643 - RNA, 64 nt, Homo Sapiens
auacaaaugcaaaugguugcaaccaugcucacccauaucccacuuucgaucucuuccugaugua

SEQ ID NO: 301644 - RNA, 64 nt, Homo Sapiens
agccauuuauccuugagacuuuguccuagcaaccauaucccaaggaauuauccuagcaacaaca

SEQ ID NO: 301645 - RNA, 64 nt, Homo Sapiens
ccuuuaguuuguuacaguagccaauugaaaauguauaucccaaaauuuaaaaaaaaaaguacca

SEQ ID NO: 301646 - RNA, 64 nt, Homo Sapiens
gaaaaaaaugcaauuugcacuucacuuuguuggaauaucccauagcacucaauaaacucagcug

SEQ ID NO: 301647 - RNA, 64 nt, Homo Sapiens
gccagaucuuagguauagaggacccuaacacaguauaucccaagugcacuuucuaauguuucug

SEQ ID NO: 301648 - RNA, 64 nt, Homo Sapiens
cuuccugggccccuagaauuuauaaggucccuagauaucccagaaccugccaccauggccucug

SEQ ID NO: 301649 - RNA, 64 nt, Homo Sapiens
cccaggcggaccagaggugggcagcgugggacccauaucccagcgguagagaagccagcagggg

SEQ ID NO: 301650 - RNA, 64 nt, Homo Sapiens
ugaauuaucuguaacagaaaauggaagauaaauaauaucccaaauucauuaauuuugauuucaa

SEQ ID NO: 301651 - RNA, 64 nt, Homo Sapiens
gaaugcucgcacguucucaauuugggaccccucgauaucccauggggaucgagcagccuucuuc

SEQ ID NO: 301652 - RNA, 64 nt, Homo Sapiens
cuggugagaaggccacucucuuuucagagcacccauaucccaccccuuuuuaaagcacuuacug

SEQ ID NO: 301653 - RNA, 64 nt, Homo Sapiens
aaccuccagugucaggguccaagguggagaaagcauaucccaccacaaaacuucagugugguac

SEQ ID NO: 301654 - RNA, 64 nt, Homo Sapiens
ccaaguagaaauauuaguguuacggaagugccuaauaucccaguccaaauuuuuuuuuuuuuuu

SEQ ID NO: 301655 - RNA, 64 nt, Homo Sapiens
aauuucagugacuccagaagccaagcuucgaaagauaucccaaacuacugcacgaagggaagau

SEQ ID NO: 301656 - RNA, 64 nt, Homo Sapiens
guccccagccucccucaggugugcugagacccccauaucccagagcaggcuucuuggauggaca

SEQ ID NO: 301657 - RNA, 64 nt, Homo Sapiens
uguugcagcugucuacuggcugcaugugcugugaauaucccaaggaacuggcuguggaaugcgu

SEQ ID NO: 301658 - RNA, 64 nt, Homo Sapiens
cucuguccguccucugagcucaagcuaagccaucauaucccagugaccugcacauauacaucca

SEQ ID NO: 301659 - RNA, 64 nt, Homo Sapiens
uuaagaaaaaaaauaacaugcugaggggugaccuauaucccaugugaguggucacuuuauuuau

SEQ ID NO: 301660 - RNA, 64 nt, Homo Sapiens
ugaggaauuugaagcucagagagguaggagucuuauaucccaggucagccuucauuaggaggcc

SEQ ID NO: 301661 - RNA, 64 nt, Homo Sapiens
uggcaggccuaauuugucuuguucuuuccuuuccauaucccaguauaaucucuguuaaucaaca

SEQ ID NO: 301662 - RNA, 64 nt, Homo Sapiens
caaaaagcugacccagaggccauacagagcaggaauaucccauugcccccuccuccacuggguu

SEQ ID NO: 301663 - RNA, 64 nt, Homo Sapiens
aaguuucugaaaagaucuaaagccuuuuuaucccauaucccaaauucuuaugagccacucacag

SEQ ID NO: 301664 - RNA, 64 nt, Homo Sapiens
aagcaaguucaaugaccuggucccuuagagcuccauaucccagucccagcccuucuuugcagcu

SEQ ID NO: 301665 - RNA, 64 nt, Homo Sapiens
agggacugcuguuugcaaugggcuuaccauccaaauaucccaaaggcuuugaccagcaaccaag

SEQ ID NO: 301666 - RNA, 64 nt, Homo Sapiens
uucuugugacugagggagauugugaaguacagcaauaucccaaguguuacugcuugccauauga

SEQ ID NO: 301667 - RNA, 64 nt, Homo Sapiens
uuuauaucgaucucuuauuuccuucucccuuuuuauaucccauuuuucaccccacccuuccccu

SEQ ID NO: 301668 - RNA, 62 nt, Homo Sapiens
ccuuugccagcuacagugauacuccaggagccauaucccagaugguggggacugcucccuag

SEQ ID NO: 301669 - RNA, 59 nt, Homo Sapiens
gcgaggucauguaacuuccucauuucugaauaucccaagggcugccagaacuugacuag

SEQ ID NO: 301670 - RNA, 64 nt, Homo Sapiens
aggaccagcuggcccccugcgcuggguccgugccauaucccagguuaugauuucagacagagcu

SEQ ID NO: 301671 - RNA, 64 nt, Homo Sapiens
ggcgggcccaaugcccacugccccccccccagcaauaucccaggccuguuugcugccaugaggc

SEQ ID NO: 301672 - RNA, 64 nt, Homo Sapiens
aaagaagauccuaucaugaagaagaggcaucuccauaucccagaucuugguaucccucauccca

SEQ ID NO: 301673 - RNA, 64 nt, Homo Sapiens
cuucuccucaaagaggggauguaugcuugcuuuuauaucccagaauuucauaucagcugaugag

SEQ ID NO: 301674 - RNA, 64 nt, Homo Sapiens
ggugguacuucggagacaccgcgcuggcccgaggauaucccagcacuguggggauucaguuuag

SEQ ID NO: 301675 - RNA, 64 nt, Homo Sapiens
ucugcugcccuuguuuugcuaauggcuguacuggauaucccagcgaggucagugcuucguggca

SEQ ID NO: 301676 - RNA, 64 nt, Homo Sapiens
cucuucuaccaauguuugggugaccaccccuccaauaucccagaaugaauaagaacaaucccua

SEQ ID NO: 301677 - RNA, 64 nt, Homo Sapiens
aacggugcaguagaauagacgcagcaaacgccucauaucccaaauuaaucauagggguuugucu

SEQ ID NO: 301678 - RNA, 64 nt, Homo Sapiens
gagccacugggcugugggggaaggggucaaggccauaucccaauacguguagggcgaggguccc

SEQ ID NO: 301679 - RNA, 64 nt, Homo Sapiens
aucaaaaucaccuagggagucggugcaaaacaaaauaucccaguccccuccccugaaacacuga

SEQ ID NO: 301680 - RNA, 64 nt, Homo Sapiens
aacaaaugauauucuuuuuaaauaagaagcuauaauaucccauuggugucauguauuagaucag

SEQ ID NO: 301681 - RNA, 64 nt, Homo Sapiens
gaaauaauaauaaauauaucuauauagaauagacauaucccacuguauauuaauugagguuaca

SEQ ID NO: 301682 - RNA, 64 nt, Homo Sapiens
uccuaagugaauuaaugcaggaacagaaaaugaaauaucccauguucucacuuauaagugggag

SEQ ID NO: 301683 - RNA, 64 nt, Homo Sapiens
ucuuuguuuacaccgauguccagggauauaguucauaucccacuaaaaaaaaagaaaaaaaaau

SEQ ID NO: 301684 - RNA, 64 nt, Homo Sapiens
ggauagucuuuaucaguucauguacccuuugaccauaucccaaaaaacauuacaaaaaggcaaa

SEQ ID NO: 301685 - RNA, 64 nt, Homo Sapiens
gagcucauuuagggcugaaaauccuccagccauuauaucccagaugggaaaaucuuuaguagga

SEQ ID NO: 301686 - RNA, 64 nt, Homo Sapiens
ggagcucacgcagggcaggaauagccagguucucauaucccagggguucagacuuuggcugaga

SEQ ID NO: 301687 - RNA, 64 nt, Homo Sapiens
agugccagggaccccucaaggagggagacgcuccauaucccagggcauaggacuugcagguucc

SEQ ID NO: 301688 - RNA, 64 nt, Homo Sapiens
gucuucccugcuguguuaggaaaaugggggcuggauaucccaagaaucagagguuauauaaaaa

SEQ ID NO: 301689 - RNA, 64 nt, Homo Sapiens
aauaagaacaugucuauguacuacuuguuuuuucauaucccaaguuaaacuuuaaaugccauua

SEQ ID NO: 301690 - RNA, 64 nt, Homo Sapiens
ucugugaaaacauuacaaauuauaugggugagguauaucccacuugagucauauaaagaaacuc

SEQ ID NO: 301691 - RNA, 64 nt, Homo Sapiens
acacagugcucugucuccuccaaggucaguuugaauaucccagaaugacaguagaggaaaugga

SEQ ID NO: 301692 - RNA, 64 nt, Homo Sapiens
ucuaaauuuagugcaauaucaauauuaaauucaaauaucccauaauauauuuaucuguuuagcu

SEQ ID NO: 301693 - RNA, 64 nt, Homo Sapiens
uuucaaaaucaaauuccagaaugauuuuacggagauaucccaggaaaauuaaggcuucucuuaa

SEQ ID NO: 301694 - RNA, 64 nt, Homo Sapiens
auccuguauuaauuacucuuaguggagaugccagauaucccauacagaauuagcagagaaaaua

SEQ ID NO: 301695 - RNA, 64 nt, Homo Sapiens
aaguaaguaacucugaagaaguauuuaugcccuuauaucccaaagaagaacuuuagaugaugau

SEQ ID NO: 301696 - RNA, 64 nt, Homo Sapiens
uccaguguuggggacugucuacguaugugcaaguauaucccagggcaugugccccgcaggggcc

SEQ ID NO: 301697 - RNA, 64 nt, Homo Sapiens
auuuuuaguaagccauuauucuccuauucaaauaauaucccaaagagcuaaacaauuccuuaca

SEQ ID NO: 301698 - RNA, 64 nt, Homo Sapiens
auaugaugcugcuauaagucuggggcucaaauugauaucccaguagcaauaaacauauaauaua

SEQ ID NO: 301699 - RNA, 64 nt, Homo Sapiens
augaucccaugguaggucuucaucuucuuaccugauaucccauguuguaguuuuguauguuacu

SEQ ID NO: 301700 - RNA, 64 nt, Homo Sapiens
uuuaaaguucuuauuuaaaaaggggaagaaggagauaucccacacagaguccucaacuggaccu

SEQ ID NO: 301701 - RNA, 64 nt, Homo Sapiens
caccuguguacaggggcucauguggaagaugaacauaucccagcauccccagcacuggccuccc

SEQ ID NO: 301702 - RNA, 64 nt, Homo Sapiens
auaacacgagccccuccaccuugauagcuccuugauaucccaaucuugcaguccuaacucaggc

SEQ ID NO: 301703 - RNA, 64 nt, Homo Sapiens; identical to SEQ ID NO: 266386

SEQ ID NO: 301704 - RNA, 64 nt, Homo Sapiens; identical to SEQ ID NO: 266387

SEQ ID NO: 301705 - RNA, 64 nt, Homo Sapiens; identical to SEQ ID NO: 266388

SEQ ID NO: 301706 - RNA, 64 nt, Homo Sapiens; identical to SEQ ID NO: 266389

SEQ ID NO: 301707 - RNA, 64 nt, Homo Sapiens; identical to SEQ ID NO: 266390

SEQ ID NO: 301708 - RNA, 64 nt, Homo Sapiens; identical to SEQ ID NO: 266391

SEQ ID NO: 301709 - RNA, 64 nt, Homo Sapiens; identical to SEQ ID NO: 266392

SEQ ID NO: 301710 - RNA, 64 nt, Homo Sapiens; identical to SEQ ID NO: 266393

SEQ ID NO: 301711 - RNA, 64 nt, Homo Sapiens; identical to SEQ ID NO: 266394

SEQ ID NO: 301712 - RNA, 64 nt, Homo Sapiens; identical to SEQ ID NO: 266395

SEQ ID NO: 301713 - RNA, 64 nt, Homo Sapiens; identical to SEQ ID NO: 266396

SEQ ID NO: 301714 - RNA, 64 nt, Homo Sapiens; identical to SEQ ID NO: 266397

SEQ ID NO: 301715 - RNA, 64 nt, Homo Sapiens; identical to SEQ ID NO: 266398

SEQ ID NO: 301716 - RNA, 64 nt, Homo Sapiens; identical to SEQ ID NO: 266399

SEQ ID NO: 301717 - RNA, 64 nt, Homo Sapiens; identical to SEQ ID NO: 266400

SEQ ID NO: 301718 - RNA, 64 nt, Homo Sapiens; identical to SEQ ID NO: 266401

SEQ ID NO: 301719 - RNA, 64 nt, Homo Sapiens; identical to SEQ ID NO: 266402

SEQ ID NO: 301720 - RNA, 64 nt, Homo Sapiens; identical to SEQ ID NO: 266403

SEQ ID NO: 301721 - RNA, 64 nt, Homo Sapiens; identical to SEQ ID NO: 266404

SEQ ID NO: 301722 - RNA, 64 nt, Homo Sapiens; identical to SEQ ID NO: 266405

SEQ ID NO: 301723 - RNA, 64 nt, Homo Sapiens; identical to SEQ ID NO: 266406

SEQ ID NO: 301724 - RNA, 64 nt, Homo Sapiens; identical to SEQ ID NO: 266407

SEQ ID NO: 301725 - RNA, 64 nt, Homo Sapiens; identical to SEQ ID NO: 266408

SEQ ID NO: 301726 - RNA, 64 nt, Homo Sapiens; identical to SEQ ID NO: 266409

SEQ ID NO: 301727 - RNA, 64 nt, Homo Sapiens; identical to SEQ ID NO: 266410

SEQ ID NO: 301728 - RNA, 64 nt, Homo Sapiens; identical to SEQ ID NO: 266411

SEQ ID NO: 301729 - RNA, 64 nt, Homo Sapiens; identical to SEQ ID NO: 266412

SEQ ID NO: 301730 - RNA, 64 nt, Homo Sapiens; identical to SEQ ID NO: 266413

SEQ ID NO: 301731 - RNA, 64 nt, Homo Sapiens; identical to SEQ ID NO: 266414

SEQ ID NO: 301732 - RNA, 64 nt, Homo Sapiens; identical to SEQ ID NO: 266415

SEQ ID NO: 301733 - RNA, 64 nt, Homo Sapiens; identical to SEQ ID NO: 266416

SEQ ID NO: 301734 - RNA, 64 nt, Homo Sapiens; identical to SEQ ID NO: 266417

SEQ ID NO: 301735 - RNA, 64 nt, Homo Sapiens; identical to SEQ ID NO: 266418

SEQ ID NO: 301736 - RNA, 64 nt, Homo Sapiens; identical to SEQ ID NO: 266419

SEQ ID NO: 301737 - RNA, 64 nt, Homo Sapiens; identical to SEQ ID NO: 266420

SEQ ID NO: 301738 - RNA, 64 nt, Homo Sapiens; identical to SEQ ID NO: 266421

SEQ ID NO: 301739 - RNA, 64 nt, Homo Sapiens; identical to SEQ ID NO: 266422

SEQ ID NO: 301740 - RNA, 64 nt, Homo Sapiens; identical to SEQ ID NO: 266423

SEQ ID NO: 301741 - RNA, 64 nt, Homo Sapiens; identical to SEQ ID NO: 266424

SEQ ID NO: 301742 - RNA, 64 nt, Homo Sapiens; identical to SEQ ID NO: 219214

SEQ ID NO: 301743 - RNA, 64 nt, Homo Sapiens; identical to SEQ ID NO: 219215

SEQ ID NO: 301744 - RNA, 64 nt, Homo Sapiens; identical to SEQ ID NO: 219216

SEQ ID NO: 301745 - RNA, 64 nt, Homo Sapiens; identical to SEQ ID NO: 219217

SEQ ID NO: 301746 - RNA, 64 nt, Homo Sapiens; identical to SEQ ID NO: 219218

SEQ ID NO: 301747 - RNA, 64 nt, Homo Sapiens; identical to SEQ ID NO: 219219

SEQ ID NO: 301748 - RNA, 64 nt, Homo Sapiens; identical to SEQ ID NO: 219220

SEQ ID NO: 301749 - RNA, 64 nt, Homo Sapiens; identical to SEQ ID NO: 219221

SEQ ID NO: 301750 - RNA, 64 nt, Homo Sapiens; identical to SEQ ID NO: 219222

SEQ ID NO: 301751 - RNA, 64 nt, Homo Sapiens; identical to SEQ ID NO: 219223

SEQ ID NO: 301752 - RNA, 64 nt, Homo Sapiens; identical to SEQ ID NO: 219224

SEQ ID NO: 301753 - RNA, 64 nt, Homo Sapiens; identical to SEQ ID NO: 219225

SEQ ID NO: 301754 - RNA, 64 nt, Homo Sapiens; identical to SEQ ID NO: 219226

SEQ ID NO: 301755 - RNA, 64 nt, Homo Sapiens; identical to SEQ ID NO: 219227

SEQ ID NO: 301756 - RNA, 64 nt, Homo Sapiens
agugcaagagccugagacuggaaaagguggacuugucucccagucgaggcugguaagggaccuu

SEQ ID NO: 301757 - RNA, 64 nt, Homo Sapiens
agaaucaggguggagaaguucccugaaccuuccugucucccagggacauguaugcuuccaggga

SEQ ID NO: 301758 - RNA, 64 nt, Homo Sapiens
gagaaacagggaggaaggggcggagcaccuggacgucucccagaagccccuccacguuugaaaa

SEQ ID NO: 301759 - RNA, 64 nt, Homo Sapiens
guucuuucaagcuacauguacuaaauugucgaaggucucccaggagcucuguacugaggcagac

SEQ ID NO: 301760 - RNA, 64 nt, Homo Sapiens
aaaguggaauugcccaguacugccugccagcugggucucccaagcaacuaccccaagacauacc

SEQ ID NO: 301761 - RNA, 64 nt, Homo Sapiens
aagcuccuuaaccugucuguauuuuuaugccucugucucccauucaguuccuccuugaauaccu

SEQ ID NO: 301762 - RNA, 64 nt, Homo Sapiens
guuugcaucucuauuuauaccucuguccugcuaggucucccaccuucccuugguuccaaaagcc

SEQ ID NO: 301763 - RNA, 64 nt, Homo Sapiens
cucagccccacuccccuuccucauccccagcugugucucccaaccucccuucguguuguuuugc

SEQ ID NO: 301764 - RNA, 64 nt, Homo Sapiens
ccgaaggucagccuugagucuuucuaacccccaggucucccaggaccuggccaucuugaggggu

SEQ ID NO: 301765 - RNA, 64 nt, Homo Sapiens
gggaggggcucgggccucuaagcaaggcuucccugucucccacgagcugaugucguguuuacag

SEQ ID NO: 301766 - RNA, 64 nt, Homo Sapiens
cauauguauuuuuuugcgacagggucgugcucuugucucccagacuggacugcaguggcacaau

SEQ ID NO: 301767 - RNA, 64 nt, Homo Sapiens
uucacucugguuacagggaggugcaaaccauucugucucccagccuuucuucucucuuugugug

SEQ ID NO: 301768 - RNA, 64 nt, Homo Sapiens
ggagaaacugcagccccacuucuguuucccuggagucucccaauggaucauucaggaguguccu

SEQ ID NO: 301769 - RNA, 64 nt, Homo Sapiens
uguuccucuccugaccccaucuggcugcugccccgucucccaccccuguccccggggcucgcug

SEQ ID NO: 301770 - RNA, 64 nt, Homo Sapiens
uuuuuuuugauacggggauacggggucuugcucugucucccaggcuggagugcagugacacaau

SEQ ID NO: 301771 - RNA, 64 nt, Homo Sapiens
aaagagcacugggucauauggaaaaaauguaugugucucccaggugcauuucuugguuuauguc

SEQ ID NO: 301772 - RNA, 64 nt, Homo Sapiens
gucuuauaaauuauaagucuuauauaauuuauaagucucccacaaucuuccaguucuuacccag

SEQ ID NO: 301773 - RNA, 64 nt, Homo Sapiens
agccaccgucucaccccugcggaggagcgcucccgucucccacaggugccuuaccgcguucccu

SEQ ID NO: 301774 - RNA, 64 nt, Homo Sapiens
ucauaaccaccugggaguugccaagaagcagacagucucccagugucugacucucggauauuug

SEQ ID NO: 301775 - RNA, 64 nt, Homo Sapiens
cugcuggagugcaguggcacaacagucuuacucugucucccagguuuuuuuuuuuucuuuuuga

SEQ ID NO: 301776 - RNA, 64 nt, Homo Sapiens
cuggagugcaguggcacaaucagagucuugcucugucucccaggccuuaaaauuuuucuuaaga

SEQ ID NO: 301777 - RNA, 64 nt, Homo Sapiens
ucugccauggcaucaaggggagaagacaaaaucugucucccacgccuguuugggcucaggagau

SEQ ID NO: 301778 - RNA, 64 nt, Homo Sapiens
cuggagugcaauggugcaaugggcaguucacucugucucccagguuuuuuggguggggggugcg

SEQ ID NO: 301779 - RNA, 64 nt, Homo Sapiens
cuagaccaccccuuuucaucauuuugcuuuuuaugucucccauaagaaaugugcuuuuuagagc

SEQ ID NO: 301780 - RNA, 64 nt, Homo Sapiens
uuagagauaauugauucagggguuuucucucccagucucccagcagggacugauuucauuucug

SEQ ID NO: 301781 - RNA, 64 nt, Homo Sapiens
aggucccaggcuguggaaaggaggcugccuccuagucucccaccccugaggccacgcugcuaug

SEQ ID NO: 301782 - RNA, 64 nt, Homo Sapiens
agccuuggugcucccggcugacuuaccccacugggucucccaaagaugggguuuggggauuaga

SEQ ID NO: 301783 - RNA, 64 nt, Homo Sapiens
ccuucccuuuccuaggauuuuucugaggucuccugucucccacuccuuucucccgccauucuuu

SEQ ID NO: 301784 - RNA, 64 nt, Homo Sapiens
acacgugugcacgcaaggcaaacuucuuucuugugucucccagcuuacgcugaagccauggauc

SEQ ID NO: 301785 - RNA, 64 nt, Homo Sapiens
cccuccagcuuagagucugcauuugggcugugacgucucccaccugccccaauaagaucugcuc

SEQ ID NO: 301786 - RNA, 64 nt, Homo Sapiens
ugaacuccugaccucaaaugagccuccugcuucagucucccaaauugccgggauuacaggcaug

SEQ ID NO: 301787 - RNA, 64 nt, Homo Sapiens
acagagaguuacagaaaugggcagcuagggcuuggucucccaggcaaugagaggggagacagag

SEQ ID NO: 301788 - RNA, 64 nt, Homo Sapiens
cugagaaaccccccaacccagucuccugcacugugucucccacacucacaccacugcugcucga

SEQ ID NO: 301789 - RNA, 64 nt, Homo Sapiens
gcucaacaaggaaaaaugccacucccuacccaaugucucccacacccacccuuuuuuuggggug

SEQ ID NO: 301790 - RNA, 64 nt, Homo Sapiens
gcaugaaaaacauuccacgugccccuugucgcgcgucucccauccugaucccagacccauuccu

SEQ ID NO: 301791 - RNA, 64 nt, Homo Sapiens
cugcugcugugcaugucccugcgaugggagucuugucucccagccugucaguuuccuccccagg

SEQ ID NO: 301792 - RNA, 64 nt, Homo Sapiens
uccucauagacggcaggugcccaccuuucagggagucucccagcaugggcggaugccgggcaug

SEQ ID NO: 301793 - RNA, 64 nt, Homo Sapiens
gacuucucuacccuaaaacuucccagugaggagcccuaagcauuuuuuaaaaugcccuuguguc

SEQ ID NO: 301794 - RNA, 64 nt, Homo Sapiens
aaucuuuuucuauauucucagaauuaaguauuuuccuaagcacaauuuuaugacuuugggccaa

SEQ ID NO: 301795 - RNA, 64 nt, Homo Sapiens
ccaaggugacucaagauaacaccagaccacgcaugaucaccaaaaccuucccauccugauucuc

SEQ ID NO: 301796 - RNA, 64 nt, Homo Sapiens
cugucaucuuacugaaaggaauaacacuucuaaagaucaccauuucugagaaguucuuggaaau

SEQ ID NO: 301797 - RNA, 64 nt, Homo Sapiens
caucucaggauuggucuaaacugcucucucucaggaucaccacgccauuuaccuggcaggcagu

SEQ ID NO: 301798 - RNA, 64 nt, Homo Sapiens
ccagaugguauugcucccucccuuuugauggcaagaucaccaauccaagaaccugcucaggaag

SEQ ID NO: 301799 - RNA, 64 nt, Homo Sapiens
ugacugccacccauacuaggacaaacacagcucagaucaccaggucaagcaccuaggccuggcu

SEQ ID NO: 301800 - RNA, 64 nt, Homo Sapiens
ucagcuaaguuuccuaacuuguccauccaaaugugaucaccacgauucaacaauuuggggcauu

SEQ ID NO: 301801 - RNA, 64 nt, Homo Sapiens
ccaaccacagcaaaggcaacacucuuccuccagagaucaccaagccccucuuaccucccucccu

SEQ ID NO: 301802 - RNA, 64 nt, Homo Sapiens
gcugaugaguaagugagggaugucuccaucuugagaucaccaggcaagagaguugccugcacca

SEQ ID NO: 301803 - RNA, 64 nt, Homo Sapiens
ccguguccguccaccgagcacucagauggaugcugaucaccagggccgagggggcucccagaag

SEQ ID NO: 301804 - RNA, 64 nt, Homo Sapiens
auaaaacuuagauggcagcuuguacugucagaaucccguguauccauuuguucuucuguuggag

SEQ ID NO: 301805 - RNA, 64 nt, Homo Sapiens
cuccugaaacaagcucauuucaguuucuggcaaccccguguauuuccguuuucccccuaaagaa

SEQ ID NO: 301806 - RNA, 55 nt, Homo Sapiens
ccccaaccgugucugucuggagcugcccguguagucuccgccucucuuuggcuga

SEQ ID NO: 301807 - RNA, 64 nt, Homo Sapiens
uagugcauuguuucugugggagacuugcccccugcccguguacagguacgugacccucugcuga

SEQ ID NO: 301808 - RNA, 64 nt, Homo Sapiens
caaauucucuacuguaugaaccuacucuccauaccccguguacuuguauggaaacauuuugugc

SEQ ID NO: 301809 - RNA, 64 nt, Homo Sapiens
uggcaguguuacauugaccccugaagagugaggacccguguaacucauauucuaugugcuuccc

SEQ ID NO: 301810 - RNA, 64 nt, Homo Sapiens
acucagauaaguauacagcguggggcaaaggugucccguguagcgucagcaggccauacugugu

SEQ ID NO: 301811 - RNA, 64 nt, Homo Sapiens
cacucuauagccauacuggacaggaaccaggugccccguguaggcaucgucggucgguuugccg

SEQ ID NO: 301812 - RNA, 64 nt, Homo Sapiens
cucuacuagcaaagacaugggcaccggaguaggucccguguagcaugcgggugcuguagagaaa

SEQ ID NO: 301813 - RNA, 64 nt, Homo Sapiens
cacaaaugggcucugugugggucaccccagcugacccguguaugugcagaugcaguuccgaagg

SEQ ID NO: 301814 - RNA, 64 nt, Homo Sapiens
uuuaaauaacuggugaucuauaugucugucuuuucccguguauuguuguaugauacuaccuuug

SEQ ID NO: 301815 - RNA, 64 nt, Homo Sapiens
accagccaucuggggcucuucuuccuuucuuccccccguguauguaaaugaauuccugaacccc

SEQ ID NO: 301816 - RNA, 64 nt, Homo Sapiens
uacagauaucauuucuugugcuugcauuuuuuuacccguguauggauccagcugagagcaaucu

SEQ ID NO: 301817 - RNA, 64 nt, Homo Sapiens
uccaguccucaguucccacugccuaacgucugcccccguguagauacugagaggugguggcagu

SEQ ID NO: 301818 - RNA, 64 nt, Homo Sapiens
gcccuccgccuagagguccccucacgugaccagccccguguagccccgggcugacccagugugu

SEQ ID NO: 301819 - RNA, 64 nt, Homo Sapiens
uaaagagauuaauuuuaacguaacucuuucuaugcccguguaaaguaugugaaucgcaaggccu

SEQ ID NO: 301820 - RNA, 64 nt, Homo Sapiens
ucuugugcuucuacuuuguauuauucauucaguucccguguauuaucguaauucaauuuuccuc

SEQ ID NO: 301821 - RNA, 64 nt, Homo Sapiens
cucccggguucacgccauucuccugccucagccucccguguagcugggacuacaggcacgcgcc

SEQ ID NO: 301822 - RNA, 64 nt, Homo Sapiens
uuaugaaaacaugguuugauauuuaaaggacauacccguguaugaugcaugaaaaaugcuccac

SEQ ID NO: 301823 - RNA, 64 nt, Homo Sapiens
cuguuaauuuucuugaaauauuugccaaaauuuacccguguagcaacuucaauauaaaguugca

SEQ ID NO: 301824 - RNA, 64 nt, Homo Sapiens
cagcauggugaacauuaccaggcaugcuagcuggcccguguaaucccaagacaaggaaaacauu

SEQ ID NO: 301825 - RNA, 64 nt, Homo Sapiens
gugccaguuccagaugggcugaccggcucuucuccccguguaggggagccccagcauggacuca

SEQ ID NO: 301826 - RNA, 64 nt, Homo Sapiens
aaucacuccucagugugaccucccaggccucuuccccguguacgucaacaccucacccagccua

SEQ ID NO: 301827 - RNA, 51 nt, Homo Sapiens
gcaaggucacugccaaauagacccguguacaaugaggagcuggggccuccu

SEQ ID NO: 301828 - RNA, 64 nt, Homo Sapiens
cuucaccaagcuuccucuaagaguacagagaauucccguguaccaccucacaagaaguuguaau

SEQ ID NO: 301829 - RNA, 64 nt, Homo Sapiens
gcucuuaacugaauugggagccucugccaccugccccguguauccuggcucucagcucaugggg

SEQ ID NO: 301830 - RNA, 64 nt, Homo Sapiens
gagggcugagcucagugccuccugggagacuugucccguguacagugacccagaaagaugagau

SEQ ID NO: 301831 - RNA, 64 nt, Homo Sapiens
ucuauauggcagcauuuuugaggcuuuauaucugcccguguacccucaacugccuccuuuuugc

SEQ ID NO: 301832 - RNA, 64 nt, Homo Sapiens
uaaccuucaccaucagcgccauggaauaaaaaggcccguguaauugaauauuuguauuuuccag

SEQ ID NO: 301833 - RNA, 64 nt, Homo Sapiens
gugugugguggguugucugugugcauauguccugcccguguauaugcacccacaccaugugccc

SEQ ID NO: 301834 - RNA, 64 nt, Homo Sapiens
cagaggccgaccuccaaggcucuguucuccccuccccguguacauauacucccgguuucccugc

SEQ ID NO: 301835 - RNA, 64 nt, Homo Sapiens
ugagucugugcagguccuuguguauggaauugcacccguguaaaggaggaaauggucagugugc

SEQ ID NO: 301836 - RNA, 64 nt, Homo Sapiens
uggggaauacagccaagggcacugcucacuguggcccguguauucauucccacaggcugcacug

SEQ ID NO: 301837 - RNA, 64 nt, Homo Sapiens
ugcgaaugcauccuaggcgcguccuccucugauccccguguaagacugcccuggugucggcacu

SEQ ID NO: 301838 - RNA, 64 nt, Homo Sapiens
ugucuuuagaauacccuuugauaagcugagcugucccguguagaugcaauucgguuuaauggca

SEQ ID NO: 301839 - RNA, 64 nt, Homo Sapiens
cuaaccuucagcguugcccauggcccugccacaucccguguaacauaaguggugcccaccaugu

SEQ ID NO: 301840 - RNA, 64 nt, Homo Sapiens
acccauggugacgaugacacacccugguggcaugcccguguauguugguuuagcguugucugca

SEQ ID NO: 301841 - RNA, 64 nt, Homo Sapiens
ggcaugacacaccugggggaaauuggcgaugucacccguguacgguacgcagcccagagcagac

SEQ ID NO: 301842 - RNA, 64 nt, Homo Sapiens
uauguacauuucucaggcuacuccuuucugagggcccguguaaacggcugugcaguccuggguc

SEQ ID NO: 301843 - RNA, 64 nt, Homo Sapiens
uaauuuauuacaagcauaacacaccagcccagcucccguguaaacugacgggaccugccacugc

SEQ ID NO: 301844 - RNA, 64 nt, Homo Sapiens
uaaaugucucucuggccaccaugcguuacguguacccguguauauguggggaggcugugcacac

SEQ ID NO: 301845 - RNA, 64 nt, Homo Sapiens
uguuggggcuuccccaccacauucaugucccucucccguguagguuucacauuauguccaggug

SEQ ID NO: 301846 - RNA, 64 nt, Homo Sapiens
auagggaacuuucaccuuaaccugcaucucccaccccguguaucccuguuuucucccuccugac

SEQ ID NO: 301847 - RNA, 64 nt, Homo Sapiens
aagccuccuugugcaauuguaugccccuccccuccccguguaaaaaggcccggcugagcccccc

SEQ ID NO: 301848 - RNA, 64 nt, Homo Sapiens
uacugaaaauggcuggguaaguguucugugaccacccguguagcugugugccgagugccgccca

SEQ ID NO: 301849 - RNA, 64 nt, Homo Sapiens
gagagauccagagcccuacagacuguguuucuaucccguguacaucauauuggcauuuccacgu

SEQ ID NO: 301850 - RNA, 64 nt, Homo Sapiens
cgggaguccaucccggcccagcacccccagcauccccguguauggccccccugcaccuccuugu

SEQ ID NO: 301851 - RNA, 64 nt, Homo Sapiens
uuuccaucccaggcuuuugaaaaacaaacagaaacccguguaucugggauauuuccauauggca

SEQ ID NO: 301852 - RNA, 64 nt, Homo Sapiens
cccugccuccaugaugcaaacugauguccccuuccccguguaugcccccuuccccaagguagca

SEQ ID NO: 301853 - RNA, 64 nt, Homo Sapiens
ccugagcccccccgucccccuguauuaaaaagaccccguguaaaucaaccagaugauuaaacgu

SEQ ID NO: 301854 - RNA, 64 nt, Homo Sapiens
ggaacagguguggggaagagagauggugguuugucccguguaaggggagaaggggucagaccaa

SEQ ID NO: 301855 - RNA, 64 nt, Homo Sapiens
gaguacacgacccagguaugggcaugacugggaucccguguaccuucuguguaccuaguacaca

SEQ ID NO: 301856 - RNA, 64 nt, Homo Sapiens
cagugaauucugugauguuucugagaugcagacucccguguaguuucagauucuugguccaugg

SEQ ID NO: 301857 - RNA, 64 nt, Homo Sapiens
ccacucccaccaucugcagguggugaaaacaaaccccguguaucucucaauaaagguggccgaa

SEQ ID NO: 301858 - RNA, 64 nt, Homo Sapiens
caggaccccaucugcugagcccccucccacaucccccguguauugggcauccccagcccccugg

SEQ ID NO: 301859 - RNA, 64 nt, Homo Sapiens
cuaggucuacacuccuaggacgcacgcauaucagcccguguacccugugacagugacugucccc

SEQ ID NO: 301860 - RNA, 64 nt, Homo Sapiens
aaccugcacacgagcagacauccuccccuggacucccguguaggaggugaugaagacagcccga

SEQ ID NO: 301861 - RNA, 64 nt, Homo Sapiens
ugcagacagggaagcugagccucucuccacccgacccguguacuacgcacacacacacccagug

SEQ ID NO: 301862 - RNA, 64 nt, Homo Sapiens
gaucccaagacaaugaaaguuugcacuguaugcuggacggcauuccugcuuaucaauaaaccug

SEQ ID NO: 301863 - RNA, 64 nt, Homo Sapiens
augcuaugggcucccuggccucccaggccaccaaggacggcaagaaggacaagaaggaggaaga

SEQ ID NO: 301864 - RNA, 64 nt, Homo Sapiens
ggcaggcauagaggcuucuccgccagccuccucuggacggcaggcucacugccaggccagccuc

SEQ ID NO: 301865 - RNA, 64 nt, Homo Sapiens
aaauaaugagauucccuaucuccuuuuagaccugggacggcaaaagggaagggaaggaaacuua

SEQ ID NO: 301866 - RNA, 64 nt, Homo Sapiens
ggcucugauuagccaggccuggucaggguccuggggacggcacccagauaugcagagucacccu

SEQ ID NO: 301867 - RNA, 64 nt, Homo Sapiens
gaugggccccaacuucgcccuccugccggaagccggacggcaggccugggaccccgggaaccuc

SEQ ID NO: 301868 - RNA, 64 nt, Homo Sapiens
acucuagggagggguguggcggccagggccagcaggacggcaggacaaccugcacuucugccaa

SEQ ID NO: 301869 - RNA, 64 nt, Homo Sapiens
cacacacaaagaggaugauuauuuuauuuagcaaggacggcaccuggauuucuucauggugucc

SEQ ID NO: 301870 - RNA, 53 nt, Homo Sapiens
agucagagggcucuaccugagaaggacggcaaggcugagguggcuaaggggga

SEQ ID NO: 301871 - RNA, 64 nt, Homo Sapiens
gauagucuuucaagcccccacaucacaggcuuagggacggcacuaacuuucucccagggaucua

SEQ ID NO: 301872 - RNA, 64 nt, Homo Sapiens
acugggaggguccccuccuccuucccuacuccugggacggcagcaaggacaugggggcugcugu

SEQ ID NO: 301873 - RNA, 64 nt, Homo Sapiens
ccgaggggcuuauuucacuuacgucugugcagguggacggcaguaaucaaagaaaauggaugug

SEQ ID NO: 301874 - RNA, 64 nt, Homo Sapiens
ccuuguccaugugaguagcaugggcgggugguggggacggcaguggugaugaagggggugcacc

SEQ ID NO: 301875 - RNA, 64 nt, Homo Sapiens
aggagaggggagcccccucuggugagccguggccggacggcagggcguucccaguggacagcgu

SEQ ID NO: 301876 - RNA, 64 nt, Homo Sapiens
cccacugcacauaacagaccacagaacauuguuuggacggcagcucugugugccgccuccgaac

SEQ ID NO: 301877 - RNA, 64 nt, Homo Sapiens
acccuuuccugggaagagaugggaugugcuggcuggacggcaccugcauccaguaacaccacug

SEQ ID NO: 301878 - RNA, 64 nt, Homo Sapiens
gagaaugaguguggauguguacaguacacgcacuggacggcagcgggaggcugggacuuuccau

SEQ ID NO: 301879 - RNA, 64 nt, Homo Sapiens
gccccucacacgccuucauccugaaacaggaagaggacggcaccaaguugggggugcuggauga

SEQ ID NO: 301880 - RNA, 64 nt, Homo Sapiens
cagguaaggaguuccaugcauaccuccgggggauggacggcaaaaacaggcccacuccucugau

SEQ ID NO: 301881 - RNA, 64 nt, Homo Sapiens
aguguccuggcugugaaugccugcacagucagaaggacggcaggccaggacacuacccugagau

SEQ ID NO: 301882 - RNA, 64 nt, Homo Sapiens
gcagggguggcugaccccaugcucagccucuaggggacggcaggccaucaggcugggggcugug

SEQ ID NO: 301883 - RNA, 64 nt, Homo Sapiens
gcccucugcuccccaaugccuuagagagaggaggggacggcacggccgcucaccggaaggcugu

SEQ ID NO: 301884 - RNA, 64 nt, Homo Sapiens
ggauaaagcccccuccucacguggaggguccuggggacggcagagcugcuggccuccugcccag

SEQ ID NO: 301885 - RNA, 64 nt, Homo Sapiens
caugcauccaucgcugaaggcagaccacauauuuggacggcagcuuaaucuuuauguugggaca

SEQ ID NO: 301886 - RNA, 64 nt, Homo Sapiens
ucaggaaagccaggacucagcaccugucccuaacggacggcaggauggcaagacuuggccccuc

SEQ ID NO: 301887 - RNA, 64 nt, Homo Sapiens
gggcaggggacaccuuggcuccucagcagcccaaggacggcaccauccagcaccuccgucauuc

SEQ ID NO: 301888 - RNA, 64 nt, Homo Sapiens
ccuccuggccgccccgcagggggcuuggagggcuggacggcaaguccgucuagcucacgggccc

SEQ ID NO: 301889 - RNA, 64 nt, Homo Sapiens
cugggccgcuccaccucaccggugcagugacccaggacggcaucagcagcccagugagcaccag

SEQ ID NO: 301890 - RNA, 64 nt, Homo Sapiens
gaggucaacauuaacgagugcaagagagaagacuggacggcaggccccgcuucccagggcuggc

SEQ ID NO: 301891 - RNA, 64 nt, Homo Sapiens
ggugagcagcuuugggagagucugccuccaggcaggacggcagguuucagguguuccuagcauu

SEQ ID NO: 301892 - RNA, 64 nt, Homo Sapiens
cagcuauauuuaguggugcccccgcauaaugaguggacggcagaccuugccuuuugaagaagag

SEQ ID NO: 301893 - RNA, 64 nt, Homo Sapiens
gugcgauguaugucuaacuuggcucccugcgugaggacggcaaggcacaugagcagugcccagg

SEQ ID NO: 301894 - RNA, 64 nt, Homo Sapiens
acgcagaggugacagugggagcuggccugggccaggacggcagguggcccuggagaugggaaag

SEQ ID NO: 301895 - RNA, 64 nt, Homo Sapiens
gaggagggcccucagcuggcccuccccacacacaggacggcaggggcacugugaggcuuuucuu

SEQ ID NO: 301896 - RNA, 64 nt, Homo Sapiens
agggguaagagcuggcuucugggguaugggguggggacggcaaaucaagaaaccaagaugguuu

SEQ ID NO: 301897 - RNA, 64 nt, Homo Sapiens
uaaaagucagagcugaagggagucgcuggggccaggacggcaugcaggccuguacccuguuccc

SEQ ID NO: 301898 - RNA, 64 nt, Homo Sapiens
aaggcuuccuggcagcucucacuacggccaaccaggacggcagggucauccugagccgccaagg

SEQ ID NO: 301899 - RNA, 64 nt, Homo Sapiens
uggcagccauguauuacagcuacuacaugcuaccggacggcacuuacugccuggcgccgccccc

SEQ ID NO: 301900 - RNA, 64 nt, Homo Sapiens
aauagcuguaaaauagugaagauguacauucaggggacggcaaaccaauugcugcauggaaauu

SEQ ID NO: 301901 - RNA, 64 nt, Homo Sapiens
ggcuccuuuccgaaguucuccugaccguguguucggacggcacuguggcgucuucugggaaagc

SEQ ID NO: 301902 - RNA, 64 nt, Homo Sapiens
cccaucagcgccuacgaccaggccgggugcugcuggacggcaagacuucuacccccuggagggg

SEQ ID NO: 301903 - RNA, 64 nt, Homo Sapiens
ugagccccugaugccgcuuauuugccgugaguuuggacggcaccccugcuggcggauagcaaga

SEQ ID NO: 301904 - RNA, 64 nt, Homo Sapiens
ggaaccuggaugugugcacgugugucccagguagggacggcacaggagggugcauggggcgugg

SEQ ID NO: 301905 - RNA, 64 nt, Homo Sapiens
gcccaaguuucaagcuuuccaaacaaaccuuucuggacggcagaggaaaaggaagugcuucuga

SEQ ID NO: 301906 - RNA, 64 nt, Homo Sapiens
aggacaaggggcgggcccgcggccucacccggagggacggcagccccggucgcgcgcuggcccc

SEQ ID NO: 301907 - RNA, 64 nt, Homo Sapiens
cgcuccuucccagacacacccccacgcccccacuggacggcauuggaggaagggacagcugcuu

SEQ ID NO: 301908 - RNA, 64 nt, Homo Sapiens
ccucgccccggccuccgggucugggaaauugaggggacggcaggcccggcugcccuggaacugg

SEQ ID NO: 301909 - RNA, 50 nt, Homo Sapiens
ugaagcccgaacccaccugaggacggcagugaggaugagcaccucuagca

SEQ ID NO: 301910 - RNA, 64 nt, Homo Sapiens
ccagugguggcagagcuuggcccgcugcgggaggggacggcaccaccuucaaagcugacugugc

SEQ ID NO: 301911 - RNA, 64 nt, Homo Sapiens
ccugcuucccuucuggcccuggaagacugagucuggacggcagaguggagggacugggaggcug

SEQ ID NO: 301912 - RNA, 64 nt, Homo Sapiens
aaaacccguuccggagccgccugcucccggaaccggacggcacagggcguucuugcccacccca

SEQ ID NO: 301913 - RNA, 64 nt, Homo Sapiens
ucugcuuaggagguggggacuugggcugggauggggacggcauaccccucccaggccucucccu

SEQ ID NO: 301914 - RNA, 64 nt, Homo Sapiens
ugaacacaagcugcugccggggacuguccuggguggacggcaggugaacacaagcggcugccgc

SEQ ID NO: 301915 - RNA, 64 nt, Homo Sapiens
uguccucccgcgaggaccaggcaucgcugugugaggacggcacggccagcgccugcugugagug

SEQ ID NO: 301916 - RNA, 64 nt, Homo Sapiens
uauagaaacuaggguacaaauuacuuccuggcugggacggcaccacugcgccagugacacauag

SEQ ID NO: 301917 - RNA, 64 nt, Homo Sapiens
ugaauaaagcacauuuccacaucaggggcccuggggacggcaagcugcugggccacaccccaag

SEQ ID NO: 301918 - RNA, 64 nt, Homo Sapiens
gcugggugcccggaggcggccauggugucucgauggacggcagccaggauggagcacccauggg

SEQ ID NO: 301919 - RNA, 64 nt, Homo Sapiens
auggugcccgccggccugccgggcucccaccccuggacggcagaggcaaggacggacgggagcu

SEQ ID NO: 301920 - RNA, 64 nt, Homo Sapiens
gcaaagggcacagccaugcaaaggcccuggggcaggacggcaccugguaugcgggaggaacaga

SEQ ID NO: 301921 - RNA, 64 nt, Homo Sapiens
cuguccccggggagccaucgccuucagugugcagggacggcaccgaggagucugagccgggggc

SEQ ID NO: 301922 - RNA, 64 nt, Homo Sapiens
cauucccucuuccaggcccuugucuccccaguugggacggcagagagacaaguucuuauaucug

SEQ ID NO: 301923 - RNA, 64 nt, Homo Sapiens
gcaauaaaacagucuugucggccagcugcccaggggacggcagcuacagcagccucugcguccu

SEQ ID NO: 301924 - RNA, 64 nt, Homo Sapiens
ugccuuccucagucucgagcggagcuccaaccccggacggcagaugagcagguguugguccuca

SEQ ID NO: 301925 - RNA, 64 nt, Homo Sapiens
accuauuuauaauauuuagcgggcgggggcaggaggacggcaaggcuccacugacugugccgag

SEQ ID NO: 301926 - RNA, 64 nt, Homo Sapiens
ucgggacccacagucucaccacgucuccuccagaggacggcagaggguacaggugguggccugg

SEQ ID NO: 301927 - RNA, 64 nt, Homo Sapiens
ucugugagaauuggccauccugaggacacagccaggacggcagaggccuccuggccucagggca

SEQ ID NO: 301928 - RNA, 64 nt, Homo Sapiens
agaggccacgugaacccacggccacagagaggcaggacggcagagccaugauuucccaccgagc

SEQ ID NO: 301929 - RNA, 64 nt, Homo Sapiens
aaaacccacccuaccacaguccgcucuuccaaguggacggcagaccugggaggggacgccugug

SEQ ID NO: 301930 - RNA, 64 nt, Homo Sapiens
gccuagacugagugugguuucgucgugaguggauggacggcaagcuuagcaagccuaagucccc

SEQ ID NO: 301931 - RNA, 64 nt, Homo Sapiens
gcaucgggccuaaguguccuggggagauuggaggggacggcagcguucugcaugauggaggcgc

SEQ ID NO: 301932 - RNA, 64 nt, Homo Sapiens
cucccugggagccacgugcuggccauguggccagggacggcaugagcaggaggcggggacgugg

SEQ ID NO: 301933 - RNA, 64 nt, Homo Sapiens
uucgcccccacgugcucgacaggggaacccgcccggacggcaucgccaggcacuggcuggggug

SEQ ID NO: 301934 - RNA, 64 nt, Homo Sapiens
agagcucgcggcaccuuccuccagggcggcccagggacggcaggaccaucuggacacagcagag

SEQ ID NO: 301935 - RNA, 64 nt, Homo Sapiens
cuccccugcgaccaugccaggcacgcugggaggaggacggcagcugcucguguccugccccugc

SEQ ID NO: 301936 - RNA, 64 nt, Homo Sapiens
cagcagaacuccuaaaaaguuacagccauaugcaggacggcaguacucagcauggucuuaugca

SEQ ID NO: 301937 - RNA, 64 nt, Homo Sapiens
uuuaguaucauuguuucauuuaguauuugguacaaucuaauaaauacuaauccaguccaauacu

SEQ ID NO: 301938 - RNA, 64 nt, Homo Sapiens
caauacuaauaauacuaacaguaguauugauacaaucuaauaaauaauguguuugacaguguag

SEQ ID NO: 301939 - RNA, 64 nt, Homo Sapiens
agggaagguaagauggauaauugaauugugugguaucuaauaaacucuuagauuuuaagaacuc

SEQ ID NO: 301940 - RNA, 64 nt, Homo Sapiens
acaaguuuguggaaaugcaauauugauuauucuaaucuaauaagcacuggguaucugcaaggcu

SEQ ID NO: 301941 - RNA, 64 nt, Homo Sapiens
acagagcacuaucucuaaccugaacugggcuuauaucuaauaauaugggauuugcauuaugacu

SEQ ID NO: 301942 - RNA, 64 nt, Homo Sapiens
cugagguggccuuuacauacucagacccagacaaaucuaauaucgcuagaugucaagaagcccu

SEQ ID NO: 301943 - RNA, 64 nt, Homo Sapiens
ggguuacuuucacauacagcuccuuaaaggcaccaucuaauagcacaggaagguggugcuuaca

SEQ ID NO: 301944 - RNA, 64 nt, Homo Sapiens
aaaaauauggaacuucuaauauagaaaacugaaaaucuaauauuguggccaaauuauuugugua

SEQ ID NO: 301945 - RNA, 64 nt, Homo Sapiens
aagaaauggguuucugcuaaugaauugagcagacaucuaauauuuuauaugccuuuugagcugu

SEQ ID NO: 301946 - RNA, 64 nt, Homo Sapiens
uaggaaugccuauaauacaucuuagauuccuuauaucuaauaagaguucaaagaguuaugaguu

SEQ ID NO: 301947 - RNA, 64 nt, Homo Sapiens
aucauuaauguaguuccucauugaacaugugauaaucuaauaccugugaaaacugacuaaucag

SEQ ID NO: 301948 - RNA, 64 nt, Homo Sapiens
accugugaaaacugacuaaucagcugccaauaauaucuaauauuuuucaucaugcacgaauuaa

SEQ ID NO: 301949 - RNA, 64 nt, Homo Sapiens
cuccuaagaguuuuacuagugcuaagugagcuuuaucuaauaucuguggggaaaaagggcuauu

SEQ ID NO: 301950 - RNA, 64 nt, Homo Sapiens
uuuuguagaaccuuccagaaaaccaggaaugaguaucuaauagcuggcuuauuuaauuuuccag

SEQ ID NO: 301951 - RNA, 64 nt, Homo Sapiens
uaugcugugauaaaaauaggugagagaucauaugaucuaauauuguauugauggaaguauaggu

SEQ ID NO: 301952 - RNA, 64 nt, Homo Sapiens
agccagucaagcuaguaggcugauugugaagaaaaucuaauaccuuaucuuuaucucaaaccuc

SEQ ID NO: 301953 - RNA, 64 nt, Homo Sapiens
uauauauuauaggccagcuacuacuguauauaacaucuaauauaaaacuauugacuugguaagu

SEQ ID NO: 301954 - RNA, 64 nt, Homo Sapiens
uauauuacaggccaaaugaacuacuguauauaacaucuaauauaaaacuauugacuugguaagu

SEQ ID NO: 301955 - RNA, 64 nt, Homo Sapiens
uuacguaccagggagucgacgcaaaaaguauccuucccgccauucgacccuccucccgcgcccg

SEQ ID NO: 301956 - RNA, 64 nt, Homo Sapiens
cuggccucccugcuugcgcuccucagcccacccuucccgccaccccucggcucggucuccagcg

SEQ ID NO: 301957 - RNA, 64 nt, Homo Sapiens
gcacguggucucgccuucccuucuuccugcagguucccgccaagccaugugacagagugcucac

SEQ ID NO: 301958 - RNA, 64 nt, Homo Sapiens
uuugagugugggagaggagaccaggucacccgauucccgccaagccggaagucccugcagcacc

SEQ ID NO: 301959 - RNA, 50 nt, Homo Sapiens
auggcccugcaaaccauugagcguaggauuuguugcauuaugcuagagca

SEQ ID NO: 301960 - RNA, 64 nt, Homo Sapiens
aagaagggacagggaauuucguuuggcgagguaugcguaggagcuuccuuugcagggugugagg

SEQ ID NO: 301961 - RNA, 64 nt, Homo Sapiens
gaggcuggacagauggcggagagacuuugcagaggcguaggaauaaucaguaguuagcauccaa

SEQ ID NO: 301962 - RNA, 64 nt, Homo Sapiens
guuuuccuuuugucaauaauuuggacacaaguuugcguaggaguagucgcugggagcagugcgg

SEQ ID NO: 301963 - RNA, 64 nt, Homo Sapiens
auaucaagaaaagugcaauuucaugcugaaugaagcguaggaacuugacaagcccauagguagc

SEQ ID NO: 301964 - RNA, 64 nt, Homo Sapiens
auauaacuggcuguuuucuguucuuguuuauccagcguaggaagaaggaaaagaaaaucuuugc

SEQ ID NO: 301965 - RNA, 64 nt, Homo Sapiens
aaccauaauuaucuuacuaauauccuaucccucugcguaggaauucuuucugggaggcauguuu

SEQ ID NO: 301966 - RNA, 64 nt, Homo Sapiens
uugugagagaaaauacuauuucaagucauauucugcguaggaaaaugaauugguuggggaaagu

SEQ ID NO: 301967 - RNA, 64 nt, Homo Sapiens
uggggcuguagcaucaucuugggcuggaaggcuggcguaggacuccugcacacaugagccuucc

SEQ ID NO: 301968 - RNA, 64 nt, Homo Sapiens
gucacuugcaauuguuaaucaaagauugaacacugcguaggagagggagaugauccagagacau

SEQ ID NO: 301969 - RNA, 64 nt, Homo Sapiens
cugaacuaagacacagggaguauuucagaggccagcguaggagucauugacaacaaaaagccga

SEQ ID NO: 301970 - RNA, 64 nt, Homo Sapiens
cuuauauacuuaucagggccauacugguaagcuugcguaggaggaguuagagggaaguugaaag

SEQ ID NO: 301971 - RNA, 64 nt, Homo Sapiens
agaacuuuccauggcaguaagaccccauaugucugcguaggagcuuuggccuggugcucacugg

SEQ ID NO: 301972 - RNA, 64 nt, Homo Sapiens
gugggcuggcgguacccaccggaaggcgcggcgggcguaggagggccccaggcggaccagaggu

SEQ ID NO: 301973 - RNA, 64 nt, Homo Sapiens
gagacaccuacagcguggaugcuguuccgagucagcguaggagaaaggccacuggaaaccagag

SEQ ID NO: 301974 - RNA, 64 nt, Homo Sapiens
cuggcugcuuaaugagcuggggcagagccucucagcguaggaagccgccugggcugacugauga

SEQ ID NO: 301975 - RNA, 64 nt, Homo Sapiens
gaagaaacaaaugcuugaaucagccucuucaauggcguaggaaaauuguaauuauuauaaucgu

SEQ ID NO: 301976 - RNA, 64 nt, Homo Sapiens
gaacagggaugcuaucucgcugaauacguaaacugcguaggagaucuaaagguuucacuguuca

SEQ ID NO: 301977 - RNA, 64 nt, Homo Sapiens
ucaguggugguggguuuuuuggagcgcggaaacugcguaggaaugagacggcccugcugcggac

SEQ ID NO: 301978 - RNA, 64 nt, Homo Sapiens; identical to SEQ ID NO: 93680

SEQ ID NO: 301979 - RNA, 64 nt, Homo Sapiens; identical to SEQ ID NO: 93681

SEQ ID NO: 301980 - RNA, 64 nt, Homo Sapiens; identical to SEQ ID NO: 93682

SEQ ID NO: 301981 - RNA, 64 nt, Homo Sapiens; identical to SEQ ID NO: 93683

SEQ ID NO: 301982 - RNA, 64 nt, Homo Sapiens; identical to SEQ ID NO: 93684

SEQ ID NO: 301983 - RNA, 64 nt, Homo Sapiens; identical to SEQ ID NO: 93685

SEQ ID NO: 301984 - RNA, 64 nt, Homo Sapiens; identical to SEQ ID NO: 93686

SEQ ID NO: 301985 - RNA, 64 nt, Homo Sapiens; identical to SEQ ID NO: 93687

SEQ ID NO: 301986 - RNA, 64 nt, Homo Sapiens; identical to SEQ ID NO: 246057

SEQ ID NO: 301987 - RNA, 64 nt, Homo Sapiens; identical to SEQ ID NO: 246058

SEQ ID NO: 301988 - RNA, 64 nt, Homo Sapiens; identical to SEQ ID NO: 246059

SEQ ID NO: 301989 - RNA, 64 nt, Homo Sapiens; identical to SEQ ID NO: 246060

SEQ ID NO: 301990 - RNA, 64 nt, Homo Sapiens; identical to SEQ ID NO: 246061

SEQ ID NO: 301991 - RNA, 64 nt, Homo Sapiens; identical to SEQ ID NO: 246062

SEQ ID NO: 301992 - RNA, 64 nt, Homo Sapiens; identical to SEQ ID NO: 246063

SEQ ID NO: 301993 - RNA, 64 nt, Homo Sapiens; identical to SEQ ID NO: 246064

SEQ ID NO: 301994 - RNA, 64 nt, Homo Sapiens; identical to SEQ ID NO: 246065

SEQ ID NO: 301995 - RNA, 64 nt, Homo Sapiens; identical to SEQ ID NO: 246066

SEQ ID NO: 301996 - RNA, 64 nt, Homo Sapiens; identical to SEQ ID NO: 246067

SEQ ID NO: 301997 - RNA, 64 nt, Homo Sapiens; identical to SEQ ID NO: 246068

SEQ ID NO: 301998 - RNA, 64 nt, Homo Sapiens; identical to SEQ ID NO: 246069

SEQ ID NO: 301999 - RNA, 64 nt, Homo Sapiens; identical to SEQ ID NO: 246070

SEQ ID NO: 302000 - RNA, 64 nt, Homo Sapiens; identical to SEQ ID NO: 246071

SEQ ID NO: 302001 - RNA, 64 nt, Homo Sapiens; identical to SEQ ID NO: 246072

SEQ ID NO: 302002 - RNA, 64 nt, Homo Sapiens; identical to SEQ ID NO: 246073

SEQ ID NO: 302003 - RNA, 64 nt, Homo Sapiens; identical to SEQ ID NO: 246074

SEQ ID NO: 302004 - RNA, 64 nt, Homo Sapiens
uucacaugguguggucugauccacuuaaaauaguccugcuuaaaaugcuucuaguauuguuucc

SEQ ID NO: 302005 - RNA, 64 nt, Homo Sapiens
uaggaggugagugccaggaagagugucccgcucuccugcuuaccugaguuuagucacaacuccu

SEQ ID NO: 302006 - RNA, 64 nt, Homo Sapiens
acauguuauuguuuucaaccuagaaaccuuuaucccugcuuaucugaaacuucccaacuucccu

SEQ ID NO: 302007 - RNA, 64 nt, Homo Sapiens
gauuugguuguuuaaauauaaaucugaucaccccccugcuuagaacccuucugcuuucuauuac

SEQ ID NO: 302008 - RNA, 64 nt, Homo Sapiens
aaauguguugguccauugaagaggggagauguguccugcuuauuuuaaaucugacaugguagga

SEQ ID NO: 302009 - RNA, 64 nt, Homo Sapiens
gugcuuaagaguauaauaaagagcauaugaaaauccugcuuaauccaaugguuucaguuugcuu

SEQ ID NO: 302010 - RNA, 64 nt, Homo Sapiens
auugacacucucuaccaagauucuguuuacguaaccugcuuagucuaaaaauugugguuguuuu

SEQ ID NO: 302011 - RNA, 64 nt, Homo Sapiens
uauaaaucauuuccuuucuuaggacagugaggcuccugcuuauugggugacagcaugguaauga

SEQ ID NO: 302012 - RNA, 64 nt, Homo Sapiens; identical to SEQ ID NO: 246041

SEQ ID NO: 302013 - RNA, 64 nt, Homo Sapiens; identical to SEQ ID NO: 246042

SEQ ID NO: 302014 - RNA, 64 nt, Homo Sapiens; identical to SEQ ID NO: 246043

SEQ ID NO: 302015 - RNA, 64 nt, Homo Sapiens; identical to SEQ ID NO: 246044

SEQ ID NO: 302016 - RNA, 64 nt, Homo Sapiens; identical to SEQ ID NO: 246045

SEQ ID NO: 302017 - RNA, 64 nt, Homo Sapiens; identical to SEQ ID NO: 246046

SEQ ID NO: 302018 - RNA, 64 nt, Homo Sapiens; identical to SEQ ID NO: 246047

SEQ ID NO: 302019 - RNA, 64 nt, Homo Sapiens; identical to SEQ ID NO: 246048

SEQ ID NO: 302020 - RNA, 64 nt, Homo Sapiens; identical to SEQ ID NO: 246049

SEQ ID NO: 302021 - RNA, 64 nt, Homo Sapiens; identical to SEQ ID NO: 246050

SEQ ID NO: 302022 - RNA, 64 nt, Homo Sapiens; identical to SEQ ID NO: 246051

SEQ ID NO: 302023 - RNA, 64 nt, Homo Sapiens; identical to SEQ ID NO: 246052

SEQ ID NO: 302024 - RNA, 64 nt, Homo Sapiens; identical to SEQ ID NO: 246053

SEQ ID NO: 302025 - RNA, 64 nt, Homo Sapiens; identical to SEQ ID NO: 246054

SEQ ID NO: 302026 - RNA, 64 nt, Homo Sapiens; identical to SEQ ID NO: 246055

SEQ ID NO: 302027 - RNA, 64 nt, Homo Sapiens; identical to SEQ ID NO: 246056

SEQ ID NO: 302028 - RNA, 64 nt, Homo Sapiens; identical to SEQ ID NO: 102243

SEQ ID NO: 302029 - RNA, 64 nt, Homo Sapiens; identical to SEQ ID NO: 102244

SEQ ID NO: 302030 - RNA, 64 nt, Homo Sapiens; identical to SEQ ID NO: 102245

SEQ ID NO: 302031 - RNA, 64 nt, Homo Sapiens; identical to SEQ ID NO: 102246

SEQ ID NO: 302032 - RNA, 64 nt, Homo Sapiens; identical to SEQ ID NO: 102247

SEQ ID NO: 302033 - RNA, 64 nt, Homo Sapiens; identical to SEQ ID NO: 102248

SEQ ID NO: 302034 - RNA, 64 nt, Homo Sapiens; identical to SEQ ID NO: 102249

SEQ ID NO: 302035 - RNA, 64 nt, Homo Sapiens; identical to SEQ ID NO: 102250

SEQ ID NO: 302036 - RNA, 64 nt, Homo Sapiens; identical to SEQ ID NO: 102251

SEQ ID NO: 302037 - RNA, 64 nt, Homo Sapiens; identical to SEQ ID NO: 102252

SEQ ID NO: 302038 - RNA, 64 nt, Homo Sapiens; identical to SEQ ID NO: 102253

SEQ ID NO: 302039 - RNA, 64 nt, Homo Sapiens; identical to SEQ ID NO: 102254

SEQ ID NO: 302040 - RNA, 64 nt, Homo Sapiens; identical to SEQ ID NO: 102255

SEQ ID NO: 302041 - RNA, 64 nt, Homo Sapiens; identical to SEQ ID NO: 102256

SEQ ID NO: 302042 - RNA, 64 nt, Homo Sapiens; identical to SEQ ID NO: 102257

SEQ ID NO: 302043 - RNA, 64 nt, Homo Sapiens; identical to SEQ ID NO: 102258

SEQ ID NO: 302044 - RNA, 62 nt, Homo Sapiens; identical to SEQ ID NO: 103355

SEQ ID NO: 302045 - RNA, 62 nt, Homo Sapiens; identical to SEQ ID NO: 103356

SEQ ID NO: 302046 - RNA, 62 nt, Homo Sapiens; identical to SEQ ID NO: 103472

SEQ ID NO: 302047 - RNA, 62 nt, Homo Sapiens; identical to SEQ ID NO: 103473

SEQ ID NO: 302048 - RNA, 64 nt, Homo Sapiens
aguaugugaagaaaaucuacuuguaaaaggcucagaucuuaauuaaaagguaauuguagcacau

SEQ ID NO: 302049 - RNA, 64 nt, Homo Sapiens
agcaaugaauugugccuaguggagaaccucuauagaucuuaaaaaaugaauuauucuuuagcag

SEQ ID NO: 302050 - RNA, 64 nt, Homo Sapiens
aaaagagucccagaauguugaauucauucuguaggaucuuaagacuuguuuuugugugugcaua

SEQ ID NO: 302051 - RNA, 64 nt, Homo Sapiens
gaagccuuucuguucagaugcuccggagaaucaagaucuuaaguagaaagaagaugaauuauag

SEQ ID NO: 302052 - RNA, 64 nt, Homo Sapiens
uaaaauaguaaauguccauuuguuccuauaaguagaucuuaaugggggcugggaauugucucuu

SEQ ID NO: 302053 - RNA, 64 nt, Homo Sapiens
uaacaacccaaaaauaaaugggcccagauagguugaucuuaaugaggugugagccaccgugccc

SEQ ID NO: 302054 - RNA, 64 nt, Homo Sapiens
agaacucccuuuggcuacuuuugaaaaucaagaugagauauauagauauauauccauacauuuu

SEQ ID NO: 302055 - RNA, 64 nt, Homo Sapiens
uuucuaauacuaauguuauuucuuaaaauucagugagauauaggauaaaauaaugcuuugagaa

SEQ ID NO: 302056 - RNA, 64 nt, Homo Sapiens
gacccagacuucaugcaaaucccauucaggguaggagauauaguauauagcugucccaucuucc

SEQ ID NO: 302057 - RNA, 64 nt, Homo Sapiens
ugucccaucuucccccauuccaccgcuucaguaugagauauagcaguugccagguuuuagcugc

SEQ ID NO: 302058 - RNA, 64 nt, Homo Sapiens
uuagaaauucaaguauuuucaaggggagucauuugagauauauuuauuuuacuaggagaucuua

SEQ ID NO: 302059 - RNA, 64 nt, Homo Sapiens
ugagacuuuucagguguuggagccucuaaaauaugagauauaaacagaaacuaauacaaguugu

SEQ ID NO: 302060 - RNA, 64 nt, Homo Sapiens
agaagccauauauuggcuuuucuucuuaacuugggagauauauugaaacaaggugcuuuauaag

SEQ ID NO: 302061 - RNA, 64 nt, Homo Sapiens
aaagagugaauaagauuauuagaauucagcaauagagauauaucuauuuucaauucaacuacag

SEQ ID NO: 302062 - RNA, 64 nt, Homo Sapiens
uuuguacugguuguaacuugcauuagaaaaaaaagagauauauacaccacaaagaaucuaauaa

SEQ ID NO: 302063 - RNA, 64 nt, Homo Sapiens
acaccacaaagaaucuaauaagaaauuuauuauggagauauagcccuuaaaaugcaauauuaag

SEQ ID NO: 302064 - RNA, 64 nt, Homo Sapiens; identical to SEQ ID NO: 106125

SEQ ID NO: 302065 - RNA, 64 nt, Homo Sapiens; identical to SEQ ID NO: 106126

SEQ ID NO: 302066 - RNA, 64 nt, Homo Sapiens; identical to SEQ ID NO: 106127

SEQ ID NO: 302067 - RNA, 64 nt, Homo Sapiens; identical to SEQ ID NO: 106128

SEQ ID NO: 302068 - RNA, 64 nt, Homo Sapiens; identical to SEQ ID NO: 106129

SEQ ID NO: 302069 - RNA, 64 nt, Homo Sapiens; identical to SEQ ID NO: 106130

SEQ ID NO: 302070 - RNA, 63 nt, Homo Sapiens
augcagugagcuuguaauugcacaagagcccaggagguugagagaugucuaagacaggaggau

SEQ ID NO: 302071 - RNA, 63 nt, Homo Sapiens
cuauguugagcugagaucacuccuugaacccaagagguugagggggaggcugaggcacgagau

SEQ ID NO: 302072 - RNA, 63 nt, Homo Sapiens
uuggucuacaggcuagcagucaaauaauacuuagagguugaauaagaugcuuaggcaccuaag

SEQ ID NO: 302073 - RNA, 63 nt, Homo Sapiens
ugggacauuugcugagcaagggguauugagugugagguugaggugauuagggaaccuguauaa

SEQ ID NO: 302074 - RNA, 63 nt, Homo Sapiens
ugggcagaucgccugagguccccagcacuuugggagguugaggcaguggcucacgccuguaau

SEQ ID NO: 302075 - RNA, 63 nt, Homo Sapiens
auaacagagugcaaaguuucgaagguagaguaagagguugaagcugggacuucggcuagggag

SEQ ID NO: 302076 - RNA, 63 nt, Homo Sapiens
cacaucuuuggagccucgggauaaaaugacagugagguugaaaagugaaaacccuagaacuug

SEQ ID NO: 302077 - RNA, 63 nt, Homo Sapiens
auggauaucaguucugccucacauuucccacuugagguugaggcguacuggagacaacaccuc

SEQ ID NO: 302078 - RNA, 64 nt, Homo Sapiens
cucacgcacacgcgcuucuuaggggcagagugcaaagacccacaugguuguaugaaaugaaaaa

SEQ ID NO: 302079 - RNA, 64 nt, Homo Sapiens
uuuugaaucucaaccgaggugcgcgagagagaucaagacccaaggagagagaaagagagagaga

SEQ ID NO: 302080 - RNA, 64 nt, Homo Sapiens
cccagcagaaagacaccgcgaaagacccagguaaaagacccaacaaaaauagcuuuccuggcua

SEQ ID NO: 302081 - RNA, 63 nt, Homo Sapiens
uaaaagacccaaccccagcacuuuccuggcuaaaagacccaggggauugccaauaaaaaauag

SEQ ID NO: 302082 - RNA, 64 nt, Homo Sapiens
uuaauuauacccauagguaauacaaaaagcucugaagacccaaagaugacauuacuaaugaugu

SEQ ID NO: 302083 - RNA, 64 nt, Homo Sapiens
cagacucacagagugaauucagcucuucugaaucaagacccacccagucucuuucauucagacc

SEQ ID NO: 302084 - RNA, 64 nt, Homo Sapiens
cugagucuuaucguuguacuaaacaaacaaacaaaagacccaaugcgagacucugucucaaaac

SEQ ID NO: 302085 - RNA, 64 nt, Homo Sapiens
cugaggccgggcacgguggcgggaggucaaaauaaagacccaaugucuaaggcaugaauaagag

SEQ ID NO: 302086 - RNA, 64 nt, Homo Sapiens; identical to SEQ ID NO: 73175

SEQ ID NO: 302087 - RNA, 64 nt, Homo Sapiens; identical to SEQ ID NO: 73176

SEQ ID NO: 302088 - RNA, 64 nt, Homo Sapiens; identical to SEQ ID NO: 73177

SEQ ID NO: 302089 - RNA, 64 nt, Homo Sapiens; identical to SEQ ID NO: 73178

SEQ ID NO: 302090 - RNA, 64 nt, Homo Sapiens; identical to SEQ ID NO: 73179

SEQ ID NO: 302091 - RNA, 64 nt, Homo Sapiens; identical to SEQ ID NO: 73180

SEQ ID NO: 302092 - RNA, 64 nt, Homo Sapiens; identical to SEQ ID NO: 73181

SEQ ID NO: 302093 - RNA, 64 nt, Homo Sapiens; identical to SEQ ID NO: 73182

SEQ ID NO: 302094 - RNA, 64 nt, Homo Sapiens; identical to SEQ ID NO: 73183

SEQ ID NO: 302095 - RNA, 64 nt, Homo Sapiens; identical to SEQ ID NO: 73184

SEQ ID NO: 302096 - RNA, 64 nt, Homo Sapiens; identical to SEQ ID NO: 74265

SEQ ID NO: 302097 - RNA, 64 nt, Homo Sapiens; identical to SEQ ID NO: 74266

SEQ ID NO: 302098 - RNA, 64 nt, Homo Sapiens; identical to SEQ ID NO: 74267

SEQ ID NO: 302099 - RNA, 64 nt, Homo Sapiens; identical to SEQ ID NO: 74268

SEQ ID NO: 302100 - RNA, 64 nt, Homo Sapiens; identical to SEQ ID NO: 74269

SEQ ID NO: 302101 - RNA, 64 nt, Homo Sapiens; identical to SEQ ID NO: 74270

SEQ ID NO: 302102 - RNA, 64 nt, Homo Sapiens; identical to SEQ ID NO: 74271

SEQ ID NO: 302103 - RNA, 64 nt, Homo Sapiens; identical to SEQ ID NO: 74272

SEQ ID NO: 302104 - RNA, 64 nt, Homo Sapiens; identical to SEQ ID NO: 74273

SEQ ID NO: 302105 - RNA, 64 nt, Homo Sapiens; identical to SEQ ID NO: 74274

SEQ ID NO: 302106 - RNA, 64 nt, Homo Sapiens; identical to SEQ ID NO: 74275

SEQ ID NO: 302107 - RNA, 64 nt, Homo Sapiens; identical to SEQ ID NO: 74276

SEQ ID NO: 302108 - RNA, 64 nt, Homo Sapiens; identical to SEQ ID NO: 74277

SEQ ID NO: 302109 - RNA, 64 nt, Homo Sapiens; identical to SEQ ID NO: 74278

SEQ ID NO: 302110 - RNA, 64 nt, Homo Sapiens; identical to SEQ ID NO: 74279

SEQ ID NO: 302111 - RNA, 64 nt, Homo Sapiens; identical to SEQ ID NO: 74280

SEQ ID NO: 302112 - RNA, 64 nt, Homo Sapiens; identical to SEQ ID NO: 74281

SEQ ID NO: 302113 - RNA, 64 nt, Homo Sapiens; identical to SEQ ID NO: 74282

SEQ ID NO: 302114 - RNA, 64 nt, Homo Sapiens; identical to SEQ ID NO: 74283

SEQ ID NO: 302115 - RNA, 64 nt, Homo Sapiens; identical to SEQ ID NO: 74284

SEQ ID NO: 302116 - RNA, 64 nt, Homo Sapiens; identical to SEQ ID NO: 74285

SEQ ID NO: 302117 - RNA, 64 nt, Homo Sapiens; identical to SEQ ID NO: 74286

SEQ ID NO: 302118 - RNA, 64 nt, Homo Sapiens; identical to SEQ ID NO: 74287

SEQ ID NO: 302119 - RNA, 64 nt, Homo Sapiens; identical to SEQ ID NO: 74288

SEQ ID NO: 302120 - RNA, 64 nt, Homo Sapiens; identical to SEQ ID NO: 74289

SEQ ID NO: 302121 - RNA, 64 nt, Homo Sapiens
uguuucauuuauaaaaggucagagaagguauaggugaucggaucgccucauuauuuggaauuug

SEQ ID NO: 302122 - RNA, 64 nt, Homo Sapiens
gguguuugggaaauucugagaugggagugagaucugaucggauccugggaagauguauacccag

SEQ ID NO: 302123 - RNA, 64 nt, Homo Sapiens
ugcuuuguaaucuacugucccaucugccuuaacgugaucggagaagaugcagccacagauugau

SEQ ID NO: 302124 - RNA, 64 nt, Homo Sapiens
gauuaaaaaacaaauucucuuuguuguguaaaauugaucggauucuauguuucuuaaugauauu

SEQ ID NO: 302125 - RNA, 64 nt, Homo Sapiens
gggugaugaucuucugaagcucuuggaugucauuugaucggaauaugcaguggaauaggugacu

SEQ ID NO: 302126 - RNA, 64 nt, Homo Sapiens
agcauuuguuucuccccaaaagaagcagagcagaugaucggagcagcaugaauugaggaacaga

SEQ ID NO: 302127 - RNA, 64 nt, Homo Sapiens
gcgccaggccucucccuggccucuuaccugucagugaucggagcacugcccugggcuggccggc

SEQ ID NO: 302128 - RNA, 64 nt, Homo Sapiens
aauuuaaccuccugauguggauuccucaaagacuugaucggagaauacucuuguuucaccauua

SEQ ID NO: 302129 - RNA, 64 nt, Homo Sapiens
cagagcaaugaguugggaaaagagguggcauuucugaucggauaauggaauacucucauuuauu

SEQ ID NO: 302130 - RNA, 64 nt, Homo Sapiens
guguguuuguuguuuguuuuguaucuuguuuuucugaucggagcaucacuacugaccuguugua

SEQ ID NO: 302131 - RNA, 64 nt, Homo Sapiens
ugaccugaggccaucuucggugaagcaagggugaugaucggagacuacuuacuuucuccagugg

SEQ ID NO: 302132 - RNA, 64 nt, Homo Sapiens
ucuuuccuuugauagagagaaauuauaauguaggugaucggagcugcagaaaauaagcacagaa

SEQ ID NO: 302133 - RNA, 64 nt, Homo Sapiens
cauguuucucucugcgagucuaaaaaggaaaagcugaucggaucucacaguuauuuccaguuua

SEQ ID NO: 302134 - RNA, 64 nt, Homo Sapiens
aacauaaugcucauagaaucagugagguuacuuuugaucggagcagcuaugaugguauuugagu

SEQ ID NO: 302135 - RNA, 64 nt, Homo Sapiens
uucuuguuaucaccauuccagauacuggcucucuugaucggaauuagauauuuuaauucaaagg

SEQ ID NO: 302136 - RNA, 64 nt, Homo Sapiens
uuuggugaccucccuuacugggcuaaucagcacuugaucggaaguccagguuaguaugugaagc

SEQ ID NO: 302137 - RNA, 64 nt, Homo Sapiens
ucagguuuacacaaacugagggaaaucaugcgugugaucggaaccaggaccccaagauacagaa

SEQ ID NO: 302138 - RNA, 64 nt, Homo Sapiens
uuagaacagaauauauaccugaacuguagugguuugaucggauggagacagaaaacccgauuuu

SEQ ID NO: 302139 - RNA, 64 nt, Homo Sapiens
ggagggcuacugccucacauccacgagggguaccugaucggagagcggcccuggaggaguucau

SEQ ID NO: 302140 - RNA, 64 nt, Homo Sapiens
guaaauguuuuauuaguucauugccugcacuuacugaucggaagagagaaagaacaguuucagu

SEQ ID NO: 302141 - RNA, 64 nt, Homo Sapiens
cacccuuggaaagcucaggguggggggaccacuuugaucggaccuguuucuugagcaucugguc

SEQ ID NO: 302142 - RNA, 64 nt, Homo Sapiens
auucugggaagaaguaauuuguccggcacguaacugaucggagcaaagugcguacaguuagaac

SEQ ID NO: 302143 - RNA, 64 nt, Homo Sapiens
cuccucucucaaacuggggcguagcacccuggauugaucggagcuuuacuugaccuccuaacaa

SEQ ID NO: 302144 - RNA, 64 nt, Homo Sapiens
auguacugugaagaguagggcucccccccuccuuugaucggaaucccuuagggaguccccaaca

SEQ ID NO: 302145 - RNA, 64 nt, Homo Sapiens
gaagacacacagcagggccagugcucuuuaagcgugaucggagggcuguucaggugggaccaug

SEQ ID NO: 302146 - RNA, 64 nt, Homo Sapiens
gcucuuccuaaucgcuaaucucuccuuaccgucuugaucggaaacugucuuagacugcuagcuu

SEQ ID NO: 302147 - RNA, 64 nt, Homo Sapiens
aaaaggggguuaaaaagcagugcuuucaugaaugccauccuacacauauuauugcuauuaccug

SEQ ID NO: 302148 - RNA, 64 nt, Homo Sapiens
caucacaucuuacugucgaaauuaaaugugugauccauccuaguauuuucuguuccauuccuuu

SEQ ID NO: 302149 - RNA, 64 nt, Homo Sapiens
aggaggggaggagagauggauauuucagcccucuccauccuagucaacacuggauccaccuagu

SEQ ID NO: 302150 - RNA, 64 nt, Homo Sapiens
ggcugggcccaugcaagggcggggcagaaaaaacccauccuaaaccuacccaugaccccuacuu

SEQ ID NO: 302151 - RNA, 64 nt, Homo Sapiens
caugaccccuacuuggggcagcuucuggcagcuuccauccuacccccagggccaggccuaagag

SEQ ID NO: 302152 - RNA, 64 nt, Homo Sapiens; identical to SEQ ID NO: 61035

SEQ ID NO: 302153 - RNA, 64 nt, Homo Sapiens; identical to SEQ ID NO: 61036

SEQ ID NO: 302154 - RNA, 64 nt, Homo Sapiens; identical to SEQ ID NO: 61037

SEQ ID NO: 302155 - RNA, 64 nt, Homo Sapiens; identical to SEQ ID NO: 61038

SEQ ID NO: 302156 - RNA, 64 nt, Homo Sapiens; identical to SEQ ID NO: 61039

SEQ ID NO: 302157 - RNA, 64 nt, Homo Sapiens; identical to SEQ ID NO: 61040

SEQ ID NO: 302158 - RNA, 64 nt, Homo Sapiens; identical to SEQ ID NO: 61041

SEQ ID NO: 302159 - RNA, 64 nt, Homo Sapiens; identical to SEQ ID NO: 61042

SEQ ID NO: 302160 - RNA, 64 nt, Homo Sapiens; identical to SEQ ID NO: 61043

SEQ ID NO: 302161 - RNA, 64 nt, Homo Sapiens; identical to SEQ ID NO: 61044

SEQ ID NO: 302162 - RNA, 64 nt, Homo Sapiens; identical to SEQ ID NO: 61045

SEQ ID NO: 302163 - RNA, 64 nt, Homo Sapiens; identical to SEQ ID NO: 61046

SEQ ID NO: 302164 - RNA, 64 nt, Homo Sapiens; identical to SEQ ID NO: 61047

SEQ ID NO: 302165 - RNA, 64 nt, Homo Sapiens; identical to SEQ ID NO: 61048

SEQ ID NO: 302166 - RNA, 64 nt, Homo Sapiens; identical to SEQ ID NO: 61049

SEQ ID NO: 302167 - RNA, 64 nt, Homo Sapiens; identical to SEQ ID NO: 61050

SEQ ID NO: 302168 - RNA, 64 nt, Homo Sapiens; identical to SEQ ID NO: 61051

SEQ ID NO: 302169 - RNA, 64 nt, Homo Sapiens; identical to SEQ ID NO: 61052

SEQ ID NO: 302170 - RNA, 64 nt, Homo Sapiens; identical to SEQ ID NO: 61053

SEQ ID NO: 302171 - RNA, 64 nt, Homo Sapiens; identical to SEQ ID NO: 61054

SEQ ID NO: 302172 - RNA, 64 nt, Homo Sapiens; identical to SEQ ID NO: 61055

SEQ ID NO: 302173 - RNA, 64 nt, Homo Sapiens; identical to SEQ ID NO: 61056

SEQ ID NO: 302174 - RNA, 64 nt, Homo Sapiens; identical to SEQ ID NO: 61057

SEQ ID NO: 302175 - RNA, 64 nt, Homo Sapiens; identical to SEQ ID NO: 61058

SEQ ID NO: 302176 - RNA, 64 nt, Homo Sapiens; identical to SEQ ID NO: 61059

SEQ ID NO: 302177 - RNA, 64 nt, Homo Sapiens; identical to SEQ ID NO: 61060

SEQ ID NO: 302178 - RNA, 64 nt, Homo Sapiens; identical to SEQ ID NO: 61061

SEQ ID NO: 302179 - RNA, 64 nt, Homo Sapiens; identical to SEQ ID NO: 61062

SEQ ID NO: 302180 - RNA, 64 nt, Homo Sapiens; identical to SEQ ID NO: 61063

SEQ ID NO: 302181 - RNA, 64 nt, Homo Sapiens; identical to SEQ ID NO: 61064

SEQ ID NO: 302182 - RNA, 64 nt, Homo Sapiens; identical to SEQ ID NO: 61065

SEQ ID NO: 302183 - RNA, 64 nt, Homo Sapiens; identical to SEQ ID NO: 61066

SEQ ID NO: 302184 - RNA, 64 nt, Homo Sapiens; identical to SEQ ID NO: 61067

SEQ ID NO: 302185 - RNA, 64 nt, Homo Sapiens; identical to SEQ ID NO: 61068

SEQ ID NO: 302186 - RNA, 64 nt, Homo Sapiens; identical to SEQ ID NO: 61069

SEQ ID NO: 302187 - RNA, 64 nt, Homo Sapiens; identical to SEQ ID NO: 61070

SEQ ID NO: 302188 - RNA, 64 nt, Homo Sapiens; identical to SEQ ID NO: 61071

SEQ ID NO: 302189 - RNA, 64 nt, Homo Sapiens; identical to SEQ ID NO: 61072

SEQ ID NO: 302190 - RNA, 64 nt, Homo Sapiens; identical to SEQ ID NO: 61073

SEQ ID NO: 302191 - RNA, 64 nt, Homo Sapiens; identical to SEQ ID NO: 61074

SEQ ID NO: 302192 - RNA, 64 nt, Homo Sapiens; identical to SEQ ID NO: 61075

SEQ ID NO: 302193 - RNA, 64 nt, Homo Sapiens; identical to SEQ ID NO: 61076

SEQ ID NO: 302194 - RNA, 64 nt, Homo Sapiens; identical to SEQ ID NO: 61077

SEQ ID NO: 302195 - RNA, 64 nt, Homo Sapiens; identical to SEQ ID NO: 61078

SEQ ID NO: 302196 - RNA, 64 nt, Homo Sapiens; identical to SEQ ID NO: 61079

SEQ ID NO: 302197 - RNA, 64 nt, Homo Sapiens; identical to SEQ ID NO: 61080

SEQ ID NO: 302198 - RNA, 64 nt, Homo Sapiens; identical to SEQ ID NO: 61081

SEQ ID NO: 302199 - RNA, 64 nt, Homo Sapiens; identical to SEQ ID NO: 61082

SEQ ID NO: 302200 - RNA, 64 nt, Homo Sapiens; identical to SEQ ID NO: 61083

SEQ ID NO: 302201 - RNA, 64 nt, Homo Sapiens; identical to SEQ ID NO: 61084

SEQ ID NO: 302202 - RNA, 64 nt, Homo Sapiens; identical to SEQ ID NO: 61085

SEQ ID NO: 302203 - RNA, 64 nt, Homo Sapiens; identical to SEQ ID NO: 61085

SEQ ID NO: 302204 - RNA, 64 nt, Homo Sapiens; identical to SEQ ID NO: 61087

SEQ ID NO: 302205 - RNA, 64 nt, Homo Sapiens; identical to SEQ ID NO: 61088

SEQ ID NO: 302206 - RNA, 64 nt, Homo Sapiens; identical to SEQ ID NO: 61089

SEQ ID NO: 302207 - RNA, 64 nt, Homo Sapiens; identical to SEQ ID NO: 61090

SEQ ID NO: 302208 - RNA, 64 nt, Homo Sapiens; identical to SEQ ID NO: 61091

SEQ ID NO: 302209 - RNA, 50 nt, Homo Sapiens; identical to SEQ ID NO: 61092

SEQ ID NO: 302210 - RNA, 64 nt, Homo Sapiens; identical to SEQ ID NO: 61093

SEQ ID NO: 302211 - RNA, 64 nt, Homo Sapiens; identical to SEQ ID NO: 61094

SEQ ID NO: 302212 - RNA, 64 nt, Homo Sapiens; identical to SEQ ID NO: 61095

SEQ ID NO: 302213 - RNA, 64 nt, Homo Sapiens; identical to SEQ ID NO: 61096

SEQ ID NO: 302214 - RNA, 64 nt, Homo Sapiens; identical to SEQ ID NO: 261635

SEQ ID NO: 302215 - RNA, 64 nt, Homo Sapiens; identical to SEQ ID NO: 261636

SEQ ID NO: 302216 - RNA, 64 nt, Homo Sapiens; identical to SEQ ID NO: 261637

SEQ ID NO: 302217 - RNA, 64 nt, Homo Sapiens; identical to SEQ ID NO: 261638

SEQ ID NO: 302218 - RNA, 64 nt, Homo Sapiens; identical to SEQ ID NO: 261639

SEQ ID NO: 302219 - RNA, 64 nt, Homo Sapiens; identical to SEQ ID NO: 261640

SEQ ID NO: 302220 - RNA, 64 nt, Homo Sapiens; identical to SEQ ID NO: 261641

SEQ ID NO: 302221 - RNA, 64 nt, Homo Sapiens; identical to SEQ ID NO: 261642

SEQ ID NO: 302222 - RNA, 64 nt, Homo Sapiens; identical to SEQ ID NO: 261643

SEQ ID NO: 302223 - RNA, 64 nt, Homo Sapiens; identical to SEQ ID NO: 261644

SEQ ID NO: 302224 - RNA, 64 nt, Homo Sapiens
auuuuaugcuuaaaaaguuaacaugauacgaaacugugauuagaaaauaucuggucuggaugug

SEQ ID NO: 302225 - RNA, 64 nt, Homo Sapiens
uacgaaacugugauuagaaaauaucuggucuggaugugauuaguaaggauacaagauaauguuc

SEQ ID NO: 302226 - RNA, 64 nt, Homo Sapiens
uguugagccuuuucaagaaccaacaaauuaucuuugugauuacaguaguuuaacuaugguuaaa

SEQ ID NO: 302227 - RNA, 64 nt, Homo Sapiens
cacuguggaacaaaauauaaggguacuguuggggugugauuaugauaacuucaggcuuuuagcu

SEQ ID NO: 302228 - RNA, 64 nt, Homo Sapiens
caaaugauaugaucagaguagugauagauaaaagugugauuaauacuauuuccaaacuaaaaau

SEQ ID NO: 302229 - RNA, 64 nt, Homo Sapiens
ggugugagccacugcacccgaccucccaaagugcugugauuacacucaugauccacccgccucg

SEQ ID NO: 302230 - RNA, 64 nt, Homo Sapiens
ggauuugaaggaugaaauuaauuguaugaagcaaugugauuauaugaagagacacaaauuaaaa

SEQ ID NO: 302231 - RNA, 64 nt, Homo Sapiens
aacuaugauguuuaguugcuuuauuuuaccucuaugugauuauuuuucuuaauuguuauuuuuu

SEQ ID NO: 302232 - RNA, 64 nt, Homo Sapiens
gggcaacuuaaugcaagauccugugagaaaacccugugauuagaacauaucuugaaagaaaagu

SEQ ID NO: 302233 - RNA, 64 nt, Homo Sapiens
uuugagugaauaggagaaaauguauauuggauuuugugauuauauuacugccuuuauucucucc

SEQ ID NO: 302234 - RNA, 64 nt, Homo Sapiens
gauucugguuuuggccggaaugugauuaggaaguugugauuauauuucauucucaugacugaac

SEQ ID NO: 302235 - RNA, 64 nt, Homo Sapiens
aaguugugauuauagauucuucucaugacugaacugugauuaggauuuccugcuuacuuuucau

SEQ ID NO: 302236 - RNA, 64 nt, Homo Sapiens
aaugaccaagauccaagcaaucugaauuuguuuuugugauuauuugacuggaaugcuucuuaag

SEQ ID NO: 302237 - RNA, 64 nt, Homo Sapiens
uugucaucacuuauucuagcaucacuguuaaggcugugauuauguuugauauucaccuggauuu

SEQ ID NO: 302238 - RNA, 64 nt, Homo Sapiens
uucacaguuuauuguuugucuguauaagaacucaugugauuaaguaauuuuccugucuugaaac

SEQ ID NO: 302239 - RNA, 64 nt, Homo Sapiens
aaaaugacuguagcugagagauaaugcagauccaugugauuauugagcauguaauaacuaauaa

SEQ ID NO: 302240 - RNA, 64 nt, Homo Sapiens
cguuaucuccggcuagaaaaucuaggccuuacuuugugauuauagcaaacaacuauaaaugguc

SEQ ID NO: 302241 - RNA, 64 nt, Homo Sapiens
aaaacucauuuucuuuucaauuuuacgugaagcaugugauuaggaugugcagcuuuacauuuua

SEQ ID NO: 302242 - RNA, 64 nt, Homo Sapiens
uggauuguauuuguagaguguuacgaguguaucaugugauuaugcuuuaccgguauaagagauu

SEQ ID NO: 302243 - RNA, 64 nt, Homo Sapiens
ugugauuaugcuuuaccgguauaagagauucuguugugauuauuugaauaguuuuauauuaaua

SEQ ID NO: 302244 - RNA, 64 nt, Homo Sapiens
uggaagcucuaagaugagagcauuuuacaaauuaugugauuaucuauugucucuuuauaaaugu

SEQ ID NO: 302245 - RNA, 64 nt, Homo Sapiens
guuuuuggagaccugaagccccccaugcccagcuugugauuauccaagugggaaaagagaacug

SEQ ID NO: 302246 - RNA, 64 nt, Homo Sapiens
ugaaaagaauuagcuugagauuaaagcugcacccugugauuauuuucauucagaaccuguuaga

SEQ ID NO: 302247 - RNA, 64 nt, Homo Sapiens
auuuaaaaacgaaaaguaugucacaaaaaguuaaugugauuaaggacaaucucauuggaacaug

SEQ ID NO: 302248 - RNA, 64 nt, Homo Sapiens
ugcugcaugaaaagugcaugccuuuuauuuaaguugugauuaccggacaaauguauagaauaaa

SEQ ID NO: 302249 - RNA, 64 nt, Homo Sapiens
uguguguucuaaugaguaacaucucaggaaaaucugugauuauuacuuucauaucuggcucaac

SEQ ID NO: 302250 - RNA, 64 nt, Homo Sapiens
gauuauaaaguauuaagacacuugaaguauggaaugugauuauaugcagcagaauuugcauuug

SEQ ID NO: 302251 - RNA, 64 nt, Homo Sapiens
ggcauguguuuguaaaauggcuucuggccucccuugugauuaauacauggagccaugaaaccuc

SEQ ID NO: 302252 - RNA, 64 nt, Homo Sapiens
gcagaaaccccugauaaacuagaaaaaaugaggaagaagcaaaaacacuucuuacauuguggca

SEQ ID NO: 302253 - RNA, 64 nt, Homo Sapiens
guggaaaccccugauaagccagagaaaaugaggaagaagcaaaagcacuucuuacauggcagca

SEQ ID NO: 302254 - RNA, 64 nt, Homo Sapiens
gguuuaaagaaauggucugcauaaccugaaugaaagaagcaaaugacuauucucugaagacaac

SEQ ID NO: 302255 - RNA, 64 nt, Homo Sapiens
gaugcugugguggaugagguuggaguucgaaagaagaagcaagcgcuggccuggccuugaaaga

SEQ ID NO: 302256 - RNA, 64 nt, Homo Sapiens
aaauaggaauccggcagaagaccuucauuaauuaagaagcaaacaaaaagagagcaacccaacc

SEQ ID NO: 302257 - RNA, 64 nt, Homo Sapiens
uuccaaacaaugugaauuuaaaaggucacacaaaagaagcaaucgggcuccgccaccacaaaau

SEQ ID NO: 302258 - RNA, 64 nt, Homo Sapiens
aagaaaaacaaaauaacaaaccuauuuuuaaagcagaagcaaaauaauucacaguccucagaag

SEQ ID NO: 302259 - RNA, 64 nt, Homo Sapiens
aucaguugguuugcuaccacucacuuaugaaaguagaagcaagagggaugauaugugggcaaaa

SEQ ID NO: 302260 - RNA, 64 nt, Homo Sapiens
cuucuuacauggcggcagcaagagaaaaugagaaagaagcaaaaguggaaaccccuaauaaacc

SEQ ID NO: 302261 - RNA, 64 nt, Homo Sapiens
cuucguacauggugguggcaagagaaaaugaagaagaagcaaaaguggaaaccccugauaaacc

SEQ ID NO: 302262 - RNA, 64 nt, Homo Sapiens
ggacagaccagacguuucauuuuucaagaguuucagaagcaacaguugacuguucuugacuaaa

SEQ ID NO: 302263 - RNA, 64 nt, Homo Sapiens
ccacuaaaagaggagaugguuuucuuggcaggagagaagcaagguggacuuuuucauuccuguu

SEQ ID NO: 302264 - RNA, 64 nt, Homo Sapiens
ucccagauauaggcugaacacaaauuuauaagguagaagcaauuuaucaucuuugaaggacacu

SEQ ID NO: 302265 - RNA, 64 nt, Homo Sapiens
auugucugcccuguuaaacuauaagugugaaugcagaagcaaauuuuuuaaaaaauguaauuga

SEQ ID NO: 302266 - RNA, 64 nt, Homo Sapiens
auaccugccagcacuucugcaagcugaaauuuacagaagcaaauucaccagaagggaaacaucu

SEQ ID NO: 302267 - RNA, 64 nt, Homo Sapiens
ugcauggcaugcacguauguaaguaaucuggggaagaagcaaagaucuguuucauucuuagccu

SEQ ID NO: 302268 - RNA, 64 nt, Homo Sapiens
uggaaaacauauauauguuagcaucaaagggggcagaagcaaagaagauacagaucugcacuga

SEQ ID NO: 302269 - RNA, 64 nt, Homo Sapiens
cauaaaggcuucauccacgaaccauccagcgcacagaagcaagugcaaaaaugacacaagcaca

SEQ ID NO: 302270 - RNA, 64 nt, Homo Sapiens
agccagggugugccaggagaccugcuggccuuggagaagcaaaaucaggugagccacucacccu

SEQ ID NO: 302271 - RNA, 64 nt, Homo Sapiens
ucaaguccuucccauacucaguguccugcugguuagaagcaaguaucccuuccccucugcccca

SEQ ID NO: 302272 - RNA, 64 nt, Homo Sapiens
cugccuggaacaaagaacugcaccuaagcagaccagaagcaaaaugucuucuucacggccugag

SEQ ID NO: 302273 - RNA, 64 nt, Homo Sapiens
ucagccuccagccauacagaacaaaugagaaauuagaagcaauuccaagaacgugugauggugu

SEQ ID NO: 302274 - RNA, 64 nt, Homo Sapiens
aacugaacucuauuacuaaugccuuccaaucagaguuccugauggggaugccugugggauggcc

SEQ ID NO: 302275 - RNA, 64 nt, Homo Sapiens
gauggggugaguuggguaaggaagaugaugcuuaguuccugauagaugcuacagauguaguuug

SEQ ID NO: 302276 - RNA, 64 nt, Homo Sapiens
auuguaguugaaacacagaaaaugccacuuuucuguuccugaagaggcucuuuugugcauaaua

SEQ ID NO: 302277 - RNA, 64 nt, Homo Sapiens
uuuguaguuccaaaaacccaucuaaauuucuugaguuccugaauuuugaacaggauuaccugga

SEQ ID NO: 302278 - RNA, 64 nt, Homo Sapiens
agagggcccgcuaguuccaggggaacugaaagcuguuccugaucagcccguaucaucugaggcc

SEQ ID NO: 302279 - RNA, 64 nt, Homo Sapiens
uggggcuguuguaagucuugcuggauguuccccuguuccugagccuuaaccccucgcacagcca

SEQ ID NO: 302280 - RNA, 64 nt, Homo Sapiens
uacaacaaaaugugugccuucuucugaaaugggaguuccugagauggggucggaagacaagggg

SEQ ID NO: 302281 - RNA, 64 nt, Homo Sapiens
accgaucuggucuguugguuccucgggucuugagguuccugacacaaaaggcagcgaggaggca

SEQ ID NO: 302282 - RNA, 64 nt, Homo Sapiens
gugggaagccugaaggcuagaagaugcuguggcaguuccugaagaagcuuuacugcaaagugaa

SEQ ID NO: 302283 - RNA, 64 nt, Homo Sapiens
aaacugccacuuuaggauggaguuuguagguggaguuccugacuaaggauuccucccaaaaugg

SEQ ID NO: 302284 - RNA, 64 nt, Homo Sapiens
gcucuauacuuguuuuaacacuuuuccccucacuguuccugaauuuagacggaaacagaaauug

SEQ ID NO: 302285 - RNA, 64 nt, Homo Sapiens
ugggauuuagugcaaaaaguguguuauuuauuuuguuccugaaacuucaguugugaauccuaug

SEQ ID NO: 302286 - RNA, 64 nt, Homo Sapiens
aaaacauuaaccuuuuaaguaauuauuguuauugguuccugaauguuagcugucuuugaugagg

SEQ ID NO: 302287 - RNA, 64 nt, Homo Sapiens
ccuaucuauuaaaccauucuucugcuuccaccauguuccugacacacaggugcacucaugaaac

SEQ ID NO: 302288 - RNA, 64 nt, Homo Sapiens
cuugguugacuauuuuggaaauaggcauaucaagguuccugauucagcacuuugcucuuuuaau

SEQ ID NO: 302289 - RNA, 64 nt, Homo Sapiens
aucaacaaguucuuguugacucagggcauaaugaguuccugagacaugcucuuuugggggcugg

SEQ ID NO: 302290 - RNA, 64 nt, Homo Sapiens
caggcucugaguggggacugcacccacucaugcuguuccugaggccgcccucuccagucccagg

SEQ ID NO: 302291 - RNA, 64 nt, Homo Sapiens
gccgcccucuccagucccaggagccgugucuagaguuccugaccagccaccuucugccagaacu

SEQ ID NO: 302292 - RNA, 64 nt, Homo Sapiens
cccagggccagagacaaggacuuaccaagaaugaguuccugaaauaccucaguggggaggcuuc

SEQ ID NO: 302293 - RNA, 64 nt, Homo Sapiens
ggccaccaggcgcccaguguccccccguggaaccguuccugaaagggagccacacuggggcccc

SEQ ID NO: 302294 - RNA, 64 nt, Homo Sapiens
ccccacccccaaucccaguguucuccccuaggugguuccugagccuguuucuucccacccuguc

SEQ ID NO: 302295 - RNA, 64 nt, Homo Sapiens
gcuggagaacacugcugggcgagccacauuagaaguuccugaggccacccacuccaggaaccca

SEQ ID NO: 302296 - RNA, 64 nt, Homo Sapiens
ccgugcccaacgagaaggugcccugggagacggaguuccugaucuaugacccacccuuuuacac

SEQ ID NO: 302297 - RNA, 64 nt, Homo Sapiens
ccuggcuggcucuucugugcuuuccacaaauaaaguuccugacacguccagggccaggggcugu

SEQ ID NO: 302298 - RNA, 64 nt, Homo Sapiens
acaaucuugaguaacugggaccgaguuugacuucguuccugaauauucuaauuaagaagugagg

SEQ ID NO: 302299 - RNA, 64 nt, Homo Sapiens
ggcucuggugauacucuccaauuccgcauggcugguuccugaguguucaauaagaaacccagcc

SEQ ID NO: 302300 - RNA, 64 nt, Homo Sapiens; identical to SEQ ID NO: 189120

SEQ ID NO: 302301 - RNA, 64 nt, Homo Sapiens; identical to SEQ ID NO: 189121

SEQ ID NO: 302302 - RNA, 64 nt, Homo Sapiens; identical to SEQ ID NO: 189122

SEQ ID NO: 302303 - RNA, 64 nt, Homo Sapiens; identical to SEQ ID NO: 189123

SEQ ID NO: 302304 - RNA, 64 nt, Homo Sapiens; identical to SEQ ID NO: 189124

SEQ ID NO: 302305 - RNA, 64 nt, Homo Sapiens; identical to SEQ ID NO: 189125

SEQ ID NO: 302306 - RNA, 64 nt, Homo Sapiens; identical to SEQ ID NO: 189126

SEQ ID NO: 302307 - RNA, 64 nt, Homo Sapiens; identical to SEQ ID NO: 189127

SEQ ID NO: 302308 - RNA, 64 nt, Homo Sapiens; identical to SEQ ID NO: 189128

SEQ ID NO: 302309 - RNA, 64 nt, Homo Sapiens; identical to SEQ ID NO: 189129

SEQ ID NO: 302310 - RNA, 64 nt, Homo Sapiens; identical to SEQ ID NO: 189130

SEQ ID NO: 302311 - RNA, 64 nt, Homo Sapiens; identical to SEQ ID NO: 189131

SEQ ID NO: 302312 - RNA, 64 nt, Homo Sapiens; identical to SEQ ID NO: 189132

SEQ ID NO: 302313 - RNA, 64 nt, Homo Sapiens; identical to SEQ ID NO: 189133

SEQ ID NO: 302314 - RNA, 64 nt, Homo Sapiens; identical to SEQ ID NO: 189134

SEQ ID NO: 302315 - RNA, 64 nt, Homo Sapiens; identical to SEQ ID NO: 189135

SEQ ID NO: 302316 - RNA, 64 nt, Homo Sapiens; identical to SEQ ID NO: 189136

SEQ ID NO: 302317 - RNA, 64 nt, Homo Sapiens; identical to SEQ ID NO: 189137

SEQ ID NO: 302318 - RNA, 64 nt, Homo Sapiens; identical to SEQ ID NO: 189138

SEQ ID NO: 302319 - RNA, 64 nt, Homo Sapiens; identical to SEQ ID NO: 189139

SEQ ID NO: 302320 - RNA, 64 nt, Homo Sapiens; identical to SEQ ID NO: 189140

SEQ ID NO: 302321 - RNA, 64 nt, Homo Sapiens; identical to SEQ ID NO: 189141

SEQ ID NO: 302322 - RNA, 64 nt, Homo Sapiens; identical to SEQ ID NO: 189142

SEQ ID NO: 302323 - RNA, 64 nt, Homo Sapiens; identical to SEQ ID NO: 189143

SEQ ID NO: 302324 - RNA, 64 nt, Homo Sapiens; identical to SEQ ID NO: 189144

SEQ ID NO: 302325 - RNA, 64 nt, Homo Sapiens; identical to SEQ ID NO: 189145

SEQ ID NO: 302326 - RNA, 64 nt, Homo Sapiens; identical to SEQ ID NO: 189146

SEQ ID NO: 302327 - RNA, 64 nt, Homo Sapiens; identical to SEQ ID NO: 189147

SEQ ID NO: 302328 - RNA, 64 nt, Homo Sapiens; identical to SEQ ID NO: 189148

SEQ ID NO: 302329 - RNA, 64 nt, Homo Sapiens; identical to SEQ ID NO: 189149

SEQ ID NO: 302330 - RNA, 64 nt, Homo Sapiens; identical to SEQ ID NO: 189150

SEQ ID NO: 302331 - RNA, 64 nt, Homo Sapiens; identical to SEQ ID NO: 189151

SEQ ID NO: 302332 - RNA, 64 nt, Homo Sapiens; identical to SEQ ID NO: 189152

SEQ ID NO: 302333 - RNA, 64 nt, Homo Sapiens; identical to SEQ ID NO: 189153

SEQ ID NO: 302334 - RNA, 64 nt, Homo Sapiens; identical to SEQ ID NO: 189154

SEQ ID NO: 302335 - RNA, 64 nt, Homo Sapiens; identical to SEQ ID NO: 189155

SEQ ID NO: 302336 - RNA, 64 nt, Homo Sapiens; identical to SEQ ID NO: 189156

SEQ ID NO: 302337 - RNA, 64 nt, Homo Sapiens; identical to SEQ ID NO: 189157

SEQ ID NO: 302338 - RNA, 64 nt, Homo Sapiens; identical to SEQ ID NO: 189158

SEQ ID NO: 302339 - RNA, 64 nt, Homo Sapiens; identical to SEQ ID NO: 189159

SEQ ID NO: 302340 - RNA, 64 nt, Homo Sapiens; identical to SEQ ID NO: 189160

SEQ ID NO: 302341 - RNA, 64 nt, Homo Sapiens; identical to SEQ ID NO: 189161

SEQ ID NO: 302342 - RNA, 64 nt, Homo Sapiens; identical to SEQ ID NO: 189162

SEQ ID NO: 302343 - RNA, 64 nt, Homo Sapiens; identical to SEQ ID NO: 189163

SEQ ID NO: 302344 - RNA, 64 nt, Homo Sapiens; identical to SEQ ID NO: 189164

SEQ ID NO: 302345 - RNA, 64 nt, Homo Sapiens; identical to SEQ ID NO: 189165

SEQ ID NO: 302346 - RNA, 64 nt, Homo Sapiens; identical to SEQ ID NO: 189166

SEQ ID NO: 302347 - RNA, 64 nt, Homo Sapiens; identical to SEQ ID NO: 189167

SEQ ID NO: 302348 - RNA, 64 nt, Homo Sapiens; identical to SEQ ID NO: 189168

SEQ ID NO: 302349 - RNA, 64 nt, Homo Sapiens; identical to SEQ ID NO: 189169

SEQ ID NO: 302350 - RNA, 64 nt, Homo Sapiens; identical to SEQ ID NO: 189170

SEQ ID NO: 302351 - RNA, 64 nt, Homo Sapiens; identical to SEQ ID NO: 189171

SEQ ID NO: 302352 - RNA, 64 nt, Homo Sapiens; identical to SEQ ID NO: 189172

SEQ ID NO: 302353 - RNA, 64 nt, Homo Sapiens; identical to SEQ ID NO: 189173

SEQ ID NO: 302354 - RNA, 64 nt, Homo Sapiens; identical to SEQ ID NO: 189174

SEQ ID NO: 302355 - RNA, 64 nt, Homo Sapiens; identical to SEQ ID NO: 189175

SEQ ID NO: 302356 - RNA, 64 nt, Homo Sapiens; identical to SEQ ID NO: 189176

SEQ ID NO: 302357 - RNA, 64 nt, Homo Sapiens; identical to SEQ ID NO: 189177

SEQ ID NO: 302358 - RNA, 64 nt, Homo Sapiens; identical to SEQ ID NO: 189178

SEQ ID NO: 302359 - RNA, 64 nt, Homo Sapiens; identical to SEQ ID NO: 189179

SEQ ID NO: 302360 - RNA, 64 nt, Homo Sapiens; identical to SEQ ID NO: 189180

SEQ ID NO: 302361 - RNA, 64 nt, Homo Sapiens; identical to SEQ ID NO: 189181

SEQ ID NO: 302362 - RNA, 64 nt, Homo Sapiens; identical to SEQ ID NO: 189182

SEQ ID NO: 302363 - RNA, 64 nt, Homo Sapiens; identical to SEQ ID NO: 189183

SEQ ID NO: 302364 - RNA, 64 nt, Homo Sapiens; identical to SEQ ID NO: 189184

SEQ ID NO: 302365 - RNA, 64 nt, Homo Sapiens; identical to SEQ ID NO: 296855

SEQ ID NO: 302366 - RNA, 64 nt, Homo Sapiens; identical to SEQ ID NO: 296856

SEQ ID NO: 302367 - RNA, 64 nt, Homo Sapiens; identical to SEQ ID NO: 296857

SEQ ID NO: 302368 - RNA, 64 nt, Homo Sapiens; identical to SEQ ID NO: 296858

SEQ ID NO: 302369 - RNA, 64 nt, Homo Sapiens; identical to SEQ ID NO: 296859

SEQ ID NO: 302370 - RNA, 64 nt, Homo Sapiens; identical to SEQ ID NO: 296860

SEQ ID NO: 302371 - RNA, 64 nt, Homo Sapiens; identical to SEQ ID NO: 296861

SEQ ID NO: 302372 - RNA, 64 nt, Homo Sapiens; identical to SEQ ID NO: 296862

SEQ ID NO: 302373 - RNA, 64 nt, Homo Sapiens; identical to SEQ ID NO: 296863

SEQ ID NO: 302374 - RNA, 64 nt, Homo Sapiens; identical to SEQ ID NO: 296864

SEQ ID NO: 302375 - RNA, 64 nt, Homo Sapiens; identical to SEQ ID NO: 296865

SEQ ID NO: 302376 - RNA, 64 nt, Homo Sapiens; identical to SEQ ID NO: 296866

SEQ ID NO: 302377 - RNA, 64 nt, Homo Sapiens; identical to SEQ ID NO: 296867

SEQ ID NO: 302378 - RNA, 64 nt, Homo Sapiens; identical to SEQ ID NO: 296868

SEQ ID NO: 302379 - RNA, 64 nt, Homo Sapiens; identical to SEQ ID NO: 296869

SEQ ID NO: 302380 - RNA, 64 nt, Homo Sapiens; identical to SEQ ID NO: 296870

SEQ ID NO: 302381 - RNA, 64 nt, Homo Sapiens; identical to SEQ ID NO: 296871

SEQ ID NO: 302382 - RNA, 64 nt, Homo Sapiens; identical to SEQ ID NO: 296872

SEQ ID NO: 302383 - RNA, 64 nt, Homo Sapiens; identical to SEQ ID NO: 296873

SEQ ID NO: 302384 - RNA, 64 nt, Homo Sapiens; identical to SEQ ID NO: 296874

SEQ ID NO: 302385 - RNA, 64 nt, Homo Sapiens; identical to SEQ ID NO: 296875

SEQ ID NO: 302386 - RNA, 64 nt, Homo Sapiens; identical to SEQ ID NO: 296876

SEQ ID NO: 302387 - RNA, 64 nt, Homo Sapiens; identical to SEQ ID NO: 296877

SEQ ID NO: 302388 - RNA, 64 nt, Homo Sapiens; identical to SEQ ID NO: 296878

SEQ ID NO: 302389 - RNA, 64 nt, Homo Sapiens; identical to SEQ ID NO: 296879

SEQ ID NO: 302390 - RNA, 64 nt, Homo Sapiens; identical to SEQ ID NO: 296880

SEQ ID NO: 302391 - RNA, 64 nt, Homo Sapiens; identical to SEQ ID NO: 296881

SEQ ID NO: 302392 - RNA, 64 nt, Homo Sapiens; identical to SEQ ID NO: 296882

SEQ ID NO: 302393 - RNA, 64 nt, Homo Sapiens; identical to SEQ ID NO: 296883

SEQ ID NO: 302394 - RNA, 64 nt, Homo Sapiens; identical to SEQ ID NO: 296884

SEQ ID NO: 302395 - RNA, 64 nt, Homo Sapiens; identical to SEQ ID NO: 296885

SEQ ID NO: 302396 - RNA, 64 nt, Homo Sapiens; identical to SEQ ID NO: 296886

SEQ ID NO: 302397 - RNA, 64 nt, Homo Sapiens; identical to SEQ ID NO: 296887

SEQ ID NO: 302398 - RNA, 64 nt, Homo Sapiens; identical to SEQ ID NO: 296888

SEQ ID NO: 302399 - RNA, 64 nt, Homo Sapiens; identical to SEQ ID NO: 296889

SEQ ID NO: 302400 - RNA, 64 nt, Homo Sapiens; identical to SEQ ID NO: 296890

SEQ ID NO: 302401 - RNA, 64 nt, Homo Sapiens; identical to SEQ ID NO: 296891

SEQ ID NO: 302402 - RNA, 64 nt, Homo Sapiens; identical to SEQ ID NO: 296892

SEQ ID NO: 302403 - RNA, 64 nt, Homo Sapiens; identical to SEQ ID NO: 296893

SEQ ID NO: 302404 - RNA, 64 nt, Homo Sapiens; identical to SEQ ID NO: 296894

SEQ ID NO: 302405 - RNA, 64 nt, Homo Sapiens; identical to SEQ ID NO: 296895

SEQ ID NO: 302406 - RNA, 64 nt, Homo Sapiens; identical to SEQ ID NO: 296896

SEQ ID NO: 302407 - RNA, 64 nt, Homo Sapiens; identical to SEQ ID NO: 296897

SEQ ID NO: 302408 - RNA, 64 nt, Homo Sapiens; identical to SEQ ID NO: 296898

SEQ ID NO: 302409 - RNA, 64 nt, Homo Sapiens; identical to SEQ ID NO: 296899

SEQ ID NO: 302410 - RNA, 64 nt, Homo Sapiens; identical to SEQ ID NO: 296900

SEQ ID NO: 302411 - RNA, 64 nt, Homo Sapiens; identical to SEQ ID NO: 296901

SEQ ID NO: 302412 - RNA, 59 nt, Homo Sapiens; identical to SEQ ID NO: 296902

SEQ ID NO: 302413 - RNA, 64 nt, Homo Sapiens; identical to SEQ ID NO: 296903

SEQ ID NO: 302414 - RNA, 64 nt, Homo Sapiens; identical to SEQ ID NO: 296904

SEQ ID NO: 302415 - RNA, 64 nt, Homo Sapiens; identical to SEQ ID NO: 296905

SEQ ID NO: 302416 - RNA, 64 nt, Homo Sapiens; identical to SEQ ID NO: 296906

SEQ ID NO: 302417 - RNA, 64 nt, Homo Sapiens; identical to SEQ ID NO: 296907

SEQ ID NO: 302418 - RNA, 64 nt, Homo Sapiens; identical to SEQ ID NO: 296908

SEQ ID NO: 302419 - RNA, 64 nt, Homo Sapiens; identical to SEQ ID NO: 296909

SEQ ID NO: 302420 - RNA, 64 nt, Homo Sapiens; identical to SEQ ID NO: 296910

SEQ ID NO: 302421 - RNA, 64 nt, Homo Sapiens; identical to SEQ ID NO: 296911

SEQ ID NO: 302422 - RNA, 64 nt, Homo Sapiens; identical to SEQ ID NO: 296912

SEQ ID NO: 302423 - RNA, 64 nt, Homo Sapiens; identical to SEQ ID NO: 296913

SEQ ID NO: 302424 - RNA, 64 nt, Homo Sapiens; identical to SEQ ID NO: 296914

SEQ ID NO: 302425 - RNA, 64 nt, Homo Sapiens; identical to SEQ ID NO: 296915

SEQ ID NO: 302426 - RNA, 64 nt, Homo Sapiens; identical to SEQ ID NO: 296916

SEQ ID NO: 302427 - RNA, 64 nt, Homo Sapiens; identical to SEQ ID NO: 296917

SEQ ID NO: 302428 - RNA, 64 nt, Homo Sapiens; identical to SEQ ID NO: 296918

SEQ ID NO: 302429 - RNA, 64 nt, Homo Sapiens; identical to SEQ ID NO: 296919

SEQ ID NO: 302430 - RNA, 64 nt, Homo Sapiens; identical to SEQ ID NO: 296920

SEQ ID NO: 302431 - RNA, 64 nt, Homo Sapiens; identical to SEQ ID NO: 296921

SEQ ID NO: 302432 - RNA, 64 nt, Homo Sapiens; identical to SEQ ID NO: 296922

SEQ ID NO: 302433 - RNA, 64 nt, Homo Sapiens; identical to SEQ ID NO: 296923

SEQ ID NO: 302434 - RNA, 64 nt, Homo Sapiens
caucugucaguaaugagaggauuggaagaauaauuuugcauacaaaugaggacuuaauuuguug

SEQ ID NO: 302435 - RNA, 64 nt, Homo Sapiens
cacauguauauagugagaugucuuuauugugugcuuugcauauuuuguaaauauuuugcacguc

SEQ ID NO: 302436 - RNA, 64 nt, Homo Sapiens
aaaugaaucauuucuuauaucuuauucaugaaaguuugcauacagauguuugcauauaugccuu

SEQ ID NO: 302437 - RNA, 64 nt, Homo Sapiens
uuauaucuuauucaugaaaguuugcauacagauguuugcauauaugccuuuuugaauuuuugcu

SEQ ID NO: 302438 - RNA, 64 nt, Homo Sapiens
ucauuuaaaaugcuaaaauagauacaaacucaauuuugcauagaaagguguauuuugaauaguu

SEQ ID NO: 302439 - RNA, 64 nt, Homo Sapiens
uugaacuugagugaaaagguugaaguuacagacuuuugcauagaugguuugucaauuuaaaauu

SEQ ID NO: 302440 - RNA, 64 nt, Homo Sapiens
uguaaaaacuguuaggucuuuaaguaguagauuauuugcauauuaaucaacuuuuuuuuauguc

SEQ ID NO: 302441 - RNA, 64 nt, Homo Sapiens
ugaacuuggcagguaccguuaauuggacaauuccuuugcauaucauuuuauaagggguaguaag

SEQ ID NO: 302442 - RNA, 64 nt, Homo Sapiens
ucuuaaccuguucaggcuuuuaaaaaaaacuguuuuugcauaggguaguacuaagaucuuaaaa

SEQ ID NO: 302443 - RNA, 64 nt, Homo Sapiens
cugugcuuaaaaaagaaauaauugaccaaguaaguuugcauaaaaugugaauacuaaauguguc

SEQ ID NO: 302444 - RNA, 64 nt, Homo Sapiens
aauuaaaggugugcuauuugucucuuggagcuuuuuugcauagcuguugcuaugugcaagaucc

SEQ ID NO: 302445 - RNA, 64 nt, Homo Sapiens
ucagaagcuagguacauaagucuuccugcaguguuuugcauacacuuuucuuucuuucauucuc

SEQ ID NO: 302446 - RNA, 64 nt, Homo Sapiens
acuggccugugauugguccauuccaggaccuucauuugcauaagguaucaaaccacaucagccu

SEQ ID NO: 302447 - RNA, 64 nt, Homo Sapiens
ucuggccaaugauugguucauuccaggacauucauuugcauaaggagucaaaccacaccagucu

SEQ ID NO: 302448 - RNA, 64 nt, Homo Sapiens
cuugugcugcacaugggcuguaauguaaaguaguuuugcauauuccuuugauaaaaagugugua

SEQ ID NO: 302449 - RNA, 64 nt, Homo Sapiens
auaaaugcuucuagaugucaucauauuuaaguuuuuugcauaaacacuuuauguguacacauaa

SEQ ID NO: 302450 - RNA, 64 nt, Homo Sapiens
uauuuuugucauagcagcaaauauguauuuuguauuugcauaugcauauguauuuuguauuugc

SEQ ID NO: 302451 - RNA, 64 nt, Homo Sapiens
uauuuuguauuugcauauguauauguauuuuguauuugcauauguuugucauauguauuuuguc

SEQ ID NO: 302452 - RNA, 64 nt, Homo Sapiens
gucucuuaccucagggaagagaugaacacugacuuuugcauauguuuuaaguaucuucauugga

SEQ ID NO: 302453 - RNA, 64 nt, Homo Sapiens
auaagagcuguagcuaccaauauuguacacuauuuuugcauaaaaggaaauuuuuaaacuuuua

SEQ ID NO: 302454 - RNA, 64 nt, Homo Sapiens
uaaaaauuaaucauuuugcaagaaaauguagcaguuugcauauuugugcaugaauugauuauug

SEQ ID NO: 302455 - RNA, 64 nt, Homo Sapiens
uuuuggcuccauucuuuccauuagagauuuucucuuugcauaaaacaauucuggaugcuaaaac

SEQ ID NO: 302456 - RNA, 64 nt, Homo Sapiens
caaaaacauacugacucagggcucuuuuuuucuuuuugcauaugacaacuguuacuagaaauac

SEQ ID NO: 302457 - RNA, 64 nt, Homo Sapiens
augacaacuguuacuagaaauacaggcuacugguuuugcauagaucauucaucuuaauuuuggu

SEQ ID NO: 302458 - RNA, 64 nt, Homo Sapiens
cauacaacucacguaugcgggcaaacacuuuugauuugcauauccuggguguacugagccacau

SEQ ID NO: 302459 - RNA, 64 nt, Homo Sapiens
auuuucuuuuggguggugacuguuuuuuucugacuuugcauaucccuagacacuagaacuaaag

SEQ ID NO: 302460 - RNA, 64 nt, Homo Sapiens
guucacugaguaacuaaaauuuagcaaaccuguguuugcauauuuuuuuggagugcagaauauu

SEQ ID NO: 302461 - RNA, 64 nt, Homo Sapiens
caguauacucaugauugcuaaguguuuuuuuauuuuugcauauuuauugaacugucuaauugaa

SEQ ID NO: 302462 - RNA, 64 nt, Homo Sapiens
aucauauaucauuuaagcaguuugaaggcauacuuuugcauagaaauaaaaaaaauacugauuu

SEQ ID NO: 302463 - RNA, 64 nt, Homo Sapiens
uuccaaagguuguugcucuacuuuguaggaagucuuugcauauggcccucccaacuuuaaaguc

SEQ ID NO: 302464 - RNA, 64 nt, Homo Sapiens
agagcgagaugaauguggcaauugcucauuuuauuuugcauauauuaaauugaguagguucagc

SEQ ID NO: 302465 - RNA, 64 nt, Homo Sapiens
gcaaacguuuuuccagggaguaaauauuuuacgcuuugcauauauaauuuauggagguguugag

SEQ ID NO: 302466 - RNA, 64 nt, Homo Sapiens
uauucaaaaauaacaucugacuacuauaaaaauauuugcauauauaaguuugacaaagaaaaga

SEQ ID NO: 302467 - RNA, 64 nt, Homo Sapiens
uauaaaauucaguuuuucauuuaacauuugcucuuuugcauaugaagagauauuuguauuuuuc

SEQ ID NO: 302468 - RNA, 64 nt, Homo Sapiens
ugcuucucauucucaucagacucuccuuguuuuguuugcauauuuaauuuuaaauuaaaccaaa

SEQ ID NO: 302469 - RNA, 64 nt, Homo Sapiens
cacccucucagaagaauccacaguguuugaacaauuugcauaaaggucagcuagcauccugcug

SEQ ID NO: 302470 - RNA, 64 nt, Homo Sapiens
uuuuaauaguuuuuguuugcaguccucuguuaguuuugcauaguugcacuacaagaagaaugua

SEQ ID NO: 302471 - RNA, 64 nt, Homo Sapiens
uauguauuuaaugauacacuguuuaauugacaguuuugcauaguuugucuaacuuuagagaauu

SEQ ID NO: 302472 - RNA, 64 nt, Homo Sapiens
uggaauuacaccuuuaaagaccuucucuuuguuuuuugcauauccuuauuacaugcuaaaguua

SEQ ID NO: 302473 - RNA, 64 nt, Homo Sapiens
ugaaaagaagcauugaauaucaaugaaauaacauuuugcauaucaauggauguugacaacaacc

SEQ ID NO: 302474 - RNA, 64 nt, Homo Sapiens
augguuugucuuauuucauucauacugaaaauucuuugcauauuuuuuuucugcuuagacuuac

SEQ ID NO: 302475 - RNA, 64 nt, Homo Sapiens
ucauuggcuuuaaagggauuuuagaauaucuuacuuugcauaguuucaugagcacuggccagga

SEQ ID NO: 302476 - RNA, 64 nt, Homo Sapiens
caccucugauccccuucagugacuuugcauaucauuugcauagacugcugugcuuauuugcaug

SEQ ID NO: 302477 - RNA, 64 nt, Homo Sapiens
auuugcauagacaccucugauuauuugcauggacuuugcauaucccuggcucuaccugcugugc

SEQ ID NO: 302478 - RNA, 64 nt, Homo Sapiens; identical to SEQ ID NO: 84790

SEQ ID NO: 302479 - RNA, 64 nt, Homo Sapiens; identical to SEQ ID NO: 84791

SEQ ID NO: 302480 - RNA, 64 nt, Homo Sapiens; identical to SEQ ID NO: 84792

SEQ ID NO: 302481 - RNA, 64 nt, Homo Sapiens; identical to SEQ ID NO: 84793

SEQ ID NO: 302482 - RNA, 64 nt, Homo Sapiens; identical to SEQ ID NO: 84794

SEQ ID NO: 302483 - RNA, 64 nt, Homo Sapiens; identical to SEQ ID NO: 84795

SEQ ID NO: 302484 - RNA, 64 nt, Homo Sapiens; identical to SEQ ID NO: 84796

SEQ ID NO: 302485 - RNA, 64 nt, Homo Sapiens; identical to SEQ ID NO: 84797

SEQ ID NO: 302486 - RNA, 64 nt, Homo Sapiens; identical to SEQ ID NO: 84798

SEQ ID NO: 302487 - RNA, 64 nt, Homo Sapiens; identical to SEQ ID NO: 84799

SEQ ID NO: 302488 - RNA, 64 nt, Homo Sapiens; identical to SEQ ID NO: 84800

SEQ ID NO: 302489 - RNA, 64 nt, Homo Sapiens; identical to SEQ ID NO: 84801

SEQ ID NO: 302490 - RNA, 64 nt, Homo Sapiens; identical to SEQ ID NO: 84802

SEQ ID NO: 302491 - RNA, 64 nt, Homo Sapiens; identical to SEQ ID NO: 84803

SEQ ID NO: 302492 - RNA, 64 nt, Homo Sapiens; identical to SEQ ID NO: 84804

SEQ ID NO: 302493 - RNA, 64 nt, Homo Sapiens; identical to SEQ ID NO: 158204

SEQ ID NO: 302494 - RNA, 64 nt, Homo Sapiens; identical to SEQ ID NO: 158205

SEQ ID NO: 302495 - RNA, 64 nt, Homo Sapiens; identical to SEQ ID NO: 158206

SEQ ID NO: 302496 - RNA, 64 nt, Homo Sapiens; identical to SEQ ID NO: 158207

SEQ ID NO: 302497 - RNA, 64 nt, Homo Sapiens; identical to SEQ ID NO: 158208

SEQ ID NO: 302498 - RNA, 64 nt, Homo Sapiens; identical to SEQ ID NO: 158209

SEQ ID NO: 302499 - RNA, 64 nt, Homo Sapiens; identical to SEQ ID NO: 158210

SEQ ID NO: 302500 - RNA, 64 nt, Homo Sapiens; identical to SEQ ID NO: 158211

SEQ ID NO: 302501 - RNA, 64 nt, Homo Sapiens; identical to SEQ ID NO: 158212

SEQ ID NO: 302502 - RNA, 64 nt, Homo Sapiens; identical to SEQ ID NO: 158213

SEQ ID NO: 302503 - RNA, 64 nt, Homo Sapiens; identical to SEQ ID NO: 158214

SEQ ID NO: 302504 - RNA, 64 nt, Homo Sapiens; identical to SEQ ID NO: 158215

SEQ ID NO: 302505 - RNA, 64 nt, Homo Sapiens; identical to SEQ ID NO: 158216

SEQ ID NO: 302506 - RNA, 64 nt, Homo Sapiens; identical to SEQ ID NO: 158217

SEQ ID NO: 302507 - RNA, 64 nt, Homo Sapiens; identical to SEQ ID NO: 158218

SEQ ID NO: 302508 - RNA, 64 nt, Homo Sapiens; identical to SEQ ID NO: 158219

SEQ ID NO: 302509 - RNA, 64 nt, Homo Sapiens; identical to SEQ ID NO: 158220

SEQ ID NO: 302510 - RNA, 64 nt, Homo Sapiens; identical to SEQ ID NO: 158221

SEQ ID NO: 302511 - RNA, 64 nt, Homo Sapiens; identical to SEQ ID NO: 158222

SEQ ID NO: 302512 - RNA, 64 nt, Homo Sapiens; identical to SEQ ID NO: 158223

SEQ ID NO: 302513 - RNA, 64 nt, Homo Sapiens; identical to SEQ ID NO: 158224

SEQ ID NO: 302514 - RNA, 64 nt, Homo Sapiens; identical to SEQ ID NO: 158225

SEQ ID NO: 302515 - RNA, 64 nt, Homo Sapiens; identical to SEQ ID NO: 158226

SEQ ID NO: 302516 - RNA, 64 nt, Homo Sapiens; identical to SEQ ID NO: 158227

SEQ ID NO: 302517 - RNA, 64 nt, Homo Sapiens; identical to SEQ ID NO: 158228

SEQ ID NO: 302518 - RNA, 64 nt, Homo Sapiens; identical to SEQ ID NO: 158229

SEQ ID NO: 302519 - RNA, 64 nt, Homo Sapiens; identical to SEQ ID NO: 282714

SEQ ID NO: 302520 - RNA, 64 nt, Homo Sapiens; identical to SEQ ID NO: 282715

SEQ ID NO: 302521 - RNA, 64 nt, Homo Sapiens; identical to SEQ ID NO: 282716

SEQ ID NO: 302522 - RNA, 64 nt, Homo Sapiens; identical to SEQ ID NO: 282717

SEQ ID NO: 302523 - RNA, 64 nt, Homo Sapiens; identical to SEQ ID NO: 282718

SEQ ID NO: 302524 - RNA, 64 nt, Homo Sapiens; identical to SEQ ID NO: 282719

SEQ ID NO: 302525 - RNA, 64 nt, Homo Sapiens; identical to SEQ ID NO: 282720

SEQ ID NO: 302526 - RNA, 64 nt, Homo Sapiens; identical to SEQ ID NO: 282721

SEQ ID NO: 302527 - RNA, 64 nt, Homo Sapiens; identical to SEQ ID NO: 282722

SEQ ID NO: 302528 - RNA, 64 nt, Homo Sapiens; identical to SEQ ID NO: 282723

SEQ ID NO: 302529 - RNA, 64 nt, Homo Sapiens; identical to SEQ ID NO: 282724

SEQ ID NO: 302530 - RNA, 64 nt, Homo Sapiens; identical to SEQ ID NO: 282725

SEQ ID NO: 302531 - RNA, 64 nt, Homo Sapiens; identical to SEQ ID NO: 282726

SEQ ID NO: 302532 - RNA, 64 nt, Homo Sapiens; identical to SEQ ID NO: 282727

SEQ ID NO: 302533 - RNA, 64 nt, Homo Sapiens; identical to SEQ ID NO: 282728

SEQ ID NO: 302534 - RNA, 64 nt, Homo Sapiens; identical to SEQ ID NO: 282729

SEQ ID NO: 302535 - RNA, 64 nt, Homo Sapiens; identical to SEQ ID NO: 282730

SEQ ID NO: 302536 - RNA, 64 nt, Homo Sapiens; identical to SEQ ID NO: 282731

SEQ ID NO: 302537 - RNA, 64 nt, Homo Sapiens; identical to SEQ ID NO: 282732

SEQ ID NO: 302538 - RNA, 64 nt, Homo Sapiens; identical to SEQ ID NO: 282733

SEQ ID NO: 302539 - RNA, 64 nt, Homo Sapiens; identical to SEQ ID NO: 282734

SEQ ID NO: 302540 - RNA, 64 nt, Homo Sapiens; identical to SEQ ID NO: 282735

SEQ ID NO: 302541 - RNA, 64 nt, Homo Sapiens; identical to SEQ ID NO: 282736

SEQ ID NO: 302542 - RNA, 64 nt, Homo Sapiens; identical to SEQ ID NO: 282737

SEQ ID NO: 302543 - RNA, 64 nt, Homo Sapiens; identical to SEQ ID NO: 282738

SEQ ID NO: 302544 - RNA, 64 nt, Homo Sapiens; identical to SEQ ID NO: 282739

SEQ ID NO: 302545 - RNA, 64 nt, Homo Sapiens; identical to SEQ ID NO: 282740

SEQ ID NO: 302546 - RNA, 64 nt, Homo Sapiens; identical to SEQ ID NO: 282741

SEQ ID NO: 302547 - RNA, 64 nt, Homo Sapiens; identical to SEQ ID NO: 282742

SEQ ID NO: 302548 - RNA, 64 nt, Homo Sapiens; identical to SEQ ID NO: 282743

SEQ ID NO: 302549 - RNA, 64 nt, Homo Sapiens; identical to SEQ ID NO: 282744

SEQ ID NO: 302550 - RNA, 64 nt, Homo Sapiens; identical to SEQ ID NO: 282745

SEQ ID NO: 302551 - RNA, 64 nt, Homo Sapiens; identical to SEQ ID NO: 282746

SEQ ID NO: 302552 - RNA, 64 nt, Homo Sapiens; identical to SEQ ID NO: 282747

SEQ ID NO: 302553 - RNA, 64 nt, Homo Sapiens; identical to SEQ ID NO: 282748

SEQ ID NO: 302554 - RNA, 64 nt, Homo Sapiens; identical to SEQ ID NO: 282749

SEQ ID NO: 302555 - RNA, 64 nt, Homo Sapiens; identical to SEQ ID NO: 282750

SEQ ID NO: 302556 - RNA, 64 nt, Homo Sapiens; identical to SEQ ID NO: 282751

SEQ ID NO: 302557 - RNA, 64 nt, Homo Sapiens; identical to SEQ ID NO: 282752

SEQ ID NO: 302558 - RNA, 64 nt, Homo Sapiens; identical to SEQ ID NO: 282753

SEQ ID NO: 302559 - RNA, 64 nt, Homo Sapiens; identical to SEQ ID NO: 282754

SEQ ID NO: 302560 - RNA, 64 nt, Homo Sapiens; identical to SEQ ID NO: 282755

SEQ ID NO: 302561 - RNA, 64 nt, Homo Sapiens; identical to SEQ ID NO: 282754

SEQ ID NO: 302562 - RNA, 64 nt, Homo Sapiens
ucuuauugaaaaguagauuuuuauuuaaaggauucugucacaagaaucauauuuauuuggcuuu

SEQ ID NO: 302563 - RNA, 64 nt, Homo Sapiens
agcaaauauguagucaaggcaagugaucaccgagcugucacaucucagagucuuguucaagaga

SEQ ID NO: 302564 - RNA, 64 nt, Homo Sapiens
ucugguugaauggcuuuucuuagugugguauuugcugucacauaguuuuuccugggugagucug

SEQ ID NO: 302565 - RNA, 64 nt, Homo Sapiens
uuuacaugucaagaggaaaagcuguaagaaaaugcugucacagacccaucccuguggcaucguc

SEQ ID NO: 302566 - RNA, 64 nt, Homo Sapiens
aaggacaugucaaucuuggucacauucuccaccacugucacaggaauggacagaguuaucaagg

SEQ ID NO: 302567 - RNA, 64 nt, Homo Sapiens
aagaaccugccaagcuuggucacauacuucaccacugucacaggaauggacagaguuaucgagg

SEQ ID NO: 302568 - RNA, 64 nt, Homo Sapiens
agugugaggcuccacuucuguugaauaugagcggcugucacacccaugagcaaguuuccuugau

SEQ ID NO: 302569 - RNA, 64 nt, Homo Sapiens
uccaugccccaguucuaagcccuguggccaggugcugucacacagcaaaggggacuuugcaggu

SEQ ID NO: 302570 - RNA, 64 nt, Homo Sapiens
agagcuucuacugaggagggcuguggcagagccacugucacacagaaugccggaggggcgcaga

SEQ ID NO: 302571 - RNA, 64 nt, Homo Sapiens
gcaggggaccagcauacccgggagcugucccugucugucacagcacaguggggccacgaggcug

SEQ ID NO: 302572 - RNA, 64 nt, Homo Sapiens
uauugaaaauggauauagaucagucauuucuuaacugucacauccauuuauaauaauauaauuu

SEQ ID NO: 302573 - RNA, 64 nt, Homo Sapiens
auuuaggaauuaagacaguaaguaauuaaauaugcugucacaacgauguaaacuaauguaccuc

SEQ ID NO: 302574 - RNA, 64 nt, Homo Sapiens
ccauucuugccccucacugguccacugagcuccucugucacaccuugugccaggacugccgugc

SEQ ID NO: 302575 - RNA, 64 nt, Homo Sapiens
guacaucuaucauaaugugcggugugauuuuggucugucacacucuacaccaauaacugcugca

SEQ ID NO: 302576 - RNA, 64 nt, Homo Sapiens
acagugaaugugucuggaccucauguuguugaggcugucacaguccugaguguggacuuggcag

SEQ ID NO: 302577 - RNA, 64 nt, Homo Sapiens
ggugccuguugaaucugagcugcagguuccuuaucugucacaccugugccuccucagaggacag

SEQ ID NO: 302578 - RNA, 64 nt, Homo Sapiens
caggcaugccccuuagaagagaagggcagagacacugucacaaaucacacacacccucaugugu

SEQ ID NO: 302579 - RNA, 64 nt, Homo Sapiens
ccggcaggcacuggugaggaugcagucaaagccacugucacaagacgcuuaagacaccucugca

SEQ ID NO: 302580 - RNA, 64 nt, Homo Sapiens
auuuagagagaaguaaucuuauuuuuguguaugucugucacauuuauguaauaaaaaaaguugg

SEQ ID NO: 302581 - RNA, 64 nt, Homo Sapiens
cugggauggauuuaucacauguucacugcagcuccugucacaagguucauguugguucugaaug

SEQ ID NO: 302582 - RNA, 65 nt, Homo Sapiens
agcugagaggccccugccggugggugauggauaucauccccgaacaggugaagggacaacugacu

SEQ ID NO: 302583 - RNA, 65 nt, Homo Sapiens
ucccucagcuccuccagauggagcaggugcgccggauccccgaggaauacucucuggggcggaug

SEQ ID NO: 302584 - RNA, 65 nt, Homo Sapiens
cugagagaucauucugcacuaaguuucgggaacuuauccccgacagugacugaacucacugacua

SEQ ID NO: 302585 - RNA, 65 nt, Homo Sapiens
cacugagugcugugcuuugucauuaacggggaaacauccccgagcagauuuacaaucuccauuuu

SEQ ID NO: 302586 - RNA, 65 nt, Homo Sapiens
uggcugccccugugugggaggagguugagucacccauccccgagggaggaagccagccgggaaga

SEQ ID NO: 302587 - RNA, 65 nt, Homo Sapiens
ucuagaaccuggacccacccagcgcguccuuucuuauccccgaguggauggauggauggauggau

SEQ ID NO: 302588 - RNA, 65 nt, Homo Sapiens
aggguggacuuagaaagcaggggcuacaagagggaauccccgaaggugcuggaggugggagcagg

SEQ ID NO: 302589 - RNA, 65 nt, Homo Sapiens
ugcugcugcugcuuguguaggucggggagccagagauccccgaggacgcgcgccggacagucggc

SEQ ID NO: 302590 - RNA, 65 nt, Homo Sapiens
acuggcauucacccccugcacugccucgacgggagauccccgauccggucuuggaggccuggucu

SEQ ID NO: 302591 - RNA, 65 nt, Homo Sapiens
uaccuuuucuaugccaaaacaaucuguuauuuccuauccccgaauuagaauuaaaucaguaaagc

SEQ ID NO: 302592 - RNA, 65 nt, Homo Sapiens
ugaccuucacgaccgcaaugagccucaugcaagucauccccgacaguucccggccccugccaccc

SEQ ID NO: 302593 - RNA, 65 nt, Homo Sapiens
guggcucuccaagcggccccgacggcuccuccccgauccccgacauuuuaaacgaagauccgagc

SEQ ID NO: 302594 - RNA, 65 nt, Homo Sapiens
cuagugacaucugaugcuugcugugaacuuuuaagauccccgaauccugagcaccucaaucuuua

SEQ ID NO: 302595 - RNA, 65 nt, Homo Sapiens
gaagcgaggaugcgugccugccacuaggcaucugcauccccgagcccaagccaggagggauuucc

SEQ ID NO: 302596 - RNA, 65 nt, Homo Sapiens
ucuuucagguacuggagugcagauguugacuucucauccccgaguucccccgcacaggacucaac

SEQ ID NO: 302597 - RNA, 65 nt, Homo Sapiens
uuccucgugccguccuccccccgcccaaauguccgauccccgaccacucauacccccccuucaac

SEQ ID NO: 302598 - RNA, 65 nt, Homo Sapiens
caaggacugggcugggguggcgggaggggagccagauccccgagggaggacccugagggccgcga

SEQ ID NO: 302599 - RNA, 65 nt, Homo Sapiens
uuuaaaauuuuaaagcauuauggauguaaacuuuuauccccgacucaauuuuccauucaucuuuu

SEQ ID NO: 302600 - RNA, 65 nt, Homo Sapiens
gaaagaaccagagaggcucugaaggucccucagacauccccgauuaugcccgcauagaugccgcg

SEQ ID NO: 302601 - RNA, 65 nt, Homo Sapiens
accccacccuccaggcuccaccugccccugccugcauccccgagcugaccuguggcucuggagcc

SEQ ID NO: 302602 - RNA, 65 nt, Homo Sapiens
ccuccuauaaagcuuagcuguuacguucaaucagaauccccgaaacucauuuauacuauuauuug

SEQ ID NO: 302603 - RNA, 65 nt, Homo Sapiens
ccaccucacucuuucgugaaggucccugucgccccauccccgaccaccuuguccuuggcccugcu

SEQ ID NO: 302604 - RNA, 65 nt, Homo Sapiens
gcgggggcaacgauucacagccccgcccguagaucauccccgaggggaaaggcccguaugagcgg

SEQ ID NO: 302605 - RNA, 65 nt, Homo Sapiens
cgcaacugcaggcugaggacgugaacuccaccgucauccccgagaucccuccccaggacacgaaa

SEQ ID NO: 302606 - RNA, 65 nt, Homo Sapiens
gcugcugcuuugcgucugugggcuggggaagaacaauccccgaggcagccacacucugggccggu

SEQ ID NO: 302607 - RNA, 65 nt, Homo Sapiens
cagcccagucccuagugcccugcugucacucccccauccccgaggauaacuggaccagggggagc

SEQ ID NO: 302608 - RNA, 65 nt, Homo Sapiens
uugccugggguucuguauuucuucucugcccuccaauccccgacugcuaugauguuuacuacagu

SEQ ID NO: 302609 - RNA, 65 nt, Homo Sapiens
gaaacgcagcagaugcagacgacagucagcagcugauccccgacacugccgucaugagcuaugcc

SEQ ID NO: 302610 - RNA, 65 nt, Homo Sapiens
ggaggaggggcagccacgggcagagcaccaugcccauccccgagucucuggugugucugcccccu

SEQ ID NO: 302611 - RNA, 65 nt, Homo Sapiens
aggccuuacagaccacacugcaccccuuuuaucccauccccgagcccauccaggcugaugccaag

SEQ ID NO: 302612 - RNA, 65 nt, Homo Sapiens
acccuagggaaacuucgugcgaguggcaggagaggauccccgacccgacaagagaggggccccag

SEQ ID NO: 302613 - RNA, 65 nt, Homo Sapiens
gcccccaggcugcuggacacgucggacagcgaaguauccccgacaggacgggcuugggcuuccau

SEQ ID NO: 302614 - RNA, 65 nt, Homo Sapiens
guagaccugggcuaugcucaguuagggguugcgggauccccgagugugggcgggacugggacacc

SEQ ID NO: 302615 - RNA, 65 nt, Homo Sapiens
cuuggagcugugaguucucccuguacaguguuaccauccccgaccaucugauuaaaaugcuuccu

SEQ ID NO: 302616 - RNA, 50 nt, Homo Sapiens
agucugcccugccuagagaaauccccgaggcaguuuacuucagcacuuaa

SEQ ID NO: 302617 - RNA, 65 nt, Homo Sapiens
cuaaauuaaaaacagaaaacuucauuacucaucacauccccgaugacccagaacaaauaacaucc

SEQ ID NO: 302618 - RNA, 65 nt, Homo Sapiens
cggacaauaaacugggcgaccucaauggugcgugcauccccgagcacccuggcgaccucgugcag

SEQ ID NO: 302619 - RNA, 65 nt, Homo Sapiens
uuuuuaucuugaccauaauuugucauucuuuuauaauccccgaaguuaaaucuugcuguuauggu

SEQ ID NO: 302620 - RNA, 65 nt, Homo Sapiens
cgccccucccgcccccauucaacaucucucauccuauccccgacccccuccggggaacaccggga

SEQ ID NO: 302621 - RNA, 65 nt, Homo Sapiens
uccccguguauggccccccugcaccuccuugucucauccccgaagauccgucccccuggccccuc

SEQ ID NO: 302622 - RNA, 65 nt, Homo Sapiens
uggucguggaagaaggcaggauggaacucggccucauccccgaggccccaguuccuauaucgggc

SEQ ID NO: 302623 - RNA, 65 nt, Homo Sapiens
agcagggcuugcuccugccaaccacaauucaaugaauccccgaccccccuaccccaugcuguacu

SEQ ID NO: 302624 - RNA, 65 nt, Homo Sapiens
cugggaggcgucuccaaggaggugacacuuaagccauccccgaaagaggugaaagagaucacuuu

SEQ ID NO: 302625 - RNA, 65 nt, Homo Sapiens
ccccgcugccagggcagagguuaaaagaggccuuaauccccgagcacaccccaccccguuuuucc

SEQ ID NO: 302626 - RNA, 65 nt, Homo Sapiens
uccccagcgaggacacacacggagaagccggacccauccccgagggcccggaaggccccugcugu

SEQ ID NO: 302627 - RNA, 65 nt, Homo Sapiens
uggagcuggucacgcugggcgcugugcagcuuaagauccccgagggggaaaaggcugaguccacc

SEQ ID NO: 302628 - RNA, 65 nt, Homo Sapiens
gguugaacauuccagccucugucuccugcucuaggauccccgacucauuaaagcaaagaggcuua

SEQ ID NO: 302629 - RNA, 65 nt, Homo Sapiens
ugguuuucauugagcauuucucuauuuuuccaguuauccccgaaauuucuauguauuauauuuuu

SEQ ID NO: 302630 - RNA, 65 nt, Homo Sapiens
gccacaccagcucuggacaugccuguuaccagaggauccccgagaagagacggggccuccaucac

SEQ ID NO: 302631 - RNA, 65 nt, Homo Sapiens
uuggugggcuugaccuccugcggugugcacagcagauccccgaaagcagggauuaagaaggaacc

SEQ ID NO: 302632 - RNA, 65 nt, Homo Sapiens
ccgugguuggcgcgccccgggugcagcgagaggccauccccgagcgcuaccuccccggagcggag

SEQ ID NO: 302633 - RNA, 59 nt, Homo Sapiens
uguagcaucuucucucccuuuuggcugaaauccccgaggcgccauuugcucucuacuga

SEQ ID NO: 302634 - RNA, 65 nt, Homo Sapiens
auuugcuaaaauaacauuguucuguucaguuuccaauccccgauacacaccagagacaguucuuc

SEQ ID NO: 302635 - RNA, 65 nt, Homo Sapiens
cccuggcaaccacuaaucuacccagugcccaccccauccccgagcgcagucaccucucauuuucu

SEQ ID NO: 302636 - RNA, 64 nt, Homo Sapiens
ucuguguuugucauuucugacuggaaaacuucuuacuccauaccuuguucgauauggaggacaa

SEQ ID NO: 302637 - RNA, 64 nt, Homo Sapiens
agguuaauuucuaucucugaucccuccccaacccacuccauauuugggucauggacaguaaagg

SEQ ID NO: 302638 - RNA, 64 nt, Homo Sapiens
aagcaauguguuuuuucggacaugcuuuucugccacuccauauuaaaacauaugaccauugagu

SEQ ID NO: 302639 - RNA, 64 nt, Homo Sapiens
aagguaauggcccaucgaugagcauuuuuaacauacuccauagucuuuuccugugguguuaggu

SEQ ID NO: 302640 - RNA, 64 nt, Homo Sapiens
guaauucuguugucuaccauuaaugcuacuaccuacuccauaauugccuauuuagcuccucuuu

SEQ ID NO: 302641 - RNA, 64 nt, Homo Sapiens
ugggacuagggugcuccuguuggauggugaggucacuccauaugccaauacaaacaacaaugcg

SEQ ID NO: 302642 - RNA, 64 nt, Homo Sapiens
gggaggagaaggaucccugugccuugaccacaucacuccauauggagguggagagacccauaaa

SEQ ID NO: 302643 - RNA, 64 nt, Homo Sapiens
agaagcaaaucugagaguaagcuuguacgauaucacuccauaagaggcugagagaauccaauua

SEQ ID NO: 302644 - RNA, 64 nt, Homo Sapiens
guucauuguaaaacuaaaagcugccagcagaaaaacuccauacuuucugauucugaagucuuaa

SEQ ID NO: 302645 - RNA, 64 nt, Homo Sapiens
uaaauaaacugggugaagcccucccuacacuuccacuccauaggauuauaagcagaccuuauuu

SEQ ID NO: 302646 - RNA, 64 nt, Homo Sapiens
agugucauuccacuggguuuaggaagaaaaguaaacuccauagacgugggauagggaagauagc

SEQ ID NO: 302647 - RNA, 64 nt, Homo Sapiens
agaagaaauaacuuuauaacuuagaugcuuugaaacuccauaucgagauucugaagcgguuaug

SEQ ID NO: 302648 - RNA, 64 nt, Homo Sapiens
uuagggcagacagaagccugucauuuacauuuugacuccauagccaugaacucaguuagcugaa

SEQ ID NO: 302649 - RNA, 64 nt, Homo Sapiens
gagugauuguuucaguccagcaauaaguaaaguaacuccauauguuauguaaacagaaggucuu

SEQ ID NO: 302650 - RNA, 64 nt, Homo Sapiens
auguguguguuauucagagguuuucagucuggacacuccauaggugagugucgugucuucguga

SEQ ID NO: 302651 - RNA, 64 nt, Homo Sapiens
aaacucuaucugaaaucccaacaaaaaaaauuuaacuccauauguguuccucuuguucuaaucu

SEQ ID NO: 302652 - RNA, 64 nt, Homo Sapiens
auuugcuucagcuuacuaagaagcuucaaaucuaacuccauacugaacaaggggcuuuaugucc

SEQ ID NO: 302653 - RNA, 64 nt, Homo Sapiens
gagcuucccaggaucccucccagauccucugcugacuccauauggaggccucacacccagaggg

SEQ ID NO: 302654 - RNA, 64 nt, Homo Sapiens
cuccaucuucucccacacuguuucuacccaccgcacuccauaacugccugagaagacagucccu

SEQ ID NO: 302655 - RNA, 64 nt, Homo Sapiens
uaucuguugaaccuucaugaaccacauacuaggcacuccauaaauugauaauagucuuauuccc

SEQ ID NO: 302656 - RNA, 64 nt, Homo Sapiens
uuugucuuucuucaagaaauacuuccuguaaaccacuccauagaguugggccaucucauucuuc

SEQ ID NO: 302657 - RNA, 64 nt, Homo Sapiens
ccgggagcaguugaccuuuggccuuguguaugugacuccauaucuggccucagcagaaggccuu

SEQ ID NO: 302658 - RNA, 64 nt, Homo Sapiens
uuaaugauuagaugguuauaauaguggucuuaaaacuccauaugagagcaaauuagcagauuaa

SEQ ID NO: 302659 - RNA, 64 nt, Homo Sapiens
gucauauauaggcauauaaauauuuaucuacaggacuccauauagaaaaaaaaaagugggcucg

SEQ ID NO: 302660 - RNA, 64 nt, Homo Sapiens
uuucaaaccuuuuuuauuuucagcugcugaguuuacuccauagcguagauugaacggaauauca

SEQ ID NO: 302661 - RNA, 64 nt, Homo Sapiens
caggcaacagacucauugaaucaggaacagauucacuccauaaaauacagagagugcugcaaug

SEQ ID NO: 302662 - RNA, 64 nt, Homo Sapiens
ugaacuuucugagccucuuguuuuuccucagcugacuccauauuuuccuacuuguggcagcgac

SEQ ID NO: 302663 - RNA, 64 nt, Homo Sapiens
uucucaaaaucaguguuauugcuuuagaguauaaacuccauauaaauugauggcaauuggaaau

SEQ ID NO: 302664 - RNA, 64 nt, Homo Sapiens
uugagaugaggucugugccugauguacaacggauacuccauaaauguuugacaaaccaacgaag

SEQ ID NO: 302665 - RNA, 64 nt, Homo Sapiens
gcaaaauugcuugcaaaaguggcacagaguuagcacuccauaccccuucaaacauguugcuuug

SEQ ID NO: 302666 - RNA, 64 nt, Homo Sapiens
agugggaauuucaaaagaacuguccccuuaucuaacuccauaaaagugaugaaucaucaccggu

SEQ ID NO: 302667 - RNA, 64 nt, Homo Sapiens
uauggggguaaaugaagucaucuuagaacucaagacuccauaacaucaauagggaugaaaauuu

SEQ ID NO: 302668 - RNA, 64 nt, Homo Sapiens
uauuacacagcaaggacugcugugaacaaaugugacuccauauuucauccauugcugcccugug

SEQ ID NO: 302669 - RNA, 64 nt, Homo Sapiens
uauauaugugugugugugugaucgacaaauuguuacuccauauagucaaaggcaguugacuaga

SEQ ID NO: 302670 - RNA, 64 nt, Homo Sapiens
auuuccauucaacucaaucuacacacacacacacacuccauaccacacacacacacacacacac

SEQ ID NO: 302671 - RNA, 64 nt, Homo Sapiens
agagguaugccaucauggaauggugaggaacgagacuccauagcuuagggaaagaagguugcug

SEQ ID NO: 302672 - RNA, 64 nt, Homo Sapiens
cucaaacugucccccuuaugucuauucauggagcacuccauagucacgugcuuugaacugcuuu

SEQ ID NO: 302673 - RNA, 64 nt, Homo Sapiens
uauuaaauuaaacuguauugaaaaauaaaucagaacuccauaaagcacacuuaaaagcaaagga

SEQ ID NO: 302674 - RNA, 64 nt, Homo Sapiens
cccuggcugaugaccacuaguggggagccguggcacuccauacccucgaagauguuguacucca

SEQ ID NO: 302675 - RNA, 64 nt, Homo Sapiens
uugaacuuuccccgucucccgucuucugccucccacuccauaccccgccaaggaaaggcaugua

SEQ ID NO: 302676 - RNA, 64 nt, Homo Sapiens
ucugugaggucacugaggccuguaguagagguuaacuccauauucagugcaguguaaauaguuc

SEQ ID NO: 302677 - RNA, 64 nt, Homo Sapiens
cuugcaaaaugcaacuugugggaaaaaaaauacaacuccauagcuaacaagaaaugguauaaau

SEQ ID NO: 302678 - RNA, 64 nt, Homo Sapiens
acugcuuuguaauuauuuucuuuauuguugguaaacuccauauuuuaaaaauuuaccuguauac

SEQ ID NO: 302679 - RNA, 64 nt, Homo Sapiens
cugaacauuucaugguguucaucaacagugagagacuccauaguuugggcuuguaccacuuuug

SEQ ID NO: 302680 - RNA, 64 nt, Homo Sapiens
gacucaaggaagaauaauuuuaacagacauguauacuccauagaaacuaaacuaaaauaguuua

SEQ ID NO: 302681 - RNA, 64 nt, Homo Sapiens
auuuagaggauguggcuguaaccugcuggaugggacuccauagcuccuucccaggaccccucag

SEQ ID NO: 302682 - RNA, 64 nt, Homo Sapiens
augaugcuuuuuaagauguacuugcacacucuugacuccauaaugcacuugcacugaguugacu

SEQ ID NO: 302683 - RNA, 64 nt, Homo Sapiens
aaugcaggagccagguugguuugcuguucuccccacuccauauuuguacauacagugaauuguu

SEQ ID NO: 302684 - RNA, 64 nt, Homo Sapiens
ccuuuccuuuuccuccuauuaagauguacauaguacuccauacucuacguauuaggcuuuaugu

SEQ ID NO: 302685 - RNA, 64 nt, Homo Sapiens
cauguggauuuuuauccaaauuccaacaaaacccacuccauagcaguuagaggacggucacuuu

SEQ ID NO: 302686 - RNA, 64 nt, Homo Sapiens
ggggcagaguuucuguguauaaauuaguauguaaacuccauauuuauuguauucauauuagucu

SEQ ID NO: 302687 - RNA, 64 nt, Homo Sapiens
ccucucuuucuuucccuacgucugccuggggucuacuccauaaggguuuacaaauggcccacaa

SEQ ID NO: 302688 - RNA, 64 nt, Homo Sapiens
ucccucggguuuggggcucuucucagagagcagcacuccauaucccuuacugucaccuucacuc

SEQ ID NO: 302689 - RNA, 64 nt, Homo Sapiens
auugacaaaauguuauuucccuacauuaaacaugacuccauagaccuuuucauuuguggguuuu

SEQ ID NO: 302690 - RNA, 64 nt, Homo Sapiens
ggguucgagcaucacaagcuuuugagcgcauggaacuccauaaacuaacaaauuacauaaacua

SEQ ID NO: 302691 - RNA, 64 nt, Homo Sapiens
ugacauuguuuuaaagucacugguacuauggacaacuccauagugaauggagauacuugcagag

SEQ ID NO: 302692 - RNA, 64 nt, Homo Sapiens
cucacuuguaagugggagcuacagaaaaccaaacacuccauauucuucauaaacuauugcagga

SEQ ID NO: 302693 - RNA, 64 nt, Homo Sapiens
caaccccaaaucuacuacuuggucugcaaaaguuacuccauauaaugaucaaaguucagaaaau

SEQ ID NO: 302694 - RNA, 64 nt, Homo Sapiens
gcuucucguacacugacaucccuggccacccaaaacuccauaugaaccugccugacuuccugcu

SEQ ID NO: 302695 - RNA, 64 nt, Homo Sapiens
ucugucugugguuguaugaagaauuaucccaaguacuccauauauguaacaaggauuuauuagu

SEQ ID NO: 302696 - RNA, 64 nt, Homo Sapiens
uuacauucuuuuacuaauaagcccagguccccugacuccauaucuguagcaaguaaacagugga

SEQ ID NO: 302697 - RNA, 64 nt, Homo Sapiens
agaguaaacuauauauuacuucugguauaaguuuacuccauaccuagggagaaauguuuaaauc

SEQ ID NO: 302698 - RNA, 64 nt, Homo Sapiens
agccuguggguuucgaugguucacagaucagaucacuccauagauucuguucucuuuacucuuc

SEQ ID NO: 302699 - RNA, 64 nt, Homo Sapiens
auuaaaaaaaaaaaaagauuguagugguagucuaacuccauaacgcugaggaaauacaucauuu

SEQ ID NO: 302700 - RNA, 64 nt, Homo Sapiens
guauauguauauauauauaguaacuacuuuuuauacuccauacauaacuugauauagaaagcug

SEQ ID NO: 302701 - RNA, 64 nt, Homo Sapiens
cuuauuucuuuaguucugcacuuuuccacauuauacuccauaugaguauuaauccuauggauac

SEQ ID NO: 302702 - RNA, 64 nt, Homo Sapiens
uuauaagcucacucuuuauuugcauaaaauuuuaacuccauaacggaagauuuucccuugcuuc

SEQ ID NO: 302703 - RNA, 64 nt, Homo Sapiens
uuaacuggggaaggcaucuaacuaguagccugcuacuccauaguauggcucaauagaugacaca

SEQ ID NO: 302704 - RNA, 64 nt, Homo Sapiens
gcccgcacaccgguacacucguggacaccuacacacuccauaggagauccuggcuuuccagggu

SEQ ID NO: 302705 - RNA, 64 nt, Homo Sapiens
guaucuauuguggaagcagcggguuggcugugccacuccauaaacgcagggcaggucacagaua

SEQ ID NO: 302706 - RNA, 64 nt, Homo Sapiens
caauauccagcaaaaugucuccugagcacccagaacuccauaccaucggccgggugugguggcu

SEQ ID NO: 302707 - RNA, 64 nt, Homo Sapiens
agcguggcccuggccccacacucccaaaucugccacuccauagacccacuugccucaaggcuuu

SEQ ID NO: 302708 - RNA, 64 nt, Homo Sapiens
accccaccccuaggaaccccgaggcugaucuuguacuccauauggacugucacucuggcacuag

SEQ ID NO: 302709 - RNA, 64 nt, Homo Sapiens
cucuuaaagagaagucauuuuaacuguuuuugcuacuccauauauugucauucaaaauauauuu

SEQ ID NO: 302710 - RNA, 64 nt, Homo Sapiens
auuaugguaaauauaaaacuccagagguuguucuacuccauacaguucacacugauugugacac

SEQ ID NO: 302711 - RNA, 64 nt, Homo Sapiens
ugguugcagcuggagggggcggaaaaaggccaaaacuccauauauguuagucuuccuuuaucuu

SEQ ID NO: 302712 - RNA, 64 nt, Homo Sapiens
ucccuaacacagccacccucccuucauuacccccacuccauacccuucucccaacuuuuugaug

SEQ ID NO: 302713 - RNA, 64 nt, Homo Sapiens
agcucauacccagcccuaccaaucaugaacuggaacuccauaaggaggggccaaauugggaggc

SEQ ID NO: 302714 - RNA, 64 nt, Homo Sapiens
gaaaacggugccaucccugaccucgugcuugugaacuccauacauuuuccgguguuguacuaaa

SEQ ID NO: 302715 - RNA, 64 nt, Homo Sapiens
acagguuucauuuaagaagacacuuuuagauccuacuccauacccacugcggccagcacauuuc

SEQ ID NO: 302716 - RNA, 64 nt, Homo Sapiens
aucugggccugguggagucucacccccaccuuccacuccauacagcacucugcugcuccucccc

SEQ ID NO: 302717 - RNA, 64 nt, Homo Sapiens
cugcuucccauuccgcagcccagagccccacuuaacuccauaaaguccuucuugggggaaauag

SEQ ID NO: 302718 - RNA, 64 nt, Homo Sapiens
agugcgcgggccuguccucccaggggccugggcgacuccauaugcaaucaguagcgagcagccg

SEQ ID NO: 302719 - RNA, 64 nt, Homo Sapiens
guauuaggugaggauggaugcuccuuagcccgucacuccauacacugcaggaacuggccuuguu

SEQ ID NO: 302720 - RNA, 64 nt, Homo Sapiens
uagaagaauuuagcucacaaaacauuuggguuucacuccauaucucauaaagggcacuaaaagu

SEQ ID NO: 302721 - RNA, 64 nt, Homo Sapiens
uaagaaauuucuaguucacaguuuccugagcauaacuccauaagaguuuaagauuuuaaguauu

SEQ ID NO: 302722 - RNA, 64 nt, Homo Sapiens
uaauuacaugauuaugauacgcuuaagugaaguaacuccauauggaacuguagcagugcaggug

SEQ ID NO: 302723 - RNA, 64 nt, Homo Sapiens
uuuugcaaagaguaaauucugguaaauaacaaggacuccauacguggucuguaacaugauauuu

SEQ ID NO: 302724 - RNA, 64 nt, Homo Sapiens
auuauaucuccucucugggacucuucaaccugguacuccauaccucuugugcccucucacuuua

SEQ ID NO: 302725 - RNA, 64 nt, Homo Sapiens
uucuauguuaucugaagagucaaaugguuuugugacuccauaguuuuuaaaguaauaaggguca

SEQ ID NO: 302726 - RNA, 64 nt, Homo Sapiens
gaacaccuuucccaauaggaucaccgccuuccucacuccauauagaggcccaagucaugggguu

SEQ ID NO: 302727 - RNA, 64 nt, Homo Sapiens
uucuauuaccuaaauauugccuaguauuuucagcacuccauaaacuagaaauuaccuuuauauu

SEQ ID NO: 302728 - RNA, 64 nt, Homo Sapiens
acacaaccaugugcuauuuaagguaguacaagauacuccauacaaaauguacauacacucagga

SEQ ID NO: 302729 - RNA, 64 nt, Homo Sapiens
cugggacuuuuuaaaaauaauguggguuaccugaacuccauaauuuaguuacugguguauggcc

SEQ ID NO: 302730 - RNA, 64 nt, Homo Sapiens
uggguccugaagaauuaagauacaaauuaauuuuacuccauaaacagacuguuaauuauaggag

SEQ ID NO: 302731 - RNA, 64 nt, Homo Sapiens
agcaguuuauggaugucugguuuaugaauuucuuacuccauacaagaaaacaaaucuuucuuca

SEQ ID NO: 302732 - RNA, 64 nt, Homo Sapiens
acuaauuuuguuucuuuauaaaaauuaaaaaaaaacuccauaguuagaguucagaugaauucuu

SEQ ID NO: 302733 - RNA, 64 nt, Homo Sapiens
uggaagagcauuggcaggaauucauguaacaguaacuccauagacggugagaauuccaacacug

SEQ ID NO: 302734 - RNA, 64 nt, Homo Sapiens
guauuugccaaauaauuuacuguauagccuaaaaacuccauauauauugagaaaagcauauguu

SEQ ID NO: 302735 - RNA, 64 nt, Homo Sapiens
cuacaguugcugucacugauguuugucauuucauacuccauacauaacaguguauuuguguaaa

SEQ ID NO: 302736 - RNA, 64 nt, Homo Sapiens
uuuacaggaaguagggauaugacuggcaagccuaacuccauaggugggacgguauuuauuauca

SEQ ID NO: 302737 - RNA, 64 nt, Homo Sapiens
auuguaaauaaaggaugauggccacaacaugaaaacuccauauuuauuuagaugcuauuauuac

SEQ ID NO: 302738 - RNA, 64 nt, Homo Sapiens
ccuccuaagaaagucaugugccucuguccuaugaacuccauauaaggcuggguccuccuuuggc

SEQ ID NO: 302739 - RNA, 64 nt, Homo Sapiens
ucuuucauuagcuaggaucuacuagaugcauuauacuccauaccugcuuuucccauggccgccc

SEQ ID NO: 302740 - RNA, 64 nt, Homo Sapiens
cacaaugcaggauccucuuugcugacucaggaauacuccauauuuuagacuacugccucuacca

SEQ ID NO: 302741 - RNA, 64 nt, Homo Sapiens
gccagagagagguguugacucugagagaccuugcacuccauacugaaaggagguggggucacag

SEQ ID NO: 302742 - RNA, 64 nt, Homo Sapiens
ugugccuaggagucuaggaaggcacugugcaaagacuccauagcuuauuaauuuuuaggguaug

SEQ ID NO: 302743 - RNA, 64 nt, Homo Sapiens
ugauccuaaaagguagccucggacagggaguaucacuccauaagcacugaaaaggcuggguugg

SEQ ID NO: 302744 - RNA, 64 nt, Homo Sapiens
cuuccccgaaucacacagacaaugcuacuaagauacuccauauuuuaggggcaaguaauaaugg

SEQ ID NO: 302745 - RNA, 64 nt, Homo Sapiens
aacauuucagauuuuaauccccagccuguuggcaacuccauaaauaaacuguaucagguacauu

SEQ ID NO: 302746 - RNA, 61 nt, Homo Sapiens
gugaaaccggccuaauuuuuccagaaaggacacuccauauuuccugaagcaauacuguuga

SEQ ID NO: 302747 - RNA, 64 nt, Homo Sapiens
caugcccucucucgggagcccuagcccugcuccaacuccauacuccacuccaagugccccacca

SEQ ID NO: 302748 - RNA, 64 nt, Homo Sapiens
ccaagccugccauggguccucucuugcuagacacacuccauagauccccccacugagcugugga

SEQ ID NO: 302749 - RNA, 64 nt, Homo Sapiens
uggugggcaagucugguuggaauggcuaucuaacacuccauaugcuucgcaaaggucacuuuuu

SEQ ID NO: 302750 - RNA, 64 nt, Homo Sapiens
uccccuuaccaugagguggauuucagauucuuacacuccauagccuggugaugggagucagcag

SEQ ID NO: 302751 - RNA, 64 nt, Homo Sapiens
auuugugggcagggguggaggaugcauguaugauacuccauaaauucaacauucuuuacuauag

SEQ ID NO: 302752 - RNA, 64 nt, Homo Sapiens
ggauggagaagggaaucuacgccaggagggaagaacuccauauggggcuagaccagauuugggg

SEQ ID NO: 302753 - RNA, 56 nt, Homo Sapiens
acagcccuuggcccagccauguauccacuccauaccuugccaaccaugccuacuga

SEQ ID NO: 302754 - RNA, 64 nt, Homo Sapiens
uucccacagcacuacgaugugccugcugguucccacuccauacuaaacaaggacuagagcucag

SEQ ID NO: 302755 - RNA, 64 nt, Homo Sapiens
uaccaaguuaaccugcucuacuccaucuggucauacuccauagcgccggccacaagacccaugu

SEQ ID NO: 302756 - RNA, 64 nt, Homo Sapiens
cuuccucccucugucccucuaggcccccuuguccacuccauaccuucuggccagggaggggauc

SEQ ID NO: 302757 - RNA, 64 nt, Homo Sapiens
cuucagacugugauauuguguuuaaauuuaguuaacuccauacuugaugucauagacaggauug

SEQ ID NO: 302758 - RNA, 64 nt, Homo Sapiens
ggggugggcuggaggaggcccuucccucccuaucacuccauacuguaggugggcuccccuugcc

SEQ ID NO: 302759 - RNA, 64 nt, Homo Sapiens
aauacauuugaugguuuuuuggaaaaccuuuuucacuccauacucagauaugcuucauugucaa

SEQ ID NO: 302760 - RNA, 64 nt, Homo Sapiens
ucuuuuuuuuggaaaugaaaucuuaguguuugacacuccauauuuuuaauaauuaaauaccuau

SEQ ID NO: 302761 - RNA, 64 nt, Homo Sapiens
cuuuuuuuuuuuuuuuaagaaaguuguuuguuggacuccauaagugaauuucaagcagugagga

SEQ ID NO: 302762 - RNA, 64 nt, Homo Sapiens
auguuaacuacuaauaaaugguuuauucuuucuaacuccauauaagcuuuuccagcaaagauug

SEQ ID NO: 302763 - RNA, 64 nt, Homo Sapiens
uagacgccccucccaagcguuccuggccuucugaacuccauacagccucuacagccgucccgcg

SEQ ID NO: 302764 - RNA, 64 nt, Homo Sapiens
caucuuaccaucuggucauucauacugaagagaaacuccauaaguaucaucucugugggaaaac

SEQ ID NO: 302765 - RNA, 64 nt, Homo Sapiens
gcuaaacucggauugugauguuuaaaaaauuguuacuccauacguuuuuggaaauaucucuuua

SEQ ID NO: 302766 - RNA, 64 nt, Homo Sapiens
uguaagcccuaaguccuagucuggaugaugccccacuccauauuugcaauuuaaaugguauggu

SEQ ID NO: 302767 - RNA, 64 nt, Homo Sapiens
gaaaaucauauccauggaucaacuagaauauucaacuccauaugaagugaagagaaaauauuaa

SEQ ID NO: 302768 - RNA, 64 nt, Homo Sapiens
acaauagcaguacaccacuaugucucaguaggauacuccauaaccugccaacauaguuuuaucc

SEQ ID NO: 302769 - RNA, 64 nt, Homo Sapiens
ggccagaggccuugcuggguggagccucugugugacuccauacuccucccaccacaacacucau

SEQ ID NO: 302770 - RNA, 64 nt, Homo Sapiens
auucugcccuucccugaccccauuguaauaaccaacuccauauccaaagggagguggugcucuc

SEQ ID NO: 302771 - RNA, 64 nt, Homo Sapiens
augacuggguugcaccucaggauacuguaauuugacuccauaauugcuuuugcuccugaaaccu

SEQ ID NO: 302772 - RNA, 64 nt, Homo Sapiens
gccccccccuugaaucugcagggagcaacucuccacuccauauuuauuuaaacaauuuuuuccc

SEQ ID NO: 302773 - RNA, 64 nt, Homo Sapiens
cgcuucagugggguuauccugcuuacaucacuuuacuccauaagcaguggacugcuugcugguc

SEQ ID NO: 302774 - RNA, 64 nt, Homo Sapiens
gacacaugaaugaauuauauucaucauagugaagacuccauacaauauccagaagaaucugaua

SEQ ID NO: 302775 - RNA, 64 nt, Homo Sapiens
auaacauuucauccaguaaauccuucaaaugaccacuccauaauccuggaccauugcaagucca

SEQ ID NO: 302776 - RNA, 64 nt, Homo Sapiens
ccuuuuuucugcuaaaacuacuuauuaguauuucacuccauaaccugguuacauuccauuauug

SEQ ID NO: 302777 - RNA, 64 nt, Homo Sapiens
agucagcuugaggauuuagcauuguuaaucuuggacuccauaacuuaugaguccuagcacugau

SEQ ID NO: 302778 - RNA, 64 nt, Homo Sapiens
gcauucauccgugacacaugaguaccuacugaggacuccauaaacagaacgggauacagagaua

SEQ ID NO: 302779 - RNA, 64 nt, Homo Sapiens
ccgaauugcuuuuauuuucuuauacuuucaguauacuccauagaccaaagagcaaaaucuaucu

SEQ ID NO: 302780 - RNA, 64 nt, Homo Sapiens
cauucucuguugaggaugucauggcuucgugcugacuccauaaaccccugggcugccccuucuc

SEQ ID NO: 302781 - RNA, 64 nt, Homo Sapiens
acuuuccucagugcuccaugauacuuuuuuugagacuccauaucauugcuuauuuuaccuuuuu

SEQ ID NO: 302782 - RNA, 64 nt, Homo Sapiens
augcuguaaauauuucauaaauuaacaaagugucacuccauaaaaagaaagcuaauacuaauag

SEQ ID NO: 302783 - RNA, 64 nt, Homo Sapiens
auagauggcaaguaagcauaugaaaagcuguuaaacuccauaagucaucagggaaugcaaauug

SEQ ID NO: 302784 - RNA, 64 nt, Homo Sapiens
augauguuugcaaaccaacauuuuucuaccuggaacuccauagaaauuuaucuguguuacccug

SEQ ID NO: 302785 - RNA, 64 nt, Homo Sapiens
cugguauucugagcacuagccugcaacgccccccacuccauagucucaaaaagcaacuucugcc

SEQ ID NO: 302786 - RNA, 64 nt, Homo Sapiens
auucuucucaggcaacauuucuuuaccaggcugugcaaaguaaauauuuuucuguccagaagag

SEQ ID NO: 302787 - RNA, 64 nt, Homo Sapiens
gaggucacuguguaaaccgauuaaaugcauauuagcaaaguauaugugcaauauuguuguguag

SEQ ID NO: 302788 - RNA, 64 nt, Homo Sapiens
ugugugacuuagagacugccuuuuaccuacauaggcaaaguaaaguacaaaucaauagaaacca

SEQ ID NO: 302789 - RNA, 64 nt, Homo Sapiens
cuuuaaaaaaauguaaauuuuugaugaauacucugcaaaguagcccacauuccuuuaagcaucu

SEQ ID NO: 302790 - RNA, 64 nt, Homo Sapiens
gaacaccuuuugagcaucuugcucucccucucaugcaaaguaggauacaauuuccuguuacaaa

SEQ ID NO: 302791 - RNA, 64 nt, Homo Sapiens
aacuacuuuacccuaccuucuucuuacaguugaugcaaaguaucuuguuuuaagguggaaaauu

SEQ ID NO: 302792 - RNA, 64 nt, Homo Sapiens
ucuucacauauggcccuuucugaaucaaagugcggcaaaguaaauauugucuaagcuuuaaucc

SEQ ID NO: 302793 - RNA, 64 nt, Homo Sapiens
cucuugaaaaugaauugucuacaaaauuucaaaugcaaaguauuacagccaaauauuaucuuaa

SEQ ID NO: 302794 - RNA, 64 nt, Homo Sapiens
ugcuuugauaucaucaacugcagagaaugcuguugaugggaaugcuggaagcagaaacuuuguc

SEQ ID NO: 302795 - RNA, 64 nt, Homo Sapiens
gcaugagacucaacaucaggauccacagcuuaaagaugggaauucagguaugaaagaaaacagg

SEQ ID NO: 302796 - RNA, 64 nt, Homo Sapiens
augacuucaccaaggagcaaaaugaauggaagaugaugggaaauaaauguaugauccaacuaga

SEQ ID NO: 302797 - RNA, 64 nt, Homo Sapiens
uacuagauggacaggcugagaucacaagcugcuugaugggaaccaaccuuguacuacucagcug

SEQ ID NO: 302798 - RNA, 64 nt, Homo Sapiens
gugaggauggccucugcuaagcucaaggcgugaggaugggaaggagggagguauucguaaggau

SEQ ID NO: 302799 - RNA, 64 nt, Homo Sapiens
gcgugaggaugggaaggagggagguauucguaaggaugggaaggagggagguauucgugcagca

SEQ ID NO: 302800 - RNA, 64 nt, Homo Sapiens
agaugcaggcugaaaagaaaaggaagugggcuaagaugggaaaaauauaaaaagauuuaaaauc

SEQ ID NO: 302801 - RNA, 64 nt, Homo Sapiens
guuggcaacacauuuauuaagugauccaacaugggaugggaaggaaugggcaaagagauuaaaa

SEQ ID NO: 302802 - RNA, 64 nt, Homo Sapiens
uaaacugagugcugggagugaguugguaauaugagaugggaaggaauguugacuugcuaacauu

SEQ ID NO: 302803 - RNA, 64 nt, Homo Sapiens
auguucaccacagggauacaagccuguuauguuugaugggaaagaccacuacaaucuaauggug

SEQ ID NO: 302804 - RNA, 64 nt, Homo Sapiens
auuuuuuaagauagaaagauuaaaaagaaagaaagaugggaagaaaaugaaugucagucaagga

SEQ ID NO: 302805 - RNA, 64 nt, Homo Sapiens
gcaagaaaagcagucggacucuaccuuaaggagggaugggaaggaaagaguugaguugguuucu

SEQ ID NO: 302806 - RNA, 64 nt, Homo Sapiens
guauuuuacucugaucaaaugcucaguuuguagugaugggaaguguguagacaacuguaguugu

SEQ ID NO: 302807 - RNA, 64 nt, Homo Sapiens
aaaauagagaauucuuaagaagaacaggagggaagaugggaaacacaucuuuggaggaugggag

SEQ ID NO: 302808 - RNA, 64 nt, Homo Sapiens
ugggucaugaccuuuucuucauccaaaacaaggugaugggaagacaaaaacaauagcuacuaca

SEQ ID NO: 302809 - RNA, 64 nt, Homo Sapiens
ccuuguccucaaaauacuuccagaagaacaaccagaugggaaggaccuugguugggacucuuuc

SEQ ID NO: 302810 - RNA, 64 nt, Homo Sapiens
guaaaagaucaaguaugcuauacuaauugguggagaugggaacuauauaguggaaaucugccaa

SEQ ID NO: 302811 - RNA, 64 nt, Homo Sapiens
ugugguacagauagacaugaacgucacagucuaagaugggaaaccagccagcccuugccagcug

SEQ ID NO: 302812 - RNA, 64 nt, Homo Sapiens
ucagcaguguagacugacuucucccgagggggaugaugggaaaucagccauuugcccagggcug

SEQ ID NO: 302813 - RNA, 64 nt, Homo Sapiens
uugggagaucugucuacagagugugugaggaacagaugggaaagucagcuguuuuuaaaugaau

SEQ ID NO: 302814 - RNA, 64 nt, Homo Sapiens
uugaauuuuguuuuuauuuucaagagggcaaguggaugggaauuugucagcguucuaccaggca

SEQ ID NO: 302815 - RNA, 64 nt, Homo Sapiens
uuuugguucagacaccuguucacagaaaaagcaugaugggaaaauauuuccugacuugaguguu

SEQ ID NO: 302816 - RNA, 64 nt, Homo Sapiens; identical to SEQ ID NO: 243860

SEQ ID NO: 302817 - RNA, 64 nt, Homo Sapiens; identical to SEQ ID NO: 243861

SEQ ID NO: 302818 - RNA, 64 nt, Homo Sapiens; identical to SEQ ID NO: 243862

SEQ ID NO: 302819 - RNA, 64 nt, Homo Sapiens; identical to SEQ ID NO: 243863

SEQ ID NO: 302820 - RNA, 64 nt, Homo Sapiens; identical to SEQ ID NO: 243864

SEQ ID NO: 302821 - RNA, 64 nt, Homo Sapiens; identical to SEQ ID NO: 243865

SEQ ID NO: 302822 - RNA, 64 nt, Homo Sapiens; identical to SEQ ID NO: 243866

SEQ ID NO: 302823 - RNA, 64 nt, Homo Sapiens; identical to SEQ ID NO: 243867

SEQ ID NO: 302824 - RNA, 64 nt, Homo Sapiens; identical to SEQ ID NO: 243868

SEQ ID NO: 302825 - RNA, 64 nt, Homo Sapiens; identical to SEQ ID NO: 243869

SEQ ID NO: 302826 - RNA, 64 nt, Homo Sapiens; identical to SEQ ID NO: 243870

SEQ ID NO: 302827 - RNA, 64 nt, Homo Sapiens; identical to SEQ ID NO: 243871

SEQ ID NO: 302828 - RNA, 64 nt, Homo Sapiens; identical to SEQ ID NO: 243872

SEQ ID NO: 302829 - RNA, 64 nt, Homo Sapiens; identical to SEQ ID NO: 243873

SEQ ID NO: 302830 - RNA, 64 nt, Homo Sapiens; identical to SEQ ID NO: 243874

SEQ ID NO: 302831 - RNA, 64 nt, Homo Sapiens; identical to SEQ ID NO: 243875

SEQ ID NO: 302832 - RNA, 64 nt, Homo Sapiens; identical to SEQ ID NO: 243876

SEQ ID NO: 302833 - RNA, 64 nt, Homo Sapiens; identical to SEQ ID NO: 243877

SEQ ID NO: 302834 - RNA, 64 nt, Homo Sapiens; identical to SEQ ID NO: 243878

SEQ ID NO: 302835 - RNA, 64 nt, Homo Sapiens; identical to SEQ ID NO: 243879

SEQ ID NO: 302836 - RNA, 64 nt, Homo Sapiens; identical to SEQ ID NO: 243880

SEQ ID NO: 302837 - RNA, 64 nt, Homo Sapiens; identical to SEQ ID NO: 243881

SEQ ID NO: 302838 - RNA, 64 nt, Homo Sapiens; identical to SEQ ID NO: 243882

SEQ ID NO: 302839 - RNA, 64 nt, Homo Sapiens; identical to SEQ ID NO: 243883

SEQ ID NO: 302840 - RNA, 64 nt, Homo Sapiens; identical to SEQ ID NO: 243884

SEQ ID NO: 302841 - RNA, 64 nt, Homo Sapiens; identical to SEQ ID NO: 243885

SEQ ID NO: 302842 - RNA, 64 nt, Homo Sapiens; identical to SEQ ID NO: 243886

SEQ ID NO: 302843 - RNA, 64 nt, Homo Sapiens; identical to SEQ ID NO: 243887

SEQ ID NO: 302844 - RNA, 64 nt, Homo Sapiens; identical to SEQ ID NO: 243888

SEQ ID NO: 302845 - RNA, 64 nt, Homo Sapiens; identical to SEQ ID NO: 243889

SEQ ID NO: 302846 - RNA, 51 nt, Homo Sapiens; identical to SEQ ID NO: 243890

SEQ ID NO: 302847 - RNA, 64 nt, Homo Sapiens; identical to SEQ ID NO: 243891

SEQ ID NO: 302848 - RNA, 64 nt, Homo Sapiens; identical to SEQ ID NO: 243892

SEQ ID NO: 302849 - RNA, 64 nt, Homo Sapiens; identical to SEQ ID NO: 243893

SEQ ID NO: 302850 - RNA, 64 nt, Homo Sapiens; identical to SEQ ID NO: 243894

SEQ ID NO: 302851 - RNA, 64 nt, Homo Sapiens; identical to SEQ ID NO: 243895

SEQ ID NO: 302852 - RNA, 64 nt, Homo Sapiens; identical to SEQ ID NO: 243896

SEQ ID NO: 302853 - RNA, 64 nt, Homo Sapiens; identical to SEQ ID NO: 243897

SEQ ID NO: 302854 - RNA, 64 nt, Homo Sapiens; identical to SEQ ID NO: 243898

SEQ ID NO: 302855 - RNA, 64 nt, Homo Sapiens; identical to SEQ ID NO: 243899

SEQ ID NO: 302856 - RNA, 64 nt, Homo Sapiens; identical to SEQ ID NO: 243900

SEQ ID NO: 302857 - RNA, 64 nt, Homo Sapiens; identical to SEQ ID NO: 243901

SEQ ID NO: 302858 - RNA, 63 nt, Homo Sapiens; identical to SEQ ID NO: 243902

SEQ ID NO: 302859 - RNA, 64 nt, Homo Sapiens; identical to SEQ ID NO: 243903

SEQ ID NO: 302860 - RNA, 64 nt, Homo Sapiens; identical to SEQ ID NO: 243904

SEQ ID NO: 302861 - RNA, 64 nt, Homo Sapiens; identical to SEQ ID NO: 243905

SEQ ID NO: 302862 - RNA, 64 nt, Homo Sapiens; identical to SEQ ID NO: 243906

SEQ ID NO: 302863 - RNA, 64 nt, Homo Sapiens; identical to SEQ ID NO: 243907

SEQ ID NO: 302864 - RNA, 64 nt, Homo Sapiens; identical to SEQ ID NO: 243908

SEQ ID NO: 302865 - RNA, 64 nt, Homo Sapiens; identical to SEQ ID NO: 243909

SEQ ID NO: 302866 - RNA, 64 nt, Homo Sapiens; identical to SEQ ID NO: 243910

SEQ ID NO: 302867 - RNA, 64 nt, Homo Sapiens; identical to SEQ ID NO: 243911

SEQ ID NO: 302868 - RNA, 64 nt, Homo Sapiens; identical to SEQ ID NO: 243912

SEQ ID NO: 302869 - RNA, 64 nt, Homo Sapiens; identical to SEQ ID NO: 243913

SEQ ID NO: 302870 - RNA, 64 nt, Homo Sapiens; identical to SEQ ID NO: 243914

SEQ ID NO: 302871 - RNA, 64 nt, Homo Sapiens; identical to SEQ ID NO: 243915

SEQ ID NO: 302872 - RNA, 64 nt, Homo Sapiens; identical to SEQ ID NO: 243916

SEQ ID NO: 302873 - RNA, 64 nt, Homo Sapiens; identical to SEQ ID NO: 243917

SEQ ID NO: 302874 - RNA, 64 nt, Homo Sapiens; identical to SEQ ID NO: 243918

SEQ ID NO: 302875 - RNA, 64 nt, Homo Sapiens; identical to SEQ ID NO: 243919

SEQ ID NO: 302876 - RNA, 64 nt, Homo Sapiens; identical to SEQ ID NO: 243920

SEQ ID NO: 302877 - RNA, 64 nt, Homo Sapiens; identical to SEQ ID NO: 243921

SEQ ID NO: 302878 - RNA, 64 nt, Homo Sapiens; identical to SEQ ID NO: 243922

SEQ ID NO: 302879 - RNA, 64 nt, Homo Sapiens; identical to SEQ ID NO: 243923

SEQ ID NO: 302880 - RNA, 64 nt, Homo Sapiens; identical to SEQ ID NO: 243924

SEQ ID NO: 302881 - RNA, 64 nt, Homo Sapiens; identical to SEQ ID NO: 243925

SEQ ID NO: 302882 - RNA, 64 nt, Homo Sapiens; identical to SEQ ID NO: 243926

SEQ ID NO: 302883 - RNA, 64 nt, Homo Sapiens; identical to SEQ ID NO: 243927

SEQ ID NO: 302884 - RNA, 64 nt, Homo Sapiens; identical to SEQ ID NO: 243928

SEQ ID NO: 302885 - RNA, 64 nt, Homo Sapiens; identical to SEQ ID NO: 243929

SEQ ID NO: 302886 - RNA, 64 nt, Homo Sapiens; identical to SEQ ID NO: 243930

SEQ ID NO: 302887 - RNA, 64 nt, Homo Sapiens; identical to SEQ ID NO: 243931

SEQ ID NO: 302888 - RNA, 64 nt, Homo Sapiens; identical to SEQ ID NO: 243932

SEQ ID NO: 302889 - RNA, 64 nt, Homo Sapiens; identical to SEQ ID NO: 243933

SEQ ID NO: 302890 - RNA, 64 nt, Homo Sapiens; identical to SEQ ID NO: 243934

SEQ ID NO: 302891 - RNA, 64 nt, Homo Sapiens; identical to SEQ ID NO: 243935

SEQ ID NO: 302892 - RNA, 64 nt, Homo Sapiens; identical to SEQ ID NO: 243936

SEQ ID NO: 302893 - RNA, 64 nt, Homo Sapiens; identical to SEQ ID NO: 243937

SEQ ID NO: 302894 - RNA, 64 nt, Homo Sapiens; identical to SEQ ID NO: 243938

SEQ ID NO: 302895 - RNA, 64 nt, Homo Sapiens; identical to SEQ ID NO: 243939

SEQ ID NO: 302896 - RNA, 64 nt, Homo Sapiens; identical to SEQ ID NO: 243940

SEQ ID NO: 302897 - RNA, 64 nt, Homo Sapiens; identical to SEQ ID NO: 243941

SEQ ID NO: 302898 - RNA, 64 nt, Homo Sapiens; identical to SEQ ID NO: 243942

SEQ ID NO: 302899 - RNA, 64 nt, Homo Sapiens; identical to SEQ ID NO: 243943

SEQ ID NO: 302900 - RNA, 64 nt, Homo Sapiens; identical to SEQ ID NO: 243944

SEQ ID NO: 302901 - RNA, 64 nt, Homo Sapiens; identical to SEQ ID NO: 243945

SEQ ID NO: 302902 - RNA, 64 nt, Homo Sapiens; identical to SEQ ID NO: 243946

SEQ ID NO: 302903 - RNA, 64 nt, Homo Sapiens; identical to SEQ ID NO: 243947

SEQ ID NO: 302904 - RNA, 64 nt, Homo Sapiens; identical to SEQ ID NO: 243948

SEQ ID NO: 302905 - RNA, 64 nt, Homo Sapiens; identical to SEQ ID NO: 302794

SEQ ID NO: 302906 - RNA, 64 nt, Homo Sapiens; identical to SEQ ID NO: 302795

SEQ ID NO: 302907 - RNA, 64 nt, Homo Sapiens; identical to SEQ ID NO: 302796

SEQ ID NO: 302908 - RNA, 64 nt, Homo Sapiens; identical to SEQ ID NO: 302797

SEQ ID NO: 302909 - RNA, 64 nt, Homo Sapiens; identical to SEQ ID NO: 302798

SEQ ID NO: 302910 - RNA, 64 nt, Homo Sapiens; identical to SEQ ID NO: 302799

SEQ ID NO: 302911 - RNA, 64 nt, Homo Sapiens; identical to SEQ ID NO: 302800

SEQ ID NO: 302912 - RNA, 64 nt, Homo Sapiens; identical to SEQ ID NO: 302801

SEQ ID NO: 302913 - RNA, 64 nt, Homo Sapiens; identical to SEQ ID NO: 302802

SEQ ID NO: 302914 - RNA, 64 nt, Homo Sapiens; identical to SEQ ID NO: 302803

SEQ ID NO: 302915 - RNA, 64 nt, Homo Sapiens; identical to SEQ ID NO: 302804

SEQ ID NO: 302916 - RNA, 64 nt, Homo Sapiens; identical to SEQ ID NO: 302805

SEQ ID NO: 302917 - RNA, 64 nt, Homo Sapiens; identical to SEQ ID NO: 302806

SEQ ID NO: 302918 - RNA, 64 nt, Homo Sapiens; identical to SEQ ID NO: 302807

SEQ ID NO: 302919 - RNA, 64 nt, Homo Sapiens; identical to SEQ ID NO: 302808

SEQ ID NO: 302920 - RNA, 64 nt, Homo Sapiens; identical to SEQ ID NO: 302809

SEQ ID NO: 302921 - RNA, 64 nt, Homo Sapiens; identical to SEQ ID NO: 302810

SEQ ID NO: 302922 - RNA, 64 nt, Homo Sapiens; identical to SEQ ID NO: 302811

SEQ ID NO: 302923 - RNA, 64 nt, Homo Sapiens; identical to SEQ ID NO: 302812

SEQ ID NO: 302924 - RNA, 64 nt, Homo Sapiens; identical to SEQ ID NO: 302813

SEQ ID NO: 302925 - RNA, 64 nt, Homo Sapiens; identical to SEQ ID NO: 302814

SEQ ID NO: 302926 - RNA, 64 nt, Homo Sapiens; identical to SEQ ID NO: 302815

SEQ ID NO: 302927 - RNA, 64 nt, Homo Sapiens; identical to SEQ ID NO: 243860

SEQ ID NO: 302928 - RNA, 64 nt, Homo Sapiens; identical to SEQ ID NO: 243861

SEQ ID NO: 302929 - RNA, 64 nt, Homo Sapiens; identical to SEQ ID NO: 243862

SEQ ID NO: 302930 - RNA, 64 nt, Homo Sapiens; identical to SEQ ID NO: 243863

SEQ ID NO: 302931 - RNA, 64 nt, Homo Sapiens; identical to SEQ ID NO: 243864

SEQ ID NO: 302932 - RNA, 64 nt, Homo Sapiens; identical to SEQ ID NO: 243865

SEQ ID NO: 302933 - RNA, 64 nt, Homo Sapiens; identical to SEQ ID NO: 243866

SEQ ID NO: 302934 - RNA, 64 nt, Homo Sapiens; identical to SEQ ID NO: 243867

SEQ ID NO: 302935 - RNA, 64 nt, Homo Sapiens; identical to SEQ ID NO: 243868

SEQ ID NO: 302936 - RNA, 64 nt, Homo Sapiens; identical to SEQ ID NO: 243869

SEQ ID NO: 302937 - RNA, 64 nt, Homo Sapiens; identical to SEQ ID NO: 243870

SEQ ID NO: 302938 - RNA, 64 nt, Homo Sapiens; identical to SEQ ID NO: 243871

SEQ ID NO: 302939 - RNA, 64 nt, Homo Sapiens; identical to SEQ ID NO: 243872

SEQ ID NO: 302940 - RNA, 64 nt, Homo Sapiens; identical to SEQ ID NO: 243873

SEQ ID NO: 302941 - RNA, 64 nt, Homo Sapiens; identical to SEQ ID NO: 243874

SEQ ID NO: 302942 - RNA, 64 nt, Homo Sapiens; identical to SEQ ID NO: 243875

SEQ ID NO: 302943 - RNA, 64 nt, Homo Sapiens; identical to SEQ ID NO: 243876

SEQ ID NO: 302944 - RNA, 64 nt, Homo Sapiens; identical to SEQ ID NO: 243877

SEQ ID NO: 302945 - RNA, 64 nt, Homo Sapiens; identical to SEQ ID NO: 243878

SEQ ID NO: 302946 - RNA, 64 nt, Homo Sapiens; identical to SEQ ID NO: 243879

SEQ ID NO: 302947 - RNA, 64 nt, Homo Sapiens; identical to SEQ ID NO: 243880

SEQ ID NO: 302948 - RNA, 64 nt, Homo Sapiens; identical to SEQ ID NO: 243881

SEQ ID NO: 302949 - RNA, 64 nt, Homo Sapiens; identical to SEQ ID NO: 243882

SEQ ID NO: 302950 - RNA, 64 nt, Homo Sapiens; identical to SEQ ID NO: 243883

SEQ ID NO: 302951 - RNA, 64 nt, Homo Sapiens; identical to SEQ ID NO: 243884

SEQ ID NO: 302952 - RNA, 64 nt, Homo Sapiens; identical to SEQ ID NO: 243885

SEQ ID NO: 302953 - RNA, 64 nt, Homo Sapiens; identical to SEQ ID NO: 243886

SEQ ID NO: 302954 - RNA, 64 nt, Homo Sapiens; identical to SEQ ID NO: 243887

SEQ ID NO: 302955 - RNA, 64 nt, Homo Sapiens; identical to SEQ ID NO: 243888

SEQ ID NO: 302956 - RNA, 64 nt, Homo Sapiens; identical to SEQ ID NO: 243889

SEQ ID NO: 302957 - RNA, 51 nt, Homo Sapiens; identical to SEQ ID NO: 243890

SEQ ID NO: 302958 - RNA, 64 nt, Homo Sapiens; identical to SEQ ID NO: 243891

SEQ ID NO: 302959 - RNA, 64 nt, Homo Sapiens; identical to SEQ ID NO: 243892

SEQ ID NO: 302960 - RNA, 64 nt, Homo Sapiens; identical to SEQ ID NO: 243893

SEQ ID NO: 302961 - RNA, 64 nt, Homo Sapiens; identical to SEQ ID NO: 243894

SEQ ID NO: 302962 - RNA, 64 nt, Homo Sapiens; identical to SEQ ID NO: 243895

SEQ ID NO: 302963 - RNA, 64 nt, Homo Sapiens; identical to SEQ ID NO: 243896

SEQ ID NO: 302964 - RNA, 64 nt, Homo Sapiens; identical to SEQ ID NO: 243897

SEQ ID NO: 302965 - RNA, 64 nt, Homo Sapiens; identical to SEQ ID NO: 243898

SEQ ID NO: 302966 - RNA, 64 nt, Homo Sapiens; identical to SEQ ID NO: 243899

SEQ ID NO: 302967 - RNA, 64 nt, Homo Sapiens; identical to SEQ ID NO: 243900

SEQ ID NO: 302968 - RNA, 64 nt, Homo Sapiens; identical to SEQ ID NO: 243901

SEQ ID NO: 302969 - RNA, 63 nt, Homo Sapiens; identical to SEQ ID NO: 243902

SEQ ID NO: 302970 - RNA, 64 nt, Homo Sapiens; identical to SEQ ID NO: 243903

SEQ ID NO: 302971 - RNA, 64 nt, Homo Sapiens; identical to SEQ ID NO: 243904

SEQ ID NO: 302972 - RNA, 64 nt, Homo Sapiens; identical to SEQ ID NO: 243905

SEQ ID NO: 302973 - RNA, 64 nt, Homo Sapiens; identical to SEQ ID NO: 243906

SEQ ID NO: 302974 - RNA, 64 nt, Homo Sapiens; identical to SEQ ID NO: 243907

SEQ ID NO: 302975 - RNA, 64 nt, Homo Sapiens; identical to SEQ ID NO: 243908

SEQ ID NO: 302976 - RNA, 64 nt, Homo Sapiens; identical to SEQ ID NO: 243909

SEQ ID NO: 302977 - RNA, 64 nt, Homo Sapiens; identical to SEQ ID NO: 243910

SEQ ID NO: 302978 - RNA, 64 nt, Homo Sapiens; identical to SEQ ID NO: 243911

SEQ ID NO: 302979 - RNA, 64 nt, Homo Sapiens; identical to SEQ ID NO: 243912

SEQ ID NO: 302980 - RNA, 64 nt, Homo Sapiens; identical to SEQ ID NO: 243913

SEQ ID NO: 302981 - RNA, 64 nt, Homo Sapiens; identical to SEQ ID NO: 243914

SEQ ID NO: 302982 - RNA, 64 nt, Homo Sapiens; identical to SEQ ID NO: 243915

SEQ ID NO: 302983 - RNA, 64 nt, Homo Sapiens; identical to SEQ ID NO: 243916

SEQ ID NO: 302984 - RNA, 64 nt, Homo Sapiens; identical to SEQ ID NO: 243917

SEQ ID NO: 302985 - RNA, 64 nt, Homo Sapiens; identical to SEQ ID NO: 243918

SEQ ID NO: 302986 - RNA, 64 nt, Homo Sapiens; identical to SEQ ID NO: 243919

SEQ ID NO: 302987 - RNA, 64 nt, Homo Sapiens; identical to SEQ ID NO: 243920

SEQ ID NO: 302988 - RNA, 64 nt, Homo Sapiens; identical to SEQ ID NO: 243921

SEQ ID NO: 302989 - RNA, 64 nt, Homo Sapiens; identical to SEQ ID NO: 243922

SEQ ID NO: 302990 - RNA, 64 nt, Homo Sapiens; identical to SEQ ID NO: 243923

SEQ ID NO: 302991 - RNA, 64 nt, Homo Sapiens; identical to SEQ ID NO: 243924

SEQ ID NO: 302992 - RNA, 64 nt, Homo Sapiens; identical to SEQ ID NO: 243925

SEQ ID NO: 302993 - RNA, 64 nt, Homo Sapiens; identical to SEQ ID NO: 243926

SEQ ID NO: 302994 - RNA, 64 nt, Homo Sapiens; identical to SEQ ID NO: 243927

SEQ ID NO: 302995 - RNA, 64 nt, Homo Sapiens; identical to SEQ ID NO: 243928

SEQ ID NO: 302996 - RNA, 64 nt, Homo Sapiens; identical to SEQ ID NO: 243929

SEQ ID NO: 302997 - RNA, 64 nt, Homo Sapiens; identical to SEQ ID NO: 243930

SEQ ID NO: 302998 - RNA, 64 nt, Homo Sapiens; identical to SEQ ID NO: 243931

SEQ ID NO: 302999 - RNA, 64 nt, Homo Sapiens; identical to SEQ ID NO: 243932

SEQ ID NO: 303000 - RNA, 64 nt, Homo Sapiens; identical to SEQ ID NO: 243933

SEQ ID NO: 303001 - RNA, 64 nt, Homo Sapiens; identical to SEQ ID NO: 243934

SEQ ID NO: 303002 - RNA, 64 nt, Homo Sapiens; identical to SEQ ID NO: 243935

SEQ ID NO: 303003 - RNA, 64 nt, Homo Sapiens; identical to SEQ ID NO: 243936

SEQ ID NO: 303004 - RNA, 64 nt, Homo Sapiens; identical to SEQ ID NO: 243937

SEQ ID NO: 303005 - RNA, 64 nt, Homo Sapiens; identical to SEQ ID NO: 243938

SEQ ID NO: 303006 - RNA, 64 nt, Homo Sapiens; identical to SEQ ID NO: 243939

SEQ ID NO: 303007 - RNA, 64 nt, Homo Sapiens; identical to SEQ ID NO: 243940

SEQ ID NO: 303008 - RNA, 64 nt, Homo Sapiens; identical to SEQ ID NO: 243941

SEQ ID NO: 303009 - RNA, 64 nt, Homo Sapiens; identical to SEQ ID NO: 243942

SEQ ID NO: 303010 - RNA, 64 nt, Homo Sapiens; identical to SEQ ID NO: 243943

SEQ ID NO: 303011 - RNA, 64 nt, Homo Sapiens; identical to SEQ ID NO: 243944

SEQ ID NO: 303012 - RNA, 64 nt, Homo Sapiens; identical to SEQ ID NO: 243945

SEQ ID NO: 303013 - RNA, 64 nt, Homo Sapiens; identical to SEQ ID NO: 243946

SEQ ID NO: 303014 - RNA, 64 nt, Homo Sapiens; identical to SEQ ID NO: 243947

SEQ ID NO: 303015 - RNA, 64 nt, Homo Sapiens; identical to SEQ ID NO: 243948

SEQ ID NO: 303016 - RNA, 64 nt, Homo Sapiens
accuaauguuuaugagccagacaaauggaggaauaugacggaagaacauagaacucugggcugc

SEQ ID NO: 303017 - RNA, 64 nt, Homo Sapiens
gcuggcccggguaucgggaaggaggagcgagggaaugacggagguagggugcagggucagggcu

SEQ ID NO: 303018 - RNA, 64 nt, Homo Sapiens
cuuuggcuggaugcaagagcagugauccuacuauaugacggaaauaguaguagguaaaaguuag

SEQ ID NO: 303019 - RNA, 64 nt, Homo Sapiens
ccagcaucuguuccugaacuguguuuuucccaucaugacggaagaagagagugagccgcaauug

SEQ ID NO: 303020 - RNA, 64 nt, Homo Sapiens
cucccuggaggagacuuauuucaaugaguccaccaugacggaugaggcaccuccuuucccugcu

SEQ ID NO: 303021 - RNA, 64 nt, Homo Sapiens
aaagucugacucagagaaagccuuccuagaaaauaugacggagaucacaaaagauggaauuugc

SEQ ID NO: 303022 - RNA, 64 nt, Homo Sapiens
ucacuaucacuuuaccucaaauugaacagauuccaugacggaacuucauucuucacaaacuagc

SEQ ID NO: 303023 - RNA, 64 nt, Homo Sapiens
aguugagaccuaacgagaaaggaacauagaacucaugacggaaguugggcucuuggaauccugg

SEQ ID NO: 303024 - RNA, 64 nt, Homo Sapiens
guuuaggaugacuacaugucuuuuuggagaaaccaugacggauaucagauaauucauguggaga

SEQ ID NO: 303025 - RNA, 64 nt, Homo Sapiens
aagaggggucuuuuauccuugucguaggaaaaccaugacggaaaggaaaaacugauguuuaaaa

SEQ ID NO: 303026 - RNA, 64 nt, Homo Sapiens
auguccucccuaggcacagugacagcuguaaaguaugacggaacaagguagcagaugguacaga

SEQ ID NO: 303027 - RNA, 64 nt, Homo Sapiens
uguauuuugcaaaacuacacugaaguuucugauaaugacggauaucaacaauuaaacgcuuacu

SEQ ID NO: 303028 - RNA, 64 nt, Homo Sapiens
uuauaggcagaaccuuagagaagaagaguggaagaugacggagaugcauuuugaagcaccccug

SEQ ID NO: 303029 - RNA, 64 nt, Homo Sapiens
gcuuacagaugacccuauuguucauccccuauggaugacggagagauggccugaaauuccaccu

SEQ ID NO: 303030 - RNA, 64 nt, Homo Sapiens
cugacucaauaugucagguuuuaguugauguaaaaugacggaaaaagcaauucacugcuauaau

SEQ ID NO: 303031 - RNA, 64 nt, Homo Sapiens
uguuaggaaaaugcuguugucccugggucauaaaaugacggaccaaaacaccaggaaagaggaa

SEQ ID NO: 303032 - RNA, 64 nt, Homo Sapiens
gcaaacauuuggucacaugcaaguuaguggucauaugacggacugcauucaggacaaggguaaa

SEQ ID NO: 303033 - RNA, 64 nt, Homo Sapiens
aacuuaacagaugaguucuugaaucugggaugagaugacggauguaaauauuucuaaauuuuaa

SEQ ID NO: 303034 - RNA, 64 nt, Homo Sapiens
uccuaggcggucccagcuggaauuacccaaccccaugacggacccuuucauugcagcgaucugc

SEQ ID NO: 303035 - RNA, 59 nt, Homo Sapiens
agaggaagaugaugaggucucaauuaccuaugacggauuaacuaagauguggaauauag

SEQ ID NO: 303036 - RNA, 64 nt, Homo Sapiens
ggacuucauguuucccucaaagacucucccguggaugacggaugaggacucugggcugcuggaa

SEQ ID NO: 303037 - RNA, 64 nt, Homo Sapiens
gcugcuuggcagcccagccuggaggagaaggcuaaugacggaggggccccucgcuggggccccu

SEQ ID NO: 303038 - RNA, 64 nt, Homo Sapiens
caaauccaucuccaaacaugauacucuugggccaaugacggaucaucaaaauguagauucauug

SEQ ID NO: 303039 - RNA, 64 nt, Homo Sapiens
guuuuauuugaauggggaaaauacccuuuaaauuaugacggacauccacuagagauggguuuga

SEQ ID NO: 303040 - RNA, 59 nt, Homo Sapiens
agaagacuguaaauaagauaaggagggagaugacggacuugaaacuugauauaaaauga

SEQ ID NO: 303041 - RNA, 64 nt, Homo Sapiens
aauucuuuaugaauuuuacacuuggcaaauguuaaugacggaagccauagucugcuccuaauac

SEQ ID NO: 303042 - RNA, 64 nt, Homo Sapiens
aaacuggacaauguccaaacccacucaugacugcaugacggagccgagccaugugucuuuacac

SEQ ID NO: 303043 - RNA, 64 nt, Homo Sapiens
ucuacugauggcaguguuuuagcugcugggacacaugacggaaguguguauuuuugggccacuc

SEQ ID NO: 303044 - RNA, 64 nt, Homo Sapiens
gugguuucuuaugcuuuggaagccccuagaaauaaugacggaagaaugccauguugcugaucgu

SEQ ID NO: 303045 - RNA, 64 nt, Homo Sapiens
uuggaaaugaagaccuaaccagcuauuggugggaaugacggaacuggggauugcgaugauugau

SEQ ID NO: 303046 - RNA, 64 nt, Homo Sapiens
uggggaaacccuuccuagucucacuugauuccucaugacggaaaucacacuaaagagagaaauc

SEQ ID NO: 303047 - RNA, 64 nt, Homo Sapiens
caucugccuaaauugacauaggaggagaugccuuaugacggagcuucuuguaaaacauaacacu

SEQ ID NO: 303048 - RNA, 64 nt, Homo Sapiens
uuucaacaguuuuugcuaauuuuuaggcugaaagaugacggaugccuagaguuuaccuuauguu

SEQ ID NO: 303049 - RNA, 64 nt, Homo Sapiens
cagucuguuccggggcccccucagccaggugggaaugacggacacguacuauccaaguguaugg

SEQ ID NO: 303050 - RNA, 64 nt, Homo Sapiens
uucggggagaggagcaggugggacccucaagaaaaugacggagaacaucccagacagaugggac

SEQ ID NO: 303051 - RNA, 64 nt, Homo Sapiens
cagggucugaccaagugccaggcuccauggccagaugacggaaagcucacagccgaggagccgu

SEQ ID NO: 303052 - RNA, 64 nt, Homo Sapiens
aguaugagaugguguaaggagaagucuuucaagaaugacggaauaagagaccuguuuuaaaaag

SEQ ID NO: 303053 - RNA, 64 nt, Homo Sapiens
ucugcugagcaggaauaucaugagcuguucaauaaugacggacgcauugguugagaugaaguuu

SEQ ID NO: 303054 - RNA, 64 nt, Homo Sapiens
auuuuuuaugucaaaauguuacaaccgcuguaaaaugacggagagagagagaaagaaucccaga

SEQ ID NO: 303055 - RNA, 64 nt, Homo Sapiens
caaccaagaacaaagccccgggacuguuuucuuuuuaauaaagccacaggcaggcaucguagcu

SEQ ID NO: 303056 - RNA, 64 nt, Homo Sapiens
gaaugagucaccuugugauuuuuaaauuuuuauuuuaauaaagcuaaucaauuucuacaaccuu

SEQ ID NO: 303057 - RNA, 64 nt, Homo Sapiens
agucuuaauuuaccuugcauuguaauauucaguuuuaauaaaucuucaaaauauuuuguauuua

SEQ ID NO: 303058 - RNA, 64 nt, Homo Sapiens
ucaaaauauuuuguauuuaggaauagaucugacuuuaauaaaaacauggcucagaaucuacagg

SEQ ID NO: 303059 - RNA, 64 nt, Homo Sapiens
uacuauaguauucuuaauacagugcucacugcauuuaauaaauauuuaauaaaugaugaaugau

SEQ ID NO: 303060 - RNA, 64 nt, Homo Sapiens
ucuuaauacagugcucacugcauuuaauaaauauuuaauaaaugaugaaugauagaaguuucca

SEQ ID NO: 303061 - RNA, 64 nt, Homo Sapiens
ugaauaauaaauuuugacacugaaaaacauuuuauuaauaaagaauauugacaugaguauacca

SEQ ID NO: 303062 - RNA, 64 nt, Homo Sapiens
auugguaaauaucaccugcucaacauguaauuauuuaauaaaacuuuggaacauuaaaaaaaua

SEQ ID NO: 303063 - RNA, 64 nt, Homo Sapiens
augguaguuccucuaccuuacaguuaaucguuucuuaauaaagaagcagaauuuagaaaccaca

SEQ ID NO: 303064 - RNA, 64 nt, Homo Sapiens
aaacuauuauaugauucauaaugguucucaggaauuaauaaaugauuacuguguuuagcucugu

SEQ ID NO: 303065 - RNA, 64 nt, Homo Sapiens
uauaauacuuauuuaugauaauugucuuuucauuuuaauaaaguuuuguugcauuauuuugaau

SEQ ID NO: 303066 - RNA, 64 nt, Homo Sapiens
uacaacacaagcuggccuuguuuuuuagacuguauuaauaaacaguguugugguuuugcuuuuu

SEQ ID NO: 303067 - RNA, 64 nt, Homo Sapiens
uuuauguacugcuguagcaacgagaaucagaauauuaauaaaaccugccauaaaagcuaugaca

SEQ ID NO: 303068 - RNA, 64 nt, Homo Sapiens
aagccauagagccccuccugucuuuugaguuagguuaauaaaucugcuguugguggcagugacu

SEQ ID NO: 303069 - RNA, 64 nt, Homo Sapiens
ugcacagugcuguugguggccuggacuugaaugguuaauaaaaccccaaucuuaccagaugcua

SEQ ID NO: 303070 - RNA, 64 nt, Homo Sapiens
augcucacuacacaguuuaguuguagaaauguaauuaauaaacagccucuuacuuuauuuaaca

SEQ ID NO: 303071 - RNA, 64 nt, Homo Sapiens
guugcacauggauacuuauacauguaagcagccauuaauaaacucacucaguaaaagagcagua

SEQ ID NO: 303072 - RNA, 64 nt, Homo Sapiens
auuaugcagcaucuacacuuaacuuugagcuuuguuaauaaacucauuuaauguuauuucugua

SEQ ID NO: 303073 - RNA, 64 nt, Homo Sapiens
aggcaaaacaaauaacuguugguugauuucaauguuaauaaacuuuuuauaguaucagaacuug

SEQ ID NO: 303074 - RNA, 64 nt, Homo Sapiens
aauaagcauucccuucuaggcauuaacaaauaaauuaauaaacuaguuucaauaaaaacugggc

SEQ ID NO: 303075 - RNA, 64 nt, Homo Sapiens
gccaacccuuuacucucucaacauugcccccaaguuaauaaaguaccagcuucaacauaugucu

SEQ ID NO: 303076 - RNA, 64 nt, Homo Sapiens
ucugaaauguuaaguagaagugauuuuuaaaggauuaauaaaauuuaacucaaaagaaauaggg

SEQ ID NO: 303077 - RNA, 64 nt, Homo Sapiens
uuuauaagauuuuuaugaagauuucugaacuugguuaauaaaaggggagaucaccccucuaauu

SEQ ID NO: 303078 - RNA, 64 nt, Homo Sapiens
auuuuaagcaauuguggaaaauuguauucuuccuuuaauaaaauuaauaaacacuuuuuguuaa

SEQ ID NO: 303079 - RNA, 64 nt, Homo Sapiens
cuuuuuguuaaauuguauucauauauuuuccccuuuaauaaacaugugccuuaaacauauuacu

SEQ ID NO: 303080 - RNA, 64 nt, Homo Sapiens
aaguucguuaguauaaauuacuuuucuaggauuauuaauaaaagccacauagguggcaaguugu

SEQ ID NO: 303081 - RNA, 64 nt, Homo Sapiens
uaacacuuacauuuccauaaagaaaacucaaguauuaauaaaagagacuuuacuggcuuaagag

SEQ ID NO: 303082 - RNA, 64 nt, Homo Sapiens
aaauaagauuaguauuaucuguuuauaaugccuguuaauaaaagaauuuacaguuugguaaaau

SEQ ID NO: 303083 - RNA, 64 nt, Homo Sapiens
aacuugcuaaauauugagaaacuaaacuacuaaguuaauaaauuauauauagcaguguagcugu

SEQ ID NO: 303084 - RNA, 64 nt, Homo Sapiens
auugaaacucaccagucauguuaaauaugcuauuuuaauaaauuauauucuugguuaaccaugg

SEQ ID NO: 303085 - RNA, 64 nt, Homo Sapiens
agucguuauacuaugcauaaaugaaaguggguacuuaauaaaugaaaaaaugccgauuuuauuu

SEQ ID NO: 303086 - RNA, 64 nt, Homo Sapiens
agaagaccauguagaaaacucaguuuuuugguuuuuaauaaaucuauagcauacaaaagugauu

SEQ ID NO: 303087 - RNA, 64 nt, Homo Sapiens
ucuuuugaggaagucuaugcgugauuuauuuguguuaauaaaacauuguuuacagccugugaaa

SEQ ID NO: 303088 - RNA, 64 nt, Homo Sapiens
uuaguuucucauuauagucuuaaaauagcaauuguuaauaaaaucagaguaaucuuucaggaac

SEQ ID NO: 303089 - RNA, 64 nt, Homo Sapiens
acuucuuuaaacaucuuauuaaaguuguuugugcuuaauaaaaguuuguauugauaauguauua

SEQ ID NO: 303090 - RNA, 64 nt, Homo Sapiens
ugaguagcuugaauuuucaucaaauguagaucaguuaauaaacaugccccuaucuuuguuuugu

SEQ ID NO: 303091 - RNA, 64 nt, Homo Sapiens
uucauuuuuuaaauuuguauuuuuguauuuaugauuaauaaaaggcccaaauaccacucaauua

SEQ ID NO: 303092 - RNA, 64 nt, Homo Sapiens
ccgcuaauauaaguaaaguuuguaaaauucauacuuaauaaacaauuuaggacagucaugucug

SEQ ID NO: 303093 - RNA, 64 nt, Homo Sapiens
caguguauaaaacauacugugugguauaacaggcuuaauaaauucuuuaaaaggagagaacuga

SEQ ID NO: 303094 - RNA, 64 nt, Homo Sapiens
uucagcaacuguuaauacucagaucauauaccucuuaauaaauagcaucuuaugcuaauuagcc

SEQ ID NO: 303095 - RNA, 64 nt, Homo Sapiens
uuuuauauggccuuguaugaggggaguuugaauguuaauaaacauguuuuccacuuuaagaucc

SEQ ID NO: 303096 - RNA, 64 nt, Homo Sapiens
aauuuuuuacuugugccacuuaauaucaggcauuuuaauaaaauauuguuacaaaaaauguaca

SEQ ID NO: 303097 - RNA, 64 nt, Homo Sapiens
aaauguacaguacugacaccaccacaaaucaugguuaauaaaagagaguaguuuuaacuuuauu

SEQ ID NO: 303098 - RNA, 64 nt, Homo Sapiens
aauacaaaguauauucucuuuauuggaaaauaaauuaauaaauauauucuguauuuuugcucuc

SEQ ID NO: 303099 - RNA, 64 nt, Homo Sapiens
uaaaguauugaaccaacucuaaaauguuaacuccuuaauaaacagauucucaguaaacaaauuu

SEQ ID NO: 303100 - RNA, 64 nt, Homo Sapiens
guuggucuucaaaauagaaaguucuauuaauaaauuaauaaacuuaauugacagaaaaauacag

SEQ ID NO: 303101 - RNA, 64 nt, Homo Sapiens
aauaaacuguuggucuucaaaaauacagguucuauuaauaaauuaagcacaauaauugacagaa

SEQ ID NO: 303102 - RNA, 64 nt, Homo Sapiens
auuuuaagcuauuuuguuggaauauuauauauacuuaauaaaaccuuuguaaauauuacccugu

SEQ ID NO: 303103 - RNA, 64 nt, Homo Sapiens
aauuaugaucuauguuguuucagcuguaauuuaguuaauaaaauaguuaaguuuuuauucaaag

SEQ ID NO: 303104 - RNA, 64 nt, Homo Sapiens
uuuuccaaaaauggauauugcauucacuaguuuuuuaauaaauauugguuuuguuuuucugcca

SEQ ID NO: 303105 - RNA, 64 nt, Homo Sapiens
uuuuuauagauguuuuauucauagugcucuauguuuaauaaaggaccuucaaaauuauuugggc

SEQ ID NO: 303106 - RNA, 64 nt, Homo Sapiens
auugaauuguaguaaagguuuccugacuuuagucuuaauaaaacgacucaguaaguuggcaagg

SEQ ID NO: 303107 - RNA, 64 nt, Homo Sapiens
cuccacucucuggaaggagaaaaauagccuauccuuaauaaaucaggagagcuuugcagauaac

SEQ ID NO: 303108 - RNA, 64 nt, Homo Sapiens
gaauguggcaaagcauuuaauugguccucaaugcuuaauaaauauaauucaugcuggagagaaa

SEQ ID NO: 303109 - RNA, 64 nt, Homo Sapiens
cuccucacauuuuacuaacuagcaauguucauacuuaauaaaaacauuauaaauguaauuucug

SEQ ID NO: 303110 - RNA, 64 nt, Homo Sapiens
aggaugccuacgucugaaauugcucuuacgaacuuuaauaaaauaguuagcuaauagaaaaaca

SEQ ID NO: 303111 - RNA, 64 nt, Homo Sapiens
gagaauugccauauuaauuuuuauaauggaaaacuuaauaaauugcuacuguuuuauaucauaa

SEQ ID NO: 303112 - RNA, 64 nt, Homo Sapiens
guuacuuaugauauauuuuguuuccucuugugguuuaauaaagugaagugugugugugugugug

SEQ ID NO: 303113 - RNA, 64 nt, Homo Sapiens
caugggacuguuugcaauaccauauggaaaucuuuuaauaaauauauguaaauaaaauaaaaaa

SEQ ID NO: 303114 - RNA, 64 nt, Homo Sapiens
auugagccacuuccuugaagaaucaaaauuccuguuaauaaaagaaaaacaaauguaauugaaa

SEQ ID NO: 303115 - RNA, 64 nt, Homo Sapiens
agcauucucuagucaauaucuuuagugaucuucuuuaauaaacuugaaagcaaagauuuugguu

SEQ ID NO: 303116 - RNA, 64 nt, Homo Sapiens
ucuucccacacacuuaccuuacuaagucuuugcuuuaauaaaugagcaacccuggguauagucu

SEQ ID NO: 303117 - RNA, 64 nt, Homo Sapiens
caccccauacuaccucacagauguguugugaggauuaauaaaauuaugucuaugguauuuucag

SEQ ID NO: 303118 - RNA, 64 nt, Homo Sapiens
uaaaaugcauaguaaaccacuaacguuagcuguuuuaauaaaaguuuucaguuauaaguuuagu

SEQ ID NO: 303119 - RNA, 64 nt, Homo Sapiens
uaauaaaaguuuucaguuauaaguuuaguaaauauuaauaaauggauacacauucaaaauacuu

SEQ ID NO: 303120 - RNA, 64 nt, Homo Sapiens
uauauguauguacguauuucagguccuugaaauuuuaauaaauauuacaguuaaauccugauau

SEQ ID NO: 303121 - RNA, 64 nt, Homo Sapiens
accacuuuauauaaaauugcaaugaaauguuucauuaauaaaaauuuauuucuacccuuaaugc

SEQ ID NO: 303122 - RNA, 64 nt, Homo Sapiens
cuuguauaguaauuuuguugugucuagcaaguauuuaauaaaccucugaaauuguucuuuuaug

SEQ ID NO: 303123 - RNA, 64 nt, Homo Sapiens
caaaacaacagcuggacugcuagcagagaauauuuuaauaaauguaaagacaaacauaacuauu

SEQ ID NO: 303124 - RNA, 64 nt, Homo Sapiens
cauuuaauagauaaaaacauggaagaugguguuguuaauaaagggaauuggaguaauagaaaau

SEQ ID NO: 303125 - RNA, 64 nt, Homo Sapiens
auucgaaauucauauuuuauaauuaaaucaucccuuaauaaaauaaagguuuuugaaauccagg

SEQ ID NO: 303126 - RNA, 64 nt, Homo Sapiens
gcaggguuacacaaaaaucuauuuguauuauuuuuuaauaaacuauaaauaaaaauuuauaagc

SEQ ID NO: 303127 - RNA, 64 nt, Homo Sapiens
caacauguugaaacaagagauuaaauuuacauuuuuaauaaaagacccaaaugccaagguaauu

SEQ ID NO: 303128 - RNA, 64 nt, Homo Sapiens
aaaaaaucuaaauuuuaacccagaaauuuaccuuuuaauaaauucauauuuucaggcaugguaa

SEQ ID NO: 303129 - RNA, 64 nt, Homo Sapiens
uuuggaaauugcuuuaaacccccaguuucucuuauuaauaaaacaauucuuuaaucuguccagu

SEQ ID NO: 303130 - RNA, 62 nt, Homo Sapiens
aaugugaaaaagagaaugucuauggaauuuguauuuaauaaaggaauuuuaaauuucuuuca

SEQ ID NO: 303131 - RNA, 64 nt, Homo Sapiens
acagaaccugaagaagucauuuagacacacuguguuaauaaauggaugaccagcagugacaauu

SEQ ID NO: 303132 - RNA, 64 nt, Homo Sapiens
gugccaucuguacauauuacuguugcauuuacuuuuaauaaagcuuguggccccuuuuacuuuu

SEQ ID NO: 303133 - RNA, 64 nt, Homo Sapiens
cuaagccaguuuucauuuugguuuuguguuuugguuaauaaaacaauacucaaauacaaaaggu

SEQ ID NO: 303134 - RNA, 64 nt, Homo Sapiens
gcaaaaaaucuauaauuugauucucauaaacauauuaauaaaguauaagugauguuuuauauga

SEQ ID NO: 303135 - RNA, 64 nt, Homo Sapiens
cauuaaauguaaauuuuacauaaaaguugugcucuuaauaaacauguaauauauaauuuaucaa

SEQ ID NO: 303136 - RNA, 64 nt, Homo Sapiens
ucuucauauacuucauuuuuuaauauaaauaauuuuaauaaauuuuauuuucuuauauucugcu

SEQ ID NO: 303137 - RNA, 64 nt, Homo Sapiens
gacauuuuuggugaauguuuagccauuuuuaauauuaauaaauugauguuaaguguuugauuca

SEQ ID NO: 303138 - RNA, 64 nt, Homo Sapiens
acauucucaaaacguaaauauuauuuuauuuuguuuaauaaagaugcuccaaaaaauauguuaa

SEQ ID NO: 303139 - RNA, 64 nt, Homo Sapiens
uaguuuaaucugaauauguaaaaauggucuuugauuaauaaacuucaagguuaaaauucugagu

SEQ ID NO: 303140 - RNA, 64 nt, Homo Sapiens
gaaagugauuuauaaaaucuaaagucugguuuacuuaauaaauuuguuuugaauguaaaguuga

SEQ ID NO: 303141 - RNA, 64 nt, Homo Sapiens
aauuaaaaaauuuuuaauguaacacaugaaauuauuaauaaaguaucacauauguucuucaaga

SEQ ID NO: 303142 - RNA, 64 nt, Homo Sapiens
accaaucaggcacauuuuaucuugacagauagaguuaauaaauucugccuacagaauauuauca

SEQ ID NO: 303143 - RNA, 64 nt, Homo Sapiens
ugcucuauuuuuacauuuaugaguuuuccuacuauuaauaaauguguuguuacuguaagcuuag

SEQ ID NO: 303144 - RNA, 64 nt, Homo Sapiens
auugaaacaguacugccuuauuuguuuccaacuguuaauaaagcaucaccuccaguuuguuggu

SEQ ID NO: 303145 - RNA, 64 nt, Homo Sapiens
aaaagagagagagagagagguugcuaagaugcauuuaauaaaaacuuucuuuuuuaaucuacuu

SEQ ID NO: 303146 - RNA, 64 nt, Homo Sapiens
guugcaauacucugacguuccaaagccaauacucuuaauaaaguuguuacuucagcuacugauu

SEQ ID NO: 303147 - RNA, 64 nt, Homo Sapiens
acaaaaaaguuugacuuuugacuguggaaugugcuuaauaaaaaauuauucaugacagcuuugu

SEQ ID NO: 303148 - RNA, 64 nt, Homo Sapiens
cuugauuucgugaccuugauuucuucccccaaauuuaauaaagacagaggguucucaugauuca

SEQ ID NO: 303149 - RNA, 64 nt, Homo Sapiens
uuaagugaauuaauauuuguaaaacgcuuagcucuuaauaaauguuucuguuguuauuauuaug

SEQ ID NO: 303150 - RNA, 64 nt, Homo Sapiens
aaaauguuaucuuuuaauuuauguuaaaauagcauuaauaaaucaguuauagguuaauguagau

SEQ ID NO: 303151 - RNA, 64 nt, Homo Sapiens
uucuuagccuccauaaucacaugagccaaucuccuuaauaaaugccugcucauagaucuguauc

SEQ ID NO: 303152 - RNA, 64 nt, Homo Sapiens
auuugcuuuccucugagauucuaagagaaggccuuuaauaaauuuaauaaauauugaguuagca

SEQ ID NO: 303153 - RNA, 64 nt, Homo Sapiens
ccucugagauucuaagagaaggccuuuaauaaauuuaauaaauauugaguuagcaccuucuuug

SEQ ID NO: 303154 - RNA, 64 nt, Homo Sapiens
ugccaguuuucacuuuuugaagcauugcaucuuuuuaauaaaucuauccugaaagcuauauaau

SEQ ID NO: 303155 - RNA, 64 nt, Homo Sapiens
aacauaaagggggaagaaacauaaagugguucucuuaauaaaacuagcagaaaauguugcuuua

SEQ ID NO: 303156 - RNA, 64 nt, Homo Sapiens
cauucucuuuguuuucauuuuccaaauauaaucuuuaauaaacuugauuuaguuucuugggaaa

SEQ ID NO: 303157 - RNA, 64 nt, Homo Sapiens
uuaaguguuugucauuuggacaaauugaaaacuuuuaauaaagccauuuucuucuuuguuaaaa

SEQ ID NO: 303158 - RNA, 64 nt, Homo Sapiens
auauucacuugaauauauggauauuaguaugcauuuaauaaaacuacucacauacuauagaaag

SEQ ID NO: 303159 - RNA, 64 nt, Homo Sapiens
uauacauuuuaauuuauuauauaucuaucuauauuuaauaaauaaauaaucauguucugguauu

SEQ ID NO: 303160 - RNA, 63 nt, Homo Sapiens
uaaaugaaauuacacuuuugcuguuuggaucauauuaauaaacccucaucucuuaagcuaaau

SEQ ID NO: 303161 - RNA, 64 nt, Homo Sapiens
acuuuaaauugucaccaauuuauuuuuauauuaguuaauaaaugucaugguucuauuguagauu

SEQ ID NO: 303162 - RNA, 64 nt, Homo Sapiens
ggacuuacugaagaguuacugaagccugugggacuuaauaaauacaauaugcuacucccuguug

SEQ ID NO: 303163 - RNA, 64 nt, Homo Sapiens
guaaauugucaacauguaauuuggaauuuucugauuaauaaaugugguuuuggacaucuuuucg

SEQ ID NO: 303164 - RNA, 64 nt, Homo Sapiens
uuuuuagugugauuuauacugaaaugugagccacuuaauaaagguucauauguucauauuaaua

SEQ ID NO: 303165 - RNA, 64 nt, Homo Sapiens
ugugagccacuuaauaaagguucauauguucauauuaauaaauauguuuucuguugagucugua

SEQ ID NO: 303166 - RNA, 64 nt, Homo Sapiens
uacagcccuuaucuagauuauauguauacuuguauuaauaaaaauguuauuuguacaaacauug

SEQ ID NO: 303167 - RNA, 64 nt, Homo Sapiens
aaugaaauccugaacuuuauucuguguaauuguguuaauaaauccuaauaaauuuaaauuuuua

SEQ ID NO: 303168 - RNA, 64 nt, Homo Sapiens
gccuacugaugcuucuuaugaucagaacucuuuuuuaauaaaauaaauaacauaaaucguugaa

SEQ ID NO: 303169 - RNA, 64 nt, Homo Sapiens
aguuucuagaacagugcuaugcacauauuagaucuuaauaaacauuugcugagugaaaguaaga

SEQ ID NO: 303170 - RNA, 64 nt, Homo Sapiens
ugaaccagaacaaaucacucgcuaaggaauaauuuuaauaaaagguguuucacuauaaggaaca

SEQ ID NO: 303171 - RNA, 64 nt, Homo Sapiens
aaggaaaacauaaugauguauaugggaaaauauuuuaauaaaacuaauaaauacuuuaauaaga

SEQ ID NO: 303172 - RNA, 64 nt, Homo Sapiens
cuuuaauaagauaugggaaacagggacagaaugcuuaauaaauaagaguauauacuaagcucua

SEQ ID NO: 303173 - RNA, 64 nt, Homo Sapiens
aaacuaguugugagauaacauucugguagcucaguuaauaaaacaauuucagaauuaaagaaau

SEQ ID NO: 303174 - RNA, 64 nt, Homo Sapiens
aaaaaagaacuguguuuuuaaacuguaggagaauuuaauaaaucagcaaggguauuuuagcuaa

SEQ ID NO: 303175 - RNA, 64 nt, Homo Sapiens
augaagcacuucacuuuuuuuuauucaaagccauuuaauaaaacacaguuggucagcccagugc

SEQ ID NO: 303176 - RNA, 64 nt, Homo Sapiens
uaucuucaccaguguucuaucuuguuccccuaaauuaauaaaauguuuuucuccaggauuuugg

SEQ ID NO: 303177 - RNA, 64 nt, Homo Sapiens
ccuguugcaauaacuuugcugaaauauuaacacauuaauaaaacuuuucuuaaacaaguugucu

SEQ ID NO: 303178 - RNA, 64 nt, Homo Sapiens
ucacagggguucuuaugaagguaaauuuaccagauuaauaaaaauuuaugaauauuaaaauuau

SEQ ID NO: 303179 - RNA, 64 nt, Homo Sapiens
gcuucuuaaaugguggcuguaacauaauaaauguuuaauaaaugcuuauaugaauggauuuuua

SEQ ID NO: 303180 - RNA, 64 nt, Homo Sapiens
gaacuuauuaaaagcuaucuaugauuuaauagauuuaauaaaauuccuucacgaccugguaccc

SEQ ID NO: 303181 - RNA, 64 nt, Homo Sapiens
cauaaaaggaaaaagguagcucucucgagucucuuuaauaaagauacuaauucucaugacugaa

SEQ ID NO: 303182 - RNA, 64 nt, Homo Sapiens
auauuagugccaaucaaauggaaaaaagguaguuuuaauaaacaagacacaacguuuuuauaca

SEQ ID NO: 303183 - RNA, 64 nt, Homo Sapiens
gaauacaaaaacuuuguuuugugugaucuuuucauuaauaaaauuaucuuuguauaagaauuau

SEQ ID NO: 303184 - RNA, 64 nt, Homo Sapiens
uuauuugugauguacuguaaauuuuguguuuaaguuaauaaaauuacagaauuuuucuucauua

SEQ ID NO: 303185 - RNA, 64 nt, Homo Sapiens
gguucaugaaucggagacuaguagauauauuuuauuaauaaaaucacaaagaauauagaugaua

SEQ ID NO: 303186 - RNA, 64 nt, Homo Sapiens
augacuuuguuuauuuaaaggucugccaauguacuuaauaaaaccauuuuggacagcacaugaa

SEQ ID NO: 303187 - RNA, 64 nt, Homo Sapiens
gcucugcucuuucuuguuuuuaagcaagaugcuauuaauaaacuguguuaauucccaugaaagu

SEQ ID NO: 303188 - RNA, 64 nt, Homo Sapiens
ccaucuaucaguaguauaggcacaugugaaaagcuuaauaaauucaauuaaaacuaugugcuau

SEQ ID NO: 303189 - RNA, 64 nt, Homo Sapiens
ucaacucaucauuuucuacugaggauguaaugcauuaauaaaaaagggguuggugauaacucuu

SEQ ID NO: 303190 - RNA, 64 nt, Homo Sapiens
uuuuaaauauuucuugguuuaauucuaauuuggguuaauaaagauuugagacaaacauuuuuau

SEQ ID NO: 303191 - RNA, 64 nt, Homo Sapiens
uauuuugguaacuaauguuuaguuuggccaacucuuaauaaaguguaauaguaauaauaguuga

SEQ ID NO: 303192 - RNA, 64 nt, Homo Sapiens
uuucagauaaacuggaguguucagauggacuguuuuaauaaaaaucuuugagcaagugaguuau

SEQ ID NO: 303193 - RNA, 64 nt, Homo Sapiens
cacauauguaauuuuaaauauucuaguagccacauuaauaaaguaaaaagaaacaggugagguu

SEQ ID NO: 303194 - RNA, 64 nt, Homo Sapiens
gagauucuguugugauuauuugaauaguuuuauauuaauaaaagaagacaaaauuuuuuaaaug

SEQ ID NO: 303195 - RNA, 64 nt, Homo Sapiens
uuuuuuggccucaaaaaaaucaaggguguaauuuuuaauaaauuguuaauccuauguuuuguaa

SEQ ID NO: 303196 - RNA, 64 nt, Homo Sapiens
cuucaagaaacuaaauugaucucguagaauuaucuuaauaaaauaauggcuauaauuucucugc

SEQ ID NO: 303197 - RNA, 64 nt, Homo Sapiens
aauaccuaauaaacugcccucaguaaauccaugguuaauaaaugugguuucuacauuaaccugc

SEQ ID NO: 303198 - RNA, 64 nt, Homo Sapiens
uuauucagaauugcguggcagcuguacauauuauuuaauaaacuuguguugaauuacuacauuu

SEQ ID NO: 303199 - RNA, 64 nt, Homo Sapiens
cuuguguuaaaauuugcauccaauuugcccgucuuuaauaaaaugaaauucagguaugccucac

SEQ ID NO: 303200 - RNA, 64 nt, Homo Sapiens
cuguuaauuuuuauacugacauuggagaaaguauuuaauaaaaccugaucuuauguguuacaaa

SEQ ID NO: 303201 - RNA, 64 nt, Homo Sapiens
gguaauauacaaaacaauuaauaacguuaauuuauuaauaaauuuugcuuucagggaaaauggu

SEQ ID NO: 303202 - RNA, 64 nt, Homo Sapiens
gugcuuuccucccucuccccugcccaccucaaguuuaauaaauaagguuguacuuuucuuacua

SEQ ID NO: 303203 - RNA, 64 nt, Homo Sapiens
cuugguuccuguaaaauuucaaauugaugugguauuaauaaaaaaaaaaaaaacacaaacaaug

SEQ ID NO: 303204 - RNA, 64 nt, Homo Sapiens
auaagguuuugaguuagcuggaaaagugaucagauuaauaaauguauauugguaguugaauuua

SEQ ID NO: 303205 - RNA, 64 nt, Homo Sapiens
accuugauagagaacuuuauaaacuucuuucucuuuaauaaagacuugucuuacaccgugcugc

SEQ ID NO: 303206 - RNA, 64 nt, Homo Sapiens
uguuuguaugugugaagcuaaauaaauauauuuuuuaauaaacaaugcagcagguguaaaaauu

SEQ ID NO: 303207 - RNA, 64 nt, Homo Sapiens
uauuuuuuaauaaacauguuagcagguguaaaaauuaauaaauauuaauagucuugugcuaugc

SEQ ID NO: 303208 - RNA, 64 nt, Homo Sapiens
aagacauuuuaugaaaucuucauugucaaaaccuuuaauaaaaguggaaauauuuugaaaugcc

SEQ ID NO: 303209 - RNA, 64 nt, Homo Sapiens
acauugagaauuucaacuagcuucugaucaauuuuuaauaaaaaauuuucaaaucauguuagcu

SEQ ID NO: 303210 - RNA, 64 nt, Homo Sapiens
guaaucucacuaauuuucaugauaaaugaaguuuuuaauaaaauauacuuguuauuaguaauuu

SEQ ID NO: 303211 - RNA, 64 nt, Homo Sapiens
cauguagggauaucagcguuucucugugugcuuguuaauaaaacuauauaaaaauuaaaauuuu

SEQ ID NO: 303212 - RNA, 64 nt, Homo Sapiens
caucagccaagcauuguuaguaguauaaauaugauuaauaaaaaugugcauggcuuuccugaag

SEQ ID NO: 303213 - RNA, 64 nt, Homo Sapiens
aauuucucaaagucuauuguuugaucuaguuauuuuaauaaaggaacucuagaaguuucaagug

SEQ ID NO: 303214 - RNA, 64 nt, Homo Sapiens
aacggaggaaaaaaaccccaaaccccaaacaaucuuaauaaacacgacugagcaagaaaguggc

SEQ ID NO: 303215 - RNA, 64 nt, Homo Sapiens
uucaagcauuuaaauacaucuuuuguaagguuuuuuaauaaaggcagauugagucaaguuuauu

SEQ ID NO: 303216 - RNA, 64 nt, Homo Sapiens
ggguguuacacuauuugauuuuggauuuauguuuuuaauaaaaguuucauucacuuuuuuacau

SEQ ID NO: 303217 - RNA, 64 nt, Homo Sapiens
ucugcuggauucuuucauuccacuuucaucuugcuuaauaaauauugaccuguguuuguaauuu

SEQ ID NO: 303218 - RNA, 64 nt, Homo Sapiens
uaugacacugaaaagauuugcauaacuuuauggcuuaauaaauguccacaagagcugaggguuu

SEQ ID NO: 303219 - RNA, 64 nt, Homo Sapiens
aauaaaggagaauuauucaauauauuucagucacuuaauaaaagauguagcuaaauaaaguaca

SEQ ID NO: 303220 - RNA, 64 nt, Homo Sapiens
uuucaagagaauuuugucuuuauuguuacuuauauuaauaaacugaccgaaaaguugaaugauu

SEQ ID NO: 303221 - RNA, 64 nt, Homo Sapiens
uaagaaaaauuaauacuaucuugaagagcuaauuuuaauaaaaaaagauuuguuaguaacaauc

SEQ ID NO: 303222 - RNA, 64 nt, Homo Sapiens
uuggauuuaauuuuauaaaaguaaccugaaauccuuaauaaaauauucuagaaauuugaaguau

SEQ ID NO: 303223 - RNA, 64 nt, Homo Sapiens
uacauugaauugauuuuuaguagauuuccugcucuuaauaaaauauugucauuagaggaagguc

SEQ ID NO: 303224 - RNA, 64 nt, Homo Sapiens
uguguaucacucugcucugacguuguagucuguguuaauaaacuaugccaggaggcuucauuga

SEQ ID NO: 303225 - RNA, 64 nt, Homo Sapiens
ugugauaaucaguuaucaguuaaaugaugagcauuuaauaaaauuuauuuucugugccaucugu

SEQ ID NO: 303226 - RNA, 64 nt, Homo Sapiens
gggcuugaacugagauuuaaaucuaauaaacaaguuaauaaauguguauguuuuguuguggguu

SEQ ID NO: 303227 - RNA, 64 nt, Homo Sapiens
ugcuugagacuuaagaggucauguugcuuuagguuuaauaaauagccuuaacuauuuggagggg

SEQ ID NO: 303228 - RNA, 64 nt, Homo Sapiens
aucaaaaaauuugcauuuauaauuuuaauuacaauuaauaaauguuaauaaauaggcccaugua

SEQ ID NO: 303229 - RNA, 64 nt, Homo Sapiens
ggcccauguaaauuuuaauuauuacacaauguccuuaauaaauaguuuaaaacaaaguggaaac

SEQ ID NO: 303230 - RNA, 64 nt, Homo Sapiens
gaggcuuuuuuagaggaagauauagaauaaugcauuaauaaaauauauaauagauaucuaucgc

SEQ ID NO: 303231 - RNA, 64 nt, Homo Sapiens
guuauuaugucaaccagugaaaaacguauuaucuuuaauaaaauuuggcagauuugauuuuuaa

SEQ ID NO: 303232 - RNA, 64 nt, Homo Sapiens
gggcuuggggacccaaugcaaagaugaugacuauuuaauaaaauggaaaauuuaauaaauccuc

SEQ ID NO: 303233 - RNA, 64 nt, Homo Sapiens
gcaaagaugaugacuauuuaauaaaauggaaaauuuaauaaauccucauuuuauuaacuaagau

SEQ ID NO: 303234 - RNA, 64 nt, Homo Sapiens
acuuuguacugagagaacuugcuuuggggugcaauuaauaaacugauuuuauuugggagaaaca

SEQ ID NO: 303235 - RNA, 64 nt, Homo Sapiens
auguagcucuuugaaucucagaaaaaaguagauuuuaauaaagugugaaaguugucaaucaaag

SEQ ID NO: 303236 - RNA, 64 nt, Homo Sapiens
aagccuaccuuauguaaauuuacagaauacgaauuuaauaaaggaaauugagaaauaucugaaa

SEQ ID NO: 303237 - RNA, 64 nt, Homo Sapiens
uaccuuauuuuguauuucacauucuaguaagaaauuaauaaaacgguaaauagauuuuaagcca

SEQ ID NO: 303238 - RNA, 64 nt, Homo Sapiens
uggauacaguuugaaagaaauauggaaaguaucuuuaauaaagcccugaaauaccaugauuguu

SEQ ID NO: 303239 - RNA, 64 nt, Homo Sapiens
uuuaggguuugguuuuuacuagaauuuguauuauuuaauaaaauagacuuacauguagugaaau

SEQ ID NO: 303240 - RNA, 64 nt, Homo Sapiens
uaugacaucugcaauguuuuauaaagcaacuaauuuaauaaaaucacuguugugaggacuuaaa

SEQ ID NO: 303241 - RNA, 64 nt, Homo Sapiens
ugggaguacaguucucuacguucucuacuaaaucuuaauaaaugcuugacauaguuacagcuuu

SEQ ID NO: 303242 - RNA, 64 nt, Homo Sapiens
uugcauuaagccaccugcuuuguaaguggauugauuaauaaauaacuuauauuucuauugucuu

SEQ ID NO: 303243 - RNA, 64 nt, Homo Sapiens
aauguaggcaaagcuuuguuacuuugaaauuuauuuaauaaaaguauuugugacauaaaccuga

SEQ ID NO: 303244 - RNA, 64 nt, Homo Sapiens
auuuuuuuuaauaacagaaucuuccaggagcauuuuaauaaaaguaugcaauaccaccugcucc

SEQ ID NO: 303245 - RNA, 64 nt, Homo Sapiens
aaaauuuugcuuauguuauuuaaagcauuuuggguuaauaaagcucaaagcccacuuuagaacc

SEQ ID NO: 303246 - RNA, 64 nt, Homo Sapiens
aaauguguaucuauguaacaucacuuaagugugcuuaauaaaucuucuguaaggauuuuagaug

SEQ ID NO: 303247 - RNA, 64 nt, Homo Sapiens
caugacuuuuggagcacuauuccauugucaguuauuaauaaagaauuccauugcuuagcuaacc

SEQ ID NO: 303248 - RNA, 64 nt, Homo Sapiens
uuagcuuuuaaucauuuuuaccaauuugaacaguuuaauaaacugguucugcucucuucugaau

SEQ ID NO: 303249 - RNA, 64 nt, Homo Sapiens
aauccaugugcccaggauuauauuagcauuauuuuuaauaaaucuauaugcuuaacauauuaga

SEQ ID NO: 303250 - RNA, 64 nt, Homo Sapiens
cuaugaaagaaucugugaauauauguaaauacguuuaauaaauuuuauuggucauguuaaauca

SEQ ID NO: 303251 - RNA, 64 nt, Homo Sapiens
uguuuaaugacuaguugauauuugugcauguuauuuaauaaagaguuauauuuuuauagaaaaa

SEQ ID NO: 303252 - RNA, 64 nt, Homo Sapiens
uauugaaguuuugguaaaaauucuuuuuucuuuuuuaauaaaaaauuagguuauuacuuuuuuu

SEQ ID NO: 303253 - RNA, 64 nt, Homo Sapiens
uuucuuugguugucccuauuaacaaaaaaguauuuuaauaaaaaauugaaaugagugagucaua

SEQ ID NO: 303254 - RNA, 64 nt, Homo Sapiens
augaagucaccguuacaguaacuugauguguauauuaauaaaaguaauucagucauuuuaguuu

SEQ ID NO: 303255 - RNA, 64 nt, Homo Sapiens
acuuuucuacacugaacauuuuuuuuaacuugauuuaauaaaaauguuaauuuuggaagugcag

SEQ ID NO: 303256 - RNA, 64 nt, Homo Sapiens
uuacaacaucauuaagguuugagaauuggcuauguuaauaaauaauucauaaaucuucuauauu

SEQ ID NO: 303257 - RNA, 64 nt, Homo Sapiens
aguuaaaaauuugucuuaugguccaucaggaccuuuaauaaaugauaaguuacuaguuuggaau

SEQ ID NO: 303258 - RNA, 64 nt, Homo Sapiens
ggcacugccccccuuuccugcccccuccucaucuuuaauaaagaccuggcuucucaucuuuaau

SEQ ID NO: 303259 - RNA, 64 nt, Homo Sapiens
uccucaucuuuaauaaagaccuggcuucucaucuuuaauaaagaccuguuuguaacagaaguuu

SEQ ID NO: 303260 - RNA, 64 nt, Homo Sapiens
ugcucacauuuuacucaacacagagaguuccugcuuaauaaaagcauuauaagugcaauuacug

SEQ ID NO: 303261 - RNA, 64 nt, Homo Sapiens
uauacgaguauaaaugaaauucauuucuaaauucuuaauaaauauuuucucaugccaggugugg

SEQ ID NO: 303262 - RNA, 64 nt, Homo Sapiens
cuguaugcacacaaacuagaaaaccuagaaaaaauuaauaaauuccuugaaagauauaaccccc

SEQ ID NO: 303263 - RNA, 64 nt, Homo Sapiens
gaccaugaucaucucuuuagaugcagaaagguuuuuaauaaaauucaacaucccuucauuuuaa

SEQ ID NO: 303264 - RNA, 64 nt, Homo Sapiens
gucuuugaaaguguaacuggaauauuguguaauuuuaauaaauaauaacuauuguuguuuuuau

SEQ ID NO: 303265 - RNA, 64 nt, Homo Sapiens
caauauaauacaauuauuauuugucaaucaaauauuaauaaaaucaaagaugagcaggucucuu

SEQ ID NO: 303266 - RNA, 64 nt, Homo Sapiens
uuuauggacacugagcuugaaucauggcuauguuuuaauaaaacuagacaaucauaaaugaaug

SEQ ID NO: 303267 - RNA, 64 nt, Homo Sapiens
uuuacagacacugaacuugaaucauggcuauguuuuaauaaaacuagacaaucauaaaugaaug

SEQ ID NO: 303268 - RNA, 64 nt, Homo Sapiens
agugaaagcaaauaugacagucuguaauauuucuuuaauaaaagggugggaguuguuauauuua

SEQ ID NO: 303269 - RNA, 64 nt, Homo Sapiens
gaagguucauaggagaaaaaaaugaauggcuuauuuaauaaaugugcuauugaaaucacugggg

SEQ ID NO: 303270 - RNA, 64 nt, Homo Sapiens
ucaaaaucacaauacuugggaugacaaauacuuuuuaauaaaugaguauccaaaaugguuacug

SEQ ID NO: 303271 - RNA, 64 nt, Homo Sapiens
cauuucaaguaaauauuugauccugcaaguaaucuuaauaaaauaaauguauuuggaggagaaa

SEQ ID NO: 303272 - RNA, 64 nt, Homo Sapiens
uacagugaugagcaugccuaguauggucaggaauuuaauaaaagcuaaggcuuauaaaauauga

SEQ ID NO: 303273 - RNA, 64 nt, Homo Sapiens
cauaaggcacagcacaucgcaagaugaacaguuguuaauaaaagcuguugcuggaaacuugcuu

SEQ ID NO: 303274 - RNA, 64 nt, Homo Sapiens
gcucaagaaccuuggaguucauauuucacaaauauuaauaaauauaaguccaagagcugucagc

SEQ ID NO: 303275 - RNA, 64 nt, Homo Sapiens
gucuccugcacagcaccugcagcauuguaacugcuuaauaaaugacaucucacugaacgaauga

SEQ ID NO: 303276 - RNA, 64 nt, Homo Sapiens
gcuuccauuguucuguuaagucuugaagaggaauuuaauaaagcaaagaaacuuuuuaaaaacg

SEQ ID NO: 303277 - RNA, 64 nt, Homo Sapiens
uuaguuguacauuuagccaguuucauaaaaaaaauuaauaaacuugaauaacaaucugaagucu

SEQ ID NO: 303278 - RNA, 64 nt, Homo Sapiens
gaaggaaugucuucaaucauauauagcuacaccuuuaauaaaauaguugagcauauucucuagu

SEQ ID NO: 303279 - RNA, 64 nt, Homo Sapiens
gauuuuauggauauaaauauuauugcuauguaauuuaauaaacugagaaaagguuugggaugua

SEQ ID NO: 303280 - RNA, 64 nt, Homo Sapiens
uuaucugagucacuugaaaccuucacccaugaaauuaauaaaacggcacugcuuuauccagggg

SEQ ID NO: 303281 - RNA, 64 nt, Homo Sapiens
cucaguaguguguucugaauucuauucaguuuguuuaauaaauagggaaaacuggcaacaugcu

SEQ ID NO: 303282 - RNA, 64 nt, Homo Sapiens
uaaauagggaaaacuggcaacaugcuaguuacuuuuaauaaaguaaucccugauucuauaccga

SEQ ID NO: 303283 - RNA, 64 nt, Homo Sapiens
aauaacagaacugccaaucagggccuaguuucuauuaauaaauuggauaaauuuaauaaaauaa

SEQ ID NO: 303284 - RNA, 64 nt, Homo Sapiens
cagggccuaguuucuauuaauaaauuggauaaauuuaauaaaauaagagugauacugaaagugc

SEQ ID NO: 303285 - RNA, 64 nt, Homo Sapiens
gaccaaaauguguugugcuccuauuuaaugucauuuaauaaaguuuuaguaguugaaacuuaaa

SEQ ID NO: 303286 - RNA, 64 nt, Homo Sapiens
uaggaaagaauaaagauuuaaaauugucauaaaauuaauaaauugccugcuuuuagcaaccaua

SEQ ID NO: 303287 - RNA, 64 nt, Homo Sapiens
acuccucuucaucuuauuaaugagcugccuuauuucuaaugaacauuauaaagaauuuggagau

SEQ ID NO: 303288 - RNA, 51 nt, Homo Sapiens
caaaaaauauucaucuguuggucuaaugaaaacucccgacauaggcuuuga

SEQ ID NO: 303289 - RNA, 64 nt, Homo Sapiens
gauaaauccuuaacauuucucuguguuugcauugucuaaugacaaacaaccuuuuacauuguga

SEQ ID NO: 303290 - RNA, 64 nt, Homo Sapiens
agaaaaaaaggaaaagaaguucggagaggccaagucuaaugaaggauaauaugagauuucuacu

SEQ ID NO: 303291 - RNA, 64 nt, Homo Sapiens
aacuaacacuuuaaaauuuaugaaugcucaaauuucuaaugagaauuaacuuccauugggcuaa

SEQ ID NO: 303292 - RNA, 64 nt, Homo Sapiens
aacuaccuauaauaggauaaacacaaugguuuuuucuaaugaaauaacauuacuucagaaguua

SEQ ID NO: 303293 - RNA, 64 nt, Homo Sapiens
aacaaaaagcuaacaucuuuugcaucuucuugcaucuaaugaaaguccaaccagacuuugagcc

SEQ ID NO: 303294 - RNA, 64 nt, Homo Sapiens
uagugucuuauggucuugauuugaauucuugaucucuaaugagcgacgaauaugaaugucacau

SEQ ID NO: 303295 - RNA, 64 nt, Homo Sapiens
uguaucauguaaugaacuaaugacuuguaaagacucuaaugauuaaaaaauccaaagacucuaa

SEQ ID NO: 303296 - RNA, 64 nt, Homo Sapiens
uguaaagacucuaaugauuuaaaaauccaaagacucuaaugacuacacaguaaaugggaguuua

SEQ ID NO: 303297 - RNA, 64 nt, Homo Sapiens
guuccaccauugcuggaaaaaccuaauuguagcaucuaaugaauaagaaucuaaugaaugugca

SEQ ID NO: 303298 - RNA, 64 nt, Homo Sapiens
gugcaaccuaauuguagcauggccaagugaagaaucuaaugaauagaugugagccagcacaccg

SEQ ID NO: 303299 - RNA, 64 nt, Homo Sapiens; identical to SEQ ID NO: 239630

SEQ ID NO: 303300 - RNA, 64 nt, Homo Sapiens; identical to SEQ ID NO: 239631

SEQ ID NO: 303301 - RNA, 64 nt, Homo Sapiens; identical to SEQ ID NO: 239632

SEQ ID NO: 303302 - RNA, 64 nt, Homo Sapiens; identical to SEQ ID NO: 239633

SEQ ID NO: 303303 - RNA, 64 nt, Homo Sapiens; identical to SEQ ID NO: 239634

SEQ ID NO: 303304 - RNA, 64 nt, Homo Sapiens; identical to SEQ ID NO: 239635

SEQ ID NO: 303305 - RNA, 64 nt, Homo Sapiens; identical to SEQ ID NO: 239636

SEQ ID NO: 303306 - RNA, 64 nt, Homo Sapiens; identical to SEQ ID NO: 239637

SEQ ID NO: 303307 - RNA, 64 nt, Homo Sapiens; identical to SEQ ID NO: 239638

SEQ ID NO: 303308 - RNA, 64 nt, Homo Sapiens; identical to SEQ ID NO: 239639

SEQ ID NO: 303309 - RNA, 64 nt, Homo Sapiens; identical to SEQ ID NO: 239640

SEQ ID NO: 303310 - RNA, 64 nt, Homo Sapiens; identical to SEQ ID NO: 239641

SEQ ID NO: 303311 - RNA, 64 nt, Homo Sapiens; identical to SEQ ID NO: 239642

SEQ ID NO: 303312 - RNA, 64 nt, Homo Sapiens; identical to SEQ ID NO: 239643

SEQ ID NO: 303313 - RNA, 64 nt, Homo Sapiens; identical to SEQ ID NO: 239644

SEQ ID NO: 303314 - RNA, 64 nt, Homo Sapiens; identical to SEQ ID NO: 239645

SEQ ID NO: 303315 - RNA, 64 nt, Homo Sapiens; identical to SEQ ID NO: 239646

SEQ ID NO: 303316 - RNA, 64 nt, Homo Sapiens; identical to SEQ ID NO: 239647

SEQ ID NO: 303317 - RNA, 64 nt, Homo Sapiens; identical to SEQ ID NO: 239648

SEQ ID NO: 303318 - RNA, 64 nt, Homo Sapiens; identical to SEQ ID NO: 239649

SEQ ID NO: 303319 - RNA, 64 nt, Homo Sapiens; identical to SEQ ID NO: 239650

SEQ ID NO: 303320 - RNA, 64 nt, Homo Sapiens; identical to SEQ ID NO: 239651

SEQ ID NO: 303321 - RNA, 64 nt, Homo Sapiens; identical to SEQ ID NO: 239652

SEQ ID NO: 303322 - RNA, 64 nt, Homo Sapiens; identical to SEQ ID NO: 239653

SEQ ID NO: 303323 - RNA, 64 nt, Homo Sapiens; identical to SEQ ID NO: 239654

SEQ ID NO: 303324 - RNA, 64 nt, Homo Sapiens; identical to SEQ ID NO: 239655

SEQ ID NO: 303325 - RNA, 64 nt, Homo Sapiens; identical to SEQ ID NO: 239656

SEQ ID NO: 303326 - RNA, 64 nt, Homo Sapiens; identical to SEQ ID NO: 239657

SEQ ID NO: 303327 - RNA, 64 nt, Homo Sapiens; identical to SEQ ID NO: 239658

SEQ ID NO: 303328 - RNA, 64 nt, Homo Sapiens; identical to SEQ ID NO: 239659

SEQ ID NO: 303329 - RNA, 64 nt, Homo Sapiens; identical to SEQ ID NO: 239660

SEQ ID NO: 303330 - RNA, 64 nt, Homo Sapiens; identical to SEQ ID NO: 239661

SEQ ID NO: 303331 - RNA, 64 nt, Homo Sapiens; identical to SEQ ID NO: 239662

SEQ ID NO: 303332 - RNA, 64 nt, Homo Sapiens; identical to SEQ ID NO: 239663

SEQ ID NO: 303333 - RNA, 64 nt, Homo Sapiens; identical to SEQ ID NO: 239664

SEQ ID NO: 303334 - RNA, 64 nt, Homo Sapiens; identical to SEQ ID NO: 239665

SEQ ID NO: 303335 - RNA, 64 nt, Homo Sapiens; identical to SEQ ID NO: 239666

SEQ ID NO: 303336 - RNA, 64 nt, Homo Sapiens; identical to SEQ ID NO: 239667

SEQ ID NO: 303337 - RNA, 64 nt, Homo Sapiens; identical to SEQ ID NO: 239668

SEQ ID NO: 303338 - RNA, 64 nt, Homo Sapiens; identical to SEQ ID NO: 239669

SEQ ID NO: 303339 - RNA, 64 nt, Homo Sapiens; identical to SEQ ID NO: 239670

SEQ ID NO: 303340 - RNA, 64 nt, Homo Sapiens; identical to SEQ ID NO: 239671

SEQ ID NO: 303341 - RNA, 64 nt, Homo Sapiens; identical to SEQ ID NO: 239672

SEQ ID NO: 303342 - RNA, 64 nt, Homo Sapiens; identical to SEQ ID NO: 239673

SEQ ID NO: 303343 - RNA, 64 nt, Homo Sapiens; identical to SEQ ID NO: 239674

SEQ ID NO: 303344 - RNA, 56 nt, Homo Sapiens; identical to SEQ ID NO: 239675

SEQ ID NO: 303345 - RNA, 64 nt, Homo Sapiens; identical to SEQ ID NO: 161898

SEQ ID NO: 303346 - RNA, 64 nt, Homo Sapiens; identical to SEQ ID NO: 161899

SEQ ID NO: 303347 - RNA, 64 nt, Homo Sapiens; identical to SEQ ID NO: 161900

SEQ ID NO: 303348 - RNA, 64 nt, Homo Sapiens; identical to SEQ ID NO: 161901

SEQ ID NO: 303349 - RNA, 64 nt, Homo Sapiens; identical to SEQ ID NO: 161902

SEQ ID NO: 303350 - RNA, 64 nt, Homo Sapiens; identical to SEQ ID NO: 161903

SEQ ID NO: 303351 - RNA, 64 nt, Homo Sapiens; identical to SEQ ID NO: 161904

SEQ ID NO: 303352 - RNA, 64 nt, Homo Sapiens; identical to SEQ ID NO: 161905

SEQ ID NO: 303353 - RNA, 64 nt, Homo Sapiens; identical to SEQ ID NO: 161906

SEQ ID NO: 303354 - RNA, 64 nt, Homo Sapiens; identical to SEQ ID NO: 161907

SEQ ID NO: 303355 - RNA, 64 nt, Homo Sapiens; identical to SEQ ID NO: 161908

SEQ ID NO: 303356 - RNA, 64 nt, Homo Sapiens; identical to SEQ ID NO: 161909

SEQ ID NO: 303357 - RNA, 64 nt, Homo Sapiens; identical to SEQ ID NO: 161910

SEQ ID NO: 303358 - RNA, 64 nt, Homo Sapiens; identical to SEQ ID NO: 161911

SEQ ID NO: 303359 - RNA, 64 nt, Homo Sapiens; identical to SEQ ID NO: 161912

SEQ ID NO: 303360 - RNA, 64 nt, Homo Sapiens; identical to SEQ ID NO: 161913

SEQ ID NO: 303361 - RNA, 64 nt, Homo Sapiens; identical to SEQ ID NO: 161914

SEQ ID NO: 303362 - RNA, 64 nt, Homo Sapiens; identical to SEQ ID NO: 161915

SEQ ID NO: 303363 - RNA, 64 nt, Homo Sapiens; identical to SEQ ID NO: 161916

SEQ ID NO: 303364 - RNA, 64 nt, Homo Sapiens; identical to SEQ ID NO: 161917

SEQ ID NO: 303365 - RNA, 64 nt, Homo Sapiens; identical to SEQ ID NO: 161918

SEQ ID NO: 303366 - RNA, 64 nt, Homo Sapiens; identical to SEQ ID NO: 161919

SEQ ID NO: 303367 - RNA, 64 nt, Homo Sapiens; identical to SEQ ID NO: 161920

SEQ ID NO: 303368 - RNA, 64 nt, Homo Sapiens; identical to SEQ ID NO: 161921

SEQ ID NO: 303369 - RNA, 64 nt, Homo Sapiens; identical to SEQ ID NO: 161922

SEQ ID NO: 303370 - RNA, 64 nt, Homo Sapiens; identical to SEQ ID NO: 161923

SEQ ID NO: 303371 - RNA, 64 nt, Homo Sapiens; identical to SEQ ID NO: 161919

SEQ ID NO: 303372 - RNA, 64 nt, Homo Sapiens; identical to SEQ ID NO: 161920

SEQ ID NO: 303373 - RNA, 63 nt, Homo Sapiens; identical to SEQ ID NO: 161926

SEQ ID NO: 303374 - RNA, 63 nt, Homo Sapiens; identical to SEQ ID NO: 161927

SEQ ID NO: 303375 - RNA, 63 nt, Homo Sapiens; identical to SEQ ID NO: 161928

SEQ ID NO: 303376 - RNA, 63 nt, Homo Sapiens; identical to SEQ ID NO: 161929

SEQ ID NO: 303377 - RNA, 63 nt, Homo Sapiens; identical to SEQ ID NO: 161930

SEQ ID NO: 303378 - RNA, 63 nt, Homo Sapiens; identical to SEQ ID NO: 161931

SEQ ID NO: 303379 - RNA, 63 nt, Homo Sapiens; identical to SEQ ID NO: 161932

SEQ ID NO: 303380 - RNA, 63 nt, Homo Sapiens; identical to SEQ ID NO: 161933

SEQ ID NO: 303381 - RNA, 63 nt, Homo Sapiens; identical to SEQ ID NO: 161934

SEQ ID NO: 303382 - RNA, 63 nt, Homo Sapiens; identical to SEQ ID NO: 161935

SEQ ID NO: 303383 - RNA, 63 nt, Homo Sapiens; identical to SEQ ID NO: 161936

SEQ ID NO: 303384 - RNA, 63 nt, Homo Sapiens; identical to SEQ ID NO: 161937

SEQ ID NO: 303385 - RNA, 63 nt, Homo Sapiens; identical to SEQ ID NO: 161938

SEQ ID NO: 303386 - RNA, 63 nt, Homo Sapiens; identical to SEQ ID NO: 161939

SEQ ID NO: 303387 - RNA, 63 nt, Homo Sapiens; identical to SEQ ID NO: 161940

SEQ ID NO: 303388 - RNA, 63 nt, Homo Sapiens; identical to SEQ ID NO: 161941

SEQ ID NO: 303389 - RNA, 63 nt, Homo Sapiens; identical to SEQ ID NO: 161942

SEQ ID NO: 303390 - RNA, 63 nt, Homo Sapiens; identical to SEQ ID NO: 161943

SEQ ID NO: 303391 - RNA, 63 nt, Homo Sapiens; identical to SEQ ID NO: 161944

SEQ ID NO: 303392 - RNA, 63 nt, Homo Sapiens; identical to SEQ ID NO: 161945

SEQ ID NO: 303393 - RNA, 63 nt, Homo Sapiens; identical to SEQ ID NO: 161946

SEQ ID NO: 303394 - RNA, 63 nt, Homo Sapiens; identical to SEQ ID NO: 161947

SEQ ID NO: 303395 - RNA, 63 nt, Homo Sapiens; identical to SEQ ID NO: 161948

SEQ ID NO: 303396 - RNA, 63 nt, Homo Sapiens; identical to SEQ ID NO: 161949

SEQ ID NO: 303397 - RNA, 63 nt, Homo Sapiens; identical to SEQ ID NO: 161950

SEQ ID NO: 303398 - RNA, 63 nt, Homo Sapiens; identical to SEQ ID NO: 161951

SEQ ID NO: 303399 - RNA, 64 nt, Homo Sapiens
caaagucacacauucagaacugucucuggcagucgaauaucacuagagaaaaguaaacagagaa

SEQ ID NO: 303400 - RNA, 64 nt, Homo Sapiens
acacacaguagccauuaguuagacucuucuuagugaauaucaggaacaucccaucugugcuuaa

SEQ ID NO: 303401 - RNA, 63 nt, Homo Sapiens
aaccauuuuuaagguuuucuuuuauauuuuauuugaauaucagauggcuuuggaauaaaucau

SEQ ID NO: 303402 - RNA, 64 nt, Homo Sapiens
ugacuguaauuccagaguguuaaauauuuuuguagaauaucauauuuuucagcuuuagaauuug

SEQ ID NO: 303403 - RNA, 64 nt, Homo Sapiens
guuacaguugucagugaaacagaagagaaaaauggaauaucagaauguccuagcuuagccauuc

SEQ ID NO: 303404 - RNA, 64 nt, Homo Sapiens
caguuccuguaauuuugugacguguauagucaucgaauaucagcuccaacauuauugagauugu

SEQ ID NO: 303405 - RNA, 64 nt, Homo Sapiens
uugggauuaauaauuauuuuuaauuuuucuggcugaauaucaaauugauaguaacaacagaagc

SEQ ID NO: 303406 - RNA, 64 nt, Homo Sapiens
caaaauuaacuuaugcucauauauuaggaugugagaauaucaucuguuuauggacacaugaaac

SEQ ID NO: 303407 - RNA, 64 nt, Homo Sapiens
uccauuucuaagcaguugaagaugaacacaaugugaauaucauuucauuuuaucgagaugccaa

SEQ ID NO: 303408 - RNA, 64 nt, Homo Sapiens
uauaaugauguaguaaaaagauagcaaugcuauggaauaucaagagccucuuauucuaaagucc

SEQ ID NO: 303409 - RNA, 64 nt, Homo Sapiens
auaaauaaggaaaauaaaucuacuucuguaaagagaauaucaauagaauuccauauugcuauag

SEQ ID NO: 303410 - RNA, 64 nt, Homo Sapiens
cuuuaaaaaccgccuuguaaccaaugaauuauuggaauaucacauguaauccacuaaagacgug

SEQ ID NO: 303411 - RNA, 64 nt, Homo Sapiens
ggaagguagaucuuaucuagccuuuggauuucaagaauaucauaguccuuuugauuuucaaagu

SEQ ID NO: 303412 - RNA, 64 nt, Homo Sapiens
gaauuaaugaaaacguagaagaaaguacuaaaaggaauaucauaagggcuguagcucaaacuuc

SEQ ID NO: 303413 - RNA, 64 nt, Homo Sapiens
auuugguauaaaauaacuagguuguuuugacuaggaauaucaaugagaaagaucuuaauuccuu

SEQ ID NO: 303414 - RNA, 64 nt, Homo Sapiens
aaaauguauauaggaauauguugaaagacaaccagaauaucaaguauuucucuguaaugcauug

SEQ ID NO: 303415 - RNA, 64 nt, Homo Sapiens
aaaggaauccuuucagcugccaguuuugaauaaugaauaucauauuguaucaucaaugcugaua

SEQ ID NO: 303416 - RNA, 64 nt, Homo Sapiens
acugaguuggucuuuagguuuaagauggauaaaugaauaucacuacuuguucugaaaacauguu

SEQ ID NO: 303417 - RNA, 64 nt, Homo Sapiens
auucugguuguauugggaacgcaugcaguccaaggaauaucaaacuuuaaucuuccucuagcag

SEQ ID NO: 303418 - RNA, 64 nt, Homo Sapiens
auucugauuguaugggaaccgcaugcaguccaaggaauaucaaacuuuaauuuuccucuagcag

SEQ ID NO: 303419 - RNA, 64 nt, Homo Sapiens
aaggauggggaucuuucaccuuuagggaucucagcacaauuagaaucguaaagugaauucuauc

SEQ ID NO: 303420 - RNA, 64 nt, Homo Sapiens
uuuggaaaugggugaccugaagugacacuuuuuccacaauuaacccaaguuguguuaauacuuc

SEQ ID NO: 303421 - RNA, 64 nt, Homo Sapiens
ugaauugagucccuggucuaagaagggaucuaagcacaauuaaguugacguaucaguacuucua

SEQ ID NO: 303422 - RNA, 64 nt, Homo Sapiens
gauuaugcuccccuuuucuugcuugguugaguaccacaauuaaauuucugcuguuuguuguccu

SEQ ID NO: 303423 - RNA, 64 nt, Homo Sapiens
auuuauaguuuucuugggaguaucacaggaaaaucacaauuacaccacuuuagacccuaugugu

SEQ ID NO: 303424 - RNA, 64 nt, Homo Sapiens
uaaaacauuuuuaaugaacuaaguugaauaaaggcacaauuaaaaacugucaucaaagcccagu

SEQ ID NO: 303425 - RNA, 64 nt, Homo Sapiens
aaggauuccagcagguuuaugucaauagaguguagaguuucagacuucacucaguugugcugag

SEQ ID NO: 303426 - RNA, 64 nt, Homo Sapiens
uuuuucauugaaucacagguauuagcaaaauuaggaguuucaucucaaaugguaugcucgcagc

SEQ ID NO: 303427 - RNA, 64 nt, Homo Sapiens
uuuaaaagugcgcaugauucaugaaauuuuaaaggaguuucaguauaugguuggauguccacug

SEQ ID NO: 303428 - RNA, 64 nt, Homo Sapiens
ggcaggggugauuccaacuuaggccucuuguggagaguuucacgcugggagcacaguuggcuac

SEQ ID NO: 303429 - RNA, 64 nt, Homo Sapiens
uuuaccauauuaguggucauuauuuaugcuuugagaguuucaauauuguucgucaaguuaacuu

SEQ ID NO: 303430 - RNA, 64 nt, Homo Sapiens
gauucagguucucaauaauaauauucaaguuuuagaguuucacuuuguacuauuuaaauuuaug

SEQ ID NO: 303431 - RNA, 64 nt, Homo Sapiens
cuuguuacccaggcuggaguuuuuuuuuuugacggaguuucacuuuguaccuuuuuuuuuuuuu

SEQ ID NO: 303432 - RNA, 64 nt, Homo Sapiens
ugaucacugcaguguugucaaugaauauuaucaagaguuucaugacgguagaaauuucuacaaa

SEQ ID NO: 303433 - RNA, 64 nt, Homo Sapiens
ccugauccuucuacaggauuuuuaaaaaguaagagaguuucagagaagccgaucccauaauccc

SEQ ID NO: 303434 - RNA, 64 nt, Homo Sapiens
agaaguagcuucucuguuuaaguuuaauaaaguugaguuucaccagucuucuauguccuaagug

SEQ ID NO: 303435 - RNA, 64 nt, Homo Sapiens
uuacaccgugcugccauuaaaggcagcuguucuagaguuucagucaccuaaguacacccacaaa

SEQ ID NO: 303436 - RNA, 64 nt, Homo Sapiens
gaucuacuuaugguugauggagcacauugauuuggaguuucagaucuuccaaagcacuauuugu

SEQ ID NO: 303437 - RNA, 64 nt, Homo Sapiens
uuaaaaaauauuuccuagggcuguaguuauuugggaguuucauaaccuguuauggugcuuuugg

SEQ ID NO: 303438 - RNA, 64 nt, Homo Sapiens
ugaagucauuacaaacuccuuguacauucacugugaguuucaaagggagucagucccuaauuua

SEQ ID NO: 303439 - RNA, 64 nt, Homo Sapiens
augguggucaggcuggucuuauuugguagagauggaguuucaccacacccagcuaauuuuuugu

SEQ ID NO: 303440 - RNA, 64 nt, Homo Sapiens
cuuguuguccagucuggaguuuuuuuuugagacagaguuucacuggacauagaucuuuuuuuuu

SEQ ID NO: 303441 - RNA, 64 nt, Homo Sapiens
auugccuucuaaauuaugauaaaacagaagugaagaguuucagagcaucagauugagugaaaag

SEQ ID NO: 303442 - RNA, 64 nt, Homo Sapiens
ucuuuucuuuccuuuuuuuuuuuuuuuugagacggaguuucacucuuguugcccaggcuggagu

SEQ ID NO: 303443 - RNA, 64 nt, Homo Sapiens
cuguugcccaggcuggaguguuuuuuucgagauggaguuucacuuuuuuuuuauuuaaaaaauu

SEQ ID NO: 303444 - RNA, 64 nt, Homo Sapiens
acaugugaauacuaccaaguaaaaaaagcaccuggaguuucaaaauuccaguuuuaaucauugu

SEQ ID NO: 303445 - RNA, 64 nt, Homo Sapiens; identical to SEQ ID NO: 47605

SEQ ID NO: 303446 - RNA, 64 nt, Homo Sapiens; identical to SEQ ID NO: 47606

SEQ ID NO: 303447 - RNA, 64 nt, Homo Sapiens; identical to SEQ ID NO: 47607

SEQ ID NO: 303448 - RNA, 64 nt, Homo Sapiens; identical to SEQ ID NO: 47608

SEQ ID NO: 303449 - RNA, 64 nt, Homo Sapiens; identical to SEQ ID NO: 47609

SEQ ID NO: 303450 - RNA, 64 nt, Homo Sapiens; identical to SEQ ID NO: 47610

SEQ ID NO: 303451 - RNA, 64 nt, Homo Sapiens; identical to SEQ ID NO: 47611

SEQ ID NO: 303452 - RNA, 64 nt, Homo Sapiens; identical to SEQ ID NO: 47612

SEQ ID NO: 303453 - RNA, 64 nt, Homo Sapiens; identical to SEQ ID NO: 47613

SEQ ID NO: 303454 - RNA, 64 nt, Homo Sapiens; identical to SEQ ID NO: 47614

SEQ ID NO: 303455 - RNA, 64 nt, Homo Sapiens; identical to SEQ ID NO: 47615

SEQ ID NO: 303456 - RNA, 64 nt, Homo Sapiens; identical to SEQ ID NO: 47616

SEQ ID NO: 303457 - RNA, 64 nt, Homo Sapiens; identical to SEQ ID NO: 47617

SEQ ID NO: 303458 - RNA, 64 nt, Homo Sapiens; identical to SEQ ID NO: 47618

SEQ ID NO: 303459 - RNA, 64 nt, Homo Sapiens; identical to SEQ ID NO: 47619

SEQ ID NO: 303460 - RNA, 64 nt, Homo Sapiens; identical to SEQ ID NO: 47620

SEQ ID NO: 303461 - RNA, 64 nt, Homo Sapiens; identical to SEQ ID NO: 47621

SEQ ID NO: 303462 - RNA, 64 nt, Homo Sapiens; identical to SEQ ID NO: 47622

SEQ ID NO: 303463 - RNA, 64 nt, Homo Sapiens; identical to SEQ ID NO: 47623

SEQ ID NO: 303464 - RNA, 64 nt, Homo Sapiens; identical to SEQ ID NO: 47624

SEQ ID NO: 303465 - RNA, 64 nt, Homo Sapiens; identical to SEQ ID NO: 47625

SEQ ID NO: 303466 - RNA, 64 nt, Homo Sapiens; identical to SEQ ID NO: 47626

SEQ ID NO: 303467 - RNA, 64 nt, Homo Sapiens; identical to SEQ ID NO: 47627

SEQ ID NO: 303468 - RNA, 64 nt, Homo Sapiens; identical to SEQ ID NO: 47628

SEQ ID NO: 303469 - RNA, 64 nt, Homo Sapiens; identical to SEQ ID NO: 47629

SEQ ID NO: 303470 - RNA, 64 nt, Homo Sapiens; identical to SEQ ID NO: 47630

SEQ ID NO: 303471 - RNA, 64 nt, Homo Sapiens; identical to SEQ ID NO: 47631

SEQ ID NO: 303472 - RNA, 64 nt, Homo Sapiens; identical to SEQ ID NO: 47632

SEQ ID NO: 303473 - RNA, 64 nt, Homo Sapiens; identical to SEQ ID NO: 47633

SEQ ID NO: 303474 - RNA, 64 nt, Homo Sapiens; identical to SEQ ID NO: 47634

SEQ ID NO: 303475 - RNA, 64 nt, Homo Sapiens; identical to SEQ ID NO: 47635

SEQ ID NO: 303476 - RNA, 64 nt, Homo Sapiens; identical to SEQ ID NO: 47636

SEQ ID NO: 303477 - RNA, 64 nt, Homo Sapiens; identical to SEQ ID NO: 47637

SEQ ID NO: 303478 - RNA, 64 nt, Homo Sapiens; identical to SEQ ID NO: 47638

SEQ ID NO: 303479 - RNA, 64 nt, Homo Sapiens; identical to SEQ ID NO: 47639

SEQ ID NO: 303480 - RNA, 64 nt, Homo Sapiens; identical to SEQ ID NO: 47640

SEQ ID NO: 303481 - RNA, 64 nt, Homo Sapiens; identical to SEQ ID NO: 47641

SEQ ID NO: 303482 - RNA, 64 nt, Homo Sapiens; identical to SEQ ID NO: 47642

SEQ ID NO: 303483 - RNA, 64 nt, Homo Sapiens; identical to SEQ ID NO: 47643

SEQ ID NO: 303484 - RNA, 64 nt, Homo Sapiens; identical to SEQ ID NO: 47644

SEQ ID NO: 303485 - RNA, 64 nt, Homo Sapiens; identical to SEQ ID NO: 47645

SEQ ID NO: 303486 - RNA, 64 nt, Homo Sapiens; identical to SEQ ID NO: 47646

SEQ ID NO: 303487 - RNA, 64 nt, Homo Sapiens; identical to SEQ ID NO: 47647

SEQ ID NO: 303488 - RNA, 64 nt, Homo Sapiens; identical to SEQ ID NO: 47648

SEQ ID NO: 303489 - RNA, 64 nt, Homo Sapiens; identical to SEQ ID NO: 47649

SEQ ID NO: 303490 - RNA, 64 nt, Homo Sapiens; identical to SEQ ID NO: 47650

SEQ ID NO: 303491 - RNA, 64 nt, Homo Sapiens; identical to SEQ ID NO: 47651

SEQ ID NO: 303492 - RNA, 64 nt, Homo Sapiens; identical to SEQ ID NO: 47652

SEQ ID NO: 303493 - RNA, 64 nt, Homo Sapiens; identical to SEQ ID NO: 47653

SEQ ID NO: 303494 - RNA, 64 nt, Homo Sapiens; identical to SEQ ID NO: 47654

SEQ ID NO: 303495 - RNA, 64 nt, Homo Sapiens; identical to SEQ ID NO: 47655

SEQ ID NO: 303496 - RNA, 64 nt, Homo Sapiens; identical to SEQ ID NO: 47656

SEQ ID NO: 303497 - RNA, 64 nt, Homo Sapiens; identical to SEQ ID NO: 47657

SEQ ID NO: 303498 - RNA, 64 nt, Homo Sapiens; identical to SEQ ID NO: 47658

SEQ ID NO: 303499 - RNA, 64 nt, Homo Sapiens; identical to SEQ ID NO: 47659

SEQ ID NO: 303500 - RNA, 64 nt, Homo Sapiens; identical to SEQ ID NO: 47660

SEQ ID NO: 303501 - RNA, 64 nt, Homo Sapiens; identical to SEQ ID NO: 47659

SEQ ID NO: 303502 - RNA, 64 nt, Homo Sapiens; identical to SEQ ID NO: 47662

SEQ ID NO: 303503 - RNA, 64 nt, Homo Sapiens; identical to SEQ ID NO: 47663

SEQ ID NO: 303504 - RNA, 64 nt, Homo Sapiens; identical to SEQ ID NO: 47664

SEQ ID NO: 303505 - RNA, 64 nt, Homo Sapiens; identical to SEQ ID NO: 47665

SEQ ID NO: 303506 - RNA, 64 nt, Homo Sapiens; identical to SEQ ID NO: 47666

SEQ ID NO: 303507 - RNA, 64 nt, Homo Sapiens; identical to SEQ ID NO: 47667

SEQ ID NO: 303508 - RNA, 64 nt, Homo Sapiens; identical to SEQ ID NO: 47668

SEQ ID NO: 303509 - RNA, 64 nt, Homo Sapiens; identical to SEQ ID NO: 47669

SEQ ID NO: 303510 - RNA, 64 nt, Homo Sapiens; identical to SEQ ID NO: 47670

SEQ ID NO: 303511 - RNA, 64 nt, Homo Sapiens; identical to SEQ ID NO: 47671

SEQ ID NO: 303512 - RNA, 64 nt, Homo Sapiens; identical to SEQ ID NO: 47672

SEQ ID NO: 303513 - RNA, 64 nt, Homo Sapiens; identical to SEQ ID NO: 47673

SEQ ID NO: 303514 - RNA, 64 nt, Homo Sapiens; identical to SEQ ID NO: 47674

SEQ ID NO: 303515 - RNA, 64 nt, Homo Sapiens
acacauauggcgaaagucaaguaucugaggccacuugcaacauugugacaaagaagauggaaga

SEQ ID NO: 303516 - RNA, 64 nt, Homo Sapiens
ucugaggccacuagugagauuucagaucucucuuuugcaacauuuuacccauuucccuucccca

SEQ ID NO: 303517 - RNA, 64 nt, Homo Sapiens
auuuucacaauuuuuuuguuuaagugugucaagguugcaacagauugaaaugacaaccuuuggu

SEQ ID NO: 303518 - RNA, 64 nt, Homo Sapiens
gcuauauuuuuucuauuuuauaaucauuuucccauugcaacagaagaaauugauuuuuuuguau

SEQ ID NO: 303519 - RNA, 64 nt, Homo Sapiens
aaaaacccaccauucucuucucccccuauuaaauuugcaacaauaaaggguggaggguaaucuc

SEQ ID NO: 303520 - RNA, 64 nt, Homo Sapiens
auugauuucuguacagucagaacaguacuuggguuugcaacagcuuucugagaaaagcuaggug

SEQ ID NO: 303521 - RNA, 64 nt, Homo Sapiens
gcaaaagccaagaaaguauauuuuuuuuuuuuaauugcaacaaucaauacugggcagccuuuuu

SEQ ID NO: 303522 - RNA, 64 nt, Homo Sapiens
aauucaucaaguaaucaugguauucucauugggguugcaacaauuuuuuuuuuuuguuccugug

SEQ ID NO: 303523 - RNA, 64 nt, Homo Sapiens
augaaaaagauggcuacugugcacgugaucaguguugcaacauagaaucagccauuuuaucgag

SEQ ID NO: 303524 - RNA, 64 nt, Homo Sapiens
guuaggaaguuuguuguuuggguagucaagccuauugcaacaaaugcauuuggccaaaugaaau

SEQ ID NO: 303525 - RNA, 64 nt, Homo Sapiens
caaacggaagucuuaaaaacuuugaauguaaaaguugcaacacaugaaauguaagagaucuggu

SEQ ID NO: 303526 - RNA, 64 nt, Homo Sapiens
augacagguuuaagucagucuaggauggugaauguugcaacacagaucauuuuuccccccaccu

SEQ ID NO: 303527 - RNA, 64 nt, Homo Sapiens
gccaguaguuaaaccaaacuguauucgaggauuauugcaacaaaccaaaagcugccacugugug

SEQ ID NO: 303528 - RNA, 64 nt, Homo Sapiens
uucugcaugguccagcgcucucugucugaaguucuugcaacaaaccaucucuaguuuuuccacg

SEQ ID NO: 303529 - RNA, 64 nt, Homo Sapiens
aacuuugaaguuaauacuuuaaguuccucaagaaucuccuuaaacaguauguauauauuguguu

SEQ ID NO: 303530 - RNA, 64 nt, Homo Sapiens
auaaauguuucuugguugacuuuaugcaguaagcucuccuuaccgaauauauuaucaauacagu

SEQ ID NO: 303531 - RNA, 64 nt, Homo Sapiens
gaagaucccuggaaaggaugacaugagcuguuucucuccuuaaacaugaugggcacagagcauc

SEQ ID NO: 303532 - RNA, 64 nt, Homo Sapiens
caauuauauuucaccuuuuauggccaucaauaucucuccuuaaauccuuaggccauaucaacuu

SEQ ID NO: 303533 - RNA, 64 nt, Homo Sapiens
agaugucauuugucucccgcccuaaguccuccagucuccuuagagcuaguacuuacuaagcauu

SEQ ID NO: 303534 - RNA, 64 nt, Homo Sapiens
gcagaagagacacuuuccuauuuugccuaauaggucuccuuauaugcaucuguaguuaacauuc

SEQ ID NO: 303535 - RNA, 64 nt, Homo Sapiens
aagucuccugucuuaugguccagaaacuccuguuucuccuuaguuggcuggaaacugcucccau

SEQ ID NO: 303536 - RNA, 64 nt, Homo Sapiens
ggccugugaaucaauccugggcaaucagacacccucuccuuaaaaacuggcccguggagacuga

SEQ ID NO: 303537 - RNA, 64 nt, Homo Sapiens
auaaaugcaauuuuaguggaauugauugacagugucuccuuacuuugaaguuuucaccaaagca

SEQ ID NO: 303538 - RNA, 64 nt, Homo Sapiens
guucauuuuuuuugucuuucccaaaucuugguagucuccuuauaguugaagauaaaauguugag

SEQ ID NO: 303539 - RNA, 64 nt, Homo Sapiens
agacaaaucuucaugcagacuggacuucuccuccugguagcacuuugcucugucauccuuuuug

SEQ ID NO: 303540 - RNA, 64 nt, Homo Sapiens
aguugaaauggacuguccauugacguuccuaaugugguagcagaaaaaaaaaaauggugucuua

SEQ ID NO: 303541 - RNA, 64 nt, Homo Sapiens
aagcucuggcccugcccuguauuccucuuccccuugguagcaguucccugaccaagggcaaggu

SEQ ID NO: 303542 - RNA, 64 nt, Homo Sapiens
uauaaauaaagcaaauaaaguugaguguuccacaugguagcauuugcuaacacuuccuaauucu

SEQ ID NO: 303543 - RNA, 64 nt, Homo Sapiens; identical to SEQ ID NO: 97744

SEQ ID NO: 303544 - RNA, 64 nt, Homo Sapiens; identical to SEQ ID NO: 97745

SEQ ID NO: 303545 - RNA, 64 nt, Homo Sapiens; identical to SEQ ID NO: 97746

SEQ ID NO: 303546 - RNA, 64 nt, Homo Sapiens; identical to SEQ ID NO: 97747

SEQ ID NO: 303547 - RNA, 64 nt, Homo Sapiens; identical to SEQ ID NO: 97748

SEQ ID NO: 303548 - RNA, 64 nt, Homo Sapiens; identical to SEQ ID NO: 97749

SEQ ID NO: 303549 - RNA, 64 nt, Homo Sapiens; identical to SEQ ID NO: 97750

SEQ ID NO: 303550 - RNA, 64 nt, Homo Sapiens; identical to SEQ ID NO: 97751

SEQ ID NO: 303551 - RNA, 64 nt, Homo Sapiens; identical to SEQ ID NO: 97752

SEQ ID NO: 303552 - RNA, 64 nt, Homo Sapiens; identical to SEQ ID NO: 97753

SEQ ID NO: 303553 - RNA, 64 nt, Homo Sapiens; identical to SEQ ID NO: 97754

SEQ ID NO: 303554 - RNA, 64 nt, Homo Sapiens; identical to SEQ ID NO: 97755

SEQ ID NO: 303555 - RNA, 64 nt, Homo Sapiens; identical to SEQ ID NO: 97756

SEQ ID NO: 303556 - RNA, 64 nt, Homo Sapiens; identical to SEQ ID NO: 97757

SEQ ID NO: 303557 - RNA, 64 nt, Homo Sapiens; identical to SEQ ID NO: 97758

SEQ ID NO: 303558 - RNA, 64 nt, Homo Sapiens; identical to SEQ ID NO: 97759

SEQ ID NO: 303559 - RNA, 64 nt, Homo Sapiens; identical to SEQ ID NO: 97760

SEQ ID NO: 303560 - RNA, 64 nt, Homo Sapiens; identical to SEQ ID NO: 97761

SEQ ID NO: 303561 - RNA, 64 nt, Homo Sapiens; identical to SEQ ID NO: 97762

SEQ ID NO: 303562 - RNA, 64 nt, Homo Sapiens; identical to SEQ ID NO: 97763

SEQ ID NO: 303563 - RNA, 64 nt, Homo Sapiens; identical to SEQ ID NO: 97764

SEQ ID NO: 303564 - RNA, 64 nt, Homo Sapiens; identical to SEQ ID NO: 97765

SEQ ID NO: 303565 - RNA, 64 nt, Homo Sapiens; identical to SEQ ID NO: 97766

SEQ ID NO: 303566 - RNA, 64 nt, Homo Sapiens; identical to SEQ ID NO: 97767

SEQ ID NO: 303567 - RNA, 64 nt, Homo Sapiens; identical to SEQ ID NO: 97768

SEQ ID NO: 303568 - RNA, 64 nt, Homo Sapiens; identical to SEQ ID NO: 97769

SEQ ID NO: 303569 - RNA, 64 nt, Homo Sapiens; identical to SEQ ID NO: 97770

SEQ ID NO: 303570 - RNA, 64 nt, Homo Sapiens; identical to SEQ ID NO: 97771

SEQ ID NO: 303571 - RNA, 64 nt, Homo Sapiens; identical to SEQ ID NO: 97772

SEQ ID NO: 303572 - RNA, 64 nt, Homo Sapiens; identical to SEQ ID NO: 97773

SEQ ID NO: 303573 - RNA, 64 nt, Homo Sapiens; identical to SEQ ID NO: 97774

SEQ ID NO: 303574 - RNA, 64 nt, Homo Sapiens; identical to SEQ ID NO: 97775

SEQ ID NO: 303575 - RNA, 64 nt, Homo Sapiens; identical to SEQ ID NO: 97776

SEQ ID NO: 303576 - RNA, 64 nt, Homo Sapiens; identical to SEQ ID NO: 97777

SEQ ID NO: 303577 - RNA, 64 nt, Homo Sapiens; identical to SEQ ID NO: 97778

SEQ ID NO: 303578 - RNA, 64 nt, Homo Sapiens; identical to SEQ ID NO: 97779

SEQ ID NO: 303579 - RNA, 64 nt, Homo Sapiens; identical to SEQ ID NO: 97780

SEQ ID NO: 303580 - RNA, 64 nt, Homo Sapiens; identical to SEQ ID NO: 97781

SEQ ID NO: 303581 - RNA, 64 nt, Homo Sapiens; identical to SEQ ID NO: 97782

SEQ ID NO: 303582 - RNA, 64 nt, Homo Sapiens; identical to SEQ ID NO: 97783

SEQ ID NO: 303583 - RNA, 64 nt, Homo Sapiens; identical to SEQ ID NO: 97784

SEQ ID NO: 303584 - RNA, 64 nt, Homo Sapiens; identical to SEQ ID NO: 97785

SEQ ID NO: 303585 - RNA, 64 nt, Homo Sapiens; identical to SEQ ID NO: 103765

SEQ ID NO: 303586 - RNA, 64 nt, Homo Sapiens; identical to SEQ ID NO: 103766

SEQ ID NO: 303587 - RNA, 53 nt, Homo Sapiens; identical to SEQ ID NO: 103767

SEQ ID NO: 303588 - RNA, 64 nt, Homo Sapiens; identical to SEQ ID NO: 103768

SEQ ID NO: 303589 - RNA, 64 nt, Homo Sapiens; identical to SEQ ID NO: 103769

SEQ ID NO: 303590 - RNA, 64 nt, Homo Sapiens; identical to SEQ ID NO: 103770

SEQ ID NO: 303591 - RNA, 53 nt, Homo Sapiens; identical to SEQ ID NO: 103771

SEQ ID NO: 303592 - RNA, 64 nt, Homo Sapiens; identical to SEQ ID NO: 103772

SEQ ID NO: 303593 - RNA, 64 nt, Homo Sapiens; identical to SEQ ID NO: 103773

SEQ ID NO: 303594 - RNA, 64 nt, Homo Sapiens; identical to SEQ ID NO: 103774

SEQ ID NO: 303595 - RNA, 64 nt, Homo Sapiens; identical to SEQ ID NO: 103775

SEQ ID NO: 303596 - RNA, 64 nt, Homo Sapiens; identical to SEQ ID NO: 103776

SEQ ID NO: 303597 - RNA, 63 nt, Homo Sapiens
uggauuugcuuuaacccucacauuuuuuuuuuaauguuucacauguuacauuauuagcugaau

SEQ ID NO: 303598 - RNA, 63 nt, Homo Sapiens
ggcagucuggcgcccaugaugggagggauugacauguuucaacaaaauaaugcacuuccuuac

SEQ ID NO: 303599 - RNA, 63 nt, Homo Sapiens
uuuucuuaaauccaaguuggccguuuuauuaguauguuucaaauguguauuaccaaugugggu

SEQ ID NO: 303600 - RNA, 63 nt, Homo Sapiens
aauaucuccaugcauaguuuuagacaaaaaaagauguuucaauaaaauuacugucuuguaaua

SEQ ID NO: 303601 - RNA, 63 nt, Homo Sapiens
cucaaccaauuuggcaccccaugcagccucaaaauguuucaaaugccuaccgccucuagaucg

SEQ ID NO: 303602 - RNA, 63 nt, Homo Sapiens
ggcuucuuuucucccuugauggucaagucucuuauguuucaauauuucuuaacuggggugucu

SEQ ID NO: 303603 - RNA, 63 nt, Homo Sapiens
augucaugaaugauuuccaguuuuuaaagcuauauguuucacugcuucauaucucuguccacu

SEQ ID NO: 303604 - RNA, 63 nt, Homo Sapiens
cgcacacaugauuuugauuaugcuacaugauauauguuucaaaaagaauuagcauagaaaucc

SEQ ID NO: 303605 - RNA, 63 nt, Homo Sapiens
agguaggggauugcugggccauaugauaagcauauguuucaguucuaccaaucuuguuuccag

SEQ ID NO: 303606 - RNA, 63 nt, Homo Sapiens
agaaaaacauuaaaaaguucauuccuuaacacaauguuucaaguuaaaccuuuugugucaccg

SEQ ID NO: 303607 - RNA, 63 nt, Homo Sapiens
uuugauaaauauccucucaguguuuuaucuuccauguuucaacaacuauugaaauaugaaaug

SEQ ID NO: 303608 - RNA, 63 nt, Homo Sapiens
gguuucucuguauaguacuggcaugguacggagauguuucacgaaguuuguucaucagacucc

SEQ ID NO: 303609 - RNA, 63 nt, Homo Sapiens
gugcuugccugaaauaaagcuaauaaaaauauuauguuucacauuaucuucuguucauuuuga

SEQ ID NO: 303610 - RNA, 63 nt, Homo Sapiens
aaaaugcaaaucgacuuuuuaacaacuguugagauguuucaugggacaguagaacucugacuc

SEQ ID NO: 303611 - RNA, 63 nt, Homo Sapiens
cacgcuugguuaauuuuuguauuuuuaguagagauguuucaccauguuggccaggcuagucuu

SEQ ID NO: 303612 - RNA, 63 nt, Homo Sapiens
ccggguguuguauguguggugacuugcggauuuauguuucaguguacuggaaacuuuccauuu

SEQ ID NO: 303613 - RNA, 63 nt, Homo Sapiens
ugauuuuguaaauuucaguaauucauuuaaaugauguuucaguagauauauucuagcauauua

SEQ ID NO: 303614 - RNA, 63 nt, Homo Sapiens
auccaaaauuaugauaacuguauuucuagggguauguuucaccuugauuuuggcccgguucuu

SEQ ID NO: 303615 - RNA, 63 nt, Homo Sapiens
cuacuugguaacaaaguucucagauguuaggucauguuucauuugcucagucggggaucacuc

SEQ ID NO: 303616 - RNA, 63 nt, Homo Sapiens
uagcaggugaacuguuccaagacugacacaaggauguuucaaacuugccucugucuguagaaa

SEQ ID NO: 303617 - RNA, 63 nt, Homo Sapiens
cguauuauauagagaaacaaauguuuuuauuaaauguuucauugacccaaguaauuuaaaagu

SEQ ID NO: 303618 - RNA, 63 nt, Homo Sapiens
guuuuucauacucuuaaguguaaauaauauaaaauguuucaagcgcuuaacucccccucauuc

SEQ ID NO: 303619 - RNA, 63 nt, Homo Sapiens
uagagcuuuagaaauuuguaagcugagagaacaauguuucacuuaauaggagggugucuuagu

SEQ ID NO: 303620 - RNA, 63 nt, Homo Sapiens
uacucuuucuuuuaagauaaguuguagacuucgauguuucaugcucauguacuucaaauaaug

SEQ ID NO: 303621 - RNA, 61 nt, Homo Sapiens
gaaaucuguuaaaauaaaauuguacauuuggagauguuucaugaugauguguuuauuucua

SEQ ID NO: 303622 - RNA, 63 nt, Homo Sapiens
aaacuugugacuuguguauuaucgucauugaggauguuucacucaugucugucauuuuauaag

SEQ ID NO: 303623 - RNA, 63 nt, Homo Sapiens
augguaaguucccuuagcuauaugaauuuuggcauguuucagagagaucaguaaauaaaauau

SEQ ID NO: 303624 - RNA, 63 nt, Homo Sapiens
augcggagacguaaagcauuaaugcaaguuaaaauguuucagugaacaaguuucagcgguuca

SEQ ID NO: 303625 - RNA, 63 nt, Homo Sapiens
uuaauuucuugaaaauguaugaaguaaauuuuaauguuucauacuagaaaacuuuggauuuuu

SEQ ID NO: 303626 - RNA, 63 nt, Homo Sapiens
ucugguuuaaccaggcuuuuugggaaaccauguauguuucauuagacucagaaggggaagcau

SEQ ID NO: 303627 - RNA, 63 nt, Homo Sapiens
aggcuggaggaagggggguuaaaggauagugcgauguuucaggucuauauggaauugcuuacc

SEQ ID NO: 303628 - RNA, 63 nt, Homo Sapiens
acuauaauuuaauugggaaaauuccucuauuagauguuucaacagucaacuuaccuauuaaau

SEQ ID NO: 303629 - RNA, 63 nt, Homo Sapiens
augcacuuuuagaaaugcaucuagaaaaauaaaauguuucauuuucuaugacaaauucaagag

SEQ ID NO: 303630 - RNA, 63 nt, Homo Sapiens
uucucugcugugaaacucuucuauaaccugaaaauguuucauggugacaccaaaaagaaaagu

SEQ ID NO: 303631 - RNA, 63 nt, Homo Sapiens
auuauaagaaaggcagaauguucuaaagaaaauauguuucagcuuugucguguuuguuuuaac

SEQ ID NO: 303632 - RNA, 63 nt, Homo Sapiens
ugcagucugaugccagguaucauguguugacccauguuucagagaaacaugcucagucaugca

SEQ ID NO: 303633 - RNA, 63 nt, Homo Sapiens
gucaagcccacauugcuuuucccaauaaagcacauguuucauguguuuauucuuuugcuucuc

SEQ ID NO: 303634 - RNA, 63 nt, Homo Sapiens
guccuuucuucucugucccuuuaccauguguggauguuucaguaaggcaaaccuggcuuuuga

SEQ ID NO: 303635 - RNA, 56 nt, Homo Sapiens
aggagcccccacccuguuccccaccaauguuucaagcccucccucacagccuguag

SEQ ID NO: 303636 - RNA, 63 nt, Homo Sapiens
gguuugugaugaucuuuacguuguuugggaaugauguuucauacuagauacuauuacgcuauc

SEQ ID NO: 303637 - RNA, 63 nt, Homo Sapiens
cucugauugccccaauaaaacguguaaaaaaugauguuucaucaauccuagaccuuuucauga

SEQ ID NO: 303638 - RNA, 63 nt, Homo Sapiens
uuucaauuuuuuuucagauucuugggauuagaaauguuucagaagcaucccuugucugaaaug

SEQ ID NO: 303639 - RNA, 63 nt, Homo Sapiens
ucugugucaugguuggaagaagauuuuuaaaguauguuucaguaccgugccuagccaaggaug

SEQ ID NO: 303640 - RNA, 63 nt, Homo Sapiens
gcaacugcuuuauaugacugucucacuuuucacauguuucauaauccacaauuaaaccauguu

SEQ ID NO: 303641 - RNA, 63 nt, Homo Sapiens
gugaaugcaaaaaagagagaaagugacacuuaaauguuucagacuaacccugauaguuaccua

SEQ ID NO: 303642 - RNA, 51 nt, Homo Sapiens
aacuacaaagcugaagaaaagauguuucacagcacucggagagaagucuag

SEQ ID NO: 303643 - RNA, 63 nt, Homo Sapiens
gccucagacaaauguguauuguuguguaugcgaauguuucagugacaaaaccugggaauuugg

SEQ ID NO: 303644 - RNA, 63 nt, Homo Sapiens
auagacaaguuuuguuuccuuuauaguuauuaaauguuucaaaugugucucaggcucaaguuu

SEQ ID NO: 303645 - RNA, 63 nt, Homo Sapiens
aaugcaguucucacgaaaguuuauaaaguucagauguuucaucugaguuauuccacaaacaca

SEQ ID NO: 303646 - RNA, 63 nt, Homo Sapiens
uuugcugugcuuuucugaauguucagcuuuucaauguuucauguaacaaacaaaagaaaugua

SEQ ID NO: 303647 - RNA, 63 nt, Homo Sapiens
ugcuuaaauauauaauacaucugcagcuauagaauguuucaaaacuuucugcugugaacugaa

SEQ ID NO: 303648 - RNA, 61 nt, Homo Sapiens
cucugugucuguuuuuaauugaaauaaaaaaugauguuucauugaauguagauacucagaa

SEQ ID NO: 303649 - RNA, 63 nt, Homo Sapiens
aaaauaaagcuuaaaaauuggagggaaucugaaauguuucauauuauugaugugcugugauau

SEQ ID NO: 303650 - RNA, 63 nt, Homo Sapiens
aacauuguagauaucuauuuauauuuaaaguuuauguuucaugaacugcagcugcaggauucu

SEQ ID NO: 303651 - RNA, 63 nt, Homo Sapiens
gccuuuuaaguaguuugaaugauaagacuuaaaauguuucauaauuauguuuuauguaacaga

SEQ ID NO: 303652 - RNA, 63 nt, Homo Sapiens
uguacugauaguacuucccaguaugauauugugauguuucauacaaugcagugaacauaacca

SEQ ID NO: 303653 - RNA, 63 nt, Homo Sapiens
ucuuaacuaauugcgguuucauaggauauauaaauguuucaagccauuauugcugaaugguuc

SEQ ID NO: 303654 - RNA, 63 nt, Homo Sapiens
auguaagcauguauacacugugcuaaaagucacauguuucaguuuguguauaauauuaauaug

SEQ ID NO: 303655 - RNA, 63 nt, Homo Sapiens
aacaggaaaaaauaauuauaagaugauaagcaaauguuucagcccaaugucaacccaguuaaa

SEQ ID NO: 303656 - RNA, 63 nt, Homo Sapiens
gcugccauaguuuucuaacuugaacagccaugaauguuucaugucucccuuuuuuuuugucua

SEQ ID NO: 303657 - RNA, 63 nt, Homo Sapiens
cauguuguccuuucuggcuucccugauggugucauguuucagcgcaugcgccccagccuuucc

SEQ ID NO: 303658 - RNA, 63 nt, Homo Sapiens
ugaauccuugugguuuuuaguuuuguauaaauuauguuucaaaucuuuacauuuuggaaauaa

SEQ ID NO: 303659 - RNA, 63 nt, Homo Sapiens
acuuuuuggggaaguaaaagaagauggaaauggauguuucauuuguaugaguuuggagcagug

SEQ ID NO: 303660 - RNA, 63 nt, Homo Sapiens
cuauucuuucccuagaggcaaacauuucuuaaaauguuucauuuucauuaaaaaugaaagcca

SEQ ID NO: 303661 - RNA, 63 nt, Homo Sapiens
accauaccaacuggaauuuaggcuuuaaaaauaauguuucaaggccagguguggugauucaug

SEQ ID NO: 303662 - RNA, 63 nt, Homo Sapiens
uuuuguguauuuauacuuguauguaugauuugcauguuucaaugauaaagggauaaaacagua

SEQ ID NO: 303663 - RNA, 63 nt, Homo Sapiens
ccauagauugcugucccccucgacggacuuauaauguuucagguggcuggcuugaacaugagu

SEQ ID NO: 303664 - RNA, 63 nt, Homo Sapiens
cugcuaaguuguaccuuaauuagagggcaauauauguuucauaaagaagagucuuuauaauuu

SEQ ID NO: 303665 - RNA, 63 nt, Homo Sapiens
aguugaccuagauuguauuaauagcuacuuaagauguuucaaagauaggaagcuauugcuugg

SEQ ID NO: 303666 - RNA, 63 nt, Homo Sapiens
aagggagagaacaaaagcuauaccaaaagggccauguuucaagaaaauggauuuaaacauauu

SEQ ID NO: 303667 - RNA, 63 nt, Homo Sapiens
caaucagaccagguaggagcuuuccuguuucauauguuucaggguugcacaguuggucucuuu

SEQ ID NO: 303668 - RNA, 63 nt, Homo Sapiens
ggcaugaaaauuuucuuaagcuaaaauacagacauguuucaaagggcuaaaguuggagaugag

SEQ ID NO: 303669 - RNA, 63 nt, Homo Sapiens
acuaaaggauauacauauacugccucuucuaugauguuucauuugaccuacaccaucagcauc

SEQ ID NO: 303670 - RNA, 63 nt, Homo Sapiens
acuuuugaaaacaaaauaugaaaagaaucggcaauguuucaaacaaaaagucauaaaagucac

SEQ ID NO: 303671 - RNA, 63 nt, Homo Sapiens
uggcuacaucuguaucuuuuccuccuguguuuaauguuucacuagggagaggaaauaaagcag

SEQ ID NO: 303672 - RNA, 63 nt, Homo Sapiens
gugguguggugggccaaaauugcccuucauuacauguuucaaaguuuuuuuuauuauaaaacu

SEQ ID NO: 303673 - RNA, 63 nt, Homo Sapiens
guuggggucauagauguuucauuagcugcuucuauguuucauaucugcuucaauguagucaga

SEQ ID NO: 303674 - RNA, 63 nt, Homo Sapiens
gauuccugaccauaagugacaggcaaaaauaaaauguuucaaguuuacauuggauaaaggauu

SEQ ID NO: 303675 - RNA, 63 nt, Homo Sapiens
uauuuccuacuuuuccacuacccugagucucagauguuucauucacacagacugcucuccaau

SEQ ID NO: 303676 - RNA, 63 nt, Homo Sapiens
guagucaaaauaaacauaaacaagagugucauaauguuucaggaaauuauaucuguuuuggag

SEQ ID NO: 303677 - RNA, 63 nt, Homo Sapiens
cgagaaaacaugaaggagggauagggcaaguuuauguuucaugcucaguaggaacuuuuugaa

SEQ ID NO: 303678 - RNA, 63 nt, Homo Sapiens
gccagguguggugauucaugggcuuuaaaaauaauguuucaagaccauaccaacuggaauuua

SEQ ID NO: 303679 - RNA, 63 nt, Homo Sapiens
gccuagucugaaaaauaacauuuuguagaaaaaauguuucaguagagacaaucucuggcaagu

SEQ ID NO: 303680 - RNA, 63 nt, Homo Sapiens
uauauaaaagcaaaagaacuauuuauagaauaaauguuucauuauucugaaaaauacauuucu

SEQ ID NO: 303681 - RNA, 63 nt, Homo Sapiens
gaguaagccuguugugacuucuuguaauccagcauguuucacaugcguccuggguagucugug

SEQ ID NO: 303682 - RNA, 63 nt, Homo Sapiens
augauuuucuauuuuucuucuauuuuauaugaaauguuucacuguaacauuaauucuacuaaa

SEQ ID NO: 303683 - RNA, 57 nt, Homo Sapiens
guggcuggacuaccgagagcagggagcauguuucacacguccacgagguuaaucuaa

SEQ ID NO: 303684 - RNA, 63 nt, Homo Sapiens
uuauuugauauuuauuuucaacaauuagauguuauguuucauaguguuauuuuuucuuaucaa

SEQ ID NO: 303685 - RNA, 63 nt, Homo Sapiens
uauguaauggggcaaaccacuuuucauaagacaauguuucagauuuaauuuuguuucauuuug

SEQ ID NO: 303686 - RNA, 63 nt, Homo Sapiens
caccggcugcacaggcacaaugagaagaugccaauguuucauccucccacugggagucaucgc

SEQ ID NO: 303687 - RNA, 63 nt, Homo Sapiens
aauauauauuauauaaauauauuaaaaaggaaaauguuucagauguuuauuuguauaauuacu

SEQ ID NO: 303688 - RNA, 63 nt, Homo Sapiens
uuauaaccaaaaacaaugugacggauacccaagauguuucauguuguagcuugggugaauuac

SEQ ID NO: 303689 - RNA, 63 nt, Homo Sapiens
auuuuuaauaacaugcaugggucccucucacuaauguuucaacaauagggaaaaaugagaacu

SEQ ID NO: 303690 - RNA, 63 nt, Homo Sapiens
gguguagaauuuacacugcugcaccugaggucgauguuucaaaguaagaucaagccaguguuu

SEQ ID NO: 303691 - RNA, 63 nt, Homo Sapiens
aagugacauuucaaaagaaguucuauaacaauuauguuucaugcuuaaaguaaaaauucccag

SEQ ID NO: 303692 - RNA, 63 nt, Homo Sapiens
uuaaucaugcaguguacaauucaaaaucaugcaauguuucacuuuagaauuggauuugaagaa

SEQ ID NO: 303693 - RNA, 63 nt, Homo Sapiens
uucaaauggcaguagccuuggcucacauaagacauguuucaugugaucuguauccuggcauac

SEQ ID NO: 303694 - RNA, 63 nt, Homo Sapiens
augcauguauaggccgaacuauuaucagcucugauguuucagagagaagaccucagaaaccga

SEQ ID NO: 303695 - RNA, 63 nt, Homo Sapiens
cauguaaagaauauaugagccuuguauggagugauguuucauuuaccuggguuguguuaauga

SEQ ID NO: 303696 - RNA, 63 nt, Homo Sapiens
acuguuggucuagccugugaagcaauuaaucgaauguuucagaaggagcagagugaauuagua

SEQ ID NO: 303697 - RNA, 63 nt, Homo Sapiens
auggacuggcuuaagccguguggcauccgaggaauguuucaaaugugucuguguuucucuuua

SEQ ID NO: 303698 - RNA, 63 nt, Homo Sapiens
aggacauuaauaaugguguacuuuaaaaaauauauguuucauuuaaucuucacaaaagaucug

SEQ ID NO: 303699 - RNA, 63 nt, Homo Sapiens
gccuccgccgccacugcugcugccaccucuuauauguuucagacacucucugcccagacucau

SEQ ID NO: 303700 - RNA, 63 nt, Homo Sapiens
aaaauaacuauaucauaacucauucauaacuugauguuucauuuucuguugaggaaccauaaa

SEQ ID NO: 303701 - RNA, 63 nt, Homo Sapiens
uauuaaaugauuuagcagucuccacguguguuaauguuucaaacguguaucauaauguguaua

SEQ ID NO: 303702 - RNA, 63 nt, Homo Sapiens
uuaugauauggacguuaucauuggucuggugagauguuucauauuugugacaguuaauuuaaa

SEQ ID NO: 303703 - RNA, 63 nt, Homo Sapiens
ccaacugccaagccauacuuauuaaguucgaacauguuucacuuaaggagagacaccuagcuu

SEQ ID NO: 303704 - RNA, 63 nt, Homo Sapiens
uugaaaacacaagaugaccuuuuaccauaugaaauguuucauaaagaagucuugggauuggau

SEQ ID NO: 303705 - RNA, 63 nt, Homo Sapiens
cagauuuauauguuuggaggggguggggaaucuauguuucacuuagugaagaaacaaguucuc

SEQ ID NO: 303706 - RNA, 63 nt, Homo Sapiens
uauaguuuuauacaaaguagagaaagaaauuuuauguuucacacuuggacguuucauuuugaa

SEQ ID NO: 303707 - RNA, 63 nt, Homo Sapiens
uuuaaaucauguuuuccuaauaauuuauauuacauguuucauaaauaaaucaugccacuauau

SEQ ID NO: 303708 - RNA, 63 nt, Homo Sapiens
cuauggaaaugugaaggaugaagggaacaaauaauguuucaucauucaucacauaguaucuua

SEQ ID NO: 303709 - RNA, 63 nt, Homo Sapiens
uauaaacugccuucuucaaccauaagauuuguaauguuucauuuuauaaguuguaugcauaaa

SEQ ID NO: 303710 - RNA, 63 nt, Homo Sapiens
gacaguuuuuaacaauaaauagauguguaucagauguuucacuugaaucuaccauucauagcc

SEQ ID NO: 303711 - RNA, 63 nt, Homo Sapiens
aacagcugaaggguuuuauuuguaauuauacuuauguuucaauuauaauaccuuuuccuugug

SEQ ID NO: 303712 - RNA, 63 nt, Homo Sapiens
guuugcacuuugcauugaacuuuauuuaaguucauguuucacuaugugaugggucuaguccag

SEQ ID NO: 303713 - RNA, 63 nt, Homo Sapiens
aaaaggaaaucuauggaguagaagaaaucaaacauguuucagggagaacuugggaauguuuaa

SEQ ID NO: 303714 - RNA, 63 nt, Homo Sapiens
cuuugugguccugaucaaggugcauuaaaauaaauguuucaggguaacuaggggcuguguuuc

SEQ ID NO: 303715 - RNA, 63 nt, Homo Sapiens
cugcaguguguuuagcauucuugcaguauaguuauguuucaguuaccagcugaauagcccagc

SEQ ID NO: 303716 - RNA, 63 nt, Homo Sapiens
ggcuccacagcuccaccgcucugggcccucaggauguuucaaacaggucacccuguggcaggc

SEQ ID NO: 303717 - RNA, 63 nt, Homo Sapiens
uuaaaugcacuucuuccgguuaaagcacaaaguauguuucaguuuagaaugcucuuuugcaug

SEQ ID NO: 303718 - RNA, 63 nt, Homo Sapiens
ugcaaacauauuaaaguuucuuuaggcuuuuguauguuucagaaguuagauauugacuuuauc

SEQ ID NO: 303719 - RNA, 63 nt, Homo Sapiens
caaacaagaagagaagaaaaggaaaaccucaggauguuucagcaccuuagaacaugagagagu

SEQ ID NO: 303720 - RNA, 63 nt, Homo Sapiens
ucagcuguacaaacuccagcuuuaaagugugaaauguuucaccuuauauuaaccucuuccuac

SEQ ID NO: 303721 - RNA, 63 nt, Homo Sapiens
guguuaccuuucuggcuuccauugauuuuguauauguuucagcuaugugauguuggaaagcuc

SEQ ID NO: 303722 - RNA, 63 nt, Homo Sapiens
aaaucugaccaaaacaaacaauacacuaugaagauguuucaaaacuauucaguuuucaggaug

SEQ ID NO: 303723 - RNA, 63 nt, Homo Sapiens
aaucucaacuggcagcaauaccaaagacacucuauguuucauuuuccccucaguucaucuuua

SEQ ID NO: 303724 - RNA, 63 nt, Homo Sapiens
aauaaaugugauguuucuagggguaggucucuaauguuucaucagaacuaucuugguugcaaa

SEQ ID NO: 303725 - RNA, 63 nt, Homo Sapiens
ugcaucaguugcuucuauagagcaucagcccucauguuucauugucuuaaugucggggagcag

SEQ ID NO: 303726 - RNA, 63 nt, Homo Sapiens
aaaaaagcaaaugaggcaaugugucaaaauuuaauguuucauaauaaaaauagauacguugac

SEQ ID NO: 303727 - RNA, 63 nt, Homo Sapiens
cacuguuucucucaacacuauuuaaucugaaaaauguuucaguacaaaccacuguuugaacua

SEQ ID NO: 303728 - RNA, 63 nt, Homo Sapiens
aaauucagaauaucucuaaaacauggaaaauugauguuucaauaaaaagggagacauuuuauu

SEQ ID NO: 303729 - RNA, 63 nt, Homo Sapiens
ccauucugccccuguacauguuuccuaccaagcauguuucacauuuuccuauuaguggaggag

SEQ ID NO: 303730 - RNA, 63 nt, Homo Sapiens
aauugccuauaaauugacucuacuaaaauaacaauguuucagucugaaaauuugaauugaaaa

SEQ ID NO: 303731 - RNA, 63 nt, Homo Sapiens
uaguguacauuguaaaacucagauauugucaugauguuucacuuggacauaagacuuauuaau

SEQ ID NO: 303732 - RNA, 63 nt, Homo Sapiens
ccugaccuugaaucacaagagucuuaacagggaauguuucaggaaacaaauaggauaagacaa

SEQ ID NO: 303733 - RNA, 63 nt, Homo Sapiens
uauuuuuauauuaaaguacuauacuaggagagaauguuucagaacucccugaugaauuucuaa

SEQ ID NO: 303734 - RNA, 63 nt, Homo Sapiens
augaauaauuccugcuauucugaaauugccuacauguuucaauaccaguuauauggagugcuu

SEQ ID NO: 303735 - RNA, 63 nt, Homo Sapiens
uguaguuuaauaaaguuccuguuuaugagagucauguuucaucucagcuucuuccauggaugu

SEQ ID NO: 303736 - RNA, 63 nt, Homo Sapiens
agcugugcaaccugugaagccaagagugaacugauguuucauuuauauuuucauccaaaugac

SEQ ID NO: 303737 - RNA, 63 nt, Homo Sapiens
gauccugugcuuaccuuuuccugcuguacucugauguuucagugaagcucauccacgaagucc

SEQ ID NO: 303738 - RNA, 63 nt, Homo Sapiens
gucagauuuugugcuugauuacaaccccuggauauguuucauuuccagaucagauggggacac

SEQ ID NO: 303739 - RNA, 63 nt, Homo Sapiens
ucuacuucugcuuuucuuauuaaagggaaacgaauguuucaaacaucagccucacugagcuaa

SEQ ID NO: 303740 - RNA, 63 nt, Homo Sapiens
uugaaacagucucuuuugagugguuuaaucauuauguuucaaaagagacagcccagucucuuc

SEQ ID NO: 303741 - RNA, 63 nt, Homo Sapiens
uggggaacugagcuaggcggcuuaacaaaaacaauguuucaucccucaugccuucaggaaaga

SEQ ID NO: 303742 - RNA, 63 nt, Homo Sapiens
uuuuugaauuuauuuauaugauugucauaaguuauguuucagaggacuauguuugugaacaua

SEQ ID NO: 303743 - RNA, 63 nt, Homo Sapiens
uauagagguaaaauuugcacaguaauuucaagaauguuucaguugguuuucaacaagccugaa

SEQ ID NO: 303744 - RNA, 63 nt, Homo Sapiens
cauuguauuugaacacaaaaacugagcuuccuuauguuucacaaguuaccccacacaaaaguu

SEQ ID NO: 303745 - RNA, 63 nt, Homo Sapiens
agaauucuguugauggaaauuaauguggaaaugauguuucauaaacugagaaggcuguggauu

SEQ ID NO: 303746 - RNA, 63 nt, Homo Sapiens
caggagugggguaaauaaguauaccaguuucugauguuucaggaugcuuggagcagucaguac

SEQ ID NO: 303747 - RNA, 63 nt, Homo Sapiens
aauaaaaaaccacuuuauauuuaaugcaaugaaauguuucauuugacauguuuauuucuaccc

SEQ ID NO: 303748 - RNA, 63 nt, Homo Sapiens
uuugugaauuagguauggccccuuguccugacuauguuucacaugcaguacagacauagcaag

SEQ ID NO: 303749 - RNA, 63 nt, Homo Sapiens
aagggcagacucacgaauuugaaaauaagcuuuauguuucaagaaaauggcauacagauaaug

SEQ ID NO: 303750 - RNA, 63 nt, Homo Sapiens
gggaaaugaacuacauauugaauuaccuaucccauguuucaguaaucagacuuacuggaaaua

SEQ ID NO: 303751 - RNA, 63 nt, Homo Sapiens
aucaggaacuuucgguuuuauucauauaguccaauguuucaucuuauuaauagauuguuucuu

SEQ ID NO: 303752 - RNA, 63 nt, Homo Sapiens
ucauuuuaaacauccuaaauauugaccugccucauguuucauuguaaaugauuguacuuauuu

SEQ ID NO: 303753 - RNA, 63 nt, Homo Sapiens
gugacugucucauugugccaugagguaaauguaauguuucaggcauucugcuugcaaaaaaau

SEQ ID NO: 303754 - RNA, 63 nt, Homo Sapiens
gagaaacuggucaaugaacaggaagacuuagagauguuucacaagccuuugauuuuuguuuca

SEQ ID NO: 303755 - RNA, 63 nt, Homo Sapiens
ucagagaugcuggaaacaaaucauuugcuuuauauguuucauuagaauaccaaugaaacauac

SEQ ID NO: 303756 - RNA, 63 nt, Homo Sapiens
gcauuuaggaaugaaguguuagagugucuuaaaauguuucaaaugguuuaacaaaauguaugu

SEQ ID NO: 303757 - RNA, 63 nt, Homo Sapiens; identical to SEQ ID NO: 303756

SEQ ID NO: 303758 - RNA, 63 nt, Homo Sapiens
uuucuuacaacagccuuucagacuauucuucauauguuucaagcuaaucuuguagcuaagcua

SEQ ID NO: 303759 - RNA, 63 nt, Homo Sapiens
ucaugcauagagugugauguauguguaauaaauauguuucacacaaacaaggccugucagcua

SEQ ID NO: 303760 - RNA, 63 nt, Homo Sapiens
agagauaaggauugcacauuggaaaaguaaaccauguuucauuccuuuuucccuauuuauauu

SEQ ID NO: 303761 - RNA, 63 nt, Homo Sapiens
agaaaugcccuccaugugucccucuaauguugcauguuucaguggguuggaaguuuuguauau

SEQ ID NO: 303762 - RNA, 52 nt, Homo Sapiens
accaacugcuuaaaacauaaggauguuucaguuccuccauuuaacagguagu

SEQ ID NO: 303763 - RNA, 63 nt, Homo Sapiens
guggacuaguauaguauacggucaguuaugucaauguuucauggucaauaaaaaggaaguugc

SEQ ID NO: 303764 - RNA, 63 nt, Homo Sapiens
uuaaauauagcaauacaaccaauaauuuguuuuauguuucacugcauauaaauauuuccauua

SEQ ID NO: 303765 - RNA, 63 nt, Homo Sapiens
auacuguacuauccuuuauaagucauuaaaauaauguuucaucaaaugguuaaauggaccacu

SEQ ID NO: 303766 - RNA, 63 nt, Homo Sapiens
gcuucuuaaggucccugcucggccgguguaaauauguuucacccugucccucuaauaaagcuc

SEQ ID NO: 303767 - RNA, 63 nt, Homo Sapiens
cauggaaugauuucucugcuaacagccgccuguauguuucaauaaauuuguccaaagcucaac

SEQ ID NO: 303768 - RNA, 63 nt, Homo Sapiens
cuacuuguaugcagaagagaauuaguugauuacauguuucaaccuuuuagggugauaaauaca

SEQ ID NO: 303769 - RNA, 63 nt, Homo Sapiens
uuaacauucagguguagauuguuucagcuucucauguuucauuuuccugaagauuuauguuuu

SEQ ID NO: 303770 - RNA, 63 nt, Homo Sapiens
uauuuucaaguaguauaccccugugguuuuacaauguuucaucauuuuuuugcauuaauaaca

SEQ ID NO: 303771 - RNA, 63 nt, Homo Sapiens
gcguauaaaauggggcugugugcaugcaggcccauguuucagccucagcccacgccaggugaa

SEQ ID NO: 303772 - RNA, 63 nt, Homo Sapiens
aaaggaaugucuugcauauuacugacauuugguauguuucauucauuggaauauuucuuauuu

SEQ ID NO: 303773 - RNA, 63 nt, Homo Sapiens
uuaugugaagguguuucaaaggguaaauuauaaauguuucaugaagaaaaaauuuuaaaaauc

SEQ ID NO: 303774 - RNA, 63 nt, Homo Sapiens
gaaccguaucaggcauucgccugccucucacaaauguuucagggaggccaguucugcagggug

SEQ ID NO: 303775 - RNA, 63 nt, Homo Sapiens
auuucauagauaauauauuuaauaugacagauuauguuucaacucuguagauguuuaacguca

SEQ ID NO: 303776 - RNA, 63 nt, Homo Sapiens
ggaauugaugggaaaugguuuaauauuucaagaauguuucacuuucccugguaaagaggauuc

SEQ ID NO: 303777 - RNA, 63 nt, Homo Sapiens
agcuuuugucuauuuuuuaacuacuucagucccauguuucagaaggcuuuuauaaugcuccgc

SEQ ID NO: 303778 - RNA, 63 nt, Homo Sapiens
uugcaagguaauauguaauaaauaugaaauauaauguuucagaaucuaaaauaaauauacaca

SEQ ID NO: 303779 - RNA, 63 nt, Homo Sapiens
aaguuucugcagcagaugcuugggcaaaugaaaauguuucaggauuucacaauccuguggauc

SEQ ID NO: 303780 - RNA, 63 nt, Homo Sapiens
uaaaaccucauucucggaccuauugaaaauaugauguuucacaguuuuuaaaauaugaguggu

SEQ ID NO: 303781 - RNA, 63 nt, Homo Sapiens
aaggaaugaaagagaguucucugaccugugaucauguuucaggguuuauauaugaacuuuacu

SEQ ID NO: 303782 - RNA, 63 nt, Homo Sapiens
aaacuugacauugucagagugugguacuuuuugauguuucagugcaggacagccuauaaaauu

SEQ ID NO: 303783 - RNA, 63 nt, Homo Sapiens
gaaccaaaguucugauaccuuuuuaggugugagauguuucagugugccuuuguaccucaggug

SEQ ID NO: 303784 - RNA, 63 nt, Homo Sapiens
ugaaccuuuccuaacuuuuuuaacaaguugaaaauguuucaucuugcgaguauacauguuuuu

SEQ ID NO: 303785 - RNA, 63 nt, Homo Sapiens
ugaaaagucugguuucuuacuauuuacaauaaaauguuucauugaggaauaccuaugaagagc

SEQ ID NO: 303786 - RNA, 63 nt, Homo Sapiens
guaggaauauuuaaguuauuaacuagagucuggauguuucauucauaaaauuuugauuaguga

SEQ ID NO: 303787 - RNA, 63 nt, Homo Sapiens
cucuuaugaccugauccauccaggauguauggaauguuucauaguuauuuaacguuugucugc

SEQ ID NO: 303788 - RNA, 63 nt, Homo Sapiens
uguaaauuguucauagaaaagugaaaaaaucuaauguuucaaacccguuuccuucccucauca

SEQ ID NO: 303789 - RNA, 63 nt, Homo Sapiens
auaacauuaauuuuuuuaaaaaauaaggucuuaauguuucauuuaauuuaaaauauacuguca

SEQ ID NO: 303790 - RNA, 63 nt, Homo Sapiens
uuuacacuucagacagauuuucuguguuaugaaauguuucaguaaaauauuguuuacugacuu

SEQ ID NO: 303791 - RNA, 63 nt, Homo Sapiens
uuucggaaguuugaucugagaaccaaccauagaauguuucaguucuaggaaauaaaaccaguu

SEQ ID NO: 303792 - RNA, 63 nt, Homo Sapiens
gacucaaagagggagugcauuuaugagcucuucauguuucaggagagaguugaaccuaaacau

SEQ ID NO: 303793 - RNA, 63 nt, Homo Sapiens
acacuacugagagaaugagaugaaaaacgauuaauguuucauuauuauuauugugaaaauauu

SEQ ID NO: 303794 - RNA, 63 nt, Homo Sapiens
gccuaauugcuguuacuaauuagaggaguaaaaauguuucacgauaacucagcaauuguaaug

SEQ ID NO: 303795 - RNA, 63 nt, Homo Sapiens
acugaaacuauggcuaauaauugggguacucuuauguuucaauccaauuuaaccucauuuccc

SEQ ID NO: 303796 - RNA, 63 nt, Homo Sapiens
uguagcugagcacuuuaacaaguugagcauuccauguuucauucuuagaaccuucuuuaauag

SEQ ID NO: 303797 - RNA, 63 nt, Homo Sapiens
uuaaccuagaaagggcucacucuaccucuaggcauguuucaucccaacaaucagacugugcca

SEQ ID NO: 303798 - RNA, 63 nt, Homo Sapiens
aauauagaaaucuuauguaaaugaaauuuugucauguuucaaauaaagagaacugaaguagaa

SEQ ID NO: 303799 - RNA, 63 nt, Homo Sapiens
agaaguuacuagcacugacacacugauuuugaaauguuucaaaaugaguagauaugauuagau

SEQ ID NO: 303800 - RNA, 63 nt, Homo Sapiens
aauacaucuuuuauaaugggggaagaaugcccuauguuucaauucaaaacaaagacaguuuuc

SEQ ID NO: 303801 - RNA, 63 nt, Homo Sapiens
uauugaaauggaaaugaaaacagccaguaacuuauguuucagaauguuuguaacacacuucau

SEQ ID NO: 303802 - RNA, 63 nt, Homo Sapiens
uguuggaauugucaucuguacaauuaguccauaauguuucauguuuguccuaagugugcuguu

SEQ ID NO: 303803 - RNA, 63 nt, Homo Sapiens
gcuaugcagugugaucuuuauuuauaguaaauuauguuucauguaaaugauauauuuuuggug

SEQ ID NO: 303804 - RNA, 63 nt, Homo Sapiens
uugcuaccagauuauaucuggugguaauuguuaauguuucagcagggcuggucucaguccuuu

SEQ ID NO: 303805 - RNA, 63 nt, Homo Sapiens
caucuuguucuucaauaucacggguuuuuguuaauguuucauaaguaauucuccccacuugau

SEQ ID NO: 303806 - RNA, 63 nt, Homo Sapiens
aauaaacaguguuuuguuuuaaauuuuguuaugauguuucauuucauucuuguauugccuuuu

SEQ ID NO: 303807 - RNA, 63 nt, Homo Sapiens
auuaguuugcauucaccuuuaagucacauuuccauguuucaaccucaccuucccucuuuuuua

SEQ ID NO: 303808 - RNA, 63 nt, Homo Sapiens
cuuguguccaggcuggaguguuuuuuugaggcgauguuucacugagcaggauaucuuuuuuuu

SEQ ID NO: 303809 - RNA, 63 nt, Homo Sapiens
aaaugcagugaaaggaacuaaaucacauauaucauguuucaguuugguacccuaggacauaaa

SEQ ID NO: 303810 - RNA, 63 nt, Homo Sapiens
ugugcuuuuaaaaaaucugguauauuuguacaaauguuucagcaugauuguuuucucucuuug

SEQ ID NO: 303811 - RNA, 63 nt, Homo Sapiens
uuuguauuaauuuguaauaguuuaaauuaggguauguuucaagcagggcccaaagcuuauuag

SEQ ID NO: 303812 - RNA, 63 nt, Homo Sapiens
cgggaaacaugacucuuuauaaauuuauuuccaauguuucaagcuuuucuuguaucuggauuc

SEQ ID NO: 303813 - RNA, 63 nt, Homo Sapiens
ugcacaaguagggcugccucaaucaguccuagaauguuucauuuuuuuaucagagucaugaug

SEQ ID NO: 303814 - RNA, 63 nt, Homo Sapiens
gcucaccaggcaguaccaauaacauuaauccacauguuucagauuuuguccugcaucaucuug

SEQ ID NO: 303815 - RNA, 63 nt, Homo Sapiens
uucuuuuuauguaaauuugucuuguuuuuucucauguuucaucucugcuuugcagggaaauaa

SEQ ID NO: 303816 - RNA, 63 nt, Homo Sapiens
ggugugugucuuuuuacuauguugacucguuuuauguuucaaugucaauaaaaauagaaguuu

SEQ ID NO: 303817 - RNA, 63 nt, Homo Sapiens
ugcauggccuucuacggcuugcauuguguuaacauguuucaagcugggccuucaugcuuuucu

SEQ ID NO: 303818 - RNA, 63 nt, Homo Sapiens
gcaucugauuugucagacccaucgcuuccacccauguuucagaagaaaaguugcaugauugac

SEQ ID NO: 303819 - RNA, 63 nt, Homo Sapiens
gaacuaugcaguuaaggcagauaaaauguacagauguuucauauauuacagguuacauauaua

SEQ ID NO: 303820 - RNA, 63 nt, Homo Sapiens
ucuuucuauauacugaucucuauauagauaucaauguuucauugaaaauccacugguaaggaa

SEQ ID NO: 303821 - RNA, 63 nt, Homo Sapiens
gcaacuuagcaaggcuucuuuucauuauuuuuuauguuucacuuauaaagucuuagguaacua

SEQ ID NO: 303822 - RNA, 63 nt, Homo Sapiens
aaguggcuuuuggggccccagguugagcucuggauguuucaagccaaggcucggcuauucccg

SEQ ID NO: 303823 - RNA, 63 nt, Homo Sapiens
aaucaguaaaucaguuucacaucauguauugugauguuucaaugugagacacaaaaacaaugg

SEQ ID NO: 303824 - RNA, 63 nt, Homo Sapiens
uccugccguuuucuuccugccaagccugaaucaauguuucaucuccaacccucugccaguuug

SEQ ID NO: 303825 - RNA, 63 nt, Homo Sapiens
ccauugggcccucgucugccucuccaggauuguauguuucaagccuuguccuguguuccuuug

SEQ ID NO: 303826 - RNA, 63 nt, Homo Sapiens
caagugggauuagaagacuaucaaaauacauguauguuucaggauauuugaccugucauuaaa

SEQ ID NO: 303827 - RNA, 63 nt, Homo Sapiens
uuugguauuacacuguauuuguaucucugaagcauguuucauguuuugugacuauauagagau

SEQ ID NO: 303828 - RNA, 63 nt, Homo Sapiens
uguauuguaauggcauuaucaaaauauuugaugauguuucagauauauugcaaagucuguauu

SEQ ID NO: 303829 - RNA, 63 nt, Homo Sapiens
accauaaguuaaaaucugaagguuaucuuuaucauguuucaucccugucugaagauuuccuag

SEQ ID NO: 303830 - RNA, 63 nt, Homo Sapiens
aaauauuguuuuccuacaggccuauuuaacaagauguuucauuuuacuguauauuuuguaguu

SEQ ID NO: 303831 - RNA, 63 nt, Homo Sapiens
aaauuuuuucucuaggaaauauuuauuuuaauaauguuucaaacauauauaacaaugcuguau

SEQ ID NO: 303832 - RNA, 63 nt, Homo Sapiens
uagagccagccuugguuggaccuauugccaggaauguuucagcugcaguugaagagccugaca

SEQ ID NO: 303833 - RNA, 63 nt, Homo Sapiens
aagaagugaguguccacgggugaagaagugaguauguuucaccuggacauuaaggugauguuu

SEQ ID NO: 303834 - RNA, 63 nt, Homo Sapiens
aacacccagagacggcacaaggagguugaacucauguuucaguucgcgaacauugacuccuua

SEQ ID NO: 303835 - RNA, 55 nt, Homo Sapiens
auaacgcugcuuuagaaugaaugaaauguuucacuaggaacguccagauuucuaa

SEQ ID NO: 303836 - RNA, 63 nt, Homo Sapiens
uacaaguauuaggcugcuuuuguauuuuuguguauguuucaaaauggguuuuauccucaaaua

SEQ ID NO: 303837 - RNA, 63 nt, Homo Sapiens
uaccucuaaauuuccauaucuugccugacuaaaauguuucauuaguuucuguaaggucuuaca

SEQ ID NO: 303838 - RNA, 63 nt, Homo Sapiens
gcgaucucagaucuaggccuugaggucacuuuaauguuucacagagugagaaaacaaguaugg

SEQ ID NO: 303839 - RNA, 63 nt, Homo Sapiens
ucccaccauuuucucaguuuaguuuccaaggauauguuucauggacgaagggagagagaaagc

SEQ ID NO: 303840 - RNA, 63 nt, Homo Sapiens
uugugacagauaaagauguauucaaaagaaugcauguuucacaacucuuagauauuuauauaa

SEQ ID NO: 303841 - RNA, 63 nt, Homo Sapiens
guuugaguccauguuuauuccuucacaaacuccauguuucaguugaccucugccacccacauc

SEQ ID NO: 303842 - RNA, 63 nt, Homo Sapiens
cuuuggaacaagaugguucuuuuuugacagaauauguuucaaacauacauuguacgaagagua

SEQ ID NO: 303843 - RNA, 63 nt, Homo Sapiens
gauauaugcaacuauucaguauaaaucaaugaaauguuucaauuaucaauauaaauaaggaaa

SEQ ID NO: 303844 - RNA, 63 nt, Homo Sapiens
ccucuaccauccugcacugugguguaagguugcauguuucaguaaaucugcuuuaccaaguaa

SEQ ID NO: 303845 - RNA, 63 nt, Homo Sapiens
uauugcauuuuucuauuaaaaaauuaacaguuaauguuucagucaauguauuaucuguagcau

SEQ ID NO: 303846 - RNA, 63 nt, Homo Sapiens
cuguaugaauaaugaaacuuacuaucauaaaccauguuucauguggccuguuagggccuguca

SEQ ID NO: 303847 - RNA, 63 nt, Homo Sapiens
ucccgucugauuguuccuccccagcccccuggcauguuucaccacaacccuguugcuacauca

SEQ ID NO: 303848 - RNA, 63 nt, Homo Sapiens
auucuguggucaaguaaguuuagggagcuauucauguuucacuugcuuuguggagauucacac

SEQ ID NO: 303849 - RNA, 63 nt, Homo Sapiens
gacaaaaaguaaaucauugaccaaagcuaugaaauguuucacaaaguuuuccucuuuugcaua

SEQ ID NO: 303850 - RNA, 63 nt, Homo Sapiens
auggaauauuacuucuaucagaagaugaucaagauguuucaguccagugcacaucagcauugc

SEQ ID NO: 303851 - RNA, 63 nt, Homo Sapiens
gagcaggaagucuagaaaugauaacuagacuguauguuucaugugugugauuuuucagaauuc

SEQ ID NO: 303852 - RNA, 63 nt, Homo Sapiens
uuugucuuaauuucuaacauuaucuuugcuuuuauguuucauaaaaauuugucauuauuuaug

SEQ ID NO: 303853 - RNA, 63 nt, Homo Sapiens
uuuucugcugguggauaaacauuaaaauuaaucauguuucaaaguuuuauuuucaguuccuuu

SEQ ID NO: 303854 - RNA, 63 nt, Homo Sapiens
ugcuagcauguacuguaugggaggaugauccagauguuucaaagagaauuucucuuaguuuag

SEQ ID NO: 303855 - RNA, 63 nt, Homo Sapiens
cuugaaauuauauugauuuaaaugaugugugagauguuucaccauuuucaggcacuguguaau

SEQ ID NO: 303856 - RNA, 63 nt, Homo Sapiens
auuaggccaagugcaauugacuucccuuuuuuaauguuucaugaccacccauugauuguauua

SEQ ID NO: 303857 - RNA, 63 nt, Homo Sapiens
ucuacauuuucuggaaaaucagcauuacuagagauguuucaaauguagauuuuaccagaccau

SEQ ID NO: 303858 - RNA, 63 nt, Homo Sapiens
ccugugcugagcccugagggcagagaggauggcauguuucaggggagggggaagccuuccucu

SEQ ID NO: 303859 - RNA, 63 nt, Homo Sapiens
uagaaugcaaaauguuggcauuguuuaaaccaaauguuucaugaauagagaauucuuaagauu

SEQ ID NO: 303860 - RNA, 63 nt, Homo Sapiens
acugcaaaacaaacaggauaaguaacuaaguuuauguuucagaugccuuguuuggguaaaggc

SEQ ID NO: 303861 - RNA, 63 nt, Homo Sapiens
acauuguugauggcauugugucuugcuucugauauguuucaauuaaaaucuuuaaaacuagau

SEQ ID NO: 303862 - RNA, 63 nt, Homo Sapiens
aaaaaaaaggaacuguaauuuaaaugcccuuugauguuucaaagcaaauuguuucaguuuuuu

SEQ ID NO: 303863 - RNA, 63 nt, Homo Sapiens
auaaaauaaucucacuuuuacauuuuugaaauaauguuucagauuuauuucaaaaacaaagua

SEQ ID NO: 303864 - RNA, 63 nt, Homo Sapiens
uuaaaugauaguaaaaacacaaagguuguggaaauguuucagacaaugucauagaagacaaag

SEQ ID NO: 303865 - RNA, 63 nt, Homo Sapiens
uugguuuuaauuuguauaucucgguguguagugauguuucauuuuccuuuuuaaccauuccaa

SEQ ID NO: 303866 - RNA, 63 nt, Homo Sapiens
guaucacauagaaauauggcgcauuuauuaaaaauguuucauuuugcaguucuaugauagauu

SEQ ID NO: 303867 - RNA, 63 nt, Homo Sapiens
ugaaacauuucagaaauuauuauugcuuugucuauguuucauaauaaacauauauccucuuuu

SEQ ID NO: 303868 - RNA, 63 nt, Homo Sapiens
uuuugaccuagaaaugcgagucucucauuggccauguuucagagcgcccucucaauuuagucu

SEQ ID NO: 303869 - RNA, 63 nt, Homo Sapiens
uaauugugaggaaggcgcagccguuuuuuggucauguuucaaugucacuuuuuugccuauccc

SEQ ID NO: 303870 - RNA, 63 nt, Homo Sapiens
aaaucaaaaaaucuuccuucuuauaacugagaaauguuucacccaaauuuccuuuguuauuau

SEQ ID NO: 303871 - RNA, 63 nt, Homo Sapiens
aauaucuucacuucaguuuuauuugugaauuacauguuucaugaauccauuuggcacagagac

SEQ ID NO: 303872 - RNA, 63 nt, Homo Sapiens
uuucucuuguagugauuuggguaggaagaggccauguuucaguucguuuucucuguagggucg

SEQ ID NO: 303873 - RNA, 63 nt, Homo Sapiens
cuagcuagccagcuggagauaauuuaccagggaauguuucaaagcccuaaccuugaaguuugg

SEQ ID NO: 303874 - RNA, 63 nt, Homo Sapiens
acaaaaugcugauucaguucaaaauuaaugcaaauguuucaaaacuggguuucugauauuugu

SEQ ID NO: 303875 - RNA, 63 nt, Homo Sapiens
guuacuaagauuucuauaccuggaauaucauguauguuucauuuacuggauguuuacauuuua

SEQ ID NO: 303876 - RNA, 63 nt, Homo Sapiens
gcaucaagcuacccucaagaguuucugggcuggauguuucagaacaacaucuacaccaguaaa

SEQ ID NO: 303877 - RNA, 63 nt, Homo Sapiens
acucccuggccuugcccgucgugugcugaagacauguuucaagaaccgcauuucgggaagggc

SEQ ID NO: 303878 - RNA, 63 nt, Homo Sapiens
caguaaagaaauaaaaguuuuuaaguuauacuaauguuucaaugguauuugacauaauaugua

SEQ ID NO: 303879 - RNA, 63 nt, Homo Sapiens
ggcuucacauggaggagcuguuccaggguguguauguuucaggugugcauaaggagaggaaag

SEQ ID NO: 303880 - RNA, 63 nt, Homo Sapiens
gguguuugcuuccuuccagaucagacugaaaacauguuucacacuaugaagaaagauacgguu

SEQ ID NO: 303881 - RNA, 63 nt, Homo Sapiens
uauuuuuaaucgccauaaaaaaaaagugucuugauguuucaguuugaaauguugcuuucacug

SEQ ID NO: 303882 - RNA, 63 nt, Homo Sapiens
auuucuaccuccaaagugugaaucaugagauuaauguuucauguuugagagcauaauuauggu

SEQ ID NO: 303883 - RNA, 63 nt, Homo Sapiens
uuugugcauuugugaacagacuugaaucaauaaauguuucaccgccucaacauuuucgcagca

SEQ ID NO: 303884 - RNA, 63 nt, Homo Sapiens
cacuuuagaaacaguacuuugugacguaggcaaauguuucaagggucauugaaaaagagaaca

SEQ ID NO: 303885 - RNA, 63 nt, Homo Sapiens
cauucuaaauaaauaauuuucauaaauacuuugauguuucaaauuccuuauuuaguguuguau

SEQ ID NO: 303886 - RNA, 63 nt, Homo Sapiens
uaauuuauagcuaugguuauaaacagguuuuagauguuucaaaugacuuguccacugaauguc

SEQ ID NO: 303887 - RNA, 63 nt, Homo Sapiens
uaucaagguucuaccuauguuaauuuacaauucauguuucaagacauuugccaaauguauuac

SEQ ID NO: 303888 - RNA, 63 nt, Homo Sapiens
ccuuuaauucuucauuaaaauggaaauaaguagauguuucaaaguaaucuacauuccuggcuu

SEQ ID NO: 303889 - RNA, 63 nt, Homo Sapiens
agguucauuacaaucgagacugcaaugugaucuauguuucaucuuguuuuuauaauaaaaagc

SEQ ID NO: 303890 - RNA, 63 nt, Homo Sapiens
agcaauucaacuugaugugagaagaaaaaacaaauguuucaacacaaaaucucuguuuuguga

SEQ ID NO: 303891 - RNA, 63 nt, Homo Sapiens
aacuaaccugaaaaacaaauaaaugcuuuggaaauguuucaguugcuuuagaaacauuagugc

SEQ ID NO: 303892 - RNA, 63 nt, Homo Sapiens
auaaaaguuuuauaguuuuaaauacauaaagaaauguuucaguuaggcauuaaccuugauaga

SEQ ID NO: 303893 - RNA, 63 nt, Homo Sapiens
uuuuuuaacaaaauauuuuuuuaagggaaagaaauguuucaggagggauaaagcuuaccauua

SEQ ID NO: 303894 - RNA, 63 nt, Homo Sapiens
agugauaaacaacagcaaauauacuugaauaaaauguuucagguauuuuuguuucauuuuguu

SEQ ID NO: 303895 - RNA, 63 nt, Homo Sapiens
uuugaucuggcaaccauauuucuggaaguugagauguuucagcuugaagaaccaaaacagaag

SEQ ID NO: 303896 - RNA, 63 nt, Homo Sapiens
ugaacauucgaccuccauuacggagaguuuccuauguuucacugugcaaauauaucugcuauu

SEQ ID NO: 303897 - RNA, 63 nt, Homo Sapiens
ugccuccagaagaaguuuuuccuugauugugcuauguuucaguggaagaaauucuuugaagua

SEQ ID NO: 303898 - RNA, 63 nt, Homo Sapiens
ugaaugucuuucuuugaaaacugcaauguauguauguuucaagguuauuuaacaguguacuau

SEQ ID NO: 303899 - RNA, 63 nt, Homo Sapiens
augcgcaucaguaugaaauugucucaaucuuggauguuucauuuuaugaauggaggcacuuua

SEQ ID NO: 303900 - RNA, 63 nt, Homo Sapiens
uugcugauuuguuuuuaaaaaaacaagaaaugcauguuucaaauaaaauucucuauuguaaau

SEQ ID NO: 303901 - RNA, 63 nt, Homo Sapiens
gcugggacucuugggcucugugccugagggaaaauguuucacaacuaguggcugcccaauugc

SEQ ID NO: 303902 - RNA, 63 nt, Homo Sapiens
uucugcauguagauuuaaauuuuuucuuuuaccauguuucaguuuuuucuagcuauuuugcau

SEQ ID NO: 303903 - RNA, 63 nt, Homo Sapiens
gcagcaugguuacuaacgcuauuguaccauuacauguuucaguuuuaacgaaucaugauucag

SEQ ID NO: 303904 - RNA, 63 nt, Homo Sapiens
aaugaugcauacagcaauuuuuauaaguauuucauguuucagaagcaauguagaguuacgcuu

SEQ ID NO: 303905 - RNA, 63 nt, Homo Sapiens
caauuucagaucacugguacuuauuaagaauugauguuucauuacugguagauauagaagccu

SEQ ID NO: 303906 - RNA, 63 nt, Homo Sapiens
gauacugugcggaaacacacaaacacaaugugcauguuucaaugucauuccacuugugaaaga

SEQ ID NO: 303907 - RNA, 63 nt, Homo Sapiens
acauccaacuguuuguuauagcuaaauacuguaauguuucaaauucaguucauagcguagacu

SEQ ID NO: 303908 - RNA, 63 nt, Homo Sapiens
gguuuuauucaaaccacaaauaauacuaauggaauguuucaaauauucucauugugagaauuu

SEQ ID NO: 303909 - RNA, 63 nt, Homo Sapiens
ugccaguaagcuucucacauuuucugcuggcccauguuucagugccauuugggaggcaaugac

SEQ ID NO: 303910 - RNA, 63 nt, Homo Sapiens
uguggacaauugcuuacuuuugaaccucaucccauguuucauccuccaugauugauucaguca

SEQ ID NO: 303911 - RNA, 63 nt, Homo Sapiens
cauugaauugagagcuuuuauaugaaaacauucauguuucagagguacaucaguucuuuuuga

SEQ ID NO: 303912 - RNA, 63 nt, Homo Sapiens
uuucugacucaugcaaucaugcugcuaaaauagauguuucauucccaucccucacagccucuu

SEQ ID NO: 303913 - RNA, 63 nt, Homo Sapiens
uaggcacagugguacaugcccagucagaaacugauguuucagcaguuguuguagucuccacuu

SEQ ID NO: 303914 - RNA, 63 nt, Homo Sapiens
guguucuaaaaccuggcuaauaaggaauuuucuauguuucaaaaaaaggacuuguuuguagaa

SEQ ID NO: 303915 - RNA, 63 nt, Homo Sapiens
uuuacaccuggcuguuuguuaaacuaaauaaaaauguuucaccucuauuuaaccucuguaaug

SEQ ID NO: 303916 - RNA, 63 nt, Homo Sapiens
uuaaaacaacacuuugucuuuugauggaaauucauguuucauauaaccuuaaagauguuaaug

SEQ ID NO: 303917 - RNA, 63 nt, Homo Sapiens
guauuuauuuaaaacauaaaucccccaaaugugauguuucaguuaguggagugaucauacagu

SEQ ID NO: 303918 - RNA, 63 nt, Homo Sapiens
ccauuuguuuuauccaucaauaaaauagaguugauguuucauuuauagaagcucuucaagcau

SEQ ID NO: 303919 - RNA, 63 nt, Homo Sapiens
augcauugaacuggauguuaauccauacuuuugauguuucaauccauaaaaacuucaaggcuu

SEQ ID NO: 303920 - RNA, 63 nt, Homo Sapiens
aggucuuuaaagugacuaauugacuagggagccauguuucacacucuucacucuucaaaugcc

SEQ ID NO: 303921 - RNA, 63 nt, Homo Sapiens
auggguauaacauccuugccuucccauuuauccauguuucacuuuaucacugauaugaagagg

SEQ ID NO: 303922 - RNA, 63 nt, Homo Sapiens
cuaaaucuucgggacuucuuuaaugcuacguuaauguuucacugcucgucuagaaacuccuaa

SEQ ID NO: 303923 - RNA, 63 nt, Homo Sapiens
auauagugacaguaccaagaguaccaggacucaauguuucauaugaagcccuuggugaugagg

SEQ ID NO: 303924 - RNA, 63 nt, Homo Sapiens
gauauuucuuucccuaaccaucauacacuuggcauguuucauucccaucuccuuuccccucac

SEQ ID NO: 303925 - RNA, 63 nt, Homo Sapiens
aaacuuuuuuaauauaugaaagcugugauaaaaauguuucagauguuuagucaauugugaaau

SEQ ID NO: 303926 - RNA, 63 nt, Homo Sapiens
acuuuguaaucauauacaaugucaacuuuuuagauguuucaccacucuuuugcaaauaaagca

SEQ ID NO: 303927 - RNA, 63 nt, Homo Sapiens
cagaccccccacccccaaggcugcagccacaccauguuucaggcuuggggcuggggcaggcuu

SEQ ID NO: 303928 - RNA, 63 nt, Homo Sapiens
uagagaacaggugguuuuuaaggguuaucuuagauguuucacaccggaagguuuuuaaacacu

SEQ ID NO: 303929 - RNA, 63 nt, Homo Sapiens
uuucccucuuccuuuaagaaaacuuacuaaaaaauguuucauugcgaagcagaggaaaagaaa

SEQ ID NO: 303930 - RNA, 63 nt, Homo Sapiens
cuggaguaaaaaucugauuugaccccucugcucauguuucaucauauuuguagcucugcauca

SEQ ID NO: 303931 - RNA, 63 nt, Homo Sapiens
caagucuacccugaucaccucagggcauaaagcauguuucauucucuggcccgacagugucuu

SEQ ID NO: 303932 - RNA, 63 nt, Homo Sapiens
ucucauucugugaaagccuuuuaauuuauugaaauguuucaugacuacugcugcuagcucuuc

SEQ ID NO: 303933 - RNA, 63 nt, Homo Sapiens
uucucugcgcgcaaggacccucgacucacccccauguuucagugucacagagacauucuuuga

SEQ ID NO: 303934 - RNA, 63 nt, Homo Sapiens
aauggaucuuuacauguugcaguaacauugacuauguuucaaaacucagaugcauaaaacgua

SEQ ID NO: 303935 - RNA, 63 nt, Homo Sapiens
uacagcugagcccaagggaccccuguuccuggaauguuucagagcagcuauccugacacagug

SEQ ID NO: 303936 - RNA, 63 nt, Homo Sapiens
uaccaagacccuuuucacagcucaaaguauauaauguuucauguaacaguucugaaugcuguc

SEQ ID NO: 303937 - RNA, 63 nt, Homo Sapiens
cuuaaucucaggacaacuuacuaauuuuaccuaauguuucaucuaacugaagaaaauaucuug

SEQ ID NO: 303938 - RNA, 63 nt, Homo Sapiens
auucuuucuaaauuugauaagaaauuucaaaguauguuucauuaaucugugagaacaaugguu

SEQ ID NO: 303939 - RNA, 63 nt, Homo Sapiens
gacaguuuuaaagggagccacucuuuaaguaaaauguuucaaagacaauuuaucuuccauaug

SEQ ID NO: 303940 - RNA, 63 nt, Homo Sapiens
accacuugccauccuguuagccugaaaaucuauauguuucaaacugaagaaucaaacuuccau

SEQ ID NO: 303941 - RNA, 63 nt, Homo Sapiens
auccuguagcuacaucuggucucguuugaaaccauguuucaucuaaaaaguaacaagaaagaa

SEQ ID NO: 303942 - RNA, 63 nt, Homo Sapiens
ccuggggagggaggggagccguaauccugagaaauguuucagggcuggggcugaaggucagaa

SEQ ID NO: 303943 - RNA, 63 nt, Homo Sapiens
cuauaguuuguguaacaacauuuaaauacuaauauguuucacauuaacaauuuuuuuuuguuu

SEQ ID NO: 303944 - RNA, 63 nt, Homo Sapiens
caguuuaguggaaggaaaaaucacuuguucuggauguuucaauauuagugccuuucucuuuca

SEQ ID NO: 303945 - RNA, 63 nt, Homo Sapiens
aacucagccccuuuuucugccucuacuugugugauguuucagggggcaucagcaccuguccag

SEQ ID NO: 303946 - RNA, 63 nt, Homo Sapiens
aaugcguuggcaagagauguagaccaaguaagaauguuucaacucucuugaaguccaauaaca

SEQ ID NO: 303947 - RNA, 63 nt, Homo Sapiens
auugauugacucugcuauugugguucaaacuguauguuucagucaguaggcaucacauaugcu

SEQ ID NO: 303948 - RNA, 63 nt, Homo Sapiens
acuuuguaugucuauugguuaauugacaguuacauguuucauagcaaaacuuuuaaauauuug

SEQ ID NO: 303949 - RNA, 63 nt, Homo Sapiens
gcuuauaccccauugguuuaauuuuugccccaaauguuucauggcuuccagacguuguuccau

SEQ ID NO: 303950 - RNA, 63 nt, Homo Sapiens
uacuuagagcagugaagacuuuugcugcugcccauguuucaaaugaacaaacaaugaaaacuc

SEQ ID NO: 303951 - RNA, 63 nt, Homo Sapiens
caaaguacaaccugaauugaacgccuugaggggauguuucaucgaaccucucagccuuccucu

SEQ ID NO: 303952 - RNA, 63 nt, Homo Sapiens
cauccuuauucacguugacaguaccuagcuguaauguuucacagagugugcugcuauuuuaua

SEQ ID NO: 303953 - RNA, 63 nt, Homo Sapiens
uuuaaagauuugaaaccacauuuuuauuguuugauguuucauuuucagacuuuuuaaugucag

SEQ ID NO: 303954 - RNA, 63 nt, Homo Sapiens
aaucaagcuuuuccacaguucuugaaaaguacuauguuucaaauuucaggaacaccagcguua

SEQ ID NO: 303955 - RNA, 63 nt, Homo Sapiens
ugcugugggauugucaaccagcuuaucugcaggauguuucagaucugauaaauccugauggaa

SEQ ID NO: 303956 - RNA, 63 nt, Homo Sapiens
ugugcagcuuucccccuuggagcaggagugaagauguuucauuaucuugggccugggaaacca

SEQ ID NO: 303957 - RNA, 63 nt, Homo Sapiens
uaucuuauaucuaaaaaauauauaacuuacuauauguuucaguugcucucugaacaaaaauua

SEQ ID NO: 303958 - RNA, 63 nt, Homo Sapiens
aaaguuaagggaaaagacuuugcuuuuaaaaaaauguuucaaaagaaagguauuuucacuaaa

SEQ ID NO: 303959 - RNA, 63 nt, Homo Sapiens
cucauaaggucuaccaagaaaauaaauguuaugauguuucaguuggcuucuaggaaauaauua

SEQ ID NO: 303960 - RNA, 63 nt, Homo Sapiens
auggguaagaaauaaauggaaauaugacaucggauguuucagcaacuguucuguaaauaaaau

SEQ ID NO: 303961 - RNA, 63 nt, Homo Sapiens
cuagcaaucugagugauggaaucuuagucauucauguuucaccagaggacagcaagcaaaagg

SEQ ID NO: 303962 - RNA, 63 nt, Homo Sapiens
cuuaugagaaguggaugguaggaggagucacuaauguuucaaucucuauuucuguaaucuugg

SEQ ID NO: 303963 - RNA, 63 nt, Homo Sapiens
ucauuccauccucacaacaguguaccaaauaacauguuucagcuagaacagcuaagguuuaca

SEQ ID NO: 303964 - RNA, 63 nt, Homo Sapiens
cuuuuuuuuauacucaagugaauaugaaguaaaauguuucagauuuaaaaaaaaaguaugugu

SEQ ID NO: 303965 - RNA, 63 nt, Homo Sapiens
aggcugucaccuauuacacugaaugccccuaaaauguuucagcauguguaaguuuuguacaag

SEQ ID NO: 303966 - RNA, 63 nt, Homo Sapiens
acuuuacuaaaagcuuauuuugguaagacguaaauguuucaacuauagauaaugaggaagaaa

SEQ ID NO: 303967 - RNA, 63 nt, Homo Sapiens
uguuuuauacauuuuuggaguucuguuuuuaacauguuucaaaacaugaauuuuuuugucuua

SEQ ID NO: 303968 - RNA, 63 nt, Homo Sapiens
uacaacuguaauguuauuuacugucuuccguggauguuucaguugucaccucauuuugcauua

SEQ ID NO: 303969 - RNA, 63 nt, Homo Sapiens
ccuagacugcccaaggaguacaucacuugaucaauguuucagcccucccaaaucaagucucuc

SEQ ID NO: 303970 - RNA, 63 nt, Homo Sapiens
agccccauuugcacagguuuagcucacaguacaauguuucagauuuuccucccuuucccugag

SEQ ID NO: 303971 - RNA, 63 nt, Homo Sapiens
cuguuguaaagucagcauaacuuuaauguuugaauguuucacuaacugcauuuguuuugacuu

SEQ ID NO: 303972 - RNA, 63 nt, Homo Sapiens
uccaaggguauucaaacuguggaaaauggacauauguuucauacauguccagaagaguaagag

SEQ ID NO: 303973 - RNA, 63 nt, Homo Sapiens
ucucuaauuaccaauuaguuucaauuaguccuaauguuucaguccuuucuuuuugcccuuuau

SEQ ID NO: 303974 - RNA, 63 nt, Homo Sapiens
uuaccccucugcuaaauaaagucuagagaacugauguuucaauaagcauacauuuccugacug

SEQ ID NO: 303975 - RNA, 63 nt, Homo Sapiens
aaugcauugauaagaaaacuuuuuauuaaaagaauguuucauuaugugucuuguauuaaauau

SEQ ID NO: 303976 - RNA, 63 nt, Homo Sapiens
uuuauauguuuucuaagauaauauccuuaaaugauguuucaauugaagcugcucugauacuag

SEQ ID NO: 303977 - RNA, 63 nt, Homo Sapiens
uaccuuaugaaaaguguuaaggaauaaucuuuuauguuucauuaccugaggaagggaaggaag

SEQ ID NO: 303978 - RNA, 63 nt, Homo Sapiens
uuuuggucaauacuugacaacacuuuaaacaucauguuucagguaggaucauauugcauucau

SEQ ID NO: 303979 - RNA, 63 nt, Homo Sapiens
gaaaacuuuggagacaguuugaugugauucaaaauguuucaguacaguacacgucacaguauu

SEQ ID NO: 303980 - RNA, 63 nt, Homo Sapiens
uccuacaaccaaaugagaaaccauuuuaaauucauguuucaacuuuuaaaagaaaaaauucua

SEQ ID NO: 303981 - RNA, 63 nt, Homo Sapiens
ggaugugcuauuguaugauuacgaauagucuguauguuucaagcccuucuguaaaauaugaag

SEQ ID NO: 303982 - RNA, 63 nt, Homo Sapiens
ccucaauucccucaccugaaauaggaaaugagaauguuucauuguagccccaagcggucaugu

SEQ ID NO: 303983 - RNA, 63 nt, Homo Sapiens
cugugcucugugaggugugaaauuaaaaacauuauguuucaccaauauuuaaacaucaguacu

SEQ ID NO: 303984 - RNA, 63 nt, Homo Sapiens
uucagucagguacacuguuacuugaaaggaagaauguuucacuuacccaagagcuauggcugc

SEQ ID NO: 303985 - RNA, 63 nt, Homo Sapiens
ucucucauuauugagauucauccauauuguugaauguuucacuaguuaauguuuauuguucaa

SEQ ID NO: 303986 - RNA, 63 nt, Homo Sapiens
uaaagucuuucuaagaccaauuauuaucuuagcauguuucaguaucuucucuaucauaggccc

SEQ ID NO: 303987 - RNA, 63 nt, Homo Sapiens
gggaaaacuucagcuuuccaaaagcuaguaaacauguuucaaagaaaaauaaggucaggagaa

SEQ ID NO: 303988 - RNA, 63 nt, Homo Sapiens
augcuugguuauuuccaguacuugucagucaacauguuucaagacgcuguguuagacacuagg

SEQ ID NO: 303989 - RNA, 63 nt, Homo Sapiens
cugucaugucauuuacccacuggaucaaaggguauguuucacuucuugacaauauaaaugcug

SEQ ID NO: 303990 - RNA, 63 nt, Homo Sapiens
cuuuacaauuuguugcaauuucaucugcuuucuauguuucauuguuaauugccauccuucagc

SEQ ID NO: 303991 - RNA, 63 nt, Homo Sapiens
cauuuaaaaguacuuuauauuuuacauaauagcauguuucauuuugauuaaaagcuaccaaag

SEQ ID NO: 303992 - RNA, 63 nt, Homo Sapiens
caggguaucauugauuuaugagcauuucuggauauguuucaucuaugaaaacaucuccgaauu

SEQ ID NO: 303993 - RNA, 63 nt, Homo Sapiens
auuacuuuuuaauuguuuuagugacuaugacuaauguuucagaguaugagaagaaaucauugg

SEQ ID NO: 303994 - RNA, 63 nt, Homo Sapiens
auucaaucgugaaggaacagcuuuguuaucuaaauguuucagaaggaaaacucaacuguuucu

SEQ ID NO: 303995 - RNA, 63 nt, Homo Sapiens
acacuaauuuagucuuuugaauuuaguauguuuauguuucauggguccaguauuuauuugauu

SEQ ID NO: 303996 - RNA, 63 nt, Homo Sapiens
caauggugaaaagguggaaauccaaagaacagcauguuucacuaaaaugaauguauuuuuuuc

SEQ ID NO: 303997 - RNA, 63 nt, Homo Sapiens
gaagaugcuguaaauagguuaauuugcaccaucauguuucagucccuggucacccgacuuugg

SEQ ID NO: 303998 - RNA, 63 nt, Homo Sapiens
ggagcggcgugugggagaagccacgagugcgccauguuucagccagguguccugcccuuccgc

SEQ ID NO: 303999 - RNA, 63 nt, Homo Sapiens
guagugccucaucacaacccaugauggcuguucauguuucaccccuuuucuuccuucagcaga

SEQ ID NO: 304000 - RNA, 63 nt, Homo Sapiens
cuggauuuggacaaaaagcaaaucuagacaugcauguuucaggguucaguaguauacuucaug

SEQ ID NO: 304001 - RNA, 63 nt, Homo Sapiens
acaugcauguuucaggguucaguaguauacuucauguuucauacagauaauucacauucaaaa

SEQ ID NO: 304002 - RNA, 63 nt, Homo Sapiens
cauuuguaaacaguccuggucaguaguuaaauaauguuucaauuaaagugcuguaaaauaaac

SEQ ID NO: 304003 - RNA, 63 nt, Homo Sapiens
gccacugauauuuuuacuggauaaaauucaaaaauguuucaauucacaaaggcuaauuguuga

SEQ ID NO: 304004 - RNA, 63 nt, Homo Sapiens
ucugugaagccuuuacucucuaggugccuuauaauguuucagggcucaacuuuuuaaaaucca

SEQ ID NO: 304005 - RNA, 63 nt, Homo Sapiens
cgugugagaauuuaggagacacugugcacugacauguuucacaacaggcauuccagaauuaug

SEQ ID NO: 304006 - RNA, 63 nt, Homo Sapiens
aaugggacccaaaucuaaacacaaaauucauuuauguuucauauacaccuuauauacaauaac

SEQ ID NO: 304007 - RNA, 63 nt, Homo Sapiens
cgcuucaugacuaaaucacauaccaacuugacuauguuucaccuuaauauuuccuuuuccuca

SEQ ID NO: 304008 - RNA, 63 nt, Homo Sapiens
aucugcaacugcuugauaaguugauagcugauaauguuucauugugaaagugccaacaaauua

SEQ ID NO: 304009 - RNA, 63 nt, Homo Sapiens
gaaagaauuuuuucuugaucuguguuuuaccagauguuucauaauguguauauguaaauaaua

SEQ ID NO: 304010 - RNA, 63 nt, Homo Sapiens
cagugacagaccucauauaugugcccuauaaugauguuucaguauuuauuaaauucuaguuau

SEQ ID NO: 304011 - RNA, 63 nt, Homo Sapiens
ggguacucugccauagaaaucacaccaaacaagauguuucacucugcagcagggggugacuga

SEQ ID NO: 304012 - RNA, 63 nt, Homo Sapiens
ccugcuucucucagccagcucagagucgcuggcauguuucacuguggggacagauucgcagca

SEQ ID NO: 304013 - RNA, 63 nt, Homo Sapiens
cagcuauuaaaauguaacugcaguaauguagaaauguuucauacaugaauggagaugcccgca

SEQ ID NO: 304014 - RNA, 63 nt, Homo Sapiens
aaacacuuguaagauacuuauuuuaggaaaacaauguuucauguucauaauguugaauuugcc

SEQ ID NO: 304015 - RNA, 63 nt, Homo Sapiens
ugauuguuaagcaauagauuugcucuauugaaaauguuucauuuuuuucacuguacaagcaac

SEQ ID NO: 304016 - RNA, 63 nt, Homo Sapiens
gcugcauuccagccagggugacagagugagaccauguuucaaacaagaaacauuucagagggu

SEQ ID NO: 304017 - RNA, 63 nt, Homo Sapiens
ucgucaccauuauacuaaugaacaauagauuucauguuucaaaauuucagauuuuacauguua

SEQ ID NO: 304018 - RNA, 63 nt, Homo Sapiens
gguuguuaauuagcacauauuccuuuuagaaaaauguuucagaaaccucagucuugauaucug

SEQ ID NO: 304019 - RNA, 54 nt, Homo Sapiens
agcugccaagugaaaguugacaccauguuucagaacucuugcccucccucucau

SEQ ID NO: 304020 - RNA, 63 nt, Homo Sapiens
gauaucuauuugaaaguucucagaguuguacauauguuucacaguacaggaucuguacauaaa

SEQ ID NO: 304021 - RNA, 63 nt, Homo Sapiens
auuucauaugacauucaugccuggcuucgcaaaauguuucaaguacuguaacugugucaugau

SEQ ID NO: 304022 - RNA, 63 nt, Homo Sapiens
gagacuccgucucaaaaaaaaaaaaaaaaagaaauguuucauuuugguuuuucaccaaccuuc

SEQ ID NO: 304023 - RNA, 63 nt, Homo Sapiens
guuagagggucucuuacuccccgcccagcugugauguuucaucugcuuugguuguuuuggugg

SEQ ID NO: 304024 - RNA, 63 nt, Homo Sapiens
uacauguccucgacggaugccaaaguggaacagauguuucagauacuguuggacccagaagag

SEQ ID NO: 304025 - RNA, 63 nt, Homo Sapiens
uugacugccuaagggacagcacgaaugacucacauguuucagacaggccuccacggcuaugga

SEQ ID NO: 304026 - RNA, 63 nt, Homo Sapiens
cuugguggauuaaccaaggccuuggauuccagaauguuucaugguaagcacuguggagaaccu

SEQ ID NO: 304027 - RNA, 63 nt, Homo Sapiens
ucuacugugauucagacagauauucaauuuuguauguuucaccgaagugcugugauuguccug

SEQ ID NO: 304028 - RNA, 63 nt, Homo Sapiens
auuuccaucaccccagaaacgucaagacauagaauguuucaaccauguuuuaccaccacccag

SEQ ID NO: 304029 - RNA, 63 nt, Homo Sapiens
uugcaaccauugguuuugagagcuugacuguucauguuucauuaaugccuguguuaaagaggc

SEQ ID NO: 304030 - RNA, 63 nt, Homo Sapiens
gaaguuguuuauaaaauucagugguuuuaauauauguuucauggucuucauaccaaauuaaag

SEQ ID NO: 304031 - RNA, 63 nt, Homo Sapiens
auugcucugaaggucaaaagaacaccacuguguauguuucauccauucagcgcugcuguggcu

SEQ ID NO: 304032 - RNA, 63 nt, Homo Sapiens
cuuauuuauaggaaaguuauaugcauccuccaaauguuucauguaaccaagcacucauuauau

SEQ ID NO: 304033 - RNA, 63 nt, Homo Sapiens
auaagaccucuuguagcuacaauguuuuagagcauguuucaucuucauuuuuaauauccugaa

SEQ ID NO: 304034 - RNA, 63 nt, Homo Sapiens
gggguuuacaacaacuaggauguguugggugagauguuucagaucuggagaaaugagcaggug

SEQ ID NO: 304035 - RNA, 63 nt, Homo Sapiens
cccccagcaaggugccuggggagacuugagcagauguuucauuuuggccuggccaguggcuga

SEQ ID NO: 304036 - RNA, 63 nt, Homo Sapiens
uauugucaagguuaacauaaaugcucuucuaaaauguuucacuuacuccuaaacuagcuaucc

SEQ ID NO: 304037 - RNA, 63 nt, Homo Sapiens
gcugccucaccgcccagacauugauuuguucagauguuucaaugccucaugauacaauaaaac

SEQ ID NO: 304038 - RNA, 63 nt, Homo Sapiens
ucacaccagauccuaccccuuucccugagccacauguuucacacaaguguagaaaaugccagg

SEQ ID NO: 304039 - RNA, 63 nt, Homo Sapiens
guucuggcauuuaaauccuugcaccuacagagaauguuucacaucagccaccagacugucccg

SEQ ID NO: 304040 - RNA, 63 nt, Homo Sapiens
auaauaagggaauuaaggauuuucuguauuuguauguuucacuuauuuguuaaaugggguauu

SEQ ID NO: 304041 - RNA, 63 nt, Homo Sapiens
aaaccuuuugauauuucucagucugagcugaguauguuucaauaccgcuucauaagccaguac

SEQ ID NO: 304042 - RNA, 63 nt, Homo Sapiens
uggcugugccaaaggugaguguccugggauaucauguuucaagacuaaguccucuccagguug

SEQ ID NO: 304043 - RNA, 63 nt, Homo Sapiens
uuuuaaauuuaaaucccacauguguagauuuuuauguuucauaugcuugauuuuuaucaguuu

SEQ ID NO: 304044 - RNA, 63 nt, Homo Sapiens
ugaucuguuagaauaaccaaaaaaucauauuauauguuucaauuuuggccaaaaauuuuuuua

SEQ ID NO: 304045 - RNA, 63 nt, Homo Sapiens
gccaaagaaggcuuagugguuuugcaauuuuguauguuucauuucacugagacugcaucagag

SEQ ID NO: 304046 - RNA, 63 nt, Homo Sapiens
uucuuugaauacuugcacaugcuaaauggagaaauguuucaauuccucucacuuggccuugca

SEQ ID NO: 304047 - RNA, 63 nt, Homo Sapiens
uucauguaguuucuuaauauauacuugaaggaaauguuucaccuuauuuuuggucuuuguuua

SEQ ID NO: 304048 - RNA, 63 nt, Homo Sapiens
cccacucacuucccuuugguuuuucauauuuaaauguuucaauuucuguauuuuuuuuucuuu

SEQ ID NO: 304049 - RNA, 63 nt, Homo Sapiens
aggccucugggagugauuugguucuuugcccuaauguuucauuugacggucucuuuuugauca

SEQ ID NO: 304050 - RNA, 63 nt, Homo Sapiens
aaguugcaauuuauacuguauggcuucuuuuucauguuucaucuagguuuuuagaagugaagu

SEQ ID NO: 304051 - RNA, 63 nt, Homo Sapiens
cucugcaguugggaacggugaucuucuugaaugauguuucagugugcaaaaacuauagagccu

SEQ ID NO: 304052 - RNA, 63 nt, Homo Sapiens
ucaugcaggccuuuaccggcauugauguggcucauguuucaggcagacuugggguccuuaagg

SEQ ID NO: 304053 - RNA, 63 nt, Homo Sapiens
augucuagcuucugagucuagaugaaagacaguauguuucagagaacauuggauaucaguuuu

SEQ ID NO: 304054 - RNA, 63 nt, Homo Sapiens
gcagugucaagccugaaaccaagcaauaccgucauguuucagccaagcccagagcccuaagau

SEQ ID NO: 304055 - RNA, 63 nt, Homo Sapiens
aaggcuagagggcgacucugguggugcuuuuguauguuucaauuaggcucugaaaucuugggc

SEQ ID NO: 304056 - RNA, 63 nt, Homo Sapiens
cccacccucugccacccaguccucccagcugccauguuucaaagacgaccuuuaccuccugcc

SEQ ID NO: 304057 - RNA, 63 nt, Homo Sapiens
ggacgucuucauugaagauucacuuacaaaggaauguuucacuaaauaaaagaaaaccagaau

SEQ ID NO: 304058 - RNA, 63 nt, Homo Sapiens
ucccugaaggggagcucuuggauaucauuggccauguuucaaucgaauggagccacugggccc

SEQ ID NO: 304059 - RNA, 63 nt, Homo Sapiens
auuuuuuuaaugaaaagaaaaaacaagaaaguuauguuucauaauuucuuacaacaugagcca

SEQ ID NO: 304060 - RNA, 63 nt, Homo Sapiens
aguccuuaggccaaccaauuuaacugcagugucauguuucacaggccuuccuacauuuagaaa

SEQ ID NO: 304061 - RNA, 63 nt, Homo Sapiens
uccagacugauagguagucauuagccaugagaaauguuucaggauggcuagggaagacuugug

SEQ ID NO: 304062 - RNA, 63 nt, Homo Sapiens
aggcaagcaaaggagaugaaaucuguucugggaauguuucagcagccaauaagugcccgagca

SEQ ID NO: 304063 - RNA, 63 nt, Homo Sapiens
gacaaaguguugaaaauguauuuccugaaauaaauguuucaaaugcagaaacccagaaggcuc

SEQ ID NO: 304064 - RNA, 63 nt, Homo Sapiens
ucuuaggaaaggagaucaacauuuucaaauuagauguuucaacugugcucuuguuuugucuug

SEQ ID NO: 304065 - RNA, 63 nt, Homo Sapiens
uauguugauucaaacuugcugaaucuuaagaucauguuucaaacuugccugucauugcacuca

SEQ ID NO: 304066 - RNA, 63 nt, Homo Sapiens
auuuuuuucaaugaauguuauugugcugaaaauauguuucagugagaagagacaguuuaauau

SEQ ID NO: 304067 - RNA, 63 nt, Homo Sapiens
uuauuuuuggucuuuguuuaauacuugaaggaaauguuucaccuugguguaguuuuuuaauau

SEQ ID NO: 304068 - RNA, 63 nt, Homo Sapiens
aauuuaagaacucugaaacaauauguaaaugguauguuucaauuaaaguauaguacauuuuac

SEQ ID NO: 304069 - RNA, 63 nt, Homo Sapiens
guauaucaagcauuauagagaguugagcuggccauguuucacagcuuuuggugccagcuacag

SEQ ID NO: 304070 - RNA, 63 nt, Homo Sapiens
uuggcauaacaugguucuuuacuacuuuuuaccauguuucaucgaaucauggacagaacuuac

SEQ ID NO: 304071 - RNA, 63 nt, Homo Sapiens
uuauuuuuggucuuuguuuaauacuugaaggaaauguuucaccuucguguaguuuuuuaauau

SEQ ID NO: 304072 - RNA, 63 nt, Homo Sapiens
cuagucuaagugggucuuuuuauuuugcauuauauguuucaacuuuucuauagcagagcauua

SEQ ID NO: 304073 - RNA, 63 nt, Homo Sapiens
ugaaacaauuuaucuuaaugucucaauuaccaaauguuucauucucagauauuaaaguaguau

SEQ ID NO: 304074 - RNA, 63 nt, Homo Sapiens
gacaguggucugugcuggcagcugugccuucucauguuucauacugcuggacaucuuugccag

SEQ ID NO: 304075 - RNA, 63 nt, Homo Sapiens
uauguguguacacuucugaccagcucuuggugcauguuucagauggcacugguguugcuggcu

SEQ ID NO: 304076 - RNA, 63 nt, Homo Sapiens
cagagcuuuagaggaagacacauagguggguuuauguuucaccucauuuggaacaaaagagga

SEQ ID NO: 304077 - RNA, 63 nt, Homo Sapiens
auacacuacagaauuuagucaacauuuuauauaauguuucaauaaauguuucuuucaauaaag

SEQ ID NO: 304078 - RNA, 63 nt, Homo Sapiens
aguuaugacauuagcuuuaaagguguaaaaaagauguuucacuaauguaacggugaaagagaa

SEQ ID NO: 304079 - RNA, 63 nt, Homo Sapiens
uuaacaaugucugaucucagcugaacaaauuagauguuucaguugcucuugggucaacuggcu

SEQ ID NO: 304080 - RNA, 63 nt, Homo Sapiens
acaaauguuuauacaaauacauacauguacaccauguuucaaauacuaaauaaauagaguuua

SEQ ID NO: 304081 - RNA, 63 nt, Homo Sapiens
uguaaacugcucugcauauaaaccaagggcagaauguuucacccugaucuuaugggaggaauc

SEQ ID NO: 304082 - RNA, 63 nt, Homo Sapiens
aagggaagucuugagguuuuagaggugugaauuauguuucaucaaugugcagaauaaucacaa

SEQ ID NO: 304083 - RNA, 63 nt, Homo Sapiens
aauuauuuuucaauuuuauuuuaguucuaaauuauguuucagaaacaaaagacaaugcuguac

SEQ ID NO: 304084 - RNA, 63 nt, Homo Sapiens
acuuauuuuagucaaugaauaaaauuccaguccauguuucaugaaugaaacuuaauagcucac

SEQ ID NO: 304085 - RNA, 63 nt, Homo Sapiens
caucacaagacaaccuuuucaucaacuaugaauauguuucaaguguccccuuuucuggcauaa

SEQ ID NO: 304086 - RNA, 63 nt, Homo Sapiens
gaaaaaugucuuuaaugcuuugacauguucuguauguuucagguguaaacaagagauuuggca

SEQ ID NO: 304087 - RNA, 63 nt, Homo Sapiens
cauugccauuaccaauaaauccagagacugucaauguuucauuggauaauugcuugauucucg

SEQ ID NO: 304088 - RNA, 63 nt, Homo Sapiens
cugugguucccccaagcucuagucuucuuccugauguuucaaaaaaaucucuguacagauugc

SEQ ID NO: 304089 - RNA, 63 nt, Homo Sapiens
cuuaauaaguccucaauucuuaacagauauaagauguuucauacuggagcgaaacuacaaucc

SEQ ID NO: 304090 - RNA, 63 nt, Homo Sapiens
acaacagagaaacccuauaaagaaugauacaauauguuucaaucagaaccuucacauccaaua

SEQ ID NO: 304091 - RNA, 63 nt, Homo Sapiens
cuuuugagaaaugccuguucagcuacuuugcccauguuucaaguaguuuuugguuucuugcug

SEQ ID NO: 304092 - RNA, 63 nt, Homo Sapiens
cauggauuucuuaguguauuugggggaagggaaauguuucaagguaaagaaccuugacccuuu

SEQ ID NO: 304093 - RNA, 63 nt, Homo Sapiens
ucauccccuccuuauuuuauuugggagagggaaauguuucagaaacaaaagggccucaucccc

SEQ ID NO: 304094 - RNA, 63 nt, Homo Sapiens
ucgucccuuuguuauuuuaugugggagagggaaauguuucagaaacgaaagaucucauccccu

SEQ ID NO: 304095 - RNA, 63 nt, Homo Sapiens
cacauuguccacuucagaugcuuguuuaaaaaaauguuucaccaugugucuuuacccaauaca

SEQ ID NO: 304096 - RNA, 63 nt, Homo Sapiens
cugcuauauuugaaugcaguuguucauguagguauguuucacuaugguaauaugguggugugc

SEQ ID NO: 304097 - RNA, 63 nt, Homo Sapiens
ggcccggggccccccagggaccuucuguccuggauguuucaugucugugucccauccugcugu

SEQ ID NO: 304098 - RNA, 63 nt, Homo Sapiens
cauccauacuucuguuuuuggccauggucuauaauguuucaugauuggagugauggauuuggu

SEQ ID NO: 304099 - RNA, 63 nt, Homo Sapiens
uuagagaaauaacuauuacuuaaaaugaaauauauguuucauuguaauauauauauauauaua

SEQ ID NO: 304100 - RNA, 63 nt, Homo Sapiens
cuucagccuuuaaccuauacgauuuuuuuuuguauguuucaagauauaucuugcucuauagag

SEQ ID NO: 304101 - RNA, 63 nt, Homo Sapiens
agcuguuguuguuuuucucuaaacugauccuucauguuucaauggguucccagagcuccgagg

SEQ ID NO: 304102 - RNA, 63 nt, Homo Sapiens
gaaaccagugaaauauuucauuucuaaaauuacauguuucacuuuuuuuuauugagaauaaau

SEQ ID NO: 304103 - RNA, 63 nt, Homo Sapiens
cuccagauuuaugaacauuugcugauucuuggaauguuucauuaauuuucuauuugaaaaugu

SEQ ID NO: 304104 - RNA, 63 nt, Homo Sapiens
caucucagcccaggcaccaggauagagccccagauguuucagcauguauaaaugccaugugga

SEQ ID NO: 304105 - RNA, 63 nt, Homo Sapiens
agcauucaggcacugccaggcagcuaacauuccauguuucagauccugaaaaaugcucaaucu

SEQ ID NO: 304106 - RNA, 63 nt, Homo Sapiens
gaguuauuugagguuuuuuguucaccuuaugaaauguuucacuuuuguaggcagucaguuacc

SEQ ID NO: 304107 - RNA, 63 nt, Homo Sapiens
gguccucauguguacuaguguucauagucauuuauguuucaucuuuccuucaccauuuaucau

SEQ ID NO: 304108 - RNA, 63 nt, Homo Sapiens
uggcauucugcauguuuagugauugucuugggaauguuucacugcuacccgcauccagcgacu

SEQ ID NO: 304109 - RNA, 63 nt, Homo Sapiens
auauuuucacuguuccuucuuucuuaaagucuuauguuucacucuuuaacucaaauguauucu

SEQ ID NO: 304110 - RNA, 63 nt, Homo Sapiens
ucaucaaguuaucuuuauaaucacuguaguuagauguuucauguccauucaagugacuuuuau

SEQ ID NO: 304111 - RNA, 63 nt, Homo Sapiens
gagaccaugagaauuccagguucccaaaauagaauguuucagugcuaggaucauuggauucag

SEQ ID NO: 304112 - RNA, 63 nt, Homo Sapiens
augccugugagcuaggucuuguaggacagugccauguuucaagccuuuaaaugucccauggau

SEQ ID NO: 304113 - RNA, 63 nt, Homo Sapiens
agccuaacuuuuuacacaguuguaauguuuuuaauguuucagaguaaaaaggcagaccaggga

SEQ ID NO: 304114 - RNA, 63 nt, Homo Sapiens
guuuagucacagcuuaaaaaguggugcagggcaauguuucaaacaguacuugauuuaggaucu

SEQ ID NO: 304115 - RNA, 63 nt, Homo Sapiens
acauuaacuucuaaagaaguuuuuucuaagaaaauguuucaaggcaauauuuuuuuugaggcu

SEQ ID NO: 304116 - RNA, 63 nt, Homo Sapiens
acuaaacuuuuguguccauauuuuacugagaccauguuucauuaaaagcauaguuucauagua

SEQ ID NO: 304117 - RNA, 63 nt, Homo Sapiens
caacacucgugaggccaggaagcuauuaaagggauguuucaagcuguuucuagcacauuccaa

SEQ ID NO: 304118 - RNA, 63 nt, Homo Sapiens
uguagcuuucucucuuaccuucuggaagagggaauguuucauuuauuacuguuugauuuucuu

SEQ ID NO: 304119 - RNA, 63 nt, Homo Sapiens
cucuuuuuccaaggcccggaguacuggggauugauguuucaaggccaaucaaugggaugcuuc

SEQ ID NO: 304120 - RNA, 63 nt, Homo Sapiens
caaaggauuugagauguucucaauaaaaagaaaauguuucacuacucugguguugcugagacu

SEQ ID NO: 304121 - RNA, 63 nt, Homo Sapiens
caagcagucccccaacucccccagaagagagaaauguuucacgaccaagacuaaguuuuaaau

SEQ ID NO: 304122 - RNA, 63 nt, Homo Sapiens
ccaaggaggcaaaucuauaagguugugugaaagauguuucauaaaaugacuccuacaauugag

SEQ ID NO: 304123 - RNA, 63 nt, Homo Sapiens
accauauaauagaaauacccuaaagguauucaaauguuucagcagaugaauuuauuuuauuuc

SEQ ID NO: 304124 - RNA, 63 nt, Homo Sapiens
cgcucggccgggaacgaguggggcccuuaguggauguuucagaaaucggugucucaggccacu

SEQ ID NO: 304125 - RNA, 63 nt, Homo Sapiens
aaggaaauauugagagagaaacuuccucuuaggauguuucaccaugugauuuucucuaaugua

SEQ ID NO: 304126 - RNA, 63 nt, Homo Sapiens
uacaguucucugcguucgucacuuaauuccugaauguuucagagaaacaggaaucagaaaaua

SEQ ID NO: 304127 - RNA, 63 nt, Homo Sapiens
ccagcaagaagggcuuggguucugaggaagcagauguuucaugcugugaggccuugcaccagg

SEQ ID NO: 304128 - RNA, 63 nt, Homo Sapiens
uuugcucugcaauucugcagguacuggaucaugauguuucaaaggaagaaccagucaccuuuc

SEQ ID NO: 304129 - RNA, 63 nt, Homo Sapiens
uuuaguugaaugccacugaagagcugugauagcauguuucaaagcugaacucuacagagcgag

SEQ ID NO: 304130 - RNA, 63 nt, Homo Sapiens
gacagagacguggcauuuggaaacgaaacuuagauguuucauggagcuuauuuugagaacuuu

SEQ ID NO: 304131 - RNA, 63 nt, Homo Sapiens
aaugucaagcuguggaccaaaauacuagcugguauguuucauaggacaaauugacugcaaugu

SEQ ID NO: 304132 - RNA, 63 nt, Homo Sapiens
cugacagauuauuuuuauuuguacccuguggggauguuucauacaaauuccucuuugaugaau

SEQ ID NO: 304133 - RNA, 63 nt, Homo Sapiens
ccacaaggggcuccacaccucauaggguccugaauguuucagauggacagucucaccuccugc

SEQ ID NO: 304134 - RNA, 63 nt, Homo Sapiens
gccagaaaagugaaguccuagguguuuccaucuauguuucaaucuguccaucuaccaggccuc

SEQ ID NO: 304135 - RNA, 63 nt, Homo Sapiens
caucagaucuucucaccuugauuuugagcuggaauguuucaaugagcaaaauaaauuagacaa

SEQ ID NO: 304136 - RNA, 63 nt, Homo Sapiens
cauugcuguaaaucuuaaaaugaaugaauaaaaauguuucauuuuacaagaggaguguaugau

SEQ ID NO: 304137 - RNA, 63 nt, Homo Sapiens
ugugacauagauuauacuacuacuaauuuuuggauguuucaaaaggucaagaaguaaaagaug

SEQ ID NO: 304138 - RNA, 63 nt, Homo Sapiens
agagccagagacaguguugcaacugggccuggcauguuucagugugguguccagcagugucuc

SEQ ID NO: 304139 - RNA, 63 nt, Homo Sapiens
uuuccauaguaaauugucuugcaguuuuugaaaauguuucaagucuaguuuuuacaagcacau

SEQ ID NO: 304140 - RNA, 63 nt, Homo Sapiens
cuugaugagauugaaacauggcuuuuggcaugaauguuucauagguuauguuguguucauuua

SEQ ID NO: 304141 - RNA, 63 nt, Homo Sapiens
ugugaucuuuccuguccugacccucucugaauuauguuucaauaguacucuugauugucugcc

SEQ ID NO: 304142 - RNA, 63 nt, Homo Sapiens
uuuucauauuuaguucugguguggugucuggaaauguuucaacuguuuuaauauauugucuga

SEQ ID NO: 304143 - RNA, 63 nt, Homo Sapiens
guuuugacccaccugccaguguuugcuugcucuauguuucaguagcagauuuucacacaugug

SEQ ID NO: 304144 - RNA, 63 nt, Homo Sapiens
uuuaaaaagguacuuaaauuuucuggaauauccauguuucagagguaauauuuacuuucuauu

SEQ ID NO: 304145 - RNA, 63 nt, Homo Sapiens
uccaauuagaaaaugggcaaaagacaugaauagauguuucacugaagaggaucuauagauggc

SEQ ID NO: 304146 - RNA, 63 nt, Homo Sapiens
agguugccuaugaaaaacuguguauuucuuuugauguuucaaagaaauuugugaaaaauauau

SEQ ID NO: 304147 - RNA, 63 nt, Homo Sapiens
uuuaaguguauuuaaagaaagaacuaccaucugauguuucauauuauagucuuccaguuuaau

SEQ ID NO: 304148 - RNA, 63 nt, Homo Sapiens
uucuaagugaagugaguugguuuguuuuuuuuaauguuucaggaagaggcugaugucuuuguu

SEQ ID NO: 304149 - RNA, 63 nt, Homo Sapiens
aauauaagaaaaguucaaaauuaguuaaaacauauguuucaaaucuguauuuuucuuguagug

SEQ ID NO: 304150 - RNA, 63 nt, Homo Sapiens
ccaucauccagcuuuggcugcaguuguauaguaauguuucaguauauuguauauguuuugucc

SEQ ID NO: 304151 - RNA, 63 nt, Homo Sapiens
uuucuaaauuuaacagagauugauaacucuuccauguuucacauuuaguauuguauuccaagu

SEQ ID NO: 304152 - RNA, 63 nt, Homo Sapiens
uaagguaacuccuagauaucaacauaacucauuauguuucagauuugauugcagacacuguag

SEQ ID NO: 304153 - RNA, 63 nt, Homo Sapiens
ugacaaaaagucguucuaauucaauaaaguuguauguuucaacaagacuucauuuguguauca

SEQ ID NO: 304154 - RNA, 63 nt, Homo Sapiens
uuguuuuccguucuguuuuauauaacagggcuuauguuucaguguucuuuaaaaucguuaaug

SEQ ID NO: 304155 - RNA, 63 nt, Homo Sapiens
aucagaucaauacaaucuugcauggaacaaagcauguuucagguguuuauuauccugaucaag

SEQ ID NO: 304156 - RNA, 63 nt, Homo Sapiens
agaagcuguuuugcuaaauuauuuuuacuuggaauguuucaaacagauuucaggcugcaaacu

SEQ ID NO: 304157 - RNA, 63 nt, Homo Sapiens
gaaaccaacuugucccaggccacaggaguguauauguuucauaaucuuuaucaagaaguuugu

SEQ ID NO: 304158 - RNA, 63 nt, Homo Sapiens
uacuuccaccuaaucuguuuacagucuuuugguauguuucaguuacuuagauggucucauaag

SEQ ID NO: 304159 - RNA, 65 nt, Homo Sapiens
aguggauuugcuuuaacccucacauuuuuuuuuuaauguuucacauguuacauuauuagcugaau

SEQ ID NO: 304160 - RNA, 65 nt, Homo Sapiens
agggcagucuggcgcccaugaugggagggauugacauguuucaacaaaauaaugcacuuccuuac

SEQ ID NO: 304161 - RNA, 65 nt, Homo Sapiens
auuuuucuuaaauccaaguuggccguuuuauuaguauguuucaaauguguauuaccaaugugggu

SEQ ID NO: 304162 - RNA, 65 nt, Homo Sapiens
uuaauaucuccaugcauaguuuuagacaaaaaaagauguuucaauaaaauuacugucuuguaaua

SEQ ID NO: 304163 - RNA, 65 nt, Homo Sapiens
aacucaaccaauuuggcaccccaugcagccucaaaauguuucaaaugccuaccgccucuagaucg

SEQ ID NO: 304164 - RNA, 65 nt, Homo Sapiens
uuggcuucuuuucucccuugauggucaagucucuuauguuucaauauuucuuaacuggggugucu

SEQ ID NO: 304165 - RNA, 65 nt, Homo Sapiens
aaaugucaugaaugauuuccaguuuuuaaagcuauauguuucacugcuucauaucucuguccacu

SEQ ID NO: 304166 - RNA, 65 nt, Homo Sapiens
cacgcacacaugauuuugauuaugcuacaugauauauguuucaaaaagaauuagcauagaaaucc

SEQ ID NO: 304167 - RNA, 65 nt, Homo Sapiens
cuagguaggggauugcugggccauaugauaagcauauguuucaguucuaccaaucuuguuuccag

SEQ ID NO: 304168 - RNA, 65 nt, Homo Sapiens
acagaaaaacauuaaaaaguucauuccuuaacacaauguuucaaguuaaaccuuuugugucaccg

SEQ ID NO: 304169 - RNA, 65 nt, Homo Sapiens
uguuugauaaauauccucucaguguuuuaucuuccauguuucaacaacuauugaaauaugaaaug

SEQ ID NO: 304170 - RNA, 65 nt, Homo Sapiens
uggguuucucuguauaguacuggcaugguacggagauguuucacgaaguuuguucaucagacucc

SEQ ID NO: 304171 - RNA, 65 nt, Homo Sapiens
augugcuugccugaaauaaagcuaauaaaaauauuauguuucacauuaucuucuguucauuuuga

SEQ ID NO: 304172 - RNA, 65 nt, Homo Sapiens
aaaaaaugcaaaucgacuuuuuaacaacuguugagauguuucaugggacaguagaacucugacuc

SEQ ID NO: 304173 - RNA, 65 nt, Homo Sapiens
accacgcuugguuaauuuuuguauuuuuaguagagauguuucaccauguuggccaggcuagucuu

SEQ ID NO: 304174 - RNA, 65 nt, Homo Sapiens
ugccggguguuguauguguggugacuugcggauuuauguuucaguguacuggaaacuuuccauuu

SEQ ID NO: 304175 - RNA, 65 nt, Homo Sapiens
ugugauuuuguaaauuucaguaauucauuuaaaugauguuucaguagauauauucuagcauauua

SEQ ID NO: 304176 - RNA, 65 nt, Homo Sapiens
aaauccaaaauuaugauaacuguauuucuagggguauguuucaccuugauuuuggcccgguucuu

SEQ ID NO: 304177 - RNA, 65 nt, Homo Sapiens
cccuacuugguaacaaaguucucagauguuaggucauguuucauuugcucagucggggaucacuc

SEQ ID NO: 304178 - RNA, 65 nt, Homo Sapiens
uuuagcaggugaacuguuccaagacugacacaaggauguuucaaacuugccucugucuguagaaa

SEQ ID NO: 304179 - RNA, 65 nt, Homo Sapiens
uacguauuauauagagaaacaaauguuuuuauuaaauguuucauugacccaaguaauuuaaaagu

SEQ ID NO: 304180 - RNA, 65 nt, Homo Sapiens
cuguuuuucauacucuuaaguguaaauaauauaaaauguuucaagcgcuuaacucccccucauuc

SEQ ID NO: 304181 - RNA, 65 nt, Homo Sapiens
uuuagagcuuuagaaauuuguaagcugagagaacaauguuucacuuaauaggagggugucuuagu

SEQ ID NO: 304182 - RNA, 65 nt, Homo Sapiens
cuuacucuuucuuuuaagauaaguuguagacuucgauguuucaugcucauguacuucaaauaaug

SEQ ID NO: 304183 - RNA, 63 nt, Homo Sapiens
uugaaaucuguuaaaauaaaauuguacauuuggagauguuucaugaugauguguuuauuucua

SEQ ID NO: 304184 - RNA, 65 nt, Homo Sapiens
ggaaacuugugacuuguguauuaucgucauugaggauguuucacucaugucugucauuuuauaag

SEQ ID NO: 304185 - RNA, 65 nt, Homo Sapiens
gcaugguaaguucccuuagcuauaugaauuuuggcauguuucagagagaucaguaaauaaaauau

SEQ ID NO: 304186 - RNA, 65 nt, Homo Sapiens
aaaugcggagacguaaagcauuaaugcaaguuaaaauguuucagugaacaaguuucagcgguuca

SEQ ID NO: 304187 - RNA, 65 nt, Homo Sapiens
uuaauuucuugaaaauguauuugaaguaaauuuuaauguuucauaaucuagaaaacuuuggauuu

SEQ ID NO: 304188 - RNA, 65 nt, Homo Sapiens
ucugguuuaaccaggcuuuuauugggaaaccauguauguuucauuggagacucagaaggggaagc

SEQ ID NO: 304189 - RNA, 65 nt, Homo Sapiens
aggcuggaggaagggggguuccaaaggauagugcgauguuucagguaucuauauggaauugcuua

SEQ ID NO: 304190 - RNA, 65 nt, Homo Sapiens
acuauaauuuaauugggaaaauauuccucuauuagauguuucaaccaagucaacuuaccuauuaa

SEQ ID NO: 304191 - RNA, 65 nt, Homo Sapiens
augcacuuuuagaaaugcauagcuagaaaaauaaaauguuucauuauuucuaugacaaauucaag

SEQ ID NO: 304192 - RNA, 65 nt, Homo Sapiens
uucucugcugugaaacucuugucuauaaccugaaaauguuucaugcugugacaccaaaaagaaaa

SEQ ID NO: 304193 - RNA, 65 nt, Homo Sapiens
auuauaagaaaggcagaaugacuucuaaagaaaauauguuucagcacuuugucguguuuguuuua

SEQ ID NO: 304194 - RNA, 65 nt, Homo Sapiens
ugcagucugaugccagguaucacauguguugacccauguuucagaaggaaacaugcucagucaug

SEQ ID NO: 304195 - RNA, 65 nt, Homo Sapiens
gucaagcccacauugcuuuuuccccaauaaagcacauguuucauguguguuuauucuuuugcuuc

SEQ ID NO: 304196 - RNA, 65 nt, Homo Sapiens
guccuuucuucucugucccugauuaccauguguggauguuucaguuaaaggcaaaccuggcuuuu

SEQ ID NO: 304197 - RNA, 56 nt, Homo Sapiens; identical to SEQ ID NO: 303635

SEQ ID NO: 304198 - RNA, 65 nt, Homo Sapiens
gguuugugaugaucuuuacgucuuguuugggaaugauguuucauauccuagauacuauuacgcua

SEQ ID NO: 304199 - RNA, 65 nt, Homo Sapiens
cucugauugccccaauaaaagacguguaaaaaaugauguuucaucauaauccuagaccuuuucau

SEQ ID NO: 304200 - RNA, 65 nt, Homo Sapiens
uuucaauuuuuuuucagauuugcuugggauuagaaauguuucagaugagcaucccuugucugaaa

SEQ ID NO: 304201 - RNA, 65 nt, Homo Sapiens
ucugugucaugguuggaagaugagauuuuuaaaguauguuucaguccaccgugccuagccaagga

SEQ ID NO: 304202 - RNA, 65 nt, Homo Sapiens
gcaacugcuuuauaugacuguuucucacuuuucacauguuucauaaaauccacaauuaaaccaug

SEQ ID NO: 304203 - RNA, 65 nt, Homo Sapiens
gugaaugcaaaaaagagagauaaagugacacuuaaauguuucagaaccuaacccugauaguuacc

SEQ ID NO: 304204 - RNA, 51 nt, Homo Sapiens; identical to SEQ ID NO: 303642

SEQ ID NO: 304205 - RNA, 65 nt, Homo Sapiens
gccucagacaaauguguauuggguuguguaugcgaauguuucagucugacaaaaccugggaauuu

SEQ ID NO: 304206 - RNA, 65 nt, Homo Sapiens
auagacaaguuuuguuuccuuuuuauaguuauuaaauguuucaaaaaugugucucaggcucaagu

SEQ ID NO: 304207 - RNA, 65 nt, Homo Sapiens
aaugcaguucucacgaaagucauuauaaaguucagauguuucaucguugaguuauuccacaaaca

SEQ ID NO: 304208 - RNA, 65 nt, Homo Sapiens
uuugcugugcuuuucugaauuaguucagcuuuucaauguuucaugccuaacaaacaaaagaaaug

SEQ ID NO: 304209 - RNA, 65 nt, Homo Sapiens
ugcuuaaauauauaauacauaacugcagcuauagaauguuucaaauuacuuucugcugugaacug

SEQ ID NO: 304210 - RNA, 63 nt, Homo Sapiens
cucugugucuguuuuuaauuaagaaauaaaaaaugauguuucaaauugaauguagauacucag

SEQ ID NO: 304211 - RNA, 65 nt, Homo Sapiens
aaaauaaagcuuaaaaauugaugagggaaucugaaauguuucauagcuuauugaugugcugugau

SEQ ID NO: 304212 - RNA, 65 nt, Homo Sapiens
aaaacauuguagauaucuauuuauauuuaaaguuuauguuucaugaacugcagcugcaggauucu

SEQ ID NO: 304213 - RNA, 65 nt, Homo Sapiens
gagccuuuuaaguaguuugaaugauaagacuuaaaauguuucauaauuauguuuuauguaacaga

SEQ ID NO: 304214 - RNA, 65 nt, Homo Sapiens
ccuguacugauaguacuucccaguaugauauugugauguuucauacaaugcagugaacauaacca

SEQ ID NO: 304215 - RNA, 65 nt, Homo Sapiens
ccucuuaacuaauugcgguuucauaggauauauaaauguuucaagccauuauugcugaaugguuc

SEQ ID NO: 304216 - RNA, 65 nt, Homo Sapiens
uuauguaagcauguauacacugugcuaaaagucacauguuucaguuuguguauaauauuaauaug

SEQ ID NO: 304217 - RNA, 65 nt, Homo Sapiens
agaacaggaaaaaauaauuauaagaugauaagcaaauguuucagcccaaugucaacccaguuaaa

SEQ ID NO: 304218 - RNA, 65 nt, Homo Sapiens
ccgcugccauaguuuucuaacuugaacagccaugaauguuucaugucucccuuuuuuuuugucua

SEQ ID NO: 304219 - RNA, 65 nt, Homo Sapiens
uccauguuguccuuucuggcuucccugauggugucauguuucagcgcaugcgccccagccuuucc

SEQ ID NO: 304220 - RNA, 65 nt, Homo Sapiens
aaugaauccuugugguuuuuaguuuuguauaaauuauguuucaaaucuuuacauuuuggaaauaa

SEQ ID NO: 304221 - RNA, 65 nt, Homo Sapiens
uuacuuuuuggggaaguaaaagaagauggaaauggauguuucauuuguaugaguuuggagcagug

SEQ ID NO: 304222 - RNA, 65 nt, Homo Sapiens
aucuauucuuucccuagaggcaaacauuucuuaaaauguuucauuuucauuaaaaaugaaagcca

SEQ ID NO: 304223 - RNA, 65 nt, Homo Sapiens
guaccauaccaacuggaauuuaggcuuuaaaaauaauguuucaaggccagguguggugauucaug

SEQ ID NO: 304224 - RNA, 65 nt, Homo Sapiens
ucuuuuguguauuuauacuuguauguaugauuugcauguuucaaugauaaagggauaaaacagua

SEQ ID NO: 304225 - RNA, 65 nt, Homo Sapiens
gaccauagauugcugucccccucgacggacuuauaauguuucagguggcuggcuugaacaugagu

SEQ ID NO: 304226 - RNA, 65 nt, Homo Sapiens
aucugcuaaguuguaccuuaauuagagggcaauauauguuucauaaagaagagucuuuauaauuu

SEQ ID NO: 304227 - RNA, 65 nt, Homo Sapiens
cuaguugaccuagauuguauuaauagcuacuuaagauguuucaaagauaggaagcuauugcuugg

SEQ ID NO: 304228 - RNA, 65 nt, Homo Sapiens
aaaagggagagaacaaaagcuauaccaaaagggccauguuucaagaaaauggauuuaaacauauu

SEQ ID NO: 304229 - RNA, 65 nt, Homo Sapiens
uccaaucagaccagguaggagcuuuccuguuucauauguuucaggguugcacaguuggucucuuu

SEQ ID NO: 304230 - RNA, 65 nt, Homo Sapiens
guggcaugaaaauuuucuuaagcuaaaauacagacauguuucaaagggcuaaaguuggagaugag

SEQ ID NO: 304231 - RNA, 65 nt, Homo Sapiens
auacuaaaggauauacauauacugccucuucuaugauguuucauuugaccuacaccaucagcauc

SEQ ID NO: 304232 - RNA, 65 nt, Homo Sapiens
ugacuuuugaaaacaaaauaugaaaagaaucggcaauguuucaaacaaaaagucauaaaagucac

SEQ ID NO: 304233 - RNA, 65 nt, Homo Sapiens
gauggcuacaucuguaucuuuuccuccuguguuuaauguuucacuagggagaggaaauaaagcag

SEQ ID NO: 304234 - RNA, 65 nt, Homo Sapiens
gugguguggugggccaaaaucuugcccuucauuacauguuucaaauuguuuuuuuuauuauaaaa

SEQ ID NO: 304235 - RNA, 65 nt, Homo Sapiens
guuggggucauagauguuucgaauuagcugcuucuauguuucauagcucugcuucaauguaguca

SEQ ID NO: 304236 - RNA, 65 nt, Homo Sapiens
gauuccugaccauaagugacuuaggcaaaaauaaaauguuucaaguguuuacauuggauaaagga

SEQ ID NO: 304237 - RNA, 65 nt, Homo Sapiens
uauuuccuacuuuuccacuaaucccugagucucagauguuucauuaccacacagacugcucucca

SEQ ID NO: 304238 - RNA, 65 nt, Homo Sapiens
guagucaaaauaaacauaaaagcaagagugucauaauguuucaggagaaauuauaucuguuuugg

SEQ ID NO: 304239 - RNA, 65 nt, Homo Sapiens
cgagaaaacaugaaggagggaaauagggcaaguuuauguuucauguacucaguaggaacuuuuug

SEQ ID NO: 304240 - RNA, 65 nt, Homo Sapiens
gccagguguggugauucauguaggcuuuaaaaauaauguuucaagguaccauaccaacuggaauu

SEQ ID NO: 304241 - RNA, 65 nt, Homo Sapiens
gccuagucugaaaaauaacaguuuuuguagaaaaaauguuucagugaagagacaaucucuggcaa

SEQ ID NO: 304242 - RNA, 65 nt, Homo Sapiens
uauauaaaagcaaaagaacucuauuuauagaauaaauguuucauuaaauucugaaaaauacauuu

SEQ ID NO: 304243 - RNA, 65 nt, Homo Sapiens
gaguaagccuguugugacuuugcuuguaauccagcauguuucacaucugcguccuggguagucug

SEQ ID NO: 304244 - RNA, 65 nt, Homo Sapiens
augauuuucuauuuuucuucaauauuuuauaugaaauguuucacuauguaacauuaauucuacua

SEQ ID NO: 304245 - RNA, 57 nt, Homo Sapiens; identical to SEQ ID NO: 303683

SEQ ID NO: 304246 - RNA, 65 nt, Homo Sapiens
uuauuugauauuuauuuucaaaacaauuagauguuauguuucauauuguguuauuuuuucuuauc

SEQ ID NO: 304247 - RNA, 65 nt, Homo Sapiens
uauguaauggggcaaaccacuguuuucauaagacaauguuucagauauuuaauuuuguuucauuu

SEQ ID NO: 304248 - RNA, 65 nt, Homo Sapiens
caccggcugcacaggcacaagcugagaagaugccaauguuucaucgccucccacugggagucauc

SEQ ID NO: 304249 - RNA, 65 nt, Homo Sapiens
uaaauauauauuauauaaauauauuaaaaaggaaaauguuucagauguuuauuuguauaauuacu

SEQ ID NO: 304250 - RNA, 65 nt, Homo Sapiens
aauuauaaccaaaaacaaugugacggauacccaagauguuucauguuguagcuugggugaauuac

SEQ ID NO: 304251 - RNA, 65 nt, Homo Sapiens
uaauuuuuaauaacaugcaugggucccucucacuaauguuucaacaauagggaaaaaugagaacu

SEQ ID NO: 304252 - RNA, 65 nt, Homo Sapiens
cugguguagaauuuacacugcugcaccugaggucgauguuucaaaguaagaucaagccaguguuu

SEQ ID NO: 304253 - RNA, 65 nt, Homo Sapiens
ucaagugacauuucaaaagaaguucuauaacaauuauguuucaugcuuaaaguaaaaauucccag

SEQ ID NO: 304254 - RNA, 65 nt, Homo Sapiens
uauuaaucaugcaguguacaauucaaaaucaugcaauguuucacuuuagaauuggauuugaagaa

SEQ ID NO: 304255 - RNA, 65 nt, Homo Sapiens
cauucaaauggcaguagccuuggcucacauaagacauguuucaugugaucuguauccuggcauac

SEQ ID NO: 304256 - RNA, 65 nt, Homo Sapiens
gcaugcauguauaggccgaacuauuaucagcucugauguuucagagagaagaccucagaaaccga

SEQ ID NO: 304257 - RNA, 65 nt, Homo Sapiens
cacauguaaagaauauaugagccuuguauggagugauguuucauuuaccuggguuguguuaauga

SEQ ID NO: 304258 - RNA, 65 nt, Homo Sapiens
auacuguuggucuagccugugaagcaauuaaucgaauguuucagaaggagcagagugaauuagua

SEQ ID NO: 304259 - RNA, 65 nt, Homo Sapiens
cuauggacuggcuuaagccguguggcauccgaggaauguuucaaaugugucuguguuucucuuua

SEQ ID NO: 304260 - RNA, 65 nt, Homo Sapiens
acaggacauuaauaaugguguacuuuaaaaaauauauguuucauuuaaucuucacaaaagaucug

SEQ ID NO: 304261 - RNA, 65 nt, Homo Sapiens
cugccuccgccgccacugcugcugccaccucuuauauguuucagacacucucugcccagacucau

SEQ ID NO: 304262 - RNA, 65 nt, Homo Sapiens
aaaaaauaacuauaucauaacucauucauaacuugauguuucauuuucuguugaggaaccauaaa

SEQ ID NO: 304263 - RNA, 65 nt, Homo Sapiens
aauauuaaaugauuuagcagucuccacguguguuaauguuucaaacguguaucauaauguguaua

SEQ ID NO: 304264 - RNA, 65 nt, Homo Sapiens
aauuaugauauggacguuaucauuggucuggugagauguuucauauuugugacaguuaauuuaaa

SEQ ID NO: 304265 - RNA, 65 nt, Homo Sapiens
ugccaacugccaagccauacuuauuaaguucgaacauguuucacuuaaggagagacaccuagcuu

SEQ ID NO: 304266 - RNA, 65 nt, Homo Sapiens
uugaaaacacaagaugaccuauuuuaccauaugaaauguuucauaccaagaagucuugggauugg

SEQ ID NO: 304267 - RNA, 65 nt, Homo Sapiens
cagauuuauauguuuggaggucggguggggaaucuauguuucacuuuuagugaagaaacaaguuc

SEQ ID NO: 304268 - RNA, 65 nt, Homo Sapiens
uauaguuuuauacaaaguagaaagaaagaaauuuuauguuucacacacuuggacguuucauuuug

SEQ ID NO: 304269 - RNA, 65 nt, Homo Sapiens
uuuaaaucauguuuuccuaaauuaauuuauauuacauguuucauaugaauaaaucaugccacuau

SEQ ID NO: 304270 - RNA, 65 nt, Homo Sapiens
cuauggaaaugugaaggauguaaagggaacaaauaauguuucaucuaauucaucacauaguaucu

SEQ ID NO: 304271 - RNA, 65 nt, Homo Sapiens
uauaaacugccuucuucaacaacauaagauuuguaauguuucauuuuuuauaaguuguaugcaua

SEQ ID NO: 304272 - RNA, 65 nt, Homo Sapiens
gacaguuuuuaacaauaaauccagauguguaucagauguuucacuuuugaaucuaccauucauag

SEQ ID NO: 304273 - RNA, 65 nt, Homo Sapiens
aacagcugaaggguuuuauuuguguaauuauacuuauguuucaaucuuauaauaccuuuuccuug

SEQ ID NO: 304274 - RNA, 65 nt, Homo Sapiens
guuugcacuuugcauugaacaguuuauuuaaguucauguuucacuggaugugaugggucuagucc

SEQ ID NO: 304275 - RNA, 65 nt, Homo Sapiens
aaaaggaaaucuauggaguaaagaagaaaucaaacauguuucaggaugagaacuugggaauguuu

SEQ ID NO: 304276 - RNA, 65 nt, Homo Sapiens
cuuugugguccugaucaaggucugcauuaaaauaaauguuucaggguguaacuaggggcuguguu

SEQ ID NO: 304277 - RNA, 65 nt, Homo Sapiens
cugcaguguguuuagcauucgcuugcaguauaguuauguuucagucguaccagcugaauagccca

SEQ ID NO: 304278 - RNA, 65 nt, Homo Sapiens
ggcuccacagcuccaccgcugccugggcccucaggauguuucaaacccaggucacccuguggcag

SEQ ID NO: 304279 - RNA, 65 nt, Homo Sapiens
uuaaaugcacuucuuccgguuguaaagcacaaaguauguuucagucuuuagaaugcucuuuugca

SEQ ID NO: 304280 - RNA, 65 nt, Homo Sapiens
ugcaaacauauuaaaguuucucuuuaggcuuuuguauguuucagauuaguuagauauugacuuua

SEQ ID NO: 304281 - RNA, 65 nt, Homo Sapiens
caaacaagaagagaagaaaaguggaaaaccucaggauguuucagcugaccuuagaacaugagaga

SEQ ID NO: 304282 - RNA, 65 nt, Homo Sapiens
ucagcuguacaaacuccagcacuuuaaagugugaaauguuucaccuguuauauuaaccucuuccu

SEQ ID NO: 304283 - RNA, 65 nt, Homo Sapiens
guguuaccuuucuggcuuccucauugauuuuguauauguuucagcauuaugugauguuggaaagc

SEQ ID NO: 304284 - RNA, 65 nt, Homo Sapiens
aaaucugaccaaaacaaacaugauacacuaugaagauguuucaaaugacuauucaguuuucagga

SEQ ID NO: 304285 - RNA, 65 nt, Homo Sapiens
aaucucaacuggcagcaauauaccaaagacacucuauguuucauuuauuccccucaguucaucuu

SEQ ID NO: 304286 - RNA, 65 nt, Homo Sapiens
aauaaaugugauguuucuagaaggguaggucucuaauguuucaucuuagaacuaucuugguugca

SEQ ID NO: 304287 - RNA, 65 nt, Homo Sapiens
ucugcaucaguugcuucuauagagcaucagcccucauguuucauugucuuaaugucggggagcag

SEQ ID NO: 304288 - RNA, 65 nt, Homo Sapiens
uuaaaaaagcaaaugaggcaaugugucaaaauuuaauguuucauaauaaaaauagauacguugac

SEQ ID NO: 304289 - RNA, 65 nt, Homo Sapiens
aucacuguuucucucaacacuauuuaaucugaaaaauguuucaguacaaaccacuguuugaacua

SEQ ID NO: 304290 - RNA, 65 nt, Homo Sapiens
uuaaauucagaauaucucuaaaacauggaaaauugauguuucaauaaaaagggagacauuuuauu

SEQ ID NO: 304291 - RNA, 65 nt, Homo Sapiens
ucccauucugccccuguacauguuuccuaccaagcauguuucacauuuuccuauuaguggaggag

SEQ ID NO: 304292 - RNA, 65 nt, Homo Sapiens
caaauugccuauaaauugacucuacuaaaauaacaauguuucagucugaaaauuugaauugaaaa

SEQ ID NO: 304293 - RNA, 65 nt, Homo Sapiens
uguaguguacauuguaaaacucagauauugucaugauguuucacuuggacauaagacuuauuaau

SEQ ID NO: 304294 - RNA, 65 nt, Homo Sapiens
cuccugaccuugaaucacaagagucuuaacagggaauguuucaggaaacaaauaggauaagacaa

SEQ ID NO: 304295 - RNA, 65 nt, Homo Sapiens
aauauuuuuauauuaaaguacuauacuaggagagaauguuucagaacucccugaugaauuucuaa

SEQ ID NO: 304296 - RNA, 65 nt, Homo Sapiens
aaaugaauaauuccugcuauucugaaauugccuacauguuucaauaccaguuauauggagugcuu

SEQ ID NO: 304297 - RNA, 65 nt, Homo Sapiens
cauguaguuuaauaaaguuccuguuuaugagagucauguuucaucucagcuucuuccauggaugu

SEQ ID NO: 304298 - RNA, 65 nt, Homo Sapiens
uaagcugugcaaccugugaagccaagagugaacugauguuucauuuauauuuucauccaaaugac

SEQ ID NO: 304299 - RNA, 65 nt, Homo Sapiens
uggauccugugcuuaccuuuuccugcuguacucugauguuucagugaagcucauccacgaagucc

SEQ ID NO: 304300 - RNA, 65 nt, Homo Sapiens
gucagauuuugugcuugauuacacaaccccuggauauguuucauuccuccagaucagauggggac

SEQ ID NO: 304301 - RNA, 65 nt, Homo Sapiens
ucuacuucugcuuuucuuauaauaaagggaaacgaauguuucaaacacaucagccucacugagcu

SEQ ID NO: 304302 - RNA, 65 nt, Homo Sapiens
uugaaacagucucuuuugagucugguuuaaucauuauguuucaaauuagagacagcccagucucu

SEQ ID NO: 304303 - RNA, 65 nt, Homo Sapiens
uggggaacugagcuaggcgggacuuaacaaaaacaauguuucaucauccucaugccuucaggaaa

SEQ ID NO: 304304 - RNA, 65 nt, Homo Sapiens
uuuuugaauuuauuuauauguaauugucauaaguuauguuucagauuggacuauguuugugaaca

SEQ ID NO: 304305 - RNA, 65 nt, Homo Sapiens
uauagagguaaaauuugcacaaaguaauuucaagaauguuucaguaaugguuuucaacaagccug

SEQ ID NO: 304306 - RNA, 65 nt, Homo Sapiens
cauuguauuugaacacaaaauuacugagcuuccuuauguuucacaaaaguuaccccacacaaaag

SEQ ID NO: 304307 - RNA, 65 nt, Homo Sapiens
agaauucuguugauggaaauuuuaauguggaaaugauguuucauauuaacugagaaggcugugga

SEQ ID NO: 304308 - RNA, 65 nt, Homo Sapiens
caggagugggguaaauaaguacauaccaguuucugauguuucagguuaugcuuggagcagucagu

SEQ ID NO: 304309 - RNA, 65 nt, Homo Sapiens
aauaaaaaaccacuuuauauccuuaaugcaaugaaauguuucauucuugacauguuuauuucuac

SEQ ID NO: 304310 - RNA, 65 nt, Homo Sapiens
uuugugaauuagguauggccagccuuguccugacuauguuucacacaugcaguacagacauagca

SEQ ID NO: 304311 - RNA, 65 nt, Homo Sapiens
aagggcagacucacgaauuuuggaaaauaagcuuuauguuucaaguuaaaauggcauacagauaa

SEQ ID NO: 304312 - RNA, 65 nt, Homo Sapiens
gggaaaugaacuacauauuguaaauuaccuaucccauguuucaguacaaucagacuuacuggaaa

SEQ ID NO: 304313 - RNA, 65 nt, Homo Sapiens
aucaggaacuuucgguuuuauuuucauauaguccaauguuucaucauuuauuaauagauuguuuc

SEQ ID NO: 304314 - RNA, 65 nt, Homo Sapiens
ucauuuuaaacauccuaaauuuauugaccugccucauguuucauuugguaaaugauuguacuuau

SEQ ID NO: 304315 - RNA, 65 nt, Homo Sapiens
uggugacugucucauugugccaugagguaaauguaauguuucaggcauucugcuugcaaaaaaau

SEQ ID NO: 304316 - RNA, 65 nt, Homo Sapiens
uugagaaacuggucaaugaacaggaagacuuagagauguuucacaagccuuugauuuuuguuuca

SEQ ID NO: 304317 - RNA, 65 nt, Homo Sapiens
uuucagagaugcuggaaacaaaucauuugcuuuauauguuucauuagaauaccaaugaaacauac

SEQ ID NO: 304318 - RNA, 65 nt, Homo Sapiens
aagcauuuaggaaugaaguguuagagugucuuaaaauguuucaaaugguuuaacaaaauguaugu

SEQ ID NO: 304319 - RNA, 65 nt, Homo Sapiens; identical to SEQ ID NO: 304318

SEQ ID NO: 304320 - RNA, 65 nt, Homo Sapiens
uuuuucuuacaacagccuuucagacuauucuucauauguuucaagcuaaucuuguagcuaagcua

SEQ ID NO: 304321 - RNA, 65 nt, Homo Sapiens
gaucaugcauagagugugauguauguguaauaaauauguuucacacaaacaaggccugucagcua

SEQ ID NO: 304322 - RNA, 65 nt, Homo Sapiens
uuagagauaaggauugcacauuggaaaaguaaaccauguuucauuccuuuuucccuauuuauauu

SEQ ID NO: 304323 - RNA, 65 nt, Homo Sapiens
acagaaaugcccuccaugugucccucuaauguugcauguuucaguggguuggaaguuuuguauau

SEQ ID NO: 304324 - RNA, 52 nt, Homo Sapiens; identical to SEQ ID NO: 303762

SEQ ID NO: 304325 - RNA, 65 nt, Homo Sapiens
ugguggacuaguauaguauacggucaguuaugucaauguuucauggucaauaaaaaggaaguugc

SEQ ID NO: 304326 - RNA, 65 nt, Homo Sapiens
guuuaaauauagcaauacaaccaauaauuuguuuuauguuucacugcauauaaauauuuccauua

SEQ ID NO: 304327 - RNA, 65 nt, Homo Sapiens
guauacuguacuauccuuuauaagucauuaaaauaauguuucaucaaaugguuaaauggaccacu

SEQ ID NO: 304328 - RNA, 65 nt, Homo Sapiens
cugcuucuuaaggucccugcucggccgguguaaauauguuucacccugucccucuaauaaagcuc

SEQ ID NO: 304329 - RNA, 65 nt, Homo Sapiens
aucauggaaugauuucucugcuaacagccgccuguauguuucaauaaauuuguccaaagcucaac

SEQ ID NO: 304330 - RNA, 65 nt, Homo Sapiens
uacuacuuguaugcagaagagaauuaguugauuacauguuucaaccuuuuagggugauaaauaca

SEQ ID NO: 304331 - RNA, 65 nt, Homo Sapiens
uuuuaacauucagguguagauuguuucagcuucucauguuucauuuuccugaagauuuauguuuu

SEQ ID NO: 304332 - RNA, 65 nt, Homo Sapiens
auuauuuucaaguaguauaccccugugguuuuacaauguuucaucauuuuuuugcauuaauaaca

SEQ ID NO: 304333 - RNA, 65 nt, Homo Sapiens
aggcguauaaaauggggcugugugcaugcaggcccauguuucagccucagcccacgccaggugaa

SEQ ID NO: 304334 - RNA, 65 nt, Homo Sapiens
ccaaaggaaugucuugcauauuacugacauuugguauguuucauucauuggaauauuucuuauuu

SEQ ID NO: 304335 - RNA, 65 nt, Homo Sapiens
uuuuaugugaagguguuucaaaggguaaauuauaaauguuucaugaagaaaaaauuuuaaaaauc

SEQ ID NO: 304336 - RNA, 65 nt, Homo Sapiens
uggaaccguaucaggcauucgccugccucucacaaauguuucagggaggccaguucugcagggug

SEQ ID NO: 304337 - RNA, 65 nt, Homo Sapiens
ugauuucauagauaauauauuuaauaugacagauuauguuucaacucuguagauguuuaacguca

SEQ ID NO: 304338 - RNA, 65 nt, Homo Sapiens
ggaauugaugggaaaugguuucuaauauuucaagaauguuucacuuuuucccugguaaagaggau

SEQ ID NO: 304339 - RNA, 65 nt, Homo Sapiens
agcuuuugucuauuuuuuaagccuacuucagucccauguuucagauuaggcuuuuauaaugcucc

SEQ ID NO: 304340 - RNA, 65 nt, Homo Sapiens
uugcaagguaauauguaauacaaauaugaaauauaauguuucagauuaucuaaaauaaauauaca

SEQ ID NO: 304341 - RNA, 65 nt, Homo Sapiens
aaguuucugcagcagaugcuucugggcaaaugaaaauguuucaggauauuucacaauccugugga

SEQ ID NO: 304342 - RNA, 65 nt, Homo Sapiens
uaaaaccucauucucggaccguuauugaaaauaugauguuucacaauguuuuuaaaauaugagug

SEQ ID NO: 304343 - RNA, 65 nt, Homo Sapiens
aaggaaugaaagagaguucucucugaccugugaucauguuucaggauguuuauauaugaacuuua

SEQ ID NO: 304344 - RNA, 65 nt, Homo Sapiens
aaacuugacauugucagaguuugugguacuuuuugauguuucagucugcaggacagccuauaaaa

SEQ ID NO: 304345 - RNA, 65 nt, Homo Sapiens
gaaccaaaguucugauaccuuguuuuaggugugagauguuucaguaggugccuuuguaccucagg

SEQ ID NO: 304346 - RNA, 65 nt, Homo Sapiens
ugaaccuuuccuaacuuuuuuuuaacaaguugaaaauguuucauccuuugcgaguauacauguuu

SEQ ID NO: 304347 - RNA, 65 nt, Homo Sapiens
ugaaaagucugguuucuuacgcuauuuacaauaaaauguuucauuacgaggaauaccuaugaaga

SEQ ID NO: 304348 - RNA, 65 nt, Homo Sapiens
guaggaauauuuaaguuauugaaacuagagucuggauguuucauuuucauaaaauuuugauuagu

SEQ ID NO: 304349 - RNA, 65 nt, Homo Sapiens
cucuuaugaccugauccaucgccaggauguauggaauguuucauacuguuauuuaacguuugucu

SEQ ID NO: 304350 - RNA, 65 nt, Homo Sapiens
uguaaauuguucauagaaaacagugaaaaaaucuaauguuucaaaagcccguuuccuucccucau

SEQ ID NO: 304351 - RNA, 65 nt, Homo Sapiens
ccauaacauuaauuuuuuuaaaaaauaaggucuuaauguuucauuuaauuuaaaauauacuguca

SEQ ID NO: 304352 - RNA, 65 nt, Homo Sapiens
acuuuacacuucagacagauuuucuguguuaugaaauguuucaguaaaauauuguuuacugacuu

SEQ ID NO: 304353 - RNA, 65 nt, Homo Sapiens
aguuucggaaguuugaucugagaaccaaccauagaauguuucaguucuaggaaauaaaaccaguu

SEQ ID NO: 304354 - RNA, 65 nt, Homo Sapiens
gagacucaaagagggagugcauuuaugagcucuucauguuucaggagagaguugaaccuaaacau

SEQ ID NO: 304355 - RNA, 65 nt, Homo Sapiens
gcacacuacugagagaaugagaugaaaaacgauuaauguuucauuauuauuauugugaaaauauu

SEQ ID NO: 304356 - RNA, 65 nt, Homo Sapiens
gagccuaauugcuguuacuaauuagaggaguaaaaauguuucacgauaacucagcaauuguaaug

SEQ ID NO: 304357 - RNA, 65 nt, Homo Sapiens
ugacugaaacuauggcuaauaauugggguacucuuauguuucaauccaauuuaaccucauuuccc

SEQ ID NO: 304358 - RNA, 65 nt, Homo Sapiens
guuguagcugagcacuuuaacaaguugagcauuccauguuucauucuuagaaccuucuuuaauag

SEQ ID NO: 304359 - RNA, 65 nt, Homo Sapiens
uguuaaccuagaaagggcucacucuaccucuaggcauguuucaucccaacaaucagacugugcca

SEQ ID NO: 304360 - RNA, 65 nt, Homo Sapiens
auaauauagaaaucuuauguaaaugaaauuuugucauguuucaaauaaagagaacugaaguagaa

SEQ ID NO: 304361 - RNA, 65 nt, Homo Sapiens
auagaaguuacuagcacugacacacugauuuugaaauguuucaaaaugaguagauaugauuagau

SEQ ID NO: 304362 - RNA, 65 nt, Homo Sapiens
gaaauacaucuuuuauaaugggggaagaaugcccuauguuucaauucaaaacaaagacaguuuuc

SEQ ID NO: 304363 - RNA, 65 nt, Homo Sapiens
guuauugaaauggaaaugaaaacagccaguaacuuauguuucagaauguuuguaacacacuucau

SEQ ID NO: 304364 - RNA, 65 nt, Homo Sapiens
acuguuggaauugucaucuguacaauuaguccauaauguuucauguuuguccuaagugugcuguu

SEQ ID NO: 304365 - RNA, 65 nt, Homo Sapiens
uugcuaugcagugugaucuuuauuuauaguaaauuauguuucauguaaaugauauauuuuuggug

SEQ ID NO: 304366 - RNA, 65 nt, Homo Sapiens
uguugcuaccagauuauaucuggugguaauuguuaauguuucagcagggcuggucucaguccuuu

SEQ ID NO: 304367 - RNA, 65 nt, Homo Sapiens
aacaucuuguucuucaauaucacggguuuuuguuaauguuucauaaguaauucuccccacuugau

SEQ ID NO: 304368 - RNA, 65 nt, Homo Sapiens
aauaaacaguguuuuguuuuuuaaauuuuguuaugauguuucauuucucauucuuguauugccuu

SEQ ID NO: 304369 - RNA, 65 nt, Homo Sapiens
auuaguuugcauucaccuuuuaaagucacauuuccauguuucaacuccucaccuucccucuuuuu

SEQ ID NO: 304370 - RNA, 65 nt, Homo Sapiens
cuuguguccaggcuggaguguuuuuuuuugaggcgauguuucacuuugagcaggauaucuuuuuu

SEQ ID NO: 304371 - RNA, 65 nt, Homo Sapiens
aaaugcagugaaaggaacuaaaaaucacauauaucauguuucaguuauugguacccuaggacaua

SEQ ID NO: 304372 - RNA, 65 nt, Homo Sapiens
ugugcuuuuaaaaaaucugguguauauuuguacaaauguuucagcgaaugauuguuuucucucuu

SEQ ID NO: 304373 - RNA, 65 nt, Homo Sapiens
uuuguauuaauuuguaauagaguuuaaauuaggguauguuucaagagcagggcccaaagcuuauu

SEQ ID NO: 304374 - RNA, 65 nt, Homo Sapiens
cgggaaacaugacucuuuauucaaauuuauuuccaauguuucaagaccuuuucuuguaucuggau

SEQ ID NO: 304375 - RNA, 65 nt, Homo Sapiens
ugcacaaguagggcugccucugaaucaguccuagaauguuucauuuuuuuuuaucagagucauga

SEQ ID NO: 304376 - RNA, 65 nt, Homo Sapiens
gcucaccaggcaguaccaauugaacauuaauccacauguuucagaucuuuuguccugcaucaucu

SEQ ID NO: 304377 - RNA, 65 nt, Homo Sapiens
uucuuuuuauguaaauuuguaacuuguuuuuucucauguuucaucgaucugcuuugcagggaaau

SEQ ID NO: 304378 - RNA, 65 nt, Homo Sapiens
ggugugugucuuuuuacuauuuguugacucguuuuauguuucaaucugucaauaaaaauagaagu

SEQ ID NO: 304379 - RNA, 65 nt, Homo Sapiens
ugcauggccuucuacggcuucugcauuguguuaacauguuucaagcucugggccuucaugcuuuu

SEQ ID NO: 304380 - RNA, 65 nt, Homo Sapiens
gcaucugauuugucagacccacaucgcuuccacccauguuucagauuagaaaaguugcaugauug

SEQ ID NO: 304381 - RNA, 65 nt, Homo Sapiens
uggaacuaugcaguuaaggcagauaaaauguacagauguuucauauauuacagguuacauauaua

SEQ ID NO: 304382 - RNA, 65 nt, Homo Sapiens
ggucuuucuauauacugaucucuauauagauaucaauguuucauugaaaauccacugguaaggaa

SEQ ID NO: 304383 - RNA, 65 nt, Homo Sapiens
aagcaacuuagcaaggcuucuuuucauuauuuuuuauguuucacuuauaaagucuuagguaacua

SEQ ID NO: 304384 - RNA, 65 nt, Homo Sapiens
ucaaguggcuuuuggggccccagguugagcucuggauguuucaagccaaggcucggcuauucccg

SEQ ID NO: 304385 - RNA, 65 nt, Homo Sapiens
uuaaucaguaaaucaguuucacaucauguauugugauguuucaaugugagacacaaaaacaaugg

SEQ ID NO: 304386 - RNA, 65 nt, Homo Sapiens
gcuccugccguuuucuuccugccaagccugaaucaauguuucaucuccaacccucugccaguuug

SEQ ID NO: 304387 - RNA, 65 nt, Homo Sapiens
ccccauugggcccucgucugccucuccaggauuguauguuucaagccuuguccuguguuccuuug

SEQ ID NO: 304388 - RNA, 65 nt, Homo Sapiens
cucaagugggauuagaagacuaucaaaauacauguauguuucaggauauuugaccugucauuaaa

SEQ ID NO: 304389 - RNA, 65 nt, Homo Sapiens
auuuugguauuacacuguauuuguaucucugaagcauguuucauguuuugugacuauauagagau

SEQ ID NO: 304390 - RNA, 65 nt, Homo Sapiens
guuguauuguaauggcauuaucaaaauauuugaugauguuucagauauauugcaaagucuguauu

SEQ ID NO: 304391 - RNA, 65 nt, Homo Sapiens
caaccauaaguuaaaaucugaagguuaucuuuaucauguuucaucccugucugaagauuuccuag

SEQ ID NO: 304392 - RNA, 65 nt, Homo Sapiens
uaaaauauuguuuuccuacaggccuauuuaacaagauguuucauuuuacuguauauuuuguaguu

SEQ ID NO: 304393 - RNA, 65 nt, Homo Sapiens
caaaauuuuuucucuaggaaauauuuauuuuaauaauguuucaaacauauauaacaaugcuguau

SEQ ID NO: 304394 - RNA, 65 nt, Homo Sapiens
uguagagccagccuugguuggaccuauugccaggaauguuucagcugcaguugaagagccugaca

SEQ ID NO: 304395 - RNA, 65 nt, Homo Sapiens
ugaagaagugaguguccacgggugaagaagugaguauguuucaccuggacauuaaggugauguuu

SEQ ID NO: 304396 - RNA, 65 nt, Homo Sapiens
aaaacacccagagacggcacaaggagguugaacucauguuucaguucgcgaacauugacuccuua

SEQ ID NO: 304397 - RNA, 55 nt, Homo Sapiens; identical to SEQ ID NO: 303835

SEQ ID NO: 304398 - RNA, 65 nt, Homo Sapiens
uacaaguauuaggcugcuuuuauguauuuuuguguauguuucaaaagauggguuuuauccucaaa

SEQ ID NO: 304399 - RNA, 65 nt, Homo Sapiens
uaccucuaaauuuccauauccauugccugacuaaaauguuucauuccaguuucuguaaggucuua

SEQ ID NO: 304400 - RNA, 65 nt, Homo Sapiens
gcgaucucagaucuaggccuggugaggucacuuuaauguuucacacugagugagaaaacaaguau

SEQ ID NO: 304401 - RNA, 65 nt, Homo Sapiens
ucccaccauuuucucaguuugcaguuuccaaggauauguuucaugaagacgaagggagagagaaa

SEQ ID NO: 304402 - RNA, 65 nt, Homo Sapiens
uugugacagauaaagauguaaauucaaaagaaugcauguuucacaaaacucuuagauauuuauau

SEQ ID NO: 304403 - RNA, 65 nt, Homo Sapiens
guuugaguccauguuuauucuccuucacaaacuccauguuucagucgugaccucugccacccaca

SEQ ID NO: 304404 - RNA, 65 nt, Homo Sapiens
cuuuggaacaagaugguucuuauuuuugacagaauauguuucaaauucauacauuguacgaagag

SEQ ID NO: 304405 - RNA, 65 nt, Homo Sapiens
gauauaugcaacuauucaguaaauaaaucaaugaaauguuucaauaauaucaauauaaauaagga

SEQ ID NO: 304406 - RNA, 65 nt, Homo Sapiens
ccucuaccauccugcacuguaagguguaagguugcauguuucagucuaaaucugcuuuaccaagu

SEQ ID NO: 304407 - RNA, 65 nt, Homo Sapiens
uguauugcauuuuucuauuaaaaaauuaacaguuaauguuucagucaauguauuaucuguagcau

SEQ ID NO: 304408 - RNA, 65 nt, Homo Sapiens
uacuguaugaauaaugaaacuuacuaucauaaaccauguuucauguggccuguuagggccuguca

SEQ ID NO: 304409 - RNA, 65 nt, Homo Sapiens
cuucccgucugauuguuccuccccagcccccuggcauguuucaccacaacccuguugcuacauca

SEQ ID NO: 304410 - RNA, 65 nt, Homo Sapiens
gcauucuguggucaaguaaguuuagggagcuauucauguuucacuugcuuuguggagauucacac

SEQ ID NO: 304411 - RNA, 65 nt, Homo Sapiens
uggacaaaaaguaaaucauugaccaaagcuaugaaauguuucacaaaguuuuccucuuuugcaua

SEQ ID NO: 304412 - RNA, 65 nt, Homo Sapiens
guauggaauauuacuucuaucagaagaugaucaagauguuucaguccagugcacaucagcauugc

SEQ ID NO: 304413 - RNA, 65 nt, Homo Sapiens
augagcaggaagucuagaaaugauaacuagacuguauguuucaugugugugauuuuucagaauuc

SEQ ID NO: 304414 - RNA, 65 nt, Homo Sapiens
cauuugucuuaauuucuaacauuaucuuugcuuuuauguuucauaaaaauuugucauuauuuaug

SEQ ID NO: 304415 - RNA, 65 nt, Homo Sapiens
uuuuuucugcugguggauaaacauuaaaauuaaucauguuucaaaguuuuauuuucaguuccuuu

SEQ ID NO: 304416 - RNA, 65 nt, Homo Sapiens
aaugcuagcauguacuguaugggaggaugauccagauguuucaaagagaauuucucuuaguuuag

SEQ ID NO: 304417 - RNA, 65 nt, Homo Sapiens
ugcuugaaauuauauugauuuaaaugaugugugagauguuucaccauuuucaggcacuguguaau

SEQ ID NO: 304418 - RNA, 65 nt, Homo Sapiens
auauuaggccaagugcaauugacuucccuuuuuuaauguuucaugaccacccauugauuguauua

SEQ ID NO: 304419 - RNA, 65 nt, Homo Sapiens
gaucuacauuuucuggaaaaucagcauuacuagagauguuucaaauguagauuuuaccagaccau

SEQ ID NO: 304420 - RNA, 65 nt, Homo Sapiens
ucccugugcugagcccugagggcagagaggauggcauguuucaggggagggggaagccuuccucu

SEQ ID NO: 304421 - RNA, 65 nt, Homo Sapiens
uagaaugcaaaauguuggcauuuuguuuaaaccaaauguuucaugaaaauagagaauucuuaaga

SEQ ID NO: 304422 - RNA, 65 nt, Homo Sapiens
acugcaaaacaaacaggauagcaguaacuaaguuuauguuucagaucugccuuguuuggguaaag

SEQ ID NO: 304423 - RNA, 65 nt, Homo Sapiens
acauuguugauggcauugugauucuugcuucugauauguuucaaugguaaaaucuuuaaaacuag

SEQ ID NO: 304424 - RNA, 65 nt, Homo Sapiens
aaaaaaaaggaacuguaauuuuuaaaugcccuuugauguuucaaaaagcaaauuguuucaguuuu

SEQ ID NO: 304425 - RNA, 65 nt, Homo Sapiens
auaaaauaaucucacuuuuauacauuuuugaaauaauguuucagaguuuuauuucaaaaacaaag

SEQ ID NO: 304426 - RNA, 65 nt, Homo Sapiens
uuaaaugauaguaaaaacacagaaagguuguggaaauguuucagagucaaugucauagaagacaa

SEQ ID NO: 304427 - RNA, 65 nt, Homo Sapiens
uugguuuuaauuuguauaucaaucgguguguagugauguuucauuuuuuccuuuuuaaccauucc

SEQ ID NO: 304428 - RNA, 65 nt, Homo Sapiens
guaucacauagaaauauggcuugcauuuauuaaaaauguuucauuacuugcaguucuaugauaga

SEQ ID NO: 304429 - RNA, 65 nt, Homo Sapiens
ugaaacauuucagaaauuauuuuauugcuuugucuauguuucauaugauaaacauauauccucuu

SEQ ID NO: 304430 - RNA, 65 nt, Homo Sapiens
uuuugaccuagaaaugcgagcuucucucauuggccauguuucagauggcgcccucucaauuuagu

SEQ ID NO: 304431 - RNA, 65 nt, Homo Sapiens
uaauugugaggaaggcgcagccccguuuuuuggucauguuucaauaugucacuuuuuugccuauc

SEQ ID NO: 304432 - RNA, 65 nt, Homo Sapiens
acaaaucaaaaaaucuuccuucuuauaacugagaaauguuucacccaaauuuccuuuguuauuau

SEQ ID NO: 304433 - RNA, 65 nt, Homo Sapiens
caaauaucuucacuucaguuuuauuugugaauuacauguuucaugaauccauuuggcacagagac

SEQ ID NO: 304434 - RNA, 65 nt, Homo Sapiens
auuuucucuuguagugauuuggguaggaagaggccauguuucaguucguuuucucuguagggucg

SEQ ID NO: 304435 - RNA, 65 nt, Homo Sapiens
aacuagcuagccagcuggagauaauuuaccagggaauguuucaaagcccuaaccuugaaguuugg

SEQ ID NO: 304436 - RNA, 65 nt, Homo Sapiens
ccacaaaaugcugauucaguucaaaauuaaugcaaauguuucaaaacuggguuucugauauuugu

SEQ ID NO: 304437 - RNA, 65 nt, Homo Sapiens
gaguuacuaagauuucuauaccuggaauaucauguauguuucauuuacuggauguuuacauuuua

SEQ ID NO: 304438 - RNA, 65 nt, Homo Sapiens
aggcaucaagcuacccucaagaguuucugggcuggauguuucagaacaacaucuacaccaguaaa

SEQ ID NO: 304439 - RNA, 65 nt, Homo Sapiens
gcacucccuggccuugcccgucgugugcugaagacauguuucaagaaccgcauuucgggaagggc

SEQ ID NO: 304440 - RNA, 65 nt, Homo Sapiens
caguaaagaaauaaaaguuuuauuaaguuauacuaauguuucaaucagguauuugacauaauaug

SEQ ID NO: 304441 - RNA, 65 nt, Homo Sapiens
ggcuucacauggaggagcugaguuccaggguguguauguuucaggucugugcauaaggagaggaa

SEQ ID NO: 304442 - RNA, 65 nt, Homo Sapiens
gguguuugcuuccuuccagauuucagacugaaaacauguuucacauccuaugaagaaagauacgg

SEQ ID NO: 304443 - RNA, 65 nt, Homo Sapiens
uauuuuuaaucgccauaaaaugaaaaagugucuugauguuucaguaauugaaauguugcuuucac

SEQ ID NO: 304444 - RNA, 65 nt, Homo Sapiens
auuucuaccuccaaagugugguaaucaugagauuaauguuucauguguuugagagcauaauuaug

SEQ ID NO: 304445 - RNA, 65 nt, Homo Sapiens
uuugugcauuugugaacagacacuugaaucaauaaauguuucaccaagccucaacauuuucgcag

SEQ ID NO: 304446 - RNA, 65 nt, Homo Sapiens
cacuuuagaaacaguacuuucagugacguaggcaaauguuucaaggaggucauugaaaaagagaa

SEQ ID NO: 304447 - RNA, 65 nt, Homo Sapiens
cauucuaaauaaauaauuuuaucauaaauacuuugauguuucaaaucuuccuuauuuaguguugu

SEQ ID NO: 304448 - RNA, 65 nt, Homo Sapiens
uuuaauuuauagcuaugguuauaaacagguuuuagauguuucaaaugacuuguccacugaauguc

SEQ ID NO: 304449 - RNA, 65 nt, Homo Sapiens
auuaucaagguucuaccuauguuaauuuacaauucauguuucaagacauuugccaaauguauuac

SEQ ID NO: 304450 - RNA, 65 nt, Homo Sapiens
auccuuuaauucuucauuaaaauggaaauaaguagauguuucaaaguaaucuacauuccuggcuu

SEQ ID NO: 304451 - RNA, 65 nt, Homo Sapiens
ugagguucauuacaaucgagacugcaaugugaucuauguuucaucuuguuuuuauaauaaaaagc

SEQ ID NO: 304452 - RNA, 65 nt, Homo Sapiens
uuagcaauucaacuugaugugagaagaaaaaacaaauguuucaacacaaaaucucuguuuuguga

SEQ ID NO: 304453 - RNA, 65 nt, Homo Sapiens
aaaacuaaccugaaaaacaaauaaaugcuuuggaaauguuucaguugcuuuagaaacauuagugc

SEQ ID NO: 304454 - RNA, 65 nt, Homo Sapiens
aaauaaaaguuuuauaguuuuaaauacauaaagaaauguuucaguuaggcauuaaccuugauaga

SEQ ID NO: 304455 - RNA, 65 nt, Homo Sapiens
uguuuuuuaacaaaauauuuuuuuaagggaaagaaauguuucaggagggauaaagcuuaccauua

SEQ ID NO: 304456 - RNA, 65 nt, Homo Sapiens
uaagugauaaacaacagcaaauauacuugaauaaaauguuucagguauuuuuguuucauuuuguu

SEQ ID NO: 304457 - RNA, 65 nt, Homo Sapiens
uuuuugaucuggcaaccauauuucuggaaguugagauguuucagcuugaagaaccaaaacagaag

SEQ ID NO: 304458 - RNA, 65 nt, Homo Sapiens
agugaacauucgaccuccauuacggagaguuuccuauguuucacugugcaaauauaucugcuauu

SEQ ID NO: 304459 - RNA, 65 nt, Homo Sapiens
uuugccuccagaagaaguuuuuccuugauugugcuauguuucaguggaagaaauucuuugaagua

SEQ ID NO: 304460 - RNA, 65 nt, Homo Sapiens
caugaaugucuuucuuugaaaacugcaauguauguauguuucaagguuauuuaacaguguacuau

SEQ ID NO: 304461 - RNA, 65 nt, Homo Sapiens
agaugcgcaucaguaugaaauugucucaaucuuggauguuucauuuuaugaauggaggcacuuua

SEQ ID NO: 304462 - RNA, 65 nt, Homo Sapiens
auuugcugauuuguuuuuaaaaaaacaagaaaugcauguuucaaauaaaauucucuauuguaaau

SEQ ID NO: 304463 - RNA, 65 nt, Homo Sapiens
cagcugggacucuugggcucugugccugagggaaaauguuucacaacuaguggcugcccaauugc

SEQ ID NO: 304464 - RNA, 65 nt, Homo Sapiens
uucugcauguagauuuaaauauuuuuucuuuuaccauguuucaguuuuuuuucuagcuauuuugc

SEQ ID NO: 304465 - RNA, 65 nt, Homo Sapiens
gcagcaugguuacuaacgcuagauuguaccauuacauguuucaguuauuuaacgaaucaugauuc

SEQ ID NO: 304466 - RNA, 65 nt, Homo Sapiens
aaugaugcauacagcaauuuuuuuauaaguauuucauguuucagaaaagcaauguagaguuacgc

SEQ ID NO: 304467 - RNA, 65 nt, Homo Sapiens
caauuucagaucacugguaccuuuauuaagaauugauguuucauuacacugguagauauagaagc

SEQ ID NO: 304468 - RNA, 65 nt, Homo Sapiens
gauacugugcggaaacacacgaaaacacaaugugcauguuucaauaugucauuccacuugugaaa

SEQ ID NO: 304469 - RNA, 65 nt, Homo Sapiens
acauccaacuguuuguuauacugcuaaauacuguaauguuucaaauguucaguucauagcguaga

SEQ ID NO: 304470 - RNA, 65 nt, Homo Sapiens
gguuuuauucaaaccacaaauuuaauacuaauggaauguuucaaacauauucucauugugagaau

SEQ ID NO: 304471 - RNA, 65 nt, Homo Sapiens
ugccaguaagcuucucacauacuuucugcuggcccauguuucagucagccauuugggaggcaaug

SEQ ID NO: 304472 - RNA, 65 nt, Homo Sapiens
uguggacaauugcuuacuuucaugaaccucaucccauguuucauccacuccaugauugauucagu

SEQ ID NO: 304473 - RNA, 65 nt, Homo Sapiens
cauugaauugagagcuuuuagauaugaaaacauucauguuucagacagguacaucaguucuuuuu

SEQ ID NO: 304474 - RNA, 65 nt, Homo Sapiens
uuucugacucaugcaaucauuugcugcuaaaauagauguuucauuaccccaucccucacagccuc

SEQ ID NO: 304475 - RNA, 65 nt, Homo Sapiens
uaggcacagugguacaugccuucagucagaaacugauguuucagcaaaguuguuguagucuccac

SEQ ID NO: 304476 - RNA, 65 nt, Homo Sapiens
guguucuaaaaccuggcuaaaauaaggaauuuucuauguuucaaacuaaaaggacuuguuuguag

SEQ ID NO: 304477 - RNA, 65 nt, Homo Sapiens
uuuacaccuggcuguuuguuugaaacuaaauaaaaauguuucaccagucuauuuaaccucuguaa

SEQ ID NO: 304478 - RNA, 65 nt, Homo Sapiens
uuaaaacaacacuuugucuuuguugauggaaauucauguuucauauuuaaccuuaaagauguuaa

SEQ ID NO: 304479 - RNA, 65 nt, Homo Sapiens
guauuuauuuaaaacauaaaguucccccaaaugugauguuucaguuauaguggagugaucauaca

SEQ ID NO: 304480 - RNA, 65 nt, Homo Sapiens
ccauuuguuuuauccaucaaauuaaaauagaguugauguuucauugguauagaagcucuucaagc

SEQ ID NO: 304481 - RNA, 65 nt, Homo Sapiens
augcauugaacuggauguuauuauccauacuuuugauguuucaauguccauaaaaacuucaaggc

SEQ ID NO: 304482 - RNA, 65 nt, Homo Sapiens
aggucuuuaaagugacuaauccugacuagggagccauguuucacaaacucuucacucuucaaaug

SEQ ID NO: 304483 - RNA, 65 nt, Homo Sapiens
guauggguauaacauccuugccuucccauuuauccauguuucacuuuaucacugauaugaagagg

SEQ ID NO: 304484 - RNA, 65 nt, Homo Sapiens
aacuaaaucuucgggacuucuuuaaugcuacguuaauguuucacugcucgucuagaaacuccuaa

SEQ ID NO: 304485 - RNA, 65 nt, Homo Sapiens
agauauagugacaguaccaagaguaccaggacucaauguuucauaugaagcccuuggugaugagg

SEQ ID NO: 304486 - RNA, 65 nt, Homo Sapiens
aagauauuucuuucccuaaccaucauacacuuggcauguuucauucccaucuccuuuccccucac

SEQ ID NO: 304487 - RNA, 65 nt, Homo Sapiens
ggaaacuuuuuuaauauaugaaagcugugauaaaaauguuucagauguuuagucaauugugaaau

SEQ ID NO: 304488 - RNA, 65 nt, Homo Sapiens
uuacuuuguaaucauauacaaugucaacuuuuuagauguuucaccacucuuuugcaaauaaagca

SEQ ID NO: 304489 - RNA, 65 nt, Homo Sapiens
gacagaccccccacccccaaggcugcagccacaccauguuucaggcuuggggcuggggcaggcuu

SEQ ID NO: 304490 - RNA, 65 nt, Homo Sapiens
ccuagagaacaggugguuuuuaaggguuaucuuagauguuucacaccggaagguuuuuaaacacu

SEQ ID NO: 304491 - RNA, 65 nt, Homo Sapiens
acuuucccucuuccuuuaagaaaacuuacuaaaaaauguuucauugcgaagcagaggaaaagaaa

SEQ ID NO: 304492 - RNA, 65 nt, Homo Sapiens
gccuggaguaaaaaucugauuugaccccucugcucauguuucaucauauuuguagcucugcauca

SEQ ID NO: 304493 - RNA, 65 nt, Homo Sapiens
cucaagucuacccugaucaccucagggcauaaagcauguuucauucucuggcccgacagugucuu

SEQ ID NO: 304494 - RNA, 65 nt, Homo Sapiens
aaucucauucugugaaagccuuuuaauuuauugaaauguuucaugacuacugcugcuagcucuuc

SEQ ID NO: 304495 - RNA, 65 nt, Homo Sapiens
gauucucugcgcgcaaggacccucgacucacccccauguuucagugucacagagacauucuuuga

SEQ ID NO: 304496 - RNA, 65 nt, Homo Sapiens
aaaauggaucuuuacauguugcaguaacauugacuauguuucaaaacucagaugcauaaaacgua

SEQ ID NO: 304497 - RNA, 65 nt, Homo Sapiens
uacagcugagcccaagggacugcccuguuccuggaauguuucagacugcagcuauccugacacag

SEQ ID NO: 304498 - RNA, 65 nt, Homo Sapiens
uaccaagacccuuuucacaguccucaaaguauauaauguuucaugcuuaacaguucugaaugcug

SEQ ID NO: 304499 - RNA, 65 nt, Homo Sapiens
cuuaaucucaggacaacuuaugcuaauuuuaccuaauguuucaucuauaacugaagaaaauaucu

SEQ ID NO: 304500 - RNA, 65 nt, Homo Sapiens
auucuuucuaaauuugauaauugaaauuucaaaguauguuucauuguaaucugugagaacaaugg

SEQ ID NO: 304501 - RNA, 65 nt, Homo Sapiens
gacaguuuuaaagggagccaugcucuuuaaguaaaauguuucaaacugacaauuuaucuuccaua

SEQ ID NO: 304502 - RNA, 65 nt, Homo Sapiens
accacuugccauccuguuagauccugaaaaucuauauguuucaaaaucugaagaaucaaacuucc

SEQ ID NO: 304503 - RNA, 65 nt, Homo Sapiens
auccuguagcuacaucugguaacucguuugaaaccauguuucaucuuuaaaaaguaacaagaaag

SEQ ID NO: 304504 - RNA, 65 nt, Homo Sapiens
ccuggggagggaggggagccaaguaauccugagaaauguuucaggcugcuggggcugaaggucag

SEQ ID NO: 304505 - RNA, 65 nt, Homo Sapiens
cuauaguuuguguaacaacauuuuuaaauacuaauauguuucacacauuaacaauuuuuuuuugu

SEQ ID NO: 304506 - RNA, 65 nt, Homo Sapiens
caguuuaguggaaggaaaaacaucacuuguucuggauguuucaauuaauuagugccuuucucuuu

SEQ ID NO: 304507 - RNA, 65 nt, Homo Sapiens
aacucagccccuuuuucugcagcucuacuugugugauguuucaggcugggcaucagcaccugucc

SEQ ID NO: 304508 - RNA, 65 nt, Homo Sapiens
aaugcguuggcaagagaugucaagaccaaguaagaauguuucaaccuucucuugaaguccaauaa

SEQ ID NO: 304509 - RNA, 65 nt, Homo Sapiens
auugauugacucugcuauugcuugguucaaacuguauguuucaguugcaguaggcaucacauaug

SEQ ID NO: 304510 - RNA, 65 nt, Homo Sapiens
acuuuguaugucuauugguuugaauugacaguuacauguuucauaaagcaaaacuuuuaaauauu

SEQ ID NO: 304511 - RNA, 65 nt, Homo Sapiens
gcuuauaccccauugguuuaauauuuuugccccaaauguuucauguugcuuccagacguuguucc

SEQ ID NO: 304512 - RNA, 65 nt, Homo Sapiens
uacuuagagcagugaagacuucuuugcugcugcccauguuucaaaggugaacaaacaaugaaaac

SEQ ID NO: 304513 - RNA, 65 nt, Homo Sapiens
caaaguacaaccugaauugacuacgccuugaggggauguuucauccagaaccucucagccuuccu

SEQ ID NO: 304514 - RNA, 65 nt, Homo Sapiens
uccauccuuauucacguugacaguaccuagcuguaauguuucacagagugugcugcuauuuuaua

SEQ ID NO: 304515 - RNA, 65 nt, Homo Sapiens
acuuuaaagauuugaaaccacauuuuuauuguuugauguuucauuuucagacuuuuuaaugucag

SEQ ID NO: 304516 - RNA, 65 nt, Homo Sapiens
guaaucaagcuuuuccacaguucuugaaaaguacuauguuucaaauuucaggaacaccagcguua

SEQ ID NO: 304517 - RNA, 65 nt, Homo Sapiens
acugcugugggauugucaaccagcuuaucugcaggauguuucagaucugauaaauccugauggaa

SEQ ID NO: 304518 - RNA, 65 nt, Homo Sapiens
ucugugcagcuuucccccuuggagcaggagugaagauguuucauuaucuugggccugggaaacca

SEQ ID NO: 304519 - RNA, 65 nt, Homo Sapiens
uuuaucuuauaucuaaaaaauauauaacuuacuauauguuucaguugcucucugaacaaaaauua

SEQ ID NO: 304520 - RNA, 65 nt, Homo Sapiens
aaaaaguuaagggaaaagacuuugcuuuuaaaaaaauguuucaaaagaaagguauuuucacuaaa

SEQ ID NO: 304521 - RNA, 65 nt, Homo Sapiens
aacucauaaggucuaccaagaaaauaaauguuaugauguuucaguuggcuucuaggaaauaauua

SEQ ID NO: 304522 - RNA, 65 nt, Homo Sapiens
cuauggguaagaaauaaauggaaauaugacaucggauguuucagcaacuguucuguaaauaaaau

SEQ ID NO: 304523 - RNA, 65 nt, Homo Sapiens
cacuagcaaucugagugauggaaucuuagucauucauguuucaccagaggacagcaagcaaaagg

SEQ ID NO: 304524 - RNA, 65 nt, Homo Sapiens
accuuaugagaaguggaugguaggaggagucacuaauguuucaaucucuauuucuguaaucuugg

SEQ ID NO: 304525 - RNA, 65 nt, Homo Sapiens
ucauuccauccucacaacagcauguaccaaauaacauguuucagcgcuagaacagcuaagguuua

SEQ ID NO: 304526 - RNA, 65 nt, Homo Sapiens
cuuuuuuuuauacucaagugguaauaugaaguaaaauguuucagauuuuuaaaaaaaaaguaugu

SEQ ID NO: 304527 - RNA, 65 nt, Homo Sapiens
aggcugucaccuauuacacuaggaaugccccuaaaauguuucagcuuauguguaaguuuuguaca

SEQ ID NO: 304528 - RNA, 65 nt, Homo Sapiens
acuuuacuaaaagcuuauuuaaugguaagacguaaauguuucaacucuauagauaaugaggaaga

SEQ ID NO: 304529 - RNA, 65 nt, Homo Sapiens
uguuuuauacauuuuuggaguauucuguuuuuaacauguuucaaaaaacaugaauuuuuuugucu

SEQ ID NO: 304530 - RNA, 65 nt, Homo Sapiens
uacaacuguaauguuauuuauacugucuuccguggauguuucagucuugucaccucauuuugcau

SEQ ID NO: 304531 - RNA, 65 nt, Homo Sapiens
ccuagacugcccaaggaguauccaucacuugaucaauguuucagcagccucccaaaucaagucuc

SEQ ID NO: 304532 - RNA, 65 nt, Homo Sapiens
agccccauuugcacagguuuagagcucacaguacaauguuucagacuuuuuccucccuuucccug

SEQ ID NO: 304533 - RNA, 65 nt, Homo Sapiens
cuguuguaaagucagcauaauucuuuaauguuugaauguuucacucuaacugcauuuguuuugac

SEQ ID NO: 304534 - RNA, 65 nt, Homo Sapiens
uccaaggguauucaaacuguagggaaaauggacauauguuucauauucauguccagaagaguaag

SEQ ID NO: 304535 - RNA, 65 nt, Homo Sapiens
ucucuaauuaccaauuaguuauucaauuaguccuaauguuucaguguccuuucuuuuugcccuuu

SEQ ID NO: 304536 - RNA, 65 nt, Homo Sapiens
uuaccccucugcuaaauaaauggucuagagaacugauguuucaaucaaagcauacauuuccugac

SEQ ID NO: 304537 - RNA, 65 nt, Homo Sapiens
aaugcauugauaagaaaacuauuuuuauuaaaagaauguuucauuaaaugugucuuguauuaaau

SEQ ID NO: 304538 - RNA, 65 nt, Homo Sapiens
uuuauauguuuucuaagauaagauauccuuaaaugauguuucaauugugaagcugcucugauacu

SEQ ID NO: 304539 - RNA, 65 nt, Homo Sapiens
uaccuuaugaaaaguguuaaagggaauaaucuuuuauguuucauuucaccugaggaagggaagga

SEQ ID NO: 304540 - RNA, 65 nt, Homo Sapiens
uuuuggucaauacuugacaaaucacuuuaaacaucauguuucaggccuaggaucauauugcauuc

SEQ ID NO: 304541 - RNA, 65 nt, Homo Sapiens
gaaaacuuuggagacaguuuuugaugugauucaaaauguuucaguucacaguacacgucacagua

SEQ ID NO: 304542 - RNA, 65 nt, Homo Sapiens
uccuacaaccaaaugagaaauaccauuuuaaauucauguuucaaccuuuuuaaaagaaaaaauuc

SEQ ID NO: 304543 - RNA, 65 nt, Homo Sapiens
uuggaugugcuauuguaugauuacgaauagucuguauguuucaagcccuucuguaaaauaugaag

SEQ ID NO: 304544 - RNA, 65 nt, Homo Sapiens
gaccucaauucccucaccugaaauaggaaaugagaauguuucauuguagccccaagcggucaugu

SEQ ID NO: 304545 - RNA, 65 nt, Homo Sapiens
aacugugcucugugaggugugaaauuaaaaacauuauguuucaccaauauuuaaacaucaguacu

SEQ ID NO: 304546 - RNA, 65 nt, Homo Sapiens
acuucagucagguacacuguuacuugaaaggaagaauguuucacuuacccaagagcuauggcugc

SEQ ID NO: 304547 - RNA, 65 nt, Homo Sapiens
ucucucucauuauugagauucauccauauuguugaauguuucacuaguuaauguuuauuguucaa

SEQ ID NO: 304548 - RNA, 65 nt, Homo Sapiens
uguaaagucuuucuaagaccaauuauuaucuuagcauguuucaguaucuucucuaucauaggccc

SEQ ID NO: 304549 - RNA, 65 nt, Homo Sapiens
aggggaaaacuucagcuuuccaaaagcuaguaaacauguuucaaagaaaaauaaggucaggagaa

SEQ ID NO: 304550 - RNA, 65 nt, Homo Sapiens
gcaugcuugguuauuuccaguacuugucagucaacauguuucaagacgcuguguuagacacuagg

SEQ ID NO: 304551 - RNA, 65 nt, Homo Sapiens
uacugucaugucauuuacccacuggaucaaaggguauguuucacuucuugacaauauaaaugcug

SEQ ID NO: 304552 - RNA, 65 nt, Homo Sapiens
uucuuuacaauuuguugcaauuucaucugcuuucuauguuucauuguuaauugccauccuucagc

SEQ ID NO: 304553 - RNA, 65 nt, Homo Sapiens
aacauuuaaaaguacuuuauauuuuacauaauagcauguuucauuuugauuaaaagcuaccaaag

SEQ ID NO: 304554 - RNA, 65 nt, Homo Sapiens
caggguaucauugauuuauguuagcauuucuggauauguuucaucuguaugaaaacaucuccgaa

SEQ ID NO: 304555 - RNA, 65 nt, Homo Sapiens
auuacuuuuuaauuguuuuagggugacuaugacuaauguuucagauaguaugagaagaaaucauu

SEQ ID NO: 304556 - RNA, 65 nt, Homo Sapiens
auucaaucgugaaggaacagcucuuuguuaucuaaauguuucagaggaggaaaacucaacuguuu

SEQ ID NO: 304557 - RNA, 65 nt, Homo Sapiens
acacuaauuuagucuuuugauuauuuaguauguuuauguuucaugaggguccaguauuuauuuga

SEQ ID NO: 304558 - RNA, 65 nt, Homo Sapiens
caauggugaaaagguggaaaucuccaaagaacagcauguuucacuaaaaaaugaauguauuuuuu

SEQ ID NO: 304559 - RNA, 65 nt, Homo Sapiens
gaagaugcuguaaauagguuggaauuugcaccaucauguuucagugucccuggucacccgacuuu

SEQ ID NO: 304560 - RNA, 65 nt, Homo Sapiens
ggagcggcgugugggagaaggcccacgagugcgccauguuucagcugcagguguccugcccuucc

SEQ ID NO: 304561 - RNA, 65 nt, Homo Sapiens
ugguagugccucaucacaacccaugauggcuguucauguuucaccccuuuucuuccuucagcaga

SEQ ID NO: 304562 - RNA, 65 nt, Homo Sapiens
ggcuggauuuggacaaaaagcaaaucuagacaugcauguuucaggguucaguaguauacuucaug

SEQ ID NO: 304563 - RNA, 65 nt, Homo Sapiens
agacaugcauguuucaggguucaguaguauacuucauguuucauacagauaauucacauucaaaa

SEQ ID NO: 304564 - RNA, 65 nt, Homo Sapiens
ugcauuuguaaacaguccuggucaguaguuaaauaauguuucaauuaaagugcuguaaaauaaac

SEQ ID NO: 304565 - RNA, 65 nt, Homo Sapiens
uugccacugauauuuuuacuggauaaaauucaaaaauguuucaauucacaaaggcuaauuguuga

SEQ ID NO: 304566 - RNA, 65 nt, Homo Sapiens
ucucugugaagccuuuacucucuaggugccuuauaauguuucagggcucaacuuuuuaaaaucca

SEQ ID NO: 304567 - RNA, 65 nt, Homo Sapiens
cacgugugagaauuuaggagacacugugcacugacauguuucacaacaggcauuccagaauuaug

SEQ ID NO: 304568 - RNA, 65 nt, Homo Sapiens
ggaaugggacccaaaucuaaacacaaaauucauuuauguuucauauacaccuuauauacaauaac

SEQ ID NO: 304569 - RNA, 65 nt, Homo Sapiens
cgcuucaugacuaaaucacacauaccaacuugacuauguuucaccuauuaauauuuccuuuuccu

SEQ ID NO: 304570 - RNA, 65 nt, Homo Sapiens
aucugcaacugcuugauaaguauugauagcugauaauguuucauuaagugaaagugccaacaaau

SEQ ID NO: 304571 - RNA, 65 nt, Homo Sapiens
gaaagaauuuuuucuugaucuauguguuuuaccagauguuucauacaauguguauauguaaauaa

SEQ ID NO: 304572 - RNA, 65 nt, Homo Sapiens
cagugacagaccucauauauaugugcccuauaaugauguuucaguugauuuauuaaauucuaguu

SEQ ID NO: 304573 - RNA, 65 nt, Homo Sapiens
ggguacucugccauagaaaugacacaccaaacaagauguuucacucucugcagcagggggugacu

SEQ ID NO: 304574 - RNA, 65 nt, Homo Sapiens
ccugcuucucucagccagcucacagagucgcuggcauguuucacuaaguggggacagauucgcag

SEQ ID NO: 304575 - RNA, 65 nt, Homo Sapiens
cagcuauuaaaauguaacugcacaguaauguagaaauguuucauaggcaugaauggagaugcccg

SEQ ID NO: 304576 - RNA, 65 nt, Homo Sapiens
aaacacuuguaagauacuuaccuuuuaggaaaacaauguuucauguuuucauaauguugaauuug

SEQ ID NO: 304577 - RNA, 65 nt, Homo Sapiens
gaugauuguuaagcaauagauuugcucuauugaaaauguuucauuuuuuucacuguacaagcaac

SEQ ID NO: 304578 - RNA, 65 nt, Homo Sapiens
cugcugcauuccagccagggugacagagugagaccauguuucaaacaagaaacauuucagagggu

SEQ ID NO: 304579 - RNA, 65 nt, Homo Sapiens
auucgucaccauuauacuaaugaacaauagauuucauguuucaaaauuucagauuuuacauguua

SEQ ID NO: 304580 - RNA, 65 nt, Homo Sapiens
gagguuguuaauuagcacauauuccuuuuagaaaaauguuucagaaaccucagucuugauaucug

SEQ ID NO: 304581 - RNA, 54 nt, Homo Sapiens; identical to SEQ ID NO: 304019

SEQ ID NO: 304582 - RNA, 65 nt, Homo Sapiens
aagauaucuauuugaaaguucucagaguuguacauauguuucacaguacaggaucuguacauaaa

SEQ ID NO: 304583 - RNA, 65 nt, Homo Sapiens
gaauuucauaugacauucaugccuggcuucgcaaaauguuucaaguacuguaacugugucaugau

SEQ ID NO: 304584 - RNA, 65 nt, Homo Sapiens
gugagacuccgucucaaaaaaaaaaaaaaaaagaaauguuucauuuugguuuuucaccaaccuuc

SEQ ID NO: 304585 - RNA, 65 nt, Homo Sapiens
auguuagagggucucuuacuccccgcccagcugugauguuucaucugcuuugguuguuuuggugg

SEQ ID NO: 304586 - RNA, 65 nt, Homo Sapiens
gauacauguccucgacggaugccaaaguggaacagauguuucagauacuguuggacccagaagag

SEQ ID NO: 304587 - RNA, 65 nt, Homo Sapiens
guuugacugccuaagggacagcacgaaugacucacauguuucagacaggccuccacggcuaugga

SEQ ID NO: 304588 - RNA, 65 nt, Homo Sapiens
gccuugguggauuaaccaaggccuuggauuccagaauguuucaugguaagcacuguggagaaccu

SEQ ID NO: 304589 - RNA, 65 nt, Homo Sapiens
ucuacugugauucagacagauguauucaauuuuguauguuucaccuugaagugcugugauugucc

SEQ ID NO: 304590 - RNA, 65 nt, Homo Sapiens
auuuccaucaccccagaaacaggucaagacauagaauguuucaacuacauguuuuaccaccaccc

SEQ ID NO: 304591 - RNA, 65 nt, Homo Sapiens
uugcaaccauugguuuugaggcagcuugacuguucauguuucauuuaaaugccuguguuaaagag

SEQ ID NO: 304592 - RNA, 65 nt, Homo Sapiens
gaaguuguuuauaaaauucaaggugguuuuaauauauguuucauggugucuucauaccaaauuaa

SEQ ID NO: 304593 - RNA, 65 nt, Homo Sapiens
auugcucugaaggucaaaagcuaacaccacuguguauguuucaucagcauucagcgcugcugugg

SEQ ID NO: 304594 - RNA, 65 nt, Homo Sapiens
cuuauuuauaggaaaguuauauaugcauccuccaaauguuucaugaguaaccaagcacucauuau

SEQ ID NO: 304595 - RNA, 65 nt, Homo Sapiens
auauaagaccucuuguagcuacaauguuuuagagcauguuucaucuucauuuuuaauauccugaa

SEQ ID NO: 304596 - RNA, 65 nt, Homo Sapiens
uugggguuuacaacaacuaggauguguugggugagauguuucagaucuggagaaaugagcaggug

SEQ ID NO: 304597 - RNA, 65 nt, Homo Sapiens
cacccccagcaaggugccuggggagacuugagcagauguuucauuuuggccuggccaguggcuga

SEQ ID NO: 304598 - RNA, 65 nt, Homo Sapiens
ccuauugucaagguuaacauaaaugcucuucuaaaauguuucacuuacuccuaaacuagcuaucc

SEQ ID NO: 304599 - RNA, 65 nt, Homo Sapiens
cagcugccucaccgcccagacauugauuuguucagauguuucaaugccucaugauacaauaaaac

SEQ ID NO: 304600 - RNA, 65 nt, Homo Sapiens
uuucacaccagauccuaccccuuucccugagccacauguuucacacaaguguagaaaaugccagg

SEQ ID NO: 304601 - RNA, 65 nt, Homo Sapiens
guucuggcauuuaaauccuucggcaccuacagagaauguuucacaugucagccaccagacugucc

SEQ ID NO: 304602 - RNA, 65 nt, Homo Sapiens
auaauaagggaauuaaggauuuuuucuguauuuguauguuucacuaguauuuguuaaauggggua

SEQ ID NO: 304603 - RNA, 65 nt, Homo Sapiens
aaaccuuuugauauuucucaacgucugagcugaguauguuucaauugaccgcuucauaagccagu

SEQ ID NO: 304604 - RNA, 65 nt, Homo Sapiens
uggcugugccaaaggugaguugguccugggauaucauguuucaagguacuaaguccucuccaggu

SEQ ID NO: 304605 - RNA, 65 nt, Homo Sapiens
uuuuaaauuuaaaucccacauuuguguagauuuuuauguuucauaugugcuugauuuuuaucagu

SEQ ID NO: 304606 - RNA, 65 nt, Homo Sapiens
ugaucuguuagaauaaccaauaaaaaucauauuauauguuucaauuguuuggccaaaaauuuuuu

SEQ ID NO: 304607 - RNA, 65 nt, Homo Sapiens
gccaaagaaggcuuagugguaguuugcaauuuuguauguuucauuaaucacugagacugcaucag

SEQ ID NO: 304608 - RNA, 65 nt, Homo Sapiens
uucuuugaauacuugcacaucagcuaaauggagaaauguuucaauuuuccucucacuuggccuug

SEQ ID NO: 304609 - RNA, 65 nt, Homo Sapiens
uuuucauguaguuucuuaauauauacuugaaggaaauguuucaccuuauuuuuggucuuuguuua

SEQ ID NO: 304610 - RNA, 65 nt, Homo Sapiens
uucccacucacuucccuuugguuuuucauauuuaaauguuucaauuucuguauuuuuuuuucuuu

SEQ ID NO: 304611 - RNA, 65 nt, Homo Sapiens
auaggccucugggagugauuugguucuuugcccuaauguuucauuugacggucucuuuuugauca

SEQ ID NO: 304612 - RNA, 65 nt, Homo Sapiens
ugaaguugcaauuuauacuguauggcuucuuuuucauguuucaucuagguuuuuagaagugaagu

SEQ ID NO: 304613 - RNA, 65 nt, Homo Sapiens
ugcucugcaguugggaacggugaucuucuugaaugauguuucagugugcaaaaacuauagagccu

SEQ ID NO: 304614 - RNA, 65 nt, Homo Sapiens
ggucaugcaggccuuuaccggcauugauguggcucauguuucaggcagacuugggguccuuaagg

SEQ ID NO: 304615 - RNA, 65 nt, Homo Sapiens
uuaugucuagcuucugagucuagaugaaagacaguauguuucagagaacauuggauaucaguuuu

SEQ ID NO: 304616 - RNA, 65 nt, Homo Sapiens
uggcagugucaagccugaaaccaagcaauaccgucauguuucagccaagcccagagcccuaagau

SEQ ID NO: 304617 - RNA, 65 nt, Homo Sapiens
agaaggcuagagggcgacucugguggugcuuuuguauguuucaauuaggcucugaaaucuugggc

SEQ ID NO: 304618 - RNA, 65 nt, Homo Sapiens
cccccacccucugccacccaguccucccagcugccauguuucaaagacgaccuuuaccuccugcc

SEQ ID NO: 304619 - RNA, 65 nt, Homo Sapiens
cgggacgucuucauugaagauucacuuacaaaggaauguuucacuaaauaaaagaaaaccagaau

SEQ ID NO: 304620 - RNA, 65 nt, Homo Sapiens
caucccugaaggggagcucuuggauaucauuggccauguuucaaucgaauggagccacugggccc

SEQ ID NO: 304621 - RNA, 65 nt, Homo Sapiens
uuauuuuuuuaaugaaaagaaaaaacaagaaaguuauguuucauaauuucuuacaacaugagcca

SEQ ID NO: 304622 - RNA, 65 nt, Homo Sapiens
uuaguccuuaggccaaccaauuuaacugcagugucauguuucacaggccuuccuacauuuagaaa

SEQ ID NO: 304623 - RNA, 65 nt, Homo Sapiens
acuccagacugauagguagucauuagccaugagaaauguuucaggauggcuagggaagacuugug

SEQ ID NO: 304624 - RNA, 65 nt, Homo Sapiens
aaaggcaagcaaaggagaugaaaucuguucugggaauguuucagcagccaauaagugcccgagca

SEQ ID NO: 304625 - RNA, 65 nt, Homo Sapiens
augacaaaguguugaaaauguauuuccugaaauaaauguuucaaaugcagaaacccagaaggcuc

SEQ ID NO: 304626 - RNA, 65 nt, Homo Sapiens
ugucuuaggaaaggagaucaacauuuucaaauuagauguuucaacugugcucuuguuuugucuug

SEQ ID NO: 304627 - RNA, 65 nt, Homo Sapiens
uauguugauucaaacuugcucagaaucuuaagaucauguuucaaaaucuugccugucauugcacu

SEQ ID NO: 304628 - RNA, 65 nt, Homo Sapiens
auuuuuuucaaugaauguuaauuugugcugaaaauauguuucaguuagagaagagacaguuuaau

SEQ ID NO: 304629 - RNA, 65 nt, Homo Sapiens
uuauuuuuggucuuuguuuaauauacuugaaggaaauguuucaccuuuugguguaguuuuuuaau

SEQ ID NO: 304630 - RNA, 65 nt, Homo Sapiens
aauuuaagaacucugaaacaacauauguaaaugguauguuucaauuuuaaaguauaguacauuuu

SEQ ID NO: 304631 - RNA, 65 nt, Homo Sapiens
guauaucaagcauuauagagagaguugagcuggccauguuucacacagcuuuuggugccagcuac

SEQ ID NO: 304632 - RNA, 65 nt, Homo Sapiens
uuggcauaacaugguucuuuacacuacuuuuuaccauguuucaucaagaaucauggacagaacuu

SEQ ID NO: 304633 - RNA, 65 nt, Homo Sapiens
uuauuuuuggucuuuguuuaauauacuugaaggaaauguuucaccuuuucguguaguuuuuuaau

SEQ ID NO: 304634 - RNA, 65 nt, Homo Sapiens
cuagucuaagugggucuuuuuauauuuugcauuauauguuucaacguuuuucuauagcagagcau

SEQ ID NO: 304635 - RNA, 65 nt, Homo Sapiens
ugaaacaauuuaucuuaaugauucucaauuaccaaauguuucauuagcucagauauuaaaguagu

SEQ ID NO: 304636 - RNA, 65 nt, Homo Sapiens
gacaguggucugugcuggcaaggcugugccuucucauguuucauaaccugcuggacaucuuugcc

SEQ ID NO: 304637 - RNA, 65 nt, Homo Sapiens
uauguguguacacuucugaccucagcucuuggugcauguuucagagguggcacugguguugcugg

SEQ ID NO: 304638 - RNA, 65 nt, Homo Sapiens
uccagagcuuuagaggaagacacauagguggguuuauguuucaccucauuuggaacaaaagagga

SEQ ID NO: 304639 - RNA, 65 nt, Homo Sapiens
aaauacacuacagaauuuagucaacauuuuauauaauguuucaauaaauguuucuuucaauaaag

SEQ ID NO: 304640 - RNA, 65 nt, Homo Sapiens
aaaguuaugacauuagcuuuaaagguguaaaaaagauguuucacuaauguaacggugaaagagaa

SEQ ID NO: 304641 - RNA, 65 nt, Homo Sapiens
auuuaacaaugucugaucucagcugaacaaauuagauguuucaguugcucuugggucaacuggcu

SEQ ID NO: 304642 - RNA, 65 nt, Homo Sapiens
uaacaaauguuuauacaaauacauacauguacaccauguuucaaauacuaaauaaauagaguuua

SEQ ID NO: 304643 - RNA, 65 nt, Homo Sapiens
uuuguaaacugcucugcauauaaaccaagggcagaauguuucacccugaucuuaugggaggaauc

SEQ ID NO: 304644 - RNA, 65 nt, Homo Sapiens
aaaagggaagucuugagguuuuagaggugugaauuauguuucaucaaugugcagaauaaucacaa

SEQ ID NO: 304645 - RNA, 65 nt, Homo Sapiens
agaauuauuuuucaauuuuauuuuaguucuaaauuauguuucagaaacaaaagacaaugcuguac

SEQ ID NO: 304646 - RNA, 65 nt, Homo Sapiens
acuuauuuuagucaaugaauacaaaauuccaguccauguuucaugaaaaugaaacuuaauagcuc

SEQ ID NO: 304647 - RNA, 65 nt, Homo Sapiens
caucacaagacaaccuuuucaaaucaacuaugaauauguuucaagaguguccccuuuucuggcau

SEQ ID NO: 304648 - RNA, 65 nt, Homo Sapiens
gaaaaaugucuuuaaugcuucaugacauguucuguauguuucagguauguaaacaagagauuugg

SEQ ID NO: 304649 - RNA, 65 nt, Homo Sapiens
cauugccauuaccaauaaaucgccagagacugucaauguuucauucuggauaauugcuugauucu

SEQ ID NO: 304650 - RNA, 65 nt, Homo Sapiens
cugugguucccccaagcucugcagucuucuuccugauguuucaaaugaaaaucucuguacagauu

SEQ ID NO: 304651 - RNA, 65 nt, Homo Sapiens
cccuuaauaaguccucaauucuuaacagauauaagauguuucauacuggagcgaaacuacaaucc

SEQ ID NO: 304652 - RNA, 65 nt, Homo Sapiens
acacaacagagaaacccuauaaagaaugauacaauauguuucaaucagaaccuucacauccaaua

SEQ ID NO: 304653 - RNA, 65 nt, Homo Sapiens
uucuuuugagaaaugccuguucagcuacuuugcccauguuucaaguaguuuuugguuucuugcug

SEQ ID NO: 304654 - RNA, 65 nt, Homo Sapiens
gucauggauuucuuaguguauuugggggaagggaaauguuucaagguaaagaaccuugacccuuu

SEQ ID NO: 304655 - RNA, 65 nt, Homo Sapiens
ugucauccccuccuuauuuuauuugggagagggaaauguuucagaaacaaaagggccucaucccc

SEQ ID NO: 304656 - RNA, 65 nt, Homo Sapiens
ugucgucccuuuguuauuuuaugugggagagggaaauguuucagaaacgaaagaucucauccccu

SEQ ID NO: 304657 - RNA, 65 nt, Homo Sapiens
gacacauuguccacuucagaugcuuguuuaaaaaaauguuucaccaugugucuuuacccaauaca

SEQ ID NO: 304658 - RNA, 65 nt, Homo Sapiens
aacugcuauauuugaaugcaguuguucauguagguauguuucacuaugguaauaugguggugugc

SEQ ID NO: 304659 - RNA, 65 nt, Homo Sapiens
ggcccggggccccccagggaguccuucuguccuggauguuucaugugucugugucccauccugcu

SEQ ID NO: 304660 - RNA, 65 nt, Homo Sapiens
cauccauacuucuguuuuuggugccauggucuauaauguuucauguuauuggagugauggauuug

SEQ ID NO: 304661 - RNA, 65 nt, Homo Sapiens
uuagagaaauaacuauuacuuauaaaaugaaauauauguuucauucuguaauauauauauauaua

SEQ ID NO: 304662 - RNA, 65 nt, Homo Sapiens
cuucagccuuuaaccuauacaggauuuuuuuuuguauguuucaaggaauauaucuugcucuauag

SEQ ID NO: 304663 - RNA, 65 nt, Homo Sapiens
agcuguuguuguuuuucucuggaaacugauccuucauguuucaauccggguucccagagcuccga

SEQ ID NO: 304664 - RNA, 65 nt, Homo Sapiens
gaaaccagugaaauauuucaauuuucuaaaauuacauguuucacuaauuuuuuuauugagaauaa

SEQ ID NO: 304665 - RNA, 65 nt, Homo Sapiens
cuccagauuuaugaacauuugugcugauucuuggaauguuucauuauaauuuucuauuugaaaau

SEQ ID NO: 304666 - RNA, 65 nt, Homo Sapiens
caucucagcccaggcaccaggagauagagccccagauguuucagcucauguauaaaugccaugug

SEQ ID NO: 304667 - RNA, 65 nt, Homo Sapiens
agcauucaggcacugccaggcucagcuaacauuccauguuucagauguccugaaaaaugcucaau

SEQ ID NO: 304668 - RNA, 65 nt, Homo Sapiens
gaguuauuugagguuuuuugccuucaccuuaugaaauguuucacuuauuuguaggcagucaguua

SEQ ID NO: 304669 - RNA, 65 nt, Homo Sapiens
gguccucauguguacuagugauuucauagucauuuauguuucaucuuuuuccuucaccauuuauc

SEQ ID NO: 304670 - RNA, 65 nt, Homo Sapiens
gcuggcauucugcauguuuagugauugucuugggaauguuucacugcuacccgcauccagcgacu

SEQ ID NO: 304671 - RNA, 65 nt, Homo Sapiens
gaauauuuucacuguuccuucuuucuuaaagucuuauguuucacucuuuaacucaaauguauucu

SEQ ID NO: 304672 - RNA, 65 nt, Homo Sapiens
auucaucaaguuaucuuuauaaucacuguaguuagauguuucauguccauucaagugacuuuuau

SEQ ID NO: 304673 - RNA, 65 nt, Homo Sapiens
gagaccaugagaauuccaggaguucccaaaauagaauguuucagugugcuaggaucauuggauuc

SEQ ID NO: 304674 - RNA, 65 nt, Homo Sapiens
augccugugagcuaggucuuauguaggacagugccauguuucaaguuccuuuaaaugucccaugg

SEQ ID NO: 304675 - RNA, 65 nt, Homo Sapiens
agccuaacuuuuuacacagugauguaauguuuuuaauguuucagacuguaaaaaggcagaccagg

SEQ ID NO: 304676 - RNA, 65 nt, Homo Sapiens
guuuagucacagcuuaaaaacuguggugcagggcaauguuucaaaugcaguacuugauuuaggau

SEQ ID NO: 304677 - RNA, 65 nt, Homo Sapiens
uaacauuaacuucuaaagaaguuuuuucuaagaaaauguuucaaggcaauauuuuuuuugaggcu

SEQ ID NO: 304678 - RNA, 65 nt, Homo Sapiens
ccacuaaacuuuuguguccauauuuuacugagaccauguuucauuaaaagcauaguuucauagua

SEQ ID NO: 304679 - RNA, 65 nt, Homo Sapiens
uucaacacucgugaggccaggaagcuauuaaagggauguuucaagcuguuucuagcacauuccaa

SEQ ID NO: 304680 - RNA, 65 nt, Homo Sapiens
aauguagcuuucucucuuaccuucuggaagagggaauguuucauuuauuacuguuugauuuucuu

SEQ ID NO: 304681 - RNA, 65 nt, Homo Sapiens
agcucuuuuuccaaggcccggaguacuggggauugauguuucaaggccaaucaaugggaugcuuc

SEQ ID NO: 304682 - RNA, 65 nt, Homo Sapiens
gacaaaggauuugagauguucucaauaaaaagaaaauguuucacuacucugguguugcugagacu

SEQ ID NO: 304683 - RNA, 65 nt, Homo Sapiens
caagcagucccccaacucccauccagaagagagaaauguuucacgcaaccaagacuaaguuuuaa

SEQ ID NO: 304684 - RNA, 65 nt, Homo Sapiens
ccaaggaggcaaaucuauaaaggguugugugaaagauguuucauaugaaaugacuccuacaauug

SEQ ID NO: 304685 - RNA, 65 nt, Homo Sapiens
accauauaauagaaauacccucuaaagguauucaaauguuucagcauagaugaauuuauuuuauu

SEQ ID NO: 304686 - RNA, 65 nt, Homo Sapiens
cgcucggccgggaacgagugcugggcccuuaguggauguuucagaccaaucggugucucaggcca

SEQ ID NO: 304687 - RNA, 65 nt, Homo Sapiens
aaggaaauauugagagagaauaacuuccucuuaggauguuucaccauaugugauuuucucuaaug

SEQ ID NO: 304688 - RNA, 65 nt, Homo Sapiens
cuuacaguucucugcguucgucacuuaauuccugaauguuucagagaaacaggaaucagaaaaua

SEQ ID NO: 304689 - RNA, 65 nt, Homo Sapiens
gcccagcaagaagggcuuggguucugaggaagcagauguuucaugcugugaggccuugcaccagg

SEQ ID NO: 304690 - RNA, 65 nt, Homo Sapiens
cuggcucaaaauggacaagaagguacuggaucaugauguuucaaaggaagaaccagucaccuuuc

SEQ ID NO: 304691 - RNA, 65 nt, Homo Sapiens
cuuuuaguugaaugccacugaagagcugugauagcauguuucaaagcugaacucuacagagcgag

SEQ ID NO: 304692 - RNA, 65 nt, Homo Sapiens
acgacagagacguggcauuuggaaacgaaacuuagauguuucauggagcuuauuuugagaacuuu

SEQ ID NO: 304693 - RNA, 65 nt, Homo Sapiens
aaugucaagcuguggaccaaguaauacuagcugguauguuucauaauggacaaauugacugcaau

SEQ ID NO: 304694 - RNA, 65 nt, Homo Sapiens
cugacagauuauuuuuauuuauguacccuguggggauguuucauagacaaauuccucuuugauga

SEQ ID NO: 304695 - RNA, 65 nt, Homo Sapiens
ccacaaggggcuccacaccugccauaggguccugaauguuucagaauuggacagucucaccuccu

SEQ ID NO: 304696 - RNA, 65 nt, Homo Sapiens
augccagaaaagugaaguccuagguguuuccaucuauguuucaaucuguccaucuaccaggccuc

SEQ ID NO: 304697 - RNA, 65 nt, Homo Sapiens
uccaucagaucuucucaccuugauuuugagcuggaauguuucaaugagcaaaauaaauuagacaa

SEQ ID NO: 304698 - RNA, 65 nt, Homo Sapiens
gccauugcuguaaaucuuaaaaugaaugaauaaaaauguuucauuuuacaagaggaguguaugau

SEQ ID NO: 304699 - RNA, 65 nt, Homo Sapiens
auugugacauagauuauacuacuacuaauuuuuggauguuucaaaaggucaagaaguaaaagaug

SEQ ID NO: 304700 - RNA, 65 nt, Homo Sapiens
agagagccagagacaguguugcaacugggccuggcauguuucagugugguguccagcagugucuc

SEQ ID NO: 304701 - RNA, 65 nt, Homo Sapiens
uuuuuccauaguaaauugucuugcaguuuuugaaaauguuucaagucuaguuuuuacaagcacau

SEQ ID NO: 304702 - RNA, 65 nt, Homo Sapiens
gacuugaugagauugaaacauggcuuuuggcaugaauguuucauagguuauguuguguucauuua

SEQ ID NO: 304703 - RNA, 65 nt, Homo Sapiens
guugugaucuuuccuguccugacccucucugaauuauguuucaauaguacucuugauugucugcc

SEQ ID NO: 304704 - RNA, 65 nt, Homo Sapiens
ucuuuucauauuuaguucugguguggugucuggaaauguuucaacuguuuuaauauauugucuga

SEQ ID NO: 304705 - RNA, 65 nt, Homo Sapiens
gcguuuugacccaccugccaguguuugcuugcucuauguuucaguagcagauuuucacacaugug

SEQ ID NO: 304706 - RNA, 65 nt, Homo Sapiens
aauuuaaaaagguacuuaaauuuucuggaauauccauguuucagagguaauauuuacuuucuauu

SEQ ID NO: 304707 - RNA, 65 nt, Homo Sapiens
aguccaauuagaaaaugggcaaaagacaugaauagauguuucacugaagaggaucuauagauggc

SEQ ID NO: 304708 - RNA, 65 nt, Homo Sapiens
agguugccuaugaaaaacugauuguauuucuuuugauguuucaaagagaaauuugugaaaaauau

SEQ ID NO: 304709 - RNA, 65 nt, Homo Sapiens
uuuaaguguauuuaaagaaaaugaacuaccaucugauguuucauagcuuauagucuuccaguuua

SEQ ID NO: 304710 - RNA, 65 nt, Homo Sapiens
uucuaagugaagugaguugguuuuuguuuuuuuuaauguuucaggcaaagaggcugaugucuuug

SEQ ID NO: 304711 - RNA, 65 nt, Homo Sapiens
aauauaagaaaaguucaaaauguuaguuaaaacauauguuucaaaguucuguauuuuucuuguag

SEQ ID NO: 304712 - RNA, 65 nt, Homo Sapiens
ccaucauccagcuuuggcugcccaguuguauaguaauguuucaguugauauuguauauguuuugu

SEQ ID NO: 304713 - RNA, 65 nt, Homo Sapiens
uuucuaaauuuaacagagauguugauaacucuuccauguuucacaguuuuaguauuguauuccaa

SEQ ID NO: 304714 - RNA, 65 nt, Homo Sapiens
uaagguaacuccuagauaucagaacauaacucauuauguuucagaaguuugauugcagacacugu

SEQ ID NO: 304715 - RNA, 65 nt, Homo Sapiens
ugacaaaaagucguucuaaucaucaauaaaguuguauguuucaaccaaagacuucauuuguguau

SEQ ID NO: 304716 - RNA, 65 nt, Homo Sapiens
uuguuuuccguucuguuuuauguauaacagggcuuauguuucaguauguucuuuaaaaucguuaa

SEQ ID NO: 304717 - RNA, 65 nt, Homo Sapiens
aucagaucaauacaaucuugagcauggaacaaagcauguuucaggguuguuuauuauccugauca

SEQ ID NO: 304718 - RNA, 65 nt, Homo Sapiens
uaagaagcuguuuugcuaaauuauuuuuacuuggaauguuucaaacagauuucaggcugcaaacu

SEQ ID NO: 304719 - RNA, 65 nt, Homo Sapiens
cugaaaccaacuugucccaggccacaggaguguauauguuucauaaucuuuaucaagaaguuugu

SEQ ID NO: 304720 - RNA, 65 nt, Homo Sapiens
ccuacuuccaccuaaucuguuuacagucuuuugguauguuucaguuacuuagauggucucauaag

SEQ ID NO: 304721 - RNA, 66 nt, Homo Sapiens
caguggauuugcuuuaacccucacauuuuuuuuuuaauguuucacauguuacauuauuagcugaau

SEQ ID NO: 304722 - RNA, 66 nt, Homo Sapiens
cagggcagucuggcgcccaugaugggagggauugacauguuucaacaaaauaaugcacuuccuuac

SEQ ID NO: 304723 - RNA, 66 nt, Homo Sapiens
cauuuuucuuaaauccaaguuggccguuuuauuaguauguuucaaauguguauuaccaaugugggu

SEQ ID NO: 304724 - RNA, 66 nt, Homo Sapiens
auuaauaucuccaugcauaguuuuagacaaaaaaagauguuucaauaaaauuacugucuuguaaua

SEQ ID NO: 304725 - RNA, 66 nt, Homo Sapiens
gaacucaaccaauuuggcaccccaugcagccucaaaauguuucaaaugccuaccgccucuagaucg

SEQ ID NO: 304726 - RNA, 66 nt, Homo Sapiens
cuuggcuucuuuucucccuugauggucaagucucuuauguuucaauauuucuuaacuggggugucu

SEQ ID NO: 304727 - RNA, 66 nt, Homo Sapiens
caaaugucaugaaugauuuccaguuuuuaaagcuauauguuucacugcuucauaucucuguccacu

SEQ ID NO: 304728 - RNA, 66 nt, Homo Sapiens
gcacgcacacaugauuuugauuaugcuacaugauauauguuucaaaaagaauuagcauagaaaucc

SEQ ID NO: 304729 - RNA, 66 nt, Homo Sapiens
ccuagguaggggauugcugggccauaugauaagcauauguuucaguucuaccaaucuuguuuccag

SEQ ID NO: 304730 - RNA, 66 nt, Homo Sapiens
aacagaaaaacauuaaaaaguucauuccuuaacacaauguuucaaguuaaaccuuuugugucaccg

SEQ ID NO: 304731 - RNA, 66 nt, Homo Sapiens
guguuugauaaauauccucucaguguuuuaucuuccauguuucaacaacuauugaaauaugaaaug

SEQ ID NO: 304732 - RNA, 66 nt, Homo Sapiens
cuggguuucucuguauaguacuggcaugguacggagauguuucacgaaguuuguucaucagacucc

SEQ ID NO: 304733 - RNA, 66 nt, Homo Sapiens
aaugugcuugccugaaauaaagcuaauaaaaauauuauguuucacauuaucuucuguucauuuuga

SEQ ID NO: 304734 - RNA, 66 nt, Homo Sapiens
aaaaaaaugcaaaucgacuuuuuaacaacuguugagauguuucaugggacaguagaacucugacuc

SEQ ID NO: 304735 - RNA, 66 nt, Homo Sapiens
caccacgcuugguuaauuuuuguauuuuuaguagagauguuucaccauguuggccaggcuagucuu

SEQ ID NO: 304736 - RNA, 66 nt, Homo Sapiens
cugccggguguuguauguguggugacuugcggauuuauguuucaguguacuggaaacuuuccauuu

SEQ ID NO: 304737 - RNA, 66 nt, Homo Sapiens
cugugauuuuguaaauuucaguaauucauuuaaaugauguuucaguagauauauucuagcauauua

SEQ ID NO: 304738 - RNA, 66 nt, Homo Sapiens
aaaauccaaaauuaugauaacuguauuucuagggguauguuucaccuugauuuuggcccgguucuu

SEQ ID NO: 304739 - RNA, 66 nt, Homo Sapiens
acccuacuugguaacaaaguucucagauguuaggucauguuucauuugcucagucggggaucacuc

SEQ ID NO: 304740 - RNA, 66 nt, Homo Sapiens
uuuuagcaggugaacuguuccaagacugacacaaggauguuucaaacuugccucugucuguagaaa

SEQ ID NO: 304741 - RNA, 66 nt, Homo Sapiens
auacguauuauauagagaaacaaauguuuuuauuaaauguuucauugacccaaguaauuuaaaagu

SEQ ID NO: 304742 - RNA, 66 nt, Homo Sapiens
acuguuuuucauacucuuaaguguaaauaauauaaaauguuucaagcgcuuaacucccccucauuc

SEQ ID NO: 304743 - RNA, 66 nt, Homo Sapiens
uuuuagagcuuuagaaauuuguaagcugagagaacaauguuucacuuaauaggagggugucuuagu

SEQ ID NO: 304744 - RNA, 66 nt, Homo Sapiens
acuuacucuuucuuuuaagauaaguuguagacuucgauguuucaugcucauguacuucaaauaaug

SEQ ID NO: 304745 - RNA, 64 nt, Homo Sapiens
cuugaaaucuguuaaaauaaaauuguacauuuggagauguuucaugaugauguguuuauuucua

SEQ ID NO: 304746 - RNA, 66 nt, Homo Sapiens
aggaaacuugugacuuguguauuaucgucauugaggauguuucacucaugucugucauuuuauaag

SEQ ID NO: 304747 - RNA, 66 nt, Homo Sapiens
agcaugguaaguucccuuagcuauaugaauuuuggcauguuucagagagaucaguaaauaaaauau

SEQ ID NO: 304748 - RNA, 66 nt, Homo Sapiens
uaaaugcggagacguaaagcauuaaugcaaguuaaaauguuucagugaacaaguuucagcgguuca

SEQ ID NO: 304749 - RNA, 66 nt, Homo Sapiens
uuaauuucuugaaaauguauuuugaaguaaauuuuaauguuucauagaucuagaaaacuuuggauu

SEQ ID NO: 304750 - RNA, 66 nt, Homo Sapiens
ucugguuuaaccaggcuuuucauugggaaaccauguauguuucauuuggagacucagaaggggaag

SEQ ID NO: 304751 - RNA, 66 nt, Homo Sapiens
aggcuggaggaagggggguuaccaaaggauagugcgauguuucaggcuaucuauauggaauugcuu

SEQ ID NO: 304752 - RNA, 66 nt, Homo Sapiens
acuauaauuuaauugggaaaaauauuccucuauuagauguuucaacgcaagucaacuuaccuauua

SEQ ID NO: 304753 - RNA, 66 nt, Homo Sapiens
augcacuuuuagaaaugcaugagcuagaaaaauaaaauguuucauuuauuucuaugacaaauucaa

SEQ ID NO: 304754 - RNA, 66 nt, Homo Sapiens
uucucugcugugaaacucuuagucuauaaccugaaaauguuucaugucugugacaccaaaaagaaa

SEQ ID NO: 304755 - RNA, 66 nt, Homo Sapiens
auuauaagaaaggcagaaugaacuucuaaagaaaauauguuucagccacuuugucguguuuguuuu

SEQ ID NO: 304756 - RNA, 66 nt, Homo Sapiens
ugcagucugaugccagguaugcacauguguugacccauguuucagagaggaaacaugcucagucau

SEQ ID NO: 304757 - RNA, 66 nt, Homo Sapiens
gucaagcccacauugcuuuucuccccaauaaagcacauguuucaugguguguuuauucuuuugcuu

SEQ ID NO: 304758 - RNA, 66 nt, Homo Sapiens
guccuuucuucucugucccuugauuaccauguguggauguuucaguauaaaggcaaaccuggcuuu

SEQ ID NO: 304759 - RNA, 56 nt, Homo Sapiens; identical to SEQ ID NO: 303635

SEQ ID NO: 304760 - RNA, 66 nt, Homo Sapiens
gguuugugaugaucuuuacgaucuuguuugggaaugauguuucauacuccuagauacuauuacgcu

SEQ ID NO: 304761 - RNA, 66 nt, Homo Sapiens
cucugauugccccaauaaaaugacguguaaaaaaugauguuucaucuauaauccuagaccuuuuca

SEQ ID NO: 304762 - RNA, 66 nt, Homo Sapiens
uuucaauuuuuuuucagauuaugcuugggauuagaaauguuucagauugagcaucccuugucugaa

SEQ ID NO: 304763 - RNA, 66 nt, Homo Sapiens
ucugugucaugguuggaagaaugagauuuuuaaaguauguuucagugccaccgugccuagccaagg

SEQ ID NO: 304764 - RNA, 66 nt, Homo Sapiens
gcaacugcuuuauaugacugguuucucacuuuucacauguuucauaaaaauccacaauuaaaccau

SEQ ID NO: 304765 - RNA, 66 nt, Homo Sapiens
gugaaugcaaaaaagagagacuaaagugacacuuaaauguuucagacaccuaacccugauaguuac

SEQ ID NO: 304766 - RNA, 51 nt, Homo Sapiens; identical to SEQ ID NO: 303642

SEQ ID NO: 304767 - RNA, 66 nt, Homo Sapiens
gccucagacaaauguguauuuggguuguguaugcgaauguuucagugcugacaaaaccugggaauu

SEQ ID NO: 304768 - RNA, 66 nt, Homo Sapiens
auagacaaguuuuguuuccuuuuuuauaguuauuaaauguuucaaauaaugugucucaggcucaag

SEQ ID NO: 304769 - RNA, 66 nt, Homo Sapiens
aaugcaguucucacgaaaguacauuauaaaguucagauguuucaucaguugaguuauuccacaaac

SEQ ID NO: 304770 - RNA, 66 nt, Homo Sapiens
uuugcugugcuuuucugaauguaguucagcuuuucaauguuucauguccuaacaaacaaaagaaau

SEQ ID NO: 304771 - RNA, 66 nt, Homo Sapiens
ugcuuaaauauauaauacaugaacugcagcuauagaauguuucaaauuuacuuucugcugugaacu

SEQ ID NO: 304772 - RNA, 64 nt, Homo Sapiens
cucugugucuguuuuuaauugaagaaauaaaaaaugauguuucacaauugaauguagauacuca

SEQ ID NO: 304773 - RNA, 66 nt, Homo Sapiens
aaaauaaagcuuaaaaauuguaugagggaaucugaaauguuucauaugcuuauugaugugcuguga

SEQ ID NO: 304774 - RNA, 66 nt, Homo Sapiens
aaaaacauuguagauaucuauuuauauuuaaaguuuauguuucaugaacugcagcugcaggauucu

SEQ ID NO: 304775 - RNA, 66 nt, Homo Sapiens
ugagccuuuuaaguaguuugaaugauaagacuuaaaauguuucauaauuauguuuuauguaacaga

SEQ ID NO: 304776 - RNA, 66 nt, Homo Sapiens
cccuguacugauaguacuucccaguaugauauugugauguuucauacaaugcagugaacauaacca

SEQ ID NO: 304777 - RNA, 66 nt, Homo Sapiens
gccucuuaacuaauugcgguuucauaggauauauaaauguuucaagccauuauugcugaaugguuc

SEQ ID NO: 304778 - RNA, 66 nt, Homo Sapiens
uuuauguaagcauguauacacugugcuaaaagucacauguuucaguuuguguauaauauuaauaug

SEQ ID NO: 304779 - RNA, 66 nt, Homo Sapiens
aagaacaggaaaaaauaauuauaagaugauaagcaaauguuucagcccaaugucaacccaguuaaa

SEQ ID NO: 304780 - RNA, 66 nt, Homo Sapiens
gccgcugccauaguuuucuaacuugaacagccaugaauguuucaugucucccuuuuuuuuugucua

SEQ ID NO: 304781 - RNA, 66 nt, Homo Sapiens
guccauguuguccuuucuggcuucccugauggugucauguuucagcgcaugcgccccagccuuucc

SEQ ID NO: 304782 - RNA, 66 nt, Homo Sapiens
gaaugaauccuugugguuuuuaguuuuguauaaauuauguuucaaaucuuuacauuuuggaaauaa

SEQ ID NO: 304783 - RNA, 66 nt, Homo Sapiens
cuuacuuuuuggggaaguaaaagaagauggaaauggauguuucauuuguaugaguuuggagcagug

SEQ ID NO: 304784 - RNA, 66 nt, Homo Sapiens
caucuauucuuucccuagaggcaaacauuucuuaaaauguuucauuuucauuaaaaaugaaagcca

SEQ ID NO: 304785 - RNA, 66 nt, Homo Sapiens
gguaccauaccaacuggaauuuaggcuuuaaaaauaauguuucaaggccagguguggugauucaug

SEQ ID NO: 304786 - RNA, 66 nt, Homo Sapiens
uucuuuuguguauuuauacuuguauguaugauuugcauguuucaaugauaaagggauaaaacagua

SEQ ID NO: 304787 - RNA, 66 nt, Homo Sapiens
ggaccauagauugcugucccccucgacggacuuauaauguuucagguggcuggcuugaacaugagu

SEQ ID NO: 304788 - RNA, 66 nt, Homo Sapiens
uaucugcuaaguuguaccuuaauuagagggcaauauauguuucauaaagaagagucuuuauaauuu

SEQ ID NO: 304789 - RNA, 66 nt, Homo Sapiens
acuaguugaccuagauuguauuaauagcuacuuaagauguuucaaagauaggaagcuauugcuugg

SEQ ID NO: 304790 - RNA, 66 nt, Homo Sapiens
caaaagggagagaacaaaagcuauaccaaaagggccauguuucaagaaaauggauuuaaacauauu

SEQ ID NO: 304791 - RNA, 66 nt, Homo Sapiens
uuccaaucagaccagguaggagcuuuccuguuucauauguuucaggguugcacaguuggucucuuu

SEQ ID NO: 304792 - RNA, 66 nt, Homo Sapiens
aguggcaugaaaauuuucuuaagcuaaaauacagacauguuucaaagggcuaaaguuggagaugag

SEQ ID NO: 304793 - RNA, 66 nt, Homo Sapiens
uauacuaaaggauauacauauacugccucuucuaugauguuucauuugaccuacaccaucagcauc

SEQ ID NO: 304794 - RNA, 66 nt, Homo Sapiens
uugacuuuugaaaacaaaauaugaaaagaaucggcaauguuucaaacaaaaagucauaaaagucac

SEQ ID NO: 304795 - RNA, 66 nt, Homo Sapiens
ugauggcuacaucuguaucuuuuccuccuguguuuaauguuucacuagggagaggaaauaaagcag

SEQ ID NO: 304796 - RNA, 66 nt, Homo Sapiens
gugguguggugggccaaaauacuugcccuucauuacauguuucaaaguuguuuuuuuuauuauaaa

SEQ ID NO: 304797 - RNA, 66 nt, Homo Sapiens
guuggggucauagauguuucagaauuagcugcuucuauguuucauaugcucugcuucaauguaguc

SEQ ID NO: 304798 - RNA, 66 nt, Homo Sapiens
gauuccugaccauaagugacauuaggcaaaaauaaaauguuucaagauguuuacauuggauaaagg

SEQ ID NO: 304799 - RNA, 66 nt, Homo Sapiens
uauuuccuacuuuuccacuaaaucccugagucucagauguuucauuuaccacacagacugcucucc

SEQ ID NO: 304800 - RNA, 66 nt, Homo Sapiens
guagucaaaauaaacauaaagagcaagagugucauaauguuucaggcagaaauuauaucuguuuug

SEQ ID NO: 304801 - RNA, 66 nt, Homo Sapiens
cgagaaaacaugaaggaggggaaauagggcaaguuuauguuucaugauacucaguaggaacuuuuu

SEQ ID NO: 304802 - RNA, 66 nt, Homo Sapiens
gccagguguggugauucauguuaggcuuuaaaaauaauguuucaaggguaccauaccaacuggaau

SEQ ID NO: 304803 - RNA, 66 nt, Homo Sapiens
gccuagucugaaaaauaacaaguuuuuguagaaaaaauguuucagucgaagagacaaucucuggca

SEQ ID NO: 304804 - RNA, 66 nt, Homo Sapiens
uauauaaaagcaaaagaacuucuauuuauagaauaaauguuucauuaaaauucugaaaaauacauu

SEQ ID NO: 304805 - RNA, 66 nt, Homo Sapiens
gaguaagccuguugugacuugugcuuguaauccagcauguuucacacucugcguccuggguagucu

SEQ ID NO: 304806 - RNA, 66 nt, Homo Sapiens
augauuuucuauuuuucuucaaauauuuuauaugaaauguuucacuaauguaacauuaauucuacu

SEQ ID NO: 304807 - RNA, 57 nt, Homo Sapiens; identical to SEQ ID NO: 303683

SEQ ID NO: 304808 - RNA, 66 nt, Homo Sapiens
uuauuugauauuuauuuucacaaacaauuagauguuauguuucauauuuguguuauuuuuucuuau

SEQ ID NO: 304809 - RNA, 66 nt, Homo Sapiens
uauguaauggggcaaaccacuuguuuucauaagacaauguuucagauuauuuaauuuuguuucauu

SEQ ID NO: 304810 - RNA, 66 nt, Homo Sapiens
caccggcugcacaggcacaacgcugagaagaugccaauguuucaucggccucccacugggagucau

SEQ ID NO: 304811 - RNA, 66 nt, Homo Sapiens
auaaauauauauuauauaaauauauuaaaaaggaaaauguuucagauguuuauuuguauaauuacu

SEQ ID NO: 304812 - RNA, 66 nt, Homo Sapiens
caauuauaaccaaaaacaaugugacggauacccaagauguuucauguuguagcuugggugaauuac

SEQ ID NO: 304813 - RNA, 66 nt, Homo Sapiens
uuaauuuuuaauaacaugcaugggucccucucacuaauguuucaacaauagggaaaaaugagaacu

SEQ ID NO: 304814 - RNA, 66 nt, Homo Sapiens
ccugguguagaauuuacacugcugcaccugaggucgauguuucaaaguaagaucaagccaguguuu

SEQ ID NO: 304815 - RNA, 66 nt, Homo Sapiens
gucaagugacauuucaaaagaaguucuauaacaauuauguuucaugcuuaaaguaaaaauucccag

SEQ ID NO: 304816 - RNA, 66 nt, Homo Sapiens
cuauuaaucaugcaguguacaauucaaaaucaugcaauguuucacuuuagaauuggauuugaagaa

SEQ ID NO: 304817 - RNA, 66 nt, Homo Sapiens
ucauucaaauggcaguagccuuggcucacauaagacauguuucaugugaucuguauccuggcauac

SEQ ID NO: 304818 - RNA, 66 nt, Homo Sapiens
agcaugcauguauaggccgaacuauuaucagcucugauguuucagagagaagaccucagaaaccga

SEQ ID NO: 304819 - RNA, 66 nt, Homo Sapiens
acacauguaaagaauauaugagccuuguauggagugauguuucauuuaccuggguuguguuaauga

SEQ ID NO: 304820 - RNA, 66 nt, Homo Sapiens
gauacuguuggucuagccugugaagcaauuaaucgaauguuucagaaggagcagagugaauuagua

SEQ ID NO: 304821 - RNA, 66 nt, Homo Sapiens
ccuauggacuggcuuaagccguguggcauccgaggaauguuucaaaugugucuguguuucucuuua

SEQ ID NO: 304822 - RNA, 66 nt, Homo Sapiens
cacaggacauuaauaaugguguacuuuaaaaaauauauguuucauuuaaucuucacaaaagaucug

SEQ ID NO: 304823 - RNA, 66 nt, Homo Sapiens
gcugccuccgccgccacugcugcugccaccucuuauauguuucagacacucucugcccagacucau

SEQ ID NO: 304824 - RNA, 66 nt, Homo Sapiens
uaaaaaauaacuauaucauaacucauucauaacuugauguuucauuuucuguugaggaaccauaaa

SEQ ID NO: 304825 - RNA, 66 nt, Homo Sapiens
aaauauuaaaugauuuagcagucuccacguguguuaauguuucaaacguguaucauaauguguaua

SEQ ID NO: 304826 - RNA, 66 nt, Homo Sapiens
aaauuaugauauggacguuaucauuggucuggugagauguuucauauuugugacaguuaauuuaaa

SEQ ID NO: 304827 - RNA, 66 nt, Homo Sapiens
uugccaacugccaagccauacuuauuaaguucgaacauguuucacuuaaggagagacaccuagcuu

SEQ ID NO: 304828 - RNA, 66 nt, Homo Sapiens
uugaaaacacaagaugaccugauuuuaccauaugaaauguuucauauccaagaagucuugggauug

SEQ ID NO: 304829 - RNA, 66 nt, Homo Sapiens
cagauuuauauguuuggaggcucggguggggaaucuauguuucacuuuuuagugaagaaacaaguu

SEQ ID NO: 304830 - RNA, 66 nt, Homo Sapiens
uauaguuuuauacaaaguaggaaagaaagaaauuuuauguuucacaucacuuggacguuucauuuu

SEQ ID NO: 304831 - RNA, 66 nt, Homo Sapiens
uuuaaaucauguuuuccuaauauuaauuuauauuacauguuucauacugaauaaaucaugccacua

SEQ ID NO: 304832 - RNA, 66 nt, Homo Sapiens
cuauggaaaugugaaggauguuaaagggaacaaauaauguuucaucguaauucaucacauaguauc

SEQ ID NO: 304833 - RNA, 66 nt, Homo Sapiens
uauaaacugccuucuucaacaaacauaagauuuguaauguuucauuauuuuauaaguuguaugcau

SEQ ID NO: 304834 - RNA, 66 nt, Homo Sapiens
gacaguuuuuaacaauaaaugccagauguguaucagauguuucacuguuugaaucuaccauucaua

SEQ ID NO: 304835 - RNA, 66 nt, Homo Sapiens
aacagcugaaggguuuuauuguguguaauuauacuuauguuucaaugcuuauaauaccuuuuccuu

SEQ ID NO: 304836 - RNA, 66 nt, Homo Sapiens
guuugcacuuugcauugaaccaguuuauuuaaguucauguuucacuuggaugugaugggucuaguc

SEQ ID NO: 304837 - RNA, 66 nt, Homo Sapiens
aaaaggaaaucuauggaguauaagaagaaaucaaacauguuucaggaaugagaacuugggaauguu

SEQ ID NO: 304838 - RNA, 66 nt, Homo Sapiens
cuuugugguccugaucaagguucugcauuaaaauaaauguuucaggaguguaacuaggggcugugu

SEQ ID NO: 304839 - RNA, 66 nt, Homo Sapiens
cugcaguguguuuagcauucagcuugcaguauaguuauguuucaguucguaccagcugaauagccc

SEQ ID NO: 304840 - RNA, 66 nt, Homo Sapiens
ggcuccacagcuccaccgcuggccugggcccucaggauguuucaaagcccaggucacccuguggca

SEQ ID NO: 304841 - RNA, 66 nt, Homo Sapiens
uuaaaugcacuucuuccgguauguaaagcacaaaguauguuucaguucuuuagaaugcucuuuugc

SEQ ID NO: 304842 - RNA, 66 nt, Homo Sapiens
ugcaaacauauuaaaguuucaucuuuaggcuuuuguauguuucagauuuaguuagauauugacuuu

SEQ ID NO: 304843 - RNA, 66 nt, Homo Sapiens
caaacaagaagagaagaaaaaguggaaaaccucaggauguuucagccugaccuuagaacaugagag

SEQ ID NO: 304844 - RNA, 66 nt, Homo Sapiens
ucagcuguacaaacuccagcuacuuuaaagugugaaauguuucaccauguuauauuaaccucuucc

SEQ ID NO: 304845 - RNA, 66 nt, Homo Sapiens
guguuaccuuucuggcuucccucauugauuuuguauauguuucagcgauuaugugauguuggaaag

SEQ ID NO: 304846 - RNA, 66 nt, Homo Sapiens
aaaucugaccaaaacaaacaaugauacacuaugaagauguuucaaagugacuauucaguuuucagg

SEQ ID NO: 304847 - RNA, 66 nt, Homo Sapiens
aaucucaacuggcagcaauauuaccaaagacacucuauguuucauuguauuccccucaguucaucu

SEQ ID NO: 304848 - RNA, 66 nt, Homo Sapiens
aauaaaugugauguuucuagaaaggguaggucucuaauguuucauccuuagaacuaucuugguugc

SEQ ID NO: 304849 - RNA, 66 nt, Homo Sapiens
cucugcaucaguugcuucuauagagcaucagcccucauguuucauugucuuaaugucggggagcag

SEQ ID NO: 304850 - RNA, 66 nt, Homo Sapiens
uuuaaaaaagcaaaugaggcaaugugucaaaauuuaauguuucauaauaaaaauagauacguugac

SEQ ID NO: 304851 - RNA, 66 nt, Homo Sapiens
gaucacuguuucucucaacacuauuuaaucugaaaaauguuucaguacaaaccacuguuugaacua

SEQ ID NO: 304852 - RNA, 66 nt, Homo Sapiens
guuaaauucagaauaucucuaaaacauggaaaauugauguuucaauaaaaagggagacauuuuauu

SEQ ID NO: 304853 - RNA, 66 nt, Homo Sapiens
gucccauucugccccuguacauguuuccuaccaagcauguuucacauuuuccuauuaguggaggag

SEQ ID NO: 304854 - RNA, 66 nt, Homo Sapiens
gcaaauugccuauaaauugacucuacuaaaauaacaauguuucagucugaaaauuugaauugaaaa

SEQ ID NO: 304855 - RNA, 66 nt, Homo Sapiens
guguaguguacauuguaaaacucagauauugucaugauguuucacuuggacauaagacuuauuaau

SEQ ID NO: 304856 - RNA, 66 nt, Homo Sapiens
ucuccugaccuugaaucacaagagucuuaacagggaauguuucaggaaacaaauaggauaagacaa

SEQ ID NO: 304857 - RNA, 66 nt, Homo Sapiens
caauauuuuuauauuaaaguacuauacuaggagagaauguuucagaacucccugaugaauuucuaa

SEQ ID NO: 304858 - RNA, 66 nt, Homo Sapiens
caaaugaauaauuccugcuauucugaaauugccuacauguuucaauaccaguuauauggagugcuu

SEQ ID NO: 304859 - RNA, 66 nt, Homo Sapiens
acauguaguuuaauaaaguuccuguuuaugagagucauguuucaucucagcuucuuccauggaugu

SEQ ID NO: 304860 - RNA, 66 nt, Homo Sapiens
cuaagcugugcaaccugugaagccaagagugaacugauguuucauuuauauuuucauccaaaugac

SEQ ID NO: 304861 - RNA, 66 nt, Homo Sapiens
uuggauccugugcuuaccuuuuccugcuguacucugauguuucagugaagcucauccacgaagucc

SEQ ID NO: 304862 - RNA, 66 nt, Homo Sapiens
gucagauuuugugcuugauucacacaaccccuggauauguuucauuaccuccagaucagaugggga

SEQ ID NO: 304863 - RNA, 66 nt, Homo Sapiens
ucuacuucugcuuuucuuauuaauaaagggaaacgaauguuucaaaacacaucagccucacugagc

SEQ ID NO: 304864 - RNA, 66 nt, Homo Sapiens
uugaaacagucucuuuugaguucugguuuaaucauuauguuucaaaguuagagacagcccagucuc

SEQ ID NO: 304865 - RNA, 66 nt, Homo Sapiens
uggggaacugagcuaggcggagacuuaacaaaaacaauguuucaucuauccucaugccuucaggaa

SEQ ID NO: 304866 - RNA, 66 nt, Homo Sapiens
uuuuugaauuuauuuauaugauaauugucauaaguuauguuucagaguuggacuauguuugugaac

SEQ ID NO: 304867 - RNA, 66 nt, Homo Sapiens
uauagagguaaaauuugcacgaaaguaauuucaagaauguuucaguaaaugguuuucaacaagccu

SEQ ID NO: 304868 - RNA, 66 nt, Homo Sapiens
cauuguauuugaacacaaaaguuacugagcuuccuuauguuucacaaaaaguuaccccacacaaaa

SEQ ID NO: 304869 - RNA, 66 nt, Homo Sapiens
agaauucuguugauggaaauauuuaauguggaaaugauguuucauaauuaacugagaaggcugugg

SEQ ID NO: 304870 - RNA, 66 nt, Homo Sapiens
caggagugggguaaauaaguuacauaccaguuucugauguuucagguuuaugcuuggagcagucag

SEQ ID NO: 304871 - RNA, 66 nt, Homo Sapiens
aauaaaaaaccacuuuauaucccuuaaugcaaugaaauguuucauuucuugacauguuuauuucua

SEQ ID NO: 304872 - RNA, 66 nt, Homo Sapiens
uuugugaauuagguauggccaagccuuguccugacuauguuucacaucaugcaguacagacauagc

SEQ ID NO: 304873 - RNA, 66 nt, Homo Sapiens
aagggcagacucacgaauuuauggaaaauaagcuuuauguuucaaguuuaaaauggcauacagaua

SEQ ID NO: 304874 - RNA, 66 nt, Homo Sapiens
gggaaaugaacuacauauugauaaauuaccuaucccauguuucaguaacaaucagacuuacuggaa

SEQ ID NO: 304875 - RNA, 66 nt, Homo Sapiens
aucaggaacuuucgguuuuacuuuucauauaguccaauguuucaucuauuuauuaauagauuguuu

SEQ ID NO: 304876 - RNA, 66 nt, Homo Sapiens
ucauuuuaaacauccuaaauuuuauugaccugccucauguuucauuaugguaaaugauuguacuua

SEQ ID NO: 304877 - RNA, 66 nt, Homo Sapiens
uuggugacugucucauugugccaugagguaaauguaauguuucaggcauucugcuugcaaaaaaau

SEQ ID NO: 304878 - RNA, 66 nt, Homo Sapiens
auugagaaacuggucaaugaacaggaagacuuagagauguuucacaagccuuugauuuuuguuuca

SEQ ID NO: 304879 - RNA, 66 nt, Homo Sapiens
cuuucagagaugcuggaaacaaaucauuugcuuuauauguuucauuagaauaccaaugaaacauac

SEQ ID NO: 304880 - RNA, 66 nt, Homo Sapiens
uaagcauuuaggaaugaaguguuagagugucuuaaaauguuucaaaugguuuaacaaaauguaugu

SEQ ID NO: 304881 - RNA, 66 nt, Homo Sapiens; identical to SEQ ID NO: 304880

SEQ ID NO: 304882 - RNA, 66 nt, Homo Sapiens
auuuuucuuacaacagccuuucagacuauucuucauauguuucaagcuaaucuuguagcuaagcua

SEQ ID NO: 304883 - RNA, 66 nt, Homo Sapiens
agaucaugcauagagugugauguauguguaauaaauauguuucacacaaacaaggccugucagcua

SEQ ID NO: 304884 - RNA, 66 nt, Homo Sapiens
uuuagagauaaggauugcacauuggaaaaguaaaccauguuucauuccuuuuucccuauuuauauu

SEQ ID NO: 304885 - RNA, 66 nt, Homo Sapiens
uacagaaaugcccuccaugugucccucuaauguugcauguuucaguggguuggaaguuuuguauau

SEQ ID NO: 304886 - RNA, 52 nt, Homo Sapiens; identical to SEQ ID NO: 303762

SEQ ID NO: 304887 - RNA, 66 nt, Homo Sapiens
uugguggacuaguauaguauacggucaguuaugucaauguuucauggucaauaaaaaggaaguugc

SEQ ID NO: 304888 - RNA, 66 nt, Homo Sapiens
uguuuaaauauagcaauacaaccaauaauuuguuuuauguuucacugcauauaaauauuuccauua

SEQ ID NO: 304889 - RNA, 66 nt, Homo Sapiens
aguauacuguacuauccuuuauaagucauuaaaauaauguuucaucaaaugguuaaauggaccacu

SEQ ID NO: 304890 - RNA, 66 nt, Homo Sapiens
ccugcuucuuaaggucccugcucggccgguguaaauauguuucacccugucccucuaauaaagcuc

SEQ ID NO: 304891 - RNA, 66 nt, Homo Sapiens
aaucauggaaugauuucucugcuaacagccgccuguauguuucaauaaauuuguccaaagcucaac

SEQ ID NO: 304892 - RNA, 66 nt, Homo Sapiens
auacuacuuguaugcagaagagaauuaguugauuacauguuucaaccuuuuagggugauaaauaca

SEQ ID NO: 304893 - RNA, 66 nt, Homo Sapiens
uuuuuaacauucagguguagauuguuucagcuucucauguuucauuuuccugaagauuuauguuuu

SEQ ID NO: 304894 - RNA, 66 nt, Homo Sapiens
cauuauuuucaaguaguauaccccugugguuuuacaauguuucaucauuuuuuugcauuaauaaca

SEQ ID NO: 304895 - RNA, 66 nt, Homo Sapiens
gaggcguauaaaauggggcugugugcaugcaggcccauguuucagccucagcccacgccaggugaa

SEQ ID NO: 304896 - RNA, 66 nt, Homo Sapiens
cccaaaggaaugucuugcauauuacugacauuugguauguuucauucauuggaauauuucuuauuu

SEQ ID NO: 304897 - RNA, 66 nt, Homo Sapiens
uuuuuaugugaagguguuucaaaggguaaauuauaaauguuucaugaagaaaaaauuuuaaaaauc

SEQ ID NO: 304898 - RNA, 66 nt, Homo Sapiens
cuggaaccguaucaggcauucgccugccucucacaaauguuucagggaggccaguucugcagggug

SEQ ID NO: 304899 - RNA, 66 nt, Homo Sapiens
gugauuucauagauaauauauuuaauaugacagauuauguuucaacucuguagauguuuaacguca

SEQ ID NO: 304900 - RNA, 66 nt, Homo Sapiens
ggaauugaugggaaaugguuuucuaauauuucaagaauguuucacuauuuucccugguaaagagga

SEQ ID NO: 304901 - RNA, 66 nt, Homo Sapiens
agcuuuugucuauuuuuuaacgccuacuucagucccauguuucagacuuaggcuuuuauaaugcuc

SEQ ID NO: 304902 - RNA, 66 nt, Homo Sapiens
uugcaagguaauauguaauaacaaauaugaaauauaauguuucagaguuaucuaaaauaaauauac

SEQ ID NO: 304903 - RNA, 66 nt, Homo Sapiens
aaguuucugcagcagaugcuaucugggcaaaugaaaauguuucaggcauauuucacaauccugugg

SEQ ID NO: 304904 - RNA, 66 nt, Homo Sapiens
uaaaaccucauucucggaccgguuauugaaaauaugauguuucacaaauguuuuuaaaauaugagu

SEQ ID NO: 304905 - RNA, 66 nt, Homo Sapiens
aaggaaugaaagagaguucuacucugaccugugaucauguuucagguauguuuauauaugaacuuu

SEQ ID NO: 304906 - RNA, 66 nt, Homo Sapiens
aaacuugacauugucagaguauugugguacuuuuugauguuucaguucugcaggacagccuauaaa

SEQ ID NO: 304907 - RNA, 66 nt, Homo Sapiens
gaaccaaaguucugauaccuguguuuuaggugugagauguuucaguaaggugccuuuguaccucag

SEQ ID NO: 304908 - RNA, 66 nt, Homo Sapiens
ugaaccuuuccuaacuuuuuuuuuaacaaguugaaaauguuucaucucuuugcgaguauacauguu

SEQ ID NO: 304909 - RNA, 66 nt, Homo Sapiens
ugaaaagucugguuucuuacagcuauuuacaauaaaauguuucauucacgaggaauaccuaugaag

SEQ ID NO: 304910 - RNA, 66 nt, Homo Sapiens
guaggaauauuuaaguuauuugaaacuagagucuggauguuucauucuucauaaaauuuugauuag

SEQ ID NO: 304911 - RNA, 66 nt, Homo Sapiens
cucuuaugaccugauccaucugccaggauguauggaauguuucauaacuguuauuuaacguuuguc

SEQ ID NO: 304912 - RNA, 66 nt, Homo Sapiens
uguaaauuguucauagaaaaucagugaaaaaaucuaauguuucaaaaagcccguuuccuucccuca

SEQ ID NO: 304913 - RNA, 66 nt, Homo Sapiens
uccauaacauuaauuuuuuuaaaaaauaaggucuuaauguuucauuuaauuuaaaauauacuguca

SEQ ID NO: 304914 - RNA, 66 nt, Homo Sapiens
aacuuuacacuucagacagauuuucuguguuaugaaauguuucaguaaaauauuguuuacugacuu

SEQ ID NO: 304915 - RNA, 66 nt, Homo Sapiens
caguuucggaaguuugaucugagaaccaaccauagaauguuucaguucuaggaaauaaaaccaguu

SEQ ID NO: 304916 - RNA, 66 nt, Homo Sapiens
agagacucaaagagggagugcauuuaugagcucuucauguuucaggagagaguugaaccuaaacau

SEQ ID NO: 304917 - RNA, 66 nt, Homo Sapiens
ugcacacuacugagagaaugagaugaaaaacgauuaauguuucauuauuauuauugugaaaauauu

SEQ ID NO: 304918 - RNA, 66 nt, Homo Sapiens
ugagccuaauugcuguuacuaauuagaggaguaaaaauguuucacgauaacucagcaauuguaaug

SEQ ID NO: 304919 - RNA, 66 nt, Homo Sapiens
cugacugaaacuauggcuaauaauugggguacucuuauguuucaauccaauuuaaccucauuuccc

SEQ ID NO: 304920 - RNA, 66 nt, Homo Sapiens
uguuguagcugagcacuuuaacaaguugagcauuccauguuucauucuuagaaccuucuuuaauag

SEQ ID NO: 304921 - RNA, 66 nt, Homo Sapiens
auguuaaccuagaaagggcucacucuaccucuaggcauguuucaucccaacaaucagacugugcca

SEQ ID NO: 304922 - RNA, 66 nt, Homo Sapiens
uauaauauagaaaucuuauguaaaugaaauuuugucauguuucaaauaaagagaacugaaguagaa

SEQ ID NO: 304923 - RNA, 66 nt, Homo Sapiens
uauagaaguuacuagcacugacacacugauuuugaaauguuucaaaaugaguagauaugauuagau

SEQ ID NO: 304924 - RNA, 66 nt, Homo Sapiens
agaaauacaucuuuuauaaugggggaagaaugcccuauguuucaauucaaaacaaagacaguuuuc

SEQ ID NO: 304925 - RNA, 66 nt, Homo Sapiens
aguuauugaaauggaaaugaaaacagccaguaacuuauguuucagaauguuuguaacacacuucau

SEQ ID NO: 304926 - RNA, 66 nt, Homo Sapiens
cacuguuggaauugucaucuguacaauuaguccauaauguuucauguuuguccuaagugugcuguu

SEQ ID NO: 304927 - RNA, 66 nt, Homo Sapiens
guugcuaugcagugugaucuuuauuuauaguaaauuauguuucauguaaaugauauauuuuuggug

SEQ ID NO: 304928 - RNA, 66 nt, Homo Sapiens
cuguugcuaccagauuauaucuggugguaauuguuaauguuucagcagggcuggucucaguccuuu

SEQ ID NO: 304929 - RNA, 66 nt, Homo Sapiens
gaacaucuuguucuucaauaucacggguuuuuguuaauguuucauaaguaauucuccccacuugau

SEQ ID NO: 304930 - RNA, 66 nt, Homo Sapiens
aauaaacaguguuuuguuuuuuuaaauuuuguuaugauguuucauucucucauucuuguauugccu

SEQ ID NO: 304931 - RNA, 66 nt, Homo Sapiens
auuaguuugcauucaccuuuuuaaagucacauuuccauguuucaaccuccucaccuucccucuuuu

SEQ ID NO: 304932 - RNA, 66 nt, Homo Sapiens
cuuguguccaggcuggaguguuuuuuuuuugaggcgauguuucacucuugagcaggauaucuuuuu

SEQ ID NO: 304933 - RNA, 66 nt, Homo Sapiens
aaaugcagugaaaggaacuaaaaaaucacauauaucauguuucaguguauugguacccuaggacau

SEQ ID NO: 304934 - RNA, 66 nt, Homo Sapiens
ugugcuuuuaaaaaaucugguuguauauuuguacaaauguuucagcugaaugauuguuuucucucu

SEQ ID NO: 304935 - RNA, 66 nt, Homo Sapiens
uuuguauuaauuuguaauaguaguuuaaauuaggguauguuucaagaagcagggcccaaagcuuau

SEQ ID NO: 304936 - RNA, 66 nt, Homo Sapiens
cgggaaacaugacucuuuauuucaaauuuauuuccaauguuucaagaaccuuuucuuguaucugga

SEQ ID NO: 304937 - RNA, 66 nt, Homo Sapiens
ugcacaaguagggcugccucaugaaucaguccuagaauguuucauuuuuuuuuuaucagagucaug

SEQ ID NO: 304938 - RNA, 66 nt, Homo Sapiens
gcucaccaggcaguaccaauuugaacauuaauccacauguuucagagucuuuuguccugcaucauc

SEQ ID NO: 304939 - RNA, 66 nt, Homo Sapiens
uucuuuuuauguaaauuuguuaacuuguuuuuucucauguuucaucugaucugcuuugcagggaaa

SEQ ID NO: 304940 - RNA, 66 nt, Homo Sapiens
ggugugugucuuuuuacuauuuuguugacucguuuuauguuucaauccugucaauaaaaauagaag

SEQ ID NO: 304941 - RNA, 66 nt, Homo Sapiens
ugcauggccuucuacggcuuucugcauuguguuaacauguuucaagccucugggccuucaugcuuu

SEQ ID NO: 304942 - RNA, 66 nt, Homo Sapiens
gcaucugauuugucagacccgacaucgcuuccacccauguuucagauuuagaaaaguugcaugauu

SEQ ID NO: 304943 - RNA, 66 nt, Homo Sapiens
uuggaacuaugcaguuaaggcagauaaaauguacagauguuucauauauuacagguuacauauaua

SEQ ID NO: 304944 - RNA, 66 nt, Homo Sapiens
aggucuuucuauauacugaucucuauauagauaucaauguuucauugaaaauccacugguaaggaa

SEQ ID NO: 304945 - RNA, 66 nt, Homo Sapiens
aaagcaacuuagcaaggcuucuuuucauuauuuuuuauguuucacuuauaaagucuuagguaacua

SEQ ID NO: 304946 - RNA, 66 nt, Homo Sapiens
uucaaguggcuuuuggggccccagguugagcucuggauguuucaagccaaggcucggcuauucccg

SEQ ID NO: 304947 - RNA, 66 nt, Homo Sapiens
uuuaaucaguaaaucaguuucacaucauguauugugauguuucaaugugagacacaaaaacaaugg

SEQ ID NO: 304948 - RNA, 66 nt, Homo Sapiens
ugcuccugccguuuucuuccugccaagccugaaucaauguuucaucuccaacccucugccaguuug

SEQ ID NO: 304949 - RNA, 66 nt, Homo Sapiens
gccccauugggcccucgucugccucuccaggauuguauguuucaagccuuguccuguguuccuuug

SEQ ID NO: 304950 - RNA, 66 nt, Homo Sapiens
acucaagugggauuagaagacuaucaaaauacauguauguuucaggauauuugaccugucauuaaa

SEQ ID NO: 304951 - RNA, 66 nt, Homo Sapiens
gauuuugguauuacacuguauuuguaucucugaagcauguuucauguuuugugacuauauagagau

SEQ ID NO: 304952 - RNA, 66 nt, Homo Sapiens
gguuguauuguaauggcauuaucaaaauauuugaugauguuucagauauauugcaaagucuguauu

SEQ ID NO: 304953 - RNA, 66 nt, Homo Sapiens
ucaaccauaaguuaaaaucugaagguuaucuuuaucauguuucaucccugucugaagauuuccuag

SEQ ID NO: 304954 - RNA, 66 nt, Homo Sapiens
uuaaaauauuguuuuccuacaggccuauuuaacaagauguuucauuuuacuguauauuuuguaguu

SEQ ID NO: 304955 - RNA, 66 nt, Homo Sapiens
gcaaaauuuuuucucuaggaaauauuuauuuuaauaauguuucaaacauauauaacaaugcuguau

SEQ ID NO: 304956 - RNA, 66 nt, Homo Sapiens
cuguagagccagccuugguuggaccuauugccaggaauguuucagcugcaguugaagagccugaca

SEQ ID NO: 304957 - RNA, 66 nt, Homo Sapiens
gugaagaagugaguguccacgggugaagaagugaguauguuucaccuggacauuaaggugauguuu

SEQ ID NO: 304958 - RNA, 66 nt, Homo Sapiens
caaaacacccagagacggcacaaggagguugaacucauguuucaguucgcgaacauugacuccuua

SEQ ID NO: 304959 - RNA, 55 nt, Homo Sapiens; identical to SEQ ID NO: 303835

SEQ ID NO: 304960 - RNA, 66 nt, Homo Sapiens
uacaaguauuaggcugcuuuauauguauuuuuguguauguuucaaaaagauggguuuuauccucaa

SEQ ID NO: 304961 - RNA, 66 nt, Homo Sapiens
uaccucuaaauuuccauaucacauugccugacuaaaauguuucauuuccaguuucuguaaggucuu

SEQ ID NO: 304962 - RNA, 66 nt, Homo Sapiens
gcgaucucagaucuaggccuuggugaggucacuuuaauguuucacaucugagugagaaaacaagua

SEQ ID NO: 304963 - RNA, 66 nt, Homo Sapiens
ucccaccauuuucucaguuuagcaguuuccaaggauauguuucaugaaagacgaagggagagagaa

SEQ ID NO: 304964 - RNA, 66 nt, Homo Sapiens
uugugacagauaaagauguauaauucaaaagaaugcauguuucacauaaacucuuagauauuuaua

SEQ ID NO: 304965 - RNA, 66 nt, Homo Sapiens
guuugaguccauguuuauucauccuucacaaacuccauguuucaguucgugaccucugccacccac

SEQ ID NO: 304966 - RNA, 66 nt, Homo Sapiens
cuuuggaacaagaugguucuguauuuuugacagaauauguuucaaaguucauacauuguacgaaga

SEQ ID NO: 304967 - RNA, 66 nt, Homo Sapiens
gauauaugcaacuauucaguaaaauaaaucaaugaaauguuucaaugaauaucaauauaaauaagg

SEQ ID NO: 304968 - RNA, 66 nt, Homo Sapiens
ccucuaccauccugcacuguuaagguguaagguugcauguuucaguacuaaaucugcuuuaccaag

SEQ ID NO: 304969 - RNA, 66 nt, Homo Sapiens
uuguauugcauuuuucuauuaaaaaauuaacaguuaauguuucagucaauguauuaucuguagcau

SEQ ID NO: 304970 - RNA, 66 nt, Homo Sapiens
auacuguaugaauaaugaaacuuacuaucauaaaccauguuucauguggccuguuagggccuguca

SEQ ID NO: 304971 - RNA, 66 nt, Homo Sapiens
ccuucccgucugauuguuccuccccagcccccuggcauguuucaccacaacccuguugcuacauca

SEQ ID NO: 304972 - RNA, 66 nt, Homo Sapiens
agcauucuguggucaaguaaguuuagggagcuauucauguuucacuugcuuuguggagauucacac

SEQ ID NO: 304973 - RNA, 66 nt, Homo Sapiens
auggacaaaaaguaaaucauugaccaaagcuaugaaauguuucacaaaguuuuccucuuuugcaua

SEQ ID NO: 304974 - RNA, 66 nt, Homo Sapiens
uguauggaauauuacuucuaucagaagaugaucaagauguuucaguccagugcacaucagcauugc

SEQ ID NO: 304975 - RNA, 66 nt, Homo Sapiens
aaugagcaggaagucuagaaaugauaacuagacuguauguuucaugugugugauuuuucagaauuc

SEQ ID NO: 304976 - RNA, 66 nt, Homo Sapiens
acauuugucuuaauuucuaacauuaucuuugcuuuuauguuucauaaaaauuugucauuauuuaug

SEQ ID NO: 304977 - RNA, 66 nt, Homo Sapiens
auuuuuucugcugguggauaaacauuaaaauuaaucauguuucaaaguuuuauuuucaguuccuuu

SEQ ID NO: 304978 - RNA, 66 nt, Homo Sapiens
aaaugcuagcauguacuguaugggaggaugauccagauguuucaaagagaauuucucuuaguuuag

SEQ ID NO: 304979 - RNA, 66 nt, Homo Sapiens
cugcuugaaauuauauugauuuaaaugaugugugagauguuucaccauuuucaggcacuguguaau

SEQ ID NO: 304980 - RNA, 66 nt, Homo Sapiens
uauauuaggccaagugcaauugacuucccuuuuuuaauguuucaugaccacccauugauuguauua

SEQ ID NO: 304981 - RNA, 66 nt, Homo Sapiens
agaucuacauuuucuggaaaaucagcauuacuagagauguuucaaauguagauuuuaccagaccau

SEQ ID NO: 304982 - RNA, 66 nt, Homo Sapiens
aucccugugcugagcccugagggcagagaggauggcauguuucaggggagggggaagccuuccucu

SEQ ID NO: 304983 - RNA, 66 nt, Homo Sapiens
uagaaugcaaaauguuggcaauuuuguuuaaaccaaauguuucaugcaaaauagagaauucuuaag

SEQ ID NO: 304984 - RNA, 66 nt, Homo Sapiens
acugcaaaacaaacaggauaggcaguaacuaaguuuauguuucagacucugccuuguuuggguaaa

SEQ ID NO: 304985 - RNA, 66 nt, Homo Sapiens
acauuguugauggcauuguggauucuugcuucugauauguuucaauugguaaaaucuuuaaaacua

SEQ ID NO: 304986 - RNA, 66 nt, Homo Sapiens
aaaaaaaaggaacuguaauuuuuuaaaugcccuuugauguuucaaaaaagcaaauuguuucaguuu

SEQ ID NO: 304987 - RNA, 66 nt, Homo Sapiens
auaaaauaaucucacuuuuaguacauuuuugaaauaauguuucagauguuuuauuucaaaaacaaa

SEQ ID NO: 304988 - RNA, 66 nt, Homo Sapiens
uuaaaugauaguaaaaacacaagaaagguuguggaaauguuucagaugucaaugucauagaagaca

SEQ ID NO: 304989 - RNA, 66 nt, Homo Sapiens
uugguuuuaauuuguauauccaaucgguguguagugauguuucauuuuuuuccuuuuuaaccauuc

SEQ ID NO: 304990 - RNA, 66 nt, Homo Sapiens
guaucacauagaaauauggcauugcauuuauuaaaaauguuucauuaacuugcaguucuaugauag

SEQ ID NO: 304991 - RNA, 66 nt, Homo Sapiens
ugaaacauuucagaaauuauuuuuauugcuuugucuauguuucauaaugauaaacauauauccucu

SEQ ID NO: 304992 - RNA, 66 nt, Homo Sapiens
uuuugaccuagaaaugcgagucuucucucauuggccauguuucagaauggcgcccucucaauuuag

SEQ ID NO: 304993 - RNA, 66 nt, Homo Sapiens
uaauugugaggaaggcgcagcccccguuuuuuggucauguuucaauaaugucacuuuuuugccuau

SEQ ID NO: 304994 - RNA, 66 nt, Homo Sapiens
uacaaaucaaaaaaucuuccuucuuauaacugagaaauguuucacccaaauuuccuuuguuauuau

SEQ ID NO: 304995 - RNA, 66 nt, Homo Sapiens
acaaauaucuucacuucaguuuuauuugugaauuacauguuucaugaauccauuuggcacagagac

SEQ ID NO: 304996 - RNA, 66 nt, Homo Sapiens
gauuuucucuuguagugauuuggguaggaagaggccauguuucaguucguuuucucuguagggucg

SEQ ID NO: 304997 - RNA, 66 nt, Homo Sapiens
uaacuagcuagccagcuggagauaauuuaccagggaauguuucaaagcccuaaccuugaaguuugg

SEQ ID NO: 304998 - RNA, 66 nt, Homo Sapiens
cccacaaaaugcugauucaguucaaaauuaaugcaaauguuucaaaacuggguuucugauauuugu

SEQ ID NO: 304999 - RNA, 66 nt, Homo Sapiens
ugaguuacuaagauuucuauaccuggaauaucauguauguuucauuuacuggauguuuacauuuua

SEQ ID NO: 305000 - RNA, 66 nt, Homo Sapiens
caggcaucaagcuacccucaagaguuucugggcuggauguuucagaacaacaucuacaccaguaaa

SEQ ID NO: 305001 - RNA, 66 nt, Homo Sapiens
ugcacucccuggccuugcccgucgugugcugaagacauguuucaagaaccgcauuucgggaagggc

SEQ ID NO: 305002 - RNA, 66 nt, Homo Sapiens
caguaaagaaauaaaaguuuguauuaaguuauacuaauguuucaauacagguauuugacauaauau

SEQ ID NO: 305003 - RNA, 66 nt, Homo Sapiens
ggcuucacauggaggagcugaaguuccaggguguguauguuucaggaucugugcauaaggagagga

SEQ ID NO: 305004 - RNA, 66 nt, Homo Sapiens
gguguuugcuuccuuccagaguuucagacugaaaacauguuucacaguccuaugaagaaagauacg

SEQ ID NO: 305005 - RNA, 66 nt, Homo Sapiens
uauuuuuaaucgccauaaaacugaaaaagugucuugauguuucaguuaauugaaauguugcuuuca

SEQ ID NO: 305006 - RNA, 66 nt, Homo Sapiens
auuucuaccuccaaaguguggguaaucaugagauuaauguuucaugcuguuugagagcauaauuau

SEQ ID NO: 305007 - RNA, 66 nt, Homo Sapiens
uuugugcauuugugaacagagcacuugaaucaauaaauguuucaccaaagccucaacauuuucgca

SEQ ID NO: 305008 - RNA, 66 nt, Homo Sapiens
cacuuuagaaacaguacuuuacagugacguaggcaaauguuucaagggaggucauugaaaaagaga

SEQ ID NO: 305009 - RNA, 66 nt, Homo Sapiens
cauucuaaauaaauaauuuuuaucauaaauacuuugauguuucaaacucuuccuuauuuaguguug

SEQ ID NO: 305010 - RNA, 66 nt, Homo Sapiens
cuuuaauuuauagcuaugguuauaaacagguuuuagauguuucaaaugacuuguccacugaauguc

SEQ ID NO: 305011 - RNA, 66 nt, Homo Sapiens
uauuaucaagguucuaccuauguuaauuuacaauucauguuucaagacauuugccaaauguauuac

SEQ ID NO: 305012 - RNA, 66 nt, Homo Sapiens
uauccuuuaauucuucauuaaaauggaaauaaguagauguuucaaaguaaucuacauuccuggcuu

SEQ ID NO: 305013 - RNA, 66 nt, Homo Sapiens
cugagguucauuacaaucgagacugcaaugugaucuauguuucaucuuguuuuuauaauaaaaagc

SEQ ID NO: 305014 - RNA, 66 nt, Homo Sapiens
uuuagcaauucaacuugaugugagaagaaaaaacaaauguuucaacacaaaaucucuguuuuguga

SEQ ID NO: 305015 - RNA, 66 nt, Homo Sapiens
uaaaacuaaccugaaaaacaaauaaaugcuuuggaaauguuucaguugcuuuagaaacauuagugc

SEQ ID NO: 305016 - RNA, 66 nt, Homo Sapiens
aaaauaaaaguuuuauaguuuuaaauacauaaagaaauguuucaguuaggcauuaaccuugauaga

SEQ ID NO: 305017 - RNA, 66 nt, Homo Sapiens
guguuuuuuaacaaaauauuuuuuuaagggaaagaaauguuucaggagggauaaagcuuaccauua

SEQ ID NO: 305018 - RNA, 66 nt, Homo Sapiens
guaagugauaaacaacagcaaauauacuugaauaaaauguuucagguauuuuuguuucauuuuguu

SEQ ID NO: 305019 - RNA, 66 nt, Homo Sapiens
auuuuugaucuggcaaccauauuucuggaaguugagauguuucagcuugaagaaccaaaacagaag

SEQ ID NO: 305020 - RNA, 66 nt, Homo Sapiens
uagugaacauucgaccuccauuacggagaguuuccuauguuucacugugcaaauauaucugcuauu

SEQ ID NO: 305021 - RNA, 66 nt, Homo Sapiens
cuuugccuccagaagaaguuuuuccuugauugugcuauguuucaguggaagaaauucuuugaagua

SEQ ID NO: 305022 - RNA, 66 nt, Homo Sapiens
acaugaaugucuuucuuugaaaacugcaauguauguauguuucaagguuauuuaacaguguacuau

SEQ ID NO: 305023 - RNA, 66 nt, Homo Sapiens
uagaugcgcaucaguaugaaauugucucaaucuuggauguuucauuuuaugaauggaggcacuuua

SEQ ID NO: 305024 - RNA, 66 nt, Homo Sapiens
cauuugcugauuuguuuuuaaaaaaacaagaaaugcauguuucaaauaaaauucucuauuguaaau

SEQ ID NO: 305025 - RNA, 66 nt, Homo Sapiens
ccagcugggacucuugggcucugugccugagggaaaauguuucacaacuaguggcugcccaauugc

SEQ ID NO: 305026 - RNA, 66 nt, Homo Sapiens
uucugcauguagauuuaaaucauuuuuucuuuuaccauguuucagucuuuuuuucuagcuauuuug

SEQ ID NO: 305027 - RNA, 66 nt, Homo Sapiens
gcagcaugguuacuaacgcucagauuguaccauuacauguuucaguauauuuaacgaaucaugauu

SEQ ID NO: 305028 - RNA, 66 nt, Homo Sapiens
aaugaugcauacagcaauuucuuuuauaaguauuucauguuucagaaaaagcaauguagaguuacg

SEQ ID NO: 305029 - RNA, 66 nt, Homo Sapiens
caauuucagaucacugguacccuuuauuaagaauugauguuucauugacacugguagauauagaag

SEQ ID NO: 305030 - RNA, 66 nt, Homo Sapiens
gauacugugcggaaacacacagaaaacacaaugugcauguuucaaucaugucauuccacuugugaa

SEQ ID NO: 305031 - RNA, 66 nt, Homo Sapiens
acauccaacuguuuguuauaacugcuaaauacuguaauguuucaaauuguucaguucauagcguag

SEQ ID NO: 305032 - RNA, 66 nt, Homo Sapiens
gguuuuauucaaaccacaaauuuuaauacuaauggaauguuucaaaccauauucucauugugagaa

SEQ ID NO: 305033 - RNA, 66 nt, Homo Sapiens
ugccaguaagcuucucacaugacuuucugcuggcccauguuucaguccagccauuugggaggcaau

SEQ ID NO: 305034 - RNA, 66 nt, Homo Sapiens
uguggacaauugcuuacuuuucaugaaccucaucccauguuucaucacacuccaugauugauucag

SEQ ID NO: 305035 - RNA, 66 nt, Homo Sapiens
cauugaauugagagcuuuuaugauaugaaaacauucauguuucagagcagguacaucaguucuuuu

SEQ ID NO: 305036 - RNA, 66 nt, Homo Sapiens
uuucugacucaugcaaucaucuugcugcuaaaauagauguuucauuuaccccaucccucacagccu

SEQ ID NO: 305037 - RNA, 66 nt, Homo Sapiens
uaggcacagugguacaugcccuucagucagaaacugauguuucagcuaaaguuguuguagucucca

SEQ ID NO: 305038 - RNA, 66 nt, Homo Sapiens
guguucuaaaaccuggcuaagaauaaggaauuuucuauguuucaaaucuaaaaggacuuguuugua

SEQ ID NO: 305039 - RNA, 66 nt, Homo Sapiens
uuuacaccuggcuguuuguuaugaaacuaaauaaaaauguuucaccaagucuauuuaaccucugua

SEQ ID NO: 305040 - RNA, 66 nt, Homo Sapiens
uuaaaacaacacuuugucuuauguugauggaaauucauguuucauaauuuaaccuuaaagauguua

SEQ ID NO: 305041 - RNA, 66 nt, Homo Sapiens
guauuuauuuaaaacauaaaaguucccccaaaugugauguuucaguuuauaguggagugaucauac

SEQ ID NO: 305042 - RNA, 66 nt, Homo Sapiens
ccauuuguuuuauccaucaacauuaaaauagaguugauguuucauuagguauagaagcucuucaag

SEQ ID NO: 305043 - RNA, 66 nt, Homo Sapiens
augcauugaacuggauguuacuuauccauacuuuugauguuucaaugguccauaaaaacuucaagg

SEQ ID NO: 305044 - RNA, 66 nt, Homo Sapiens
aggucuuuaaagugacuaaugccugacuagggagccauguuucacagaacucuucacucuucaaau

SEQ ID NO: 305045 - RNA, 66 nt, Homo Sapiens
aguauggguauaacauccuugccuucccauuuauccauguuucacuuuaucacugauaugaagagg

SEQ ID NO: 305046 - RNA, 66 nt, Homo Sapiens
aaacuaaaucuucgggacuucuuuaaugcuacguuaauguuucacugcucgucuagaaacuccuaa

SEQ ID NO: 305047 - RNA, 66 nt, Homo Sapiens
uagauauagugacaguaccaagaguaccaggacucaauguuucauaugaagcccuuggugaugagg

SEQ ID NO: 305048 - RNA, 66 nt, Homo Sapiens
uaagauauuucuuucccuaaccaucauacacuuggcauguuucauucccaucuccuuuccccucac

SEQ ID NO: 305049 - RNA, 66 nt, Homo Sapiens
aggaaacuuuuuuaauauaugaaagcugugauaaaaauguuucagauguuuagucaauugugaaau

SEQ ID NO: 305050 - RNA, 66 nt, Homo Sapiens
uuuacuuuguaaucauauacaaugucaacuuuuuagauguuucaccacucuuuugcaaauaaagca

SEQ ID NO: 305051 - RNA, 66 nt, Homo Sapiens
ggacagaccccccacccccaaggcugcagccacaccauguuucaggcuuggggcuggggcaggcuu

SEQ ID NO: 305052 - RNA, 66 nt, Homo Sapiens
accuagagaacaggugguuuuuaaggguuaucuuagauguuucacaccggaagguuuuuaaacacu

SEQ ID NO: 305053 - RNA, 66 nt, Homo Sapiens
cacuuucccucuuccuuuaagaaaacuuacuaaaaaauguuucauugcgaagcagaggaaaagaaa

SEQ ID NO: 305054 - RNA, 66 nt, Homo Sapiens
ugccuggaguaaaaaucugauuugaccccucugcucauguuucaucauauuuguagcucugcauca

SEQ ID NO: 305055 - RNA, 66 nt, Homo Sapiens
gcucaagucuacccugaucaccucagggcauaaagcauguuucauucucuggcccgacagugucuu

SEQ ID NO: 305056 - RNA, 66 nt, Homo Sapiens
gaaucucauucugugaaagccuuuuaauuuauugaaauguuucaugacuacugcugcuagcucuuc

SEQ ID NO: 305057 - RNA, 66 nt, Homo Sapiens
cgauucucugcgcgcaaggacccucgacucacccccauguuucagugucacagagacauucuuuga

SEQ ID NO: 305058 - RNA, 66 nt, Homo Sapiens
uaaaauggaucuuuacauguugcaguaacauugacuauguuucaaaacucagaugcauaaaacgua

SEQ ID NO: 305059 - RNA, 66 nt, Homo Sapiens
uacagcugagcccaagggacgugcccuguuccuggaauguuucagagcugcagcuauccugacaca

SEQ ID NO: 305060 - RNA, 66 nt, Homo Sapiens
uaccaagacccuuuucacagguccucaaaguauauaauguuucaugucuuaacaguucugaaugcu

SEQ ID NO: 305061 - RNA, 66 nt, Homo Sapiens
cuuaaucucaggacaacuuauugcuaauuuuaccuaauguuucauccuauaacugaagaaaauauc

SEQ ID NO: 305062 - RNA, 66 nt, Homo Sapiens
auucuuucuaaauuugauaaguugaaauuucaaaguauguuucauuuguaaucugugagaacaaug

SEQ ID NO: 305063 - RNA, 66 nt, Homo Sapiens
gacaguuuuaaagggagccaaugcucuuuaaguaaaauguuucaaaucugacaauuuaucuuccau

SEQ ID NO: 305064 - RNA, 66 nt, Homo Sapiens
accacuugccauccuguuagcauccugaaaaucuauauguuucaaaaaucugaagaaucaaacuuc

SEQ ID NO: 305065 - RNA, 66 nt, Homo Sapiens
auccuguagcuacaucuggugaacucguuugaaaccauguuucaucuuuuaaaaaguaacaagaaa

SEQ ID NO: 305066 - RNA, 66 nt, Homo Sapiens
ccuggggagggaggggagccgaaguaauccugagaaauguuucaggccugcuggggcugaagguca

SEQ ID NO: 305067 - RNA, 66 nt, Homo Sapiens
cuauaguuuguguaacaacauuuuuuaaauacuaauauguuucacaccauuaacaauuuuuuuuug

SEQ ID NO: 305068 - RNA, 66 nt, Homo Sapiens
caguuuaguggaaggaaaaaucaucacuuguucuggauguuucaaucuaauuagugccuuucucuu

SEQ ID NO: 305069 - RNA, 66 nt, Homo Sapiens
aacucagccccuuuuucugccagcucuacuugugugauguuucagggcugggcaucagcaccuguc

SEQ ID NO: 305070 - RNA, 66 nt, Homo Sapiens
aaugcguuggcaagagauguacaagaccaaguaagaauguuucaacccuucucuugaaguccaaua

SEQ ID NO: 305071 - RNA, 66 nt, Homo Sapiens
auugauugacucugcuauuggcuugguucaaacuguauguuucagugugcaguaggcaucacauau

SEQ ID NO: 305072 - RNA, 66 nt, Homo Sapiens
acuuuguaugucuauugguuuugaauugacaguuacauguuucauacaagcaaaacuuuuaaauau

SEQ ID NO: 305073 - RNA, 66 nt, Homo Sapiens
gcuuauaccccauugguuuacauauuuuugccccaaauguuucauguuugcuuccagacguuguuc

SEQ ID NO: 305074 - RNA, 66 nt, Homo Sapiens
uacuuagagcagugaagacucucuuugcugcugcccauguuucaaagggugaacaaacaaugaaaa

SEQ ID NO: 305075 - RNA, 66 nt, Homo Sapiens
caaaguacaaccugaauugaucuacgccuugaggggauguuucaucgcagaaccucucagccuucc

SEQ ID NO: 305076 - RNA, 66 nt, Homo Sapiens
auccauccuuauucacguugacaguaccuagcuguaauguuucacagagugugcugcuauuuuaua

SEQ ID NO: 305077 - RNA, 66 nt, Homo Sapiens
cacuuuaaagauuugaaaccacauuuuuauuguuugauguuucauuuucagacuuuuuaaugucag

SEQ ID NO: 305078 - RNA, 66 nt, Homo Sapiens
uguaaucaagcuuuuccacaguucuugaaaaguacuauguuucaaauuucaggaacaccagcguua

SEQ ID NO: 305079 - RNA, 66 nt, Homo Sapiens
aacugcugugggauugucaaccagcuuaucugcaggauguuucagaucugauaaauccugauggaa

SEQ ID NO: 305080 - RNA, 66 nt, Homo Sapiens
cucugugcagcuuucccccuuggagcaggagugaagauguuucauuaucuugggccugggaaacca

SEQ ID NO: 305081 - RNA, 66 nt, Homo Sapiens
uuuuaucuuauaucuaaaaaauauauaacuuacuauauguuucaguugcucucugaacaaaaauua

SEQ ID NO: 305082 - RNA, 66 nt, Homo Sapiens
aaaaaaguuaagggaaaagacuuugcuuuuaaaaaaauguuucaaaagaaagguauuuucacuaaa

SEQ ID NO: 305083 - RNA, 66 nt, Homo Sapiens
aaacucauaaggucuaccaagaaaauaaauguuaugauguuucaguuggcuucuaggaaauaauua

SEQ ID NO: 305084 - RNA, 66 nt, Homo Sapiens
ccuauggguaagaaauaaauggaaauaugacaucggauguuucagcaacuguucuguaaauaaaau

SEQ ID NO: 305085 - RNA, 66 nt, Homo Sapiens
ccacuagcaaucugagugauggaaucuuagucauucauguuucaccagaggacagcaagcaaaagg

SEQ ID NO: 305086 - RNA, 66 nt, Homo Sapiens
gaccuuaugagaaguggaugguaggaggagucacuaauguuucaaucucuauuucuguaaucuugg

SEQ ID NO: 305087 - RNA, 66 nt, Homo Sapiens
ucauuccauccucacaacagacauguaccaaauaacauguuucagcugcuagaacagcuaagguuu

SEQ ID NO: 305088 - RNA, 66 nt, Homo Sapiens
cuuuuuuuuauacucaaguguguaauaugaaguaaaauguuucagauuuuuuaaaaaaaaaguaug

SEQ ID NO: 305089 - RNA, 66 nt, Homo Sapiens
aggcugucaccuauuacacuaaggaaugccccuaaaauguuucagcuuuauguguaaguuuuguac

SEQ ID NO: 305090 - RNA, 66 nt, Homo Sapiens
acuuuacuaaaagcuuauuuaaaugguaagacguaaauguuucaacuucuauagauaaugaggaag

SEQ ID NO: 305091 - RNA, 66 nt, Homo Sapiens
uguuuuauacauuuuuggaguuauucuguuuuuaacauguuucaaaaaaacaugaauuuuuuuguc

SEQ ID NO: 305092 - RNA, 66 nt, Homo Sapiens
uacaacuguaauguuauuuauuacugucuuccguggauguuucaguucuugucaccucauuuugca

SEQ ID NO: 305093 - RNA, 66 nt, Homo Sapiens
ccuagacugcccaaggaguacuccaucacuugaucaauguuucagccagccucccaaaucaagucu

SEQ ID NO: 305094 - RNA, 66 nt, Homo Sapiens
agccccauuugcacagguuugagagcucacaguacaauguuucagaucuuuuuccucccuuucccu

SEQ ID NO: 305095 - RNA, 66 nt, Homo Sapiens
cuguuguaaagucagcauaacuucuuuaauguuugaauguuucacuccuaacugcauuuguuuuga

SEQ ID NO: 305096 - RNA, 66 nt, Homo Sapiens
uccaaggguauucaaacugugagggaaaauggacauauguuucauacuucauguccagaagaguaa

SEQ ID NO: 305097 - RNA, 66 nt, Homo Sapiens
ucucuaauuaccaauuaguuuauucaauuaguccuaauguuucaguaguccuuucuuuuugcccuu

SEQ ID NO: 305098 - RNA, 66 nt, Homo Sapiens
uuaccccucugcuaaauaaacuggucuagagaacugauguuucaauacaaagcauacauuuccuga

SEQ ID NO: 305099 - RNA, 66 nt, Homo Sapiens
aaugcauugauaagaaaacuuauuuuuauuaaaagaauguuucauuaaaaugugucuuguauuaaa

SEQ ID NO: 305100 - RNA, 66 nt, Homo Sapiens
uuuauauguuuucuaagauauagauauccuuaaaugauguuucaauuugugaagcugcucugauac

SEQ ID NO: 305101 - RNA, 66 nt, Homo Sapiens
uaccuuaugaaaaguguuaaaagggaauaaucuuuuauguuucauucucaccugaggaagggaagg

SEQ ID NO: 305102 - RNA, 66 nt, Homo Sapiens
uuuuggucaauacuugacaacaucacuuuaaacaucauguuucaggaccuaggaucauauugcauu

SEQ ID NO: 305103 - RNA, 66 nt, Homo Sapiens
gaaaacuuuggagacaguuuauugaugugauucaaaauguuucaguuucacaguacacgucacagu

SEQ ID NO: 305104 - RNA, 66 nt, Homo Sapiens
uccuacaaccaaaugagaaacuaccauuuuaaauucauguuucaacacuuuuuaaaagaaaaaauu

SEQ ID NO: 305105 - RNA, 66 nt, Homo Sapiens
uuuggaugugcuauuguaugauuacgaauagucuguauguuucaagcccuucuguaaaauaugaag

SEQ ID NO: 305106 - RNA, 66 nt, Homo Sapiens
ugaccucaauucccucaccugaaauaggaaaugagaauguuucauuguagccccaagcggucaugu

SEQ ID NO: 305107 - RNA, 66 nt, Homo Sapiens
caacugugcucugugaggugugaaauuaaaaacauuauguuucaccaauauuuaaacaucaguacu

SEQ ID NO: 305108 - RNA, 66 nt, Homo Sapiens
cacuucagucagguacacuguuacuugaaaggaagaauguuucacuuacccaagagcuauggcugc

SEQ ID NO: 305109 - RNA, 66 nt, Homo Sapiens
uucucucucauuauugagauucauccauauuguugaauguuucacuaguuaauguuuauuguucaa

SEQ ID NO: 305110 - RNA, 66 nt, Homo Sapiens
cuguaaagucuuucuaagaccaauuauuaucuuagcauguuucaguaucuucucuaucauaggccc

SEQ ID NO: 305111 - RNA, 66 nt, Homo Sapiens
aaggggaaaacuucagcuuuccaaaagcuaguaaacauguuucaaagaaaaauaaggucaggagaa

SEQ ID NO: 305112 - RNA, 66 nt, Homo Sapiens
ggcaugcuugguuauuuccaguacuugucagucaacauguuucaagacgcuguguuagacacuagg

SEQ ID NO: 305113 - RNA, 66 nt, Homo Sapiens
uuacugucaugucauuuacccacuggaucaaaggguauguuucacuucuugacaauauaaaugcug

SEQ ID NO: 305114 - RNA, 66 nt, Homo Sapiens
uuucuuuacaauuuguugcaauuucaucugcuuucuauguuucauuguuaauugccauccuucagc

SEQ ID NO: 305115 - RNA, 66 nt, Homo Sapiens
uaacauuuaaaaguacuuuauauuuuacauaauagcauguuucauuuugauuaaaagcuaccaaag

SEQ ID NO: 305116 - RNA, 66 nt, Homo Sapiens
caggguaucauugauuuaugauuagcauuucuggauauguuucauccuguaugaaaacaucuccga

SEQ ID NO: 305117 - RNA, 66 nt, Homo Sapiens
auuacuuuuuaauuguuuuaugggugacuaugacuaauguuucagaguaguaugagaagaaaucau

SEQ ID NO: 305118 - RNA, 66 nt, Homo Sapiens
auucaaucgugaaggaacagucucuuuguuaucuaaauguuucagagggaggaaaacucaacuguu

SEQ ID NO: 305119 - RNA, 66 nt, Homo Sapiens
acacuaauuuagucuuuugaauuauuuaguauguuuauguuucaugaaggguccaguauuuauuug

SEQ ID NO: 305120 - RNA, 66 nt, Homo Sapiens
caauggugaaaagguggaaauucuccaaagaacagcauguuucacuaaaaaaaugaauguauuuuu

SEQ ID NO: 305121 - RNA, 66 nt, Homo Sapiens
gaagaugcuguaaauagguuuggaauuugcaccaucauguuucagucgucccuggucacccgacuu

SEQ ID NO: 305122 - RNA, 66 nt, Homo Sapiens
ggagcggcgugugggagaagcgcccacgagugcgccauguuucagccugcagguguccugcccuuc

SEQ ID NO: 305123 - RNA, 66 nt, Homo Sapiens
cugguagugccucaucacaacccaugauggcuguucauguuucaccccuuuucuuccuucagcaga

SEQ ID NO: 305124 - RNA, 66 nt, Homo Sapiens
aggcuggauuuggacaaaaagcaaaucuagacaugcauguuucaggguucaguaguauacuucaug

SEQ ID NO: 305125 - RNA, 66 nt, Homo Sapiens
uagacaugcauguuucaggguucaguaguauacuucauguuucauacagauaauucacauucaaaa

SEQ ID NO: 305126 - RNA, 66 nt, Homo Sapiens
uugcauuuguaaacaguccuggucaguaguuaaauaauguuucaauuaaagugcuguaaaauaaac

SEQ ID NO: 305127 - RNA, 66 nt, Homo Sapiens
uuugccacugauauuuuuacuggauaaaauucaaaaauguuucaauucacaaaggcuaauuguuga

SEQ ID NO: 305128 - RNA, 66 nt, Homo Sapiens
gucucugugaagccuuuacucucuaggugccuuauaauguuucagggcucaacuuuuuaaaaucca

SEQ ID NO: 305129 - RNA, 66 nt, Homo Sapiens
gcacgugugagaauuuaggagacacugugcacugacauguuucacaacaggcauuccagaauuaug

SEQ ID NO: 305130 - RNA, 66 nt, Homo Sapiens
gggaaugggacccaaaucuaaacacaaaauucauuuauguuucauauacaccuuauauacaauaac

SEQ ID NO: 305131 - RNA, 66 nt, Homo Sapiens
cgcuucaugacuaaaucacaucauaccaacuugacuauguuucaccauauuaauauuuccuuuucc

SEQ ID NO: 305132 - RNA, 66 nt, Homo Sapiens
aucugcaacugcuugauaaguuauugauagcugauaauguuucauuaaagugaaagugccaacaaa

SEQ ID NO: 305133 - RNA, 66 nt, Homo Sapiens
gaaagaauuuuuucuugaucauauguguuuuaccagauguuucauaacaauguguauauguaaaua

SEQ ID NO: 305134 - RNA, 66 nt, Homo Sapiens
cagugacagaccucauauauuaugugcccuauaaugauguuucaguuugauuuauuaaauucuagu

SEQ ID NO: 305135 - RNA, 66 nt, Homo Sapiens
ggguacucugccauagaaauugacacaccaaacaagauguuucacuacucugcagcagggggugac

SEQ ID NO: 305136 - RNA, 66 nt, Homo Sapiens
ccugcuucucucagccagcugcacagagucgcuggcauguuucacugaaguggggacagauucgca

SEQ ID NO: 305137 - RNA, 66 nt, Homo Sapiens
cagcuauuaaaauguaacuggcacaguaauguagaaauguuucauagggcaugaauggagaugccc

SEQ ID NO: 305138 - RNA, 66 nt, Homo Sapiens
aaacacuuguaagauacuuagccuuuuaggaaaacaauguuucaugauuuucauaauguugaauuu

SEQ ID NO: 305139 - RNA, 66 nt, Homo Sapiens
ggaugauuguuaagcaauagauuugcucuauugaaaauguuucauuuuuuucacuguacaagcaac

SEQ ID NO: 305140 - RNA, 66 nt, Homo Sapiens
acugcugcauuccagccagggugacagagugagaccauguuucaaacaagaaacauuucagagggu

SEQ ID NO: 305141 - RNA, 66 nt, Homo Sapiens
cauucgucaccauuauacuaaugaacaauagauuucauguuucaaaauuucagauuuuacauguua

SEQ ID NO: 305142 - RNA, 66 nt, Homo Sapiens
agagguuguuaauuagcacauauuccuuuuagaaaaauguuucagaaaccucagucuugauaucug

SEQ ID NO: 305143 - RNA, 54 nt, Homo Sapiens; identical to SEQ ID NO: 304019

SEQ ID NO: 305144 - RNA, 66 nt, Homo Sapiens
aaagauaucuauuugaaaguucucagaguuguacauauguuucacaguacaggaucuguacauaaa

SEQ ID NO: 305145 - RNA, 66 nt, Homo Sapiens
agaauuucauaugacauucaugccuggcuucgcaaaauguuucaaguacuguaacugugucaugau

SEQ ID NO: 305146 - RNA, 66 nt, Homo Sapiens
agugagacuccgucucaaaaaaaaaaaaaaaaagaaauguuucauuuugguuuuucaccaaccuuc

SEQ ID NO: 305147 - RNA, 66 nt, Homo Sapiens
aauguuagagggucucuuacuccccgcccagcugugauguuucaucugcuuugguuguuuuggugg

SEQ ID NO: 305148 - RNA, 66 nt, Homo Sapiens
cgauacauguccucgacggaugccaaaguggaacagauguuucagauacuguuggacccagaagag

SEQ ID NO: 305149 - RNA, 66 nt, Homo Sapiens
aguuugacugccuaagggacagcacgaaugacucacauguuucagacaggccuccacggcuaugga

SEQ ID NO: 305150 - RNA, 66 nt, Homo Sapiens
ggccuugguggauuaaccaaggccuuggauuccagaauguuucaugguaagcacuguggagaaccu

SEQ ID NO: 305151 - RNA, 66 nt, Homo Sapiens
ucuacugugauucagacagacuguauucaauuuuguauguuucaccguugaagugcugugauuguc

SEQ ID NO: 305152 - RNA, 66 nt, Homo Sapiens
auuuccaucaccccagaaaccaggucaagacauagaauguuucaacguacauguuuuaccaccacc

SEQ ID NO: 305153 - RNA, 66 nt, Homo Sapiens
uugcaaccauugguuuugagggcagcuugacuguucauguuucauuguaaaugccuguguuaaaga

SEQ ID NO: 305154 - RNA, 66 nt, Homo Sapiens
gaaguuguuuauaaaauucaaaggugguuuuaauauauguuucaugagugucuucauaccaaauua

SEQ ID NO: 305155 - RNA, 66 nt, Homo Sapiens
auugcucugaaggucaaaaggcuaacaccacuguguauguuucaucuagcauucagcgcugcugug

SEQ ID NO: 305156 - RNA, 66 nt, Homo Sapiens
cuuauuuauaggaaaguuauuauaugcauccuccaaauguuucauguaguaaccaagcacucauua

SEQ ID NO: 305157 - RNA, 66 nt, Homo Sapiens
aauauaagaccucuuguagcuacaauguuuuagagcauguuucaucuucauuuuuaauauccugaa

SEQ ID NO: 305158 - RNA, 66 nt, Homo Sapiens
uuugggguuuacaacaacuaggauguguugggugagauguuucagaucuggagaaaugagcaggug

SEQ ID NO: 305159 - RNA, 66 nt, Homo Sapiens
ucacccccagcaaggugccuggggagacuugagcagauguuucauuuuggccuggccaguggcuga

SEQ ID NO: 305160 - RNA, 66 nt, Homo Sapiens
uccuauugucaagguuaacauaaaugcucuucuaaaauguuucacuuacuccuaaacuagcuaucc

SEQ ID NO: 305161 - RNA, 66 nt, Homo Sapiens
gcagcugccucaccgcccagacauugauuuguucagauguuucaaugccucaugauacaauaaaac

SEQ ID NO: 305162 - RNA, 66 nt, Homo Sapiens
auuucacaccagauccuaccccuuucccugagccacauguuucacacaaguguagaaaaugccagg

SEQ ID NO: 305163 - RNA, 66 nt, Homo Sapiens
guucuggcauuuaaauccuuccggcaccuacagagaauguuucacauugucagccaccagacuguc

SEQ ID NO: 305164 - RNA, 66 nt, Homo Sapiens
auaauaagggaauuaaggauauuuuucuguauuuguauguuucacuuaguauuuguuaaauggggu

SEQ ID NO: 305165 - RNA, 66 nt, Homo Sapiens
aaaccuuuugauauuucucauacgucugagcugaguauguuucaaucugaccgcuucauaagccag

SEQ ID NO: 305166 - RNA, 66 nt, Homo Sapiens
uggcugugccaaaggugaguuugguccugggauaucauguuucaaggguacuaaguccucuccagg

SEQ ID NO: 305167 - RNA, 66 nt, Homo Sapiens
uuuuaaauuuaaaucccacauuuuguguagauuuuuauguuucauacugugcuugauuuuuaucag

SEQ ID NO: 305168 - RNA, 66 nt, Homo Sapiens
ugaucuguuagaauaaccaauuaaaaaucauauuauauguuucaauguguuuggccaaaaauuuuu

SEQ ID NO: 305169 - RNA, 66 nt, Homo Sapiens
gccaaagaaggcuuaguggugaguuugcaauuuuguauguuucauucaaucacugagacugcauca

SEQ ID NO: 305170 - RNA, 66 nt, Homo Sapiens
uucuuugaauacuugcacaugcagcuaaauggagaaauguuucaauuuuuccucucacuuggccuu

SEQ ID NO: 305171 - RNA, 66 nt, Homo Sapiens
uuuuucauguaguuucuuaauauauacuugaaggaaauguuucaccuuauuuuuggucuuuguuua

SEQ ID NO: 305172 - RNA, 66 nt, Homo Sapiens
cuucccacucacuucccuuugguuuuucauauuuaaauguuucaauuucuguauuuuuuuuucuuu

SEQ ID NO: 305173 - RNA, 66 nt, Homo Sapiens
cauaggccucugggagugauuugguucuuugcccuaauguuucauuugacggucucuuuuugauca

SEQ ID NO: 305174 - RNA, 66 nt, Homo Sapiens
cugaaguugcaauuuauacuguauggcuucuuuuucauguuucaucuagguuuuuagaagugaagu

SEQ ID NO: 305175 - RNA, 66 nt, Homo Sapiens
uugcucugcaguugggaacggugaucuucuugaaugauguuucagugugcaaaaacuauagagccu

SEQ ID NO: 305176 - RNA, 66 nt, Homo Sapiens
aggucaugcaggccuuuaccggcauugauguggcucauguuucaggcagacuugggguccuuaagg

SEQ ID NO: 305177 - RNA, 66 nt, Homo Sapiens
uuuaugucuagcuucugagucuagaugaaagacaguauguuucagagaacauuggauaucaguuuu

SEQ ID NO: 305178 - RNA, 66 nt, Homo Sapiens
cuggcagugucaagccugaaaccaagcaauaccgucauguuucagccaagcccagagcccuaagau

SEQ ID NO: 305179 - RNA, 66 nt, Homo Sapiens
cagaaggcuagagggcgacucugguggugcuuuuguauguuucaauuaggcucugaaaucuugggc

SEQ ID NO: 305180 - RNA, 66 nt, Homo Sapiens
gcccccacccucugccacccaguccucccagcugccauguuucaaagacgaccuuuaccuccugcc

SEQ ID NO: 305181 - RNA, 66 nt, Homo Sapiens
ucgggacgucuucauugaagauucacuuacaaaggaauguuucacuaaauaaaagaaaaccagaau

SEQ ID NO: 305182 - RNA, 66 nt, Homo Sapiens
acaucccugaaggggagcucuuggauaucauuggccauguuucaaucgaauggagccacugggccc

SEQ ID NO: 305183 - RNA, 66 nt, Homo Sapiens
uuuauuuuuuuaaugaaaagaaaaaacaagaaaguuauguuucauaauuucuuacaacaugagcca

SEQ ID NO: 305184 - RNA, 66 nt, Homo Sapiens
cuuaguccuuaggccaaccaauuuaacugcagugucauguuucacaggccuuccuacauuuagaaa

SEQ ID NO: 305185 - RNA, 66 nt, Homo Sapiens
aacuccagacugauagguagucauuagccaugagaaauguuucaggauggcuagggaagacuugug

SEQ ID NO: 305186 - RNA, 66 nt, Homo Sapiens
aaaaggcaagcaaaggagaugaaaucuguucugggaauguuucagcagccaauaagugcccgagca

SEQ ID NO: 305187 - RNA, 66 nt, Homo Sapiens
aaugacaaaguguugaaaauguauuuccugaaauaaauguuucaaaugcagaaacccagaaggcuc

SEQ ID NO: 305188 - RNA, 66 nt, Homo Sapiens
augucuuaggaaaggagaucaacauuuucaaauuagauguuucaacugugcucuuguuuugucuug

SEQ ID NO: 305189 - RNA, 66 nt, Homo Sapiens
uauguugauucaaacuugcuucagaaucuuaagaucauguuucaaaaaucuugccugucauugcac

SEQ ID NO: 305190 - RNA, 66 nt, Homo Sapiens
auuuuuuucaaugaauguuauauuugugcugaaaauauguuucaguguagagaagagacaguuuaa

SEQ ID NO: 305191 - RNA, 66 nt, Homo Sapiens
uuauuuuuggucuuuguuuauauauacuugaaggaaauguuucaccuuuuugguguaguuuuuuaa

SEQ ID NO: 305192 - RNA, 66 nt, Homo Sapiens
aauuuaagaacucugaaacauacauauguaaaugguauguuucaaucuuuaaaguauaguacauuu

SEQ ID NO: 305193 - RNA, 66 nt, Homo Sapiens
guauaucaagcauuauagagcagaguugagcuggccauguuucacaucagcuuuuggugccagcua

SEQ ID NO: 305194 - RNA, 66 nt, Homo Sapiens
uuggcauaacaugguucuuuuacacuacuuuuuaccauguuucaucaaagaaucauggacagaacu

SEQ ID NO: 305195 - RNA, 66 nt, Homo Sapiens
uuauuuuuggucuuuguuuauauauacuugaaggaaauguuucaccuuuuucguguaguuuuuuaa

SEQ ID NO: 305196 - RNA, 66 nt, Homo Sapiens
cuagucuaagugggucuuuuuuauauuuugcauuauauguuucaacuguuuuucuauagcagagca

SEQ ID NO: 305197 - RNA, 66 nt, Homo Sapiens
ugaaacaauuuaucuuaauguauucucaauuaccaaauguuucauuuagcucagauauuaaaguag

SEQ ID NO: 305198 - RNA, 66 nt, Homo Sapiens
gacaguggucugugcuggcacaggcugugccuucucauguuucauacaccugcuggacaucuuugc

SEQ ID NO: 305199 - RNA, 66 nt, Homo Sapiens
uauguguguacacuucugacgcucagcucuuggugcauguuucagaggguggcacugguguugcug

SEQ ID NO: 305200 - RNA, 66 nt, Homo Sapiens
auccagagcuuuagaggaagacacauagguggguuuauguuucaccucauuuggaacaaaagagga

SEQ ID NO: 305201 - RNA, 66 nt, Homo Sapiens
caaauacacuacagaauuuagucaacauuuuauauaauguuucaauaaauguuucuuucaauaaag

SEQ ID NO: 305202 - RNA, 66 nt, Homo Sapiens
gaaaguuaugacauuagcuuuaaagguguaaaaaagauguuucacuaauguaacggugaaagagaa

SEQ ID NO: 305203 - RNA, 66 nt, Homo Sapiens
aauuuaacaaugucugaucucagcugaacaaauuagauguuucaguugcucuugggucaacuggcu

SEQ ID NO: 305204 - RNA, 66 nt, Homo Sapiens
guaacaaauguuuauacaaauacauacauguacaccauguuucaaauacuaaauaaauagaguuua

SEQ ID NO: 305205 - RNA, 66 nt, Homo Sapiens
uuuuguaaacugcucugcauauaaaccaagggcagaauguuucacccugaucuuaugggaggaauc

SEQ ID NO: 305206 - RNA, 66 nt, Homo Sapiens
aaaaagggaagucuugagguuuuagaggugugaauuauguuucaucaaugugcagaauaaucacaa

SEQ ID NO: 305207 - RNA, 66 nt, Homo Sapiens
gagaauuauuuuucaauuuuauuuuaguucuaaauuauguuucagaaacaaaagacaaugcuguac

SEQ ID NO: 305208 - RNA, 66 nt, Homo Sapiens
acuuauuuuagucaaugaaucacaaaauuccaguccauguuucaugcaaaaugaaacuuaauagcu

SEQ ID NO: 305209 - RNA, 66 nt, Homo Sapiens
caucacaagacaaccuuuucuaaaucaacuaugaauauguuucaagcaguguccccuuuucuggca

SEQ ID NO: 305210 - RNA, 66 nt, Homo Sapiens
gaaaaaugucuuuaaugcuugcaugacauguucuguauguuucagguuauguaaacaagagauuug

SEQ ID NO: 305211 - RNA, 66 nt, Homo Sapiens
cauugccauuaccaauaaauucgccagagacugucaauguuucauuccuggauaauugcuugauuc

SEQ ID NO: 305212 - RNA, 66 nt, Homo Sapiens
cugugguucccccaagcucuugcagucuucuuccugauguuucaaaaugaaaaucucuguacagau

SEQ ID NO: 305213 - RNA, 66 nt, Homo Sapiens
gcccuuaauaaguccucaauucuuaacagauauaagauguuucauacuggagcgaaacuacaaucc

SEQ ID NO: 305214 - RNA, 66 nt, Homo Sapiens
cacacaacagagaaacccuauaaagaaugauacaauauguuucaaucagaaccuucacauccaaua

SEQ ID NO: 305215 - RNA, 66 nt, Homo Sapiens
cuucuuuugagaaaugccuguucagcuacuuugcccauguuucaaguaguuuuugguuucuugcug

SEQ ID NO: 305216 - RNA, 66 nt, Homo Sapiens
ugucauggauuucuuaguguauuugggggaagggaaauguuucaagguaaagaaccuugacccuuu

SEQ ID NO: 305217 - RNA, 66 nt, Homo Sapiens
uugucauccccuccuuauuuuauuugggagagggaaauguuucagaaacaaaagggccucaucccc

SEQ ID NO: 305218 - RNA, 66 nt, Homo Sapiens
uugucgucccuuuguuauuuuaugugggagagggaaauguuucagaaacgaaagaucucauccccu

SEQ ID NO: 305219 - RNA, 66 nt, Homo Sapiens
ggacacauuguccacuucagaugcuuguuuaaaaaaauguuucaccaugugucuuuacccaauaca

SEQ ID NO: 305220 - RNA, 66 nt, Homo Sapiens
aaacugcuauauuugaaugcaguuguucauguagguauguuucacuaugguaauaugguggugugc

SEQ ID NO: 305221 - RNA, 66 nt, Homo Sapiens
ggcccggggccccccagggauguccuucuguccuggauguuucaugcugucugugucccauccugc

SEQ ID NO: 305222 - RNA, 66 nt, Homo Sapiens
cauccauacuucuguuuuugggugccauggucuauaauguuucauguuuauuggagugauggauuu

SEQ ID NO: 305223 - RNA, 66 nt, Homo Sapiens
uuagagaaauaacuauuacuauauaaaaugaaauauauguuucauuucuguaauauauauauauau

SEQ ID NO: 305224 - RNA, 66 nt, Homo Sapiens
cuucagccuuuaaccuauacgaggauuuuuuuuuguauguuucaagggaauauaucuugcucuaua

SEQ ID NO: 305225 - RNA, 66 nt, Homo Sapiens
agcuguuguuguuuuucucuaggaaacugauccuucauguuucaaucccggguucccagagcuccg

SEQ ID NO: 305226 - RNA, 66 nt, Homo Sapiens
gaaaccagugaaauauuucaaauuuucuaaaauuacauguuucacuaaauuuuuuuauugagaaua

SEQ ID NO: 305227 - RNA, 66 nt, Homo Sapiens
cuccagauuuaugaacauuuugugcugauucuuggaauguuucauucauaauuuucuauuugaaaa

SEQ ID NO: 305228 - RNA, 66 nt, Homo Sapiens
caucucagcccaggcaccagggagauagagccccagauguuucagccucauguauaaaugccaugu

SEQ ID NO: 305229 - RNA, 66 nt, Homo Sapiens
agcauucaggcacugccaggucucagcuaacauuccauguuucagaauguccugaaaaaugcucaa

SEQ ID NO: 305230 - RNA, 66 nt, Homo Sapiens
gaguuauuugagguuuuuugaccuucaccuuaugaaauguuucacuauauuuguaggcagucaguu

SEQ ID NO: 305231 - RNA, 66 nt, Homo Sapiens
gguccucauguguacuagugcauuucauagucauuuauguuucaucuuuuuuccuucaccauuuau

SEQ ID NO: 305232 - RNA, 66 nt, Homo Sapiens
ggcuggcauucugcauguuuagugauugucuugggaauguuucacugcuacccgcauccagcgacu

SEQ ID NO: 305233 - RNA, 66 nt, Homo Sapiens
agaauauuuucacuguuccuucuuucuuaaagucuuauguuucacucuuuaacucaaauguauucu

SEQ ID NO: 305234 - RNA, 66 nt, Homo Sapiens
cauucaucaaguuaucuuuauaaucacuguaguuagauguuucauguccauucaagugacuuuuau

SEQ ID NO: 305235 - RNA, 66 nt, Homo Sapiens
gagaccaugagaauuccaggcaguucccaaaauagaauguuucaguagugcuaggaucauuggauu

SEQ ID NO: 305236 - RNA, 66 nt, Homo Sapiens
augccugugagcuaggucuugauguaggacagugccauguuucaagcuuccuuuaaaugucccaug

SEQ ID NO: 305237 - RNA, 66 nt, Homo Sapiens
agccuaacuuuuuacacaguggauguaauguuuuuaauguuucagaucuguaaaaaggcagaccag

SEQ ID NO: 305238 - RNA, 66 nt, Homo Sapiens
guuuagucacagcuuaaaaaucuguggugcagggcaauguuucaaauugcaguacuugauuuagga

SEQ ID NO: 305239 - RNA, 66 nt, Homo Sapiens
uuaacauuaacuucuaaagaaguuuuuucuaagaaaauguuucaaggcaauauuuuuuuugaggcu

SEQ ID NO: 305240 - RNA, 66 nt, Homo Sapiens
accacuaaacuuuuguguccauauuuuacugagaccauguuucauuaaaagcauaguuucauagua

SEQ ID NO: 305241 - RNA, 66 nt, Homo Sapiens
auucaacacucgugaggccaggaagcuauuaaagggauguuucaagcuguuucuagcacauuccaa

SEQ ID NO: 305242 - RNA, 66 nt, Homo Sapiens
uaauguagcuuucucucuuaccuucuggaagagggaauguuucauuuauuacuguuugauuuucuu

SEQ ID NO: 305243 - RNA, 66 nt, Homo Sapiens
cagcucuuuuuccaaggcccggaguacuggggauugauguuucaaggccaaucaaugggaugcuuc

SEQ ID NO: 305244 - RNA, 66 nt, Homo Sapiens
agacaaaggauuugagauguucucaauaaaaagaaaauguuucacuacucugguguugcugagacu

SEQ ID NO: 305245 - RNA, 66 nt, Homo Sapiens
caagcagucccccaacucccaauccagaagagagaaauguuucacggcaaccaagacuaaguuuua

SEQ ID NO: 305246 - RNA, 66 nt, Homo Sapiens
ccaaggaggcaaaucuauaagaggguugugugaaagauguuucauacugaaaugacuccuacaauu

SEQ ID NO: 305247 - RNA, 66 nt, Homo Sapiens
accauauaauagaaauacccuucuaaagguauucaaauguuucagcaauagaugaauuuauuuuau

SEQ ID NO: 305248 - RNA, 66 nt, Homo Sapiens
cgcucggccgggaacgagugacugggcccuuaguggauguuucagaaccaaucggugucucaggcc

SEQ ID NO: 305249 - RNA, 66 nt, Homo Sapiens
aaggaaauauugagagagaaguaacuuccucuuaggauguuucaccaauaugugauuuucucuaau

SEQ ID NO: 305250 - RNA, 66 nt, Homo Sapiens
gcuuacaguucucugcguucgucacuuaauuccugaauguuucagagaaacaggaaucagaaaaua

SEQ ID NO: 305251 - RNA, 66 nt, Homo Sapiens
ggcccagcaagaagggcuuggguucugaggaagcagauguuucaugcugugaggccuugcaccagg

SEQ ID NO: 305252 - RNA, 66 nt, Homo Sapiens
ccuggcucaaaauggacaagaagguacuggaucaugauguuucaaaggaagaaccagucaccuuuc

SEQ ID NO: 305253 - RNA, 66 nt, Homo Sapiens
ccuuuuaguugaaugccacugaagagcugugauagcauguuucaaagcugaacucuacagagcgag

SEQ ID NO: 305254 - RNA, 66 nt, Homo Sapiens
uacgacagagacguggcauuuggaaacgaaacuuagauguuucauggagcuuauuuugagaacuuu

SEQ ID NO: 305255 - RNA, 66 nt, Homo Sapiens
aaugucaagcuguggaccaauguaauacuagcugguauguuucauaaauggacaaauugacugcaa

SEQ ID NO: 305256 - RNA, 66 nt, Homo Sapiens
cugacagauuauuuuuauuuaauguacccuguggggauguuucauaugacaaauuccucuuugaug

SEQ ID NO: 305257 - RNA, 66 nt, Homo Sapiens
ccacaaggggcuccacaccuugccauaggguccugaauguuucagauauuggacagucucaccucc

SEQ ID NO: 305258 - RNA, 66 nt, Homo Sapiens
caugccagaaaagugaaguccuagguguuuccaucuauguuucaaucuguccaucuaccaggccuc

SEQ ID NO: 305259 - RNA, 66 nt, Homo Sapiens
cuccaucagaucuucucaccuugauuuugagcuggaauguuucaaugagcaaaauaaauuagacaa

SEQ ID NO: 305260 - RNA, 66 nt, Homo Sapiens
ugccauugcuguaaaucuuaaaaugaaugaauaaaaauguuucauuuuacaagaggaguguaugau

SEQ ID NO: 305261 - RNA, 66 nt, Homo Sapiens
gauugugacauagauuauacuacuacuaauuuuuggauguuucaaaaggucaagaaguaaaagaug

SEQ ID NO: 305262 - RNA, 66 nt, Homo Sapiens
gagagagccagagacaguguugcaacugggccuggcauguuucagugugguguccagcagugucuc

SEQ ID NO: 305263 - RNA, 66 nt, Homo Sapiens
auuuuuccauaguaaauugucuugcaguuuuugaaaauguuucaagucuaguuuuuacaagcacau

SEQ ID NO: 305264 - RNA, 66 nt, Homo Sapiens
agacuugaugagauugaaacauggcuuuuggcaugaauguuucauagguuauguuguguucauuua

SEQ ID NO: 305265 - RNA, 66 nt, Homo Sapiens
gguugugaucuuuccuguccugacccucucugaauuauguuucaauaguacucuugauugucugcc

SEQ ID NO: 305266 - RNA, 66 nt, Homo Sapiens
gucuuuucauauuuaguucugguguggugucuggaaauguuucaacuguuuuaauauauugucuga

SEQ ID NO: 305267 - RNA, 66 nt, Homo Sapiens
agcguuuugacccaccugccaguguuugcuugcucuauguuucaguagcagauuuucacacaugug

SEQ ID NO: 305268 - RNA, 66 nt, Homo Sapiens
aaauuuaaaaagguacuuaaauuuucuggaauauccauguuucagagguaauauuuacuuucuauu

SEQ ID NO: 305269 - RNA, 66 nt, Homo Sapiens
caguccaauuagaaaaugggcaaaagacaugaauagauguuucacugaagaggaucuauagauggc

SEQ ID NO: 305270 - RNA, 66 nt, Homo Sapiens
agguugccuaugaaaaacuguauuguauuucuuuugauguuucaaaugagaaauuugugaaaaaua

SEQ ID NO: 305271 - RNA, 66 nt, Homo Sapiens
uuuaaguguauuuaaagaaaaaugaacuaccaucugauguuucauaagcuuauagucuuccaguuu

SEQ ID NO: 305272 - RNA, 66 nt, Homo Sapiens
uucuaagugaagugaguuggguuuuuguuuuuuuuaauguuucaggccaaagaggcugaugucuuu

SEQ ID NO: 305273 - RNA, 66 nt, Homo Sapiens
aauauaagaaaaguucaaaaguguuaguuaaaacauauguuucaaauguucuguauuuuucuugua

SEQ ID NO: 305274 - RNA, 66 nt, Homo Sapiens
ccaucauccagcuuuggcugucccaguuguauaguaauguuucagugugauauuguauauguuuug

SEQ ID NO: 305275 - RNA, 66 nt, Homo Sapiens
uuucuaaauuuaacagagauaguugauaacucuuccauguuucacaaguuuuaguauuguauucca

SEQ ID NO: 305276 - RNA, 66 nt, Homo Sapiens
uaagguaacuccuagauaucuagaacauaacucauuauguuucagaaaguuugauugcagacacug

SEQ ID NO: 305277 - RNA, 66 nt, Homo Sapiens
ugacaaaaagucguucuaauucaucaauaaaguuguauguuucaacccaaagacuucauuugugua

SEQ ID NO: 305278 - RNA, 66 nt, Homo Sapiens
uuguuuuccguucuguuuuaauguauaacagggcuuauguuucagugauguucuuuaaaaucguua

SEQ ID NO: 305279 - RNA, 66 nt, Homo Sapiens
aucagaucaauacaaucuugaagcauggaacaaagcauguuucaggaguuguuuauuauccugauc

SEQ ID NO: 305280 - RNA, 66 nt, Homo Sapiens
uuaagaagcuguuuugcuaaauuauuuuuacuuggaauguuucaaacagauuucaggcugcaaacu

SEQ ID NO: 305281 - RNA, 66 nt, Homo Sapiens
ucugaaaccaacuugucccaggccacaggaguguauauguuucauaaucuuuaucaagaaguuugu

SEQ ID NO: 305282 - RNA, 66 nt, Homo Sapiens
cccuacuuccaccuaaucuguuuacagucuuuugguauguuucaguuacuuagauggucucauaag

SEQ ID NO: 305283 - RNA, 64 nt, Homo Sapiens
accacaccaucuucuugcugugagaggucucaccccgggcuaccuccugucacuacucacugcc

SEQ ID NO: 305284 - RNA, 64 nt, Homo Sapiens
uauuuuuacuacagacggaguuuccccauguuggccgggcuagucucgaacuccugaccucagg

SEQ ID NO: 305285 - RNA, 56 nt, Homo Sapiens
gcaagcuccaggugcucugaccccagccgggcuacuaggacaggccagggcacuug

SEQ ID NO: 305286 - RNA, 64 nt, Homo Sapiens
cgaccgggagguccaccugcguugugagcucucaccgggcuacuaccuggcuguccccagcacc

SEQ ID NO: 305287 - RNA, 64 nt, Homo Sapiens
aggagugagaccagcuucugcuuagcuccucuguccgggcuacucuaugcacacagcacucgcu

SEQ ID NO: 305288 - RNA, 64 nt, Homo Sapiens
ggcaggauugggccacagacagccucucauugguccgggcuaauucacuccugcugcuccccuu

SEQ ID NO: 305289 - RNA, 64 nt, Homo Sapiens
agguggcccucugucugggcccucugcucugcucccgggcuagggcuuagcugcaggcccaggc

SEQ ID NO: 305290 - RNA, 64 nt, Homo Sapiens
uucuugaagcacuuuggcccaaaagaguuaucgcccgggcuagaauuuagcagacagcuguucc

SEQ ID NO: 305291 - RNA, 64 nt, Homo Sapiens
ggccugauggaaucccugucaugcgcuggucccaccgggcuacggucagcucagucaagacaga

SEQ ID NO: 305292 - RNA, 64 nt, Homo Sapiens
caaguagcugggauuacaggcgugcaccaccacgccgggcuaaauuuuuuuguauuuuuaguag

SEQ ID NO: 305293 - RNA, 64 nt, Homo Sapiens
uaggauuuuuggaucuuucuacagcuacggggcuccgggcuacuuugcagggaugcgaugcgua

SEQ ID NO: 305294 - RNA, 64 nt, Homo Sapiens
gugucugucagacugcccuggguggagggagacgccgggcuagagccuuugggaucguccugga

SEQ ID NO: 305295 - RNA, 64 nt, Homo Sapiens
uguaauugcguuaaaucuuuugagaguguaaaugccgggcuaggcaauugcaguuaauacauac

SEQ ID NO: 305296 - RNA, 62 nt, Homo Sapiens
gucuugugccugaaaaccacgguugcuggaggccgggcuaccgcagcagcccagcuguuuag

SEQ ID NO: 305297 - RNA, 64 nt, Homo Sapiens
aaugcagacuuuucagacugugaucaucugaaucccgggcuaaguuuaagauucccaaaccuaa

SEQ ID NO: 305298 - RNA, 64 nt, Homo Sapiens
gaacugcuggaaguucaggaugacauuaguggaaccgggcuaggcuuuaacuccagccgcggaa

SEQ ID NO: 305299 - RNA, 64 nt, Homo Sapiens
uggcugcccagagccucugagccagcgggucgcaccgggcuagcccccuucccacucagcuucu

SEQ ID NO: 305300 - RNA, 64 nt, Homo Sapiens
cugcagacuuuugcaggauugucuagccugaguaccgggcuacuucuuaaaugccgucacuccu

SEQ ID NO: 305301 - RNA, 64 nt, Homo Sapiens
gacauggcagggccugggcacccugccacccaggccgggcuaggccugccgcccaggagcuggg

SEQ ID NO: 305302 - RNA, 64 nt, Homo Sapiens
ggccucuugggagccagcgggugugaccucccuaccgggcuaucuccagggaucagcugugugu

SEQ ID NO: 305303 - RNA, 64 nt, Homo Sapiens
uugaacccaggaauccuugguugggccucagugcccgggcuauuauugcagcggcucuggcuaa

SEQ ID NO: 305304 - RNA, 64 nt, Homo Sapiens
uuuuguauuuuuaguagagacacaugccuccauaccgggcuaaucaaguagcugggauuacagg

SEQ ID NO: 305305 - RNA, 56 nt, Homo Sapiens
acgacuuuggcugggauugagcagacccgggcuauguaccuuacccacguggcuua

SEQ ID NO: 305306 - RNA, 64 nt, Homo Sapiens
uguaauugcguuaaaucuuuugagaauguaaaugccgggcuaggcaauugcaguuaauacauac

SEQ ID NO: 305307 - RNA, 64 nt, Homo Sapiens
cuuugaccagccuugugagggcaucgaugcugccccgggcuaccuggcugcucugggcagggug

SEQ ID NO: 305308 - RNA, 64 nt, Homo Sapiens
auguuuauauuauaaaagaguguccuaacaguccccgggcuagagaggacuaaggaaaacagag

SEQ ID NO: 305309 - RNA, 64 nt, Homo Sapiens
cuuuuuuuuuuaagauagagucucacucugcugcccgggcuagagugcaguggugggaucucgg

SEQ ID NO: 305310 - RNA, 64 nt, Homo Sapiens
uuuuguauuuuuuguagagauguguaccaccacaccgggcuaaucagguauuugaaacuacagg

SEQ ID NO: 305311 - RNA, 64 nt, Homo Sapiens
ccauuccagaccuaacccagaccaucuccccccgccgggcuacgaugacauguaccugugaagg

SEQ ID NO: 305312 - RNA, 64 nt, Homo Sapiens
uguagccaaaaugcaacuggauuccuccugugacccgggcuaccaggaacucccagggaugaag

SEQ ID NO: 305313 - RNA, 64 nt, Homo Sapiens
agggacaugccagagggcucgcagcggcuggugcccgggcuacccauggugccccucacaagcc

SEQ ID NO: 305314 - RNA, 64 nt, Homo Sapiens
cuaccacuccuaccucaccaucuucgggcagaucccgggcuacaucgacgguaggagccgggcg

SEQ ID NO: 305315 - RNA, 64 nt, Homo Sapiens
cgaguagcugggacuacaggcacgugugaccaugccgggcuaauuuuuuauauuuuuaguagag

SEQ ID NO: 305316 - RNA, 64 nt, Homo Sapiens
uugugcgaaaacaccaccuggggcgcguccugcgccgggcuagggcucucuuugcugauuaccu

SEQ ID NO: 305317 - RNA, 64 nt, Homo Sapiens
guggggaaggugugagucagcgccccuggacgggccgggcuaaaaaaggcuguuagaaccuuug

SEQ ID NO: 305318 - RNA, 64 nt, Homo Sapiens; identical to SEQ ID NO: 276332

SEQ ID NO: 305319 - RNA, 64 nt, Homo Sapiens; identical to SEQ ID NO: 276333

SEQ ID NO: 305320 - RNA, 64 nt, Homo Sapiens; identical to SEQ ID NO: 276334

SEQ ID NO: 305321 - RNA, 64 nt, Homo Sapiens; identical to SEQ ID NO: 276335

SEQ ID NO: 305322 - RNA, 64 nt, Homo Sapiens; identical to SEQ ID NO: 276336

SEQ ID NO: 305323 - RNA, 64 nt, Homo Sapiens; identical to SEQ ID NO: 276337

SEQ ID NO: 305324 - RNA, 64 nt, Homo Sapiens; identical to SEQ ID NO: 276338

SEQ ID NO: 305325 - RNA, 64 nt, Homo Sapiens; identical to SEQ ID NO: 276339

SEQ ID NO: 305326 - RNA, 64 nt, Homo Sapiens; identical to SEQ ID NO: 276340

SEQ ID NO: 305327 - RNA, 64 nt, Homo Sapiens; identical to SEQ ID NO: 276341

SEQ ID NO: 305328 - RNA, 64 nt, Homo Sapiens; identical to SEQ ID NO: 276342

SEQ ID NO: 305329 - RNA, 64 nt, Homo Sapiens; identical to SEQ ID NO: 276343

SEQ ID NO: 305330 - RNA, 64 nt, Homo Sapiens; identical to SEQ ID NO: 276344

SEQ ID NO: 305331 - RNA, 64 nt, Homo Sapiens; identical to SEQ ID NO: 276345

SEQ ID NO: 305332 - RNA, 64 nt, Homo Sapiens; identical to SEQ ID NO: 276346

SEQ ID NO: 305333 - RNA, 64 nt, Homo Sapiens; identical to SEQ ID NO: 276347

SEQ ID NO: 305334 - RNA, 64 nt, Homo Sapiens; identical to SEQ ID NO: 276348

SEQ ID NO: 305335 - RNA, 64 nt, Homo Sapiens; identical to SEQ ID NO: 276349

SEQ ID NO: 305336 - RNA, 64 nt, Homo Sapiens; identical to SEQ ID NO: 276350

SEQ ID NO: 305337 - RNA, 64 nt, Homo Sapiens; identical to SEQ ID NO: 276351

SEQ ID NO: 305338 - RNA, 64 nt, Homo Sapiens; identical to SEQ ID NO: 276352

SEQ ID NO: 305339 - RNA, 64 nt, Homo Sapiens; identical to SEQ ID NO: 276353

SEQ ID NO: 305340 - RNA, 64 nt, Homo Sapiens; identical to SEQ ID NO: 276354

SEQ ID NO: 305341 - RNA, 64 nt, Homo Sapiens; identical to SEQ ID NO: 276355

SEQ ID NO: 305342 - RNA, 64 nt, Homo Sapiens; identical to SEQ ID NO: 276356

SEQ ID NO: 305343 - RNA, 64 nt, Homo Sapiens; identical to SEQ ID NO: 276357

SEQ ID NO: 305344 - RNA, 64 nt, Homo Sapiens; identical to SEQ ID NO: 276358

SEQ ID NO: 305345 - RNA, 64 nt, Homo Sapiens; identical to SEQ ID NO: 276359

SEQ ID NO: 305346 - RNA, 64 nt, Homo Sapiens
aauacuuaaggcacuauggcacuuagcuuugaagugacacgacccugucuuccuuccgcccgcu

SEQ ID NO: 305347 - RNA, 64 nt, Homo Sapiens
uuuuccucauggauuuugucaaauagaugaucuuugacacgauuagacacuccuccccacaaag

SEQ ID NO: 305348 - RNA, 64 nt, Homo Sapiens
uggggaaaacaaauguguaacuuuuccaguuacuugacacgauucagugggggaaaaccagcau

SEQ ID NO: 305349 - RNA, 64 nt, Homo Sapiens
aucagaauauuaauaaaacuugccauaaaagcuaugacacgagaggcauguccucauccuuucc

SEQ ID NO: 305350 - RNA, 64 nt, Homo Sapiens
auuuuggaggaaccaauugagccaaguaauuuguugacacgaaacaccccuuuuuucugacuuu

SEQ ID NO: 305351 - RNA, 64 nt, Homo Sapiens
acucugaauguguggcccucgcgucagcccgaauugacacgacaaugagggaucgugcacggua

SEQ ID NO: 305352 - RNA, 64 nt, Homo Sapiens
uccugcacgcguccuccucucagaaggugacaauugacacgauugugucccugugggaggcagg

SEQ ID NO: 305353 - RNA, 64 nt, Homo Sapiens
cacagaaaacaaauaucaaacugccgaauucaguugacacgagguguggcaacaggcggccgag

SEQ ID NO: 305354 - RNA, 64 nt, Homo Sapiens
ggagucucacucugucacccaggcuggaguacagugacacgaccucggcucacugcagccuccu

SEQ ID NO: 305355 - RNA, 64 nt, Homo Sapiens
gccagaucauggacuccggacuuagugguagccaugacacgaugggacauuccaucccuguacc

SEQ ID NO: 305356 - RNA, 64 nt, Homo Sapiens
gaugcuccaggcaacacgguucugagucaccuucugacacgagcucccucugcuugcuuuccag

SEQ ID NO: 305357 - RNA, 64 nt, Homo Sapiens
auaacaaaauaucaauacuuaacggaaaauaaggugacacgaagaaaguacauauguuaacuau

SEQ ID NO: 305358 - RNA, 64 nt, Homo Sapiens
agagucuugcuccaucgcccaggcugcagugcagugacacgaucuugucucacugcaaccucug

SEQ ID NO: 305359 - RNA, 64 nt, Homo Sapiens
acacagggacagguucuaucgguucugucaugggugacacgagggacaccaggacacagggaca

SEQ ID NO: 305360 - RNA, 64 nt, Homo Sapiens
ccaaaggucugccauacucuuuucagucucguccugacacgauugaauucacacuugccuugac

SEQ ID NO: 305361 - RNA, 64 nt, Homo Sapiens
cucagacacagaagggacugggaguacugcaaccugacacgaugauggaucccaaagucagaug

SEQ ID NO: 305362 - RNA, 64 nt, Homo Sapiens
ccaguccccaggagcagccccaugcuuuucuccaugacacgaggccccagcgcgccccgacaca

SEQ ID NO: 305363 - RNA, 64 nt, Homo Sapiens
auauaauuaaauuuagcugcugcaaccauuguucugacacgacuucuguuucacaguucagacc

SEQ ID NO: 305364 - RNA, 64 nt, Homo Sapiens
cgcuucuagaagccaggcacagguugccaagaggugacacgaaacaggaggaaacucagugacc

SEQ ID NO: 305365 - RNA, 64 nt, Homo Sapiens
gauagaguuucacagauuuccacaauguuaaaacugacacgaagccugaaauggcugccaucaa

SEQ ID NO: 305366 - RNA, 64 nt, Homo Sapiens
gaucuuauuccauacuucuuuuuuuggauagcguugacacgauagucuacuuuuuaguaaaaua

SEQ ID NO: 305367 - RNA, 64 nt, Homo Sapiens
uaaaucuuuucaaauguuuuuucugcuaugaccaugacacgauugccauuucaaagacucaugu

SEQ ID NO: 305368 - RNA, 64 nt, Homo Sapiens
cugcaauaaaagccaucagugauuauccuuguaaugacacgaauuuuuuaaaaauauauuccca

SEQ ID NO: 305369 - RNA, 64 nt, Homo Sapiens
cucccugggccggugaagucggccgggccaucccugacacgaagcccacucuccaguagggagg

SEQ ID NO: 305370 - RNA, 64 nt, Homo Sapiens
uacuuauguuuauuucuuagacggggaguaauuaugacacgaagcuugcauuuaauuagacgaa

SEQ ID NO: 305371 - RNA, 64 nt, Homo Sapiens
ucgagucucgcucugucaccaggcuggagugcagugacacgaucuuggcucacugcaaccuccg

SEQ ID NO: 305372 - RNA, 64 nt, Homo Sapiens
acccaaaguuuucccaaaucagcauggccccugcugacacgagaucagccuucagguuucccac

SEQ ID NO: 305373 - RNA, 64 nt, Homo Sapiens
ccuguaagcagguggugagaccagcaugguggggugacacgagagagagguuuuacauccccug

SEQ ID NO: 305374 - RNA, 64 nt, Homo Sapiens
auaaacuauaucuacacugucucgucaaguucucugacacgaucuuucugggcucuacauuucc

SEQ ID NO: 305375 - RNA, 54 nt, Homo Sapiens
ccuuauuucuagaagcacauaguuugacacgaagacuccaccccacccaucuag

SEQ ID NO: 305376 - RNA, 64 nt, Homo Sapiens
aaaaauaauuuuuacuuauauuuuucagaggauuugacacgauaagccucaucugauggaagag

SEQ ID NO: 305377 - RNA, 64 nt, Homo Sapiens
ucagcucacugcaaccucugaggcuggagugcagugacacgaucggaaucuugcuuugucagcc

SEQ ID NO: 305378 - RNA, 64 nt, Homo Sapiens
ucucuccuggcuugggucaccagccaggcaccugugacacgagugcugcucuccaggaucucca

SEQ ID NO: 305379 - RNA, 64 nt, Homo Sapiens
caaguggcucacaaccuccuuacuccauucuuugugacacgagugucuuucagaguuguuaguu

SEQ ID NO: 305380 - RNA, 64 nt, Homo Sapiens
ggcaucucacucugucacccaggcuggaguguagugacacgaucucgacucacugcaauuucca

SEQ ID NO: 305381 - RNA, 64 nt, Homo Sapiens
aaaaggaccugagcuagggucugcugggauuuccugacacgauuuuccaucuucauggacaaug

SEQ ID NO: 305382 - RNA, 64 nt, Homo Sapiens
cugcugugaaccccgcaaccguuaccuccgcauuugacacgagugcccccucccuguggagccu

SEQ ID NO: 305383 - RNA, 64 nt, Homo Sapiens
uaguccacguugacagcuuaccuucucgagcagaugacacgagcgaaacaagaacagcgacagc

SEQ ID NO: 305384 - RNA, 64 nt, Homo Sapiens
ccagcagaggucagaggggagagauccgggagacugacacgaagcugcucuggagccugcagau

SEQ ID NO: 305385 - RNA, 64 nt, Homo Sapiens
acuccuuucaucucagcagguagaggaggacugaugacacgagcugccauggcgggaggagggg

SEQ ID NO: 305386 - RNA, 64 nt, Homo Sapiens
gaaaaguaagagcugguucugacuucaucacauaugacacgagaagggggaauugucaagugag

SEQ ID NO: 305387 - RNA, 64 nt, Homo Sapiens
aacauguuuuacuaagccuagaguaauucguaaaggguauaagcauaggacagauuuugcccuc

SEQ ID NO: 305388 - RNA, 64 nt, Homo Sapiens
uccuauauauuugucacacauugaaaacuggacuggguauaacuauguuauaggaaaguagaaa

SEQ ID NO: 305389 - RNA, 64 nt, Homo Sapiens
ucguagaguucccucagaagagccaugguguuuaugaagagaagaguagugauugcucugccag

SEQ ID NO: 305390 - RNA, 64 nt, Homo Sapiens
uccucucuugaugaauuucuuaaggcugaaggaaugaagagagugggacaugggguaaucuuua

SEQ ID NO: 305391 - RNA, 64 nt, Homo Sapiens
cauuuagcuaguaacgugaugaauugcaauagaaugaagagaaaaauaaauucauuguauguua

SEQ ID NO: 305392 - RNA, 64 nt, Homo Sapiens
gcuguuaaagcaaaaauuuuuuuaaaaauaaucaugaagagaagcuucucaggcaacauuugcu

SEQ ID NO: 305393 - RNA, 64 nt, Homo Sapiens
gacuaauggguagcaaucguauuauuugcuggccugaagagaaaaaaugguaaugugugccuuu

SEQ ID NO: 305394 - RNA, 64 nt, Homo Sapiens
cauguguuuuguguauaugcucacaaaaugucugugaagagauuucuuucagcuuuugcucagc

SEQ ID NO: 305395 - RNA, 64 nt, Homo Sapiens
uaaccaccucugaagaaguucaaaaaaaauuauaugaagagauaaaccaaguuuuuggaaaugg

SEQ ID NO: 305396 - RNA, 64 nt, Homo Sapiens
uauauggugaccacaguacuucuuaguguauuggugaagagacugcaccuacuuucuguggagg

SEQ ID NO: 305397 - RNA, 64 nt, Homo Sapiens
auacauuuuauauaaacaggaaaacggcuauauuugaagagagaauugagaacaauuucauaau

SEQ ID NO: 305398 - RNA, 64 nt, Homo Sapiens
uuuucccugugaaaaguaagucaaauuagccucaugaagagaauagucuuuaauuucaaaaacu

SEQ ID NO: 305399 - RNA, 64 nt, Homo Sapiens
uagaauguagcaaauuauguaauauuaauuuacuugaagagaugacuuuaccuagcguuuuaga

SEQ ID NO: 305400 - RNA, 64 nt, Homo Sapiens
gcccacgaagaaaaaagccuggggcagagauggaugaagagaaagaugacgccaagaaguaagg

SEQ ID NO: 305401 - RNA, 64 nt, Homo Sapiens
accacaaucaagcuaaaccuauauguauacauugugaagagacuucacaacaugaugcuuuagu

SEQ ID NO: 305402 - RNA, 64 nt, Homo Sapiens
uuuuaauggguauuuaauuuuuaaucuuaauucuugaagagaauuaucuagaauaucauuuuug

SEQ ID NO: 305403 - RNA, 64 nt, Homo Sapiens
cugguuguuuuauuuucaauagagaauaaauauaugaagagagaagaccaaaacauguuuggaa

SEQ ID NO: 305404 - RNA, 64 nt, Homo Sapiens
uuuuuccccagguaggaaggcaaacuaugcacugugaagagauucccauauugcacuuugauuu

SEQ ID NO: 305405 - RNA, 64 nt, Homo Sapiens
uuuguaacaaaauauaaaugaagauauuuuaccaugaagagauugcacuuauccuugagaacag

SEQ ID NO: 305406 - RNA, 64 nt, Homo Sapiens
gaacagucuaaauauaaaugaagauauuuuaccaugaagagauugcacuuauccuugagaacag

SEQ ID NO: 305407 - RNA, 64 nt, Homo Sapiens
ucacuuacucuuucugagguccaggguccuuauaugaagagauucauauauaugaagagauucg

SEQ ID NO: 305408 - RNA, 64 nt, Homo Sapiens
guccaggguccuuauaugaagagauucauauauaugaagagauucgucuagagcagugguuguc

SEQ ID NO: 305409 - RNA, 64 nt, Homo Sapiens
uacaagauuccagcuuucgucugucaucagacauugaagagauuuggagaaauguaaagcagca

SEQ ID NO: 305410 - RNA, 64 nt, Homo Sapiens
auuucucccaggaaaucuuuuauaaaccucuguaugaagagaaggcuggaauuacuccuguagg

SEQ ID NO: 305411 - RNA, 64 nt, Homo Sapiens
caaaaccagaauaagccacuuugauaaagauuguugaagagaucuuuuuacaguuccaaaugag

SEQ ID NO: 305412 - RNA, 64 nt, Homo Sapiens
auauuaaaacuagaauauucuuuuccaggacaagugaagagaaaccucuuuuauagggggaugu

SEQ ID NO: 305413 - RNA, 64 nt, Homo Sapiens
gauaagaaagaucaaguguaaaugcaacuuuuuuugaagagaugcuucucuuggaaacaucaua

SEQ ID NO: 305414 - RNA, 64 nt, Homo Sapiens
uuacaaguguaauaaauguguggagaauccacagugaagagauccuacaaccauugcacaucau

SEQ ID NO: 305415 - RNA, 64 nt, Homo Sapiens
ccauacagagguaagguuugaagaaaauucacauugaagagaaaaaucaaaccuuaaaacacau

SEQ ID NO: 305416 - RNA, 64 nt, Homo Sapiens
guaguugucagagugaagagagaaaaagaaaaacugaagagagaaacaaaacuccaucuaaaga

SEQ ID NO: 305417 - RNA, 64 nt, Homo Sapiens
ggccaggcgcgguggcucacucuuguuuugaaauugaagagagaaaagagugaugaaaaauuga

SEQ ID NO: 305418 - RNA, 64 nt, Homo Sapiens
aaaccucaauggcuuuuugcuuuugaaggugguaugaagagaacguccacuuuaaggcuuuaaa

SEQ ID NO: 305419 - RNA, 64 nt, Homo Sapiens
acccacuuuugaccgucacacacauuucagcauuugaagagacacaggcuaccuggaaacugcc

SEQ ID NO: 305420 - RNA, 52 nt, Homo Sapiens
cgcagcugcaggaguccugacccgcccagacuguccccagacucccccgaga

SEQ ID NO: 305421 - RNA, 64 nt, Homo Sapiens
uagaggcacugggaggacaguggcugaguggaggcgcccagaccugggcaggcagcaggcucag

SEQ ID NO: 305422 - RNA, 64 nt, Homo Sapiens
aaagguuuagaugcuggagaucuccagagcagacuucugacaggguccuugcagaugaaaaaag

SEQ ID NO: 305423 - RNA, 64 nt, Homo Sapiens
gaauucuuugagguccgcagccgugggggccuucuucugacagaauuauguauuucagaucccu

SEQ ID NO: 305424 - RNA, 64 nt, Homo Sapiens
agugaugcuccaggcaacacgguucugagucaccuucugacacgagcucccucugcuugcuuuc

SEQ ID NO: 305425 - RNA, 64 nt, Homo Sapiens
ccuggaaacggggccccagacgccacgucgggauuucugacaugcucagcagguagaccagagg

SEQ ID NO: 305426 - RNA, 64 nt, Homo Sapiens
augugcaaacugauccaucccaccuuuccugaaauucugacacccucuuccuuacaggugugag

SEQ ID NO: 305427 - RNA, 64 nt, Homo Sapiens
guuuuaggugccuggauauuaggggcauagccaguucugacaguagccagcaggaggugaucau

SEQ ID NO: 305428 - RNA, 64 nt, Homo Sapiens
aauuaagaggaaaauagaaguugcuuuuagggguuucugacauauauucuggauacuauccgag

SEQ ID NO: 305429 - RNA, 64 nt, Homo Sapiens
augacaugaaaauaauugugaaauauggaauuauuucugacacaugaagcccacuaaacuaugc

SEQ ID NO: 305430 - RNA, 64 nt, Homo Sapiens
aguuaucucugaggaauuggacucugaaauaauauucugacagcgcguauuuguguauagcaga

SEQ ID NO: 305431 - RNA, 64 nt, Homo Sapiens
cuaggcuucauauacauuaauaaggcucuaucaguucugacauugaaauagacuugaaagucuc

SEQ ID NO: 305432 - RNA, 64 nt, Homo Sapiens
gcuuuaagucauucaagagaaccucaggcuguuuuucugacagugaugauaugauauacagaua

SEQ ID NO: 305433 - RNA, 64 nt, Homo Sapiens
aaaaagcagcaaacagagggucagucacaggauguucugacacaccauuguaacuuuuuguuag

SEQ ID NO: 305434 - RNA, 64 nt, Homo Sapiens
aaucuuuagcauuuaaaacuuuuuuuguuuuguuuucugacauauucugacaaagagcagcaaa

SEQ ID NO: 305435 - RNA, 64 nt, Homo Sapiens
auuuaaaacuuuuuuuguuuuguuuucugacauauucugacaaagagcagcaaaccacugcugu

SEQ ID NO: 305436 - RNA, 64 nt, Homo Sapiens
cuuuaauuaccuuuuuuucuuuucuuuuugauuuuucugacacugugugcgaaggcuuggaguc

SEQ ID NO: 305437 - RNA, 64 nt, Homo Sapiens
ugacacugugugcgaaggcuuggaguccaagguguucugacaaggguggcuuuucucugccauu

SEQ ID NO: 305438 - RNA, 64 nt, Homo Sapiens
aucauaagaauucauauuaaacuccuguuaaacuuucugacaauuuuuaacaggaguuaaaaua

SEQ ID NO: 305439 - RNA, 64 nt, Homo Sapiens
acaaaaguagaaagugcuuggauuuuccugggauuucugacaaccuuuuuuuuuuucauuucug

SEQ ID NO: 305440 - RNA, 64 nt, Homo Sapiens; identical to SEQ ID NO: 196865

SEQ ID NO: 305441 - RNA, 64 nt, Homo Sapiens; identical to SEQ ID NO: 196866

SEQ ID NO: 305442 - RNA, 64 nt, Homo Sapiens; identical to SEQ ID NO: 196867

SEQ ID NO: 305443 - RNA, 64 nt, Homo Sapiens; identical to SEQ ID NO: 196868

SEQ ID NO: 305444 - RNA, 64 nt, Homo Sapiens; identical to SEQ ID NO: 196869

SEQ ID NO: 305445 - RNA, 64 nt, Homo Sapiens; identical to SEQ ID NO: 196870

SEQ ID NO: 305446 - RNA, 64 nt, Homo Sapiens; identical to SEQ ID NO: 196871

SEQ ID NO: 305447 - RNA, 64 nt, Homo Sapiens; identical to SEQ ID NO: 196872

SEQ ID NO: 305448 - RNA, 64 nt, Homo Sapiens; identical to SEQ ID NO: 196873

SEQ ID NO: 305449 - RNA, 64 nt, Homo Sapiens; identical to SEQ ID NO: 196874

SEQ ID NO: 305450 - RNA, 64 nt, Homo Sapiens; identical to SEQ ID NO: 196875

SEQ ID NO: 305451 - RNA, 64 nt, Homo Sapiens; identical to SEQ ID NO: 196876

SEQ ID NO: 305452 - RNA, 64 nt, Homo Sapiens; identical to SEQ ID NO: 196877

SEQ ID NO: 305453 - RNA, 64 nt, Homo Sapiens; identical to SEQ ID NO: 196878

SEQ ID NO: 305454 - RNA, 64 nt, Homo Sapiens; identical to SEQ ID NO: 196879

SEQ ID NO: 305455 - RNA, 64 nt, Homo Sapiens; identical to SEQ ID NO: 196880

SEQ ID NO: 305456 - RNA, 64 nt, Homo Sapiens; identical to SEQ ID NO: 196881

SEQ ID NO: 305457 - RNA, 64 nt, Homo Sapiens; identical to SEQ ID NO: 196882

SEQ ID NO: 305458 - RNA, 64 nt, Homo Sapiens; identical to SEQ ID NO: 196883

SEQ ID NO: 305459 - RNA, 64 nt, Homo Sapiens; identical to SEQ ID NO: 196884

SEQ ID NO: 305460 - RNA, 64 nt, Homo Sapiens; identical to SEQ ID NO: 196885

SEQ ID NO: 305461 - RNA, 64 nt, Homo Sapiens; identical to SEQ ID NO: 196886

SEQ ID NO: 305462 - RNA, 64 nt, Homo Sapiens; identical to SEQ ID NO: 196887

SEQ ID NO: 305463 - RNA, 64 nt, Homo Sapiens; identical to SEQ ID NO: 196888

SEQ ID NO: 305464 - RNA, 64 nt, Homo Sapiens; identical to SEQ ID NO: 196889

SEQ ID NO: 305465 - RNA, 64 nt, Homo Sapiens; identical to SEQ ID NO: 196890

SEQ ID NO: 305466 - RNA, 64 nt, Homo Sapiens; identical to SEQ ID NO: 196891

SEQ ID NO: 305467 - RNA, 64 nt, Homo Sapiens; identical to SEQ ID NO: 196892

SEQ ID NO: 305468 - RNA, 64 nt, Homo Sapiens; identical to SEQ ID NO: 196893

SEQ ID NO: 305469 - RNA, 64 nt, Homo Sapiens; identical to SEQ ID NO: 196894

SEQ ID NO: 305470 - RNA, 64 nt, Homo Sapiens; identical to SEQ ID NO: 196895

SEQ ID NO: 305471 - RNA, 64 nt, Homo Sapiens; identical to SEQ ID NO: 196896

SEQ ID NO: 305472 - RNA, 64 nt, Homo Sapiens; identical to SEQ ID NO: 196897

SEQ ID NO: 305473 - RNA, 64 nt, Homo Sapiens; identical to SEQ ID NO: 196898

SEQ ID NO: 305474 - RNA, 64 nt, Homo Sapiens; identical to SEQ ID NO: 196899

SEQ ID NO: 305475 - RNA, 64 nt, Homo Sapiens; identical to SEQ ID NO: 196900

SEQ ID NO: 305476 - RNA, 64 nt, Homo Sapiens; identical to SEQ ID NO: 196901

SEQ ID NO: 305477 - RNA, 64 nt, Homo Sapiens; identical to SEQ ID NO: 196902

SEQ ID NO: 305478 - RNA, 64 nt, Homo Sapiens; identical to SEQ ID NO: 196903

SEQ ID NO: 305479 - RNA, 64 nt, Homo Sapiens; identical to SEQ ID NO: 196904

SEQ ID NO: 305480 - RNA, 64 nt, Homo Sapiens; identical to SEQ ID NO: 196905

SEQ ID NO: 305481 - RNA, 64 nt, Homo Sapiens; identical to SEQ ID NO: 196906

SEQ ID NO: 305482 - RNA, 64 nt, Homo Sapiens; identical to SEQ ID NO: 196907

SEQ ID NO: 305483 - RNA, 64 nt, Homo Sapiens; identical to SEQ ID NO: 196908

SEQ ID NO: 305484 - RNA, 64 nt, Homo Sapiens; identical to SEQ ID NO: 196909

SEQ ID NO: 305485 - RNA, 64 nt, Homo Sapiens; identical to SEQ ID NO: 196910

SEQ ID NO: 305486 - RNA, 64 nt, Homo Sapiens; identical to SEQ ID NO: 196911

SEQ ID NO: 305487 - RNA, 64 nt, Homo Sapiens; identical to SEQ ID NO: 196912

SEQ ID NO: 305488 - RNA, 64 nt, Homo Sapiens; identical to SEQ ID NO: 196913

SEQ ID NO: 305489 - RNA, 64 nt, Homo Sapiens; identical to SEQ ID NO: 196914

SEQ ID NO: 305490 - RNA, 64 nt, Homo Sapiens; identical to SEQ ID NO: 196915

SEQ ID NO: 305491 - RNA, 64 nt, Homo Sapiens; identical to SEQ ID NO: 196916

SEQ ID NO: 305492 - RNA, 64 nt, Homo Sapiens; identical to SEQ ID NO: 196917

SEQ ID NO: 305493 - RNA, 64 nt, Homo Sapiens; identical to SEQ ID NO: 196918

SEQ ID NO: 305494 - RNA, 64 nt, Homo Sapiens; identical to SEQ ID NO: 196919

SEQ ID NO: 305495 - RNA, 64 nt, Homo Sapiens; identical to SEQ ID NO: 196920

SEQ ID NO: 305496 - RNA, 64 nt, Homo Sapiens; identical to SEQ ID NO: 196921

SEQ ID NO: 305497 - RNA, 64 nt, Homo Sapiens; identical to SEQ ID NO: 196922

SEQ ID NO: 305498 - RNA, 64 nt, Homo Sapiens; identical to SEQ ID NO: 196923

SEQ ID NO: 305499 - RNA, 64 nt, Homo Sapiens; identical to SEQ ID NO: 196924

SEQ ID NO: 305500 - RNA, 64 nt, Homo Sapiens; identical to SEQ ID NO: 196925

SEQ ID NO: 305501 - RNA, 64 nt, Homo Sapiens; identical to SEQ ID NO: 196926

SEQ ID NO: 305502 - RNA, 64 nt, Homo Sapiens; identical to SEQ ID NO: 196927

SEQ ID NO: 305503 - RNA, 64 nt, Homo Sapiens; identical to SEQ ID NO: 196928

SEQ ID NO: 305504 - RNA, 64 nt, Homo Sapiens; identical to SEQ ID NO: 196929

SEQ ID NO: 305505 - RNA, 64 nt, Homo Sapiens; identical to SEQ ID NO: 196930

SEQ ID NO: 305506 - RNA, 64 nt, Homo Sapiens; identical to SEQ ID NO: 196931

SEQ ID NO: 305507 - RNA, 64 nt, Homo Sapiens; identical to SEQ ID NO: 196932

SEQ ID NO: 305508 - RNA, 64 nt, Homo Sapiens; identical to SEQ ID NO: 196933

SEQ ID NO: 305509 - RNA, 64 nt, Homo Sapiens; identical to SEQ ID NO: 196934

SEQ ID NO: 305510 - RNA, 64 nt, Homo Sapiens; identical to SEQ ID NO: 196935

SEQ ID NO: 305511 - RNA, 64 nt, Homo Sapiens; identical to SEQ ID NO: 196936

SEQ ID NO: 305512 - RNA, 64 nt, Homo Sapiens; identical to SEQ ID NO: 196937

SEQ ID NO: 305513 - RNA, 64 nt, Homo Sapiens; identical to SEQ ID NO: 196938

SEQ ID NO: 305514 - RNA, 64 nt, Homo Sapiens; identical to SEQ ID NO: 196939

SEQ ID NO: 305515 - RNA, 64 nt, Homo Sapiens; identical to SEQ ID NO: 196940

SEQ ID NO: 305516 - RNA, 64 nt, Homo Sapiens; identical to SEQ ID NO: 196941

SEQ ID NO: 305517 - RNA, 64 nt, Homo Sapiens; identical to SEQ ID NO: 196942

SEQ ID NO: 305518 - RNA, 64 nt, Homo Sapiens; identical to SEQ ID NO: 196943

SEQ ID NO: 305519 - RNA, 64 nt, Homo Sapiens; identical to SEQ ID NO: 196944

SEQ ID NO: 305520 - RNA, 64 nt, Homo Sapiens; identical to SEQ ID NO: 196945

SEQ ID NO: 305521 - RNA, 64 nt, Homo Sapiens; identical to SEQ ID NO: 196946

SEQ ID NO: 305522 - RNA, 64 nt, Homo Sapiens; identical to SEQ ID NO: 196947

SEQ ID NO: 305523 - RNA, 64 nt, Homo Sapiens; identical to SEQ ID NO: 196948

SEQ ID NO: 305524 - RNA, 64 nt, Homo Sapiens; identical to SEQ ID NO: 196949

SEQ ID NO: 305525 - RNA, 64 nt, Homo Sapiens; identical to SEQ ID NO: 196950

SEQ ID NO: 305526 - RNA, 64 nt, Homo Sapiens; identical to SEQ ID NO: 196951

SEQ ID NO: 305527 - RNA, 64 nt, Homo Sapiens; identical to SEQ ID NO: 196952

SEQ ID NO: 305528 - RNA, 64 nt, Homo Sapiens; identical to SEQ ID NO: 196953

SEQ ID NO: 305529 - RNA, 64 nt, Homo Sapiens; identical to SEQ ID NO: 196954

SEQ ID NO: 305530 - RNA, 64 nt, Homo Sapiens; identical to SEQ ID NO: 196955

SEQ ID NO: 305531 - RNA, 64 nt, Homo Sapiens; identical to SEQ ID NO: 196956

SEQ ID NO: 305532 - RNA, 64 nt, Homo Sapiens; identical to SEQ ID NO: 196957

SEQ ID NO: 305533 - RNA, 64 nt, Homo Sapiens; identical to SEQ ID NO: 196958

SEQ ID NO: 305534 - RNA, 64 nt, Homo Sapiens; identical to SEQ ID NO: 196959

SEQ ID NO: 305535 - RNA, 64 nt, Homo Sapiens; identical to SEQ ID NO: 196960

SEQ ID NO: 305536 - RNA, 64 nt, Homo Sapiens; identical to SEQ ID NO: 196961

SEQ ID NO: 305537 - RNA, 64 nt, Homo Sapiens; identical to SEQ ID NO: 196962

SEQ ID NO: 305538 - RNA, 64 nt, Homo Sapiens; identical to SEQ ID NO: 196963

SEQ ID NO: 305539 - RNA, 64 nt, Homo Sapiens; identical to SEQ ID NO: 196964

SEQ ID NO: 305540 - RNA, 64 nt, Homo Sapiens; identical to SEQ ID NO: 196965

SEQ ID NO: 305541 - RNA, 64 nt, Homo Sapiens; identical to SEQ ID NO: 196966

SEQ ID NO: 305542 - RNA, 64 nt, Homo Sapiens; identical to SEQ ID NO: 196967

SEQ ID NO: 305543 - RNA, 64 nt, Homo Sapiens; identical to SEQ ID NO: 196968

SEQ ID NO: 305544 - RNA, 64 nt, Homo Sapiens; identical to SEQ ID NO: 196969

SEQ ID NO: 305545 - RNA, 64 nt, Homo Sapiens; identical to SEQ ID NO: 196970

SEQ ID NO: 305546 - RNA, 64 nt, Homo Sapiens; identical to SEQ ID NO: 196971

SEQ ID NO: 305547 - RNA, 64 nt, Homo Sapiens; identical to SEQ ID NO: 196972

SEQ ID NO: 305548 - RNA, 64 nt, Homo Sapiens; identical to SEQ ID NO: 196973

SEQ ID NO: 305549 - RNA, 64 nt, Homo Sapiens; identical to SEQ ID NO: 196974

SEQ ID NO: 305550 - RNA, 64 nt, Homo Sapiens; identical to SEQ ID NO: 196975

SEQ ID NO: 305551 - RNA, 64 nt, Homo Sapiens; identical to SEQ ID NO: 196976

SEQ ID NO: 305552 - RNA, 64 nt, Homo Sapiens; identical to SEQ ID NO: 196977

SEQ ID NO: 305553 - RNA, 64 nt, Homo Sapiens; identical to SEQ ID NO: 196978

SEQ ID NO: 305554 - RNA, 64 nt, Homo Sapiens; identical to SEQ ID NO: 196979

SEQ ID NO: 305555 - RNA, 64 nt, Homo Sapiens; identical to SEQ ID NO: 196980

SEQ ID NO: 305556 - RNA, 64 nt, Homo Sapiens; identical to SEQ ID NO: 196981

SEQ ID NO: 305557 - RNA, 64 nt, Homo Sapiens; identical to SEQ ID NO: 196982

SEQ ID NO: 305558 - RNA, 64 nt, Homo Sapiens; identical to SEQ ID NO: 196983

SEQ ID NO: 305559 - RNA, 64 nt, Homo Sapiens; identical to SEQ ID NO: 196984

SEQ ID NO: 305560 - RNA, 64 nt, Homo Sapiens; identical to SEQ ID NO: 196985

SEQ ID NO: 305561 - RNA, 64 nt, Homo Sapiens; identical to SEQ ID NO: 196986

SEQ ID NO: 305562 - RNA, 64 nt, Homo Sapiens; identical to SEQ ID NO: 196987

SEQ ID NO: 305563 - RNA, 64 nt, Homo Sapiens; identical to SEQ ID NO: 196988

SEQ ID NO: 305564 - RNA, 64 nt, Homo Sapiens; identical to SEQ ID NO: 196989

SEQ ID NO: 305565 - RNA, 64 nt, Homo Sapiens; identical to SEQ ID NO: 196990

SEQ ID NO: 305566 - RNA, 64 nt, Homo Sapiens; identical to SEQ ID NO: 196991

SEQ ID NO: 305567 - RNA, 64 nt, Homo Sapiens; identical to SEQ ID NO: 196992

SEQ ID NO: 305568 - RNA, 64 nt, Homo Sapiens; identical to SEQ ID NO: 196993

SEQ ID NO: 305569 - RNA, 64 nt, Homo Sapiens; identical to SEQ ID NO: 196994

SEQ ID NO: 305570 - RNA, 64 nt, Homo Sapiens; identical to SEQ ID NO: 196995

SEQ ID NO: 305571 - RNA, 64 nt, Homo Sapiens; identical to SEQ ID NO: 196996

SEQ ID NO: 305572 - RNA, 64 nt, Homo Sapiens; identical to SEQ ID NO: 196997

SEQ ID NO: 305573 - RNA, 64 nt, Homo Sapiens; identical to SEQ ID NO: 196998

SEQ ID NO: 305574 - RNA, 64 nt, Homo Sapiens; identical to SEQ ID NO: 196999

SEQ ID NO: 305575 - RNA, 64 nt, Homo Sapiens; identical to SEQ ID NO: 197000

SEQ ID NO: 305576 - RNA, 64 nt, Homo Sapiens; identical to SEQ ID NO: 197001

SEQ ID NO: 305577 - RNA, 64 nt, Homo Sapiens; identical to SEQ ID NO: 197002

SEQ ID NO: 305578 - RNA, 64 nt, Homo Sapiens; identical to SEQ ID NO: 197003

SEQ ID NO: 305579 - RNA, 64 nt, Homo Sapiens; identical to SEQ ID NO: 197004

SEQ ID NO: 305580 - RNA, 64 nt, Homo Sapiens; identical to SEQ ID NO: 197005

SEQ ID NO: 305581 - RNA, 64 nt, Homo Sapiens; identical to SEQ ID NO: 197006

SEQ ID NO: 305582 - RNA, 64 nt, Homo Sapiens; identical to SEQ ID NO: 197007

SEQ ID NO: 305583 - RNA, 64 nt, Homo Sapiens; identical to SEQ ID NO: 197008

SEQ ID NO: 305584 - RNA, 64 nt, Homo Sapiens; identical to SEQ ID NO: 197009

SEQ ID NO: 305585 - RNA, 64 nt, Homo Sapiens; identical to SEQ ID NO: 197010

SEQ ID NO: 305586 - RNA, 64 nt, Homo Sapiens; identical to SEQ ID NO: 197011

SEQ ID NO: 305587 - RNA, 64 nt, Homo Sapiens; identical to SEQ ID NO: 197012

SEQ ID NO: 305588 - RNA, 64 nt, Homo Sapiens; identical to SEQ ID NO: 197013

SEQ ID NO: 305589 - RNA, 64 nt, Homo Sapiens; identical to SEQ ID NO: 197014

SEQ ID NO: 305590 - RNA, 64 nt, Homo Sapiens; identical to SEQ ID NO: 197015

SEQ ID NO: 305591 - RNA, 64 nt, Homo Sapiens; identical to SEQ ID NO: 197016

SEQ ID NO: 305592 - RNA, 64 nt, Homo Sapiens; identical to SEQ ID NO: 197017

SEQ ID NO: 305593 - RNA, 64 nt, Homo Sapiens; identical to SEQ ID NO: 197018

SEQ ID NO: 305594 - RNA, 64 nt, Homo Sapiens; identical to SEQ ID NO: 197019

SEQ ID NO: 305595 - RNA, 64 nt, Homo Sapiens; identical to SEQ ID NO: 197020

SEQ ID NO: 305596 - RNA, 64 nt, Homo Sapiens; identical to SEQ ID NO: 197021

SEQ ID NO: 305597 - RNA, 64 nt, Homo Sapiens; identical to SEQ ID NO: 197022

SEQ ID NO: 305598 - RNA, 64 nt, Homo Sapiens; identical to SEQ ID NO: 197023

SEQ ID NO: 305599 - RNA, 64 nt, Homo Sapiens; identical to SEQ ID NO: 197024

SEQ ID NO: 305600 - RNA, 64 nt, Homo Sapiens; identical to SEQ ID NO: 197025

SEQ ID NO: 305601 - RNA, 64 nt, Homo Sapiens; identical to SEQ ID NO: 197026

SEQ ID NO: 305602 - RNA, 64 nt, Homo Sapiens; identical to SEQ ID NO: 197027

SEQ ID NO: 305603 - RNA, 64 nt, Homo Sapiens; identical to SEQ ID NO: 197028

SEQ ID NO: 305604 - RNA, 64 nt, Homo Sapiens; identical to SEQ ID NO: 197029

SEQ ID NO: 305605 - RNA, 64 nt, Homo Sapiens; identical to SEQ ID NO: 197030

SEQ ID NO: 305606 - RNA, 64 nt, Homo Sapiens; identical to SEQ ID NO: 197031

SEQ ID NO: 305607 - RNA, 64 nt, Homo Sapiens; identical to SEQ ID NO: 107827

SEQ ID NO: 305608 - RNA, 64 nt, Homo Sapiens; identical to SEQ ID NO: 107828

SEQ ID NO: 305609 - RNA, 64 nt, Homo Sapiens; identical to SEQ ID NO: 107829

SEQ ID NO: 305610 - RNA, 64 nt, Homo Sapiens; identical to SEQ ID NO: 107830

SEQ ID NO: 305611 - RNA, 64 nt, Homo Sapiens; identical to SEQ ID NO: 107831

SEQ ID NO: 305612 - RNA, 64 nt, Homo Sapiens; identical to SEQ ID NO: 107832

SEQ ID NO: 305613 - RNA, 64 nt, Homo Sapiens; identical to SEQ ID NO: 107833

SEQ ID NO: 305614 - RNA, 64 nt, Homo Sapiens; identical to SEQ ID NO: 107834

SEQ ID NO: 305615 - RNA, 64 nt, Homo Sapiens; identical to SEQ ID NO: 107835

SEQ ID NO: 305616 - RNA, 64 nt, Homo Sapiens; identical to SEQ ID NO: 107836

SEQ ID NO: 305617 - RNA, 64 nt, Homo Sapiens; identical to SEQ ID NO: 107837

SEQ ID NO: 305618 - RNA, 64 nt, Homo Sapiens; identical to SEQ ID NO: 107838

SEQ ID NO: 305619 - RNA, 64 nt, Homo Sapiens; identical to SEQ ID NO: 107839

SEQ ID NO: 305620 - RNA, 64 nt, Homo Sapiens; identical to SEQ ID NO: 107840

SEQ ID NO: 305621 - RNA, 64 nt, Homo Sapiens
uccaauuuuccuaaguuucuuugaggguuccaugggagcaaauaucuaaauaauggccugguag

SEQ ID NO: 305622 - RNA, 64 nt, Homo Sapiens
ccacugacagccuccaccuugagcacuauucuaaggagcaaauaccuuagcucccuugagcugg

SEQ ID NO: 305623 - RNA, 64 nt, Homo Sapiens
gguuggcccuccucaaggucagccuucagauuugggagcaaacuucagagaaggcagaggaaga

SEQ ID NO: 305624 - RNA, 64 nt, Homo Sapiens
cccaggauaaguagaaauaugaucacagagcaacggagcaaaggcuuucgggagugugaggcug

SEQ ID NO: 305625 - RNA, 64 nt, Homo Sapiens
caaaggcuuucgggagugugaggcugcaucugcuggagcaaagggaaaccgugggcuuuuccgg

SEQ ID NO: 305626 - RNA, 64 nt, Homo Sapiens
cauguucacacugaccuaauaggucugaccauugggagcaaagcucuucagaaggacccauguc

SEQ ID NO: 305627 - RNA, 64 nt, Homo Sapiens
gcuggcaccuauucuggguuugguguggcccacuggagcaaacucagagccugagcugcugcug

SEQ ID NO: 305628 - RNA, 64 nt, Homo Sapiens
uccugccaugagcuucccagagacagaagagacuggagcaaagucggaaacacagagaagcacg

SEQ ID NO: 305629 - RNA, 64 nt, Homo Sapiens
acgcacuacagagcuacgacacagggaaaccuuaggagcaaauaaaccgugcuuucauguuuuu

SEQ ID NO: 305630 - RNA, 64 nt, Homo Sapiens
uaaccaauccugccagaccuguuuggggcaguggggagcaaaccuagauaaggaccuguuuggg

SEQ ID NO: 305631 - RNA, 64 nt, Homo Sapiens
gcaaaccuagauaaggaccuguuuggggcagcagggagcaaaaucuccuuuaacaaccaagcag

SEQ ID NO: 305632 - RNA, 64 nt, Homo Sapiens
aagcuuuaaaaacaagauugcaucauaacccccaggagcaaagcaaccuggaggcugcauaucc

SEQ ID NO: 305633 - RNA, 64 nt, Homo Sapiens
uuuuguugguuauguggaaaucacaaacuccagaggagcaaagggguuuuucaaugucuuuugc

SEQ ID NO: 305634 - RNA, 64 nt, Homo Sapiens
uaguagauagucgaauaauacaggucuagccuuaggagcaaauguagaauucuugccgccaucc

SEQ ID NO: 305635 - RNA, 64 nt, Homo Sapiens
aauuugauuauuuuuucauuuuugcuucucaaauggagcaaacauguuucugucugguagagag

SEQ ID NO: 305636 - RNA, 64 nt, Homo Sapiens
gucuuaacuucugucuuugauugcuuaaggccggggagcaaagucaggaaugauuucuccuuaa

SEQ ID NO: 305637 - RNA, 64 nt, Homo Sapiens
ccgccuucagagggcagacaggcagucuugacgaggagcaaaccgagucugcgguucucgccug

SEQ ID NO: 305638 - RNA, 64 nt, Homo Sapiens; identical to SEQ ID NO: 165842

SEQ ID NO: 305639 - RNA, 64 nt, Homo Sapiens; identical to SEQ ID NO: 165843

SEQ ID NO: 305640 - RNA, 64 nt, Homo Sapiens
augcccuauuggcagugcucgcagacugggugaggagaccuagcauuaaccuaagacacagaag

SEQ ID NO: 305641 - RNA, 64 nt, Homo Sapiens
cucuguaaaaauaauccuaguagggugaaauuuugagaccuagaaccaaaaagaaccaaaucca

SEQ ID NO: 305642 - RNA, 64 nt, Homo Sapiens
accacauuuguucacaggaguggcuggaauuuauagaggcuacaaguucuggugccuuaacgca

SEQ ID NO: 305643 - RNA, 64 nt, Homo Sapiens
uuaaucuuuagugcaugguuuauauaucuuuuacagaggcuauuaagaguuuucagagauuuca

SEQ ID NO: 305644 - RNA, 64 nt, Homo Sapiens
uuuaugugucgucuuccggggacuuucaugcgggagaggcuacucccccaccacugagaagcua

SEQ ID NO: 305645 - RNA, 64 nt, Homo Sapiens
auauccagcuuugggggaccuagaagccuucagaagaggcuaaaaacaagguacccagaauuuu

SEQ ID NO: 305646 - RNA, 64 nt, Homo Sapiens; identical to SEQ ID NO: 209353

SEQ ID NO: 305647 - RNA, 64 nt, Homo Sapiens; identical to SEQ ID NO: 209354

SEQ ID NO: 305648 - RNA, 64 nt, Homo Sapiens; identical to SEQ ID NO: 209355

SEQ ID NO: 305649 - RNA, 64 nt, Homo Sapiens; identical to SEQ ID NO: 209356

SEQ ID NO: 305650 - RNA, 64 nt, Homo Sapiens; identical to SEQ ID NO: 209357

SEQ ID NO: 305651 - RNA, 64 nt, Homo Sapiens; identical to SEQ ID NO: 209358

SEQ ID NO: 305652 - RNA, 64 nt, Homo Sapiens; identical to SEQ ID NO: 209359

SEQ ID NO: 305653 - RNA, 64 nt, Homo Sapiens; identical to SEQ ID NO: 209360

SEQ ID NO: 305654 - RNA, 64 nt, Homo Sapiens; identical to SEQ ID NO: 209361

SEQ ID NO: 305655 - RNA, 64 nt, Homo Sapiens; identical to SEQ ID NO: 209362

SEQ ID NO: 305656 - RNA, 64 nt, Homo Sapiens; identical to SEQ ID NO: 209363

SEQ ID NO: 305657 - RNA, 64 nt, Homo Sapiens; identical to SEQ ID NO: 209364

SEQ ID NO: 305658 - RNA, 64 nt, Homo Sapiens
ucuacuacugagacacuucagcaucaaccucuucaugauaaauauaaacuauucuugucacuug

SEQ ID NO: 305659 - RNA, 64 nt, Homo Sapiens
auucuugucacuuggcaucaugagcaucaaucuuaugauaaacucugaugaggcugccauauuu

SEQ ID NO: 305660 - RNA, 64 nt, Homo Sapiens
gaacaaagggccaaauagaguuuuuauauuuguuaugauaaaaggaaguagaugugaaaaagcc

SEQ ID NO: 305661 - RNA, 64 nt, Homo Sapiens
uugucuuuaucucaaguauauaaaguuuugccccaugauaaaauaaguaacauauaaauuaaua

SEQ ID NO: 305662 - RNA, 64 nt, Homo Sapiens
uguugugacaguaauaaugguuauaauaauaaaaaugauaaaauugccaucauucuauuuuuau

SEQ ID NO: 305663 - RNA, 64 nt, Homo Sapiens
ggguaauugcugaggugugcgguuuaucuuugagaugauaaagcuaaauuauagucuuuugcca

SEQ ID NO: 305664 - RNA, 64 nt, Homo Sapiens
gaugcuaacuauuuuucaagcaagcuacagagaaaugauaaauguuuuuuguuuuauuauuuau

SEQ ID NO: 305665 - RNA, 64 nt, Homo Sapiens
acacacaaaaaauaccuaaauuuuggaugagaaaaugauaaaauaugcuaaguucuaggcugga

SEQ ID NO: 305666 - RNA, 64 nt, Homo Sapiens
uguguuggucguaagccacuuacaaaacuuuaugaugauaaauuauauguuugacuuguuaacc

SEQ ID NO: 305667 - RNA, 64 nt, Homo Sapiens
cuuaaauauuucuaaaauauguaugugaauguuuaugauaaacggccacuuuacagagauaaau

SEQ ID NO: 305668 - RNA, 64 nt, Homo Sapiens
uuuucuacuuuuccauuaaaacauuggcaccucaaugauaaagaaauuuaagguauaaaauuaa

SEQ ID NO: 305669 - RNA, 64 nt, Homo Sapiens
gucugauucugagauuucuaauuguguugugaaaaugauaaaugcagcaaaucuagcuuucagu

SEQ ID NO: 305670 - RNA, 64 nt, Homo Sapiens
aaauauauaucuuuauaaaguaauauucaggaugaugauaaaaauuguuuauauuguuaugaua

SEQ ID NO: 305671 - RNA, 64 nt, Homo Sapiens
auucaggaugaugauaaaaauuguuuauauuguuaugauaaaaaugacaguauaauguugccca

SEQ ID NO: 305672 - RNA, 64 nt, Homo Sapiens
agaauuagacaucaagucauuaguccucagguauaugauaaaaauauagcaggguuguagaaug

SEQ ID NO: 305673 - RNA, 64 nt, Homo Sapiens
cucucaacacagaaggaauauccaauauccauucaugauaaaacagaaaaagcauuugacaaaa

SEQ ID NO: 305674 - RNA, 64 nt, Homo Sapiens
cuuuaaaaaaacauauuaaucauugacuacaucuaugauaaaagugcuuauuuugguuuacuaa

SEQ ID NO: 305675 - RNA, 64 nt, Homo Sapiens
auuuugguuuacuaagauaaugcaguugguggaaaugauaaacguuuuaaguguuaacauccuu

SEQ ID NO: 305676 - RNA, 64 nt, Homo Sapiens
uucagcuggguuuugaggaauauaagagcuuucaaugauaaagguuuguuguaguugucuuaug

SEQ ID NO: 305677 - RNA, 64 nt, Homo Sapiens
auuuuggaagcugugaagauaaucaguuaaauaaaugauaaauauuugcuucuggcucacuuuc

SEQ ID NO: 305678 - RNA, 64 nt, Homo Sapiens
ugcgaaccguggcacacgcuugugacaaaacagaaugauaaagcuauuaacuauauaagagagu

SEQ ID NO: 305679 - RNA, 64 nt, Homo Sapiens
gagccugcuuuuuucccuaauuaugagaaucaaaaugauaaaaauaaauacauugauugguaaa

SEQ ID NO: 305680 - RNA, 64 nt, Homo Sapiens
caagauugguaaauaaauacuaaucguuuaugccaugauaaauagcugugaaauaguaaaauua

SEQ ID NO: 305681 - RNA, 64 nt, Homo Sapiens
cuuuaccaauuguuacuuucaaugugaggaaugaaugauaaauuaagagaaaaaaauaucagga

SEQ ID NO: 305682 - RNA, 64 nt, Homo Sapiens
caacagugaggcauaucauguguuuuuauuaaaaaugauaaagauguguuucuucucaucuaaa

SEQ ID NO: 305683 - RNA, 64 nt, Homo Sapiens
auaguauagaaugaacugucuagauggaugaauuaugauaaaggcuuaggacuucaaaagguga

SEQ ID NO: 305684 - RNA, 64 nt, Homo Sapiens
ggagugaaguaauugacagggaaaauauagaccuaugauaaauaaccaggaagcauugcuuuug

SEQ ID NO: 305685 - RNA, 64 nt, Homo Sapiens
gccuuuaacuuaagauggccaaaccauauauuuuaugauaaagguucaauuugaguaaaauuua

SEQ ID NO: 305686 - RNA, 64 nt, Homo Sapiens
aucaauauaguuuaguauuuaccacaaacuaagaaugauaaauuugcguguacuguuucuaaaa

SEQ ID NO: 305687 - RNA, 64 nt, Homo Sapiens
auauaaugaguaaaaauuauuacgcuguuaugcuaugauaaauggggccuuccuuuuuggaaug

SEQ ID NO: 305688 - RNA, 64 nt, Homo Sapiens
auuuguguauggauuagaaucuucuaaaaccauuaugauaaaaugaauauagaaauaauauuca

SEQ ID NO: 305689 - RNA, 64 nt, Homo Sapiens
ucacuggguuauaagaaaaauuuuagcccuauagaugauaaauaggagcucuguccuucaaacc

SEQ ID NO: 305690 - RNA, 64 nt, Homo Sapiens
cacuuucagauuguucugcauuguucuuguuucuaugauaaaaggaaagagcaaaucauuaaug

SEQ ID NO: 305691 - RNA, 64 nt, Homo Sapiens
aaauuacugcuuuccaucuagcaaaaagcaauucaugauaaauacuguugcacauguuuaauug

SEQ ID NO: 305692 - RNA, 64 nt, Homo Sapiens
ugacacuaagcuauuaauacuguagauuauuuuaaugauaaaaauaaauuaguauucugauauu

SEQ ID NO: 305693 - RNA, 64 nt, Homo Sapiens
uucuguugugcauucaauuccaaugauaaagaaaaugauaaauuugcuuucuuucccuccccuc

SEQ ID NO: 305694 - RNA, 64 nt, Homo Sapiens
aaaugauaaauuuucuguuguucccuccccuccaaugauaaagacccaccucugcuugcuuucu

SEQ ID NO: 305695 - RNA, 64 nt, Homo Sapiens
gaagggaaaaaagagaaaaaaagccaaauuuaaauuauaagaaaacccaaacuuuuagaguaaa

SEQ ID NO: 305696 - RNA, 64 nt, Homo Sapiens
ggcagaaugcagaacaccuaaauauguuucagcauuauaagaaauuguuuuaacuucuaaagaa

SEQ ID NO: 305697 - RNA, 64 nt, Homo Sapiens
cucuuguaaccaaccauccaaaguauguuugauuuuauaagaagugagagaaaacacaaaucua

SEQ ID NO: 305698 - RNA, 64 nt, Homo Sapiens
cugcaauaauaucucauaauagagcaguaggaaauuauaagacuugauucauugaauuuaaaau

SEQ ID NO: 305699 - RNA, 64 nt, Homo Sapiens
uaaguugaacaauuccccagucugaguucauagguuauaagaggcucagcccacccccaggguu

SEQ ID NO: 305700 - RNA, 64 nt, Homo Sapiens
agaggucugacaccuuuuuuuugaagugucuuauuuauaagaucuaaaacuguuuuugcuacuu

SEQ ID NO: 305701 - RNA, 64 nt, Homo Sapiens
aggaaauuaaagucuuccaugaauggaagcaaaauuauaagaagucagcuuaaaauugguaauu

SEQ ID NO: 305702 - RNA, 64 nt, Homo Sapiens
uaaucuuaauuuuguauuuuuugagcugaguuccuuauaagaaucuugucauauaaaccugaug

SEQ ID NO: 305703 - RNA, 64 nt, Homo Sapiens
gauuaugaaagggaauuacuuuuauaagagggaauuauaagagguaauguaauuauaacaggga

SEQ ID NO: 305704 - RNA, 64 nt, Homo Sapiens
gaauuauaagagggauuaugauuauaacagggauuuauaagaggaaaguuguucuuauaaugua

SEQ ID NO: 305705 - RNA, 64 nt, Homo Sapiens
gcagggaggcaauguuucugaagacauuuucuguuuauaagagaguagaaagaaacacgaguuu

SEQ ID NO: 305706 - RNA, 64 nt, Homo Sapiens
auuuguaggugcuuuuauguauaacuuuaaugauuuauaagaugcuaaaugaauuguuuuugua

SEQ ID NO: 305707 - RNA, 64 nt, Homo Sapiens
gaaaaugcaucacaugaugaaaaauuauaguagcuuauaagagggcauauacagugaagaguaa

SEQ ID NO: 305708 - RNA, 64 nt, Homo Sapiens
uuuuuucugguuuuuguuuuacuuucaaccuagguuauaagacuguuauucuauagcuccaacu

SEQ ID NO: 305709 - RNA, 64 nt, Homo Sapiens
cugacuguaauggccucaagauagagagauacccuuauaagaguaaagaauuaagaugauaguc

SEQ ID NO: 305710 - RNA, 64 nt, Homo Sapiens
cugcaacacuggaaaugaguucuggguaagugaguuauaagaguacaugcucuaguaacucugg

SEQ ID NO: 305711 - RNA, 64 nt, Homo Sapiens
uuucccauaccuuuuuuuuucuuacuauaaaauauuauaagauccauugauguccaaauaauac

SEQ ID NO: 305712 - RNA, 64 nt, Homo Sapiens
uuaaaagaacaguauuuuacaaaagguguagcuuuuauaagagugcagaaaagggaaggaugug

SEQ ID NO: 305713 - RNA, 64 nt, Homo Sapiens
uaguucuuuuaaugugacuaaaacucuugagcuguuauaagagauguguuucuuuaugguuuua

SEQ ID NO: 305714 - RNA, 64 nt, Homo Sapiens
aaugauucuucuucagaaaucaugguaguugaccuuauaagaaaaguggaaaccaggagguuau

SEQ ID NO: 305715 - RNA, 64 nt, Homo Sapiens
cgcaaugaaaacugacuugagauaaauagcacauuuauaagaacauaggacagguacaauuuug

SEQ ID NO: 305716 - RNA, 64 nt, Homo Sapiens
gaguaguuguugauuaaauuauuuucuuuugugauuauaagaaaacauuucacccaggcaggcc

SEQ ID NO: 305717 - RNA, 64 nt, Homo Sapiens
cagacacuugguuaguggcuuggaaugugucaaauuauaagagaaccauuagaauagucauacc

SEQ ID NO: 305718 - RNA, 64 nt, Homo Sapiens
aaaugauuagaaguaccuaauuuuccaaugcuucuuauaagacuguuuguuacuauguauguuu

SEQ ID NO: 305719 - RNA, 64 nt, Homo Sapiens
gcauuuuauuuauaucauuuuguauuuauuauuauuauaagacucaguacuuuauauuuauaaa

SEQ ID NO: 305720 - RNA, 64 nt, Homo Sapiens
agaagguagacuuucuaagcaaugccacuuuuguuuauaagacccguuaguuacaaaggaaacc

SEQ ID NO: 305721 - RNA, 64 nt, Homo Sapiens
aggacuccuaucgguauacaaauuccauuucuuuuuauaagaaaaacacauaaaccauuaucau

SEQ ID NO: 305722 - RNA, 64 nt, Homo Sapiens
ugguaaagcaaauuucacaggaaaauagacaaaauuauaagagauuccuggagacaacacaagg

SEQ ID NO: 305723 - RNA, 64 nt, Homo Sapiens
uaaaaauuguguuuacagauaaugcaugcaauacuuauaagacuauaaauguaaaaugcacaga

SEQ ID NO: 305724 - RNA, 64 nt, Homo Sapiens
agugauucacuggggcauuacgaagucaaacaacuuauaagacuuauuuuuaaaaggacuuuaa

SEQ ID NO: 305725 - RNA, 64 nt, Homo Sapiens
gcuuugucuuggccaauuacuucagcaaguacugagaacucauuuucuacccugccucgucuua

SEQ ID NO: 305726 - RNA, 64 nt, Homo Sapiens
gaacgauaaacagugaagucuccuucccuccuuuagaacucauuuucucuucccaaaaaguguu

SEQ ID NO: 305727 - RNA, 64 nt, Homo Sapiens
cuucuggcucccucuucuuucacauauuuuauuaagaacucaaaauggguuuuaugagauggau

SEQ ID NO: 305728 - RNA, 64 nt, Homo Sapiens
acuguggcugucuggaaagcuguccugccaugcaagaacucaucggagagauagccuguggccc

SEQ ID NO: 305729 - RNA, 64 nt, Homo Sapiens
ugcuauuugaagcagauguucaccaaugucagcaagaacucaaccugaauuuaaagguggcauu

SEQ ID NO: 305730 - RNA, 64 nt, Homo Sapiens
acucuuacagugauuauuuagauauuaaagacugagaacucacggcuuaaccccagucuugaug

SEQ ID NO: 305731 - RNA, 64 nt, Homo Sapiens
caucuaguucaacaucagagcauucauaccaaagagaacucaugaauguaaugaagaugggaag

SEQ ID NO: 305732 - RNA, 64 nt, Homo Sapiens
gcgugugucacugugcugggccuauuuuauuuauagaacucauuuaagcuguuuuuauuuuaau

SEQ ID NO: 305733 - RNA, 64 nt, Homo Sapiens
gugggcuaggguggucagaggagagggagcuuggagaacucacuccaagggccacgggaacuug

SEQ ID NO: 305734 - RNA, 64 nt, Homo Sapiens
gaaaacugucugggagauuccuuuuccagaucaaagaacucaaaccgaugcaguaucagcagcu

SEQ ID NO: 305735 - RNA, 64 nt, Homo Sapiens
cuuucaucagaagucagcucuaauuguucaccacagaacucauauaagacagaaacccuauggg

SEQ ID NO: 305736 - RNA, 64 nt, Homo Sapiens
gagagcuagaaaaccuggaguguggcauuagaauagaacucauaucuuuuaaauauauaggaac

SEQ ID NO: 305737 - RNA, 64 nt, Homo Sapiens
gucuccuaggauccaggccucugggcuucugccaagaacucaggguggcccuaugacuuggagg

SEQ ID NO: 305738 - RNA, 64 nt, Homo Sapiens
ccuggagugagggggcugaagucagaccaaaggaagaacucagaaaugucuuguuuauuugugu

SEQ ID NO: 305739 - RNA, 64 nt, Homo Sapiens
aaacugauguaaggcaauuagacauugucacaucagaacucauguuguggacccauuagcaagu

SEQ ID NO: 305740 - RNA, 64 nt, Homo Sapiens
uuuuaccuucaggggugggaauuuuuuauuuuccagaacucauugaauuuugaauuguuauucu

SEQ ID NO: 305741 - RNA, 64 nt, Homo Sapiens
acugguucucagccuccuccuuaucaaaccauuaagaacucauuuuaauauuuaaaaacccaaa

SEQ ID NO: 305742 - RNA, 64 nt, Homo Sapiens
gcugguuuguaaauggugagaggagcggaggcugagaacucagugaucuugucuccuaguccug

SEQ ID NO: 305743 - RNA, 64 nt, Homo Sapiens
caaacugucucucagaccacagugcaaucaaacuagaacucaggauuaagaaacucacucaaaa

SEQ ID NO: 305744 - RNA, 64 nt, Homo Sapiens
aacuagcagaaggcaagaaauaacuaaaaucagcagaacucaaggaaauagagacacaaaaaaa

SEQ ID NO: 305745 - RNA, 64 nt, Homo Sapiens
agauaauuaggcaccgaccuugggcugcuguuagagaacucaggcagcagcgccagugacacgg

SEQ ID NO: 305746 - RNA, 64 nt, Homo Sapiens
gaaguggcugaaaaacuaaggcaguggcaaagguagaacucaggcagggguggagaaaaggcgu

SEQ ID NO: 305747 - RNA, 64 nt, Homo Sapiens
agcgcugggggugauuuuaggcagcaagaauuggagaacucacacugcgaaaagaaaaccuugg

SEQ ID NO: 305748 - RNA, 64 nt, Homo Sapiens
ccgcaaagaagcuaugugaauucaaggacaugaaagaacucauacuucacucauucccguuucc

SEQ ID NO: 305749 - RNA, 64 nt, Homo Sapiens
cuggagagaagaaacucuauugcaaagucaugaaagaacucacacuuugauuguuccaguacac

SEQ ID NO: 305750 - RNA, 64 nt, Homo Sapiens
cuggagagaaacuauaugaauucguaugcaugaaagaacucacuauuuuucuggcccaguuuau

SEQ ID NO: 305751 - RNA, 64 nt, Homo Sapiens
accucaaaauugaguuacugagcaucuggugcacagaacucaagacaguucuucuaugauucca

SEQ ID NO: 305752 - RNA, 64 nt, Homo Sapiens
uggugggaauauuuuaugauuuacauacuguuagagaacucaaaaaugauugccauuaucauca

SEQ ID NO: 305753 - RNA, 64 nt, Homo Sapiens
aaggcuggaguuauuauucaacucaaucucccagagaacucagaggcuacaguuucuacaggca

SEQ ID NO: 305754 - RNA, 64 nt, Homo Sapiens
gagucucagguccagguggagucuguagguugccagaacucaaaagucugaaaaacaucccaaa

SEQ ID NO: 305755 - RNA, 64 nt, Homo Sapiens
auaucuuuguuuuaaccaguacuucuaagagcauagaacucaaaugcuggggguagguggcuaa

SEQ ID NO: 305756 - RNA, 64 nt, Homo Sapiens
cgaacauaauggacgugaaguggggcagaaacccagaacucagcauucaaggaugcccaggaga

SEQ ID NO: 305757 - RNA, 57 nt, Homo Sapiens
uaaaaaggcugauaugaacaccuacuuacauucaagucacaacuccuaugacuggcu

SEQ ID NO: 305758 - RNA, 57 nt, Homo Sapiens
ggagacuuggaguuuauugugcaguccacauucaagaucuaccugggagacuaguua

SEQ ID NO: 305759 - RNA, 57 nt, Homo Sapiens
aggucugucacucuuguuacauuguguacauucaaaaggaagagagaaaauauauau

SEQ ID NO: 305760 - RNA, 57 nt, Homo Sapiens
acaugcaaaaggcucuccuaauacuccacauucaaacugaagaggaaaauugaaauc

SEQ ID NO: 305761 - RNA, 57 nt, Homo Sapiens
cguuuauguuucucaucuaacuucagaacauucaaaccacuauacuuugcuucaaac

SEQ ID NO: 305762 - RNA, 57 nt, Homo Sapiens
ucugauauacauugcuugaauuauaaaacauucaaaucaucuugcuuagucauguug

SEQ ID NO: 305763 - RNA, 57 nt, Homo Sapiens
uucguauagggugcagaguauagugagacauucaaaaauaggucauacaugaauguc

SEQ ID NO: 305764 - RNA, 57 nt, Homo Sapiens
cacacaucaagucuucaggaguaaugcacauucaaaauauuuuuuaaaauuuacuua

SEQ ID NO: 305765 - RNA, 57 nt, Homo Sapiens
guuuguguucuuuuacuguguccucucacauucaaguauuagcaacuugcaguauau

SEQ ID NO: 305766 - RNA, 57 nt, Homo Sapiens
auucuguuaaaaugcagaggugcuauaacauucaaagugucagauuccuugggagua

SEQ ID NO: 305767 - RNA, 57 nt, Homo Sapiens
uaaauaaauaaccaaaaauguauguaaacauucaaaugauuaucugaacaaaugaga

SEQ ID NO: 305768 - RNA, 57 nt, Homo Sapiens
uaugauguuuauuugaaugacuguugaacauucaaauuuguauuauuuggagaugaa

SEQ ID NO: 305769 - RNA, 57 nt, Homo Sapiens
agaacuagguagaaacagaggaugaaaacauucaagcuuaaugaaauagguuccagu

SEQ ID NO: 305770 - RNA, 57 nt, Homo Sapiens
ucaccugaaagagaaauggguugaggaacauucaaugaaaucugcuagaggaaaacu

SEQ ID NO: 305771 - RNA, 57 nt, Homo Sapiens
uuucaaagcgccagucauuugcagaauacauucaagggaacuugaugcucaguauuu

SEQ ID NO: 305772 - RNA, 57 nt, Homo Sapiens
augauuacaguuuucauuuuuuaauaaacauucaauacaguuaacaaaagaaaacau

SEQ ID NO: 305773 - RNA, 57 nt, Homo Sapiens
uuagguccuacuacauuguuccuccuaacauucaauuaagacccuuaaaaugaagaa

SEQ ID NO: 305774 - RNA, 64 nt, Homo Sapiens
guuguguguauucaaugugugggguuuggugaagaaaucugauuagccaguugcuaaaaaauug

SEQ ID NO: 305775 - RNA, 64 nt, Homo Sapiens
ccuugagaaccuugggucuggggcugugggccauaaaucugaagcuggauuuaggugguaauag

SEQ ID NO: 305776 - RNA, 64 nt, Homo Sapiens
cuuuuugagcacugacuugaauccagaagcuucaaaaucugaaucucuaauucaaaaaucugaa

SEQ ID NO: 305777 - RNA, 64 nt, Homo Sapiens
uccagaagcuucaaaaucugcaucucuaauucaaaaaucugaaagaaugauacuacaaguugag

SEQ ID NO: 305778 - RNA, 64 nt, Homo Sapiens
cagggugauagcucaaaguugcagguaccguucuaaaucugaaaccuuugcauaucugaacuug

SEQ ID NO: 305779 - RNA, 64 nt, Homo Sapiens
cuuauguaaggguugagcgaaacucuaaaaaucuaaaucugaugcgauuugaguuggugggcaa

SEQ ID NO: 305780 - RNA, 64 nt, Homo Sapiens
uuauuucugguuuugaaguaaucgaacaaauugaaaaucugaagaccgaugcugcaagcagacc

SEQ ID NO: 305781 - RNA, 64 nt, Homo Sapiens
gucaucucaucacucaucaaagagagacuggucuaaaucugauaaggauguccagagcucuuua

SEQ ID NO: 305782 - RNA, 64 nt, Homo Sapiens
uagccaguccaggaguccaaguagaucucgaaguaaaucugaaaccaaaucaagacacagaaca

SEQ ID NO: 305783 - RNA, 64 nt, Homo Sapiens
aauauuugcauuauacuuaccaguugggcaucccaaaucugaaaucugaaauguuccaugagca

SEQ ID NO: 305784 - RNA, 64 nt, Homo Sapiens
gcauuauacuuaccaguugggcaucccaaaucugaaaucugaaauguuccaugagcauuuccuu

SEQ ID NO: 305785 - RNA, 64 nt, Homo Sapiens
cauggauuaauggggcuuacccuuguugcacucgaaaucugagguguaucuagcccugccacua

SEQ ID NO: 305786 - RNA, 64 nt, Homo Sapiens
uuaguucuagauauguacuucaugguuaaauucuaaaucugaaaaugcuagugggagauaucaa

SEQ ID NO: 305787 - RNA, 64 nt, Homo Sapiens
uauguuaugcugugaauuauauaugguauguaacaaaucugaaucaugucaacuaauagcuuuu

SEQ ID NO: 305788 - RNA, 64 nt, Homo Sapiens
uguaguuuuuauuagcauguuucacuaaaggcaaaaaucugauucaucuggcuuuuuaggcacc

SEQ ID NO: 305789 - RNA, 64 nt, Homo Sapiens
cacaacaaaagaaacaucagaaguuuauaaaaauaaaucugacuauaugcauccucauuuauuc

SEQ ID NO: 305790 - RNA, 64 nt, Homo Sapiens
aaagaccauugcaggcaauggaauugugccagagaaaucugauuucuaguacaaaaggaauacu

SEQ ID NO: 305791 - RNA, 64 nt, Homo Sapiens
aagaaaugaauauccaguauaauagguaauguggaaaucugaagcucaaaauuuucaguaggca

SEQ ID NO: 305792 - RNA, 64 nt, Homo Sapiens
agacugaaacaauugggagaggcguucauaggcaaaaucugacacuuuauagcuacaaagucag

SEQ ID NO: 305793 - RNA, 64 nt, Homo Sapiens
uuuccacuauggucgguuucaggaauuucaaaagaaaucugacgucaaugcaauuauccauuau

SEQ ID NO: 305794 - RNA, 63 nt, Homo Sapiens
auaauucacuguaaugauguaauucuugaauaauaaaucugacaaaauauuaguuguguucaa

SEQ ID NO: 305795 - RNA, 64 nt, Homo Sapiens
caguaauucucuuacauccuagucuuuaaacccuaaaucugaguauaccuuccuauuucucaau

SEQ ID NO: 305796 - RNA, 64 nt, Homo Sapiens
caguaauucucuaaaaauccagucuuuaagcccuaaaucugaguauaccuuccuauuucucaau

SEQ ID NO: 305797 - RNA, 64 nt, Homo Sapiens
ccuggggggaaguuuguuuuaaaaugaucuggauaaaucugagaaaugggguaucuggaaaagg

SEQ ID NO: 305798 - RNA, 64 nt, Homo Sapiens
uauuuuacuauuuguuucuagggaaagugcaaucaaaucugaauaauaauuuaucaaaauaaga

SEQ ID NO: 305799 - RNA, 64 nt, Homo Sapiens
uugacaaagaaaagaaaaucaauguuaaaccauuaaaucugagcacuguuagacuugauuaauc

SEQ ID NO: 305800 - RNA, 64 nt, Homo Sapiens
ugacuaaaguuauaaauacaauauuuauaucuauaaaucugaaguuuaacaugauuaauuuaaa

SEQ ID NO: 305801 - RNA, 64 nt, Homo Sapiens
auuaucaaaggaaaaaguauuugcugaggugaaaaaaucugauguuugaggaaguuuuuauuuu

SEQ ID NO: 305802 - RNA, 64 nt, Homo Sapiens
agagacagggaggaaguuuuuauuuuuauaaacaaaaucugauguucagaggccccguuucuua

SEQ ID NO: 305803 - RNA, 64 nt, Homo Sapiens
uuugcaauguauuuagcuacagauguuuuguauaaaaucugaauuuuuuuauaaagucuaagca

SEQ ID NO: 305804 - RNA, 64 nt, Homo Sapiens
uaaaaguugaaaagccaaagaauagcagagagccaaaucugaccacagggaaagcauuuaggag

SEQ ID NO: 305805 - RNA, 64 nt, Homo Sapiens
ggaaaggggggaaaagaguaacuuuacaguggagaaaucugacagacaccagcucagccaggug

SEQ ID NO: 305806 - RNA, 64 nt, Homo Sapiens
uucucaaaacuaucaaggccauaaaaaacaaggaaaaucugagacauggucacagccaagagga

SEQ ID NO: 305807 - RNA, 64 nt, Homo Sapiens
aaaagaaaaaaaggucauuugguagaaacuagggaaaucugaauacaguguggacuucaguuaa

SEQ ID NO: 305808 - RNA, 64 nt, Homo Sapiens
ucccuuccuuaaaguacucuaaaccuuuaaaaaaaaaucugauuuaugcagcagagaugggaca

SEQ ID NO: 305809 - RNA, 64 nt, Homo Sapiens
gcaaguaaguaucauaguauuaagaaauuugccuaaaucugaguugugccuuucuuuacucaca

SEQ ID NO: 305810 - RNA, 64 nt, Homo Sapiens
aauucaaagcaugccucugccaaauguuuucugaaaaucugaguuuauagagaaaggguuuugu

SEQ ID NO: 305811 - RNA, 64 nt, Homo Sapiens
gccuucucauuuaauucugauacauucuguucuuaaaucugaauaaaugugccuaauccugugu

SEQ ID NO: 305812 - RNA, 64 nt, Homo Sapiens
ccauaaaaguaauuauacuggugagaaauccuagaaaucugaagagugagauaaagccuuuaaa

SEQ ID NO: 305813 - RNA, 64 nt, Homo Sapiens
uucagauauacuaaaucagagugcuaaguauagaaaaucugaaacuaaaguugguagaaaaguu

SEQ ID NO: 305814 - RNA, 64 nt, Homo Sapiens
cuucucugugacugugaagccugcuguucccugaaaaucugauaauggagcaguggagguuuuu

SEQ ID NO: 305815 - RNA, 64 nt, Homo Sapiens
uuuagccaacucccauuccaacuaggcuuuggcuaaaucugacaauuuuauauauagcuuaaaa

SEQ ID NO: 305816 - RNA, 64 nt, Homo Sapiens
aauucucaguaugggguuucccucuggaaaaagaaaaucugaagacauuacaguugccuauugc

SEQ ID NO: 305817 - RNA, 64 nt, Homo Sapiens
cauuaaagaaagcacuaaggaugaugggagcuccaaaucugauaucagauaauuuagauugugg

SEQ ID NO: 305818 - RNA, 64 nt, Homo Sapiens; identical to SEQ ID NO: 50550

SEQ ID NO: 305819 - RNA, 64 nt, Homo Sapiens; identical to SEQ ID NO: 50551

SEQ ID NO: 305820 - RNA, 64 nt, Homo Sapiens; identical to SEQ ID NO: 50552

SEQ ID NO: 305821 - RNA, 64 nt, Homo Sapiens; identical to SEQ ID NO: 50553

SEQ ID NO: 305822 - RNA, 64 nt, Homo Sapiens; identical to SEQ ID NO: 50554

SEQ ID NO: 305823 - RNA, 64 nt, Homo Sapiens; identical to SEQ ID NO: 50555

SEQ ID NO: 305824 - RNA, 64 nt, Homo Sapiens; identical to SEQ ID NO: 194965

SEQ ID NO: 305825 - RNA, 64 nt, Homo Sapiens; identical to SEQ ID NO: 194966

SEQ ID NO: 305826 - RNA, 64 nt, Homo Sapiens; identical to SEQ ID NO: 194967

SEQ ID NO: 305827 - RNA, 64 nt, Homo Sapiens; identical to SEQ ID NO: 194968

SEQ ID NO: 305828 - RNA, 64 nt, Homo Sapiens; identical to SEQ ID NO: 194969

SEQ ID NO: 305829 - RNA, 64 nt, Homo Sapiens; identical to SEQ ID NO: 194970

SEQ ID NO: 305830 - RNA, 64 nt, Homo Sapiens; identical to SEQ ID NO: 194971

SEQ ID NO: 305831 - RNA, 64 nt, Homo Sapiens; identical to SEQ ID NO: 194972

SEQ ID NO: 305832 - RNA, 64 nt, Homo Sapiens; identical to SEQ ID NO: 194973

SEQ ID NO: 305833 - RNA, 64 nt, Homo Sapiens; identical to SEQ ID NO: 194974

SEQ ID NO: 305834 - RNA, 64 nt, Homo Sapiens; identical to SEQ ID NO: 194975

SEQ ID NO: 305835 - RNA, 64 nt, Homo Sapiens; identical to SEQ ID NO: 194976

SEQ ID NO: 305836 - RNA, 64 nt, Homo Sapiens; identical to SEQ ID NO: 194977

SEQ ID NO: 305837 - RNA, 64 nt, Homo Sapiens; identical to SEQ ID NO: 194978

SEQ ID NO: 305838 - RNA, 64 nt, Homo Sapiens; identical to SEQ ID NO: 194979

SEQ ID NO: 305839 - RNA, 64 nt, Homo Sapiens; identical to SEQ ID NO: 194980

SEQ ID NO: 305840 - RNA, 64 nt, Homo Sapiens; identical to SEQ ID NO: 194981

SEQ ID NO: 305841 - RNA, 64 nt, Homo Sapiens; identical to SEQ ID NO: 194982

SEQ ID NO: 305842 - RNA, 64 nt, Homo Sapiens
acuacacauuggcaaauagcgugggauagauuuguuucuuaaugggugugaccaauccuguuuu

SEQ ID NO: 305843 - RNA, 64 nt, Homo Sapiens
aucuuuuuuccuaguuuuucuaauacuaauguuauuucuuaaaauucagugagauauaggauaa

SEQ ID NO: 305844 - RNA, 64 nt, Homo Sapiens
uuuuuacaguacauaugucuugacugagcuguccuuucuuaauacaaaagcguguauaauuuuc

SEQ ID NO: 305845 - RNA, 64 nt, Homo Sapiens
agcuguccuuucuuaauacaaaagcguguauaauuuucuuaacuuguacaguugguaaacuuuu

SEQ ID NO: 305846 - RNA, 64 nt, Homo Sapiens
agagcuaaguaaguaaaguuuuauaacuguuagguuucuuaaugaucauauuuugcaguuuuag

SEQ ID NO: 305847 - RNA, 64 nt, Homo Sapiens
aacauccuuauacuuucuauuuuaaguauaucuguuucuuaaguaaacaacuuagauauuuucc

SEQ ID NO: 305848 - RNA, 64 nt, Homo Sapiens
gcaagaaccuaacuaacgugaugauaugaagaguuuucuuaagaccugucgucaaacuuaaaag

SEQ ID NO: 305849 - RNA, 64 nt, Homo Sapiens
ucaggugcaguaugauauuuccuaaucuuuccuauuucuuaacaaaagauuuuaaaguacuucu

SEQ ID NO: 305850 - RNA, 64 nt, Homo Sapiens
cagcuccucuuuaaacuccuccucucuugaugaauuucuuaaggcugaaggaaugaagagagug

SEQ ID NO: 305851 - RNA, 64 nt, Homo Sapiens
acagacaguccauaucugugaggccagcaaauauuuucuuaaacucauggggagacagcagauu

SEQ ID NO: 305852 - RNA, 64 nt, Homo Sapiens
acaggcucaguguaacuguauauccauucuaggcuuucuuaauaaaucuugaggcuaugggaua

SEQ ID NO: 305853 - RNA, 64 nt, Homo Sapiens
uauugaaacguugaaaucuaaagcaaauuugcaauuucuuaagauuucuaaaauuuaccagaac

SEQ ID NO: 305854 - RNA, 64 nt, Homo Sapiens
agucaguuugagucucacaagaagguaaguagaguuucuuaauagucacaacuuaauuugaacc

SEQ ID NO: 305855 - RNA, 64 nt, Homo Sapiens
guuugcuuuaauauggcuuguaauucuugacauuuuucuuaaaauuaaaacgaauuuuuauuuu

SEQ ID NO: 305856 - RNA, 64 nt, Homo Sapiens
caauaguguauaaauaucauguaaaugugauggauuucuuaaucauauuuauuucauauuaauc

SEQ ID NO: 305857 - RNA, 64 nt, Homo Sapiens
uuuagucagagggcuagaggugcagauuucauauuuucuuaaugaaaauauuuuccuaauacac

SEQ ID NO: 305858 - RNA, 64 nt, Homo Sapiens
ugucuagcugucggaaaagguuaaaauuacacuuuuucuuaaccagaaaccaaggguauguguu

SEQ ID NO: 305859 - RNA, 64 nt, Homo Sapiens
cguauuuucugauguggcuuggcaaaugccuuaguuucuuaaaaagacgauuaggugccuaacu

SEQ ID NO: 305860 - RNA, 64 nt, Homo Sapiens
ugacuaguggucuugaugcucgaccaaccugcccuuucuuaauaaguucuuccuauuccauucu

SEQ ID NO: 305861 - RNA, 64 nt, Homo Sapiens
cugccuuccucucucaguaccuauuucugcaucauuucuuaaggcuuggaaaaaucuugcuugg

SEQ ID NO: 305862 - RNA, 64 nt, Homo Sapiens
uccuuuuugucccaucucuaggaaagaagacauuuuucuuaauauggcugcuuuugaaugggga

SEQ ID NO: 305863 - RNA, 64 nt, Homo Sapiens
aaaauuacuuuuuacuuuaaucugguacuucauuuuucuuaacuaaaauauauguuacaguuua

SEQ ID NO: 305864 - RNA, 64 nt, Homo Sapiens
gcccuuaauauuuugacauaaccucauagucauuuuucuuaauuauacuuaaacugggauuaaa

SEQ ID NO: 305865 - RNA, 64 nt, Homo Sapiens
acaagaacauuuguuuguuugucuucugauguuuuuucuuaaaauaguaauuucuccuacuuuu

SEQ ID NO: 305866 - RNA, 64 nt, Homo Sapiens
ggaacuaagacauuucuaauuuauugcuuauuacuuucuuaauuuuacaggauaauuauaagca

SEQ ID NO: 305867 - RNA, 64 nt, Homo Sapiens
agcuaacagggagagguuacacaauauuuuacaguuucuuaaacauaauuuaaugcaucaccuu

SEQ ID NO: 305868 - RNA, 64 nt, Homo Sapiens
auucgaguauuuuaauguuauaccugccauuuuuuuucuuaaagcauauucuuugcaucuaacu

SEQ ID NO: 305869 - RNA, 64 nt, Homo Sapiens
agguauagcuauugcacuuaugccaucuccaaaauuucuuaaguauucuuucacuauccauuag

SEQ ID NO: 305870 - RNA, 64 nt, Homo Sapiens
uucuuaaguauucuuucacuauccauuaggaguuuuucuuaaacuugucugauaauaagaauca

SEQ ID NO: 305871 - RNA, 64 nt, Homo Sapiens
auauuccggugauaacuuuaaaaauuagauacauuuucuuaacauuuuuuucuuuuuuaauguu

SEQ ID NO: 305872 - RNA, 64 nt, Homo Sapiens
accucuguaagcaauagauuuugcuuggguuuucuuucuuaaaaaaauaauacuaugcaggcaa

SEQ ID NO: 305873 - RNA, 64 nt, Homo Sapiens
cauauuacagcugaaaauuuugagaagguaaaaguuucuuaauuaaaauaugaacauauuuagc

SEQ ID NO: 305874 - RNA, 64 nt, Homo Sapiens
uguuaaugccaaaguugccugaacauugggcgguuuucuuaauuugaaguauaaaaauuauaaa

SEQ ID NO: 305875 - RNA, 64 nt, Homo Sapiens
uuuagaacauaugaacugaaugaaauggacauuuuuucuuaauuuauguauaaauccauaugau

SEQ ID NO: 305876 - RNA, 64 nt, Homo Sapiens
caugcaacugaaaaugucucaccuuucaucuuuuuuucuuaauucauaaaguuaucuuguagaa

SEQ ID NO: 305877 - RNA, 64 nt, Homo Sapiens
uuauuuuuuauuuucaggaaaguuauacuaguauuuucuuaaguguggaaucaaaugagcacau

SEQ ID NO: 305878 - RNA, 64 nt, Homo Sapiens
uucuaauuuugcagaucuuuacauuuuuauugcuuuucuuaaaauaagggauagcuuugcaacc

SEQ ID NO: 305879 - RNA, 64 nt, Homo Sapiens
gagagaggugacgaaggaaguuaagcuuauucuuuuucuuaaaaagguuugguaaugugauauu

SEQ ID NO: 305880 - RNA, 64 nt, Homo Sapiens
uaugucaaaugacuacaaucaguauuugaaggguuuucuuaaaguaaaaugcaauaaacaucuc

SEQ ID NO: 305881 - RNA, 64 nt, Homo Sapiens
aaauaagcuccaaagagccaucaaucaaggaaaauuucuuaauggugccccagcugcccugagg

SEQ ID NO: 305882 - RNA, 64 nt, Homo Sapiens
guguauuuaugccaaguuugguaaagcuacugucuuucuuaagauuuugcucccucuuuugagg

SEQ ID NO: 305883 - RNA, 64 nt, Homo Sapiens
gcaugucuuuugggaggcagauauccacuuaacuuuucuuaaaaauacuuucaguugccuuugc

SEQ ID NO: 305884 - RNA, 64 nt, Homo Sapiens
caaacuauuuauauugaaagcuauaugcacuuuauuucuuaacugaauugcaucaacaauguuc

SEQ ID NO: 305885 - RNA, 64 nt, Homo Sapiens
aguaggaggcagugugagcuuuuuauuuuuuauuuuucuuaagguggucuuaguaauauaacau

SEQ ID NO: 305886 - RNA, 64 nt, Homo Sapiens
caaaauugagagaaauuaggaacacugcuauuuuuuucuuaaaaauguuuuuaagaauauguuc

SEQ ID NO: 305887 - RNA, 64 nt, Homo Sapiens
ugccauuuuguaaacuaaggauuuuggacugagauuucuuaaaucuuucuucaaaucucccaca

SEQ ID NO: 305888 - RNA, 64 nt, Homo Sapiens
uaaggaaaggauccuacaauauuuuauucuaggguuucuuaaauauaugauuuauauuacuguc

SEQ ID NO: 305889 - RNA, 64 nt, Homo Sapiens
uaucaugggcucugcagaacauaucaaaauaggauuucuuaaauuuuucaacccccagaccaua

SEQ ID NO: 305890 - RNA, 64 nt, Homo Sapiens
uauuaucaagugucaagaucggaaaaccuuuccauuucuuaaaguuaagcagguauuagauuua

SEQ ID NO: 305891 - RNA, 64 nt, Homo Sapiens
ucugcucugagccuuaaaacaaaauuguuugauauuucuuaaugauuugaaaaacuuuuuauaa

SEQ ID NO: 305892 - RNA, 64 nt, Homo Sapiens
gugauaaauaacauuuuuucuauuuuaaauaauauuucuuaagauauuccuuuuaaaccauaaa

SEQ ID NO: 305893 - RNA, 64 nt, Homo Sapiens
cagauacgaugacauaaggcuuugaagaaguguuuuucuuaaagaguuuuucauaguguaggau

SEQ ID NO: 305894 - RNA, 64 nt, Homo Sapiens
aacuagaaacagcuccaguguuuuuaagagaauguuucuuaaaaccaauaggaaacuuaagcga

SEQ ID NO: 305895 - RNA, 64 nt, Homo Sapiens
ccagagaaacugagguaacugucauuagaaaagguuucuuaaaauacucacaaagcuguuauug

SEQ ID NO: 305896 - RNA, 64 nt, Homo Sapiens
uguaaauuuaaaaaggggaaauacuuuaauuuuuuuucuuaauaguguaaaaauucccugagcu

SEQ ID NO: 305897 - RNA, 64 nt, Homo Sapiens
ugucuugucccaguucuucaaacacucuuaaauuuuucuuaaguaauguaaaaauggaacugcc

SEQ ID NO: 305898 - RNA, 64 nt, Homo Sapiens
uuucccuggugccucucacuucguuggugaccaguuucuuaaacugaaagcuuuaauguuacau

SEQ ID NO: 305899 - RNA, 64 nt, Homo Sapiens
uuuguuugguauaaauuaauuuguuaauuaaauauuucuuaaguauaaaccuuaugaacuacag

SEQ ID NO: 305900 - RNA, 64 nt, Homo Sapiens
aauauuuuguuaacuuuuguuuuuuuuuguuuguuuucuuaaaaguaccucugcauugagcaua

SEQ ID NO: 305901 - RNA, 64 nt, Homo Sapiens
uaaacauguuuaaaguguacuuauaaacuauuuuuuucuuaaagcaaacuaugauuuauuuugg

SEQ ID NO: 305902 - RNA, 64 nt, Homo Sapiens
acagcuagacuugcauuucagguauuaaaauugcuuucuuaacugucaagaaucacaaaauaac

SEQ ID NO: 305903 - RNA, 64 nt, Homo Sapiens
uauuacccuuguaggaauaguuuaaggaaauucauuucuuaaaaauauaguguccucaaauaau

SEQ ID NO: 305904 - RNA, 64 nt, Homo Sapiens
gaccacaaauaguuaucuuuuaauuacagaagaguuucuuaacuuacuuuuguaaguuuuuauu

SEQ ID NO: 305905 - RNA, 64 nt, Homo Sapiens
aauguacauguuccuuuguaauugacacuauauauuucuuaauaaaauaauucucaaauuuguu

SEQ ID NO: 305906 - RNA, 64 nt, Homo Sapiens
gauaggcagcuucaggaugcauugcaaucauccuuuucuuaaauuaugucacuagucuuuuauu

SEQ ID NO: 305907 - RNA, 64 nt, Homo Sapiens
uucuucaggauuauugaguagguugugaauuuucuuucuuaaaaauuguaaaacauaaugguac

SEQ ID NO: 305908 - RNA, 64 nt, Homo Sapiens
cagucccccucucauaccaaaggaugacuguauauuucuuaaaugaagagacuuucauucuuua

SEQ ID NO: 305909 - RNA, 64 nt, Homo Sapiens
aauguuugagcuaauauaaauuauggaauucgguuuucuuaauaaacuuaaugucuguguuuau

SEQ ID NO: 305910 - RNA, 64 nt, Homo Sapiens
acaacugugugagaguguaguaucuuauuuucauuuucuuaagcuaacgcuuuuauuuuuauuu

SEQ ID NO: 305911 - RNA, 64 nt, Homo Sapiens
uugagaaguaagacauaaaguagauguuuuuguuuuucuuaaguaaacucauguaagauguugc

SEQ ID NO: 305912 - RNA, 64 nt, Homo Sapiens
auaaguguuaaaggaauaacguaaaauaaauuuauuucuuaaaauaggguuuaaguaacuacaa

SEQ ID NO: 305913 - RNA, 64 nt, Homo Sapiens
cacacuuccuacacacagcuaacaggcauuucauuuucuuaaggguuugaauucuaaaauucaa

SEQ ID NO: 305914 - RNA, 64 nt, Homo Sapiens
ugccuaaguuaauuucuguaacuaacacauguaauuucuuaauguuuuuaagccaaaaaucugu

SEQ ID NO: 305915 - RNA, 64 nt, Homo Sapiens
uaaaugaccagaggaaagauggauaagaugauaauuucuuaaauagacauuuuccuuuuuucuu

SEQ ID NO: 305916 - RNA, 64 nt, Homo Sapiens
gguuggugcuugaagauaaaugugcuguuucuaguuucuuaaauagcccacaccccuggaugca

SEQ ID NO: 305917 - RNA, 64 nt, Homo Sapiens
gcaaaugauuuuauaaacaauggacaauauauacuuucuuaagaucuaagguacuuucuuaaga

SEQ ID NO: 305918 - RNA, 64 nt, Homo Sapiens
uggacaauauauacuuucuuaagaucuaagguacuuucuuaagaucuaagaauuugcugaaagc

SEQ ID NO: 305919 - RNA, 64 nt, Homo Sapiens
uucuguaauauugagaguuauuuuauagaaaugauuucuuaauuagcuguugugagauauuucu

SEQ ID NO: 305920 - RNA, 64 nt, Homo Sapiens
uuuucacugaucaaaauguuguucugcuuuuucauuucuuaaggaauacauguuugggauuuuu

SEQ ID NO: 305921 - RNA, 64 nt, Homo Sapiens
agcaaguacauguaucggaaaaauucggcauguuuuucuuaaguauuacaguacuauuugcuuu

SEQ ID NO: 305922 - RNA, 64 nt, Homo Sapiens
cauauaaggauaaaauaauacaacucauaaauaauuucuuaacccauugguagauuucuaaaga

SEQ ID NO: 305923 - RNA, 64 nt, Homo Sapiens
agguauuuugauuuaaaguauacuuaaauuaggauuucuuaaagaaaacauagggagaaaacuu

SEQ ID NO: 305924 - RNA, 64 nt, Homo Sapiens
uauucugaaaggagauuugacacuuaauucccauuuucuuaaaauaacaguuuuguugacuuaa

SEQ ID NO: 305925 - RNA, 64 nt, Homo Sapiens
gugaaauuuuaacuacuuuaacuaguuuuauaaauuucuuaauauguuacaauaacuuagggac

SEQ ID NO: 305926 - RNA, 64 nt, Homo Sapiens
uuuugggaugagaacauuuuaguuguuuaguuuguuucuuaagcagugcuauuuuuuguaaaca

SEQ ID NO: 305927 - RNA, 64 nt, Homo Sapiens
gcaaaugugaaaauaguuucaauauaucuuaugauuucuuaauguaaaauguuuuguugaagua

SEQ ID NO: 305928 - RNA, 64 nt, Homo Sapiens
ggcuuuccuagcaucccaaagcagucaacagugauuucuuaagcaauuugaucuguaccuuuac

SEQ ID NO: 305929 - RNA, 64 nt, Homo Sapiens
cuauuaaaaaaaaaacacccuuccuaacccuucuuuucuuaaaauuccacauucauccacaauc

SEQ ID NO: 305930 - RNA, 64 nt, Homo Sapiens
auugaugaacuuuggaguacagcuauucggauaauuucuuaaauuagcuguaaaccaaguugga

SEQ ID NO: 305931 - RNA, 64 nt, Homo Sapiens
guuaucagcauugaccaaguuacuagcauacguuuuucuuaauuagucaguauauuuagagcaa

SEQ ID NO: 305932 - RNA, 64 nt, Homo Sapiens
aagaaaaagacauugguuguuaauuuauucuuuuuuucuuaaaguauaauuugccaaagguaau

SEQ ID NO: 305933 - RNA, 64 nt, Homo Sapiens
gauugguggucccaaugucaugaagaguuacauuuuucuuaaaagguuuuugucaaauagcaug

SEQ ID NO: 305934 - RNA, 64 nt, Homo Sapiens
aaaaaucuaguauagcacuauucuguaccuaaauuuucuuaaaacuauuuucauacccuacuuu

SEQ ID NO: 305935 - RNA, 64 nt, Homo Sapiens
aacugaagagucucaguaugugaggaaauacauuuuucuuaauauauauauauuuuaaaaugcc

SEQ ID NO: 305936 - RNA, 64 nt, Homo Sapiens
uuggauggcagguagaguucgugccgggucuucguuucuuaaaggguuuuguuucuuuuucaca

SEQ ID NO: 305937 - RNA, 64 nt, Homo Sapiens
guucuugugcaaucgacaaugcuuaccugcugauuuucuuaacuuguuccaucuuugcacuguu

SEQ ID NO: 305938 - RNA, 64 nt, Homo Sapiens
agauuugcuucugucuuagcguguggguggcauuuuucuuaacguuuuggauaaauuuccuguu

SEQ ID NO: 305939 - RNA, 64 nt, Homo Sapiens
agcaaguguagguuucagcuacauggucuuuccguuucuuaagucacgcugcacucccagccag

SEQ ID NO: 305940 - RNA, 64 nt, Homo Sapiens
caaacaacaaaaauguacaugcaacuugaucaaauuucuuaaagccgugcccacacauuuccuu

SEQ ID NO: 305941 - RNA, 64 nt, Homo Sapiens
agaaauaaaacauacuaccuugaugugacauuuuuuucuuaaccuuguugagcugguuuuguuc

SEQ ID NO: 305942 - RNA, 64 nt, Homo Sapiens
aggguugacacagcagggcuaguccugcauauuuuuucuuaaauauuucccaauuguguuuuuc

SEQ ID NO: 305943 - RNA, 64 nt, Homo Sapiens
aucaagugcagcugaacuggaacauaaaagauuuuuucuuaacuuuuuuuuuuuaacacacuaa

SEQ ID NO: 305944 - RNA, 64 nt, Homo Sapiens
guagcugaagccgaaguaugaacaguccauuuuguuucuuaaaauuugaagucgugucugucau

SEQ ID NO: 305945 - RNA, 64 nt, Homo Sapiens
cuugucuuaggauauucuguagauugauugcagauuucuuaaaucugaaaugaucuuuacacug

SEQ ID NO: 305946 - RNA, 64 nt, Homo Sapiens
aaaaugcccccacccugauguaauugacauuacauuucuuaacauuuuaaaaucuagaauuucu

SEQ ID NO: 305947 - RNA, 64 nt, Homo Sapiens
uggcuaaaggauuugacuuucucucaacugcaguuuucuuaaucuuugaaaugcaaauaauguu

SEQ ID NO: 305948 - RNA, 64 nt, Homo Sapiens
uaggcucaaaaucgccccuacaaagcaguaguuguuucuuaauugcuaaguaaucuguuugcac

SEQ ID NO: 305949 - RNA, 64 nt, Homo Sapiens
guuuugguuaaaguuuucaucaagagaaacaagguuucuuaagucuaucccugagcuugcucaa

SEQ ID NO: 305950 - RNA, 64 nt, Homo Sapiens
gaagcugugaucgacuuagauuuuauaggucauuuuucuuaauaguuuucccuugcuuuagggg

SEQ ID NO: 305951 - RNA, 64 nt, Homo Sapiens
guguguaugccucaaaugcagaaacaguugggcuuuucuuaacagguuaacaguuugugcuggu

SEQ ID NO: 305952 - RNA, 64 nt, Homo Sapiens
uucuuuuugccaaggguugcaugugaauuauaccuuucuuaauauuugauuaaauaaugcaguc

SEQ ID NO: 305953 - RNA, 64 nt, Homo Sapiens
aauaaauaaaauguuuauaguuuucugaagcuacuuucuuaaaaugaucuagauauuuuccucu

SEQ ID NO: 305954 - RNA, 64 nt, Homo Sapiens
cugaacguagcauaagggcuacuuguucagggcuuuucuuaauaugccagaagcagcauccucc

SEQ ID NO: 305955 - RNA, 64 nt, Homo Sapiens
aaaguugaauuuugaaaagaaguuguacucagcauuucuuaaccccucaguguuucuuaaccaa

SEQ ID NO: 305956 - RNA, 64 nt, Homo Sapiens
aaaguuguacucagcauuucccaugaccucaguguuucuuaacccggcaucugugacucuuuau

SEQ ID NO: 305957 - RNA, 64 nt, Homo Sapiens
agcuuacuuaguugcugauuuccagauuucgauguuucuuaagucuaggugaauuuauauauau

SEQ ID NO: 305958 - RNA, 64 nt, Homo Sapiens
cugucagcuuaaacacaaauguuacugcuuaucuuuucuuaaaaaaaaaaaaaacaaaguguag

SEQ ID NO: 305959 - RNA, 64 nt, Homo Sapiens
cauguauuugaauauaguuaaaucguauuauuuuuuucuuaacagaaauauuuuuaaaaaugaa

SEQ ID NO: 305960 - RNA, 64 nt, Homo Sapiens
uuugguuugcagagaacacagccugauacuuaauuuucuuaaaacuauuuuuaaugauccacua

SEQ ID NO: 305961 - RNA, 64 nt, Homo Sapiens
aaacaaacucuuuuuuaaaagagcauugcuuuuguuucuuaagaugguccugcugacaaaucaa

SEQ ID NO: 305962 - RNA, 64 nt, Homo Sapiens
cauacuaguacaagugguaaacaauuuguacuuuuuucuuaaggaaguguguaauuauguaaau

SEQ ID NO: 305963 - RNA, 64 nt, Homo Sapiens
aagagcagaguuauucaugaagagucaaaaacuauuucuuaagauguuauggguucuuacccaa

SEQ ID NO: 305964 - RNA, 64 nt, Homo Sapiens
cagcugguucauaacauagggucuuauuuuuguuuuucuuaaguaaauugauugcuguccuuuu

SEQ ID NO: 305965 - RNA, 64 nt, Homo Sapiens
caaggcaugcauaagagucacaacauuacuuuucuuucuuaaggguacuuacuuuuuaaaccau

SEQ ID NO: 305966 - RNA, 64 nt, Homo Sapiens
aaauaguaucaccugcuuccaguuggcaucccaguuucuuaaaccuuggggaacuccacguguu

SEQ ID NO: 305967 - RNA, 64 nt, Homo Sapiens
caucucaaaaguuugggauuuuccuccucuuaacuuucuuaauauuuggacaugcaguugucgc

SEQ ID NO: 305968 - RNA, 64 nt, Homo Sapiens
gauacugaagacugccaaauacauaggaauuuucuuucuuaaaaaacaguaaugaagacuauau

SEQ ID NO: 305969 - RNA, 64 nt, Homo Sapiens
ccaggaguuuauuuagcaagauaaauagugguaauuucuuaaucauuccccuuuccuuugcuuu

SEQ ID NO: 305970 - RNA, 64 nt, Homo Sapiens
uuaaaauauaaaguacuugggauuuugcauuauuuuucuuaauaucuauuuacuaaguauguaa

SEQ ID NO: 305971 - RNA, 64 nt, Homo Sapiens
cgguaaauuuuuuaaaccuguaauucuuguaaaguuucuuaacuguuuuuuugaggagaaagaa

SEQ ID NO: 305972 - RNA, 64 nt, Homo Sapiens
caguaggaauagggguuggaggauuaagaggguuuuucuuaaauauuagcuuuuaauguguaca

SEQ ID NO: 305973 - RNA, 64 nt, Homo Sapiens
uuacucagagcuuuggaucaaguuaacugagcuuuuucuuaauuucauuccuuuuuuuggacac

SEQ ID NO: 305974 - RNA, 64 nt, Homo Sapiens
agcaguacgugguagccacaauugcacaauauauuuucuuaaaaaauaccagcaguuacucaug

SEQ ID NO: 305975 - RNA, 64 nt, Homo Sapiens
uuguuucuugacaguacauuuuuagaucuggccuuuucuuaacaaaaucugugcaaaagaugca

SEQ ID NO: 305976 - RNA, 64 nt, Homo Sapiens
ucuuccucucccuucuccucugcugcagcaugauuuucuuaaucuucagacacucacuauuuuc

SEQ ID NO: 305977 - RNA, 64 nt, Homo Sapiens
ugccaacuaaaauaauuagaucuuucucuuuuuuuuucuuaaaauugguuuagcgucuuuuuuu

SEQ ID NO: 305978 - RNA, 64 nt, Homo Sapiens
auauuagucagaguuaagcacauuccgcuuuuucuuucuuaaaauauuugauaaugagacugau

SEQ ID NO: 305979 - RNA, 64 nt, Homo Sapiens
uauagaaaacaguuauuacauauguguuaagucauuucuuaagaauuuucuaaaaugccaacua

SEQ ID NO: 305980 - RNA, 64 nt, Homo Sapiens
aaaaacugaaaucuaccaaaagagcauggagauuuuucuuaaauaauaauauugugcucuccac

SEQ ID NO: 305981 - RNA, 64 nt, Homo Sapiens
ucuaauaaguuuguguuagaaaaguuucgacuuauuucuuaaagcuuuuuuuuuuuucccauca

SEQ ID NO: 305982 - RNA, 64 nt, Homo Sapiens
uagcaucagaagguucacccagcaccuugcagauuuucuuaaggaauuuugucucacuuuuaaa

SEQ ID NO: 305983 - RNA, 64 nt, Homo Sapiens
ugacaucuuuucuucaagccugccaucaaggacauuucuuaagacccaacuggcaugaguuggg

SEQ ID NO: 305984 - RNA, 64 nt, Homo Sapiens
gggguaauuuccuauuauuuucaucuuggacaacuuucuuaacuuauauucuuuauagaggauu

SEQ ID NO: 305985 - RNA, 64 nt, Homo Sapiens
guccaaauguaauaaaaaaaucugaugguauauguuucuuaaaguuuuacugaauagugguaua

SEQ ID NO: 305986 - RNA, 64 nt, Homo Sapiens
guugugaagauggcucuuuucucagucagucaccuuucuuaaguuagcaucaugagccuaaugg

SEQ ID NO: 305987 - RNA, 64 nt, Homo Sapiens
auguuuguguguguguuggcaacaugccuaauguuuucuuaaugaugacaacaaauauuuuaaa

SEQ ID NO: 305988 - RNA, 64 nt, Homo Sapiens
uaucuguuucccacccccuacauuaggaggauaauuucuuaaaccacauuguuuuaauugauuu

SEQ ID NO: 305989 - RNA, 64 nt, Homo Sapiens
guucauuuggaaaauauagacauauuucuuuugcuuucuuaaaacagcuuaaaaugaugaacuu

SEQ ID NO: 305990 - RNA, 64 nt, Homo Sapiens
guaaauuaauugucagcauuccaugucucaagauuuucuuaauuuaguucgcuguuuaaauuaa

SEQ ID NO: 305991 - RNA, 64 nt, Homo Sapiens
uccugugacauuugaaguuucuuuuaaagggguuuuucuuaaucaaaguuuuacauuugguagc

SEQ ID NO: 305992 - RNA, 64 nt, Homo Sapiens
uggauaacuaggaaauauuuuuguuguuguuuuguuucuuaaagaguacagaggccauugaagc

SEQ ID NO: 305993 - RNA, 64 nt, Homo Sapiens
aauuaagauguagauagaaauuaauuuaaggucuuuucuuaaaaaaaaaauccaccucauuuuc

SEQ ID NO: 305994 - RNA, 64 nt, Homo Sapiens
ugaaaguuugacaguauuaauauuuuuuuuauauuuucuuaaaucauuaaaccauuuuaauaua

SEQ ID NO: 305995 - RNA, 64 nt, Homo Sapiens
aauuuuacauagaucaguugcccaaaagaaaccauuucuuaaaauuuucuuaaaaaaggcucaa

SEQ ID NO: 305996 - RNA, 64 nt, Homo Sapiens
aaggcucaacccaaaagaaaaaggggagaucccuuuucuuaaaacuuaucaaggccuguuugca

SEQ ID NO: 305997 - RNA, 64 nt, Homo Sapiens
agccugauaguguauauguugggucgccaaauguuuucuuaaagauagagucuaccuagagcag

SEQ ID NO: 305998 - RNA, 64 nt, Homo Sapiens
uuuuguuuuuguuuuuguugcaccacgaucuggauuucuuaauuugaaaggacuagaauguuca

SEQ ID NO: 305999 - RNA, 64 nt, Homo Sapiens
aucuucagauuucucuguauuucugcaucuuuuauuucuuaauuuugcugaauuuaaagagaag

SEQ ID NO: 306000 - RNA, 64 nt, Homo Sapiens
auuugggguacauaauaugauauuuaaauuuauuuuucuuaauugcccagccaaauguuuauuu

SEQ ID NO: 306001 - RNA, 64 nt, Homo Sapiens
acgugcgucaauauuguaaaaacccugccacugcuuucuuaacuaauuggagccaauccucuca

SEQ ID NO: 306002 - RNA, 64 nt, Homo Sapiens
aauuugcuuucacuuaaaaauuuuauuccuuuacuuucuuaacaugccuauggaguagccguuc

SEQ ID NO: 306003 - RNA, 64 nt, Homo Sapiens
auuucacauacuguaacaaaggaaaacagaggcuuuucuuaacuagccauuuguuaccaaacug

SEQ ID NO: 306004 - RNA, 64 nt, Homo Sapiens
guagcaguauaauguauuuuacaaaaagcacuuuuuucuuaaugaaaaaaagaaagaaaggaaa

SEQ ID NO: 306005 - RNA, 64 nt, Homo Sapiens
gaaaauccgggaagcagguguuuacaaauggcauuuucuuaauuuccagcccaccgcccaaccu

SEQ ID NO: 306006 - RNA, 64 nt, Homo Sapiens
cucccuuccuaaaaucuggguagcuagccagucauuucuuaaacaccuuuuuuuuuuuggacca

SEQ ID NO: 306007 - RNA, 64 nt, Homo Sapiens
aauugcuuuuaaaacaaauagcuguuuucaguauuuucuuaagagccaggaaaauagaugucuu

SEQ ID NO: 306008 - RNA, 64 nt, Homo Sapiens
uaaaaaaucuaaguauauucaccauaggcaauaauuucuuaauuauuaauaagacuguuuccac

SEQ ID NO: 306009 - RNA, 64 nt, Homo Sapiens
aaaucuaugcauuuuaaggacuugccaucuuuguuuucuuaaagauaaauugcaguuauugauu

SEQ ID NO: 306010 - RNA, 64 nt, Homo Sapiens
uugauggagaagggaaaauauuaacuuccuauucuuucuuaaauauuccacaauauuuuaguag

SEQ ID NO: 306011 - RNA, 64 nt, Homo Sapiens
auaccagcuguucucuuuccuuucuauuuaaaucuuucuuaaauuuugcucucauguguaaugu

SEQ ID NO: 306012 - RNA, 64 nt, Homo Sapiens
gaaauggacuauuuugcucugaguguuuauugguuuucuuaagaaccuaaaaaugaaaguuugu

SEQ ID NO: 306013 - RNA, 64 nt, Homo Sapiens
auuacacaaguuuaaaaauauuauuaacuuguauuuucuuaauauacaaucuaucuuuuccaca

SEQ ID NO: 306014 - RNA, 64 nt, Homo Sapiens
uauauauguaaauagcuuuucaucaauucuuaaauuucuuaaccuaggcuucagggagcauaug

SEQ ID NO: 306015 - RNA, 64 nt, Homo Sapiens
uuccauguuagcacuuuacugcugaauucucaauuuucuuaacauugagacaauaaaugugugu

SEQ ID NO: 306016 - RNA, 64 nt, Homo Sapiens
ugguaagcuggauuugaagguagugguuucaguguuucuuaaguugguagcugaggguaucagg

SEQ ID NO: 306017 - RNA, 64 nt, Homo Sapiens
cauugggugaucauucaccaguacauucucaguuuuucuuaauauauagcauuuaugguaauca

SEQ ID NO: 306018 - RNA, 64 nt, Homo Sapiens
uaugugaaggaccuucacucuaagauguuauauuuuucuuaaaaaguaacuccuaguaggggua

SEQ ID NO: 306019 - RNA, 64 nt, Homo Sapiens
ucaacauacuuuuguagaauacaccuguuuuguuuuucuuaaguaagcuuuugagaauauaaac

SEQ ID NO: 306020 - RNA, 64 nt, Homo Sapiens
guuucauuaauguugagucccaguuaaguacuuguuucuuaauacaguaggcuucaauuacaaa

SEQ ID NO: 306021 - RNA, 64 nt, Homo Sapiens
uuagguagauaagucagcucaaaagaggauuuauuuucuuaaguagguuagagcacuagaaugc

SEQ ID NO: 306022 - RNA, 64 nt, Homo Sapiens
aaauaauaaaacuacagacaguugguguuuucuuuuucuuaaaaauggcaaaaggcuuuuaaaa

SEQ ID NO: 306023 - RNA, 64 nt, Homo Sapiens; identical to SEQ ID NO: 111894

SEQ ID NO: 306024 - RNA, 64 nt, Homo Sapiens; identical to SEQ ID NO: 111895

SEQ ID NO: 306025 - RNA, 64 nt, Homo Sapiens; identical to SEQ ID NO: 111896

SEQ ID NO: 306026 - RNA, 64 nt, Homo Sapiens; identical to SEQ ID NO: 111897

SEQ ID NO: 306027 - RNA, 64 nt, Homo Sapiens; identical to SEQ ID NO: 111898

SEQ ID NO: 306028 - RNA, 64 nt, Homo Sapiens; identical to SEQ ID NO: 111899

SEQ ID NO: 306029 - RNA, 64 nt, Homo Sapiens; identical to SEQ ID NO: 111900

SEQ ID NO: 306030 - RNA, 64 nt, Homo Sapiens; identical to SEQ ID NO: 111901

SEQ ID NO: 306031 - RNA, 64 nt, Homo Sapiens; identical to SEQ ID NO: 111902

SEQ ID NO: 306032 - RNA, 64 nt, Homo Sapiens; identical to SEQ ID NO: 111903

SEQ ID NO: 306033 - RNA, 64 nt, Homo Sapiens; identical to SEQ ID NO: 111904

SEQ ID NO: 306034 - RNA, 64 nt, Homo Sapiens; identical to SEQ ID NO: 111905

SEQ ID NO: 306035 - RNA, 64 nt, Homo Sapiens; identical to SEQ ID NO: 111906

SEQ ID NO: 306036 - RNA, 64 nt, Homo Sapiens; identical to SEQ ID NO: 111907

SEQ ID NO: 306037 - RNA, 64 nt, Homo Sapiens; identical to SEQ ID NO: 111908

SEQ ID NO: 306038 - RNA, 64 nt, Homo Sapiens; identical to SEQ ID NO: 111909

SEQ ID NO: 306039 - RNA, 64 nt, Homo Sapiens; identical to SEQ ID NO: 111910

SEQ ID NO: 306040 - RNA, 64 nt, Homo Sapiens; identical to SEQ ID NO: 111911

SEQ ID NO: 306041 - RNA, 64 nt, Homo Sapiens; identical to SEQ ID NO: 111912

SEQ ID NO: 306042 - RNA, 64 nt, Homo Sapiens; identical to SEQ ID NO: 111913

SEQ ID NO: 306043 - RNA, 64 nt, Homo Sapiens; identical to SEQ ID NO: 111914

SEQ ID NO: 306044 - RNA, 64 nt, Homo Sapiens; identical to SEQ ID NO: 111915

SEQ ID NO: 306045 - RNA, 64 nt, Homo Sapiens; identical to SEQ ID NO: 111916

SEQ ID NO: 306046 - RNA, 64 nt, Homo Sapiens; identical to SEQ ID NO: 111917

SEQ ID NO: 306047 - RNA, 64 nt, Homo Sapiens; identical to SEQ ID NO: 111918

SEQ ID NO: 306048 - RNA, 64 nt, Homo Sapiens; identical to SEQ ID NO: 111919

SEQ ID NO: 306049 - RNA, 64 nt, Homo Sapiens; identical to SEQ ID NO: 111920

SEQ ID NO: 306050 - RNA, 64 nt, Homo Sapiens; identical to SEQ ID NO: 111921

SEQ ID NO: 306051 - RNA, 64 nt, Homo Sapiens; identical to SEQ ID NO: 111922

SEQ ID NO: 306052 - RNA, 64 nt, Homo Sapiens; identical to SEQ ID NO: 111923

SEQ ID NO: 306053 - RNA, 64 nt, Homo Sapiens; identical to SEQ ID NO: 111924

SEQ ID NO: 306054 - RNA, 64 nt, Homo Sapiens; identical to SEQ ID NO: 111925

SEQ ID NO: 306055 - RNA, 64 nt, Homo Sapiens; identical to SEQ ID NO: 111926

SEQ ID NO: 306056 - RNA, 64 nt, Homo Sapiens; identical to SEQ ID NO: 111927

SEQ ID NO: 306057 - RNA, 64 nt, Homo Sapiens
agucaacugaguuaaggcaggaaaagaaauaagcccaaccaacuugccaaagguaucuuugucc

SEQ ID NO: 306058 - RNA, 64 nt, Homo Sapiens
cuuggggaaacuugcagugggucaguggucugugccaaccaaacgauagccccauccaagccag

SEQ ID NO: 306059 - RNA, 64 nt, Homo Sapiens
cacauguacagcuuucuacuucuuuguaagaacaccaaccaaccaagguuuaagugauuaauag

SEQ ID NO: 306060 - RNA, 64 nt, Homo Sapiens
uguacagcuuucuacuucuuuguaagaacaccaaccaaccaagguuuaagugauuaauaggcuu

SEQ ID NO: 306061 - RNA, 64 nt, Homo Sapiens
acaaaccacccuaaaaugacaaccaaccaaccaaccaaccaaccaaaaaggaaagaaaacuaac

SEQ ID NO: 306062 - RNA, 64 nt, Homo Sapiens
aaccacaaaccacccuaaaauaacaaccaaccaaccaaccaaccaauuaaaaaggaaagaaaac

SEQ ID NO: 306063 - RNA, 64 nt, Homo Sapiens
aaccaaccacaaaccacccuaaacuaacaaccaaccaaccaaccuauaaauuaaaaaggaaaga

SEQ ID NO: 306064 - RNA, 64 nt, Homo Sapiens
aaccaaccaaccacaaaccaaagaaaacuaacaaccaaccaaccuauauauaaauuaaaaagga

SEQ ID NO: 306065 - RNA, 64 nt, Homo Sapiens
uucugcauucgagucuuaacaauuagcuuuccaaccaaccaaauuuugagcaaguuggaaguuu

SEQ ID NO: 306066 - RNA, 64 nt, Homo Sapiens
aaauuucugcauucgagucuguuuaauuagcuuuccaaccaaccucuauuugagcaaguuggaa

SEQ ID NO: 306067 - RNA, 64 nt, Homo Sapiens
auaaauaucuauaugacgcucuuaaaaaaacaucccaaccaaaaccaaccaaacaaaaacaucc

SEQ ID NO: 306068 - RNA, 64 nt, Homo Sapiens
auaugacgcucuuaaaaaaacaucccaaccaaaaccaaccaaacaaaaacauccucacaacucc

SEQ ID NO: 306069 - RNA, 64 nt, Homo Sapiens
agaaagucugguggcagcgcagagcccaaucauuccaaccaaagcaggguuggggaaucccgaa

SEQ ID NO: 306070 - RNA, 64 nt, Homo Sapiens
cguaaaagcauugacgcagccccuacacuccaucccaaccaagaaacugcauuuccuggggcca

SEQ ID NO: 306071 - RNA, 64 nt, Homo Sapiens
auauguauguauucacugaccaaaaauucacugaccaaccaaccaaacuccacacuucaucuga

SEQ ID NO: 306072 - RNA, 64 nt, Homo Sapiens
guauguauucacugaccaaaaauucacugaccaaccaaccaaacuccacacuucaucugauccc

SEQ ID NO: 306073 - RNA, 64 nt, Homo Sapiens
auacuccccuccuucaacucuccccagaaauagcccaaccaagcgaguggauguccccaccacu

SEQ ID NO: 306074 - RNA, 64 nt, Homo Sapiens
caacuaaaauauuacagauuaauaauaaauuaaaccaaccaaugauaaacacuacucaguccac

SEQ ID NO: 306075 - RNA, 64 nt, Homo Sapiens
cccuccgauccagccccaggccucucuucuccucccaaccaaaagagaagaauucuugcccucc

SEQ ID NO: 306076 - RNA, 64 nt, Homo Sapiens
acuuguaccucccuggcauaggaccccucauuaaccaaccaagcgggccugggaccauuggcug

SEQ ID NO: 306077 - RNA, 64 nt, Homo Sapiens; identical to SEQ ID NO: 190131

SEQ ID NO: 306078 - RNA, 64 nt, Homo Sapiens; identical to SEQ ID NO: 190132

SEQ ID NO: 306079 - RNA, 64 nt, Homo Sapiens; identical to SEQ ID NO: 190133

SEQ ID NO: 306080 - RNA, 64 nt, Homo Sapiens; identical to SEQ ID NO: 190134

SEQ ID NO: 306081 - RNA, 64 nt, Homo Sapiens; identical to SEQ ID NO: 190135

SEQ ID NO: 306082 - RNA, 64 nt, Homo Sapiens; identical to SEQ ID NO: 190136

SEQ ID NO: 306083 - RNA, 64 nt, Homo Sapiens; identical to SEQ ID NO: 190137

SEQ ID NO: 306084 - RNA, 64 nt, Homo Sapiens; identical to SEQ ID NO: 190138

SEQ ID NO: 306085 - RNA, 64 nt, Homo Sapiens; identical to SEQ ID NO: 190139

SEQ ID NO: 306086 - RNA, 64 nt, Homo Sapiens; identical to SEQ ID NO: 190140

SEQ ID NO: 306087 - RNA, 64 nt, Homo Sapiens; identical to SEQ ID NO: 190141

SEQ ID NO: 306088 - RNA, 64 nt, Homo Sapiens; identical to SEQ ID NO: 190142

SEQ ID NO: 306089 - RNA, 64 nt, Homo Sapiens; identical to SEQ ID NO: 190143

SEQ ID NO: 306090 - RNA, 64 nt, Homo Sapiens; identical to SEQ ID NO: 190144

SEQ ID NO: 306091 - RNA, 64 nt, Homo Sapiens; identical to SEQ ID NO: 190145

SEQ ID NO: 306092 - RNA, 64 nt, Homo Sapiens; identical to SEQ ID NO: 190146

SEQ ID NO: 306093 - RNA, 64 nt, Homo Sapiens; identical to SEQ ID NO: 190147

SEQ ID NO: 306094 - RNA, 64 nt, Homo Sapiens; identical to SEQ ID NO: 190148

SEQ ID NO: 306095 - RNA, 64 nt, Homo Sapiens; identical to SEQ ID NO: 190149

SEQ ID NO: 306096 - RNA, 64 nt, Homo Sapiens; identical to SEQ ID NO: 190150

SEQ ID NO: 306097 - RNA, 64 nt, Homo Sapiens; identical to SEQ ID NO: 190151

SEQ ID NO: 306098 - RNA, 64 nt, Homo Sapiens; identical to SEQ ID NO: 190152

SEQ ID NO: 306099 - RNA, 64 nt, Homo Sapiens; identical to SEQ ID NO: 190153

SEQ ID NO: 306100 - RNA, 64 nt, Homo Sapiens; identical to SEQ ID NO: 190154

SEQ ID NO: 306101 - RNA, 64 nt, Homo Sapiens; identical to SEQ ID NO: 190155

SEQ ID NO: 306102 - RNA, 64 nt, Homo Sapiens; identical to SEQ ID NO: 190156

SEQ ID NO: 306103 - RNA, 64 nt, Homo Sapiens; identical to SEQ ID NO: 190157

SEQ ID NO: 306104 - RNA, 64 nt, Homo Sapiens; identical to SEQ ID NO: 190158

SEQ ID NO: 306105 - RNA, 64 nt, Homo Sapiens; identical to SEQ ID NO: 190159

SEQ ID NO: 306106 - RNA, 64 nt, Homo Sapiens; identical to SEQ ID NO: 190160

SEQ ID NO: 306107 - RNA, 64 nt, Homo Sapiens; identical to SEQ ID NO: 190161

SEQ ID NO: 306108 - RNA, 64 nt, Homo Sapiens; identical to SEQ ID NO: 190162

SEQ ID NO: 306109 - RNA, 64 nt, Homo Sapiens; identical to SEQ ID NO: 190163

SEQ ID NO: 306110 - RNA, 64 nt, Homo Sapiens; identical to SEQ ID NO: 190164

SEQ ID NO: 306111 - RNA, 64 nt, Homo Sapiens; identical to SEQ ID NO: 190165

SEQ ID NO: 306112 - RNA, 64 nt, Homo Sapiens; identical to SEQ ID NO: 190166

SEQ ID NO: 306113 - RNA, 64 nt, Homo Sapiens; identical to SEQ ID NO: 190167

SEQ ID NO: 306114 - RNA, 64 nt, Homo Sapiens; identical to SEQ ID NO: 190168

SEQ ID NO: 306115 - RNA, 64 nt, Homo Sapiens; identical to SEQ ID NO: 190169

SEQ ID NO: 306116 - RNA, 64 nt, Homo Sapiens; identical to SEQ ID NO: 190170

SEQ ID NO: 306117 - RNA, 64 nt, Homo Sapiens; identical to SEQ ID NO: 190171

SEQ ID NO: 306118 - RNA, 64 nt, Homo Sapiens; identical to SEQ ID NO: 190172

SEQ ID NO: 306119 - RNA, 64 nt, Homo Sapiens; identical to SEQ ID NO: 190173

SEQ ID NO: 306120 - RNA, 64 nt, Homo Sapiens; identical to SEQ ID NO: 190174

SEQ ID NO: 306121 - RNA, 64 nt, Homo Sapiens; identical to SEQ ID NO: 190175

SEQ ID NO: 306122 - RNA, 64 nt, Homo Sapiens; identical to SEQ ID NO: 190176

SEQ ID NO: 306123 - RNA, 64 nt, Homo Sapiens; identical to SEQ ID NO: 190177

SEQ ID NO: 306124 - RNA, 64 nt, Homo Sapiens; identical to SEQ ID NO: 190178

SEQ ID NO: 306125 - RNA, 64 nt, Homo Sapiens; identical to SEQ ID NO: 190179

SEQ ID NO: 306126 - RNA, 64 nt, Homo Sapiens; identical to SEQ ID NO: 190180

SEQ ID NO: 306127 - RNA, 64 nt, Homo Sapiens; identical to SEQ ID NO: 190181

SEQ ID NO: 306128 - RNA, 64 nt, Homo Sapiens; identical to SEQ ID NO: 190182

SEQ ID NO: 306129 - RNA, 64 nt, Homo Sapiens; identical to SEQ ID NO: 190183

SEQ ID NO: 306130 - RNA, 64 nt, Homo Sapiens; identical to SEQ ID NO: 190184

SEQ ID NO: 306131 - RNA, 64 nt, Homo Sapiens; identical to SEQ ID NO: 190185

SEQ ID NO: 306132 - RNA, 64 nt, Homo Sapiens; identical to SEQ ID NO: 190186

SEQ ID NO: 306133 - RNA, 64 nt, Homo Sapiens; identical to SEQ ID NO: 190187

SEQ ID NO: 306134 - RNA, 64 nt, Homo Sapiens; identical to SEQ ID NO: 190188

SEQ ID NO: 306135 - RNA, 64 nt, Homo Sapiens; identical to SEQ ID NO: 190189

SEQ ID NO: 306136 - RNA, 64 nt, Homo Sapiens; identical to SEQ ID NO: 190190

SEQ ID NO: 306137 - RNA, 64 nt, Homo Sapiens; identical to SEQ ID NO: 190191

SEQ ID NO: 306138 - RNA, 64 nt, Homo Sapiens; identical to SEQ ID NO: 190192

SEQ ID NO: 306139 - RNA, 64 nt, Homo Sapiens; identical to SEQ ID NO: 190193

SEQ ID NO: 306140 - RNA, 64 nt, Homo Sapiens; identical to SEQ ID NO: 190194

SEQ ID NO: 306141 - RNA, 64 nt, Homo Sapiens; identical to SEQ ID NO: 190195

SEQ ID NO: 306142 - RNA, 64 nt, Homo Sapiens; identical to SEQ ID NO: 190196

SEQ ID NO: 306143 - RNA, 64 nt, Homo Sapiens; identical to SEQ ID NO: 190197

SEQ ID NO: 306144 - RNA, 64 nt, Homo Sapiens; identical to SEQ ID NO: 190198

SEQ ID NO: 306145 - RNA, 64 nt, Homo Sapiens; identical to SEQ ID NO: 190199

SEQ ID NO: 306146 - RNA, 64 nt, Homo Sapiens; identical to SEQ ID NO: 190200

SEQ ID NO: 306147 - RNA, 64 nt, Homo Sapiens; identical to SEQ ID NO: 190201

SEQ ID NO: 306148 - RNA, 64 nt, Homo Sapiens; identical to SEQ ID NO: 190202

SEQ ID NO: 306149 - RNA, 64 nt, Homo Sapiens; identical to SEQ ID NO: 190203

SEQ ID NO: 306150 - RNA, 64 nt, Homo Sapiens; identical to SEQ ID NO: 190204

SEQ ID NO: 306151 - RNA, 64 nt, Homo Sapiens; identical to SEQ ID NO: 190205

SEQ ID NO: 306152 - RNA, 64 nt, Homo Sapiens; identical to SEQ ID NO: 190206

SEQ ID NO: 306153 - RNA, 64 nt, Homo Sapiens; identical to SEQ ID NO: 190207

SEQ ID NO: 306154 - RNA, 64 nt, Homo Sapiens; identical to SEQ ID NO: 190208

SEQ ID NO: 306155 - RNA, 64 nt, Homo Sapiens; identical to SEQ ID NO: 190209

SEQ ID NO: 306156 - RNA, 64 nt, Homo Sapiens; identical to SEQ ID NO: 190210

SEQ ID NO: 306157 - RNA, 64 nt, Homo Sapiens; identical to SEQ ID NO: 190211

SEQ ID NO: 306158 - RNA, 64 nt, Homo Sapiens; identical to SEQ ID NO: 190212

SEQ ID NO: 306159 - RNA, 64 nt, Homo Sapiens; identical to SEQ ID NO: 190213

SEQ ID NO: 306160 - RNA, 64 nt, Homo Sapiens; identical to SEQ ID NO: 190214

SEQ ID NO: 306161 - RNA, 64 nt, Homo Sapiens; identical to SEQ ID NO: 190215

SEQ ID NO: 306162 - RNA, 64 nt, Homo Sapiens; identical to SEQ ID NO: 190216

SEQ ID NO: 306163 - RNA, 64 nt, Homo Sapiens; identical to SEQ ID NO: 190217

SEQ ID NO: 306164 - RNA, 64 nt, Homo Sapiens; identical to SEQ ID NO: 190218

SEQ ID NO: 306165 - RNA, 64 nt, Homo Sapiens; identical to SEQ ID NO: 190219

SEQ ID NO: 306166 - RNA, 64 nt, Homo Sapiens; identical to SEQ ID NO: 190220

SEQ ID NO: 306167 - RNA, 64 nt, Homo Sapiens; identical to SEQ ID NO: 190221

SEQ ID NO: 306168 - RNA, 64 nt, Homo Sapiens; identical to SEQ ID NO: 190222

SEQ ID NO: 306169 - RNA, 64 nt, Homo Sapiens; identical to SEQ ID NO: 190223

SEQ ID NO: 306170 - RNA, 64 nt, Homo Sapiens; identical to SEQ ID NO: 190224

SEQ ID NO: 306171 - RNA, 64 nt, Homo Sapiens; identical to SEQ ID NO: 190225

SEQ ID NO: 306172 - RNA, 64 nt, Homo Sapiens; identical to SEQ ID NO: 190226

SEQ ID NO: 306173 - RNA, 64 nt, Homo Sapiens; identical to SEQ ID NO: 190227

SEQ ID NO: 306174 - RNA, 64 nt, Homo Sapiens; identical to SEQ ID NO: 190228

SEQ ID NO: 306175 - RNA, 64 nt, Homo Sapiens; identical to SEQ ID NO: 190229

SEQ ID NO: 306176 - RNA, 64 nt, Homo Sapiens; identical to SEQ ID NO: 190230

SEQ ID NO: 306177 - RNA, 64 nt, Homo Sapiens; identical to SEQ ID NO: 190231

SEQ ID NO: 306178 - RNA, 64 nt, Homo Sapiens; identical to SEQ ID NO: 190232

SEQ ID NO: 306179 - RNA, 64 nt, Homo Sapiens; identical to SEQ ID NO: 190233

SEQ ID NO: 306180 - RNA, 54 nt, Homo Sapiens; identical to SEQ ID NO: 190234

SEQ ID NO: 306181 - RNA, 64 nt, Homo Sapiens; identical to SEQ ID NO: 190235

SEQ ID NO: 306182 - RNA, 64 nt, Homo Sapiens; identical to SEQ ID NO: 190236

SEQ ID NO: 306183 - RNA, 64 nt, Homo Sapiens; identical to SEQ ID NO: 190237

SEQ ID NO: 306184 - RNA, 64 nt, Homo Sapiens; identical to SEQ ID NO: 190238

SEQ ID NO: 306185 - RNA, 64 nt, Homo Sapiens; identical to SEQ ID NO: 190239

SEQ ID NO: 306186 - RNA, 64 nt, Homo Sapiens; identical to SEQ ID NO: 190240

SEQ ID NO: 306187 - RNA, 64 nt, Homo Sapiens; identical to SEQ ID NO: 190241

SEQ ID NO: 306188 - RNA, 64 nt, Homo Sapiens; identical to SEQ ID NO: 190242

SEQ ID NO: 306189 - RNA, 64 nt, Homo Sapiens; identical to SEQ ID NO: 190243

SEQ ID NO: 306190 - RNA, 64 nt, Homo Sapiens; identical to SEQ ID NO: 190244

SEQ ID NO: 306191 - RNA, 64 nt, Homo Sapiens; identical to SEQ ID NO: 190245

SEQ ID NO: 306192 - RNA, 64 nt, Homo Sapiens; identical to SEQ ID NO: 190246

SEQ ID NO: 306193 - RNA, 64 nt, Homo Sapiens; identical to SEQ ID NO: 190247

SEQ ID NO: 306194 - RNA, 64 nt, Homo Sapiens; identical to SEQ ID NO: 190248

SEQ ID NO: 306195 - RNA, 64 nt, Homo Sapiens; identical to SEQ ID NO: 190249

SEQ ID NO: 306196 - RNA, 64 nt, Homo Sapiens; identical to SEQ ID NO: 190250

SEQ ID NO: 306197 - RNA, 64 nt, Homo Sapiens; identical to SEQ ID NO: 190251

SEQ ID NO: 306198 - RNA, 64 nt, Homo Sapiens; identical to SEQ ID NO: 190252

SEQ ID NO: 306199 - RNA, 64 nt, Homo Sapiens; identical to SEQ ID NO: 190253

SEQ ID NO: 306200 - RNA, 64 nt, Homo Sapiens; identical to SEQ ID NO: 190254

SEQ ID NO: 306201 - RNA, 64 nt, Homo Sapiens; identical to SEQ ID NO: 190255

SEQ ID NO: 306202 - RNA, 64 nt, Homo Sapiens; identical to SEQ ID NO: 190256

SEQ ID NO: 306203 - RNA, 64 nt, Homo Sapiens; identical to SEQ ID NO: 190257

SEQ ID NO: 306204 - RNA, 64 nt, Homo Sapiens; identical to SEQ ID NO: 190258

SEQ ID NO: 306205 - RNA, 64 nt, Homo Sapiens; identical to SEQ ID NO: 190259

SEQ ID NO: 306206 - RNA, 64 nt, Homo Sapiens; identical to SEQ ID NO: 190260

SEQ ID NO: 306207 - RNA, 64 nt, Homo Sapiens; identical to SEQ ID NO: 190261

SEQ ID NO: 306208 - RNA, 64 nt, Homo Sapiens; identical to SEQ ID NO: 190262

SEQ ID NO: 306209 - RNA, 64 nt, Homo Sapiens; identical to SEQ ID NO: 190263

SEQ ID NO: 306210 - RNA, 64 nt, Homo Sapiens; identical to SEQ ID NO: 190264

SEQ ID NO: 306211 - RNA, 64 nt, Homo Sapiens; identical to SEQ ID NO: 190265

SEQ ID NO: 306212 - RNA, 64 nt, Homo Sapiens; identical to SEQ ID NO: 190266

SEQ ID NO: 306213 - RNA, 64 nt, Homo Sapiens; identical to SEQ ID NO: 190267

SEQ ID NO: 306214 - RNA, 64 nt, Homo Sapiens; identical to SEQ ID NO: 190268

SEQ ID NO: 306215 - RNA, 64 nt, Homo Sapiens; identical to SEQ ID NO: 190269

SEQ ID NO: 306216 - RNA, 64 nt, Homo Sapiens; identical to SEQ ID NO: 190270

SEQ ID NO: 306217 - RNA, 61 nt, Homo Sapiens; identical to SEQ ID NO: 190271

SEQ ID NO: 306218 - RNA, 64 nt, Homo Sapiens; identical to SEQ ID NO: 190272

SEQ ID NO: 306219 - RNA, 64 nt, Homo Sapiens; identical to SEQ ID NO: 190273

SEQ ID NO: 306220 - RNA, 63 nt, Homo Sapiens; identical to SEQ ID NO: 190274

SEQ ID NO: 306221 - RNA, 64 nt, Homo Sapiens; identical to SEQ ID NO: 190275

SEQ ID NO: 306222 - RNA, 64 nt, Homo Sapiens; identical to SEQ ID NO: 190276

SEQ ID NO: 306223 - RNA, 64 nt, Homo Sapiens; identical to SEQ ID NO: 190277

SEQ ID NO: 306224 - RNA, 64 nt, Homo Sapiens; identical to SEQ ID NO: 190278

SEQ ID NO: 306225 - RNA, 64 nt, Homo Sapiens; identical to SEQ ID NO: 190279

SEQ ID NO: 306226 - RNA, 64 nt, Homo Sapiens; identical to SEQ ID NO: 190280

SEQ ID NO: 306227 - RNA, 64 nt, Homo Sapiens; identical to SEQ ID NO: 190281

SEQ ID NO: 306228 - RNA, 64 nt, Homo Sapiens; identical to SEQ ID NO: 190282

SEQ ID NO: 306229 - RNA, 64 nt, Homo Sapiens; identical to SEQ ID NO: 190283

SEQ ID NO: 306230 - RNA, 64 nt, Homo Sapiens; identical to SEQ ID NO: 190284

SEQ ID NO: 306231 - RNA, 64 nt, Homo Sapiens; identical to SEQ ID NO: 190285

SEQ ID NO: 306232 - RNA, 64 nt, Homo Sapiens; identical to SEQ ID NO: 190286

SEQ ID NO: 306233 - RNA, 64 nt, Homo Sapiens; identical to SEQ ID NO: 190287

SEQ ID NO: 306234 - RNA, 64 nt, Homo Sapiens; identical to SEQ ID NO: 190288

SEQ ID NO: 306235 - RNA, 64 nt, Homo Sapiens; identical to SEQ ID NO: 190289

SEQ ID NO: 306236 - RNA, 64 nt, Homo Sapiens; identical to SEQ ID NO: 190290

SEQ ID NO: 306237 - RNA, 64 nt, Homo Sapiens; identical to SEQ ID NO: 190291

SEQ ID NO: 306238 - RNA, 64 nt, Homo Sapiens; identical to SEQ ID NO: 190292

SEQ ID NO: 306239 - RNA, 64 nt, Homo Sapiens; identical to SEQ ID NO: 190293

SEQ ID NO: 306240 - RNA, 64 nt, Homo Sapiens; identical to SEQ ID NO: 190294

SEQ ID NO: 306241 - RNA, 64 nt, Homo Sapiens; identical to SEQ ID NO: 190295

SEQ ID NO: 306242 - RNA, 64 nt, Homo Sapiens; identical to SEQ ID NO: 190296

SEQ ID NO: 306243 - RNA, 64 nt, Homo Sapiens; identical to SEQ ID NO: 190297

SEQ ID NO: 306244 - RNA, 64 nt, Homo Sapiens; identical to SEQ ID NO: 190298

SEQ ID NO: 306245 - RNA, 64 nt, Homo Sapiens; identical to SEQ ID NO: 190299

SEQ ID NO: 306246 - RNA, 64 nt, Homo Sapiens; identical to SEQ ID NO: 190300

SEQ ID NO: 306247 - RNA, 64 nt, Homo Sapiens; identical to SEQ ID NO: 190301

SEQ ID NO: 306248 - RNA, 64 nt, Homo Sapiens; identical to SEQ ID NO: 190302

SEQ ID NO: 306249 - RNA, 64 nt, Homo Sapiens; identical to SEQ ID NO: 190303

SEQ ID NO: 306250 - RNA, 64 nt, Homo Sapiens; identical to SEQ ID NO: 190304

SEQ ID NO: 306251 - RNA, 64 nt, Homo Sapiens; identical to SEQ ID NO: 190305

SEQ ID NO: 306252 - RNA, 64 nt, Homo Sapiens; identical to SEQ ID NO: 190306

SEQ ID NO: 306253 - RNA, 64 nt, Homo Sapiens; identical to SEQ ID NO: 190307

SEQ ID NO: 306254 - RNA, 64 nt, Homo Sapiens; identical to SEQ ID NO: 190308

SEQ ID NO: 306255 - RNA, 64 nt, Homo Sapiens; identical to SEQ ID NO: 190309

SEQ ID NO: 306256 - RNA, 64 nt, Homo Sapiens; identical to SEQ ID NO: 190310

SEQ ID NO: 306257 - RNA, 64 nt, Homo Sapiens; identical to SEQ ID NO: 190311

SEQ ID NO: 306258 - RNA, 64 nt, Homo Sapiens; identical to SEQ ID NO: 190312

SEQ ID NO: 306259 - RNA, 64 nt, Homo Sapiens; identical to SEQ ID NO: 190313

SEQ ID NO: 306260 - RNA, 64 nt, Homo Sapiens; identical to SEQ ID NO: 190314

SEQ ID NO: 306261 - RNA, 64 nt, Homo Sapiens; identical to SEQ ID NO: 190315

SEQ ID NO: 306262 - RNA, 64 nt, Homo Sapiens; identical to SEQ ID NO: 190316

SEQ ID NO: 306263 - RNA, 64 nt, Homo Sapiens; identical to SEQ ID NO: 190317

SEQ ID NO: 306264 - RNA, 64 nt, Homo Sapiens; identical to SEQ ID NO: 190318

SEQ ID NO: 306265 - RNA, 64 nt, Homo Sapiens; identical to SEQ ID NO: 190319

SEQ ID NO: 306266 - RNA, 64 nt, Homo Sapiens; identical to SEQ ID NO: 190320

SEQ ID NO: 306267 - RNA, 64 nt, Homo Sapiens; identical to SEQ ID NO: 190321

SEQ ID NO: 306268 - RNA, 64 nt, Homo Sapiens; identical to SEQ ID NO: 190322

SEQ ID NO: 306269 - RNA, 64 nt, Homo Sapiens; identical to SEQ ID NO: 190323

SEQ ID NO: 306270 - RNA, 64 nt, Homo Sapiens; identical to SEQ ID NO: 190324

SEQ ID NO: 306271 - RNA, 64 nt, Homo Sapiens; identical to SEQ ID NO: 190325

SEQ ID NO: 306272 - RNA, 64 nt, Homo Sapiens; identical to SEQ ID NO: 190326

SEQ ID NO: 306273 - RNA, 64 nt, Homo Sapiens; identical to SEQ ID NO: 190327

SEQ ID NO: 306274 - RNA, 64 nt, Homo Sapiens; identical to SEQ ID NO: 190328

SEQ ID NO: 306275 - RNA, 64 nt, Homo Sapiens; identical to SEQ ID NO: 190329

SEQ ID NO: 306276 - RNA, 64 nt, Homo Sapiens; identical to SEQ ID NO: 190330

SEQ ID NO: 306277 - RNA, 64 nt, Homo Sapiens; identical to SEQ ID NO: 190331

SEQ ID NO: 306278 - RNA, 64 nt, Homo Sapiens; identical to SEQ ID NO: 190332

SEQ ID NO: 306279 - RNA, 64 nt, Homo Sapiens; identical to SEQ ID NO: 190333

SEQ ID NO: 306280 - RNA, 64 nt, Homo Sapiens; identical to SEQ ID NO: 190334

SEQ ID NO: 306281 - RNA, 64 nt, Homo Sapiens; identical to SEQ ID NO: 190335

SEQ ID NO: 306282 - RNA, 64 nt, Homo Sapiens; identical to SEQ ID NO: 190336

SEQ ID NO: 306283 - RNA, 64 nt, Homo Sapiens; identical to SEQ ID NO: 190337

SEQ ID NO: 306284 - RNA, 64 nt, Homo Sapiens; identical to SEQ ID NO: 190338

SEQ ID NO: 306285 - RNA, 64 nt, Homo Sapiens; identical to SEQ ID NO: 190339

SEQ ID NO: 306286 - RNA, 61 nt, Homo Sapiens; identical to SEQ ID NO: 190340

SEQ ID NO: 306287 - RNA, 64 nt, Homo Sapiens; identical to SEQ ID NO: 190341

SEQ ID NO: 306288 - RNA, 64 nt, Homo Sapiens; identical to SEQ ID NO: 190342

SEQ ID NO: 306289 - RNA, 64 nt, Homo Sapiens; identical to SEQ ID NO: 190343

SEQ ID NO: 306290 - RNA, 64 nt, Homo Sapiens; identical to SEQ ID NO: 190344

SEQ ID NO: 306291 - RNA, 64 nt, Homo Sapiens; identical to SEQ ID NO: 190345

SEQ ID NO: 306292 - RNA, 64 nt, Homo Sapiens; identical to SEQ ID NO: 190346

SEQ ID NO: 306293 - RNA, 64 nt, Homo Sapiens; identical to SEQ ID NO: 190347

SEQ ID NO: 306294 - RNA, 64 nt, Homo Sapiens; identical to SEQ ID NO: 190348

SEQ ID NO: 306295 - RNA, 64 nt, Homo Sapiens; identical to SEQ ID NO: 190349

SEQ ID NO: 306296 - RNA, 64 nt, Homo Sapiens; identical to SEQ ID NO: 190350

SEQ ID NO: 306297 - RNA, 64 nt, Homo Sapiens; identical to SEQ ID NO: 190351

SEQ ID NO: 306298 - RNA, 64 nt, Homo Sapiens; identical to SEQ ID NO: 190352

SEQ ID NO: 306299 - RNA, 64 nt, Homo Sapiens; identical to SEQ ID NO: 190353

SEQ ID NO: 306300 - RNA, 64 nt, Homo Sapiens; identical to SEQ ID NO: 190354

SEQ ID NO: 306301 - RNA, 64 nt, Homo Sapiens; identical to SEQ ID NO: 190355

SEQ ID NO: 306302 - RNA, 64 nt, Homo Sapiens; identical to SEQ ID NO: 190356

SEQ ID NO: 306303 - RNA, 64 nt, Homo Sapiens; identical to SEQ ID NO: 190357

SEQ ID NO: 306304 - RNA, 64 nt, Homo Sapiens; identical to SEQ ID NO: 190358

SEQ ID NO: 306305 - RNA, 64 nt, Homo Sapiens; identical to SEQ ID NO: 190359

SEQ ID NO: 306306 - RNA, 64 nt, Homo Sapiens; identical to SEQ ID NO: 190360

SEQ ID NO: 306307 - RNA, 64 nt, Homo Sapiens; identical to SEQ ID NO: 190361

SEQ ID NO: 306308 - RNA, 64 nt, Homo Sapiens; identical to SEQ ID NO: 190362

SEQ ID NO: 306309 - RNA, 64 nt, Homo Sapiens; identical to SEQ ID NO: 190363

SEQ ID NO: 306310 - RNA, 64 nt, Homo Sapiens; identical to SEQ ID NO: 190364

SEQ ID NO: 306311 - RNA, 64 nt, Homo Sapiens; identical to SEQ ID NO: 190365

SEQ ID NO: 306312 - RNA, 64 nt, Homo Sapiens; identical to SEQ ID NO: 190366

SEQ ID NO: 306313 - RNA, 63 nt, Homo Sapiens; identical to SEQ ID NO: 190367

SEQ ID NO: 306314 - RNA, 64 nt, Homo Sapiens; identical to SEQ ID NO: 190368

SEQ ID NO: 306315 - RNA, 64 nt, Homo Sapiens; identical to SEQ ID NO: 190369

SEQ ID NO: 306316 - RNA, 64 nt, Homo Sapiens; identical to SEQ ID NO: 190370

SEQ ID NO: 306317 - RNA, 64 nt, Homo Sapiens; identical to SEQ ID NO: 190371

SEQ ID NO: 306318 - RNA, 64 nt, Homo Sapiens; identical to SEQ ID NO: 190372

SEQ ID NO: 306319 - RNA, 64 nt, Homo Sapiens; identical to SEQ ID NO: 190373

SEQ ID NO: 306320 - RNA, 64 nt, Homo Sapiens; identical to SEQ ID NO: 190374

SEQ ID NO: 306321 - RNA, 64 nt, Homo Sapiens; identical to SEQ ID NO: 190375

SEQ ID NO: 306322 - RNA, 64 nt, Homo Sapiens; identical to SEQ ID NO: 190376

SEQ ID NO: 306323 - RNA, 58 nt, Homo Sapiens; identical to SEQ ID NO: 190377

SEQ ID NO: 306324 - RNA, 64 nt, Homo Sapiens; identical to SEQ ID NO: 190378

SEQ ID NO: 306325 - RNA, 64 nt, Homo Sapiens; identical to SEQ ID NO: 190379

SEQ ID NO: 306326 - RNA, 64 nt, Homo Sapiens; identical to SEQ ID NO: 190380

SEQ ID NO: 306327 - RNA, 64 nt, Homo Sapiens; identical to SEQ ID NO: 190381

SEQ ID NO: 306328 - RNA, 64 nt, Homo Sapiens; identical to SEQ ID NO: 190382

SEQ ID NO: 306329 - RNA, 64 nt, Homo Sapiens; identical to SEQ ID NO: 190383

SEQ ID NO: 306330 - RNA, 64 nt, Homo Sapiens; identical to SEQ ID NO: 190384

SEQ ID NO: 306331 - RNA, 64 nt, Homo Sapiens; identical to SEQ ID NO: 190385

SEQ ID NO: 306332 - RNA, 64 nt, Homo Sapiens; identical to SEQ ID NO: 190386

SEQ ID NO: 306333 - RNA, 64 nt, Homo Sapiens; identical to SEQ ID NO: 190387

SEQ ID NO: 306334 - RNA, 64 nt, Homo Sapiens; identical to SEQ ID NO: 190388

SEQ ID NO: 306335 - RNA, 64 nt, Homo Sapiens; identical to SEQ ID NO: 190389

SEQ ID NO: 306336 - RNA, 64 nt, Homo Sapiens; identical to SEQ ID NO: 190390

SEQ ID NO: 306337 - RNA, 64 nt, Homo Sapiens; identical to SEQ ID NO: 190391

SEQ ID NO: 306338 - RNA, 64 nt, Homo Sapiens; identical to SEQ ID NO: 190392

SEQ ID NO: 306339 - RNA, 64 nt, Homo Sapiens; identical to SEQ ID NO: 190393

SEQ ID NO: 306340 - RNA, 64 nt, Homo Sapiens; identical to SEQ ID NO: 190394

SEQ ID NO: 306341 - RNA, 64 nt, Homo Sapiens; identical to SEQ ID NO: 190395

SEQ ID NO: 306342 - RNA, 64 nt, Homo Sapiens; identical to SEQ ID NO: 190396

SEQ ID NO: 306343 - RNA, 64 nt, Homo Sapiens; identical to SEQ ID NO: 190397

SEQ ID NO: 306344 - RNA, 64 nt, Homo Sapiens; identical to SEQ ID NO: 190398

SEQ ID NO: 306345 - RNA, 64 nt, Homo Sapiens; identical to SEQ ID NO: 190399

SEQ ID NO: 306346 - RNA, 62 nt, Homo Sapiens; identical to SEQ ID NO: 253135

SEQ ID NO: 306347 - RNA, 62 nt, Homo Sapiens; identical to SEQ ID NO: 253136

SEQ ID NO: 306348 - RNA, 62 nt, Homo Sapiens; identical to SEQ ID NO: 253137

SEQ ID NO: 306349 - RNA, 62 nt, Homo Sapiens; identical to SEQ ID NO: 253138

SEQ ID NO: 306350 - RNA, 62 nt, Homo Sapiens; identical to SEQ ID NO: 253139

SEQ ID NO: 306351 - RNA, 62 nt, Homo Sapiens; identical to SEQ ID NO: 253140

SEQ ID NO: 306352 - RNA, 62 nt, Homo Sapiens; identical to SEQ ID NO: 253141

SEQ ID NO: 306353 - RNA, 62 nt, Homo Sapiens; identical to SEQ ID NO: 253142

SEQ ID NO: 306354 - RNA, 62 nt, Homo Sapiens; identical to SEQ ID NO: 253143

SEQ ID NO: 306355 - RNA, 62 nt, Homo Sapiens; identical to SEQ ID NO: 253144

SEQ ID NO: 306356 - RNA, 62 nt, Homo Sapiens; identical to SEQ ID NO: 253145

SEQ ID NO: 306357 - RNA, 58 nt, Homo Sapiens; identical to SEQ ID NO: 102991

SEQ ID NO: 306358 - RNA, 62 nt, Homo Sapiens; identical to SEQ ID NO: 253147

SEQ ID NO: 306359 - RNA, 62 nt, Homo Sapiens; identical to SEQ ID NO: 253148

SEQ ID NO: 306360 - RNA, 62 nt, Homo Sapiens; identical to SEQ ID NO: 253149

SEQ ID NO: 306361 - RNA, 62 nt, Homo Sapiens; identical to SEQ ID NO: 253150

SEQ ID NO: 306362 - RNA, 62 nt, Homo Sapiens; identical to SEQ ID NO: 253151

SEQ ID NO: 306363 - RNA, 62 nt, Homo Sapiens; identical to SEQ ID NO: 253152

SEQ ID NO: 306364 - RNA, 62 nt, Homo Sapiens; identical to SEQ ID NO: 253153

SEQ ID NO: 306365 - RNA, 62 nt, Homo Sapiens; identical to SEQ ID NO: 253154

SEQ ID NO: 306366 - RNA, 62 nt, Homo Sapiens; identical to SEQ ID NO: 253155

SEQ ID NO: 306367 - RNA, 62 nt, Homo Sapiens; identical to SEQ ID NO: 253156

SEQ ID NO: 306368 - RNA, 62 nt, Homo Sapiens; identical to SEQ ID NO: 253157

SEQ ID NO: 306369 - RNA, 62 nt, Homo Sapiens; identical to SEQ ID NO: 253158

SEQ ID NO: 306370 - RNA, 62 nt, Homo Sapiens; identical to SEQ ID NO: 253159

SEQ ID NO: 306371 - RNA, 62 nt, Homo Sapiens; identical to SEQ ID NO: 253160

SEQ ID NO: 306372 - RNA, 62 nt, Homo Sapiens; identical to SEQ ID NO: 253161

SEQ ID NO: 306373 - RNA, 62 nt, Homo Sapiens; identical to SEQ ID NO: 253162

SEQ ID NO: 306374 - RNA, 62 nt, Homo Sapiens; identical to SEQ ID NO: 253163

SEQ ID NO: 306375 - RNA, 62 nt, Homo Sapiens; identical to SEQ ID NO: 253164

SEQ ID NO: 306376 - RNA, 62 nt, Homo Sapiens; identical to SEQ ID NO: 253165

SEQ ID NO: 306377 - RNA, 62 nt, Homo Sapiens; identical to SEQ ID NO: 253166

SEQ ID NO: 306378 - RNA, 62 nt, Homo Sapiens; identical to SEQ ID NO: 253167

SEQ ID NO: 306379 - RNA, 62 nt, Homo Sapiens; identical to SEQ ID NO: 253168

SEQ ID NO: 306380 - RNA, 53 nt, Homo Sapiens; identical to SEQ ID NO: 103014

SEQ ID NO: 306381 - RNA, 62 nt, Homo Sapiens; identical to SEQ ID NO: 253170

SEQ ID NO: 306382 - RNA, 62 nt, Homo Sapiens; identical to SEQ ID NO: 253171

SEQ ID NO: 306383 - RNA, 62 nt, Homo Sapiens; identical to SEQ ID NO: 253172

SEQ ID NO: 306384 - RNA, 62 nt, Homo Sapiens; identical to SEQ ID NO: 253173

SEQ ID NO: 306385 - RNA, 62 nt, Homo Sapiens; identical to SEQ ID NO: 253174

SEQ ID NO: 306386 - RNA, 62 nt, Homo Sapiens; identical to SEQ ID NO: 253175

SEQ ID NO: 306387 - RNA, 62 nt, Homo Sapiens; identical to SEQ ID NO: 253176

SEQ ID NO: 306388 - RNA, 62 nt, Homo Sapiens; identical to SEQ ID NO: 253177

SEQ ID NO: 306389 - RNA, 62 nt, Homo Sapiens; identical to SEQ ID NO: 253178

SEQ ID NO: 306390 - RNA, 62 nt, Homo Sapiens; identical to SEQ ID NO: 253179

SEQ ID NO: 306391 - RNA, 62 nt, Homo Sapiens; identical to SEQ ID NO: 253180

SEQ ID NO: 306392 - RNA, 62 nt, Homo Sapiens; identical to SEQ ID NO: 253181

SEQ ID NO: 306393 - RNA, 62 nt, Homo Sapiens; identical to SEQ ID NO: 253182

SEQ ID NO: 306394 - RNA, 62 nt, Homo Sapiens; identical to SEQ ID NO: 253183

SEQ ID NO: 306395 - RNA, 62 nt, Homo Sapiens; identical to SEQ ID NO: 253184

SEQ ID NO: 306396 - RNA, 62 nt, Homo Sapiens; identical to SEQ ID NO: 253185

SEQ ID NO: 306397 - RNA, 62 nt, Homo Sapiens; identical to SEQ ID NO: 253186

SEQ ID NO: 306398 - RNA, 62 nt, Homo Sapiens; identical to SEQ ID NO: 253187

SEQ ID NO: 306399 - RNA, 62 nt, Homo Sapiens; identical to SEQ ID NO: 253188

SEQ ID NO: 306400 - RNA, 62 nt, Homo Sapiens; identical to SEQ ID NO: 253189

SEQ ID NO: 306401 - RNA, 62 nt, Homo Sapiens; identical to SEQ ID NO: 253190

SEQ ID NO: 306402 - RNA, 62 nt, Homo Sapiens; identical to SEQ ID NO: 253191

SEQ ID NO: 306403 - RNA, 62 nt, Homo Sapiens; identical to SEQ ID NO: 253192

SEQ ID NO: 306404 - RNA, 62 nt, Homo Sapiens; identical to SEQ ID NO: 253193

SEQ ID NO: 306405 - RNA, 62 nt, Homo Sapiens; identical to SEQ ID NO: 253194

SEQ ID NO: 306406 - RNA, 62 nt, Homo Sapiens; identical to SEQ ID NO: 253195

SEQ ID NO: 306407 - RNA, 62 nt, Homo Sapiens; identical to SEQ ID NO: 253196

SEQ ID NO: 306408 - RNA, 62 nt, Homo Sapiens; identical to SEQ ID NO: 253197

SEQ ID NO: 306409 - RNA, 62 nt, Homo Sapiens; identical to SEQ ID NO: 253198

SEQ ID NO: 306410 - RNA, 62 nt, Homo Sapiens; identical to SEQ ID NO: 253199

SEQ ID NO: 306411 - RNA, 62 nt, Homo Sapiens; identical to SEQ ID NO: 253200

SEQ ID NO: 306412 - RNA, 62 nt, Homo Sapiens; identical to SEQ ID NO: 253201

SEQ ID NO: 306413 - RNA, 62 nt, Homo Sapiens; identical to SEQ ID NO: 253202

SEQ ID NO: 306414 - RNA, 62 nt, Homo Sapiens; identical to SEQ ID NO: 253203

SEQ ID NO: 306415 - RNA, 62 nt, Homo Sapiens; identical to SEQ ID NO: 253204

SEQ ID NO: 306416 - RNA, 62 nt, Homo Sapiens; identical to SEQ ID NO: 253205

SEQ ID NO: 306417 - RNA, 62 nt, Homo Sapiens; identical to SEQ ID NO: 253206

SEQ ID NO: 306418 - RNA, 62 nt, Homo Sapiens; identical to SEQ ID NO: 253207

SEQ ID NO: 306419 - RNA, 62 nt, Homo Sapiens; identical to SEQ ID NO: 253208

SEQ ID NO: 306420 - RNA, 62 nt, Homo Sapiens; identical to SEQ ID NO: 253209

SEQ ID NO: 306421 - RNA, 62 nt, Homo Sapiens; identical to SEQ ID NO: 253210

SEQ ID NO: 306422 - RNA, 62 nt, Homo Sapiens; identical to SEQ ID NO: 253211

SEQ ID NO: 306423 - RNA, 62 nt, Homo Sapiens; identical to SEQ ID NO: 253212

SEQ ID NO: 306424 - RNA, 62 nt, Homo Sapiens; identical to SEQ ID NO: 253213

SEQ ID NO: 306425 - RNA, 62 nt, Homo Sapiens; identical to SEQ ID NO: 253214

SEQ ID NO: 306426 - RNA, 62 nt, Homo Sapiens; identical to SEQ ID NO: 253215

SEQ ID NO: 306427 - RNA, 62 nt, Homo Sapiens; identical to SEQ ID NO: 253216

SEQ ID NO: 306428 - RNA, 62 nt, Homo Sapiens; identical to SEQ ID NO: 253217

SEQ ID NO: 306429 - RNA, 62 nt, Homo Sapiens; identical to SEQ ID NO: 253218

SEQ ID NO: 306430 - RNA, 62 nt, Homo Sapiens; identical to SEQ ID NO: 253219

SEQ ID NO: 306431 - RNA, 62 nt, Homo Sapiens; identical to SEQ ID NO: 253220

SEQ ID NO: 306432 - RNA, 62 nt, Homo Sapiens; identical to SEQ ID NO: 253221

SEQ ID NO: 306433 - RNA, 62 nt, Homo Sapiens; identical to SEQ ID NO: 253222

SEQ ID NO: 306434 - RNA, 62 nt, Homo Sapiens; identical to SEQ ID NO: 253223

SEQ ID NO: 306435 - RNA, 62 nt, Homo Sapiens; identical to SEQ ID NO: 253224

SEQ ID NO: 306436 - RNA, 62 nt, Homo Sapiens; identical to SEQ ID NO: 253225

SEQ ID NO: 306437 - RNA, 62 nt, Homo Sapiens; identical to SEQ ID NO: 253226

SEQ ID NO: 306438 - RNA, 62 nt, Homo Sapiens; identical to SEQ ID NO: 253227

SEQ ID NO: 306439 - RNA, 62 nt, Homo Sapiens; identical to SEQ ID NO: 253228

SEQ ID NO: 306440 - RNA, 62 nt, Homo Sapiens; identical to SEQ ID NO: 253229

SEQ ID NO: 306441 - RNA, 62 nt, Homo Sapiens; identical to SEQ ID NO: 253230

SEQ ID NO: 306442 - RNA, 62 nt, Homo Sapiens; identical to SEQ ID NO: 253231

SEQ ID NO: 306443 - RNA, 62 nt, Homo Sapiens; identical to SEQ ID NO: 253232

SEQ ID NO: 306444 - RNA, 62 nt, Homo Sapiens; identical to SEQ ID NO: 253233

SEQ ID NO: 306445 - RNA, 62 nt, Homo Sapiens; identical to SEQ ID NO: 253234

SEQ ID NO: 306446 - RNA, 62 nt, Homo Sapiens; identical to SEQ ID NO: 253235

SEQ ID NO: 306447 - RNA, 62 nt, Homo Sapiens; identical to SEQ ID NO: 253236

SEQ ID NO: 306448 - RNA, 62 nt, Homo Sapiens; identical to SEQ ID NO: 253237

SEQ ID NO: 306449 - RNA, 62 nt, Homo Sapiens; identical to SEQ ID NO: 253238

SEQ ID NO: 306450 - RNA, 62 nt, Homo Sapiens; identical to SEQ ID NO: 253239

SEQ ID NO: 306451 - RNA, 62 nt, Homo Sapiens; identical to SEQ ID NO: 253240

SEQ ID NO: 306452 - RNA, 62 nt, Homo Sapiens; identical to SEQ ID NO: 253241

SEQ ID NO: 306453 - RNA, 62 nt, Homo Sapiens; identical to SEQ ID NO: 253242

SEQ ID NO: 306454 - RNA, 62 nt, Homo Sapiens; identical to SEQ ID NO: 253243

SEQ ID NO: 306455 - RNA, 62 nt, Homo Sapiens; identical to SEQ ID NO: 253244

SEQ ID NO: 306456 - RNA, 62 nt, Homo Sapiens; identical to SEQ ID NO: 253245

SEQ ID NO: 306457 - RNA, 62 nt, Homo Sapiens; identical to SEQ ID NO: 253246

SEQ ID NO: 306458 - RNA, 62 nt, Homo Sapiens; identical to SEQ ID NO: 253247

SEQ ID NO: 306459 - RNA, 62 nt, Homo Sapiens; identical to SEQ ID NO: 253248

SEQ ID NO: 306460 - RNA, 62 nt, Homo Sapiens; identical to SEQ ID NO: 253249

SEQ ID NO: 306461 - RNA, 62 nt, Homo Sapiens; identical to SEQ ID NO: 253250

SEQ ID NO: 306462 - RNA, 62 nt, Homo Sapiens; identical to SEQ ID NO: 253251

SEQ ID NO: 306463 - RNA, 62 nt, Homo Sapiens; identical to SEQ ID NO: 253252

SEQ ID NO: 306464 - RNA, 60 nt, Homo Sapiens; identical to SEQ ID NO: 103098

SEQ ID NO: 306465 - RNA, 62 nt, Homo Sapiens; identical to SEQ ID NO: 253254

SEQ ID NO: 306466 - RNA, 62 nt, Homo Sapiens; identical to SEQ ID NO: 253255

SEQ ID NO: 306467 - RNA, 62 nt, Homo Sapiens; identical to SEQ ID NO: 253256

SEQ ID NO: 306468 - RNA, 62 nt, Homo Sapiens; identical to SEQ ID NO: 253257

SEQ ID NO: 306469 - RNA, 62 nt, Homo Sapiens; identical to SEQ ID NO: 253258

SEQ ID NO: 306470 - RNA, 62 nt, Homo Sapiens; identical to SEQ ID NO: 253259

SEQ ID NO: 306471 - RNA, 62 nt, Homo Sapiens; identical to SEQ ID NO: 253260

SEQ ID NO: 306472 - RNA, 62 nt, Homo Sapiens; identical to SEQ ID NO: 253261

SEQ ID NO: 306473 - RNA, 62 nt, Homo Sapiens; identical to SEQ ID NO: 253262

SEQ ID NO: 306474 - RNA, 62 nt, Homo Sapiens; identical to SEQ ID NO: 253263

SEQ ID NO: 306475 - RNA, 62 nt, Homo Sapiens; identical to SEQ ID NO: 253264

SEQ ID NO: 306476 - RNA, 62 nt, Homo Sapiens; identical to SEQ ID NO: 253265

SEQ ID NO: 306477 - RNA, 62 nt, Homo Sapiens; identical to SEQ ID NO: 253266

SEQ ID NO: 306478 - RNA, 62 nt, Homo Sapiens; identical to SEQ ID NO: 253267

SEQ ID NO: 306479 - RNA, 62 nt, Homo Sapiens; identical to SEQ ID NO: 253268

SEQ ID NO: 306480 - RNA, 62 nt, Homo Sapiens; identical to SEQ ID NO: 253269

SEQ ID NO: 306481 - RNA, 62 nt, Homo Sapiens; identical to SEQ ID NO: 253270

SEQ ID NO: 306482 - RNA, 62 nt, Homo Sapiens; identical to SEQ ID NO: 253271

SEQ ID NO: 306483 - RNA, 62 nt, Homo Sapiens; identical to SEQ ID NO: 253272

SEQ ID NO: 306484 - RNA, 62 nt, Homo Sapiens; identical to SEQ ID NO: 253273

SEQ ID NO: 306485 - RNA, 62 nt, Homo Sapiens; identical to SEQ ID NO: 253274

SEQ ID NO: 306486 - RNA, 62 nt, Homo Sapiens; identical to SEQ ID NO: 253275

SEQ ID NO: 306487 - RNA, 62 nt, Homo Sapiens; identical to SEQ ID NO: 253276

SEQ ID NO: 306488 - RNA, 62 nt, Homo Sapiens; identical to SEQ ID NO: 253277

SEQ ID NO: 306489 - RNA, 62 nt, Homo Sapiens; identical to SEQ ID NO: 253278

SEQ ID NO: 306490 - RNA, 62 nt, Homo Sapiens; identical to SEQ ID NO: 253279

SEQ ID NO: 306491 - RNA, 62 nt, Homo Sapiens; identical to SEQ ID NO: 253280

SEQ ID NO: 306492 - RNA, 62 nt, Homo Sapiens; identical to SEQ ID NO: 253281

SEQ ID NO: 306493 - RNA, 62 nt, Homo Sapiens; identical to SEQ ID NO: 253282

SEQ ID NO: 306494 - RNA, 62 nt, Homo Sapiens; identical to SEQ ID NO: 253283

SEQ ID NO: 306495 - RNA, 62 nt, Homo Sapiens; identical to SEQ ID NO: 253284

SEQ ID NO: 306496 - RNA, 62 nt, Homo Sapiens; identical to SEQ ID NO: 253285

SEQ ID NO: 306497 - RNA, 62 nt, Homo Sapiens; identical to SEQ ID NO: 253286

SEQ ID NO: 306498 - RNA, 62 nt, Homo Sapiens; identical to SEQ ID NO: 253287

SEQ ID NO: 306499 - RNA, 62 nt, Homo Sapiens; identical to SEQ ID NO: 253288

SEQ ID NO: 306500 - RNA, 62 nt, Homo Sapiens; identical to SEQ ID NO: 253289

SEQ ID NO: 306501 - RNA, 62 nt, Homo Sapiens; identical to SEQ ID NO: 253290

SEQ ID NO: 306502 - RNA, 62 nt, Homo Sapiens; identical to SEQ ID NO: 253291

SEQ ID NO: 306503 - RNA, 62 nt, Homo Sapiens; identical to SEQ ID NO: 253292

SEQ ID NO: 306504 - RNA, 62 nt, Homo Sapiens; identical to SEQ ID NO: 253293

SEQ ID NO: 306505 - RNA, 62 nt, Homo Sapiens; identical to SEQ ID NO: 253294

SEQ ID NO: 306506 - RNA, 62 nt, Homo Sapiens; identical to SEQ ID NO: 253295

SEQ ID NO: 306507 - RNA, 62 nt, Homo Sapiens; identical to SEQ ID NO: 253296

SEQ ID NO: 306508 - RNA, 62 nt, Homo Sapiens; identical to SEQ ID NO: 253297

SEQ ID NO: 306509 - RNA, 62 nt, Homo Sapiens; identical to SEQ ID NO: 253298

SEQ ID NO: 306510 - RNA, 62 nt, Homo Sapiens; identical to SEQ ID NO: 253299

SEQ ID NO: 306511 - RNA, 62 nt, Homo Sapiens; identical to SEQ ID NO: 253300

SEQ ID NO: 306512 - RNA, 62 nt, Homo Sapiens; identical to SEQ ID NO: 253301

SEQ ID NO: 306513 - RNA, 62 nt, Homo Sapiens; identical to SEQ ID NO: 253302

SEQ ID NO: 306514 - RNA, 62 nt, Homo Sapiens; identical to SEQ ID NO: 253303

SEQ ID NO: 306515 - RNA, 62 nt, Homo Sapiens; identical to SEQ ID NO: 253304

SEQ ID NO: 306516 - RNA, 62 nt, Homo Sapiens; identical to SEQ ID NO: 253305

SEQ ID NO: 306517 - RNA, 62 nt, Homo Sapiens; identical to SEQ ID NO: 253306

SEQ ID NO: 306518 - RNA, 62 nt, Homo Sapiens; identical to SEQ ID NO: 253307

SEQ ID NO: 306519 - RNA, 62 nt, Homo Sapiens; identical to SEQ ID NO: 253308

SEQ ID NO: 306520 - RNA, 62 nt, Homo Sapiens; identical to SEQ ID NO: 253309

SEQ ID NO: 306521 - RNA, 62 nt, Homo Sapiens; identical to SEQ ID NO: 253310

SEQ ID NO: 306522 - RNA, 62 nt, Homo Sapiens; identical to SEQ ID NO: 253311

SEQ ID NO: 306523 - RNA, 62 nt, Homo Sapiens; identical to SEQ ID NO: 253312

SEQ ID NO: 306524 - RNA, 62 nt, Homo Sapiens; identical to SEQ ID NO: 253313

SEQ ID NO: 306525 - RNA, 62 nt, Homo Sapiens; identical to SEQ ID NO: 253314

SEQ ID NO: 306526 - RNA, 62 nt, Homo Sapiens; identical to SEQ ID NO: 253315

SEQ ID NO: 306527 - RNA, 62 nt, Homo Sapiens; identical to SEQ ID NO: 253316

SEQ ID NO: 306528 - RNA, 62 nt, Homo Sapiens; identical to SEQ ID NO: 253317

SEQ ID NO: 306529 - RNA, 62 nt, Homo Sapiens; identical to SEQ ID NO: 253318

SEQ ID NO: 306530 - RNA, 62 nt, Homo Sapiens; identical to SEQ ID NO: 253319

SEQ ID NO: 306531 - RNA, 62 nt, Homo Sapiens; identical to SEQ ID NO: 253320

SEQ ID NO: 306532 - RNA, 62 nt, Homo Sapiens; identical to SEQ ID NO: 253321

SEQ ID NO: 306533 - RNA, 62 nt, Homo Sapiens; identical to SEQ ID NO: 253322

SEQ ID NO: 306534 - RNA, 62 nt, Homo Sapiens; identical to SEQ ID NO: 253323

SEQ ID NO: 306535 - RNA, 62 nt, Homo Sapiens; identical to SEQ ID NO: 253324

SEQ ID NO: 306536 - RNA, 62 nt, Homo Sapiens; identical to SEQ ID NO: 253325

SEQ ID NO: 306537 - RNA, 62 nt, Homo Sapiens; identical to SEQ ID NO: 253326

SEQ ID NO: 306538 - RNA, 62 nt, Homo Sapiens; identical to SEQ ID NO: 253327

SEQ ID NO: 306539 - RNA, 62 nt, Homo Sapiens; identical to SEQ ID NO: 253328

SEQ ID NO: 306540 - RNA, 62 nt, Homo Sapiens; identical to SEQ ID NO: 253329

SEQ ID NO: 306541 - RNA, 62 nt, Homo Sapiens; identical to SEQ ID NO: 253330

SEQ ID NO: 306542 - RNA, 62 nt, Homo Sapiens; identical to SEQ ID NO: 253331

SEQ ID NO: 306543 - RNA, 62 nt, Homo Sapiens; identical to SEQ ID NO: 253332

SEQ ID NO: 306544 - RNA, 62 nt, Homo Sapiens; identical to SEQ ID NO: 253333

SEQ ID NO: 306545 - RNA, 62 nt, Homo Sapiens; identical to SEQ ID NO: 253334

SEQ ID NO: 306546 - RNA, 62 nt, Homo Sapiens; identical to SEQ ID NO: 253335

SEQ ID NO: 306547 - RNA, 62 nt, Homo Sapiens; identical to SEQ ID NO: 253336

SEQ ID NO: 306548 - RNA, 62 nt, Homo Sapiens; identical to SEQ ID NO: 253337

SEQ ID NO: 306549 - RNA, 62 nt, Homo Sapiens; identical to SEQ ID NO: 253338

SEQ ID NO: 306550 - RNA, 62 nt, Homo Sapiens; identical to SEQ ID NO: 253339

SEQ ID NO: 306551 - RNA, 62 nt, Homo Sapiens; identical to SEQ ID NO: 253340

SEQ ID NO: 306552 - RNA, 62 nt, Homo Sapiens; identical to SEQ ID NO: 253341

SEQ ID NO: 306553 - RNA, 62 nt, Homo Sapiens; identical to SEQ ID NO: 253342

SEQ ID NO: 306554 - RNA, 62 nt, Homo Sapiens; identical to SEQ ID NO: 253343

SEQ ID NO: 306555 - RNA, 62 nt, Homo Sapiens; identical to SEQ ID NO: 253344

SEQ ID NO: 306556 - RNA, 62 nt, Homo Sapiens; identical to SEQ ID NO: 253345

SEQ ID NO: 306557 - RNA, 62 nt, Homo Sapiens; identical to SEQ ID NO: 253346

SEQ ID NO: 306558 - RNA, 62 nt, Homo Sapiens; identical to SEQ ID NO: 253347

SEQ ID NO: 306559 - RNA, 62 nt, Homo Sapiens; identical to SEQ ID NO: 253348

SEQ ID NO: 306560 - RNA, 62 nt, Homo Sapiens; identical to SEQ ID NO: 253349

SEQ ID NO: 306561 - RNA, 62 nt, Homo Sapiens; identical to SEQ ID NO: 253350

SEQ ID NO: 306562 - RNA, 51 nt, Homo Sapiens; identical to SEQ ID NO: 103196

SEQ ID NO: 306563 - RNA, 62 nt, Homo Sapiens; identical to SEQ ID NO: 253352

SEQ ID NO: 306564 - RNA, 62 nt, Homo Sapiens; identical to SEQ ID NO: 253353

SEQ ID NO: 306565 - RNA, 62 nt, Homo Sapiens; identical to SEQ ID NO: 253354

SEQ ID NO: 306566 - RNA, 62 nt, Homo Sapiens; identical to SEQ ID NO: 253355

SEQ ID NO: 306567 - RNA, 62 nt, Homo Sapiens; identical to SEQ ID NO: 253356

SEQ ID NO: 306568 - RNA, 62 nt, Homo Sapiens; identical to SEQ ID NO: 253357

SEQ ID NO: 306569 - RNA, 62 nt, Homo Sapiens; identical to SEQ ID NO: 253358

SEQ ID NO: 306570 - RNA, 62 nt, Homo Sapiens; identical to SEQ ID NO: 253359

SEQ ID NO: 306571 - RNA, 62 nt, Homo Sapiens; identical to SEQ ID NO: 253360

SEQ ID NO: 306572 - RNA, 62 nt, Homo Sapiens; identical to SEQ ID NO: 253361

SEQ ID NO: 306573 - RNA, 62 nt, Homo Sapiens; identical to SEQ ID NO: 253362

SEQ ID NO: 306574 - RNA, 62 nt, Homo Sapiens; identical to SEQ ID NO: 253363

SEQ ID NO: 306575 - RNA, 62 nt, Homo Sapiens; identical to SEQ ID NO: 253364

SEQ ID NO: 306576 - RNA, 62 nt, Homo Sapiens; identical to SEQ ID NO: 253365

SEQ ID NO: 306577 - RNA, 62 nt, Homo Sapiens; identical to SEQ ID NO: 253366

SEQ ID NO: 306578 - RNA, 62 nt, Homo Sapiens; identical to SEQ ID NO: 253367

SEQ ID NO: 306579 - RNA, 62 nt, Homo Sapiens; identical to SEQ ID NO: 253368

SEQ ID NO: 306580 - RNA, 62 nt, Homo Sapiens; identical to SEQ ID NO: 253369

SEQ ID NO: 306581 - RNA, 62 nt, Homo Sapiens; identical to SEQ ID NO: 253370

SEQ ID NO: 306582 - RNA, 62 nt, Homo Sapiens; identical to SEQ ID NO: 253371

SEQ ID NO: 306583 - RNA, 62 nt, Homo Sapiens; identical to SEQ ID NO: 253372

SEQ ID NO: 306584 - RNA, 62 nt, Homo Sapiens; identical to SEQ ID NO: 253373

SEQ ID NO: 306585 - RNA, 62 nt, Homo Sapiens; identical to SEQ ID NO: 253374

SEQ ID NO: 306586 - RNA, 62 nt, Homo Sapiens; identical to SEQ ID NO: 253375

SEQ ID NO: 306587 - RNA, 62 nt, Homo Sapiens; identical to SEQ ID NO: 253376

SEQ ID NO: 306588 - RNA, 62 nt, Homo Sapiens; identical to SEQ ID NO: 253377

SEQ ID NO: 306589 - RNA, 62 nt, Homo Sapiens; identical to SEQ ID NO: 253378

SEQ ID NO: 306590 - RNA, 62 nt, Homo Sapiens; identical to SEQ ID NO: 253379

SEQ ID NO: 306591 - RNA, 62 nt, Homo Sapiens; identical to SEQ ID NO: 253380

SEQ ID NO: 306592 - RNA, 62 nt, Homo Sapiens; identical to SEQ ID NO: 253381

SEQ ID NO: 306593 - RNA, 62 nt, Homo Sapiens; identical to SEQ ID NO: 253382

SEQ ID NO: 306594 - RNA, 62 nt, Homo Sapiens; identical to SEQ ID NO: 253383

SEQ ID NO: 306595 - RNA, 62 nt, Homo Sapiens; identical to SEQ ID NO: 253384

SEQ ID NO: 306596 - RNA, 62 nt, Homo Sapiens; identical to SEQ ID NO: 253385

SEQ ID NO: 306597 - RNA, 62 nt, Homo Sapiens; identical to SEQ ID NO: 253386

SEQ ID NO: 306598 - RNA, 62 nt, Homo Sapiens; identical to SEQ ID NO: 253387

SEQ ID NO: 306599 - RNA, 62 nt, Homo Sapiens; identical to SEQ ID NO: 253388

SEQ ID NO: 306600 - RNA, 62 nt, Homo Sapiens; identical to SEQ ID NO: 253389

SEQ ID NO: 306601 - RNA, 62 nt, Homo Sapiens; identical to SEQ ID NO: 253390

SEQ ID NO: 306602 - RNA, 62 nt, Homo Sapiens; identical to SEQ ID NO: 253391

SEQ ID NO: 306603 - RNA, 62 nt, Homo Sapiens; identical to SEQ ID NO: 253392

SEQ ID NO: 306604 - RNA, 62 nt, Homo Sapiens; identical to SEQ ID NO: 253393

SEQ ID NO: 306605 - RNA, 62 nt, Homo Sapiens; identical to SEQ ID NO: 253394

SEQ ID NO: 306606 - RNA, 62 nt, Homo Sapiens; identical to SEQ ID NO: 253395

SEQ ID NO: 306607 - RNA, 62 nt, Homo Sapiens; identical to SEQ ID NO: 253396

SEQ ID NO: 306608 - RNA, 62 nt, Homo Sapiens; identical to SEQ ID NO: 253397

SEQ ID NO: 306609 - RNA, 62 nt, Homo Sapiens; identical to SEQ ID NO: 253398

SEQ ID NO: 306610 - RNA, 62 nt, Homo Sapiens; identical to SEQ ID NO: 253399

SEQ ID NO: 306611 - RNA, 62 nt, Homo Sapiens; identical to SEQ ID NO: 253400

SEQ ID NO: 306612 - RNA, 62 nt, Homo Sapiens; identical to SEQ ID NO: 253401

SEQ ID NO: 306613 - RNA, 62 nt, Homo Sapiens; identical to SEQ ID NO: 253402

SEQ ID NO: 306614 - RNA, 62 nt, Homo Sapiens; identical to SEQ ID NO: 253403

SEQ ID NO: 306615 - RNA, 62 nt, Homo Sapiens; identical to SEQ ID NO: 253404

SEQ ID NO: 306616 - RNA, 62 nt, Homo Sapiens; identical to SEQ ID NO: 253405

SEQ ID NO: 306617 - RNA, 62 nt, Homo Sapiens; identical to SEQ ID NO: 253406

SEQ ID NO: 306618 - RNA, 62 nt, Homo Sapiens; identical to SEQ ID NO: 253407

SEQ ID NO: 306619 - RNA, 62 nt, Homo Sapiens; identical to SEQ ID NO: 253408

SEQ ID NO: 306620 - RNA, 62 nt, Homo Sapiens; identical to SEQ ID NO: 253409

SEQ ID NO: 306621 - RNA, 62 nt, Homo Sapiens; identical to SEQ ID NO: 253410

SEQ ID NO: 306622 - RNA, 62 nt, Homo Sapiens; identical to SEQ ID NO: 253411

SEQ ID NO: 306623 - RNA, 62 nt, Homo Sapiens; identical to SEQ ID NO: 253412

SEQ ID NO: 306624 - RNA, 62 nt, Homo Sapiens; identical to SEQ ID NO: 253413

SEQ ID NO: 306625 - RNA, 62 nt, Homo Sapiens; identical to SEQ ID NO: 253414

SEQ ID NO: 306626 - RNA, 62 nt, Homo Sapiens; identical to SEQ ID NO: 253415

SEQ ID NO: 306627 - RNA, 62 nt, Homo Sapiens; identical to SEQ ID NO: 253416

SEQ ID NO: 306628 - RNA, 62 nt, Homo Sapiens; identical to SEQ ID NO: 253417

SEQ ID NO: 306629 - RNA, 62 nt, Homo Sapiens; identical to SEQ ID NO: 253418

SEQ ID NO: 306630 - RNA, 62 nt, Homo Sapiens; identical to SEQ ID NO: 253419

SEQ ID NO: 306631 - RNA, 62 nt, Homo Sapiens; identical to SEQ ID NO: 253420

SEQ ID NO: 306632 - RNA, 62 nt, Homo Sapiens; identical to SEQ ID NO: 253421

SEQ ID NO: 306633 - RNA, 62 nt, Homo Sapiens; identical to SEQ ID NO: 253422

SEQ ID NO: 306634 - RNA, 62 nt, Homo Sapiens; identical to SEQ ID NO: 253423

SEQ ID NO: 306635 - RNA, 62 nt, Homo Sapiens; identical to SEQ ID NO: 253424

SEQ ID NO: 306636 - RNA, 62 nt, Homo Sapiens; identical to SEQ ID NO: 253425

SEQ ID NO: 306637 - RNA, 62 nt, Homo Sapiens; identical to SEQ ID NO: 253426

SEQ ID NO: 306638 - RNA, 62 nt, Homo Sapiens; identical to SEQ ID NO: 253427

SEQ ID NO: 306639 - RNA, 62 nt, Homo Sapiens; identical to SEQ ID NO: 253428

SEQ ID NO: 306640 - RNA, 62 nt, Homo Sapiens; identical to SEQ ID NO: 253429

SEQ ID NO: 306641 - RNA, 62 nt, Homo Sapiens; identical to SEQ ID NO: 253430

SEQ ID NO: 306642 - RNA, 62 nt, Homo Sapiens; identical to SEQ ID NO: 253431

SEQ ID NO: 306643 - RNA, 62 nt, Homo Sapiens; identical to SEQ ID NO: 253432

SEQ ID NO: 306644 - RNA, 62 nt, Homo Sapiens; identical to SEQ ID NO: 253433

SEQ ID NO: 306645 - RNA, 62 nt, Homo Sapiens; identical to SEQ ID NO: 253434

SEQ ID NO: 306646 - RNA, 62 nt, Homo Sapiens; identical to SEQ ID NO: 253435

SEQ ID NO: 306647 - RNA, 62 nt, Homo Sapiens; identical to SEQ ID NO: 253436

SEQ ID NO: 306648 - RNA, 62 nt, Homo Sapiens; identical to SEQ ID NO: 253437

SEQ ID NO: 306649 - RNA, 62 nt, Homo Sapiens; identical to SEQ ID NO: 253438

SEQ ID NO: 306650 - RNA, 62 nt, Homo Sapiens; identical to SEQ ID NO: 253439

SEQ ID NO: 306651 - RNA, 62 nt, Homo Sapiens; identical to SEQ ID NO: 253440

SEQ ID NO: 306652 - RNA, 62 nt, Homo Sapiens; identical to SEQ ID NO: 253441

SEQ ID NO: 306653 - RNA, 62 nt, Homo Sapiens; identical to SEQ ID NO: 253442

SEQ ID NO: 306654 - RNA, 62 nt, Homo Sapiens; identical to SEQ ID NO: 253443

SEQ ID NO: 306655 - RNA, 66 nt, Homo Sapiens; identical to SEQ ID NO: 253444

SEQ ID NO: 306656 - RNA, 66 nt, Homo Sapiens; identical to SEQ ID NO: 253445

SEQ ID NO: 306657 - RNA, 66 nt, Homo Sapiens; identical to SEQ ID NO: 253446

SEQ ID NO: 306658 - RNA, 66 nt, Homo Sapiens; identical to SEQ ID NO: 253447

SEQ ID NO: 306659 - RNA, 66 nt, Homo Sapiens; identical to SEQ ID NO: 253448

SEQ ID NO: 306660 - RNA, 66 nt, Homo Sapiens; identical to SEQ ID NO: 253449

SEQ ID NO: 306661 - RNA, 66 nt, Homo Sapiens; identical to SEQ ID NO: 253450

SEQ ID NO: 306662 - RNA, 66 nt, Homo Sapiens; identical to SEQ ID NO: 253451

SEQ ID NO: 306663 - RNA, 66 nt, Homo Sapiens; identical to SEQ ID NO: 253452

SEQ ID NO: 306664 - RNA, 66 nt, Homo Sapiens; identical to SEQ ID NO: 253453

SEQ ID NO: 306665 - RNA, 66 nt, Homo Sapiens; identical to SEQ ID NO: 253454

SEQ ID NO: 306666 - RNA, 58 nt, Homo Sapiens; identical to SEQ ID NO: 102991

SEQ ID NO: 306667 - RNA, 66 nt, Homo Sapiens; identical to SEQ ID NO: 253456

SEQ ID NO: 306668 - RNA, 66 nt, Homo Sapiens; identical to SEQ ID NO: 253457

SEQ ID NO: 306669 - RNA, 66 nt, Homo Sapiens; identical to SEQ ID NO: 253458

SEQ ID NO: 306670 - RNA, 66 nt, Homo Sapiens; identical to SEQ ID NO: 253459

SEQ ID NO: 306671 - RNA, 66 nt, Homo Sapiens; identical to SEQ ID NO: 253460

SEQ ID NO: 306672 - RNA, 66 nt, Homo Sapiens; identical to SEQ ID NO: 253461

SEQ ID NO: 306673 - RNA, 66 nt, Homo Sapiens; identical to SEQ ID NO: 253462

SEQ ID NO: 306674 - RNA, 66 nt, Homo Sapiens; identical to SEQ ID NO: 253463

SEQ ID NO: 306675 - RNA, 66 nt, Homo Sapiens; identical to SEQ ID NO: 253464

SEQ ID NO: 306676 - RNA, 66 nt, Homo Sapiens; identical to SEQ ID NO: 253465

SEQ ID NO: 306677 - RNA, 66 nt, Homo Sapiens; identical to SEQ ID NO: 253466

SEQ ID NO: 306678 - RNA, 66 nt, Homo Sapiens; identical to SEQ ID NO: 253467

SEQ ID NO: 306679 - RNA, 66 nt, Homo Sapiens; identical to SEQ ID NO: 253468

SEQ ID NO: 306680 - RNA, 66 nt, Homo Sapiens; identical to SEQ ID NO: 253469

SEQ ID NO: 306681 - RNA, 66 nt, Homo Sapiens; identical to SEQ ID NO: 253470

SEQ ID NO: 306682 - RNA, 66 nt, Homo Sapiens; identical to SEQ ID NO: 253471

SEQ ID NO: 306683 - RNA, 66 nt, Homo Sapiens; identical to SEQ ID NO: 253472

SEQ ID NO: 306684 - RNA, 66 nt, Homo Sapiens; identical to SEQ ID NO: 253473

SEQ ID NO: 306685 - RNA, 66 nt, Homo Sapiens; identical to SEQ ID NO: 253474

SEQ ID NO: 306686 - RNA, 66 nt, Homo Sapiens; identical to SEQ ID NO: 253475

SEQ ID NO: 306687 - RNA, 66 nt, Homo Sapiens; identical to SEQ ID NO: 253476

SEQ ID NO: 306688 - RNA, 66 nt, Homo Sapiens; identical to SEQ ID NO: 253477

SEQ ID NO: 306689 - RNA, 53 nt, Homo Sapiens; identical to SEQ ID NO: 103014

SEQ ID NO: 306690 - RNA, 66 nt, Homo Sapiens; identical to SEQ ID NO: 253479

SEQ ID NO: 306691 - RNA, 66 nt, Homo Sapiens; identical to SEQ ID NO: 253480

SEQ ID NO: 306692 - RNA, 66 nt, Homo Sapiens; identical to SEQ ID NO: 253481

SEQ ID NO: 306693 - RNA, 66 nt, Homo Sapiens; identical to SEQ ID NO: 253482

SEQ ID NO: 306694 - RNA, 66 nt, Homo Sapiens; identical to SEQ ID NO: 253483

SEQ ID NO: 306695 - RNA, 66 nt, Homo Sapiens; identical to SEQ ID NO: 253484

SEQ ID NO: 306696 - RNA, 66 nt, Homo Sapiens; identical to SEQ ID NO: 253485

SEQ ID NO: 306697 - RNA, 66 nt, Homo Sapiens; identical to SEQ ID NO: 253486

SEQ ID NO: 306698 - RNA, 66 nt, Homo Sapiens; identical to SEQ ID NO: 253487

SEQ ID NO: 306699 - RNA, 66 nt, Homo Sapiens; identical to SEQ ID NO: 253488

SEQ ID NO: 306700 - RNA, 66 nt, Homo Sapiens; identical to SEQ ID NO: 253489

SEQ ID NO: 306701 - RNA, 66 nt, Homo Sapiens; identical to SEQ ID NO: 253490

SEQ ID NO: 306702 - RNA, 66 nt, Homo Sapiens; identical to SEQ ID NO: 253491

SEQ ID NO: 306703 - RNA, 66 nt, Homo Sapiens; identical to SEQ ID NO: 253492

SEQ ID NO: 306704 - RNA, 66 nt, Homo Sapiens; identical to SEQ ID NO: 253493

SEQ ID NO: 306705 - RNA, 66 nt, Homo Sapiens; identical to SEQ ID NO: 253494

SEQ ID NO: 306706 - RNA, 66 nt, Homo Sapiens; identical to SEQ ID NO: 253495

SEQ ID NO: 306707 - RNA, 66 nt, Homo Sapiens; identical to SEQ ID NO: 253496

SEQ ID NO: 306708 - RNA, 66 nt, Homo Sapiens; identical to SEQ ID NO: 253497

SEQ ID NO: 306709 - RNA, 66 nt, Homo Sapiens; identical to SEQ ID NO: 253498

SEQ ID NO: 306710 - RNA, 66 nt, Homo Sapiens; identical to SEQ ID NO: 253499

SEQ ID NO: 306711 - RNA, 66 nt, Homo Sapiens; identical to SEQ ID NO: 253500

SEQ ID NO: 306712 - RNA, 66 nt, Homo Sapiens; identical to SEQ ID NO: 253501

SEQ ID NO: 306713 - RNA, 66 nt, Homo Sapiens; identical to SEQ ID NO: 253502

SEQ ID NO: 306714 - RNA, 66 nt, Homo Sapiens; identical to SEQ ID NO: 253503

SEQ ID NO: 306715 - RNA, 66 nt, Homo Sapiens; identical to SEQ ID NO: 253504

SEQ ID NO: 306716 - RNA, 66 nt, Homo Sapiens; identical to SEQ ID NO: 253505

SEQ ID NO: 306717 - RNA, 66 nt, Homo Sapiens; identical to SEQ ID NO: 253506

SEQ ID NO: 306718 - RNA, 66 nt, Homo Sapiens; identical to SEQ ID NO: 253507

SEQ ID NO: 306719 - RNA, 66 nt, Homo Sapiens; identical to SEQ ID NO: 253508

SEQ ID NO: 306720 - RNA, 66 nt, Homo Sapiens; identical to SEQ ID NO: 253509

SEQ ID NO: 306721 - RNA, 66 nt, Homo Sapiens; identical to SEQ ID NO: 253510

SEQ ID NO: 306722 - RNA, 66 nt, Homo Sapiens; identical to SEQ ID NO: 253511

SEQ ID NO: 306723 - RNA, 66 nt, Homo Sapiens; identical to SEQ ID NO: 253512

SEQ ID NO: 306724 - RNA, 66 nt, Homo Sapiens; identical to SEQ ID NO: 253513

SEQ ID NO: 306725 - RNA, 66 nt, Homo Sapiens; identical to SEQ ID NO: 253514

SEQ ID NO: 306726 - RNA, 66 nt, Homo Sapiens; identical to SEQ ID NO: 253515

SEQ ID NO: 306727 - RNA, 66 nt, Homo Sapiens; identical to SEQ ID NO: 253516

SEQ ID NO: 306728 - RNA, 66 nt, Homo Sapiens; identical to SEQ ID NO: 253517

SEQ ID NO: 306729 - RNA, 66 nt, Homo Sapiens; identical to SEQ ID NO: 253518

SEQ ID NO: 306730 - RNA, 66 nt, Homo Sapiens; identical to SEQ ID NO: 253519

SEQ ID NO: 306731 - RNA, 66 nt, Homo Sapiens; identical to SEQ ID NO: 253520

SEQ ID NO: 306732 - RNA, 66 nt, Homo Sapiens; identical to SEQ ID NO: 253521

SEQ ID NO: 306733 - RNA, 66 nt, Homo Sapiens; identical to SEQ ID NO: 253522

SEQ ID NO: 306734 - RNA, 66 nt, Homo Sapiens; identical to SEQ ID NO: 253523

SEQ ID NO: 306735 - RNA, 66 nt, Homo Sapiens; identical to SEQ ID NO: 253524

SEQ ID NO: 306736 - RNA, 66 nt, Homo Sapiens; identical to SEQ ID NO: 253525

SEQ ID NO: 306737 - RNA, 66 nt, Homo Sapiens; identical to SEQ ID NO: 253526

SEQ ID NO: 306738 - RNA, 66 nt, Homo Sapiens; identical to SEQ ID NO: 253527

SEQ ID NO: 306739 - RNA, 66 nt, Homo Sapiens; identical to SEQ ID NO: 253528

SEQ ID NO: 306740 - RNA, 66 nt, Homo Sapiens; identical to SEQ ID NO: 253529

SEQ ID NO: 306741 - RNA, 66 nt, Homo Sapiens; identical to SEQ ID NO: 253530

SEQ ID NO: 306742 - RNA, 66 nt, Homo Sapiens; identical to SEQ ID NO: 253531

SEQ ID NO: 306743 - RNA, 66 nt, Homo Sapiens; identical to SEQ ID NO: 253532

SEQ ID NO: 306744 - RNA, 66 nt, Homo Sapiens; identical to SEQ ID NO: 253533

SEQ ID NO: 306745 - RNA, 66 nt, Homo Sapiens; identical to SEQ ID NO: 253534

SEQ ID NO: 306746 - RNA, 66 nt, Homo Sapiens; identical to SEQ ID NO: 253535

SEQ ID NO: 306747 - RNA, 66 nt, Homo Sapiens; identical to SEQ ID NO: 253536

SEQ ID NO: 306748 - RNA, 66 nt, Homo Sapiens; identical to SEQ ID NO: 253537

SEQ ID NO: 306749 - RNA, 66 nt, Homo Sapiens; identical to SEQ ID NO: 253538

SEQ ID NO: 306750 - RNA, 66 nt, Homo Sapiens; identical to SEQ ID NO: 253539

SEQ ID NO: 306751 - RNA, 66 nt, Homo Sapiens; identical to SEQ ID NO: 253540

SEQ ID NO: 306752 - RNA, 66 nt, Homo Sapiens; identical to SEQ ID NO: 253541

SEQ ID NO: 306753 - RNA, 66 nt, Homo Sapiens; identical to SEQ ID NO: 253542

SEQ ID NO: 306754 - RNA, 66 nt, Homo Sapiens; identical to SEQ ID NO: 253543

SEQ ID NO: 306755 - RNA, 66 nt, Homo Sapiens; identical to SEQ ID NO: 253544

SEQ ID NO: 306756 - RNA, 66 nt, Homo Sapiens; identical to SEQ ID NO: 253545

SEQ ID NO: 306757 - RNA, 66 nt, Homo Sapiens; identical to SEQ ID NO: 253546

SEQ ID NO: 306758 - RNA, 66 nt, Homo Sapiens; identical to SEQ ID NO: 253547

SEQ ID NO: 306759 - RNA, 66 nt, Homo Sapiens; identical to SEQ ID NO: 253548

SEQ ID NO: 306760 - RNA, 66 nt, Homo Sapiens; identical to SEQ ID NO: 253549

SEQ ID NO: 306761 - RNA, 66 nt, Homo Sapiens; identical to SEQ ID NO: 253550

SEQ ID NO: 306762 - RNA, 66 nt, Homo Sapiens; identical to SEQ ID NO: 253551

SEQ ID NO: 306763 - RNA, 66 nt, Homo Sapiens; identical to SEQ ID NO: 253552

SEQ ID NO: 306764 - RNA, 66 nt, Homo Sapiens; identical to SEQ ID NO: 253553

SEQ ID NO: 306765 - RNA, 66 nt, Homo Sapiens; identical to SEQ ID NO: 253554

SEQ ID NO: 306766 - RNA, 66 nt, Homo Sapiens; identical to SEQ ID NO: 253555

SEQ ID NO: 306767 - RNA, 66 nt, Homo Sapiens; identical to SEQ ID NO: 253556

SEQ ID NO: 306768 - RNA, 66 nt, Homo Sapiens; identical to SEQ ID NO: 253557

SEQ ID NO: 306769 - RNA, 66 nt, Homo Sapiens; identical to SEQ ID NO: 253558

SEQ ID NO: 306770 - RNA, 66 nt, Homo Sapiens; identical to SEQ ID NO: 253559

SEQ ID NO: 306771 - RNA, 66 nt, Homo Sapiens; identical to SEQ ID NO: 253560

SEQ ID NO: 306772 - RNA, 66 nt, Homo Sapiens; identical to SEQ ID NO: 253561

SEQ ID NO: 306773 - RNA, 60 nt, Homo Sapiens; identical to SEQ ID NO: 103098

SEQ ID NO: 306774 - RNA, 66 nt, Homo Sapiens; identical to SEQ ID NO: 253563

SEQ ID NO: 306775 - RNA, 66 nt, Homo Sapiens; identical to SEQ ID NO: 253564

SEQ ID NO: 306776 - RNA, 66 nt, Homo Sapiens; identical to SEQ ID NO: 253565

SEQ ID NO: 306777 - RNA, 66 nt, Homo Sapiens; identical to SEQ ID NO: 253566

SEQ ID NO: 306778 - RNA, 66 nt, Homo Sapiens; identical to SEQ ID NO: 253567

SEQ ID NO: 306779 - RNA, 66 nt, Homo Sapiens; identical to SEQ ID NO: 253568

SEQ ID NO: 306780 - RNA, 66 nt, Homo Sapiens; identical to SEQ ID NO: 253569

SEQ ID NO: 306781 - RNA, 66 nt, Homo Sapiens; identical to SEQ ID NO: 253570

SEQ ID NO: 306782 - RNA, 66 nt, Homo Sapiens; identical to SEQ ID NO: 253571

SEQ ID NO: 306783 - RNA, 66 nt, Homo Sapiens; identical to SEQ ID NO: 253572

SEQ ID NO: 306784 - RNA, 66 nt, Homo Sapiens; identical to SEQ ID NO: 253573

SEQ ID NO: 306785 - RNA, 66 nt, Homo Sapiens; identical to SEQ ID NO: 253574

SEQ ID NO: 306786 - RNA, 66 nt, Homo Sapiens; identical to SEQ ID NO: 253575

SEQ ID NO: 306787 - RNA, 66 nt, Homo Sapiens; identical to SEQ ID NO: 253576

SEQ ID NO: 306788 - RNA, 66 nt, Homo Sapiens; identical to SEQ ID NO: 253577

SEQ ID NO: 306789 - RNA, 66 nt, Homo Sapiens; identical to SEQ ID NO: 253578

SEQ ID NO: 306790 - RNA, 66 nt, Homo Sapiens; identical to SEQ ID NO: 253579

SEQ ID NO: 306791 - RNA, 66 nt, Homo Sapiens; identical to SEQ ID NO: 253580

SEQ ID NO: 306792 - RNA, 66 nt, Homo Sapiens; identical to SEQ ID NO: 253581

SEQ ID NO: 306793 - RNA, 66 nt, Homo Sapiens; identical to SEQ ID NO: 253582

SEQ ID NO: 306794 - RNA, 66 nt, Homo Sapiens; identical to SEQ ID NO: 253583

SEQ ID NO: 306795 - RNA, 66 nt, Homo Sapiens; identical to SEQ ID NO: 253584

SEQ ID NO: 306796 - RNA, 66 nt, Homo Sapiens; identical to SEQ ID NO: 253585

SEQ ID NO: 306797 - RNA, 66 nt, Homo Sapiens; identical to SEQ ID NO: 253586

SEQ ID NO: 306798 - RNA, 66 nt, Homo Sapiens; identical to SEQ ID NO: 253587

SEQ ID NO: 306799 - RNA, 66 nt, Homo Sapiens; identical to SEQ ID NO: 253588

SEQ ID NO: 306800 - RNA, 66 nt, Homo Sapiens; identical to SEQ ID NO: 253589

SEQ ID NO: 306801 - RNA, 66 nt, Homo Sapiens; identical to SEQ ID NO: 253590

SEQ ID NO: 306802 - RNA, 66 nt, Homo Sapiens; identical to SEQ ID NO: 253591

SEQ ID NO: 306803 - RNA, 66 nt, Homo Sapiens; identical to SEQ ID NO: 253592

SEQ ID NO: 306804 - RNA, 66 nt, Homo Sapiens; identical to SEQ ID NO: 253593

SEQ ID NO: 306805 - RNA, 66 nt, Homo Sapiens; identical to SEQ ID NO: 253594

SEQ ID NO: 306806 - RNA, 66 nt, Homo Sapiens; identical to SEQ ID NO: 253595

SEQ ID NO: 306807 - RNA, 66 nt, Homo Sapiens; identical to SEQ ID NO: 253596

SEQ ID NO: 306808 - RNA, 66 nt, Homo Sapiens; identical to SEQ ID NO: 253597

SEQ ID NO: 306809 - RNA, 66 nt, Homo Sapiens; identical to SEQ ID NO: 253598

SEQ ID NO: 306810 - RNA, 66 nt, Homo Sapiens; identical to SEQ ID NO: 253599

SEQ ID NO: 306811 - RNA, 66 nt, Homo Sapiens; identical to SEQ ID NO: 253600

SEQ ID NO: 306812 - RNA, 66 nt, Homo Sapiens; identical to SEQ ID NO: 253601

SEQ ID NO: 306813 - RNA, 66 nt, Homo Sapiens; identical to SEQ ID NO: 253602

SEQ ID NO: 306814 - RNA, 66 nt, Homo Sapiens; identical to SEQ ID NO: 253603

SEQ ID NO: 306815 - RNA, 66 nt, Homo Sapiens; identical to SEQ ID NO: 253604

SEQ ID NO: 306816 - RNA, 66 nt, Homo Sapiens; identical to SEQ ID NO: 253605

SEQ ID NO: 306817 - RNA, 66 nt, Homo Sapiens; identical to SEQ ID NO: 253606

SEQ ID NO: 306818 - RNA, 66 nt, Homo Sapiens; identical to SEQ ID NO: 253607

SEQ ID NO: 306819 - RNA, 66 nt, Homo Sapiens; identical to SEQ ID NO: 253608

SEQ ID NO: 306820 - RNA, 66 nt, Homo Sapiens; identical to SEQ ID NO: 253609

SEQ ID NO: 306821 - RNA, 66 nt, Homo Sapiens; identical to SEQ ID NO: 253610

SEQ ID NO: 306822 - RNA, 66 nt, Homo Sapiens; identical to SEQ ID NO: 253611

SEQ ID NO: 306823 - RNA, 66 nt, Homo Sapiens; identical to SEQ ID NO: 253612

SEQ ID NO: 306824 - RNA, 66 nt, Homo Sapiens; identical to SEQ ID NO: 253613

SEQ ID NO: 306825 - RNA, 66 nt, Homo Sapiens; identical to SEQ ID NO: 253614

SEQ ID NO: 306826 - RNA, 66 nt, Homo Sapiens; identical to SEQ ID NO: 253615

SEQ ID NO: 306827 - RNA, 66 nt, Homo Sapiens; identical to SEQ ID NO: 253616

SEQ ID NO: 306828 - RNA, 66 nt, Homo Sapiens; identical to SEQ ID NO: 253617

SEQ ID NO: 306829 - RNA, 66 nt, Homo Sapiens; identical to SEQ ID NO: 253618

SEQ ID NO: 306830 - RNA, 66 nt, Homo Sapiens; identical to SEQ ID NO: 253619

SEQ ID NO: 306831 - RNA, 66 nt, Homo Sapiens; identical to SEQ ID NO: 253620

SEQ ID NO: 306832 - RNA, 66 nt, Homo Sapiens; identical to SEQ ID NO: 253621

SEQ ID NO: 306833 - RNA, 66 nt, Homo Sapiens; identical to SEQ ID NO: 253622

SEQ ID NO: 306834 - RNA, 66 nt, Homo Sapiens; identical to SEQ ID NO: 253623

SEQ ID NO: 306835 - RNA, 66 nt, Homo Sapiens; identical to SEQ ID NO: 253624

SEQ ID NO: 306836 - RNA, 66 nt, Homo Sapiens; identical to SEQ ID NO: 253625

SEQ ID NO: 306837 - RNA, 66 nt, Homo Sapiens; identical to SEQ ID NO: 253626

SEQ ID NO: 306838 - RNA, 66 nt, Homo Sapiens; identical to SEQ ID NO: 253627

SEQ ID NO: 306839 - RNA, 66 nt, Homo Sapiens; identical to SEQ ID NO: 253628

SEQ ID NO: 306840 - RNA, 66 nt, Homo Sapiens; identical to SEQ ID NO: 253629

SEQ ID NO: 306841 - RNA, 66 nt, Homo Sapiens; identical to SEQ ID NO: 253630

SEQ ID NO: 306842 - RNA, 66 nt, Homo Sapiens; identical to SEQ ID NO: 253631

SEQ ID NO: 306843 - RNA, 66 nt, Homo Sapiens; identical to SEQ ID NO: 253632

SEQ ID NO: 306844 - RNA, 66 nt, Homo Sapiens; identical to SEQ ID NO: 253633

SEQ ID NO: 306845 - RNA, 66 nt, Homo Sapiens; identical to SEQ ID NO: 253634

SEQ ID NO: 306846 - RNA, 66 nt, Homo Sapiens; identical to SEQ ID NO: 253635

SEQ ID NO: 306847 - RNA, 66 nt, Homo Sapiens; identical to SEQ ID NO: 253636

SEQ ID NO: 306848 - RNA, 66 nt, Homo Sapiens; identical to SEQ ID NO: 253637

SEQ ID NO: 306849 - RNA, 66 nt, Homo Sapiens; identical to SEQ ID NO: 253638

SEQ ID NO: 306850 - RNA, 66 nt, Homo Sapiens; identical to SEQ ID NO: 253639

SEQ ID NO: 306851 - RNA, 66 nt, Homo Sapiens; identical to SEQ ID NO: 253640

SEQ ID NO: 306852 - RNA, 66 nt, Homo Sapiens; identical to SEQ ID NO: 253641

SEQ ID NO: 306853 - RNA, 66 nt, Homo Sapiens; identical to SEQ ID NO: 253642

SEQ ID NO: 306854 - RNA, 66 nt, Homo Sapiens; identical to SEQ ID NO: 253643

SEQ ID NO: 306855 - RNA, 66 nt, Homo Sapiens; identical to SEQ ID NO: 253644

SEQ ID NO: 306856 - RNA, 66 nt, Homo Sapiens; identical to SEQ ID NO: 253645

SEQ ID NO: 306857 - RNA, 66 nt, Homo Sapiens; identical to SEQ ID NO: 253646

SEQ ID NO: 306858 - RNA, 66 nt, Homo Sapiens; identical to SEQ ID NO: 253647

SEQ ID NO: 306859 - RNA, 66 nt, Homo Sapiens; identical to SEQ ID NO: 253648

SEQ ID NO: 306860 - RNA, 66 nt, Homo Sapiens; identical to SEQ ID NO: 253649

SEQ ID NO: 306861 - RNA, 66 nt, Homo Sapiens; identical to SEQ ID NO: 253650

SEQ ID NO: 306862 - RNA, 66 nt, Homo Sapiens; identical to SEQ ID NO: 253651

SEQ ID NO: 306863 - RNA, 66 nt, Homo Sapiens; identical to SEQ ID NO: 253652

SEQ ID NO: 306864 - RNA, 66 nt, Homo Sapiens; identical to SEQ ID NO: 253653

SEQ ID NO: 306865 - RNA, 66 nt, Homo Sapiens; identical to SEQ ID NO: 253654

SEQ ID NO: 306866 - RNA, 66 nt, Homo Sapiens; identical to SEQ ID NO: 253655

SEQ ID NO: 306867 - RNA, 66 nt, Homo Sapiens; identical to SEQ ID NO: 253656

SEQ ID NO: 306868 - RNA, 66 nt, Homo Sapiens; identical to SEQ ID NO: 253657

SEQ ID NO: 306869 - RNA, 66 nt, Homo Sapiens; identical to SEQ ID NO: 253658

SEQ ID NO: 306870 - RNA, 63 nt, Homo Sapiens; identical to SEQ ID NO: 103195

SEQ ID NO: 306871 - RNA, 51 nt, Homo Sapiens; identical to SEQ ID NO: 103196

SEQ ID NO: 306872 - RNA, 66 nt, Homo Sapiens; identical to SEQ ID NO: 253661

SEQ ID NO: 306873 - RNA, 66 nt, Homo Sapiens; identical to SEQ ID NO: 253662

SEQ ID NO: 306874 - RNA, 66 nt, Homo Sapiens; identical to SEQ ID NO: 253663

SEQ ID NO: 306875 - RNA, 66 nt, Homo Sapiens; identical to SEQ ID NO: 253664

SEQ ID NO: 306876 - RNA, 66 nt, Homo Sapiens; identical to SEQ ID NO: 253665

SEQ ID NO: 306877 - RNA, 66 nt, Homo Sapiens; identical to SEQ ID NO: 253666

SEQ ID NO: 306878 - RNA, 66 nt, Homo Sapiens; identical to SEQ ID NO: 253667

SEQ ID NO: 306879 - RNA, 66 nt, Homo Sapiens; identical to SEQ ID NO: 253668

SEQ ID NO: 306880 - RNA, 66 nt, Homo Sapiens; identical to SEQ ID NO: 253669

SEQ ID NO: 306881 - RNA, 66 nt, Homo Sapiens; identical to SEQ ID NO: 253670

SEQ ID NO: 306882 - RNA, 66 nt, Homo Sapiens; identical to SEQ ID NO: 253671

SEQ ID NO: 306883 - RNA, 66 nt, Homo Sapiens; identical to SEQ ID NO: 253672

SEQ ID NO: 306884 - RNA, 66 nt, Homo Sapiens; identical to SEQ ID NO: 253673

SEQ ID NO: 306885 - RNA, 66 nt, Homo Sapiens; identical to SEQ ID NO: 253674

SEQ ID NO: 306886 - RNA, 66 nt, Homo Sapiens; identical to SEQ ID NO: 253675

SEQ ID NO: 306887 - RNA, 66 nt, Homo Sapiens; identical to SEQ ID NO: 253676

SEQ ID NO: 306888 - RNA, 66 nt, Homo Sapiens; identical to SEQ ID NO: 253677

SEQ ID NO: 306889 - RNA, 66 nt, Homo Sapiens; identical to SEQ ID NO: 253678

SEQ ID NO: 306890 - RNA, 66 nt, Homo Sapiens; identical to SEQ ID NO: 253679

SEQ ID NO: 306891 - RNA, 66 nt, Homo Sapiens; identical to SEQ ID NO: 253680

SEQ ID NO: 306892 - RNA, 66 nt, Homo Sapiens; identical to SEQ ID NO: 253681

SEQ ID NO: 306893 - RNA, 66 nt, Homo Sapiens; identical to SEQ ID NO: 253682

SEQ ID NO: 306894 - RNA, 66 nt, Homo Sapiens; identical to SEQ ID NO: 253683

SEQ ID NO: 306895 - RNA, 66 nt, Homo Sapiens; identical to SEQ ID NO: 253684

SEQ ID NO: 306896 - RNA, 66 nt, Homo Sapiens; identical to SEQ ID NO: 253685

SEQ ID NO: 306897 - RNA, 66 nt, Homo Sapiens; identical to SEQ ID NO: 253686

SEQ ID NO: 306898 - RNA, 66 nt, Homo Sapiens; identical to SEQ ID NO: 253687

SEQ ID NO: 306899 - RNA, 66 nt, Homo Sapiens; identical to SEQ ID NO: 253688

SEQ ID NO: 306900 - RNA, 66 nt, Homo Sapiens; identical to SEQ ID NO: 253689

SEQ ID NO: 306901 - RNA, 66 nt, Homo Sapiens; identical to SEQ ID NO: 253690

SEQ ID NO: 306902 - RNA, 66 nt, Homo Sapiens; identical to SEQ ID NO: 253691

SEQ ID NO: 306903 - RNA, 66 nt, Homo Sapiens; identical to SEQ ID NO: 253692

SEQ ID NO: 306904 - RNA, 66 nt, Homo Sapiens; identical to SEQ ID NO: 253693

SEQ ID NO: 306905 - RNA, 66 nt, Homo Sapiens; identical to SEQ ID NO: 253694

SEQ ID NO: 306906 - RNA, 66 nt, Homo Sapiens; identical to SEQ ID NO: 253695

SEQ ID NO: 306907 - RNA, 66 nt, Homo Sapiens; identical to SEQ ID NO: 253696

SEQ ID NO: 306908 - RNA, 66 nt, Homo Sapiens; identical to SEQ ID NO: 253697

SEQ ID NO: 306909 - RNA, 66 nt, Homo Sapiens; identical to SEQ ID NO: 253698

SEQ ID NO: 306910 - RNA, 66 nt, Homo Sapiens; identical to SEQ ID NO: 253699

SEQ ID NO: 306911 - RNA, 66 nt, Homo Sapiens; identical to SEQ ID NO: 253700

SEQ ID NO: 306912 - RNA, 66 nt, Homo Sapiens; identical to SEQ ID NO: 253701

SEQ ID NO: 306913 - RNA, 66 nt, Homo Sapiens; identical to SEQ ID NO: 253702

SEQ ID NO: 306914 - RNA, 66 nt, Homo Sapiens; identical to SEQ ID NO: 253703

SEQ ID NO: 306915 - RNA, 66 nt, Homo Sapiens; identical to SEQ ID NO: 253704

SEQ ID NO: 306916 - RNA, 66 nt, Homo Sapiens; identical to SEQ ID NO: 253705

SEQ ID NO: 306917 - RNA, 66 nt, Homo Sapiens; identical to SEQ ID NO: 253706

SEQ ID NO: 306918 - RNA, 66 nt, Homo Sapiens; identical to SEQ ID NO: 253707

SEQ ID NO: 306919 - RNA, 66 nt, Homo Sapiens; identical to SEQ ID NO: 253708

SEQ ID NO: 306920 - RNA, 66 nt, Homo Sapiens; identical to SEQ ID NO: 253709

SEQ ID NO: 306921 - RNA, 66 nt, Homo Sapiens; identical to SEQ ID NO: 253710

SEQ ID NO: 306922 - RNA, 66 nt, Homo Sapiens; identical to SEQ ID NO: 253711

SEQ ID NO: 306923 - RNA, 66 nt, Homo Sapiens; identical to SEQ ID NO: 253712

SEQ ID NO: 306924 - RNA, 66 nt, Homo Sapiens; identical to SEQ ID NO: 253713

SEQ ID NO: 306925 - RNA, 66 nt, Homo Sapiens; identical to SEQ ID NO: 253714

SEQ ID NO: 306926 - RNA, 66 nt, Homo Sapiens; identical to SEQ ID NO: 253715

SEQ ID NO: 306927 - RNA, 66 nt, Homo Sapiens; identical to SEQ ID NO: 253716

SEQ ID NO: 306928 - RNA, 66 nt, Homo Sapiens; identical to SEQ ID NO: 253717

SEQ ID NO: 306929 - RNA, 66 nt, Homo Sapiens; identical to SEQ ID NO: 253718

SEQ ID NO: 306930 - RNA, 66 nt, Homo Sapiens; identical to SEQ ID NO: 253719

SEQ ID NO: 306931 - RNA, 66 nt, Homo Sapiens; identical to SEQ ID NO: 253720

SEQ ID NO: 306932 - RNA, 66 nt, Homo Sapiens; identical to SEQ ID NO: 253721

SEQ ID NO: 306933 - RNA, 66 nt, Homo Sapiens; identical to SEQ ID NO: 253722

SEQ ID NO: 306934 - RNA, 66 nt, Homo Sapiens; identical to SEQ ID NO: 253723

SEQ ID NO: 306935 - RNA, 66 nt, Homo Sapiens; identical to SEQ ID NO: 253724

SEQ ID NO: 306936 - RNA, 66 nt, Homo Sapiens; identical to SEQ ID NO: 253725

SEQ ID NO: 306937 - RNA, 66 nt, Homo Sapiens; identical to SEQ ID NO: 253726

SEQ ID NO: 306938 - RNA, 66 nt, Homo Sapiens; identical to SEQ ID NO: 253727

SEQ ID NO: 306939 - RNA, 66 nt, Homo Sapiens; identical to SEQ ID NO: 253728

SEQ ID NO: 306940 - RNA, 66 nt, Homo Sapiens; identical to SEQ ID NO: 253729

SEQ ID NO: 306941 - RNA, 66 nt, Homo Sapiens; identical to SEQ ID NO: 253730

SEQ ID NO: 306942 - RNA, 66 nt, Homo Sapiens; identical to SEQ ID NO: 253731

SEQ ID NO: 306943 - RNA, 66 nt, Homo Sapiens; identical to SEQ ID NO: 253732

SEQ ID NO: 306944 - RNA, 66 nt, Homo Sapiens; identical to SEQ ID NO: 253733

SEQ ID NO: 306945 - RNA, 66 nt, Homo Sapiens; identical to SEQ ID NO: 253734

SEQ ID NO: 306946 - RNA, 66 nt, Homo Sapiens; identical to SEQ ID NO: 253735

SEQ ID NO: 306947 - RNA, 66 nt, Homo Sapiens; identical to SEQ ID NO: 253736

SEQ ID NO: 306948 - RNA, 66 nt, Homo Sapiens; identical to SEQ ID NO: 253737

SEQ ID NO: 306949 - RNA, 66 nt, Homo Sapiens; identical to SEQ ID NO: 253738

SEQ ID NO: 306950 - RNA, 66 nt, Homo Sapiens; identical to SEQ ID NO: 253739

SEQ ID NO: 306951 - RNA, 66 nt, Homo Sapiens; identical to SEQ ID NO: 253740

SEQ ID NO: 306952 - RNA, 66 nt, Homo Sapiens; identical to SEQ ID NO: 253741

SEQ ID NO: 306953 - RNA, 66 nt, Homo Sapiens; identical to SEQ ID NO: 253742

SEQ ID NO: 306954 - RNA, 66 nt, Homo Sapiens; identical to SEQ ID NO: 253743

SEQ ID NO: 306955 - RNA, 66 nt, Homo Sapiens; identical to SEQ ID NO: 253744

SEQ ID NO: 306956 - RNA, 66 nt, Homo Sapiens; identical to SEQ ID NO: 253745

SEQ ID NO: 306957 - RNA, 66 nt, Homo Sapiens; identical to SEQ ID NO: 253746

SEQ ID NO: 306958 - RNA, 66 nt, Homo Sapiens; identical to SEQ ID NO: 253747

SEQ ID NO: 306959 - RNA, 66 nt, Homo Sapiens; identical to SEQ ID NO: 253748

SEQ ID NO: 306960 - RNA, 66 nt, Homo Sapiens; identical to SEQ ID NO: 253749

SEQ ID NO: 306961 - RNA, 66 nt, Homo Sapiens; identical to SEQ ID NO: 253750

SEQ ID NO: 306962 - RNA, 66 nt, Homo Sapiens; identical to SEQ ID NO: 253751

SEQ ID NO: 306963 - RNA, 66 nt, Homo Sapiens; identical to SEQ ID NO: 253752

SEQ ID NO: 306964 - RNA, 65 nt, Homo Sapiens
gcuaauauuaaguuauugcagauaccacauucauuaugcugcaguacuguacauauuuuucuuag

SEQ ID NO: 306965 - RNA, 65 nt, Homo Sapiens
cugagcaguaugccucuucuuuuagaauuaaaugaaugcugcacagguccagauguguguugaug

SEQ ID NO: 306966 - RNA, 65 nt, Homo Sapiens
cauuugaccugaacuugugguugguuucacucaaaaugcugcaguauccaugaacuuagauuuua

SEQ ID NO: 306967 - RNA, 65 nt, Homo Sapiens
ucaggggccaccauggagcauucaaggcugcugaaaugcugcauuuacucuccaggcuuugucau

SEQ ID NO: 306968 - RNA, 65 nt, Homo Sapiens
uagcuccacuggagagaaguggaauccuauauagaaugcugcacuaauugacaacacagccuaua

SEQ ID NO: 306969 - RNA, 65 nt, Homo Sapiens
uaagaaaugcauaugucacuagaauggauaaaauaaugcugcaaacuuaauguucuuaugcaaaa

SEQ ID NO: 306970 - RNA, 65 nt, Homo Sapiens
uguauuuuauuuaguuauccacggaauugcagaauaugcugcacaaaaaaaaacuacuguaugua

SEQ ID NO: 306971 - RNA, 65 nt, Homo Sapiens
cuacacaugaaggcccucucucaaaaaggucccaaaugcugcacuacauuccguuuuggucuuuu

SEQ ID NO: 306972 - RNA, 65 nt, Homo Sapiens
uuaaagggauggaugcaaccuagcuuaacaguauaaugcugcaaauuuuccuccauuaucagcca

SEQ ID NO: 306973 - RNA, 65 nt, Homo Sapiens
ccuuaugugcagcacucaaucccacuggaagccuaaugcugcagucagaagcaaugccuggcugg

SEQ ID NO: 306974 - RNA, 65 nt, Homo Sapiens
uauauguaagugacauuugauugaugcuucguggaaugcugcauucccagcacaugauucugaac

SEQ ID NO: 306975 - RNA, 65 nt, Homo Sapiens
uuuuauaauugauugguuacuaucacaccuaaaauaugcugcagaaacaaaauaaaccuuagaca

SEQ ID NO: 306976 - RNA, 65 nt, Homo Sapiens
cauucuguccauguguucucuggucuucucucacaaugcugcaucccugucccauuuuuaggguc

SEQ ID NO: 306977 - RNA, 65 nt, Homo Sapiens
ccugucccauuuuuagggucccugucuaucacuggaugcugcagcuucuguucauuacuguuagu

SEQ ID NO: 306978 - RNA, 65 nt, Homo Sapiens
aguaagacuuucugaaaacacuugaugauguggaaaugcugcaggauuaaauaacuugaagagcc

SEQ ID NO: 306979 - RNA, 65 nt, Homo Sapiens
gacguauacauaggcaucauuucacaaggucaguaaugcugcaggaaaagcaaaauugcaaucua

SEQ ID NO: 306980 - RNA, 65 nt, Homo Sapiens
cuuguguuaauucuguuuaauuugcaacuaaucucaugcugcaaauauuaauaauagggaauaag

SEQ ID NO: 306981 - RNA, 65 nt, Homo Sapiens
cuuccaauauguucauaucgauuagacauaggcaaaugcugcaaaugcacaaauuaagagagcug

SEQ ID NO: 306982 - RNA, 65 nt, Homo Sapiens
gcuggaacgggguccaggagcccaaugacccagugaugcugcaagaugccgggccagcuccuuaa

SEQ ID NO: 306983 - RNA, 65 nt, Homo Sapiens
agacccaggguccugguaagucugcuguuugcugcaugcugcaugcuuacuguuuuacaguuaac

SEQ ID NO: 306984 - RNA, 64 nt, Homo Sapiens; identical to SEQ ID NO: 248368

SEQ ID NO: 306985 - RNA, 64 nt, Homo Sapiens; identical to SEQ ID NO: 248369

SEQ ID NO: 306986 - RNA, 64 nt, Homo Sapiens; identical to SEQ ID NO: 248370

SEQ ID NO: 306987 - RNA, 64 nt, Homo Sapiens; identical to SEQ ID NO: 248371

SEQ ID NO: 306988 - RNA, 64 nt, Homo Sapiens; identical to SEQ ID NO: 248372

SEQ ID NO: 306989 - RNA, 64 nt, Homo Sapiens; identical to SEQ ID NO: 248373

SEQ ID NO: 306990 - RNA, 64 nt, Homo Sapiens; identical to SEQ ID NO: 248374

SEQ ID NO: 306991 - RNA, 64 nt, Homo Sapiens; identical to SEQ ID NO: 248375

SEQ ID NO: 306992 - RNA, 64 nt, Homo Sapiens; identical to SEQ ID NO: 248376

SEQ ID NO: 306993 - RNA, 64 nt, Homo Sapiens; identical to SEQ ID NO: 248377

SEQ ID NO: 306994 - RNA, 64 nt, Homo Sapiens
ugcaggugcugccccaugacaacaccuccaccccaacguagacccaugaagcaggcaaggaccg

SEQ ID NO: 306995 - RNA, 64 nt, Homo Sapiens
ccgcagcagucagcgauguuaauucaucauuugaaacguagaggcaaugacaaggcuacuaaga

SEQ ID NO: 306996 - RNA, 64 nt, Homo Sapiens
gguuuggguuugauacuuuagaugggaaagugaggggcuugagaaagugggugggaggagggaa

SEQ ID NO: 306997 - RNA, 64 nt, Homo Sapiens
cuuugccucacucucuccaguugguuuucagcuggggcuugaaaugcauuuuuagcccuuugac

SEQ ID NO: 306998 - RNA, 64 nt, Homo Sapiens
gaagccaggguguaaucuugugagccucgauccagggcuugaaagacggaguuucaaaaacuga

SEQ ID NO: 306999 - RNA, 64 nt, Homo Sapiens
gguggguuuguguuucaaggugaaaccccaaagugggcuugaugcagaaacccacacucuagac

SEQ ID NO: 307000 - RNA, 64 nt, Homo Sapiens
cucccuauacuuuucugucuugcucucccucccagggcuugaggcccuagggaaaggcugcucu

SEQ ID NO: 307001 - RNA, 64 nt, Homo Sapiens
cccucgcugaacuuugggguccuuucuuuucaaggggcuugaguuguccugcccccaugagagc

SEQ ID NO: 307002 - RNA, 64 nt, Homo Sapiens
cgccugaaccaagagcaggagugcaagaaaaugagggcuugagucaggacagcuuuaagcccau

SEQ ID NO: 307003 - RNA, 64 nt, Homo Sapiens
cgccugaacgaagagcaggaguggaagaaaaugagggcuugagucaggacagcuuuaagcccaa

SEQ ID NO: 307004 - RNA, 64 nt, Homo Sapiens
uccuccucgcgagugccuucaagaaauagaagaggggcuugaagcaucccccugauuuuauaug

SEQ ID NO: 307005 - RNA, 64 nt, Homo Sapiens
acggggcuuccuuacagcccgggagaagagaugggggcuugaaccaacuucguaccagcuagaa

SEQ ID NO: 307006 - RNA, 64 nt, Homo Sapiens
aggaagucucuggcugucuucauguggggaagccgggcuugaguugcccauaggccccugcccu

SEQ ID NO: 307007 - RNA, 64 nt, Homo Sapiens
cggacgcuggggcccgggcucugcacagagagcugggcuugaguggaguuuauuguagauuucu

SEQ ID NO: 307008 - RNA, 64 nt, Homo Sapiens; identical to SEQ ID NO: 184094

SEQ ID NO: 307009 - RNA, 64 nt, Homo Sapiens; identical to SEQ ID NO: 184095

SEQ ID NO: 307010 - RNA, 64 nt, Homo Sapiens; identical to SEQ ID NO: 184096

SEQ ID NO: 307011 - RNA, 64 nt, Homo Sapiens; identical to SEQ ID NO: 184097

SEQ ID NO: 307012 - RNA, 64 nt, Homo Sapiens; identical to SEQ ID NO: 184098

SEQ ID NO: 307013 - RNA, 64 nt, Homo Sapiens; identical to SEQ ID NO: 184099

SEQ ID NO: 307014 - RNA, 64 nt, Homo Sapiens; identical to SEQ ID NO: 184100

SEQ ID NO: 307015 - RNA, 64 nt, Homo Sapiens; identical to SEQ ID NO: 184101

SEQ ID NO: 307016 - RNA, 64 nt, Homo Sapiens; identical to SEQ ID NO: 184102

SEQ ID NO: 307017 - RNA, 64 nt, Homo Sapiens; identical to SEQ ID NO: 184103

SEQ ID NO: 307018 - RNA, 64 nt, Homo Sapiens; identical to SEQ ID NO: 184104

SEQ ID NO: 307019 - RNA, 64 nt, Homo Sapiens; identical to SEQ ID NO: 184105

SEQ ID NO: 307020 - RNA, 64 nt, Homo Sapiens; identical to SEQ ID NO: 184106

SEQ ID NO: 307021 - RNA, 64 nt, Homo Sapiens; identical to SEQ ID NO: 184107

SEQ ID NO: 307022 - RNA, 64 nt, Homo Sapiens; identical to SEQ ID NO: 184108

SEQ ID NO: 307023 - RNA, 64 nt, Homo Sapiens; identical to SEQ ID NO: 184109

SEQ ID NO: 307024 - RNA, 64 nt, Homo Sapiens; identical to SEQ ID NO: 184110

SEQ ID NO: 307025 - RNA, 64 nt, Homo Sapiens; identical to SEQ ID NO: 184111

SEQ ID NO: 307026 - RNA, 64 nt, Homo Sapiens; identical to SEQ ID NO: 184112

SEQ ID NO: 307027 - RNA, 64 nt, Homo Sapiens; identical to SEQ ID NO: 184113

SEQ ID NO: 307028 - RNA, 64 nt, Homo Sapiens; identical to SEQ ID NO: 184114

SEQ ID NO: 307029 - RNA, 64 nt, Homo Sapiens; identical to SEQ ID NO: 184115

SEQ ID NO: 307030 - RNA, 64 nt, Homo Sapiens; identical to SEQ ID NO: 184116

SEQ ID NO: 307031 - RNA, 64 nt, Homo Sapiens; identical to SEQ ID NO: 184117

SEQ ID NO: 307032 - RNA, 64 nt, Homo Sapiens; identical to SEQ ID NO: 184118

SEQ ID NO: 307033 - RNA, 64 nt, Homo Sapiens; identical to SEQ ID NO: 184119

SEQ ID NO: 307034 - RNA, 64 nt, Homo Sapiens; identical to SEQ ID NO: 184120

SEQ ID NO: 307035 - RNA, 64 nt, Homo Sapiens; identical to SEQ ID NO: 184121

SEQ ID NO: 307036 - RNA, 64 nt, Homo Sapiens; identical to SEQ ID NO: 245412

SEQ ID NO: 307037 - RNA, 64 nt, Homo Sapiens; identical to SEQ ID NO: 245413

SEQ ID NO: 307038 - RNA, 64 nt, Homo Sapiens; identical to SEQ ID NO: 245414

SEQ ID NO: 307039 - RNA, 64 nt, Homo Sapiens; identical to SEQ ID NO: 245415

SEQ ID NO: 307040 - RNA, 64 nt, Homo Sapiens; identical to SEQ ID NO: 245416

SEQ ID NO: 307041 - RNA, 64 nt, Homo Sapiens; identical to SEQ ID NO: 245417

SEQ ID NO: 307042 - RNA, 64 nt, Homo Sapiens; identical to SEQ ID NO: 245418

SEQ ID NO: 307043 - RNA, 64 nt, Homo Sapiens; identical to SEQ ID NO: 245419

SEQ ID NO: 307044 - RNA, 64 nt, Homo Sapiens; identical to SEQ ID NO: 245420

SEQ ID NO: 307045 - RNA, 64 nt, Homo Sapiens; identical to SEQ ID NO: 245421

SEQ ID NO: 307046 - RNA, 64 nt, Homo Sapiens; identical to SEQ ID NO: 245422

SEQ ID NO: 307047 - RNA, 64 nt, Homo Sapiens; identical to SEQ ID NO: 245423

SEQ ID NO: 307048 - RNA, 64 nt, Homo Sapiens; identical to SEQ ID NO: 245424

SEQ ID NO: 307049 - RNA, 50 nt, Homo Sapiens; identical to SEQ ID NO: 245425

SEQ ID NO: 307050 - RNA, 64 nt, Homo Sapiens; identical to SEQ ID NO: 245426

SEQ ID NO: 307051 - RNA, 64 nt, Homo Sapiens; identical to SEQ ID NO: 245427

SEQ ID NO: 307052 - RNA, 64 nt, Homo Sapiens; identical to SEQ ID NO: 245428

SEQ ID NO: 307053 - RNA, 64 nt, Homo Sapiens; identical to SEQ ID NO: 245429

SEQ ID NO: 307054 - RNA, 64 nt, Homo Sapiens; identical to SEQ ID NO: 245430

SEQ ID NO: 307055 - RNA, 64 nt, Homo Sapiens; identical to SEQ ID NO: 245431

SEQ ID NO: 307056 - RNA, 64 nt, Homo Sapiens; identical to SEQ ID NO: 245432

SEQ ID NO: 307057 - RNA, 64 nt, Homo Sapiens; identical to SEQ ID NO: 245433

SEQ ID NO: 307058 - RNA, 64 nt, Homo Sapiens; identical to SEQ ID NO: 245434

SEQ ID NO: 307059 - RNA, 64 nt, Homo Sapiens; identical to SEQ ID NO: 245435

SEQ ID NO: 307060 - RNA, 64 nt, Homo Sapiens; identical to SEQ ID NO: 245436

SEQ ID NO: 307061 - RNA, 64 nt, Homo Sapiens; identical to SEQ ID NO: 245437

SEQ ID NO: 307062 - RNA, 64 nt, Homo Sapiens; identical to SEQ ID NO: 245438

SEQ ID NO: 307063 - RNA, 64 nt, Homo Sapiens; identical to SEQ ID NO: 245439

SEQ ID NO: 307064 - RNA, 64 nt, Homo Sapiens; identical to SEQ ID NO: 245440

SEQ ID NO: 307065 - RNA, 53 nt, Homo Sapiens; identical to SEQ ID NO: 245441

SEQ ID NO: 307066 - RNA, 64 nt, Homo Sapiens; identical to SEQ ID NO: 245442

SEQ ID NO: 307067 - RNA, 64 nt, Homo Sapiens; identical to SEQ ID NO: 245443

SEQ ID NO: 307068 - RNA, 64 nt, Homo Sapiens; identical to SEQ ID NO: 245444

SEQ ID NO: 307069 - RNA, 64 nt, Homo Sapiens; identical to SEQ ID NO: 245445

SEQ ID NO: 307070 - RNA, 64 nt, Homo Sapiens; identical to SEQ ID NO: 245446

SEQ ID NO: 307071 - RNA, 64 nt, Homo Sapiens; identical to SEQ ID NO: 245447

SEQ ID NO: 307072 - RNA, 64 nt, Homo Sapiens; identical to SEQ ID NO: 245448

SEQ ID NO: 307073 - RNA, 64 nt, Homo Sapiens; identical to SEQ ID NO: 245449

SEQ ID NO: 307074 - RNA, 64 nt, Homo Sapiens; identical to SEQ ID NO: 245450

SEQ ID NO: 307075 - RNA, 64 nt, Homo Sapiens; identical to SEQ ID NO: 245451

SEQ ID NO: 307076 - RNA, 64 nt, Homo Sapiens; identical to SEQ ID NO: 245452

SEQ ID NO: 307077 - RNA, 64 nt, Homo Sapiens; identical to SEQ ID NO: 245453

SEQ ID NO: 307078 - RNA, 64 nt, Homo Sapiens; identical to SEQ ID NO: 245454

SEQ ID NO: 307079 - RNA, 64 nt, Homo Sapiens; identical to SEQ ID NO: 245455

SEQ ID NO: 307080 - RNA, 64 nt, Homo Sapiens; identical to SEQ ID NO: 245456

SEQ ID NO: 307081 - RNA, 64 nt, Homo Sapiens; identical to SEQ ID NO: 245457

SEQ ID NO: 307082 - RNA, 64 nt, Homo Sapiens; identical to SEQ ID NO: 245458

SEQ ID NO: 307083 - RNA, 64 nt, Homo Sapiens; identical to SEQ ID NO: 245459

SEQ ID NO: 307084 - RNA, 64 nt, Homo Sapiens; identical to SEQ ID NO: 245460

SEQ ID NO: 307085 - RNA, 64 nt, Homo Sapiens; identical to SEQ ID NO: 245461

SEQ ID NO: 307086 - RNA, 64 nt, Homo Sapiens; identical to SEQ ID NO: 245462

SEQ ID NO: 307087 - RNA, 64 nt, Homo Sapiens; identical to SEQ ID NO: 245463

SEQ ID NO: 307088 - RNA, 64 nt, Homo Sapiens; identical to SEQ ID NO: 245464

SEQ ID NO: 307089 - RNA, 64 nt, Homo Sapiens; identical to SEQ ID NO: 245465

SEQ ID NO: 307090 - RNA, 64 nt, Homo Sapiens; identical to SEQ ID NO: 245466

SEQ ID NO: 307091 - RNA, 64 nt, Homo Sapiens; identical to SEQ ID NO: 245467

SEQ ID NO: 307092 - RNA, 64 nt, Homo Sapiens; identical to SEQ ID NO: 245468

SEQ ID NO: 307093 - RNA, 64 nt, Homo Sapiens; identical to SEQ ID NO: 245469

SEQ ID NO: 307094 - RNA, 64 nt, Homo Sapiens; identical to SEQ ID NO: 245470

SEQ ID NO: 307095 - RNA, 64 nt, Homo Sapiens; identical to SEQ ID NO: 245471

SEQ ID NO: 307096 - RNA, 64 nt, Homo Sapiens; identical to SEQ ID NO: 245472

SEQ ID NO: 307097 - RNA, 64 nt, Homo Sapiens; identical to SEQ ID NO: 245473

SEQ ID NO: 307098 - RNA, 64 nt, Homo Sapiens; identical to SEQ ID NO: 245474

SEQ ID NO: 307099 - RNA, 64 nt, Homo Sapiens; identical to SEQ ID NO: 245475

SEQ ID NO: 307100 - RNA, 64 nt, Homo Sapiens; identical to SEQ ID NO: 245476

SEQ ID NO: 307101 - RNA, 64 nt, Homo Sapiens; identical to SEQ ID NO: 245477

SEQ ID NO: 307102 - RNA, 64 nt, Homo Sapiens; identical to SEQ ID NO: 245478

SEQ ID NO: 307103 - RNA, 64 nt, Homo Sapiens; identical to SEQ ID NO: 245479

SEQ ID NO: 307104 - RNA, 64 nt, Homo Sapiens; identical to SEQ ID NO: 245480

SEQ ID NO: 307105 - RNA, 64 nt, Homo Sapiens; identical to SEQ ID NO: 245481

SEQ ID NO: 307106 - RNA, 64 nt, Homo Sapiens; identical to SEQ ID NO: 245482

SEQ ID NO: 307107 - RNA, 64 nt, Homo Sapiens; identical to SEQ ID NO: 245483

SEQ ID NO: 307108 - RNA, 64 nt, Homo Sapiens; identical to SEQ ID NO: 245484

SEQ ID NO: 307109 - RNA, 64 nt, Homo Sapiens; identical to SEQ ID NO: 245485

SEQ ID NO: 307110 - RNA, 64 nt, Homo Sapiens; identical to SEQ ID NO: 245486

SEQ ID NO: 307111 - RNA, 64 nt, Homo Sapiens; identical to SEQ ID NO: 245487

SEQ ID NO: 307112 - RNA, 64 nt, Homo Sapiens; identical to SEQ ID NO: 245488

SEQ ID NO: 307113 - RNA, 64 nt, Homo Sapiens; identical to SEQ ID NO: 245489

SEQ ID NO: 307114 - RNA, 64 nt, Homo Sapiens; identical to SEQ ID NO: 245490

SEQ ID NO: 307115 - RNA, 64 nt, Homo Sapiens; identical to SEQ ID NO: 245491

SEQ ID NO: 307116 - RNA, 64 nt, Homo Sapiens; identical to SEQ ID NO: 245492

SEQ ID NO: 307117 - RNA, 64 nt, Homo Sapiens; identical to SEQ ID NO: 245493

SEQ ID NO: 307118 - RNA, 64 nt, Homo Sapiens; identical to SEQ ID NO: 245494

SEQ ID NO: 307119 - RNA, 64 nt, Homo Sapiens; identical to SEQ ID NO: 245495

SEQ ID NO: 307120 - RNA, 64 nt, Homo Sapiens; identical to SEQ ID NO: 245496

SEQ ID NO: 307121 - RNA, 64 nt, Homo Sapiens; identical to SEQ ID NO: 245497

SEQ ID NO: 307122 - RNA, 64 nt, Homo Sapiens; identical to SEQ ID NO: 245498

SEQ ID NO: 307123 - RNA, 64 nt, Homo Sapiens; identical to SEQ ID NO: 245499

SEQ ID NO: 307124 - RNA, 64 nt, Homo Sapiens; identical to SEQ ID NO: 245500

SEQ ID NO: 307125 - RNA, 64 nt, Homo Sapiens; identical to SEQ ID NO: 245501

SEQ ID NO: 307126 - RNA, 64 nt, Homo Sapiens; identical to SEQ ID NO: 245502

SEQ ID NO: 307127 - RNA, 64 nt, Homo Sapiens; identical to SEQ ID NO: 245503

SEQ ID NO: 307128 - RNA, 64 nt, Homo Sapiens; identical to SEQ ID NO: 245504

SEQ ID NO: 307129 - RNA, 64 nt, Homo Sapiens; identical to SEQ ID NO: 245505

SEQ ID NO: 307130 - RNA, 64 nt, Homo Sapiens; identical to SEQ ID NO: 245506

SEQ ID NO: 307131 - RNA, 64 nt, Homo Sapiens; identical to SEQ ID NO: 245507

SEQ ID NO: 307132 - RNA, 64 nt, Homo Sapiens; identical to SEQ ID NO: 245508

SEQ ID NO: 307133 - RNA, 64 nt, Homo Sapiens; identical to SEQ ID NO: 245509

SEQ ID NO: 307134 - RNA, 64 nt, Homo Sapiens; identical to SEQ ID NO: 245510

SEQ ID NO: 307135 - RNA, 64 nt, Homo Sapiens; identical to SEQ ID NO: 245511

SEQ ID NO: 307136 - RNA, 64 nt, Homo Sapiens; identical to SEQ ID NO: 245512

SEQ ID NO: 307137 - RNA, 64 nt, Homo Sapiens; identical to SEQ ID NO: 245513

SEQ ID NO: 307138 - RNA, 64 nt, Homo Sapiens; identical to SEQ ID NO: 245514

SEQ ID NO: 307139 - RNA, 64 nt, Homo Sapiens; identical to SEQ ID NO: 245515

SEQ ID NO: 307140 - RNA, 64 nt, Homo Sapiens; identical to SEQ ID NO: 245516

SEQ ID NO: 307141 - RNA, 64 nt, Homo Sapiens; identical to SEQ ID NO: 245517

SEQ ID NO: 307142 - RNA, 64 nt, Homo Sapiens; identical to SEQ ID NO: 245518

SEQ ID NO: 307143 - RNA, 64 nt, Homo Sapiens; identical to SEQ ID NO: 245519

SEQ ID NO: 307144 - RNA, 64 nt, Homo Sapiens; identical to SEQ ID NO: 245520

SEQ ID NO: 307145 - RNA, 64 nt, Homo Sapiens; identical to SEQ ID NO: 245521

SEQ ID NO: 307146 - RNA, 64 nt, Homo Sapiens; identical to SEQ ID NO: 245522

SEQ ID NO: 307147 - RNA, 64 nt, Homo Sapiens; identical to SEQ ID NO: 245523

SEQ ID NO: 307148 - RNA, 64 nt, Homo Sapiens; identical to SEQ ID NO: 245524

SEQ ID NO: 307149 - RNA, 64 nt, Homo Sapiens; identical to SEQ ID NO: 245525

SEQ ID NO: 307150 - RNA, 64 nt, Homo Sapiens; identical to SEQ ID NO: 245526

SEQ ID NO: 307151 - RNA, 64 nt, Homo Sapiens; identical to SEQ ID NO: 245527

SEQ ID NO: 307152 - RNA, 64 nt, Homo Sapiens; identical to SEQ ID NO: 245528

SEQ ID NO: 307153 - RNA, 64 nt, Homo Sapiens; identical to SEQ ID NO: 245529

SEQ ID NO: 307154 - RNA, 64 nt, Homo Sapiens; identical to SEQ ID NO: 245530

SEQ ID NO: 307155 - RNA, 64 nt, Homo Sapiens; identical to SEQ ID NO: 245531

SEQ ID NO: 307156 - RNA, 64 nt, Homo Sapiens; identical to SEQ ID NO: 245532

SEQ ID NO: 307157 - RNA, 64 nt, Homo Sapiens; identical to SEQ ID NO: 245533

SEQ ID NO: 307158 - RNA, 64 nt, Homo Sapiens; identical to SEQ ID NO: 245534

SEQ ID NO: 307159 - RNA, 64 nt, Homo Sapiens; identical to SEQ ID NO: 245535

SEQ ID NO: 307160 - RNA, 64 nt, Homo Sapiens; identical to SEQ ID NO: 245536

SEQ ID NO: 307161 - RNA, 64 nt, Homo Sapiens; identical to SEQ ID NO: 245537

SEQ ID NO: 307162 - RNA, 64 nt, Homo Sapiens; identical to SEQ ID NO: 245538

SEQ ID NO: 307163 - RNA, 64 nt, Homo Sapiens; identical to SEQ ID NO: 245539

SEQ ID NO: 307164 - RNA, 64 nt, Homo Sapiens; identical to SEQ ID NO: 245540

SEQ ID NO: 307165 - RNA, 64 nt, Homo Sapiens; identical to SEQ ID NO: 245541

SEQ ID NO: 307166 - RNA, 64 nt, Homo Sapiens; identical to SEQ ID NO: 245542

SEQ ID NO: 307167 - RNA, 64 nt, Homo Sapiens; identical to SEQ ID NO: 245543

SEQ ID NO: 307168 - RNA, 64 nt, Homo Sapiens; identical to SEQ ID NO: 245544

SEQ ID NO: 307169 - RNA, 64 nt, Homo Sapiens; identical to SEQ ID NO: 245545

SEQ ID NO: 307170 - RNA, 64 nt, Homo Sapiens; identical to SEQ ID NO: 245546

SEQ ID NO: 307171 - RNA, 64 nt, Homo Sapiens; identical to SEQ ID NO: 245547

SEQ ID NO: 307172 - RNA, 64 nt, Homo Sapiens; identical to SEQ ID NO: 245548

SEQ ID NO: 307173 - RNA, 64 nt, Homo Sapiens; identical to SEQ ID NO: 245549

SEQ ID NO: 307174 - RNA, 64 nt, Homo Sapiens; identical to SEQ ID NO: 245550

SEQ ID NO: 307175 - RNA, 64 nt, Homo Sapiens; identical to SEQ ID NO: 245551

SEQ ID NO: 307176 - RNA, 64 nt, Homo Sapiens; identical to SEQ ID NO: 245552

SEQ ID NO: 307177 - RNA, 64 nt, Homo Sapiens; identical to SEQ ID NO: 245553

SEQ ID NO: 307178 - RNA, 64 nt, Homo Sapiens; identical to SEQ ID NO: 245554

SEQ ID NO: 307179 - RNA, 64 nt, Homo Sapiens; identical to SEQ ID NO: 245555

SEQ ID NO: 307180 - RNA, 64 nt, Homo Sapiens; identical to SEQ ID NO: 245556

SEQ ID NO: 307181 - RNA, 64 nt, Homo Sapiens; identical to SEQ ID NO: 245557

SEQ ID NO: 307182 - RNA, 64 nt, Homo Sapiens; identical to SEQ ID NO: 245558

SEQ ID NO: 307183 - RNA, 64 nt, Homo Sapiens; identical to SEQ ID NO: 245559

SEQ ID NO: 307184 - RNA, 64 nt, Homo Sapiens; identical to SEQ ID NO: 245560

SEQ ID NO: 307185 - RNA, 64 nt, Homo Sapiens; identical to SEQ ID NO: 245561

SEQ ID NO: 307186 - RNA, 64 nt, Homo Sapiens; identical to SEQ ID NO: 245562

SEQ ID NO: 307187 - RNA, 64 nt, Homo Sapiens; identical to SEQ ID NO: 245563

SEQ ID NO: 307188 - RNA, 64 nt, Homo Sapiens; identical to SEQ ID NO: 245564

SEQ ID NO: 307189 - RNA, 64 nt, Homo Sapiens; identical to SEQ ID NO: 245565

SEQ ID NO: 307190 - RNA, 64 nt, Homo Sapiens; identical to SEQ ID NO: 245566

SEQ ID NO: 307191 - RNA, 64 nt, Homo Sapiens; identical to SEQ ID NO: 245567

SEQ ID NO: 307192 - RNA, 64 nt, Homo Sapiens; identical to SEQ ID NO: 245568

SEQ ID NO: 307193 - RNA, 64 nt, Homo Sapiens; identical to SEQ ID NO: 245569

SEQ ID NO: 307194 - RNA, 64 nt, Homo Sapiens; identical to SEQ ID NO: 245570

SEQ ID NO: 307195 - RNA, 64 nt, Homo Sapiens; identical to SEQ ID NO: 245571

SEQ ID NO: 307196 - RNA, 64 nt, Homo Sapiens; identical to SEQ ID NO: 245572

SEQ ID NO: 307197 - RNA, 64 nt, Homo Sapiens; identical to SEQ ID NO: 245573

SEQ ID NO: 307198 - RNA, 64 nt, Homo Sapiens; identical to SEQ ID NO: 245574

SEQ ID NO: 307199 - RNA, 64 nt, Homo Sapiens; identical to SEQ ID NO: 245575

SEQ ID NO: 307200 - RNA, 64 nt, Homo Sapiens; identical to SEQ ID NO: 245576

SEQ ID NO: 307201 - RNA, 64 nt, Homo Sapiens; identical to SEQ ID NO: 245577

SEQ ID NO: 307202 - RNA, 64 nt, Homo Sapiens; identical to SEQ ID NO: 245578

SEQ ID NO: 307203 - RNA, 50 nt, Homo Sapiens; identical to SEQ ID NO: 245579

SEQ ID NO: 307204 - RNA, 64 nt, Homo Sapiens; identical to SEQ ID NO: 245580

SEQ ID NO: 307205 - RNA, 64 nt, Homo Sapiens; identical to SEQ ID NO: 245581

SEQ ID NO: 307206 - RNA, 64 nt, Homo Sapiens; identical to SEQ ID NO: 245582

SEQ ID NO: 307207 - RNA, 64 nt, Homo Sapiens; identical to SEQ ID NO: 245583

SEQ ID NO: 307208 - RNA, 64 nt, Homo Sapiens; identical to SEQ ID NO: 245584

SEQ ID NO: 307209 - RNA, 64 nt, Homo Sapiens; identical to SEQ ID NO: 245585

SEQ ID NO: 307210 - RNA, 64 nt, Homo Sapiens; identical to SEQ ID NO: 245586

SEQ ID NO: 307211 - RNA, 64 nt, Homo Sapiens; identical to SEQ ID NO: 245587

SEQ ID NO: 307212 - RNA, 64 nt, Homo Sapiens; identical to SEQ ID NO: 245588

SEQ ID NO: 307213 - RNA, 64 nt, Homo Sapiens; identical to SEQ ID NO: 245589

SEQ ID NO: 307214 - RNA, 64 nt, Homo Sapiens; identical to SEQ ID NO: 245590

SEQ ID NO: 307215 - RNA, 64 nt, Homo Sapiens; identical to SEQ ID NO: 245591

SEQ ID NO: 307216 - RNA, 64 nt, Homo Sapiens; identical to SEQ ID NO: 245592

SEQ ID NO: 307217 - RNA, 64 nt, Homo Sapiens; identical to SEQ ID NO: 245593

SEQ ID NO: 307218 - RNA, 64 nt, Homo Sapiens; identical to SEQ ID NO: 245594

SEQ ID NO: 307219 - RNA, 64 nt, Homo Sapiens; identical to SEQ ID NO: 245595

SEQ ID NO: 307220 - RNA, 64 nt, Homo Sapiens; identical to SEQ ID NO: 245596

SEQ ID NO: 307221 - RNA, 64 nt, Homo Sapiens; identical to SEQ ID NO: 245597

SEQ ID NO: 307222 - RNA, 64 nt, Homo Sapiens; identical to SEQ ID NO: 245598

SEQ ID NO: 307223 - RNA, 64 nt, Homo Sapiens; identical to SEQ ID NO: 245599

SEQ ID NO: 307224 - RNA, 64 nt, Homo Sapiens; identical to SEQ ID NO: 245600

SEQ ID NO: 307225 - RNA, 64 nt, Homo Sapiens; identical to SEQ ID NO: 245601

SEQ ID NO: 307226 - RNA, 64 nt, Homo Sapiens; identical to SEQ ID NO: 245602

SEQ ID NO: 307227 - RNA, 64 nt, Homo Sapiens; identical to SEQ ID NO: 245603

SEQ ID NO: 307228 - RNA, 64 nt, Homo Sapiens; identical to SEQ ID NO: 245604

SEQ ID NO: 307229 - RNA, 64 nt, Homo Sapiens; identical to SEQ ID NO: 245605

SEQ ID NO: 307230 - RNA, 64 nt, Homo Sapiens; identical to SEQ ID NO: 245606

SEQ ID NO: 307231 - RNA, 64 nt, Homo Sapiens; identical to SEQ ID NO: 245607

SEQ ID NO: 307232 - RNA, 64 nt, Homo Sapiens; identical to SEQ ID NO: 245608

SEQ ID NO: 307233 - RNA, 64 nt, Homo Sapiens; identical to SEQ ID NO: 245609

SEQ ID NO: 307234 - RNA, 64 nt, Homo Sapiens; identical to SEQ ID NO: 245610

SEQ ID NO: 307235 - RNA, 64 nt, Homo Sapiens; identical to SEQ ID NO: 245611

SEQ ID NO: 307236 - RNA, 64 nt, Homo Sapiens; identical to SEQ ID NO: 245612

SEQ ID NO: 307237 - RNA, 64 nt, Homo Sapiens; identical to SEQ ID NO: 245613

SEQ ID NO: 307238 - RNA, 64 nt, Homo Sapiens; identical to SEQ ID NO: 245614

SEQ ID NO: 307239 - RNA, 64 nt, Homo Sapiens; identical to SEQ ID NO: 245615

SEQ ID NO: 307240 - RNA, 64 nt, Homo Sapiens; identical to SEQ ID NO: 245616

SEQ ID NO: 307241 - RNA, 64 nt, Homo Sapiens; identical to SEQ ID NO: 245617

SEQ ID NO: 307242 - RNA, 64 nt, Homo Sapiens; identical to SEQ ID NO: 245618

SEQ ID NO: 307243 - RNA, 64 nt, Homo Sapiens; identical to SEQ ID NO: 245619

SEQ ID NO: 307244 - RNA, 64 nt, Homo Sapiens; identical to SEQ ID NO: 245620

SEQ ID NO: 307245 - RNA, 64 nt, Homo Sapiens; identical to SEQ ID NO: 245621

SEQ ID NO: 307246 - RNA, 64 nt, Homo Sapiens; identical to SEQ ID NO: 245622

SEQ ID NO: 307247 - RNA, 64 nt, Homo Sapiens; identical to SEQ ID NO: 245623

SEQ ID NO: 307248 - RNA, 64 nt, Homo Sapiens; identical to SEQ ID NO: 245624

SEQ ID NO: 307249 - RNA, 64 nt, Homo Sapiens; identical to SEQ ID NO: 245625

SEQ ID NO: 307250 - RNA, 64 nt, Homo Sapiens; identical to SEQ ID NO: 245626

SEQ ID NO: 307251 - RNA, 64 nt, Homo Sapiens; identical to SEQ ID NO: 245627

SEQ ID NO: 307252 - RNA, 64 nt, Homo Sapiens; identical to SEQ ID NO: 245628

SEQ ID NO: 307253 - RNA, 64 nt, Homo Sapiens; identical to SEQ ID NO: 245629

SEQ ID NO: 307254 - RNA, 64 nt, Homo Sapiens; identical to SEQ ID NO: 245630

SEQ ID NO: 307255 - RNA, 64 nt, Homo Sapiens; identical to SEQ ID NO: 245631

SEQ ID NO: 307256 - RNA, 64 nt, Homo Sapiens; identical to SEQ ID NO: 245632

SEQ ID NO: 307257 - RNA, 64 nt, Homo Sapiens; identical to SEQ ID NO: 245633

SEQ ID NO: 307258 - RNA, 64 nt, Homo Sapiens; identical to SEQ ID NO: 245634

SEQ ID NO: 307259 - RNA, 64 nt, Homo Sapiens; identical to SEQ ID NO: 245635

SEQ ID NO: 307260 - RNA, 64 nt, Homo Sapiens; identical to SEQ ID NO: 245636

SEQ ID NO: 307261 - RNA, 64 nt, Homo Sapiens; identical to SEQ ID NO: 245637

SEQ ID NO: 307262 - RNA, 64 nt, Homo Sapiens
agaagcaucuuccuuaggucugcccugcuugcaaauccacuagcaccgaccccaccaccugguu

SEQ ID NO: 307263 - RNA, 52 nt, Homo Sapiens
uacguggagaacgugcuuaagaauccacuaugaugggaaacauuucauucuc

SEQ ID NO: 307264 - RNA, 64 nt, Homo Sapiens
caagaaaaaguuagcaaaccuuuuguuuagagggauccacuacucuguggcuuuccacgugagg

SEQ ID NO: 307265 - RNA, 64 nt, Homo Sapiens
agaaggaaggauguccccagcaaccuccugcuccauccacuacaagcaugugacagucccugga

SEQ ID NO: 307266 - RNA, 64 nt, Homo Sapiens
auuauaaacugugucucgacaacaauuuagcuauauccacuaugauguaagauauuauuucuga

SEQ ID NO: 307267 - RNA, 64 nt, Homo Sapiens
aucaaguuggggggaaucugaaagcacaccauuaauccacuaugcauugacuaaccacauccac

SEQ ID NO: 307268 - RNA, 64 nt, Homo Sapiens
acaucuaaguuuuguguacauauguucugggaaaauccacuaugguuuucaauaaugugaaugc

SEQ ID NO: 307269 - RNA, 64 nt, Homo Sapiens
uaaauggcucacaagucaaugacaagucuguacuauccacuaugaacacugugaucugaccugu

SEQ ID NO: 307270 - RNA, 64 nt, Homo Sapiens
ugcugcugagcauucuccuguuccaucaguugccauccacuaccccguuuucucuucuugcugc

SEQ ID NO: 307271 - RNA, 64 nt, Homo Sapiens
acauuuccuuuuucugugggaaucacaagaguuuauccacuaaaaaaagauauguaaaaaagau

SEQ ID NO: 307272 - RNA, 64 nt, Homo Sapiens
aaggaggugcuuaggauuguggguuucugauugcauccacuagcuucucuuuuucucgccauaa

SEQ ID NO: 307273 - RNA, 64 nt, Homo Sapiens
gccacggccugggagggugguuccuguucucagcauccacuaauauucaguccuguauauuuua

SEQ ID NO: 307274 - RNA, 64 nt, Homo Sapiens
gaaauauaacuagaaaagaaugacuugccaccauauccacuaggugucacuaccucuaaccuuu

SEQ ID NO: 307275 - RNA, 64 nt, Homo Sapiens
aauugcauuuuuaccuuucaugugccugaaggcuauccacuacauucugaaggccuuguuaaaa

SEQ ID NO: 307276 - RNA, 64 nt, Homo Sapiens
cuggucuucuucaagagagcuaaauuagacauuaauccacuaaauuugucuuuauuacuauaug

SEQ ID NO: 307277 - RNA, 64 nt, Homo Sapiens
acguccacgggauuaacagaaugacaaacggaagauccacuaaauuccaacguuugccaucugg

SEQ ID NO: 307278 - RNA, 64 nt, Homo Sapiens
gcagcagucccugaaccacuuccuguucuucauaauccacuacuggucuccccuucugcuguuc

SEQ ID NO: 307279 - RNA, 64 nt, Homo Sapiens
uuuucaucguaaaaccaucugaaaucucuuuguaauccacuagguucuguuuuuugauggaggu

SEQ ID NO: 307280 - RNA, 64 nt, Homo Sapiens
uccucccuggugugaacucuuucuuugguauuccauccacuauccuggcaacucaaggcugcuu

SEQ ID NO: 307281 - RNA, 64 nt, Homo Sapiens
uucagagagaguacgguauauuuaugguaauuuuauccacuagcaaaucuugauuuaguuugau

SEQ ID NO: 307282 - RNA, 64 nt, Homo Sapiens
cuguguaacaagagagacauggaaaaggaaaaaaauccacuauaucaugggcucugcagaacau

SEQ ID NO: 307283 - RNA, 64 nt, Homo Sapiens
aucaaacaauucagggagugggaagaauuuuuauauccacuaaauggaacuaagaaagcccuua

SEQ ID NO: 307284 - RNA, 64 nt, Homo Sapiens
cuguuauagggaguuguuuuauuuacuugguaagauccacuaaucccuaagauugaauuccuau

SEQ ID NO: 307285 - RNA, 64 nt, Homo Sapiens
gcaaaucauagcuggggguuguagugccucuuucauccacuaguuacaauguucaucccaugau

SEQ ID NO: 307286 - RNA, 64 nt, Homo Sapiens
gaaguauugcuaaaaucuuauaauaugaaaagagauccacuaauguagcuuaagguuauuagau

SEQ ID NO: 307287 - RNA, 64 nt, Homo Sapiens
acuuuaguuauauucacugguuucuuuuaauccaauccacuaacaccuguucuugccuaauaag

SEQ ID NO: 307288 - RNA, 64 nt, Homo Sapiens
auguaauggcaugaaaaucuauaauguaaauuaaauccacuaaaugccucccccaccaaagaau

SEQ ID NO: 307289 - RNA, 64 nt, Homo Sapiens
uugaauguccacuggucauuugcucauucaggaaauccacuaugguuuucugaaaccaggauga

SEQ ID NO: 307290 - RNA, 64 nt, Homo Sapiens
aauaggcuuuuaaaagcauugagucauugucagaauccacuaugggaagcucuguguguaccug

SEQ ID NO: 307291 - RNA, 64 nt, Homo Sapiens
cugaaauaugugaaguggcuauuucuuuauauuuauccacuacuccgugaaggcuucucuguuc

SEQ ID NO: 307292 - RNA, 64 nt, Homo Sapiens
ugaguuuauauugauuuuuuuuuuccauuuaaaaauccacuaaugguguaaaagagaccaguag

SEQ ID NO: 307293 - RNA, 64 nt, Homo Sapiens
gcugccuuucauuuauaauacaaaagugccuggcauccacuacucuuuagaaucuggcacacaa

SEQ ID NO: 307294 - RNA, 64 nt, Homo Sapiens
aucuacugucugcacuguuugaauaccuuggcacauccacuaggccugggauugacucugagug

SEQ ID NO: 307295 - RNA, 64 nt, Homo Sapiens
aauucuugaguuuguuuucuaaaggagaccagaaauccacuauuacaaauguauuugaaaacau

SEQ ID NO: 307296 - RNA, 64 nt, Homo Sapiens
uuaauaauaaauaacgugucagcauuuaguaagcauccacuaaguguacaauacuucuacaaua

SEQ ID NO: 307297 - RNA, 64 nt, Homo Sapiens
ccaacacuaagaugggaaaaauugaauugacuggauccacuaaaccuuuuggcuuacuucgagu

SEQ ID NO: 307298 - RNA, 64 nt, Homo Sapiens
auuuuuuuugcuuuuaugacauguuaacuuucaaauccacuagugucuucuaauguaaauuuua

SEQ ID NO: 307299 - RNA, 64 nt, Homo Sapiens
accaacuuugagucagucucgucuauuuugcuucauccacuagaugauuggccaugcuggucau

SEQ ID NO: 307300 - RNA, 64 nt, Homo Sapiens
gaaagcuuguuggaaugcaggccacuucugucucauccacuaaacccccaaugcugguuguaau

SEQ ID NO: 307301 - RNA, 64 nt, Homo Sapiens
ucuuguucuuaugaaugacuaggaggaagaaaggauccacuacuuucagaauuuucagauacua

SEQ ID NO: 307302 - RNA, 64 nt, Homo Sapiens
gggcuuaccucacugagagugcuccccagcaggcauccacuaccccagggccccccacauguca

SEQ ID NO: 307303 - RNA, 64 nt, Homo Sapiens
augcauagcacuuaauaaaauggauuuuuaaaaaauccacuaguaauaucagaauguccaggga

SEQ ID NO: 307304 - RNA, 64 nt, Homo Sapiens
uuucauccuauaguuaguaagaugcauaaaaucaauccacuacugaaauaguuuccagucagac

SEQ ID NO: 307305 - RNA, 64 nt, Homo Sapiens
uuuaaaagccaccuggguugacaccuuccuacuuauccacuagaugucaucagaggugcuguuc

SEQ ID NO: 307306 - RNA, 64 nt, Homo Sapiens
gacgugccaaugaauuauugcuuaaaguacuguaauccacuaaaaagacuaaaauauuugggga

SEQ ID NO: 307307 - RNA, 64 nt, Homo Sapiens
cccaagggcuaaggaauaguaauagugacauaucauccacuaguaaagggaccaggaaguuuga

SEQ ID NO: 307308 - RNA, 64 nt, Homo Sapiens
aggugauguuaagucacaaggugcugcuuuucagauccacuaugcaagaggggaggguggggcc

SEQ ID NO: 307309 - RNA, 64 nt, Homo Sapiens
cacucuucaagugaaaagaagcuguuucaaguuuauccacuaucgauguaagugaguaauaaaa

SEQ ID NO: 307310 - RNA, 64 nt, Homo Sapiens
guuuaccuugaguggccugcguguaaacucuggaauccacuaugaggggcagcagucucagggg

SEQ ID NO: 307311 - RNA, 64 nt, Homo Sapiens
ccuuaaugguuuccuccauuaacuuggugacuugauccacuaugagguagcaauaccaguuuca

SEQ ID NO: 307312 - RNA, 64 nt, Homo Sapiens
aguauuucugugcuuuauaauauauuggaggagcauccacuaucaaaauauaaacuuauuugca

SEQ ID NO: 307313 - RNA, 64 nt, Homo Sapiens
cauccccauugcccacaaauggaauccucacuguauccacuaggagauuagaaauuaagguuuc

SEQ ID NO: 307314 - RNA, 64 nt, Homo Sapiens
ugccucagcacauggaaccugaagugucuuucggauccacuauauguaauaaauguacuuccug

SEQ ID NO: 307315 - RNA, 64 nt, Homo Sapiens
agauagcucaggcaaaacuauuaccuggguauuuauccacuaaugagucacaagaaaaggagug

SEQ ID NO: 307316 - RNA, 64 nt, Homo Sapiens
guuacuguauggcacucaaaaacuauguuaaaugauccacuaacuuuuuuuuucuuggcccaug

SEQ ID NO: 307317 - RNA, 64 nt, Homo Sapiens
gccaaagcaaauacuccuuauaagcagaugugugauccacuaccuaaaaaauaucaaagcaaga

SEQ ID NO: 307318 - RNA, 64 nt, Homo Sapiens
guauguuuuguuucauugacgauuggcuuuugucauccacuauuauucuuuucaaagauucaga

SEQ ID NO: 307319 - RNA, 64 nt, Homo Sapiens
guuguuaucagcuacuguaaguauaagcaauaauauccacuagugauguauaaaugaacuuggg

SEQ ID NO: 307320 - RNA, 64 nt, Homo Sapiens
uuucauguugggcaaggaaauuccuucccucucaauccacuagcauacuuuuucaguucccuuc

SEQ ID NO: 307321 - RNA, 64 nt, Homo Sapiens
cccucuauuuuccucuaagggaggcuguucauugauccacuauuuuucuucaaacagagaaaga

SEQ ID NO: 307322 - RNA, 64 nt, Homo Sapiens
agggggcaggaaggugggacgaaugacgaugcccauccacuaccugaagcacuaggacacucuu

SEQ ID NO: 307323 - RNA, 64 nt, Homo Sapiens
aaaugugcuuguuauugauaugaaugugucuuuaauccacuacaugaacacuggauugcauggu

SEQ ID NO: 307324 - RNA, 64 nt, Homo Sapiens
aggcacccuuuagaacagggccugccuccaccauauccacuaccuggcuccaaccaaccccucc

SEQ ID NO: 307325 - RNA, 64 nt, Homo Sapiens
acaacauuaaaggaccuuuauguguuuauugcauauccacuauaccccccuuuuacccuccauu

SEQ ID NO: 307326 - RNA, 64 nt, Homo Sapiens
cugauacuuaauuuucuuaaaacuauuuuuaaugauccacuaaacaaagcaggggauccugaag

SEQ ID NO: 307327 - RNA, 64 nt, Homo Sapiens
gaauggggaaaauacccuuuaaauuaugacggacauccacuagagauggguuugaggauuuucc

SEQ ID NO: 307328 - RNA, 64 nt, Homo Sapiens
uauugccgcuaugaguuagaagcauuuuagugacauccacuacuaaaaauaaagacacacacag

SEQ ID NO: 307329 - RNA, 64 nt, Homo Sapiens
ggccuuuaagcuuucuuugagaaauaaugcaagcauccacuaaggauucauguucaauuauuug

SEQ ID NO: 307330 - RNA, 64 nt, Homo Sapiens
aauuuguggcauuuuuagucuaaugcauguuuucauccacuauccaguacugauuauuaaaaug

SEQ ID NO: 307331 - RNA, 64 nt, Homo Sapiens
uuuuuuuuaguugggaaauauaccuguauuuuuaauccacuaaucugucuacuuaaagucaagg

SEQ ID NO: 307332 - RNA, 64 nt, Homo Sapiens
uauguacagcuuaaggaagauguuaacaccuguaauccacuaaggaacugaauggcaauuugcu

SEQ ID NO: 307333 - RNA, 64 nt, Homo Sapiens
uauuauaaaguuaaauuugcaaaauaauucuaacauccacuauuguucaguauagguaaucucc

SEQ ID NO: 307334 - RNA, 64 nt, Homo Sapiens
uauuuuagacgguauaacuauuucaauuugauuaauccacuauuauauaaacaauagugggagu

SEQ ID NO: 307335 - RNA, 64 nt, Homo Sapiens
ucacccaauuuuuuauuuuuauugcuauuaaaauauccacuagaugccaccuagagcuccaguu

SEQ ID NO: 307336 - RNA, 64 nt, Homo Sapiens
agccuuuugggcaaagccccugggaacgaggccuauccacuauggacuaugguaacuugguagg

SEQ ID NO: 307337 - RNA, 64 nt, Homo Sapiens
cagaucacucugacuucuuaugcuucuccuguggauccacuaucaaaguacuaaaugcugugua

SEQ ID NO: 307338 - RNA, 64 nt, Homo Sapiens
gaguagguggucaucuuguacauuucagcaaagcauccacuaggaaaccucauaggacaguguu

SEQ ID NO: 307339 - RNA, 64 nt, Homo Sapiens
aucugagauccugcuggaaaccacagcaaccuguauccacuauuaggagguaaaaaucaauaaa

SEQ ID NO: 307340 - RNA, 64 nt, Homo Sapiens
aggagguaaaaaucaauaaaccacggcaaccuguauccacuauuaucugagauccugcuggaaa

SEQ ID NO: 307341 - RNA, 64 nt, Homo Sapiens
uaaacaccaccaccguggacaacucuugaauuaaauccacuagagcgagcuuuaaaacuaaucu

SEQ ID NO: 307342 - RNA, 64 nt, Homo Sapiens
cuucagggagcaagacaugaacugacuaauugguauccacuacuuguacagcuuacauaaauga

SEQ ID NO: 307343 - RNA, 64 nt, Homo Sapiens
cuaaaacuagagcaguuugauguguuuauuaaccauccacuaagaucacuucagcguaaagcag

SEQ ID NO: 307344 - RNA, 64 nt, Homo Sapiens
uaagaaauuauuccaauccuugaaauaauuuguaauccacuagcuccagucauggcaccaaaua

SEQ ID NO: 307345 - RNA, 64 nt, Homo Sapiens
gucuuuaagaugcagaguggggaggaucuggaggauccacuacucucccuucuccagccucagg

SEQ ID NO: 307346 - RNA, 64 nt, Homo Sapiens
ucuagugcuugacuuuaaaugcaaaagaguauuaauccacuaucacaucuguauauaguguacg

SEQ ID NO: 307347 - RNA, 64 nt, Homo Sapiens
uggcagucauugaucauaauuugaggaaaguuauauccacuaggggaaaucucaauauagagau

SEQ ID NO: 307348 - RNA, 64 nt, Homo Sapiens
uaaaauguuagacugaaaugguugacaaauauuuauccacuaagauuuauacuauuuacagauu

SEQ ID NO: 307349 - RNA, 64 nt, Homo Sapiens
auaaaauuaucauuugaaauggauuguuuccuauauccacuaucaucauuuauucgucauguau

SEQ ID NO: 307350 - RNA, 64 nt, Homo Sapiens
ugaaaaaggcccaaguacagucuuaaugcgauaaauccacuagcuaagacgucgagugccaaga

SEQ ID NO: 307351 - RNA, 64 nt, Homo Sapiens
ugugcccugggucugugcaaacguugggaccagaauccacuauaaguuucauucuucggagaca

SEQ ID NO: 307352 - RNA, 64 nt, Homo Sapiens
uucagcugagccgaguguguauacugcucuggccauccacuagcccagggaggacccagaccuc

SEQ ID NO: 307353 - RNA, 64 nt, Homo Sapiens
aaugcacuaggugggaggagugucagaugcucccauccacuauuccacugccugaucucacuuc

SEQ ID NO: 307354 - RNA, 64 nt, Homo Sapiens
uccauugagcgaaccugccugcuacccaguaaaaauccacuauucggguggucgcggagguccu

SEQ ID NO: 307355 - RNA, 64 nt, Homo Sapiens
aauaagcacagagaagcagaacucuaauugcuuaauccacuaaacauuacuucugggaauuggc

SEQ ID NO: 307356 - RNA, 64 nt, Homo Sapiens
ugaagcaaauuuggaacuuuucugucucagugugauccacuaacccacaggaucauuuggaacc

SEQ ID NO: 307357 - RNA, 64 nt, Homo Sapiens
gggagcuacagagccaaggucaaugugagucaacauccacuagaaauauccauguuguguagac

SEQ ID NO: 307358 - RNA, 64 nt, Homo Sapiens
auuguuuccucuauuuuauuuuauuuauuuuugaauccacuaucucuuuccauucaaaauauuu

SEQ ID NO: 307359 - RNA, 64 nt, Homo Sapiens
caaaguguugucuuauuccuaauuccuguauguuauccacuacagguuuuaugagacuuccuau

SEQ ID NO: 307360 - RNA, 64 nt, Homo Sapiens
ugcccagucuugagugggccacuccacuccccucauccacuaggucugucugagcccugcccuc

SEQ ID NO: 307361 - RNA, 64 nt, Homo Sapiens; identical to SEQ ID NO: 165047

SEQ ID NO: 307362 - RNA, 64 nt, Homo Sapiens; identical to SEQ ID NO: 165048

SEQ ID NO: 307363 - RNA, 64 nt, Homo Sapiens; identical to SEQ ID NO: 165049

SEQ ID NO: 307364 - RNA, 64 nt, Homo Sapiens; identical to SEQ ID NO: 165050

SEQ ID NO: 307365 - RNA, 64 nt, Homo Sapiens; identical to SEQ ID NO: 165051

SEQ ID NO: 307366 - RNA, 64 nt, Homo Sapiens; identical to SEQ ID NO: 165052

SEQ ID NO: 307367 - RNA, 64 nt, Homo Sapiens; identical to SEQ ID NO: 165053

SEQ ID NO: 307368 - RNA, 64 nt, Homo Sapiens; identical to SEQ ID NO: 165054

SEQ ID NO: 307369 - RNA, 64 nt, Homo Sapiens; identical to SEQ ID NO: 165055

SEQ ID NO: 307370 - RNA, 64 nt, Homo Sapiens; identical to SEQ ID NO: 165056

SEQ ID NO: 307371 - RNA, 64 nt, Homo Sapiens; identical to SEQ ID NO: 165057

SEQ ID NO: 307372 - RNA, 64 nt, Homo Sapiens; identical to SEQ ID NO: 165058

SEQ ID NO: 307373 - RNA, 64 nt, Homo Sapiens; identical to SEQ ID NO: 165059

SEQ ID NO: 307374 - RNA, 64 nt, Homo Sapiens; identical to SEQ ID NO: 165060

SEQ ID NO: 307375 - RNA, 64 nt, Homo Sapiens; identical to SEQ ID NO: 165061

SEQ ID NO: 307376 - RNA, 64 nt, Homo Sapiens; identical to SEQ ID NO: 165062

SEQ ID NO: 307377 - RNA, 64 nt, Homo Sapiens
uacuuuacucccuauagagaaaccauugccaucauuguagcaagugcuggaaugucccuuuuuu

SEQ ID NO: 307378 - RNA, 64 nt, Homo Sapiens
ggcaccaaauggcuggguacaaucaagugauauuuuguagcaccucacuaucugaaaggccaug

SEQ ID NO: 307379 - RNA, 64 nt, Homo Sapiens
ccagaauuaugcuuuuggaauagcagagaugacauuguagcaacaccuuugaaacaaugguuug

SEQ ID NO: 307380 - RNA, 64 nt, Homo Sapiens
gaugacauuguagcaacccauuugaaacaaugguuuguagcagaaccaucuuguuucuuucacc

SEQ ID NO: 307381 - RNA, 64 nt, Homo Sapiens
ugaaaaucuuguguaaauccugccauuuaaaaaguuguagcagauuguuuccucuuccaaagua

SEQ ID NO: 307382 - RNA, 64 nt, Homo Sapiens
auaacccaggccugucugacuacuuugccuucuuuuguagcauauaggugauguuugcucuugu

SEQ ID NO: 307383 - RNA, 64 nt, Homo Sapiens
auuucaggcuuucuccccugacacuuuuacaguuaucuuggacuucguauauucuggcaaacug

SEQ ID NO: 307384 - RNA, 64 nt, Homo Sapiens
gcccagagcaaggaacagguauaauaaguggaaaaucuuggaauaaguauaauuaucauccagc

SEQ ID NO: 307385 - RNA, 64 nt, Homo Sapiens
cgucugucucucccauaugacagaauuccuaaacaucuuggagcaaacuuacauaccauaaaga

SEQ ID NO: 307386 - RNA, 64 nt, Homo Sapiens
ucagacacauucuguuucuuacaagaauacagguaucuuggauuaauuuuuuugacagccacaa

SEQ ID NO: 307387 - RNA, 64 nt, Homo Sapiens
uuaaaagagccuuuuggacacauuaauaguguauaucuuggaggccgccccacuaugggccuac

SEQ ID NO: 307388 - RNA, 64 nt, Homo Sapiens
aaccauaagaaaaagugucccggaaguuauaaucaucuuggaggaaagaauauauagugucaga

SEQ ID NO: 307389 - RNA, 64 nt, Homo Sapiens
cuuagaggguucugaacccguucccuacacagaaaucuuggaaaccaaaugcugcugaguaagg

SEQ ID NO: 307390 - RNA, 64 nt, Homo Sapiens
ccugaggcuuccugcuugagaaccugcccccuggaucuuggacacuuacagauugagcuguaug

SEQ ID NO: 307391 - RNA, 64 nt, Homo Sapiens
aaaaagaauuccaccaggcuguuuggagauccucaucuuggagcuuuuucaaaagcggggcuuc

SEQ ID NO: 307392 - RNA, 64 nt, Homo Sapiens
aauggggaaagcgggaacccuggaguucuugggaaucuuggagccuaaagagaaaccgaggugc

SEQ ID NO: 307393 - RNA, 64 nt, Homo Sapiens
uccucagagcccuucuuccccuggagguugggguaucuuggagcacuacccccuaaugaagggc

SEQ ID NO: 307394 - RNA, 64 nt, Homo Sapiens
uuaaccccugaggcuccacccacccacagacacaaucuuggacaacguuugaauacugacugcu

SEQ ID NO: 307395 - RNA, 64 nt, Homo Sapiens
agcccaauaggcucagcucaugaugacagaacacaucuuggaaagacugacucuguuauguaac

SEQ ID NO: 307396 - RNA, 64 nt, Homo Sapiens
auagaugaauacucaggcuaaccuaguggaugugaucuuggaacuuccaugauuauccacuuaa

SEQ ID NO: 307397 - RNA, 64 nt, Homo Sapiens; identical to SEQ ID NO: 92469

SEQ ID NO: 307398 - RNA, 64 nt, Homo Sapiens; identical to SEQ ID NO: 92470

SEQ ID NO: 307399 - RNA, 64 nt, Homo Sapiens; identical to SEQ ID NO: 92471

SEQ ID NO: 307400 - RNA, 64 nt, Homo Sapiens; identical to SEQ ID NO: 92472

SEQ ID NO: 307401 - RNA, 64 nt, Homo Sapiens; identical to SEQ ID NO: 92473

SEQ ID NO: 307402 - RNA, 64 nt, Homo Sapiens; identical to SEQ ID NO: 92474

SEQ ID NO: 307403 - RNA, 63 nt, Homo Sapiens; identical to SEQ ID NO: 92475

SEQ ID NO: 307404 - RNA, 64 nt, Homo Sapiens; identical to SEQ ID NO: 92476

SEQ ID NO: 307405 - RNA, 64 nt, Homo Sapiens; identical to SEQ ID NO: 92477

SEQ ID NO: 307406 - RNA, 64 nt, Homo Sapiens; identical to SEQ ID NO: 92478

SEQ ID NO: 307407 - RNA, 64 nt, Homo Sapiens; identical to SEQ ID NO: 92479

SEQ ID NO: 307408 - RNA, 64 nt, Homo Sapiens; identical to SEQ ID NO: 92480

SEQ ID NO: 307409 - RNA, 64 nt, Homo Sapiens; identical to SEQ ID NO: 92481

SEQ ID NO: 307410 - RNA, 64 nt, Homo Sapiens; identical to SEQ ID NO: 92482

SEQ ID NO: 307411 - RNA, 64 nt, Homo Sapiens; identical to SEQ ID NO: 92483

SEQ ID NO: 307412 - RNA, 64 nt, Homo Sapiens; identical to SEQ ID NO: 92484

SEQ ID NO: 307413 - RNA, 64 nt, Homo Sapiens; identical to SEQ ID NO: 92485

SEQ ID NO: 307414 - RNA, 64 nt, Homo Sapiens; identical to SEQ ID NO: 92486

SEQ ID NO: 307415 - RNA, 64 nt, Homo Sapiens; identical to SEQ ID NO: 92487

SEQ ID NO: 307416 - RNA, 64 nt, Homo Sapiens; identical to SEQ ID NO: 92488

SEQ ID NO: 307417 - RNA, 64 nt, Homo Sapiens; identical to SEQ ID NO: 92489

SEQ ID NO: 307418 - RNA, 64 nt, Homo Sapiens; identical to SEQ ID NO: 92490

SEQ ID NO: 307419 - RNA, 64 nt, Homo Sapiens; identical to SEQ ID NO: 92491

SEQ ID NO: 307420 - RNA, 64 nt, Homo Sapiens; identical to SEQ ID NO: 92492

SEQ ID NO: 307421 - RNA, 64 nt, Homo Sapiens; identical to SEQ ID NO: 92493

SEQ ID NO: 307422 - RNA, 64 nt, Homo Sapiens; identical to SEQ ID NO: 92494

SEQ ID NO: 307423 - RNA, 64 nt, Homo Sapiens; identical to SEQ ID NO: 92495

SEQ ID NO: 307424 - RNA, 64 nt, Homo Sapiens; identical to SEQ ID NO: 92496

SEQ ID NO: 307425 - RNA, 64 nt, Homo Sapiens; identical to SEQ ID NO: 92497

SEQ ID NO: 307426 - RNA, 64 nt, Homo Sapiens; identical to SEQ ID NO: 92498

SEQ ID NO: 307427 - RNA, 64 nt, Homo Sapiens; identical to SEQ ID NO: 92499

SEQ ID NO: 307428 - RNA, 64 nt, Homo Sapiens; identical to SEQ ID NO: 92500

SEQ ID NO: 307429 - RNA, 64 nt, Homo Sapiens; identical to SEQ ID NO: 92501

SEQ ID NO: 307430 - RNA, 64 nt, Homo Sapiens; identical to SEQ ID NO: 92502

SEQ ID NO: 307431 - RNA, 64 nt, Homo Sapiens; identical to SEQ ID NO: 92503

SEQ ID NO: 307432 - RNA, 64 nt, Homo Sapiens; identical to SEQ ID NO: 92504

SEQ ID NO: 307433 - RNA, 64 nt, Homo Sapiens; identical to SEQ ID NO: 92505

SEQ ID NO: 307434 - RNA, 64 nt, Homo Sapiens; identical to SEQ ID NO: 92506

SEQ ID NO: 307435 - RNA, 64 nt, Homo Sapiens; identical to SEQ ID NO: 92507

SEQ ID NO: 307436 - RNA, 64 nt, Homo Sapiens; identical to SEQ ID NO: 92508

SEQ ID NO: 307437 - RNA, 64 nt, Homo Sapiens; identical to SEQ ID NO: 92509

SEQ ID NO: 307438 - RNA, 64 nt, Homo Sapiens; identical to SEQ ID NO: 92510

SEQ ID NO: 307439 - RNA, 64 nt, Homo Sapiens; identical to SEQ ID NO: 92511

SEQ ID NO: 307440 - RNA, 64 nt, Homo Sapiens; identical to SEQ ID NO: 92512

SEQ ID NO: 307441 - RNA, 64 nt, Homo Sapiens; identical to SEQ ID NO: 92513

SEQ ID NO: 307442 - RNA, 64 nt, Homo Sapiens; identical to SEQ ID NO: 92514

SEQ ID NO: 307443 - RNA, 64 nt, Homo Sapiens; identical to SEQ ID NO: 92515

SEQ ID NO: 307444 - RNA, 64 nt, Homo Sapiens; identical to SEQ ID NO: 92516

SEQ ID NO: 307445 - RNA, 64 nt, Homo Sapiens; identical to SEQ ID NO: 92517

SEQ ID NO: 307446 - RNA, 64 nt, Homo Sapiens; identical to SEQ ID NO: 92518

SEQ ID NO: 307447 - RNA, 64 nt, Homo Sapiens
aacggagaccaucaagccacacccccuucuuaaaacuggggacaugagccugagcagaaagggu

SEQ ID NO: 307448 - RNA, 64 nt, Homo Sapiens
caguccacagagucgguagaccagggguuacgugacuggggaaaaucucacaucuccuugucug

SEQ ID NO: 307449 - RNA, 64 nt, Homo Sapiens
ccugcauguucaggccccucgggggauuggggggacuggggaggcgcagccuagacccaauugc

SEQ ID NO: 307450 - RNA, 64 nt, Homo Sapiens
acaaccaaccccucuccugggaggccccugccccacuggggauaggagccugugucccuggugc

SEQ ID NO: 307451 - RNA, 64 nt, Homo Sapiens
cuggacaugcgggccuuucuucgguggcauacagacuggggaccccauggcagaagucaacgcc

SEQ ID NO: 307452 - RNA, 64 nt, Homo Sapiens
ggcggcacugugcgggugaggcccuccaaaccugacuggggaugugggaagggcugcgaggccu

SEQ ID NO: 307453 - RNA, 64 nt, Homo Sapiens
cuuuuucuucugucagaggaccauucuuaguggcacuggggaaaucuuggcacccagaagaauu

SEQ ID NO: 307454 - RNA, 64 nt, Homo Sapiens
cuagcagauuuauauuauaugcagauaauaauuaacuggggauaaaagaauggcaaggggugac

SEQ ID NO: 307455 - RNA, 64 nt, Homo Sapiens
ccgaggcaaugcuguacuugcaggauccagcagcacuggggaugucccccaaggugcaggaggg

SEQ ID NO: 307456 - RNA, 64 nt, Homo Sapiens
cucauuuuccccugcagcucuguuggaaguucacacuggggaaauugcugccaaaggagauaac

SEQ ID NO: 307457 - RNA, 64 nt, Homo Sapiens
ucagauggugcgaacagcagagcaggcaagggaaacuggggagauggggauggaggaggaaggc

SEQ ID NO: 307458 - RNA, 64 nt, Homo Sapiens
ccagccucucccuacucccaucccauuuccaccaacuggggaacugugacuaucuaucuccccc

SEQ ID NO: 307459 - RNA, 64 nt, Homo Sapiens
aaagggcaggguggcucaggcuuuaggcccagguacuggggaggccugaggagcccuccuggag

SEQ ID NO: 307460 - RNA, 64 nt, Homo Sapiens
gcagugucauaggaguggagggggauaaguggggacuggggacaugugaaaugaugggcauucc

SEQ ID NO: 307461 - RNA, 64 nt, Homo Sapiens
cagccugggcuagagcuccugggcugugccguccacuggggacuggggaugggacaccugagga

SEQ ID NO: 307462 - RNA, 64 nt, Homo Sapiens
ggcuagagcuccugggcugugccguccacuggggacuggggaugggacaccugaggacauucug

SEQ ID NO: 307463 - RNA, 64 nt, Homo Sapiens
uaguaauaccugaguacccaugggaauaauagacacuggggagguaggguggggagcgggagca

SEQ ID NO: 307464 - RNA, 64 nt, Homo Sapiens
uggggagcgggagcaagagcugaaaaacuuaccuacuggggacugugcucacuaccugggugac

SEQ ID NO: 307465 - RNA, 64 nt, Homo Sapiens
ccagauguuuugaguuauuucccuuaaguguuucacuggggagagaacagggagugcuccucca

SEQ ID NO: 307466 - RNA, 64 nt, Homo Sapiens
uuucucucucgcuacaaguauucuuucacucagcacuggggaaguugggaacagcuggucacca

SEQ ID NO: 307467 - RNA, 64 nt, Homo Sapiens
gccagguuggcacuguagggacaaagccauaagcacuggggacugccgggcacuggggauauac

SEQ ID NO: 307468 - RNA, 64 nt, Homo Sapiens
uacacaaagccauaagcacugcacugugccgggcacuggggauagagcaucuauuaugugccag

SEQ ID NO: 307469 - RNA, 64 nt, Homo Sapiens
gggagccacuugaaacaaaaaucguccacacagcacuggggaagagccuucuccucuucagucc

SEQ ID NO: 307470 - RNA, 64 nt, Homo Sapiens
cugaggcaggagaaucgcuucuguaaucccagcuacuggggaggucgggcgugguggugcaugc

SEQ ID NO: 307471 - RNA, 64 nt, Homo Sapiens
gucuuuccugugcucugaagaugccagcuacaucacuggggaaacaguggugguggguggagga

SEQ ID NO: 307472 - RNA, 64 nt, Homo Sapiens
ccuuggcaaagaccaagauauuuuuuccugggccacuggggaaucugaggggugaugggagaga

SEQ ID NO: 307473 - RNA, 64 nt, Homo Sapiens
auagacugaacauaugguuagucauuuaggauaaacuggggagaacccaaaucacaauaaaauu

SEQ ID NO: 307474 - RNA, 64 nt, Homo Sapiens
uuguuuguaacuuugguuauaauuuauuggcaaaacuggggauucacuuugcuuauuuuuaaaa

SEQ ID NO: 307475 - RNA, 64 nt, Homo Sapiens
caaaaauuagccaggcgugguggugggcaccuguacuggggaggugcccacccagcuacugggg

SEQ ID NO: 307476 - RNA, 64 nt, Homo Sapiens
ugggcaccuguacuggggaggugcccacccagcuacuggggaggcugagucaggagaaucgcuu

SEQ ID NO: 307477 - RNA, 64 nt, Homo Sapiens
ccaaaaugaauaagcuggacuuucuccccauggcacuggggaaccauggaaguucagggaacuu

SEQ ID NO: 307478 - RNA, 64 nt, Homo Sapiens
uauguagccucuggguguggagcugggaucuucaacuggggacaguacaguaaagaacaucaca

SEQ ID NO: 307479 - RNA, 64 nt, Homo Sapiens
ugauaaguguccaugaaaucucacaaggguauugacuggggaagguaaagacaggcauaggaaa

SEQ ID NO: 307480 - RNA, 64 nt, Homo Sapiens
aauacuaugaauguaaggauaugaaagaauucacacuggggagauuccucaugccuaaguaugc

SEQ ID NO: 307481 - RNA, 64 nt, Homo Sapiens
gcuggguggguggggggccucggaauuggcggugacuggggaggagaagcuucugcuguuuugc

SEQ ID NO: 307482 - RNA, 64 nt, Homo Sapiens
gcgcugcauccggaagucgcucgucggagggauuacuggggagugcagguuucugucugcgucg

SEQ ID NO: 307483 - RNA, 64 nt, Homo Sapiens
uuuucaccccauuauggccaaauaguauagggccacuggggagggggaagggaaucauuuugug

SEQ ID NO: 307484 - RNA, 64 nt, Homo Sapiens
uucgagacuggccccgucugaaccuucucugggcacuggggacuaagguugcaggccuuagccu

SEQ ID NO: 307485 - RNA, 64 nt, Homo Sapiens
guaguuaauuuuagguuauguuuuauauuaggcuacuggggacauaaacggucauaacuaauga

SEQ ID NO: 307486 - RNA, 64 nt, Homo Sapiens
gugugugagugugaguguguguguacgcacacacacuggggauagauaagcuaccugguaaagg

SEQ ID NO: 307487 - RNA, 64 nt, Homo Sapiens
acaucccacaucagguauauuagagcuuauccgaacuggggaaagacggauugagauuaacugc

SEQ ID NO: 307488 - RNA, 64 nt, Homo Sapiens
uuuugaggauguugugugaggguguuugacugugacuggggaagcucagacuacuuuguaugug

SEQ ID NO: 307489 - RNA, 64 nt, Homo Sapiens; identical to SEQ ID NO: 141798

SEQ ID NO: 307490 - RNA, 64 nt, Homo Sapiens; identical to SEQ ID NO: 141799

SEQ ID NO: 307491 - RNA, 64 nt, Homo Sapiens; identical to SEQ ID NO: 141800

SEQ ID NO: 307492 - RNA, 64 nt, Homo Sapiens; identical to SEQ ID NO: 141801

SEQ ID NO: 307493 - RNA, 64 nt, Homo Sapiens; identical to SEQ ID NO: 141802

SEQ ID NO: 307494 - RNA, 64 nt, Homo Sapiens; identical to SEQ ID NO: 141803

SEQ ID NO: 307495 - RNA, 64 nt, Homo Sapiens; identical to SEQ ID NO: 141804

SEQ ID NO: 307496 - RNA, 64 nt, Homo Sapiens; identical to SEQ ID NO: 141805

SEQ ID NO: 307497 - RNA, 64 nt, Homo Sapiens
uaaacuugauggucauuguuaugauuaagauaaugccgggcaggccgggcacaguggcucacgc

SEQ ID NO: 307498 - RNA, 64 nt, Homo Sapiens
uggucauuguuaugauuaagauaaugccgggcaggccgggcacaguggcucacgccuguaaucc

SEQ ID NO: 307499 - RNA, 64 nt, Homo Sapiens
ucaggagcacaggcaaggggugcuuguggcaguggccgggcaccugagccccagcucguuguua

SEQ ID NO: 307500 - RNA, 64 nt, Homo Sapiens
uauuauagcaaguucuuuauuaaagauuuuugaggccgggcacagugacucacgccuguaaccc

SEQ ID NO: 307501 - RNA, 64 nt, Homo Sapiens
gugaaacacugucuguacuaaaaauacagaauuagccgggcauggugcaugccuguaaucccag

SEQ ID NO: 307502 - RNA, 64 nt, Homo Sapiens
guggcaggcgccuauaauccaaauacaaaaauuagccgggcaugugaaaccccgucucuacuaa

SEQ ID NO: 307503 - RNA, 64 nt, Homo Sapiens
auggugcaugccuguagucucaaaaacaaaauuagccgggcaugaccucaucucuacuaaaauu

SEQ ID NO: 307504 - RNA, 64 nt, Homo Sapiens
guggcgcaugccuguaauccagauucucugcccagccgggcacauaguguaauggaucaaauua

SEQ ID NO: 307505 - RNA, 64 nt, Homo Sapiens
guggcucacgccuguaauccauuaccaagggguggccgggcacauucuaacucauauguuccca

SEQ ID NO: 307506 - RNA, 64 nt, Homo Sapiens
cacagggcagaaggguggguucccuguuggcccagccgggcacucaccgcaagagccauggcug

SEQ ID NO: 307507 - RNA, 64 nt, Homo Sapiens
guggcucacaccuguaaucccaaagaaagguugugccgggcacgagcagacacaguguucauaa

SEQ ID NO: 307508 - RNA, 64 nt, Homo Sapiens
gucccacagcaucuccuagaguagucaccgcgaagccgggcaccgcucugcuccuuagggcaug

SEQ ID NO: 307509 - RNA, 64 nt, Homo Sapiens
cugcgggcaagcuccggggucagagcuggggcaggccgggcaguuacucuggaguucacuuucc

SEQ ID NO: 307510 - RNA, 64 nt, Homo Sapiens
guggcucaugccuguaauccuagaagaagaaaaggccgggcauguguauuuaaaaaaauaaaaa

SEQ ID NO: 307511 - RNA, 64 nt, Homo Sapiens
guggcucacgccuguaaucuuaaaaaucuugagggccgggcaugagcauuucaugugguccuca

SEQ ID NO: 307512 - RNA, 64 nt, Homo Sapiens
guggaaugugccuguaauccaaauacaaaaauuagccgggcaugugaaacccugucucuccuaa

SEQ ID NO: 307513 - RNA, 64 nt, Homo Sapiens
ccugcgugccgggagaggacgccgcagcgcagccgccgggcagggcucauaugcgucccaagca

SEQ ID NO: 307514 - RNA, 64 nt, Homo Sapiens
cccaaccucauggucauggaccucggagcugccagccgggcaccgcaggcucagacucuggguc

SEQ ID NO: 307515 - RNA, 64 nt, Homo Sapiens
cuagugccgaggacacguuaaacgaacaggaugggccgggcacgguggcucacgccuguaaucc

SEQ ID NO: 307516 - RNA, 64 nt, Homo Sapiens
ugaaaccccaucuccacuaaaaauagaaaaauuagccgggcauggugacacaugccuguagucc

SEQ ID NO: 307517 - RNA, 64 nt, Homo Sapiens
gggaggcuuccccaucuuuaguuuuccacucugccccggggagcacccuucuacuccuagccac

SEQ ID NO: 307518 - RNA, 64 nt, Homo Sapiens
ggcaggccucccucagggccaggggcgauggcaccccggggacaggcagaccuccuuccugccg

SEQ ID NO: 307519 - RNA, 64 nt, Homo Sapiens
gccgagggcugaggccaggcaaucacgggcuaugcccggggagcugucgggaguggcgggaauc

SEQ ID NO: 307520 - RNA, 64 nt, Homo Sapiens
ggagcugucgggaguggcgggaaucggggccaugcccggggagcugucgggaguggcgggaauc

SEQ ID NO: 307521 - RNA, 64 nt, Homo Sapiens
ggagcugucgggaguggcgggaaucggggccaugcccggggagcugucgggaguggcgggaaau

SEQ ID NO: 307522 - RNA, 64 nt, Homo Sapiens
ugcagagcagcagcaccuuuuugagugggcccugcccggggagcugcuucucccggggacgcuu

SEQ ID NO: 307523 - RNA, 64 nt, Homo Sapiens
cuuuugagugggcccugcccaacacccugcuucucccggggacgcucuguccucccauccccuc

SEQ ID NO: 307524 - RNA, 64 nt, Homo Sapiens; identical to SEQ ID NO: 81134

SEQ ID NO: 307525 - RNA, 64 nt, Homo Sapiens; identical to SEQ ID NO: 81135

SEQ ID NO: 307526 - RNA, 64 nt, Homo Sapiens; identical to SEQ ID NO: 81136

SEQ ID NO: 307527 - RNA, 64 nt, Homo Sapiens; identical to SEQ ID NO: 81137

SEQ ID NO: 307528 - RNA, 64 nt, Homo Sapiens; identical to SEQ ID NO: 81138

SEQ ID NO: 307529 - RNA, 64 nt, Homo Sapiens; identical to SEQ ID NO: 81139

SEQ ID NO: 307530 - RNA, 64 nt, Homo Sapiens; identical to SEQ ID NO: 81140

SEQ ID NO: 307531 - RNA, 64 nt, Homo Sapiens; identical to SEQ ID NO: 81141

SEQ ID NO: 307532 - RNA, 64 nt, Homo Sapiens; identical to SEQ ID NO: 81142

SEQ ID NO: 307533 - RNA, 64 nt, Homo Sapiens; identical to SEQ ID NO: 81143

SEQ ID NO: 307534 - RNA, 64 nt, Homo Sapiens; identical to SEQ ID NO: 81144

SEQ ID NO: 307535 - RNA, 64 nt, Homo Sapiens; identical to SEQ ID NO: 81145

SEQ ID NO: 307536 - RNA, 64 nt, Homo Sapiens; identical to SEQ ID NO: 81146

SEQ ID NO: 307537 - RNA, 64 nt, Homo Sapiens; identical to SEQ ID NO: 81147

SEQ ID NO: 307538 - RNA, 64 nt, Homo Sapiens; identical to SEQ ID NO: 81148

SEQ ID NO: 307539 - RNA, 64 nt, Homo Sapiens; identical to SEQ ID NO: 81149

SEQ ID NO: 307540 - RNA, 64 nt, Homo Sapiens; identical to SEQ ID NO: 81150

SEQ ID NO: 307541 - RNA, 64 nt, Homo Sapiens; identical to SEQ ID NO: 81151

SEQ ID NO: 307542 - RNA, 64 nt, Homo Sapiens; identical to SEQ ID NO: 81152

SEQ ID NO: 307543 - RNA, 64 nt, Homo Sapiens; identical to SEQ ID NO: 81153

SEQ ID NO: 307544 - RNA, 64 nt, Homo Sapiens; identical to SEQ ID NO: 81154

SEQ ID NO: 307545 - RNA, 64 nt, Homo Sapiens; identical to SEQ ID NO: 81155

SEQ ID NO: 307546 - RNA, 64 nt, Homo Sapiens; identical to SEQ ID NO: 81156

SEQ ID NO: 307547 - RNA, 64 nt, Homo Sapiens; identical to SEQ ID NO: 81157

SEQ ID NO: 307548 - RNA, 64 nt, Homo Sapiens; identical to SEQ ID NO: 81158

SEQ ID NO: 307549 - RNA, 64 nt, Homo Sapiens; identical to SEQ ID NO: 81159

SEQ ID NO: 307550 - RNA, 64 nt, Homo Sapiens; identical to SEQ ID NO: 81160

SEQ ID NO: 307551 - RNA, 64 nt, Homo Sapiens; identical to SEQ ID NO: 81161

SEQ ID NO: 307552 - RNA, 64 nt, Homo Sapiens; identical to SEQ ID NO: 81162

SEQ ID NO: 307553 - RNA, 64 nt, Homo Sapiens; identical to SEQ ID NO: 81163

SEQ ID NO: 307554 - RNA, 64 nt, Homo Sapiens; identical to SEQ ID NO: 81164

SEQ ID NO: 307555 - RNA, 64 nt, Homo Sapiens; identical to SEQ ID NO: 81165

SEQ ID NO: 307556 - RNA, 64 nt, Homo Sapiens; identical to SEQ ID NO: 81166

SEQ ID NO: 307557 - RNA, 64 nt, Homo Sapiens; identical to SEQ ID NO: 81167

SEQ ID NO: 307558 - RNA, 64 nt, Homo Sapiens; identical to SEQ ID NO: 81168

SEQ ID NO: 307559 - RNA, 64 nt, Homo Sapiens; identical to SEQ ID NO: 81169

SEQ ID NO: 307560 - RNA, 64 nt, Homo Sapiens; identical to SEQ ID NO: 81170

SEQ ID NO: 307561 - RNA, 64 nt, Homo Sapiens; identical to SEQ ID NO: 81171

SEQ ID NO: 307562 - RNA, 64 nt, Homo Sapiens; identical to SEQ ID NO: 81172

SEQ ID NO: 307563 - RNA, 64 nt, Homo Sapiens; identical to SEQ ID NO: 81173

SEQ ID NO: 307564 - RNA, 64 nt, Homo Sapiens
ccuggagccuggcccucugaggcuuacggucuuggcaaggcagcaucgccuuggcucuugggaa

SEQ ID NO: 307565 - RNA, 64 nt, Homo Sapiens
cucugggggcgguggggugcguggggguggcaaugcaaggcacugaggccacagaugugaguaa

SEQ ID NO: 307566 - RNA, 64 nt, Homo Sapiens
uccauggaugagaagugcaagguuaauucuuaaggcaaggcaaacacccaggccacaaggccau

SEQ ID NO: 307567 - RNA, 64 nt, Homo Sapiens
aacaccacaaaagcaaaacccugcugcucuagcagcaaggcagugaggcgcuacgcagacaguc

SEQ ID NO: 307568 - RNA, 64 nt, Homo Sapiens
uugguuaauuagaucuggggcagcaacgucaaaagcaaggcagguaauguuaauagaggaaaug

SEQ ID NO: 307569 - RNA, 64 nt, Homo Sapiens
ugcauucuccuggcugcugggccuggccuggagggcaaggcagaggucucuccaagugcaucua

SEQ ID NO: 307570 - RNA, 64 nt, Homo Sapiens
ggauucuggcagcacccugaucagacccacagccgcaaggcacuccggcagggaaucggaaccc

SEQ ID NO: 307571 - RNA, 64 nt, Homo Sapiens
cagugaugggcaaaccaauuggccagggcugggcgcaaggcacguauuuacuuuucuuggcccu

SEQ ID NO: 307572 - RNA, 64 nt, Homo Sapiens
acuugaaucugggaucucgccuuauucucaaguagcaaggcaucucgacaagcauggucuaggu

SEQ ID NO: 307573 - RNA, 64 nt, Homo Sapiens
cuagucuggaaucuuugugaagcauaggguuauugcaaggcaaaugggaacuaacacaucuugc

SEQ ID NO: 307574 - RNA, 64 nt, Homo Sapiens
gucuuggaaccggagaauuuuuaauggcuacauagcaaggcaucguuuaccaggagcuuaauaa

SEQ ID NO: 307575 - RNA, 64 nt, Homo Sapiens
uggcacuaaaagucauuuuuugcuagagauaauugcaaggcacguugagggagcuaggcuguuu

SEQ ID NO: 307576 - RNA, 64 nt, Homo Sapiens
gucagagcugggacugggcgugaugggugacucagcaaggcagucguccaggaagcguuagggc

SEQ ID NO: 307577 - RNA, 64 nt, Homo Sapiens
ccagcucugugaugugacuugggccagggagucagcaaggcaccacaaauggaaaagcagauug

SEQ ID NO: 307578 - RNA, 64 nt, Homo Sapiens; identical to SEQ ID NO: 119656

SEQ ID NO: 307579 - RNA, 64 nt, Homo Sapiens; identical to SEQ ID NO: 119657

SEQ ID NO: 307580 - RNA, 64 nt, Homo Sapiens; identical to SEQ ID NO: 119658

SEQ ID NO: 307581 - RNA, 64 nt, Homo Sapiens; identical to SEQ ID NO: 119659

SEQ ID NO: 307582 - RNA, 64 nt, Homo Sapiens; identical to SEQ ID NO: 119660

SEQ ID NO: 307583 - RNA, 64 nt, Homo Sapiens; identical to SEQ ID NO: 119661

SEQ ID NO: 307584 - RNA, 64 nt, Homo Sapiens; identical to SEQ ID NO: 119662

SEQ ID NO: 307585 - RNA, 64 nt, Homo Sapiens; identical to SEQ ID NO: 119663

SEQ ID NO: 307586 - RNA, 64 nt, Homo Sapiens; identical to SEQ ID NO: 119664

SEQ ID NO: 307587 - RNA, 64 nt, Homo Sapiens; identical to SEQ ID NO: 119665

SEQ ID NO: 307588 - RNA, 64 nt, Homo Sapiens; identical to SEQ ID NO: 119666

SEQ ID NO: 307589 - RNA, 64 nt, Homo Sapiens; identical to SEQ ID NO: 119667

SEQ ID NO: 307590 - RNA, 64 nt, Homo Sapiens; identical to SEQ ID NO: 119668

SEQ ID NO: 307591 - RNA, 64 nt, Homo Sapiens; identical to SEQ ID NO: 119669

SEQ ID NO: 307592 - RNA, 64 nt, Homo Sapiens; identical to SEQ ID NO: 119670

SEQ ID NO: 307593 - RNA, 64 nt, Homo Sapiens; identical to SEQ ID NO: 119671

SEQ ID NO: 307594 - RNA, 64 nt, Homo Sapiens; identical to SEQ ID NO: 119672

SEQ ID NO: 307595 - RNA, 64 nt, Homo Sapiens; identical to SEQ ID NO: 119673

SEQ ID NO: 307596 - RNA, 64 nt, Homo Sapiens; identical to SEQ ID NO: 119674

SEQ ID NO: 307597 - RNA, 64 nt, Homo Sapiens; identical to SEQ ID NO: 119675

SEQ ID NO: 307598 - RNA, 64 nt, Homo Sapiens; identical to SEQ ID NO: 119676

SEQ ID NO: 307599 - RNA, 64 nt, Homo Sapiens; identical to SEQ ID NO: 119677

SEQ ID NO: 307600 - RNA, 64 nt, Homo Sapiens; identical to SEQ ID NO: 119678

SEQ ID NO: 307601 - RNA, 64 nt, Homo Sapiens; identical to SEQ ID NO: 119679

SEQ ID NO: 307602 - RNA, 64 nt, Homo Sapiens
gguccaaacauguaagacuucuacccuaaucaguauccuucagcuuuuuacauuaacccagugu

SEQ ID NO: 307603 - RNA, 64 nt, Homo Sapiens
ucagggaaugcuaaauuagaguaauaaguuuuauauccuucauucugggagaggaaaucaacau

SEQ ID NO: 307604 - RNA, 64 nt, Homo Sapiens
gagucauucuaacuauaaaagugcaaugacuaagauccuucacuucucugaaaguaaggcccua

SEQ ID NO: 307605 - RNA, 64 nt, Homo Sapiens
auccuucuuuaacaggcugcugagucacucagaaauccuucaaacaugauuaauuaugaagaug

SEQ ID NO: 307606 - RNA, 64 nt, Homo Sapiens
aauucuaauccacuuuggguacaacggcagggaaauccuucagcaagagaauagauuguaucaa

SEQ ID NO: 307607 - RNA, 64 nt, Homo Sapiens
ggguacuccugaaaucagaccagccauucaucggauccuucauuuauuacucugaguaacuggc

SEQ ID NO: 307608 - RNA, 64 nt, Homo Sapiens
aauaaguuaaaauguuuuugagugguaauaacuaauccuucaaaguuuguaaauggauauagac

SEQ ID NO: 307609 - RNA, 64 nt, Homo Sapiens
acaaucagauaauucacacaucuugacugaauuaauccuucaaauaagaugaguugggaaauuc

SEQ ID NO: 307610 - RNA, 64 nt, Homo Sapiens
uaaaaauuaaaaacaucagucauuuagauauaacauccuucacuguucuguuuuuuagcacagc

SEQ ID NO: 307611 - RNA, 64 nt, Homo Sapiens
acaaucugcauuaagaagauaacugugauguuuuauccuucaaauuauguacguugcauauuca

SEQ ID NO: 307612 - RNA, 64 nt, Homo Sapiens; identical to SEQ ID NO: 90288

SEQ ID NO: 307613 - RNA, 64 nt, Homo Sapiens; identical to SEQ ID NO: 90289

SEQ ID NO: 307614 - RNA, 64 nt, Homo Sapiens; identical to SEQ ID NO: 90290

SEQ ID NO: 307615 - RNA, 64 nt, Homo Sapiens; identical to SEQ ID NO: 90291

SEQ ID NO: 307616 - RNA, 64 nt, Homo Sapiens; identical to SEQ ID NO: 90292

SEQ ID NO: 307617 - RNA, 64 nt, Homo Sapiens; identical to SEQ ID NO: 90293

SEQ ID NO: 307618 - RNA, 62 nt, Homo Sapiens; identical to SEQ ID NO: 90294

SEQ ID NO: 307619 - RNA, 64 nt, Homo Sapiens; identical to SEQ ID NO: 90295

SEQ ID NO: 307620 - RNA, 53 nt, Homo Sapiens; identical to SEQ ID NO: 90296

SEQ ID NO: 307621 - RNA, 64 nt, Homo Sapiens; identical to SEQ ID NO: 90297

SEQ ID NO: 307622 - RNA, 64 nt, Homo Sapiens; identical to SEQ ID NO: 90298

SEQ ID NO: 307623 - RNA, 64 nt, Homo Sapiens; identical to SEQ ID NO: 90299

SEQ ID NO: 307624 - RNA, 64 nt, Homo Sapiens; identical to SEQ ID NO: 90300

SEQ ID NO: 307625 - RNA, 64 nt, Homo Sapiens; identical to SEQ ID NO: 90301

SEQ ID NO: 307626 - RNA, 64 nt, Homo Sapiens; identical to SEQ ID NO: 90302

SEQ ID NO: 307627 - RNA, 64 nt, Homo Sapiens; identical to SEQ ID NO: 90303

SEQ ID NO: 307628 - RNA, 64 nt, Homo Sapiens; identical to SEQ ID NO: 90304

SEQ ID NO: 307629 - RNA, 64 nt, Homo Sapiens; identical to SEQ ID NO: 90305

SEQ ID NO: 307630 - RNA, 64 nt, Homo Sapiens; identical to SEQ ID NO: 90306

SEQ ID NO: 307631 - RNA, 64 nt, Homo Sapiens; identical to SEQ ID NO: 90307

SEQ ID NO: 307632 - RNA, 64 nt, Homo Sapiens; identical to SEQ ID NO: 90308

SEQ ID NO: 307633 - RNA, 64 nt, Homo Sapiens; identical to SEQ ID NO: 90309

SEQ ID NO: 307634 - RNA, 64 nt, Homo Sapiens; identical to SEQ ID NO: 90310

SEQ ID NO: 307635 - RNA, 64 nt, Homo Sapiens; identical to SEQ ID NO: 90311

SEQ ID NO: 307636 - RNA, 64 nt, Homo Sapiens; identical to SEQ ID NO: 90312

SEQ ID NO: 307637 - RNA, 64 nt, Homo Sapiens; identical to SEQ ID NO: 90313

SEQ ID NO: 307638 - RNA, 64 nt, Homo Sapiens; identical to SEQ ID NO: 90314

SEQ ID NO: 307639 - RNA, 64 nt, Homo Sapiens; identical to SEQ ID NO: 90315

SEQ ID NO: 307640 - RNA, 64 nt, Homo Sapiens; identical to SEQ ID NO: 90316

SEQ ID NO: 307641 - RNA, 64 nt, Homo Sapiens; identical to SEQ ID NO: 90317

SEQ ID NO: 307642 - RNA, 64 nt, Homo Sapiens; identical to SEQ ID NO: 90318

SEQ ID NO: 307643 - RNA, 64 nt, Homo Sapiens; identical to SEQ ID NO: 90319

SEQ ID NO: 307644 - RNA, 64 nt, Homo Sapiens; identical to SEQ ID NO: 90320

SEQ ID NO: 307645 - RNA, 64 nt, Homo Sapiens; identical to SEQ ID NO: 90321

SEQ ID NO: 307646 - RNA, 64 nt, Homo Sapiens; identical to SEQ ID NO: 90322

SEQ ID NO: 307647 - RNA, 64 nt, Homo Sapiens; identical to SEQ ID NO: 90323

SEQ ID NO: 307648 - RNA, 64 nt, Homo Sapiens; identical to SEQ ID NO: 90324

SEQ ID NO: 307649 - RNA, 64 nt, Homo Sapiens; identical to SEQ ID NO: 90325

SEQ ID NO: 307650 - RNA, 64 nt, Homo Sapiens; identical to SEQ ID NO: 90326

SEQ ID NO: 307651 - RNA, 64 nt, Homo Sapiens; identical to SEQ ID NO: 90327

SEQ ID NO: 307652 - RNA, 64 nt, Homo Sapiens; identical to SEQ ID NO: 90328

SEQ ID NO: 307653 - RNA, 64 nt, Homo Sapiens; identical to SEQ ID NO: 90329

SEQ ID NO: 307654 - RNA, 64 nt, Homo Sapiens; identical to SEQ ID NO: 90330

SEQ ID NO: 307655 - RNA, 64 nt, Homo Sapiens; identical to SEQ ID NO: 90331

SEQ ID NO: 307656 - RNA, 64 nt, Homo Sapiens; identical to SEQ ID NO: 90332

SEQ ID NO: 307657 - RNA, 64 nt, Homo Sapiens; identical to SEQ ID NO: 90333

SEQ ID NO: 307658 - RNA, 64 nt, Homo Sapiens; identical to SEQ ID NO: 90334

SEQ ID NO: 307659 - RNA, 64 nt, Homo Sapiens; identical to SEQ ID NO: 90335

SEQ ID NO: 307660 - RNA, 64 nt, Homo Sapiens; identical to SEQ ID NO: 90336

SEQ ID NO: 307661 - RNA, 64 nt, Homo Sapiens; identical to SEQ ID NO: 90337

SEQ ID NO: 307662 - RNA, 64 nt, Homo Sapiens; identical to SEQ ID NO: 90338

SEQ ID NO: 307663 - RNA, 64 nt, Homo Sapiens; identical to SEQ ID NO: 90339

SEQ ID NO: 307664 - RNA, 64 nt, Homo Sapiens; identical to SEQ ID NO: 90340

SEQ ID NO: 307665 - RNA, 64 nt, Homo Sapiens; identical to SEQ ID NO: 90341

SEQ ID NO: 307666 - RNA, 64 nt, Homo Sapiens; identical to SEQ ID NO: 90342

SEQ ID NO: 307667 - RNA, 64 nt, Homo Sapiens; identical to SEQ ID NO: 90343

SEQ ID NO: 307668 - RNA, 64 nt, Homo Sapiens; identical to SEQ ID NO: 90344

SEQ ID NO: 307669 - RNA, 64 nt, Homo Sapiens; identical to SEQ ID NO: 90345

SEQ ID NO: 307670 - RNA, 64 nt, Homo Sapiens; identical to SEQ ID NO: 90346

SEQ ID NO: 307671 - RNA, 64 nt, Homo Sapiens; identical to SEQ ID NO: 90347

SEQ ID NO: 307672 - RNA, 64 nt, Homo Sapiens; identical to SEQ ID NO: 90348

SEQ ID NO: 307673 - RNA, 64 nt, Homo Sapiens; identical to SEQ ID NO: 90349

SEQ ID NO: 307674 - RNA, 64 nt, Homo Sapiens; identical to SEQ ID NO: 90350

SEQ ID NO: 307675 - RNA, 64 nt, Homo Sapiens; identical to SEQ ID NO: 90351

SEQ ID NO: 307676 - RNA, 64 nt, Homo Sapiens; identical to SEQ ID NO: 90352

SEQ ID NO: 307677 - RNA, 64 nt, Homo Sapiens; identical to SEQ ID NO: 90353

SEQ ID NO: 307678 - RNA, 64 nt, Homo Sapiens; identical to SEQ ID NO: 90354

SEQ ID NO: 307679 - RNA, 64 nt, Homo Sapiens; identical to SEQ ID NO: 90355

SEQ ID NO: 307680 - RNA, 64 nt, Homo Sapiens; identical to SEQ ID NO: 90356

SEQ ID NO: 307681 - RNA, 64 nt, Homo Sapiens; identical to SEQ ID NO: 90357

SEQ ID NO: 307682 - RNA, 64 nt, Homo Sapiens; identical to SEQ ID NO: 90358

SEQ ID NO: 307683 - RNA, 64 nt, Homo Sapiens; identical to SEQ ID NO: 90359

SEQ ID NO: 307684 - RNA, 64 nt, Homo Sapiens; identical to SEQ ID NO: 90360

SEQ ID NO: 307685 - RNA, 64 nt, Homo Sapiens; identical to SEQ ID NO: 90361

SEQ ID NO: 307686 - RNA, 64 nt, Homo Sapiens; identical to SEQ ID NO: 90362

SEQ ID NO: 307687 - RNA, 64 nt, Homo Sapiens; identical to SEQ ID NO: 90363

SEQ ID NO: 307688 - RNA, 64 nt, Homo Sapiens; identical to SEQ ID NO: 90364

SEQ ID NO: 307689 - RNA, 64 nt, Homo Sapiens; identical to SEQ ID NO: 90365

SEQ ID NO: 307690 - RNA, 64 nt, Homo Sapiens; identical to SEQ ID NO: 90366

SEQ ID NO: 307691 - RNA, 64 nt, Homo Sapiens; identical to SEQ ID NO: 90367

SEQ ID NO: 307692 - RNA, 64 nt, Homo Sapiens; identical to SEQ ID NO: 90368

SEQ ID NO: 307693 - RNA, 64 nt, Homo Sapiens; identical to SEQ ID NO: 90369

SEQ ID NO: 307694 - RNA, 64 nt, Homo Sapiens; identical to SEQ ID NO: 90370

SEQ ID NO: 307695 - RNA, 64 nt, Homo Sapiens; identical to SEQ ID NO: 90371

SEQ ID NO: 307696 - RNA, 64 nt, Homo Sapiens; identical to SEQ ID NO: 90372

SEQ ID NO: 307697 - RNA, 64 nt, Homo Sapiens; identical to SEQ ID NO: 90373

SEQ ID NO: 307698 - RNA, 64 nt, Homo Sapiens; identical to SEQ ID NO: 90374

SEQ ID NO: 307699 - RNA, 64 nt, Homo Sapiens; identical to SEQ ID NO: 90375

SEQ ID NO: 307700 - RNA, 64 nt, Homo Sapiens; identical to SEQ ID NO: 90376

SEQ ID NO: 307701 - RNA, 64 nt, Homo Sapiens; identical to SEQ ID NO: 90377

SEQ ID NO: 307702 - RNA, 64 nt, Homo Sapiens; identical to SEQ ID NO: 90378

SEQ ID NO: 307703 - RNA, 64 nt, Homo Sapiens; identical to SEQ ID NO: 90379

SEQ ID NO: 307704 - RNA, 64 nt, Homo Sapiens; identical to SEQ ID NO: 90380

SEQ ID NO: 307705 - RNA, 64 nt, Homo Sapiens; identical to SEQ ID NO: 90381

SEQ ID NO: 307706 - RNA, 64 nt, Homo Sapiens; identical to SEQ ID NO: 90382

SEQ ID NO: 307707 - RNA, 64 nt, Homo Sapiens; identical to SEQ ID NO: 90383

SEQ ID NO: 307708 - RNA, 64 nt, Homo Sapiens; identical to SEQ ID NO: 90384

SEQ ID NO: 307709 - RNA, 64 nt, Homo Sapiens; identical to SEQ ID NO: 90385

SEQ ID NO: 307710 - RNA, 64 nt, Homo Sapiens; identical to SEQ ID NO: 90386

SEQ ID NO: 307711 - RNA, 64 nt, Homo Sapiens; identical to SEQ ID NO: 90387

SEQ ID NO: 307712 - RNA, 64 nt, Homo Sapiens; identical to SEQ ID NO: 90388

SEQ ID NO: 307713 - RNA, 64 nt, Homo Sapiens; identical to SEQ ID NO: 90389

SEQ ID NO: 307714 - RNA, 64 nt, Homo Sapiens; identical to SEQ ID NO: 90390

SEQ ID NO: 307715 - RNA, 64 nt, Homo Sapiens; identical to SEQ ID NO: 90391

SEQ ID NO: 307716 - RNA, 64 nt, Homo Sapiens; identical to SEQ ID NO: 90392

SEQ ID NO: 307717 - RNA, 64 nt, Homo Sapiens; identical to SEQ ID NO: 90393

SEQ ID NO: 307718 - RNA, 64 nt, Homo Sapiens; identical to SEQ ID NO: 90394

SEQ ID NO: 307719 - RNA, 64 nt, Homo Sapiens; identical to SEQ ID NO: 90395

SEQ ID NO: 307720 - RNA, 64 nt, Homo Sapiens; identical to SEQ ID NO: 90396

SEQ ID NO: 307721 - RNA, 64 nt, Homo Sapiens; identical to SEQ ID NO: 90397

SEQ ID NO: 307722 - RNA, 64 nt, Homo Sapiens; identical to SEQ ID NO: 90398

SEQ ID NO: 307723 - RNA, 64 nt, Homo Sapiens; identical to SEQ ID NO: 90399

SEQ ID NO: 307724 - RNA, 64 nt, Homo Sapiens; identical to SEQ ID NO: 90400

SEQ ID NO: 307725 - RNA, 64 nt, Homo Sapiens; identical to SEQ ID NO: 90401

SEQ ID NO: 307726 - RNA, 64 nt, Homo Sapiens; identical to SEQ ID NO: 90402

SEQ ID NO: 307727 - RNA, 64 nt, Homo Sapiens; identical to SEQ ID NO: 90403

SEQ ID NO: 307728 - RNA, 64 nt, Homo Sapiens; identical to SEQ ID NO: 90404

SEQ ID NO: 307729 - RNA, 64 nt, Homo Sapiens; identical to SEQ ID NO: 90405

SEQ ID NO: 307730 - RNA, 64 nt, Homo Sapiens; identical to SEQ ID NO: 90406

SEQ ID NO: 307731 - RNA, 64 nt, Homo Sapiens; identical to SEQ ID NO: 90407

SEQ ID NO: 307732 - RNA, 64 nt, Homo Sapiens; identical to SEQ ID NO: 90408

SEQ ID NO: 307733 - RNA, 64 nt, Homo Sapiens; identical to SEQ ID NO: 90409

SEQ ID NO: 307734 - RNA, 64 nt, Homo Sapiens
ggaauacucucuggggcggauggcagaaggccugagccaccacgaccccaucaugaaggugcug

SEQ ID NO: 307735 - RNA, 64 nt, Homo Sapiens
ggcugccgcacgggaacucauggguguguuacucagccaccacccaccgcuggagccccagcug

SEQ ID NO: 307736 - RNA, 64 nt, Homo Sapiens
cuacucucuggccuaacggagcccacccaggcacagccaccacuuugcaagugggaggagggga

SEQ ID NO: 307737 - RNA, 64 nt, Homo Sapiens
aaggggagacaaaaccacugcagaccuaccacgaagccaccaccaccuucaguaacaaggguac

SEQ ID NO: 307738 - RNA, 64 nt, Homo Sapiens
cgauaugggggucugccaagcugugaggaccaguagccaccaagccacccacaagcccccuccc

SEQ ID NO: 307739 - RNA, 64 nt, Homo Sapiens
cacugacuggcauuucuguccaccaguaauaaaaagccaccacacugcccccacacccacucca

SEQ ID NO: 307740 - RNA, 64 nt, Homo Sapiens
ccugccugcccccacacccacuggccuaggugggagccaccacuuccuguuuggaaauggggag

SEQ ID NO: 307741 - RNA, 64 nt, Homo Sapiens
ccccgccccagauggauuuuggauuacaggcgugagccaccaugcuuggccucccaaagugcug

SEQ ID NO: 307742 - RNA, 59 nt, Homo Sapiens
cagcaucccaggcugguggcgcccagcagagccaccaccgaagucauggcaccuuguga

SEQ ID NO: 307743 - RNA, 64 nt, Homo Sapiens
ccucagccuccaacuagcugggauuacaggcacaagccaccaugccuggcuaaaauucuuuugu

SEQ ID NO: 307744 - RNA, 64 nt, Homo Sapiens
cucggccucccaaaguucugggauuaaaugcgugagccaccaugcccggccgcuauugcucuuu

SEQ ID NO: 307745 - RNA, 64 nt, Homo Sapiens
ccauugggcaggcagauguuagaaagccaugugcagccaccagucgugcagcaucagcaucccu

SEQ ID NO: 307746 - RNA, 64 nt, Homo Sapiens
cugguggcucugugugcucuaguguuaagcguugagccaccaagggagcaucuccucaacucug

SEQ ID NO: 307747 - RNA, 64 nt, Homo Sapiens
uuccagcugaccagacuaaaggcucuuuuucccaagccaccauccucuguguagguaaccagau

SEQ ID NO: 307748 - RNA, 64 nt, Homo Sapiens
ggaccagcucuguguagguacagaaccuaccugcagccaccaggaccccuaauucccucaacag

SEQ ID NO: 307749 - RNA, 64 nt, Homo Sapiens
cuuggccucccaaagugcugggauuacaggugugagccaccaugccuggcccuaauuuuugugu

SEQ ID NO: 307750 - RNA, 64 nt, Homo Sapiens
gcugaaguccaaucccacaaucauggcucacugcagccaccaccuccugagcucaagugauccu

SEQ ID NO: 307751 - RNA, 64 nt, Homo Sapiens
uggcagagaugaggagguuuggcacagaaaacauagccaccauuuuguccaagccugggcaugg

SEQ ID NO: 307752 - RNA, 64 nt, Homo Sapiens
auuagguugacaacuugucaugauuuugacgguaagccaccaugauuguguucucugccucugg

SEQ ID NO: 307753 - RNA, 64 nt, Homo Sapiens
cucagccucccaaagugcugggauuauagucgugagccaccacgccuggccagaguuuuuuauu

SEQ ID NO: 307754 - RNA, 64 nt, Homo Sapiens
cucggccucccaaagugcuggcauuacaggcaugagccaccaugccuggcccaaaguucuagaa

SEQ ID NO: 307755 - RNA, 64 nt, Homo Sapiens
ccccaccuauugucuauauuggauuacagggacgagccaccacacuuggccucccaaagugcug

SEQ ID NO: 307756 - RNA, 64 nt, Homo Sapiens
cccggcugucaucaucaaauggauuacaggcgugagccaccacucucggccucccaaagugcua

SEQ ID NO: 307757 - RNA, 64 nt, Homo Sapiens
cccagccucuccccuuuaaaagauuacaagugugagccaccacgcucggccucccaaagugcug

SEQ ID NO: 307758 - RNA, 64 nt, Homo Sapiens
gggccccaaguggcagcaacgcuaugcaagaagcagccaccagaaauuucauaccuagcgugga

SEQ ID NO: 307759 - RNA, 64 nt, Homo Sapiens
aaagcuguuuucccuacaaggugcuugguggugaagccaccaagcugucuuugguacucuuaaa

SEQ ID NO: 307760 - RNA, 64 nt, Homo Sapiens
uaugaccucaucacccucagacuuuaagacaagaagccaccaucaaaacaaaggaugggauacg

SEQ ID NO: 307761 - RNA, 64 nt, Homo Sapiens
ccaggcccgagaaaugcuuuggauuacaggcgugagccaccacacucagccucccaaagugcug

SEQ ID NO: 307762 - RNA, 64 nt, Homo Sapiens
aucucuggcccaagcuucugugccauccuguggaagccaccaucagcagagugagggcacucac

SEQ ID NO: 307763 - RNA, 64 nt, Homo Sapiens
ccuggccaauuauguaauuuggauuacaggcgugagccaccacgcucggccucccaaagugcug

SEQ ID NO: 307764 - RNA, 64 nt, Homo Sapiens
uccggccaauuuuucucauuggauuacaggugugagccaccacgcuuggccucccaaaguucua

SEQ ID NO: 307765 - RNA, 64 nt, Homo Sapiens
cccugccugguuuucaaauuggauuacaggcgugagccaccaggcuuggcuccccaaagugcug

SEQ ID NO: 307766 - RNA, 64 nt, Homo Sapiens
uuucuguuugaaccccaugugggaugaaucucaaagccaccagcguucuugccuaguguccaga

SEQ ID NO: 307767 - RNA, 64 nt, Homo Sapiens
gccaugggggagggaagaguguguccuggcaggaagccaccauuggagaaggugaggccaguaa

SEQ ID NO: 307768 - RNA, 64 nt, Homo Sapiens
cucugccaauuauuuuaaauggauuacaggugugagccaccaugccuggccucccagagugcug

SEQ ID NO: 307769 - RNA, 64 nt, Homo Sapiens
acuggauuuguuuguuuuucuuucucuuuuuuagagccaccaauuuauuuuauuauuucuucuu

SEQ ID NO: 307770 - RNA, 64 nt, Homo Sapiens
ugucucagggcuaccuucucuccuucucccucgcagccaccacaugcuccucaaggguuggggg

SEQ ID NO: 307771 - RNA, 64 nt, Homo Sapiens
ucagcagcuaagagaucggccagggacugugcucagccaccaguacugccaugagcuuucuacc

SEQ ID NO: 307772 - RNA, 64 nt, Homo Sapiens
cugccaggggcugccguccacccacucauuccaaagccaccaaagggcuuagugccacaugcac

SEQ ID NO: 307773 - RNA, 64 nt, Homo Sapiens
uccacagaacuacugcagccuccccgagcguggcagccaccaggugugucagccucucaccggc

SEQ ID NO: 307774 - RNA, 64 nt, Homo Sapiens
ugcucccuugaugggguccagagagccucccugcagccaccagacuuggccuccagcuguucuu

SEQ ID NO: 307775 - RNA, 64 nt, Homo Sapiens
uauguuuauucuaguuaaggaaauguugagggcaagccaccaaauuaccuaggcugagguuaga

SEQ ID NO: 307776 - RNA, 64 nt, Homo Sapiens
cucagccucccaaaguacugggauuauaggcaugagccaccacgcccagccuguuauuuuuuua

SEQ ID NO: 307777 - RNA, 64 nt, Homo Sapiens
cucggucucccaaagugcugggauuacaggcgugagccaccaugcccggcccaaauauuuuuua

SEQ ID NO: 307778 - RNA, 64 nt, Homo Sapiens
gcaguuuaaaauguugggaugccugaggaccaggagccaccacccacugggguguugugagaga

SEQ ID NO: 307779 - RNA, 64 nt, Homo Sapiens
cucagccucccaaagugcugagauuacaggcaugagccaccacgcccagccauugaguauucuu

SEQ ID NO: 307780 - RNA, 64 nt, Homo Sapiens
agaggugcaggggagucaccgcccagaccuccccagccaccaaccgaccccaccucuguuccua

SEQ ID NO: 307781 - RNA, 64 nt, Homo Sapiens
ggaggcccugcccggggcuggggccuaguccagcagccaccaaagucuggcagacuuucugcau

SEQ ID NO: 307782 - RNA, 64 nt, Homo Sapiens
cgaacucuugggcuucaagcaauccuccugugucagccaccagaguagcugagacuacaggggu

SEQ ID NO: 307783 - RNA, 64 nt, Homo Sapiens
cuugcccucccaaaguguugggauuauaggcaugagccaccacgacuggccagaggacaaaauu

SEQ ID NO: 307784 - RNA, 64 nt, Homo Sapiens
cucagccucccaaagugcugggauuacaggcaugagccaccacacccagcgagacgggguuuca

SEQ ID NO: 307785 - RNA, 64 nt, Homo Sapiens
cuuggccucccaaagugcugggauuacagacaugagccaccacgcuuggccgggauaguauauu

SEQ ID NO: 307786 - RNA, 64 nt, Homo Sapiens
cccagcugggagcguucuuuggauuacaggcgugagccaccaugcucggccucccaaagugcua

SEQ ID NO: 307787 - RNA, 64 nt, Homo Sapiens
cccggccaauacuacacucuggauuacacgcgugagccaccaugcuuggccucccaaagugcug

SEQ ID NO: 307788 - RNA, 64 nt, Homo Sapiens
cucagcaucccaaguagcugggauaacaggugccagccaccaugcccagcuaauuuguguauuu

SEQ ID NO: 307789 - RNA, 64 nt, Homo Sapiens
cucagccucccaaagugcugggauuacaggcuugagccaccacgcccagccuguagcauauuuu

SEQ ID NO: 307790 - RNA, 64 nt, Homo Sapiens
ucgucacccgcaucuccaacgaccucgagcucugagccaccacggucccagggcccuuacucuu

SEQ ID NO: 307791 - RNA, 64 nt, Homo Sapiens
auaucgggccccccauucauccacucacacucccagccaccauguuacacuggacucuaagcca

SEQ ID NO: 307792 - RNA, 64 nt, Homo Sapiens
gcuggcugaagauuauacuuggauuacagacgugagccaccacacucugccucccaaagugcug

SEQ ID NO: 307793 - RNA, 64 nt, Homo Sapiens
ccaggcucauuguuauauuuggacuacaauugugagccaccauguucagccucccaaguagcug

SEQ ID NO: 307794 - RNA, 64 nt, Homo Sapiens
accaacguguuucuuaauuuggauuacagccaugagccaccaugauuggccucccaaggugcug

SEQ ID NO: 307795 - RNA, 64 nt, Homo Sapiens
ccuggccuguuuuuuguuucagauuacaggcgugagccaccacacuccaccugccaaagugcug

SEQ ID NO: 307796 - RNA, 64 nt, Homo Sapiens
ccugacccauaggucuucaaggauuacaggugugagccaccacacucggccucccaaagugcug

SEQ ID NO: 307797 - RNA, 62 nt, Homo Sapiens
guccuuccaaagccagaucucccggggcccaaagccaccaccugcugaagacucggcuguga

SEQ ID NO: 307798 - RNA, 64 nt, Homo Sapiens
cccagccccagcuuaguuuuggauuacaggggugagccaccacgcucagccucccaaagugcug

SEQ ID NO: 307799 - RNA, 64 nt, Homo Sapiens
ccuggccaacucacauuuuuggacuacaggcaugagccaccaugcucagccuccugaguagcug

SEQ ID NO: 307800 - RNA, 64 nt, Homo Sapiens
cccaagccccuccccacgucgcccccuccugcacagccaccagcagccagcccccuccgauaca

SEQ ID NO: 307801 - RNA, 64 nt, Homo Sapiens
aggucucugccccacgcguucccgucgcugacaaagccaccagcugccuccuuuaagcuuggug

SEQ ID NO: 307802 - RNA, 64 nt, Homo Sapiens
uggaggaaaggggcuccaagaggcccugagaaggagccaccagcaaaguggccugaaugaggcc

SEQ ID NO: 307803 - RNA, 64 nt, Homo Sapiens
acccaugcacagugcugcagcacguggcugucccagccaccaaaaggccacugagggaauccuc

SEQ ID NO: 307804 - RNA, 64 nt, Homo Sapiens
cuuuuuccuaccacuaccuucuggccacugccucagccaccaagggggucagcuggucucaaaa

SEQ ID NO: 307805 - RNA, 64 nt, Homo Sapiens
gcgucaggguggagaucuggcugcaaaccaccgcagccaccacagucuccccuggccucgccuu

SEQ ID NO: 307806 - RNA, 64 nt, Homo Sapiens
cucagcccuuuaaaccuuucggauuacugacaugagccaccacacgcagucucccgaagugcug

SEQ ID NO: 307807 - RNA, 64 nt, Homo Sapiens
ccuggccuauucuggucucugaauuacaggcauuagccaccaugccuuggcucccaaagugcug

SEQ ID NO: 307808 - RNA, 64 nt, Homo Sapiens
ugucauuauaaaaguuuccuuuuuuauucucucaagccaccagcugccagccaccagcagccag

SEQ ID NO: 307809 - RNA, 64 nt, Homo Sapiens
uuuccuuuuuuauucucucaagccaccagcugccagccaccagcagccagcugccagccuagcu

SEQ ID NO: 307810 - RNA, 60 nt, Homo Sapiens
ggaucccugagcucugagccaagggugaggauggggaaacucuaagcucccaccuaauaa

SEQ ID NO: 307811 - RNA, 60 nt, Homo Sapiens
ccaaccaucggguggagcuccugcugggcuauggggaagggagguugugcggaucuugac

SEQ ID NO: 307812 - RNA, 60 nt, Homo Sapiens
ugcauaccugccagcucguaugccucuggcauggggaaauuaagggaacagugucuguuu

SEQ ID NO: 307813 - RNA, 60 nt, Homo Sapiens
auuggcgcaauauuuaugggagugggagggauggggaaaauaaacuuaacucuacaaaag

SEQ ID NO: 307814 - RNA, 60 nt, Homo Sapiens
gaaauccuacuucagaaguguaauaaauggauggggaaaucguuugauggggaaaagucu

SEQ ID NO: 307815 - RNA, 60 nt, Homo Sapiens
aguguaauaaauggauggggaaaucguuugauggggaaaagucucuuguaaguaaaagua

SEQ ID NO: 307816 - RNA, 60 nt, Homo Sapiens
aaaaaucagugcacaagaauaacccgagaaauggggaaaaaaaugaauagaaaauuuuaa

SEQ ID NO: 307817 - RNA, 60 nt, Homo Sapiens
ggagugggggcacaaucugaucugucaggaauggggaagggaagaucuuuugcauuuucu

SEQ ID NO: 307818 - RNA, 60 nt, Homo Sapiens
ggccagcauggggugggcuucacuaaggaaauggggaagguuuuagugaugggucuugcu

SEQ ID NO: 307819 - RNA, 60 nt, Homo Sapiens
gagcucucccugccucucucucugggggcgauggggaaggucaggaguccagcccauucc

SEQ ID NO: 307820 - RNA, 60 nt, Homo Sapiens
uuuuucucugaccuuuccauccuugaaaaaauggggaaaaaagaagaaaaaagacaaaau

SEQ ID NO: 307821 - RNA, 60 nt, Homo Sapiens
cugguuuggggcacaaggaagccuuaggguauggggaaaggcuguuauuaccuagaguuu

SEQ ID NO: 307822 - RNA, 60 nt, Homo Sapiens
aaugagcaucugugaauaauaaagauuaaaauggggaaauaacuguguuguauauaaugu

SEQ ID NO: 307823 - RNA, 60 nt, Homo Sapiens
gcuuuauacagacaucaguuacuggaucacauggggaagcgacauguacauugucaugug

SEQ ID NO: 307824 - RNA, 60 nt, Homo Sapiens
aauacuuugggcaguaucuuaaagcaagucauggggaauguggcucaaaaauggaaacug

SEQ ID NO: 307825 - RNA, 60 nt, Homo Sapiens
uguucucggggcagguuuccuugcaaagcaauggggaacggugcuuuuaaaaagagaugc

SEQ ID NO: 307826 - RNA, 60 nt, Homo Sapiens
auauuuuuugaaagacuuuuaggaaaaccuauggggaaugaaaaaaaucagguuuuaaac

SEQ ID NO: 307827 - RNA, 60 nt, Homo Sapiens
uggcucugcuuuugcccuuuucccaccaucauggggaagcauuacauagcaauuucuccu

SEQ ID NO: 307828 - RNA, 60 nt, Homo Sapiens
aguugccccacaaaauguggucaggccacuauggggaagccccuguggguuggagccgag

SEQ ID NO: 307829 - RNA, 60 nt, Homo Sapiens
cacuaacuauccaaccagcuuuuuaauauuauggggaaacgcuuaggcccugucucucuu

SEQ ID NO: 307830 - RNA, 60 nt, Homo Sapiens
agccaagguggcugggaucuggccccacagauggggaaagauggggaaggguguggagug

SEQ ID NO: 307831 - RNA, 60 nt, Homo Sapiens
gcugggaucuggccccacagauggggaaagauggggaaggguguggaguggggaggagcc

SEQ ID NO: 307832 - RNA, 60 nt, Homo Sapiens
caagaaggaauugaaauaaggagggacaugauggggaaggaguacaaaacaaucucucaa

SEQ ID NO: 307833 - RNA, 60 nt, Homo Sapiens
ucauugcagacaccaccauauugcuaucuaauggggaaauguagcuaugggccauaacca

SEQ ID NO: 307834 - RNA, 60 nt, Homo Sapiens
acucuccugggccccaaggagucccacggaauggggaaagcgggaacccuggaguucuug

SEQ ID NO: 307835 - RNA, 60 nt, Homo Sapiens
gaugcuucugagggaugcugaccucccacuauggggaaaaggguugcuuggaggaccugg

SEQ ID NO: 307836 - RNA, 60 nt, Homo Sapiens
gguguuggaugccuuuuuccuagaccaggaauggggaauauauaacaccugugccaccgc

SEQ ID NO: 307837 - RNA, 60 nt, Homo Sapiens
uugugagcuuccuaccugacguaauggcuuauggggaacaugauuuuccuuagccaguuu

SEQ ID NO: 307838 - RNA, 60 nt, Homo Sapiens
ggaggcaggagacuuugagguguguauaaaauggggaaaucuguauuuaaaagcaugaac

SEQ ID NO: 307839 - RNA, 60 nt, Homo Sapiens
uggagcaaaccuagcccccagccaagggccauggggaagagaguugccaacuauucucag

SEQ ID NO: 307840 - RNA, 60 nt, Homo Sapiens
gagucucucuuccaaguccuauucaagugaauggggaagggccagugcugucugggaugu

SEQ ID NO: 307841 - RNA, 60 nt, Homo Sapiens
aguuauagaaaaugucacugagucagugacauggggaaauuaaggaagugaaaacuuagc

SEQ ID NO: 307842 - RNA, 60 nt, Homo Sapiens
aaagucuugugauugacuuuugccuagauaauggggaaaauaucauaaaauuuucauaua

SEQ ID NO: 307843 - RNA, 60 nt, Homo Sapiens
guuuggagcaaagagaugaacccuccauacauggggaaguacugcauggauuaaaguagu

SEQ ID NO: 307844 - RNA, 64 nt, Homo Sapiens; identical to SEQ ID NO: 244135

SEQ ID NO: 307845 - RNA, 64 nt, Homo Sapiens; identical to SEQ ID NO: 244136

SEQ ID NO: 307846 - RNA, 64 nt, Homo Sapiens; identical to SEQ ID NO: 244137

SEQ ID NO: 307847 - RNA, 64 nt, Homo Sapiens; identical to SEQ ID NO: 244138

SEQ ID NO: 307848 - RNA, 64 nt, Homo Sapiens; identical to SEQ ID NO: 244139

SEQ ID NO: 307849 - RNA, 64 nt, Homo Sapiens; identical to SEQ ID NO: 244140

SEQ ID NO: 307850 - RNA, 64 nt, Homo Sapiens; identical to SEQ ID NO: 244141

SEQ ID NO: 307851 - RNA, 64 nt, Homo Sapiens; identical to SEQ ID NO: 244142

SEQ ID NO: 307852 - RNA, 64 nt, Homo Sapiens
uaaagaaauacuauugcucucucuguccugcuaccuaaaggauaaucucuuuacuauguccuag

SEQ ID NO: 307853 - RNA, 64 nt, Homo Sapiens
aaauuuguuuuauaaugauguccauaugauaaaacuaaaggacuuaccaggacaauagggucau

SEQ ID NO: 307854 - RNA, 64 nt, Homo Sapiens
aggcuggccccagagaugaucuugcccuuccuaacuaaaggacagaagugcaauuuagcuuaaa

SEQ ID NO: 307855 - RNA, 64 nt, Homo Sapiens
ucauuggauauuucugauccuuauugcauuguaccuaaaggagaguaacuaaugguaaccuuuu

SEQ ID NO: 307856 - RNA, 64 nt, Homo Sapiens
ucuauuugcugucaguuaaauugccacgaucucacuaaaggauuuuaauuauaauacugucaaa

SEQ ID NO: 307857 - RNA, 64 nt, Homo Sapiens
aggaugaugguagaacggaguuauugccccauaacuaaaggaucuuuacucauugcacuugagu

SEQ ID NO: 307858 - RNA, 64 nt, Homo Sapiens
agccuuaaauaccuaaaagacucaaaguagcuagcuaaaggagugagauagucacuuuaaacag

SEQ ID NO: 307859 - RNA, 64 nt, Homo Sapiens
uguauuuccauaaaugcuuugaagcaucucucuucuaaaggaugcauuaaagucagucgugcgu

SEQ ID NO: 307860 - RNA, 64 nt, Homo Sapiens
ggcauaauuuucuuuccucuggcugaucccagcccuaaaggaaggguagacccgugucuuucca

SEQ ID NO: 307861 - RNA, 64 nt, Homo Sapiens
ccuaaaggaaggguagacccgugucuuuccagcccuaaaggaaggguagacccgugucuuucca

SEQ ID NO: 307862 - RNA, 64 nt, Homo Sapiens
ccuaaaggaaggguagacccgugucuuuccagcccuaaaggaagggcagacccgugucuuucca

SEQ ID NO: 307863 - RNA, 64 nt, Homo Sapiens
augccucugagcuucuaaacugaagcugcuguaacuaaaggaaucugaaaagaacaacccugaa

SEQ ID NO: 307864 - RNA, 64 nt, Homo Sapiens
gcugucgguguggacgcugugcugguucuguuuucuaaaggagcagaaggacaggucucugaga

SEQ ID NO: 307865 - RNA, 64 nt, Homo Sapiens; identical to SEQ ID NO: 172254

SEQ ID NO: 307866 - RNA, 64 nt, Homo Sapiens; identical to SEQ ID NO: 172255

SEQ ID NO: 307867 - RNA, 64 nt, Homo Sapiens; identical to SEQ ID NO: 172256

SEQ ID NO: 307868 - RNA, 64 nt, Homo Sapiens; identical to SEQ ID NO: 172257

SEQ ID NO: 307869 - RNA, 64 nt, Homo Sapiens; identical to SEQ ID NO: 172258

SEQ ID NO: 307870 - RNA, 64 nt, Homo Sapiens; identical to SEQ ID NO: 172259

SEQ ID NO: 307871 - RNA, 64 nt, Homo Sapiens; identical to SEQ ID NO: 172260

SEQ ID NO: 307872 - RNA, 64 nt, Homo Sapiens; identical to SEQ ID NO: 172261

SEQ ID NO: 307873 - RNA, 64 nt, Homo Sapiens; identical to SEQ ID NO: 172262

SEQ ID NO: 307874 - RNA, 64 nt, Homo Sapiens; identical to SEQ ID NO: 172263

SEQ ID NO: 307875 - RNA, 64 nt, Homo Sapiens; identical to SEQ ID NO: 172264

SEQ ID NO: 307876 - RNA, 64 nt, Homo Sapiens; identical to SEQ ID NO: 172265

SEQ ID NO: 307877 - RNA, 64 nt, Homo Sapiens; identical to SEQ ID NO: 172266

SEQ ID NO: 307878 - RNA, 64 nt, Homo Sapiens; identical to SEQ ID NO: 45833

SEQ ID NO: 307879 - RNA, 64 nt, Homo Sapiens; identical to SEQ ID NO: 45834

SEQ ID NO: 307880 - RNA, 64 nt, Homo Sapiens; identical to SEQ ID NO: 45835

SEQ ID NO: 307881 - RNA, 64 nt, Homo Sapiens; identical to SEQ ID NO: 45836

SEQ ID NO: 307882 - RNA, 64 nt, Homo Sapiens; identical to SEQ ID NO: 45837

SEQ ID NO: 307883 - RNA, 64 nt, Homo Sapiens; identical to SEQ ID NO: 45838

SEQ ID NO: 307884 - RNA, 64 nt, Homo Sapiens; identical to SEQ ID NO: 45839

SEQ ID NO: 307885 - RNA, 64 nt, Homo Sapiens; identical to SEQ ID NO: 45840

SEQ ID NO: 307886 - RNA, 64 nt, Homo Sapiens
uccccacugcccccugcagccccugagauauuuugcucacuaucccuccccacuugcuucccug

SEQ ID NO: 307887 - RNA, 64 nt, Homo Sapiens
ucagugaauuaccacugccugugggccaaaucuagcucacuaucuguuuuuguaaauaaaauuu

SEQ ID NO: 307888 - RNA, 64 nt, Homo Sapiens
agagguacauuacugcaaugacagaagagaaggugcucacuaacuuuaucuugaagagauaagc

SEQ ID NO: 307889 - RNA, 64 nt, Homo Sapiens
ugcuuuuuagcaucucugguaaagaguaauaacugcucacuagugaaauauauuccaucaaguc

SEQ ID NO: 307890 - RNA, 64 nt, Homo Sapiens
caguuuagaauagacguucuaauuaauaaacaaugcucacuacaauuuaacauuguagaaaugu

SEQ ID NO: 307891 - RNA, 64 nt, Homo Sapiens
cauguuuuuguuuugcagacgagauuaguagauggcucacuagacaugaguuagaccagugguu

SEQ ID NO: 307892 - RNA, 64 nt, Homo Sapiens
cucuuaaucagcaaacgcaguggucccuggaguggcucacuaagccgcauccagaagggagaau

SEQ ID NO: 307893 - RNA, 52 nt, Homo Sapiens
ggcggaacccaggcguuuaacggcucacuaggcagccccagaucuggggaac

SEQ ID NO: 307894 - RNA, 64 nt, Homo Sapiens
acuggaagcccucuuggaaacuucccugaagugcgcucacuaacucucagcuguuagaaucugc

SEQ ID NO: 307895 - RNA, 64 nt, Homo Sapiens
cuuaaaggaaaugauucuaucuuaccuauaaacagcucacuacaucucuguuggaauuugccua

SEQ ID NO: 307896 - RNA, 64 nt, Homo Sapiens
uguucugcuguguuucaggacauauuuuuugugggcucacuaagauucugaaacuuaagucuua

SEQ ID NO: 307897 - RNA, 64 nt, Homo Sapiens
gucauccaggcuggagugcagugguggaaucauagcucacuauagccucaaacuucugggcuua

SEQ ID NO: 307898 - RNA, 64 nt, Homo Sapiens
agcauuaccacucaggcauuugacugaagaugcagcucacuacccuauucucucuuuacgcuua

SEQ ID NO: 307899 - RNA, 64 nt, Homo Sapiens
accucugccucccggguucaguggugugaucuuggcucacuacaguugcccaggcugcagugca

SEQ ID NO: 307900 - RNA, 64 nt, Homo Sapiens
auucuauccuuuccaaucggccgggacuggggcagcucacuagguaugcaggcacucaugcuua

SEQ ID NO: 307901 - RNA, 64 nt, Homo Sapiens
uuaacaauaaacaauaaacgcuuuucucaugagagcucacuauugaaggcccuuuuuacauacu

SEQ ID NO: 307902 - RNA, 64 nt, Homo Sapiens
uguggagguccucaggaguguggcuagggauacugcucacuagcuuaaguccagacuuggcaca

SEQ ID NO: 307903 - RNA, 64 nt, Homo Sapiens
cuguaaaaacaaaacaauguuuacugaguuauaagcucacuagguagaauuucuuaaaagggug

SEQ ID NO: 307904 - RNA, 64 nt, Homo Sapiens
ucagucaaagcucugcuuucaauuucucugauuugcucacuaaugccuuguguguguuuuacua

SEQ ID NO: 307905 - RNA, 64 nt, Homo Sapiens
gucauaaucuguguaauacuacaauuuaugggaugcucacuaugcccuguuucucuucuaaaca

SEQ ID NO: 307906 - RNA, 64 nt, Homo Sapiens
gagauggauucucaccugucgcaggggccugcuugcucacuagaguugcccuccccaguggcug

SEQ ID NO: 307907 - RNA, 64 nt, Homo Sapiens
auaucaaguuacacuaagacaaagggaccaagcagcucacuacgaucaauaagaaaaaggaucg

SEQ ID NO: 307908 - RNA, 64 nt, Homo Sapiens
gcgguuugccugugccuggaaugcaaguaccaaagcucacuacuuuguuuuucuuuuaaaguaa

SEQ ID NO: 307909 - RNA, 64 nt, Homo Sapiens
aaucauauauuuuacagauuauuuggcucuuucugcucacuaaaaugccucacuucaagcacua

SEQ ID NO: 307910 - RNA, 64 nt, Homo Sapiens
uagaguccagagggacagucgaggaaauguguuggcucacuacgaaaaacauauccaaaauaau

SEQ ID NO: 307911 - RNA, 64 nt, Homo Sapiens
accuccgccucccagguucaguggcacgaucucggcucacuacagucacccaggcuggagugca

SEQ ID NO: 307912 - RNA, 64 nt, Homo Sapiens
uacucuguuucccaggcuggagugcacaaacauggcucacuacagccucgcucucccgggcucc

SEQ ID NO: 307913 - RNA, 64 nt, Homo Sapiens
ccuagaagacucaccuuggguuuccacagcuauggcucacuaccaggugcuugaugaaucuggc

SEQ ID NO: 307914 - RNA, 64 nt, Homo Sapiens
ucaaauuuggguauagacaauaaagaacugaagugcucacuacucagugauuuggaaauuuuga

SEQ ID NO: 307915 - RNA, 64 nt, Homo Sapiens
guuucaacgucccccgcucagaagcaugaucacagcucacuacagucacccaggcuggagugca

SEQ ID NO: 307916 - RNA, 64 nt, Homo Sapiens
uacuucaggccuucuuggacaaauuucaaguguggcucacuaggcagauauuuaugaaguggug

SEQ ID NO: 307917 - RNA, 64 nt, Homo Sapiens
aaugaagucugcauagugaccucagcauaauaaugcucacuaauccagccaggaccuuacugau

SEQ ID NO: 307918 - RNA, 64 nt, Homo Sapiens
gucaaaaagugauggcuuucguuacaaaagaagagcucacuauguaagguuagaagccugaacc

SEQ ID NO: 307919 - RNA, 64 nt, Homo Sapiens
aucuggcuugagcucccgcuuuccuggucuaccggcucacuaacuugguggcaucaucacgcca

SEQ ID NO: 307920 - RNA, 64 nt, Homo Sapiens
guuauguauaaaagcauaugugcuacucaucuuugcucacuaugcagucuuuuuuaagagagca

SEQ ID NO: 307921 - RNA, 64 nt, Homo Sapiens
uuuugccuagugcuuuuucucuaccugcccuugggcucacuaauaucaccaguauuauuaccaa

SEQ ID NO: 307922 - RNA, 64 nt, Homo Sapiens
guuguuccccugaucucuaaguggauugguugcugcucacuaaagcacaaggcagacuguuuga

SEQ ID NO: 307923 - RNA, 64 nt, Homo Sapiens
cugguagagguagacgggcggugcggcagcaccugcucacuaaccacccccacaggacauggcc

SEQ ID NO: 307924 - RNA, 64 nt, Homo Sapiens
augcuaauuaggcaaagacaugaccaaucagagagcucacuaaacuugcaacuuagcucacacc

SEQ ID NO: 307925 - RNA, 64 nt, Homo Sapiens
gcaagagcugaaaaacuuaccuacuggggacugugcucacuaccugggugacaggaucauacgu

SEQ ID NO: 307926 - RNA, 64 nt, Homo Sapiens
cuuucucagacauuuuguagaauucauuucggcagcucacuaggauuuugcugaacauuaaaaa

SEQ ID NO: 307927 - RNA, 64 nt, Homo Sapiens
gccuugaccucucaggcucaauggugcaaucuuggcucacuauagucucccaggcuggagugca

SEQ ID NO: 307928 - RNA, 64 nt, Homo Sapiens
aaucuauuauacuguauuaaaaaauaauuuuauggcucacuaugauugacauugcuuuacuguc

SEQ ID NO: 307929 - RNA, 64 nt, Homo Sapiens
gagaaggaugcacaaauaagaaacuuuuuucauagcucacuagguuaagauuacuucccuuuga

SEQ ID NO: 307930 - RNA, 64 nt, Homo Sapiens
guagugaaugagugaaggacuguaaucauaauaugcucacuacuugcucuuguuuuuguuuuaa

SEQ ID NO: 307931 - RNA, 64 nt, Homo Sapiens
uuuaacuucauuuuguaucuugcuuaaguagcaggcucacuaaaauuagagaaaguccaauaac

SEQ ID NO: 307932 - RNA, 64 nt, Homo Sapiens
cucagggcuuguguaauauugucaguaguaagaugcucacuaguaagcuuugguauuguacaag

SEQ ID NO: 307933 - RNA, 64 nt, Homo Sapiens
uuauuuccaggaagguguguccagguuucuccgugcucacuaaucagcuguggcugccacccag

SEQ ID NO: 307934 - RNA, 64 nt, Homo Sapiens
accuccaccuccuggguuccguggcaugaucucggcucacuacaauuguucagacuggagugca

SEQ ID NO: 307935 - RNA, 64 nt, Homo Sapiens
guugcucaggcuggagugcaguggcgugaucucagcucacuacagccuccaccucguggguuca

SEQ ID NO: 307936 - RNA, 64 nt, Homo Sapiens
ggacggaccccugguacccagaagaggaguucuugcucacuaacccggauccgccucgugcccc

SEQ ID NO: 307937 - RNA, 64 nt, Homo Sapiens
ugaccuuucacccugccaucccaucccaaccccagcucacuagccuucauauaugccuuauacu

SEQ ID NO: 307938 - RNA, 64 nt, Homo Sapiens
gguagguggacaccacuuucauaagugaacuugagcucacuacucaauugugcagcuuaauaug

SEQ ID NO: 307939 - RNA, 64 nt, Homo Sapiens
aaauguuaauaaagcccgcggcccugggggccgugcucacuaccgggacccgagcccccgcgau

SEQ ID NO: 307940 - RNA, 64 nt, Homo Sapiens
gaacacauguguaugauacuggaggcuuuggguggcucacuacucgacuacugcuccuguggca

SEQ ID NO: 307941 - RNA, 64 nt, Homo Sapiens
ugugaggcagccuguuccacuagaggaaacgagagcucacuauuggcccauaguagaaucugug

SEQ ID NO: 307942 - RNA, 64 nt, Homo Sapiens
caugugcccauuucuaugugugugucuacgugcagcucacuaccaacagccucaugugcacuug

SEQ ID NO: 307943 - RNA, 64 nt, Homo Sapiens
gaauuuaaaggagauaagaggcguaaaguaggaugcucacuacaaccauaggugggguuucagc

SEQ ID NO: 307944 - RNA, 64 nt, Homo Sapiens
gcucugauguauauagcacaucccugggugggaugcucacuacaucugcugccccggagucccc

SEQ ID NO: 307945 - RNA, 64 nt, Homo Sapiens
aacgcugacagaagaguguuuaggcaaccucccagcucacuaugugaagcuaggucuuaaugcg

SEQ ID NO: 307946 - RNA, 64 nt, Homo Sapiens
ucaguauauuuuauucucacuaaagaaagacugagcucacuaguuuccaaagucaagccuauuu

SEQ ID NO: 307947 - RNA, 64 nt, Homo Sapiens
agccagcuaaguucaucuuuaauucuuuuguguagcucacuauuuccuugcaauacuggaacau

SEQ ID NO: 307948 - RNA, 64 nt, Homo Sapiens
acaggaacagcauggaggaaaucucaugagaccggcucacuaucgacgcuuauaaaaccuucag

SEQ ID NO: 307949 - RNA, 64 nt, Homo Sapiens
accuccgccucccagauucaguggcaccaucucggcucacuacaguugcccaggcuugagcgca

SEQ ID NO: 307950 - RNA, 64 nt, Homo Sapiens
gucacccaggcuggagugcaguggugagauuuuggcucacuauaaccucuuccuccaggguuca

SEQ ID NO: 307951 - RNA, 64 nt, Homo Sapiens
uguugccaggcuggagugcaguggcgcgaucucagcucacuacaaccuccgccucccauguuca

SEQ ID NO: 307952 - RNA, 64 nt, Homo Sapiens
uaaaaugggggacuuggaccagguagauugcugagcucacuaccagguucaaaguucaaugaca

SEQ ID NO: 307953 - RNA, 64 nt, Homo Sapiens
augaccucagcacaugacgaaacaaacaaugguagcucacuaaaaauuacuuuucuuguauuua

SEQ ID NO: 307954 - RNA, 64 nt, Homo Sapiens
cugugugcgugcccugguguucagcuuguguucugcucacuaagcagcuaauggaggcuggaau

SEQ ID NO: 307955 - RNA, 64 nt, Homo Sapiens
agggccucuaggcccugggccugccuccccaagggcucacuaagccagaggccaaagugccccc

SEQ ID NO: 307956 - RNA, 64 nt, Homo Sapiens
gucgcccaggcuggagugcaguggcgugaucucggcucacuacaaccucgaccuccuggguuca

SEQ ID NO: 307957 - RNA, 64 nt, Homo Sapiens
augguguuucacaagaaugagccauucagucuuugcucacuauauauuuaauauuuuauuauug

SEQ ID NO: 307958 - RNA, 64 nt, Homo Sapiens
ucacaaggcaggucauuucaucucuugacagggagcucacuacccuacccauugcuugaaaauc

SEQ ID NO: 307959 - RNA, 64 nt, Homo Sapiens
ggaaucccaugaguuuccauggaacaugggaagggcucacuauugcuagaauuggauaugucca

SEQ ID NO: 307960 - RNA, 64 nt, Homo Sapiens
ggugcccaggcuggagugcaguggcgugaucucggcucacuacaaccuccaccucccagccacc

SEQ ID NO: 307961 - RNA, 64 nt, Homo Sapiens
guugcccaggcuggagugcaauggcgcguucucugcucacuacagcacccgcuucccagguuga

SEQ ID NO: 307962 - RNA, 64 nt, Homo Sapiens
ucuucucuuuauuuuagaagaaaguggaugaucagcucacuaccacaucaaaggugccaacucu

SEQ ID NO: 307963 - RNA, 64 nt, Homo Sapiens
ccuggccaaugccuauggguggccccucuggagugcucacuaacaagggugagugcucucgcua

SEQ ID NO: 307964 - RNA, 64 nt, Homo Sapiens
gucgcccaggcugaggugcaguagugcaaucuccgcucacuacaaccuccacucccuggggcuc

SEQ ID NO: 307965 - RNA, 64 nt, Homo Sapiens
gccucgaacuccuggucucaguggugcagucuuggcucacuacagucacccgagcuagagugca

SEQ ID NO: 307966 - RNA, 64 nt, Homo Sapiens
guuuaugucuuauauuaaaucagauguguuaguugcucacuagauguugauauuacaacaggga

SEQ ID NO: 307967 - RNA, 64 nt, Homo Sapiens
gcuuuguaguaaccccugccuugguuaaaaauuggcucacuauucaucaaaucucugucucugc

SEQ ID NO: 307968 - RNA, 64 nt, Homo Sapiens
uucgcccaggcuggagugcauuggcaugaucucagcucacuacaaccucugccuucugguuuca

SEQ ID NO: 307969 - RNA, 64 nt, Homo Sapiens
cccgcccuccucccugugagacacugggccaaaggcucacuaccccugugcguuguccagcaca

SEQ ID NO: 307970 - RNA, 64 nt, Homo Sapiens
cgacaaagcuacuugaaggacacaagagagaaaagcucacuaagaagcuugaaucuacuuuuuu

SEQ ID NO: 307971 - RNA, 64 nt, Homo Sapiens
uaccccagaccaaugccacccuccugggaugggugcucacuaucaucuacaggccuuugauuac

SEQ ID NO: 307972 - RNA, 64 nt, Homo Sapiens
guugcccaggcuggagugcaguggcgugaucuuggcucacuacaaccuccaccuuccaggcuua

SEQ ID NO: 307973 - RNA, 64 nt, Homo Sapiens
cagcgggcagagugggaguuggcucacucagcacgcucacuaacccagcaugccacuuccagca

SEQ ID NO: 307974 - RNA, 64 nt, Homo Sapiens
ucaguccuuccuuagccuggguggucuuggaacagcucacuaagcacagggaaccaugagcuca

SEQ ID NO: 307975 - RNA, 64 nt, Homo Sapiens
accuggaguuugaguugaagugagggaccguugagcucacuaccugcugucauguuuuguggaa

SEQ ID NO: 307976 - RNA, 64 nt, Homo Sapiens
ggccagaacaaaaacacaugccuagugggggaaggcucacuaagagggcaccaaguggggcaaa

SEQ ID NO: 307977 - RNA, 64 nt, Homo Sapiens
cgccccaugggcccucagcgucuccccaugcugggcucacuacaugggccagcccuugcucuac

SEQ ID NO: 307978 - RNA, 64 nt, Homo Sapiens
gacccuccuccagaaggcagccgcugaguucggggcucacuacugacugugcccucaggcuggg

SEQ ID NO: 307979 - RNA, 64 nt, Homo Sapiens
gcggagacacugagccuaccucugacagcgcggggcucacuaguuaccgcccaaccuggauccg

SEQ ID NO: 307980 - RNA, 64 nt, Homo Sapiens
uuagcccccacccacuucccugggcaaaugaauggcucacuauggugccaauggaaccuccuuu

SEQ ID NO: 307981 - RNA, 64 nt, Homo Sapiens
auaugaaaagagacgaaaagcaccaacaaaugaagcucacuaaaugugcugaaaguugaaacca

SEQ ID NO: 307982 - RNA, 64 nt, Homo Sapiens
ugccugggggaggaggggagaaagcaccaugagugcucacuaaaacaacuuuuuccauuuuuaa

SEQ ID NO: 307983 - RNA, 64 nt, Homo Sapiens
gcuccuacccaccgcccuugccgaaccaggagcugcucacuaccuccucagggauggccguugg

SEQ ID NO: 307984 - RNA, 64 nt, Homo Sapiens
auuuuauauauuuguaugauagauggauucaauagcucacuaaaugaagaaauaaagaggcaga

SEQ ID NO: 307985 - RNA, 64 nt, Homo Sapiens
cuucaaguaaaaaguuuuccaaauguacaacugugcucacuaggaguugaagguggauuauagu

SEQ ID NO: 307986 - RNA, 64 nt, Homo Sapiens
cagggggauugacucugcaguuugggagccacaaaaagcguagcggugugauuucuagcucagc

SEQ ID NO: 307987 - RNA, 64 nt, Homo Sapiens
aaacagaacacuuuugaaccaagcacuaccagacaaagcguauugaaaccaaccacaggcaccc

SEQ ID NO: 307988 - RNA, 64 nt, Homo Sapiens
uuugugaaaucuuuuaagagcugugauucuccucaaagcguauuguagauacuaaucaagaaag

SEQ ID NO: 307989 - RNA, 64 nt, Homo Sapiens
cauauauuuaugaaugugcaguguuugauuuuuuaaagcguagaugcacagcaacugccuggau

SEQ ID NO: 307990 - RNA, 64 nt, Homo Sapiens
gugaaaaugaauaagugaaauuaauuucaauuaaaaagcguaaaauguauguuaagugacuaau

SEQ ID NO: 307991 - RNA, 64 nt, Homo Sapiens
uauuagccggcagccuguugcuugacuuggagggaaagcguaugcuuucggggggaaaaagcua

SEQ ID NO: 307992 - RNA, 64 nt, Homo Sapiens
uuauacacugauuuuuguaaaggacaaaguuuuaaaagcguauuuaacuugauguuuucuauca

SEQ ID NO: 307993 - RNA, 64 nt, Homo Sapiens
gagaggguggauuugugcagaaaguguccagggcaaagcguaggaggcagugugauguguucug

SEQ ID NO: 307994 - RNA, 64 nt, Homo Sapiens
augaagagagaggaaaugaacagcaaggcaagcaaaagcguaagcuuacugcaugauaacaaag

SEQ ID NO: 307995 - RNA, 64 nt, Homo Sapiens
uuguuuuugaacgauaauuuagaaguucucauagaaagcguauaacauaggucuucagaaacua

SEQ ID NO: 307996 - RNA, 64 nt, Homo Sapiens
agccacugcgcccagccaacaauccgcucugaggaaagcguaagcaggaagaccucuuaauggc

SEQ ID NO: 307997 - RNA, 64 nt, Homo Sapiens
augaaguuugauaauucacuuuucugucauuguuaaagcguacauacuguaaauuaaagggagg

SEQ ID NO: 307998 - RNA, 64 nt, Homo Sapiens
gacuauuauaggccagcuuuccauuuagucaauaaaagcguacauuuuuaguuacuuaccuuga

SEQ ID NO: 307999 - RNA, 64 nt, Homo Sapiens
guugcagauaaccagagacccaacaaccaaaggcaaagcguaagccuugauuggauuuugguuu

SEQ ID NO: 308000 - RNA, 64 nt, Homo Sapiens
gaggauguguggcauuuucaacuuaguguacaugaaagcguaaagguaucaaccaaauggagug

SEQ ID NO: 308001 - RNA, 64 nt, Homo Sapiens
uacuguuuuuuguuauucuaagucaguguuuuucaaagcguagugguccccauauuagcugcau

SEQ ID NO: 308002 - RNA, 64 nt, Homo Sapiens
uaaaugauaaaggaauuauuguaugaaauauuacaaagcguagacuaugcauuguuauucauua

SEQ ID NO: 308003 - RNA, 64 nt, Homo Sapiens
gaaaaaaaacauagagaucacaccgcaaagaagcaaagcguaauaauuacuauaguaggauaag

SEQ ID NO: 308004 - RNA, 64 nt, Homo Sapiens
uucacuuuccauguuaacauguagccuauucuucaaagcguaucuguguaauguauucucucuu

SEQ ID NO: 308005 - RNA, 64 nt, Homo Sapiens
ggcagaauuagaggccucucccucagacccagcaaaagcguagaauggcuccucccucccaugu

SEQ ID NO: 308006 - RNA, 64 nt, Homo Sapiens
uucugauuuauguuauagaauuccuuaaaagcaaaaagcguaguguugcaauuauguuucuuau

SEQ ID NO: 308007 - RNA, 64 nt, Homo Sapiens
gcaggcuuuucugaauaccaaaucugcuuuuuguaaagcguaaaaacaucacaaaguaggucau

SEQ ID NO: 308008 - RNA, 64 nt, Homo Sapiens
cuauuuuuuugcacaagguguaaaccaaccaguaaaagcguauccaaaagugguucucucucau

SEQ ID NO: 308009 - RNA, 64 nt, Homo Sapiens
auuuucuugggaaaacauacucacaucuggaaauaaagcguauuauaaguucuggucuuuccag

SEQ ID NO: 308010 - RNA, 64 nt, Homo Sapiens
cccggggcccagggucugccaguguggcgaccagaaagcguagagguguugccgugcuucagga

SEQ ID NO: 308011 - RNA, 64 nt, Homo Sapiens
cagcaauacuuguaugcauguucauugcaacuuaaaagcguaaaaaccccaaauguccauccac

SEQ ID NO: 308012 - RNA, 64 nt, Homo Sapiens
aacuuuuuaugaaucuucgaguugacaguuccuaaaagcguaacucagauauuaaugggcugug

SEQ ID NO: 308013 - RNA, 64 nt, Homo Sapiens
ucacacauucgcaaugcaucaaugcaucugcuagaaagcguacaguugcgaagaccuaaccuca

SEQ ID NO: 308014 - RNA, 64 nt, Homo Sapiens
agcccagagccauguggauuugacuuacgggaguaaagcguaacuuuuuacugcaucuaaugag

SEQ ID NO: 308015 - RNA, 64 nt, Homo Sapiens
guaccaacgaucugugaaaaccaacguuuuaaccaaagcguaucgaagacauuaugagcugugu

SEQ ID NO: 308016 - RNA, 64 nt, Homo Sapiens
ccaggccucaucucccaaauaauacugucggaaaaaagcguacccagguggcagaaauuuuaaa

SEQ ID NO: 308017 - RNA, 64 nt, Homo Sapiens
ugugaaagguaggaaacuuagagccauauguaugaaagcguauccgaagaguuagucaccaaga

SEQ ID NO: 308018 - RNA, 64 nt, Homo Sapiens
uuuucuccaguucuguuacccaauuuagauuaguaaagcguacacaacuggaaagacugcugua

SEQ ID NO: 308019 - RNA, 64 nt, Homo Sapiens
cugaaaaaaugccaagacaugauuauuuuuuuaaaaagcguacuuuaaauguuuguguuaauaa

SEQ ID NO: 308020 - RNA, 64 nt, Homo Sapiens
ccugcauuucucccaggacuuggggguggggugaaaagcguacaaaagauacuuaaaagggcuc

SEQ ID NO: 308021 - RNA, 64 nt, Homo Sapiens
aggagaccuacaucaggccucucacaaauaaauuaaagcguaaaagauaauacaagagcguccc

SEQ ID NO: 308022 - RNA, 64 nt, Homo Sapiens
ucgcaaagccuuccagaaguuuucugugcuuaugaaagcguauguguggccuuucucuucccuu

SEQ ID NO: 308023 - RNA, 64 nt, Homo Sapiens
uccagauuuuauauuccuaaucccaguaaggaagaaagcguagugugggagaggagagagcuga

SEQ ID NO: 308024 - RNA, 64 nt, Homo Sapiens
agcaagaauaguugcaagaaguaaauucuggcacaaagcguaaaaauauaacagaagaaauaau

SEQ ID NO: 308025 - RNA, 64 nt, Homo Sapiens
acaagaugaagagcaggcgcuugaacuugcucggaaagcguaagccucaccuuuucuuucuggu

SEQ ID NO: 308026 - RNA, 64 nt, Homo Sapiens
cuuuggcugggcaugguggcaaauaauuucuuuaaaagcguaagauuuuuuucuguguagauuu

SEQ ID NO: 308027 - RNA, 64 nt, Homo Sapiens
cauccggaggcuuuggagggccucuaugucuggaaaagcguagguuuucucgaagacaaacuuu

SEQ ID NO: 308028 - RNA, 64 nt, Homo Sapiens
ccucugcaauuuuaacuucuauuugaaauaaaagaaagcguaagccugguuaaucacuaugcau

SEQ ID NO: 308029 - RNA, 64 nt, Homo Sapiens
ugaaaaugguccaggacaggccuaugggagaggaaaagcguaucgugagcacuguuagcagaug

SEQ ID NO: 308030 - RNA, 64 nt, Homo Sapiens
cgaauuauuuuuuuaaagugauuugccauuuuugaaagcguauuuaaugauagaauacuaucga

SEQ ID NO: 308031 - RNA, 64 nt, Homo Sapiens; identical to SEQ ID NO: 174977

SEQ ID NO: 308032 - RNA, 64 nt, Homo Sapiens; identical to SEQ ID NO: 174978

SEQ ID NO: 308033 - RNA, 64 nt, Homo Sapiens; identical to SEQ ID NO: 174979

SEQ ID NO: 308034 - RNA, 64 nt, Homo Sapiens; identical to SEQ ID NO: 174980

SEQ ID NO: 308035 - RNA, 64 nt, Homo Sapiens; identical to SEQ ID NO: 174981

SEQ ID NO: 308036 - RNA, 64 nt, Homo Sapiens; identical to SEQ ID NO: 174982

SEQ ID NO: 308037 - RNA, 64 nt, Homo Sapiens; identical to SEQ ID NO: 174983

SEQ ID NO: 308038 - RNA, 64 nt, Homo Sapiens; identical to SEQ ID NO: 174984

SEQ ID NO: 308039 - RNA, 64 nt, Homo Sapiens; identical to SEQ ID NO: 174985

SEQ ID NO: 308040 - RNA, 55 nt, Homo Sapiens; identical to SEQ ID NO: 174986

SEQ ID NO: 308041 - RNA, 64 nt, Homo Sapiens; identical to SEQ ID NO: 174987

SEQ ID NO: 308042 - RNA, 64 nt, Homo Sapiens; identical to SEQ ID NO: 174988

SEQ ID NO: 308043 - RNA, 64 nt, Homo Sapiens
agcaagauaagcagggccagucucagggcccggagacgaacacggggacaauugucaaaggagc

SEQ ID NO: 308044 - RNA, 64 nt, Homo Sapiens
cauuaggucaccuuuuguguuagacuucaaaagggacgaacaaacaugcuuccuuuucaaagaa

SEQ ID NO: 308045 - RNA, 64 nt, Homo Sapiens
uuuuacaacgugacaggaagaggagggagagggugacgaacaccaggcauuuccaggggcuaua

SEQ ID NO: 308046 - RNA, 64 nt, Homo Sapiens
auuuccugacacugagaaugaagaguaucacagugacgaacaaaaugauacucagaagcaauuu

SEQ ID NO: 308047 - RNA, 64 nt, Homo Sapiens
aagagauccuuaaauuaugauugauaaccuuugugacgaacauaugcagaugcucuuaaaagca

SEQ ID NO: 308048 - RNA, 64 nt, Homo Sapiens
uccagguguggccucuggaaccugacuccguuaggacgaacaucugccccuucagggaggguga

SEQ ID NO: 308049 - RNA, 64 nt, Homo Sapiens
gagugguggcagcucaaaaugauauguuugaguagacgaacagcugacauggaguucccgugca

SEQ ID NO: 308050 - RNA, 64 nt, Homo Sapiens
gcaccucacgcacagcucucagaagcugcaggcggacgaacaucugaccaaagagguguggucg

SEQ ID NO: 308051 - RNA, 64 nt, Homo Sapiens
uaggggaaaguuucaugaugguaucuauagucaagacgaacauguagcauggugccuauguaga

SEQ ID NO: 308052 - RNA, 64 nt, Homo Sapiens
cccccucccugguggucuuaggucuauaaucagugacgaacagagggugcccuuggccaaugua

SEQ ID NO: 308053 - RNA, 64 nt, Homo Sapiens
uuugcaggaagguaacuguuuuucaagaaauaaagacgaacacacuucuaaaaucuaaaaucca

SEQ ID NO: 308054 - RNA, 64 nt, Homo Sapiens
cucuucugccugauagagggaagaggaagaggaggacgaacagagauccugaaauucugacuug

SEQ ID NO: 308055 - RNA, 54 nt, Homo Sapiens
uugggaucauugcccugugaggaggacgaacauccaaccuucccaaacgccucc

SEQ ID NO: 308056 - RNA, 64 nt, Homo Sapiens
gcgugggcaaagcugaaggugaugaggaagaagagacgaacauuaaagaugucuauuuacuaug

SEQ ID NO: 308057 - RNA, 64 nt, Homo Sapiens
ugggacuuugcgagcucuguggcagggaucagaggacgaacagggggacuccugagaugggaga

SEQ ID NO: 308058 - RNA, 64 nt, Homo Sapiens
gaggaaauucggagcuauacuuguuuuugcaccagacgaacaguuaaucagacaagcuugaaua

SEQ ID NO: 308059 - RNA, 64 nt, Homo Sapiens
uucucacagacccuucagcaauggcuacuagaaggacgaacaauugcccuccuuuggaaguacg

SEQ ID NO: 308060 - RNA, 64 nt, Homo Sapiens
uuuauugguacugaaaagagacagaaauacagcagacgaacauauuacaaacucagaaauacga

SEQ ID NO: 308061 - RNA, 57 nt, Homo Sapiens
aucuuuacagauucauuuaagccaucagacgaacacaagagaggcucaaacaagaaa

SEQ ID NO: 308062 - RNA, 64 nt, Homo Sapiens
aaauuacgaaagaaaagaaaucucuaugcaaaaugacgaacaugguccuguggacuccucuggc

SEQ ID NO: 308063 - RNA, 64 nt, Homo Sapiens
agggaaaggaaaaaaugggguggaugagcggugagacgaacaaagugccucucuggccgcccac

SEQ ID NO: 308064 - RNA, 64 nt, Homo Sapiens
gagcuggccaucccaaauucaaucaguccauagagacgaacagaaugagaccuuccggcccaag

SEQ ID NO: 308065 - RNA, 64 nt, Homo Sapiens
acuuucuugaucuuauuuccaaauaaaugcuaaagacgaacacccaaacaguuuuuccaauuau

SEQ ID NO: 308066 - RNA, 64 nt, Homo Sapiens
caagccuccucaccccuagucuucaucuccuguggacgaacaucugggguggaaguuuuguagc

SEQ ID NO: 308067 - RNA, 64 nt, Homo Sapiens
uucuuuaaaaagaaagaggguugaaaauccucuggacgaacagaagucacuuuggcuguucagu

SEQ ID NO: 308068 - RNA, 64 nt, Homo Sapiens
cugccuaacuaucaaaggauuaacgccagaccgagacgaacacucuccguaaacagcccagcug

SEQ ID NO: 308069 - RNA, 64 nt, Homo Sapiens
gucacgcuggcgcugaauacuuuuuguauaaaccgacgaacagcugaugaccgcaugaaugcuc

SEQ ID NO: 308070 - RNA, 64 nt, Homo Sapiens
uguuugcugcccagccauaacccacucagugacagacgaacacagcuaaggccucgcugccagc

SEQ ID NO: 308071 - RNA, 64 nt, Homo Sapiens
uuugucacacaggauggcaugugauccucaagacgacgaacaaugaacuaaagccaaaugcagc

SEQ ID NO: 308072 - RNA, 64 nt, Homo Sapiens
agugugcucccaccucagggccuucagagcuagggacgaacagcugauuccgaccagggcaccc

SEQ ID NO: 308073 - RNA, 64 nt, Homo Sapiens
cuuucauuucuggauauauuuucaaagcuuacuagacgaacaauggacaucagaucacucugua

SEQ ID NO: 308074 - RNA, 64 nt, Homo Sapiens
aaggccacguaugugccuugaauguagccaaaaugacgaacaacacccagaaaucugugauuua

SEQ ID NO: 308075 - RNA, 64 nt, Homo Sapiens
aggcacugagagcuggagaguuggugauaagcgagacgaacacauuuccugcccucauacacac

SEQ ID NO: 308076 - RNA, 64 nt, Homo Sapiens
ggccaaacuggugggaggcaaggaaaggaggauggacgaacaggggccccugaccucaagauca

SEQ ID NO: 308077 - RNA, 64 nt, Homo Sapiens
gcacugccguggcagacagcuggacuugagcagagggaacgaccugacuuacuugcacugugau

SEQ ID NO: 308078 - RNA, 64 nt, Homo Sapiens
cuuuucaggauuugagacuguucucaaagggauugggaacgaaggccccaucucgggcagaccc

SEQ ID NO: 308079 - RNA, 64 nt, Homo Sapiens
uucagcagcagcauggaggagggugcugaaccucgggaacgagcuauccuagcuucugaaucca

SEQ ID NO: 308080 - RNA, 64 nt, Homo Sapiens
uucuuuucuuucuucaugauuuugcugaccacaggggaacgaugcuuccacugggcugacagac

SEQ ID NO: 308081 - RNA, 64 nt, Homo Sapiens
cugacgucuaccucauggggucccacacguagaagggaacgaaaccgugccacauuccuccagu

SEQ ID NO: 308082 - RNA, 64 nt, Homo Sapiens
cuagcuuuuuccuggaaagcccgcuagaagguuugggaacgaggggaaaguucucagaacuguu

SEQ ID NO: 308083 - RNA, 64 nt, Homo Sapiens
ugcauaucugauguucagguagaccugggcgccugggaacgaggccaucagcugccaugcacau

SEQ ID NO: 308084 - RNA, 64 nt, Homo Sapiens
gcaugcaggcugcugggcaccacccccucauccagggaacgagugugucucaaggggcauuugu

SEQ ID NO: 308085 - RNA, 64 nt, Homo Sapiens
guaaaccguggcugucuccuucaggcucugccaugggaacgagugggggaggaggaccugugug

SEQ ID NO: 308086 - RNA, 64 nt, Homo Sapiens
ccagaacagaaggaggguggaggaagugaucagagggaacgagcuguagguuugcagaaaugug

SEQ ID NO: 308087 - RNA, 64 nt, Homo Sapiens
gccucccaauagauaggaaaggcagcuggcgccagggaacgaugucucuaacauaauaaugagu

SEQ ID NO: 308088 - RNA, 64 nt, Homo Sapiens
uaaaauaugauagagaacuauuugagaugggggugggaacgaauuuacgucuguagucaucuua

SEQ ID NO: 308089 - RNA, 64 nt, Homo Sapiens
ggacugucacgggguucccucugccccuggaccugggaacgacuaccucaccaaggaucggacu

SEQ ID NO: 308090 - RNA, 64 nt, Homo Sapiens
uaaaaguuaaggggcaagcagcauugcauucugggggaacgauccuggccacagccgccaaaca

SEQ ID NO: 308091 - RNA, 64 nt, Homo Sapiens
uucucagcugggcucugaccuggggucuggggcagggaacgaacaugguggcuuugggcugaga

SEQ ID NO: 308092 - RNA, 64 nt, Homo Sapiens
guaauuugaagaaugcuugaacaaagcucagcuggggaacgagauguccccaacccccucagca

SEQ ID NO: 308093 - RNA, 64 nt, Homo Sapiens
gggcgccgggccacucggggaaggggcgagaggagggaacgagcggccagacaaagacucggca

SEQ ID NO: 308094 - RNA, 64 nt, Homo Sapiens
guuuggugcaucuugaccugggaagacgccucaugggaacgaacuuggacagguguuggguuga

SEQ ID NO: 308095 - RNA, 64 nt, Homo Sapiens
agaggaaaagaaugaauggauucuaggaauguuagggaacgauuuacuuuacccgauggcugua

SEQ ID NO: 308096 - RNA, 64 nt, Homo Sapiens
gcgcggggcgcggacuccgggcacggcuucccaggggaacgaggagaucuguguuuacuuaaga

SEQ ID NO: 308097 - RNA, 64 nt, Homo Sapiens
caggaggccgugggugccauucgggggaaagugggggaacgacacacacuucaccugcaagggc

SEQ ID NO: 308098 - RNA, 64 nt, Homo Sapiens
ucguggcuucggagagcagaggggucaggcccaggggaacgagcuggccuugccaacccucugc

SEQ ID NO: 308099 - RNA, 64 nt, Homo Sapiens
cauaacucaauggccuaaaacuggccugacuugggggaacgaugugucuguauuucauguggcu

SEQ ID NO: 308100 - RNA, 64 nt, Homo Sapiens
gcuucugccuaguaccuaucacacucccuccgcugggaacgaugcucuaguggcagagcagcuc

SEQ ID NO: 308101 - RNA, 64 nt, Homo Sapiens
uagauuaagcccuauaaugcuauuuauauuccaggggaacgaaaaucugaauuuguuuuaugau

SEQ ID NO: 308102 - RNA, 64 nt, Homo Sapiens
caagaaaaugugcagccuuuugggcaaagccccugggaacgaggccuauccacuauggacuaug

SEQ ID NO: 308103 - RNA, 64 nt, Homo Sapiens
caucuccaucuugaaggaacucaaagacucaagugggaacgacugggcacugccaccaccagaa

SEQ ID NO: 308104 - RNA, 64 nt, Homo Sapiens
ggggaagaguguacuggggguguaacguugcugugggaacgagagaaacuuauuuuuuucugau

SEQ ID NO: 308105 - RNA, 64 nt, Homo Sapiens
uaagaguacagcuaagugcggggguggcgguggagggaacgaaaauugaaccugucugccugug

SEQ ID NO: 308106 - RNA, 64 nt, Homo Sapiens
gcagcugcccaggacccauggcugacccaggggugggaacgauggggugccugagucaggcgga

SEQ ID NO: 308107 - RNA, 64 nt, Homo Sapiens
ugcaugugagggauggcacagggaaggagggguggggaacgacacuggagccaagagaagcccu

SEQ ID NO: 308108 - RNA, 64 nt, Homo Sapiens
gcaacagggaguaaggacucauucgaaaacuuuggggaacgaaucuuguuugaacuuuuuaaaa

SEQ ID NO: 308109 - RNA, 64 nt, Homo Sapiens
acuucagguaccagcuuaaagagcacuagggauggggaacgaaugccaaaucagacuccaccua

SEQ ID NO: 308110 - RNA, 64 nt, Homo Sapiens
uuguuuucuaguguggucuguagcccaauaacuggggaacgaguuacagacaaacaucaccgua

SEQ ID NO: 308111 - RNA, 64 nt, Homo Sapiens
cuuccaauggacaccagaacgucaaugcggguuggggaacgaaagggauuuuugcauuggcaaa

SEQ ID NO: 308112 - RNA, 61 nt, Homo Sapiens
cuaucuccagugucagcuaauggaacaucaggggaacgaugacuccuggauucuccuuccu

SEQ ID NO: 308113 - RNA, 64 nt, Homo Sapiens
acgugaguuagagggagaagauggagggaaucuagggaacgaggcagccuauuggagaugcgga

SEQ ID NO: 308114 - RNA, 64 nt, Homo Sapiens
guuugcauucacggcaguaguuagcccagguguggggaacgagagugcacugcaugauagcguu

SEQ ID NO: 308115 - RNA, 64 nt, Homo Sapiens
cugguggagcagaacacacugaugguggaagagcgggaacgagagauucgccagauuguacagu

SEQ ID NO: 308116 - RNA, 64 nt, Homo Sapiens
acuuguccaugugccaagagacauguggagggaggggaacgagagggagcuucugaagagcuga

SEQ ID NO: 308117 - RNA, 64 nt, Homo Sapiens
cccaccaccaggaggaaugcucagacgcucggccgggaacgaaucugggcccuuaguggauguu

SEQ ID NO: 308118 - RNA, 64 nt, Homo Sapiens
cugccacgccacugugucaugaaggaaagugaaagggaacgaggaaguaggaaugcccacgcuc

SEQ ID NO: 308119 - RNA, 64 nt, Homo Sapiens; identical to SEQ ID NO: 157920

SEQ ID NO: 308120 - RNA, 64 nt, Homo Sapiens; identical to SEQ ID NO: 157921

SEQ ID NO: 308121 - RNA, 64 nt, Homo Sapiens; identical to SEQ ID NO: 157922

SEQ ID NO: 308122 - RNA, 64 nt, Homo Sapiens; identical to SEQ ID NO: 157923

SEQ ID NO: 308123 - RNA, 64 nt, Homo Sapiens; identical to SEQ ID NO: 157924

SEQ ID NO: 308124 - RNA, 64 nt, Homo Sapiens; identical to SEQ ID NO: 157925

SEQ ID NO: 308125 - RNA, 64 nt, Homo Sapiens; identical to SEQ ID NO: 157926

SEQ ID NO: 308126 - RNA, 64 nt, Homo Sapiens; identical to SEQ ID NO: 157927

SEQ ID NO: 308127 - RNA, 64 nt, Homo Sapiens; identical to SEQ ID NO: 157928

SEQ ID NO: 308128 - RNA, 64 nt, Homo Sapiens; identical to SEQ ID NO: 157929

SEQ ID NO: 308129 - RNA, 64 nt, Homo Sapiens; identical to SEQ ID NO: 157930

SEQ ID NO: 308130 - RNA, 64 nt, Homo Sapiens; identical to SEQ ID NO: 157931

SEQ ID NO: 308131 - RNA, 64 nt, Homo Sapiens; identical to SEQ ID NO: 157932

SEQ ID NO: 308132 - RNA, 64 nt, Homo Sapiens; identical to SEQ ID NO: 157933

SEQ ID NO: 308133 - RNA, 64 nt, Homo Sapiens; identical to SEQ ID NO: 157934

SEQ ID NO: 308134 - RNA, 64 nt, Homo Sapiens; identical to SEQ ID NO: 157935

SEQ ID NO: 308135 - RNA, 64 nt, Homo Sapiens; identical to SEQ ID NO: 157936

SEQ ID NO: 308136 - RNA, 64 nt, Homo Sapiens; identical to SEQ ID NO: 157937

SEQ ID NO: 308137 - RNA, 64 nt, Homo Sapiens; identical to SEQ ID NO: 157938

SEQ ID NO: 308138 - RNA, 64 nt, Homo Sapiens; identical to SEQ ID NO: 157939

SEQ ID NO: 308139 - RNA, 64 nt, Homo Sapiens; identical to SEQ ID NO: 157940

SEQ ID NO: 308140 - RNA, 64 nt, Homo Sapiens; identical to SEQ ID NO: 157941

SEQ ID NO: 308141 - RNA, 64 nt, Homo Sapiens; identical to SEQ ID NO: 157942

SEQ ID NO: 308142 - RNA, 64 nt, Homo Sapiens; identical to SEQ ID NO: 157943

SEQ ID NO: 308143 - RNA, 64 nt, Homo Sapiens; identical to SEQ ID NO: 157944

SEQ ID NO: 308144 - RNA, 64 nt, Homo Sapiens; identical to SEQ ID NO: 157945

SEQ ID NO: 308145 - RNA, 64 nt, Homo Sapiens; identical to SEQ ID NO: 157946

SEQ ID NO: 308146 - RNA, 64 nt, Homo Sapiens; identical to SEQ ID NO: 157947

SEQ ID NO: 308147 - RNA, 64 nt, Homo Sapiens; identical to SEQ ID NO: 157948

SEQ ID NO: 308148 - RNA, 64 nt, Homo Sapiens; identical to SEQ ID NO: 157949

SEQ ID NO: 308149 - RNA, 62 nt, Homo Sapiens; identical to SEQ ID NO: 115690

SEQ ID NO: 308150 - RNA, 64 nt, Homo Sapiens; identical to SEQ ID NO: 157951

SEQ ID NO: 308151 - RNA, 64 nt, Homo Sapiens; identical to SEQ ID NO: 157952

SEQ ID NO: 308152 - RNA, 64 nt, Homo Sapiens; identical to SEQ ID NO: 157953

SEQ ID NO: 308153 - RNA, 64 nt, Homo Sapiens; identical to SEQ ID NO: 157954

SEQ ID NO: 308154 - RNA, 64 nt, Homo Sapiens; identical to SEQ ID NO: 157955

SEQ ID NO: 308155 - RNA, 64 nt, Homo Sapiens; identical to SEQ ID NO: 157956

SEQ ID NO: 308156 - RNA, 64 nt, Homo Sapiens; identical to SEQ ID NO: 157955

SEQ ID NO: 308157 - RNA, 64 nt, Homo Sapiens; identical to SEQ ID NO: 157958

SEQ ID NO: 308158 - RNA, 64 nt, Homo Sapiens; identical to SEQ ID NO: 157959

SEQ ID NO: 308159 - RNA, 64 nt, Homo Sapiens; identical to SEQ ID NO: 157960

SEQ ID NO: 308160 - RNA, 64 nt, Homo Sapiens; identical to SEQ ID NO: 157961

SEQ ID NO: 308161 - RNA, 64 nt, Homo Sapiens; identical to SEQ ID NO: 157962

SEQ ID NO: 308162 - RNA, 64 nt, Homo Sapiens; identical to SEQ ID NO: 157963

SEQ ID NO: 308163 - RNA, 64 nt, Homo Sapiens; identical to SEQ ID NO: 157964

SEQ ID NO: 308164 - RNA, 64 nt, Homo Sapiens; identical to SEQ ID NO: 157965

SEQ ID NO: 308165 - RNA, 64 nt, Homo Sapiens; identical to SEQ ID NO: 157966

SEQ ID NO: 308166 - RNA, 64 nt, Homo Sapiens; identical to SEQ ID NO: 157967

SEQ ID NO: 308167 - RNA, 64 nt, Homo Sapiens; identical to SEQ ID NO: 157968

SEQ ID NO: 308168 - RNA, 64 nt, Homo Sapiens; identical to SEQ ID NO: 157969

SEQ ID NO: 308169 - RNA, 64 nt, Homo Sapiens; identical to SEQ ID NO: 157970

SEQ ID NO: 308170 - RNA, 64 nt, Homo Sapiens; identical to SEQ ID NO: 157971

SEQ ID NO: 308171 - RNA, 64 nt, Homo Sapiens; identical to SEQ ID NO: 157972

SEQ ID NO: 308172 - RNA, 64 nt, Homo Sapiens; identical to SEQ ID NO: 157973

SEQ ID NO: 308173 - RNA, 64 nt, Homo Sapiens
auuuuuacugagauuuggcgagaccgaauggaagcguccgcacaguaacugcagcugcuaggcc

SEQ ID NO: 308174 - RNA, 64 nt, Homo Sapiens
ccuucucgguccccgagggcccuggcccccgcugcguccgcaucacucugcaucagcacugccg

SEQ ID NO: 308175 - RNA, 64 nt, Homo Sapiens
cggccgcucuccgccccccggccgugaguauuugcguccgcacguccgggguucggaucgcucc

SEQ ID NO: 308176 - RNA, 64 nt, Homo Sapiens
ggguguugccucuuugugugaaagucuguuuccccguccgcaguugagagguggaugaaacacc

SEQ ID NO: 308177 - RNA, 64 nt, Homo Sapiens
gccaggcucagccccugcccccacccagcaguaccguccgcaccguuugugguguaggcaccac

SEQ ID NO: 308178 - RNA, 64 nt, Homo Sapiens
ggcgcuucuguccagcugcaugccaugcuucgcccguccgcaugaggcagaggugccgagugac

SEQ ID NO: 308179 - RNA, 64 nt, Homo Sapiens
gcauacccagcucggaccucucccgcagugucugcguccgcacaccgcgggacaccuguuuccu

SEQ ID NO: 308180 - RNA, 64 nt, Homo Sapiens
ugccguguucugccagcaccuggccaugcagaggcguccgcaggguuccucgacugagggccgg

SEQ ID NO: 308181 - RNA, 64 nt, Homo Sapiens
gugaugguggccgacugcagcucaaugccagcaccguccgcacgggcuguucaagauccagaac

SEQ ID NO: 308182 - RNA, 64 nt, Homo Sapiens
cuucuggaagugagccuuuguggcugggaggucgcguccgcacaaggcuccauaggagggcugg

SEQ ID NO: 308183 - RNA, 64 nt, Homo Sapiens
uccugucggggugacgggcccauggggcggagcucguccgcauggugcugaauggcugaggacc

SEQ ID NO: 308184 - RNA, 64 nt, Homo Sapiens
ggggacagcuggccaccgugucccaggaccguaccguccgcaucugggaccuggccacccugca

SEQ ID NO: 308185 - RNA, 64 nt, Homo Sapiens
agaccugcaagcucccugagcggugggcgggccucguccgcaggucucaucccacacucuugag

SEQ ID NO: 308186 - RNA, 51 nt, Homo Sapiens
gggagggggagugggacugagcguccgcagaggugaccgaaaagccguaug

SEQ ID NO: 308187 - RNA, 64 nt, Homo Sapiens
uuucuaucuccagcaucccccugcugccuucuuccguccgcagugcgccuucuagugcuccauc

SEQ ID NO: 308188 - RNA, 64 nt, Homo Sapiens
uucccagccuggauggagcuccagggcuggggaacguccgcaagucaaugcucagagaugcccg

SEQ ID NO: 308189 - RNA, 64 nt, Homo Sapiens
ugcuggagaccaacaagccguaccuggugaacugcguccgcaucccugcccuccaggugggccu

SEQ ID NO: 308190 - RNA, 64 nt, Homo Sapiens
gccaaacuggagaaccccaccccaaggcaugccacguccgcagccccggccuggcugcggugcu

SEQ ID NO: 308191 - RNA, 64 nt, Homo Sapiens
guacgucuucaugggagucauuucuccuuccacucguccgcacggugucuuuguaauggccaaa

SEQ ID NO: 308192 - RNA, 64 nt, Homo Sapiens
guauccccagcccuuggcaacacuggagugcacacgccgccacgguugcccagaaaaagugccc

SEQ ID NO: 308193 - RNA, 64 nt, Homo Sapiens
aggaaggugcagcuuuuccauaucagcucaaccacgccgccaguccauucuuaaggaacugccg

SEQ ID NO: 308194 - RNA, 64 nt, Homo Sapiens
aaggcauugccaagccccccgagugaggacgcaccgccgccaccagcccgcaacucuccagccg

SEQ ID NO: 308195 - RNA, 64 nt, Homo Sapiens
cagcccaggcagcaccagcgcggccacgugcacgcgccgccacuacgagagguacggcggggcg

SEQ ID NO: 308196 - RNA, 64 nt, Homo Sapiens
cucagccugccgagugccugcgauuacaggcgcgcgccgccacaccugacugguuuucguauuu

SEQ ID NO: 308197 - RNA, 54 nt, Homo Sapiens; identical to SEQ ID NO: 214225

SEQ ID NO: 308198 - RNA, 64 nt, Homo Sapiens
acugcccaggccuuuguuaggaaaacccaugggccgccgccacacucagugccauggggaagcg

SEQ ID NO: 308199 - RNA, 59 nt, Homo Sapiens; identical to SEQ ID NO: 214227

SEQ ID NO: 308200 - RNA, 64 nt, Homo Sapiens
ccugguccucucgcaggaaugcugcugcugccuccgccgccacugcugcugccaccucuuauau

SEQ ID NO: 308201 - RNA, 64 nt, Homo Sapiens
gugccccccgucccuccaccaacguuccuucccccgccgccacuggcaggcucaccugggacuc

SEQ ID NO: 308202 - RNA, 64 nt, Homo Sapiens
cugaccucacacccucuggggcagccgacgacgccgccgccagcgcgcgacgccggccccgguc

SEQ ID NO: 308203 - RNA, 64 nt, Homo Sapiens
cacuccggagcuguccgcuuggccgugccgccgccgccgccaggcccgcgggcgggggcugcag

SEQ ID NO: 308204 - RNA, 64 nt, Homo Sapiens
ggcuucauucgagagcugcugccaaaacgccuggcgccgccaccgucgggggcuggcuucgagg

SEQ ID NO: 308205 - RNA, 64 nt, Homo Sapiens
cgcugccccggguggugagcgggcaggaaccuggcgccgccaccgagacugagccuccugcaga

SEQ ID NO: 308206 - RNA, 59 nt, Homo Sapiens; identical to SEQ ID NO: 214234

SEQ ID NO: 308207 - RNA, 64 nt, Homo Sapiens
cucagccucccaaguagcugugacuaaaggugcacgccgccaugcccagcuaauuuuuuguauu

SEQ ID NO: 308208 - RNA, 64 nt, Homo Sapiens
gugcuggacgugucccggagacccaccgggagggcgccgccaugccuuguacccccaccgugca

SEQ ID NO: 308209 - RNA, 64 nt, Homo Sapiens
cuaacaugagcacaggugcuuagcaguaguggggcgccgccaaugcauuaaucccaggaaccac

SEQ ID NO: 308210 - RNA, 64 nt, Homo Sapiens
gccuugguuacucagagcacagccucugucaccccgccgccacuagcccagugacagaaagaac

SEQ ID NO: 308211 - RNA, 64 nt, Homo Sapiens
cuguuuucuggaaaggcugcgaguucuggagaggcgccgccaucgcaggaguagggaggaaaag

SEQ ID NO: 308212 - RNA, 64 nt, Homo Sapiens
cccagcucauuuuuguauuaguauacaggcacaucgccgccacacucagccugcugaguagcug

SEQ ID NO: 308213 - RNA, 64 nt, Homo Sapiens
agggaacucuccccauuggcaaaccggacccggccgccgccaggacuguguuuccaaagguucc

SEQ ID NO: 308214 - RNA, 64 nt, Homo Sapiens
acccuuguauuuuaucacguccuuugagggaucccgccgccaccgaccccgugccucucguggu

SEQ ID NO: 308215 - RNA, 64 nt, Homo Sapiens
ugcaagugcuggagucuccugaggacacgcgcgucgccgccaccgcgggugugggaaagcgcgg

SEQ ID NO: 308216 - RNA, 64 nt, Homo Sapiens
gcaggcucaggcggccccacucacccacagcauccgccgccaccccuucgggugugagcgcuca

SEQ ID NO: 308217 - RNA, 64 nt, Homo Sapiens
ggagugcccuguauggaaguucuccagugcagcccgccgccacuuuuuuacaaaggggaauggu

SEQ ID NO: 308218 - RNA, 64 nt, Homo Sapiens
ggccgcuccagaagggugcccagucaggccgcaccgccgccagccuccuccggcccuggaggga

SEQ ID NO: 308219 - RNA, 64 nt, Homo Sapiens
cgaggcugaggacuccgaucuagcgacccgccgccgccgccaaggcuuucacugcggucccgcu

SEQ ID NO: 308220 - RNA, 64 nt, Homo Sapiens
gagccgcggguugacgacgguguccucgcagugucgccgccaccccagcguaguccaagucaga

SEQ ID NO: 308221 - RNA, 64 nt, Homo Sapiens
cccaagagaaagacugaaggcccgccgccgccgccgccgccaugcccacacccggugcccacau

SEQ ID NO: 308222 - RNA, 64 nt, Homo Sapiens
gcccgcagacacccuggcauggcccuucccgcaccgccgccagccuggcccaguccugggccuc

SEQ ID NO: 308223 - RNA, 64 nt, Homo Sapiens
gauaggguuuuuggagggcuccccacagacucagcgccgccagaugguggugcugggggaggca

SEQ ID NO: 308224 - RNA, 64 nt, Homo Sapiens
ugaaguauguagggugggcagaagccacagucgccgccgccaggggcuugcuccuggcucuguc

SEQ ID NO: 308225 - RNA, 64 nt, Homo Sapiens
agcauaccugcugguguguaaguguggacuaacccgccgccaccacccucuguuccagcaggcu

SEQ ID NO: 308226 - RNA, 64 nt, Homo Sapiens
ggcucucacucagcucccacgggacucagaagugcgccgccaugcugccuaggguacugucccc

SEQ ID NO: 308227 - RNA, 64 nt, Homo Sapiens
acucgcucgcccucccgcuugccacagccacagccgccgccaucugcacgccgcccuccgccac

SEQ ID NO: 308228 - RNA, 64 nt, Homo Sapiens
cugccccuaaguuauuaccuggguuagccugcaccgccgccaccaaggcugcuggcuucaggga

SEQ ID NO: 308229 - RNA, 64 nt, Homo Sapiens
cucagccugccgagugccugcaauugcaggcgagcgccgccacgccugacugccucggccuccc

SEQ ID NO: 308230 - RNA, 64 nt, Homo Sapiens
gcaccccguacauacacacagggaauuugaggaccgccgccaggcguucugucugccaccugaa

SEQ ID NO: 308231 - RNA, 64 nt, Homo Sapiens
gucugcagaaugugagaugagucgagcacugccccgccgccaaaaccagcccacccagccagug

SEQ ID NO: 308232 - RNA, 64 nt, Homo Sapiens
gggaggaagccugacugucccccugcccagcccacgccgccaccugccuccuccgggaagccuu

SEQ ID NO: 308233 - RNA, 55 nt, Homo Sapiens; identical to SEQ ID NO: 214261

SEQ ID NO: 308234 - RNA, 60 nt, Homo Sapiens; identical to SEQ ID NO: 214262

SEQ ID NO: 308235 - RNA, 64 nt, Homo Sapiens
caucuguccccuccuccccccgcagcccggccgccgccgccaagagacccggcucugagcgccc

SEQ ID NO: 308236 - RNA, 64 nt, Homo Sapiens
ggcacccacccagcugggguguuuuugggggagucgccgccaagcccaggcugcuggagccagg

SEQ ID NO: 308237 - RNA, 57 nt, Homo Sapiens; identical to SEQ ID NO: 214265

SEQ ID NO: 308238 - RNA, 64 nt, Homo Sapiens
ccugaagugccagcaccaccagcaccagauccuccgccgccacaccgcacugaggacacgccgg

SEQ ID NO: 308239 - RNA, 64 nt, Homo Sapiens
cucagccuccugaguagcugggauuacaggugugcgccgccacacccagcuaauuuuguauuuu

SEQ ID NO: 308240 - RNA, 64 nt, Homo Sapiens
gggccccgggacccccacgggaugcugcuucaggcgccgccacucagcagguccgcauccagga

SEQ ID NO: 308241 - RNA, 64 nt, Homo Sapiens
ccugcagcgggccggccagagcuggcggggucuccgccgccagcgcgcggcacccggagccaca

SEQ ID NO: 308242 - RNA, 64 nt, Homo Sapiens
ccccagacuauggucacaggggcuucugcguccccgccgccaggaagaaucuggcucucagggu

SEQ ID NO: 308243 - RNA, 64 nt, Homo Sapiens
ucccccagacccccuccacccuccgcggcggggccgccgccagccucaacaucugguaccagca

SEQ ID NO: 308244 - RNA, 64 nt, Homo Sapiens
uccccugggaccccgcccccugcuccucuagggccgccgccacccccuccacccccuccaacuc

SEQ ID NO: 308245 - RNA, 64 nt, Homo Sapiens
acagagaagggacgggguggggcggcuagggccucgccgccaggggccuugguccccagaagau

SEQ ID NO: 308246 - RNA, 64 nt, Homo Sapiens
uccugacucucgggugaucuuuuccagggccccucgccgccacgccagcuuugguaucuggaga

SEQ ID NO: 308247 - RNA, 64 nt, Homo Sapiens
gggagcccugucccuguugcuguggccccucucacgccgccaucucucugccccgccccgcccc

SEQ ID NO: 308248 - RNA, 64 nt, Homo Sapiens
uuuucugcucagugugauccugagauggcuuccccgccgccacccagagugugguccuuggccg

SEQ ID NO: 308249 - RNA, 64 nt, Homo Sapiens
gcugcccacagagggccgagggucacccgucggccgccgccaccccaggcgaggccggaggaag

SEQ ID NO: 308250 - RNA, 64 nt, Homo Sapiens
ccguugcagcccagagccacuggucccuacagggcgccgccacaccagcaggaaggaggauggc

SEQ ID NO: 308251 - RNA, 64 nt, Homo Sapiens
ccaauccggagaaggggcucuguccacagucccccgccgccagguggcccacaugggaccagca

SEQ ID NO: 308252 - RNA, 64 nt, Homo Sapiens
ggcugcccagggcuggaggggacgcuguuccucccgccgccacugcccaaccuuuccugauaau

SEQ ID NO: 308253 - RNA, 64 nt, Homo Sapiens
gggccagcacggaccacccaaggccucugcuucccgccgccacccuccucgcugccauucucug

SEQ ID NO: 308254 - RNA, 64 nt, Homo Sapiens
uccucggaggccagacccaggcacacggugcgcccgccgccagccgccaucccugcaggccagg

SEQ ID NO: 308255 - RNA, 64 nt, Homo Sapiens
ccagccgggcggccgacccgggggucucucuccacgccgccaagagccagguguguguacauac

SEQ ID NO: 308256 - RNA, 59 nt, Homo Sapiens; identical to SEQ ID NO: 214284

SEQ ID NO: 308257 - RNA, 64 nt, Homo Sapiens
ggaguacaagagccagaggcuccgcccccacccccgccgccagaccucaccagaggaugccacc

SEQ ID NO: 308258 - RNA, 64 nt, Homo Sapiens
cccuccccgcagcccucaccgggagggcccugcacgccgccaccucgacccucgggccucgggg

SEQ ID NO: 308259 - RNA, 64 nt, Homo Sapiens; identical to SEQ ID NO: 126154

SEQ ID NO: 308260 - RNA, 64 nt, Homo Sapiens; identical to SEQ ID NO: 126155

SEQ ID NO: 308261 - RNA, 64 nt, Homo Sapiens; identical to SEQ ID NO: 126156

SEQ ID NO: 308262 - RNA, 64 nt, Homo Sapiens; identical to SEQ ID NO: 126157

SEQ ID NO: 308263 - RNA, 64 nt, Homo Sapiens; identical to SEQ ID NO: 126158

SEQ ID NO: 308264 - RNA, 64 nt, Homo Sapiens; identical to SEQ ID NO: 126159

SEQ ID NO: 308265 - RNA, 64 nt, Homo Sapiens; identical to SEQ ID NO: 61376

SEQ ID NO: 308266 - RNA, 64 nt, Homo Sapiens; identical to SEQ ID NO: 61377

SEQ ID NO: 308267 - RNA, 64 nt, Homo Sapiens; identical to SEQ ID NO: 61378

SEQ ID NO: 308268 - RNA, 64 nt, Homo Sapiens; identical to SEQ ID NO: 61379

SEQ ID NO: 308269 - RNA, 64 nt, Homo Sapiens; identical to SEQ ID NO: 61380

SEQ ID NO: 308270 - RNA, 64 nt, Homo Sapiens; identical to SEQ ID NO: 61381

SEQ ID NO: 308271 - RNA, 64 nt, Homo Sapiens; identical to SEQ ID NO: 61382

SEQ ID NO: 308272 - RNA, 64 nt, Homo Sapiens; identical to SEQ ID NO: 61383

SEQ ID NO: 308273 - RNA, 64 nt, Homo Sapiens; identical to SEQ ID NO: 61384

SEQ ID NO: 308274 - RNA, 64 nt, Homo Sapiens; identical to SEQ ID NO: 61384

SEQ ID NO: 308275 - RNA, 64 nt, Homo Sapiens; identical to SEQ ID NO: 61386

SEQ ID NO: 308276 - RNA, 64 nt, Homo Sapiens; identical to SEQ ID NO: 61387

SEQ ID NO: 308277 - RNA, 64 nt, Homo Sapiens; identical to SEQ ID NO: 61388

SEQ ID NO: 308278 - RNA, 64 nt, Homo Sapiens; identical to SEQ ID NO: 61389

SEQ ID NO: 308279 - RNA, 64 nt, Homo Sapiens
cauuaguuuggggggcccucuucuuaaaguggggaucuugaaccauccuuucuuuuguauuccc

SEQ ID NO: 308280 - RNA, 64 nt, Homo Sapiens
auguuuacugcuaaaaaccaaagcuuuguguaaaaucuugaauuuauggggcgggaggguagga

SEQ ID NO: 308281 - RNA, 64 nt, Homo Sapiens
gauaagcacagaagagaaggccuuccauguauuuaucuugaagaugguguuccgauuuucacau

SEQ ID NO: 308282 - RNA, 64 nt, Homo Sapiens
auaaaacgauaauagaacuauguaccugucacacaucuugaaaauuggcaaccauauugucacc

SEQ ID NO: 308283 - RNA, 64 nt, Homo Sapiens
gaaucuagauaggugcuuuugacuuuguugccuuaucuugaaaaaugaaaacuauuuuaaagcu

SEQ ID NO: 308284 - RNA, 64 nt, Homo Sapiens
uuugcuuaaaauugcuagugucuaaagguagaucaucuugaauaaccuuaaaucugccuuuguu

SEQ ID NO: 308285 - RNA, 64 nt, Homo Sapiens
aaguggccuuaaauaugaguagugaauugagaacaucuugaauucuuaaaagacuucuuaguga

SEQ ID NO: 308286 - RNA, 64 nt, Homo Sapiens
uugcauguauguguauuuacaaauuuuucuaaguaucuugaauucucagacugcaaaaggccua

SEQ ID NO: 308287 - RNA, 64 nt, Homo Sapiens
gaguauaaguuuuccguuguguucugauggaaaaaucuugaaugacccaaauaaaaugauuaaa

SEQ ID NO: 308288 - RNA, 64 nt, Homo Sapiens
aucuaaaauuguugcaaaacauggaaaugguugaaucuugaaaaaagccucugugauguuacau

SEQ ID NO: 308289 - RNA, 64 nt, Homo Sapiens
guguuuauugucaaaguggugagaggcauccaguaucuugaagacuuuucuuucagccaagaau

SEQ ID NO: 308290 - RNA, 64 nt, Homo Sapiens
cuuucagccaagaauucuuaaauauguggaguucaucuugaauuguaaggaaugauuaauuaaa

SEQ ID NO: 308291 - RNA, 64 nt, Homo Sapiens
gagaccccucccagcuuuguuugagauccugaaaaucuugaagaagguauuccucaccuuucuu

SEQ ID NO: 308292 - RNA, 64 nt, Homo Sapiens
ggaaaacagccuguugcaugguaagagugauaccaucuugaagugaaaccaccacaauggccau

SEQ ID NO: 308293 - RNA, 64 nt, Homo Sapiens
uaaugcuuuuacaggaaaacuaaagaaacugucaaucuugaagguggaucagaauagacucaca

SEQ ID NO: 308294 - RNA, 64 nt, Homo Sapiens
auaacaaaaauauguauuucuuuuuuguuauuuuaucuugaaaacgguacauauuuuaguauuu

SEQ ID NO: 308295 - RNA, 64 nt, Homo Sapiens
uuccgacguguaacucacagaagguacaucauuuaucuugaacaucugacguguaaaggaccau

SEQ ID NO: 308296 - RNA, 64 nt, Homo Sapiens
uucugacguguaaaggaccaaagguacaucaguuaucuugaacagucuuccuuucaaggaccau

SEQ ID NO: 308297 - RNA, 64 nt, Homo Sapiens
aaggcuuuuauuaagaaaacagcagaaagauuaaaucuugaauuaagucuggggggaaauggcc

SEQ ID NO: 308298 - RNA, 64 nt, Homo Sapiens
ugugggugugccuaucauaacaauuguuuucuguaucuugaaaaaguauucuccacauuuuaaa

SEQ ID NO: 308299 - RNA, 64 nt, Homo Sapiens
ucuuacaccaacccccacuuggcuguuggcugucaucuugaacucuauuugaaugugacuuaaa

SEQ ID NO: 308300 - RNA, 64 nt, Homo Sapiens
aucacaggaguuuagaaagacucugccucccagcaucuugaauaucuccagccuguucacuguu

SEQ ID NO: 308301 - RNA, 64 nt, Homo Sapiens
cacaaauaaaguucuauucuaaucauuuuuuaaaaucuugaaucuugcacacuuuaaaguguaa

SEQ ID NO: 308302 - RNA, 64 nt, Homo Sapiens
aaaucauauaaaaagcauuucugagucuucccagaucuugaagagaacuacuaaaauguggcca

SEQ ID NO: 308303 - RNA, 64 nt, Homo Sapiens
gcuccuguacuugcucuuugugauugaauacaugaucuugaacaguacaagucacauuucauuu

SEQ ID NO: 308304 - RNA, 64 nt, Homo Sapiens
uaaagaaugcugacuuuuccuauuuaaacuuaauaucuugaaccaugaggccacauucagcugc

SEQ ID NO: 308305 - RNA, 64 nt, Homo Sapiens
uucuuuugacagcuuaucagucuguaggagaaugaucuugaaauguuaacccugacuaaaauuu

SEQ ID NO: 308306 - RNA, 64 nt, Homo Sapiens
ccugcagcucugcucucgggauggugcuuccuuuaucuugaaggguggcacauguuugcagcug

SEQ ID NO: 308307 - RNA, 64 nt, Homo Sapiens
cagaacccaaguguuccaugcaagacauugccaaaucuugaacucccuaccuuccaacccaggu

SEQ ID NO: 308308 - RNA, 64 nt, Homo Sapiens
cuggaccaaagcuuuuccagcaaggcacucucaaaucuugaaccccccaaacuggggccuggag

SEQ ID NO: 308309 - RNA, 64 nt, Homo Sapiens
agucaccccaggaaguggggcugaguggugauacccagaccagcagauguuuguggauguagca

SEQ ID NO: 308310 - RNA, 64 nt, Homo Sapiens
gucccugucugggagcucagguuuuugugcauuuccagaccaggguuguucauuuggggcucca

SEQ ID NO: 308311 - RNA, 64 nt, Homo Sapiens
accgcgccgagccgccgggaccaaccccaccgacccagaccaagccggccgcgggucucccggc

SEQ ID NO: 308312 - RNA, 64 nt, Homo Sapiens
aaaauacauuuauuauuugcugcucaugccauuuccagaccaagauggaaaucugaaaggagug

SEQ ID NO: 308313 - RNA, 64 nt, Homo Sapiens
gggaucggaggcucaggccccagaccagaccagaccagaccagaaguggauguggaggagugac

SEQ ID NO: 308314 - RNA, 64 nt, Homo Sapiens
ccagagggaucggaggcucagugaccagaccagaccagaccagaguggaaguggauguggagga

SEQ ID NO: 308315 - RNA, 64 nt, Homo Sapiens
ccagaccagagggaucggaggaggagugaccagaccagaccagaaagggguggaaguggaugug

SEQ ID NO: 308316 - RNA, 64 nt, Homo Sapiens
ccagaccagaccagagggauauguggaggagugaccagaccagacaaugaagggguggaagugg

SEQ ID NO: 308317 - RNA, 64 nt, Homo Sapiens
cugugucucugaauuccugucuuccaaauugaagccagaccaugcugaugaccucaaguagcac

SEQ ID NO: 308318 - RNA, 64 nt, Homo Sapiens
auaucaaaauaggauuucuuaaauuuuucaacccccagaccauacugacucaacauggagucuc

SEQ ID NO: 308319 - RNA, 64 nt, Homo Sapiens
gcgaguuuccccacuaauaagaucccagucucugccagaccaagagaugggugcugguccuguu

SEQ ID NO: 308320 - RNA, 64 nt, Homo Sapiens
gacaucgagccugacaucgauacagccgccgcuuccagaccauuacggugugccccuacgcagg

SEQ ID NO: 308321 - RNA, 64 nt, Homo Sapiens
cucccugauagaugcugagagcauccagaaacuuccagaccagcccucucaccacacccagaag

SEQ ID NO: 308322 - RNA, 64 nt, Homo Sapiens
ccagaagaggccuuucccaucuggagagaagcuuccagaccagcccuucacacaccacagccag

SEQ ID NO: 308323 - RNA, 64 nt, Homo Sapiens
ccaggaggggccuuucccaccuggagagaaacuuccagaccagccccucauaccacagccaaga

SEQ ID NO: 308324 - RNA, 64 nt, Homo Sapiens
ccaagaggggccuuucucaccuggagagaaauuuccagaccauccccucucaccacagccagga

SEQ ID NO: 308325 - RNA, 64 nt, Homo Sapiens
ccaggagaggccuuucccaccgguagagaaacuuccagaccagccccucacaccacagccaaga

SEQ ID NO: 308326 - RNA, 64 nt, Homo Sapiens
ccaagagaagccuuuccagccuggagagaaacuuccagaccagcccucucacuacagccaggag

SEQ ID NO: 308327 - RNA, 64 nt, Homo Sapiens
ccaggagaggccuuucccaccuggacagaaacuuccagaccagccccucucaccacagccagga

SEQ ID NO: 308328 - RNA, 64 nt, Homo Sapiens
ccaggagaggccuuuaccaccuggagagaagcuuccagaccagccccucacaccacagccagga

SEQ ID NO: 308329 - RNA, 64 nt, Homo Sapiens
ccaggagaggccuuucccaccuggagagaaacuuccagaccagccccucauaccacagccaaga

SEQ ID NO: 308330 - RNA, 64 nt, Homo Sapiens
ccaagaggggccuuucucaccuggagagaaacuuccagaccagccccucacaccaccgccagga

SEQ ID NO: 308331 - RNA, 64 nt, Homo Sapiens
ccaggagaggccuuucccaccgggagagaaacuuccagaccagccccucacaccacagccagga

SEQ ID NO: 308332 - RNA, 64 nt, Homo Sapiens
ccaggagaggccuuucccaccgggagagaaacuuccagaccagcccucucacuacagccagaag

SEQ ID NO: 308333 - RNA, 64 nt, Homo Sapiens
ccagaagaggccuuucccaccgggagaggaacuuccagaccagccccucacaccacagccagga

SEQ ID NO: 308334 - RNA, 64 nt, Homo Sapiens
ccaggagaggccguuccugccuggagagaagcuuccagaccagcccuucacaccacagccagga

SEQ ID NO: 308335 - RNA, 64 nt, Homo Sapiens
ccaggagaggccuuucccaccuggagagaaacuuccagaccagccccucucaccacagccagga

SEQ ID NO: 308336 - RNA, 64 nt, Homo Sapiens
ccugccuccaccucugacuccccagccccaggagccagaccacucugcccucucaccucugaca

SEQ ID NO: 308337 - RNA, 64 nt, Homo Sapiens
uuuccaagagaaaccuggugggcucuuggagcagccagaccauggugaugaugguguccuuuag

SEQ ID NO: 308338 - RNA, 64 nt, Homo Sapiens
uuagaauugggaaauuuuaggccacugcgccuggccagaccauuugcugggauuacaggcguga

SEQ ID NO: 308339 - RNA, 64 nt, Homo Sapiens
uuauuuuauuuuuuuauuuagguguugaccaaauccagaccauuauuaaggauuuacugaauaa

SEQ ID NO: 308340 - RNA, 64 nt, Homo Sapiens
aaccccagaaggagacagaguuggggagacuccuccagaccaggaacagccagcuuuggcgcug

SEQ ID NO: 308341 - RNA, 64 nt, Homo Sapiens
uccggaauccugccaccuguugguggugggggggccagaccaccgcuccguuguucccuugccc

SEQ ID NO: 308342 - RNA, 64 nt, Homo Sapiens
auccaguggccaucaggucuaugagaacuuguuuccagaccagcaagaucacauuucugggaag

SEQ ID NO: 308343 - RNA, 64 nt, Homo Sapiens
gauacccagagcuaccugcccgagugggcgaaugccagaccaaucuuuaggacagcuuagaugc

SEQ ID NO: 308344 - RNA, 64 nt, Homo Sapiens
gggcaccguguaugcccuggcggucaucucgacgccagaccagaccaaagucuucagugcaucc

SEQ ID NO: 308345 - RNA, 64 nt, Homo Sapiens
ccguguaugcccuggcggucaucucgacgccagaccagaccaaagucuucagugcauccuacga

SEQ ID NO: 308346 - RNA, 64 nt, Homo Sapiens
gagcugugcucccuugagugcacuugagcacuccccagaccagaucacuuuuuggacacaccca

SEQ ID NO: 308347 - RNA, 64 nt, Homo Sapiens
ccacugggcuccccccgggguugaaacggguuucccagaccagggguucagaggagacuauuua

SEQ ID NO: 308348 - RNA, 64 nt, Homo Sapiens
ugccauucaugacuaaucagcgggugacugucgcccagaccaggggccagcucagggcuuccug

SEQ ID NO: 308349 - RNA, 64 nt, Homo Sapiens
uccagggccuccuccacagcgccucugacagacaccagaccaggagucaaaggacugggcaccu

SEQ ID NO: 308350 - RNA, 64 nt, Homo Sapiens
aaacugagcaguuucuguguauauauagaagguagaaaugaaaagugagaaaauauuugaaagg

SEQ ID NO: 308351 - RNA, 64 nt, Homo Sapiens
aaaacagagauaugugcaugaaaucaagaaaaaagaaaugaacaaaagcaaagcauuaguggcu

SEQ ID NO: 308352 - RNA, 64 nt, Homo Sapiens
cuguguuauccuaguuugaacaggauauguucaggaaaugaaaggugaauuaugccccuuauug

SEQ ID NO: 308353 - RNA, 64 nt, Homo Sapiens
ucuuauuugacauuucguagguguaagagaaauggaaaugaaugguuucaacaaagaucauuua

SEQ ID NO: 308354 - RNA, 64 nt, Homo Sapiens
auuucucauuuaacuuuacuguuaagacaucacugaaaugaacuucaguaagcuuucaauuuug

SEQ ID NO: 308355 - RNA, 64 nt, Homo Sapiens
uuucugauuucuuggagcaggaauuuuagagauugaaaugaaugaucauuuagucagauuuauc

SEQ ID NO: 308356 - RNA, 64 nt, Homo Sapiens
gaaaagaaaaaucaugucaucuucuauuuguacagaaaugaaaauaaaauaugaaaauaaugaa

SEQ ID NO: 308357 - RNA, 64 nt, Homo Sapiens
acagaaaugaaaauaaaauaugaaaauaaugaaagaaaugaaaagauagcuuuuaauuguggua

SEQ ID NO: 308358 - RNA, 57 nt, Homo Sapiens
uuaccauggaaacugagugaaugguuugaaaugaagacuuugucguguacuuaggaa

SEQ ID NO: 308359 - RNA, 64 nt, Homo Sapiens
caccaccuaaauguaauguugauuccucaagaaugaaaugaaggcacuacauugaaauauguuu

SEQ ID NO: 308360 - RNA, 64 nt, Homo Sapiens
guagcacaaucuuagccuacaggguacuucuuuggaaaugaaauaaagacaauaaagaccucca

SEQ ID NO: 308361 - RNA, 64 nt, Homo Sapiens
gaguuagcucccaggcuccuguaagggcaggaaggaaaugaacggcccacaggacaagaagugg

SEQ ID NO: 308362 - RNA, 64 nt, Homo Sapiens
ccaaaugcauuuuuuaacuagacucuaaggaggugaaaugaaucaaaaauaaaguuaagucuga

SEQ ID NO: 308363 - RNA, 64 nt, Homo Sapiens
uaaagaacaguuagaguaacguacauccugggaggaaaugaaacgcccuauuuaaaaaagagca

SEQ ID NO: 308364 - RNA, 64 nt, Homo Sapiens
aauaaauaaggauggugauagagagguugaagaagaaaugaagaagcaugaaaguaauaaugug

SEQ ID NO: 308365 - RNA, 64 nt, Homo Sapiens
uauuuuccagcuagaaaauuuuauggcuaucgaagaaaugaagaagcacggaaguacucauguc

SEQ ID NO: 308366 - RNA, 64 nt, Homo Sapiens
gaccuaagguguugguauuuuccaggugucgggggaaaugaacuggugaagggguuuuguaaag

SEQ ID NO: 308367 - RNA, 64 nt, Homo Sapiens
cauguaauguguacagucuuugcaguuccaccaagaaaugaacuugguaccugcagaguggcug

SEQ ID NO: 308368 - RNA, 64 nt, Homo Sapiens
cuuguuuaaacauuaaaauuggaauuuuugaaaugaaaugaaacaucuuuaugcuaauagauuu

SEQ ID NO: 308369 - RNA, 64 nt, Homo Sapiens
gaaaccuuguuuaaacauuagauuuggaauuuuugaaaugaaauguuacaucuuuaugcuaaua

SEQ ID NO: 308370 - RNA, 64 nt, Homo Sapiens
auaaacugaugcuaucucaaugacucuauuaucugaaaugaagaacuaaguauaccaaaauaau

SEQ ID NO: 308371 - RNA, 64 nt, Homo Sapiens
cgauucuccuugaguucugaacaacaucggcgaggaaaugaaagcauuuauguuccuauauauu

SEQ ID NO: 308372 - RNA, 64 nt, Homo Sapiens
agaaagaaaccauaagccuuauuaaguaauaucugaaaugaauuaacuuaaaucacaguuuguu

SEQ ID NO: 308373 - RNA, 64 nt, Homo Sapiens
aaaacuuaaaucacaguuugaaaaaaaaauagaagaaaugaacaccuuaggcuuaugaauucaa

SEQ ID NO: 308374 - RNA, 64 nt, Homo Sapiens
gaaaccuuggaagcccucuuaugagcgaauucaggaaaugaaagcuaaaacaacccauuugcua

SEQ ID NO: 308375 - RNA, 64 nt, Homo Sapiens
ugcuguggaaguuaagguguugaccacugugccugaaaugaaaccacaaggcuugagaauagaa

SEQ ID NO: 308376 - RNA, 64 nt, Homo Sapiens
acucacacaugccacaacauuuagacucuaaaaagaaaugaaguguccacgcaauggaacauua

SEQ ID NO: 308377 - RNA, 64 nt, Homo Sapiens
cguacauacacacaaaaacuguauuuacccaagagaaaugaaaacccaggaaugccacuccuag

SEQ ID NO: 308378 - RNA, 64 nt, Homo Sapiens
uuuaauucaagaaacauucagaaaguaagaugaugaaaugaauuaaagagagaugccguguuuu

SEQ ID NO: 308379 - RNA, 64 nt, Homo Sapiens
auuaggagcucugcuuggaaugguuguaggacaggaaaugaaaccagcuccacuggguccccuu

SEQ ID NO: 308380 - RNA, 64 nt, Homo Sapiens
uagaaccuaggguuucuaauugacuugauuucuggaaaugaaaacccgcgcuuuuauuauggga

SEQ ID NO: 308381 - RNA, 64 nt, Homo Sapiens
aauagauugaguucuguaagggcaaaaacggauugaaaugaacauagcguuuugcacuaaugau

SEQ ID NO: 308382 - RNA, 64 nt, Homo Sapiens
uggaacauuucaaucaaacagcuauaagcuuggugaaaugaaaaaaaguuuguauaaacagguu

SEQ ID NO: 308383 - RNA, 64 nt, Homo Sapiens
cauggagcauuguuaauuuaaaauugcuaaacaagaaaugaaaauacaauagguucuaaaaaua

SEQ ID NO: 308384 - RNA, 64 nt, Homo Sapiens
uuaucuucuguuuuggucucuuuucugaaauauagaaaugaaauucaaaguguauucaaguagg

SEQ ID NO: 308385 - RNA, 64 nt, Homo Sapiens
acauauugagaugcugacagccauguuucagugggaaaugaacucuggaaauaaauuaccuauc

SEQ ID NO: 308386 - RNA, 64 nt, Homo Sapiens
aaaaaaaaauggcuuaucugaaaucaguacuguggaaaugaacuauauuagcuauuaugaauaa

SEQ ID NO: 308387 - RNA, 64 nt, Homo Sapiens
uaauaaaguaggcauuuguuuauuuuguaaaaaagaaaugaaaaucugcuggccagcuaugucc

SEQ ID NO: 308388 - RNA, 64 nt, Homo Sapiens
cagcauggcauuuauuugugugaguguuuauauagaaaugaacauagaccuggccaguaaaagg

SEQ ID NO: 308389 - RNA, 64 nt, Homo Sapiens
aaaaaauugcacugaaaugcugacaaaaaauaaugaaaugaaguggcuuccaaaauaugcacug

SEQ ID NO: 308390 - RNA, 64 nt, Homo Sapiens
uaauaauacauuaaauuuuuaauguauucuacuggaaaugaaugguagaugugauagugccgug

SEQ ID NO: 308391 - RNA, 64 nt, Homo Sapiens
aaaguaauuuuaaugaauuuaguuccugauuugagaaaugaaucauuaaacugaugaugaagaa

SEQ ID NO: 308392 - RNA, 64 nt, Homo Sapiens
aaguuucaugucuguacagauuauuuaaaucauggaaaugaaaaaaauguucucugcuugcuac

SEQ ID NO: 308393 - RNA, 64 nt, Homo Sapiens
uguucucugcuugcuaccaaaggacaaacucuuggaaaugaacacuuucugcuuuccuuccucc

SEQ ID NO: 308394 - RNA, 64 nt, Homo Sapiens
uguuuaauaagagcaaauauaggggaaaaucuuugaaaugaaagcuacaaauacaugugagaag

SEQ ID NO: 308395 - RNA, 64 nt, Homo Sapiens
cuggggcuggcuaggccuccacuuguccaucugugaaaugaaaggaucagccuggacagcccuc

SEQ ID NO: 308396 - RNA, 64 nt, Homo Sapiens
aauuugauaugcucuaaauauauuaacagggaaagaaaugaauuuucugugaauguaccuuuuu

SEQ ID NO: 308397 - RNA, 64 nt, Homo Sapiens
cuccuggccuuaaacaucacugauacaagguugagaaaugaauguaguccgauggauccuggau

SEQ ID NO: 308398 - RNA, 64 nt, Homo Sapiens
cauuuauucauuccuuccuuaacaaauaguaguagaaaugaauguuaguuuacaguuuagcaua

SEQ ID NO: 308399 - RNA, 64 nt, Homo Sapiens
cuacuucuggccaaagcacauacugaaucaucaugaaaugaacuucaaaaauaguaucugaaga

SEQ ID NO: 308400 - RNA, 64 nt, Homo Sapiens
aauggcuugaaacuuguguaucauaugugauuuugaaaugaacaccuugaauagcacuaauuuu

SEQ ID NO: 308401 - RNA, 64 nt, Homo Sapiens
aauuuugugacuguuaccaugugaaaguccuguugaaaugaacaauugucugccccacaaucaa

SEQ ID NO: 308402 - RNA, 64 nt, Homo Sapiens
gucuaauuaauuuauguagaugagauuuuauuuagaaaugaauuauucaacuuauuguaaauuu

SEQ ID NO: 308403 - RNA, 64 nt, Homo Sapiens
auuagucacuuccucacauggcccuuuauagugugaaaugaaaacuucuguuuugccuuuucac

SEQ ID NO: 308404 - RNA, 64 nt, Homo Sapiens
uuggucugcagucuggaagcuugucugcucuauagaaaugaaaaugcagcaugaaguugacauu

SEQ ID NO: 308405 - RNA, 64 nt, Homo Sapiens
agaaaugaaaaugcagcaugaaguugacauuguggaaaugaaaguaauuggguauuagaaaucu

SEQ ID NO: 308406 - RNA, 64 nt, Homo Sapiens
auuguuuccaauuauuuauauugucuggguuugagaaaugaaaugcaugauauuuacuguuuug

SEQ ID NO: 308407 - RNA, 64 nt, Homo Sapiens
uaaucaaguaaggauguaugaguuuucagaaaaagaaaugaacaauuacucugauuuuugauac

SEQ ID NO: 308408 - RNA, 64 nt, Homo Sapiens
guccuaucaauuuuauuuugagaagacuaaguaagaaaugaaauguauuuuuauaaccccauug

SEQ ID NO: 308409 - RNA, 64 nt, Homo Sapiens
ucaccuaucuuucuaucacauggccaaccugaaggaaaugaaacggcguacuuuguuuauccau

SEQ ID NO: 308410 - RNA, 64 nt, Homo Sapiens
gacagauaaacaguaacucauuuggggggugggagaaaugaacucugccagacugagggugcuu

SEQ ID NO: 308411 - RNA, 64 nt, Homo Sapiens
agucugcuaccucuucauccuucaccuuacaauagaaaugaacacaaugcuguugacaguggaa

SEQ ID NO: 308412 - RNA, 64 nt, Homo Sapiens
cuaauuuauacacagcaggccagcuuacaauguggaaaugaaaggcuccccuaauucagugugc

SEQ ID NO: 308413 - RNA, 64 nt, Homo Sapiens
gcuuguuuccgucuagucuaguagguuuaucagugaaaugaaagccuuucgaucguguauuuau

SEQ ID NO: 308414 - RNA, 64 nt, Homo Sapiens
acaauccugacaaguuuggaagaauaaaagucuagaaaugaaacucuuccucaucaucccuuug

SEQ ID NO: 308415 - RNA, 64 nt, Homo Sapiens
caggagaacugcugccgucaagcaagugcucagggaaaugaagacucucacgguuuuuugcaga

SEQ ID NO: 308416 - RNA, 64 nt, Homo Sapiens
agaggaaggaaacauagaaaguuagcccaauggagaaaugaagcugcagacaauucucccugag

SEQ ID NO: 308417 - RNA, 64 nt, Homo Sapiens
ugacaagcuaggaaagaggaagagugguaaaaaagaaaugaaauuaauuucuaggcagguggag

SEQ ID NO: 308418 - RNA, 64 nt, Homo Sapiens
uugcuuauguugcuuuuucacaugcuuaaugauggaaaugaaauguuaaaucaacaaaauaaga

SEQ ID NO: 308419 - RNA, 64 nt, Homo Sapiens
guuuuuagaaaauaauucucaucuuuuuucuaaagaaaugaauuuguggcuggucugaagguag

SEQ ID NO: 308420 - RNA, 64 nt, Homo Sapiens
aaauuuauuguuuacagauguuaaaucuuuaaaagaaaugaaauuauauacguuuuguauauca

SEQ ID NO: 308421 - RNA, 64 nt, Homo Sapiens
aaucacgcagccuuuugguugccauucaacuagggaaaugaagauuauuggcagcuguuuuauu

SEQ ID NO: 308422 - RNA, 64 nt, Homo Sapiens
uagagaaucagacaggcgaggccuccaccaccaagaaaugaacuagugacuccagaagaaauga

SEQ ID NO: 308423 - RNA, 64 nt, Homo Sapiens
aagaaaaugaugaaaagaguaucccucuaagaaagaaaugaagaaaccuuucagguaaaaggug

SEQ ID NO: 308424 - RNA, 64 nt, Homo Sapiens
aagggacagacauguucaucggguacuucaagaagaaaugaaagcuugucaaagagagaagguc

SEQ ID NO: 308425 - RNA, 64 nt, Homo Sapiens
ccaagagcuacaagauggcuaaccuguucugguggaaaugaaaagagggacaggaggaaaauga

SEQ ID NO: 308426 - RNA, 64 nt, Homo Sapiens
auauuucguucucuccccauggggcacugacagagaaaugaaauaguuuuaucuggaaaauucc

SEQ ID NO: 308427 - RNA, 64 nt, Homo Sapiens
gccaugaagaagugcuuccguggccgacagucuggaaaugaauccaucauacauuagugccaua

SEQ ID NO: 308428 - RNA, 64 nt, Homo Sapiens
gguugaauugauuuuuaaacacauauaacaguaggaaaugaauaaaugggcuucugcauuuggc

SEQ ID NO: 308429 - RNA, 64 nt, Homo Sapiens
gccaugccuuuuaagcauguguaaaauuuuuaaagaaaugaacauacacauaguuauuuuagua

SEQ ID NO: 308430 - RNA, 64 nt, Homo Sapiens
ccucuuuguaaucacagggcagggaucagaguuugaaaugaaauguugucaggguguuggaaaa

SEQ ID NO: 308431 - RNA, 64 nt, Homo Sapiens
agaugagccuacuugugagcgaugugacuuuaaggaaaugaagacuggggaagaauaauuagug

SEQ ID NO: 308432 - RNA, 64 nt, Homo Sapiens
auaguuuaagaccaaacauugccucugcuugcuggaaaugaaauguucccguuaacaaauuacg

SEQ ID NO: 308433 - RNA, 64 nt, Homo Sapiens
uggccagucaaaaaaaaaaacaacccaggucauugaaaugaaaucuccugaauaaaacaacauc

SEQ ID NO: 308434 - RNA, 64 nt, Homo Sapiens
uccaagacacauaauugucagauucaccaaaguugaaaugaaggaaaaaauguuaagggcagcc

SEQ ID NO: 308435 - RNA, 64 nt, Homo Sapiens
caaccugcuccugaaugacuacuggguacauaacgaaaugaaggcaggaauaaagauguucuuu

SEQ ID NO: 308436 - RNA, 64 nt, Homo Sapiens
acagugagaugccugcacauuuauagacuauguagaaaugaaugguuuaaaaucaaaaccaaaa

SEQ ID NO: 308437 - RNA, 64 nt, Homo Sapiens
uagacacauuuggauuaaaagagauacauacuaugaaaugaagaaauaaaagaucguaugauau

SEQ ID NO: 308438 - RNA, 64 nt, Homo Sapiens
gaaauuuaaaauguuuacggcgcuuaauugccuggaaaugaaaugaaaucaaauuuaucaguuu

SEQ ID NO: 308439 - RNA, 64 nt, Homo Sapiens
uuaaaauguuuacggcgcuuaauugccuggaaaugaaaugaaaucaaauuuaucaguuuuuuuc

SEQ ID NO: 308440 - RNA, 64 nt, Homo Sapiens
ugcaaaaaaagaaaaagaacuuuuuguucuaggggaaaugaaugaauuuuuuuuaaguucacuu

SEQ ID NO: 308441 - RNA, 64 nt, Homo Sapiens
guuccacucaaauguccugccucugauuagaaaggaaaugaaugugugcagauaaacagaaaug

SEQ ID NO: 308442 - RNA, 64 nt, Homo Sapiens
auuaaaagaacuuaaaaaguauauauauuuuuuggaaaugaaacgcccuaugaaaaaauaccca

SEQ ID NO: 308443 - RNA, 64 nt, Homo Sapiens
cuuuugauaugcauucgcuaaugaaagaacaaaagaaaugaagcuuugaugugcuacaagccuc

SEQ ID NO: 308444 - RNA, 64 nt, Homo Sapiens
ugagccaccuugcccagcccacaucauacaguuugaaaugaaacuuugccacaaccagccuuug

SEQ ID NO: 308445 - RNA, 64 nt, Homo Sapiens
auguugcuuuaucuuugaaauuuugcaugaaaaggaaaugaauggauucgaaugaaauuguccu

SEQ ID NO: 308446 - RNA, 64 nt, Homo Sapiens
uguuugguuuuaugugcagcaccuugacuucuaagaaaugaaucaugucccuuugccccuuaua

SEQ ID NO: 308447 - RNA, 64 nt, Homo Sapiens
auaaauacagucuuaaaccuuuaugucugagucugaaaugaaccuguucacuuagacuagauuu

SEQ ID NO: 308448 - RNA, 64 nt, Homo Sapiens
cccagcaguugugcuccuggacauucauuccagagaaaugaaaaccuauauuguacuuguacuc

SEQ ID NO: 308449 - RNA, 64 nt, Homo Sapiens
auuuauauaacauucuugaggugacaaaauuauugaaaugaagaacagauuaaugguugccagg

SEQ ID NO: 308450 - RNA, 64 nt, Homo Sapiens
agcaucccaagaaggaaagagcagagguaagaggaagaggcagcagcacacacuggcucaagca

SEQ ID NO: 308451 - RNA, 64 nt, Homo Sapiens
aacaggaggaggaggacuuggcagccgaagaaagaagaggcagccagggcauaugcugacccau

SEQ ID NO: 308452 - RNA, 64 nt, Homo Sapiens
ucucugaacccgucucugacacucgguccccuugaagaggcaaccuaagaucaaagucaacaac

SEQ ID NO: 308453 - RNA, 64 nt, Homo Sapiens
cuugacggcacaggaagucaaaacugagccccagaagaggcacacccaggaaacagacgcguga

SEQ ID NO: 308454 - RNA, 64 nt, Homo Sapiens
cuucucugaugugcacaaacucuccuuguugaagaagaggcaucuugugcccuggagugggguu

SEQ ID NO: 308455 - RNA, 64 nt, Homo Sapiens
guggggccugcagccuggacggaaugcccaagggaagaggcaaguuacagcaguagugggcucu

SEQ ID NO: 308456 - RNA, 64 nt, Homo Sapiens
cuguugaauuuacucucucauguaauuccucccuaagaggcaacucgguaggaauuggagccgg

SEQ ID NO: 308457 - RNA, 64 nt, Homo Sapiens
cccagaauuugcugcauuuacugucucccaaugaaagaggcauuugggaaauugauuaaagggg

SEQ ID NO: 308458 - RNA, 64 nt, Homo Sapiens
gagauguagccuggcccuggagggcauucccccuaagaggcaguucuuuuugaucucacacacc

SEQ ID NO: 308459 - RNA, 64 nt, Homo Sapiens
gauuugccaaagugacacagaacugaggcccagaaagaggcaguggagggaauuugaagaaagg

SEQ ID NO: 308460 - RNA, 64 nt, Homo Sapiens
gaagccccuaggcaaagacuagucuugguuacuuaagaggcagagcucagccacacaggaagaa

SEQ ID NO: 308461 - RNA, 64 nt, Homo Sapiens
cuccuuccuuuaggcugugcucuugccugucacaaagaggcaacguagccacugccucccuaug

SEQ ID NO: 308462 - RNA, 64 nt, Homo Sapiens
ccggcacuggucagggagucugggaagaguggagaagaggcagggucaggccucagcaucucac

SEQ ID NO: 308463 - RNA, 64 nt, Homo Sapiens
cuggaugcuuauaucaauuuaggaaaugucuugaaagaggcacgcauuuuugacaggugagaga

SEQ ID NO: 308464 - RNA, 64 nt, Homo Sapiens
cuagccaauaucaaacgagaacagggaaacauugaagaggcaguucgcuuguaucguaaagcau

SEQ ID NO: 308465 - RNA, 64 nt, Homo Sapiens
uagagacaaaccaauuuaauaacucuugauuacuaagaggcaguaugagguuuugccaagcaag

SEQ ID NO: 308466 - RNA, 64 nt, Homo Sapiens
uuauuagaauuugacaacguuagcacauggauauaagaggcacuuuaauauuugaauuauuacu

SEQ ID NO: 308467 - RNA, 64 nt, Homo Sapiens
ucucugugagggaccuccccggccuucggcggagguggaguaagcuccgucaaggcagguggcu

SEQ ID NO: 308468 - RNA, 64 nt, Homo Sapiens
gugucaggaaggcaggggugccgggucccacccaguggaguaacaaacuguggguggcguuugg

SEQ ID NO: 308469 - RNA, 64 nt, Homo Sapiens
agggaaagaagaguuacagagccagauggaguauguggaguaauguaccuguuggcaggagaag

SEQ ID NO: 308470 - RNA, 64 nt, Homo Sapiens
uacaauguauuggaugaaaagccauuauaagccaguggaguaaucucugaaaucaaaaugcuac

SEQ ID NO: 308471 - RNA, 64 nt, Homo Sapiens
ugggggugugaagguuucagcaaggcaggagaauugcuagaaccaucccagcuacucgagaggc

SEQ ID NO: 308472 - RNA, 64 nt, Homo Sapiens
agcagagagcauuugaggagggugcagacccagcugcuagaaggccaggcaaaggaacaaaacu

SEQ ID NO: 308473 - RNA, 64 nt, Homo Sapiens
uagggcugcuucugugaguuuuuugaccagguugugcuagaaagcccccuguaaauuauuuugc

SEQ ID NO: 308474 - RNA, 64 nt, Homo Sapiens
uucucuaagauaagaggccagaagcaaguuguacugcuagaaacgaaauaaaaacaaaaaacaa

SEQ ID NO: 308475 - RNA, 64 nt, Homo Sapiens
ucgucauugaaggacaauuuauauuuucuaucuuugcuagaacuugaaccagcagagcuguguu

SEQ ID NO: 308476 - RNA, 64 nt, Homo Sapiens
uuaaagaaaaaaaaacuuuuuugugccacuucagugcuagaaaggcuggucuacuaggcagccu

SEQ ID NO: 308477 - RNA, 64 nt, Homo Sapiens
caagagccugauuuuuugaggccaguaauucguuugcuagaauugauuuuuuuucucucucucu

SEQ ID NO: 308478 - RNA, 64 nt, Homo Sapiens
uuuccagaagccuccccugccuggcugacugccuugcuagaaacauaauuuuuuuuuucucacu

SEQ ID NO: 308479 - RNA, 64 nt, Homo Sapiens
gcagacagggucggagguguuagcgagccuuuggugcuagaagccugcggggucaugugcuaag

SEQ ID NO: 308480 - RNA, 64 nt, Homo Sapiens
aggcggagggacugaagccauugcguuccuucccugcuagaaacacaggaagaaguugaggacu

SEQ ID NO: 308481 - RNA, 64 nt, Homo Sapiens
aaauaguggauugggcagacuggccuggaggaaaugcuagaacagagggaaaggaggcuggaga

SEQ ID NO: 308482 - RNA, 64 nt, Homo Sapiens
gaggccuggauuggauucgguaaaaagaggggguugcuagaaggaaaaacaggugugaccugau

SEQ ID NO: 308483 - RNA, 64 nt, Homo Sapiens; identical to SEQ ID NO: 172363

SEQ ID NO: 308484 - RNA, 64 nt, Homo Sapiens; identical to SEQ ID NO: 172364

SEQ ID NO: 308485 - RNA, 64 nt, Homo Sapiens; identical to SEQ ID NO: 172365

SEQ ID NO: 308486 - RNA, 64 nt, Homo Sapiens; identical to SEQ ID NO: 172366

SEQ ID NO: 308487 - RNA, 64 nt, Homo Sapiens; identical to SEQ ID NO: 172367

SEQ ID NO: 308488 - RNA, 64 nt, Homo Sapiens; identical to SEQ ID NO: 172368

SEQ ID NO: 308489 - RNA, 64 nt, Homo Sapiens; identical to SEQ ID NO: 243440

SEQ ID NO: 308490 - RNA, 64 nt, Homo Sapiens; identical to SEQ ID NO: 243441

SEQ ID NO: 308491 - RNA, 64 nt, Homo Sapiens; identical to SEQ ID NO: 243442

SEQ ID NO: 308492 - RNA, 64 nt, Homo Sapiens; identical to SEQ ID NO: 243443

SEQ ID NO: 308493 - RNA, 64 nt, Homo Sapiens; identical to SEQ ID NO: 243444

SEQ ID NO: 308494 - RNA, 64 nt, Homo Sapiens; identical to SEQ ID NO: 243445

SEQ ID NO: 308495 - RNA, 64 nt, Homo Sapiens; identical to SEQ ID NO: 243446

SEQ ID NO: 308496 - RNA, 64 nt, Homo Sapiens; identical to SEQ ID NO: 243447

SEQ ID NO: 308497 - RNA, 64 nt, Homo Sapiens; identical to SEQ ID NO: 243448

SEQ ID NO: 308498 - RNA, 64 nt, Homo Sapiens; identical to SEQ ID NO: 243449

SEQ ID NO: 308499 - RNA, 64 nt, Homo Sapiens; identical to SEQ ID NO: 243450

SEQ ID NO: 308500 - RNA, 64 nt, Homo Sapiens; identical to SEQ ID NO: 243451

SEQ ID NO: 308501 - RNA, 64 nt, Homo Sapiens; identical to SEQ ID NO: 243452

SEQ ID NO: 308502 - RNA, 64 nt, Homo Sapiens; identical to SEQ ID NO: 243453

SEQ ID NO: 308503 - RNA, 64 nt, Homo Sapiens; identical to SEQ ID NO: 243454

SEQ ID NO: 308504 - RNA, 64 nt, Homo Sapiens; identical to SEQ ID NO: 243455

SEQ ID NO: 308505 - RNA, 64 nt, Homo Sapiens; identical to SEQ ID NO: 243456

SEQ ID NO: 308506 - RNA, 64 nt, Homo Sapiens; identical to SEQ ID NO: 243457

SEQ ID NO: 308507 - RNA, 64 nt, Homo Sapiens
gucuugugucuuguuugaccgcuagauagcuagauagcuagauaaaagagaaguaagagagaua

SEQ ID NO: 308508 - RNA, 64 nt, Homo Sapiens
gcuagauagucuugugucuugagagauagcuagauagcuagauaggggcgccaaagagaaguaa

SEQ ID NO: 308509 - RNA, 64 nt, Homo Sapiens
gcuagauagcuagauagucuagaaguaagagagauagcuagauagacacaugggggcgccaaag

SEQ ID NO: 308510 - RNA, 64 nt, Homo Sapiens
aguuaacuccaggauagguagguuucuauuguuauagcuagauguaaaucuuuaguuccaagaa

SEQ ID NO: 308511 - RNA, 64 nt, Homo Sapiens
aaaugcugcuugcacauguugguucuugaaaccuuagcuagaagaauuucaggucauaccaaca

SEQ ID NO: 308512 - RNA, 64 nt, Homo Sapiens
agaucuuuuccaaaguuuuuuggguuguuuuucauagcuagauauucuggaauaaggcaaggag

SEQ ID NO: 308513 - RNA, 64 nt, Homo Sapiens
cagaccagaaugaaaaugccacaugaaaugguuuuagcuagaguauccauuucuucaaagcaaa

SEQ ID NO: 308514 - RNA, 64 nt, Homo Sapiens; identical to SEQ ID NO: 45477

SEQ ID NO: 308515 - RNA, 64 nt, Homo Sapiens; identical to SEQ ID NO: 45478

SEQ ID NO: 308516 - RNA, 64 nt, Homo Sapiens; identical to SEQ ID NO: 45479

SEQ ID NO: 308517 - RNA, 64 nt, Homo Sapiens; identical to SEQ ID NO: 45480

SEQ ID NO: 308518 - RNA, 64 nt, Homo Sapiens; identical to SEQ ID NO: 45481

SEQ ID NO: 308519 - RNA, 64 nt, Homo Sapiens; identical to SEQ ID NO: 45482

SEQ ID NO: 308520 - RNA, 64 nt, Homo Sapiens; identical to SEQ ID NO: 45483

SEQ ID NO: 308521 - RNA, 64 nt, Homo Sapiens; identical to SEQ ID NO: 45484

SEQ ID NO: 308522 - RNA, 64 nt, Homo Sapiens; identical to SEQ ID NO: 45485

SEQ ID NO: 308523 - RNA, 64 nt, Homo Sapiens; identical to SEQ ID NO: 45486

SEQ ID NO: 308524 - RNA, 64 nt, Homo Sapiens; identical to SEQ ID NO: 45487

SEQ ID NO: 308525 - RNA, 56 nt, Homo Sapiens; identical to SEQ ID NO: 45488

SEQ ID NO: 308526 - RNA, 64 nt, Homo Sapiens; identical to SEQ ID NO: 45489

SEQ ID NO: 308527 - RNA, 64 nt, Homo Sapiens; identical to SEQ ID NO: 45490

SEQ ID NO: 308528 - RNA, 64 nt, Homo Sapiens; identical to SEQ ID NO: 45491

SEQ ID NO: 308529 - RNA, 64 nt, Homo Sapiens; identical to SEQ ID NO: 45492

SEQ ID NO: 308530 - RNA, 64 nt, Homo Sapiens; identical to SEQ ID NO: 45493

SEQ ID NO: 308531 - RNA, 64 nt, Homo Sapiens; identical to SEQ ID NO: 45494

SEQ ID NO: 308532 - RNA, 64 nt, Homo Sapiens; identical to SEQ ID NO: 45495

SEQ ID NO: 308533 - RNA, 64 nt, Homo Sapiens; identical to SEQ ID NO: 45496

SEQ ID NO: 308534 - RNA, 64 nt, Homo Sapiens; identical to SEQ ID NO: 45497

SEQ ID NO: 308535 - RNA, 64 nt, Homo Sapiens; identical to SEQ ID NO: 45498

SEQ ID NO: 308536 - RNA, 64 nt, Homo Sapiens; identical to SEQ ID NO: 45499

SEQ ID NO: 308537 - RNA, 64 nt, Homo Sapiens; identical to SEQ ID NO: 45500

SEQ ID NO: 308538 - RNA, 64 nt, Homo Sapiens; identical to SEQ ID NO: 45501

SEQ ID NO: 308539 - RNA, 64 nt, Homo Sapiens; identical to SEQ ID NO: 45502

SEQ ID NO: 308540 - RNA, 64 nt, Homo Sapiens; identical to SEQ ID NO: 45503

SEQ ID NO: 308541 - RNA, 64 nt, Homo Sapiens; identical to SEQ ID NO: 45504

SEQ ID NO: 308542 - RNA, 64 nt, Homo Sapiens; identical to SEQ ID NO: 45505

SEQ ID NO: 308543 - RNA, 64 nt, Homo Sapiens; identical to SEQ ID NO: 45506

SEQ ID NO: 308544 - RNA, 64 nt, Homo Sapiens; identical to SEQ ID NO: 45507

SEQ ID NO: 308545 - RNA, 64 nt, Homo Sapiens; identical to SEQ ID NO: 45508

SEQ ID NO: 308546 - RNA, 64 nt, Homo Sapiens; identical to SEQ ID NO: 45509

SEQ ID NO: 308547 - RNA, 64 nt, Homo Sapiens; identical to SEQ ID NO: 45510

SEQ ID NO: 308548 - RNA, 64 nt, Homo Sapiens; identical to SEQ ID NO: 45511

SEQ ID NO: 308549 - RNA, 64 nt, Homo Sapiens; identical to SEQ ID NO: 45512

SEQ ID NO: 308550 - RNA, 64 nt, Homo Sapiens; identical to SEQ ID NO: 45513

SEQ ID NO: 308551 - RNA, 64 nt, Homo Sapiens; identical to SEQ ID NO: 45514

SEQ ID NO: 308552 - RNA, 64 nt, Homo Sapiens; identical to SEQ ID NO: 45515

SEQ ID NO: 308553 - RNA, 64 nt, Homo Sapiens; identical to SEQ ID NO: 45516

SEQ ID NO: 308554 - RNA, 64 nt, Homo Sapiens; identical to SEQ ID NO: 45517

SEQ ID NO: 308555 - RNA, 64 nt, Homo Sapiens; identical to SEQ ID NO: 45518

SEQ ID NO: 308556 - RNA, 64 nt, Homo Sapiens; identical to SEQ ID NO: 45519

SEQ ID NO: 308557 - RNA, 64 nt, Homo Sapiens; identical to SEQ ID NO: 45520

SEQ ID NO: 308558 - RNA, 64 nt, Homo Sapiens; identical to SEQ ID NO: 45521

SEQ ID NO: 308559 - RNA, 64 nt, Homo Sapiens; identical to SEQ ID NO: 45522

SEQ ID NO: 308560 - RNA, 64 nt, Homo Sapiens; identical to SEQ ID NO: 45523

SEQ ID NO: 308561 - RNA, 64 nt, Homo Sapiens; identical to SEQ ID NO: 45524

SEQ ID NO: 308562 - RNA, 64 nt, Homo Sapiens; identical to SEQ ID NO: 45525

SEQ ID NO: 308563 - RNA, 64 nt, Homo Sapiens; identical to SEQ ID NO: 45526

SEQ ID NO: 308564 - RNA, 64 nt, Homo Sapiens; identical to SEQ ID NO: 45527

SEQ ID NO: 308565 - RNA, 64 nt, Homo Sapiens; identical to SEQ ID NO: 45528

SEQ ID NO: 308566 - RNA, 64 nt, Homo Sapiens; identical to SEQ ID NO: 45529

SEQ ID NO: 308567 - RNA, 64 nt, Homo Sapiens; identical to SEQ ID NO: 45530

SEQ ID NO: 308568 - RNA, 64 nt, Homo Sapiens; identical to SEQ ID NO: 45531

SEQ ID NO: 308569 - RNA, 64 nt, Homo Sapiens; identical to SEQ ID NO: 45532

SEQ ID NO: 308570 - RNA, 64 nt, Homo Sapiens; identical to SEQ ID NO: 45533

SEQ ID NO: 308571 - RNA, 64 nt, Homo Sapiens; identical to SEQ ID NO: 45534

SEQ ID NO: 308572 - RNA, 64 nt, Homo Sapiens; identical to SEQ ID NO: 45535

SEQ ID NO: 308573 - RNA, 64 nt, Homo Sapiens; identical to SEQ ID NO: 45536

SEQ ID NO: 308574 - RNA, 64 nt, Homo Sapiens; identical to SEQ ID NO: 45537

SEQ ID NO: 308575 - RNA, 64 nt, Homo Sapiens; identical to SEQ ID NO: 45538

SEQ ID NO: 308576 - RNA, 64 nt, Homo Sapiens; identical to SEQ ID NO: 45539

SEQ ID NO: 308577 - RNA, 64 nt, Homo Sapiens; identical to SEQ ID NO: 45540

SEQ ID NO: 308578 - RNA, 64 nt, Homo Sapiens; identical to SEQ ID NO: 45541

SEQ ID NO: 308579 - RNA, 64 nt, Homo Sapiens; identical to SEQ ID NO: 45542

SEQ ID NO: 308580 - RNA, 64 nt, Homo Sapiens; identical to SEQ ID NO: 45543

SEQ ID NO: 308581 - RNA, 64 nt, Homo Sapiens; identical to SEQ ID NO: 45544

SEQ ID NO: 308582 - RNA, 64 nt, Homo Sapiens; identical to SEQ ID NO: 45545

SEQ ID NO: 308583 - RNA, 64 nt, Homo Sapiens; identical to SEQ ID NO: 45546

SEQ ID NO: 308584 - RNA, 64 nt, Homo Sapiens; identical to SEQ ID NO: 45547

SEQ ID NO: 308585 - RNA, 64 nt, Homo Sapiens; identical to SEQ ID NO: 45548

SEQ ID NO: 308586 - RNA, 64 nt, Homo Sapiens; identical to SEQ ID NO: 45549

SEQ ID NO: 308587 - RNA, 64 nt, Homo Sapiens; identical to SEQ ID NO: 45550

SEQ ID NO: 308588 - RNA, 64 nt, Homo Sapiens; identical to SEQ ID NO: 45551

SEQ ID NO: 308589 - RNA, 64 nt, Homo Sapiens; identical to SEQ ID NO: 45552

SEQ ID NO: 308590 - RNA, 64 nt, Homo Sapiens; identical to SEQ ID NO: 45553

SEQ ID NO: 308591 - RNA, 64 nt, Homo Sapiens; identical to SEQ ID NO: 45554

SEQ ID NO: 308592 - RNA, 64 nt, Homo Sapiens; identical to SEQ ID NO: 45555

SEQ ID NO: 308593 - RNA, 64 nt, Homo Sapiens; identical to SEQ ID NO: 45556

SEQ ID NO: 308594 - RNA, 64 nt, Homo Sapiens; identical to SEQ ID NO: 45557

SEQ ID NO: 308595 - RNA, 64 nt, Homo Sapiens; identical to SEQ ID NO: 45558

SEQ ID NO: 308596 - RNA, 64 nt, Homo Sapiens; identical to SEQ ID NO: 45559

SEQ ID NO: 308597 - RNA, 64 nt, Homo Sapiens; identical to SEQ ID NO: 45560

SEQ ID NO: 308598 - RNA, 64 nt, Homo Sapiens; identical to SEQ ID NO: 45561

SEQ ID NO: 308599 - RNA, 64 nt, Homo Sapiens; identical to SEQ ID NO: 45562

SEQ ID NO: 308600 - RNA, 64 nt, Homo Sapiens; identical to SEQ ID NO: 45563

SEQ ID NO: 308601 - RNA, 64 nt, Homo Sapiens; identical to SEQ ID NO: 45564

SEQ ID NO: 308602 - RNA, 64 nt, Homo Sapiens; identical to SEQ ID NO: 45565

SEQ ID NO: 308603 - RNA, 64 nt, Homo Sapiens; identical to SEQ ID NO: 45566

SEQ ID NO: 308604 - RNA, 64 nt, Homo Sapiens; identical to SEQ ID NO: 45567

SEQ ID NO: 308605 - RNA, 64 nt, Homo Sapiens; identical to SEQ ID NO: 45568

SEQ ID NO: 308606 - RNA, 64 nt, Homo Sapiens; identical to SEQ ID NO: 45569

SEQ ID NO: 308607 - RNA, 64 nt, Homo Sapiens; identical to SEQ ID NO: 45570

SEQ ID NO: 308608 - RNA, 64 nt, Homo Sapiens; identical to SEQ ID NO: 45571

SEQ ID NO: 308609 - RNA, 64 nt, Homo Sapiens; identical to SEQ ID NO: 45572

SEQ ID NO: 308610 - RNA, 64 nt, Homo Sapiens; identical to SEQ ID NO: 45573

SEQ ID NO: 308611 - RNA, 64 nt, Homo Sapiens; identical to SEQ ID NO: 45574

SEQ ID NO: 308612 - RNA, 64 nt, Homo Sapiens; identical to SEQ ID NO: 45575

SEQ ID NO: 308613 - RNA, 64 nt, Homo Sapiens; identical to SEQ ID NO: 45576

SEQ ID NO: 308614 - RNA, 64 nt, Homo Sapiens; identical to SEQ ID NO: 45577

SEQ ID NO: 308615 - RNA, 64 nt, Homo Sapiens; identical to SEQ ID NO: 45578

SEQ ID NO: 308616 - RNA, 64 nt, Homo Sapiens; identical to SEQ ID NO: 45579

SEQ ID NO: 308617 - RNA, 64 nt, Homo Sapiens; identical to SEQ ID NO: 45580

SEQ ID NO: 308618 - RNA, 64 nt, Homo Sapiens; identical to SEQ ID NO: 45581

SEQ ID NO: 308619 - RNA, 64 nt, Homo Sapiens; identical to SEQ ID NO: 45582

SEQ ID NO: 308620 - RNA, 64 nt, Homo Sapiens; identical to SEQ ID NO: 45583

SEQ ID NO: 308621 - RNA, 64 nt, Homo Sapiens; identical to SEQ ID NO: 45584

SEQ ID NO: 308622 - RNA, 64 nt, Homo Sapiens; identical to SEQ ID NO: 45585

SEQ ID NO: 308623 - RNA, 64 nt, Homo Sapiens; identical to SEQ ID NO: 45586

SEQ ID NO: 308624 - RNA, 64 nt, Homo Sapiens; identical to SEQ ID NO: 45587

SEQ ID NO: 308625 - RNA, 64 nt, Homo Sapiens; identical to SEQ ID NO: 45588

SEQ ID NO: 308626 - RNA, 64 nt, Homo Sapiens; identical to SEQ ID NO: 45589

SEQ ID NO: 308627 - RNA, 64 nt, Homo Sapiens; identical to SEQ ID NO: 45590

SEQ ID NO: 308628 - RNA, 64 nt, Homo Sapiens; identical to SEQ ID NO: 45591

SEQ ID NO: 308629 - RNA, 64 nt, Homo Sapiens; identical to SEQ ID NO: 45592

SEQ ID NO: 308630 - RNA, 64 nt, Homo Sapiens; identical to SEQ ID NO: 45593

SEQ ID NO: 308631 - RNA, 64 nt, Homo Sapiens; identical to SEQ ID NO: 45594

SEQ ID NO: 308632 - RNA, 64 nt, Homo Sapiens; identical to SEQ ID NO: 45595

SEQ ID NO: 308633 - RNA, 64 nt, Homo Sapiens; identical to SEQ ID NO: 45596

SEQ ID NO: 308634 - RNA, 64 nt, Homo Sapiens; identical to SEQ ID NO: 45597

SEQ ID NO: 308635 - RNA, 64 nt, Homo Sapiens; identical to SEQ ID NO: 45598

SEQ ID NO: 308636 - RNA, 64 nt, Homo Sapiens; identical to SEQ ID NO: 45599

SEQ ID NO: 308637 - RNA, 64 nt, Homo Sapiens; identical to SEQ ID NO: 45600

SEQ ID NO: 308638 - RNA, 64 nt, Homo Sapiens; identical to SEQ ID NO: 45601

SEQ ID NO: 308639 - RNA, 64 nt, Homo Sapiens; identical to SEQ ID NO: 45602

SEQ ID NO: 308640 - RNA, 64 nt, Homo Sapiens; identical to SEQ ID NO: 45603

SEQ ID NO: 308641 - RNA, 64 nt, Homo Sapiens; identical to SEQ ID NO: 45604

SEQ ID NO: 308642 - RNA, 64 nt, Homo Sapiens; identical to SEQ ID NO: 45605

SEQ ID NO: 308643 - RNA, 64 nt, Homo Sapiens; identical to SEQ ID NO: 45606

SEQ ID NO: 308644 - RNA, 64 nt, Homo Sapiens; identical to SEQ ID NO: 45607

SEQ ID NO: 308645 - RNA, 64 nt, Homo Sapiens; identical to SEQ ID NO: 45608

SEQ ID NO: 308646 - RNA, 64 nt, Homo Sapiens; identical to SEQ ID NO: 45609

SEQ ID NO: 308647 - RNA, 64 nt, Homo Sapiens; identical to SEQ ID NO: 45610

SEQ ID NO: 308648 - RNA, 64 nt, Homo Sapiens; identical to SEQ ID NO: 45611

SEQ ID NO: 308649 - RNA, 64 nt, Homo Sapiens; identical to SEQ ID NO: 45612

SEQ ID NO: 308650 - RNA, 64 nt, Homo Sapiens; identical to SEQ ID NO: 45613

SEQ ID NO: 308651 - RNA, 64 nt, Homo Sapiens; identical to SEQ ID NO: 45614

SEQ ID NO: 308652 - RNA, 64 nt, Homo Sapiens; identical to SEQ ID NO: 45615

SEQ ID NO: 308653 - RNA, 64 nt, Homo Sapiens; identical to SEQ ID NO: 45616

SEQ ID NO: 308654 - RNA, 64 nt, Homo Sapiens; identical to SEQ ID NO: 45617

SEQ ID NO: 308655 - RNA, 64 nt, Homo Sapiens; identical to SEQ ID NO: 45618

SEQ ID NO: 308656 - RNA, 64 nt, Homo Sapiens; identical to SEQ ID NO: 45619

SEQ ID NO: 308657 - RNA, 64 nt, Homo Sapiens; identical to SEQ ID NO: 45620

SEQ ID NO: 308658 - RNA, 64 nt, Homo Sapiens; identical to SEQ ID NO: 45621

SEQ ID NO: 308659 - RNA, 64 nt, Homo Sapiens; identical to SEQ ID NO: 45622

SEQ ID NO: 308660 - RNA, 64 nt, Homo Sapiens; identical to SEQ ID NO: 45623

SEQ ID NO: 308661 - RNA, 64 nt, Homo Sapiens; identical to SEQ ID NO: 45624

SEQ ID NO: 308662 - RNA, 64 nt, Homo Sapiens; identical to SEQ ID NO: 45625

SEQ ID NO: 308663 - RNA, 64 nt, Homo Sapiens; identical to SEQ ID NO: 45626

SEQ ID NO: 308664 - RNA, 64 nt, Homo Sapiens; identical to SEQ ID NO: 45627

SEQ ID NO: 308665 - RNA, 64 nt, Homo Sapiens; identical to SEQ ID NO: 45628

SEQ ID NO: 308666 - RNA, 64 nt, Homo Sapiens; identical to SEQ ID NO: 45629

SEQ ID NO: 308667 - RNA, 64 nt, Homo Sapiens; identical to SEQ ID NO: 45630

SEQ ID NO: 308668 - RNA, 64 nt, Homo Sapiens; identical to SEQ ID NO: 45631

SEQ ID NO: 308669 - RNA, 64 nt, Homo Sapiens; identical to SEQ ID NO: 45632

SEQ ID NO: 308670 - RNA, 64 nt, Homo Sapiens; identical to SEQ ID NO: 45633

SEQ ID NO: 308671 - RNA, 64 nt, Homo Sapiens; identical to SEQ ID NO: 45634

SEQ ID NO: 308672 - RNA, 64 nt, Homo Sapiens; identical to SEQ ID NO: 45635

SEQ ID NO: 308673 - RNA, 64 nt, Homo Sapiens; identical to SEQ ID NO: 45636

SEQ ID NO: 308674 - RNA, 64 nt, Homo Sapiens; identical to SEQ ID NO: 45637

SEQ ID NO: 308675 - RNA, 64 nt, Homo Sapiens; identical to SEQ ID NO: 45638

SEQ ID NO: 308676 - RNA, 64 nt, Homo Sapiens; identical to SEQ ID NO: 45639

SEQ ID NO: 308677 - RNA, 64 nt, Homo Sapiens; identical to SEQ ID NO: 45640

SEQ ID NO: 308678 - RNA, 64 nt, Homo Sapiens; identical to SEQ ID NO: 45641

SEQ ID NO: 308679 - RNA, 64 nt, Homo Sapiens; identical to SEQ ID NO: 45642

SEQ ID NO: 308680 - RNA, 64 nt, Homo Sapiens; identical to SEQ ID NO: 45643

SEQ ID NO: 308681 - RNA, 64 nt, Homo Sapiens; identical to SEQ ID NO: 45644

SEQ ID NO: 308682 - RNA, 64 nt, Homo Sapiens; identical to SEQ ID NO: 45645

SEQ ID NO: 308683 - RNA, 64 nt, Homo Sapiens; identical to SEQ ID NO: 45646

SEQ ID NO: 308684 - RNA, 64 nt, Homo Sapiens; identical to SEQ ID NO: 45647

SEQ ID NO: 308685 - RNA, 64 nt, Homo Sapiens; identical to SEQ ID NO: 45648

SEQ ID NO: 308686 - RNA, 64 nt, Homo Sapiens; identical to SEQ ID NO: 45649

SEQ ID NO: 308687 - RNA, 64 nt, Homo Sapiens; identical to SEQ ID NO: 45650

SEQ ID NO: 308688 - RNA, 64 nt, Homo Sapiens; identical to SEQ ID NO: 45651

SEQ ID NO: 308689 - RNA, 64 nt, Homo Sapiens; identical to SEQ ID NO: 45652

SEQ ID NO: 308690 - RNA, 64 nt, Homo Sapiens; identical to SEQ ID NO: 45653

SEQ ID NO: 308691 - RNA, 64 nt, Homo Sapiens; identical to SEQ ID NO: 45654

SEQ ID NO: 308692 - RNA, 64 nt, Homo Sapiens; identical to SEQ ID NO: 45655

SEQ ID NO: 308693 - RNA, 64 nt, Homo Sapiens; identical to SEQ ID NO: 96939

SEQ ID NO: 308694 - RNA, 64 nt, Homo Sapiens; identical to SEQ ID NO: 96940

SEQ ID NO: 308695 - RNA, 64 nt, Homo Sapiens; identical to SEQ ID NO: 96941

SEQ ID NO: 308696 - RNA, 64 nt, Homo Sapiens; identical to SEQ ID NO: 96942

SEQ ID NO: 308697 - RNA, 64 nt, Homo Sapiens; identical to SEQ ID NO: 96943

SEQ ID NO: 308698 - RNA, 64 nt, Homo Sapiens; identical to SEQ ID NO: 96944

SEQ ID NO: 308699 - RNA, 64 nt, Homo Sapiens; identical to SEQ ID NO: 96945

SEQ ID NO: 308700 - RNA, 64 nt, Homo Sapiens; identical to SEQ ID NO: 96946

SEQ ID NO: 308701 - RNA, 64 nt, Homo Sapiens; identical to SEQ ID NO: 96947

SEQ ID NO: 308702 - RNA, 64 nt, Homo Sapiens; identical to SEQ ID NO: 96948

SEQ ID NO: 308703 - RNA, 64 nt, Homo Sapiens; identical to SEQ ID NO: 96949

SEQ ID NO: 308704 - RNA, 64 nt, Homo Sapiens; identical to SEQ ID NO: 96950

SEQ ID NO: 308705 - RNA, 64 nt, Homo Sapiens; identical to SEQ ID NO: 96951

SEQ ID NO: 308706 - RNA, 64 nt, Homo Sapiens; identical to SEQ ID NO: 96952

SEQ ID NO: 308707 - RNA, 64 nt, Homo Sapiens; identical to SEQ ID NO: 96953

SEQ ID NO: 308708 - RNA, 64 nt, Homo Sapiens; identical to SEQ ID NO: 96954

SEQ ID NO: 308709 - RNA, 64 nt, Homo Sapiens; identical to SEQ ID NO: 96955

SEQ ID NO: 308710 - RNA, 64 nt, Homo Sapiens; identical to SEQ ID NO: 96956

SEQ ID NO: 308711 - RNA, 64 nt, Homo Sapiens; identical to SEQ ID NO: 96957

SEQ ID NO: 308712 - RNA, 62 nt, Homo Sapiens; identical to SEQ ID NO: 96958

SEQ ID NO: 308713 - RNA, 64 nt, Homo Sapiens; identical to SEQ ID NO: 96959

SEQ ID NO: 308714 - RNA, 64 nt, Homo Sapiens; identical to SEQ ID NO: 96960

SEQ ID NO: 308715 - RNA, 64 nt, Homo Sapiens; identical to SEQ ID NO: 96961

SEQ ID NO: 308716 - RNA, 64 nt, Homo Sapiens; identical to SEQ ID NO: 96962

SEQ ID NO: 308717 - RNA, 64 nt, Homo Sapiens; identical to SEQ ID NO: 96963

SEQ ID NO: 308718 - RNA, 64 nt, Homo Sapiens; identical to SEQ ID NO: 96964

SEQ ID NO: 308719 - RNA, 64 nt, Homo Sapiens; identical to SEQ ID NO: 96965

SEQ ID NO: 308720 - RNA, 64 nt, Homo Sapiens; identical to SEQ ID NO: 96966

SEQ ID NO: 308721 - RNA, 64 nt, Homo Sapiens; identical to SEQ ID NO: 96967

SEQ ID NO: 308722 - RNA, 64 nt, Homo Sapiens; identical to SEQ ID NO: 96968

SEQ ID NO: 308723 - RNA, 64 nt, Homo Sapiens; identical to SEQ ID NO: 96969

SEQ ID NO: 308724 - RNA, 64 nt, Homo Sapiens; identical to SEQ ID NO: 96970

SEQ ID NO: 308725 - RNA, 64 nt, Homo Sapiens; identical to SEQ ID NO: 96971

SEQ ID NO: 308726 - RNA, 64 nt, Homo Sapiens; identical to SEQ ID NO: 96972

SEQ ID NO: 308727 - RNA, 64 nt, Homo Sapiens; identical to SEQ ID NO: 96973

SEQ ID NO: 308728 - RNA, 64 nt, Homo Sapiens; identical to SEQ ID NO: 96974

SEQ ID NO: 308729 - RNA, 64 nt, Homo Sapiens; identical to SEQ ID NO: 96975

SEQ ID NO: 308730 - RNA, 64 nt, Homo Sapiens; identical to SEQ ID NO: 96976

SEQ ID NO: 308731 - RNA, 64 nt, Homo Sapiens; identical to SEQ ID NO: 96977

SEQ ID NO: 308732 - RNA, 64 nt, Homo Sapiens; identical to SEQ ID NO: 96978

SEQ ID NO: 308733 - RNA, 64 nt, Homo Sapiens; identical to SEQ ID NO: 96979

SEQ ID NO: 308734 - RNA, 64 nt, Homo Sapiens; identical to SEQ ID NO: 96980

SEQ ID NO: 308735 - RNA, 64 nt, Homo Sapiens; identical to SEQ ID NO: 96981

SEQ ID NO: 308736 - RNA, 64 nt, Homo Sapiens; identical to SEQ ID NO: 96982

SEQ ID NO: 308737 - RNA, 64 nt, Homo Sapiens; identical to SEQ ID NO: 96983

SEQ ID NO: 308738 - RNA, 64 nt, Homo Sapiens; identical to SEQ ID NO: 96984

SEQ ID NO: 308739 - RNA, 64 nt, Homo Sapiens; identical to SEQ ID NO: 96985

SEQ ID NO: 308740 - RNA, 64 nt, Homo Sapiens; identical to SEQ ID NO: 96986

SEQ ID NO: 308741 - RNA, 64 nt, Homo Sapiens; identical to SEQ ID NO: 96987

SEQ ID NO: 308742 - RNA, 64 nt, Homo Sapiens; identical to SEQ ID NO: 96988

SEQ ID NO: 308743 - RNA, 64 nt, Homo Sapiens; identical to SEQ ID NO: 96989

SEQ ID NO: 308744 - RNA, 64 nt, Homo Sapiens; identical to SEQ ID NO: 96990

SEQ ID NO: 308745 - RNA, 64 nt, Homo Sapiens; identical to SEQ ID NO: 96991

SEQ ID NO: 308746 - RNA, 64 nt, Homo Sapiens; identical to SEQ ID NO: 96992

SEQ ID NO: 308747 - RNA, 64 nt, Homo Sapiens; identical to SEQ ID NO: 96993

SEQ ID NO: 308748 - RNA, 64 nt, Homo Sapiens; identical to SEQ ID NO: 96994

SEQ ID NO: 308749 - RNA, 64 nt, Homo Sapiens; identical to SEQ ID NO: 96995

SEQ ID NO: 308750 - RNA, 64 nt, Homo Sapiens; identical to SEQ ID NO: 96996

SEQ ID NO: 308751 - RNA, 64 nt, Homo Sapiens; identical to SEQ ID NO: 96997

SEQ ID NO: 308752 - RNA, 64 nt, Homo Sapiens; identical to SEQ ID NO: 96998

SEQ ID NO: 308753 - RNA, 64 nt, Homo Sapiens; identical to SEQ ID NO: 96999

SEQ ID NO: 308754 - RNA, 64 nt, Homo Sapiens; identical to SEQ ID NO: 97000

SEQ ID NO: 308755 - RNA, 64 nt, Homo Sapiens; identical to SEQ ID NO: 97001

SEQ ID NO: 308756 - RNA, 64 nt, Homo Sapiens; identical to SEQ ID NO: 97002

SEQ ID NO: 308757 - RNA, 64 nt, Homo Sapiens; identical to SEQ ID NO: 97003

SEQ ID NO: 308758 - RNA, 64 nt, Homo Sapiens; identical to SEQ ID NO: 97004

SEQ ID NO: 308759 - RNA, 64 nt, Homo Sapiens; identical to SEQ ID NO: 97005

SEQ ID NO: 308760 - RNA, 64 nt, Homo Sapiens; identical to SEQ ID NO: 97006

SEQ ID NO: 308761 - RNA, 64 nt, Homo Sapiens; identical to SEQ ID NO: 97007

SEQ ID NO: 308762 - RNA, 64 nt, Homo Sapiens; identical to SEQ ID NO: 97008

SEQ ID NO: 308763 - RNA, 64 nt, Homo Sapiens; identical to SEQ ID NO: 97009

SEQ ID NO: 308764 - RNA, 64 nt, Homo Sapiens; identical to SEQ ID NO: 97010

SEQ ID NO: 308765 - RNA, 64 nt, Homo Sapiens; identical to SEQ ID NO: 97011

SEQ ID NO: 308766 - RNA, 64 nt, Homo Sapiens; identical to SEQ ID NO: 97012

SEQ ID NO: 308767 - RNA, 64 nt, Homo Sapiens; identical to SEQ ID NO: 97013

SEQ ID NO: 308768 - RNA, 64 nt, Homo Sapiens; identical to SEQ ID NO: 97014

SEQ ID NO: 308769 - RNA, 64 nt, Homo Sapiens; identical to SEQ ID NO: 97015

SEQ ID NO: 308770 - RNA, 64 nt, Homo Sapiens; identical to SEQ ID NO: 97016

SEQ ID NO: 308771 - RNA, 64 nt, Homo Sapiens; identical to SEQ ID NO: 97017

SEQ ID NO: 308772 - RNA, 64 nt, Homo Sapiens; identical to SEQ ID NO: 106495

SEQ ID NO: 308773 - RNA, 64 nt, Homo Sapiens; identical to SEQ ID NO: 106496

SEQ ID NO: 308774 - RNA, 64 nt, Homo Sapiens; identical to SEQ ID NO: 106497

SEQ ID NO: 308775 - RNA, 64 nt, Homo Sapiens; identical to SEQ ID NO: 106498

SEQ ID NO: 308776 - RNA, 64 nt, Homo Sapiens; identical to SEQ ID NO: 106499

SEQ ID NO: 308777 - RNA, 64 nt, Homo Sapiens; identical to SEQ ID NO: 106500

SEQ ID NO: 308778 - RNA, 64 nt, Homo Sapiens; identical to SEQ ID NO: 106501

SEQ ID NO: 308779 - RNA, 64 nt, Homo Sapiens; identical to SEQ ID NO: 106502

SEQ ID NO: 308780 - RNA, 64 nt, Homo Sapiens; identical to SEQ ID NO: 106503

SEQ ID NO: 308781 - RNA, 64 nt, Homo Sapiens; identical to SEQ ID NO: 106504

SEQ ID NO: 308782 - RNA, 64 nt, Homo Sapiens; identical to SEQ ID NO: 106505

SEQ ID NO: 308783 - RNA, 64 nt, Homo Sapiens; identical to SEQ ID NO: 106506

SEQ ID NO: 308784 - RNA, 61 nt, Homo Sapiens
uaggagagauaucauuaucgcuguuuuauaaauaagggaaacuuuagcuugaggguuuaag

SEQ ID NO: 308785 - RNA, 61 nt, Homo Sapiens
cugauguuuucagcauauuuucaaaauauugauaagggaaguuauuacuuuuauauaguau

SEQ ID NO: 308786 - RNA, 61 nt, Homo Sapiens
aaucaaguauuauaaacaagauauggugguaauaagggaaaaaaauacuuaaauguuaugu

SEQ ID NO: 308787 - RNA, 61 nt, Homo Sapiens
gauguuugugcaguaacuugagaguuacuugauaagggacuacuagauuugggagaagggc

SEQ ID NO: 308788 - RNA, 64 nt, Homo Sapiens; identical to SEQ ID NO: 167885

SEQ ID NO: 308789 - RNA, 64 nt, Homo Sapiens; identical to SEQ ID NO: 167886

SEQ ID NO: 308790 - RNA, 64 nt, Homo Sapiens; identical to SEQ ID NO: 167887

SEQ ID NO: 308791 - RNA, 64 nt, Homo Sapiens; identical to SEQ ID NO: 167888

SEQ ID NO: 308792 - RNA, 64 nt, Homo Sapiens; identical to SEQ ID NO: 167889

SEQ ID NO: 308793 - RNA, 64 nt, Homo Sapiens; identical to SEQ ID NO: 167890

SEQ ID NO: 308794 - RNA, 64 nt, Homo Sapiens; identical to SEQ ID NO: 167891

SEQ ID NO: 308795 - RNA, 64 nt, Homo Sapiens; identical to SEQ ID NO: 167892

SEQ ID NO: 308796 - RNA, 64 nt, Homo Sapiens; identical to SEQ ID NO: 167893

SEQ ID NO: 308797 - RNA, 64 nt, Homo Sapiens; identical to SEQ ID NO: 167894

SEQ ID NO: 308798 - RNA, 64 nt, Homo Sapiens; identical to SEQ ID NO: 167895

SEQ ID NO: 308799 - RNA, 64 nt, Homo Sapiens; identical to SEQ ID NO: 167896

SEQ ID NO: 308800 - RNA, 64 nt, Homo Sapiens; identical to SEQ ID NO: 167897

SEQ ID NO: 308801 - RNA, 64 nt, Homo Sapiens; identical to SEQ ID NO: 167898

SEQ ID NO: 308802 - RNA, 64 nt, Homo Sapiens; identical to SEQ ID NO: 167899

SEQ ID NO: 308803 - RNA, 64 nt, Homo Sapiens; identical to SEQ ID NO: 167900

SEQ ID NO: 308804 - RNA, 64 nt, Homo Sapiens; identical to SEQ ID NO: 167901

SEQ ID NO: 308805 - RNA, 64 nt, Homo Sapiens; identical to SEQ ID NO: 167902

SEQ ID NO: 308806 - RNA, 64 nt, Homo Sapiens; identical to SEQ ID NO: 167903

SEQ ID NO: 308807 - RNA, 64 nt, Homo Sapiens; identical to SEQ ID NO: 167904

SEQ ID NO: 308808 - RNA, 64 nt, Homo Sapiens; identical to SEQ ID NO: 167905

SEQ ID NO: 308809 - RNA, 64 nt, Homo Sapiens; identical to SEQ ID NO: 167906

SEQ ID NO: 308810 - RNA, 64 nt, Homo Sapiens; identical to SEQ ID NO: 167907

SEQ ID NO: 308811 - RNA, 64 nt, Homo Sapiens; identical to SEQ ID NO: 167908

SEQ ID NO: 308812 - RNA, 64 nt, Homo Sapiens; identical to SEQ ID NO: 167909

SEQ ID NO: 308813 - RNA, 64 nt, Homo Sapiens; identical to SEQ ID NO: 167910

SEQ ID NO: 308814 - RNA, 64 nt, Homo Sapiens; identical to SEQ ID NO: 167911

SEQ ID NO: 308815 - RNA, 64 nt, Homo Sapiens; identical to SEQ ID NO: 167912

SEQ ID NO: 308816 - RNA, 64 nt, Homo Sapiens; identical to SEQ ID NO: 167913

SEQ ID NO: 308817 - RNA, 64 nt, Homo Sapiens
ggcccccuugacacauccagcagaugucuuuacuagagcugaaaaagcuccuuggauguggaga

SEQ ID NO: 308818 - RNA, 64 nt, Homo Sapiens
acacuuguccaaggucucacgacuugaggcucugagagcugaaagccccacuuucuggaugaca

SEQ ID NO: 308819 - RNA, 64 nt, Homo Sapiens
ggggaaacuugguaacuugcucagaaugcacgccagagcugaagcaugaggaucuuccacaauu

SEQ ID NO: 308820 - RNA, 64 nt, Homo Sapiens
auuauugaggacagaaggcuuuucuuauccccugagagcugaugcguuucccauugcuguagca

SEQ ID NO: 308821 - RNA, 64 nt, Homo Sapiens
ucauuguaucuguguauccaaaguggugcuagacagagcugagggaggacauccgccucccuga

SEQ ID NO: 308822 - RNA, 64 nt, Homo Sapiens
uucuuacccuuguugcaugcugccauuuagggaaagagcugaggugacuaaccccgggucagcc

SEQ ID NO: 308823 - RNA, 64 nt, Homo Sapiens
gaaggggcuggccaugccugaguccagccuagugagagcugaguuguuuucuuacauuggguag

SEQ ID NO: 308824 - RNA, 64 nt, Homo Sapiens
uucuggauuuugacugugcacaguguacacucccagagcugauaggaugugcuucauccucuaa

SEQ ID NO: 308825 - RNA, 64 nt, Homo Sapiens
cgaaauauaagaauaauauaugcucuccccacugagagcugagcgcauugugguccgagguagc

SEQ ID NO: 308826 - RNA, 64 nt, Homo Sapiens
acuagccacauucccaaggucccaaggagaaggaagagcugaaauucaucuccuagugacagug

SEQ ID NO: 308827 - RNA, 64 nt, Homo Sapiens
gaacuuccuccagcuaugcagggauucucauuaaagagcugaucugcaucuguuuauccauuuu

SEQ ID NO: 308828 - RNA, 64 nt, Homo Sapiens
gaaaccgacugaagggacugaccagcuagcuaggagagcugagacgccaguccucaaauggcgu

SEQ ID NO: 308829 - RNA, 64 nt, Homo Sapiens
acucaucauggauugcucagaguuccuuuagggcagagcugagggccugggauccaggaaccag

SEQ ID NO: 308830 - RNA, 64 nt, Homo Sapiens
ugcauggcaucaccuccaccauacuccaucaguuagagcugacacaaaccugccuggguuuaag

SEQ ID NO: 308831 - RNA, 64 nt, Homo Sapiens
acuugaggcuuagcuuugcucugccaacuucuucagagcugacacaggaugaaggcaaugccau

SEQ ID NO: 308832 - RNA, 64 nt, Homo Sapiens
uuugugaauuauuucuggguuuguguuuugccuaagagcugaucuuauuucugauuugugugug

SEQ ID NO: 308833 - RNA, 64 nt, Homo Sapiens
gauggcucaggggcgcacuaccuauuuugucaccagagcugacucaggcuuccuggacccucaa

SEQ ID NO: 308834 - RNA, 64 nt, Homo Sapiens
ggcaagauaaaaacccugaagaaguacuuuagugagagcugacuagccaccuucucacucugug

SEQ ID NO: 308835 - RNA, 64 nt, Homo Sapiens
aaucguggccuuaacaacugaggguucaaagaugagagcugaaaaaggugaaaucuuucuuaac

SEQ ID NO: 308836 - RNA, 64 nt, Homo Sapiens
ugucccuccccugcuagucacuucggcagaauggagagcugagggagguuaugaucccugggcg

SEQ ID NO: 308837 - RNA, 64 nt, Homo Sapiens
ggccgggcacgguggcucacgugucagaaucuuaagagcugagaucaccagcuuccccaagaga

SEQ ID NO: 308838 - RNA, 64 nt, Homo Sapiens
gagaaaaggagagagcgcgugcagagacuugguggugcauaauggauauuuuuuaacuuggcga

SEQ ID NO: 308839 - RNA, 64 nt, Homo Sapiens
aguagccacgacuuuaucaggcagccccaaacuggugcauaaugcaugguacaagaaauauuua

SEQ ID NO: 308840 - RNA, 64 nt, Homo Sapiens
uagacaucuucagaaugacuaauuucuccgaguggugcauaaucuuauuuuguuugggaguaac

SEQ ID NO: 308841 - RNA, 64 nt, Homo Sapiens
ucaauccaaaggcacuuugcagugcaguccacaugugcauaaggaccauggggagcuuguauuu

SEQ ID NO: 308842 - RNA, 64 nt, Homo Sapiens
gucaguuauugcccuuuuauauugugaauguaaugugcauaagcuauauccguagauguuauug

SEQ ID NO: 308843 - RNA, 64 nt, Homo Sapiens
gaauaucaucugucauuauauucuaauuaaaauugugcauaaugcuuuggaaaaaugggucuuu

SEQ ID NO: 308844 - RNA, 64 nt, Homo Sapiens
uuggcacaaaugugcagaauagauacaucaguuggugcauaaucgaaaaaaauaggaauuuuga

SEQ ID NO: 308845 - RNA, 64 nt, Homo Sapiens
uauauuagguuuuacugccuauugagacaaccaggugcauaauugauugcccuuuggccauaaa

SEQ ID NO: 308846 - RNA, 64 nt, Homo Sapiens
cgaguagcuuguguggaugcaguccugugagggugugcauaaccguucccagguguacgcacgc

SEQ ID NO: 308847 - RNA, 64 nt, Homo Sapiens
uucuaaagcuaaaccucucaaggaaaaggacucagugcauaagaugacuuuggugaaaccccgu

SEQ ID NO: 308848 - RNA, 64 nt, Homo Sapiens
aaucuccacccaaugaaugaugaugguauaguaugugcauaauggaaaguuaccuuacugaaaa

SEQ ID NO: 308849 - RNA, 64 nt, Homo Sapiens
cccuuaaaaauauguguauacuacuuuggcucuugugcauaaaaacaagaacacugaaaauugg

SEQ ID NO: 308850 - RNA, 64 nt, Homo Sapiens
agucaugugucuuaauuuuauuuucucuauuugagugcauaauuauccuaauaaucccaaagac

SEQ ID NO: 308851 - RNA, 64 nt, Homo Sapiens
aagaacucuacagcagcccaaugaggucuccucagugcauaaggaacucacauucuaugacauc

SEQ ID NO: 308852 - RNA, 64 nt, Homo Sapiens
auucuaaaugaaagggugugcuaagguuacucgugugcauaaaauugucaugugaacuuggaaa

SEQ ID NO: 308853 - RNA, 64 nt, Homo Sapiens
ucugcucuuguguagcucagccaaaguagaagaugugcauaaugauguuaggagcugcaaggcc

SEQ ID NO: 308854 - RNA, 64 nt, Homo Sapiens
uagcuuuagcaauuaaauucuuaguuuaauagaugugcauaaggagggguuaaagucguuucuu

SEQ ID NO: 308855 - RNA, 64 nt, Homo Sapiens
acaauggucacaaggucuuuacuuaugcacauuugugcauaaauuuccacccaauuuccaagac

SEQ ID NO: 308856 - RNA, 64 nt, Homo Sapiens
guaagugagugugcugcuguaagaaaucucccaugugcauaacaaauucugaauauuuuuugag

SEQ ID NO: 308857 - RNA, 64 nt, Homo Sapiens
uuauauuucuuauagucuuaauuuuguuauccaugugcauaauuuaccucaugauuucuuuugg

SEQ ID NO: 308858 - RNA, 64 nt, Homo Sapiens
gaaaguauuggacugagauagaagucaggguauugugcauaauaaauuuggaucacuuucaauu

SEQ ID NO: 308859 - RNA, 64 nt, Homo Sapiens
gcuacagugcauaguuguagaaugcuuuuagugugugcauaauauauuuuuguacuuuaucaug

SEQ ID NO: 308860 - RNA, 64 nt, Homo Sapiens
gagagagagaauauguguguauguggauggaugugugcauaagauagcaccugcaauuguuggg

SEQ ID NO: 308861 - RNA, 64 nt, Homo Sapiens
cccuuaaauucaucuaguagauaaguucuauaaggugcauaaaacaacuaaaacuauuuuugcu

SEQ ID NO: 308862 - RNA, 64 nt, Homo Sapiens
uauuuaucuacuuuuuagguaacaaauaacaaaggugcauaauucuuagguaaucccaaaaacu

SEQ ID NO: 308863 - RNA, 53 nt, Homo Sapiens
cucaccuucuugaacauuagagagugcauaauggugauacuuguuuauaauuc

SEQ ID NO: 308864 - RNA, 64 nt, Homo Sapiens
aaacacaugccaguugggaaggucugaaaacucagugcauaauaggaacacuugagacuaauga

SEQ ID NO: 308865 - RNA, 64 nt, Homo Sapiens
gugaggcauuguguccuggaagcagcugauacgugugcauaacaacccuugucaagccuaccag

SEQ ID NO: 308866 - RNA, 64 nt, Homo Sapiens
aucacuggggaucuuguuaaucacaaacuugauugugcauaaaacagaagucugcagcggugcc

SEQ ID NO: 308867 - RNA, 64 nt, Homo Sapiens
cugggaugcugguggaggacgaucagaugaacaagugcauaagcccaggguuucugguuuggga

SEQ ID NO: 308868 - RNA, 64 nt, Homo Sapiens
aaaguuuaugauuaaauguauauggccaugcuuugugcauaaucauaacauuaaccucauuguu

SEQ ID NO: 308869 - RNA, 64 nt, Homo Sapiens
uuauaaagcauauacucacaauagauacauuucugugcauaagauuuuccaacuuucuguacua

SEQ ID NO: 308870 - RNA, 64 nt, Homo Sapiens
acaggguugaaagcuguuggagaggggaaaaguugugcauaaagaacugaaaaggguucuggag

SEQ ID NO: 308871 - RNA, 64 nt, Homo Sapiens
cuuuugacauuugacuuugcauaaaaguuuaucugugcauaauuuuauauguaguugaauucau

SEQ ID NO: 308872 - RNA, 64 nt, Homo Sapiens
aaugccacuuuucuguuccugaagaggcucuuuugugcauaauauucuaaaaugaagacauuuc

SEQ ID NO: 308873 - RNA, 64 nt, Homo Sapiens
uaacaccaaaaccucugucagaacacaaaggaaugugcauaauggagagaagacauauuuuuuu

SEQ ID NO: 308874 - RNA, 64 nt, Homo Sapiens
accaaaauuguauguacuauuuacuuuaaaagaagugcauaauuuuuauaucuaaaagcuguau

SEQ ID NO: 308875 - RNA, 64 nt, Homo Sapiens
cauuaauauccauaaacauauuuaggauuuaguagugcauaaagagauucccccuuuuccugug

SEQ ID NO: 308876 - RNA, 64 nt, Homo Sapiens
aaauuuuacugcuugaggacuuaauuauaaaauggugcauaaucugcuauguaaaugugacaua

SEQ ID NO: 308877 - RNA, 64 nt, Homo Sapiens
ugugauuucaggagauugugcagugccagcaucagugcauaaaggguccuguauguccuuuggc

SEQ ID NO: 308878 - RNA, 64 nt, Homo Sapiens
uuagagauauuuuuauauagaccccaagcauucugugcauaaaaguuaacauuaggcuguggug

SEQ ID NO: 308879 - RNA, 64 nt, Homo Sapiens
aguugauuauucuuuuuaucuauuuggagauucagugcauaacuaaguauuuuccuuaauacua

SEQ ID NO: 308880 - RNA, 64 nt, Homo Sapiens
aguacauuggaaagcugguauugauguagaaccagugcauaacuuuuuaugggguuuuguuauu

SEQ ID NO: 308881 - RNA, 64 nt, Homo Sapiens
aauguuuuaaauguaacugucauuuucaaguauagugcauaaaguuaagugguauuauauuuua

SEQ ID NO: 308882 - RNA, 64 nt, Homo Sapiens
aauacuuccgaauuaaauuacagguguaguuugugugcauaaaugguaaaaggucaugcuguua

SEQ ID NO: 308883 - RNA, 64 nt, Homo Sapiens
uucagugccucuuguaagcagauguucuagaaaugugcauaaauaagagacaucauguuggaaa

SEQ ID NO: 308884 - RNA, 64 nt, Homo Sapiens
accguuaugcauuacucugugucuacuauuaugugugcauaauuuauaccguaaauguuuacuc

SEQ ID NO: 308885 - RNA, 64 nt, Homo Sapiens
ccugggcauggagcaccuguccaacaaccgcuuugugcauaaggacuuggcugcgcguaacugc

SEQ ID NO: 308886 - RNA, 64 nt, Homo Sapiens
gcugugauaaguaaguguuuacauacacugucuagugcauaaaaaccuuaguguuugcuaucau

SEQ ID NO: 308887 - RNA, 64 nt, Homo Sapiens
aagugauaggggucacaauggggaaauugaaguggugcauaacauugccaaaauagugugccac

SEQ ID NO: 308888 - RNA, 64 nt, Homo Sapiens
aaugcccacacagugaccaacagaacuggucugcgugcauaaccagcugccacccucaggccug

SEQ ID NO: 308889 - RNA, 64 nt, Homo Sapiens
auuccauuuguuccuuuagcaagcaauaaugccagugcauaaucgguauguucuaaucuauauu

SEQ ID NO: 308890 - RNA, 64 nt, Homo Sapiens
acagaaaucugaaaaauggccaaagugucacuuggugcauaagcccauguugcuucacucuauc

SEQ ID NO: 308891 - RNA, 64 nt, Homo Sapiens
aaacuacuaaccagaggagucaguuuugaaagaggugcauaauacacacagccaugaggagccu

SEQ ID NO: 308892 - RNA, 64 nt, Homo Sapiens
uaacuaggcaguggcggugcuacucuugaaaugggugcauaauaugagggagguguaguuuuuu

SEQ ID NO: 308893 - RNA, 64 nt, Homo Sapiens
cauuaugauaaauuaagcauuugaagggaauacugugcauaagcguauuuauguguauauggag

SEQ ID NO: 308894 - RNA, 64 nt, Homo Sapiens
aacucuuuguuuuccucuccaucuacuuuucccugugcauaauauccauccaaaggacaacagu

SEQ ID NO: 308895 - RNA, 64 nt, Homo Sapiens
uuugaaagcauuaaaauaaaugauccuagagcaugugcauaaugagaggacuguauucucucug

SEQ ID NO: 308896 - RNA, 64 nt, Homo Sapiens
uacuuuuuugcuuguuucuuuaaaguuuucugacgugcauaaugcauaauucauugaaaagcau

SEQ ID NO: 308897 - RNA, 64 nt, Homo Sapiens
aggccccacuuggcuauuucgacgcaacuaguuggugcauaagaaaagggugauccagacauga

SEQ ID NO: 308898 - RNA, 64 nt, Homo Sapiens
aacuaaaugugaauauaaaaaaagucuuaaaugugugcauaaaauugcuaauguuaguguuuau

SEQ ID NO: 308899 - RNA, 64 nt, Homo Sapiens
aagagaaaagagaugccuuuauauacucugcuuggugcauaagaacacucacaagacaucagcu

SEQ ID NO: 308900 - RNA, 64 nt, Homo Sapiens
gcagggcaccccugcugggguugggggcuggucugugcauaauccuggacugugaugggaacag

SEQ ID NO: 308901 - RNA, 64 nt, Homo Sapiens
uucugcaguugcagagccagccccgcgugagaacgugcauaaugagugcacaccaucaugucaa

SEQ ID NO: 308902 - RNA, 64 nt, Homo Sapiens
gaacuaaaaaaaugggaagcccuccccaaaaaaagugcauaaaauguuauuuuugcauggcaug

SEQ ID NO: 308903 - RNA, 64 nt, Homo Sapiens
acuccuaacaacccaaagaccuauuuaacaauuggugcauaaaugaaaguaguacuguauacuu

SEQ ID NO: 308904 - RNA, 64 nt, Homo Sapiens
aagaacuguacugucuguuaugauuuccuucaaugugcauaaugauaaaauaaauaauuuuaau

SEQ ID NO: 308905 - RNA, 64 nt, Homo Sapiens
gaaaaaacugacuuuuuuucgcuuguuuugaguggugcauaaggaaaaacauuuagaggauuau

SEQ ID NO: 308906 - RNA, 64 nt, Homo Sapiens
uaaagauuauucugccuuuguguauaaauuacuggugcauaacuuguuuaaauuuuagaaaacc

SEQ ID NO: 308907 - RNA, 64 nt, Homo Sapiens
acaaucaucacugauuagaacaugaagaugucgugugcauaagcgcaaucagccuggucucucc

SEQ ID NO: 308908 - RNA, 64 nt, Homo Sapiens
uauuaugguguuuugccuaucauucuuaaauacugugcauaaauaauucuguuaucaaggccca

SEQ ID NO: 308909 - RNA, 64 nt, Homo Sapiens
ugcccuucugauucccgccucugguccuuuacaugugcauaaccacaugcacacacacucacgc

SEQ ID NO: 308910 - RNA, 64 nt, Homo Sapiens
gagcaggaggcuggaaucugccugcauuucagcagugcauaaucauuaaaaaguugaauauguu

SEQ ID NO: 308911 - RNA, 64 nt, Homo Sapiens
agaggaaaguuccagggugucagccuguccaucugugcauaaggagcccagagacaggggaagg

SEQ ID NO: 308912 - RNA, 64 nt, Homo Sapiens
ggaucccauaccaaagcccuaugaccagaguucugugcauaacaaguagcaaugucuuccucuu

SEQ ID NO: 308913 - RNA, 64 nt, Homo Sapiens
guaaugagaucuggaaacacuuuuauuugaaugugugcauaacagagcuuuugacucuguuggg

SEQ ID NO: 308914 - RNA, 64 nt, Homo Sapiens
ucuauacucuuuuugaaacugcuggcagaagggugugcauaaaucauuguuaacauuaaggaaa

SEQ ID NO: 308915 - RNA, 64 nt, Homo Sapiens
uacucggauccccaccugacgcuguuuggccaaugugcauaaccgggugagcauaccugucuca

SEQ ID NO: 308916 - RNA, 64 nt, Homo Sapiens
ccuggugcccagaacagggcauggcauauuguuggugcauaauaaauauuguggaaauaauuuc

SEQ ID NO: 308917 - RNA, 64 nt, Homo Sapiens
acaaaauguggugcagaaacuaucuugcaccugugugcauaaacuguuagucgugacugacuug

SEQ ID NO: 308918 - RNA, 64 nt, Homo Sapiens
caucucauuauuuucaggccaaggugggaguauagugcauaauaauuguacaguagcaauuuuu

SEQ ID NO: 308919 - RNA, 64 nt, Homo Sapiens
gcaaaaggaagcaucaauaguggacccagaggcagugcauaaaaccuuaggauagauuccuaag

SEQ ID NO: 308920 - RNA, 64 nt, Homo Sapiens
auaaaaggaccuugggacauaagaaccaaugauugugcauaaguucuaaauuagagacacauau

SEQ ID NO: 308921 - RNA, 64 nt, Homo Sapiens
uuuuuaaaaauauauauaucuaaaugaaugcaaugugcauaaauauuuuuuaaacauaacagug

SEQ ID NO: 308922 - RNA, 64 nt, Homo Sapiens
cuccugggaaaagaaccuuaagaaaagaaaugaagugcauaagugccauucucacacuauaaca

SEQ ID NO: 308923 - RNA, 64 nt, Homo Sapiens
auuaaauagaggugaacacauguuuguaauacgugugcauaaaaagcugugucaaaaggaagcu

SEQ ID NO: 308924 - RNA, 64 nt, Homo Sapiens
gauacaaaguuucugauuggagaauggguaguuagugcauaaugaagccacccuguggggaugg

SEQ ID NO: 308925 - RNA, 64 nt, Homo Sapiens
ccugugcuccuuaagccucacaauuugcuaacaggugcauaauccuucacaggagccuuguuuu

SEQ ID NO: 308926 - RNA, 64 nt, Homo Sapiens
ucauucuguaggaucuuaagacuuguuuuugugugugcauaaauuuuugaauguuuuguauuau

SEQ ID NO: 308927 - RNA, 64 nt, Homo Sapiens
aguuuuuuuuuuuccauaaggcaaugccagugaugugcauaaacgccuucuuuuucagcuugug

SEQ ID NO: 308928 - RNA, 64 nt, Homo Sapiens
auggcaugaaguaaaaggggcuugggacucuuaagugcauaaugauuugggaacauuugacuuc

SEQ ID NO: 308929 - RNA, 64 nt, Homo Sapiens
gcugcugcacacuucucggucuaggugggagagagugcauaaagguucuggggcugggccugag

SEQ ID NO: 308930 - RNA, 64 nt, Homo Sapiens
ugggauccaguguauaaauccaauaucaugucuugugcauaauucuuccaaaggaucuuauuuu

SEQ ID NO: 308931 - RNA, 64 nt, Homo Sapiens
uuuauuuuacagaauuuaccuucucuguauauaugugcauaaagugugguguaaauauacuaaa

SEQ ID NO: 308932 - RNA, 64 nt, Homo Sapiens
gcaagccccauauaaugaagauuuuaacucauuagugcauaaaggcuaguguuuuauccuaugu

SEQ ID NO: 308933 - RNA, 64 nt, Homo Sapiens
auuuuuucccaggaaaagauuagaccgaagccuugugcauaaggggugggagaagaggggcugg

SEQ ID NO: 308934 - RNA, 64 nt, Homo Sapiens
ccacauauguauaacuaugugaaaaauuauauuugugcauaauaaaaugugauaacuuuuuaca

SEQ ID NO: 308935 - RNA, 64 nt, Homo Sapiens
uaguaaagaugagaaagaugguugaagaaaauuagugcauaauuucucagugaauaaaguugua

SEQ ID NO: 308936 - RNA, 64 nt, Homo Sapiens
gauaaugaaguugcaaguuuugauagcccgugaagugcauaaguaucuaauuuuaccugaauug

SEQ ID NO: 308937 - RNA, 64 nt, Homo Sapiens
auguaugaggaugaucacugaaauauuuaugacagugcauaauuugcaaaauaaaaaauguaca

SEQ ID NO: 308938 - RNA, 64 nt, Homo Sapiens
aguuuuuuuuguuuuuguuugagccuuuuucacagugcauaagcggggccccugguucgucccu

SEQ ID NO: 308939 - RNA, 64 nt, Homo Sapiens
uaguuuguaguaucaauguguucuuuggcuaccugugcauaauggcauuugaauugugauagau

SEQ ID NO: 308940 - RNA, 64 nt, Homo Sapiens
uucaaacuuugagugacauuuggguugauaccaagugcauaagaaaguuaaacugagcagcauu

SEQ ID NO: 308941 - RNA, 64 nt, Homo Sapiens
uagaaacuucuaagugcacuauuagggcaauggagugcauaaauggaaaauguauagcuuuuug

SEQ ID NO: 308942 - RNA, 64 nt, Homo Sapiens
uccuaauuuaugcuugucagucugaaugugucaggugcauaauaaugggaaagaaaauggacau

SEQ ID NO: 308943 - RNA, 64 nt, Homo Sapiens
uuugaauuauuuuguucuugccagaguuacuucagugcauaaagucucccggcacuucuaccuu

SEQ ID NO: 308944 - RNA, 64 nt, Homo Sapiens
caccuaguaugcucaguaaauguuuguggaauaagugcauaaaauguucuuaaccuuugauucu

SEQ ID NO: 308945 - RNA, 64 nt, Homo Sapiens
uuacuuuugugaauuccuuagccuuucuuccuuggugcauaaaguuaaaaugcacaucagcaga

SEQ ID NO: 308946 - RNA, 64 nt, Homo Sapiens
aauaguaauuuagaaguauccucuuaagauuuaagugcauaaaguucuagguuagucaagauuu

SEQ ID NO: 308947 - RNA, 64 nt, Homo Sapiens
aaucacuguguacaaacugggaaacccuuucggcgugcauaagguauauaaugucauuuuuacg

SEQ ID NO: 308948 - RNA, 64 nt, Homo Sapiens
acuuggaaaauccaaauaaggaaguuuuagguuggugcauaacuuuguuucucaaauuuucguu

SEQ ID NO: 308949 - RNA, 64 nt, Homo Sapiens
gaaacacgagaagcagcaaagacagagcacacaagugcauaaggcuguugucuucggcuugggu

SEQ ID NO: 308950 - RNA, 64 nt, Homo Sapiens
ucuuaaugucaaccaucuuugucauuauuucagugugcauaaguaucuuucuuggauccuuuug

SEQ ID NO: 308951 - RNA, 64 nt, Homo Sapiens
cucuugcacucaaagcuuguuaagauaguuaagcgugcauaaguuaacuuccaauuuacauacu

SEQ ID NO: 308952 - RNA, 64 nt, Homo Sapiens
aacacuaauauuuaucaucugcuagaauucauaugugcauaaauuaauuucuguuacuggcuuu

SEQ ID NO: 308953 - RNA, 64 nt, Homo Sapiens
uaccucugugucugaaguauaugacauggguagugugcauaaaguuuuuaaaauauucugugug

SEQ ID NO: 308954 - RNA, 64 nt, Homo Sapiens
uaaauuuccaguucaacuuguaaauguuuuuauugugcauaaauacauacuaauguugaucuaa

SEQ ID NO: 308955 - RNA, 64 nt, Homo Sapiens
ugucaacuguuucauugcuuuuuaaauuuuucacgugcauaacccccuuuagaaguaaauuuuu

SEQ ID NO: 308956 - RNA, 64 nt, Homo Sapiens
uacaaaucagagcugaguggaaaauaugcaucaagugcauaaauuggaaagagccugauuuucu

SEQ ID NO: 308957 - RNA, 64 nt, Homo Sapiens
augcaauaggugucauauguggaaugcaagacuagugcauaaaaaagacgaggaaguaaggaag

SEQ ID NO: 308958 - RNA, 64 nt, Homo Sapiens
caaguuuuaaaaaaaugacaggguuuaauggagcgugcauaaaaauguacuguuuucaccuuuu

SEQ ID NO: 308959 - RNA, 64 nt, Homo Sapiens
aaggcugauagcugguaucacauaguuggagucagugcauaauuccaaguggcuuuuuuuuuuu

SEQ ID NO: 308960 - RNA, 64 nt, Homo Sapiens
agaguguaaauaaaauagugagaaagauguuaaugugcauaaauguugacaaugcacugacuuu

SEQ ID NO: 308961 - RNA, 64 nt, Homo Sapiens
cacgaauccguaaaaaccccaugacuuucucuucgugcauaaacagauguauuuuugauuucag

SEQ ID NO: 308962 - RNA, 64 nt, Homo Sapiens
gaauauaguuuuaaaaacccuuugaacaaagugugugcauaaccagucaugagauaaaacaaca

SEQ ID NO: 308963 - RNA, 64 nt, Homo Sapiens
cugagauuuggaaagaauaaugcucuuccaucuugugcauaagcccauuuuuuaauuuuaacag

SEQ ID NO: 308964 - RNA, 64 nt, Homo Sapiens
cuccaucagaagcccuggggcagccgaggggacggugcauaacucaaucagugaauguacaacc

SEQ ID NO: 308965 - RNA, 64 nt, Homo Sapiens
agcuguuguuacugguaaaaaguguuuaauagaggugcauaaucacuguuuuguauaacuguac

SEQ ID NO: 308966 - RNA, 64 nt, Homo Sapiens
uguuuucaguuucccuguuuuaaaagaaaaagaugugcauaacuggaggaaacaaucuagaaga

SEQ ID NO: 308967 - RNA, 64 nt, Homo Sapiens
guagaaauacagauuuuguuuacaauaacauuuugugcauaauugaguacuggauggaaaacuc

SEQ ID NO: 308968 - RNA, 64 nt, Homo Sapiens
uucugaauuauucuggauaucgucauuuugcagugugcauaauuuugccaaccguugcuuucgu

SEQ ID NO: 308969 - RNA, 64 nt, Homo Sapiens
uggauguccaaauuugaacuagagcaccagcuuugugcauaauucuuugguuucuggggcaaau

SEQ ID NO: 308970 - RNA, 64 nt, Homo Sapiens
aaguaucagaccucagaauguuguggaugucagugugcauaagcugcuuccgcaccgguagcag

SEQ ID NO: 308971 - RNA, 64 nt, Homo Sapiens
aacagauuuuguaauaauguaacuuuguuaauaggugcauaaacacuaaugcagucaauuugaa

SEQ ID NO: 308972 - RNA, 64 nt, Homo Sapiens
aaauaaaauccacucaagagucacaaggcccgcugugcauaaucgguuucacuuuuaccuuuuu

SEQ ID NO: 308973 - RNA, 64 nt, Homo Sapiens
gauuguuccucuuauauuugauauuacaguuauugugcauaacacuguguauaacauguacuaa

SEQ ID NO: 308974 - RNA, 64 nt, Homo Sapiens
aggagucugagaauauuggcccuuucuaaccuaugugcauaauuaaaaccagcuucauuuguug

SEQ ID NO: 308975 - RNA, 64 nt, Homo Sapiens
uaaaucacuucugucuuugcuggaaaguguauuugugcauaaauaaagucuguguauuuguuuc

SEQ ID NO: 308976 - RNA, 64 nt, Homo Sapiens
ucaaugguguuggcuuccccuccccaccccacgcgugcauaaaaacugguucuacaaauuuuua

SEQ ID NO: 308977 - RNA, 64 nt, Homo Sapiens
ggauguguuugaaccuaguauucucaccucgauggugcauaacaugaugaucccaugguagguc

SEQ ID NO: 308978 - RNA, 64 nt, Homo Sapiens
auuuuugaccagcagauggcuugaaguuuuucaagugcauaacuuucuaccguacuuuaguagu

SEQ ID NO: 308979 - RNA, 64 nt, Homo Sapiens
gaguuuucuauaaaugccuucuccacauuuuucagugcauaauuguugauagugcagagaaacc

SEQ ID NO: 308980 - RNA, 64 nt, Homo Sapiens
aauuuuguuuuaaucuuuuucagagguaaauagagugcauaaauaguaaguuucauucuaaaau

SEQ ID NO: 308981 - RNA, 64 nt, Homo Sapiens
ucuuuggccuucaagauccaauacaucuauuuaagugcauaaggcucuauuacagcauguugcc

SEQ ID NO: 308982 - RNA, 64 nt, Homo Sapiens
augccaagcauuuuagugaauuuagauugagcuugugcauaagauccauacuaaagccccauua

SEQ ID NO: 308983 - RNA, 64 nt, Homo Sapiens
cauguuaggaaggucaaaaaaaaggaaaaaagaaaaauaauaaaaaauaauaaaaauccuuagg

SEQ ID NO: 308984 - RNA, 64 nt, Homo Sapiens
aggucaaaaaaaaggaaaaaagaaaaauaauaaaaaauaauaaaaauccuuaggauaacuugag

SEQ ID NO: 308985 - RNA, 64 nt, Homo Sapiens
gccaccaagucuagacuugaugguguucaagaauaaauaauacugauugccucccuaguccuug

SEQ ID NO: 308986 - RNA, 64 nt, Homo Sapiens
cuuaugugcaguaacuauaaugguaaagaauguuaaauaauaaaauuuaacauuuuccaaaugc

SEQ ID NO: 308987 - RNA, 64 nt, Homo Sapiens
guagucucacacuguuuuucauacucuuaaguguaaauaauauaaaauguuucaagcgcuuaac

SEQ ID NO: 308988 - RNA, 64 nt, Homo Sapiens
uuguggcaaaauauucuucuuugauaguguaaacaaauaauaaagcaaucuagguccuuuaggu

SEQ ID NO: 308989 - RNA, 64 nt, Homo Sapiens
ugcuuccuaggacuuuaaugcauuucucaucaguaaauaauaguuguuuaacuuucuaagccuc

SEQ ID NO: 308990 - RNA, 64 nt, Homo Sapiens
acucuuuuaauaguauacaauuggguauagcauaaaauaauaucaacaguuaucuugaaagcua

SEQ ID NO: 308991 - RNA, 64 nt, Homo Sapiens
acaaauuguuuuaaauguuuguauauucuauaauaaauaauaaauugguuuuacaauuuaaaaa

SEQ ID NO: 308992 - RNA, 64 nt, Homo Sapiens
aaucauuuugcuguuaacacucauuuauauugaaaaauaauauucuuuaaaaaauguaaggauu

SEQ ID NO: 308993 - RNA, 64 nt, Homo Sapiens
aaucacaaaggaaagauuugucuuuuacuuuuuaaaauaauaacguggaguagccauucuuuau

SEQ ID NO: 308994 - RNA, 64 nt, Homo Sapiens
gccccacuugacacuauucaugcuuacucauuaaaaauaauagagccaauagaguugggacaau

SEQ ID NO: 308995 - RNA, 64 nt, Homo Sapiens
gauauuauuaaaguuucuggaauaauaccaaguaaaauaauacauuaaaugguguggaaaugca

SEQ ID NO: 308996 - RNA, 64 nt, Homo Sapiens
aaguaaaauaauacagauauugguguggaaaugcaaauaauaccugcaagcuaaaauuuuuaaa

SEQ ID NO: 308997 - RNA, 64 nt, Homo Sapiens
accaaucugaguuuagccucaaaguagcucauauaaauaauaaagaaaacugaggcaguuaacc

SEQ ID NO: 308998 - RNA, 64 nt, Homo Sapiens
ccagauaauugguuuuugccuauuuguaggacugaaauaauaauacuaauguaagauuagcuau

SEQ ID NO: 308999 - RNA, 64 nt, Homo Sapiens
uuauaagauuuaauuguaauugucucaaagcaucaaauaauacaucuuuaucauuaaacaugaa

SEQ ID NO: 309000 - RNA, 64 nt, Homo Sapiens
cuaaaacuagauaacuuaaauaauuuaagccaauaaauaauauuauauuguauuuaacccauua

SEQ ID NO: 309001 - RNA, 64 nt, Homo Sapiens
aucuaauaaaauggcuauuccucuuuuuacuuggaaauaauaaauuaacauuauauuuuaaaca

SEQ ID NO: 309002 - RNA, 64 nt, Homo Sapiens
aguugcugaaaaguauuaacaugguauuaagcuuaaauaauacguaaugggacuagauggccca

SEQ ID NO: 309003 - RNA, 64 nt, Homo Sapiens
uguuacuuuucuggucuuuucauggcauaugagcaaauaauaaacuauuuacacuacuauucug

SEQ ID NO: 309004 - RNA, 64 nt, Homo Sapiens
accguaauauuauaucuugcccuacuuauuuacaaaauaauauguuucuguuaugguccuuagu

SEQ ID NO: 309005 - RNA, 64 nt, Homo Sapiens
uccuuugucuuuggcugauuucugcuuuguagauaaauaauaauagcccugagauguuucuaac

SEQ ID NO: 309006 - RNA, 64 nt, Homo Sapiens
aacugaccugaauuggaaaggaugugauuaauauaaauaauagcagauauaaauugugguuaug

SEQ ID NO: 309007 - RNA, 64 nt, Homo Sapiens
ucucccgagaaaaauaucucauuaaaaagcccauaaauaauaggggagaagaaagccuuaggua

SEQ ID NO: 309008 - RNA, 64 nt, Homo Sapiens
accuacuugaaaggaucauugugcggauuaaaagaaauaauauauguaaagcacuuuaacacag

SEQ ID NO: 309009 - RNA, 64 nt, Homo Sapiens
gauuucaguaaccuucuggaaagcuaucaguuucaaauaauauuuucucuguaguaugagauga

SEQ ID NO: 309010 - RNA, 64 nt, Homo Sapiens
cauugaagaaaaaaauaacugugaaaaaauacgaaaauaauaaauagauuuuauguaguauuaa

SEQ ID NO: 309011 - RNA, 64 nt, Homo Sapiens
gccgauuuucauauaaaugugcaauacaacugugaaauaauaaguuaauaaaauaauuuuuaug

SEQ ID NO: 309012 - RNA, 64 nt, Homo Sapiens
acacuuagagaaaaaggaagagaaaauguggaggaaauaauaugccaggaaagaagcagcuuag

SEQ ID NO: 309013 - RNA, 64 nt, Homo Sapiens
ucaacaacuaauggccaucuccgcaagguauacuaaauaauauacuacugcuggcaauugggaa

SEQ ID NO: 309014 - RNA, 64 nt, Homo Sapiens
cucaaauuugcuauaguuugucauuuuugcuuacaaauaauauaacuuuucaaccuucuaguua

SEQ ID NO: 309015 - RNA, 64 nt, Homo Sapiens
aaauuuaaaaucacaugcaaaaaaaaaaucagcaaaauaauaaaaugaacgaaaaaaaaugaca

SEQ ID NO: 309016 - RNA, 64 nt, Homo Sapiens
ucuacugcccgugucuccagauauuucaagcugaaaauaauaguuuuuuaccaaaguguagcua

SEQ ID NO: 309017 - RNA, 64 nt, Homo Sapiens
guaugacaacuauuuccacauguuauuauucucuaaauaauacaacauguacagacuuuuuucu

SEQ ID NO: 309018 - RNA, 64 nt, Homo Sapiens
acaguaucaguggacuaaacuaaaccuugcauuaaaauaauaucucuguaauaaaaaacuaaau

SEQ ID NO: 309019 - RNA, 64 nt, Homo Sapiens
uguaaauugaaauuuuuuucaauguacuauuuuaaaauaauaugcuaugucucauaaaaauuag

SEQ ID NO: 309020 - RNA, 64 nt, Homo Sapiens
caagaucugccccaguaauuuaccaaagguagcaaaauaauagugaagauggaauaugucugcu

SEQ ID NO: 309021 - RNA, 64 nt, Homo Sapiens
guugauuuuuuugcucuccauuuugacuugcaagaaauaauaccucaagauaaucugauuuauu

SEQ ID NO: 309022 - RNA, 64 nt, Homo Sapiens
aguacaucucccuuuugccuaaugaacuuuugaaaaauaauaaaauaauagaauaaauuagacu

SEQ ID NO: 309023 - RNA, 64 nt, Homo Sapiens
ucccuuuugccuaaugaacuuuugaaaaauaauaaaauaauagaauaaauuagacuuugaaugg

SEQ ID NO: 309024 - RNA, 64 nt, Homo Sapiens
uguugcauuucaguaaaagcagaauaaccuuucaaaauaauaacaggcugggugcaauggcuca

SEQ ID NO: 309025 - RNA, 64 nt, Homo Sapiens
ccuggccugggcaacagagcaagacccugucucaaaauaauaauaauauauaauuuuacaccaa

SEQ ID NO: 309026 - RNA, 64 nt, Homo Sapiens
acuuuuauuucgucucaguuuuuggucacaggccaaauaauacagcgcucucucugcuucucuc

SEQ ID NO: 309027 - RNA, 64 nt, Homo Sapiens
aaauuagucaauaaugaccccaauuuuuucauuaaaauaauaguggugaauuauauguuauugu

SEQ ID NO: 309028 - RNA, 64 nt, Homo Sapiens
ggauucaaccaaccaaggacggaaaaugcuuaaaaaauaauacaacaacaacaaaaaauacauu

SEQ ID NO: 309029 - RNA, 64 nt, Homo Sapiens
cccuaaaauaguuagaucuuuguaaaugcauauuaaauaauaaaguaugacccacauuacuuuu

SEQ ID NO: 309030 - RNA, 64 nt, Homo Sapiens
cccacauuacuuuuuaugggugaaaauaagacaaaaauaauaguuuuagugaggauggugcuga

SEQ ID NO: 309031 - RNA, 64 nt, Homo Sapiens
auuuuuagauucaauauuuauauggaguuuugaaaaauaauaguggcccugaaggaauaaauuc

SEQ ID NO: 309032 - RNA, 64 nt, Homo Sapiens
auaccccccaauuguuuuucaauccccuuuucucaaauaauaaauuaguuaaaucaguuucuga

SEQ ID NO: 309033 - RNA, 64 nt, Homo Sapiens
ccuuugacuauaagaaauuaaaaaaaaaacaccaaaauaauauuuuucuuacuugauauaccaa

SEQ ID NO: 309034 - RNA, 64 nt, Homo Sapiens
uuuacaaaccauauuaaaaggcuaauuuaaauauaaauaauauaaagugcucugaauaaagcag

SEQ ID NO: 309035 - RNA, 64 nt, Homo Sapiens
cauaauuuuuagguaaggauagugcuaaugcaggaaauaauacaccagaagcacuggacuaaag

SEQ ID NO: 309036 - RNA, 64 nt, Homo Sapiens
gauaacuaucuuuauugagccagcuuuaacuuuuaaauaauaauuggaaauuaaaacaccaucu

SEQ ID NO: 309037 - RNA, 64 nt, Homo Sapiens
gugacaguuuaguaauucuagcuuuuguaaaggaaaauaauacuaguuuuuguuuuacugagau

SEQ ID NO: 309038 - RNA, 64 nt, Homo Sapiens
aaucuggugccucaguuuccaaaucuuuaaaaaaaaauaauaauuucccugucuaacuguagac

SEQ ID NO: 309039 - RNA, 64 nt, Homo Sapiens
uuuaagaaugaaaaauuuaaacuuuuuaacaacaaaauaauaaugugcuuuacaacuacauagu

SEQ ID NO: 309040 - RNA, 64 nt, Homo Sapiens
uauuuaaaauuuuugguuacguaugaggcaagagaaauaauauguauucaagacaaaaagaaca

SEQ ID NO: 309041 - RNA, 64 nt, Homo Sapiens
ugacaugccaccgaaguacagcugagagacaguaaaauaauaaccaaccaacagugaaugugga

SEQ ID NO: 309042 - RNA, 64 nt, Homo Sapiens
uaagcuaugauaggagaauaggaaaguuuaauauaaauaauaaucaagguaguaauuuaaacag

SEQ ID NO: 309043 - RNA, 64 nt, Homo Sapiens
caguggaauauaaggaaagcugaaaauacaacuuaaauaauaaaauaaauucuauaggaacaua

SEQ ID NO: 309044 - RNA, 64 nt, Homo Sapiens
aauguuuaauauugagaaagcuuuuguuguaaaaaaauaauaauugugauguuuguccugaaca

SEQ ID NO: 309045 - RNA, 64 nt, Homo Sapiens
uguauucauaaaacucguguugaauggagaccucaaauaauaacauuucccaaagaaauguaag

SEQ ID NO: 309046 - RNA, 64 nt, Homo Sapiens
auauacaguuuuguuauuguccauaagucauacuaaauaauauuauuuuaaagauucaaggaag

SEQ ID NO: 309047 - RNA, 64 nt, Homo Sapiens
gcccugcaaguacccaguaauuuggcaaucucuuaaauaauauuagagauguauggcauuuuaa

SEQ ID NO: 309048 - RNA, 64 nt, Homo Sapiens
guuucacaguauuucuauuuuuuuuguuauaugaaaauaauaguuugaaggucauaaucaguga

SEQ ID NO: 309049 - RNA, 64 nt, Homo Sapiens
gggacucauauucagucuuugggcugcagcaaauaaauaauauugugcccuuaaaauugugcug

SEQ ID NO: 309050 - RNA, 64 nt, Homo Sapiens
uaaaaauuuuaaaaacagccgaaaauaauuuuuaaaauaauagaaaguguuugauuaaaauaga

SEQ ID NO: 309051 - RNA, 64 nt, Homo Sapiens
uuauugccagauuuggggcaaucccuucucuuaaaaauaauaacagccuggccaccuuagugag

SEQ ID NO: 309052 - RNA, 64 nt, Homo Sapiens
uuuuuagacaagcaaagacucaagggugaagguaaaauaauacaucuauauucacccaaauaau

SEQ ID NO: 309053 - RNA, 64 nt, Homo Sapiens
uagauauauauguccaccagguauaucuauauacaaauaauauacuuugguacaaauaaaaacu

SEQ ID NO: 309054 - RNA, 64 nt, Homo Sapiens
uuccuucuuuauaaugcuaauauuuaaauguuuuaaauaauauagcaaaaauguccauaugcac

SEQ ID NO: 309055 - RNA, 64 nt, Homo Sapiens
cuucauaauuucacccugugacuauccugaaaagaaauaauaaucauuuuaugauugaugggcc

SEQ ID NO: 309056 - RNA, 64 nt, Homo Sapiens
cagaauuacuaagcauguggcauaaauuuggagaaaauaauaugacuagaaaaauuaguguuau

SEQ ID NO: 309057 - RNA, 64 nt, Homo Sapiens
gagcaguuaacuuuacucuugguucugagucuccaaauaauaauagccgacguuuauugagcac

SEQ ID NO: 309058 - RNA, 64 nt, Homo Sapiens
auggacauagugcagacauuaauaagacauagaaaaauaauaauuauacaugcuguuguacccu

SEQ ID NO: 309059 - RNA, 64 nt, Homo Sapiens
ccaaaguaaaucugauauauguaaugaaguuauuaaauaauacuuuuaaaaaucagacauuuau

SEQ ID NO: 309060 - RNA, 64 nt, Homo Sapiens
cucuauccuggguaacagcgagacucugucuuaaaaauaauaacaauaauaauaauaauaaaga

SEQ ID NO: 309061 - RNA, 64 nt, Homo Sapiens
agccaaagacugcuugcuaguaggaaaaaauuucaaauaauaaccaaagcugaaaaauggucug

SEQ ID NO: 309062 - RNA, 64 nt, Homo Sapiens
auuuaacaaauguagguagaaugauuuacauacgaaauaauagcgcucucaauaaauaugcauu

SEQ ID NO: 309063 - RNA, 64 nt, Homo Sapiens
uaagaugauacuuuaaaaucuccauuuuuguuacaaauaauaagcaggucauuacuguaaguuu

SEQ ID NO: 309064 - RNA, 64 nt, Homo Sapiens
uggauuauggauaacaagagaauauacccaugugaaauaauaauuauauacuaagaauaaauaa

SEQ ID NO: 309065 - RNA, 64 nt, Homo Sapiens
auuccaccuuuuccugcuguugaaucauuugcucaaauaauaacaauguuaguauucaucucuu

SEQ ID NO: 309066 - RNA, 64 nt, Homo Sapiens
uuuauagcugaguuuucccuucuguaucaaaacaaaauaauacaaaaaaugcuuuuagaguuua

SEQ ID NO: 309067 - RNA, 64 nt, Homo Sapiens
aagcaagcacaaguaugcugguaguagccucuuuaaauaauauguauagacaacaacaacgaca

SEQ ID NO: 309068 - RNA, 64 nt, Homo Sapiens
cuuuggaagguguaacucucuggaauggaauuccaaauaauaaauuuaucacagaguagaucac

SEQ ID NO: 309069 - RNA, 64 nt, Homo Sapiens
ggggaaaucggagcaacaauaaguuuacauggugaaauaauacuuacauuaugacaggaaguaa

SEQ ID NO: 309070 - RNA, 64 nt, Homo Sapiens
aguacuauugcuaguacuagaaaauuuaccuuuaaaauaauaauuacuauuuuuauuuuaaaau

SEQ ID NO: 309071 - RNA, 64 nt, Homo Sapiens
uuagauuacaggauuaauauuaagaauauugcccaaauaauauuuuaaucaauauuuaagagau

SEQ ID NO: 309072 - RNA, 64 nt, Homo Sapiens
guacugccaccagauuuuuuaauguaauucagcaaaauaauacaagguagcuucuuuuuucuca

SEQ ID NO: 309073 - RNA, 64 nt, Homo Sapiens
uccucaugagaaauuuaugacaauaacacagaucaaauaauaucaauguuuugcaaauacaugc

SEQ ID NO: 309074 - RNA, 64 nt, Homo Sapiens
uaguaagcuagcaaauaguauuacugcuuaauucaaauaauaauagaaacuuaaauuuuaguuc

SEQ ID NO: 309075 - RNA, 64 nt, Homo Sapiens
uuuuaagaaauaaauuuauugacauaauccaguaaaauaauaauaagaacacagcccugcuucu

SEQ ID NO: 309076 - RNA, 64 nt, Homo Sapiens
aaaagaaagcaugauauuuaacaaaaacaaaauaaaauaauaaaacuauuuccaaacucauauu

SEQ ID NO: 309077 - RNA, 64 nt, Homo Sapiens
caugcauuuaauauuuccuuucaucaaguucuuaaaauaauauauuaaaagaauguaaaauaua

SEQ ID NO: 309078 - RNA, 64 nt, Homo Sapiens
ccuauaccugaauauaacaaccuuuaaaaaagcaaaauaauaagaaggaaaaauuccaggaggg

SEQ ID NO: 309079 - RNA, 64 nt, Homo Sapiens
uugcccuaucgugauuucaguugaauucaugugaaaauaauagccauccuuggccuggcgcggu

SEQ ID NO: 309080 - RNA, 64 nt, Homo Sapiens
cagccugggugacagagcgacccucugucucaaaaaauaauaauaauaauaaauaaaacaacaa

SEQ ID NO: 309081 - RNA, 64 nt, Homo Sapiens
gaaaccuuuacuauuuccaauguauguuuguuaaaaauaauaauaauaaaaccaaaagccuuug

SEQ ID NO: 309082 - RNA, 64 nt, Homo Sapiens
aauagcugacccuaaauucauuuuucaugcuuaaaaauaauagaacaaauaauaauacuauuuu

SEQ ID NO: 309083 - RNA, 64 nt, Homo Sapiens
uaaauucauuuuucaugcuuaaaaauaauagaacaaauaauaauacuauuuuugggcaaaaucc

SEQ ID NO: 309084 - RNA, 64 nt, Homo Sapiens
ucugguauuuucuucauuauuauauugaugggugaaauaauauuauaucucugaaauaaugaaa

SEQ ID NO: 309085 - RNA, 64 nt, Homo Sapiens
cuaagauugauuuuaugcucaacagagauagcuuaaauaauacaauauggaagucaaagugagg

SEQ ID NO: 309086 - RNA, 64 nt, Homo Sapiens
cuggaggugggaauggagaacauguuuacauaagaaauaauaaaccugggauguaacuaucuua

SEQ ID NO: 309087 - RNA, 64 nt, Homo Sapiens
cucuaaaacacaggaacugcauauacugcagggcaaauaauauuuuauuuuaacaaagauuaaa

SEQ ID NO: 309088 - RNA, 64 nt, Homo Sapiens
uaaaauggaaggccacagaaaaggggaaaagaggaaauaauacaguaaucguuaauccagcaaa

SEQ ID NO: 309089 - RNA, 64 nt, Homo Sapiens
aaucuauaaugccauaaaugauaaugcaaaaccuaaauaauaugguggccggaggggcugccuu

SEQ ID NO: 309090 - RNA, 64 nt, Homo Sapiens
ucuucaucucacccauuucaagucugagguaaaaaaauaauaaugauaacaaaacggggugggu

SEQ ID NO: 309091 - RNA, 64 nt, Homo Sapiens
uuuaaaagcacuuucuauuuuuaaaaguaacuugaaauaauauaguauaagaauccuauugucu

SEQ ID NO: 309092 - RNA, 64 nt, Homo Sapiens
ggcucucuaaagaaaaacucauuguaacuuauuaaaauaauaucuggugcaaaguaucuguuuu

SEQ ID NO: 309093 - RNA, 64 nt, Homo Sapiens
gaacuuugccaaugauagugaccacagcaaaagcaaauaauaauaauauuaauaauaauaaaga

SEQ ID NO: 309094 - RNA, 64 nt, Homo Sapiens
auaauaauaauauuaauaauaauaaagagaaauaaaauaauaaaauaaaaaacaauagcacagc

SEQ ID NO: 309095 - RNA, 64 nt, Homo Sapiens
ugcuuuuuaaaaauuggaauaauguauuaaggucaaauaauaucccauaaaauauauauuucug

SEQ ID NO: 309096 - RNA, 64 nt, Homo Sapiens
aggucuaaaacacacuagaguagcuggugacuauaaauaauauuuuaaaaugcugugucuacac

SEQ ID NO: 309097 - RNA, 64 nt, Homo Sapiens
uuaaaacaaguagcuguuacggucaccaaaaaugaaauaauaguauuauggucaaauauaauuu

SEQ ID NO: 309098 - RNA, 64 nt, Homo Sapiens
uaguaaaacuaagauuuaagaauccaggaguaccaaauaauauauuuuuuuaccccaacuacug

SEQ ID NO: 309099 - RNA, 64 nt, Homo Sapiens
acuaaaaacaaaaaguaaaauucauaaucagucaaaauaauaaagaguaaacuuauugcauauu

SEQ ID NO: 309100 - RNA, 64 nt, Homo Sapiens
gcagaugguugccuuuggguguuucagguuacauaaauaauagaggaaugaagaauuaggcuug

SEQ ID NO: 309101 - RNA, 64 nt, Homo Sapiens
gaagagauaacuuccaaaagagugcuguuuuuaaaaauaauaauuaggaaauguuuauuuagca

SEQ ID NO: 309102 - RNA, 64 nt, Homo Sapiens
auguacaguuguauauacaguaugacaagauguaaaauaauauguuuuucaugcaguuuaaaau

SEQ ID NO: 309103 - RNA, 64 nt, Homo Sapiens
aaaauaauuaaaaauuuauuuauuuguuuauuuaaaauaauaaucauaaauaacagucugaacu

SEQ ID NO: 309104 - RNA, 64 nt, Homo Sapiens
gaaaguuuuguguuugacugaacccacaacuccuaaauaauacauucuaaagaugagcuuccaa

SEQ ID NO: 309105 - RNA, 64 nt, Homo Sapiens
uuguaaucagcaguaaaggaugguggaugaaaagaaauaauaaacguauaauuugaggagugga

SEQ ID NO: 309106 - RNA, 64 nt, Homo Sapiens
gaggcaugaaaguuaaauguauauauuaugguagaaauaauauugaaggauauuguacuucacu

SEQ ID NO: 309107 - RNA, 64 nt, Homo Sapiens
guauuguugcuccuaccuucaaauaugacaccugaaauaauaagucuguuguccagaauuuaug

SEQ ID NO: 309108 - RNA, 64 nt, Homo Sapiens
gcaccauuuuuuucuucauacauccuauagugccaaauaauaaaaucuucugaauguucaagag

SEQ ID NO: 309109 - RNA, 64 nt, Homo Sapiens
uugcccacccuguuugugacuauugucaacagcaaaauaauauuaacaccagucuagagcaucu

SEQ ID NO: 309110 - RNA, 64 nt, Homo Sapiens
aaaguauuauuugaacuuuuguucucucuuccccaaauaauauugauacuuaggucaaauuucu

SEQ ID NO: 309111 - RNA, 64 nt, Homo Sapiens
uaauaaaaagucacaaaguuaauuugaaauauuaaaauaauaucauauaaggaaagugauccaa

SEQ ID NO: 309112 - RNA, 64 nt, Homo Sapiens
cuauucauuuugaaaaacacucguuuaauacuauaaauaauauuacuacauaucuaguaaaacc

SEQ ID NO: 309113 - RNA, 64 nt, Homo Sapiens
uuucucuguuaaacaauuuucauucugaacccugaaauaauauuagucuccuaguauucaacau

SEQ ID NO: 309114 - RNA, 64 nt, Homo Sapiens
uauaagaucagcagaauguucuucagauuggaccaaauaauacuuuuuaguuuaaaaagaccuu

SEQ ID NO: 309115 - RNA, 64 nt, Homo Sapiens
uaaagagcacaagaaaaauuuuaaauuauuccauaaauaauauuuaagcaguuuuuauaaugaa

SEQ ID NO: 309116 - RNA, 64 nt, Homo Sapiens
aaacaaugagguauuuaaagcugugagaagaaaaaaauaauauguuuuggcuguauaaauaaaa

SEQ ID NO: 309117 - RNA, 64 nt, Homo Sapiens
uaugacauuuaucacacaaaacuuaaguuucacuaaauaauauaaauugcuuuaaaucugaaga

SEQ ID NO: 309118 - RNA, 64 nt, Homo Sapiens
auuguuuuuguuuacuuuuacugcagaccauuagaaauaauacaacauagaaaauuaaagauag

SEQ ID NO: 309119 - RNA, 64 nt, Homo Sapiens
gaacaaaaaauguuuuaaauuucucuuauauaggaaauaauaggaacgucaaagcucuguauac

SEQ ID NO: 309120 - RNA, 64 nt, Homo Sapiens
aaaugaaaauguaucaccuguuccuuaacuguguaaauaauaauuaaauuucuuugaaacugga

SEQ ID NO: 309121 - RNA, 64 nt, Homo Sapiens
ggacuagugaaaaaucuaguauuuguauccuggcaaauaauacuaauuuauaauccacaguaaa

SEQ ID NO: 309122 - RNA, 64 nt, Homo Sapiens
uccagccugggcaacaagagcaaaacucagucucaaauaauaauaauaacaacaacuuaaugug

SEQ ID NO: 309123 - RNA, 64 nt, Homo Sapiens
aaaagaaacaguugcuuguaaaauauacuuuuguaaauaauauuuaauuuuuuaaauaauauau

SEQ ID NO: 309124 - RNA, 64 nt, Homo Sapiens
aaaauauacuuuuguaaauaauauuuaauuuuuuaaauaauauauuuggugcuguuuucucaga

SEQ ID NO: 309125 - RNA, 53 nt, Homo Sapiens
uuuuucuuuucuuacaguaaaugaaauaauacgaaaugaccucuccagcacga

SEQ ID NO: 309126 - RNA, 64 nt, Homo Sapiens
auguguguacauaucuaggcaucuauuuauguauaaauaauaacagagccgacguguccucgcc

SEQ ID NO: 309127 - RNA, 64 nt, Homo Sapiens
agaaauagaaauuuugaaugccagagaaauuuuaaaauaauagauuuuaaucaguuugcuuucu

SEQ ID NO: 309128 - RNA, 64 nt, Homo Sapiens
guaaaguucaauuucaacaucuggagguuuccaaaaauaauauuuuaggucuuugucagacauu

SEQ ID NO: 309129 - RNA, 64 nt, Homo Sapiens
uuuagcucuaauagcucaagucauauaacuuuaaaaauaauacuuacuuuuauuauucccuugc

SEQ ID NO: 309130 - RNA, 64 nt, Homo Sapiens
cauuuugacauucuaccaagugaaaauacuuuggaaauaauauauuauuugaguagauuaauaa

SEQ ID NO: 309131 - RNA, 64 nt, Homo Sapiens
agacauuacacuaaaucagagugcugaguauagaaaauaauacaaacagauuugucuaaacauu

SEQ ID NO: 309132 - RNA, 64 nt, Homo Sapiens
agucauauguuauuuuauuaauuguacuucuaugaaauaauaugcagucuauuuuuaaauuaua

SEQ ID NO: 309133 - RNA, 64 nt, Homo Sapiens
aaaaaaaacccaccacaaacuuuauuuuuguacaaaauaauaaaaagaaauuccuaaaagucga

SEQ ID NO: 309134 - RNA, 64 nt, Homo Sapiens
cuuuuccucagaggagcaggauauauauauauauaaauaauauaaacaaaauuuauauauagau

SEQ ID NO: 309135 - RNA, 64 nt, Homo Sapiens
ugcacagacauggagagaauaggaucauauuauuaaauaauauagguuggaucacauacauuua

SEQ ID NO: 309136 - RNA, 64 nt, Homo Sapiens
ucccaucauaauauaaaauacucuucauauggaaaaauaauaucauuacuuaaaaauuaauuga

SEQ ID NO: 309137 - RNA, 64 nt, Homo Sapiens
cacuucuaaaaccauuaugaggaaaagaauauagaaauaauauugauauauagugaaaagugug

SEQ ID NO: 309138 - RNA, 64 nt, Homo Sapiens
uacuggcacuuuuccuugcaacauauuccuaugaaaauaauaaauguuaaacuugauucuuaug

SEQ ID NO: 309139 - RNA, 64 nt, Homo Sapiens
uccucuacgguuauuuccugcuuucuaauuaaaaaaauaauaaccauggcaagagagaaagaaa

SEQ ID NO: 309140 - RNA, 64 nt, Homo Sapiens
gugacaugaaaauuacaacagauauuccagaccaaaauaauacaacaaucccagcaucugauug

SEQ ID NO: 309141 - RNA, 64 nt, Homo Sapiens
uaagcuuguuuuaauggucaaaaaauuaggacagaaauaauauggacauuuauuaguaucuucc

SEQ ID NO: 309142 - RNA, 64 nt, Homo Sapiens
aucaaaagcauaauugaaaguucugaaaaaagaaaaauaauaauauguagaaaaauguaacuua

SEQ ID NO: 309143 - RNA, 64 nt, Homo Sapiens
gguuuuaagaauaucugaguaaaauaacaauaugaaauaauaaacagaagcucuaacgucaggu

SEQ ID NO: 309144 - RNA, 64 nt, Homo Sapiens
cuagagaguugacaaguugcuuguaguuuuaaaaaaauaauaaaguauacccuucugguauauc

SEQ ID NO: 309145 - RNA, 64 nt, Homo Sapiens
auaaaugcccuuguacccuuucaaauaugcagaaaaauaauaauucuuuuuaauuaaaaauauu

SEQ ID NO: 309146 - RNA, 64 nt, Homo Sapiens
uuguuauuugauacauuuuuagugucuguggcuuaaauaauaugugcuccaauguauguacaua

SEQ ID NO: 309147 - RNA, 64 nt, Homo Sapiens
uuaauaggccuaaaauagugagcauauauaaucaaaauaauacuucauacaacauauacuucca

SEQ ID NO: 309148 - RNA, 64 nt, Homo Sapiens
accuaccucacaagguuaucagaaagaucaaauuaaauaauagaugugaaaaugcuuugaaaau

SEQ ID NO: 309149 - RNA, 64 nt, Homo Sapiens
uaacuacuacauugaauugcauguuaaggugcagaaauaauacauuaaaagauuuucacuuuaa

SEQ ID NO: 309150 - RNA, 64 nt, Homo Sapiens
ugaugauauuauuaaacaccauuauucacauuucaaauaauaacaauacuuuuuguuuuucaaa

SEQ ID NO: 309151 - RNA, 64 nt, Homo Sapiens
gucaaaaauucaggggcaguuccaaaauacuuaaaaauaauaguaugagaacaggugugaguuu

SEQ ID NO: 309152 - RNA, 64 nt, Homo Sapiens
aggggaaguuuuauuagcuuuaugcacacauuacaaauaauauaguaacaaaaguguacuaugu

SEQ ID NO: 309153 - RNA, 64 nt, Homo Sapiens
agaaaccaccaggcacacggcaccagguacgacgaccagguaccacccccagccuggguagagc

SEQ ID NO: 309154 - RNA, 64 nt, Homo Sapiens
acgaccagguaccagaaaccgccuggguagagccaccagguacggccccuccccucgaccccca

SEQ ID NO: 309155 - RNA, 64 nt, Homo Sapiens
aacaugacccuuaguaacaaacacaauuuauauaaugacccagcaaaacacaucacaucuuacu

SEQ ID NO: 309156 - RNA, 64 nt, Homo Sapiens
aacaugcuaguugagacuuuucaaauggauuuuuaugacccacuacuggguuuggauccacagu

SEQ ID NO: 309157 - RNA, 64 nt, Homo Sapiens
uagcuagugucagcgauguaucaaccacuauggcaugacccaugaauguccuucuccuccaacc

SEQ ID NO: 309158 - RNA, 64 nt, Homo Sapiens
ggugaugcgcucaccuucugguuugagaaggaaaaugacccaucauuggcaauaaaaccugugu

SEQ ID NO: 309159 - RNA, 64 nt, Homo Sapiens
cagggcuugguggugguagcacugcagccgcugccgucgcgacaaggaaggauuguuucuggug

SEQ ID NO: 309160 - RNA, 64 nt, Homo Sapiens
gcuuguuuccccacggucugugcccgggguggcacgucgcgaaacaaggacugaagccucaagc

SEQ ID NO: 309161 - RNA, 64 nt, Homo Sapiens
cuccaacacugcaacauggggacauuugccaacucgaacaaaggcugagaagcagccacaccgu

SEQ ID NO: 309162 - RNA, 64 nt, Homo Sapiens
uucuuacuuacuaaaauauauauagaaauauauacgaacaaaacacacgcgcgcacacacacac

SEQ ID NO: 309163 - RNA, 64 nt, Homo Sapiens
caaacacccggacgacccucagcccagaaacuuucgaacaaaacauuuuacaaaaaaaaaaaaa

SEQ ID NO: 309164 - RNA, 64 nt, Homo Sapiens
uuaggucaccuuuuguguuugacuucaaaagggacgaacaaacaugcuuccuuuucaaagaaua

SEQ ID NO: 309165 - RNA, 64 nt, Homo Sapiens
cucauguauuugaagacuguuucaugcuuugcuccgaacaaauaguaaauaacugaguauguuc

SEQ ID NO: 309166 - RNA, 64 nt, Homo Sapiens
uuccugacacugagaaugaagaguaucacagugacgaacaaaaugauacucagaagcaauuuug

SEQ ID NO: 309167 - RNA, 64 nt, Homo Sapiens
uuuacauccgaaaagcaaccugaaauuuuacauccgaacaaaaugcauaauuuuuaugaugacc

SEQ ID NO: 309168 - RNA, 64 nt, Homo Sapiens
gcgaaccaaagcgaugcuucagaacccgcgcccgcgaacaaagagauggauggauggaugagcg

SEQ ID NO: 309169 - RNA, 64 nt, Homo Sapiens
guaggaguggaagagaggugugaagaaaccucuccgaacaaaugaaccagcaguaaguuucuaa

SEQ ID NO: 309170 - RNA, 64 nt, Homo Sapiens
ucuuuggacugguuauuucugguuuugaaguaaucgaacaaauugaaaaucugaagaccgaugc

SEQ ID NO: 309171 - RNA, 64 nt, Homo Sapiens
aagucagaauauaauaugaaguuccccaaggaaacgaacaaaaugaacucuagaauaucuagca

SEQ ID NO: 309172 - RNA, 64 nt, Homo Sapiens
acgaaugguacguuuaaaaucagaaacaaaacaucgaacaaaacccuauuuaagagacugauca

SEQ ID NO: 309173 - RNA, 64 nt, Homo Sapiens
cugggguccuuggggaccaguauuugccuuuaagcgaacaaaugauccuccugaccucaaagug

SEQ ID NO: 309174 - RNA, 64 nt, Homo Sapiens
caauauguuagauuagguguaagacuuuaagaagcgaacaaaaaguaauguauaucuguaauau

SEQ ID NO: 309175 - RNA, 64 nt, Homo Sapiens
ucaucaccacaggguccugucuauacuuuugguacgaacaaaauucuuuuuucagaauuucuga

SEQ ID NO: 309176 - RNA, 64 nt, Homo Sapiens
auagccuuucuuuuccgaugcgaggaauuaaaaucgaacaaaacaauugaugaaaaacuaaauu

SEQ ID NO: 309177 - RNA, 64 nt, Homo Sapiens
aaggaaaucuaaguuucgagcaaugggagagacacgaacaaaccgaccccaggaagucauccug

SEQ ID NO: 309178 - RNA, 64 nt, Homo Sapiens
cacacuucuaacugcuucugaauccgcuuggacacgaacaaagccuuuauguauauauuuuaac

SEQ ID NO: 309179 - RNA, 64 nt, Homo Sapiens
agcaaagggaaugccagcuauguguuccuucucucgaacaaaacauaucaaauacaaacgaugu

SEQ ID NO: 309180 - RNA, 64 nt, Homo Sapiens
uuucuccuucaguggacugucugugucccccugccgaacaaagcugggaguaaaggcaaaaccu

SEQ ID NO: 309181 - RNA, 64 nt, Homo Sapiens
caccugagaucagcagagccaacccuuagacucacgaacaaaucaggucagccaacccccaucc

SEQ ID NO: 309182 - RNA, 64 nt, Homo Sapiens
aacaguauugcguugucagacuaggaaagcuaaacgaacaaaaugguuuuaguuuugcugaaga

SEQ ID NO: 309183 - RNA, 64 nt, Homo Sapiens
ucaaggucauugaucuuacgcauuuacuguuuaccgaacaaaugucugacuguguacucgggug

SEQ ID NO: 309184 - RNA, 64 nt, Homo Sapiens
ggaaaggaaaaaaugggggugaugagcggugagacgaacaaaaggccucucuggccgcccacug

SEQ ID NO: 309185 - RNA, 64 nt, Homo Sapiens
aguuugccagccaggccccaccuacagcgucugucgaacaaacagaggucuggugguuuucccu

SEQ ID NO: 309186 - RNA, 64 nt, Homo Sapiens
ucugaauuaguucaugagccuuuuugaagagacacgaacaaaaauaacuuuucuaagauagcaa

SEQ ID NO: 309187 - RNA, 62 nt, Homo Sapiens
caacaagcaugcagccagcauuaccugugucacgaacaaaggcacuucauuuuaucaaguaa

SEQ ID NO: 309188 - RNA, 64 nt, Homo Sapiens
ccaccaaucccuuuacaaaauugaaauggcaucucgaacaaaguuuucuuuuuucucauuucuu

SEQ ID NO: 309189 - RNA, 64 nt, Homo Sapiens
uauucgacggaggacagaguaugugagccuuugccgaacaaacaaacguaaguuauuguuauuu

SEQ ID NO: 309190 - RNA, 64 nt, Homo Sapiens
uaaaagaaaaacguuuggauuauuuucccucuuucgaacaaagacauugguuugcccaaggacu

SEQ ID NO: 309191 - RNA, 64 nt, Homo Sapiens
cuuacccagguguuuauacuugucaacauggacacgaacaaaaccacuuuaacgguaguuccgg

SEQ ID NO: 309192 - RNA, 64 nt, Homo Sapiens
cuucaaccuuucuuugucuugcacuuauggacaacgaacaaauuugaacgaauuauuucuucaa

SEQ ID NO: 309193 - RNA, 64 nt, Homo Sapiens
uuauaccucuucugauaguucaacauuccacaaacgaacaaacaaaauuuuugcagcaagcagu

SEQ ID NO: 309194 - RNA, 64 nt, Homo Sapiens
uccccggccccucccccgcagaggucaaugccaacgaacaaacguccccucccucccucccucu

SEQ ID NO: 309195 - RNA, 64 nt, Homo Sapiens
guuuuaagaaguggcuauauagcucuggauaaaacgaacaaaagaauuagaauuccugcgggga

SEQ ID NO: 309196 - RNA, 64 nt, Homo Sapiens
agaacauuuccucccuccccaucauauugaugagcgaacaaacagguuugggacacgagaccuc

SEQ ID NO: 309197 - RNA, 64 nt, Homo Sapiens
ugcagccucuuaugcaccacaguuaaaucuagaacgaacaaaauuucagagcucaagacauggg

SEQ ID NO: 309198 - RNA, 64 nt, Homo Sapiens
ggaagcagcgccuccuucaggguuggcugggagcucggcccauccaccucuugggguaccugcc

SEQ ID NO: 309199 - RNA, 64 nt, Homo Sapiens
ucuuccugucucuguccuggucccugcccccgucucggcccagccucuguauucuccacccuug

SEQ ID NO: 309200 - RNA, 64 nt, Homo Sapiens
acgguuuucugugccaccaucggucacccauugaucggcccacucugaacccccuggcucucca

SEQ ID NO: 309201 - RNA, 64 nt, Homo Sapiens
uccccuaagucucugcucaaaaaaaaaacaauucucggcccaaagaaaacaaucagaagaauuc

SEQ ID NO: 309202 - RNA, 64 nt, Homo Sapiens
ugguagcuuagcaaagagaccagcugacugucucucggcccagcccaccacgccgaguagcuug

SEQ ID NO: 309203 - RNA, 64 nt, Homo Sapiens
agaagcagcauuugauauacaugcucaaccuucaucggcccacguguauuguccgggcucagaa

SEQ ID NO: 309204 - RNA, 64 nt, Homo Sapiens
uguccauccuccucuccaugugggccauggguccucggcccaucugucccuuuuugcaggggac

SEQ ID NO: 309205 - RNA, 54 nt, Homo Sapiens
ccuccugccucuccccucccucccucggcccaugugggcucccagcucuccuaa

SEQ ID NO: 309206 - RNA, 64 nt, Homo Sapiens
ccuugaagccgcggcgaaccuguggcucccccgcucggcccagggcaggcuccggaacccucgc

SEQ ID NO: 309207 - RNA, 64 nt, Homo Sapiens
agugauauuucagcuuggacauuuuacccuucagucggcccaagaaaucaaaauaaaggaaaca

SEQ ID NO: 309208 - RNA, 64 nt, Homo Sapiens
gcccaagggcuuagcuuuagggcuccuccugaguucggcccacaguagaagcaagauuuuaacu

SEQ ID NO: 309209 - RNA, 64 nt, Homo Sapiens
ugaccagugaucaaggcuaauuggaaaagaguuaucggcccauagcuaauaaguagugacagac

SEQ ID NO: 309210 - RNA, 64 nt, Homo Sapiens
agacacuuccccuggguugcgcuauaaaaacagcucggcccaacagaacacugguggcugagau

SEQ ID NO: 309211 - RNA, 64 nt, Homo Sapiens
acccccucuccuggagggcgccugccagcccggcucggcccagcucccgaaggccgacaccacu

SEQ ID NO: 309212 - RNA, 64 nt, Homo Sapiens
ugcugccugaaaccccagaccgagaaguugaugcucggcccacgccguuagcucgugugcgugu

SEQ ID NO: 309213 - RNA, 64 nt, Homo Sapiens
aaauagugaauugauaaucuacuuguuaauauauucggcccauauuuuguguguuuggacaagu

SEQ ID NO: 309214 - RNA, 64 nt, Homo Sapiens
ucugacugaaggggcuuggcauuugggucugagaucggcccagccagggcuugguggugguagc

SEQ ID NO: 309215 - RNA, 64 nt, Homo Sapiens
ucugaaacuugggaaggugauuucacucaacagcucggcccagcacaaacucugccuucgguca

SEQ ID NO: 309216 - RNA, 64 nt, Homo Sapiens
gugagcccgcccaccgcggaacguucggucagucucggcccacaccccaaaggcucuuuucaga

SEQ ID NO: 309217 - RNA, 64 nt, Homo Sapiens
ggagggcaggcuccggggccgggaggcugcacgcucggcccacgugccgggccgggagggaaga

SEQ ID NO: 309218 - RNA, 64 nt, Homo Sapiens
aagcucaaggacaaaauccagcuaacccagucccucggcccaggccuccuuucgugcuuugugc

SEQ ID NO: 309219 - RNA, 64 nt, Homo Sapiens
cuuuccuucccaccacagagguggacgagugcucucggcccaaccgcgggggcugugagcagcg

SEQ ID NO: 309220 - RNA, 64 nt, Homo Sapiens
gaagaggccacuggccaggcccccacccagguuuucggcccagugcccugcagcccccagcccu

SEQ ID NO: 309221 - RNA, 64 nt, Homo Sapiens
caucaaaggagggauuauguggcugcuaaagccaucggcccacagcccuguucacaucuuggug

SEQ ID NO: 309222 - RNA, 64 nt, Homo Sapiens
ucguugugucccccacaacuguccucuugcuagcucggcccagcuuugucccuggagcccgaug

SEQ ID NO: 309223 - RNA, 64 nt, Homo Sapiens
ugcagaaucucccaguuccuuggaagcccugaccucggcccaucuggaagacuucuuccuagcc

SEQ ID NO: 309224 - RNA, 64 nt, Homo Sapiens
gagggggccaggcuuccuuucacaagcaucucacucggcccacgacagaggcaccugcugcaca

SEQ ID NO: 309225 - RNA, 64 nt, Homo Sapiens
ggguccccucuccagcaagccuccaccagcaagcucggcccagagcuucccuuccggcuggcuc

SEQ ID NO: 309226 - RNA, 64 nt, Homo Sapiens
gccugccuggacugcgcggcgccgugagggggauucggcccagcucgucccggccuccaccaag

SEQ ID NO: 309227 - RNA, 64 nt, Homo Sapiens
uugagacuccuguugggacacaguuggucugcagucggcccaggacggucuacucagcacaacu

SEQ ID NO: 309228 - RNA, 64 nt, Homo Sapiens
acggccacauccugcuaaaacugggauggaggaaucggcccagccccaagagcaacugugauuu

SEQ ID NO: 309229 - RNA, 64 nt, Homo Sapiens
gcagcccccucaaguucuccccuuuugagggguuucggcccagccccagccugccggagcccac

SEQ ID NO: 309230 - RNA, 64 nt, Homo Sapiens
cagaaaaggcuucuuacacagcagccuuacuucaucggcccacagacaccaccgcaguuucuuc

SEQ ID NO: 309231 - RNA, 64 nt, Homo Sapiens
ccucggugaucacugagggacgccgacgccgcccucggcccagacccagcgccgccgcugacgc

SEQ ID NO: 309232 - RNA, 64 nt, Homo Sapiens
accccuaucccauuuccagacccauggggacaucucggcccagcuccucccucuggccccuucu

SEQ ID NO: 309233 - RNA, 64 nt, Homo Sapiens
aucggccagguccagcgcuucuggugcuguccucucggcccacccucgccccacuucucccagc

SEQ ID NO: 309234 - RNA, 64 nt, Homo Sapiens
uccugagcagcucuugguuuuggcgucuuuugggucggcccaugugguuugagcacccagccag

SEQ ID NO: 309235 - RNA, 64 nt, Homo Sapiens
uucacaugcucaauugauauuuuuugcugcuuccucggcccagggagaaagcaugucaggacag

SEQ ID NO: 309236 - RNA, 64 nt, Homo Sapiens
acucagcguugccaggugugcugccaucugcuguucggcccaaccucagagugaaggcagggug

SEQ ID NO: 309237 - RNA, 64 nt, Homo Sapiens
uccuguguguugugugcaggaucuguuugcccacucggcccaggaggucagcagucuguucuug

SEQ ID NO: 309238 - RNA, 64 nt, Homo Sapiens
gcucccaccccacccccuuccucacgauaaauaaucggcccacagggucucccucuccugccua

SEQ ID NO: 309239 - RNA, 64 nt, Homo Sapiens
cuguuuagaaauauauuuuauuacugugacugagucggcccauuucuacuauggagaucaacag

SEQ ID NO: 309240 - RNA, 64 nt, Homo Sapiens
cuggaagagucuuccgcacccucuccaggugcacucggcccaguccugccgccguguccaggcg

SEQ ID NO: 309241 - RNA, 64 nt, Homo Sapiens
uccucggaggggccguggugagucuccaguauguucggcccagcgcucuucgcacccuucugga

SEQ ID NO: 309242 - RNA, 64 nt, Homo Sapiens
aaagugcugggauuacgggcgugagccaccgugcucggcccaaggcaggagaaucucuugaagc

SEQ ID NO: 309243 - RNA, 64 nt, Homo Sapiens
aagcucagcaccaccggccaugaccagagguugcucggcccagggucugggagcugggcuaaca

SEQ ID NO: 309244 - RNA, 64 nt, Homo Sapiens
cuauuccuccugucccaaccgcccugaccccccuucggcccaugcgugaccauggcccacugca

SEQ ID NO: 309245 - RNA, 64 nt, Homo Sapiens
cauggggcaguuuccuuugguggaccccaggacuucggcccacuccggggccuccccucccugc

SEQ ID NO: 309246 - RNA, 64 nt, Homo Sapiens
aaggucaccauguaccacacaccaaagaagggggucggcccaggggugggcgacacaggcagcu

SEQ ID NO: 309247 - RNA, 64 nt, Homo Sapiens
ccaugcuccccagcaguggcgagucacugguuucucggcccaaacccuucugcauuuccucccg

SEQ ID NO: 309248 - RNA, 64 nt, Homo Sapiens
caagaacaacccugacggcugcccucccucuuauucggcccaaggacuugaagcccggcaucuu

SEQ ID NO: 309249 - RNA, 64 nt, Homo Sapiens
ucugucacccaggcuggaguacaauggcgugaucucggcccacugcaaccucugccuccugggu

SEQ ID NO: 309250 - RNA, 64 nt, Homo Sapiens
auuuacccggcaugcacucuucagauaagccaugucggcccaaaucugaguaacuuuauauaaa

SEQ ID NO: 309251 - RNA, 64 nt, Homo Sapiens
uagguuguuggccucuuacuugugucgccuuguaucggcccaggcgucagccacgggugggccu

SEQ ID NO: 309252 - RNA, 64 nt, Homo Sapiens
cugggggccuggaaaugcuggcccaugucccccuucggcccacuuacuuaauguggaaagacac

SEQ ID NO: 309253 - RNA, 64 nt, Homo Sapiens
ggaccccuagugucccuggucuaucucuccagccucggcccacacgcaagggagucgggggacg

SEQ ID NO: 309254 - RNA, 64 nt, Homo Sapiens
acgcgauuucuaacgaaaugaagaaagacgagccucggcccagguccccaaaccaacugcagag

SEQ ID NO: 309255 - RNA, 64 nt, Homo Sapiens
cuggggggcccgcccagcccucuacuugcgcugcucggcccagccucgcccgcuccugacuucc

SEQ ID NO: 309256 - RNA, 55 nt, Homo Sapiens
acugucuucccaaguuuuaccacccucggcccacgcagaaccggcugcagacuga

SEQ ID NO: 309257 - RNA, 64 nt, Homo Sapiens
gccgucaaggaaagggcaguagggcaccagggacucggcccaggcggcagcaccucugagccgg

SEQ ID NO: 309258 - RNA, 64 nt, Homo Sapiens
agagaagagacuagcaaaaagcugcagagaggauucggcccaaacucagaacuguuccccugag

SEQ ID NO: 309259 - RNA, 64 nt, Homo Sapiens
ggccccuggccugagcaggugcggggugguguguucggcccagaccggguccagugggcacugg

SEQ ID NO: 309260 - RNA, 64 nt, Homo Sapiens
ucacugaagcugcccugccugcugcgcgaagcgcucggcccagccucucagccuccugcccuca

SEQ ID NO: 309261 - RNA, 64 nt, Homo Sapiens
ugucuugguuggaaauaccaucagccuuccuugcucggcccaggucuguuucaggcaucugagu

SEQ ID NO: 309262 - RNA, 64 nt, Homo Sapiens
uaugaaaacuaaguucucuaucuuaggaguaaugucggcccacaagggugcccaccucuuguuu

SEQ ID NO: 309263 - RNA, 64 nt, Homo Sapiens
ucuggcuaugguaaccacaccucacccuaaggccucggcccaccacugcugcccucucggguaa

SEQ ID NO: 309264 - RNA, 64 nt, Homo Sapiens
ucuggccucagccucaaaguccuuuguagugcuuucggcccaguuuuccagaagcccacuauug

SEQ ID NO: 309265 - RNA, 64 nt, Homo Sapiens
cugagggccccugugucccgaacccggagcggaggcgcccaacccggcagacgggugcaggccc

SEQ ID NO: 309266 - RNA, 64 nt, Homo Sapiens
cacggucgcuuauggcaguuccacacaguaguuggcgcccaauggggggucccugagacuugca

SEQ ID NO: 309267 - RNA, 64 nt, Homo Sapiens
uacacauucauaucaaccagcacaacacgggauggcgcccaaacuccggcguucacaagaggag

SEQ ID NO: 309268 - RNA, 64 nt, Homo Sapiens
accugcugcuggcgcccuagucgcccucagucuggcgcccaaccccugggguuccugcuggucu

SEQ ID NO: 309269 - RNA, 64 nt, Homo Sapiens
acuugcauuucuaacaaguuuuagauuugggauggcgcccaauacucccagcauuucuggcacg

SEQ ID NO: 309270 - RNA, 64 nt, Homo Sapiens
agcacuuuaggaaaucaccuuucuaagcccuggggcgcccaagucccaugggacagggaaacgu

SEQ ID NO: 309271 - RNA, 64 nt, Homo Sapiens
gcuuuuauccccauucuuagggugguaccaaggggcgcccaacaacuaugaucuucuaugaaau

SEQ ID NO: 309272 - RNA, 64 nt, Homo Sapiens
cgaggggcagcagcgcccccacggggcucgcugggcgcccaacuacgacccgcucugcucacuc

SEQ ID NO: 309273 - RNA, 64 nt, Homo Sapiens
aagauaagcaaguauuuccuuguuuugucuguccgcgcccaagacaccucccuccccaccucag

SEQ ID NO: 309274 - RNA, 64 nt, Homo Sapiens
ucagcuuagaaguucgaaaaugagucccaccauagcgcccaagcggagaagacucggaauuccc

SEQ ID NO: 309275 - RNA, 64 nt, Homo Sapiens
caaaacccauacauccaggugcuggagccugcuggcgcccaauauggcagucccuccagguggg

SEQ ID NO: 309276 - RNA, 64 nt, Homo Sapiens
cuugggaccgagaacugagaaucacaagggaguugcgcccaacaugcagaacaugaauccucug

SEQ ID NO: 309277 - RNA, 64 nt, Homo Sapiens
ugcugugcuccacacccugcaggcgccucgggaagcgcccaaaggauuccccuucacguuggug

SEQ ID NO: 309278 - RNA, 64 nt, Homo Sapiens
ccacaggguuccgggaccucuucugagcgacauggcgcccaauguggcaggagagcagauguga

SEQ ID NO: 309279 - RNA, 64 nt, Homo Sapiens
aagaaagaggaagccacggugugacaucuacaaagcgcccaauaaguguaacuuuuagaccugc

SEQ ID NO: 309280 - RNA, 64 nt, Homo Sapiens
gugucucuguggcucaggaaacccacggcuccccgcgcccaagagcguccugcggucucgcugg

SEQ ID NO: 309281 - RNA, 64 nt, Homo Sapiens
acccgcccgagggauggugccccuagggucccucgcgcccaaaagauugaacuuaaaugccccc

SEQ ID NO: 309282 - RNA, 64 nt, Homo Sapiens
aaggccacuucucaacuggcccacugcaaucccagcgcccaagggccagugcgccugcuccuga

SEQ ID NO: 309283 - RNA, 64 nt, Homo Sapiens
ucccaaagugcugggauuacagacuugagccacugcgcccaaccuggaguguuuuuacauauug

SEQ ID NO: 309284 - RNA, 64 nt, Homo Sapiens
cauuguggauuauuuuccugcaagcucagaguaggcgcccaaaguuaaugaauggaugcccagc

SEQ ID NO: 309285 - RNA, 64 nt, Homo Sapiens
ugccccgggaggucuccccggcccgcaucccgaggcgcccaagcuggagccgccuggagggcuc

SEQ ID NO: 309286 - RNA, 64 nt, Homo Sapiens
acauccacccagaccucauucugggcuccauccugcgcccaaagccacacuguaaccacugggu

SEQ ID NO: 309287 - RNA, 64 nt, Homo Sapiens
uagaugagagacagggcagggggaaccuugcuuagcgcccaagguggcugcugggagagcccau

SEQ ID NO: 309288 - RNA, 64 nt, Homo Sapiens
cuggcaggucaggcaagcagcccaguggccuguggcgcccaaagagcuagaggagcuggccuug

SEQ ID NO: 309289 - RNA, 64 nt, Homo Sapiens
gcguggaugucgaugacuuccugggcuccggccagcgcccaacaguaucaguacaugccuagac

SEQ ID NO: 309290 - RNA, 64 nt, Homo Sapiens
gagggggccccugccggagcacucccagggcuccgcgcccaagugugugggguccgcucucucc

SEQ ID NO: 309291 - RNA, 64 nt, Homo Sapiens
acaggguccaacauagagccggguguccccaacagcgcccaaaggacgcacugagcaacgcuau

SEQ ID NO: 309292 - RNA, 64 nt, Homo Sapiens
ccccgagggagaggccugggggggcuguggggaugcgcccaagcggcagagcccccaucccuug

SEQ ID NO: 309293 - RNA, 64 nt, Homo Sapiens
cucaucaguuuuauugccugaguuaggacgcucggcgcccaaauagcccugagacacaggccuc

SEQ ID NO: 309294 - RNA, 64 nt, Homo Sapiens
cacuggcucgaggcugcgaggcugaccgacaggggcgcccaauagaguuugugggaauggagua

SEQ ID NO: 309295 - RNA, 64 nt, Homo Sapiens
ccagcagccauaucuggcaagugugaaucugugggcgcccaagggggcacaugugauguggugc

SEQ ID NO: 309296 - RNA, 64 nt, Homo Sapiens
cacacagcuccauuaugcaaggggagggaccagagcgcccaauacccucaugaacacagggauu

SEQ ID NO: 309297 - RNA, 63 nt, Homo Sapiens; identical to SEQ ID NO: 118067

SEQ ID NO: 309298 - RNA, 64 nt, Homo Sapiens; identical to SEQ ID NO: 118068

SEQ ID NO: 309299 - RNA, 64 nt, Homo Sapiens; identical to SEQ ID NO: 118069

SEQ ID NO: 309300 - RNA, 64 nt, Homo Sapiens; identical to SEQ ID NO: 118070

SEQ ID NO: 309301 - RNA, 64 nt, Homo Sapiens; identical to SEQ ID NO: 118071

SEQ ID NO: 309302 - RNA, 64 nt, Homo Sapiens; identical to SEQ ID NO: 118072

SEQ ID NO: 309303 - RNA, 64 nt, Homo Sapiens; identical to SEQ ID NO: 118073

SEQ ID NO: 309304 - RNA, 64 nt, Homo Sapiens; identical to SEQ ID NO: 118074

SEQ ID NO: 309305 - RNA, 64 nt, Homo Sapiens; identical to SEQ ID NO: 118075

SEQ ID NO: 309306 - RNA, 64 nt, Homo Sapiens; identical to SEQ ID NO: 118076

SEQ ID NO: 309307 - RNA, 64 nt, Homo Sapiens; identical to SEQ ID NO: 118077

SEQ ID NO: 309308 - RNA, 64 nt, Homo Sapiens; identical to SEQ ID NO: 118078

SEQ ID NO: 309309 - RNA, 64 nt, Homo Sapiens; identical to SEQ ID NO: 118079

SEQ ID NO: 309310 - RNA, 64 nt, Homo Sapiens; identical to SEQ ID NO: 118080

SEQ ID NO: 309311 - RNA, 64 nt, Homo Sapiens; identical to SEQ ID NO: 118081

SEQ ID NO: 309312 - RNA, 64 nt, Homo Sapiens; identical to SEQ ID NO: 118082

SEQ ID NO: 309313 - RNA, 64 nt, Homo Sapiens; identical to SEQ ID NO: 118083

SEQ ID NO: 309314 - RNA, 64 nt, Homo Sapiens; identical to SEQ ID NO: 118084

SEQ ID NO: 309315 - RNA, 64 nt, Homo Sapiens; identical to SEQ ID NO: 118085

SEQ ID NO: 309316 - RNA, 64 nt, Homo Sapiens; identical to SEQ ID NO: 118086

SEQ ID NO: 309317 - RNA, 64 nt, Homo Sapiens; identical to SEQ ID NO: 118087

SEQ ID NO: 309318 - RNA, 64 nt, Homo Sapiens; identical to SEQ ID NO: 118088

SEQ ID NO: 309319 - RNA, 64 nt, Homo Sapiens; identical to SEQ ID NO: 118089

SEQ ID NO: 309320 - RNA, 64 nt, Homo Sapiens; identical to SEQ ID NO: 118090

SEQ ID NO: 309321 - RNA, 64 nt, Homo Sapiens; identical to SEQ ID NO: 118091

SEQ ID NO: 309322 - RNA, 64 nt, Homo Sapiens; identical to SEQ ID NO: 118092

SEQ ID NO: 309323 - RNA, 64 nt, Homo Sapiens; identical to SEQ ID NO: 118093

SEQ ID NO: 309324 - RNA, 64 nt, Homo Sapiens; identical to SEQ ID NO: 118094

SEQ ID NO: 309325 - RNA, 64 nt, Homo Sapiens; identical to SEQ ID NO: 118095

SEQ ID NO: 309326 - RNA, 64 nt, Homo Sapiens; identical to SEQ ID NO: 118096

SEQ ID NO: 309327 - RNA, 64 nt, Homo Sapiens; identical to SEQ ID NO: 118097

SEQ ID NO: 309328 - RNA, 64 nt, Homo Sapiens; identical to SEQ ID NO: 118098

SEQ ID NO: 309329 - RNA, 64 nt, Homo Sapiens; identical to SEQ ID NO: 118099

SEQ ID NO: 309330 - RNA, 64 nt, Homo Sapiens; identical to SEQ ID NO: 118100

SEQ ID NO: 309331 - RNA, 64 nt, Homo Sapiens; identical to SEQ ID NO: 118101

SEQ ID NO: 309332 - RNA, 64 nt, Homo Sapiens; identical to SEQ ID NO: 118102

SEQ ID NO: 309333 - RNA, 64 nt, Homo Sapiens; identical to SEQ ID NO: 118103

SEQ ID NO: 309334 - RNA, 64 nt, Homo Sapiens; identical to SEQ ID NO: 118104

SEQ ID NO: 309335 - RNA, 64 nt, Homo Sapiens; identical to SEQ ID NO: 118105

SEQ ID NO: 309336 - RNA, 64 nt, Homo Sapiens; identical to SEQ ID NO: 118106

SEQ ID NO: 309337 - RNA, 64 nt, Homo Sapiens; identical to SEQ ID NO: 118107

SEQ ID NO: 309338 - RNA, 64 nt, Homo Sapiens; identical to SEQ ID NO: 118108

SEQ ID NO: 309339 - RNA, 64 nt, Homo Sapiens; identical to SEQ ID NO: 118109

SEQ ID NO: 309340 - RNA, 64 nt, Homo Sapiens; identical to SEQ ID NO: 118110

SEQ ID NO: 309341 - RNA, 64 nt, Homo Sapiens; identical to SEQ ID NO: 118111

SEQ ID NO: 309342 - RNA, 64 nt, Homo Sapiens; identical to SEQ ID NO: 118112

SEQ ID NO: 309343 - RNA, 64 nt, Homo Sapiens; identical to SEQ ID NO: 118113

SEQ ID NO: 309344 - RNA, 64 nt, Homo Sapiens; identical to SEQ ID NO: 118114

SEQ ID NO: 309345 - RNA, 64 nt, Homo Sapiens; identical to SEQ ID NO: 118115

SEQ ID NO: 309346 - RNA, 64 nt, Homo Sapiens; identical to SEQ ID NO: 118116

SEQ ID NO: 309347 - RNA, 64 nt, Homo Sapiens; identical to SEQ ID NO: 118117

SEQ ID NO: 309348 - RNA, 64 nt, Homo Sapiens; identical to SEQ ID NO: 118118

SEQ ID NO: 309349 - RNA, 64 nt, Homo Sapiens; identical to SEQ ID NO: 118119

SEQ ID NO: 309350 - RNA, 64 nt, Homo Sapiens; identical to SEQ ID NO: 118120

SEQ ID NO: 309351 - RNA, 64 nt, Homo Sapiens; identical to SEQ ID NO: 118121

SEQ ID NO: 309352 - RNA, 64 nt, Homo Sapiens
ccugcuuaagguuuuaggguucuguaggcuuccauguccagaauacauauuuauuuuugucuau

SEQ ID NO: 309353 - RNA, 64 nt, Homo Sapiens
gugaugacugccagcacaggacggaaggacaugcuguccagacuaggcacugagcugggcaccc

SEQ ID NO: 309354 - RNA, 64 nt, Homo Sapiens
uguggggagccugccucccuggucccaaauuccauguccagaggaggcagacgggcugaagugg

SEQ ID NO: 309355 - RNA, 64 nt, Homo Sapiens
uucaaguugaaaggcagucccuuuaguugggggcuguccagagcugcagcagggcuuugcacgg

SEQ ID NO: 309356 - RNA, 64 nt, Homo Sapiens
cccuggcccuggccuugcuugcccaugguguguguguccagaggugugugugaggcugccagaa

SEQ ID NO: 309357 - RNA, 64 nt, Homo Sapiens
aggccuuaauuauggacuguugggaaaaggguuuuguccagaaggacaagccggacaaaugagc

SEQ ID NO: 309358 - RNA, 64 nt, Homo Sapiens
gagaaggggggccuugggccgcugcagucacaucuguccagagaaauuccuuuugggacuggag

SEQ ID NO: 309359 - RNA, 64 nt, Homo Sapiens
ccugagcgaacuugccugaugcagggcugugcuguguccagauguugcuggggccucacuuuuu

SEQ ID NO: 309360 - RNA, 64 nt, Homo Sapiens
ggaagugggaacaguuuuguccuguaugcugauguguccagaauuucauuuaaugauagacgga

SEQ ID NO: 309361 - RNA, 64 nt, Homo Sapiens
cggaaccugggaugagaaacgacagguggaagguuguccagagacaccuacagcguggaugcug

SEQ ID NO: 309362 - RNA, 64 nt, Homo Sapiens
uggacacgccaccggcagccguaagggaaaaggguguccagaacuagcgaccgggagagcuuuu

SEQ ID NO: 309363 - RNA, 64 nt, Homo Sapiens
guaaaccugccgggcaggaccgugccacaccagcuguccagagucggaggaccccagcuccuca

SEQ ID NO: 309364 - RNA, 64 nt, Homo Sapiens
caccuacgccgagggaguggagcuccugggugcguguccagaugggaaaggcagggucguaucu

SEQ ID NO: 309365 - RNA, 64 nt, Homo Sapiens
ccucagccaucucagggugaggagcugccagucauguccagauggaaugacucccauccucucc

SEQ ID NO: 309366 - RNA, 64 nt, Homo Sapiens
uggcucaguuccaucaucuggaggucagacacacuguccagaggcagaacugaagcccucucgg

SEQ ID NO: 309367 - RNA, 64 nt, Homo Sapiens
ugugaguuuuguuacugaaucuuugugccagaacuguccagagcugcccacagacagacuugac
